United States Patent 8,178,503 (RIBONUCLEIC ACID INTERFERENCE MOLECULES AND BINDING SITES DERIVED BY ANALYZING INTERGENIC AND INTRONIC REGIONS OF GENOMES) - sequence listing, part 7

SEQ ID NO: 267756 - DNA, 16 bp, P. troglodytes
tcctttaggttttcta

SEQ ID NO: 267757 - DNA, 16 bp, P. troglodytes
tcctttagtcccagct

SEQ ID NO: 267758 - DNA, 16 bp, P. troglodytes
tcctttatatttctgt

SEQ ID NO: 267759 - DNA, 16 bp, P. troglodytes
tcctttatttttgaag

SEQ ID NO: 267760 - DNA, 16 bp, P. troglodytes
tcctttcaaaaagcca

SEQ ID NO: 267761 - DNA, 16 bp, P. troglodytes
tcctttccagcatctg

SEQ ID NO: 267762 - DNA, 16 bp, P. troglodytes
tcctttccatatttat

SEQ ID NO: 267763 - DNA, 16 bp, P. troglodytes
tcctttccccatggct

SEQ ID NO: 267764 - DNA, 16 bp, P. troglodytes
tcctttccttcctggg

SEQ ID NO: 267765 - DNA, 16 bp, P. troglodytes
tcctttccttctgcca

SEQ ID NO: 267766 - DNA, 16 bp, P. troglodytes
tcctttctaaggctga

SEQ ID NO: 267767 - DNA, 16 bp, P. troglodytes
tcctttctaatttgga

SEQ ID NO: 267768 - DNA, 16 bp, P. troglodytes
tcctttctccacatcc

SEQ ID NO: 267769 - DNA, 16 bp, P. troglodytes
tcctttctctacaaaa

SEQ ID NO: 267770 - DNA, 16 bp, P. troglodytes
tcctttctctgagcac

SEQ ID NO: 267771 - DNA, 16 bp, P. troglodytes
tcctttctgatttctt

SEQ ID NO: 267772 - DNA, 16 bp, P. troglodytes
tcctttctgcttgtta

SEQ ID NO: 267773 - DNA, 16 bp, P. troglodytes
tcctttcttcttctga

SEQ ID NO: 267774 - DNA, 16 bp, P. troglodytes
tcctttctttaagaat

SEQ ID NO: 267775 - DNA, 16 bp, P. troglodytes
tcctttcttttggatg

SEQ ID NO: 267776 - DNA, 16 bp, P. troglodytes
tcctttcttttgggaa

SEQ ID NO: 267777 - DNA, 16 bp, P. troglodytes
tcctttcttttgggtg

SEQ ID NO: 267778 - DNA, 16 bp, P. troglodytes
tcctttgaaataaaaa

SEQ ID NO: 267779 - DNA, 16 bp, P. troglodytes
tcctttgaaggagaag

SEQ ID NO: 267780 - DNA, 16 bp, P. troglodytes
tcctttgaattacaaa

SEQ ID NO: 267781 - DNA, 16 bp, P. troglodytes
tcctttgaatttctat

SEQ ID NO: 267782 - DNA, 16 bp, P. troglodytes
tcctttgagaaatctc

SEQ ID NO: 267783 - DNA, 16 bp, P. troglodytes
tcctttgagcccagaa

SEQ ID NO: 267784 - DNA, 16 bp, P. troglodytes
tcctttgaggccagga

SEQ ID NO: 267785 - DNA, 16 bp, P. troglodytes
tcctttgatgtgcaga

SEQ ID NO: 267786 - DNA, 16 bp, P. troglodytes
tcctttgcaacaacat

SEQ ID NO: 267787 - DNA, 16 bp, P. troglodytes
tcctttgcagggacag

SEQ ID NO: 267788 - DNA, 16 bp, P. troglodytes
tcctttgcagggatgt

SEQ ID NO: 267789 - DNA, 16 bp, P. troglodytes
tcctttgcatttctgt

SEQ ID NO: 267790 - DNA, 16 bp, P. troglodytes
tcctttgcatttcttt

SEQ ID NO: 267791 - DNA, 16 bp, P. troglodytes
tcctttgcatttgctg

SEQ ID NO: 267792 - DNA, 16 bp, P. troglodytes
tcctttgcccacttgt

SEQ ID NO: 267793 - DNA, 16 bp, P. troglodytes
tcctttgcctattttt

SEQ ID NO: 267794 - DNA, 16 bp, P. troglodytes
tcctttgcctcccaaa

SEQ ID NO: 267795 - DNA, 16 bp, P. troglodytes
tcctttgccttccgcc

SEQ ID NO: 267796 - DNA, 16 bp, P. troglodytes
tcctttgctgggcaga

SEQ ID NO: 267797 - DNA, 16 bp, P. troglodytes
tcctttggagaagaag

SEQ ID NO: 267798 - DNA, 16 bp, P. troglodytes
tcctttggagaaggag

SEQ ID NO: 267799 - DNA, 16 bp, P. troglodytes
tcctttgggaggctga

SEQ ID NO: 267800 - DNA, 16 bp, P. troglodytes
tcctttggttatatac

SEQ ID NO: 267801 - DNA, 52 bp, P. troglodytes
tcctttgtagggacatggatgaaattggaaatcatcattctcagtaaactat

SEQ ID NO: 267802 - DNA, 16 bp, P. troglodytes
tcctttgtctttccat

SEQ ID NO: 267803 - DNA, 16 bp, P. troglodytes
tcctttgttaaattta

SEQ ID NO: 267804 - DNA, 16 bp, P. troglodytes
tccttttaaatctctt

SEQ ID NO: 267805 - DNA, 16 bp, P. troglodytes
tccttttattttcaac

SEQ ID NO: 267806 - DNA, 16 bp, P. troglodytes
tccttttcacatttca

SEQ ID NO: 267807 - DNA, 21 bp, P. troglodytes
tccttttcctggctcatcctg

SEQ ID NO: 267808 - DNA, 16 bp, P. troglodytes
tccttttcttccccaa

SEQ ID NO: 267809 - DNA, 16 bp, P. troglodytes
tccttttgataatagc

SEQ ID NO: 267810 - DNA, 16 bp, P. troglodytes
tccttttgctttttaa

SEQ ID NO: 267811 - DNA, 16 bp, P. troglodytes
tcctttttaaaaaaca

SEQ ID NO: 267812 - DNA, 16 bp, P. troglodytes
tcctttttaaaataat

SEQ ID NO: 267813 - DNA, 16 bp, P. troglodytes
tcctttttaaacattt

SEQ ID NO: 267814 - DNA, 16 bp, P. troglodytes
tcctttttcattcctg

SEQ ID NO: 267815 - DNA, 16 bp, P. troglodytes
tccttttttaaaaaga

SEQ ID NO: 267816 - DNA, 16 bp, P. troglodytes
tcctttttttaagaga

SEQ ID NO: 267817 - DNA, 16 bp, P. troglodytes
tcctttttttcctaaa

SEQ ID NO: 267818 - DNA, 16 bp, P. troglodytes
tcgaactcctcatctc

SEQ ID NO: 267819 - DNA, 16 bp, P. troglodytes
tcgaactgacctcaag

SEQ ID NO: 267820 - DNA, 16 bp, P. troglodytes
tcgaagtgctgggatt

SEQ ID NO: 267821 - DNA, 16 bp, P. troglodytes
tcgacaaacctgacaa

SEQ ID NO: 267822 - DNA, 16 bp, P. troglodytes
tcgacctcctgggccc

SEQ ID NO: 267823 - DNA, 16 bp, P. troglodytes
tcgagaacagcctggc

SEQ ID NO: 267824 - DNA, 16 bp, P. troglodytes
tcgagaacatcctggc

SEQ ID NO: 267825 - DNA, 16 bp, P. troglodytes
tcgagaccaccctggc

SEQ ID NO: 267826 - DNA, 16 bp, P. troglodytes
tcgagaccatactggc

SEQ ID NO: 267827 - DNA, 16 bp, P. troglodytes
tcgagacccgcctggc

SEQ ID NO: 267828 - DNA, 16 bp, P. troglodytes
tcgagcccagcctggg

SEQ ID NO: 267829 - DNA, 16 bp, P. troglodytes
tcgagcccaggagttc

SEQ ID NO: 267830 - DNA, 16 bp, P. troglodytes
tcgaggcgggcagatc

SEQ ID NO: 267831 - DNA, 17 bp, P. troglodytes
tcgaggcgggcggatca

SEQ ID NO: 267832 - DNA, 16 bp, P. troglodytes
tcgaggctgccatgag

SEQ ID NO: 267833 - DNA, 16 bp, P. troglodytes
tcgagtagttgggact

SEQ ID NO: 267834 - DNA, 22 bp, P. troglodytes
tcgcacgcctccagcccggccc

SEQ ID NO: 267835 - DNA, 16 bp, P. troglodytes
tcgccactgcactcca

SEQ ID NO: 267836 - DNA, 16 bp, P. troglodytes
tcgccatgttgctcag

SEQ ID NO: 267837 - DNA, 18 bp, P. troglodytes
tcgcccacctcggcctcc

SEQ ID NO: 267838 - DNA, 16 bp, P. troglodytes
tcgcccaggctgagtg

SEQ ID NO: 267839 - DNA, 16 bp, P. troglodytes
tcgcccaggctggaac

SEQ ID NO: 267840 - DNA, 19 bp, P. troglodytes
tcgcccaggctggaatgca

SEQ ID NO: 267841 - DNA, 16 bp, P. troglodytes
tcgcccaggctggagc

SEQ ID NO: 267842 - DNA, 16 bp, P. troglodytes
tcgcccaggctggtgt

SEQ ID NO: 267843 - DNA, 16 bp, P. troglodytes
tcgcccaggctgtagt

SEQ ID NO: 267844 - DNA, 16 bp, P. troglodytes
tcgcccagggtggagt

SEQ ID NO: 267845 - DNA, 16 bp, P. troglodytes
tcgcctgcctcggcct

SEQ ID NO: 267846 - DNA, 16 bp, P. troglodytes
tcgctcactgcaacct

SEQ ID NO: 267847 - DNA, 16 bp, P. troglodytes
tcgctcaggctggagt

SEQ ID NO: 267848 - DNA, 21 bp, P. troglodytes
tcgctctgttgcccaggctga

SEQ ID NO: 267849 - DNA, 23 bp, P. troglodytes
tcgctcttgtcacccaggctgga

SEQ ID NO: 267850 - DNA, 20 bp, P. troglodytes
tcgctcttgttgcccaggct

SEQ ID NO: 267851 - DNA, 16 bp, P. troglodytes
tcgctggagcctggga

SEQ ID NO: 267852 - DNA, 16 bp, P. troglodytes
tcgctttgctgcccag

SEQ ID NO: 267853 - DNA, 16 bp, P. troglodytes
tcggaattagtttagc

SEQ ID NO: 267854 - DNA, 16 bp, P. troglodytes
tcggagcagccggcca

SEQ ID NO: 267855 - DNA, 16 bp, P. troglodytes
tcggagccccacagcc

SEQ ID NO: 267856 - DNA, 16 bp, P. troglodytes
tcggaggcagaggcag

SEQ ID NO: 267857 - DNA, 16 bp, P. troglodytes
tcggaggttgcagtga

SEQ ID NO: 267858 - DNA, 16 bp, P. troglodytes
tcggccaggctggtct

SEQ ID NO: 267859 - DNA, 16 bp, P. troglodytes
tcggcccacctcagcc

SEQ ID NO: 267860 - DNA, 17 bp, P. troglodytes
tcggccgggcacggtgg

SEQ ID NO: 267861 - DNA, 19 bp, P. troglodytes
tcggccgggtgcagtggct

SEQ ID NO: 267862 - DNA, 17 bp, P. troglodytes
tcggcctcccaaagtgg

SEQ ID NO: 267863 - DNA, 16 bp, P. troglodytes
tcggcctcccatagtg

SEQ ID NO: 267864 - DNA, 18 bp, P. troglodytes
tcggcctcctgagtagct

SEQ ID NO: 267865 - DNA, 16 bp, P. troglodytes
tcggccttccaaagtg

SEQ ID NO: 267866 - DNA, 20 bp, P. troglodytes
tcggctcactgcaacccccg

SEQ ID NO: 267867 - DNA, 16 bp, P. troglodytes
tcggctcactgctgcc

SEQ ID NO: 267868 - DNA, 18 bp, P. troglodytes
tcggctgggcgcagtggc

SEQ ID NO: 267869 - DNA, 17 bp, P. troglodytes
tcggcttcccaaagtgt

SEQ ID NO: 267870 - DNA, 16 bp, P. troglodytes
tcgggaggccaaggtg

SEQ ID NO: 267871 - DNA, 16 bp, P. troglodytes
tcgggaggctgaggag

SEQ ID NO: 267872 - DNA, 19 bp, P. troglodytes
tcgggaggctgaggcaggt

SEQ ID NO: 267873 - DNA, 16 bp, P. troglodytes
tcgggaggctgaggcc

SEQ ID NO: 267874 - DNA, 16 bp, P. troglodytes
tcgggaggctgaggtg

SEQ ID NO: 267875 - DNA, 16 bp, P. troglodytes
tcgggaggcttaggtg

SEQ ID NO: 267876 - DNA, 16 bp, P. troglodytes
tcgggaggtggaggca

SEQ ID NO: 267877 - DNA, 16 bp, P. troglodytes
tcgggccactgcactc

SEQ ID NO: 267878 - DNA, 16 bp, P. troglodytes
tcgggctggtcttgaa

SEQ ID NO: 267879 - DNA, 16 bp, P. troglodytes
tcgggtggctgaggca

SEQ ID NO: 267880 - DNA, 16 bp, P. troglodytes
tcggtcaggctggtct

SEQ ID NO: 267881 - DNA, 16 bp, P. troglodytes
tcgtatatatatatat

SEQ ID NO: 267882 - DNA, 16 bp, P. troglodytes
tcgtatttttagtaga

SEQ ID NO: 267883 - DNA, 16 bp, P. troglodytes
tcgtcatcatcatcac

SEQ ID NO: 267884 - DNA, 16 bp, P. troglodytes
tcgtcatcatcatcat

SEQ ID NO: 267885 - DNA, 16 bp, P. troglodytes
tcgtctcaaactcctg

SEQ ID NO: 267886 - DNA, 16 bp, P. troglodytes
tcgtctctaaaaaaat

SEQ ID NO: 267887 - DNA, 16 bp, P. troglodytes
tcgtctttgttttaaa

SEQ ID NO: 267888 - DNA, 16 bp, P. troglodytes
tcgtgagccactgcac

SEQ ID NO: 267889 - DNA, 16 bp, P. troglodytes
tcgtgaggctgaggca

SEQ ID NO: 267890 - DNA, 16 bp, P. troglodytes
tcgtgatagtgaatga

SEQ ID NO: 267891 - DNA, 16 bp, P. troglodytes
tcgtgatccacccgcg

SEQ ID NO: 267892 - DNA, 16 bp, P. troglodytes
tcgtgatccgcccagc

SEQ ID NO: 267893 - DNA, 18 bp, P. troglodytes
tcgtgatccgcccgcctt

SEQ ID NO: 267894 - DNA, 16 bp, P. troglodytes
tcgtgccttcccaaca

SEQ ID NO: 267895 - DNA, 17 bp, P. troglodytes
tcgtggctcacgcctgt

SEQ ID NO: 267896 - DNA, 16 bp, P. troglodytes
tcgtttaatcctcaca

SEQ ID NO: 267897 - DNA, 16 bp, P. troglodytes
tctaaaaaatgtacat

SEQ ID NO: 267898 - DNA, 16 bp, P. troglodytes
tctaaaaatcaaagca

SEQ ID NO: 267899 - DNA, 17 bp, P. troglodytes
tctaaaaccagctgtaa

SEQ ID NO: 267900 - DNA, 16 bp, P. troglodytes
tctaaaactttttcat

SEQ ID NO: 267901 - DNA, 16 bp, P. troglodytes
tctaaaagggagaaat

SEQ ID NO: 267902 - DNA, 16 bp, P. troglodytes
tctaaaatatttacta

SEQ ID NO: 267903 - DNA, 16 bp, P. troglodytes
tctaaaatattttgca

SEQ ID NO: 267904 - DNA, 16 bp, P. troglodytes
tctaaaattaaagttt

SEQ ID NO: 267905 - DNA, 16 bp, P. troglodytes
tctaaaattccaaaaa

SEQ ID NO: 267906 - DNA, 16 bp, P. troglodytes
tctaaaattctcttct

SEQ ID NO: 267907 - DNA, 16 bp, P. troglodytes
tctaaacatggaaaag

SEQ ID NO: 267908 - DNA, 16 bp, P. troglodytes
tctaaactgttctcca

SEQ ID NO: 267909 - DNA, 16 bp, P. troglodytes
tctaaatatatatgta

SEQ ID NO: 267910 - DNA, 16 bp, P. troglodytes
tctaaatcagtggttc

SEQ ID NO: 267911 - DNA, 16 bp, P. troglodytes
tctaaatctcttcata

SEQ ID NO: 267912 - DNA, 16 bp, P. troglodytes
tctaaattaaaagaaa

SEQ ID NO: 267913 - DNA, 16 bp, P. troglodytes
tctaaatttgatgaaa

SEQ ID NO: 267914 - DNA, 16 bp, P. troglodytes
tctaacaacttgcttt

SEQ ID NO: 267915 - DNA, 16 bp, P. troglodytes
tctaacagaaagcagc

SEQ ID NO: 267916 - DNA, 16 bp, P. troglodytes
tctaactcctggactc

SEQ ID NO: 267917 - DNA, 16 bp, P. troglodytes
tctaagaagtaactaa

SEQ ID NO: 267918 - DNA, 16 bp, P. troglodytes
tctaagatctggaaaa

SEQ ID NO: 267919 - DNA, 16 bp, P. troglodytes
tctaagatgaaaaata

SEQ ID NO: 267920 - DNA, 16 bp, P. troglodytes
tctaagcctccatttc

SEQ ID NO: 267921 - DNA, 16 bp, P. troglodytes
tctaagttttcatttt

SEQ ID NO: 267922 - DNA, 16 bp, P. troglodytes
tctaataatttttggt

SEQ ID NO: 267923 - DNA, 16 bp, P. troglodytes
tctaatactgtcagtg

SEQ ID NO: 267924 - DNA, 16 bp, P. troglodytes
tctaatagtttatttg

SEQ ID NO: 267925 - DNA, 16 bp, P. troglodytes
tctaatatccagaatc

SEQ ID NO: 267926 - DNA, 16 bp, P. troglodytes
tctaatcccagctact

SEQ ID NO: 267927 - DNA, 16 bp, P. troglodytes
tctaatgactaatgat

SEQ ID NO: 267928 - DNA, 16 bp, P. troglodytes
tctaatgagataatca

SEQ ID NO: 267929 - DNA, 16 bp, P. troglodytes
tctaatgatgagtgat

SEQ ID NO: 267930 - DNA, 16 bp, P. troglodytes
tctaattacctcccaa

SEQ ID NO: 267931 - DNA, 16 bp, P. troglodytes
tctaattcattttatg

SEQ ID NO: 267932 - DNA, 16 bp, P. troglodytes
tctaattcctggcctc

SEQ ID NO: 267933 - DNA, 16 bp, P. troglodytes
tctaattctctttgta

SEQ ID NO: 267934 - DNA, 16 bp, P. troglodytes
tctaatttcaaaatat

SEQ ID NO: 267935 - DNA, 16 bp, P. troglodytes
tctaatttcagacaaa

SEQ ID NO: 267936 - DNA, 16 bp, P. troglodytes
tctaatttgattgtgc

SEQ ID NO: 267937 - DNA, 16 bp, P. troglodytes
tctaattttgaaagaa

SEQ ID NO: 267938 - DNA, 16 bp, P. troglodytes
tctaatttttatgtga

SEQ ID NO: 267939 - DNA, 16 bp, P. troglodytes
tctacaaaaaaatgtt

SEQ ID NO: 267940 - DNA, 16 bp, P. troglodytes
tctacaaaaacagaaa

SEQ ID NO: 267941 - DNA, 16 bp, P. troglodytes
tctacaaaaaggaaaa

SEQ ID NO: 267942 - DNA, 16 bp, P. troglodytes
tctacaaaaagttttt

SEQ ID NO: 267943 - DNA, 16 bp, P. troglodytes
tctacaaaaataaaga

SEQ ID NO: 267944 - DNA, 16 bp, P. troglodytes
tctacaaaaatgtttt

SEQ ID NO: 267945 - DNA, 16 bp, P. troglodytes
tctacaaaacattaaa

SEQ ID NO: 267946 - DNA, 16 bp, P. troglodytes
tctacaaaatatgaaa

SEQ ID NO: 267947 - DNA, 16 bp, P. troglodytes
tctacaaaatattttt

SEQ ID NO: 267948 - DNA, 16 bp, P. troglodytes
tctacaaagaacctaa

SEQ ID NO: 267949 - DNA, 16 bp, P. troglodytes
tctacaaagaataaaa

SEQ ID NO: 267950 - DNA, 16 bp, P. troglodytes
tctacaaagggatatt

SEQ ID NO: 267951 - DNA, 16 bp, P. troglodytes
tctacaaccatctgat

SEQ ID NO: 267952 - DNA, 16 bp, P. troglodytes
tctacaagagtttcct

SEQ ID NO: 267953 - DNA, 16 bp, P. troglodytes
tctacaagccaaggaa

SEQ ID NO: 267954 - DNA, 16 bp, P. troglodytes
tctacaaggaaaatta

SEQ ID NO: 267955 - DNA, 16 bp, P. troglodytes
tctacaaggaacttca

SEQ ID NO: 267956 - DNA, 16 bp, P. troglodytes
tctacacaaaaacttg

SEQ ID NO: 267957 - DNA, 16 bp, P. troglodytes
tctacacttgatctta

SEQ ID NO: 267958 - DNA, 16 bp, P. troglodytes
tctacagaaaaatttt

SEQ ID NO: 267959 - DNA, 16 bp, P. troglodytes
tctacagaaaatacaa

SEQ ID NO: 267960 - DNA, 16 bp, P. troglodytes
tctacagagacagaaa

SEQ ID NO: 267961 - DNA, 16 bp, P. troglodytes
tctacagataaggaaa

SEQ ID NO: 267962 - DNA, 16 bp, P. troglodytes
tctacagccataccac

SEQ ID NO: 267963 - DNA, 16 bp, P. troglodytes
tctacatatttatata

SEQ ID NO: 267964 - DNA, 16 bp, P. troglodytes
tctacatcttgtccca

SEQ ID NO: 267965 - DNA, 16 bp, P. troglodytes
tctaccaaaaatgaaa

SEQ ID NO: 267966 - DNA, 16 bp, P. troglodytes
tctaccaactgaccaa

SEQ ID NO: 267967 - DNA, 16 bp, P. troglodytes
tctaccagaaaatgaa

SEQ ID NO: 267968 - DNA, 16 bp, P. troglodytes
tctaccagcaccttga

SEQ ID NO: 267969 - DNA, 16 bp, P. troglodytes
tctaccagcctcagcc

SEQ ID NO: 267970 - DNA, 16 bp, P. troglodytes
tctacccaacaacagc

SEQ ID NO: 267971 - DNA, 16 bp, P. troglodytes
tctacccaccttggcc

SEQ ID NO: 267972 - DNA, 16 bp, P. troglodytes
tctacccatctggcaa

SEQ ID NO: 267973 - DNA, 16 bp, P. troglodytes
tctacctatttatcta

SEQ ID NO: 267974 - DNA, 16 bp, P. troglodytes
tctacctcataggatt

SEQ ID NO: 267975 - DNA, 16 bp, P. troglodytes
tctacctccagggctc

SEQ ID NO: 267976 - DNA, 16 bp, P. troglodytes
tctacctcctaaatat

SEQ ID NO: 267977 - DNA, 16 bp, P. troglodytes
tctacctcctgggtcc

SEQ ID NO: 267978 - DNA, 16 bp, P. troglodytes
tctacctgcctcagcc

SEQ ID NO: 267979 - DNA, 16 bp, P. troglodytes
tctacctttggtcttc

SEQ ID NO: 267980 - DNA, 26 bp, P. troglodytes
tctacgtctgattggtgtacctgaaa

SEQ ID NO: 267981 - DNA, 16 bp, P. troglodytes
tctactaaaaagacaa

SEQ ID NO: 267982 - DNA, 18 bp, P. troglodytes
tctactaaaaatatgaaa

SEQ ID NO: 267983 - DNA, 16 bp, P. troglodytes
tctactaaaaatccaa

SEQ ID NO: 267984 - DNA, 16 bp, P. troglodytes
tctactaaaacaaaac

SEQ ID NO: 267985 - DNA, 16 bp, P. troglodytes
tctactaaaagataca

SEQ ID NO: 267986 - DNA, 16 bp, P. troglodytes
tctactaaagtacaaa

SEQ ID NO: 267987 - DNA, 16 bp, P. troglodytes
tctactaagatacaaa

SEQ ID NO: 267988 - DNA, 16 bp, P. troglodytes
tctactcaaaatacaa

SEQ ID NO: 267989 - DNA, 16 bp, P. troglodytes
tctactcattcttcaa

SEQ ID NO: 267990 - DNA, 16 bp, P. troglodytes
tctactctgtgcttct

SEQ ID NO: 267991 - DNA, 16 bp, P. troglodytes
tctactgttgatgggc

SEQ ID NO: 267992 - DNA, 16 bp, P. troglodytes
tctacttcctgtttct

SEQ ID NO: 267993 - DNA, 16 bp, P. troglodytes
tctacttctatgagtt

SEQ ID NO: 267994 - DNA, 16 bp, P. troglodytes
tctacttctggtgagg

SEQ ID NO: 267995 - DNA, 16 bp, P. troglodytes
tctactttctgtctct

SEQ ID NO: 267996 - DNA, 16 bp, P. troglodytes
tctactttgtgtctct

SEQ ID NO: 267997 - DNA, 16 bp, P. troglodytes
tctactttttaaaatc

SEQ ID NO: 267998 - DNA, 16 bp, P. troglodytes
tctagaaaaaattaaa

SEQ ID NO: 267999 - DNA, 16 bp, P. troglodytes
tctagaaaatgcaaac

SEQ ID NO: 268000 - DNA, 16 bp, P. troglodytes
tctagaaatttattca

SEQ ID NO: 268001 - DNA, 16 bp, P. troglodytes
tctagaactcttgacc

SEQ ID NO: 268002 - DNA, 16 bp, P. troglodytes
tctagaagaaaatcta

SEQ ID NO: 268003 - DNA, 16 bp, P. troglodytes
tctagaagatggaaaa

SEQ ID NO: 268004 - DNA, 16 bp, P. troglodytes
tctagaagcagaaata

SEQ ID NO: 268005 - DNA, 16 bp, P. troglodytes
tctagaagctagaagt

SEQ ID NO: 268006 - DNA, 16 bp, P. troglodytes
tctagaagttctgttt

SEQ ID NO: 268007 - DNA, 16 bp, P. troglodytes
tctagaatcagaaata

SEQ ID NO: 268008 - DNA, 16 bp, P. troglodytes
tctagaatttattttt

SEQ ID NO: 268009 - DNA, 16 bp, P. troglodytes
tctagacaagcctggc

SEQ ID NO: 268010 - DNA, 16 bp, P. troglodytes
tctagaggatccccct

SEQ ID NO: 268011 - DNA, 16 bp, P. troglodytes
tctagaggctgggaag

SEQ ID NO: 268012 - DNA, 16 bp, P. troglodytes
tctagcaaagcaggcc

SEQ ID NO: 268013 - DNA, 16 bp, P. troglodytes
tctagcatttcctttt

SEQ ID NO: 268014 - DNA, 16 bp, P. troglodytes
tctagcctaggcaaca

SEQ ID NO: 268015 - DNA, 16 bp, P. troglodytes
tctagcctgagcgaca

SEQ ID NO: 268016 - DNA, 16 bp, P. troglodytes
tctagcctggatgaca

SEQ ID NO: 268017 - DNA, 20 bp, P. troglodytes
tctagctcaaggtttgtaaa

SEQ ID NO: 268018 - DNA, 20 bp, P. troglodytes
tctagctcagggattgtaaa

SEQ ID NO: 268019 - DNA, 16 bp, P. troglodytes
tctagctcagggtttg

SEQ ID NO: 268020 - DNA, 16 bp, P. troglodytes
tctaggaagttccaaa

SEQ ID NO: 268021 - DNA, 24 bp, P. troglodytes
tctaggaatccaacttacaaggga

SEQ ID NO: 268022 - DNA, 16 bp, P. troglodytes
tctaggaatttatcca

SEQ ID NO: 268023 - DNA, 16 bp, P. troglodytes
tctaggaatttttttt

SEQ ID NO: 268024 - DNA, 16 bp, P. troglodytes
tctaggccgggcacag

SEQ ID NO: 268025 - DNA, 16 bp, P. troglodytes
tctaggctggagtgca

SEQ ID NO: 268026 - DNA, 16 bp, P. troglodytes
tctaggtgagtcagtg

SEQ ID NO: 268027 - DNA, 16 bp, P. troglodytes
tctagtcccagctacc

SEQ ID NO: 268028 - DNA, 16 bp, P. troglodytes
tctagtcccagctact

SEQ ID NO: 268029 - DNA, 16 bp, P. troglodytes
tctagtctattattga

SEQ ID NO: 268030 - DNA, 16 bp, P. troglodytes
tctagtgaggaagaca

SEQ ID NO: 268031 - DNA, 16 bp, P. troglodytes
tctagtggaggagaca

SEQ ID NO: 268032 - DNA, 18 bp, P. troglodytes
tctagtggggacttggag

SEQ ID NO: 268033 - DNA, 16 bp, P. troglodytes
tctagttcttttaatt

SEQ ID NO: 268034 - DNA, 16 bp, P. troglodytes
tctagttcttttcatt

SEQ ID NO: 268035 - DNA, 16 bp, P. troglodytes
tctagttttctagttt

SEQ ID NO: 268036 - DNA, 16 bp, P. troglodytes
tctagtttttatcttg

SEQ ID NO: 268037 - DNA, 16 bp, P. troglodytes
tctataaaatagagat

SEQ ID NO: 268038 - DNA, 16 bp, P. troglodytes
tctataaaatgaagaa

SEQ ID NO: 268039 - DNA, 16 bp, P. troglodytes
tctataaaatggatat

SEQ ID NO: 268040 - DNA, 16 bp, P. troglodytes
tctataaaatgggaat

SEQ ID NO: 268041 - DNA, 16 bp, P. troglodytes
tctataaggaaattaa

SEQ ID NO: 268042 - DNA, 16 bp, P. troglodytes
tctataatttccattt

SEQ ID NO: 268043 - DNA, 16 bp, P. troglodytes
tctatataatggaata

SEQ ID NO: 268044 - DNA, 16 bp, P. troglodytes
tctatatatgtattat

SEQ ID NO: 268045 - DNA, 20 bp, P. troglodytes
tctatatctctgttttggta

SEQ ID NO: 268046 - DNA, 16 bp, P. troglodytes
tctatcaacaggtgaa

SEQ ID NO: 268047 - DNA, 16 bp, P. troglodytes
tctatcaccatagatt

SEQ ID NO: 268048 - DNA, 16 bp, P. troglodytes
tctatcagcagcatga

SEQ ID NO: 268049 - DNA, 16 bp, P. troglodytes
tctatccatttattca

SEQ ID NO: 268050 - DNA, 16 bp, P. troglodytes
tctatcctggagaatg

SEQ ID NO: 268051 - DNA, 16 bp, P. troglodytes
tctatcctgtttcatt

SEQ ID NO: 268052 - DNA, 16 bp, P. troglodytes
tctatctatccatcca

SEQ ID NO: 268053 - DNA, 17 bp, P. troglodytes
tctatctatctatatat

SEQ ID NO: 268054 - DNA, 17 bp, P. troglodytes
tctatctatctatctat

SEQ ID NO: 268055 - DNA, 16 bp, P. troglodytes
tctatctatttatcta

SEQ ID NO: 268056 - DNA, 16 bp, P. troglodytes
tctatctcatctatct

SEQ ID NO: 268057 - DNA, 16 bp, P. troglodytes
tctatcttggctcact

SEQ ID NO: 268058 - DNA, 16 bp, P. troglodytes
tctatgaaaaagaaaa

SEQ ID NO: 268059 - DNA, 16 bp, P. troglodytes
tctatgaaaaatataa

SEQ ID NO: 268060 - DNA, 16 bp, P. troglodytes
tctatgaaagaaaaaa

SEQ ID NO: 268061 - DNA, 16 bp, P. troglodytes
tctatgaatttgacca

SEQ ID NO: 268062 - DNA, 16 bp, P. troglodytes
tctatgaatttgatta

SEQ ID NO: 268063 - DNA, 16 bp, P. troglodytes
tctatgactcattggc

SEQ ID NO: 268064 - DNA, 16 bp, P. troglodytes
tctatgatttatttca

SEQ ID NO: 268065 - DNA, 16 bp, P. troglodytes
tctatgcagcctcagg

SEQ ID NO: 268066 - DNA, 16 bp, P. troglodytes
tctatggaaataaaaa

SEQ ID NO: 268067 - DNA, 16 bp, P. troglodytes
tctatggattcaacca

SEQ ID NO: 268068 - DNA, 16 bp, P. troglodytes
tctatggctgctgtaa

SEQ ID NO: 268069 - DNA, 16 bp, P. troglodytes
tctatgggtcaggaat

SEQ ID NO: 268070 - DNA, 16 bp, P. troglodytes
tctatgggttgtctgt

SEQ ID NO: 268071 - DNA, 16 bp, P. troglodytes
tctatgtaatatatat

SEQ ID NO: 268072 - DNA, 16 bp, P. troglodytes
tctatgtattttgtta

SEQ ID NO: 268073 - DNA, 16 bp, P. troglodytes
tctatgtgtgtgtgtg

SEQ ID NO: 268074 - DNA, 16 bp, P. troglodytes
tctatgtgttcatgtg

SEQ ID NO: 268075 - DNA, 16 bp, P. troglodytes
tctatgtttaagtttt

SEQ ID NO: 268076 - DNA, 16 bp, P. troglodytes
tctattaaaaacaaac

SEQ ID NO: 268077 - DNA, 16 bp, P. troglodytes
tctattaaagaaaaaa

SEQ ID NO: 268078 - DNA, 16 bp, P. troglodytes
tctattaagccagaca

SEQ ID NO: 268079 - DNA, 17 bp, P. troglodytes
tctattaggttggtgca

SEQ ID NO: 268080 - DNA, 16 bp, P. troglodytes
tctattataaagatat

SEQ ID NO: 268081 - DNA, 16 bp, P. troglodytes
tctattattttgttaa

SEQ ID NO: 268082 - DNA, 16 bp, P. troglodytes
tctattcaaagttatc

SEQ ID NO: 268083 - DNA, 17 bp, P. troglodytes
tctattcagagattgaa

SEQ ID NO: 268084 - DNA, 16 bp, P. troglodytes
tctattcatctgttga

SEQ ID NO: 268085 - DNA, 16 bp, P. troglodytes
tctattctctctgaaa

SEQ ID NO: 268086 - DNA, 16 bp, P. troglodytes
tctattctctctgaag

SEQ ID NO: 268087 - DNA, 16 bp, P. troglodytes
tctattctgaacattt

SEQ ID NO: 268088 - DNA, 16 bp, P. troglodytes
tctattctggatattt

SEQ ID NO: 268089 - DNA, 16 bp, P. troglodytes
tctattctgttggtct

SEQ ID NO: 268090 - DNA, 16 bp, P. troglodytes
tctattgaattgcctt

SEQ ID NO: 268091 - DNA, 28 bp, P. troglodytes
tctattgagataatcatgtggtttttgt

SEQ ID NO: 268092 - DNA, 16 bp, P. troglodytes
tctattgagatagtca

SEQ ID NO: 268093 - DNA, 16 bp, P. troglodytes
tctattgccaggctgg

SEQ ID NO: 268094 - DNA, 16 bp, P. troglodytes
tctattgtaaatggga

SEQ ID NO: 268095 - DNA, 16 bp, P. troglodytes
tctattgttgtcatct

SEQ ID NO: 268096 - DNA, 16 bp, P. troglodytes
tctatttaaagaaaaa

SEQ ID NO: 268097 - DNA, 16 bp, P. troglodytes
tctatttacataaaat

SEQ ID NO: 268098 - DNA, 16 bp, P. troglodytes
tctatttctatgagat

SEQ ID NO: 268099 - DNA, 16 bp, P. troglodytes
tctatttctgggcttt

SEQ ID NO: 268100 - DNA, 16 bp, P. troglodytes
tctatttcttcttgat

SEQ ID NO: 268101 - DNA, 16 bp, P. troglodytes
tctatttcttcttgta

SEQ ID NO: 268102 - DNA, 23 bp, P. troglodytes
tctatttgattcttctctctttt

SEQ ID NO: 268103 - DNA, 16 bp, P. troglodytes
tctatttgctaatatt

SEQ ID NO: 268104 - DNA, 16 bp, P. troglodytes
tctatttggccatctt

SEQ ID NO: 268105 - DNA, 16 bp, P. troglodytes
tctatttgtctgttct

SEQ ID NO: 268106 - DNA, 16 bp, P. troglodytes
tctattttaaaacatt

SEQ ID NO: 268107 - DNA, 16 bp, P. troglodytes
tctattttaaaataca

SEQ ID NO: 268108 - DNA, 16 bp, P. troglodytes
tctattttaaagataa

SEQ ID NO: 268109 - DNA, 16 bp, P. troglodytes
tctattttacagaaga

SEQ ID NO: 268110 - DNA, 16 bp, P. troglodytes
tctattttctcagtga

SEQ ID NO: 268111 - DNA, 16 bp, P. troglodytes
tctatttttactagag

SEQ ID NO: 268112 - DNA, 16 bp, P. troglodytes
tctatttttgtaaaaa

SEQ ID NO: 268113 - DNA, 16 bp, P. troglodytes
tctatttttgtgtgtg

SEQ ID NO: 268114 - DNA, 16 bp, P. troglodytes
tctcaaaaaaaaaagc

SEQ ID NO: 268115 - DNA, 16 bp, P. troglodytes
tctcaaaaaaaaagag

SEQ ID NO: 268116 - DNA, 16 bp, P. troglodytes
tctcaaaaaaaagaat

SEQ ID NO: 268117 - DNA, 16 bp, P. troglodytes
tctcaaaaaaaagggt

SEQ ID NO: 268118 - DNA, 16 bp, P. troglodytes
tctcaaaaaaaattgt

SEQ ID NO: 268119 - DNA, 16 bp, P. troglodytes
tctcaaaaaaagaagc

SEQ ID NO: 268120 - DNA, 16 bp, P. troglodytes
tctcaaaaaaatagaa

SEQ ID NO: 268121 - DNA, 16 bp, P. troglodytes
tctcaaaaaaattttt

SEQ ID NO: 268122 - DNA, 16 bp, P. troglodytes
tctcaaaaaagaaata

SEQ ID NO: 268123 - DNA, 16 bp, P. troglodytes
tctcaaaaaagagaaa

SEQ ID NO: 268124 - DNA, 16 bp, P. troglodytes
tctcaaaaaatgaaat

SEQ ID NO: 268125 - DNA, 16 bp, P. troglodytes
tctcaaaaacagaaca

SEQ ID NO: 268126 - DNA, 16 bp, P. troglodytes
tctcaaaaagagaaaa

SEQ ID NO: 268127 - DNA, 16 bp, P. troglodytes
tctcaaaagaaaataa

SEQ ID NO: 268128 - DNA, 16 bp, P. troglodytes
tctcaaaagaaacaaa

SEQ ID NO: 268129 - DNA, 16 bp, P. troglodytes
tctcaaaagagaaaaa

SEQ ID NO: 268130 - DNA, 16 bp, P. troglodytes
tctcaaaagtcaaaga

SEQ ID NO: 268131 - DNA, 16 bp, P. troglodytes
tctcaaaatcaaaaca

SEQ ID NO: 268132 - DNA, 16 bp, P. troglodytes
tctcaaaatgaaaagt

SEQ ID NO: 268133 - DNA, 16 bp, P. troglodytes
tctcaaacaccaaaag

SEQ ID NO: 268134 - DNA, 16 bp, P. troglodytes
tctcaaacattaatgt

SEQ ID NO: 268135 - DNA, 16 bp, P. troglodytes
tctcaaactcctgact

SEQ ID NO: 268136 - DNA, 16 bp, P. troglodytes
tctcaaactccttggc

SEQ ID NO: 268137 - DNA, 16 bp, P. troglodytes
tctcaaactcgtgacc

SEQ ID NO: 268138 - DNA, 16 bp, P. troglodytes
tctcaaagaaaaaaag

SEQ ID NO: 268139 - DNA, 16 bp, P. troglodytes
tctcaaagaaaaaaga

SEQ ID NO: 268140 - DNA, 16 bp, P. troglodytes
tctcaaagaaaagaaa

SEQ ID NO: 268141 - DNA, 16 bp, P. troglodytes
tctcaaagaaaggaaa

SEQ ID NO: 268142 - DNA, 16 bp, P. troglodytes
tctcaaagaaattaaa

SEQ ID NO: 268143 - DNA, 16 bp, P. troglodytes
tctcaaagaagaaaaa

SEQ ID NO: 268144 - DNA, 16 bp, P. troglodytes
tctcaaagaagaagaa

SEQ ID NO: 268145 - DNA, 16 bp, P. troglodytes
tctcaaagaagacatt

SEQ ID NO: 268146 - DNA, 16 bp, P. troglodytes
tctcaaagaagtttct

SEQ ID NO: 268147 - DNA, 16 bp, P. troglodytes
tctcaaaggaaaaaaa

SEQ ID NO: 268148 - DNA, 16 bp, P. troglodytes
tctcaaaggacttaaa

SEQ ID NO: 268149 - DNA, 16 bp, P. troglodytes
tctcaaagggacagag

SEQ ID NO: 268150 - DNA, 17 bp, P. troglodytes
tctcaaagtgctaggat

SEQ ID NO: 268151 - DNA, 16 bp, P. troglodytes
tctcaaataactaaaa

SEQ ID NO: 268152 - DNA, 16 bp, P. troglodytes
tctcaaatcctgacct

SEQ ID NO: 268153 - DNA, 16 bp, P. troglodytes
tctcaaatgacagaat

SEQ ID NO: 268154 - DNA, 16 bp, P. troglodytes
tctcaaatgtcttcag

SEQ ID NO: 268155 - DNA, 16 bp, P. troglodytes
tctcaaattccttcag

SEQ ID NO: 268156 - DNA, 16 bp, P. troglodytes
tctcaaatttatatct

SEQ ID NO: 268157 - DNA, 16 bp, P. troglodytes
tctcaacaaaaaaaag

SEQ ID NO: 268158 - DNA, 16 bp, P. troglodytes
tctcaacaaaaaaatt

SEQ ID NO: 268159 - DNA, 16 bp, P. troglodytes
tctcaacaaaaaattt

SEQ ID NO: 268160 - DNA, 16 bp, P. troglodytes
tctcaacacagcagcc

SEQ ID NO: 268161 - DNA, 16 bp, P. troglodytes
tctcaacctcccaagt

SEQ ID NO: 268162 - DNA, 16 bp, P. troglodytes
tctcaacctcctgacc

SEQ ID NO: 268163 - DNA, 17 bp, P. troglodytes
tctcaactgcaagaggc

SEQ ID NO: 268164 - DNA, 16 bp, P. troglodytes
tctcaagaaaagaaaa

SEQ ID NO: 268165 - DNA, 16 bp, P. troglodytes
tctcaagaaatatttg

SEQ ID NO: 268166 - DNA, 16 bp, P. troglodytes
tctcaagcatttatcc

SEQ ID NO: 268167 - DNA, 16 bp, P. troglodytes
tctcaagctcctgggt

SEQ ID NO: 268168 - DNA, 16 bp, P. troglodytes
tctcaaggacctggga

SEQ ID NO: 268169 - DNA, 16 bp, P. troglodytes
tctcaaggagtttaca

SEQ ID NO: 268170 - DNA, 16 bp, P. troglodytes
tctcaagttcaaagtt

SEQ ID NO: 268171 - DNA, 16 bp, P. troglodytes
tctcaagtttttaaaa

SEQ ID NO: 268172 - DNA, 16 bp, P. troglodytes
tctcaataaaagaaaa

SEQ ID NO: 268173 - DNA, 16 bp, P. troglodytes
tctcaataaatattca

SEQ ID NO: 268174 - DNA, 16 bp, P. troglodytes
tctcaataaatggtgc

SEQ ID NO: 268175 - DNA, 16 bp, P. troglodytes
tctcaataattttata

SEQ ID NO: 268176 - DNA, 16 bp, P. troglodytes
tctcaatcttttggaa

SEQ ID NO: 268177 - DNA, 16 bp, P. troglodytes
tctcacaatatctgat

SEQ ID NO: 268178 - DNA, 16 bp, P. troglodytes
tctcacaatgttgcct

SEQ ID NO: 268179 - DNA, 16 bp, P. troglodytes
tctcacacacacacag

SEQ ID NO: 268180 - DNA, 17 bp, P. troglodytes
tctcacacaggggagac

SEQ ID NO: 268181 - DNA, 16 bp, P. troglodytes
tctcacaccacaacaa

SEQ ID NO: 268182 - DNA, 16 bp, P. troglodytes
tctcacagctccatta

SEQ ID NO: 268183 - DNA, 16 bp, P. troglodytes
tctcacaggctggagt

SEQ ID NO: 268184 - DNA, 16 bp, P. troglodytes
tctcacaggttggagt

SEQ ID NO: 268185 - DNA, 16 bp, P. troglodytes
tctcacagtttctgtg

SEQ ID NO: 268186 - DNA, 19 bp, P. troglodytes
tctcacatcagttagaatg

SEQ ID NO: 268187 - DNA, 16 bp, P. troglodytes
tctcacatccaggtca

SEQ ID NO: 268188 - DNA, 16 bp, P. troglodytes
tctcacatctccacta

SEQ ID NO: 268189 - DNA, 16 bp, P. troglodytes
tctcacatggcggcag

SEQ ID NO: 268190 - DNA, 16 bp, P. troglodytes
tctcacattttcctgt

SEQ ID NO: 268191 - DNA, 16 bp, P. troglodytes
tctcaccaaagaagat

SEQ ID NO: 268192 - DNA, 16 bp, P. troglodytes
tctcaccactgcaccc

SEQ ID NO: 268193 - DNA, 16 bp, P. troglodytes
tctcaccacttctttt

SEQ ID NO: 268194 - DNA, 16 bp, P. troglodytes
tctcaccatataaaaa

SEQ ID NO: 268195 - DNA, 16 bp, P. troglodytes
tctcaccatgtccctt

SEQ ID NO: 268196 - DNA, 16 bp, P. troglodytes
tctcaccattttgccc

SEQ ID NO: 268197 - DNA, 16 bp, P. troglodytes
tctcacctcagccccc

SEQ ID NO: 268198 - DNA, 16 bp, P. troglodytes
tctcacctcagtctcc

SEQ ID NO: 268199 - DNA, 16 bp, P. troglodytes
tctcacctctgcctcc

SEQ ID NO: 268200 - DNA, 16 bp, P. troglodytes
tctcaccttggtctcc

SEQ ID NO: 268201 - DNA, 16 bp, P. troglodytes
tctcactaggctaaaa

SEQ ID NO: 268202 - DNA, 16 bp, P. troglodytes
tctcactccgttgcct

SEQ ID NO: 268203 - DNA, 16 bp, P. troglodytes
tctcactctcttgctc

SEQ ID NO: 268204 - DNA, 16 bp, P. troglodytes
tctcactctgccttat

SEQ ID NO: 268205 - DNA, 23 bp, P. troglodytes
tctcactctgtcgccaggctgga

SEQ ID NO: 268206 - DNA, 16 bp, P. troglodytes
tctcactctgtgcccc

SEQ ID NO: 268207 - DNA, 16 bp, P. troglodytes
tctcactctgtgtgtg

SEQ ID NO: 268208 - DNA, 16 bp, P. troglodytes
tctcactcttgtcacc

SEQ ID NO: 268209 - DNA, 16 bp, P. troglodytes
tctcactgcaacctcc

SEQ ID NO: 268210 - DNA, 16 bp, P. troglodytes
tctcactgcaacctct

SEQ ID NO: 268211 - DNA, 17 bp, P. troglodytes
tctcactgcaagctctg

SEQ ID NO: 268212 - DNA, 16 bp, P. troglodytes
tctcactgcaatctct

SEQ ID NO: 268213 - DNA, 16 bp, P. troglodytes
tctcactgggtccctc

SEQ ID NO: 268214 - DNA, 16 bp, P. troglodytes
tctcacttaatcctca

SEQ ID NO: 268215 - DNA, 16 bp, P. troglodytes
tctcacttgatcctca

SEQ ID NO: 268216 - DNA, 16 bp, P. troglodytes
tctcactttgggccac

SEQ ID NO: 268217 - DNA, 16 bp, P. troglodytes
tctcactttgttgacc

SEQ ID NO: 268218 - DNA, 16 bp, P. troglodytes
tctcactttttaaaat

SEQ ID NO: 268219 - DNA, 16 bp, P. troglodytes
tctcagaaaaaggaaa

SEQ ID NO: 268220 - DNA, 16 bp, P. troglodytes
tctcagaaacttctct

SEQ ID NO: 268221 - DNA, 16 bp, P. troglodytes
tctcagaaagaaaaga

SEQ ID NO: 268222 - DNA, 16 bp, P. troglodytes
tctcagaaattaccac

SEQ ID NO: 268223 - DNA, 16 bp, P. troglodytes
tctcagaaggaaagaa

SEQ ID NO: 268224 - DNA, 16 bp, P. troglodytes
tctcagaattggaaaa

SEQ ID NO: 268225 - DNA, 16 bp, P. troglodytes
tctcagacagaaatga

SEQ ID NO: 268226 - DNA, 16 bp, P. troglodytes
tctcagagaaacagaa

SEQ ID NO: 268227 - DNA, 16 bp, P. troglodytes
tctcagagagaatgct

SEQ ID NO: 268228 - DNA, 16 bp, P. troglodytes
tctcagaggagtaccc

SEQ ID NO: 268229 - DNA, 16 bp, P. troglodytes
tctcagatacttggga

SEQ ID NO: 268230 - DNA, 16 bp, P. troglodytes
tctcagatattttgtt

SEQ ID NO: 268231 - DNA, 16 bp, P. troglodytes
tctcagatgaagatga

SEQ ID NO: 268232 - DNA, 16 bp, P. troglodytes
tctcagatgagacttt

SEQ ID NO: 268233 - DNA, 16 bp, P. troglodytes
tctcagatggagatga

SEQ ID NO: 268234 - DNA, 16 bp, P. troglodytes
tctcagcaataaaaag

SEQ ID NO: 268235 - DNA, 16 bp, P. troglodytes
tctcagcaatttggga

SEQ ID NO: 268236 - DNA, 16 bp, P. troglodytes
tctcagcacactgcag

SEQ ID NO: 268237 - DNA, 16 bp, P. troglodytes
tctcagcagaaacact

SEQ ID NO: 268238 - DNA, 16 bp, P. troglodytes
tctcagcagaagccag

SEQ ID NO: 268239 - DNA, 16 bp, P. troglodytes
tctcagcagagaggag

SEQ ID NO: 268240 - DNA, 16 bp, P. troglodytes
tctcagcagcatttga

SEQ ID NO: 268241 - DNA, 16 bp, P. troglodytes
tctcagcccaaaaact

SEQ ID NO: 268242 - DNA, 29 bp, P. troglodytes
tctcagcccaaaatctccttaagctgata

SEQ ID NO: 268243 - DNA, 29 bp, P. troglodytes
tctcagcccaaaatctccttaagctgatg

SEQ ID NO: 268244 - DNA, 16 bp, P. troglodytes
tctcagcccagttcag

SEQ ID NO: 268245 - DNA, 16 bp, P. troglodytes
tctcagccccaaagct

SEQ ID NO: 268246 - DNA, 16 bp, P. troglodytes
tctcagccctgctcac

SEQ ID NO: 268247 - DNA, 16 bp, P. troglodytes
tctcagccgggcgtgg

SEQ ID NO: 268248 - DNA, 16 bp, P. troglodytes
tctcagcctacatctt

SEQ ID NO: 268249 - DNA, 16 bp, P. troglodytes
tctcagcctcagtttc

SEQ ID NO: 268250 - DNA, 16 bp, P. troglodytes
tctcagcctccagctt

SEQ ID NO: 268251 - DNA, 18 bp, P. troglodytes
tctcagcctcccaagtaa

SEQ ID NO: 268252 - DNA, 16 bp, P. troglodytes
tctcagcctcccacag

SEQ ID NO: 268253 - DNA, 16 bp, P. troglodytes
tctcagcctcccaggt

SEQ ID NO: 268254 - DNA, 16 bp, P. troglodytes
tctcagcctctggagt

SEQ ID NO: 268255 - DNA, 16 bp, P. troglodytes
tctcagcctggttcag

SEQ ID NO: 268256 - DNA, 16 bp, P. troglodytes
tctcagccttatttta

SEQ ID NO: 268257 - DNA, 16 bp, P. troglodytes
tctcagctacatggga

SEQ ID NO: 268258 - DNA, 16 bp, P. troglodytes
tctcagctcaaaatct

SEQ ID NO: 268259 - DNA, 16 bp, P. troglodytes
tctcagctcacagcag

SEQ ID NO: 268260 - DNA, 16 bp, P. troglodytes
tctcagctcaccacag

SEQ ID NO: 268261 - DNA, 17 bp, P. troglodytes
tctcagctcacttcaat

SEQ ID NO: 268262 - DNA, 16 bp, P. troglodytes
tctcagctcagtgcag

SEQ ID NO: 268263 - DNA, 16 bp, P. troglodytes
tctcagctcctcagga

SEQ ID NO: 268264 - DNA, 16 bp, P. troglodytes
tctcagctctgcctcc

SEQ ID NO: 268265 - DNA, 16 bp, P. troglodytes
tctcagctctggaggc

SEQ ID NO: 268266 - DNA, 16 bp, P. troglodytes
tctcagctgcttggga

SEQ ID NO: 268267 - DNA, 16 bp, P. troglodytes
tctcagctgtttggga

SEQ ID NO: 268268 - DNA, 16 bp, P. troglodytes
tctcagcttatgaaga

SEQ ID NO: 268269 - DNA, 16 bp, P. troglodytes
tctcagcttcccaagt

SEQ ID NO: 268270 - DNA, 16 bp, P. troglodytes
tctcagcttcctcatc

SEQ ID NO: 268271 - DNA, 16 bp, P. troglodytes
tctcagcttgctgggc

SEQ ID NO: 268272 - DNA, 16 bp, P. troglodytes
tctcagctttccaaag

SEQ ID NO: 268273 - DNA, 16 bp, P. troglodytes
tctcaggatagaaaat

SEQ ID NO: 268274 - DNA, 16 bp, P. troglodytes
tctcaggccaggcaca

SEQ ID NO: 268275 - DNA, 16 bp, P. troglodytes
tctcaggccccacccc

SEQ ID NO: 268276 - DNA, 16 bp, P. troglodytes
tctcaggcctttggcc

SEQ ID NO: 268277 - DNA, 16 bp, P. troglodytes
tctcaggctcaagcaa

SEQ ID NO: 268278 - DNA, 16 bp, P. troglodytes
tctcaggcttccagcc

SEQ ID NO: 268279 - DNA, 16 bp, P. troglodytes
tctcagggatggcaga

SEQ ID NO: 268280 - DNA, 16 bp, P. troglodytes
tctcaggggtagcaga

SEQ ID NO: 268281 - DNA, 16 bp, P. troglodytes
tctcaggggtggcaga

SEQ ID NO: 268282 - DNA, 16 bp, P. troglodytes
tctcaggtattttctt

SEQ ID NO: 268283 - DNA, 23 bp, P. troglodytes
tctcaggtgatctgcccgcctcg

SEQ ID NO: 268284 - DNA, 16 bp, P. troglodytes
tctcaggtttattctc

SEQ ID NO: 268285 - DNA, 16 bp, P. troglodytes
tctcagtagacacaga

SEQ ID NO: 268286 - DNA, 16 bp, P. troglodytes
tctcagtcacaatttt

SEQ ID NO: 268287 - DNA, 17 bp, P. troglodytes
tctcagtctcctgacct

SEQ ID NO: 268288 - DNA, 16 bp, P. troglodytes
tctcagtgctttgaga

SEQ ID NO: 268289 - DNA, 16 bp, P. troglodytes
tctcagtggacagagc

SEQ ID NO: 268290 - DNA, 16 bp, P. troglodytes
tctcagtgtgtgtgtg

SEQ ID NO: 268291 - DNA, 16 bp, P. troglodytes
tctcagttctgttcca

SEQ ID NO: 268292 - DNA, 16 bp, P. troglodytes
tctcagtttcctaatc

SEQ ID NO: 268293 - DNA, 16 bp, P. troglodytes
tctcagtttctcatct

SEQ ID NO: 268294 - DNA, 16 bp, P. troglodytes
tctcagttttctcatc

SEQ ID NO: 268295 - DNA, 16 bp, P. troglodytes
tctcagttttcttttc

SEQ ID NO: 268296 - DNA, 16 bp, P. troglodytes
tctcataaggagcaca

SEQ ID NO: 268297 - DNA, 16 bp, P. troglodytes
tctcataatatttcaa

SEQ ID NO: 268298 - DNA, 16 bp, P. troglodytes
tctcatacactgctgg

SEQ ID NO: 268299 - DNA, 16 bp, P. troglodytes
tctcataggcagaagg

SEQ ID NO: 268300 - DNA, 16 bp, P. troglodytes
tctcatattgttttat

SEQ ID NO: 268301 - DNA, 16 bp, P. troglodytes
tctcatcagagacaag

SEQ ID NO: 268302 - DNA, 16 bp, P. troglodytes
tctcatcccagcctcc

SEQ ID NO: 268303 - DNA, 17 bp, P. troglodytes
tctcatctgtaaaatgg

SEQ ID NO: 268304 - DNA, 17 bp, P. troglodytes
tctcatcttgaattgta

SEQ ID NO: 268305 - DNA, 16 bp, P. troglodytes
tctcatcttgaatttt

SEQ ID NO: 268306 - DNA, 16 bp, P. troglodytes
tctcatgaaatttatt

SEQ ID NO: 268307 - DNA, 16 bp, P. troglodytes
tctcatgacctcatct

SEQ ID NO: 268308 - DNA, 16 bp, P. troglodytes
tctcatgagagctcac

SEQ ID NO: 268309 - DNA, 16 bp, P. troglodytes
tctcatgagagctgat

SEQ ID NO: 268310 - DNA, 18 bp, P. troglodytes
tctcatgatccacctgcc

SEQ ID NO: 268311 - DNA, 16 bp, P. troglodytes
tctcatgcctcatcct

SEQ ID NO: 268312 - DNA, 16 bp, P. troglodytes
tctcatgcctccacct

SEQ ID NO: 268313 - DNA, 16 bp, P. troglodytes
tctcatgctgaattgt

SEQ ID NO: 268314 - DNA, 16 bp, P. troglodytes
tctcatggaagtagag

SEQ ID NO: 268315 - DNA, 16 bp, P. troglodytes
tctcatgtaatgtatt

SEQ ID NO: 268316 - DNA, 16 bp, P. troglodytes
tctcatgttaaaatgt

SEQ ID NO: 268317 - DNA, 16 bp, P. troglodytes
tctcatgttgaaatgt

SEQ ID NO: 268318 - DNA, 16 bp, P. troglodytes
tctcattagaactcac

SEQ ID NO: 268319 - DNA, 16 bp, P. troglodytes
tctcattcagtcctca

SEQ ID NO: 268320 - DNA, 16 bp, P. troglodytes
tctcattctctcttgc

SEQ ID NO: 268321 - DNA, 16 bp, P. troglodytes
tctcattcttttgccc

SEQ ID NO: 268322 - DNA, 16 bp, P. troglodytes
tctcattcttttgtat

SEQ ID NO: 268323 - DNA, 16 bp, P. troglodytes
tctcattgctctggct

SEQ ID NO: 268324 - DNA, 16 bp, P. troglodytes
tctcattgtccaattc

SEQ ID NO: 268325 - DNA, 16 bp, P. troglodytes
tctcattgtggtttta

SEQ ID NO: 268326 - DNA, 16 bp, P. troglodytes
tctcattgtgttgtcc

SEQ ID NO: 268327 - DNA, 33 bp, P. troglodytes; identical to SEQ ID NO: 138944

SEQ ID NO: 268328 - DNA, 16 bp, P. troglodytes
tctcattgttttactt

SEQ ID NO: 268329 - DNA, 16 bp, P. troglodytes
tctcattgttttcaaa

SEQ ID NO: 268330 - DNA, 16 bp, P. troglodytes
tctcatttaagcctca

SEQ ID NO: 268331 - DNA, 16 bp, P. troglodytes
tctcatttaatattca

SEQ ID NO: 268332 - DNA, 16 bp, P. troglodytes
tctcatttaattctca

SEQ ID NO: 268333 - DNA, 16 bp, P. troglodytes
tctcatttaattctga

SEQ ID NO: 268334 - DNA, 16 bp, P. troglodytes
tctcatttactcctca

SEQ ID NO: 268335 - DNA, 16 bp, P. troglodytes
tctcatttataaatgg

SEQ ID NO: 268336 - DNA, 16 bp, P. troglodytes
tctcatttattcctca

SEQ ID NO: 268337 - DNA, 16 bp, P. troglodytes
tctcatttccttttgt

SEQ ID NO: 268338 - DNA, 16 bp, P. troglodytes
tctcatttctaaaata

SEQ ID NO: 268339 - DNA, 16 bp, P. troglodytes
tctcatttgtgtattt

SEQ ID NO: 268340 - DNA, 16 bp, P. troglodytes
tctcattttaaaaaat

SEQ ID NO: 268341 - DNA, 16 bp, P. troglodytes
tctcattttaaagatg

SEQ ID NO: 268342 - DNA, 16 bp, P. troglodytes
tctcattttcctcatc

SEQ ID NO: 268343 - DNA, 16 bp, P. troglodytes
tctcattttcttctgt

SEQ ID NO: 268344 - DNA, 16 bp, P. troglodytes
tctcattttgtagctc

SEQ ID NO: 268345 - DNA, 16 bp, P. troglodytes
tctccaaaaaagaaag

SEQ ID NO: 268346 - DNA, 16 bp, P. troglodytes
tctccaaaactctttt

SEQ ID NO: 268347 - DNA, 16 bp, P. troglodytes
tctccaaaagtgctgg

SEQ ID NO: 268348 - DNA, 16 bp, P. troglodytes
tctccaaaattcatgt

SEQ ID NO: 268349 - DNA, 16 bp, P. troglodytes
tctccaaacaccatca

SEQ ID NO: 268350 - DNA, 16 bp, P. troglodytes
tctccaaactcatcaa

SEQ ID NO: 268351 - DNA, 16 bp, P. troglodytes
tctccaacacctgggc

SEQ ID NO: 268352 - DNA, 16 bp, P. troglodytes
tctccaaccagtccca

SEQ ID NO: 268353 - DNA, 16 bp, P. troglodytes
tctccaaggctgaaat

SEQ ID NO: 268354 - DNA, 16 bp, P. troglodytes
tctccaagtccccatc

SEQ ID NO: 268355 - DNA, 16 bp, P. troglodytes
tctccaatgtggcagt

SEQ ID NO: 268356 - DNA, 16 bp, P. troglodytes
tctccaattaaaagat

SEQ ID NO: 268357 - DNA, 16 bp, P. troglodytes
tctccacagaaacaga

SEQ ID NO: 268358 - DNA, 16 bp, P. troglodytes
tctccacatcttcctt

SEQ ID NO: 268359 - DNA, 16 bp, P. troglodytes
tctccacatgctgctc

SEQ ID NO: 268360 - DNA, 16 bp, P. troglodytes
tctccaccaaaaataa

SEQ ID NO: 268361 - DNA, 16 bp, P. troglodytes
tctccaccatgacaat

SEQ ID NO: 268362 - DNA, 16 bp, P. troglodytes
tctccacctcctgacc

SEQ ID NO: 268363 - DNA, 16 bp, P. troglodytes
tctccactaaaaatac

SEQ ID NO: 268364 - DNA, 16 bp, P. troglodytes
tctccactaaaaatat

SEQ ID NO: 268365 - DNA, 16 bp, P. troglodytes
tctccagaaaaaaaaa

SEQ ID NO: 268366 - DNA, 16 bp, P. troglodytes
tctccagaacttattc

SEQ ID NO: 268367 - DNA, 16 bp, P. troglodytes
tctccagaagcagatg

SEQ ID NO: 268368 - DNA, 16 bp, P. troglodytes
tctccagaagctgagc

SEQ ID NO: 268369 - DNA, 16 bp, P. troglodytes
tctccagaattgtgag

SEQ ID NO: 268370 - DNA, 16 bp, P. troglodytes
tctccagacactgcca

SEQ ID NO: 268371 - DNA, 16 bp, P. troglodytes
tctccagaccccagaa

SEQ ID NO: 268372 - DNA, 16 bp, P. troglodytes
tctccagactttgcca

SEQ ID NO: 268373 - DNA, 16 bp, P. troglodytes
tctccagatattgcca

SEQ ID NO: 268374 - DNA, 16 bp, P. troglodytes
tctccagcaagggttc

SEQ ID NO: 268375 - DNA, 16 bp, P. troglodytes
tctccagcatctgtgg

SEQ ID NO: 268376 - DNA, 16 bp, P. troglodytes
tctccagcatttgttg

SEQ ID NO: 268377 - DNA, 16 bp, P. troglodytes
tctccagccatgtgga

SEQ ID NO: 268378 - DNA, 16 bp, P. troglodytes
tctccagccccatctc

SEQ ID NO: 268379 - DNA, 16 bp, P. troglodytes
tctccagcctcacctc

SEQ ID NO: 268380 - DNA, 16 bp, P. troglodytes
tctccagcctcagcct

SEQ ID NO: 268381 - DNA, 16 bp, P. troglodytes
tctccagcctcagctt

SEQ ID NO: 268382 - DNA, 16 bp, P. troglodytes
tctccagcctcatctt

SEQ ID NO: 268383 - DNA, 16 bp, P. troglodytes
tctccagcctccagaa

SEQ ID NO: 268384 - DNA, 16 bp, P. troglodytes
tctccagcctggcgac

SEQ ID NO: 268385 - DNA, 17 bp, P. troglodytes
tctccagctgcgtactg

SEQ ID NO: 268386 - DNA, 16 bp, P. troglodytes
tctccagcttacagat

SEQ ID NO: 268387 - DNA, 16 bp, P. troglodytes
tctccagcttgctgac

SEQ ID NO: 268388 - DNA, 16 bp, P. troglodytes
tctccaggacagatca

SEQ ID NO: 268389 - DNA, 16 bp, P. troglodytes
tctccaggctcaggtg

SEQ ID NO: 268390 - DNA, 16 bp, P. troglodytes
tctccaggctgaagtg

SEQ ID NO: 268391 - DNA, 16 bp, P. troglodytes
tctccagggcctcctc

SEQ ID NO: 268392 - DNA, 16 bp, P. troglodytes
tctccaggtgattctg

SEQ ID NO: 268393 - DNA, 16 bp, P. troglodytes
tctccaggttggccac

SEQ ID NO: 268394 - DNA, 16 bp, P. troglodytes
tctccagtaaaaggaa

SEQ ID NO: 268395 - DNA, 16 bp, P. troglodytes
tctccagtcaaaagac

SEQ ID NO: 268396 - DNA, 16 bp, P. troglodytes
tctccagtgcccagca

SEQ ID NO: 268397 - DNA, 16 bp, P. troglodytes
tctccagtgttggagg

SEQ ID NO: 268398 - DNA, 16 bp, P. troglodytes
tctccagttccatcca

SEQ ID NO: 268399 - DNA, 16 bp, P. troglodytes
tctccatactattaga

SEQ ID NO: 268400 - DNA, 16 bp, P. troglodytes
tctccatactgtcttc

SEQ ID NO: 268401 - DNA, 16 bp, P. troglodytes
tctccatatcagcaat

SEQ ID NO: 268402 - DNA, 16 bp, P. troglodytes
tctccatatcctctct

SEQ ID NO: 268403 - DNA, 16 bp, P. troglodytes
tctccatcacccaggc

SEQ ID NO: 268404 - DNA, 16 bp, P. troglodytes
tctccatctataaaat

SEQ ID NO: 268405 - DNA, 16 bp, P. troglodytes
tctccatctcaagatc

SEQ ID NO: 268406 - DNA, 16 bp, P. troglodytes
tctccatctctatctc

SEQ ID NO: 268407 - DNA, 16 bp, P. troglodytes
tctccatctctctcca

SEQ ID NO: 268408 - DNA, 16 bp, P. troglodytes
tctccatctctgtctc

SEQ ID NO: 268409 - DNA, 16 bp, P. troglodytes
tctccatctctgtctt

SEQ ID NO: 268410 - DNA, 16 bp, P. troglodytes
tctccatctttgtggt

SEQ ID NO: 268411 - DNA, 16 bp, P. troglodytes
tctccatgaattcaat

SEQ ID NO: 268412 - DNA, 16 bp, P. troglodytes
tctccatgttggcctg

SEQ ID NO: 268413 - DNA, 16 bp, P. troglodytes
tctccattgcttgtta

SEQ ID NO: 268414 - DNA, 16 bp, P. troglodytes
tctccattttatggat

SEQ ID NO: 268415 - DNA, 16 bp, P. troglodytes
tctccattttgtcttg

SEQ ID NO: 268416 - DNA, 16 bp, P. troglodytes
tctcccaaagtgctgg

SEQ ID NO: 268417 - DNA, 16 bp, P. troglodytes
tctcccaactcagcct

SEQ ID NO: 268418 - DNA, 16 bp, P. troglodytes
tctcccaagtagccag

SEQ ID NO: 268419 - DNA, 16 bp, P. troglodytes
tctcccaccaggtccc

SEQ ID NO: 268420 - DNA, 16 bp, P. troglodytes
tctcccaccaggttcc

SEQ ID NO: 268421 - DNA, 16 bp, P. troglodytes
tctcccacctcagcct

SEQ ID NO: 268422 - DNA, 16 bp, P. troglodytes
tctcccaccttggcct

SEQ ID NO: 268423 - DNA, 16 bp, P. troglodytes
tctcccactcctgacc

SEQ ID NO: 268424 - DNA, 16 bp, P. troglodytes
tctcccagcaggcagc

SEQ ID NO: 268425 - DNA, 16 bp, P. troglodytes
tctcccagcctcagtt

SEQ ID NO: 268426 - DNA, 16 bp, P. troglodytes
tctcccaggtagctgg

SEQ ID NO: 268427 - DNA, 16 bp, P. troglodytes
tctcccaggttcaagc

SEQ ID NO: 268428 - DNA, 16 bp, P. troglodytes
tctcccatcatcccca

SEQ ID NO: 268429 - DNA, 16 bp, P. troglodytes
tctcccatcccagaag

SEQ ID NO: 268430 - DNA, 16 bp, P. troglodytes
tctcccatgttcaagc

SEQ ID NO: 268431 - DNA, 16 bp, P. troglodytes
tctccccacctcagcc

SEQ ID NO: 268432 - DNA, 16 bp, P. troglodytes
tctccccactcccagt

SEQ ID NO: 268433 - DNA, 16 bp, P. troglodytes
tctccccagagcctcc

SEQ ID NO: 268434 - DNA, 16 bp, P. troglodytes
tctcccccatgctgtt

SEQ ID NO: 268435 - DNA, 18 bp, P. troglodytes
tctccccctccaaaggaa

SEQ ID NO: 268436 - DNA, 16 bp, P. troglodytes
tctcccctgaactcca

SEQ ID NO: 268437 - DNA, 16 bp, P. troglodytes
tctcccgagcagctgg

SEQ ID NO: 268438 - DNA, 17 bp, P. troglodytes
tctcccgggttcaaatg

SEQ ID NO: 268439 - DNA, 16 bp, P. troglodytes
tctcccgggttcaagc

SEQ ID NO: 268440 - DNA, 16 bp, P. troglodytes
tctcccgggttccagc

SEQ ID NO: 268441 - DNA, 16 bp, P. troglodytes
tctccctatcaggaat

SEQ ID NO: 268442 - DNA, 16 bp, P. troglodytes
tctccctatgctgccc

SEQ ID NO: 268443 - DNA, 16 bp, P. troglodytes
tctccctcctcccagc

SEQ ID NO: 268444 - DNA, 16 bp, P. troglodytes
tctccctcctgcctca

SEQ ID NO: 268445 - DNA, 16 bp, P. troglodytes
tctccctctagcacca

SEQ ID NO: 268446 - DNA, 16 bp, P. troglodytes
tctccctgactgacta

SEQ ID NO: 268447 - DNA, 16 bp, P. troglodytes
tctccctgccccagcc

SEQ ID NO: 268448 - DNA, 16 bp, P. troglodytes
tctccctgctcccagc

SEQ ID NO: 268449 - DNA, 16 bp, P. troglodytes
tctccctgctcctggc

SEQ ID NO: 268450 - DNA, 16 bp, P. troglodytes
tctccctggttcaagt

SEQ ID NO: 268451 - DNA, 24 bp, P. troglodytes
tctccctgtgatgctgtgcttcag

SEQ ID NO: 268452 - DNA, 16 bp, P. troglodytes
tctccctttccccagg

SEQ ID NO: 268453 - DNA, 18 bp, P. troglodytes
tctccgcctccagggttc

SEQ ID NO: 268454 - DNA, 18 bp, P. troglodytes
tctccgctaaaaatacaa

SEQ ID NO: 268455 - DNA, 16 bp, P. troglodytes
tctcctaaaaatataa

SEQ ID NO: 268456 - DNA, 16 bp, P. troglodytes
tctcctaagacagagt

SEQ ID NO: 268457 - DNA, 16 bp, P. troglodytes
tctcctaatgttttcc

SEQ ID NO: 268458 - DNA, 16 bp, P. troglodytes
tctcctacctcatcct

SEQ ID NO: 268459 - DNA, 17 bp, P. troglodytes
tctcctacttgcacatc

SEQ ID NO: 268460 - DNA, 16 bp, P. troglodytes
tctcctatctcagaat

SEQ ID NO: 268461 - DNA, 16 bp, P. troglodytes
tctcctatgttcaggt

SEQ ID NO: 268462 - DNA, 16 bp, P. troglodytes
tctcctcagaagaaag

SEQ ID NO: 268463 - DNA, 16 bp, P. troglodytes
tctcctcagcctcctg

SEQ ID NO: 268464 - DNA, 16 bp, P. troglodytes
tctcctcaggagccac

SEQ ID NO: 268465 - DNA, 16 bp, P. troglodytes
tctcctcatctgtaaa

SEQ ID NO: 268466 - DNA, 16 bp, P. troglodytes
tctcctccagggactt

SEQ ID NO: 268467 - DNA, 16 bp, P. troglodytes
tctcctcccagcccct

SEQ ID NO: 268468 - DNA, 16 bp, P. troglodytes
tctcctcccccagcct

SEQ ID NO: 268469 - DNA, 16 bp, P. troglodytes
tctcctctcagcctcc

SEQ ID NO: 268470 - DNA, 16 bp, P. troglodytes
tctcctctctgagcct

SEQ ID NO: 268471 - DNA, 16 bp, P. troglodytes
tctcctctctgggcct

SEQ ID NO: 268472 - DNA, 16 bp, P. troglodytes
tctcctctttgtgtcc

SEQ ID NO: 268473 - DNA, 16 bp, P. troglodytes
tctcctgacctcaagt

SEQ ID NO: 268474 - DNA, 19 bp, P. troglodytes
tctcctgacctcaggtgat

SEQ ID NO: 268475 - DNA, 16 bp, P. troglodytes
tctcctgacctgaggg

SEQ ID NO: 268476 - DNA, 16 bp, P. troglodytes
tctcctgaccttgtca

SEQ ID NO: 268477 - DNA, 16 bp, P. troglodytes
tctcctgactcagtct

SEQ ID NO: 268478 - DNA, 16 bp, P. troglodytes
tctcctgagctacaga

SEQ ID NO: 268479 - DNA, 16 bp, P. troglodytes
tctcctgaggcctccc

SEQ ID NO: 268480 - DNA, 16 bp, P. troglodytes
tctcctgatatctgca

SEQ ID NO: 268481 - DNA, 16 bp, P. troglodytes
tctcctgatctcctga

SEQ ID NO: 268482 - DNA, 16 bp, P. troglodytes
tctcctgcacagctgg

SEQ ID NO: 268483 - DNA, 16 bp, P. troglodytes
tctcctgcagcacccc

SEQ ID NO: 268484 - DNA, 16 bp, P. troglodytes
tctcctgccccactca

SEQ ID NO: 268485 - DNA, 16 bp, P. troglodytes
tctcctgccccagccc

SEQ ID NO: 268486 - DNA, 17 bp, P. troglodytes
tctcctgccccagcctc

SEQ ID NO: 268487 - DNA, 16 bp, P. troglodytes
tctcctgccccaggct

SEQ ID NO: 268488 - DNA, 16 bp, P. troglodytes
tctcctgccccatcct

SEQ ID NO: 268489 - DNA, 16 bp, P. troglodytes
tctcctgcctcaccat

SEQ ID NO: 268490 - DNA, 16 bp, P. troglodytes
tctcctgcctcatccc

SEQ ID NO: 268491 - DNA, 16 bp, P. troglodytes
tctcctgcctcatttt

SEQ ID NO: 268492 - DNA, 16 bp, P. troglodytes
tctcctgcctccaccc

SEQ ID NO: 268493 - DNA, 16 bp, P. troglodytes
tctcctgccttggcct

SEQ ID NO: 268494 - DNA, 16 bp, P. troglodytes
tctcctgctagctttg

SEQ ID NO: 268495 - DNA, 16 bp, P. troglodytes
tctcctggaaaaaaaa

SEQ ID NO: 268496 - DNA, 16 bp, P. troglodytes
tctcctgggctcaagt

SEQ ID NO: 268497 - DNA, 16 bp, P. troglodytes
tctcctgggctgaagt

SEQ ID NO: 268498 - DNA, 16 bp, P. troglodytes
tctcctggggctgtgt

SEQ ID NO: 268499 - DNA, 16 bp, P. troglodytes
tctcctgggttcaagc

SEQ ID NO: 268500 - DNA, 16 bp, P. troglodytes
tctcctgggttcaagg

SEQ ID NO: 268501 - DNA, 20 bp, P. troglodytes
tctcctgggttcaagtgatt

SEQ ID NO: 268502 - DNA, 20 bp, P. troglodytes
tctcctgggttcacgccatt

SEQ ID NO: 268503 - DNA, 16 bp, P. troglodytes
tctcctgggttcaggc

SEQ ID NO: 268504 - DNA, 16 bp, P. troglodytes
tctcctggtctgcaga

SEQ ID NO: 268505 - DNA, 16 bp, P. troglodytes
tctcctggttcagcct

SEQ ID NO: 268506 - DNA, 16 bp, P. troglodytes
tctcctgtcctcatga

SEQ ID NO: 268507 - DNA, 16 bp, P. troglodytes
tctcctgtgctagatg

SEQ ID NO: 268508 - DNA, 16 bp, P. troglodytes
tctcctgtgggcattt

SEQ ID NO: 268509 - DNA, 17 bp, P. troglodytes
tctcctgttggttctgt

SEQ ID NO: 268510 - DNA, 16 bp, P. troglodytes
tctccttcaccttttg

SEQ ID NO: 268511 - DNA, 16 bp, P. troglodytes
tctccttcatgtttaa

SEQ ID NO: 268512 - DNA, 16 bp, P. troglodytes
tctccttcctgcctgc

SEQ ID NO: 268513 - DNA, 16 bp, P. troglodytes
tctccttcctgtcacc

SEQ ID NO: 268514 - DNA, 16 bp, P. troglodytes
tctccttcgccttctg

SEQ ID NO: 268515 - DNA, 16 bp, P. troglodytes
tctccttctctgccat

SEQ ID NO: 268516 - DNA, 16 bp, P. troglodytes
tctccttctggaactc

SEQ ID NO: 268517 - DNA, 16 bp, P. troglodytes
tctcctttagcaacac

SEQ ID NO: 268518 - DNA, 16 bp, P. troglodytes
tctcctttataaatta

SEQ ID NO: 268519 - DNA, 16 bp, P. troglodytes
tctcctttgactccag

SEQ ID NO: 268520 - DNA, 16 bp, P. troglodytes
tctcctttgccttcca

SEQ ID NO: 268521 - DNA, 16 bp, P. troglodytes
tctcctttgttggctt

SEQ ID NO: 268522 - DNA, 16 bp, P. troglodytes
tctccttttgagaaat

SEQ ID NO: 268523 - DNA, 16 bp, P. troglodytes
tctcctttttaaaaat

SEQ ID NO: 268524 - DNA, 17 bp, P. troglodytes
tctcgaactcatgacct

SEQ ID NO: 268525 - DNA, 19 bp, P. troglodytes
tctcgaactcccgacctca

SEQ ID NO: 268526 - DNA, 16 bp, P. troglodytes
tctcgaactcctggac

SEQ ID NO: 268527 - DNA, 16 bp, P. troglodytes
tctcgaatcctgacct

SEQ ID NO: 268528 - DNA, 16 bp, P. troglodytes
tctcgagcagctggga

SEQ ID NO: 268529 - DNA, 17 bp, P. troglodytes
tctcgatctcttgacct

SEQ ID NO: 268530 - DNA, 16 bp, P. troglodytes
tctcgattaaccaggg

SEQ ID NO: 268531 - DNA, 17 bp, P. troglodytes
tctcgccctgtcgccca

SEQ ID NO: 268532 - DNA, 16 bp, P. troglodytes
tctcgctatgttgacc

SEQ ID NO: 268533 - DNA, 16 bp, P. troglodytes
tctcgctcgctcgctc

SEQ ID NO: 268534 - DNA, 22 bp, P. troglodytes
tctcgctctgtcacccaggcta

SEQ ID NO: 268535 - DNA, 20 bp, P. troglodytes
tctcgctctgtcacccaggt

SEQ ID NO: 268536 - DNA, 17 bp, P. troglodytes
tctcgctctgtcacccc

SEQ ID NO: 268537 - DNA, 21 bp, P. troglodytes
tctcgctctgtctcccaggct

SEQ ID NO: 268538 - DNA, 16 bp, P. troglodytes
tctcggctcactccaa

SEQ ID NO: 268539 - DNA, 19 bp, P. troglodytes
tctcggctcactgcaaccc

SEQ ID NO: 268540 - DNA, 20 bp, P. troglodytes
tctcggctcactgcaaccta

SEQ ID NO: 268541 - DNA, 20 bp, P. troglodytes
tctcggctcactgcacctct

SEQ ID NO: 268542 - DNA, 16 bp, P. troglodytes
tctcggctcatcacaa

SEQ ID NO: 268543 - DNA, 18 bp, P. troglodytes
tctcggcttactgcaact

SEQ ID NO: 268544 - DNA, 16 bp, P. troglodytes
tctcgggcctttggcc

SEQ ID NO: 268545 - DNA, 16 bp, P. troglodytes
tctcgtctgccaccat

SEQ ID NO: 268546 - DNA, 16 bp, P. troglodytes
tctcgtgcctcagcat

SEQ ID NO: 268547 - DNA, 16 bp, P. troglodytes
tctctaaaaaaagaaa

SEQ ID NO: 268548 - DNA, 16 bp, P. troglodytes
tctctaaaaaaataca

SEQ ID NO: 268549 - DNA, 16 bp, P. troglodytes
tctctaaaaaaatttt

SEQ ID NO: 268550 - DNA, 16 bp, P. troglodytes
tctctaaaaacataaa

SEQ ID NO: 268551 - DNA, 16 bp, P. troglodytes
tctctaaaaataaatg

SEQ ID NO: 268552 - DNA, 16 bp, P. troglodytes
tctctaaaaataattt

SEQ ID NO: 268553 - DNA, 16 bp, P. troglodytes
tctctaaaaatacaaa

SEQ ID NO: 268554 - DNA, 16 bp, P. troglodytes
tctctaaaatagtaat

SEQ ID NO: 268555 - DNA, 16 bp, P. troglodytes
tctctaaaattaaaat

SEQ ID NO: 268556 - DNA, 16 bp, P. troglodytes
tctctaagtaaacttg

SEQ ID NO: 268557 - DNA, 17 bp, P. troglodytes
tctctaataaaaataca

SEQ ID NO: 268558 - DNA, 16 bp, P. troglodytes
tctctaatgaccaatg

SEQ ID NO: 268559 - DNA, 16 bp, P. troglodytes
tctctacaaaaagatt

SEQ ID NO: 268560 - DNA, 16 bp, P. troglodytes
tctctacaaagaaaac

SEQ ID NO: 268561 - DNA, 16 bp, P. troglodytes
tctctacaataaaaac

SEQ ID NO: 268562 - DNA, 16 bp, P. troglodytes
tctctacaataaattt

SEQ ID NO: 268563 - DNA, 16 bp, P. troglodytes
tctctacattgcccag

SEQ ID NO: 268564 - DNA, 16 bp, P. troglodytes
tctctaccaaaaataa

SEQ ID NO: 268565 - DNA, 17 bp, P. troglodytes
tctctaccaaaaataca

SEQ ID NO: 268566 - DNA, 16 bp, P. troglodytes
tctctacctgccctgg

SEQ ID NO: 268567 - DNA, 17 bp, P. troglodytes
tctctacgaaaaataca

SEQ ID NO: 268568 - DNA, 16 bp, P. troglodytes
tctctactaaaaaaac

SEQ ID NO: 268569 - DNA, 16 bp, P. troglodytes
tctctactaaaaaaat

SEQ ID NO: 268570 - DNA, 16 bp, P. troglodytes
tctctactaaaaaata

SEQ ID NO: 268571 - DNA, 16 bp, P. troglodytes
tctctactaaaaacac

SEQ ID NO: 268572 - DNA, 16 bp, P. troglodytes
tctctactaaaaacat

SEQ ID NO: 268573 - DNA, 16 bp, P. troglodytes
tctctactaaaaacta

SEQ ID NO: 268574 - DNA, 16 bp, P. troglodytes
tctctactaaaaatac

SEQ ID NO: 268575 - DNA, 16 bp, P. troglodytes
tctctactaaaaatag

SEQ ID NO: 268576 - DNA, 16 bp, P. troglodytes
tctctactaaaaatat

SEQ ID NO: 268577 - DNA, 17 bp, P. troglodytes
tctctactaaaaatgca

SEQ ID NO: 268578 - DNA, 16 bp, P. troglodytes
tctctactaaaacaca

SEQ ID NO: 268579 - DNA, 17 bp, P. troglodytes
tctctactaaaactaca

SEQ ID NO: 268580 - DNA, 17 bp, P. troglodytes
tctctactaaaagtaca

SEQ ID NO: 268581 - DNA, 16 bp, P. troglodytes
tctctactaaaagtat

SEQ ID NO: 268582 - DNA, 16 bp, P. troglodytes
tctctactaaaataca

SEQ ID NO: 268583 - DNA, 17 bp, P. troglodytes
tctctactaaacataca

SEQ ID NO: 268584 - DNA, 18 bp, P. troglodytes
tctctactaaagatacaa

SEQ ID NO: 268585 - DNA, 17 bp, P. troglodytes
tctctactaaatataca

SEQ ID NO: 268586 - DNA, 16 bp, P. troglodytes
tctctactaacaatac

SEQ ID NO: 268587 - DNA, 20 bp, P. troglodytes
tctctactaagaatacaaaa

SEQ ID NO: 268588 - DNA, 16 bp, P. troglodytes
tctctactaataaaaa

SEQ ID NO: 268589 - DNA, 17 bp, P. troglodytes
tctctactaataataca

SEQ ID NO: 268590 - DNA, 17 bp, P. troglodytes
tctctactacaaataca

SEQ ID NO: 268591 - DNA, 17 bp, P. troglodytes
tctctactagaaataca

SEQ ID NO: 268592 - DNA, 17 bp, P. troglodytes
tctctactataaataca

SEQ ID NO: 268593 - DNA, 16 bp, P. troglodytes
tctctactgaaaaaac

SEQ ID NO: 268594 - DNA, 17 bp, P. troglodytes
tctctactgaaaataca

SEQ ID NO: 268595 - DNA, 17 bp, P. troglodytes
tctctactgaaagtaca

SEQ ID NO: 268596 - DNA, 17 bp, P. troglodytes
tctctacttaaaataca

SEQ ID NO: 268597 - DNA, 16 bp, P. troglodytes
tctctagaaaaaaaga

SEQ ID NO: 268598 - DNA, 16 bp, P. troglodytes
tctctagacctcagtt

SEQ ID NO: 268599 - DNA, 16 bp, P. troglodytes
tctctagtaaaaaata

SEQ ID NO: 268600 - DNA, 17 bp, P. troglodytes
tctctagtaaaaataca

SEQ ID NO: 268601 - DNA, 16 bp, P. troglodytes
tctctataaaaaattt

SEQ ID NO: 268602 - DNA, 16 bp, P. troglodytes
tctctataaaaatatt

SEQ ID NO: 268603 - DNA, 16 bp, P. troglodytes
tctctataaaatacaa

SEQ ID NO: 268604 - DNA, 16 bp, P. troglodytes
tctctataaggagaac

SEQ ID NO: 268605 - DNA, 16 bp, P. troglodytes
tctctatcttcatgag

SEQ ID NO: 268606 - DNA, 17 bp, P. troglodytes
tctctatcttctgacct

SEQ ID NO: 268607 - DNA, 16 bp, P. troglodytes
tctctatgaatttgat

SEQ ID NO: 268608 - DNA, 16 bp, P. troglodytes
tctctatggatttgac

SEQ ID NO: 268609 - DNA, 16 bp, P. troglodytes
tctctatggatttgcc

SEQ ID NO: 268610 - DNA, 16 bp, P. troglodytes
tctctatgttgctcag

SEQ ID NO: 268611 - DNA, 16 bp, P. troglodytes
tctctattaaaaataa

SEQ ID NO: 268612 - DNA, 16 bp, P. troglodytes
tctctattctattcta

SEQ ID NO: 268613 - DNA, 16 bp, P. troglodytes
tctctatttaaaaaaa

SEQ ID NO: 268614 - DNA, 16 bp, P. troglodytes
tctctatttcttttag

SEQ ID NO: 268615 - DNA, 16 bp, P. troglodytes
tctctatttgcaaatg

SEQ ID NO: 268616 - DNA, 16 bp, P. troglodytes
tctctattttacaaat

SEQ ID NO: 268617 - DNA, 16 bp, P. troglodytes
tctctcaaaaaataaa

SEQ ID NO: 268618 - DNA, 16 bp, P. troglodytes
tctctcaaaataaaaa

SEQ ID NO: 268619 - DNA, 16 bp, P. troglodytes
tctctcacacacacaa

SEQ ID NO: 268620 - DNA, 16 bp, P. troglodytes
tctctcaccagtccta

SEQ ID NO: 268621 - DNA, 16 bp, P. troglodytes
tctctcacccaagctg

SEQ ID NO: 268622 - DNA, 16 bp, P. troglodytes
tctctcactctgcctt

SEQ ID NO: 268623 - DNA, 16 bp, P. troglodytes
tctctcagaccacagt

SEQ ID NO: 268624 - DNA, 25 bp, P. troglodytes
tctctcagaccacagtgcaatcaaa

SEQ ID NO: 268625 - DNA, 16 bp, P. troglodytes
tctctcagcacttgct

SEQ ID NO: 268626 - DNA, 16 bp, P. troglodytes
tctctcatcatttgct

SEQ ID NO: 268627 - DNA, 16 bp, P. troglodytes
tctctcatgaggttgc

SEQ ID NO: 268628 - DNA, 16 bp, P. troglodytes
tctctccaaaaaaata

SEQ ID NO: 268629 - DNA, 16 bp, P. troglodytes
tctctccatctcaagg

SEQ ID NO: 268630 - DNA, 16 bp, P. troglodytes
tctctcccactagaat

SEQ ID NO: 268631 - DNA, 16 bp, P. troglodytes
tctctcccaggttttg

SEQ ID NO: 268632 - DNA, 16 bp, P. troglodytes
tctctcccattctgtg

SEQ ID NO: 268633 - DNA, 16 bp, P. troglodytes
tctctccccagcctct

SEQ ID NO: 268634 - DNA, 16 bp, P. troglodytes
tctctcccctgcccca

SEQ ID NO: 268635 - DNA, 16 bp, P. troglodytes
tctctccctcccccag

SEQ ID NO: 268636 - DNA, 16 bp, P. troglodytes
tctctccctgactgct

SEQ ID NO: 268637 - DNA, 16 bp, P. troglodytes
tctctccctgggatgg

SEQ ID NO: 268638 - DNA, 17 bp, P. troglodytes
tctctcctaaaaataca

SEQ ID NO: 268639 - DNA, 16 bp, P. troglodytes
tctctcctagagcctt

SEQ ID NO: 268640 - DNA, 16 bp, P. troglodytes
tctctcctgctctgcc

SEQ ID NO: 268641 - DNA, 16 bp, P. troglodytes
tctctcctgctgcttt

SEQ ID NO: 268642 - DNA, 16 bp, P. troglodytes
tctctcctggagcctc

SEQ ID NO: 268643 - DNA, 16 bp, P. troglodytes
tctctcctggcttctg

SEQ ID NO: 268644 - DNA, 16 bp, P. troglodytes
tctctcgctcgctctc

SEQ ID NO: 268645 - DNA, 16 bp, P. troglodytes
tctctctatatataca

SEQ ID NO: 268646 - DNA, 16 bp, P. troglodytes
tctctctatatttata

SEQ ID NO: 268647 - DNA, 16 bp, P. troglodytes
tctctctatgttgccc

SEQ ID NO: 268648 - DNA, 16 bp, P. troglodytes
tctctctcaatttcaa

SEQ ID NO: 268649 - DNA, 16 bp, P. troglodytes
tctctctcagaccaca

SEQ ID NO: 268650 - DNA, 16 bp, P. troglodytes
tctctctcatttctga

SEQ ID NO: 268651 - DNA, 16 bp, P. troglodytes
tctctctcctgctgct

SEQ ID NO: 268652 - DNA, 16 bp, P. troglodytes
tctctctctacatata

SEQ ID NO: 268653 - DNA, 16 bp, P. troglodytes
tctctctctatatata

SEQ ID NO: 268654 - DNA, 16 bp, P. troglodytes
tctctctctatgtctc

SEQ ID NO: 268655 - DNA, 16 bp, P. troglodytes
tctctctctcactcac

SEQ ID NO: 268656 - DNA, 16 bp, P. troglodytes
tctctctctcagcctc

SEQ ID NO: 268657 - DNA, 16 bp, P. troglodytes
tctctctctctcacgc

SEQ ID NO: 268658 - DNA, 16 bp, P. troglodytes
tctctctctctcagtg

SEQ ID NO: 268659 - DNA, 16 bp, P. troglodytes
tctctctctctcatat

SEQ ID NO: 268660 - DNA, 16 bp, P. troglodytes
tctctctctctcctgg

SEQ ID NO: 268661 - DNA, 16 bp, P. troglodytes
tctctctctctctaac

SEQ ID NO: 268662 - DNA, 16 bp, P. troglodytes
tctctctctctgtctg

SEQ ID NO: 268663 - DNA, 16 bp, P. troglodytes
tctctctctctttcaa

SEQ ID NO: 268664 - DNA, 16 bp, P. troglodytes
tctctctctgactctg

SEQ ID NO: 268665 - DNA, 16 bp, P. troglodytes
tctctctctgcctcag

SEQ ID NO: 268666 - DNA, 16 bp, P. troglodytes
tctctctctgcctgcc

SEQ ID NO: 268667 - DNA, 16 bp, P. troglodytes
tctctctctgtctctg

SEQ ID NO: 268668 - DNA, 16 bp, P. troglodytes
tctctctcttgcctga

SEQ ID NO: 268669 - DNA, 16 bp, P. troglodytes
tctctctctttctatg

SEQ ID NO: 268670 - DNA, 16 bp, P. troglodytes
tctctctctttgccta

SEQ ID NO: 268671 - DNA, 16 bp, P. troglodytes
tctctctctttttcag

SEQ ID NO: 268672 - DNA, 16 bp, P. troglodytes
tctctctgagactcag

SEQ ID NO: 268673 - DNA, 16 bp, P. troglodytes
tctctctgatccacct

SEQ ID NO: 268674 - DNA, 16 bp, P. troglodytes
tctctctgatgtccag

SEQ ID NO: 268675 - DNA, 16 bp, P. troglodytes
tctctctgccagctga

SEQ ID NO: 268676 - DNA, 16 bp, P. troglodytes
tctctctgcctccagc

SEQ ID NO: 268677 - DNA, 16 bp, P. troglodytes
tctctctgcctctgcc

SEQ ID NO: 268678 - DNA, 16 bp, P. troglodytes
tctctctgcctgaaat

SEQ ID NO: 268679 - DNA, 16 bp, P. troglodytes
tctctctggctgccct

SEQ ID NO: 268680 - DNA, 16 bp, P. troglodytes
tctctctgtctccctg

SEQ ID NO: 268681 - DNA, 16 bp, P. troglodytes
tctctctgtctctgtc

SEQ ID NO: 268682 - DNA, 16 bp, P. troglodytes
tctctctgtgcctcag

SEQ ID NO: 268683 - DNA, 16 bp, P. troglodytes
tctctctgtgtctgtg

SEQ ID NO: 268684 - DNA, 16 bp, P. troglodytes
tctctctgttgcccag

SEQ ID NO: 268685 - DNA, 16 bp, P. troglodytes
tctctctttacacaca

SEQ ID NO: 268686 - DNA, 16 bp, P. troglodytes
tctctgaaaaaaagaa

SEQ ID NO: 268687 - DNA, 16 bp, P. troglodytes
tctctgaaaaaacaaa

SEQ ID NO: 268688 - DNA, 16 bp, P. troglodytes
tctctgaaaaatgaaa

SEQ ID NO: 268689 - DNA, 16 bp, P. troglodytes
tctctgaaaattattt

SEQ ID NO: 268690 - DNA, 16 bp, P. troglodytes
tctctgaaactgcttt

SEQ ID NO: 268691 - DNA, 16 bp, P. troglodytes
tctctgaacctcaatt

SEQ ID NO: 268692 - DNA, 16 bp, P. troglodytes
tctctgaacttcattt

SEQ ID NO: 268693 - DNA, 16 bp, P. troglodytes
tctctgacccaggagt

SEQ ID NO: 268694 - DNA, 16 bp, P. troglodytes
tctctgacttttcttt

SEQ ID NO: 268695 - DNA, 16 bp, P. troglodytes
tctctgagaacttgtt

SEQ ID NO: 268696 - DNA, 16 bp, P. troglodytes
tctctgagcctcagtg

SEQ ID NO: 268697 - DNA, 16 bp, P. troglodytes
tctctgagcctctgct

SEQ ID NO: 268698 - DNA, 16 bp, P. troglodytes
tctctgagccttagtt

SEQ ID NO: 268699 - DNA, 16 bp, P. troglodytes
tctctgagccttggtt

SEQ ID NO: 268700 - DNA, 16 bp, P. troglodytes
tctctgagcttcagct

SEQ ID NO: 268701 - DNA, 16 bp, P. troglodytes
tctctgagcttcctgt

SEQ ID NO: 268702 - DNA, 16 bp, P. troglodytes
tctctgagcttgagga

SEQ ID NO: 268703 - DNA, 16 bp, P. troglodytes
tctctgaggttttttt

SEQ ID NO: 268704 - DNA, 16 bp, P. troglodytes
tctctgagtctgtttc

SEQ ID NO: 268705 - DNA, 16 bp, P. troglodytes
tctctgagttttagtt

SEQ ID NO: 268706 - DNA, 16 bp, P. troglodytes
tctctgatatcctttt

SEQ ID NO: 268707 - DNA, 16 bp, P. troglodytes
tctctgatggccagtg

SEQ ID NO: 268708 - DNA, 16 bp, P. troglodytes
tctctgatggggaaaa

SEQ ID NO: 268709 - DNA, 16 bp, P. troglodytes
tctctgcaagctctgc

SEQ ID NO: 268710 - DNA, 16 bp, P. troglodytes
tctctgcacctgagat

SEQ ID NO: 268711 - DNA, 16 bp, P. troglodytes
tctctgcagaaacact

SEQ ID NO: 268712 - DNA, 16 bp, P. troglodytes
tctctgcagaccagca

SEQ ID NO: 268713 - DNA, 16 bp, P. troglodytes
tctctgcaggtctctg

SEQ ID NO: 268714 - DNA, 16 bp, P. troglodytes
tctctgcatgtgagat

SEQ ID NO: 268715 - DNA, 16 bp, P. troglodytes
tctctgcccagctgcc

SEQ ID NO: 268716 - DNA, 16 bp, P. troglodytes
tctctgccccagccct

SEQ ID NO: 268717 - DNA, 16 bp, P. troglodytes
tctctgcctcagccac

SEQ ID NO: 268718 - DNA, 16 bp, P. troglodytes
tctctgcctcagcctt

SEQ ID NO: 268719 - DNA, 16 bp, P. troglodytes
tctctgcctcctggct

SEQ ID NO: 268720 - DNA, 16 bp, P. troglodytes
tctctgcctctgcctc

SEQ ID NO: 268721 - DNA, 16 bp, P. troglodytes
tctctgcctgcctgcc

SEQ ID NO: 268722 - DNA, 16 bp, P. troglodytes
tctctgcctggccgcc

SEQ ID NO: 268723 - DNA, 16 bp, P. troglodytes
tctctgcctggttttg

SEQ ID NO: 268724 - DNA, 16 bp, P. troglodytes
tctctgccttaatttc

SEQ ID NO: 268725 - DNA, 16 bp, P. troglodytes
tctctgccttcaagga

SEQ ID NO: 268726 - DNA, 16 bp, P. troglodytes
tctctgccttttgatt

SEQ ID NO: 268727 - DNA, 16 bp, P. troglodytes
tctctgctaaaaatac

SEQ ID NO: 268728 - DNA, 16 bp, P. troglodytes
tctctgctcagggtct

SEQ ID NO: 268729 - DNA, 16 bp, P. troglodytes
tctctgctctgctctg

SEQ ID NO: 268730 - DNA, 16 bp, P. troglodytes
tctctgcttcatagat

SEQ ID NO: 268731 - DNA, 16 bp, P. troglodytes
tctctgcttctgagat

SEQ ID NO: 268732 - DNA, 16 bp, P. troglodytes
tctctgcttgcctgtt

SEQ ID NO: 268733 - DNA, 16 bp, P. troglodytes
tctctggaacacattc

SEQ ID NO: 268734 - DNA, 16 bp, P. troglodytes
tctctggaacccagga

SEQ ID NO: 268735 - DNA, 16 bp, P. troglodytes
tctctggaagttttgt

SEQ ID NO: 268736 - DNA, 16 bp, P. troglodytes
tctctggcgggcagag

SEQ ID NO: 268737 - DNA, 16 bp, P. troglodytes
tctctggctggcaggg

SEQ ID NO: 268738 - DNA, 16 bp, P. troglodytes
tctctggcttcctctc

SEQ ID NO: 268739 - DNA, 16 bp, P. troglodytes
tctctggctttgttct

SEQ ID NO: 268740 - DNA, 16 bp, P. troglodytes
tctctgggaaacattt

SEQ ID NO: 268741 - DNA, 16 bp, P. troglodytes
tctctgggacacagtt

SEQ ID NO: 268742 - DNA, 16 bp, P. troglodytes
tctctgggacacattg

SEQ ID NO: 268743 - DNA, 16 bp, P. troglodytes
tctctgggcactgggg

SEQ ID NO: 268744 - DNA, 16 bp, P. troglodytes
tctctgggcctcattt

SEQ ID NO: 268745 - DNA, 16 bp, P. troglodytes
tctctgggccttagtt

SEQ ID NO: 268746 - DNA, 16 bp, P. troglodytes
tctctgggcttcagtt

SEQ ID NO: 268747 - DNA, 16 bp, P. troglodytes
tctctgggctttggtt

SEQ ID NO: 268748 - DNA, 16 bp, P. troglodytes
tctctggggcctcttt

SEQ ID NO: 268749 - DNA, 16 bp, P. troglodytes
tctctgggtctctgtt

SEQ ID NO: 268750 - DNA, 41 bp, P. troglodytes
tctctggtatctcagtcaggtcaatgataggatgacaacag

SEQ ID NO: 268751 - DNA, 16 bp, P. troglodytes
tctctggtatttcttt

SEQ ID NO: 268752 - DNA, 16 bp, P. troglodytes
tctctggtgcctcctt

SEQ ID NO: 268753 - DNA, 16 bp, P. troglodytes
tctctggtgcttttct

SEQ ID NO: 268754 - DNA, 22 bp, P. troglodytes
tctctggttttcctaggcagag

SEQ ID NO: 268755 - DNA, 23 bp, P. troglodytes
tctctgtaaaatggaccaatcag

SEQ ID NO: 268756 - DNA, 16 bp, P. troglodytes
tctctgtatttattta

SEQ ID NO: 268757 - DNA, 17 bp, P. troglodytes
tctctgtcacccaggct

SEQ ID NO: 268758 - DNA, 16 bp, P. troglodytes
tctctgtcactgaggc

SEQ ID NO: 268759 - DNA, 16 bp, P. troglodytes
tctctgtcctgttcca

SEQ ID NO: 268760 - DNA, 16 bp, P. troglodytes
tctctgtcgcccaggt

SEQ ID NO: 268761 - DNA, 16 bp, P. troglodytes
tctctgtctccaaaaa

SEQ ID NO: 268762 - DNA, 16 bp, P. troglodytes
tctctgtctccatctc

SEQ ID NO: 268763 - DNA, 16 bp, P. troglodytes
tctctgtcttcatgag

SEQ ID NO: 268764 - DNA, 16 bp, P. troglodytes
tctctgtgcttcaatt

SEQ ID NO: 268765 - DNA, 16 bp, P. troglodytes
tctctgtggccctggg

SEQ ID NO: 268766 - DNA, 16 bp, P. troglodytes
tctctgtgggcattta

SEQ ID NO: 268767 - DNA, 16 bp, P. troglodytes
tctctgtgtccaaatt

SEQ ID NO: 268768 - DNA, 16 bp, P. troglodytes
tctctgtgtccctgtg

SEQ ID NO: 268769 - DNA, 16 bp, P. troglodytes
tctctgtgtgtgtctt

SEQ ID NO: 268770 - DNA, 18 bp, P. troglodytes
tctctgtgtgtgtgtgta

SEQ ID NO: 268771 - DNA, 16 bp, P. troglodytes
tctctgtgttgcccag

SEQ ID NO: 268772 - DNA, 16 bp, P. troglodytes
tctctgttacccaggc

SEQ ID NO: 268773 - DNA, 16 bp, P. troglodytes
tctctgttcatatcct

SEQ ID NO: 268774 - DNA, 16 bp, P. troglodytes
tctctgttcttcagtt

SEQ ID NO: 268775 - DNA, 16 bp, P. troglodytes
tctctgttgaattcca

SEQ ID NO: 268776 - DNA, 16 bp, P. troglodytes
tctctgtttaaaaaaa

SEQ ID NO: 268777 - DNA, 16 bp, P. troglodytes
tctctgttttttaaaa

SEQ ID NO: 268778 - DNA, 16 bp, P. troglodytes
tctcttaaaaacaaaa

SEQ ID NO: 268779 - DNA, 16 bp, P. troglodytes
tctcttaaaaatgttt

SEQ ID NO: 268780 - DNA, 16 bp, P. troglodytes
tctcttaataccatca

SEQ ID NO: 268781 - DNA, 16 bp, P. troglodytes
tctcttcaaactgtgt

SEQ ID NO: 268782 - DNA, 16 bp, P. troglodytes
tctcttcaaatatttt

SEQ ID NO: 268783 - DNA, 16 bp, P. troglodytes
tctcttcaactggaat

SEQ ID NO: 268784 - DNA, 21 bp, P. troglodytes
tctcttcaaggagaactacaa

SEQ ID NO: 268785 - DNA, 16 bp, P. troglodytes
tctcttcagaaaatgg

SEQ ID NO: 268786 - DNA, 16 bp, P. troglodytes
tctcttcatatccttc

SEQ ID NO: 268787 - DNA, 16 bp, P. troglodytes
tctcttcctatatgaa

SEQ ID NO: 268788 - DNA, 16 bp, P. troglodytes
tctcttcctgtttgga

SEQ ID NO: 268789 - DNA, 16 bp, P. troglodytes
tctcttcctttttgaa

SEQ ID NO: 268790 - DNA, 16 bp, P. troglodytes
tctcttctccagcctc

SEQ ID NO: 268791 - DNA, 16 bp, P. troglodytes
tctcttctgtaaaatg

SEQ ID NO: 268792 - DNA, 16 bp, P. troglodytes
tctcttctttctcagg

SEQ ID NO: 268793 - DNA, 16 bp, P. troglodytes
tctcttgaaatatttt

SEQ ID NO: 268794 - DNA, 16 bp, P. troglodytes
tctcttgaattatttt

SEQ ID NO: 268795 - DNA, 16 bp, P. troglodytes
tctcttgagcccagag

SEQ ID NO: 268796 - DNA, 16 bp, P. troglodytes
tctcttgaggccaaga

SEQ ID NO: 268797 - DNA, 16 bp, P. troglodytes
tctcttgatcctggga

SEQ ID NO: 268798 - DNA, 16 bp, P. troglodytes
tctcttgctattttca

SEQ ID NO: 268799 - DNA, 16 bp, P. troglodytes
tctcttgctccctgtc

SEQ ID NO: 268800 - DNA, 16 bp, P. troglodytes
tctcttgctgccgcca

SEQ ID NO: 268801 - DNA, 16 bp, P. troglodytes
tctcttgcttctgctc

SEQ ID NO: 268802 - DNA, 16 bp, P. troglodytes
tctcttgggcccagga

SEQ ID NO: 268803 - DNA, 16 bp, P. troglodytes
tctcttgtgatttctt

SEQ ID NO: 268804 - DNA, 16 bp, P. troglodytes
tctcttgtttaaaaaa

SEQ ID NO: 268805 - DNA, 16 bp, P. troglodytes
tctcttgtttaaattc

SEQ ID NO: 268806 - DNA, 16 bp, P. troglodytes
tctctttaaaaaatga

SEQ ID NO: 268807 - DNA, 16 bp, P. troglodytes
tctctttaccattatg

SEQ ID NO: 268808 - DNA, 16 bp, P. troglodytes
tctctttataataaaa

SEQ ID NO: 268809 - DNA, 16 bp, P. troglodytes
tctctttatttaaaaa

SEQ ID NO: 268810 - DNA, 16 bp, P. troglodytes
tctctttcaaaaataa

SEQ ID NO: 268811 - DNA, 16 bp, P. troglodytes
tctctttcctcagctt

SEQ ID NO: 268812 - DNA, 16 bp, P. troglodytes
tctctttcctgctgcc

SEQ ID NO: 268813 - DNA, 16 bp, P. troglodytes
tctctttcctttaaaa

SEQ ID NO: 268814 - DNA, 16 bp, P. troglodytes
tctctttctgtgcctg

SEQ ID NO: 268815 - DNA, 16 bp, P. troglodytes
tctctttcttcttgag

SEQ ID NO: 268816 - DNA, 16 bp, P. troglodytes
tctctttgacttcttc

SEQ ID NO: 268817 - DNA, 16 bp, P. troglodytes
tctctttgcccttcca

SEQ ID NO: 268818 - DNA, 16 bp, P. troglodytes
tctctttgcctactgc

SEQ ID NO: 268819 - DNA, 16 bp, P. troglodytes
tctctttggaaaaaaa

SEQ ID NO: 268820 - DNA, 16 bp, P. troglodytes
tctctttgtagcattt

SEQ ID NO: 268821 - DNA, 16 bp, P. troglodytes
tctctttgtatgtctc

SEQ ID NO: 268822 - DNA, 16 bp, P. troglodytes
tctctttgttaaaaca

SEQ ID NO: 268823 - DNA, 16 bp, P. troglodytes
tctcttttcatctttg

SEQ ID NO: 268824 - DNA, 16 bp, P. troglodytes
tctctttttaaaatgt

SEQ ID NO: 268825 - DNA, 16 bp, P. troglodytes
tctctttttttcctga

SEQ ID NO: 268826 - DNA, 16 bp, P. troglodytes
tctgaaaaaaaaattg

SEQ ID NO: 268827 - DNA, 16 bp, P. troglodytes
tctgaaaaaaattatt

SEQ ID NO: 268828 - DNA, 16 bp, P. troglodytes
tctgaaaaacagaaag

SEQ ID NO: 268829 - DNA, 16 bp, P. troglodytes
tctgaaaaacattttt

SEQ ID NO: 268830 - DNA, 16 bp, P. troglodytes
tctgaaaaagaaagaa

SEQ ID NO: 268831 - DNA, 16 bp, P. troglodytes
tctgaaaaagaaatta

SEQ ID NO: 268832 - DNA, 16 bp, P. troglodytes
tctgaaaaagaaattt

SEQ ID NO: 268833 - DNA, 16 bp, P. troglodytes
tctgaaaaataaaata

SEQ ID NO: 268834 - DNA, 16 bp, P. troglodytes
tctgaaaaatatcttg

SEQ ID NO: 268835 - DNA, 16 bp, P. troglodytes
tctgaaaaatatttta

SEQ ID NO: 268836 - DNA, 16 bp, P. troglodytes
tctgaaaaatgaaatt

SEQ ID NO: 268837 - DNA, 16 bp, P. troglodytes
tctgaaaaatgaagat

SEQ ID NO: 268838 - DNA, 16 bp, P. troglodytes
tctgaaaaatgagaat

SEQ ID NO: 268839 - DNA, 16 bp, P. troglodytes
tctgaaaaattttttt

SEQ ID NO: 268840 - DNA, 16 bp, P. troglodytes
tctgaaaacaaataaa

SEQ ID NO: 268841 - DNA, 16 bp, P. troglodytes
tctgaaaacatttttt

SEQ ID NO: 268842 - DNA, 16 bp, P. troglodytes
tctgaaaagaaaatta

SEQ ID NO: 268843 - DNA, 16 bp, P. troglodytes
tctgaaaagagcagtg

SEQ ID NO: 268844 - DNA, 16 bp, P. troglodytes
tctgaaaagtcctgca

SEQ ID NO: 268845 - DNA, 16 bp, P. troglodytes
tctgaaaataaagaca

SEQ ID NO: 268846 - DNA, 16 bp, P. troglodytes
tctgaaaataataata

SEQ ID NO: 268847 - DNA, 16 bp, P. troglodytes
tctgaaaatatcttta

SEQ ID NO: 268848 - DNA, 16 bp, P. troglodytes
tctgaaaatgacttta

SEQ ID NO: 268849 - DNA, 16 bp, P. troglodytes
tctgaaaatgtcttca

SEQ ID NO: 268850 - DNA, 16 bp, P. troglodytes
tctgaaaatgtcttta

SEQ ID NO: 268851 - DNA, 16 bp, P. troglodytes
tctgaaaatgtctttg

SEQ ID NO: 268852 - DNA, 16 bp, P. troglodytes
tctgaaaatttttttt

SEQ ID NO: 268853 - DNA, 16 bp, P. troglodytes
tctgaaactcctgacc

SEQ ID NO: 268854 - DNA, 16 bp, P. troglodytes
tctgaaagaaaaataa

SEQ ID NO: 268855 - DNA, 16 bp, P. troglodytes
tctgaaagaaaaggac

SEQ ID NO: 268856 - DNA, 16 bp, P. troglodytes
tctgaaagaaatgaaa

SEQ ID NO: 268857 - DNA, 16 bp, P. troglodytes
tctgaaagaagagaaa

SEQ ID NO: 268858 - DNA, 16 bp, P. troglodytes
tctgaaagagaagaaa

SEQ ID NO: 268859 - DNA, 16 bp, P. troglodytes
tctgaaagctgggaag

SEQ ID NO: 268860 - DNA, 16 bp, P. troglodytes
tctgaaagtgttggga

SEQ ID NO: 268861 - DNA, 17 bp, P. troglodytes
tctgaaagtgttgggat

SEQ ID NO: 268862 - DNA, 24 bp, P. troglodytes
tctgaaatatggcctcgtgggatg

SEQ ID NO: 268863 - DNA, 16 bp, P. troglodytes
tctgaaatccagcggg

SEQ ID NO: 268864 - DNA, 17 bp, P. troglodytes
tctgaaatgatctcctt

SEQ ID NO: 268865 - DNA, 16 bp, P. troglodytes
tctgaaattctccaaa

SEQ ID NO: 268866 - DNA, 16 bp, P. troglodytes
tctgaaattgaattag

SEQ ID NO: 268867 - DNA, 16 bp, P. troglodytes
tctgaaattgaggaag

SEQ ID NO: 268868 - DNA, 20 bp, P. troglodytes
tctgaaattgaggcaataat

SEQ ID NO: 268869 - DNA, 16 bp, P. troglodytes
tctgaaattttccatt

SEQ ID NO: 268870 - DNA, 16 bp, P. troglodytes
tctgaaatttttaaaa

SEQ ID NO: 268871 - DNA, 16 bp, P. troglodytes
tctgaaatttttcaaa

SEQ ID NO: 268872 - DNA, 16 bp, P. troglodytes
tctgaacctcagtttc

SEQ ID NO: 268873 - DNA, 16 bp, P. troglodytes
tctgaacctctgtttc

SEQ ID NO: 268874 - DNA, 16 bp, P. troglodytes
tctgaagaacaaagag

SEQ ID NO: 268875 - DNA, 16 bp, P. troglodytes
tctgaagaagaaaaaa

SEQ ID NO: 268876 - DNA, 16 bp, P. troglodytes
tctgaagaattttttt

SEQ ID NO: 268877 - DNA, 16 bp, P. troglodytes
tctgaagacatttcta

SEQ ID NO: 268878 - DNA, 16 bp, P. troglodytes
tctgaagacatttttg

SEQ ID NO: 268879 - DNA, 16 bp, P. troglodytes
tctgaagactgggaag

SEQ ID NO: 268880 - DNA, 16 bp, P. troglodytes
tctgaagagaccaata

SEQ ID NO: 268881 - DNA, 16 bp, P. troglodytes
tctgaagatgtgactg

SEQ ID NO: 268882 - DNA, 16 bp, P. troglodytes
tctgaagatgtttcct

SEQ ID NO: 268883 - DNA, 16 bp, P. troglodytes
tctgaagccatggccc

SEQ ID NO: 268884 - DNA, 20 bp, P. troglodytes
tctgaagccttcttctctca

SEQ ID NO: 268885 - DNA, 16 bp, P. troglodytes
tctgaagctgaaaaat

SEQ ID NO: 268886 - DNA, 16 bp, P. troglodytes
tctgaaggataatttt

SEQ ID NO: 268887 - DNA, 16 bp, P. troglodytes
tctgaaggctctaggg

SEQ ID NO: 268888 - DNA, 16 bp, P. troglodytes
tctgaaggctgtgaga

SEQ ID NO: 268889 - DNA, 16 bp, P. troglodytes
tctgaagtttttattt

SEQ ID NO: 268890 - DNA, 16 bp, P. troglodytes
tctgaatatatttaaa

SEQ ID NO: 268891 - DNA, 16 bp, P. troglodytes
tctgaatctgtttcct

SEQ ID NO: 268892 - DNA, 16 bp, P. troglodytes
tctgaatgcctggaga

SEQ ID NO: 268893 - DNA, 16 bp, P. troglodytes
tctgaattattttctt

SEQ ID NO: 268894 - DNA, 16 bp, P. troglodytes
tctgaatttctaacaa

SEQ ID NO: 268895 - DNA, 16 bp, P. troglodytes
tctgaatttcttgaat

SEQ ID NO: 268896 - DNA, 16 bp, P. troglodytes
tctgaattttgctgat

SEQ ID NO: 268897 - DNA, 16 bp, P. troglodytes
tctgaatttttcttct

SEQ ID NO: 268898 - DNA, 16 bp, P. troglodytes
tctgaattttttaaaa

SEQ ID NO: 268899 - DNA, 16 bp, P. troglodytes
tctgacagagctgaat

SEQ ID NO: 268900 - DNA, 16 bp, P. troglodytes
tctgacaggaggcaga

SEQ ID NO: 268901 - DNA, 16 bp, P. troglodytes
tctgacatacagagaa

SEQ ID NO: 268902 - DNA, 17 bp, P. troglodytes
tctgacatgtcctggag

SEQ ID NO: 268903 - DNA, 16 bp, P. troglodytes
tctgacattccctgga

SEQ ID NO: 268904 - DNA, 16 bp, P. troglodytes
tctgaccacttctcac

SEQ ID NO: 268905 - DNA, 16 bp, P. troglodytes
tctgacctcaagtgat

SEQ ID NO: 268906 - DNA, 18 bp, P. troglodytes
tctgacctcaagtgatct

SEQ ID NO: 268907 - DNA, 17 bp, P. troglodytes
tctgacctcaggtgatc

SEQ ID NO: 268908 - DNA, 18 bp, P. troglodytes
tctgacctcaggtgatcc

SEQ ID NO: 268909 - DNA, 16 bp, P. troglodytes
tctgacctcagtttcc

SEQ ID NO: 268910 - DNA, 16 bp, P. troglodytes
tctgacctcatgatcc

SEQ ID NO: 268911 - DNA, 19 bp, P. troglodytes
tctgacctcgtgatctgcc

SEQ ID NO: 268912 - DNA, 16 bp, P. troglodytes
tctgacctctcccttc

SEQ ID NO: 268913 - DNA, 16 bp, P. troglodytes
tctgacctgcttcctc

SEQ ID NO: 268914 - DNA, 16 bp, P. troglodytes
tctgacctttctctct

SEQ ID NO: 268915 - DNA, 16 bp, P. troglodytes
tctgactccagagctt

SEQ ID NO: 268916 - DNA, 16 bp, P. troglodytes
tctgactccagagtct

SEQ ID NO: 268917 - DNA, 16 bp, P. troglodytes
tctgactctgtcaccc

SEQ ID NO: 268918 - DNA, 17 bp, P. troglodytes
tctgactggtgtacctg

SEQ ID NO: 268919 - DNA, 16 bp, P. troglodytes
tctgactgtgtatttt

SEQ ID NO: 268920 - DNA, 16 bp, P. troglodytes
tctgactttgttgccc

SEQ ID NO: 268921 - DNA, 16 bp, P. troglodytes
tctgacttttaaaaat

SEQ ID NO: 268922 - DNA, 16 bp, P. troglodytes
tctgagaaaataaaat

SEQ ID NO: 268923 - DNA, 16 bp, P. troglodytes
tctgagaaagaaaaag

SEQ ID NO: 268924 - DNA, 16 bp, P. troglodytes
tctgagaaagccatca

SEQ ID NO: 268925 - DNA, 16 bp, P. troglodytes
tctgagaaataaaaag

SEQ ID NO: 268926 - DNA, 16 bp, P. troglodytes
tctgagaagtgaggag

SEQ ID NO: 268927 - DNA, 16 bp, P. troglodytes
tctgagaattaaataa

SEQ ID NO: 268928 - DNA, 16 bp, P. troglodytes
tctgagacaggtctca

SEQ ID NO: 268929 - DNA, 16 bp, P. troglodytes
tctgagactcagtttt

SEQ ID NO: 268930 - DNA, 16 bp, P. troglodytes
tctgagagactgttat

SEQ ID NO: 268931 - DNA, 16 bp, P. troglodytes
tctgagagagagtttg

SEQ ID NO: 268932 - DNA, 16 bp, P. troglodytes
tctgagagattgttat

SEQ ID NO: 268933 - DNA, 16 bp, P. troglodytes
tctgagagttttaaaa

SEQ ID NO: 268934 - DNA, 16 bp, P. troglodytes
tctgagatactggggg

SEQ ID NO: 268935 - DNA, 16 bp, P. troglodytes
tctgagattacaggca

SEQ ID NO: 268936 - DNA, 16 bp, P. troglodytes
tctgagattctgcatt

SEQ ID NO: 268937 - DNA, 16 bp, P. troglodytes
tctgagattttaccct

SEQ ID NO: 268938 - DNA, 16 bp, P. troglodytes
tctgagcccagctcag

SEQ ID NO: 268939 - DNA, 16 bp, P. troglodytes
tctgagcccagggagg

SEQ ID NO: 268940 - DNA, 16 bp, P. troglodytes
tctgagcctcagtttt

SEQ ID NO: 268941 - DNA, 16 bp, P. troglodytes
tctgagccttagtttc

SEQ ID NO: 268942 - DNA, 16 bp, P. troglodytes
tctgagcctttgtttc

SEQ ID NO: 268943 - DNA, 16 bp, P. troglodytes
tctgagctcagacaca

SEQ ID NO: 268944 - DNA, 16 bp, P. troglodytes
tctgaggaagaagaga

SEQ ID NO: 268945 - DNA, 16 bp, P. troglodytes
tctgaggaggtgacat

SEQ ID NO: 268946 - DNA, 16 bp, P. troglodytes
tctgaggcaggaggac

SEQ ID NO: 268947 - DNA, 16 bp, P. troglodytes
tctgaggccaggagtt

SEQ ID NO: 268948 - DNA, 16 bp, P. troglodytes
tctgaggcccaggctg

SEQ ID NO: 268949 - DNA, 16 bp, P. troglodytes
tctgaggccctcacca

SEQ ID NO: 268950 - DNA, 16 bp, P. troglodytes
tctgaggctcagagag

SEQ ID NO: 268951 - DNA, 16 bp, P. troglodytes
tctgagggctgtgagg

SEQ ID NO: 268952 - DNA, 18 bp, P. troglodytes
tctgaggtcaggagttca

SEQ ID NO: 268953 - DNA, 16 bp, P. troglodytes
tctgaggtcctgggga

SEQ ID NO: 268954 - DNA, 16 bp, P. troglodytes
tctgaggtcctttcca

SEQ ID NO: 268955 - DNA, 16 bp, P. troglodytes
tctgagtctgttttct

SEQ ID NO: 268956 - DNA, 16 bp, P. troglodytes
tctgagtcttggtttc

SEQ ID NO: 268957 - DNA, 16 bp, P. troglodytes
tctgagtttgactttt

SEQ ID NO: 268958 - DNA, 16 bp, P. troglodytes
tctgagttttagtttc

SEQ ID NO: 268959 - DNA, 16 bp, P. troglodytes
tctgataaacagactt

SEQ ID NO: 268960 - DNA, 16 bp, P. troglodytes
tctgataaagggctaa

SEQ ID NO: 268961 - DNA, 16 bp, P. troglodytes
tctgataaatattgat

SEQ ID NO: 268962 - DNA, 16 bp, P. troglodytes
tctgatcatcctcact

SEQ ID NO: 268963 - DNA, 16 bp, P. troglodytes
tctgatctcaggtgat

SEQ ID NO: 268964 - DNA, 16 bp, P. troglodytes
tctgatctcctgacct

SEQ ID NO: 268965 - DNA, 16 bp, P. troglodytes
tctgatcttaggggaa

SEQ ID NO: 268966 - DNA, 16 bp, P. troglodytes
tctgatctttatttct

SEQ ID NO: 268967 - DNA, 16 bp, P. troglodytes
tctgatgatactttct

SEQ ID NO: 268968 - DNA, 16 bp, P. troglodytes
tctgatgatttcataa

SEQ ID NO: 268969 - DNA, 16 bp, P. troglodytes
tctgatgctgctgctg

SEQ ID NO: 268970 - DNA, 16 bp, P. troglodytes
tctgatggtttataag

SEQ ID NO: 268971 - DNA, 16 bp, P. troglodytes
tctgattggcccagct

SEQ ID NO: 268972 - DNA, 16 bp, P. troglodytes
tctgattgtttccttt

SEQ ID NO: 268973 - DNA, 16 bp, P. troglodytes
tctgatttctgtctct

SEQ ID NO: 268974 - DNA, 16 bp, P. troglodytes
tctgatttctttcact

SEQ ID NO: 268975 - DNA, 16 bp, P. troglodytes
tctgattttaaaaagt

SEQ ID NO: 268976 - DNA, 16 bp, P. troglodytes
tctgatttttaaaaat

SEQ ID NO: 268977 - DNA, 16 bp, P. troglodytes
tctgatttttaaaatt

SEQ ID NO: 268978 - DNA, 16 bp, P. troglodytes
tctgatttttcaaatt

SEQ ID NO: 268979 - DNA, 16 bp, P. troglodytes
tctgatttttctcatt

SEQ ID NO: 268980 - DNA, 16 bp, P. troglodytes
tctgcaaaatgaggaa

SEQ ID NO: 268981 - DNA, 16 bp, P. troglodytes
tctgcaaaatggagat

SEQ ID NO: 268982 - DNA, 16 bp, P. troglodytes
tctgcaaaatgggggt

SEQ ID NO: 268983 - DNA, 37 bp, P. troglodytes
tctgcaaacagggacaatttgacttcctcttttccta

SEQ ID NO: 268984 - DNA, 16 bp, P. troglodytes
tctgcaaacatttatt

SEQ ID NO: 268985 - DNA, 16 bp, P. troglodytes
tctgcaaaccagaaag

SEQ ID NO: 268986 - DNA, 16 bp, P. troglodytes
tctgcaaacggagaca

SEQ ID NO: 268987 - DNA, 16 bp, P. troglodytes
tctgcaaataaagata

SEQ ID NO: 268988 - DNA, 16 bp, P. troglodytes
tctgcaaatgttttct

SEQ ID NO: 268989 - DNA, 16 bp, P. troglodytes
tctgcaacctcatcag

SEQ ID NO: 268990 - DNA, 16 bp, P. troglodytes
tctgcaagctgagaag

SEQ ID NO: 268991 - DNA, 16 bp, P. troglodytes
tctgcaagctgaggag

SEQ ID NO: 268992 - DNA, 16 bp, P. troglodytes
tctgcacacatttctt

SEQ ID NO: 268993 - DNA, 16 bp, P. troglodytes
tctgcacagcagaaga

SEQ ID NO: 268994 - DNA, 16 bp, P. troglodytes
tctgcactcccatgtt

SEQ ID NO: 268995 - DNA, 16 bp, P. troglodytes
tctgcagaacagtttg

SEQ ID NO: 268996 - DNA, 39 bp, P. troglodytes
tctgcagacttaaatgtccctgtctgacagctttgaaga

SEQ ID NO: 268997 - DNA, 16 bp, P. troglodytes
tctgcagagactgtgg

SEQ ID NO: 268998 - DNA, 16 bp, P. troglodytes
tctgcagattcaacca

SEQ ID NO: 268999 - DNA, 16 bp, P. troglodytes
tctgcagcaacatgga

SEQ ID NO: 269000 - DNA, 16 bp, P. troglodytes
tctgcagcccatggat

SEQ ID NO: 269001 - DNA, 16 bp, P. troglodytes
tctgcagcctctgcta

SEQ ID NO: 269002 - DNA, 18 bp, P. troglodytes
tctgcagccttgacctcc

SEQ ID NO: 269003 - DNA, 16 bp, P. troglodytes
tctgcagctcatcctg

SEQ ID NO: 269004 - DNA, 16 bp, P. troglodytes
tctgcagctcccagag

SEQ ID NO: 269005 - DNA, 19 bp, P. troglodytes
tctgcagcttcactcctga

SEQ ID NO: 269006 - DNA, 16 bp, P. troglodytes
tctgcagcttccttac

SEQ ID NO: 269007 - DNA, 16 bp, P. troglodytes
tctgcaggatgtacag

SEQ ID NO: 269008 - DNA, 16 bp, P. troglodytes
tctgcaggctgagaag

SEQ ID NO: 269009 - DNA, 16 bp, P. troglodytes
tctgcaggctgggaag

SEQ ID NO: 269010 - DNA, 16 bp, P. troglodytes
tctgcaggctttacag

SEQ ID NO: 269011 - DNA, 16 bp, P. troglodytes
tctgcagggctgggga

SEQ ID NO: 269012 - DNA, 16 bp, P. troglodytes
tctgcaggtggatatt

SEQ ID NO: 269013 - DNA, 16 bp, P. troglodytes
tctgcagtggctggta

SEQ ID NO: 269014 - DNA, 16 bp, P. troglodytes
tctgcagttcctggtg

SEQ ID NO: 269015 - DNA, 16 bp, P. troglodytes
tctgcagttgttgaat

SEQ ID NO: 269016 - DNA, 16 bp, P. troglodytes
tctgcatatatatata

SEQ ID NO: 269017 - DNA, 16 bp, P. troglodytes
tctgcatctgtggatt

SEQ ID NO: 269018 - DNA, 16 bp, P. troglodytes
tctgcatgctccccct

SEQ ID NO: 269019 - DNA, 16 bp, P. troglodytes
tctgcatgtggacatc

SEQ ID NO: 269020 - DNA, 16 bp, P. troglodytes
tctgcattgaaaattc

SEQ ID NO: 269021 - DNA, 16 bp, P. troglodytes
tctgcattgctcatgc

SEQ ID NO: 269022 - DNA, 16 bp, P. troglodytes
tctgcatttattgaaa

SEQ ID NO: 269023 - DNA, 16 bp, P. troglodytes
tctgcatttatttatt

SEQ ID NO: 269024 - DNA, 16 bp, P. troglodytes
tctgcatttctgacaa

SEQ ID NO: 269025 - DNA, 16 bp, P. troglodytes
tctgcattttataaat

SEQ ID NO: 269026 - DNA, 17 bp, P. troglodytes
tctgccaagagatccac

SEQ ID NO: 269027 - DNA, 16 bp, P. troglodytes
tctgccaagagatctg

SEQ ID NO: 269028 - DNA, 17 bp, P. troglodytes
tctgccaccacgcctgg

SEQ ID NO: 269029 - DNA, 16 bp, P. troglodytes
tctgccacccctgaga

SEQ ID NO: 269030 - DNA, 16 bp, P. troglodytes
tctgccacctccactg

SEQ ID NO: 269031 - DNA, 16 bp, P. troglodytes
tctgccacttaatagc

SEQ ID NO: 269032 - DNA, 16 bp, P. troglodytes
tctgccacttattagc

SEQ ID NO: 269033 - DNA, 16 bp, P. troglodytes
tctgccagattttggt

SEQ ID NO: 269034 - DNA, 16 bp, P. troglodytes
tctgccagcactttga

SEQ ID NO: 269035 - DNA, 16 bp, P. troglodytes
tctgccataattggaa

SEQ ID NO: 269036 - DNA, 16 bp, P. troglodytes
tctgccatcccaccca

SEQ ID NO: 269037 - DNA, 16 bp, P. troglodytes
tctgccatccctgaga

SEQ ID NO: 269038 - DNA, 16 bp, P. troglodytes
tctgccatgggatgac

SEQ ID NO: 269039 - DNA, 16 bp, P. troglodytes
tctgccattctgtggg

SEQ ID NO: 269040 - DNA, 16 bp, P. troglodytes
tctgccatttattagc

SEQ ID NO: 269041 - DNA, 16 bp, P. troglodytes
tctgccattttgtttt

SEQ ID NO: 269042 - DNA, 16 bp, P. troglodytes
tctgcccacctccgcc

SEQ ID NO: 269043 - DNA, 16 bp, P. troglodytes
tctgcccacctcgggc

SEQ ID NO: 269044 - DNA, 17 bp, P. troglodytes
tctgcccaccttgacct

SEQ ID NO: 269045 - DNA, 16 bp, P. troglodytes
tctgcccagctcagcc

SEQ ID NO: 269046 - DNA, 16 bp, P. troglodytes
tctgcccaggagcctg

SEQ ID NO: 269047 - DNA, 16 bp, P. troglodytes
tctgcccattcagtat

SEQ ID NO: 269048 - DNA, 16 bp, P. troglodytes
tctgcccccagggttc

SEQ ID NO: 269049 - DNA, 16 bp, P. troglodytes
tctgcccctactgtgg

SEQ ID NO: 269050 - DNA, 16 bp, P. troglodytes
tctgcccctgacccct

SEQ ID NO: 269051 - DNA, 17 bp, P. troglodytes
tctgcccctgtggcttt

SEQ ID NO: 269052 - DNA, 16 bp, P. troglodytes
tctgcccgcctcgggc

SEQ ID NO: 269053 - DNA, 16 bp, P. troglodytes
tctgccctccagaact

SEQ ID NO: 269054 - DNA, 16 bp, P. troglodytes
tctgccctggcctccc

SEQ ID NO: 269055 - DNA, 16 bp, P. troglodytes
tctgccgcccaggctg

SEQ ID NO: 269056 - DNA, 16 bp, P. troglodytes
tctgcctcagccacct

SEQ ID NO: 269057 - DNA, 16 bp, P. troglodytes
tctgcctcagcctcac

SEQ ID NO: 269058 - DNA, 16 bp, P. troglodytes
tctgcctcagcctccc

SEQ ID NO: 269059 - DNA, 16 bp, P. troglodytes
tctgcctcagctgccc

SEQ ID NO: 269060 - DNA, 16 bp, P. troglodytes
tctgcctcaggacctt

SEQ ID NO: 269061 - DNA, 16 bp, P. troglodytes
tctgcctcagggcctt

SEQ ID NO: 269062 - DNA, 16 bp, P. troglodytes
tctgcctcagtctcct

SEQ ID NO: 269063 - DNA, 16 bp, P. troglodytes
tctgcctccacctccc

SEQ ID NO: 269064 - DNA, 16 bp, P. troglodytes
tctgcctccagactgc

SEQ ID NO: 269065 - DNA, 16 bp, P. troglodytes
tctgcctcccaagttg

SEQ ID NO: 269066 - DNA, 16 bp, P. troglodytes
tctgcctcccgggctc

SEQ ID NO: 269067 - DNA, 16 bp, P. troglodytes
tctgcctcccttggcc

SEQ ID NO: 269068 - DNA, 16 bp, P. troglodytes
tctgcctcctgaccaa

SEQ ID NO: 269069 - DNA, 16 bp, P. troglodytes
tctgcctcctgccacc

SEQ ID NO: 269070 - DNA, 16 bp, P. troglodytes
tctgcctcctggcttc

SEQ ID NO: 269071 - DNA, 16 bp, P. troglodytes
tctgcctctctctgcc

SEQ ID NO: 269072 - DNA, 16 bp, P. troglodytes
tctgcctctgccacct

SEQ ID NO: 269073 - DNA, 16 bp, P. troglodytes
tctgcctctggggttc

SEQ ID NO: 269074 - DNA, 17 bp, P. troglodytes
tctgcctgccaggttca

SEQ ID NO: 269075 - DNA, 16 bp, P. troglodytes
tctgcctgcctcaacc

SEQ ID NO: 269076 - DNA, 16 bp, P. troglodytes
tctgcctgcctcagct

SEQ ID NO: 269077 - DNA, 16 bp, P. troglodytes
tctgcctgcctctgcc

SEQ ID NO: 269078 - DNA, 16 bp, P. troglodytes
tctgcctgcctgggcc

SEQ ID NO: 269079 - DNA, 16 bp, P. troglodytes
tctgcctgccttattt

SEQ ID NO: 269080 - DNA, 16 bp, P. troglodytes
tctgcctgccttggct

SEQ ID NO: 269081 - DNA, 16 bp, P. troglodytes
tctgcctgctttatat

SEQ ID NO: 269082 - DNA, 16 bp, P. troglodytes
tctgcctgggatgctc

SEQ ID NO: 269083 - DNA, 16 bp, P. troglodytes
tctgcctgttacccaa

SEQ ID NO: 269084 - DNA, 16 bp, P. troglodytes
tctgccttactcactc

SEQ ID NO: 269085 - DNA, 16 bp, P. troglodytes
tctgccttagcctcct

SEQ ID NO: 269086 - DNA, 16 bp, P. troglodytes
tctgccttccaccatg

SEQ ID NO: 269087 - DNA, 16 bp, P. troglodytes
tctgccttccaggctc

SEQ ID NO: 269088 - DNA, 17 bp, P. troglodytes
tctgccttccgggttca

SEQ ID NO: 269089 - DNA, 16 bp, P. troglodytes
tctgccttgggctccc

SEQ ID NO: 269090 - DNA, 16 bp, P. troglodytes
tctgcctttctcagcc

SEQ ID NO: 269091 - DNA, 16 bp, P. troglodytes
tctgcctttgcctccc

SEQ ID NO: 269092 - DNA, 16 bp, P. troglodytes
tctgcggaggcctcag

SEQ ID NO: 269093 - DNA, 16 bp, P. troglodytes
tctgcgtgtgtgtgtg

SEQ ID NO: 269094 - DNA, 16 bp, P. troglodytes
tctgctagcttccaac

SEQ ID NO: 269095 - DNA, 16 bp, P. troglodytes
tctgctatcttcaaga

SEQ ID NO: 269096 - DNA, 16 bp, P. troglodytes
tctgctatgtgaggac

SEQ ID NO: 269097 - DNA, 16 bp, P. troglodytes
tctgctcaatttttct

SEQ ID NO: 269098 - DNA, 16 bp, P. troglodytes
tctgctcacctcggcc

SEQ ID NO: 269099 - DNA, 16 bp, P. troglodytes
tctgctcacttcaacc

SEQ ID NO: 269100 - DNA, 16 bp, P. troglodytes
tctgctcagctcctgg

SEQ ID NO: 269101 - DNA, 16 bp, P. troglodytes
tctgctcagcttccag

SEQ ID NO: 269102 - DNA, 16 bp, P. troglodytes
tctgctcagcttttgg

SEQ ID NO: 269103 - DNA, 16 bp, P. troglodytes
tctgctcagtttctgg

SEQ ID NO: 269104 - DNA, 16 bp, P. troglodytes
tctgctccagaccctg

SEQ ID NO: 269105 - DNA, 16 bp, P. troglodytes
tctgctccagccactc

SEQ ID NO: 269106 - DNA, 16 bp, P. troglodytes
tctgctcccatgaccc

SEQ ID NO: 269107 - DNA, 16 bp, P. troglodytes
tctgctccctctgcct

SEQ ID NO: 269108 - DNA, 16 bp, P. troglodytes
tctgctccctggctcc

SEQ ID NO: 269109 - DNA, 16 bp, P. troglodytes
tctgctccctgggttc

SEQ ID NO: 269110 - DNA, 16 bp, P. troglodytes
tctgctcctctgccag

SEQ ID NO: 269111 - DNA, 16 bp, P. troglodytes
tctgctcctgctgcct

SEQ ID NO: 269112 - DNA, 16 bp, P. troglodytes
tctgctctcaaaccct

SEQ ID NO: 269113 - DNA, 16 bp, P. troglodytes
tctgctctgatctttt

SEQ ID NO: 269114 - DNA, 16 bp, P. troglodytes
tctgctctgatttcag

SEQ ID NO: 269115 - DNA, 16 bp, P. troglodytes
tctgctgactgtttct

SEQ ID NO: 269116 - DNA, 16 bp, P. troglodytes
tctgctgagaagtcca

SEQ ID NO: 269117 - DNA, 16 bp, P. troglodytes
tctgctgcccaggcca

SEQ ID NO: 269118 - DNA, 16 bp, P. troglodytes
tctgctgccccagcct

SEQ ID NO: 269119 - DNA, 16 bp, P. troglodytes
tctgctgccttgtgaa

SEQ ID NO: 269120 - DNA, 16 bp, P. troglodytes
tctgctgctgcaggct

SEQ ID NO: 269121 - DNA, 16 bp, P. troglodytes
tctgctgctgtaacag

SEQ ID NO: 269122 - DNA, 16 bp, P. troglodytes
tctgctggcctctccc

SEQ ID NO: 269123 - DNA, 16 bp, P. troglodytes
tctgctggcctctcct

SEQ ID NO: 269124 - DNA, 16 bp, P. troglodytes
tctgctggccttggcc

SEQ ID NO: 269125 - DNA, 16 bp, P. troglodytes
tctgctggtctgcaga

SEQ ID NO: 269126 - DNA, 16 bp, P. troglodytes
tctgctgtggtctgaa

SEQ ID NO: 269127 - DNA, 16 bp, P. troglodytes
tctgctgtgtgtgtgt

SEQ ID NO: 269128 - DNA, 16 bp, P. troglodytes
tctgctgttgctgtct

SEQ ID NO: 269129 - DNA, 16 bp, P. troglodytes
tctgcttatttattta

SEQ ID NO: 269130 - DNA, 16 bp, P. troglodytes
tctgcttcaatttttt

SEQ ID NO: 269131 - DNA, 16 bp, P. troglodytes
tctgcttcagcttcct

SEQ ID NO: 269132 - DNA, 16 bp, P. troglodytes
tctgcttccaagttca

SEQ ID NO: 269133 - DNA, 16 bp, P. troglodytes
tctgcttcctcagcct

SEQ ID NO: 269134 - DNA, 16 bp, P. troglodytes
tctgcttcctgctgcc

SEQ ID NO: 269135 - DNA, 16 bp, P. troglodytes
tctgcttctaagagtt

SEQ ID NO: 269136 - DNA, 16 bp, P. troglodytes
tctgcttctcagagga

SEQ ID NO: 269137 - DNA, 16 bp, P. troglodytes
tctgcttctgcattca

SEQ ID NO: 269138 - DNA, 16 bp, P. troglodytes
tctgcttctgcctccc

SEQ ID NO: 269139 - DNA, 16 bp, P. troglodytes
tctgcttctgggaaga

SEQ ID NO: 269140 - DNA, 16 bp, P. troglodytes
tctgcttctggggaaa

SEQ ID NO: 269141 - DNA, 16 bp, P. troglodytes
tctgcttctggggagg

SEQ ID NO: 269142 - DNA, 16 bp, P. troglodytes
tctgcttctgtgagtt

SEQ ID NO: 269143 - DNA, 16 bp, P. troglodytes
tctgcttcttggagga

SEQ ID NO: 269144 - DNA, 16 bp, P. troglodytes
tctgcttgatcaattc

SEQ ID NO: 269145 - DNA, 16 bp, P. troglodytes
tctgcttgcctcagcc

SEQ ID NO: 269146 - DNA, 16 bp, P. troglodytes
tctgcttgctttaggt

SEQ ID NO: 269147 - DNA, 16 bp, P. troglodytes
tctgcttgctttctca

SEQ ID NO: 269148 - DNA, 16 bp, P. troglodytes
tctgcttgtggatatt

SEQ ID NO: 269149 - DNA, 16 bp, P. troglodytes
tctgctttcctcagcc

SEQ ID NO: 269150 - DNA, 16 bp, P. troglodytes
tctgctttcctgaaat

SEQ ID NO: 269151 - DNA, 16 bp, P. troglodytes
tctgctttctcctgtg

SEQ ID NO: 269152 - DNA, 16 bp, P. troglodytes
tctgctttctgcctct

SEQ ID NO: 269153 - DNA, 16 bp, P. troglodytes
tctgctttgtctgata

SEQ ID NO: 269154 - DNA, 16 bp, P. troglodytes
tctgctttgtgaaaga

SEQ ID NO: 269155 - DNA, 16 bp, P. troglodytes
tctgctttgtttacct

SEQ ID NO: 269156 - DNA, 16 bp, P. troglodytes
tctgcttttaaaaaaa

SEQ ID NO: 269157 - DNA, 16 bp, P. troglodytes
tctgcttttagttctt

SEQ ID NO: 269158 - DNA, 16 bp, P. troglodytes
tctgcttttctggggg

SEQ ID NO: 269159 - DNA, 16 bp, P. troglodytes
tctgcttttggtatca

SEQ ID NO: 269160 - DNA, 16 bp, P. troglodytes
tctggaaaaaataatt

SEQ ID NO: 269161 - DNA, 16 bp, P. troglodytes
tctggaaaagagaaaa

SEQ ID NO: 269162 - DNA, 16 bp, P. troglodytes
tctggaaaagattgta

SEQ ID NO: 269163 - DNA, 16 bp, P. troglodytes
tctggaaaaggaaaaa

SEQ ID NO: 269164 - DNA, 16 bp, P. troglodytes
tctggaaacagagaca

SEQ ID NO: 269165 - DNA, 16 bp, P. troglodytes
tctggaaacagggaca

SEQ ID NO: 269166 - DNA, 16 bp, P. troglodytes
tctggaaactttggtg

SEQ ID NO: 269167 - DNA, 16 bp, P. troglodytes
tctggaaagaagaaaa

SEQ ID NO: 269168 - DNA, 16 bp, P. troglodytes
tctggaaagaattcac

SEQ ID NO: 269169 - DNA, 16 bp, P. troglodytes
tctggaaaggaaggaa

SEQ ID NO: 269170 - DNA, 16 bp, P. troglodytes
tctggaaccaaaccca

SEQ ID NO: 269171 - DNA, 16 bp, P. troglodytes
tctggaactcctcacc

SEQ ID NO: 269172 - DNA, 16 bp, P. troglodytes
tctggaactcttgacc

SEQ ID NO: 269173 - DNA, 16 bp, P. troglodytes
tctggaactttgaact

SEQ ID NO: 269174 - DNA, 16 bp, P. troglodytes
tctggaagaaaaagat

SEQ ID NO: 269175 - DNA, 16 bp, P. troglodytes
tctggaagaaaacata

SEQ ID NO: 269176 - DNA, 16 bp, P. troglodytes
tctggaagaaaaccta

SEQ ID NO: 269177 - DNA, 16 bp, P. troglodytes
tctggaagaaatggat

SEQ ID NO: 269178 - DNA, 16 bp, P. troglodytes
tctggaagacagtggc

SEQ ID NO: 269179 - DNA, 16 bp, P. troglodytes
tctggaagccattatc

SEQ ID NO: 269180 - DNA, 16 bp, P. troglodytes
tctggaagcccagact

SEQ ID NO: 269181 - DNA, 16 bp, P. troglodytes
tctggaagctgaaaaa

SEQ ID NO: 269182 - DNA, 16 bp, P. troglodytes
tctggaagctgagaag

SEQ ID NO: 269183 - DNA, 16 bp, P. troglodytes
tctggaagctggaaaa

SEQ ID NO: 269184 - DNA, 16 bp, P. troglodytes
tctggaaggaaaaaaa

SEQ ID NO: 269185 - DNA, 16 bp, P. troglodytes
tctggaatttccattt

SEQ ID NO: 269186 - DNA, 16 bp, P. troglodytes
tctggacaacagagtg

SEQ ID NO: 269187 - DNA, 16 bp, P. troglodytes
tctggacaccaaggct

SEQ ID NO: 269188 - DNA, 16 bp, P. troglodytes
tctggacatttcatat

SEQ ID NO: 269189 - DNA, 16 bp, P. troglodytes
tctggaccctcccagc

SEQ ID NO: 269190 - DNA, 16 bp, P. troglodytes
tctggacctaccctgg

SEQ ID NO: 269191 - DNA, 16 bp, P. troglodytes
tctggacctttacaga

SEQ ID NO: 269192 - DNA, 16 bp, P. troglodytes
tctggagacatttttg

SEQ ID NO: 269193 - DNA, 16 bp, P. troglodytes
tctggagactggaaat

SEQ ID NO: 269194 - DNA, 16 bp, P. troglodytes
tctggagactgggaaa

SEQ ID NO: 269195 - DNA, 16 bp, P. troglodytes
tctggagaggatgtgg

SEQ ID NO: 269196 - DNA, 17 bp, P. troglodytes
tctggagattctggctt

SEQ ID NO: 269197 - DNA, 16 bp, P. troglodytes
tctggagcaaaaattc

SEQ ID NO: 269198 - DNA, 16 bp, P. troglodytes
tctggagcagctgctg

SEQ ID NO: 269199 - DNA, 16 bp, P. troglodytes
tctggagccagacagc

SEQ ID NO: 269200 - DNA, 16 bp, P. troglodytes
tctggagctcagaaga

SEQ ID NO: 269201 - DNA, 16 bp, P. troglodytes
tctggagctggatggt

SEQ ID NO: 269202 - DNA, 16 bp, P. troglodytes
tctggaggcagaattc

SEQ ID NO: 269203 - DNA, 16 bp, P. troglodytes
tctggaggcagaggtg

SEQ ID NO: 269204 - DNA, 16 bp, P. troglodytes
tctggaggcatcacat

SEQ ID NO: 269205 - DNA, 16 bp, P. troglodytes
tctggaggctccaagg

SEQ ID NO: 269206 - DNA, 16 bp, P. troglodytes
tctggaggctctgagg

SEQ ID NO: 269207 - DNA, 16 bp, P. troglodytes
tctggaggctgcctgc

SEQ ID NO: 269208 - DNA, 16 bp, P. troglodytes
tctggaggtgatggga

SEQ ID NO: 269209 - DNA, 16 bp, P. troglodytes
tctggagtcagaaaga

SEQ ID NO: 269210 - DNA, 16 bp, P. troglodytes
tctggagtctgggaag

SEQ ID NO: 269211 - DNA, 16 bp, P. troglodytes
tctggagtgcagtggc

SEQ ID NO: 269212 - DNA, 17 bp, P. troglodytes
tctggagtgcagtggca

SEQ ID NO: 269213 - DNA, 18 bp, P. troglodytes
tctggagtgcagtggcac

SEQ ID NO: 269214 - DNA, 18 bp, P. troglodytes
tctggagtgcagtggtgc

SEQ ID NO: 269215 - DNA, 23 bp, P. troglodytes
tctggagtgcagtggtgtgatct

SEQ ID NO: 269216 - DNA, 16 bp, P. troglodytes
tctggagttcaagacc

SEQ ID NO: 269217 - DNA, 17 bp, P. troglodytes
tctggagttgttcgttc

SEQ ID NO: 269218 - DNA, 19 bp, P. troglodytes
tctggagttgttcgttcct

SEQ ID NO: 269219 - DNA, 16 bp, P. troglodytes
tctggatagaagatca

SEQ ID NO: 269220 - DNA, 16 bp, P. troglodytes
tctggatatgaaattc

SEQ ID NO: 269221 - DNA, 16 bp, P. troglodytes
tctggatgtggtggtg

SEQ ID NO: 269222 - DNA, 16 bp, P. troglodytes
tctggattctctattt

SEQ ID NO: 269223 - DNA, 16 bp, P. troglodytes
tctggattctggattc

SEQ ID NO: 269224 - DNA, 16 bp, P. troglodytes
tctggattttggattt

SEQ ID NO: 269225 - DNA, 16 bp, P. troglodytes
tctggattttttttaa

SEQ ID NO: 269226 - DNA, 16 bp, P. troglodytes
tctggcatctggagga

SEQ ID NO: 269227 - DNA, 16 bp, P. troglodytes
tctggccaacatagtg

SEQ ID NO: 269228 - DNA, 16 bp, P. troglodytes
tctggccaacatggca

SEQ ID NO: 269229 - DNA, 16 bp, P. troglodytes
tctggccaacatggtg

SEQ ID NO: 269230 - DNA, 16 bp, P. troglodytes
tctggccaatgagatg

SEQ ID NO: 269231 - DNA, 16 bp, P. troglodytes
tctggccagcatggtg

SEQ ID NO: 269232 - DNA, 22 bp, P. troglodytes
tctggccaggcgcggtggctca

SEQ ID NO: 269233 - DNA, 16 bp, P. troglodytes
tctggcccaaggcagg

SEQ ID NO: 269234 - DNA, 16 bp, P. troglodytes
tctggcccagggcagg

SEQ ID NO: 269235 - DNA, 16 bp, P. troglodytes
tctggcccagggtggg

SEQ ID NO: 269236 - DNA, 17 bp, P. troglodytes
tctggccgggtgcagtg

SEQ ID NO: 269237 - DNA, 16 bp, P. troglodytes
tctggcctgagtgaca

SEQ ID NO: 269238 - DNA, 16 bp, P. troglodytes
tctggcctggtgacag

SEQ ID NO: 269239 - DNA, 16 bp, P. troglodytes
tctggccttggcctcc

SEQ ID NO: 269240 - DNA, 16 bp, P. troglodytes
tctggcctttgggcag

SEQ ID NO: 269241 - DNA, 16 bp, P. troglodytes
tctggctaattttctt

SEQ ID NO: 269242 - DNA, 16 bp, P. troglodytes
tctggctaatttttgt

SEQ ID NO: 269243 - DNA, 18 bp, P. troglodytes
tctggctacttcctgctg

SEQ ID NO: 269244 - DNA, 16 bp, P. troglodytes
tctggctctgccactt

SEQ ID NO: 269245 - DNA, 16 bp, P. troglodytes
tctggctctggctctg

SEQ ID NO: 269246 - DNA, 16 bp, P. troglodytes
tctggctctgtgtctc

SEQ ID NO: 269247 - DNA, 16 bp, P. troglodytes
tctggctgagcccagg

SEQ ID NO: 269248 - DNA, 16 bp, P. troglodytes
tctggctgcccttcac

SEQ ID NO: 269249 - DNA, 16 bp, P. troglodytes
tctggctgctgtgctg

SEQ ID NO: 269250 - DNA, 16 bp, P. troglodytes
tctggctgtgttgccc

SEQ ID NO: 269251 - DNA, 16 bp, P. troglodytes
tctggctgtttaaaag

SEQ ID NO: 269252 - DNA, 16 bp, P. troglodytes
tctggcttcagccccc

SEQ ID NO: 269253 - DNA, 16 bp, P. troglodytes
tctggcttctctctct

SEQ ID NO: 269254 - DNA, 16 bp, P. troglodytes
tctggctttatttatt

SEQ ID NO: 269255 - DNA, 16 bp, P. troglodytes
tctggctttcattttt

SEQ ID NO: 269256 - DNA, 16 bp, P. troglodytes
tctggcttttcttgaa

SEQ ID NO: 269257 - DNA, 16 bp, P. troglodytes
tctgggaaaaagaaaa

SEQ ID NO: 269258 - DNA, 16 bp, P. troglodytes
tctgggaaagaaaata

SEQ ID NO: 269259 - DNA, 16 bp, P. troglodytes
tctgggaaatgtagtt

SEQ ID NO: 269260 - DNA, 16 bp, P. troglodytes
tctgggaagtaactaa

SEQ ID NO: 269261 - DNA, 16 bp, P. troglodytes
tctgggaatgcagccc

SEQ ID NO: 269262 - DNA, 16 bp, P. troglodytes
tctgggaccagcagtc

SEQ ID NO: 269263 - DNA, 16 bp, P. troglodytes
tctgggactacaggca

SEQ ID NO: 269264 - DNA, 16 bp, P. troglodytes
tctgggactcctgacc

SEQ ID NO: 269265 - DNA, 16 bp, P. troglodytes
tctgggagaaaagtgg

SEQ ID NO: 269266 - DNA, 16 bp, P. troglodytes
tctgggagaagagcat

SEQ ID NO: 269267 - DNA, 16 bp, P. troglodytes
tctgggagataaaatt

SEQ ID NO: 269268 - DNA, 16 bp, P. troglodytes
tctgggagcagggcat

SEQ ID NO: 269269 - DNA, 16 bp, P. troglodytes
tctgggagggggaggt

SEQ ID NO: 269270 - DNA, 16 bp, P. troglodytes
tctgggaggtgaggag

SEQ ID NO: 269271 - DNA, 16 bp, P. troglodytes
tctgggaggtggggag

SEQ ID NO: 269272 - DNA, 16 bp, P. troglodytes
tctgggaggttgaggc

SEQ ID NO: 269273 - DNA, 16 bp, P. troglodytes
tctgggatgtgaggag

SEQ ID NO: 269274 - DNA, 23 bp, P. troglodytes
tctgggattacaggcatgagcca

SEQ ID NO: 269275 - DNA, 16 bp, P. troglodytes
tctgggattacaggcg

SEQ ID NO: 269276 - DNA, 17 bp, P. troglodytes
tctgggcaacatagcaa

SEQ ID NO: 269277 - DNA, 16 bp, P. troglodytes
tctgggcaccatggcc

SEQ ID NO: 269278 - DNA, 16 bp, P. troglodytes
tctgggcatccaggca

SEQ ID NO: 269279 - DNA, 16 bp, P. troglodytes
tctgggcctccatttt

SEQ ID NO: 269280 - DNA, 16 bp, P. troglodytes
tctgggctcaagcaat

SEQ ID NO: 269281 - DNA, 16 bp, P. troglodytes
tctgggctcaagtaat

SEQ ID NO: 269282 - DNA, 16 bp, P. troglodytes
tctgggctcaggtgat

SEQ ID NO: 269283 - DNA, 16 bp, P. troglodytes
tctgggctccctgaag

SEQ ID NO: 269284 - DNA, 16 bp, P. troglodytes
tctgggctctgggctc

SEQ ID NO: 269285 - DNA, 16 bp, P. troglodytes
tctgggctgggctggg

SEQ ID NO: 269286 - DNA, 16 bp, P. troglodytes
tctggggaagaatctg

SEQ ID NO: 269287 - DNA, 16 bp, P. troglodytes
tctggggagacctcag

SEQ ID NO: 269288 - DNA, 16 bp, P. troglodytes
tctggggaggagagag

SEQ ID NO: 269289 - DNA, 16 bp, P. troglodytes
tctggggaggccttgg

SEQ ID NO: 269290 - DNA, 16 bp, P. troglodytes
tctggggcaagttctc

SEQ ID NO: 269291 - DNA, 16 bp, P. troglodytes
tctggggcctctgttc

SEQ ID NO: 269292 - DNA, 16 bp, P. troglodytes
tctggggccttgctga

SEQ ID NO: 269293 - DNA, 16 bp, P. troglodytes
tctggggtgatggaaa

SEQ ID NO: 269294 - DNA, 16 bp, P. troglodytes
tctgggtaggcaccat

SEQ ID NO: 269295 - DNA, 16 bp, P. troglodytes
tctgggtgctcctgtt

SEQ ID NO: 269296 - DNA, 16 bp, P. troglodytes
tctgggttcaagccat

SEQ ID NO: 269297 - DNA, 18 bp, P. troglodytes
tctgggttcacgccattc

SEQ ID NO: 269298 - DNA, 16 bp, P. troglodytes
tctgggttctctattc

SEQ ID NO: 269299 - DNA, 16 bp, P. troglodytes
tctgggtttgaatcct

SEQ ID NO: 269300 - DNA, 16 bp, P. troglodytes
tctggtaacatcttcc

SEQ ID NO: 269301 - DNA, 16 bp, P. troglodytes
tctggtaaccatcctt

SEQ ID NO: 269302 - DNA, 16 bp, P. troglodytes
tctggtataatttggc

SEQ ID NO: 269303 - DNA, 16 bp, P. troglodytes
tctggtatacatgtgc

SEQ ID NO: 269304 - DNA, 16 bp, P. troglodytes
tctggtattcctttat

SEQ ID NO: 269305 - DNA, 16 bp, P. troglodytes
tctggtatttcccctg

SEQ ID NO: 269306 - DNA, 23 bp, P. troglodytes
tctggtcaacatggtgaaacccc

SEQ ID NO: 269307 - DNA, 16 bp, P. troglodytes
tctggtcacaaaaata

SEQ ID NO: 269308 - DNA, 16 bp, P. troglodytes
tctggtcctggacttc

SEQ ID NO: 269309 - DNA, 16 bp, P. troglodytes
tctggtcttgaactcc

SEQ ID NO: 269310 - DNA, 16 bp, P. troglodytes
tctggtgaaaaaggaa

SEQ ID NO: 269311 - DNA, 16 bp, P. troglodytes
tctggtgaagcctcag

SEQ ID NO: 269312 - DNA, 16 bp, P. troglodytes
tctggtgagggtcttc

SEQ ID NO: 269313 - DNA, 16 bp, P. troglodytes
tctggtgatagctggg

SEQ ID NO: 269314 - DNA, 16 bp, P. troglodytes
tctggtggcaggcttt

SEQ ID NO: 269315 - DNA, 17 bp, P. troglodytes
tctggtggctcatgcct

SEQ ID NO: 269316 - DNA, 16 bp, P. troglodytes
tctggtggctgccagc

SEQ ID NO: 269317 - DNA, 19 bp, P. troglodytes
tctggtggggacgtggaga

SEQ ID NO: 269318 - DNA, 23 bp, P. troglodytes
tctggtggggccttggagaacct

SEQ ID NO: 269319 - DNA, 16 bp, P. troglodytes
tctggtgttctattgc

SEQ ID NO: 269320 - DNA, 16 bp, P. troglodytes
tctggttaaaaaaaaa

SEQ ID NO: 269321 - DNA, 16 bp, P. troglodytes
tctggttgcttttaag

SEQ ID NO: 269322 - DNA, 16 bp, P. troglodytes
tctggtttctatgacc

SEQ ID NO: 269323 - DNA, 16 bp, P. troglodytes
tctggtttctttcact

SEQ ID NO: 269324 - DNA, 16 bp, P. troglodytes
tctggtttttcagcct

SEQ ID NO: 269325 - DNA, 16 bp, P. troglodytes
tctgtaaaaacaaaca

SEQ ID NO: 269326 - DNA, 18 bp, P. troglodytes
tctgtaaaacagaccaat

SEQ ID NO: 269327 - DNA, 16 bp, P. troglodytes
tctgtaaaataaataa

SEQ ID NO: 269328 - DNA, 16 bp, P. troglodytes
tctgtaaaatcaggat

SEQ ID NO: 269329 - DNA, 16 bp, P. troglodytes
tctgtaaaatgaagag

SEQ ID NO: 269330 - DNA, 16 bp, P. troglodytes
tctgtaaaatggaaaa

SEQ ID NO: 269331 - DNA, 16 bp, P. troglodytes
tctgtaaaatggaaat

SEQ ID NO: 269332 - DNA, 16 bp, P. troglodytes
tctgtaaaatggaatg

SEQ ID NO: 269333 - DNA, 26 bp, P. troglodytes
tctgtaaaatggaccaatcagcagga

SEQ ID NO: 269334 - DNA, 16 bp, P. troglodytes
tctgtaaaatggaggt

SEQ ID NO: 269335 - DNA, 16 bp, P. troglodytes
tctgtaaaatgggact

SEQ ID NO: 269336 - DNA, 16 bp, P. troglodytes
tctgtaaagaatctct

SEQ ID NO: 269337 - DNA, 16 bp, P. troglodytes
tctgtaaagggacaga

SEQ ID NO: 269338 - DNA, 16 bp, P. troglodytes
tctgtaaagggccaaa

SEQ ID NO: 269339 - DNA, 16 bp, P. troglodytes
tctgtaaatatttgtt

SEQ ID NO: 269340 - DNA, 16 bp, P. troglodytes
tctgtaaatttaaaac

SEQ ID NO: 269341 - DNA, 16 bp, P. troglodytes
tctgtaactttctttt

SEQ ID NO: 269342 - DNA, 16 bp, P. troglodytes
tctgtaatatttattt

SEQ ID NO: 269343 - DNA, 16 bp, P. troglodytes
tctgtaatcccagcca

SEQ ID NO: 269344 - DNA, 16 bp, P. troglodytes
tctgtaattattttat

SEQ ID NO: 269345 - DNA, 16 bp, P. troglodytes
tctgtacagcaaaaga

SEQ ID NO: 269346 - DNA, 16 bp, P. troglodytes
tctgtacagcctgtgg

SEQ ID NO: 269347 - DNA, 16 bp, P. troglodytes
tctgtaccaagcagac

SEQ ID NO: 269348 - DNA, 16 bp, P. troglodytes
tctgtactaaaaatac

SEQ ID NO: 269349 - DNA, 16 bp, P. troglodytes
tctgtactaaaaatag

SEQ ID NO: 269350 - DNA, 16 bp, P. troglodytes
tctgtactaaaataca

SEQ ID NO: 269351 - DNA, 16 bp, P. troglodytes
tctgtagatcagaagt

SEQ ID NO: 269352 - DNA, 16 bp, P. troglodytes
tctgtagcagcaactg

SEQ ID NO: 269353 - DNA, 16 bp, P. troglodytes
tctgtagcccatgctg

SEQ ID NO: 269354 - DNA, 16 bp, P. troglodytes
tctgtagcttttccag

SEQ ID NO: 269355 - DNA, 16 bp, P. troglodytes
tctgtaggtcagaagt

SEQ ID NO: 269356 - DNA, 16 bp, P. troglodytes
tctgtagtggagcatg

SEQ ID NO: 269357 - DNA, 16 bp, P. troglodytes
tctgtagttttcttgt

SEQ ID NO: 269358 - DNA, 19 bp, P. troglodytes
tctgtatctaactaatctg

SEQ ID NO: 269359 - DNA, 16 bp, P. troglodytes
tctgtatctggctaat

SEQ ID NO: 269360 - DNA, 16 bp, P. troglodytes
tctgtatcttctttgg

SEQ ID NO: 269361 - DNA, 16 bp, P. troglodytes
tctgtatcttgactgt

SEQ ID NO: 269362 - DNA, 16 bp, P. troglodytes
tctgtatcttgctttt

SEQ ID NO: 269363 - DNA, 16 bp, P. troglodytes
tctgtatgcagaagaa

SEQ ID NO: 269364 - DNA, 16 bp, P. troglodytes
tctgtatgtatctgtt

SEQ ID NO: 269365 - DNA, 16 bp, P. troglodytes
tctgtatgttgcctgt

SEQ ID NO: 269366 - DNA, 16 bp, P. troglodytes
tctgtattaggccatt

SEQ ID NO: 269367 - DNA, 16 bp, P. troglodytes
tctgtattagtctgtt

SEQ ID NO: 269368 - DNA, 16 bp, P. troglodytes
tctgtatttcctgcat

SEQ ID NO: 269369 - DNA, 16 bp, P. troglodytes
tctgtatttcctggat

SEQ ID NO: 269370 - DNA, 16 bp, P. troglodytes
tctgtatttctgtgtg

SEQ ID NO: 269371 - DNA, 16 bp, P. troglodytes
tctgtattttctgtaa

SEQ ID NO: 269372 - DNA, 16 bp, P. troglodytes
tctgtatttttaaaaa

SEQ ID NO: 269373 - DNA, 16 bp, P. troglodytes
tctgtatttttaaatt

SEQ ID NO: 269374 - DNA, 16 bp, P. troglodytes
tctgtatttttaatag

SEQ ID NO: 269375 - DNA, 16 bp, P. troglodytes
tctgtatttttagtaa

SEQ ID NO: 269376 - DNA, 16 bp, P. troglodytes
tctgtatttttctaaa

SEQ ID NO: 269377 - DNA, 16 bp, P. troglodytes
tctgtattttttaaaa

SEQ ID NO: 269378 - DNA, 16 bp, P. troglodytes
tctgtcaaccagactg

SEQ ID NO: 269379 - DNA, 16 bp, P. troglodytes
tctgtcaccagtctgg

SEQ ID NO: 269380 - DNA, 16 bp, P. troglodytes
tctgtcacccaagctg

SEQ ID NO: 269381 - DNA, 16 bp, P. troglodytes
tctgtcacccaggccg

SEQ ID NO: 269382 - DNA, 16 bp, P. troglodytes
tctgtcacccagggct

SEQ ID NO: 269383 - DNA, 16 bp, P. troglodytes
tctgtcaccctgactg

SEQ ID NO: 269384 - DNA, 16 bp, P. troglodytes
tctgtcacctaggctg

SEQ ID NO: 269385 - DNA, 16 bp, P. troglodytes
tctgtcacctggctgg

SEQ ID NO: 269386 - DNA, 16 bp, P. troglodytes
tctgtcactcaataaa

SEQ ID NO: 269387 - DNA, 16 bp, P. troglodytes
tctgtcactctggctg

SEQ ID NO: 269388 - DNA, 16 bp, P. troglodytes
tctgtcactgatggac

SEQ ID NO: 269389 - DNA, 16 bp, P. troglodytes
tctgtcactgatgggc

SEQ ID NO: 269390 - DNA, 16 bp, P. troglodytes
tctgtcacttattagc

SEQ ID NO: 269391 - DNA, 16 bp, P. troglodytes
tctgtcagccaggctg

SEQ ID NO: 269392 - DNA, 16 bp, P. troglodytes
tctgtcataaaaaaaa

SEQ ID NO: 269393 - DNA, 16 bp, P. troglodytes
tctgtcattttcattt

SEQ ID NO: 269394 - DNA, 16 bp, P. troglodytes
tctgtccatttttgtt

SEQ ID NO: 269395 - DNA, 16 bp, P. troglodytes
tctgtccccaggctgg

SEQ ID NO: 269396 - DNA, 16 bp, P. troglodytes
tctgtccctctgtctc

SEQ ID NO: 269397 - DNA, 16 bp, P. troglodytes
tctgtccctttatttt

SEQ ID NO: 269398 - DNA, 16 bp, P. troglodytes
tctgtcctcctcagcc

SEQ ID NO: 269399 - DNA, 17 bp, P. troglodytes
tctgtcgccaggctggt

SEQ ID NO: 269400 - DNA, 16 bp, P. troglodytes
tctgtcgcccaggcta

SEQ ID NO: 269401 - DNA, 16 bp, P. troglodytes
tctgtctaaaagaaaa

SEQ ID NO: 269402 - DNA, 16 bp, P. troglodytes
tctgtctatcatctat

SEQ ID NO: 269403 - DNA, 16 bp, P. troglodytes
tctgtctcacaaaaag

SEQ ID NO: 269404 - DNA, 16 bp, P. troglodytes
tctgtctcacaaacaa

SEQ ID NO: 269405 - DNA, 16 bp, P. troglodytes
tctgtctcagaaaaaa

SEQ ID NO: 269406 - DNA, 16 bp, P. troglodytes
tctgtctcagtctccc

SEQ ID NO: 269407 - DNA, 16 bp, P. troglodytes
tctgtctccaaaaaaa

SEQ ID NO: 269408 - DNA, 16 bp, P. troglodytes
tctgtctccaaaaaag

SEQ ID NO: 269409 - DNA, 16 bp, P. troglodytes
tctgtctccaggctgg

SEQ ID NO: 269410 - DNA, 16 bp, P. troglodytes
tctgtctccccggctg

SEQ ID NO: 269411 - DNA, 16 bp, P. troglodytes
tctgtctcctgggtcc

SEQ ID NO: 269412 - DNA, 16 bp, P. troglodytes
tctgtctctaaaatat

SEQ ID NO: 269413 - DNA, 16 bp, P. troglodytes
tctgtctctacaaaat

SEQ ID NO: 269414 - DNA, 16 bp, P. troglodytes
tctgtctctctcctgc

SEQ ID NO: 269415 - DNA, 16 bp, P. troglodytes
tctgtctctctcgctc

SEQ ID NO: 269416 - DNA, 16 bp, P. troglodytes
tctgtctctctctgtg

SEQ ID NO: 269417 - DNA, 16 bp, P. troglodytes
tctgtctctctgtctc

SEQ ID NO: 269418 - DNA, 16 bp, P. troglodytes
tctgtctctgcctccc

SEQ ID NO: 269419 - DNA, 16 bp, P. troglodytes
tctgtctctgcctctg

SEQ ID NO: 269420 - DNA, 16 bp, P. troglodytes
tctgtctctgtagatt

SEQ ID NO: 269421 - DNA, 16 bp, P. troglodytes
tctgtctctgtcttcc

SEQ ID NO: 269422 - DNA, 16 bp, P. troglodytes
tctgtctctgtctttg

SEQ ID NO: 269423 - DNA, 16 bp, P. troglodytes
tctgtctgaaaagaaa

SEQ ID NO: 269424 - DNA, 16 bp, P. troglodytes
tctgtctgaatgatct

SEQ ID NO: 269425 - DNA, 16 bp, P. troglodytes
tctgtctgactccaaa

SEQ ID NO: 269426 - DNA, 16 bp, P. troglodytes
tctgtctgactccaag

SEQ ID NO: 269427 - DNA, 16 bp, P. troglodytes
tctgtctgcctcagcc

SEQ ID NO: 269428 - DNA, 16 bp, P. troglodytes
tctgtctggtcctgag

SEQ ID NO: 269429 - DNA, 16 bp, P. troglodytes
tctgtctgtccatcca

SEQ ID NO: 269430 - DNA, 16 bp, P. troglodytes
tctgtctgtctatcta

SEQ ID NO: 269431 - DNA, 16 bp, P. troglodytes
tctgtctgtctctgcc

SEQ ID NO: 269432 - DNA, 16 bp, P. troglodytes
tctgtctgtctgtctt

SEQ ID NO: 269433 - DNA, 16 bp, P. troglodytes
tctgtctgtgtgtctg

SEQ ID NO: 269434 - DNA, 16 bp, P. troglodytes
tctgtcttacaagaaa

SEQ ID NO: 269435 - DNA, 16 bp, P. troglodytes
tctgtcttagtctatt

SEQ ID NO: 269436 - DNA, 16 bp, P. troglodytes
tctgtcttggaaaaaa

SEQ ID NO: 269437 - DNA, 16 bp, P. troglodytes
tctgtcttgttcactg

SEQ ID NO: 269438 - DNA, 16 bp, P. troglodytes
tctgtctttgtctctg

SEQ ID NO: 269439 - DNA, 16 bp, P. troglodytes
tctgtcttttaattgg

SEQ ID NO: 269440 - DNA, 16 bp, P. troglodytes
tctgtgaaaaatataa

SEQ ID NO: 269441 - DNA, 16 bp, P. troglodytes
tctgtgaaaggaaaat

SEQ ID NO: 269442 - DNA, 16 bp, P. troglodytes
tctgtgaacaatgtca

SEQ ID NO: 269443 - DNA, 16 bp, P. troglodytes
tctgtgaagaaattca

SEQ ID NO: 269444 - DNA, 16 bp, P. troglodytes
tctgtgaagaatgtaa

SEQ ID NO: 269445 - DNA, 16 bp, P. troglodytes
tctgtgaagccagcat

SEQ ID NO: 269446 - DNA, 16 bp, P. troglodytes
tctgtgaattttgaca

SEQ ID NO: 269447 - DNA, 16 bp, P. troglodytes
tctgtgacagcttctt

SEQ ID NO: 269448 - DNA, 16 bp, P. troglodytes
tctgtgaccctgggca

SEQ ID NO: 269449 - DNA, 16 bp, P. troglodytes
tctgtgacctcaggca

SEQ ID NO: 269450 - DNA, 16 bp, P. troglodytes
tctgtgaccttgcccc

SEQ ID NO: 269451 - DNA, 16 bp, P. troglodytes
tctgtgactcaatttc

SEQ ID NO: 269452 - DNA, 16 bp, P. troglodytes
tctgtgacttttaaaa

SEQ ID NO: 269453 - DNA, 16 bp, P. troglodytes
tctgtgagaagaatgc

SEQ ID NO: 269454 - DNA, 16 bp, P. troglodytes
tctgtgagccactcta

SEQ ID NO: 269455 - DNA, 16 bp, P. troglodytes
tctgtgaggacaggga

SEQ ID NO: 269456 - DNA, 16 bp, P. troglodytes
tctgtgagggctccac

SEQ ID NO: 269457 - DNA, 16 bp, P. troglodytes
tctgtgagttgaacgc

SEQ ID NO: 269458 - DNA, 16 bp, P. troglodytes
tctgtgatattcctgc

SEQ ID NO: 269459 - DNA, 16 bp, P. troglodytes
tctgtgatttatttca

SEQ ID NO: 269460 - DNA, 16 bp, P. troglodytes
tctgtgcagggggaag

SEQ ID NO: 269461 - DNA, 16 bp, P. troglodytes
tctgtgcagtgggcag

SEQ ID NO: 269462 - DNA, 16 bp, P. troglodytes
tctgtgcattttgttt

SEQ ID NO: 269463 - DNA, 16 bp, P. troglodytes
tctgtgccagacactg

SEQ ID NO: 269464 - DNA, 16 bp, P. troglodytes
tctgtgcctcaatttc

SEQ ID NO: 269465 - DNA, 16 bp, P. troglodytes
tctgtgcctcagttta

SEQ ID NO: 269466 - DNA, 16 bp, P. troglodytes
tctgtgcctcagtttt

SEQ ID NO: 269467 - DNA, 16 bp, P. troglodytes
tctgtgccttggtttc

SEQ ID NO: 269468 - DNA, 16 bp, P. troglodytes
tctgtgctctgcctgt

SEQ ID NO: 269469 - DNA, 16 bp, P. troglodytes
tctgtgctgtgggccc

SEQ ID NO: 269470 - DNA, 16 bp, P. troglodytes
tctgtgcttcagtttt

SEQ ID NO: 269471 - DNA, 16 bp, P. troglodytes
tctgtggaaagtgtaa

SEQ ID NO: 269472 - DNA, 16 bp, P. troglodytes
tctgtggaaatttgaa

SEQ ID NO: 269473 - DNA, 16 bp, P. troglodytes
tctgtggatggcaaag

SEQ ID NO: 269474 - DNA, 16 bp, P. troglodytes
tctgtggattcaacca

SEQ ID NO: 269475 - DNA, 16 bp, P. troglodytes
tctgtggcttgtctct

SEQ ID NO: 269476 - DNA, 16 bp, P. troglodytes
tctgtgggccccactt

SEQ ID NO: 269477 - DNA, 16 bp, P. troglodytes
tctgtgggggtgggat

SEQ ID NO: 269478 - DNA, 16 bp, P. troglodytes
tctgtggtattcttgc

SEQ ID NO: 269479 - DNA, 16 bp, P. troglodytes
tctgtggtattttgtt

SEQ ID NO: 269480 - DNA, 16 bp, P. troglodytes
tctgtggtccaggctg

SEQ ID NO: 269481 - DNA, 16 bp, P. troglodytes
tctgtggtctgtgcct

SEQ ID NO: 269482 - DNA, 16 bp, P. troglodytes
tctgtggtttcctgac

SEQ ID NO: 269483 - DNA, 16 bp, P. troglodytes
tctgtgtaaaaaaaaa

SEQ ID NO: 269484 - DNA, 16 bp, P. troglodytes
tctgtgtaagtcataa

SEQ ID NO: 269485 - DNA, 16 bp, P. troglodytes
tctgtgtatgtgtgtg

SEQ ID NO: 269486 - DNA, 16 bp, P. troglodytes
tctgtgtatttatata

SEQ ID NO: 269487 - DNA, 16 bp, P. troglodytes
tctgtgtcaaaaaata

SEQ ID NO: 269488 - DNA, 16 bp, P. troglodytes
tctgtgtcacaaataa

SEQ ID NO: 269489 - DNA, 16 bp, P. troglodytes
tctgtgtccccaccta

SEQ ID NO: 269490 - DNA, 16 bp, P. troglodytes
tctgtgtcctaaattt

SEQ ID NO: 269491 - DNA, 16 bp, P. troglodytes
tctgtgtctaaatttc

SEQ ID NO: 269492 - DNA, 16 bp, P. troglodytes
tctgtgtctatgtgtg

SEQ ID NO: 269493 - DNA, 16 bp, P. troglodytes
tctgtgtctctatttc

SEQ ID NO: 269494 - DNA, 16 bp, P. troglodytes
tctgtgtctgtctctg

SEQ ID NO: 269495 - DNA, 16 bp, P. troglodytes
tctgtgtctgtctgtc

SEQ ID NO: 269496 - DNA, 16 bp, P. troglodytes
tctgtgtctgtgtcta

SEQ ID NO: 269497 - DNA, 16 bp, P. troglodytes
tctgtgtctgtgtctg

SEQ ID NO: 269498 - DNA, 16 bp, P. troglodytes
tctgtgtctgtgtctt

SEQ ID NO: 269499 - DNA, 16 bp, P. troglodytes
tctgtgtcttctcctc

SEQ ID NO: 269500 - DNA, 16 bp, P. troglodytes
tctgtgtgtatctgtg

SEQ ID NO: 269501 - DNA, 16 bp, P. troglodytes
tctgtgtgtctctgtg

SEQ ID NO: 269502 - DNA, 16 bp, P. troglodytes
tctgtgtgtctgtgta

SEQ ID NO: 269503 - DNA, 16 bp, P. troglodytes
tctgtgtgtgtatctg

SEQ ID NO: 269504 - DNA, 16 bp, P. troglodytes
tctgtgtgtgtgtata

SEQ ID NO: 269505 - DNA, 16 bp, P. troglodytes
tctgtgtgtgtgtatg

SEQ ID NO: 269506 - DNA, 16 bp, P. troglodytes
tctgtgttcatgaggg

SEQ ID NO: 269507 - DNA, 16 bp, P. troglodytes
tctgtgttgttgcaaa

SEQ ID NO: 269508 - DNA, 16 bp, P. troglodytes
tctgtgttttaataag

SEQ ID NO: 269509 - DNA, 16 bp, P. troglodytes
tctgtgtttttaaaat

SEQ ID NO: 269510 - DNA, 16 bp, P. troglodytes
tctgtgtttttagtag

SEQ ID NO: 269511 - DNA, 16 bp, P. troglodytes
tctgttaaaatgcaga

SEQ ID NO: 269512 - DNA, 16 bp, P. troglodytes
tctgttaaatggagat

SEQ ID NO: 269513 - DNA, 16 bp, P. troglodytes
tctgttactcaggctg

SEQ ID NO: 269514 - DNA, 16 bp, P. troglodytes
tctgttaggtccattt

SEQ ID NO: 269515 - DNA, 16 bp, P. troglodytes
tctgttatttaaaaaa

SEQ ID NO: 269516 - DNA, 16 bp, P. troglodytes
tctgttatttaagatg

SEQ ID NO: 269517 - DNA, 16 bp, P. troglodytes
tctgttatttcagcca

SEQ ID NO: 269518 - DNA, 16 bp, P. troglodytes
tctgttcaaatctttt

SEQ ID NO: 269519 - DNA, 16 bp, P. troglodytes
tctgttcatctccttt

SEQ ID NO: 269520 - DNA, 16 bp, P. troglodytes
tctgttcatgtctttt

SEQ ID NO: 269521 - DNA, 16 bp, P. troglodytes
tctgttcatgtttttg

SEQ ID NO: 269522 - DNA, 16 bp, P. troglodytes
tctgttccattgattt

SEQ ID NO: 269523 - DNA, 16 bp, P. troglodytes
tctgttccattgttct

SEQ ID NO: 269524 - DNA, 16 bp, P. troglodytes
tctgttccctgcctct

SEQ ID NO: 269525 - DNA, 16 bp, P. troglodytes
tctgttcctatccttc

SEQ ID NO: 269526 - DNA, 16 bp, P. troglodytes
tctgttcctgtcttag

SEQ ID NO: 269527 - DNA, 16 bp, P. troglodytes
tctgttccttcctctg

SEQ ID NO: 269528 - DNA, 16 bp, P. troglodytes
tctgttctcaagctgc

SEQ ID NO: 269529 - DNA, 16 bp, P. troglodytes
tctgttctcaggctgc

SEQ ID NO: 269530 - DNA, 16 bp, P. troglodytes
tctgttctcccactgc

SEQ ID NO: 269531 - DNA, 16 bp, P. troglodytes
tctgttctgttccact

SEQ ID NO: 269532 - DNA, 16 bp, P. troglodytes
tctgttctgttggtct

SEQ ID NO: 269533 - DNA, 16 bp, P. troglodytes
tctgttcttaacaagg

SEQ ID NO: 269534 - DNA, 16 bp, P. troglodytes
tctgttcttcagattg

SEQ ID NO: 269535 - DNA, 16 bp, P. troglodytes
tctgttcttcatttct

SEQ ID NO: 269536 - DNA, 16 bp, P. troglodytes
tctgttcttgcatgct

SEQ ID NO: 269537 - DNA, 16 bp, P. troglodytes
tctgttctttataaat

SEQ ID NO: 269538 - DNA, 16 bp, P. troglodytes
tctgttgattttttaa

SEQ ID NO: 269539 - DNA, 16 bp, P. troglodytes
tctgttgcaaaaaaaa

SEQ ID NO: 269540 - DNA, 16 bp, P. troglodytes
tctgttgcagtttgct

SEQ ID NO: 269541 - DNA, 16 bp, P. troglodytes
tctgttgccagcctgg

SEQ ID NO: 269542 - DNA, 16 bp, P. troglodytes
tctgttgcccaagatg

SEQ ID NO: 269543 - DNA, 16 bp, P. troglodytes
tctgttgcccacactg

SEQ ID NO: 269544 - DNA, 16 bp, P. troglodytes
tctgttgcccagaatg

SEQ ID NO: 269545 - DNA, 16 bp, P. troglodytes
tctgttgcctaaaaga

SEQ ID NO: 269546 - DNA, 16 bp, P. troglodytes
tctgttggacagcact

SEQ ID NO: 269547 - DNA, 16 bp, P. troglodytes
tctgttggcaggctgg

SEQ ID NO: 269548 - DNA, 16 bp, P. troglodytes
tctgttggtgggagtg

SEQ ID NO: 269549 - DNA, 16 bp, P. troglodytes
tctgttgtttaagcca

SEQ ID NO: 269550 - DNA, 16 bp, P. troglodytes
tctgttgttttttaac

SEQ ID NO: 269551 - DNA, 16 bp, P. troglodytes
tctgtttaaaaaaata

SEQ ID NO: 269552 - DNA, 20 bp, P. troglodytes
tctgtttatatgctggatta

SEQ ID NO: 269553 - DNA, 16 bp, P. troglodytes
tctgtttattaaaaaa

SEQ ID NO: 269554 - DNA, 16 bp, P. troglodytes
tctgtttattcattta

SEQ ID NO: 269555 - DNA, 16 bp, P. troglodytes
tctgtttcaaaagaaa

SEQ ID NO: 269556 - DNA, 16 bp, P. troglodytes
tctgtttcacaacaat

SEQ ID NO: 269557 - DNA, 16 bp, P. troglodytes
tctgtttcccagggaa

SEQ ID NO: 269558 - DNA, 16 bp, P. troglodytes
tctgtttcctcagctg

SEQ ID NO: 269559 - DNA, 16 bp, P. troglodytes
tctgtttcctctgctg

SEQ ID NO: 269560 - DNA, 16 bp, P. troglodytes
tctgtttctaaataaa

SEQ ID NO: 269561 - DNA, 16 bp, P. troglodytes
tctgtttctctgcaga

SEQ ID NO: 269562 - DNA, 16 bp, P. troglodytes
tctgtttctctggtga

SEQ ID NO: 269563 - DNA, 16 bp, P. troglodytes
tctgtttctggacttt

SEQ ID NO: 269564 - DNA, 16 bp, P. troglodytes
tctgtttctgtgatgg

SEQ ID NO: 269565 - DNA, 16 bp, P. troglodytes
tctgtttcttcatctg

SEQ ID NO: 269566 - DNA, 16 bp, P. troglodytes
tctgtttgccagtatt

SEQ ID NO: 269567 - DNA, 16 bp, P. troglodytes
tctgtttgtctgtctg

SEQ ID NO: 269568 - DNA, 17 bp, P. troglodytes
tctgtttgtgtgatgaa

SEQ ID NO: 269569 - DNA, 16 bp, P. troglodytes
tctgttttatcagaga

SEQ ID NO: 269570 - DNA, 16 bp, P. troglodytes
tctgttttcagctctt

SEQ ID NO: 269571 - DNA, 16 bp, P. troglodytes
tctgttttcagtttca

SEQ ID NO: 269572 - DNA, 16 bp, P. troglodytes
tctgttttccttttaa

SEQ ID NO: 269573 - DNA, 16 bp, P. troglodytes
tctgttttcttcatta

SEQ ID NO: 269574 - DNA, 16 bp, P. troglodytes
tctgttttggaaccag

SEQ ID NO: 269575 - DNA, 16 bp, P. troglodytes
tctgttttgggctggg

SEQ ID NO: 269576 - DNA, 16 bp, P. troglodytes
tctgttttgttcatct

SEQ ID NO: 269577 - DNA, 16 bp, P. troglodytes
tctgttttgttccatt

SEQ ID NO: 269578 - DNA, 16 bp, P. troglodytes
tctgtttttcctttca

SEQ ID NO: 269579 - DNA, 16 bp, P. troglodytes
tctgtttttgtaccag

SEQ ID NO: 269580 - DNA, 16 bp, P. troglodytes
tctgttttttataaat

SEQ ID NO: 269581 - DNA, 16 bp, P. troglodytes
tctgttttttccctat

SEQ ID NO: 269582 - DNA, 16 bp, P. troglodytes
tcttaaaaagaacaaa

SEQ ID NO: 269583 - DNA, 16 bp, P. troglodytes
tcttaaaaagttattt

SEQ ID NO: 269584 - DNA, 16 bp, P. troglodytes
tcttaaaaattaaagt

SEQ ID NO: 269585 - DNA, 16 bp, P. troglodytes
tcttaaaaatttgaaa

SEQ ID NO: 269586 - DNA, 16 bp, P. troglodytes
tcttaaaagttatttt

SEQ ID NO: 269587 - DNA, 16 bp, P. troglodytes
tcttaaaatagttttt

SEQ ID NO: 269588 - DNA, 16 bp, P. troglodytes
tcttaaaatatgtttt

SEQ ID NO: 269589 - DNA, 16 bp, P. troglodytes
tcttaaaatgattttt

SEQ ID NO: 269590 - DNA, 16 bp, P. troglodytes
tcttaaaatgttattt

SEQ ID NO: 269591 - DNA, 16 bp, P. troglodytes
tcttaaagaagaaaaa

SEQ ID NO: 269592 - DNA, 16 bp, P. troglodytes
tcttaaagaattagaa

SEQ ID NO: 269593 - DNA, 18 bp, P. troglodytes
tcttaaagatggtgtgtc

SEQ ID NO: 269594 - DNA, 16 bp, P. troglodytes
tcttaaagctctaaaa

SEQ ID NO: 269595 - DNA, 16 bp, P. troglodytes
tcttaaagtatatttt

SEQ ID NO: 269596 - DNA, 16 bp, P. troglodytes
tcttaaatgttatttt

SEQ ID NO: 269597 - DNA, 16 bp, P. troglodytes
tcttaaatgttctcac

SEQ ID NO: 269598 - DNA, 16 bp, P. troglodytes
tcttaaatttctgcaa

SEQ ID NO: 269599 - DNA, 16 bp, P. troglodytes
tcttaaatttgtattt

SEQ ID NO: 269600 - DNA, 16 bp, P. troglodytes
tcttaacaagcatgct

SEQ ID NO: 269601 - DNA, 16 bp, P. troglodytes
tcttaacattgtcttt

SEQ ID NO: 269602 - DNA, 16 bp, P. troglodytes
tcttaaccactgtgtt

SEQ ID NO: 269603 - DNA, 16 bp, P. troglodytes
tcttaaccattttaaa

SEQ ID NO: 269604 - DNA, 16 bp, P. troglodytes
tcttaactaattacat

SEQ ID NO: 269605 - DNA, 16 bp, P. troglodytes
tcttaactattgtgaa

SEQ ID NO: 269606 - DNA, 16 bp, P. troglodytes
tcttaactcctgggct

SEQ ID NO: 269607 - DNA, 16 bp, P. troglodytes
tcttaacttccagttc

SEQ ID NO: 269608 - DNA, 16 bp, P. troglodytes
tcttaagaaataaaat

SEQ ID NO: 269609 - DNA, 16 bp, P. troglodytes
tcttaaggccttcaac

SEQ ID NO: 269610 - DNA, 16 bp, P. troglodytes
tcttaagtgtacagtt

SEQ ID NO: 269611 - DNA, 16 bp, P. troglodytes
tcttaagttttaaatt

SEQ ID NO: 269612 - DNA, 16 bp, P. troglodytes
tcttaataaaattaca

SEQ ID NO: 269613 - DNA, 16 bp, P. troglodytes
tcttaatactgttaca

SEQ ID NO: 269614 - DNA, 16 bp, P. troglodytes
tcttaatggtgtcttt

SEQ ID NO: 269615 - DNA, 16 bp, P. troglodytes
tcttaattggaaatga

SEQ ID NO: 269616 - DNA, 16 bp, P. troglodytes
tcttaatttttaaaga

SEQ ID NO: 269617 - DNA, 16 bp, P. troglodytes
tcttacagttctggag

SEQ ID NO: 269618 - DNA, 16 bp, P. troglodytes
tcttacatatactgat

SEQ ID NO: 269619 - DNA, 16 bp, P. troglodytes
tcttacatatattgat

SEQ ID NO: 269620 - DNA, 16 bp, P. troglodytes
tcttacatggtggcag

SEQ ID NO: 269621 - DNA, 16 bp, P. troglodytes
tcttacatttatatct

SEQ ID NO: 269622 - DNA, 16 bp, P. troglodytes
tcttacatttattgag

SEQ ID NO: 269623 - DNA, 16 bp, P. troglodytes
tcttacctggcagcag

SEQ ID NO: 269624 - DNA, 17 bp, P. troglodytes
tcttactatattgccca

SEQ ID NO: 269625 - DNA, 16 bp, P. troglodytes
tcttactgatttattt

SEQ ID NO: 269626 - DNA, 16 bp, P. troglodytes
tcttactgtgttgtcc

SEQ ID NO: 269627 - DNA, 16 bp, P. troglodytes
tcttagaaaaaaacat

SEQ ID NO: 269628 - DNA, 16 bp, P. troglodytes
tcttagaaagaaacat

SEQ ID NO: 269629 - DNA, 16 bp, P. troglodytes
tcttagaagaaaacag

SEQ ID NO: 269630 - DNA, 16 bp, P. troglodytes
tcttagaagaaaacct

SEQ ID NO: 269631 - DNA, 16 bp, P. troglodytes
tcttagaagaaaatat

SEQ ID NO: 269632 - DNA, 16 bp, P. troglodytes
tcttagaagaaaatgt

SEQ ID NO: 269633 - DNA, 16 bp, P. troglodytes
tcttagaagaagacat

SEQ ID NO: 269634 - DNA, 16 bp, P. troglodytes
tcttagatttaggtct

SEQ ID NO: 269635 - DNA, 16 bp, P. troglodytes
tcttagatttgatgaa

SEQ ID NO: 269636 - DNA, 16 bp, P. troglodytes
tcttagcaaatttcaa

SEQ ID NO: 269637 - DNA, 16 bp, P. troglodytes
tcttagcctcagtttc

SEQ ID NO: 269638 - DNA, 16 bp, P. troglodytes
tcttagctacttggga

SEQ ID NO: 269639 - DNA, 17 bp, P. troglodytes
tcttagcttgctgggct

SEQ ID NO: 269640 - DNA, 16 bp, P. troglodytes
tcttaggaaaaaaaaa

SEQ ID NO: 269641 - DNA, 16 bp, P. troglodytes
tcttaggaggaaaaaa

SEQ ID NO: 269642 - DNA, 16 bp, P. troglodytes
tcttaggggaaaaaaa

SEQ ID NO: 269643 - DNA, 16 bp, P. troglodytes
tcttaggtcaggagtt

SEQ ID NO: 269644 - DNA, 16 bp, P. troglodytes
tcttagtccatttgtg

SEQ ID NO: 269645 - DNA, 16 bp, P. troglodytes
tcttagtccattttct

SEQ ID NO: 269646 - DNA, 16 bp, P. troglodytes
tcttagtctaggtaga

SEQ ID NO: 269647 - DNA, 16 bp, P. troglodytes
tcttagtttccttgca

SEQ ID NO: 269648 - DNA, 16 bp, P. troglodytes
tcttagtttctgtttc

SEQ ID NO: 269649 - DNA, 16 bp, P. troglodytes
tcttagtttttaacaa

SEQ ID NO: 269650 - DNA, 16 bp, P. troglodytes
tcttatacctcagcct

SEQ ID NO: 269651 - DNA, 16 bp, P. troglodytes
tcttatagtttgaggt

SEQ ID NO: 269652 - DNA, 16 bp, P. troglodytes
tcttatataaaatctc

SEQ ID NO: 269653 - DNA, 16 bp, P. troglodytes
tcttatatatggaaaa

SEQ ID NO: 269654 - DNA, 16 bp, P. troglodytes
tcttatcattcatgtg

SEQ ID NO: 269655 - DNA, 16 bp, P. troglodytes
tcttatccaaaatgct

SEQ ID NO: 269656 - DNA, 16 bp, P. troglodytes
tcttatgccagtcaga

SEQ ID NO: 269657 - DNA, 16 bp, P. troglodytes
tcttatgccagttttc

SEQ ID NO: 269658 - DNA, 16 bp, P. troglodytes
tcttatttaaagaaaa

SEQ ID NO: 269659 - DNA, 16 bp, P. troglodytes
tcttatttcacttaac

SEQ ID NO: 269660 - DNA, 16 bp, P. troglodytes
tcttatttcatcttca

SEQ ID NO: 269661 - DNA, 16 bp, P. troglodytes
tcttatttggagaaat

SEQ ID NO: 269662 - DNA, 16 bp, P. troglodytes
tcttattttaaaatac

SEQ ID NO: 269663 - DNA, 16 bp, P. troglodytes
tcttattttaaagata

SEQ ID NO: 269664 - DNA, 16 bp, P. troglodytes
tcttattttatgaaat

SEQ ID NO: 269665 - DNA, 16 bp, P. troglodytes
tcttattttgaaaagt

SEQ ID NO: 269666 - DNA, 16 bp, P. troglodytes
tcttattttgagaaat

SEQ ID NO: 269667 - DNA, 16 bp, P. troglodytes
tcttatttttaatgta

SEQ ID NO: 269668 - DNA, 16 bp, P. troglodytes
tcttcaaaaatgaaga

SEQ ID NO: 269669 - DNA, 16 bp, P. troglodytes
tcttcaaaaatgtcaa

SEQ ID NO: 269670 - DNA, 16 bp, P. troglodytes
tcttcaaaaatgtcag

SEQ ID NO: 269671 - DNA, 16 bp, P. troglodytes
tcttcaaacatttttt

SEQ ID NO: 269672 - DNA, 16 bp, P. troglodytes
tcttcaaagaaaaaaa

SEQ ID NO: 269673 - DNA, 16 bp, P. troglodytes
tcttcaaagccagcag

SEQ ID NO: 269674 - DNA, 16 bp, P. troglodytes
tcttcaaagtcagcag

SEQ ID NO: 269675 - DNA, 16 bp, P. troglodytes
tcttcaaatattgttt

SEQ ID NO: 269676 - DNA, 16 bp, P. troglodytes
tcttcaaatatttgga

SEQ ID NO: 269677 - DNA, 16 bp, P. troglodytes
tcttcaaatcaactca

SEQ ID NO: 269678 - DNA, 20 bp, P. troglodytes
tcttcaaatggagccccaga

SEQ ID NO: 269679 - DNA, 16 bp, P. troglodytes
tcttcaacaaagttga

SEQ ID NO: 269680 - DNA, 16 bp, P. troglodytes
tcttcaacatcatctt

SEQ ID NO: 269681 - DNA, 16 bp, P. troglodytes
tcttcaagagacctat

SEQ ID NO: 269682 - DNA, 16 bp, P. troglodytes
tcttcaagatcctgct

SEQ ID NO: 269683 - DNA, 16 bp, P. troglodytes
tcttcaagcatctcaa

SEQ ID NO: 269684 - DNA, 16 bp, P. troglodytes
tcttcaagctgtcaga

SEQ ID NO: 269685 - DNA, 28 bp, P. troglodytes
tcttcaaggagaactacaaaccactgct

SEQ ID NO: 269686 - DNA, 30 bp, P. troglodytes
tcttcaaggagaactacaaaccactgctca

SEQ ID NO: 269687 - DNA, 30 bp, P. troglodytes
tcttcaaggagaactacaaaccgctgctca

SEQ ID NO: 269688 - DNA, 21 bp, P. troglodytes
tcttcaaggagaactacaaat

SEQ ID NO: 269689 - DNA, 16 bp, P. troglodytes
tcttcaaggagaactg

SEQ ID NO: 269690 - DNA, 16 bp, P. troglodytes
tcttcaaggatgcagg

SEQ ID NO: 269691 - DNA, 16 bp, P. troglodytes
tcttcaagttcacaga

SEQ ID NO: 269692 - DNA, 16 bp, P. troglodytes
tcttcaagttcactaa

SEQ ID NO: 269693 - DNA, 16 bp, P. troglodytes
tcttcaataaatgata

SEQ ID NO: 269694 - DNA, 16 bp, P. troglodytes
tcttcaatacactgat

SEQ ID NO: 269695 - DNA, 16 bp, P. troglodytes
tcttcaatagttttac

SEQ ID NO: 269696 - DNA, 16 bp, P. troglodytes
tcttcaatttctttca

SEQ ID NO: 269697 - DNA, 16 bp, P. troglodytes
tcttcacaagatggca

SEQ ID NO: 269698 - DNA, 16 bp, P. troglodytes
tcttcacaatagccaa

SEQ ID NO: 269699 - DNA, 16 bp, P. troglodytes
tcttcacaggatggca

SEQ ID NO: 269700 - DNA, 16 bp, P. troglodytes
tcttcacatagttctc

SEQ ID NO: 269701 - DNA, 16 bp, P. troglodytes
tcttcacatggtcatc

SEQ ID NO: 269702 - DNA, 16 bp, P. troglodytes
tcttcacattaaaact

SEQ ID NO: 269703 - DNA, 16 bp, P. troglodytes
tcttcacattgtcttt

SEQ ID NO: 269704 - DNA, 16 bp, P. troglodytes
tcttcaccttccgcca

SEQ ID NO: 269705 - DNA, 16 bp, P. troglodytes
tcttcaccttgctcac

SEQ ID NO: 269706 - DNA, 16 bp, P. troglodytes
tcttcactgctgaatt

SEQ ID NO: 269707 - DNA, 16 bp, P. troglodytes
tcttcactttttaata

SEQ ID NO: 269708 - DNA, 16 bp, P. troglodytes
tcttcagaaaaacaaa

SEQ ID NO: 269709 - DNA, 16 bp, P. troglodytes
tcttcagaattgtcag

SEQ ID NO: 269710 - DNA, 16 bp, P. troglodytes
tcttcagactccactt

SEQ ID NO: 269711 - DNA, 16 bp, P. troglodytes
tcttcagagaaaaaaa

SEQ ID NO: 269712 - DNA, 16 bp, P. troglodytes
tcttcagagaaacaga

SEQ ID NO: 269713 - DNA, 16 bp, P. troglodytes
tcttcagagctgtgag

SEQ ID NO: 269714 - DNA, 16 bp, P. troglodytes
tcttcagataaattct

SEQ ID NO: 269715 - DNA, 16 bp, P. troglodytes
tcttcagattcaatgc

SEQ ID NO: 269716 - DNA, 16 bp, P. troglodytes
tcttcagccatgtgga

SEQ ID NO: 269717 - DNA, 16 bp, P. troglodytes
tcttcagcttcctcaa

SEQ ID NO: 269718 - DNA, 16 bp, P. troglodytes
tcttcagctttgggac

SEQ ID NO: 269719 - DNA, 16 bp, P. troglodytes
tcttcaggaagaagaa

SEQ ID NO: 269720 - DNA, 16 bp, P. troglodytes
tcttcagggagaacta

SEQ ID NO: 269721 - DNA, 16 bp, P. troglodytes
tcttcagtgtcttctt

SEQ ID NO: 269722 - DNA, 16 bp, P. troglodytes
tcttcagtttcttcat

SEQ ID NO: 269723 - DNA, 16 bp, P. troglodytes
tcttcagttttctcat

SEQ ID NO: 269724 - DNA, 16 bp, P. troglodytes
tcttcagttttctgga

SEQ ID NO: 269725 - DNA, 16 bp, P. troglodytes
tcttcatatggtggca

SEQ ID NO: 269726 - DNA, 16 bp, P. troglodytes
tcttcatcaccatcat

SEQ ID NO: 269727 - DNA, 16 bp, P. troglodytes
tcttcatcatcatcat

SEQ ID NO: 269728 - DNA, 16 bp, P. troglodytes
tcttcatcctcatctt

SEQ ID NO: 269729 - DNA, 16 bp, P. troglodytes
tcttcatcctcattgt

SEQ ID NO: 269730 - DNA, 16 bp, P. troglodytes
tcttcatccttatcct

SEQ ID NO: 269731 - DNA, 16 bp, P. troglodytes
tcttcatctgcaaaat

SEQ ID NO: 269732 - DNA, 16 bp, P. troglodytes
tcttcatctgtgaaaa

SEQ ID NO: 269733 - DNA, 16 bp, P. troglodytes
tcttcatcttgtaaaa

SEQ ID NO: 269734 - DNA, 16 bp, P. troglodytes
tcttcatctttgtctt

SEQ ID NO: 269735 - DNA, 16 bp, P. troglodytes
tcttcatgaaatattt

SEQ ID NO: 269736 - DNA, 16 bp, P. troglodytes
tcttcatgaagaagaa

SEQ ID NO: 269737 - DNA, 16 bp, P. troglodytes
tcttcatgctgctgat

SEQ ID NO: 269738 - DNA, 16 bp, P. troglodytes
tcttcatggtccagga

SEQ ID NO: 269739 - DNA, 16 bp, P. troglodytes
tcttcatgtggcagca

SEQ ID NO: 269740 - DNA, 16 bp, P. troglodytes
tcttcattggagaaat

SEQ ID NO: 269741 - DNA, 16 bp, P. troglodytes
tcttcatttctctggg

SEQ ID NO: 269742 - DNA, 16 bp, P. troglodytes
tcttcatttctgaaat

SEQ ID NO: 269743 - DNA, 16 bp, P. troglodytes
tcttcatttcttaaaa

SEQ ID NO: 269744 - DNA, 16 bp, P. troglodytes
tcttcattttacatat

SEQ ID NO: 269745 - DNA, 16 bp, P. troglodytes
tcttcattttataaaa

SEQ ID NO: 269746 - DNA, 16 bp, P. troglodytes
tcttcattttattgat

SEQ ID NO: 269747 - DNA, 16 bp, P. troglodytes
tcttcatttttaaaga

SEQ ID NO: 269748 - DNA, 16 bp, P. troglodytes
tcttccaaaaattaaa

SEQ ID NO: 269749 - DNA, 16 bp, P. troglodytes
tcttccaaaactgaaa

SEQ ID NO: 269750 - DNA, 16 bp, P. troglodytes
tcttccaaagtagctg

SEQ ID NO: 269751 - DNA, 16 bp, P. troglodytes
tcttccaatacatgaa

SEQ ID NO: 269752 - DNA, 16 bp, P. troglodytes
tcttccacaatgactg

SEQ ID NO: 269753 - DNA, 16 bp, P. troglodytes
tcttccacctctgcct

SEQ ID NO: 269754 - DNA, 16 bp, P. troglodytes
tcttccactgtggccc

SEQ ID NO: 269755 - DNA, 16 bp, P. troglodytes
tcttccagaaaagaaa

SEQ ID NO: 269756 - DNA, 16 bp, P. troglodytes
tcttccagaaaataaa

SEQ ID NO: 269757 - DNA, 16 bp, P. troglodytes
tcttccagacaatgaa

SEQ ID NO: 269758 - DNA, 16 bp, P. troglodytes
tcttccagacagaaaa

SEQ ID NO: 269759 - DNA, 16 bp, P. troglodytes
tcttccagcctccaga

SEQ ID NO: 269760 - DNA, 16 bp, P. troglodytes
tcttccagcctctacc

SEQ ID NO: 269761 - DNA, 16 bp, P. troglodytes
tcttccaggctttggt

SEQ ID NO: 269762 - DNA, 16 bp, P. troglodytes
tcttccagggttttta

SEQ ID NO: 269763 - DNA, 16 bp, P. troglodytes
tcttccaggttttcca

SEQ ID NO: 269764 - DNA, 16 bp, P. troglodytes
tcttccagttctggag

SEQ ID NO: 269765 - DNA, 16 bp, P. troglodytes
tcttccatcttaaaaa

SEQ ID NO: 269766 - DNA, 16 bp, P. troglodytes
tcttccattagaatgc

SEQ ID NO: 269767 - DNA, 16 bp, P. troglodytes
tcttccatttgtttgt

SEQ ID NO: 269768 - DNA, 16 bp, P. troglodytes
tcttcccaaagtgctg

SEQ ID NO: 269769 - DNA, 16 bp, P. troglodytes
tcttcccaccctggcc

SEQ ID NO: 269770 - DNA, 16 bp, P. troglodytes
tcttcccactgcttct

SEQ ID NO: 269771 - DNA, 16 bp, P. troglodytes
tcttcccagatgctgg

SEQ ID NO: 269772 - DNA, 16 bp, P. troglodytes
tcttcccagctcagcc

SEQ ID NO: 269773 - DNA, 16 bp, P. troglodytes
tcttcccagtcttgga

SEQ ID NO: 269774 - DNA, 16 bp, P. troglodytes
tcttcccatccatgaa

SEQ ID NO: 269775 - DNA, 16 bp, P. troglodytes
tcttcccatcttggcc

SEQ ID NO: 269776 - DNA, 16 bp, P. troglodytes
tcttccccaggctgga

SEQ ID NO: 269777 - DNA, 16 bp, P. troglodytes
tcttcccctggagttt

SEQ ID NO: 269778 - DNA, 16 bp, P. troglodytes
tcttccctcagcctcc

SEQ ID NO: 269779 - DNA, 16 bp, P. troglodytes
tcttccctgtgctgtt

SEQ ID NO: 269780 - DNA, 16 bp, P. troglodytes
tcttccctttctacat

SEQ ID NO: 269781 - DNA, 16 bp, P. troglodytes
tcttccgtctcagcct

SEQ ID NO: 269782 - DNA, 16 bp, P. troglodytes
tcttcctactgcccat

SEQ ID NO: 269783 - DNA, 16 bp, P. troglodytes
tcttcctatctcagcc

SEQ ID NO: 269784 - DNA, 16 bp, P. troglodytes
tcttcctatctgaata

SEQ ID NO: 269785 - DNA, 16 bp, P. troglodytes
tcttcctcctctgcca

SEQ ID NO: 269786 - DNA, 16 bp, P. troglodytes
tcttcctctggaagct

SEQ ID NO: 269787 - DNA, 16 bp, P. troglodytes
tcttcctgcctcagct

SEQ ID NO: 269788 - DNA, 16 bp, P. troglodytes
tcttcctgcctggaat

SEQ ID NO: 269789 - DNA, 16 bp, P. troglodytes
tcttcctgcctttgcc

SEQ ID NO: 269790 - DNA, 16 bp, P. troglodytes
tcttcctgctgctgct

SEQ ID NO: 269791 - DNA, 16 bp, P. troglodytes
tcttcctgcttccacc

SEQ ID NO: 269792 - DNA, 16 bp, P. troglodytes
tcttcctgcttctgct

SEQ ID NO: 269793 - DNA, 16 bp, P. troglodytes
tcttcctggcctgcag

SEQ ID NO: 269794 - DNA, 16 bp, P. troglodytes
tcttcctggcttacag

SEQ ID NO: 269795 - DNA, 16 bp, P. troglodytes
tcttcctgggtctcaa

SEQ ID NO: 269796 - DNA, 16 bp, P. troglodytes
tcttcctggttcaatc

SEQ ID NO: 269797 - DNA, 16 bp, P. troglodytes
tcttcctgtgttaatt

SEQ ID NO: 269798 - DNA, 16 bp, P. troglodytes
tcttccttgaagaaat

SEQ ID NO: 269799 - DNA, 16 bp, P. troglodytes
tcttcctttcagtgaa

SEQ ID NO: 269800 - DNA, 16 bp, P. troglodytes
tcttcctttctgattt

SEQ ID NO: 269801 - DNA, 16 bp, P. troglodytes
tcttcctttctttaaa

SEQ ID NO: 269802 - DNA, 16 bp, P. troglodytes
tcttccttttaaaaaa

SEQ ID NO: 269803 - DNA, 16 bp, P. troglodytes
tcttcctttttaataa

SEQ ID NO: 269804 - DNA, 16 bp, P. troglodytes
tcttctaaatatacaa

SEQ ID NO: 269805 - DNA, 16 bp, P. troglodytes
tcttctacctctgcca

SEQ ID NO: 269806 - DNA, 16 bp, P. troglodytes
tcttctactttaaaaa

SEQ ID NO: 269807 - DNA, 16 bp, P. troglodytes
tcttctagaagttgta

SEQ ID NO: 269808 - DNA, 16 bp, P. troglodytes
tcttctaggttttcta

SEQ ID NO: 269809 - DNA, 16 bp, P. troglodytes
tcttctcaaggagtgt

SEQ ID NO: 269810 - DNA, 16 bp, P. troglodytes
tcttctcagaccacag

SEQ ID NO: 269811 - DNA, 16 bp, P. troglodytes
tcttctcagcaacaca

SEQ ID NO: 269812 - DNA, 16 bp, P. troglodytes
tcttctcatttttctg

SEQ ID NO: 269813 - DNA, 16 bp, P. troglodytes
tcttctccaaaggatc

SEQ ID NO: 269814 - DNA, 16 bp, P. troglodytes
tcttctccagcacctg

SEQ ID NO: 269815 - DNA, 16 bp, P. troglodytes
tcttctccatctcagt

SEQ ID NO: 269816 - DNA, 16 bp, P. troglodytes
tcttctccatctgaga

SEQ ID NO: 269817 - DNA, 16 bp, P. troglodytes
tcttctccctgtgtcc

SEQ ID NO: 269818 - DNA, 16 bp, P. troglodytes
tcttctccttctggga

SEQ ID NO: 269819 - DNA, 16 bp, P. troglodytes
tcttctccttgctgct

SEQ ID NO: 269820 - DNA, 16 bp, P. troglodytes
tcttctctctgctctg

SEQ ID NO: 269821 - DNA, 16 bp, P. troglodytes
tcttctctgatcacaa

SEQ ID NO: 269822 - DNA, 16 bp, P. troglodytes
tcttctctgtatgtca

SEQ ID NO: 269823 - DNA, 16 bp, P. troglodytes
tcttctgaaagagatt

SEQ ID NO: 269824 - DNA, 16 bp, P. troglodytes
tcttctgagccctcca

SEQ ID NO: 269825 - DNA, 16 bp, P. troglodytes
tcttctgattttaaaa

SEQ ID NO: 269826 - DNA, 16 bp, P. troglodytes
tcttctgcagcttcct

SEQ ID NO: 269827 - DNA, 16 bp, P. troglodytes
tcttctgcatattgct

SEQ ID NO: 269828 - DNA, 16 bp, P. troglodytes
tcttctgcatgtggtt

SEQ ID NO: 269829 - DNA, 16 bp, P. troglodytes
tcttctgccactgcca

SEQ ID NO: 269830 - DNA, 16 bp, P. troglodytes
tcttctgccagttcaa

SEQ ID NO: 269831 - DNA, 16 bp, P. troglodytes
tcttctgcctatgagc

SEQ ID NO: 269832 - DNA, 16 bp, P. troglodytes
tcttctgcctcaccct

SEQ ID NO: 269833 - DNA, 17 bp, P. troglodytes
tcttctgcctcagcttc

SEQ ID NO: 269834 - DNA, 16 bp, P. troglodytes
tcttctgcctctgcct

SEQ ID NO: 269835 - DNA, 16 bp, P. troglodytes
tcttctgcctgtctgt

SEQ ID NO: 269836 - DNA, 16 bp, P. troglodytes
tcttctgccttctgcc

SEQ ID NO: 269837 - DNA, 16 bp, P. troglodytes
tcttctgcgtggctca

SEQ ID NO: 269838 - DNA, 16 bp, P. troglodytes
tcttctgctaggtttg

SEQ ID NO: 269839 - DNA, 16 bp, P. troglodytes
tcttctgcttaccttt

SEQ ID NO: 269840 - DNA, 16 bp, P. troglodytes
tcttctggaagctctg

SEQ ID NO: 269841 - DNA, 16 bp, P. troglodytes
tcttctggaatacctt

SEQ ID NO: 269842 - DNA, 16 bp, P. troglodytes
tcttctggaattttta

SEQ ID NO: 269843 - DNA, 17 bp, P. troglodytes
tcttctggatctagcca

SEQ ID NO: 269844 - DNA, 16 bp, P. troglodytes
tcttctggcttccctg

SEQ ID NO: 269845 - DNA, 16 bp, P. troglodytes
tcttctggggaggcct

SEQ ID NO: 269846 - DNA, 16 bp, P. troglodytes
tcttctgtgcctcagt

SEQ ID NO: 269847 - DNA, 16 bp, P. troglodytes
tcttctgttcctgggt

SEQ ID NO: 269848 - DNA, 16 bp, P. troglodytes
tcttctgttttccatt

SEQ ID NO: 269849 - DNA, 16 bp, P. troglodytes
tcttcttaaaatgttt

SEQ ID NO: 269850 - DNA, 16 bp, P. troglodytes
tcttcttataaagaca

SEQ ID NO: 269851 - DNA, 16 bp, P. troglodytes
tcttcttattgatttc

SEQ ID NO: 269852 - DNA, 16 bp, P. troglodytes
tcttcttcagcttcct

SEQ ID NO: 269853 - DNA, 16 bp, P. troglodytes
tcttcttcagtgaaat

SEQ ID NO: 269854 - DNA, 16 bp, P. troglodytes
tcttcttcatttctga

SEQ ID NO: 269855 - DNA, 16 bp, P. troglodytes
tcttcttccagtgtgg

SEQ ID NO: 269856 - DNA, 16 bp, P. troglodytes
tcttcttccagttctc

SEQ ID NO: 269857 - DNA, 16 bp, P. troglodytes
tcttcttcctcaggaa

SEQ ID NO: 269858 - DNA, 16 bp, P. troglodytes
tcttcttcctctgtgg

SEQ ID NO: 269859 - DNA, 16 bp, P. troglodytes
tcttcttccttaggaa

SEQ ID NO: 269860 - DNA, 16 bp, P. troglodytes
tcttcttctgagccct

SEQ ID NO: 269861 - DNA, 16 bp, P. troglodytes
tcttcttctgctgctg

SEQ ID NO: 269862 - DNA, 16 bp, P. troglodytes
tcttcttgcctcagcc

SEQ ID NO: 269863 - DNA, 16 bp, P. troglodytes
tcttcttgctcaggct

SEQ ID NO: 269864 - DNA, 16 bp, P. troglodytes
tcttcttgctcattaa

SEQ ID NO: 269865 - DNA, 16 bp, P. troglodytes
tcttcttgctgctgcc

SEQ ID NO: 269866 - DNA, 16 bp, P. troglodytes
tcttcttggtattgat

SEQ ID NO: 269867 - DNA, 16 bp, P. troglodytes
tcttcttgtaaattta

SEQ ID NO: 269868 - DNA, 16 bp, P. troglodytes
tcttcttgtgagccct

SEQ ID NO: 269869 - DNA, 16 bp, P. troglodytes
tcttcttgtggagtat

SEQ ID NO: 269870 - DNA, 16 bp, P. troglodytes
tcttcttgttaaattg

SEQ ID NO: 269871 - DNA, 16 bp, P. troglodytes
tcttctttaagaatgt

SEQ ID NO: 269872 - DNA, 16 bp, P. troglodytes
tcttctttctcagcct

SEQ ID NO: 269873 - DNA, 16 bp, P. troglodytes
tcttctttgtgtccat

SEQ ID NO: 269874 - DNA, 16 bp, P. troglodytes
tcttctttgttagtct

SEQ ID NO: 269875 - DNA, 16 bp, P. troglodytes
tcttcttttcagaatt

SEQ ID NO: 269876 - DNA, 16 bp, P. troglodytes
tcttcttttgggaaat

SEQ ID NO: 269877 - DNA, 16 bp, P. troglodytes
tcttcttttgtaaagt

SEQ ID NO: 269878 - DNA, 16 bp, P. troglodytes
tcttctttttatggct

SEQ ID NO: 269879 - DNA, 16 bp, P. troglodytes
tcttgaaaaaataaat

SEQ ID NO: 269880 - DNA, 16 bp, P. troglodytes
tcttgaaaaagaagaa

SEQ ID NO: 269881 - DNA, 16 bp, P. troglodytes
tcttgaaaataaataa

SEQ ID NO: 269882 - DNA, 16 bp, P. troglodytes
tcttgaaaatgaagaa

SEQ ID NO: 269883 - DNA, 16 bp, P. troglodytes
tcttgaaagaaattaa

SEQ ID NO: 269884 - DNA, 16 bp, P. troglodytes
tcttgaaagatatttt

SEQ ID NO: 269885 - DNA, 16 bp, P. troglodytes
tcttgaaatattttct

SEQ ID NO: 269886 - DNA, 16 bp, P. troglodytes
tcttgaaatcctgact

SEQ ID NO: 269887 - DNA, 16 bp, P. troglodytes
tcttgaaatttatttt

SEQ ID NO: 269888 - DNA, 17 bp, P. troglodytes
tcttgaactcccgacct

SEQ ID NO: 269889 - DNA, 16 bp, P. troglodytes
tcttgaactcctcctg

SEQ ID NO: 269890 - DNA, 16 bp, P. troglodytes
tcttgaactcctgagc

SEQ ID NO: 269891 - DNA, 18 bp, P. troglodytes
tcttgaactcttgacctt

SEQ ID NO: 269892 - DNA, 16 bp, P. troglodytes
tcttgaacttctaacc

SEQ ID NO: 269893 - DNA, 16 bp, P. troglodytes
tcttgaagtaaataaa

SEQ ID NO: 269894 - DNA, 16 bp, P. troglodytes
tcttgaatgctttact

SEQ ID NO: 269895 - DNA, 16 bp, P. troglodytes
tcttgaattctttgct

SEQ ID NO: 269896 - DNA, 16 bp, P. troglodytes
tcttgaattgtaactc

SEQ ID NO: 269897 - DNA, 16 bp, P. troglodytes
tcttgaatttctccaa

SEQ ID NO: 269898 - DNA, 16 bp, P. troglodytes
tcttgacacatgggga

SEQ ID NO: 269899 - DNA, 16 bp, P. troglodytes
tcttgacattttaaaa

SEQ ID NO: 269900 - DNA, 16 bp, P. troglodytes
tcttgactactgtagc

SEQ ID NO: 269901 - DNA, 16 bp, P. troglodytes
tcttgactcactgcaa

SEQ ID NO: 269902 - DNA, 16 bp, P. troglodytes
tcttgagaaagaaaaa

SEQ ID NO: 269903 - DNA, 16 bp, P. troglodytes
tcttgagaaagaagaa

SEQ ID NO: 269904 - DNA, 16 bp, P. troglodytes
tcttgagacaggatct

SEQ ID NO: 269905 - DNA, 16 bp, P. troglodytes
tcttgagacagggtct

SEQ ID NO: 269906 - DNA, 16 bp, P. troglodytes
tcttgagatttctttt

SEQ ID NO: 269907 - DNA, 17 bp, P. troglodytes
tcttgagctcaagcgat

SEQ ID NO: 269908 - DNA, 16 bp, P. troglodytes
tcttgagctcaggagt

SEQ ID NO: 269909 - DNA, 17 bp, P. troglodytes
tcttgaggaacctccaa

SEQ ID NO: 269910 - DNA, 16 bp, P. troglodytes
tcttgagggttttttt

SEQ ID NO: 269911 - DNA, 16 bp, P. troglodytes
tcttgagtaactggga

SEQ ID NO: 269912 - DNA, 16 bp, P. troglodytes
tcttgagttaatattt

SEQ ID NO: 269913 - DNA, 16 bp, P. troglodytes
tcttgagttcattttt

SEQ ID NO: 269914 - DNA, 16 bp, P. troglodytes
tcttgatcccacttgt

SEQ ID NO: 269915 - DNA, 17 bp, P. troglodytes
tcttgatctcctgacct

SEQ ID NO: 269916 - DNA, 16 bp, P. troglodytes
tcttgatctgctgacc

SEQ ID NO: 269917 - DNA, 16 bp, P. troglodytes
tcttgatttcttttca

SEQ ID NO: 269918 - DNA, 16 bp, P. troglodytes
tcttgattttggtggt

SEQ ID NO: 269919 - DNA, 16 bp, P. troglodytes
tcttgatttttgcctt

SEQ ID NO: 269920 - DNA, 16 bp, P. troglodytes
tcttgcaaaactgaaa

SEQ ID NO: 269921 - DNA, 16 bp, P. troglodytes
tcttgcaaatttgttt

SEQ ID NO: 269922 - DNA, 16 bp, P. troglodytes
tcttgcatttttagta

SEQ ID NO: 269923 - DNA, 16 bp, P. troglodytes
tcttgccaaaaatatt

SEQ ID NO: 269924 - DNA, 16 bp, P. troglodytes
tcttgcccaaattcct

SEQ ID NO: 269925 - DNA, 16 bp, P. troglodytes
tcttgcccaaggcctg

SEQ ID NO: 269926 - DNA, 16 bp, P. troglodytes
tcttgccctgtcgcca

SEQ ID NO: 269927 - DNA, 16 bp, P. troglodytes
tcttgcctagaactgg

SEQ ID NO: 269928 - DNA, 16 bp, P. troglodytes
tcttgcctcagccttc

SEQ ID NO: 269929 - DNA, 16 bp, P. troglodytes
tcttgcctcagtctcc

SEQ ID NO: 269930 - DNA, 16 bp, P. troglodytes
tcttgcctcagtgttg

SEQ ID NO: 269931 - DNA, 16 bp, P. troglodytes
tcttgcctcctgggtt

SEQ ID NO: 269932 - DNA, 16 bp, P. troglodytes
tcttgcctctctagct

SEQ ID NO: 269933 - DNA, 16 bp, P. troglodytes
tcttgccttcttttga

SEQ ID NO: 269934 - DNA, 16 bp, P. troglodytes
tcttgccttggcctcc

SEQ ID NO: 269935 - DNA, 16 bp, P. troglodytes
tcttgctaaaactgga

SEQ ID NO: 269936 - DNA, 16 bp, P. troglodytes
tcttgctacattgcct

SEQ ID NO: 269937 - DNA, 16 bp, P. troglodytes
tcttgctattgaattg

SEQ ID NO: 269938 - DNA, 16 bp, P. troglodytes
tcttgctcccactctc

SEQ ID NO: 269939 - DNA, 16 bp, P. troglodytes
tcttgctcctgttctc

SEQ ID NO: 269940 - DNA, 18 bp, P. troglodytes
tcttgctctgacgcccag

SEQ ID NO: 269941 - DNA, 16 bp, P. troglodytes
tcttgctctgtcacct

SEQ ID NO: 269942 - DNA, 16 bp, P. troglodytes
tcttgctctgtctctc

SEQ ID NO: 269943 - DNA, 16 bp, P. troglodytes
tcttgctctgtcttcc

SEQ ID NO: 269944 - DNA, 17 bp, P. troglodytes
tcttgctctgttgccca

SEQ ID NO: 269945 - DNA, 16 bp, P. troglodytes
tcttgctgcactttat

SEQ ID NO: 269946 - DNA, 16 bp, P. troglodytes
tcttgctgcagctgct

SEQ ID NO: 269947 - DNA, 16 bp, P. troglodytes
tcttgctgcatcataa

SEQ ID NO: 269948 - DNA, 16 bp, P. troglodytes
tcttgctgctgccatg

SEQ ID NO: 269949 - DNA, 16 bp, P. troglodytes
tcttgctgctgctcag

SEQ ID NO: 269950 - DNA, 16 bp, P. troglodytes
tcttgctgctgctgct

SEQ ID NO: 269951 - DNA, 16 bp, P. troglodytes
tcttgctgtcttctgt

SEQ ID NO: 269952 - DNA, 16 bp, P. troglodytes
tcttgctgtgtcatcc

SEQ ID NO: 269953 - DNA, 16 bp, P. troglodytes
tcttgctgtttcccag

SEQ ID NO: 269954 - DNA, 16 bp, P. troglodytes
tcttgcttaactgaaa

SEQ ID NO: 269955 - DNA, 16 bp, P. troglodytes
tcttgcttctctagct

SEQ ID NO: 269956 - DNA, 16 bp, P. troglodytes
tcttgcttctttcatt

SEQ ID NO: 269957 - DNA, 16 bp, P. troglodytes
tcttggaaaaacaaaa

SEQ ID NO: 269958 - DNA, 16 bp, P. troglodytes
tcttggaacatattcc

SEQ ID NO: 269959 - DNA, 16 bp, P. troglodytes
tcttggacttccagac

SEQ ID NO: 269960 - DNA, 16 bp, P. troglodytes
tcttggagaaattcaa

SEQ ID NO: 269961 - DNA, 16 bp, P. troglodytes
tcttggagttgctttt

SEQ ID NO: 269962 - DNA, 16 bp, P. troglodytes
tcttggatatttcttc

SEQ ID NO: 269963 - DNA, 16 bp, P. troglodytes
tcttggcagaaggtga

SEQ ID NO: 269964 - DNA, 16 bp, P. troglodytes
tcttggccaacatgat

SEQ ID NO: 269965 - DNA, 16 bp, P. troglodytes
tcttggccacatgtat

SEQ ID NO: 269966 - DNA, 16 bp, P. troglodytes
tcttggcctcagtttt

SEQ ID NO: 269967 - DNA, 16 bp, P. troglodytes
tcttggcctcccatag

SEQ ID NO: 269968 - DNA, 16 bp, P. troglodytes
tcttggcctctctgag

SEQ ID NO: 269969 - DNA, 16 bp, P. troglodytes
tcttggctcactacag

SEQ ID NO: 269970 - DNA, 18 bp, P. troglodytes
tcttggctcactgcaact

SEQ ID NO: 269971 - DNA, 16 bp, P. troglodytes
tcttggctcactgtat

SEQ ID NO: 269972 - DNA, 16 bp, P. troglodytes
tcttggctcagcctcc

SEQ ID NO: 269973 - DNA, 16 bp, P. troglodytes
tcttggctcctcctcc

SEQ ID NO: 269974 - DNA, 16 bp, P. troglodytes
tcttggctgataattt

SEQ ID NO: 269975 - DNA, 16 bp, P. troglodytes
tcttggcttttgtgaa

SEQ ID NO: 269976 - DNA, 16 bp, P. troglodytes
tcttgggaattaacat

SEQ ID NO: 269977 - DNA, 16 bp, P. troglodytes
tcttgggagagtatat

SEQ ID NO: 269978 - DNA, 16 bp, P. troglodytes
tcttgggaggctgagg

SEQ ID NO: 269979 - DNA, 16 bp, P. troglodytes
tcttgggcaggctggt

SEQ ID NO: 269980 - DNA, 16 bp, P. troglodytes
tcttgggcttaagtga

SEQ ID NO: 269981 - DNA, 17 bp, P. troglodytes
tcttggggattaacatt

SEQ ID NO: 269982 - DNA, 16 bp, P. troglodytes
tcttggggtttttata

SEQ ID NO: 269983 - DNA, 16 bp, P. troglodytes
tcttgggtatgtacct

SEQ ID NO: 269984 - DNA, 16 bp, P. troglodytes
tcttggtagtgaataa

SEQ ID NO: 269985 - DNA, 16 bp, P. troglodytes
tcttggtgatgccctg

SEQ ID NO: 269986 - DNA, 16 bp, P. troglodytes
tcttggtgcctcagtt

SEQ ID NO: 269987 - DNA, 16 bp, P. troglodytes
tcttggtgtctgcttc

SEQ ID NO: 269988 - DNA, 16 bp, P. troglodytes
tcttggttctgccact

SEQ ID NO: 269989 - DNA, 16 bp, P. troglodytes
tcttgtaaatgtgttt

SEQ ID NO: 269990 - DNA, 16 bp, P. troglodytes
tcttgtaaattcattt

SEQ ID NO: 269991 - DNA, 16 bp, P. troglodytes
tcttgtaaatttcttt

SEQ ID NO: 269992 - DNA, 16 bp, P. troglodytes
tcttgtagagacagag

SEQ ID NO: 269993 - DNA, 16 bp, P. troglodytes
tcttgtaggatggaaa

SEQ ID NO: 269994 - DNA, 16 bp, P. troglodytes
tcttgtatttttaaaa

SEQ ID NO: 269995 - DNA, 16 bp, P. troglodytes
tcttgtcacacaacca

SEQ ID NO: 269996 - DNA, 16 bp, P. troglodytes
tcttgtcctttgtagg

SEQ ID NO: 269997 - DNA, 16 bp, P. troglodytes
tcttgtctaactgaaa

SEQ ID NO: 269998 - DNA, 16 bp, P. troglodytes
tcttgtctcagcctcc

SEQ ID NO: 269999 - DNA, 16 bp, P. troglodytes
tcttgtctcagtctcc

SEQ ID NO: 270000 - DNA, 16 bp, P. troglodytes
tcttgtcttctgctgg

SEQ ID NO: 270001 - DNA, 16 bp, P. troglodytes
tcttgtgaatttgttt

SEQ ID NO: 270002 - DNA, 16 bp, P. troglodytes
tcttgtgagggtgtat

SEQ ID NO: 270003 - DNA, 16 bp, P. troglodytes
tcttgtgatttttaaa

SEQ ID NO: 270004 - DNA, 16 bp, P. troglodytes
tcttgtggaagtgaaa

SEQ ID NO: 270005 - DNA, 16 bp, P. troglodytes
tcttgttaaaatgtag

SEQ ID NO: 270006 - DNA, 16 bp, P. troglodytes
tcttgttacttattat

SEQ ID NO: 270007 - DNA, 16 bp, P. troglodytes
tcttgttccaattctc

SEQ ID NO: 270008 - DNA, 16 bp, P. troglodytes
tcttgttccatttctt

SEQ ID NO: 270009 - DNA, 16 bp, P. troglodytes
tcttgttgcccagcct

SEQ ID NO: 270010 - DNA, 16 bp, P. troglodytes
tcttgtttgcttccaa

SEQ ID NO: 270011 - DNA, 16 bp, P. troglodytes
tcttgttttgcttgat

SEQ ID NO: 270012 - DNA, 16 bp, P. troglodytes
tcttgtttttggaatt

SEQ ID NO: 270013 - DNA, 16 bp, P. troglodytes
tctttaaaaaagaaaa

SEQ ID NO: 270014 - DNA, 16 bp, P. troglodytes
tctttaaaaagtattt

SEQ ID NO: 270015 - DNA, 16 bp, P. troglodytes
tctttaaaaagtcaaa

SEQ ID NO: 270016 - DNA, 16 bp, P. troglodytes
tctttaaaaataactt

SEQ ID NO: 270017 - DNA, 16 bp, P. troglodytes
tctttaaaaatgaatt

SEQ ID NO: 270018 - DNA, 16 bp, P. troglodytes
tctttaaaaatgtgaa

SEQ ID NO: 270019 - DNA, 16 bp, P. troglodytes
tctttaaaagaaaatt

SEQ ID NO: 270020 - DNA, 16 bp, P. troglodytes
tctttaaaataagaaa

SEQ ID NO: 270021 - DNA, 16 bp, P. troglodytes
tctttaaaatgtataa

SEQ ID NO: 270022 - DNA, 16 bp, P. troglodytes
tctttaaaatgtcatt

SEQ ID NO: 270023 - DNA, 16 bp, P. troglodytes
tctttaaaatgttttt

SEQ ID NO: 270024 - DNA, 16 bp, P. troglodytes
tctttaaagaaaaaaa

SEQ ID NO: 270025 - DNA, 16 bp, P. troglodytes
tctttaaagagaaaaa

SEQ ID NO: 270026 - DNA, 16 bp, P. troglodytes
tctttaaatacagtca

SEQ ID NO: 270027 - DNA, 16 bp, P. troglodytes
tctttaagaaaaacaa

SEQ ID NO: 270028 - DNA, 16 bp, P. troglodytes
tctttaagaaaatatt

SEQ ID NO: 270029 - DNA, 16 bp, P. troglodytes
tctttaagaaataaaa

SEQ ID NO: 270030 - DNA, 16 bp, P. troglodytes
tctttaagctgataag

SEQ ID NO: 270031 - DNA, 16 bp, P. troglodytes
tctttaatgcattttg

SEQ ID NO: 270032 - DNA, 16 bp, P. troglodytes
tctttacagaaaatgt

SEQ ID NO: 270033 - DNA, 16 bp, P. troglodytes
tctttactaaaaaata

SEQ ID NO: 270034 - DNA, 16 bp, P. troglodytes
tctttactaaaaatac

SEQ ID NO: 270035 - DNA, 17 bp, P. troglodytes
tctttactaaaaataca

SEQ ID NO: 270036 - DNA, 18 bp, P. troglodytes
tctttactaacaatacaa

SEQ ID NO: 270037 - DNA, 16 bp, P. troglodytes
tctttactcaaaatac

SEQ ID NO: 270038 - DNA, 16 bp, P. troglodytes
tctttactcattcatc

SEQ ID NO: 270039 - DNA, 16 bp, P. troglodytes
tctttactttttcaaa

SEQ ID NO: 270040 - DNA, 16 bp, P. troglodytes
tctttagatttttcta

SEQ ID NO: 270041 - DNA, 16 bp, P. troglodytes
tctttaggaaaaaaaa

SEQ ID NO: 270042 - DNA, 16 bp, P. troglodytes
tctttagtttaattaa

SEQ ID NO: 270043 - DNA, 16 bp, P. troglodytes
tctttagttttttcca

SEQ ID NO: 270044 - DNA, 16 bp, P. troglodytes
tctttatatattctgg

SEQ ID NO: 270045 - DNA, 16 bp, P. troglodytes
tctttatcagcatcat

SEQ ID NO: 270046 - DNA, 16 bp, P. troglodytes
tctttatccaatttgc

SEQ ID NO: 270047 - DNA, 16 bp, P. troglodytes
tctttatccagcccac

SEQ ID NO: 270048 - DNA, 16 bp, P. troglodytes
tctttatctctgtctt

SEQ ID NO: 270049 - DNA, 16 bp, P. troglodytes
tctttatctttgacct

SEQ ID NO: 270050 - DNA, 16 bp, P. troglodytes
tctttatgaccttgga

SEQ ID NO: 270051 - DNA, 16 bp, P. troglodytes
tctttatgtgtgtgtg

SEQ ID NO: 270052 - DNA, 16 bp, P. troglodytes
tctttattccattttg

SEQ ID NO: 270053 - DNA, 16 bp, P. troglodytes
tctttattcctgcctt

SEQ ID NO: 270054 - DNA, 16 bp, P. troglodytes
tctttatttcattaag

SEQ ID NO: 270055 - DNA, 16 bp, P. troglodytes
tctttatttgtaaaat

SEQ ID NO: 270056 - DNA, 16 bp, P. troglodytes
tctttattttgaatat

SEQ ID NO: 270057 - DNA, 16 bp, P. troglodytes
tctttatttttgaagg

SEQ ID NO: 270058 - DNA, 16 bp, P. troglodytes
tctttatttttgagac

SEQ ID NO: 270059 - DNA, 16 bp, P. troglodytes
tctttattttttgaaa

SEQ ID NO: 270060 - DNA, 16 bp, P. troglodytes
tctttcaaaatgaaaa

SEQ ID NO: 270061 - DNA, 16 bp, P. troglodytes
tctttcaaaatgtatt

SEQ ID NO: 270062 - DNA, 16 bp, P. troglodytes
tctttcaaacaaaaat

SEQ ID NO: 270063 - DNA, 16 bp, P. troglodytes
tctttcaaagagcaga

SEQ ID NO: 270064 - DNA, 16 bp, P. troglodytes
tctttcaccattaaat

SEQ ID NO: 270065 - DNA, 16 bp, P. troglodytes
tctttcactttttaaa

SEQ ID NO: 270066 - DNA, 16 bp, P. troglodytes
tctttcagaaaataaa

SEQ ID NO: 270067 - DNA, 16 bp, P. troglodytes
tctttcatcactttgt

SEQ ID NO: 270068 - DNA, 16 bp, P. troglodytes
tctttcatgctttctc

SEQ ID NO: 270069 - DNA, 16 bp, P. troglodytes
tctttcatgtattcat

SEQ ID NO: 270070 - DNA, 16 bp, P. troglodytes
tctttcattaaaaaat

SEQ ID NO: 270071 - DNA, 16 bp, P. troglodytes
tctttcattgctttgt

SEQ ID NO: 270072 - DNA, 16 bp, P. troglodytes
tctttcatttatgaag

SEQ ID NO: 270073 - DNA, 16 bp, P. troglodytes
tctttccaattctgtg

SEQ ID NO: 270074 - DNA, 16 bp, P. troglodytes
tctttccaccatgtga

SEQ ID NO: 270075 - DNA, 16 bp, P. troglodytes
tctttccagaaaaaaa

SEQ ID NO: 270076 - DNA, 16 bp, P. troglodytes
tctttccattatacca

SEQ ID NO: 270077 - DNA, 16 bp, P. troglodytes
tctttccattccttga

SEQ ID NO: 270078 - DNA, 16 bp, P. troglodytes
tctttccatttttgtg

SEQ ID NO: 270079 - DNA, 16 bp, P. troglodytes
tctttcccatctcagt

SEQ ID NO: 270080 - DNA, 16 bp, P. troglodytes
tctttcctctataaat

SEQ ID NO: 270081 - DNA, 16 bp, P. troglodytes
tctttcctctgtgtgt

SEQ ID NO: 270082 - DNA, 17 bp, P. troglodytes
tctttctacacagacac

SEQ ID NO: 270083 - DNA, 17 bp, P. troglodytes
tctttctacacagacat

SEQ ID NO: 270084 - DNA, 16 bp, P. troglodytes
tctttctacttctctg

SEQ ID NO: 270085 - DNA, 16 bp, P. troglodytes
tctttctagatttttg

SEQ ID NO: 270086 - DNA, 16 bp, P. troglodytes
tctttctcagtctttt

SEQ ID NO: 270087 - DNA, 16 bp, P. troglodytes
tctttctccaaaaaaa

SEQ ID NO: 270088 - DNA, 16 bp, P. troglodytes
tctttctcccatgctg

SEQ ID NO: 270089 - DNA, 16 bp, P. troglodytes
tctttctcctgctcca

SEQ ID NO: 270090 - DNA, 16 bp, P. troglodytes
tctttctctatggatt

SEQ ID NO: 270091 - DNA, 16 bp, P. troglodytes
tctttctctctgactc

SEQ ID NO: 270092 - DNA, 16 bp, P. troglodytes
tctttctctctgactt

SEQ ID NO: 270093 - DNA, 16 bp, P. troglodytes
tctttctcttccctga

SEQ ID NO: 270094 - DNA, 16 bp, P. troglodytes
tctttctgaaactatt

SEQ ID NO: 270095 - DNA, 16 bp, P. troglodytes
tctttctgatgctctc

SEQ ID NO: 270096 - DNA, 16 bp, P. troglodytes
tctttctgctctgcca

SEQ ID NO: 270097 - DNA, 16 bp, P. troglodytes
tctttctgggctctct

SEQ ID NO: 270098 - DNA, 16 bp, P. troglodytes
tctttctgtagagatg

SEQ ID NO: 270099 - DNA, 16 bp, P. troglodytes
tctttctgtccatgtg

SEQ ID NO: 270100 - DNA, 16 bp, P. troglodytes
tctttctgtctctgcc

SEQ ID NO: 270101 - DNA, 16 bp, P. troglodytes
tctttctgtttctcag

SEQ ID NO: 270102 - DNA, 16 bp, P. troglodytes
tctttcttcagctgtg

SEQ ID NO: 270103 - DNA, 16 bp, P. troglodytes
tctttcttctgaagag

SEQ ID NO: 270104 - DNA, 16 bp, P. troglodytes
tctttcttgcctgctg

SEQ ID NO: 270105 - DNA, 16 bp, P. troglodytes
tctttctttaaaagaa

SEQ ID NO: 270106 - DNA, 16 bp, P. troglodytes
tctttctttaaagaaa

SEQ ID NO: 270107 - DNA, 16 bp, P. troglodytes
tctttctttactgcaa

SEQ ID NO: 270108 - DNA, 16 bp, P. troglodytes
tctttctttctgaaat

SEQ ID NO: 270109 - DNA, 16 bp, P. troglodytes
tctttcttttgtaaat

SEQ ID NO: 270110 - DNA, 16 bp, P. troglodytes
tctttgaaaaacctga

SEQ ID NO: 270111 - DNA, 16 bp, P. troglodytes
tctttgaaaaataatt

SEQ ID NO: 270112 - DNA, 16 bp, P. troglodytes
tctttgaaaaatgaaa

SEQ ID NO: 270113 - DNA, 16 bp, P. troglodytes
tctttgaaaacatcaa

SEQ ID NO: 270114 - DNA, 16 bp, P. troglodytes
tctttgaaaagacaaa

SEQ ID NO: 270115 - DNA, 16 bp, P. troglodytes
tctttgaaaagaccaa

SEQ ID NO: 270116 - DNA, 16 bp, P. troglodytes
tctttgaaaagactaa

SEQ ID NO: 270117 - DNA, 16 bp, P. troglodytes
tctttgaaaataaaat

SEQ ID NO: 270118 - DNA, 16 bp, P. troglodytes
tctttgaaaatgtctt

SEQ ID NO: 270119 - DNA, 16 bp, P. troglodytes
tctttgaaaccagtga

SEQ ID NO: 270120 - DNA, 16 bp, P. troglodytes
tctttgaaactgatga

SEQ ID NO: 270121 - DNA, 16 bp, P. troglodytes
tctttgaagaaaacat

SEQ ID NO: 270122 - DNA, 16 bp, P. troglodytes
tctttgaagaaatgct

SEQ ID NO: 270123 - DNA, 16 bp, P. troglodytes
tctttgaataattttt

SEQ ID NO: 270124 - DNA, 17 bp, P. troglodytes
tctttgagacagggtct

SEQ ID NO: 270125 - DNA, 16 bp, P. troglodytes
tctttgagatactgat

SEQ ID NO: 270126 - DNA, 16 bp, P. troglodytes
tctttgagcatcatgt

SEQ ID NO: 270127 - DNA, 16 bp, P. troglodytes
tctttgagcttcagtt

SEQ ID NO: 270128 - DNA, 17 bp, P. troglodytes
tctttgaggaatcacca

SEQ ID NO: 270129 - DNA, 16 bp, P. troglodytes
tctttgagtttatctt

SEQ ID NO: 270130 - DNA, 16 bp, P. troglodytes
tctttgatccactttg

SEQ ID NO: 270131 - DNA, 16 bp, P. troglodytes
tctttgatgaacattg

SEQ ID NO: 270132 - DNA, 16 bp, P. troglodytes
tctttgatgatgatga

SEQ ID NO: 270133 - DNA, 16 bp, P. troglodytes
tctttgatgtactgat

SEQ ID NO: 270134 - DNA, 16 bp, P. troglodytes
tctttgatgttgctga

SEQ ID NO: 270135 - DNA, 16 bp, P. troglodytes
tctttgattaaattta

SEQ ID NO: 270136 - DNA, 16 bp, P. troglodytes
tctttgattttctgca

SEQ ID NO: 270137 - DNA, 26 bp, P. troglodytes
tctttgcaataaatcttgctactgct

SEQ ID NO: 270138 - DNA, 16 bp, P. troglodytes
tctttgcaatttttct

SEQ ID NO: 270139 - DNA, 16 bp, P. troglodytes
tctttgcagatgtagt

SEQ ID NO: 270140 - DNA, 16 bp, P. troglodytes
tctttgccaaagcata

SEQ ID NO: 270141 - DNA, 16 bp, P. troglodytes
tctttgccaggttttg

SEQ ID NO: 270142 - DNA, 16 bp, P. troglodytes
tctttgcctaatccaa

SEQ ID NO: 270143 - DNA, 16 bp, P. troglodytes
tctttgcctgctgtca

SEQ ID NO: 270144 - DNA, 16 bp, P. troglodytes
tctttgcctgttcctg

SEQ ID NO: 270145 - DNA, 16 bp, P. troglodytes
tctttgctaattttct

SEQ ID NO: 270146 - DNA, 16 bp, P. troglodytes
tctttgctattgcgaa

SEQ ID NO: 270147 - DNA, 16 bp, P. troglodytes
tctttgctattgtaaa

SEQ ID NO: 270148 - DNA, 16 bp, P. troglodytes
tctttgctattgtgaa

SEQ ID NO: 270149 - DNA, 16 bp, P. troglodytes
tctttgctattgtgag

SEQ ID NO: 270150 - DNA, 16 bp, P. troglodytes
tctttgctcattcctg

SEQ ID NO: 270151 - DNA, 16 bp, P. troglodytes
tctttgctgttctgca

SEQ ID NO: 270152 - DNA, 16 bp, P. troglodytes
tctttgctttttaaat

SEQ ID NO: 270153 - DNA, 16 bp, P. troglodytes
tctttggaaaagaaaa

SEQ ID NO: 270154 - DNA, 16 bp, P. troglodytes
tctttggaaagataaa

SEQ ID NO: 270155 - DNA, 16 bp, P. troglodytes
tctttggagaaatgtc

SEQ ID NO: 270156 - DNA, 16 bp, P. troglodytes
tctttggagaattgtc

SEQ ID NO: 270157 - DNA, 16 bp, P. troglodytes
tctttggatcttcatt

SEQ ID NO: 270158 - DNA, 16 bp, P. troglodytes
tctttggattttggag

SEQ ID NO: 270159 - DNA, 16 bp, P. troglodytes
tctttggcttcccaaa

SEQ ID NO: 270160 - DNA, 16 bp, P. troglodytes
tctttggcttgtagat

SEQ ID NO: 270161 - DNA, 16 bp, P. troglodytes
tctttgggcttcagtt

SEQ ID NO: 270162 - DNA, 16 bp, P. troglodytes
tctttggggaaaaata

SEQ ID NO: 270163 - DNA, 16 bp, P. troglodytes
tctttgggtcttcatt

SEQ ID NO: 270164 - DNA, 16 bp, P. troglodytes
tctttggttaaatata

SEQ ID NO: 270165 - DNA, 16 bp, P. troglodytes
tctttgtagcaatttt

SEQ ID NO: 270166 - DNA, 16 bp, P. troglodytes
tctttgtccatttttc

SEQ ID NO: 270167 - DNA, 16 bp, P. troglodytes
tctttgtcttttaact

SEQ ID NO: 270168 - DNA, 16 bp, P. troglodytes
tctttgtgaatgaata

SEQ ID NO: 270169 - DNA, 16 bp, P. troglodytes
tctttgtggtgatgga

SEQ ID NO: 270170 - DNA, 16 bp, P. troglodytes
tctttgtgtcacattt

SEQ ID NO: 270171 - DNA, 16 bp, P. troglodytes
tctttgtgtctctgtg

SEQ ID NO: 270172 - DNA, 16 bp, P. troglodytes
tctttgttctccttgg

SEQ ID NO: 270173 - DNA, 16 bp, P. troglodytes
tctttgttttaaaaat

SEQ ID NO: 270174 - DNA, 16 bp, P. troglodytes
tctttgtttttaaaat

SEQ ID NO: 270175 - DNA, 16 bp, P. troglodytes
tcttttaaaaaaatct

SEQ ID NO: 270176 - DNA, 16 bp, P. troglodytes
tcttttaaaaaatgct

SEQ ID NO: 270177 - DNA, 16 bp, P. troglodytes
tcttttaaaaattcat

SEQ ID NO: 270178 - DNA, 16 bp, P. troglodytes
tcttttaaaaggaaaa

SEQ ID NO: 270179 - DNA, 16 bp, P. troglodytes
tcttttaaaattcaaa

SEQ ID NO: 270180 - DNA, 16 bp, P. troglodytes
tcttttaaagaaataa

SEQ ID NO: 270181 - DNA, 16 bp, P. troglodytes
tcttttaaataaatga

SEQ ID NO: 270182 - DNA, 16 bp, P. troglodytes
tcttttaaatcagata

SEQ ID NO: 270183 - DNA, 16 bp, P. troglodytes
tcttttaacagtctgg

SEQ ID NO: 270184 - DNA, 16 bp, P. troglodytes
tcttttaagagtttta

SEQ ID NO: 270185 - DNA, 16 bp, P. troglodytes
tcttttaatatgcaaa

SEQ ID NO: 270186 - DNA, 21 bp, P. troglodytes
tcttttacatttgctgaggag

SEQ ID NO: 270187 - DNA, 16 bp, P. troglodytes
tcttttagatatatac

SEQ ID NO: 270188 - DNA, 16 bp, P. troglodytes
tcttttataaatgttt

SEQ ID NO: 270189 - DNA, 16 bp, P. troglodytes
tcttttataaattgcc

SEQ ID NO: 270190 - DNA, 16 bp, P. troglodytes
tcttttataataaact

SEQ ID NO: 270191 - DNA, 16 bp, P. troglodytes
tcttttatagagatgg

SEQ ID NO: 270192 - DNA, 16 bp, P. troglodytes
tcttttatattttgga

SEQ ID NO: 270193 - DNA, 16 bp, P. troglodytes
tcttttatccctcact

SEQ ID NO: 270194 - DNA, 16 bp, P. troglodytes
tcttttatttctgaaa

SEQ ID NO: 270195 - DNA, 16 bp, P. troglodytes
tcttttcaaaaaatca

SEQ ID NO: 270196 - DNA, 16 bp, P. troglodytes
tcttttcaaaaagcaa

SEQ ID NO: 270197 - DNA, 16 bp, P. troglodytes
tcttttcaaaaagcca

SEQ ID NO: 270198 - DNA, 16 bp, P. troglodytes
tcttttcaaaaatgtt

SEQ ID NO: 270199 - DNA, 16 bp, P. troglodytes
tcttttcaaagctgtc

SEQ ID NO: 270200 - DNA, 16 bp, P. troglodytes
tcttttcaaatgtttt

SEQ ID NO: 270201 - DNA, 16 bp, P. troglodytes
tcttttcaagattttt

SEQ ID NO: 270202 - DNA, 16 bp, P. troglodytes
tcttttcaataaatag

SEQ ID NO: 270203 - DNA, 17 bp, P. troglodytes
tcttttcagaagtgtct

SEQ ID NO: 270204 - DNA, 16 bp, P. troglodytes
tcttttcatatagtcc

SEQ ID NO: 270205 - DNA, 16 bp, P. troglodytes
tcttttcatttcaaat

SEQ ID NO: 270206 - DNA, 16 bp, P. troglodytes
tcttttccccagtata

SEQ ID NO: 270207 - DNA, 16 bp, P. troglodytes
tcttttcctctgggtg

SEQ ID NO: 270208 - DNA, 16 bp, P. troglodytes
tcttttcctgtgctta

SEQ ID NO: 270209 - DNA, 16 bp, P. troglodytes
tcttttccttattgat

SEQ ID NO: 270210 - DNA, 16 bp, P. troglodytes
tcttttcctttgggaa

SEQ ID NO: 270211 - DNA, 16 bp, P. troglodytes
tcttttccttttaaaa

SEQ ID NO: 270212 - DNA, 16 bp, P. troglodytes
tcttttctcttgctac

SEQ ID NO: 270213 - DNA, 16 bp, P. troglodytes
tcttttctgtgcagaa

SEQ ID NO: 270214 - DNA, 16 bp, P. troglodytes
tcttttcttaaaaaaa

SEQ ID NO: 270215 - DNA, 16 bp, P. troglodytes
tcttttctttcaaaag

SEQ ID NO: 270216 - DNA, 16 bp, P. troglodytes
tcttttctttgaaata

SEQ ID NO: 270217 - DNA, 16 bp, P. troglodytes
tcttttctttgtcatc

SEQ ID NO: 270218 - DNA, 16 bp, P. troglodytes
tcttttctttgtgaat

SEQ ID NO: 270219 - DNA, 16 bp, P. troglodytes
tcttttcttttgaaag

SEQ ID NO: 270220 - DNA, 16 bp, P. troglodytes
tcttttgaaaaataaa

SEQ ID NO: 270221 - DNA, 16 bp, P. troglodytes
tcttttgaaagtgtct

SEQ ID NO: 270222 - DNA, 16 bp, P. troglodytes
tcttttgaactttgtt

SEQ ID NO: 270223 - DNA, 16 bp, P. troglodytes
tcttttgaagacagca

SEQ ID NO: 270224 - DNA, 16 bp, P. troglodytes
tcttttgaagagcaaa

SEQ ID NO: 270225 - DNA, 16 bp, P. troglodytes
tcttttgaatggtttt

SEQ ID NO: 270226 - DNA, 16 bp, P. troglodytes
tcttttgagatggaat

SEQ ID NO: 270227 - DNA, 16 bp, P. troglodytes
tcttttgaggaatgtc

SEQ ID NO: 270228 - DNA, 16 bp, P. troglodytes
tcttttgagtttctga

SEQ ID NO: 270229 - DNA, 16 bp, P. troglodytes
tcttttgattaatgtt

SEQ ID NO: 270230 - DNA, 16 bp, P. troglodytes
tcttttgattagtgtt

SEQ ID NO: 270231 - DNA, 16 bp, P. troglodytes
tcttttgatttggggt

SEQ ID NO: 270232 - DNA, 16 bp, P. troglodytes
tcttttgcccattttt

SEQ ID NO: 270233 - DNA, 16 bp, P. troglodytes
tcttttgcctttttaa

SEQ ID NO: 270234 - DNA, 16 bp, P. troglodytes
tcttttgctgtgcaca

SEQ ID NO: 270235 - DNA, 16 bp, P. troglodytes
tcttttggaaaatcaa

SEQ ID NO: 270236 - DNA, 16 bp, P. troglodytes
tcttttggcttatgat

SEQ ID NO: 270237 - DNA, 16 bp, P. troglodytes
tcttttggggttccat

SEQ ID NO: 270238 - DNA, 16 bp, P. troglodytes
tcttttgggtatatac

SEQ ID NO: 270239 - DNA, 16 bp, P. troglodytes
tcttttgtaaagacag

SEQ ID NO: 270240 - DNA, 16 bp, P. troglodytes
tcttttgtactctttc

SEQ ID NO: 270241 - DNA, 16 bp, P. troglodytes
tcttttgtatttccat

SEQ ID NO: 270242 - DNA, 16 bp, P. troglodytes
tcttttgtcttaggat

SEQ ID NO: 270243 - DNA, 16 bp, P. troglodytes
tcttttgttagattta

SEQ ID NO: 270244 - DNA, 16 bp, P. troglodytes
tcttttgttttaaatg

SEQ ID NO: 270245 - DNA, 16 bp, P. troglodytes
tctttttaaaaaaatc

SEQ ID NO: 270246 - DNA, 16 bp, P. troglodytes
tctttttaaaaacaaa

SEQ ID NO: 270247 - DNA, 16 bp, P. troglodytes
tctttttaaaaactgt

SEQ ID NO: 270248 - DNA, 16 bp, P. troglodytes
tctttttaaaagattt

SEQ ID NO: 270249 - DNA, 16 bp, P. troglodytes
tctttttaaaagttta

SEQ ID NO: 270250 - DNA, 16 bp, P. troglodytes
tctttttaaagaaaat

SEQ ID NO: 270251 - DNA, 16 bp, P. troglodytes
tctttttaaagaatca

SEQ ID NO: 270252 - DNA, 16 bp, P. troglodytes
tctttttaaatgagaa

SEQ ID NO: 270253 - DNA, 16 bp, P. troglodytes
tctttttaatgctgaa

SEQ ID NO: 270254 - DNA, 16 bp, P. troglodytes
tctttttataaggaaa

SEQ ID NO: 270255 - DNA, 16 bp, P. troglodytes
tctttttatatacctg

SEQ ID NO: 270256 - DNA, 16 bp, P. troglodytes
tctttttattgtgatg

SEQ ID NO: 270257 - DNA, 16 bp, P. troglodytes
tctttttcaaagtttt

SEQ ID NO: 270258 - DNA, 16 bp, P. troglodytes
tctttttcacattgtt

SEQ ID NO: 270259 - DNA, 16 bp, P. troglodytes
tctttttcagaatttt

SEQ ID NO: 270260 - DNA, 16 bp, P. troglodytes
tctttttcagacaaat

SEQ ID NO: 270261 - DNA, 16 bp, P. troglodytes
tctttttcagagtttt

SEQ ID NO: 270262 - DNA, 16 bp, P. troglodytes
tctttttctatttgaa

SEQ ID NO: 270263 - DNA, 16 bp, P. troglodytes
tctttttctctaaaat

SEQ ID NO: 270264 - DNA, 16 bp, P. troglodytes
tctttttctgagacag

SEQ ID NO: 270265 - DNA, 16 bp, P. troglodytes
tctttttctgagccct

SEQ ID NO: 270266 - DNA, 16 bp, P. troglodytes
tctttttctttccagt

SEQ ID NO: 270267 - DNA, 16 bp, P. troglodytes
tctttttgaaaaaaat

SEQ ID NO: 270268 - DNA, 16 bp, P. troglodytes
tctttttgaaaatata

SEQ ID NO: 270269 - DNA, 16 bp, P. troglodytes
tctttttgataacagc

SEQ ID NO: 270270 - DNA, 16 bp, P. troglodytes
tctttttggaaaaaaa

SEQ ID NO: 270271 - DNA, 16 bp, P. troglodytes
tctttttggagttgat

SEQ ID NO: 270272 - DNA, 16 bp, P. troglodytes
tcttttttaaaaatac

SEQ ID NO: 270273 - DNA, 16 bp, P. troglodytes
tcttttttaaaagttt

SEQ ID NO: 270274 - DNA, 16 bp, P. troglodytes
tcttttttaatgtagg

SEQ ID NO: 270275 - DNA, 16 bp, P. troglodytes
tcttttttcaaagttt

SEQ ID NO: 270276 - DNA, 16 bp, P. troglodytes
tcttttttctccaaac

SEQ ID NO: 270277 - DNA, 16 bp, P. troglodytes
tcttttttctttgaga

SEQ ID NO: 270278 - DNA, 16 bp, P. troglodytes
tcttttttgcctgctg

SEQ ID NO: 270279 - DNA, 16 bp, P. troglodytes
tctttttttaaaagat

SEQ ID NO: 270280 - DNA, 16 bp, P. troglodytes
tctttttttaaagaat

SEQ ID NO: 270281 - DNA, 16 bp, P. troglodytes
tcttttttttaaagac

SEQ ID NO: 270282 - DNA, 16 bp, P. troglodytes
tcttttttttgagacg

SEQ ID NO: 270283 - DNA, 22 bp, P. troglodytes
tcttttttttgagatggagttt

SEQ ID NO: 270284 - DNA, 16 bp, P. troglodytes
tgaaaaaaaaagctca

SEQ ID NO: 270285 - DNA, 16 bp, P. troglodytes
tgaaaaaaaaattgca

SEQ ID NO: 270286 - DNA, 16 bp, P. troglodytes
tgaaaaaaaacttttt

SEQ ID NO: 270287 - DNA, 16 bp, P. troglodytes
tgaaaaaaaatcatta

SEQ ID NO: 270288 - DNA, 16 bp, P. troglodytes
tgaaaaaaaatccatg

SEQ ID NO: 270289 - DNA, 16 bp, P. troglodytes
tgaaaaaaaatgtttt

SEQ ID NO: 270290 - DNA, 16 bp, P. troglodytes
tgaaaaaaagcttaac

SEQ ID NO: 270291 - DNA, 16 bp, P. troglodytes
tgaaaaaaatgcacat

SEQ ID NO: 270292 - DNA, 16 bp, P. troglodytes
tgaaaaaactacttta

SEQ ID NO: 270293 - DNA, 16 bp, P. troglodytes
tgaaaaaagattagac

SEQ ID NO: 270294 - DNA, 16 bp, P. troglodytes
tgaaaaaataatggcc

SEQ ID NO: 270295 - DNA, 16 bp, P. troglodytes
tgaaaaaatacattat

SEQ ID NO: 270296 - DNA, 16 bp, P. troglodytes
tgaaaaaatgctcaaa

SEQ ID NO: 270297 - DNA, 16 bp, P. troglodytes
tgaaaaaatgctcaat

SEQ ID NO: 270298 - DNA, 16 bp, P. troglodytes
tgaaaaaatgtctttt

SEQ ID NO: 270299 - DNA, 16 bp, P. troglodytes
tgaaaaaattcaacat

SEQ ID NO: 270300 - DNA, 16 bp, P. troglodytes
tgaaaaacaaatggaa

SEQ ID NO: 270301 - DNA, 16 bp, P. troglodytes
tgaaaaacaacttcag

SEQ ID NO: 270302 - DNA, 16 bp, P. troglodytes
tgaaaaacacagcata

SEQ ID NO: 270303 - DNA, 17 bp, P. troglodytes
tgaaaaacacagcatga

SEQ ID NO: 270304 - DNA, 16 bp, P. troglodytes
tgaaaaacagaaattt

SEQ ID NO: 270305 - DNA, 16 bp, P. troglodytes
tgaaaaacatatttga

SEQ ID NO: 270306 - DNA, 16 bp, P. troglodytes
tgaaaaacattatttt

SEQ ID NO: 270307 - DNA, 16 bp, P. troglodytes
tgaaaaaccatacaaa

SEQ ID NO: 270308 - DNA, 16 bp, P. troglodytes
tgaaaaaccctccaaa

SEQ ID NO: 270309 - DNA, 16 bp, P. troglodytes
tgaaaaacctagaaga

SEQ ID NO: 270310 - DNA, 16 bp, P. troglodytes
tgaaaaactgaaaatc

SEQ ID NO: 270311 - DNA, 16 bp, P. troglodytes
tgaaaaactgcttggc

SEQ ID NO: 270312 - DNA, 16 bp, P. troglodytes
tgaaaaagaaaatgca

SEQ ID NO: 270313 - DNA, 16 bp, P. troglodytes
tgaaaaagaatgaagc

SEQ ID NO: 270314 - DNA, 16 bp, P. troglodytes
tgaaaaaggaaatacc

SEQ ID NO: 270315 - DNA, 16 bp, P. troglodytes
tgaaaaaggaaatgtc

SEQ ID NO: 270316 - DNA, 16 bp, P. troglodytes
tgaaaaagtattcaaa

SEQ ID NO: 270317 - DNA, 16 bp, P. troglodytes
tgaaaaagtatttgat

SEQ ID NO: 270318 - DNA, 16 bp, P. troglodytes
tgaaaaagtgaatatc

SEQ ID NO: 270319 - DNA, 16 bp, P. troglodytes
tgaaaaagtgctcaac

SEQ ID NO: 270320 - DNA, 16 bp, P. troglodytes
tgaaaaagttgatttt

SEQ ID NO: 270321 - DNA, 16 bp, P. troglodytes
tgaaaaataaatcaag

SEQ ID NO: 270322 - DNA, 16 bp, P. troglodytes
tgaaaaataaatgctt

SEQ ID NO: 270323 - DNA, 16 bp, P. troglodytes
tgaaaaataaatgtct

SEQ ID NO: 270324 - DNA, 16 bp, P. troglodytes
tgaaaaataaatttca

SEQ ID NO: 270325 - DNA, 16 bp, P. troglodytes
tgaaaaataatgcaaa

SEQ ID NO: 270326 - DNA, 16 bp, P. troglodytes
tgaaaaatacaaaatt

SEQ ID NO: 270327 - DNA, 16 bp, P. troglodytes
tgaaaaatacatgaaa

SEQ ID NO: 270328 - DNA, 16 bp, P. troglodytes
tgaaaaatacatgaga

SEQ ID NO: 270329 - DNA, 16 bp, P. troglodytes
tgaaaaatacattatt

SEQ ID NO: 270330 - DNA, 16 bp, P. troglodytes
tgaaaaatagaatggt

SEQ ID NO: 270331 - DNA, 16 bp, P. troglodytes
tgaaaaatatcatttt

SEQ ID NO: 270332 - DNA, 16 bp, P. troglodytes
tgaaaaatatctcaag

SEQ ID NO: 270333 - DNA, 16 bp, P. troglodytes
tgaaaaatatcttgaa

SEQ ID NO: 270334 - DNA, 16 bp, P. troglodytes
tgaaaaatattctatt

SEQ ID NO: 270335 - DNA, 16 bp, P. troglodytes
tgaaaaatatttctaa

SEQ ID NO: 270336 - DNA, 16 bp, P. troglodytes
tgaaaaatattttgta

SEQ ID NO: 270337 - DNA, 16 bp, P. troglodytes
tgaaaaatatttttca

SEQ ID NO: 270338 - DNA, 16 bp, P. troglodytes
tgaaaaatcaaaatca

SEQ ID NO: 270339 - DNA, 16 bp, P. troglodytes
tgaaaaatctgctgtt

SEQ ID NO: 270340 - DNA, 16 bp, P. troglodytes
tgaaaaatgagaaatt

SEQ ID NO: 270341 - DNA, 16 bp, P. troglodytes
tgaaaaatgatgagtt

SEQ ID NO: 270342 - DNA, 16 bp, P. troglodytes
tgaaaaatgttctaaa

SEQ ID NO: 270343 - DNA, 16 bp, P. troglodytes
tgaaaaatgtttaata

SEQ ID NO: 270344 - DNA, 16 bp, P. troglodytes
tgaaaaattaatcttg

SEQ ID NO: 270345 - DNA, 16 bp, P. troglodytes
tgaaaaattaattgta

SEQ ID NO: 270346 - DNA, 16 bp, P. troglodytes
tgaaaaattacatttt

SEQ ID NO: 270347 - DNA, 16 bp, P. troglodytes
tgaaaaattacttatt

SEQ ID NO: 270348 - DNA, 16 bp, P. troglodytes
tgaaaaattcctattg

SEQ ID NO: 270349 - DNA, 16 bp, P. troglodytes
tgaaaaattggaaaca

SEQ ID NO: 270350 - DNA, 16 bp, P. troglodytes
tgaaaaatttcaaatg

SEQ ID NO: 270351 - DNA, 16 bp, P. troglodytes
tgaaaaatttgcagtc

SEQ ID NO: 270352 - DNA, 16 bp, P. troglodytes
tgaaaaattttaagca

SEQ ID NO: 270353 - DNA, 16 bp, P. troglodytes
tgaaaacaaaacatac

SEQ ID NO: 270354 - DNA, 16 bp, P. troglodytes
tgaaaacaaaacatat

SEQ ID NO: 270355 - DNA, 16 bp, P. troglodytes
tgaaaacaaaatcaag

SEQ ID NO: 270356 - DNA, 16 bp, P. troglodytes
tgaaaacaaaatcaca

SEQ ID NO: 270357 - DNA, 16 bp, P. troglodytes
tgaaaacaaacacaca

SEQ ID NO: 270358 - DNA, 16 bp, P. troglodytes
tgaaaacaacctaaat

SEQ ID NO: 270359 - DNA, 16 bp, P. troglodytes
tgaaaacaattttttt

SEQ ID NO: 270360 - DNA, 16 bp, P. troglodytes
tgaaaacacatcccat

SEQ ID NO: 270361 - DNA, 16 bp, P. troglodytes
tgaaaacactgttttt

SEQ ID NO: 270362 - DNA, 16 bp, P. troglodytes
tgaaaacactttaaaa

SEQ ID NO: 270363 - DNA, 16 bp, P. troglodytes
tgaaaacactttgaaa

SEQ ID NO: 270364 - DNA, 16 bp, P. troglodytes
tgaaaacagagacaat

SEQ ID NO: 270365 - DNA, 16 bp, P. troglodytes
tgaaaacagcacagga

SEQ ID NO: 270366 - DNA, 16 bp, P. troglodytes
tgaaaacaggaaatca

SEQ ID NO: 270367 - DNA, 16 bp, P. troglodytes
tgaaaacaggaactca

SEQ ID NO: 270368 - DNA, 16 bp, P. troglodytes
tgaaaacaggagtgcc

SEQ ID NO: 270369 - DNA, 16 bp, P. troglodytes
tgaaaacagtcttttt

SEQ ID NO: 270370 - DNA, 16 bp, P. troglodytes
tgaaaacataaaatgt

SEQ ID NO: 270371 - DNA, 16 bp, P. troglodytes
tgaaaacataaatatt

SEQ ID NO: 270372 - DNA, 16 bp, P. troglodytes
tgaaaacatcatgcta

SEQ ID NO: 270373 - DNA, 16 bp, P. troglodytes
tgaaaacatccagaaa

SEQ ID NO: 270374 - DNA, 16 bp, P. troglodytes
tgaaaacatgaaaaat

SEQ ID NO: 270375 - DNA, 16 bp, P. troglodytes
tgaaaacatgtctaca

SEQ ID NO: 270376 - DNA, 16 bp, P. troglodytes
tgaaaacattaaaaat

SEQ ID NO: 270377 - DNA, 16 bp, P. troglodytes
tgaaaacattaaagaa

SEQ ID NO: 270378 - DNA, 16 bp, P. troglodytes
tgaaaacatttgaaaa

SEQ ID NO: 270379 - DNA, 16 bp, P. troglodytes
tgaaaacatttttaga

SEQ ID NO: 270380 - DNA, 16 bp, P. troglodytes
tgaaaaccaatacaaa

SEQ ID NO: 270381 - DNA, 16 bp, P. troglodytes
tgaaaaccacagtgag

SEQ ID NO: 270382 - DNA, 16 bp, P. troglodytes
tgaaaaccagcagaag

SEQ ID NO: 270383 - DNA, 16 bp, P. troglodytes
tgaaaacctagaggaa

SEQ ID NO: 270384 - DNA, 16 bp, P. troglodytes
tgaaaaccttttggaa

SEQ ID NO: 270385 - DNA, 16 bp, P. troglodytes
tgaaaactacaaagca

SEQ ID NO: 270386 - DNA, 16 bp, P. troglodytes
tgaaaactataaaaac

SEQ ID NO: 270387 - DNA, 16 bp, P. troglodytes
tgaaaactataaaaca

SEQ ID NO: 270388 - DNA, 16 bp, P. troglodytes
tgaaaactatacaaca

SEQ ID NO: 270389 - DNA, 16 bp, P. troglodytes
tgaaaactgaaggaaa

SEQ ID NO: 270390 - DNA, 16 bp, P. troglodytes
tgaaaactggatattt

SEQ ID NO: 270391 - DNA, 16 bp, P. troglodytes
tgaaaactggtaataa

SEQ ID NO: 270392 - DNA, 16 bp, P. troglodytes
tgaaaacttaaaacaa

SEQ ID NO: 270393 - DNA, 16 bp, P. troglodytes
tgaaaacttgccaaga

SEQ ID NO: 270394 - DNA, 16 bp, P. troglodytes
tgaaaactttaaaaca

SEQ ID NO: 270395 - DNA, 16 bp, P. troglodytes
tgaaaagaaaaagcca

SEQ ID NO: 270396 - DNA, 16 bp, P. troglodytes
tgaaaagaaaatcaag

SEQ ID NO: 270397 - DNA, 16 bp, P. troglodytes
tgaaaagaaatgaagt

SEQ ID NO: 270398 - DNA, 16 bp, P. troglodytes
tgaaaagaatgtatat

SEQ ID NO: 270399 - DNA, 16 bp, P. troglodytes
tgaaaagacacctgaa

SEQ ID NO: 270400 - DNA, 16 bp, P. troglodytes
tgaaaagacatggaga

SEQ ID NO: 270401 - DNA, 16 bp, P. troglodytes
tgaaaagactgccctt

SEQ ID NO: 270402 - DNA, 16 bp, P. troglodytes
tgaaaagagatagttt

SEQ ID NO: 270403 - DNA, 16 bp, P. troglodytes
tgaaaagagtgtatat

SEQ ID NO: 270404 - DNA, 16 bp, P. troglodytes
tgaaaagagttctgga

SEQ ID NO: 270405 - DNA, 16 bp, P. troglodytes
tgaaaagatgaatgaa

SEQ ID NO: 270406 - DNA, 16 bp, P. troglodytes
tgaaaagcaagaaatt

SEQ ID NO: 270407 - DNA, 16 bp, P. troglodytes
tgaaaagctttttaaa

SEQ ID NO: 270408 - DNA, 16 bp, P. troglodytes
tgaaaaggaaaatttt

SEQ ID NO: 270409 - DNA, 16 bp, P. troglodytes
tgaaaaggaaagaaca

SEQ ID NO: 270410 - DNA, 16 bp, P. troglodytes
tgaaaaggaacaaagt

SEQ ID NO: 270411 - DNA, 16 bp, P. troglodytes
tgaaaaggaagaacaa

SEQ ID NO: 270412 - DNA, 16 bp, P. troglodytes
tgaaaaggcaatctac

SEQ ID NO: 270413 - DNA, 16 bp, P. troglodytes
tgaaaagttttaagca

SEQ ID NO: 270414 - DNA, 16 bp, P. troglodytes
tgaaaagttttgtttt

SEQ ID NO: 270415 - DNA, 16 bp, P. troglodytes
tgaaaataaaaatgca

SEQ ID NO: 270416 - DNA, 16 bp, P. troglodytes
tgaaaataaaacaatg

SEQ ID NO: 270417 - DNA, 16 bp, P. troglodytes
tgaaaataaaatctga

SEQ ID NO: 270418 - DNA, 16 bp, P. troglodytes
tgaaaataaaatttca

SEQ ID NO: 270419 - DNA, 16 bp, P. troglodytes
tgaaaataaatatgca

SEQ ID NO: 270420 - DNA, 16 bp, P. troglodytes
tgaaaataaatatttc

SEQ ID NO: 270421 - DNA, 16 bp, P. troglodytes
tgaaaataataagagc

SEQ ID NO: 270422 - DNA, 16 bp, P. troglodytes
tgaaaataattttcct

SEQ ID NO: 270423 - DNA, 16 bp, P. troglodytes
tgaaaatacaaattta

SEQ ID NO: 270424 - DNA, 16 bp, P. troglodytes
tgaaaatacacatttt

SEQ ID NO: 270425 - DNA, 16 bp, P. troglodytes
tgaaaatacatttaat

SEQ ID NO: 270426 - DNA, 16 bp, P. troglodytes
tgaaaatactaaaaac

SEQ ID NO: 270427 - DNA, 16 bp, P. troglodytes
tgaaaatatattttca

SEQ ID NO: 270428 - DNA, 16 bp, P. troglodytes
tgaaaatatccagaaa

SEQ ID NO: 270429 - DNA, 16 bp, P. troglodytes
tgaaaatatcctttaa

SEQ ID NO: 270430 - DNA, 16 bp, P. troglodytes
tgaaaatatcttaaaa

SEQ ID NO: 270431 - DNA, 16 bp, P. troglodytes
tgaaaatatctttttt

SEQ ID NO: 270432 - DNA, 16 bp, P. troglodytes
tgaaaatatggaagca

SEQ ID NO: 270433 - DNA, 16 bp, P. troglodytes
tgaaaatatgttttca

SEQ ID NO: 270434 - DNA, 16 bp, P. troglodytes
tgaaaatattatgcta

SEQ ID NO: 270435 - DNA, 16 bp, P. troglodytes
tgaaaatattccaaaa

SEQ ID NO: 270436 - DNA, 16 bp, P. troglodytes
tgaaaatattctcttt

SEQ ID NO: 270437 - DNA, 16 bp, P. troglodytes
tgaaaatattctgttt

SEQ ID NO: 270438 - DNA, 16 bp, P. troglodytes
tgaaaatattttcatg

SEQ ID NO: 270439 - DNA, 16 bp, P. troglodytes
tgaaaatattttcttt

SEQ ID NO: 270440 - DNA, 16 bp, P. troglodytes
tgaaaatattttggaa

SEQ ID NO: 270441 - DNA, 16 bp, P. troglodytes
tgaaaatatttttgaa

SEQ ID NO: 270442 - DNA, 16 bp, P. troglodytes
tgaaaatcagatggtt

SEQ ID NO: 270443 - DNA, 16 bp, P. troglodytes
tgaaaatctaaaaata

SEQ ID NO: 270444 - DNA, 16 bp, P. troglodytes
tgaaaatgaaaacaca

SEQ ID NO: 270445 - DNA, 16 bp, P. troglodytes
tgaaaatgaaaataca

SEQ ID NO: 270446 - DNA, 16 bp, P. troglodytes
tgaaaatgaaaccaaa

SEQ ID NO: 270447 - DNA, 16 bp, P. troglodytes
tgaaaatgaacaaagt

SEQ ID NO: 270448 - DNA, 16 bp, P. troglodytes
tgaaaatgaacagaat

SEQ ID NO: 270449 - DNA, 16 bp, P. troglodytes
tgaaaatgaatgaatg

SEQ ID NO: 270450 - DNA, 16 bp, P. troglodytes
tgaaaatgaatttttt

SEQ ID NO: 270451 - DNA, 16 bp, P. troglodytes
tgaaaatgacaattga

SEQ ID NO: 270452 - DNA, 16 bp, P. troglodytes
tgaaaatgacaggatt

SEQ ID NO: 270453 - DNA, 16 bp, P. troglodytes
tgaaaatgaccatgct

SEQ ID NO: 270454 - DNA, 16 bp, P. troglodytes
tgaaaatgactatact

SEQ ID NO: 270455 - DNA, 16 bp, P. troglodytes
tgaaaatgagaaaaca

SEQ ID NO: 270456 - DNA, 16 bp, P. troglodytes
tgaaaatgaggaactt

SEQ ID NO: 270457 - DNA, 16 bp, P. troglodytes
tgaaaatgatttttca

SEQ ID NO: 270458 - DNA, 16 bp, P. troglodytes
tgaaaatgcagagaaa

SEQ ID NO: 270459 - DNA, 16 bp, P. troglodytes
tgaaaatgctttgaaa

SEQ ID NO: 270460 - DNA, 16 bp, P. troglodytes
tgaaaatggacatact

SEQ ID NO: 270461 - DNA, 16 bp, P. troglodytes
tgaaaatggccatcct

SEQ ID NO: 270462 - DNA, 16 bp, P. troglodytes
tgaaaatggctatact

SEQ ID NO: 270463 - DNA, 16 bp, P. troglodytes
tgaaaatggtcatact

SEQ ID NO: 270464 - DNA, 16 bp, P. troglodytes
tgaaaatgtatttctt

SEQ ID NO: 270465 - DNA, 16 bp, P. troglodytes
tgaaaatgtcaacaaa

SEQ ID NO: 270466 - DNA, 16 bp, P. troglodytes
tgaaaatgtctttctt

SEQ ID NO: 270467 - DNA, 16 bp, P. troglodytes
tgaaaatgtgaagaaa

SEQ ID NO: 270468 - DNA, 16 bp, P. troglodytes
tgaaaatgtgactgaa

SEQ ID NO: 270469 - DNA, 16 bp, P. troglodytes
tgaaaatgtgatagaa

SEQ ID NO: 270470 - DNA, 16 bp, P. troglodytes
tgaaaatgtggaagca

SEQ ID NO: 270471 - DNA, 16 bp, P. troglodytes
tgaaaatgtgtgtgtg

SEQ ID NO: 270472 - DNA, 16 bp, P. troglodytes
tgaaaatgttaaatat

SEQ ID NO: 270473 - DNA, 16 bp, P. troglodytes
tgaaaatgttaagaaa

SEQ ID NO: 270474 - DNA, 16 bp, P. troglodytes
tgaaaatgttattaaa

SEQ ID NO: 270475 - DNA, 16 bp, P. troglodytes
tgaaaatgttctcaaa

SEQ ID NO: 270476 - DNA, 16 bp, P. troglodytes
tgaaaatgttttaatt

SEQ ID NO: 270477 - DNA, 16 bp, P. troglodytes
tgaaaatgttttcaaa

SEQ ID NO: 270478 - DNA, 16 bp, P. troglodytes
tgaaaatgtttttaaa

SEQ ID NO: 270479 - DNA, 16 bp, P. troglodytes
tgaaaattacaaaatg

SEQ ID NO: 270480 - DNA, 16 bp, P. troglodytes
tgaaaattcagagaaa

SEQ ID NO: 270481 - DNA, 16 bp, P. troglodytes
tgaaaattctttgaaa

SEQ ID NO: 270482 - DNA, 16 bp, P. troglodytes
tgaaaattgtgtattt

SEQ ID NO: 270483 - DNA, 16 bp, P. troglodytes
tgaaaattgttttcaa

SEQ ID NO: 270484 - DNA, 16 bp, P. troglodytes
tgaaaattgttttgtt

SEQ ID NO: 270485 - DNA, 16 bp, P. troglodytes
tgaaaatttggaaaat

SEQ ID NO: 270486 - DNA, 16 bp, P. troglodytes
tgaaaattttaaacaa

SEQ ID NO: 270487 - DNA, 16 bp, P. troglodytes
tgaaaattttcaaaca

SEQ ID NO: 270488 - DNA, 16 bp, P. troglodytes
tgaaacaaaatattta

SEQ ID NO: 270489 - DNA, 16 bp, P. troglodytes
tgaaacaaaatgaaac

SEQ ID NO: 270490 - DNA, 16 bp, P. troglodytes
tgaaacaaaattgaaa

SEQ ID NO: 270491 - DNA, 16 bp, P. troglodytes
tgaaacaaatgaaagt

SEQ ID NO: 270492 - DNA, 16 bp, P. troglodytes
tgaaacaaatgaattt

SEQ ID NO: 270493 - DNA, 16 bp, P. troglodytes
tgaaacaaccagatct

SEQ ID NO: 270494 - DNA, 16 bp, P. troglodytes
tgaaacaagcaaacaa

SEQ ID NO: 270495 - DNA, 16 bp, P. troglodytes
tgaaacactagttcag

SEQ ID NO: 270496 - DNA, 16 bp, P. troglodytes
tgaaacagaaacagaa

SEQ ID NO: 270497 - DNA, 16 bp, P. troglodytes
tgaaacatgaaagaaa

SEQ ID NO: 270498 - DNA, 16 bp, P. troglodytes
tgaaacatttagaaaa

SEQ ID NO: 270499 - DNA, 16 bp, P. troglodytes
tgaaacatttttattt

SEQ ID NO: 270500 - DNA, 16 bp, P. troglodytes
tgaaacattttttttt

SEQ ID NO: 270501 - DNA, 16 bp, P. troglodytes
tgaaaccaaagagaac

SEQ ID NO: 270502 - DNA, 16 bp, P. troglodytes
tgaaaccacagacagt

SEQ ID NO: 270503 - DNA, 16 bp, P. troglodytes
tgaaaccagcctggtc

SEQ ID NO: 270504 - DNA, 16 bp, P. troglodytes
tgaaaccataaaaatt

SEQ ID NO: 270505 - DNA, 16 bp, P. troglodytes
tgaaaccatctgggcc

SEQ ID NO: 270506 - DNA, 16 bp, P. troglodytes
tgaaaccattccaaaa

SEQ ID NO: 270507 - DNA, 16 bp, P. troglodytes
tgaaaccccacctcta

SEQ ID NO: 270508 - DNA, 16 bp, P. troglodytes
tgaaaccccatctcaa

SEQ ID NO: 270509 - DNA, 23 bp, P. troglodytes
tgaaaccccatctctactaaaat

SEQ ID NO: 270510 - DNA, 16 bp, P. troglodytes
tgaaaccccatctctc

SEQ ID NO: 270511 - DNA, 16 bp, P. troglodytes
tgaaaccccgtcacta

SEQ ID NO: 270512 - DNA, 17 bp, P. troglodytes
tgaaaccccgtctctac

SEQ ID NO: 270513 - DNA, 16 bp, P. troglodytes
tgaaacccggtctcta

SEQ ID NO: 270514 - DNA, 16 bp, P. troglodytes
tgaaaccctgtctctt

SEQ ID NO: 270515 - DNA, 16 bp, P. troglodytes
tgaaacctaatctcta

SEQ ID NO: 270516 - DNA, 16 bp, P. troglodytes
tgaaacctcatctctt

SEQ ID NO: 270517 - DNA, 16 bp, P. troglodytes
tgaaacctccaactcc

SEQ ID NO: 270518 - DNA, 16 bp, P. troglodytes
tgaaacctccatctcc

SEQ ID NO: 270519 - DNA, 16 bp, P. troglodytes
tgaaacctctgcttcc

SEQ ID NO: 270520 - DNA, 16 bp, P. troglodytes
tgaaaccttgtctcta

SEQ ID NO: 270521 - DNA, 16 bp, P. troglodytes
tgaaactaaagcaaat

SEQ ID NO: 270522 - DNA, 16 bp, P. troglodytes
tgaaactactgaaaat

SEQ ID NO: 270523 - DNA, 16 bp, P. troglodytes
tgaaactattccagaa

SEQ ID NO: 270524 - DNA, 16 bp, P. troglodytes
tgaaactatttcaaat

SEQ ID NO: 270525 - DNA, 16 bp, P. troglodytes
tgaaactatttttttt

SEQ ID NO: 270526 - DNA, 16 bp, P. troglodytes
tgaaactcagtctcta

SEQ ID NO: 270527 - DNA, 16 bp, P. troglodytes
tgaaactccatctcag

SEQ ID NO: 270528 - DNA, 23 bp, P. troglodytes
tgaaactccgtctcaaaaaaaaa

SEQ ID NO: 270529 - DNA, 16 bp, P. troglodytes
tgaaactgaggctcag

SEQ ID NO: 270530 - DNA, 16 bp, P. troglodytes
tgaaactgatttcaga

SEQ ID NO: 270531 - DNA, 16 bp, P. troglodytes
tgaaactgcacccctt

SEQ ID NO: 270532 - DNA, 16 bp, P. troglodytes
tgaaactgcagacctt

SEQ ID NO: 270533 - DNA, 16 bp, P. troglodytes
tgaaactgctccacct

SEQ ID NO: 270534 - DNA, 16 bp, P. troglodytes
tgaaactggaaccctt

SEQ ID NO: 270535 - DNA, 16 bp, P. troglodytes
tgaaactggacacctt

SEQ ID NO: 270536 - DNA, 16 bp, P. troglodytes
tgaaactggaggatat

SEQ ID NO: 270537 - DNA, 16 bp, P. troglodytes
tgaaactggataattt

SEQ ID NO: 270538 - DNA, 37 bp, P. troglodytes
tgaaactggatcccttccttacaccttatacaaaaat

SEQ ID NO: 270539 - DNA, 16 bp, P. troglodytes
tgaaactgtctaaaaa

SEQ ID NO: 270540 - DNA, 16 bp, P. troglodytes
tgaaacttatatttgt

SEQ ID NO: 270541 - DNA, 16 bp, P. troglodytes
tgaaactttttgtttt

SEQ ID NO: 270542 - DNA, 16 bp, P. troglodytes
tgaaagaaaaagtcaa

SEQ ID NO: 270543 - DNA, 16 bp, P. troglodytes
tgaaagaaaagtattt

SEQ ID NO: 270544 - DNA, 16 bp, P. troglodytes
tgaaagaaaataacat

SEQ ID NO: 270545 - DNA, 16 bp, P. troglodytes
tgaaagaaaatcattt

SEQ ID NO: 270546 - DNA, 16 bp, P. troglodytes
tgaaagaaaccacaga

SEQ ID NO: 270547 - DNA, 16 bp, P. troglodytes
tgaaagaaatacattt

SEQ ID NO: 270548 - DNA, 16 bp, P. troglodytes
tgaaagaaattaaaca

SEQ ID NO: 270549 - DNA, 16 bp, P. troglodytes
tgaaagaaattagaga

SEQ ID NO: 270550 - DNA, 16 bp, P. troglodytes
tgaaagaacaaatgaa

SEQ ID NO: 270551 - DNA, 16 bp, P. troglodytes
tgaaagaagccaggca

SEQ ID NO: 270552 - DNA, 16 bp, P. troglodytes
tgaaagaaggcatgaa

SEQ ID NO: 270553 - DNA, 16 bp, P. troglodytes
tgaaagaatcacttga

SEQ ID NO: 270554 - DNA, 16 bp, P. troglodytes
tgaaagaattaatgaa

SEQ ID NO: 270555 - DNA, 16 bp, P. troglodytes
tgaaagaatttgaaga

SEQ ID NO: 270556 - DNA, 16 bp, P. troglodytes
tgaaagacagtgtggc

SEQ ID NO: 270557 - DNA, 16 bp, P. troglodytes
tgaaagacattaaaaa

SEQ ID NO: 270558 - DNA, 16 bp, P. troglodytes
tgaaagacctttacaa

SEQ ID NO: 270559 - DNA, 16 bp, P. troglodytes
tgaaagactgaatatt

SEQ ID NO: 270560 - DNA, 16 bp, P. troglodytes
tgaaagactgaggcag

SEQ ID NO: 270561 - DNA, 16 bp, P. troglodytes
tgaaagagaaatattt

SEQ ID NO: 270562 - DNA, 16 bp, P. troglodytes
tgaaagagaaattaag

SEQ ID NO: 270563 - DNA, 16 bp, P. troglodytes
tgaaagagaagacatt

SEQ ID NO: 270564 - DNA, 16 bp, P. troglodytes
tgaaagagatggggag

SEQ ID NO: 270565 - DNA, 16 bp, P. troglodytes
tgaaagagatttttaa

SEQ ID NO: 270566 - DNA, 16 bp, P. troglodytes
tgaaagagctgtaaca

SEQ ID NO: 270567 - DNA, 16 bp, P. troglodytes
tgaaagaggcattgaa

SEQ ID NO: 270568 - DNA, 16 bp, P. troglodytes
tgaaagatattttcat

SEQ ID NO: 270569 - DNA, 16 bp, P. troglodytes
tgaaagatgaaatgaa

SEQ ID NO: 270570 - DNA, 16 bp, P. troglodytes
tgaaagatgtcacttt

SEQ ID NO: 270571 - DNA, 16 bp, P. troglodytes
tgaaagatgtctacaa

SEQ ID NO: 270572 - DNA, 16 bp, P. troglodytes
tgaaagatttctctat

SEQ ID NO: 270573 - DNA, 16 bp, P. troglodytes
tgaaagcaaccaggag

SEQ ID NO: 270574 - DNA, 16 bp, P. troglodytes
tgaaagcactttgaaa

SEQ ID NO: 270575 - DNA, 16 bp, P. troglodytes
tgaaagcagaagaaaa

SEQ ID NO: 270576 - DNA, 16 bp, P. troglodytes
tgaaagcagctgagag

SEQ ID NO: 270577 - DNA, 16 bp, P. troglodytes
tgaaagcaggagcaag

SEQ ID NO: 270578 - DNA, 16 bp, P. troglodytes
tgaaagcagggacttg

SEQ ID NO: 270579 - DNA, 25 bp, P. troglodytes
tgaaagcagtgtgtagagggaaatt

SEQ ID NO: 270580 - DNA, 16 bp, P. troglodytes
tgaaagcattccctct

SEQ ID NO: 270581 - DNA, 16 bp, P. troglodytes
tgaaagcatttaaaat

SEQ ID NO: 270582 - DNA, 16 bp, P. troglodytes
tgaaagcattttattt

SEQ ID NO: 270583 - DNA, 16 bp, P. troglodytes
tgaaagcattttctct

SEQ ID NO: 270584 - DNA, 16 bp, P. troglodytes
tgaaagccatcatcct

SEQ ID NO: 270585 - DNA, 16 bp, P. troglodytes
tgaaagctgagagagg

SEQ ID NO: 270586 - DNA, 16 bp, P. troglodytes
tgaaagcttcctgagg

SEQ ID NO: 270587 - DNA, 16 bp, P. troglodytes
tgaaagctttgaagag

SEQ ID NO: 270588 - DNA, 16 bp, P. troglodytes
tgaaaggaaattaaat

SEQ ID NO: 270589 - DNA, 16 bp, P. troglodytes
tgaaaggaagagtcaa

SEQ ID NO: 270590 - DNA, 16 bp, P. troglodytes
tgaaaggaatcttttt

SEQ ID NO: 270591 - DNA, 16 bp, P. troglodytes
tgaaaggaattgaaga

SEQ ID NO: 270592 - DNA, 16 bp, P. troglodytes
tgaaaggataaatgaa

SEQ ID NO: 270593 - DNA, 16 bp, P. troglodytes
tgaaaggcaaggagga

SEQ ID NO: 270594 - DNA, 16 bp, P. troglodytes
tgaaaggcagtctagg

SEQ ID NO: 270595 - DNA, 16 bp, P. troglodytes
tgaaaggcatatctca

SEQ ID NO: 270596 - DNA, 16 bp, P. troglodytes
tgaaaggttttaagca

SEQ ID NO: 270597 - DNA, 16 bp, P. troglodytes
tgaaagtaagcctctt

SEQ ID NO: 270598 - DNA, 16 bp, P. troglodytes
tgaaagtcagtgtggc

SEQ ID NO: 270599 - DNA, 16 bp, P. troglodytes
tgaaagtctgaaatcc

SEQ ID NO: 270600 - DNA, 16 bp, P. troglodytes
tgaaagtgaaaaacag

SEQ ID NO: 270601 - DNA, 16 bp, P. troglodytes
tgaaagtgatgaggag

SEQ ID NO: 270602 - DNA, 16 bp, P. troglodytes
tgaaagtgctaggatt

SEQ ID NO: 270603 - DNA, 16 bp, P. troglodytes
tgaaagtgctgagatt

SEQ ID NO: 270604 - DNA, 16 bp, P. troglodytes
tgaaagtgctttgcaa

SEQ ID NO: 270605 - DNA, 16 bp, P. troglodytes
tgaaagtggacatcct

SEQ ID NO: 270606 - DNA, 16 bp, P. troglodytes
tgaaagtggctacact

SEQ ID NO: 270607 - DNA, 16 bp, P. troglodytes
tgaaagtgttttaaaa

SEQ ID NO: 270608 - DNA, 16 bp, P. troglodytes
tgaaagtgttttggaa

SEQ ID NO: 270609 - DNA, 16 bp, P. troglodytes
tgaaagttgtcagaat

SEQ ID NO: 270610 - DNA, 16 bp, P. troglodytes
tgaaagttttttcttt

SEQ ID NO: 270611 - DNA, 16 bp, P. troglodytes
tgaaataaaaattttg

SEQ ID NO: 270612 - DNA, 16 bp, P. troglodytes
tgaaataaaacagaat

SEQ ID NO: 270613 - DNA, 16 bp, P. troglodytes
tgaaataaaagcagaa

SEQ ID NO: 270614 - DNA, 16 bp, P. troglodytes
tgaaataaaatataca

SEQ ID NO: 270615 - DNA, 16 bp, P. troglodytes
tgaaataaaattcatt

SEQ ID NO: 270616 - DNA, 16 bp, P. troglodytes
tgaaataaaattgttt

SEQ ID NO: 270617 - DNA, 16 bp, P. troglodytes
tgaaataaaccaaaca

SEQ ID NO: 270618 - DNA, 16 bp, P. troglodytes
tgaaataaactgaaga

SEQ ID NO: 270619 - DNA, 16 bp, P. troglodytes
tgaaataaatattcat

SEQ ID NO: 270620 - DNA, 16 bp, P. troglodytes
tgaaataaatatttca

SEQ ID NO: 270621 - DNA, 16 bp, P. troglodytes
tgaaataactgaaaaa

SEQ ID NO: 270622 - DNA, 16 bp, P. troglodytes
tgaaataagacagtca

SEQ ID NO: 270623 - DNA, 16 bp, P. troglodytes
tgaaataatattttga

SEQ ID NO: 270624 - DNA, 16 bp, P. troglodytes
tgaaataatctttaca

SEQ ID NO: 270625 - DNA, 16 bp, P. troglodytes
tgaaataatttttgta

SEQ ID NO: 270626 - DNA, 16 bp, P. troglodytes
tgaaatacaaaaatta

SEQ ID NO: 270627 - DNA, 16 bp, P. troglodytes
tgaaatacagcaaaag

SEQ ID NO: 270628 - DNA, 16 bp, P. troglodytes
tgaaatacctaagaat

SEQ ID NO: 270629 - DNA, 16 bp, P. troglodytes
tgaaatactgaaagct

SEQ ID NO: 270630 - DNA, 16 bp, P. troglodytes
tgaaatactgaaatat

SEQ ID NO: 270631 - DNA, 16 bp, P. troglodytes
tgaaatactgcaagaa

SEQ ID NO: 270632 - DNA, 16 bp, P. troglodytes
tgaaatagaaaatctg

SEQ ID NO: 270633 - DNA, 16 bp, P. troglodytes
tgaaatagaaagcaga

SEQ ID NO: 270634 - DNA, 16 bp, P. troglodytes
tgaaataggtattatt

SEQ ID NO: 270635 - DNA, 16 bp, P. troglodytes
tgaaatatattttgaa

SEQ ID NO: 270636 - DNA, 16 bp, P. troglodytes
tgaaatatccagaaaa

SEQ ID NO: 270637 - DNA, 16 bp, P. troglodytes
tgaaatatctaaaata

SEQ ID NO: 270638 - DNA, 16 bp, P. troglodytes
tgaaatatctctacaa

SEQ ID NO: 270639 - DNA, 16 bp, P. troglodytes
tgaaatatgcaataaa

SEQ ID NO: 270640 - DNA, 16 bp, P. troglodytes
tgaaatattctgtaca

SEQ ID NO: 270641 - DNA, 16 bp, P. troglodytes
tgaaatatttaaagtg

SEQ ID NO: 270642 - DNA, 16 bp, P. troglodytes
tgaaatatttagaagt

SEQ ID NO: 270643 - DNA, 16 bp, P. troglodytes
tgaaatatttcagaca

SEQ ID NO: 270644 - DNA, 16 bp, P. troglodytes
tgaaatatttgcatat

SEQ ID NO: 270645 - DNA, 16 bp, P. troglodytes
tgaaatatttgttgaa

SEQ ID NO: 270646 - DNA, 16 bp, P. troglodytes
tgaaatattttaagtg

SEQ ID NO: 270647 - DNA, 16 bp, P. troglodytes
tgaaatatttttttct

SEQ ID NO: 270648 - DNA, 16 bp, P. troglodytes
tgaaatcaaagacagg

SEQ ID NO: 270649 - DNA, 16 bp, P. troglodytes
tgaaatcagtatctca

SEQ ID NO: 270650 - DNA, 16 bp, P. troglodytes
tgaaatcatacagtat

SEQ ID NO: 270651 - DNA, 16 bp, P. troglodytes
tgaaatcatattaagt

SEQ ID NO: 270652 - DNA, 16 bp, P. troglodytes
tgaaatccaggctgaa

SEQ ID NO: 270653 - DNA, 16 bp, P. troglodytes
tgaaatccaggtggag

SEQ ID NO: 270654 - DNA, 16 bp, P. troglodytes
tgaaatcccaactact

SEQ ID NO: 270655 - DNA, 16 bp, P. troglodytes
tgaaatcctaacctct

SEQ ID NO: 270656 - DNA, 16 bp, P. troglodytes
tgaaatcctgacctca

SEQ ID NO: 270657 - DNA, 16 bp, P. troglodytes
tgaaatctactttatc

SEQ ID NO: 270658 - DNA, 16 bp, P. troglodytes
tgaaatctatttttaa

SEQ ID NO: 270659 - DNA, 16 bp, P. troglodytes
tgaaatctgggctttt

SEQ ID NO: 270660 - DNA, 16 bp, P. troglodytes
tgaaatcttgaacccc

SEQ ID NO: 270661 - DNA, 16 bp, P. troglodytes
tgaaatgaaaatttta

SEQ ID NO: 270662 - DNA, 16 bp, P. troglodytes
tgaaatgaagcaagaa

SEQ ID NO: 270663 - DNA, 16 bp, P. troglodytes
tgaaatgaatgaaata

SEQ ID NO: 270664 - DNA, 16 bp, P. troglodytes
tgaaatgaatgtattt

SEQ ID NO: 270665 - DNA, 16 bp, P. troglodytes
tgaaatgaattttaat

SEQ ID NO: 270666 - DNA, 16 bp, P. troglodytes
tgaaatgacagataaa

SEQ ID NO: 270667 - DNA, 16 bp, P. troglodytes
tgaaatgagccaagat

SEQ ID NO: 270668 - DNA, 16 bp, P. troglodytes
tgaaatgattgccaca

SEQ ID NO: 270669 - DNA, 16 bp, P. troglodytes
tgaaatgatttttctt

SEQ ID NO: 270670 - DNA, 16 bp, P. troglodytes
tgaaatgctgtatgga

SEQ ID NO: 270671 - DNA, 16 bp, P. troglodytes
tgaaatgctgtctcaa

SEQ ID NO: 270672 - DNA, 16 bp, P. troglodytes
tgaaatgctgtctcta

SEQ ID NO: 270673 - DNA, 16 bp, P. troglodytes
tgaaatggaaacattt

SEQ ID NO: 270674 - DNA, 16 bp, P. troglodytes
tgaaatggaagaaaat

SEQ ID NO: 270675 - DNA, 16 bp, P. troglodytes
tgaaatggaatcttgc

SEQ ID NO: 270676 - DNA, 16 bp, P. troglodytes
tgaaatgggagaaaat

SEQ ID NO: 270677 - DNA, 16 bp, P. troglodytes
tgaaatgggagaattg

SEQ ID NO: 270678 - DNA, 16 bp, P. troglodytes
tgaaatggggataata

SEQ ID NO: 270679 - DNA, 16 bp, P. troglodytes
tgaaatgtacaataaa

SEQ ID NO: 270680 - DNA, 16 bp, P. troglodytes
tgaaatgtatttaaaa

SEQ ID NO: 270681 - DNA, 16 bp, P. troglodytes
tgaaatgtccagaaaa

SEQ ID NO: 270682 - DNA, 16 bp, P. troglodytes
tgaaatgtccagaaca

SEQ ID NO: 270683 - DNA, 16 bp, P. troglodytes
tgaaatgtctttaaaa

SEQ ID NO: 270684 - DNA, 16 bp, P. troglodytes
tgaaatgtgaatttca

SEQ ID NO: 270685 - DNA, 16 bp, P. troglodytes
tgaaatgtgaccccca

SEQ ID NO: 270686 - DNA, 16 bp, P. troglodytes
tgaaatgtgatctcca

SEQ ID NO: 270687 - DNA, 16 bp, P. troglodytes
tgaaatgtggctagtc

SEQ ID NO: 270688 - DNA, 16 bp, P. troglodytes
tgaaatgttaatctcc

SEQ ID NO: 270689 - DNA, 16 bp, P. troglodytes
tgaaatgttcccagca

SEQ ID NO: 270690 - DNA, 16 bp, P. troglodytes
tgaaatgtttgggacc

SEQ ID NO: 270691 - DNA, 16 bp, P. troglodytes
tgaaatgttttttaaa

SEQ ID NO: 270692 - DNA, 16 bp, P. troglodytes
tgaaatgttttttctt

SEQ ID NO: 270693 - DNA, 16 bp, P. troglodytes
tgaaattaaaaacata

SEQ ID NO: 270694 - DNA, 16 bp, P. troglodytes
tgaaattaaaattgct

SEQ ID NO: 270695 - DNA, 16 bp, P. troglodytes
tgaaattaaataattc

SEQ ID NO: 270696 - DNA, 16 bp, P. troglodytes
tgaaattaaatgaaca

SEQ ID NO: 270697 - DNA, 16 bp, P. troglodytes
tgaaattaactttaat

SEQ ID NO: 270698 - DNA, 16 bp, P. troglodytes
tgaaattaaggaagaa

SEQ ID NO: 270699 - DNA, 16 bp, P. troglodytes
tgaaattacaagtgtg

SEQ ID NO: 270700 - DNA, 16 bp, P. troglodytes
tgaaattagttttcct

SEQ ID NO: 270701 - DNA, 16 bp, P. troglodytes
tgaaattataccaagt

SEQ ID NO: 270702 - DNA, 16 bp, P. troglodytes
tgaaattatataaagt

SEQ ID NO: 270703 - DNA, 16 bp, P. troglodytes
tgaaattatctttttt

SEQ ID NO: 270704 - DNA, 16 bp, P. troglodytes
tgaaattattccaatc

SEQ ID NO: 270705 - DNA, 16 bp, P. troglodytes
tgaaattatttcttct

SEQ ID NO: 270706 - DNA, 16 bp, P. troglodytes
tgaaattcaaatttca

SEQ ID NO: 270707 - DNA, 16 bp, P. troglodytes
tgaaattcaattttaa

SEQ ID NO: 270708 - DNA, 16 bp, P. troglodytes
tgaaattcaggctgag

SEQ ID NO: 270709 - DNA, 16 bp, P. troglodytes
tgaaattctatcattt

SEQ ID NO: 270710 - DNA, 16 bp, P. troglodytes
tgaaattctgcatttt

SEQ ID NO: 270711 - DNA, 16 bp, P. troglodytes
tgaaattgaaattgaa

SEQ ID NO: 270712 - DNA, 16 bp, P. troglodytes
tgaaattgaagcagta

SEQ ID NO: 270713 - DNA, 16 bp, P. troglodytes
tgaaattgaattagta

SEQ ID NO: 270714 - DNA, 16 bp, P. troglodytes
tgaaattgaggaagta

SEQ ID NO: 270715 - DNA, 16 bp, P. troglodytes
tgaaattgccaatatt

SEQ ID NO: 270716 - DNA, 16 bp, P. troglodytes
tgaaattgctggatca

SEQ ID NO: 270717 - DNA, 16 bp, P. troglodytes
tgaaattgtatctcat

SEQ ID NO: 270718 - DNA, 16 bp, P. troglodytes
tgaaatttaggcagag

SEQ ID NO: 270719 - DNA, 16 bp, P. troglodytes
tgaaatttcttttctt

SEQ ID NO: 270720 - DNA, 16 bp, P. troglodytes
tgaaatttgaaagtaa

SEQ ID NO: 270721 - DNA, 16 bp, P. troglodytes
tgaaattttatttgaa

SEQ ID NO: 270722 - DNA, 16 bp, P. troglodytes
tgaaattttcagcctt

SEQ ID NO: 270723 - DNA, 16 bp, P. troglodytes
tgaaatttttcttctt

SEQ ID NO: 270724 - DNA, 16 bp, P. troglodytes
tgaaatttttgaaatt

SEQ ID NO: 270725 - DNA, 16 bp, P. troglodytes
tgaacaaataagcaaa

SEQ ID NO: 270726 - DNA, 16 bp, P. troglodytes
tgaacaaatgaataat

SEQ ID NO: 270727 - DNA, 16 bp, P. troglodytes
tgaacaaatgagtgaa

SEQ ID NO: 270728 - DNA, 16 bp, P. troglodytes
tgaacaaatgtacaat

SEQ ID NO: 270729 - DNA, 16 bp, P. troglodytes
tgaacaaattaatgaa

SEQ ID NO: 270730 - DNA, 16 bp, P. troglodytes
tgaacaacagaaatgt

SEQ ID NO: 270731 - DNA, 16 bp, P. troglodytes
tgaacaacctgctgct

SEQ ID NO: 270732 - DNA, 16 bp, P. troglodytes
tgaacaaccttctcct

SEQ ID NO: 270733 - DNA, 16 bp, P. troglodytes
tgaacaagacagataa

SEQ ID NO: 270734 - DNA, 16 bp, P. troglodytes
tgaacaagtttacagt

SEQ ID NO: 270735 - DNA, 16 bp, P. troglodytes
tgaacaatctaaaaat

SEQ ID NO: 270736 - DNA, 16 bp, P. troglodytes
tgaacaatgagaacac

SEQ ID NO: 270737 - DNA, 16 bp, P. troglodytes
tgaacaattagaacac

SEQ ID NO: 270738 - DNA, 16 bp, P. troglodytes
tgaacacacccatgta

SEQ ID NO: 270739 - DNA, 16 bp, P. troglodytes
tgaacacacgaatgat

SEQ ID NO: 270740 - DNA, 16 bp, P. troglodytes
tgaacactggactcca

SEQ ID NO: 270741 - DNA, 16 bp, P. troglodytes
tgaacagaaagtacag

SEQ ID NO: 270742 - DNA, 16 bp, P. troglodytes
tgaacagaaatttctc

SEQ ID NO: 270743 - DNA, 16 bp, P. troglodytes
tgaacagacatttctc

SEQ ID NO: 270744 - DNA, 16 bp, P. troglodytes
tgaacagagatttacc

SEQ ID NO: 270745 - DNA, 16 bp, P. troglodytes
tgaacagcaaaggaaa

SEQ ID NO: 270746 - DNA, 16 bp, P. troglodytes
tgaacatacaaaaatt

SEQ ID NO: 270747 - DNA, 16 bp, P. troglodytes
tgaacatacatgtgta

SEQ ID NO: 270748 - DNA, 16 bp, P. troglodytes
tgaacatagaagcaaa

SEQ ID NO: 270749 - DNA, 16 bp, P. troglodytes
tgaacatagctcactg

SEQ ID NO: 270750 - DNA, 16 bp, P. troglodytes
tgaacatatttataat

SEQ ID NO: 270751 - DNA, 16 bp, P. troglodytes
tgaacatatttccttt

SEQ ID NO: 270752 - DNA, 16 bp, P. troglodytes
tgaacatcaaaataaa

SEQ ID NO: 270753 - DNA, 17 bp, P. troglodytes
tgaacatcaatgtgaaa

SEQ ID NO: 270754 - DNA, 16 bp, P. troglodytes
tgaacatcataatgac

SEQ ID NO: 270755 - DNA, 16 bp, P. troglodytes
tgaacatctatgcaaa

SEQ ID NO: 270756 - DNA, 16 bp, P. troglodytes
tgaacatgcctagtcc

SEQ ID NO: 270757 - DNA, 16 bp, P. troglodytes
tgaacatggacacaaa

SEQ ID NO: 270758 - DNA, 16 bp, P. troglodytes
tgaacattcatgtaca

SEQ ID NO: 270759 - DNA, 16 bp, P. troglodytes
tgaacatttatgtaca

SEQ ID NO: 270760 - DNA, 16 bp, P. troglodytes
tgaacatttattgaat

SEQ ID NO: 270761 - DNA, 16 bp, P. troglodytes
tgaacatttcagttct

SEQ ID NO: 270762 - DNA, 16 bp, P. troglodytes
tgaacatttctcaaaa

SEQ ID NO: 270763 - DNA, 16 bp, P. troglodytes
tgaacatttgaagaaa

SEQ ID NO: 270764 - DNA, 16 bp, P. troglodytes
tgaacatttgtgaaca

SEQ ID NO: 270765 - DNA, 18 bp, P. troglodytes
tgaaccaagatcacacca

SEQ ID NO: 270766 - DNA, 16 bp, P. troglodytes
tgaaccaagtggacct

SEQ ID NO: 270767 - DNA, 16 bp, P. troglodytes
tgaaccaatcacctcc

SEQ ID NO: 270768 - DNA, 16 bp, P. troglodytes
tgaaccaccacgcccg

SEQ ID NO: 270769 - DNA, 16 bp, P. troglodytes
tgaaccaggaagtggg

SEQ ID NO: 270770 - DNA, 16 bp, P. troglodytes
tgaaccagggagacag

SEQ ID NO: 270771 - DNA, 16 bp, P. troglodytes
tgaaccattcttgcat

SEQ ID NO: 270772 - DNA, 16 bp, P. troglodytes
tgaaccatttgaaaat

SEQ ID NO: 270773 - DNA, 16 bp, P. troglodytes
tgaaccatttgaaatt

SEQ ID NO: 270774 - DNA, 16 bp, P. troglodytes
tgaacccaccgggagg

SEQ ID NO: 270775 - DNA, 16 bp, P. troglodytes
tgaacccagaaggtga

SEQ ID NO: 270776 - DNA, 17 bp, P. troglodytes
tgaacccagaaggtgga

SEQ ID NO: 270777 - DNA, 16 bp, P. troglodytes
tgaacccagcaggcgg

SEQ ID NO: 270778 - DNA, 17 bp, P. troglodytes
tgaacccaggagatgga

SEQ ID NO: 270779 - DNA, 16 bp, P. troglodytes
tgaacccaggaggcaa

SEQ ID NO: 270780 - DNA, 16 bp, P. troglodytes
tgaacccaggaggtca

SEQ ID NO: 270781 - DNA, 16 bp, P. troglodytes
tgaacccagggagtct

SEQ ID NO: 270782 - DNA, 16 bp, P. troglodytes
tgaaccccaaatatct

SEQ ID NO: 270783 - DNA, 16 bp, P. troglodytes
tgaaccccagaggcag

SEQ ID NO: 270784 - DNA, 16 bp, P. troglodytes
tgaaccccagcctggg

SEQ ID NO: 270785 - DNA, 16 bp, P. troglodytes
tgaacccgcgaggcag

SEQ ID NO: 270786 - DNA, 16 bp, P. troglodytes
tgaacccgggagacag

SEQ ID NO: 270787 - DNA, 18 bp, P. troglodytes
tgaacccgggagatggag

SEQ ID NO: 270788 - DNA, 17 bp, P. troglodytes
tgaacccgggaggcaga

SEQ ID NO: 270789 - DNA, 17 bp, P. troglodytes
tgaacccgggatgcaga

SEQ ID NO: 270790 - DNA, 16 bp, P. troglodytes
tgaacccgggcggcag

SEQ ID NO: 270791 - DNA, 16 bp, P. troglodytes
tgaacccggggaggcg

SEQ ID NO: 270792 - DNA, 18 bp, P. troglodytes
tgaacccggtaggtggag

SEQ ID NO: 270793 - DNA, 17 bp, P. troglodytes
tgaaccctggaggtgga

SEQ ID NO: 270794 - DNA, 16 bp, P. troglodytes
tgaacctacatggaca

SEQ ID NO: 270795 - DNA, 16 bp, P. troglodytes
tgaacctacattgaca

SEQ ID NO: 270796 - DNA, 16 bp, P. troglodytes
tgaacctcggaggcag

SEQ ID NO: 270797 - DNA, 16 bp, P. troglodytes
tgaacctctgacctca

SEQ ID NO: 270798 - DNA, 16 bp, P. troglodytes
tgaacctgaaataaaa

SEQ ID NO: 270799 - DNA, 16 bp, P. troglodytes
tgaacctgagaggcga

SEQ ID NO: 270800 - DNA, 16 bp, P. troglodytes
tgaacctgagaggtga

SEQ ID NO: 270801 - DNA, 16 bp, P. troglodytes
tgaacctggaaagcag

SEQ ID NO: 270802 - DNA, 16 bp, P. troglodytes
tgaacctggaaggagg

SEQ ID NO: 270803 - DNA, 16 bp, P. troglodytes
tgaacctggaggcaga

SEQ ID NO: 270804 - DNA, 16 bp, P. troglodytes
tgaacctggagggtgg

SEQ ID NO: 270805 - DNA, 16 bp, P. troglodytes
tgaacctgggcagtgg

SEQ ID NO: 270806 - DNA, 16 bp, P. troglodytes
tgaacctgggcggcgg

SEQ ID NO: 270807 - DNA, 16 bp, P. troglodytes
tgaacctggggggcag

SEQ ID NO: 270808 - DNA, 17 bp, P. troglodytes
tgaacctgtgaggtgga

SEQ ID NO: 270809 - DNA, 16 bp, P. troglodytes
tgaacgaatgaatgaa

SEQ ID NO: 270810 - DNA, 16 bp, P. troglodytes
tgaacgcctgacctca

SEQ ID NO: 270811 - DNA, 16 bp, P. troglodytes
tgaacgctgtgctggg

SEQ ID NO: 270812 - DNA, 16 bp, P. troglodytes
tgaactaaaggagatt

SEQ ID NO: 270813 - DNA, 16 bp, P. troglodytes
tgaactaactcagaaa

SEQ ID NO: 270814 - DNA, 16 bp, P. troglodytes
tgaactaactttggga

SEQ ID NO: 270815 - DNA, 16 bp, P. troglodytes
tgaactaatttatact

SEQ ID NO: 270816 - DNA, 16 bp, P. troglodytes
tgaactactttacagt

SEQ ID NO: 270817 - DNA, 16 bp, P. troglodytes
tgaactagtgtgattt

SEQ ID NO: 270818 - DNA, 16 bp, P. troglodytes
tgaactatgatcatgc

SEQ ID NO: 270819 - DNA, 16 bp, P. troglodytes
tgaactcaatctccag

SEQ ID NO: 270820 - DNA, 16 bp, P. troglodytes
tgaactcagccctgga

SEQ ID NO: 270821 - DNA, 16 bp, P. troglodytes
tgaactcatcatattt

SEQ ID NO: 270822 - DNA, 16 bp, P. troglodytes
tgaactcatcctttta

SEQ ID NO: 270823 - DNA, 16 bp, P. troglodytes
tgaactcccattccca

SEQ ID NO: 270824 - DNA, 17 bp, P. troglodytes
tgaactcctgacctcaa

SEQ ID NO: 270825 - DNA, 17 bp, P. troglodytes
tgaactcctgacctcac

SEQ ID NO: 270826 - DNA, 16 bp, P. troglodytes
tgaactcctgacctct

SEQ ID NO: 270827 - DNA, 17 bp, P. troglodytes
tgaactcctgaccttgg

SEQ ID NO: 270828 - DNA, 16 bp, P. troglodytes
tgaactcctgagctcg

SEQ ID NO: 270829 - DNA, 16 bp, P. troglodytes
tgaactcctgatccca

SEQ ID NO: 270830 - DNA, 16 bp, P. troglodytes
tgaactcctggattca

SEQ ID NO: 270831 - DNA, 16 bp, P. troglodytes
tgaactcctggcctca

SEQ ID NO: 270832 - DNA, 17 bp, P. troglodytes
tgaactcctggcctcat

SEQ ID NO: 270833 - DNA, 16 bp, P. troglodytes
tgaactcctggcctcg

SEQ ID NO: 270834 - DNA, 17 bp, P. troglodytes
tgaactcctgggctcag

SEQ ID NO: 270835 - DNA, 16 bp, P. troglodytes
tgaactctgtgagttg

SEQ ID NO: 270836 - DNA, 16 bp, P. troglodytes
tgaactcttgagctca

SEQ ID NO: 270837 - DNA, 16 bp, P. troglodytes
tgaactgaaaaaaata

SEQ ID NO: 270838 - DNA, 16 bp, P. troglodytes
tgaactgaaggaaatc

SEQ ID NO: 270839 - DNA, 16 bp, P. troglodytes
tgaactgaatgaaaat

SEQ ID NO: 270840 - DNA, 16 bp, P. troglodytes
tgaactgacaaggaag

SEQ ID NO: 270841 - DNA, 16 bp, P. troglodytes
tgaacttcagtttctt

SEQ ID NO: 270842 - DNA, 16 bp, P. troglodytes
tgaacttcctggcagc

SEQ ID NO: 270843 - DNA, 16 bp, P. troglodytes
tgaacttcctggtggc

SEQ ID NO: 270844 - DNA, 16 bp, P. troglodytes
tgaacttctgacctca

SEQ ID NO: 270845 - DNA, 16 bp, P. troglodytes
tgaacttctggcctca

SEQ ID NO: 270846 - DNA, 16 bp, P. troglodytes
tgaacttctttctttt

SEQ ID NO: 270847 - DNA, 16 bp, P. troglodytes
tgaacttgggaggggg

SEQ ID NO: 270848 - DNA, 16 bp, P. troglodytes
tgaactttgaaaacat

SEQ ID NO: 270849 - DNA, 17 bp, P. troglodytes
tgaactttgtaacaatt

SEQ ID NO: 270850 - DNA, 16 bp, P. troglodytes
tgaacttttaaaacat

SEQ ID NO: 270851 - DNA, 16 bp, P. troglodytes
tgaactttttttcata

SEQ ID NO: 270852 - DNA, 16 bp, P. troglodytes
tgaagaaaaataaagc

SEQ ID NO: 270853 - DNA, 16 bp, P. troglodytes
tgaagaaaaattattt

SEQ ID NO: 270854 - DNA, 16 bp, P. troglodytes
tgaagaaaacacaaat

SEQ ID NO: 270855 - DNA, 16 bp, P. troglodytes
tgaagaaaacagaaat

SEQ ID NO: 270856 - DNA, 16 bp, P. troglodytes
tgaagaaaacaggttt

SEQ ID NO: 270857 - DNA, 16 bp, P. troglodytes
tgaagaaaagagtttt

SEQ ID NO: 270858 - DNA, 16 bp, P. troglodytes
tgaagaaaaggcattt

SEQ ID NO: 270859 - DNA, 16 bp, P. troglodytes
tgaagaaaagttgaaa

SEQ ID NO: 270860 - DNA, 16 bp, P. troglodytes
tgaagaaaataaagca

SEQ ID NO: 270861 - DNA, 16 bp, P. troglodytes
tgaagaaaatgaaaca

SEQ ID NO: 270862 - DNA, 16 bp, P. troglodytes
tgaagaaaatgaaatg

SEQ ID NO: 270863 - DNA, 16 bp, P. troglodytes
tgaagaaaatgaagct

SEQ ID NO: 270864 - DNA, 16 bp, P. troglodytes
tgaagaaaatgtaaat

SEQ ID NO: 270865 - DNA, 16 bp, P. troglodytes
tgaagaaaattttatt

SEQ ID NO: 270866 - DNA, 16 bp, P. troglodytes
tgaagaaacaaaggct

SEQ ID NO: 270867 - DNA, 16 bp, P. troglodytes
tgaagaaacagaagga

SEQ ID NO: 270868 - DNA, 16 bp, P. troglodytes
tgaagaaacatttatt

SEQ ID NO: 270869 - DNA, 16 bp, P. troglodytes
tgaagaaactaaggca

SEQ ID NO: 270870 - DNA, 16 bp, P. troglodytes
tgaagaaactgaaaaa

SEQ ID NO: 270871 - DNA, 16 bp, P. troglodytes
tgaagaaactgaaact

SEQ ID NO: 270872 - DNA, 16 bp, P. troglodytes
tgaagaaactgaagcc

SEQ ID NO: 270873 - DNA, 16 bp, P. troglodytes
tgaagaaactgaagta

SEQ ID NO: 270874 - DNA, 16 bp, P. troglodytes
tgaagaaactgaagtt

SEQ ID NO: 270875 - DNA, 16 bp, P. troglodytes
tgaagaaactgaatca

SEQ ID NO: 270876 - DNA, 16 bp, P. troglodytes
tgaagaaactgaggca

SEQ ID NO: 270877 - DNA, 16 bp, P. troglodytes
tgaagaaactgcacca

SEQ ID NO: 270878 - DNA, 16 bp, P. troglodytes
tgaagaaactttaaaa

SEQ ID NO: 270879 - DNA, 16 bp, P. troglodytes
tgaagaaagaaaatgt

SEQ ID NO: 270880 - DNA, 16 bp, P. troglodytes
tgaagaaagaaatttt

SEQ ID NO: 270881 - DNA, 16 bp, P. troglodytes
tgaagaaagttattgg

SEQ ID NO: 270882 - DNA, 16 bp, P. troglodytes
tgaagaaataccagag

SEQ ID NO: 270883 - DNA, 16 bp, P. troglodytes
tgaagaaatacttgag

SEQ ID NO: 270884 - DNA, 16 bp, P. troglodytes
tgaagaaatatctgag

SEQ ID NO: 270885 - DNA, 16 bp, P. troglodytes
tgaagaaatatttgta

SEQ ID NO: 270886 - DNA, 16 bp, P. troglodytes
tgaagaaatcaaggct

SEQ ID NO: 270887 - DNA, 16 bp, P. troglodytes
tgaagaaatcagaaaa

SEQ ID NO: 270888 - DNA, 16 bp, P. troglodytes
tgaagaaatgaatgaa

SEQ ID NO: 270889 - DNA, 17 bp, P. troglodytes
tgaagaaatgctcaaca

SEQ ID NO: 270890 - DNA, 16 bp, P. troglodytes
tgaagaaatggaaata

SEQ ID NO: 270891 - DNA, 16 bp, P. troglodytes
tgaagaaatggaggca

SEQ ID NO: 270892 - DNA, 16 bp, P. troglodytes
tgaagaaattgaaaat

SEQ ID NO: 270893 - DNA, 16 bp, P. troglodytes
tgaagaaattgaagca

SEQ ID NO: 270894 - DNA, 16 bp, P. troglodytes
tgaagaacaaagaaca

SEQ ID NO: 270895 - DNA, 16 bp, P. troglodytes
tgaagaacaacaacaa

SEQ ID NO: 270896 - DNA, 16 bp, P. troglodytes
tgaagaacagagaaaa

SEQ ID NO: 270897 - DNA, 16 bp, P. troglodytes
tgaagaactcctttta

SEQ ID NO: 270898 - DNA, 16 bp, P. troglodytes
tgaagaactctcttta

SEQ ID NO: 270899 - DNA, 16 bp, P. troglodytes
tgaagaactgaaagaa

SEQ ID NO: 270900 - DNA, 16 bp, P. troglodytes
tgaagaactgaatttt

SEQ ID NO: 270901 - DNA, 16 bp, P. troglodytes
tgaagaactgcctgag

SEQ ID NO: 270902 - DNA, 16 bp, P. troglodytes
tgaagaacttgcagtc

SEQ ID NO: 270903 - DNA, 16 bp, P. troglodytes
tgaagaactttttaaa

SEQ ID NO: 270904 - DNA, 16 bp, P. troglodytes
tgaagaagaaaaccaa

SEQ ID NO: 270905 - DNA, 16 bp, P. troglodytes
tgaagaagaaatcaag

SEQ ID NO: 270906 - DNA, 16 bp, P. troglodytes
tgaagaagacaaaaat

SEQ ID NO: 270907 - DNA, 16 bp, P. troglodytes
tgaagaagacacaaac

SEQ ID NO: 270908 - DNA, 16 bp, P. troglodytes
tgaagaagacaccaaa

SEQ ID NO: 270909 - DNA, 16 bp, P. troglodytes
tgaagaagatgaagat

SEQ ID NO: 270910 - DNA, 16 bp, P. troglodytes
tgaagaagctgcagaa

SEQ ID NO: 270911 - DNA, 16 bp, P. troglodytes
tgaagaaggaaaacaa

SEQ ID NO: 270912 - DNA, 16 bp, P. troglodytes
tgaagaaggacatatt

SEQ ID NO: 270913 - DNA, 16 bp, P. troglodytes
tgaagaaggagaatca

SEQ ID NO: 270914 - DNA, 16 bp, P. troglodytes
tgaagaatattttatt

SEQ ID NO: 270915 - DNA, 16 bp, P. troglodytes
tgaagaatgagaagga

SEQ ID NO: 270916 - DNA, 16 bp, P. troglodytes
tgaagaatgatgatgg

SEQ ID NO: 270917 - DNA, 16 bp, P. troglodytes
tgaagaatgatggtgg

SEQ ID NO: 270918 - DNA, 25 bp, P. troglodytes
tgaagaatgcagaagcctcaggagc

SEQ ID NO: 270919 - DNA, 16 bp, P. troglodytes
tgaagaatgcattaga

SEQ ID NO: 270920 - DNA, 16 bp, P. troglodytes
tgaagaatgctgctat

SEQ ID NO: 270921 - DNA, 16 bp, P. troglodytes
tgaagaatgggagaaa

SEQ ID NO: 270922 - DNA, 16 bp, P. troglodytes
tgaagaatgtcagtgg

SEQ ID NO: 270923 - DNA, 16 bp, P. troglodytes
tgaagaatgtgacaaa

SEQ ID NO: 270924 - DNA, 16 bp, P. troglodytes
tgaagaatgtggaaaa

SEQ ID NO: 270925 - DNA, 16 bp, P. troglodytes
tgaagaattcaataaa

SEQ ID NO: 270926 - DNA, 16 bp, P. troglodytes
tgaagaatttccttta

SEQ ID NO: 270927 - DNA, 16 bp, P. troglodytes
tgaagaattttataaa

SEQ ID NO: 270928 - DNA, 16 bp, P. troglodytes
tgaagaatttttcttt

SEQ ID NO: 270929 - DNA, 16 bp, P. troglodytes
tgaagacacagaaaga

SEQ ID NO: 270930 - DNA, 16 bp, P. troglodytes
tgaagacacagagaca

SEQ ID NO: 270931 - DNA, 16 bp, P. troglodytes
tgaagacagagacaca

SEQ ID NO: 270932 - DNA, 16 bp, P. troglodytes
tgaagacagagtctca

SEQ ID NO: 270933 - DNA, 16 bp, P. troglodytes
tgaagacaggctactt

SEQ ID NO: 270934 - DNA, 16 bp, P. troglodytes
tgaagacaggttattt

SEQ ID NO: 270935 - DNA, 16 bp, P. troglodytes
tgaagacagtaaaaag

SEQ ID NO: 270936 - DNA, 16 bp, P. troglodytes
tgaagacatagcaaga

SEQ ID NO: 270937 - DNA, 16 bp, P. troglodytes
tgaagacatttttaaa

SEQ ID NO: 270938 - DNA, 16 bp, P. troglodytes
tgaagaccagtctggg

SEQ ID NO: 270939 - DNA, 16 bp, P. troglodytes
tgaagacccaaagatg

SEQ ID NO: 270940 - DNA, 16 bp, P. troglodytes
tgaagaccttccagtg

SEQ ID NO: 270941 - DNA, 16 bp, P. troglodytes
tgaagacggaggcaga

SEQ ID NO: 270942 - DNA, 16 bp, P. troglodytes
tgaagactccaccaaa

SEQ ID NO: 270943 - DNA, 16 bp, P. troglodytes
tgaagactgtgggaaa

SEQ ID NO: 270944 - DNA, 16 bp, P. troglodytes
tgaagagaaaatattt

SEQ ID NO: 270945 - DNA, 16 bp, P. troglodytes
tgaagagaccactaaa

SEQ ID NO: 270946 - DNA, 16 bp, P. troglodytes
tgaagagactattctt

SEQ ID NO: 270947 - DNA, 16 bp, P. troglodytes
tgaagagactgtcctt

SEQ ID NO: 270948 - DNA, 16 bp, P. troglodytes
tgaagagactgttctt

SEQ ID NO: 270949 - DNA, 16 bp, P. troglodytes
tgaagagatatttgta

SEQ ID NO: 270950 - DNA, 16 bp, P. troglodytes
tgaagagatgccttcc

SEQ ID NO: 270951 - DNA, 16 bp, P. troglodytes
tgaagagctctgtgat

SEQ ID NO: 270952 - DNA, 16 bp, P. troglodytes
tgaagagcttggagtc

SEQ ID NO: 270953 - DNA, 16 bp, P. troglodytes
tgaagagctttaaaaa

SEQ ID NO: 270954 - DNA, 16 bp, P. troglodytes
tgaagaggaaggaggc

SEQ ID NO: 270955 - DNA, 16 bp, P. troglodytes
tgaagaggtccttgac

SEQ ID NO: 270956 - DNA, 16 bp, P. troglodytes
tgaagagttgagagaa

SEQ ID NO: 270957 - DNA, 16 bp, P. troglodytes
tgaagataatatttta

SEQ ID NO: 270958 - DNA, 16 bp, P. troglodytes
tgaagatattaccttt

SEQ ID NO: 270959 - DNA, 16 bp, P. troglodytes
tgaagatatttattct

SEQ ID NO: 270960 - DNA, 16 bp, P. troglodytes
tgaagatcagatggtc

SEQ ID NO: 270961 - DNA, 16 bp, P. troglodytes
tgaagatcattgagat

SEQ ID NO: 270962 - DNA, 16 bp, P. troglodytes
tgaagatctaaataaa

SEQ ID NO: 270963 - DNA, 16 bp, P. troglodytes
tgaagatgagaaactt

SEQ ID NO: 270964 - DNA, 16 bp, P. troglodytes
tgaagatgatgaagat

SEQ ID NO: 270965 - DNA, 16 bp, P. troglodytes
tgaagatgatgagaat

SEQ ID NO: 270966 - DNA, 16 bp, P. troglodytes
tgaagatgatgatggt

SEQ ID NO: 270967 - DNA, 16 bp, P. troglodytes
tgaagatgattttgag

SEQ ID NO: 270968 - DNA, 16 bp, P. troglodytes
tgaagatggaaaccat

SEQ ID NO: 270969 - DNA, 16 bp, P. troglodytes
tgaagatggagacaga

SEQ ID NO: 270970 - DNA, 16 bp, P. troglodytes
tgaagatggaggaaaa

SEQ ID NO: 270971 - DNA, 16 bp, P. troglodytes
tgaagatggaggagga

SEQ ID NO: 270972 - DNA, 16 bp, P. troglodytes
tgaagatggagtctcg

SEQ ID NO: 270973 - DNA, 16 bp, P. troglodytes
tgaagatggggagaaa

SEQ ID NO: 270974 - DNA, 16 bp, P. troglodytes
tgaagatgtgaatgaa

SEQ ID NO: 270975 - DNA, 16 bp, P. troglodytes
tgaagatgtggaaaaa

SEQ ID NO: 270976 - DNA, 16 bp, P. troglodytes
tgaagattacatgaga

SEQ ID NO: 270977 - DNA, 16 bp, P. troglodytes
tgaagattccagagga

SEQ ID NO: 270978 - DNA, 16 bp, P. troglodytes
tgaagatttctcccct

SEQ ID NO: 270979 - DNA, 16 bp, P. troglodytes
tgaagattttaaaaat

SEQ ID NO: 270980 - DNA, 16 bp, P. troglodytes
tgaagcaaaataaaat

SEQ ID NO: 270981 - DNA, 16 bp, P. troglodytes
tgaagcaaacaaacaa

SEQ ID NO: 270982 - DNA, 16 bp, P. troglodytes
tgaagcaaaggtgact

SEQ ID NO: 270983 - DNA, 16 bp, P. troglodytes
tgaagcaactgaagaa

SEQ ID NO: 270984 - DNA, 16 bp, P. troglodytes
tgaagcaagtgaagaa

SEQ ID NO: 270985 - DNA, 16 bp, P. troglodytes
tgaagcacaccaacat

SEQ ID NO: 270986 - DNA, 16 bp, P. troglodytes
tgaagcacagagaggt

SEQ ID NO: 270987 - DNA, 16 bp, P. troglodytes
tgaagcagaaataaaa

SEQ ID NO: 270988 - DNA, 16 bp, P. troglodytes
tgaagcagaagaaaga

SEQ ID NO: 270989 - DNA, 16 bp, P. troglodytes
tgaagcagaaggaaaa

SEQ ID NO: 270990 - DNA, 16 bp, P. troglodytes
tgaagcagagaattgc

SEQ ID NO: 270991 - DNA, 16 bp, P. troglodytes
tgaagcaggaaaatca

SEQ ID NO: 270992 - DNA, 16 bp, P. troglodytes
tgaagcaggaaaatgg

SEQ ID NO: 270993 - DNA, 16 bp, P. troglodytes
tgaagcaggaagaaat

SEQ ID NO: 270994 - DNA, 16 bp, P. troglodytes
tgaagcaggagcatca

SEQ ID NO: 270995 - DNA, 16 bp, P. troglodytes
tgaagcaggaggatct

SEQ ID NO: 270996 - DNA, 16 bp, P. troglodytes
tgaagcagggtggggc

SEQ ID NO: 270997 - DNA, 16 bp, P. troglodytes
tgaagcagggttttct

SEQ ID NO: 270998 - DNA, 18 bp, P. troglodytes
tgaagcaggtggatcact

SEQ ID NO: 270999 - DNA, 16 bp, P. troglodytes
tgaagcagtgttgaat

SEQ ID NO: 271000 - DNA, 20 bp, P. troglodytes
tgaagcatacacaagtatca

SEQ ID NO: 271001 - DNA, 16 bp, P. troglodytes
tgaagcatttttaaaa

SEQ ID NO: 271002 - DNA, 16 bp, P. troglodytes
tgaagccaacttggtc

SEQ ID NO: 271003 - DNA, 16 bp, P. troglodytes
tgaagccacggaccct

SEQ ID NO: 271004 - DNA, 16 bp, P. troglodytes
tgaagccagaagccat

SEQ ID NO: 271005 - DNA, 16 bp, P. troglodytes
tgaagccagacaactt

SEQ ID NO: 271006 - DNA, 16 bp, P. troglodytes
tgaagccagcatagca

SEQ ID NO: 271007 - DNA, 16 bp, P. troglodytes
tgaagccaggggttca

SEQ ID NO: 271008 - DNA, 16 bp, P. troglodytes
tgaagccatcaagtcc

SEQ ID NO: 271009 - DNA, 16 bp, P. troglodytes
tgaagccatggcccaa

SEQ ID NO: 271010 - DNA, 16 bp, P. troglodytes
tgaagcccagagaggt

SEQ ID NO: 271011 - DNA, 16 bp, P. troglodytes
tgaagccccaccttca

SEQ ID NO: 271012 - DNA, 16 bp, P. troglodytes
tgaagcccttgcccat

SEQ ID NO: 271013 - DNA, 16 bp, P. troglodytes
tgaagcctctccagcc

SEQ ID NO: 271014 - DNA, 16 bp, P. troglodytes
tgaagctcagaaaggt

SEQ ID NO: 271015 - DNA, 16 bp, P. troglodytes
tgaagctccaaaatga

SEQ ID NO: 271016 - DNA, 16 bp, P. troglodytes
tgaagctgcagacttt

SEQ ID NO: 271017 - DNA, 16 bp, P. troglodytes
tgaagctgcagtgacc

SEQ ID NO: 271018 - DNA, 18 bp, P. troglodytes
tgaagctgcagtgagcta

SEQ ID NO: 271019 - DNA, 16 bp, P. troglodytes
tgaagctggaaaccac

SEQ ID NO: 271020 - DNA, 16 bp, P. troglodytes
tgaagctggaagccat

SEQ ID NO: 271021 - DNA, 17 bp, P. troglodytes
tgaagctggaagccatc

SEQ ID NO: 271022 - DNA, 16 bp, P. troglodytes
tgaagctggaggccat

SEQ ID NO: 271023 - DNA, 16 bp, P. troglodytes
tgaagcttagtttgac

SEQ ID NO: 271024 - DNA, 16 bp, P. troglodytes
tgaagcttcactcact

SEQ ID NO: 271025 - DNA, 16 bp, P. troglodytes
tgaagcttccagagga

SEQ ID NO: 271026 - DNA, 16 bp, P. troglodytes
tgaagcttccataaaa

SEQ ID NO: 271027 - DNA, 16 bp, P. troglodytes
tgaagctttgcggcag

SEQ ID NO: 271028 - DNA, 16 bp, P. troglodytes
tgaaggaaaaaaatgt

SEQ ID NO: 271029 - DNA, 16 bp, P. troglodytes
tgaaggaaaaaatgat

SEQ ID NO: 271030 - DNA, 16 bp, P. troglodytes
tgaaggaaagaagcca

SEQ ID NO: 271031 - DNA, 16 bp, P. troglodytes
tgaaggaaatcataga

SEQ ID NO: 271032 - DNA, 16 bp, P. troglodytes
tgaaggaactcttcaa

SEQ ID NO: 271033 - DNA, 16 bp, P. troglodytes
tgaaggaagcactgaa

SEQ ID NO: 271034 - DNA, 16 bp, P. troglodytes
tgaaggaagcagtaaa

SEQ ID NO: 271035 - DNA, 16 bp, P. troglodytes
tgaaggaatgagtgaa

SEQ ID NO: 271036 - DNA, 16 bp, P. troglodytes
tgaaggacaaaaatca

SEQ ID NO: 271037 - DNA, 16 bp, P. troglodytes
tgaaggacaaaaccat

SEQ ID NO: 271038 - DNA, 16 bp, P. troglodytes
tgaaggacattctaca

SEQ ID NO: 271039 - DNA, 16 bp, P. troglodytes
tgaaggacctcttcag

SEQ ID NO: 271040 - DNA, 17 bp, P. troglodytes
tgaaggactactgggta

SEQ ID NO: 271041 - DNA, 16 bp, P. troglodytes
tgaaggagaagaacaa

SEQ ID NO: 271042 - DNA, 16 bp, P. troglodytes
tgaaggagaagaggca

SEQ ID NO: 271043 - DNA, 16 bp, P. troglodytes
tgaaggaggtcctgaa

SEQ ID NO: 271044 - DNA, 16 bp, P. troglodytes
tgaaggaggtgaagga

SEQ ID NO: 271045 - DNA, 16 bp, P. troglodytes
tgaaggaggtgagaga

SEQ ID NO: 271046 - DNA, 16 bp, P. troglodytes
tgaaggatatgaacaa

SEQ ID NO: 271047 - DNA, 16 bp, P. troglodytes
tgaaggatgagtagga

SEQ ID NO: 271048 - DNA, 16 bp, P. troglodytes
tgaaggcacaaaactc

SEQ ID NO: 271049 - DNA, 16 bp, P. troglodytes
tgaaggcacaaataaa

SEQ ID NO: 271050 - DNA, 16 bp, P. troglodytes
tgaaggcagccaggag

SEQ ID NO: 271051 - DNA, 16 bp, P. troglodytes
tgaaggcatttcagaa

SEQ ID NO: 271052 - DNA, 21 bp, P. troglodytes
tgaaggccaactaatcttaaa

SEQ ID NO: 271053 - DNA, 16 bp, P. troglodytes
tgaaggccaggctgag

SEQ ID NO: 271054 - DNA, 16 bp, P. troglodytes
tgaaggccctcttcaa

SEQ ID NO: 271055 - DNA, 16 bp, P. troglodytes
tgaaggcttcttctct

SEQ ID NO: 271056 - DNA, 16 bp, P. troglodytes
tgaaggctttcccaca

SEQ ID NO: 271057 - DNA, 16 bp, P. troglodytes
tgaagggatttttttt

SEQ ID NO: 271058 - DNA, 16 bp, P. troglodytes
tgaagggcagccagag

SEQ ID NO: 271059 - DNA, 16 bp, P. troglodytes
tgaaggggaagcagac

SEQ ID NO: 271060 - DNA, 16 bp, P. troglodytes
tgaaggggatggcatt

SEQ ID NO: 271061 - DNA, 16 bp, P. troglodytes
tgaaggggcaaaaact

SEQ ID NO: 271062 - DNA, 16 bp, P. troglodytes
tgaaggtgaaggggaa

SEQ ID NO: 271063 - DNA, 16 bp, P. troglodytes
tgaaggtggagccctc

SEQ ID NO: 271064 - DNA, 16 bp, P. troglodytes
tgaaggtggggcctgg

SEQ ID NO: 271065 - DNA, 16 bp, P. troglodytes
tgaaggtgtttctgga

SEQ ID NO: 271066 - DNA, 16 bp, P. troglodytes
tgaaggttaagttgat

SEQ ID NO: 271067 - DNA, 16 bp, P. troglodytes
tgaaggttcagatgat

SEQ ID NO: 271068 - DNA, 16 bp, P. troglodytes
tgaaggtttgtggcaa

SEQ ID NO: 271069 - DNA, 16 bp, P. troglodytes
tgaaggtttttttaaa

SEQ ID NO: 271070 - DNA, 16 bp, P. troglodytes
tgaagtaaaataaggg

SEQ ID NO: 271071 - DNA, 16 bp, P. troglodytes
tgaagtaaaataattt

SEQ ID NO: 271072 - DNA, 16 bp, P. troglodytes
tgaagtaactgaagaa

SEQ ID NO: 271073 - DNA, 16 bp, P. troglodytes
tgaagtatttagggat

SEQ ID NO: 271074 - DNA, 16 bp, P. troglodytes
tgaagtattttaaagt

SEQ ID NO: 271075 - DNA, 16 bp, P. troglodytes
tgaagtcacaattaca

SEQ ID NO: 271076 - DNA, 17 bp, P. troglodytes
tgaagtcagcaagacca

SEQ ID NO: 271077 - DNA, 16 bp, P. troglodytes
tgaagtcaggagattg

SEQ ID NO: 271078 - DNA, 16 bp, P. troglodytes
tgaagtcataataaaa

SEQ ID NO: 271079 - DNA, 16 bp, P. troglodytes
tgaagtcccagctact

SEQ ID NO: 271080 - DNA, 16 bp, P. troglodytes
tgaagtctccataaaa

SEQ ID NO: 271081 - DNA, 16 bp, P. troglodytes
tgaagtctgagatttt

SEQ ID NO: 271082 - DNA, 16 bp, P. troglodytes
tgaagtctttgaccat

SEQ ID NO: 271083 - DNA, 16 bp, P. troglodytes
tgaagtgagagaatca

SEQ ID NO: 271084 - DNA, 16 bp, P. troglodytes
tgaagtgagctgagat

SEQ ID NO: 271085 - DNA, 16 bp, P. troglodytes
tgaagtgatttgccca

SEQ ID NO: 271086 - DNA, 16 bp, P. troglodytes
tgaagtgcaatggtgc

SEQ ID NO: 271087 - DNA, 16 bp, P. troglodytes
tgaagtgctgggatta

SEQ ID NO: 271088 - DNA, 16 bp, P. troglodytes
tgaagtggcatctcat

SEQ ID NO: 271089 - DNA, 16 bp, P. troglodytes
tgaagtgggaagattg

SEQ ID NO: 271090 - DNA, 16 bp, P. troglodytes
tgaagtgggagaatcg

SEQ ID NO: 271091 - DNA, 16 bp, P. troglodytes
tgaagtgggagaatgg

SEQ ID NO: 271092 - DNA, 16 bp, P. troglodytes
tgaagtgggaggattg

SEQ ID NO: 271093 - DNA, 16 bp, P. troglodytes
tgaagtgggcttcatc

SEQ ID NO: 271094 - DNA, 16 bp, P. troglodytes
tgaagtgggtattatt

SEQ ID NO: 271095 - DNA, 16 bp, P. troglodytes
tgaagtgtagtggcat

SEQ ID NO: 271096 - DNA, 16 bp, P. troglodytes
tgaagtgttccagaaa

SEQ ID NO: 271097 - DNA, 16 bp, P. troglodytes
tgaagttaaaaacaaa

SEQ ID NO: 271098 - DNA, 16 bp, P. troglodytes
tgaagttaaataactt

SEQ ID NO: 271099 - DNA, 16 bp, P. troglodytes
tgaagttaattttaat

SEQ ID NO: 271100 - DNA, 16 bp, P. troglodytes
tgaagtttgaatatga

SEQ ID NO: 271101 - DNA, 16 bp, P. troglodytes
tgaagtttggcagtta

SEQ ID NO: 271102 - DNA, 16 bp, P. troglodytes
tgaagttttaaaaatg

SEQ ID NO: 271103 - DNA, 16 bp, P. troglodytes
tgaagttttaaaattt

SEQ ID NO: 271104 - DNA, 16 bp, P. troglodytes
tgaagttttctttatt

SEQ ID NO: 271105 - DNA, 16 bp, P. troglodytes
tgaagttttgctgggg

SEQ ID NO: 271106 - DNA, 16 bp, P. troglodytes
tgaagttttgggcacg

SEQ ID NO: 271107 - DNA, 16 bp, P. troglodytes
tgaataaaatctgttt

SEQ ID NO: 271108 - DNA, 16 bp, P. troglodytes
tgaataaaatgagaat

SEQ ID NO: 271109 - DNA, 16 bp, P. troglodytes
tgaataaaatgtattt

SEQ ID NO: 271110 - DNA, 16 bp, P. troglodytes
tgaataaacaaaatgc

SEQ ID NO: 271111 - DNA, 16 bp, P. troglodytes
tgaataaagaatgaat

SEQ ID NO: 271112 - DNA, 16 bp, P. troglodytes
tgaataaataaatgag

SEQ ID NO: 271113 - DNA, 16 bp, P. troglodytes
tgaataaataaatgtt

SEQ ID NO: 271114 - DNA, 16 bp, P. troglodytes
tgaataaatagatgaa

SEQ ID NO: 271115 - DNA, 16 bp, P. troglodytes
tgaataaatgaacaaa

SEQ ID NO: 271116 - DNA, 16 bp, P. troglodytes
tgaataaatgaaccaa

SEQ ID NO: 271117 - DNA, 16 bp, P. troglodytes
tgaataaatgaatgca

SEQ ID NO: 271118 - DNA, 16 bp, P. troglodytes
tgaataaatggatgaa

SEQ ID NO: 271119 - DNA, 16 bp, P. troglodytes
tgaataaattcttgga

SEQ ID NO: 271120 - DNA, 16 bp, P. troglodytes
tgaataacaaaagaca

SEQ ID NO: 271121 - DNA, 16 bp, P. troglodytes
tgaataagaaatattt

SEQ ID NO: 271122 - DNA, 16 bp, P. troglodytes
tgaataagcaaatgaa

SEQ ID NO: 271123 - DNA, 16 bp, P. troglodytes
tgaataagtcttatga

SEQ ID NO: 271124 - DNA, 16 bp, P. troglodytes
tgaataatattccctt

SEQ ID NO: 271125 - DNA, 16 bp, P. troglodytes
tgaataatatttgatt

SEQ ID NO: 271126 - DNA, 16 bp, P. troglodytes
tgaataatcatgtaag

SEQ ID NO: 271127 - DNA, 16 bp, P. troglodytes
tgaataatgctatgaa

SEQ ID NO: 271128 - DNA, 16 bp, P. troglodytes
tgaataatgctggaat

SEQ ID NO: 271129 - DNA, 16 bp, P. troglodytes
tgaataatttcatttt

SEQ ID NO: 271130 - DNA, 16 bp, P. troglodytes
tgaatacaatgtggaa

SEQ ID NO: 271131 - DNA, 16 bp, P. troglodytes
tgaatacagcacacca

SEQ ID NO: 271132 - DNA, 16 bp, P. troglodytes
tgaatacataaataca

SEQ ID NO: 271133 - DNA, 16 bp, P. troglodytes
tgaatacatgaataca

SEQ ID NO: 271134 - DNA, 16 bp, P. troglodytes
tgaatacatgaatgaa

SEQ ID NO: 271135 - DNA, 16 bp, P. troglodytes
tgaatacatggaaatt

SEQ ID NO: 271136 - DNA, 16 bp, P. troglodytes
tgaatacatttttaaa

SEQ ID NO: 271137 - DNA, 16 bp, P. troglodytes
tgaatagaaatagtga

SEQ ID NO: 271138 - DNA, 16 bp, P. troglodytes
tgaatagaagtggtaa

SEQ ID NO: 271139 - DNA, 16 bp, P. troglodytes
tgaatagacatttctc

SEQ ID NO: 271140 - DNA, 16 bp, P. troglodytes
tgaatagacatttttc

SEQ ID NO: 271141 - DNA, 16 bp, P. troglodytes
tgaatagattaatcca

SEQ ID NO: 271142 - DNA, 16 bp, P. troglodytes
tgaataggaaacattt

SEQ ID NO: 271143 - DNA, 16 bp, P. troglodytes
tgaatagtaaatatgt

SEQ ID NO: 271144 - DNA, 16 bp, P. troglodytes
tgaatagtgctgtgat

SEQ ID NO: 271145 - DNA, 16 bp, P. troglodytes
tgaatagtttgaaaat

SEQ ID NO: 271146 - DNA, 16 bp, P. troglodytes
tgaatataaatggatt

SEQ ID NO: 271147 - DNA, 16 bp, P. troglodytes
tgaatatactattcta

SEQ ID NO: 271148 - DNA, 16 bp, P. troglodytes
tgaatatacttttttt

SEQ ID NO: 271149 - DNA, 16 bp, P. troglodytes
tgaatatattttgcat

SEQ ID NO: 271150 - DNA, 16 bp, P. troglodytes
tgaatatcagatggtt

SEQ ID NO: 271151 - DNA, 16 bp, P. troglodytes
tgaatatctacatgca

SEQ ID NO: 271152 - DNA, 16 bp, P. troglodytes
tgaatatctactatgt

SEQ ID NO: 271153 - DNA, 16 bp, P. troglodytes
tgaatatgctttattt

SEQ ID NO: 271154 - DNA, 16 bp, P. troglodytes
tgaatatgtcattcca

SEQ ID NO: 271155 - DNA, 16 bp, P. troglodytes
tgaatattaaatgaga

SEQ ID NO: 271156 - DNA, 16 bp, P. troglodytes
tgaatattaatccttt

SEQ ID NO: 271157 - DNA, 16 bp, P. troglodytes
tgaatattcatataca

SEQ ID NO: 271158 - DNA, 16 bp, P. troglodytes
tgaatattgatatctt

SEQ ID NO: 271159 - DNA, 16 bp, P. troglodytes
tgaatatttattaagc

SEQ ID NO: 271160 - DNA, 16 bp, P. troglodytes
tgaatatttcaaaata

SEQ ID NO: 271161 - DNA, 16 bp, P. troglodytes
tgaatattttaaaaga

SEQ ID NO: 271162 - DNA, 16 bp, P. troglodytes
tgaatattttaagcac

SEQ ID NO: 271163 - DNA, 16 bp, P. troglodytes
tgaatattttcaaatg

SEQ ID NO: 271164 - DNA, 16 bp, P. troglodytes
tgaatattttcatttt

SEQ ID NO: 271165 - DNA, 16 bp, P. troglodytes
tgaatatttttagaaa

SEQ ID NO: 271166 - DNA, 16 bp, P. troglodytes
tgaatcaaaaactctg

SEQ ID NO: 271167 - DNA, 16 bp, P. troglodytes
tgaatcaccaacacca

SEQ ID NO: 271168 - DNA, 16 bp, P. troglodytes
tgaatcatggaagcag

SEQ ID NO: 271169 - DNA, 16 bp, P. troglodytes
tgaatcatttccagaa

SEQ ID NO: 271170 - DNA, 16 bp, P. troglodytes
tgaatccaggaggtgg

SEQ ID NO: 271171 - DNA, 16 bp, P. troglodytes
tgaatccatctggtct

SEQ ID NO: 271172 - DNA, 16 bp, P. troglodytes
tgaatccccgtctcta

SEQ ID NO: 271173 - DNA, 20 bp, P. troglodytes
tgaatccgggaggcggagct

SEQ ID NO: 271174 - DNA, 16 bp, P. troglodytes
tgaatctaaaagaaaa

SEQ ID NO: 271175 - DNA, 16 bp, P. troglodytes
tgaatctaaaataaaa

SEQ ID NO: 271176 - DNA, 16 bp, P. troglodytes
tgaatctaaaatacaa

SEQ ID NO: 271177 - DNA, 16 bp, P. troglodytes
tgaatctcagctccac

SEQ ID NO: 271178 - DNA, 16 bp, P. troglodytes
tgaatctctgaagaga

SEQ ID NO: 271179 - DNA, 16 bp, P. troglodytes
tgaatctgaaactctg

SEQ ID NO: 271180 - DNA, 16 bp, P. troglodytes
tgaatctgggagttgg

SEQ ID NO: 271181 - DNA, 16 bp, P. troglodytes
tgaatctgggtgctgc

SEQ ID NO: 271182 - DNA, 16 bp, P. troglodytes
tgaatctgtaattatt

SEQ ID NO: 271183 - DNA, 16 bp, P. troglodytes
tgaatctgtggatgtg

SEQ ID NO: 271184 - DNA, 16 bp, P. troglodytes
tgaatcttttaaaaaa

SEQ ID NO: 271185 - DNA, 16 bp, P. troglodytes
tgaatgaaaaaaatgt

SEQ ID NO: 271186 - DNA, 16 bp, P. troglodytes
tgaatgaaaaagacaa

SEQ ID NO: 271187 - DNA, 16 bp, P. troglodytes
tgaatgaaaaatattt

SEQ ID NO: 271188 - DNA, 16 bp, P. troglodytes
tgaatgaaaatggaaa

SEQ ID NO: 271189 - DNA, 16 bp, P. troglodytes
tgaatgaaagaagcaa

SEQ ID NO: 271190 - DNA, 16 bp, P. troglodytes
tgaatgaaagaatgaa

SEQ ID NO: 271191 - DNA, 16 bp, P. troglodytes
tgaatgaaatatttta

SEQ ID NO: 271192 - DNA, 21 bp, P. troglodytes
tgaatgaaatgaagcgagaag

SEQ ID NO: 271193 - DNA, 16 bp, P. troglodytes
tgaatgaaatgaatga

SEQ ID NO: 271194 - DNA, 16 bp, P. troglodytes
tgaatgaacaaaagct

SEQ ID NO: 271195 - DNA, 16 bp, P. troglodytes
tgaatgaacaaatgaa

SEQ ID NO: 271196 - DNA, 16 bp, P. troglodytes
tgaatgaacaagcaaa

SEQ ID NO: 271197 - DNA, 16 bp, P. troglodytes
tgaatgaagaaatgaa

SEQ ID NO: 271198 - DNA, 16 bp, P. troglodytes
tgaatgaataaaagga

SEQ ID NO: 271199 - DNA, 16 bp, P. troglodytes
tgaatgaataaatgaa

SEQ ID NO: 271200 - DNA, 16 bp, P. troglodytes
tgaatgaatattttta

SEQ ID NO: 271201 - DNA, 16 bp, P. troglodytes
tgaatgaatcaacaaa

SEQ ID NO: 271202 - DNA, 16 bp, P. troglodytes
tgaatgaatgaaagaa

SEQ ID NO: 271203 - DNA, 16 bp, P. troglodytes
tgaatgaatgaactct

SEQ ID NO: 271204 - DNA, 16 bp, P. troglodytes
tgaatgaatgaataaa

SEQ ID NO: 271205 - DNA, 16 bp, P. troglodytes
tgaatgaatgaataca

SEQ ID NO: 271206 - DNA, 16 bp, P. troglodytes
tgaatgaatgaatgaa

SEQ ID NO: 271207 - DNA, 16 bp, P. troglodytes
tgaatgaatgaatgat

SEQ ID NO: 271208 - DNA, 16 bp, P. troglodytes
tgaatgaatgaatgca

SEQ ID NO: 271209 - DNA, 16 bp, P. troglodytes
tgaatgaatgaatgga

SEQ ID NO: 271210 - DNA, 16 bp, P. troglodytes
tgaatgaatgagtgaa

SEQ ID NO: 271211 - DNA, 16 bp, P. troglodytes
tgaatgaatgcatgga

SEQ ID NO: 271212 - DNA, 16 bp, P. troglodytes
tgaatgaattgatgaa

SEQ ID NO: 271213 - DNA, 16 bp, P. troglodytes
tgaatgactgcatgga

SEQ ID NO: 271214 - DNA, 16 bp, P. troglodytes
tgaatgagatcatgtc

SEQ ID NO: 271215 - DNA, 16 bp, P. troglodytes
tgaatgaggaaatgaa

SEQ ID NO: 271216 - DNA, 16 bp, P. troglodytes
tgaatgaggcccaccc

SEQ ID NO: 271217 - DNA, 16 bp, P. troglodytes
tgaatgcaaagaaaaa

SEQ ID NO: 271218 - DNA, 16 bp, P. troglodytes
tgaatgcaaaggaaaa

SEQ ID NO: 271219 - DNA, 16 bp, P. troglodytes
tgaatgcaaagggaaa

SEQ ID NO: 271220 - DNA, 16 bp, P. troglodytes
tgaatgcagcacactg

SEQ ID NO: 271221 - DNA, 16 bp, P. troglodytes
tgaatgcagctggagg

SEQ ID NO: 271222 - DNA, 16 bp, P. troglodytes
tgaatgcaggaggcgg

SEQ ID NO: 271223 - DNA, 16 bp, P. troglodytes
tgaatgcataaataaa

SEQ ID NO: 271224 - DNA, 16 bp, P. troglodytes
tgaatgcatgaatgag

SEQ ID NO: 271225 - DNA, 16 bp, P. troglodytes
tgaatgccatttattt

SEQ ID NO: 271226 - DNA, 16 bp, P. troglodytes
tgaatgcctactgtgt

SEQ ID NO: 271227 - DNA, 16 bp, P. troglodytes
tgaatggaaaagcaaa

SEQ ID NO: 271228 - DNA, 16 bp, P. troglodytes
tgaatggaaaattact

SEQ ID NO: 271229 - DNA, 16 bp, P. troglodytes
tgaatggagaatgagt

SEQ ID NO: 271230 - DNA, 16 bp, P. troglodytes
tgaatggaggaatgaa

SEQ ID NO: 271231 - DNA, 16 bp, P. troglodytes
tgaatggataaacaaa

SEQ ID NO: 271232 - DNA, 16 bp, P. troglodytes
tgaatggataataaaa

SEQ ID NO: 271233 - DNA, 16 bp, P. troglodytes
tgaatggatgaagaaa

SEQ ID NO: 271234 - DNA, 16 bp, P. troglodytes
tgaatggatgaatgaa

SEQ ID NO: 271235 - DNA, 16 bp, P. troglodytes
tgaatggattaaaaaa

SEQ ID NO: 271236 - DNA, 16 bp, P. troglodytes
tgaatggattaaaaat

SEQ ID NO: 271237 - DNA, 16 bp, P. troglodytes
tgaatggctgtgacca

SEQ ID NO: 271238 - DNA, 16 bp, P. troglodytes
tgaatgggaaaaagct

SEQ ID NO: 271239 - DNA, 16 bp, P. troglodytes
tgaatgggcaaaactg

SEQ ID NO: 271240 - DNA, 16 bp, P. troglodytes
tgaatgggtaaacaaa

SEQ ID NO: 271241 - DNA, 16 bp, P. troglodytes
tgaatggtggccccca

SEQ ID NO: 271242 - DNA, 16 bp, P. troglodytes
tgaatggttaaaaaaa

SEQ ID NO: 271243 - DNA, 16 bp, P. troglodytes
tgaatgtaggcaacaa

SEQ ID NO: 271244 - DNA, 16 bp, P. troglodytes
tgaatgtattttgcat

SEQ ID NO: 271245 - DNA, 16 bp, P. troglodytes
tgaatgtgagggccta

SEQ ID NO: 271246 - DNA, 16 bp, P. troglodytes
tgaatgtgcttgctct

SEQ ID NO: 271247 - DNA, 16 bp, P. troglodytes
tgaatgtgtcccagaa

SEQ ID NO: 271248 - DNA, 16 bp, P. troglodytes
tgaatgtgtcccccaa

SEQ ID NO: 271249 - DNA, 16 bp, P. troglodytes
tgaatgtgtgtgtgtg

SEQ ID NO: 271250 - DNA, 16 bp, P. troglodytes
tgaatgtgtttcctct

SEQ ID NO: 271251 - DNA, 16 bp, P. troglodytes
tgaatgtgtttgctct

SEQ ID NO: 271252 - DNA, 16 bp, P. troglodytes
tgaatgttattttcat

SEQ ID NO: 271253 - DNA, 16 bp, P. troglodytes
tgaatgtttacagctg

SEQ ID NO: 271254 - DNA, 16 bp, P. troglodytes
tgaatgtttgtgtgcc

SEQ ID NO: 271255 - DNA, 16 bp, P. troglodytes
tgaatgtttgtgtgtg

SEQ ID NO: 271256 - DNA, 16 bp, P. troglodytes
tgaatgttttcttttg

SEQ ID NO: 271257 - DNA, 16 bp, P. troglodytes
tgaattaaacattttt

SEQ ID NO: 271258 - DNA, 16 bp, P. troglodytes
tgaattaaatttcttt

SEQ ID NO: 271259 - DNA, 16 bp, P. troglodytes
tgaattaataaatgag

SEQ ID NO: 271260 - DNA, 16 bp, P. troglodytes
tgaattacatttttat

SEQ ID NO: 271261 - DNA, 16 bp, P. troglodytes
tgaattacttttaaaa

SEQ ID NO: 271262 - DNA, 16 bp, P. troglodytes
tgaattagaatctgca

SEQ ID NO: 271263 - DNA, 16 bp, P. troglodytes
tgaattagtaataaat

SEQ ID NO: 271264 - DNA, 16 bp, P. troglodytes
tgaattatctttttta

SEQ ID NO: 271265 - DNA, 16 bp, P. troglodytes
tgaattatgggggtgg

SEQ ID NO: 271266 - DNA, 16 bp, P. troglodytes
tgaattatttcctcaa

SEQ ID NO: 271267 - DNA, 16 bp, P. troglodytes
tgaattattttcttct

SEQ ID NO: 271268 - DNA, 17 bp, P. troglodytes
tgaattcctgacctcaa

SEQ ID NO: 271269 - DNA, 16 bp, P. troglodytes
tgaattctttcttcca

SEQ ID NO: 271270 - DNA, 16 bp, P. troglodytes
tgaattctttttctgg

SEQ ID NO: 271271 - DNA, 16 bp, P. troglodytes
tgaattgagatgtgct

SEQ ID NO: 271272 - DNA, 16 bp, P. troglodytes
tgaattgatccctttg

SEQ ID NO: 271273 - DNA, 16 bp, P. troglodytes
tgaattgatttttaaa

SEQ ID NO: 271274 - DNA, 16 bp, P. troglodytes
tgaattgctgcaatct

SEQ ID NO: 271275 - DNA, 16 bp, P. troglodytes
tgaattggaaaactca

SEQ ID NO: 271276 - DNA, 16 bp, P. troglodytes
tgaattggaaatatca

SEQ ID NO: 271277 - DNA, 16 bp, P. troglodytes
tgaattggcaaaagct

SEQ ID NO: 271278 - DNA, 16 bp, P. troglodytes
tgaattgtaattccca

SEQ ID NO: 271279 - DNA, 16 bp, P. troglodytes
tgaattgtctattttt

SEQ ID NO: 271280 - DNA, 16 bp, P. troglodytes
tgaattgtgtccccca

SEQ ID NO: 271281 - DNA, 16 bp, P. troglodytes
tgaatttattttcaaa

SEQ ID NO: 271282 - DNA, 16 bp, P. troglodytes
tgaatttattttctta

SEQ ID NO: 271283 - DNA, 16 bp, P. troglodytes
tgaatttcaaataaaa

SEQ ID NO: 271284 - DNA, 16 bp, P. troglodytes
tgaatttcaaataaat

SEQ ID NO: 271285 - DNA, 16 bp, P. troglodytes
tgaatttcagataaca

SEQ ID NO: 271286 - DNA, 16 bp, P. troglodytes
tgaatttcattttctt

SEQ ID NO: 271287 - DNA, 16 bp, P. troglodytes
tgaatttccacatgtt

SEQ ID NO: 271288 - DNA, 16 bp, P. troglodytes
tgaatttccatgtatt

SEQ ID NO: 271289 - DNA, 16 bp, P. troglodytes
tgaatttcctttattt

SEQ ID NO: 271290 - DNA, 16 bp, P. troglodytes
tgaatttccttttctt

SEQ ID NO: 271291 - DNA, 16 bp, P. troglodytes
tgaatttctcattttt

SEQ ID NO: 271292 - DNA, 16 bp, P. troglodytes
tgaatttctctgatga

SEQ ID NO: 271293 - DNA, 16 bp, P. troglodytes
tgaatttcttaatatt

SEQ ID NO: 271294 - DNA, 16 bp, P. troglodytes
tgaatttgaaaagaat

SEQ ID NO: 271295 - DNA, 16 bp, P. troglodytes
tgaatttgaatttcag

SEQ ID NO: 271296 - DNA, 16 bp, P. troglodytes
tgaatttgagaaaaat

SEQ ID NO: 271297 - DNA, 16 bp, P. troglodytes
tgaatttggaagtatt

SEQ ID NO: 271298 - DNA, 16 bp, P. troglodytes
tgaatttgtttatgag

SEQ ID NO: 271299 - DNA, 16 bp, P. troglodytes
tgaattttaaaatctt

SEQ ID NO: 271300 - DNA, 16 bp, P. troglodytes
tgaattttaagagttt

SEQ ID NO: 271301 - DNA, 16 bp, P. troglodytes
tgaattttagaattgc

SEQ ID NO: 271302 - DNA, 16 bp, P. troglodytes
tgaattttataaaatg

SEQ ID NO: 271303 - DNA, 16 bp, P. troglodytes
tgaattttatcaaaca

SEQ ID NO: 271304 - DNA, 16 bp, P. troglodytes
tgaattttatgaaatt

SEQ ID NO: 271305 - DNA, 16 bp, P. troglodytes
tgaattttattgaaag

SEQ ID NO: 271306 - DNA, 16 bp, P. troglodytes
tgaattttatttcaat

SEQ ID NO: 271307 - DNA, 16 bp, P. troglodytes
tgaattttatttctat

SEQ ID NO: 271308 - DNA, 16 bp, P. troglodytes
tgaattttcataaagt

SEQ ID NO: 271309 - DNA, 16 bp, P. troglodytes
tgaattttgaaaacat

SEQ ID NO: 271310 - DNA, 16 bp, P. troglodytes
tgaattttgacaaatg

SEQ ID NO: 271311 - DNA, 16 bp, P. troglodytes
tgaattttgagggaac

SEQ ID NO: 271312 - DNA, 16 bp, P. troglodytes
tgaattttggaggcaa

SEQ ID NO: 271313 - DNA, 16 bp, P. troglodytes
tgaattttgtcaaaca

SEQ ID NO: 271314 - DNA, 16 bp, P. troglodytes
tgaattttgtggtatg

SEQ ID NO: 271315 - DNA, 24 bp, P. troglodytes
tgaattttgttgaaggccttttct

SEQ ID NO: 271316 - DNA, 16 bp, P. troglodytes
tgaattttgttgaatg

SEQ ID NO: 271317 - DNA, 16 bp, P. troglodytes
tgaatttttaaaagtt

SEQ ID NO: 271318 - DNA, 16 bp, P. troglodytes
tgaatttttaaaatgt

SEQ ID NO: 271319 - DNA, 16 bp, P. troglodytes
tgaatttttaaagact

SEQ ID NO: 271320 - DNA, 16 bp, P. troglodytes
tgaatttttctatttc

SEQ ID NO: 271321 - DNA, 16 bp, P. troglodytes
tgaattttttcttaaa

SEQ ID NO: 271322 - DNA, 16 bp, P. troglodytes
tgacaaaaatgagcaa

SEQ ID NO: 271323 - DNA, 16 bp, P. troglodytes
tgacaaaatatatttt

SEQ ID NO: 271324 - DNA, 16 bp, P. troglodytes
tgacaaaatgtctcag

SEQ ID NO: 271325 - DNA, 16 bp, P. troglodytes
tgacaaagatgtcaag

SEQ ID NO: 271326 - DNA, 16 bp, P. troglodytes
tgacaaagtgagaccc

SEQ ID NO: 271327 - DNA, 16 bp, P. troglodytes
tgacaaatgatgttga

SEQ ID NO: 271328 - DNA, 16 bp, P. troglodytes
tgacaaatgtttcttc

SEQ ID NO: 271329 - DNA, 16 bp, P. troglodytes
tgacaaccagaaatgt

SEQ ID NO: 271330 - DNA, 16 bp, P. troglodytes
tgacaagagcaaaaca

SEQ ID NO: 271331 - DNA, 16 bp, P. troglodytes
tgacaaggctgtggag

SEQ ID NO: 271332 - DNA, 16 bp, P. troglodytes
tgacaagggcaccaag

SEQ ID NO: 271333 - DNA, 16 bp, P. troglodytes
tgacaagggtgtcaag

SEQ ID NO: 271334 - DNA, 16 bp, P. troglodytes
tgacaaggtagagggt

SEQ ID NO: 271335 - DNA, 16 bp, P. troglodytes
tgacaattgaatgaaa

SEQ ID NO: 271336 - DNA, 16 bp, P. troglodytes
tgacacaagtttacct

SEQ ID NO: 271337 - DNA, 17 bp, P. troglodytes
tgacacagcaagactcc

SEQ ID NO: 271338 - DNA, 16 bp, P. troglodytes
tgacacagcctcagga

SEQ ID NO: 271339 - DNA, 16 bp, P. troglodytes
tgacacaggagccttc

SEQ ID NO: 271340 - DNA, 16 bp, P. troglodytes
tgacacataaaattaa

SEQ ID NO: 271341 - DNA, 16 bp, P. troglodytes
tgacacattttattat

SEQ ID NO: 271342 - DNA, 16 bp, P. troglodytes
tgacaccagcctgggc

SEQ ID NO: 271343 - DNA, 16 bp, P. troglodytes
tgacaccatcctggcc

SEQ ID NO: 271344 - DNA, 16 bp, P. troglodytes
tgacaccatcttggct

SEQ ID NO: 271345 - DNA, 16 bp, P. troglodytes
tgacaccccgtctcta

SEQ ID NO: 271346 - DNA, 16 bp, P. troglodytes
tgacacggtgaaaccc

SEQ ID NO: 271347 - DNA, 16 bp, P. troglodytes
tgacactacaaagaaa

SEQ ID NO: 271348 - DNA, 16 bp, P. troglodytes
tgacactattccacaa

SEQ ID NO: 271349 - DNA, 16 bp, P. troglodytes
tgacactgacattttt

SEQ ID NO: 271350 - DNA, 16 bp, P. troglodytes
tgacactgtctacctg

SEQ ID NO: 271351 - DNA, 16 bp, P. troglodytes
tgacactttgtctcaa

SEQ ID NO: 271352 - DNA, 16 bp, P. troglodytes
tgacagaaatcaaaga

SEQ ID NO: 271353 - DNA, 16 bp, P. troglodytes
tgacagaactgaaggg

SEQ ID NO: 271354 - DNA, 16 bp, P. troglodytes
tgacagaaggagaccc

SEQ ID NO: 271355 - DNA, 21 bp, P. troglodytes
tgacagaagtaggcttcagaa

SEQ ID NO: 271356 - DNA, 16 bp, P. troglodytes
tgacagaagtgggctt

SEQ ID NO: 271357 - DNA, 17 bp, P. troglodytes
tgacagaatgagaccct

SEQ ID NO: 271358 - DNA, 16 bp, P. troglodytes
tgacagacaaaatagc

SEQ ID NO: 271359 - DNA, 16 bp, P. troglodytes
tgacagagagagactc

SEQ ID NO: 271360 - DNA, 16 bp, P. troglodytes
tgacagagagagattc

SEQ ID NO: 271361 - DNA, 16 bp, P. troglodytes
tgacagagcaaaactc

SEQ ID NO: 271362 - DNA, 16 bp, P. troglodytes
tgacagagcaagacct

SEQ ID NO: 271363 - DNA, 16 bp, P. troglodytes
tgacagagcaagactt

SEQ ID NO: 271364 - DNA, 16 bp, P. troglodytes
tgacagagcaggagca

SEQ ID NO: 271365 - DNA, 16 bp, P. troglodytes
tgacagagccagacct

SEQ ID NO: 271366 - DNA, 16 bp, P. troglodytes
tgacagagcgagacct

SEQ ID NO: 271367 - DNA, 16 bp, P. troglodytes
tgacagagcgagactt

SEQ ID NO: 271368 - DNA, 16 bp, P. troglodytes
tgacagagctagaccc

SEQ ID NO: 271369 - DNA, 16 bp, P. troglodytes
tgacagagctgggatt

SEQ ID NO: 271370 - DNA, 16 bp, P. troglodytes
tgacagaggaagaaaa

SEQ ID NO: 271371 - DNA, 16 bp, P. troglodytes
tgacagaggaagactc

SEQ ID NO: 271372 - DNA, 16 bp, P. troglodytes
tgacagagggagactt

SEQ ID NO: 271373 - DNA, 16 bp, P. troglodytes
tgacagagtaagactc

SEQ ID NO: 271374 - DNA, 16 bp, P. troglodytes
tgacagagtcagactc

SEQ ID NO: 271375 - DNA, 16 bp, P. troglodytes
tgacagagtctggctc

SEQ ID NO: 271376 - DNA, 16 bp, P. troglodytes
tgacagagtgagacag

SEQ ID NO: 271377 - DNA, 16 bp, P. troglodytes
tgacagagtgagaccc

SEQ ID NO: 271378 - DNA, 16 bp, P. troglodytes
tgacagagtgagatcc

SEQ ID NO: 271379 - DNA, 17 bp, P. troglodytes
tgacagagtgagattcc

SEQ ID NO: 271380 - DNA, 16 bp, P. troglodytes
tgacagagtgataccc

SEQ ID NO: 271381 - DNA, 16 bp, P. troglodytes
tgacagagtgggactc

SEQ ID NO: 271382 - DNA, 16 bp, P. troglodytes
tgacagagtgtgactc

SEQ ID NO: 271383 - DNA, 16 bp, P. troglodytes
tgacagattaaaaaaa

SEQ ID NO: 271384 - DNA, 16 bp, P. troglodytes
tgacagcacatctgtt

SEQ ID NO: 271385 - DNA, 16 bp, P. troglodytes
tgacaggatttccttc

SEQ ID NO: 271386 - DNA, 16 bp, P. troglodytes
tgacaggatttctttc

SEQ ID NO: 271387 - DNA, 16 bp, P. troglodytes
tgacagggtctcactc

SEQ ID NO: 271388 - DNA, 16 bp, P. troglodytes
tgacagtgacctctgg

SEQ ID NO: 271389 - DNA, 16 bp, P. troglodytes
tgacagtgagtgagtc

SEQ ID NO: 271390 - DNA, 16 bp, P. troglodytes
tgacagtgtcatcaca

SEQ ID NO: 271391 - DNA, 16 bp, P. troglodytes
tgacagtttctttttt

SEQ ID NO: 271392 - DNA, 16 bp, P. troglodytes
tgacagtttttagcat

SEQ ID NO: 271393 - DNA, 16 bp, P. troglodytes
tgacagttttttaaaa

SEQ ID NO: 271394 - DNA, 16 bp, P. troglodytes
tgacagtttttttctt

SEQ ID NO: 271395 - DNA, 16 bp, P. troglodytes
tgacataagtttacct

SEQ ID NO: 271396 - DNA, 16 bp, P. troglodytes
tgacatagccctcagg

SEQ ID NO: 271397 - DNA, 16 bp, P. troglodytes
tgacatcctggaaaag

SEQ ID NO: 271398 - DNA, 16 bp, P. troglodytes
tgacatcttggggcct

SEQ ID NO: 271399 - DNA, 16 bp, P. troglodytes
tgacatctttaaaata

SEQ ID NO: 271400 - DNA, 16 bp, P. troglodytes
tgacatgaaagaaaaa

SEQ ID NO: 271401 - DNA, 16 bp, P. troglodytes
tgacatgactgtatat

SEQ ID NO: 271402 - DNA, 16 bp, P. troglodytes
tgacatgatcagattt

SEQ ID NO: 271403 - DNA, 16 bp, P. troglodytes
tgacatgatcctatat

SEQ ID NO: 271404 - DNA, 16 bp, P. troglodytes
tgacatgattgtatat

SEQ ID NO: 271405 - DNA, 16 bp, P. troglodytes
tgacatgcacctgtag

SEQ ID NO: 271406 - DNA, 16 bp, P. troglodytes
tgacatgcctgctccc

SEQ ID NO: 271407 - DNA, 16 bp, P. troglodytes
tgacatggcgaaaccc

SEQ ID NO: 271408 - DNA, 16 bp, P. troglodytes
tgacatggtcagattt

SEQ ID NO: 271409 - DNA, 16 bp, P. troglodytes
tgacattattcacaat

SEQ ID NO: 271410 - DNA, 16 bp, P. troglodytes
tgacattctgaaaaag

SEQ ID NO: 271411 - DNA, 16 bp, P. troglodytes
tgacattctggaaatg

SEQ ID NO: 271412 - DNA, 16 bp, P. troglodytes
tgacatttaagcaaag

SEQ ID NO: 271413 - DNA, 16 bp, P. troglodytes
tgacatttaagctgaa

SEQ ID NO: 271414 - DNA, 16 bp, P. troglodytes
tgacatttactttttt

SEQ ID NO: 271415 - DNA, 16 bp, P. troglodytes
tgacatttattttatt

SEQ ID NO: 271416 - DNA, 16 bp, P. troglodytes
tgacatttcaacatga

SEQ ID NO: 271417 - DNA, 16 bp, P. troglodytes
tgacatttcccctgct

SEQ ID NO: 271418 - DNA, 16 bp, P. troglodytes
tgacatttctttttct

SEQ ID NO: 271419 - DNA, 16 bp, P. troglodytes
tgacatttgagctggg

SEQ ID NO: 271420 - DNA, 16 bp, P. troglodytes
tgacatttggggccag

SEQ ID NO: 271421 - DNA, 16 bp, P. troglodytes
tgacattttaacagta

SEQ ID NO: 271422 - DNA, 16 bp, P. troglodytes
tgacattttaataaaa

SEQ ID NO: 271423 - DNA, 16 bp, P. troglodytes
tgacattttctatttt

SEQ ID NO: 271424 - DNA, 16 bp, P. troglodytes
tgacattttgcttttt

SEQ ID NO: 271425 - DNA, 16 bp, P. troglodytes
tgacattttggactgg

SEQ ID NO: 271426 - DNA, 16 bp, P. troglodytes
tgacatttttcaaaaa

SEQ ID NO: 271427 - DNA, 16 bp, P. troglodytes
tgacatttttttctta

SEQ ID NO: 271428 - DNA, 16 bp, P. troglodytes
tgaccaaaatccagaa

SEQ ID NO: 271429 - DNA, 16 bp, P. troglodytes
tgaccaaaatgctgat

SEQ ID NO: 271430 - DNA, 16 bp, P. troglodytes
tgaccaaaatgtcatt

SEQ ID NO: 271431 - DNA, 16 bp, P. troglodytes
tgaccaaatatctggg

SEQ ID NO: 271432 - DNA, 22 bp, P. troglodytes
tgaccaacatagtgaaacccca

SEQ ID NO: 271433 - DNA, 16 bp, P. troglodytes
tgaccaactcagcatt

SEQ ID NO: 271434 - DNA, 16 bp, P. troglodytes
tgaccaagaagaaaaa

SEQ ID NO: 271435 - DNA, 16 bp, P. troglodytes
tgaccaatcagcactc

SEQ ID NO: 271436 - DNA, 16 bp, P. troglodytes
tgaccacagaggcaga

SEQ ID NO: 271437 - DNA, 16 bp, P. troglodytes
tgaccagcctggccaa

SEQ ID NO: 271438 - DNA, 16 bp, P. troglodytes
tgaccagcctgggcaa

SEQ ID NO: 271439 - DNA, 16 bp, P. troglodytes
tgaccagtctggtctt

SEQ ID NO: 271440 - DNA, 16 bp, P. troglodytes
tgaccagtgatgacga

SEQ ID NO: 271441 - DNA, 16 bp, P. troglodytes
tgaccagtgatgatga

SEQ ID NO: 271442 - DNA, 16 bp, P. troglodytes
tgaccatatttggaaa

SEQ ID NO: 271443 - DNA, 17 bp, P. troglodytes
tgaccatcatggagaaa

SEQ ID NO: 271444 - DNA, 16 bp, P. troglodytes
tgaccatttttatttt

SEQ ID NO: 271445 - DNA, 16 bp, P. troglodytes
tgacccaccgcacctg

SEQ ID NO: 271446 - DNA, 16 bp, P. troglodytes
tgacccactggttatt

SEQ ID NO: 271447 - DNA, 16 bp, P. troglodytes
tgacccagaaattcca

SEQ ID NO: 271448 - DNA, 16 bp, P. troglodytes
tgacccagatgttgga

SEQ ID NO: 271449 - DNA, 16 bp, P. troglodytes
tgacccagcaattcca

SEQ ID NO: 271450 - DNA, 16 bp, P. troglodytes
tgacccagccacccca

SEQ ID NO: 271451 - DNA, 16 bp, P. troglodytes
tgacccagcctcagaa

SEQ ID NO: 271452 - DNA, 16 bp, P. troglodytes
tgacccaggaagtcca

SEQ ID NO: 271453 - DNA, 16 bp, P. troglodytes
tgacccagtaatttca

SEQ ID NO: 271454 - DNA, 16 bp, P. troglodytes
tgaccccaggagttcg

SEQ ID NO: 271455 - DNA, 16 bp, P. troglodytes
tgacccctgtgcctcc

SEQ ID NO: 271456 - DNA, 16 bp, P. troglodytes
tgaccccttcatggga

SEQ ID NO: 271457 - DNA, 16 bp, P. troglodytes
tgacccctttcagcca

SEQ ID NO: 271458 - DNA, 19 bp, P. troglodytes
tgacccgattttccaggtg

SEQ ID NO: 271459 - DNA, 16 bp, P. troglodytes
tgaccctccctccact

SEQ ID NO: 271460 - DNA, 22 bp, P. troglodytes
tgaccctgccaaatccccctct

SEQ ID NO: 271461 - DNA, 16 bp, P. troglodytes
tgaccctgggcaagtt

SEQ ID NO: 271462 - DNA, 16 bp, P. troglodytes
tgaccctgtcattatg

SEQ ID NO: 271463 - DNA, 16 bp, P. troglodytes
tgaccctgtgatccgc

SEQ ID NO: 271464 - DNA, 16 bp, P. troglodytes
tgacctagatgtgaga

SEQ ID NO: 271465 - DNA, 16 bp, P. troglodytes
tgacctatatcatttt

SEQ ID NO: 271466 - DNA, 16 bp, P. troglodytes
tgacctcaagtgttct

SEQ ID NO: 271467 - DNA, 16 bp, P. troglodytes
tgacctcagcctccca

SEQ ID NO: 271468 - DNA, 16 bp, P. troglodytes
tgacctcagtgatccg

SEQ ID NO: 271469 - DNA, 16 bp, P. troglodytes
tgacctcatcttaact

SEQ ID NO: 271470 - DNA, 16 bp, P. troglodytes
tgacctcatgacccgc

SEQ ID NO: 271471 - DNA, 24 bp, P. troglodytes
tgacctcatgatctgcctgcctcg

SEQ ID NO: 271472 - DNA, 16 bp, P. troglodytes
tgacctcatggagctg

SEQ ID NO: 271473 - DNA, 16 bp, P. troglodytes
tgacctccagagctgt

SEQ ID NO: 271474 - DNA, 16 bp, P. troglodytes
tgacctccagtgatcc

SEQ ID NO: 271475 - DNA, 16 bp, P. troglodytes
tgacctcccagtctca

SEQ ID NO: 271476 - DNA, 16 bp, P. troglodytes
tgacctcccgggctca

SEQ ID NO: 271477 - DNA, 16 bp, P. troglodytes
tgacctcctgacctca

SEQ ID NO: 271478 - DNA, 16 bp, P. troglodytes
tgacctcctgggccca

SEQ ID NO: 271479 - DNA, 16 bp, P. troglodytes
tgacctcctgggctca

SEQ ID NO: 271480 - DNA, 17 bp, P. troglodytes
tgacctcgtgatatgcc

SEQ ID NO: 271481 - DNA, 16 bp, P. troglodytes
tgacctcgtgatctgc

SEQ ID NO: 271482 - DNA, 16 bp, P. troglodytes
tgacctctagctccat

SEQ ID NO: 271483 - DNA, 16 bp, P. troglodytes
tgacctcttgatccac

SEQ ID NO: 271484 - DNA, 16 bp, P. troglodytes
tgacctgccaggctca

SEQ ID NO: 271485 - DNA, 16 bp, P. troglodytes
tgacctggaagccccc

SEQ ID NO: 271486 - DNA, 16 bp, P. troglodytes
tgacctggaagcctcc

SEQ ID NO: 271487 - DNA, 16 bp, P. troglodytes
tgacctggaagctccc

SEQ ID NO: 271488 - DNA, 16 bp, P. troglodytes
tgacctggctggtctc

SEQ ID NO: 271489 - DNA, 16 bp, P. troglodytes
tgacctggtggagctg

SEQ ID NO: 271490 - DNA, 16 bp, P. troglodytes
tgaccttaaacaagtc

SEQ ID NO: 271491 - DNA, 16 bp, P. troglodytes
tgaccttagacaagtc

SEQ ID NO: 271492 - DNA, 16 bp, P. troglodytes
tgaccttatttggaaa

SEQ ID NO: 271493 - DNA, 16 bp, P. troglodytes
tgaccttcctgcttct

SEQ ID NO: 271494 - DNA, 16 bp, P. troglodytes
tgaccttctccccacc

SEQ ID NO: 271495 - DNA, 26 bp, P. troglodytes
tgaccttctccttattatcaccctgc

SEQ ID NO: 271496 - DNA, 16 bp, P. troglodytes
tgaccttgagaaagtt

SEQ ID NO: 271497 - DNA, 16 bp, P. troglodytes
tgaccttgagcaggtt

SEQ ID NO: 271498 - DNA, 16 bp, P. troglodytes
tgaccttgatagtttt

SEQ ID NO: 271499 - DNA, 16 bp, P. troglodytes
tgaccttggacaaatt

SEQ ID NO: 271500 - DNA, 16 bp, P. troglodytes
tgaccttggacaagtc

SEQ ID NO: 271501 - DNA, 16 bp, P. troglodytes
tgaccttggacagtct

SEQ ID NO: 271502 - DNA, 16 bp, P. troglodytes
tgaccttggcaagtca

SEQ ID NO: 271503 - DNA, 16 bp, P. troglodytes
tgaccttggccaagtc

SEQ ID NO: 271504 - DNA, 16 bp, P. troglodytes
tgaccttgggcaaatt

SEQ ID NO: 271505 - DNA, 16 bp, P. troglodytes
tgaccttgggcaagct

SEQ ID NO: 271506 - DNA, 16 bp, P. troglodytes
tgaccttgggcaagtg

SEQ ID NO: 271507 - DNA, 16 bp, P. troglodytes
tgaccttgggcaggtt

SEQ ID NO: 271508 - DNA, 16 bp, P. troglodytes
tgaccttgtgaaccac

SEQ ID NO: 271509 - DNA, 16 bp, P. troglodytes
tgacctttcaggcaga

SEQ ID NO: 271510 - DNA, 17 bp, P. troglodytes
tgacctttgctccagtt

SEQ ID NO: 271511 - DNA, 16 bp, P. troglodytes
tgacgaggatgtggag

SEQ ID NO: 271512 - DNA, 16 bp, P. troglodytes
tgacgcagaagacggg

SEQ ID NO: 271513 - DNA, 17 bp, P. troglodytes
tgacggagtctcactct

SEQ ID NO: 271514 - DNA, 16 bp, P. troglodytes
tgacgtcaggagttcg

SEQ ID NO: 271515 - DNA, 16 bp, P. troglodytes
tgactaatatccagaa

SEQ ID NO: 271516 - DNA, 16 bp, P. troglodytes
tgactaattttttaaa

SEQ ID NO: 271517 - DNA, 16 bp, P. troglodytes
tgactactttagatac

SEQ ID NO: 271518 - DNA, 16 bp, P. troglodytes
tgactagagttaacaa

SEQ ID NO: 271519 - DNA, 16 bp, P. troglodytes
tgactatagttaacaa

SEQ ID NO: 271520 - DNA, 16 bp, P. troglodytes
tgactatatatatttt

SEQ ID NO: 271521 - DNA, 16 bp, P. troglodytes
tgactcaaaaataaaa

SEQ ID NO: 271522 - DNA, 16 bp, P. troglodytes
tgactcaaatattaat

SEQ ID NO: 271523 - DNA, 16 bp, P. troglodytes
tgactcatccctgtaa

SEQ ID NO: 271524 - DNA, 16 bp, P. troglodytes
tgactcattttattgc

SEQ ID NO: 271525 - DNA, 16 bp, P. troglodytes
tgactccagcttcctt

SEQ ID NO: 271526 - DNA, 16 bp, P. troglodytes
tgactcggcctcccaa

SEQ ID NO: 271527 - DNA, 16 bp, P. troglodytes
tgactctcctacctca

SEQ ID NO: 271528 - DNA, 16 bp, P. troglodytes
tgactctgaccagtgc

SEQ ID NO: 271529 - DNA, 16 bp, P. troglodytes
tgactctggcataaca

SEQ ID NO: 271530 - DNA, 16 bp, P. troglodytes
tgactgagtgaatgaa

SEQ ID NO: 271531 - DNA, 16 bp, P. troglodytes
tgactgcacattagaa

SEQ ID NO: 271532 - DNA, 16 bp, P. troglodytes
tgactgcaccactgca

SEQ ID NO: 271533 - DNA, 16 bp, P. troglodytes
tgactgcactccagcc

SEQ ID NO: 271534 - DNA, 16 bp, P. troglodytes
tgactgcagaactgcc

SEQ ID NO: 271535 - DNA, 16 bp, P. troglodytes
tgactgcaggtgatcc

SEQ ID NO: 271536 - DNA, 16 bp, P. troglodytes
tgactgcctgcagggt

SEQ ID NO: 271537 - DNA, 16 bp, P. troglodytes
tgactggaaaagaatg

SEQ ID NO: 271538 - DNA, 16 bp, P. troglodytes
tgactggatcacaggg

SEQ ID NO: 271539 - DNA, 16 bp, P. troglodytes
tgactggatgaggccc

SEQ ID NO: 271540 - DNA, 16 bp, P. troglodytes
tgactggcatctgaag

SEQ ID NO: 271541 - DNA, 16 bp, P. troglodytes
tgactggcttcaagtt

SEQ ID NO: 271542 - DNA, 16 bp, P. troglodytes
tgactgggagctgtgg

SEQ ID NO: 271543 - DNA, 17 bp, P. troglodytes
tgactggggaagtgata

SEQ ID NO: 271544 - DNA, 16 bp, P. troglodytes
tgactgtaattaacaa

SEQ ID NO: 271545 - DNA, 16 bp, P. troglodytes
tgactgtgtgtctgtg

SEQ ID NO: 271546 - DNA, 16 bp, P. troglodytes
tgactgtgtgtgtgtg

SEQ ID NO: 271547 - DNA, 16 bp, P. troglodytes
tgacttagaatgtctt

SEQ ID NO: 271548 - DNA, 16 bp, P. troglodytes
tgacttcaagggatcc

SEQ ID NO: 271549 - DNA, 16 bp, P. troglodytes
tgacttcagggacaaa

SEQ ID NO: 271550 - DNA, 16 bp, P. troglodytes
tgacttcattcttttt

SEQ ID NO: 271551 - DNA, 16 bp, P. troglodytes
tgacttcatttatatg

SEQ ID NO: 271552 - DNA, 16 bp, P. troglodytes
tgacttccagctccat

SEQ ID NO: 271553 - DNA, 17 bp, P. troglodytes
tgacttcgtgatctgcc

SEQ ID NO: 271554 - DNA, 16 bp, P. troglodytes
tgacttctcagcctcc

SEQ ID NO: 271555 - DNA, 16 bp, P. troglodytes
tgacttctctgggcct

SEQ ID NO: 271556 - DNA, 16 bp, P. troglodytes
tgacttctttttctct

SEQ ID NO: 271557 - DNA, 16 bp, P. troglodytes
tgacttcttttttaaa

SEQ ID NO: 271558 - DNA, 16 bp, P. troglodytes
tgacttgatagctcat

SEQ ID NO: 271559 - DNA, 16 bp, P. troglodytes
tgacttgattgtatat

SEQ ID NO: 271560 - DNA, 16 bp, P. troglodytes
tgacttgcctaaggcc

SEQ ID NO: 271561 - DNA, 16 bp, P. troglodytes
tgacttgcctgaggtc

SEQ ID NO: 271562 - DNA, 16 bp, P. troglodytes
tgacttgctttgacca

SEQ ID NO: 271563 - DNA, 16 bp, P. troglodytes
tgacttgctttggcca

SEQ ID NO: 271564 - DNA, 16 bp, P. troglodytes
tgacttgtttttaaaa

SEQ ID NO: 271565 - DNA, 16 bp, P. troglodytes
tgactttaaaaatatt

SEQ ID NO: 271566 - DNA, 16 bp, P. troglodytes
tgactttaaaataaaa

SEQ ID NO: 271567 - DNA, 16 bp, P. troglodytes
tgactttaatgtttat

SEQ ID NO: 271568 - DNA, 16 bp, P. troglodytes
tgactttatttctgag

SEQ ID NO: 271569 - DNA, 16 bp, P. troglodytes
tgactttctggaaggc

SEQ ID NO: 271570 - DNA, 19 bp, P. troglodytes
tgactttcttcacagaatt

SEQ ID NO: 271571 - DNA, 16 bp, P. troglodytes
tgactttcttcataga

SEQ ID NO: 271572 - DNA, 16 bp, P. troglodytes
tgactttcttcttctt

SEQ ID NO: 271573 - DNA, 16 bp, P. troglodytes
tgactttctttgtctt

SEQ ID NO: 271574 - DNA, 16 bp, P. troglodytes
tgactttgagcaagtt

SEQ ID NO: 271575 - DNA, 16 bp, P. troglodytes
tgactttgaggagctg

SEQ ID NO: 271576 - DNA, 16 bp, P. troglodytes
tgactttgatgagttg

SEQ ID NO: 271577 - DNA, 16 bp, P. troglodytes
tgactttggaaaagtt

SEQ ID NO: 271578 - DNA, 16 bp, P. troglodytes
tgactttggaactggt

SEQ ID NO: 271579 - DNA, 16 bp, P. troglodytes
tgactttggacaagtc

SEQ ID NO: 271580 - DNA, 16 bp, P. troglodytes
tgactttggacttccc

SEQ ID NO: 271581 - DNA, 16 bp, P. troglodytes
tgactttgggcaagtt

SEQ ID NO: 271582 - DNA, 18 bp, P. troglodytes
tgactttgtgatccgccc

SEQ ID NO: 271583 - DNA, 16 bp, P. troglodytes
tgacttttaaatgatt

SEQ ID NO: 271584 - DNA, 16 bp, P. troglodytes
tgacttttattatgtt

SEQ ID NO: 271585 - DNA, 16 bp, P. troglodytes
tgacttttcattttga

SEQ ID NO: 271586 - DNA, 16 bp, P. troglodytes
tgacttttcttcacag

SEQ ID NO: 271587 - DNA, 16 bp, P. troglodytes
tgacttttgcttggaa

SEQ ID NO: 271588 - DNA, 16 bp, P. troglodytes
tgactttttaaaaatt

SEQ ID NO: 271589 - DNA, 16 bp, P. troglodytes
tgactttttaaataat

SEQ ID NO: 271590 - DNA, 16 bp, P. troglodytes
tgactttttaataaaa

SEQ ID NO: 271591 - DNA, 16 bp, P. troglodytes
tgactttttaattata

SEQ ID NO: 271592 - DNA, 16 bp, P. troglodytes
tgactttttataatag

SEQ ID NO: 271593 - DNA, 16 bp, P. troglodytes
tgactttttgaaaaaa

SEQ ID NO: 271594 - DNA, 16 bp, P. troglodytes
tgacttttttcctttc

SEQ ID NO: 271595 - DNA, 16 bp, P. troglodytes
tgactttttttcctct

SEQ ID NO: 271596 - DNA, 16 bp, P. troglodytes
tgacttttttttaaat

SEQ ID NO: 271597 - DNA, 16 bp, P. troglodytes
tgagaaaaaatatttt

SEQ ID NO: 271598 - DNA, 16 bp, P. troglodytes
tgagaaaaacaacaga

SEQ ID NO: 271599 - DNA, 16 bp, P. troglodytes
tgagaaaaagaatgtg

SEQ ID NO: 271600 - DNA, 16 bp, P. troglodytes
tgagaaaaatgtctcc

SEQ ID NO: 271601 - DNA, 16 bp, P. troglodytes
tgagaaaacagagact

SEQ ID NO: 271602 - DNA, 16 bp, P. troglodytes
tgagaaaaccaaggct

SEQ ID NO: 271603 - DNA, 16 bp, P. troglodytes
tgagaaaaccacagaa

SEQ ID NO: 271604 - DNA, 16 bp, P. troglodytes
tgagaaaactgaagtt

SEQ ID NO: 271605 - DNA, 16 bp, P. troglodytes
tgagaaaactgaatat

SEQ ID NO: 271606 - DNA, 16 bp, P. troglodytes
tgagaaaactgaggaa

SEQ ID NO: 271607 - DNA, 16 bp, P. troglodytes
tgagaaaactgaggcc

SEQ ID NO: 271608 - DNA, 16 bp, P. troglodytes
tgagaaaactgaggtt

SEQ ID NO: 271609 - DNA, 16 bp, P. troglodytes
tgagaaaactgcagaa

SEQ ID NO: 271610 - DNA, 16 bp, P. troglodytes
tgagaaaagcagagaa

SEQ ID NO: 271611 - DNA, 16 bp, P. troglodytes
tgagaaaagcagagga

SEQ ID NO: 271612 - DNA, 16 bp, P. troglodytes
tgagaaaatataattt

SEQ ID NO: 271613 - DNA, 16 bp, P. troglodytes
tgagaaaatatttcca

SEQ ID NO: 271614 - DNA, 16 bp, P. troglodytes
tgagaaaatatttgca

SEQ ID NO: 271615 - DNA, 16 bp, P. troglodytes
tgagaaaatgaaaaca

SEQ ID NO: 271616 - DNA, 16 bp, P. troglodytes
tgagaaaatgtggtgt

SEQ ID NO: 271617 - DNA, 16 bp, P. troglodytes
tgagaaaattatggca

SEQ ID NO: 271618 - DNA, 16 bp, P. troglodytes
tgagaaaattgaggct

SEQ ID NO: 271619 - DNA, 16 bp, P. troglodytes
tgagaaacaaatgttt

SEQ ID NO: 271620 - DNA, 16 bp, P. troglodytes
tgagaaacatggcaaa

SEQ ID NO: 271621 - DNA, 16 bp, P. troglodytes
tgagaaaccctggcct

SEQ ID NO: 271622 - DNA, 16 bp, P. troglodytes
tgagaaacctccatat

SEQ ID NO: 271623 - DNA, 16 bp, P. troglodytes
tgagaaactagaaaaa

SEQ ID NO: 271624 - DNA, 16 bp, P. troglodytes
tgagaaactgaatttt

SEQ ID NO: 271625 - DNA, 16 bp, P. troglodytes
tgagaaacttgtttgt

SEQ ID NO: 271626 - DNA, 17 bp, P. troglodytes
tgagaaagatccaccta

SEQ ID NO: 271627 - DNA, 16 bp, P. troglodytes
tgagaaataaagggac

SEQ ID NO: 271628 - DNA, 16 bp, P. troglodytes
tgagaaataaatgttc

SEQ ID NO: 271629 - DNA, 16 bp, P. troglodytes
tgagaaataactttct

SEQ ID NO: 271630 - DNA, 16 bp, P. troglodytes
tgagaaatcactcact

SEQ ID NO: 271631 - DNA, 16 bp, P. troglodytes
tgagaaatctgaggct

SEQ ID NO: 271632 - DNA, 16 bp, P. troglodytes
tgagaaatggaacaag

SEQ ID NO: 271633 - DNA, 16 bp, P. troglodytes
tgagaaatgtctcttc

SEQ ID NO: 271634 - DNA, 16 bp, P. troglodytes
tgagaaattgctttgt

SEQ ID NO: 271635 - DNA, 16 bp, P. troglodytes
tgagaaatttaccaag

SEQ ID NO: 271636 - DNA, 16 bp, P. troglodytes
tgagaaatttctgttc

SEQ ID NO: 271637 - DNA, 16 bp, P. troglodytes
tgagaacaaagagaca

SEQ ID NO: 271638 - DNA, 16 bp, P. troglodytes
tgagaacaagcagtat

SEQ ID NO: 271639 - DNA, 16 bp, P. troglodytes
tgagaacagaagcatt

SEQ ID NO: 271640 - DNA, 16 bp, P. troglodytes
tgagaacagcaccaaa

SEQ ID NO: 271641 - DNA, 16 bp, P. troglodytes
tgagaacagcctgagc

SEQ ID NO: 271642 - DNA, 16 bp, P. troglodytes
tgagaacagcctggga

SEQ ID NO: 271643 - DNA, 16 bp, P. troglodytes
tgagaacatgccgtgt

SEQ ID NO: 271644 - DNA, 16 bp, P. troglodytes
tgagaacatgctgtgt

SEQ ID NO: 271645 - DNA, 16 bp, P. troglodytes
tgagaacatgtgccca

SEQ ID NO: 271646 - DNA, 16 bp, P. troglodytes
tgagaacattaaaaaa

SEQ ID NO: 271647 - DNA, 16 bp, P. troglodytes
tgagaaccactgctct

SEQ ID NO: 271648 - DNA, 16 bp, P. troglodytes
tgagaaccactggact

SEQ ID NO: 271649 - DNA, 16 bp, P. troglodytes
tgagaaccagaacaag

SEQ ID NO: 271650 - DNA, 16 bp, P. troglodytes
tgagaaccaggagctc

SEQ ID NO: 271651 - DNA, 16 bp, P. troglodytes
tgagaacttctattcc

SEQ ID NO: 271652 - DNA, 16 bp, P. troglodytes
tgagaacttctgttcc

SEQ ID NO: 271653 - DNA, 16 bp, P. troglodytes
tgagaagaaaccagaa

SEQ ID NO: 271654 - DNA, 16 bp, P. troglodytes
tgagaagagcatgggg

SEQ ID NO: 271655 - DNA, 16 bp, P. troglodytes
tgagaagagggccacc

SEQ ID NO: 271656 - DNA, 16 bp, P. troglodytes
tgagaaggaaccagtg

SEQ ID NO: 271657 - DNA, 16 bp, P. troglodytes
tgagaagttgcttctt

SEQ ID NO: 271658 - DNA, 16 bp, P. troglodytes
tgagaataaatttctg

SEQ ID NO: 271659 - DNA, 16 bp, P. troglodytes
tgagaataataatact

SEQ ID NO: 271660 - DNA, 16 bp, P. troglodytes
tgagaatagcatgggg

SEQ ID NO: 271661 - DNA, 16 bp, P. troglodytes
tgagaatattcaaaat

SEQ ID NO: 271662 - DNA, 16 bp, P. troglodytes
tgagaatattttaaaa

SEQ ID NO: 271663 - DNA, 16 bp, P. troglodytes
tgagaatattttaaat

SEQ ID NO: 271664 - DNA, 16 bp, P. troglodytes
tgagaatctaatgaaa

SEQ ID NO: 271665 - DNA, 16 bp, P. troglodytes
tgagaatctaatgcct

SEQ ID NO: 271666 - DNA, 16 bp, P. troglodytes
tgagaatctcttgaac

SEQ ID NO: 271667 - DNA, 16 bp, P. troglodytes
tgagaatctgatgaaa

SEQ ID NO: 271668 - DNA, 16 bp, P. troglodytes
tgagaatgaaatattt

SEQ ID NO: 271669 - DNA, 16 bp, P. troglodytes
tgagaatgaaatgttt

SEQ ID NO: 271670 - DNA, 16 bp, P. troglodytes
tgagaatgatggtttt

SEQ ID NO: 271671 - DNA, 16 bp, P. troglodytes
tgagaatgatgttttc

SEQ ID NO: 271672 - DNA, 16 bp, P. troglodytes
tgagaatgcttctgtt

SEQ ID NO: 271673 - DNA, 16 bp, P. troglodytes
tgagaattaaaaaaca

SEQ ID NO: 271674 - DNA, 16 bp, P. troglodytes
tgagaattaaatgaaa

SEQ ID NO: 271675 - DNA, 16 bp, P. troglodytes
tgagaattaaatgtgt

SEQ ID NO: 271676 - DNA, 16 bp, P. troglodytes
tgagaattagaaaaca

SEQ ID NO: 271677 - DNA, 16 bp, P. troglodytes
tgagaatttctttttt

SEQ ID NO: 271678 - DNA, 16 bp, P. troglodytes
tgagaatttttgcatt

SEQ ID NO: 271679 - DNA, 16 bp, P. troglodytes
tgagaattttttaaaa

SEQ ID NO: 271680 - DNA, 16 bp, P. troglodytes
tgagaatttttttaaa

SEQ ID NO: 271681 - DNA, 16 bp, P. troglodytes
tgagaatttttttctt

SEQ ID NO: 271682 - DNA, 16 bp, P. troglodytes
tgagacaaaatttcca

SEQ ID NO: 271683 - DNA, 16 bp, P. troglodytes
tgagacaaagtctcag

SEQ ID NO: 271684 - DNA, 16 bp, P. troglodytes
tgagacaaattaaaat

SEQ ID NO: 271685 - DNA, 16 bp, P. troglodytes
tgagacaccacacctg

SEQ ID NO: 271686 - DNA, 16 bp, P. troglodytes
tgagacaccagctggg

SEQ ID NO: 271687 - DNA, 16 bp, P. troglodytes
tgagacagaaaatgaa

SEQ ID NO: 271688 - DNA, 16 bp, P. troglodytes
tgagacagaatctgtc

SEQ ID NO: 271689 - DNA, 16 bp, P. troglodytes
tgagacagagtctcaa

SEQ ID NO: 271690 - DNA, 16 bp, P. troglodytes
tgagacagagttgcac

SEQ ID NO: 271691 - DNA, 16 bp, P. troglodytes
tgagacagagtttccc

SEQ ID NO: 271692 - DNA, 16 bp, P. troglodytes
tgagacaggagaactg

SEQ ID NO: 271693 - DNA, 16 bp, P. troglodytes
tgagacaggatctcac

SEQ ID NO: 271694 - DNA, 16 bp, P. troglodytes
tgagacagggtctcaa

SEQ ID NO: 271695 - DNA, 16 bp, P. troglodytes
tgagacagtgaaaaag

SEQ ID NO: 271696 - DNA, 16 bp, P. troglodytes
tgagacatcaatcaaa

SEQ ID NO: 271697 - DNA, 16 bp, P. troglodytes
tgagacatgcattaca

SEQ ID NO: 271698 - DNA, 16 bp, P. troglodytes
tgagaccaagaactca

SEQ ID NO: 271699 - DNA, 16 bp, P. troglodytes
tgagaccagcctaacc

SEQ ID NO: 271700 - DNA, 18 bp, P. troglodytes
tgagaccagcctcgccaa

SEQ ID NO: 271701 - DNA, 16 bp, P. troglodytes
tgagaccagcctgagc

SEQ ID NO: 271702 - DNA, 16 bp, P. troglodytes
tgagaccagccttggt

SEQ ID NO: 271703 - DNA, 16 bp, P. troglodytes
tgagaccagctgggcc

SEQ ID NO: 271704 - DNA, 16 bp, P. troglodytes
tgagaccaggctgggc

SEQ ID NO: 271705 - DNA, 16 bp, P. troglodytes
tgagaccatctctaca

SEQ ID NO: 271706 - DNA, 16 bp, P. troglodytes
tgagaccatgaaccca

SEQ ID NO: 271707 - DNA, 16 bp, P. troglodytes
tgagaccccatctcca

SEQ ID NO: 271708 - DNA, 18 bp, P. troglodytes
tgagaccctgtctcaaag

SEQ ID NO: 271709 - DNA, 16 bp, P. troglodytes
tgagaccctgtttcaa

SEQ ID NO: 271710 - DNA, 16 bp, P. troglodytes
tgagaccgagtctctc

SEQ ID NO: 271711 - DNA, 16 bp, P. troglodytes
tgagaccggcctgggc

SEQ ID NO: 271712 - DNA, 16 bp, P. troglodytes
tgagacctcatctcta

SEQ ID NO: 271713 - DNA, 16 bp, P. troglodytes
tgagacctcatctctt

SEQ ID NO: 271714 - DNA, 16 bp, P. troglodytes
tgagacctgcctggcc

SEQ ID NO: 271715 - DNA, 16 bp, P. troglodytes
tgagacctgtctcaga

SEQ ID NO: 271716 - DNA, 16 bp, P. troglodytes
tgagaccttgtttcaa

SEQ ID NO: 271717 - DNA, 16 bp, P. troglodytes
tgagacgctgtctcaa

SEQ ID NO: 271718 - DNA, 16 bp, P. troglodytes
tgagacggagtctcag

SEQ ID NO: 271719 - DNA, 16 bp, P. troglodytes
tgagacgggaggatca

SEQ ID NO: 271720 - DNA, 16 bp, P. troglodytes
tgagactacaggcttg

SEQ ID NO: 271721 - DNA, 16 bp, P. troglodytes
tgagactatagaatac

SEQ ID NO: 271722 - DNA, 16 bp, P. troglodytes
tgagactatgtaaaaa

SEQ ID NO: 271723 - DNA, 16 bp, P. troglodytes
tgagactctaatgcca

SEQ ID NO: 271724 - DNA, 16 bp, P. troglodytes
tgagactctgtctgga

SEQ ID NO: 271725 - DNA, 16 bp, P. troglodytes
tgagactgagcaattt

SEQ ID NO: 271726 - DNA, 16 bp, P. troglodytes
tgagactgctgggtca

SEQ ID NO: 271727 - DNA, 16 bp, P. troglodytes
tgagacttattcacta

SEQ ID NO: 271728 - DNA, 16 bp, P. troglodytes
tgagacttgctggctt

SEQ ID NO: 271729 - DNA, 20 bp, P. troglodytes
tgagagaagaaggcttcaga

SEQ ID NO: 271730 - DNA, 16 bp, P. troglodytes
tgagagaatttatcac

SEQ ID NO: 271731 - DNA, 16 bp, P. troglodytes
tgagagagaaaattaa

SEQ ID NO: 271732 - DNA, 16 bp, P. troglodytes
tgagagagaaataaac

SEQ ID NO: 271733 - DNA, 16 bp, P. troglodytes
tgagagagacagacag

SEQ ID NO: 271734 - DNA, 16 bp, P. troglodytes
tgagagagggcatcct

SEQ ID NO: 271735 - DNA, 16 bp, P. troglodytes
tgagagagggcatgct

SEQ ID NO: 271736 - DNA, 17 bp, P. troglodytes
tgagagatgaggatcca

SEQ ID NO: 271737 - DNA, 16 bp, P. troglodytes
tgagagcaaagacaca

SEQ ID NO: 271738 - DNA, 16 bp, P. troglodytes
tgagagcaggagcaag

SEQ ID NO: 271739 - DNA, 16 bp, P. troglodytes
tgagagcatcctggct

SEQ ID NO: 271740 - DNA, 16 bp, P. troglodytes
tgagagcatgtggtgt

SEQ ID NO: 271741 - DNA, 16 bp, P. troglodytes
tgagagccaagcaaag

SEQ ID NO: 271742 - DNA, 16 bp, P. troglodytes
tgagagcccagaaata

SEQ ID NO: 271743 - DNA, 16 bp, P. troglodytes
tgagagcctcagtttc

SEQ ID NO: 271744 - DNA, 16 bp, P. troglodytes
tgagagccttgaagat

SEQ ID NO: 271745 - DNA, 16 bp, P. troglodytes
tgagagctggttgttt

SEQ ID NO: 271746 - DNA, 16 bp, P. troglodytes
tgagagctgtgggctg

SEQ ID NO: 271747 - DNA, 16 bp, P. troglodytes
tgagaggatcatttga

SEQ ID NO: 271748 - DNA, 24 bp, P. troglodytes
tgagaggatgtggagaaataggaa

SEQ ID NO: 271749 - DNA, 16 bp, P. troglodytes
tgagaggcagaagttg

SEQ ID NO: 271750 - DNA, 16 bp, P. troglodytes
tgagaggcagagattg

SEQ ID NO: 271751 - DNA, 16 bp, P. troglodytes
tgagaggcagagctgg

SEQ ID NO: 271752 - DNA, 16 bp, P. troglodytes
tgagaggcccaggtgg

SEQ ID NO: 271753 - DNA, 16 bp, P. troglodytes
tgagaggctgaggcat

SEQ ID NO: 271754 - DNA, 18 bp, P. troglodytes
tgagaggctgaggtgggc

SEQ ID NO: 271755 - DNA, 19 bp, P. troglodytes
tgagaggtgaagccagctg

SEQ ID NO: 271756 - DNA, 16 bp, P. troglodytes
tgagagtgaataagtc

SEQ ID NO: 271757 - DNA, 16 bp, P. troglodytes
tgagagtgtgaccaaa

SEQ ID NO: 271758 - DNA, 16 bp, P. troglodytes
tgagagttctttatat

SEQ ID NO: 271759 - DNA, 16 bp, P. troglodytes
tgagagttcttttttt

SEQ ID NO: 271760 - DNA, 16 bp, P. troglodytes
tgagagtttgattatt

SEQ ID NO: 271761 - DNA, 16 bp, P. troglodytes
tgagataagggtccaa

SEQ ID NO: 271762 - DNA, 16 bp, P. troglodytes
tgagataccatctcac

SEQ ID NO: 271763 - DNA, 16 bp, P. troglodytes
tgagataccctctcac

SEQ ID NO: 271764 - DNA, 16 bp, P. troglodytes
tgagataggaggactg

SEQ ID NO: 271765 - DNA, 16 bp, P. troglodytes
tgagatatgcctttca

SEQ ID NO: 271766 - DNA, 16 bp, P. troglodytes
tgagatatttttaaaa

SEQ ID NO: 271767 - DNA, 16 bp, P. troglodytes
tgagatcacactgctg

SEQ ID NO: 271768 - DNA, 16 bp, P. troglodytes
tgagatcagaaagcat

SEQ ID NO: 271769 - DNA, 16 bp, P. troglodytes
tgagatcaggtgttcg

SEQ ID NO: 271770 - DNA, 16 bp, P. troglodytes
tgagatcatgagtttg

SEQ ID NO: 271771 - DNA, 16 bp, P. troglodytes
tgagatcatgtcatct

SEQ ID NO: 271772 - DNA, 16 bp, P. troglodytes
tgagatcatgtcattg

SEQ ID NO: 271773 - DNA, 16 bp, P. troglodytes
tgagatccagcctggg

SEQ ID NO: 271774 - DNA, 16 bp, P. troglodytes
tgagatcctgcctcta

SEQ ID NO: 271775 - DNA, 16 bp, P. troglodytes
tgagatcctggtgcac

SEQ ID NO: 271776 - DNA, 16 bp, P. troglodytes
tgagatcctgtctcca

SEQ ID NO: 271777 - DNA, 16 bp, P. troglodytes
tgagatcctgtcttta

SEQ ID NO: 271778 - DNA, 16 bp, P. troglodytes
tgagatgaaacttcca

SEQ ID NO: 271779 - DNA, 16 bp, P. troglodytes
tgagatgaagcttcca

SEQ ID NO: 271780 - DNA, 16 bp, P. troglodytes
tgagatgagcagatca

SEQ ID NO: 271781 - DNA, 16 bp, P. troglodytes
tgagatggaattttgt

SEQ ID NO: 271782 - DNA, 16 bp, P. troglodytes
tgagatggacaaattg

SEQ ID NO: 271783 - DNA, 16 bp, P. troglodytes
tgagatggagcctcgc

SEQ ID NO: 271784 - DNA, 16 bp, P. troglodytes
tgagatggagtccagc

SEQ ID NO: 271785 - DNA, 16 bp, P. troglodytes
tgagatggagtcctgc

SEQ ID NO: 271786 - DNA, 16 bp, P. troglodytes
tgagatggagtctcat

SEQ ID NO: 271787 - DNA, 16 bp, P. troglodytes
tgagatggagtctccg

SEQ ID NO: 271788 - DNA, 16 bp, P. troglodytes
tgagatggagtctcct

SEQ ID NO: 271789 - DNA, 16 bp, P. troglodytes
tgagatggagtctcgt

SEQ ID NO: 271790 - DNA, 16 bp, P. troglodytes
tgagatggagtctgtt

SEQ ID NO: 271791 - DNA, 16 bp, P. troglodytes
tgagatggagtttcgc

SEQ ID NO: 271792 - DNA, 16 bp, P. troglodytes
tgagatgggaggattt

SEQ ID NO: 271793 - DNA, 16 bp, P. troglodytes
tgagatgggatttcac

SEQ ID NO: 271794 - DNA, 18 bp, P. troglodytes
tgagatggggtcttgcta

SEQ ID NO: 271795 - DNA, 17 bp, P. troglodytes
tgagatggtatctcact

SEQ ID NO: 271796 - DNA, 20 bp, P. troglodytes
tgagatggtatctcattgtg

SEQ ID NO: 271797 - DNA, 17 bp, P. troglodytes
tgagatgttatctcatt

SEQ ID NO: 271798 - DNA, 16 bp, P. troglodytes
tgagatgttttcatac

SEQ ID NO: 271799 - DNA, 16 bp, P. troglodytes
tgagattatccagtct

SEQ ID NO: 271800 - DNA, 16 bp, P. troglodytes
tgagattcatctgtgt

SEQ ID NO: 271801 - DNA, 16 bp, P. troglodytes
tgagattcattcatgt

SEQ ID NO: 271802 - DNA, 16 bp, P. troglodytes
tgagattccttatgaa

SEQ ID NO: 271803 - DNA, 16 bp, P. troglodytes
tgagattctgccactg

SEQ ID NO: 271804 - DNA, 16 bp, P. troglodytes
tgagattctgtctcta

SEQ ID NO: 271805 - DNA, 16 bp, P. troglodytes
tgagattgagtctcac

SEQ ID NO: 271806 - DNA, 16 bp, P. troglodytes
tgagattgcaccgctg

SEQ ID NO: 271807 - DNA, 16 bp, P. troglodytes
tgagattgctgagtca

SEQ ID NO: 271808 - DNA, 16 bp, P. troglodytes
tgagattgctgggtca

SEQ ID NO: 271809 - DNA, 16 bp, P. troglodytes
tgagattgtgttgaat

SEQ ID NO: 271810 - DNA, 16 bp, P. troglodytes
tgagatttgaacccag

SEQ ID NO: 271811 - DNA, 16 bp, P. troglodytes
tgagatttgctttaaa

SEQ ID NO: 271812 - DNA, 16 bp, P. troglodytes
tgagatttgggaacct

SEQ ID NO: 271813 - DNA, 16 bp, P. troglodytes
tgagatttgggaggaa

SEQ ID NO: 271814 - DNA, 16 bp, P. troglodytes
tgagatttgtgtgggg

SEQ ID NO: 271815 - DNA, 16 bp, P. troglodytes
tgagattttaaaaatt

SEQ ID NO: 271816 - DNA, 16 bp, P. troglodytes
tgagattttggtgcac

SEQ ID NO: 271817 - DNA, 16 bp, P. troglodytes
tgagattttggtgcat

SEQ ID NO: 271818 - DNA, 16 bp, P. troglodytes
tgagatttttttaaaa

SEQ ID NO: 271819 - DNA, 17 bp, P. troglodytes
tgagcaaaactccatct

SEQ ID NO: 271820 - DNA, 16 bp, P. troglodytes
tgagcaaagacagcca

SEQ ID NO: 271821 - DNA, 16 bp, P. troglodytes
tgagcaaagatctgaa

SEQ ID NO: 271822 - DNA, 16 bp, P. troglodytes
tgagcaaagatttcat

SEQ ID NO: 271823 - DNA, 16 bp, P. troglodytes
tgagcaacagagtgag

SEQ ID NO: 271824 - DNA, 17 bp, P. troglodytes
tgagcaacatggagaaa

SEQ ID NO: 271825 - DNA, 16 bp, P. troglodytes
tgagcaactggaagga

SEQ ID NO: 271826 - DNA, 16 bp, P. troglodytes
tgagcaagaaataaac

SEQ ID NO: 271827 - DNA, 16 bp, P. troglodytes
tgagcaagttacataa

SEQ ID NO: 271828 - DNA, 16 bp, P. troglodytes
tgagcaagttacttca

SEQ ID NO: 271829 - DNA, 16 bp, P. troglodytes
tgagcacagcagctgc

SEQ ID NO: 271830 - DNA, 16 bp, P. troglodytes
tgagcacatactgtgt

SEQ ID NO: 271831 - DNA, 16 bp, P. troglodytes
tgagcacatgctgttg

SEQ ID NO: 271832 - DNA, 16 bp, P. troglodytes
tgagcacatgttgttg

SEQ ID NO: 271833 - DNA, 16 bp, P. troglodytes
tgagcaccactgcact

SEQ ID NO: 271834 - DNA, 16 bp, P. troglodytes
tgagcacccactatgt

SEQ ID NO: 271835 - DNA, 16 bp, P. troglodytes
tgagcacctactatgt

SEQ ID NO: 271836 - DNA, 16 bp, P. troglodytes
tgagcacctactgtgt

SEQ ID NO: 271837 - DNA, 16 bp, P. troglodytes
tgagcacctgctgtgt

SEQ ID NO: 271838 - DNA, 16 bp, P. troglodytes
tgagcacttaccatgt

SEQ ID NO: 271839 - DNA, 16 bp, P. troglodytes
tgagcacttattatgt

SEQ ID NO: 271840 - DNA, 16 bp, P. troglodytes
tgagcacttgaaatgt

SEQ ID NO: 271841 - DNA, 16 bp, P. troglodytes
tgagcactttttcata

SEQ ID NO: 271842 - DNA, 16 bp, P. troglodytes
tgagcagagctgagcc

SEQ ID NO: 271843 - DNA, 16 bp, P. troglodytes
tgagcagaggcctgaa

SEQ ID NO: 271844 - DNA, 16 bp, P. troglodytes
tgagcagcaaaataaa

SEQ ID NO: 271845 - DNA, 16 bp, P. troglodytes
tgagcagtaacatttt

SEQ ID NO: 271846 - DNA, 18 bp, P. troglodytes
tgagcagtggggcactga

SEQ ID NO: 271847 - DNA, 30 bp, P. troglodytes
tgagcagtggtttgtagttctccttgaaga

SEQ ID NO: 271848 - DNA, 16 bp, P. troglodytes
tgagcatctttccatg

SEQ ID NO: 271849 - DNA, 16 bp, P. troglodytes
tgagcatgccactgca

SEQ ID NO: 271850 - DNA, 16 bp, P. troglodytes
tgagcattaccgcctg

SEQ ID NO: 271851 - DNA, 16 bp, P. troglodytes
tgagcattcatgtaca

SEQ ID NO: 271852 - DNA, 16 bp, P. troglodytes
tgagcatttcctttga

SEQ ID NO: 271853 - DNA, 16 bp, P. troglodytes
tgagcatttgaaatat

SEQ ID NO: 271854 - DNA, 16 bp, P. troglodytes
tgagcatttgggctgg

SEQ ID NO: 271855 - DNA, 17 bp, P. troglodytes
tgagcattttttcatgt

SEQ ID NO: 271856 - DNA, 16 bp, P. troglodytes
tgagccaaagaaacct

SEQ ID NO: 271857 - DNA, 18 bp, P. troglodytes
tgagccaacgcacctggc

SEQ ID NO: 271858 - DNA, 18 bp, P. troglodytes
tgagccaagataacacca

SEQ ID NO: 271859 - DNA, 16 bp, P. troglodytes
tgagccaagatcactg

SEQ ID NO: 271860 - DNA, 16 bp, P. troglodytes
tgagccaagattgcac

SEQ ID NO: 271861 - DNA, 21 bp, P. troglodytes
tgagccaagattgcgccattg

SEQ ID NO: 271862 - DNA, 16 bp, P. troglodytes
tgagccaagcttgtgc

SEQ ID NO: 271863 - DNA, 16 bp, P. troglodytes
tgagccaaggaggttg

SEQ ID NO: 271864 - DNA, 18 bp, P. troglodytes
tgagccaagttcgtgcca

SEQ ID NO: 271865 - DNA, 16 bp, P. troglodytes
tgagccacacacccag

SEQ ID NO: 271866 - DNA, 16 bp, P. troglodytes
tgagccacagtacctg

SEQ ID NO: 271867 - DNA, 16 bp, P. troglodytes
tgagccacagtgccca

SEQ ID NO: 271868 - DNA, 17 bp, P. troglodytes
tgagccaccacacctga

SEQ ID NO: 271869 - DNA, 16 bp, P. troglodytes
tgagccaccacagcca

SEQ ID NO: 271870 - DNA, 16 bp, P. troglodytes
tgagccaccacccttg

SEQ ID NO: 271871 - DNA, 16 bp, P. troglodytes
tgagccaccactccca

SEQ ID NO: 271872 - DNA, 17 bp, P. troglodytes
tgagccaccatgcccaa

SEQ ID NO: 271873 - DNA, 16 bp, P. troglodytes
tgagccaccatgcccg

SEQ ID NO: 271874 - DNA, 20 bp, P. troglodytes
tgagccaccatgcccggccg

SEQ ID NO: 271875 - DNA, 16 bp, P. troglodytes
tgagccaccccacccg

SEQ ID NO: 271876 - DNA, 16 bp, P. troglodytes
tgagccacccgcctgg

SEQ ID NO: 271877 - DNA, 20 bp, P. troglodytes
tgagccaccgcacctggcca

SEQ ID NO: 271878 - DNA, 20 bp, P. troglodytes
tgagccaccgcacctggccg

SEQ ID NO: 271879 - DNA, 16 bp, P. troglodytes
tgagccaccgcgccgg

SEQ ID NO: 271880 - DNA, 20 bp, P. troglodytes
tgagccaccgcgcctggcct

SEQ ID NO: 271881 - DNA, 16 bp, P. troglodytes
tgagccaccgcgtctg

SEQ ID NO: 271882 - DNA, 17 bp, P. troglodytes
tgagccaccgtgactgg

SEQ ID NO: 271883 - DNA, 16 bp, P. troglodytes
tgagccaccgtgccag

SEQ ID NO: 271884 - DNA, 21 bp, P. troglodytes
tgagccaccgtgcccggccct

SEQ ID NO: 271885 - DNA, 23 bp, P. troglodytes
tgagccaccgtgcccggcctatt

SEQ ID NO: 271886 - DNA, 21 bp, P. troglodytes
tgagccaccgtgcccggcctc

SEQ ID NO: 271887 - DNA, 21 bp, P. troglodytes
tgagccaccgtgcctggccac

SEQ ID NO: 271888 - DNA, 16 bp, P. troglodytes
tgagccacctcaccca

SEQ ID NO: 271889 - DNA, 16 bp, P. troglodytes
tgagccacctcacttg

SEQ ID NO: 271890 - DNA, 16 bp, P. troglodytes
tgagccacgcgcctgg

SEQ ID NO: 271891 - DNA, 16 bp, P. troglodytes
tgagccacggcacctg

SEQ ID NO: 271892 - DNA, 16 bp, P. troglodytes
tgagccactatgtcca

SEQ ID NO: 271893 - DNA, 17 bp, P. troglodytes
tgagccactgcacccaa

SEQ ID NO: 271894 - DNA, 20 bp, P. troglodytes
tgagccactgcacccggcca

SEQ ID NO: 271895 - DNA, 16 bp, P. troglodytes
tgagccactgcatccc

SEQ ID NO: 271896 - DNA, 16 bp, P. troglodytes
tgagccactgcatcta

SEQ ID NO: 271897 - DNA, 16 bp, P. troglodytes
tgagccactgcccctg

SEQ ID NO: 271898 - DNA, 16 bp, P. troglodytes
tgagccactgcgccca

SEQ ID NO: 271899 - DNA, 21 bp, P. troglodytes
tgagccactgcgcccagccag

SEQ ID NO: 271900 - DNA, 16 bp, P. troglodytes
tgagccactgcgcccc

SEQ ID NO: 271901 - DNA, 21 bp, P. troglodytes
tgagccactgcgcccggcccc

SEQ ID NO: 271902 - DNA, 21 bp, P. troglodytes
tgagccactgcgcccggcctc

SEQ ID NO: 271903 - DNA, 16 bp, P. troglodytes
tgagccactgcgcctg

SEQ ID NO: 271904 - DNA, 16 bp, P. troglodytes
tgagccactgctccca

SEQ ID NO: 271905 - DNA, 16 bp, P. troglodytes
tgagccactgggcctg

SEQ ID NO: 271906 - DNA, 16 bp, P. troglodytes
tgagccactgtaccag

SEQ ID NO: 271907 - DNA, 16 bp, P. troglodytes
tgagccactgtacccc

SEQ ID NO: 271908 - DNA, 16 bp, P. troglodytes
tgagccactgtacctg

SEQ ID NO: 271909 - DNA, 16 bp, P. troglodytes
tgagccactgtatcca

SEQ ID NO: 271910 - DNA, 16 bp, P. troglodytes
tgagccactgtccccg

SEQ ID NO: 271911 - DNA, 16 bp, P. troglodytes
tgagccactgtgcccc

SEQ ID NO: 271912 - DNA, 20 bp, P. troglodytes
tgagccactgtgcccggcca

SEQ ID NO: 271913 - DNA, 20 bp, P. troglodytes
tgagccactgtgcccggctc

SEQ ID NO: 271914 - DNA, 16 bp, P. troglodytes
tgagccactgtgcttg

SEQ ID NO: 271915 - DNA, 16 bp, P. troglodytes
tgagccactgtggccg

SEQ ID NO: 271916 - DNA, 16 bp, P. troglodytes
tgagccactgtgtctg

SEQ ID NO: 271917 - DNA, 16 bp, P. troglodytes
tgagccagacaaaggc

SEQ ID NO: 271918 - DNA, 16 bp, P. troglodytes
tgagccagcagcagca

SEQ ID NO: 271919 - DNA, 16 bp, P. troglodytes
tgagccaggaagaaat

SEQ ID NO: 271920 - DNA, 16 bp, P. troglodytes
tgagccaggaggtcga

SEQ ID NO: 271921 - DNA, 16 bp, P. troglodytes
tgagccaggagtttga

SEQ ID NO: 271922 - DNA, 16 bp, P. troglodytes
tgagccaggcactgtg

SEQ ID NO: 271923 - DNA, 16 bp, P. troglodytes
tgagccaggccctgtg

SEQ ID NO: 271924 - DNA, 16 bp, P. troglodytes
tgagccaggctctgtg

SEQ ID NO: 271925 - DNA, 16 bp, P. troglodytes
tgagccagggaggcgg

SEQ ID NO: 271926 - DNA, 16 bp, P. troglodytes
tgagccatcacgccca

SEQ ID NO: 271927 - DNA, 16 bp, P. troglodytes
tgagccatcacgcctg

SEQ ID NO: 271928 - DNA, 16 bp, P. troglodytes
tgagccatcctgccca

SEQ ID NO: 271929 - DNA, 16 bp, P. troglodytes
tgagccatcgcgcctg

SEQ ID NO: 271930 - DNA, 16 bp, P. troglodytes
tgagcccaagagtctg

SEQ ID NO: 271931 - DNA, 16 bp, P. troglodytes
tgagcccaagggtttg

SEQ ID NO: 271932 - DNA, 16 bp, P. troglodytes
tgagcccagcaggtca

SEQ ID NO: 271933 - DNA, 16 bp, P. troglodytes
tgagcccagcaggtcg

SEQ ID NO: 271934 - DNA, 16 bp, P. troglodytes
tgagcccaggaagcgg

SEQ ID NO: 271935 - DNA, 16 bp, P. troglodytes
tgagcccaggaggaca

SEQ ID NO: 271936 - DNA, 31 bp, P. troglodytes
tgagcccaggaggtcaaggctgcagtgagct

SEQ ID NO: 271937 - DNA, 17 bp, P. troglodytes
tgagcccaggagtttga

SEQ ID NO: 271938 - DNA, 16 bp, P. troglodytes
tgagcccagtttgaga

SEQ ID NO: 271939 - DNA, 16 bp, P. troglodytes
tgagccccagttttct

SEQ ID NO: 271940 - DNA, 16 bp, P. troglodytes
tgagcccccatgcctg

SEQ ID NO: 271941 - DNA, 16 bp, P. troglodytes
tgagccctcagcctgt

SEQ ID NO: 271942 - DNA, 16 bp, P. troglodytes
tgagccctggaggctg

SEQ ID NO: 271943 - DNA, 16 bp, P. troglodytes
tgagccgagactgagc

SEQ ID NO: 271944 - DNA, 18 bp, P. troglodytes
tgagccgagattgtgcca

SEQ ID NO: 271945 - DNA, 16 bp, P. troglodytes
tgagccgccatgcctg

SEQ ID NO: 271946 - DNA, 17 bp, P. troglodytes
tgagcctaggagttcaa

SEQ ID NO: 271947 - DNA, 16 bp, P. troglodytes
tgagcctatggatgtc

SEQ ID NO: 271948 - DNA, 16 bp, P. troglodytes
tgagcctatgtatgtc

SEQ ID NO: 271949 - DNA, 18 bp, P. troglodytes
tgagcctcagtttcctca

SEQ ID NO: 271950 - DNA, 16 bp, P. troglodytes
tgagcctccagaactg

SEQ ID NO: 271951 - DNA, 16 bp, P. troglodytes
tgagcctccatgcccg

SEQ ID NO: 271952 - DNA, 16 bp, P. troglodytes
tgagcctccatgcctg

SEQ ID NO: 271953 - DNA, 16 bp, P. troglodytes
tgagcctcctgcctca

SEQ ID NO: 271954 - DNA, 16 bp, P. troglodytes
tgagcctctgtttctt

SEQ ID NO: 271955 - DNA, 16 bp, P. troglodytes
tgagcctgagagtttg

SEQ ID NO: 271956 - DNA, 16 bp, P. troglodytes
tgagcctgaggaggtc

SEQ ID NO: 271957 - DNA, 16 bp, P. troglodytes
tgagcctgggaaatca

SEQ ID NO: 271958 - DNA, 16 bp, P. troglodytes
tgagcctgggaagcgg

SEQ ID NO: 271959 - DNA, 16 bp, P. troglodytes
tgagcctgggaggagg

SEQ ID NO: 271960 - DNA, 16 bp, P. troglodytes
tgagcctgggaggcgg

SEQ ID NO: 271961 - DNA, 17 bp, P. troglodytes
tgagcctgggaggcgga

SEQ ID NO: 271962 - DNA, 16 bp, P. troglodytes
tgagcctgggagggtg

SEQ ID NO: 271963 - DNA, 16 bp, P. troglodytes
tgagcctgtgaggttg

SEQ ID NO: 271964 - DNA, 16 bp, P. troglodytes
tgagcctgtgagtgca

SEQ ID NO: 271965 - DNA, 16 bp, P. troglodytes
tgagcctgttgatgcc

SEQ ID NO: 271966 - DNA, 16 bp, P. troglodytes
tgagcgcctactatgt

SEQ ID NO: 271967 - DNA, 16 bp, P. troglodytes
tgagctacaagagaac

SEQ ID NO: 271968 - DNA, 16 bp, P. troglodytes
tgagctaccatgtcca

SEQ ID NO: 271969 - DNA, 17 bp, P. troglodytes
tgagctaccgcgcctgg

SEQ ID NO: 271970 - DNA, 16 bp, P. troglodytes
tgagctactgagcctg

SEQ ID NO: 271971 - DNA, 16 bp, P. troglodytes
tgagctactgcgcccg

SEQ ID NO: 271972 - DNA, 16 bp, P. troglodytes
tgagctactgtgccca

SEQ ID NO: 271973 - DNA, 16 bp, P. troglodytes
tgagctatcacctcac

SEQ ID NO: 271974 - DNA, 16 bp, P. troglodytes
tgagctatgataacac

SEQ ID NO: 271975 - DNA, 16 bp, P. troglodytes
tgagctatgatggcac

SEQ ID NO: 271976 - DNA, 16 bp, P. troglodytes
tgagctcaagagttcg

SEQ ID NO: 271977 - DNA, 16 bp, P. troglodytes
tgagctcaagagttgg

SEQ ID NO: 271978 - DNA, 16 bp, P. troglodytes
tgagctcacaccactg

SEQ ID NO: 271979 - DNA, 16 bp, P. troglodytes
tgagctcagctcactg

SEQ ID NO: 271980 - DNA, 16 bp, P. troglodytes
tgagctcaggagtccg

SEQ ID NO: 271981 - DNA, 29 bp, P. troglodytes
tgagctcaggagttcaagaccagcctggg

SEQ ID NO: 271982 - DNA, 18 bp, P. troglodytes
tgagctcaggagtttgaa

SEQ ID NO: 271983 - DNA, 16 bp, P. troglodytes
tgagctcatgatccac

SEQ ID NO: 271984 - DNA, 16 bp, P. troglodytes
tgagctccctgctcag

SEQ ID NO: 271985 - DNA, 16 bp, P. troglodytes
tgagctcctgaccttg

SEQ ID NO: 271986 - DNA, 16 bp, P. troglodytes
tgagctcctggactca

SEQ ID NO: 271987 - DNA, 16 bp, P. troglodytes
tgagctctgagaacgg

SEQ ID NO: 271988 - DNA, 16 bp, P. troglodytes
tgagctgaaattgtac

SEQ ID NO: 271989 - DNA, 16 bp, P. troglodytes
tgagctgaagcagggt

SEQ ID NO: 271990 - DNA, 16 bp, P. troglodytes
tgagctgagacttgaa

SEQ ID NO: 271991 - DNA, 18 bp, P. troglodytes
tgagctgagatcgtgcca

SEQ ID NO: 271992 - DNA, 16 bp, P. troglodytes
tgagctgaggagtttg

SEQ ID NO: 271993 - DNA, 16 bp, P. troglodytes
tgagctgaggctggag

SEQ ID NO: 271994 - DNA, 17 bp, P. troglodytes
tgagctgagttcgtgcc

SEQ ID NO: 271995 - DNA, 16 bp, P. troglodytes
tgagctgcagctggag

SEQ ID NO: 271996 - DNA, 16 bp, P. troglodytes
tgagctgcattcccag

SEQ ID NO: 271997 - DNA, 16 bp, P. troglodytes
tgagctgcctgcctca

SEQ ID NO: 271998 - DNA, 16 bp, P. troglodytes
tgagctggcagaagaa

SEQ ID NO: 271999 - DNA, 16 bp, P. troglodytes
tgagctgggctttgaa

SEQ ID NO: 272000 - DNA, 16 bp, P. troglodytes
tgagctggggaggtgg

SEQ ID NO: 272001 - DNA, 16 bp, P. troglodytes
tgagctgtacctgggc

SEQ ID NO: 272002 - DNA, 16 bp, P. troglodytes
tgagcttcagtttcct

SEQ ID NO: 272003 - DNA, 16 bp, P. troglodytes
tgagcttctgggctca

SEQ ID NO: 272004 - DNA, 16 bp, P. troglodytes
tgagcttctgtttcct

SEQ ID NO: 272005 - DNA, 16 bp, P. troglodytes
tgagcttcttgtgttt

SEQ ID NO: 272006 - DNA, 16 bp, P. troglodytes
tgagcttgaaggcagg

SEQ ID NO: 272007 - DNA, 16 bp, P. troglodytes
tgagctttgggtgggg

SEQ ID NO: 272008 - DNA, 16 bp, P. troglodytes
tgagcttttaaatgtt

SEQ ID NO: 272009 - DNA, 16 bp, P. troglodytes
tgaggaaaaagaacaa

SEQ ID NO: 272010 - DNA, 16 bp, P. troglodytes
tgaggaaaataaaaca

SEQ ID NO: 272011 - DNA, 16 bp, P. troglodytes
tgaggaaaatgaggca

SEQ ID NO: 272012 - DNA, 16 bp, P. troglodytes
tgaggaaacagagact

SEQ ID NO: 272013 - DNA, 16 bp, P. troglodytes
tgaggaaaccaaggca

SEQ ID NO: 272014 - DNA, 16 bp, P. troglodytes
tgaggaaaccgaggca

SEQ ID NO: 272015 - DNA, 16 bp, P. troglodytes
tgaggaaaccgaggcc

SEQ ID NO: 272016 - DNA, 16 bp, P. troglodytes
tgaggaaactccaaac

SEQ ID NO: 272017 - DNA, 16 bp, P. troglodytes
tgaggaaactgaaaca

SEQ ID NO: 272018 - DNA, 16 bp, P. troglodytes
tgaggaaactgaagcc

SEQ ID NO: 272019 - DNA, 16 bp, P. troglodytes
tgaggaaactgagagg

SEQ ID NO: 272020 - DNA, 16 bp, P. troglodytes
tgaggaaactgaggaa

SEQ ID NO: 272021 - DNA, 16 bp, P. troglodytes
tgaggaaactgaggac

SEQ ID NO: 272022 - DNA, 16 bp, P. troglodytes
tgaggaaactgagtca

SEQ ID NO: 272023 - DNA, 16 bp, P. troglodytes
tgaggaaactgcatca

SEQ ID NO: 272024 - DNA, 16 bp, P. troglodytes
tgaggaaactgtggct

SEQ ID NO: 272025 - DNA, 16 bp, P. troglodytes
tgaggaaagaaaacaa

SEQ ID NO: 272026 - DNA, 16 bp, P. troglodytes
tgaggaaatcacagac

SEQ ID NO: 272027 - DNA, 16 bp, P. troglodytes
tgaggaaatgaatttt

SEQ ID NO: 272028 - DNA, 16 bp, P. troglodytes
tgaggaaattgaagcc

SEQ ID NO: 272029 - DNA, 16 bp, P. troglodytes
tgaggaacagaaggaa

SEQ ID NO: 272030 - DNA, 16 bp, P. troglodytes
tgaggaactgaaagaa

SEQ ID NO: 272031 - DNA, 16 bp, P. troglodytes
tgaggaactgctaaac

SEQ ID NO: 272032 - DNA, 16 bp, P. troglodytes
tgaggaagaagcagaa

SEQ ID NO: 272033 - DNA, 16 bp, P. troglodytes
tgaggaagcagcctga

SEQ ID NO: 272034 - DNA, 16 bp, P. troglodytes
tgaggaagctgaagct

SEQ ID NO: 272035 - DNA, 16 bp, P. troglodytes
tgaggaagctgaggtt

SEQ ID NO: 272036 - DNA, 16 bp, P. troglodytes
tgaggaagctgcagaa

SEQ ID NO: 272037 - DNA, 16 bp, P. troglodytes
tgaggaagctgtagaa

SEQ ID NO: 272038 - DNA, 16 bp, P. troglodytes
tgaggaagtggagaaa

SEQ ID NO: 272039 - DNA, 16 bp, P. troglodytes
tgaggaataaaagact

SEQ ID NO: 272040 - DNA, 16 bp, P. troglodytes
tgaggaatctaaaata

SEQ ID NO: 272041 - DNA, 17 bp, P. troglodytes
tgaggaatgtgttgcct

SEQ ID NO: 272042 - DNA, 16 bp, P. troglodytes
tgaggacaaacctctg

SEQ ID NO: 272043 - DNA, 16 bp, P. troglodytes
tgaggacacagagaag

SEQ ID NO: 272044 - DNA, 16 bp, P. troglodytes
tgaggacacagagcca

SEQ ID NO: 272045 - DNA, 16 bp, P. troglodytes
tgaggacacagtgttt

SEQ ID NO: 272046 - DNA, 16 bp, P. troglodytes
tgaggacactgaggct

SEQ ID NO: 272047 - DNA, 16 bp, P. troglodytes
tgaggacactgagttt

SEQ ID NO: 272048 - DNA, 16 bp, P. troglodytes
tgaggacagcaccaaa

SEQ ID NO: 272049 - DNA, 16 bp, P. troglodytes
tgaggacaggaagcat

SEQ ID NO: 272050 - DNA, 16 bp, P. troglodytes
tgaggacaggaattca

SEQ ID NO: 272051 - DNA, 16 bp, P. troglodytes
tgaggacagggacttt

SEQ ID NO: 272052 - DNA, 16 bp, P. troglodytes
tgaggacagggctgtg

SEQ ID NO: 272053 - DNA, 16 bp, P. troglodytes
tgaggaccttcttgct

SEQ ID NO: 272054 - DNA, 16 bp, P. troglodytes
tgaggacgtggagaaa

SEQ ID NO: 272055 - DNA, 16 bp, P. troglodytes
tgaggactctgtgtgg

SEQ ID NO: 272056 - DNA, 16 bp, P. troglodytes
tgaggactggagagag

SEQ ID NO: 272057 - DNA, 16 bp, P. troglodytes
tgaggagaaatccaag

SEQ ID NO: 272058 - DNA, 16 bp, P. troglodytes
tgaggagatgacattt

SEQ ID NO: 272059 - DNA, 16 bp, P. troglodytes
tgaggagatggaggac

SEQ ID NO: 272060 - DNA, 16 bp, P. troglodytes
tgaggagatgggagat

SEQ ID NO: 272061 - DNA, 16 bp, P. troglodytes
tgaggagctgccagac

SEQ ID NO: 272062 - DNA, 16 bp, P. troglodytes
tgaggaggaaggactc

SEQ ID NO: 272063 - DNA, 16 bp, P. troglodytes
tgaggaggcaagaatc

SEQ ID NO: 272064 - DNA, 16 bp, P. troglodytes
tgaggaggcagcctgt

SEQ ID NO: 272065 - DNA, 17 bp, P. troglodytes
tgaggaggcctcacaat

SEQ ID NO: 272066 - DNA, 16 bp, P. troglodytes
tgaggagggagaactg

SEQ ID NO: 272067 - DNA, 16 bp, P. troglodytes
tgaggagtaaatgaga

SEQ ID NO: 272068 - DNA, 16 bp, P. troglodytes
tgaggagtgcgggtgc

SEQ ID NO: 272069 - DNA, 16 bp, P. troglodytes
tgaggagtgtgggcac

SEQ ID NO: 272070 - DNA, 16 bp, P. troglodytes
tgaggagttcaaaacc

SEQ ID NO: 272071 - DNA, 16 bp, P. troglodytes
tgaggagtttgagatc

SEQ ID NO: 272072 - DNA, 16 bp, P. troglodytes
tgaggatatgaagaaa

SEQ ID NO: 272073 - DNA, 16 bp, P. troglodytes
tgaggatgaaatgaaa

SEQ ID NO: 272074 - DNA, 16 bp, P. troglodytes
tgaggatgaaatgaga

SEQ ID NO: 272075 - DNA, 16 bp, P. troglodytes
tgaggatgatgatgat

SEQ ID NO: 272076 - DNA, 16 bp, P. troglodytes
tgaggatgatgatttc

SEQ ID NO: 272077 - DNA, 16 bp, P. troglodytes
tgaggatgatggcttc

SEQ ID NO: 272078 - DNA, 16 bp, P. troglodytes
tgaggatgatggtttc

SEQ ID NO: 272079 - DNA, 16 bp, P. troglodytes
tgaggatgcaaagaca

SEQ ID NO: 272080 - DNA, 16 bp, P. troglodytes
tgaggatgcagagaga

SEQ ID NO: 272081 - DNA, 16 bp, P. troglodytes
tgaggatggagagaag

SEQ ID NO: 272082 - DNA, 16 bp, P. troglodytes
tgaggatgtagagaaa

SEQ ID NO: 272083 - DNA, 16 bp, P. troglodytes
tgaggatgtggacaaa

SEQ ID NO: 272084 - DNA, 16 bp, P. troglodytes
tgaggatgtggagaaa

SEQ ID NO: 272085 - DNA, 16 bp, P. troglodytes
tgaggatgtggagaag

SEQ ID NO: 272086 - DNA, 16 bp, P. troglodytes
tgaggatttttgcagc

SEQ ID NO: 272087 - DNA, 16 bp, P. troglodytes
tgaggcaaaaggattg

SEQ ID NO: 272088 - DNA, 16 bp, P. troglodytes
tgaggcaaggagttca

SEQ ID NO: 272089 - DNA, 16 bp, P. troglodytes
tgaggcacacagaggt

SEQ ID NO: 272090 - DNA, 16 bp, P. troglodytes
tgaggcagaaataaat

SEQ ID NO: 272091 - DNA, 16 bp, P. troglodytes
tgaggcagaagaaaag

SEQ ID NO: 272092 - DNA, 22 bp, P. troglodytes
tgaggcagaagaatcgcttgaa

SEQ ID NO: 272093 - DNA, 16 bp, P. troglodytes
tgaggcagagaattgt

SEQ ID NO: 272094 - DNA, 16 bp, P. troglodytes
tgaggcagatattatt

SEQ ID NO: 272095 - DNA, 16 bp, P. troglodytes
tgaggcagcagaattg

SEQ ID NO: 272096 - DNA, 16 bp, P. troglodytes
tgaggcagcagcctgg

SEQ ID NO: 272097 - DNA, 16 bp, P. troglodytes
tgaggcagcttctaag

SEQ ID NO: 272098 - DNA, 16 bp, P. troglodytes
tgaggcaggagaacct

SEQ ID NO: 272099 - DNA, 21 bp, P. troglodytes
tgaggcaggagaatcacttga

SEQ ID NO: 272100 - DNA, 16 bp, P. troglodytes
tgaggcaggagcccag

SEQ ID NO: 272101 - DNA, 16 bp, P. troglodytes
tgaggcaggaggacca

SEQ ID NO: 272102 - DNA, 16 bp, P. troglodytes
tgaggcaggaggacct

SEQ ID NO: 272103 - DNA, 16 bp, P. troglodytes
tgaggcaggagggctg

SEQ ID NO: 272104 - DNA, 16 bp, P. troglodytes
tgaggcaggagtttga

SEQ ID NO: 272105 - DNA, 21 bp, P. troglodytes
tgaggcaggcggatcacttga

SEQ ID NO: 272106 - DNA, 16 bp, P. troglodytes
tgaggcagggagaatg

SEQ ID NO: 272107 - DNA, 16 bp, P. troglodytes
tgaggcatccccagcc

SEQ ID NO: 272108 - DNA, 16 bp, P. troglodytes
tgaggcatgaggatcc

SEQ ID NO: 272109 - DNA, 16 bp, P. troglodytes
tgaggccaaggtgggc

SEQ ID NO: 272110 - DNA, 16 bp, P. troglodytes
tgaggccagcatcaac

SEQ ID NO: 272111 - DNA, 16 bp, P. troglodytes
tgaggccagcctggga

SEQ ID NO: 272112 - DNA, 16 bp, P. troglodytes
tgaggccaggaattgg

SEQ ID NO: 272113 - DNA, 16 bp, P. troglodytes
tgaggccaggactttg

SEQ ID NO: 272114 - DNA, 16 bp, P. troglodytes
tgaggccaggagctcc

SEQ ID NO: 272115 - DNA, 16 bp, P. troglodytes
tgaggccaggaggcag

SEQ ID NO: 272116 - DNA, 17 bp, P. troglodytes
tgaggccaggtgcggtg

SEQ ID NO: 272117 - DNA, 16 bp, P. troglodytes
tgaggccatgagggtg

SEQ ID NO: 272118 - DNA, 16 bp, P. troglodytes
tgaggcccacaaggaa

SEQ ID NO: 272119 - DNA, 16 bp, P. troglodytes
tgaggcccagaaagag

SEQ ID NO: 272120 - DNA, 16 bp, P. troglodytes
tgaggcccagagagat

SEQ ID NO: 272121 - DNA, 16 bp, P. troglodytes
tgaggcccagagagcc

SEQ ID NO: 272122 - DNA, 16 bp, P. troglodytes
tgaggcccagagaggt

SEQ ID NO: 272123 - DNA, 16 bp, P. troglodytes
tgaggcccagcaagaa

SEQ ID NO: 272124 - DNA, 16 bp, P. troglodytes
tgaggcccagggaggt

SEQ ID NO: 272125 - DNA, 16 bp, P. troglodytes
tgaggccccccagcca

SEQ ID NO: 272126 - DNA, 16 bp, P. troglodytes
tgaggccgggcatggt

SEQ ID NO: 272127 - DNA, 16 bp, P. troglodytes
tgaggcctaaggtgaa

SEQ ID NO: 272128 - DNA, 16 bp, P. troglodytes
tgaggcctcagggagc

SEQ ID NO: 272129 - DNA, 16 bp, P. troglodytes
tgaggcctccacagcc

SEQ ID NO: 272130 - DNA, 16 bp, P. troglodytes
tgaggcctccccagcc

SEQ ID NO: 272131 - DNA, 16 bp, P. troglodytes
tgaggcctccctagcc

SEQ ID NO: 272132 - DNA, 16 bp, P. troglodytes
tgaggcctcctcagcc

SEQ ID NO: 272133 - DNA, 17 bp, P. troglodytes
tgaggcctctcaagcca

SEQ ID NO: 272134 - DNA, 16 bp, P. troglodytes
tgaggcctctcttctg

SEQ ID NO: 272135 - DNA, 16 bp, P. troglodytes
tgaggcctgagaatcg

SEQ ID NO: 272136 - DNA, 16 bp, P. troglodytes
tgaggcctgtggctgc

SEQ ID NO: 272137 - DNA, 16 bp, P. troglodytes
tgaggcctgtggtgga

SEQ ID NO: 272138 - DNA, 16 bp, P. troglodytes
tgaggccttcccagct

SEQ ID NO: 272139 - DNA, 16 bp, P. troglodytes
tgaggcctttctcctt

SEQ ID NO: 272140 - DNA, 16 bp, P. troglodytes
tgaggcgagaggatca

SEQ ID NO: 272141 - DNA, 16 bp, P. troglodytes
tgaggcgggaggatga

SEQ ID NO: 272142 - DNA, 16 bp, P. troglodytes
tgaggctcagaaaagg

SEQ ID NO: 272143 - DNA, 16 bp, P. troglodytes
tgaggctcagaaaggt

SEQ ID NO: 272144 - DNA, 16 bp, P. troglodytes
tgaggctcagagaact

SEQ ID NO: 272145 - DNA, 16 bp, P. troglodytes
tgaggctcagagaggc

SEQ ID NO: 272146 - DNA, 16 bp, P. troglodytes
tgaggctcagagaggg

SEQ ID NO: 272147 - DNA, 16 bp, P. troglodytes
tgaggctcagagaggt

SEQ ID NO: 272148 - DNA, 16 bp, P. troglodytes
tgaggctcagagatgc

SEQ ID NO: 272149 - DNA, 16 bp, P. troglodytes
tgaggctcagggaagt

SEQ ID NO: 272150 - DNA, 16 bp, P. troglodytes
tgaggctcagggagag

SEQ ID NO: 272151 - DNA, 16 bp, P. troglodytes
tgaggctccccagcca

SEQ ID NO: 272152 - DNA, 16 bp, P. troglodytes
tgaggctgaggcagaa

SEQ ID NO: 272153 - DNA, 18 bp, P. troglodytes
tgaggctgaggcaggaga

SEQ ID NO: 272154 - DNA, 16 bp, P. troglodytes
tgaggctgcaaagagc

SEQ ID NO: 272155 - DNA, 19 bp, P. troglodytes
tgaggctgcagtgagctga

SEQ ID NO: 272156 - DNA, 16 bp, P. troglodytes
tgaggctgcagtgatt

SEQ ID NO: 272157 - DNA, 16 bp, P. troglodytes
tgaggctgcagtgtgc

SEQ ID NO: 272158 - DNA, 16 bp, P. troglodytes
tgaggctgctgaccct

SEQ ID NO: 272159 - DNA, 16 bp, P. troglodytes
tgaggctgctgtgagc

SEQ ID NO: 272160 - DNA, 16 bp, P. troglodytes
tgaggctggattttct

SEQ ID NO: 272161 - DNA, 16 bp, P. troglodytes
tgaggctggggctggg

SEQ ID NO: 272162 - DNA, 16 bp, P. troglodytes
tgaggctgtggaggaa

SEQ ID NO: 272163 - DNA, 16 bp, P. troglodytes
tgaggctgtttctgga

SEQ ID NO: 272164 - DNA, 16 bp, P. troglodytes
tgaggcttctccagcc

SEQ ID NO: 272165 - DNA, 16 bp, P. troglodytes
tgaggcttgaacccag

SEQ ID NO: 272166 - DNA, 16 bp, P. troglodytes
tgaggcttggaaaggt

SEQ ID NO: 272167 - DNA, 16 bp, P. troglodytes
tgagggaaagtttaga

SEQ ID NO: 272168 - DNA, 16 bp, P. troglodytes
tgagggaactgaggcc

SEQ ID NO: 272169 - DNA, 16 bp, P. troglodytes
tgagggacaaacattc

SEQ ID NO: 272170 - DNA, 18 bp, P. troglodytes
tgagggactgtgccatga

SEQ ID NO: 272171 - DNA, 16 bp, P. troglodytes
tgagggagggagagca

SEQ ID NO: 272172 - DNA, 16 bp, P. troglodytes
tgagggaggtatgtag

SEQ ID NO: 272173 - DNA, 16 bp, P. troglodytes
tgagggaggtggaggc

SEQ ID NO: 272174 - DNA, 16 bp, P. troglodytes
tgagggatctgcctcc

SEQ ID NO: 272175 - DNA, 16 bp, P. troglodytes
tgagggcagcacctgc

SEQ ID NO: 272176 - DNA, 16 bp, P. troglodytes
tgagggccaggtgcag

SEQ ID NO: 272177 - DNA, 16 bp, P. troglodytes
tgagggctctcttctt

SEQ ID NO: 272178 - DNA, 16 bp, P. troglodytes
tgagggcttcagtatt

SEQ ID NO: 272179 - DNA, 16 bp, P. troglodytes
tgagggctttcttcct

SEQ ID NO: 272180 - DNA, 16 bp, P. troglodytes
tgaggggaaaaaaaca

SEQ ID NO: 272181 - DNA, 16 bp, P. troglodytes
tgaggggcacctctgc

SEQ ID NO: 272182 - DNA, 16 bp, P. troglodytes
tgaggggcccctctgc

SEQ ID NO: 272183 - DNA, 16 bp, P. troglodytes
tgaggggcttagcacc

SEQ ID NO: 272184 - DNA, 16 bp, P. troglodytes
tgagggtctgtggctt

SEQ ID NO: 272185 - DNA, 16 bp, P. troglodytes
tgagggtgggccctaa

SEQ ID NO: 272186 - DNA, 16 bp, P. troglodytes
tgagggtgtttccaaa

SEQ ID NO: 272187 - DNA, 16 bp, P. troglodytes
tgagggttctgcagga

SEQ ID NO: 272188 - DNA, 16 bp, P. troglodytes
tgagggttctgcccct

SEQ ID NO: 272189 - DNA, 16 bp, P. troglodytes
tgagggttttcatcat

SEQ ID NO: 272190 - DNA, 16 bp, P. troglodytes
tgaggtcaagagttca

SEQ ID NO: 272191 - DNA, 16 bp, P. troglodytes
tgaggtcaagtgtttg

SEQ ID NO: 272192 - DNA, 16 bp, P. troglodytes
tgaggtcacaagttca

SEQ ID NO: 272193 - DNA, 16 bp, P. troglodytes
tgaggtcagcctgggc

SEQ ID NO: 272194 - DNA, 16 bp, P. troglodytes
tgaggtcaggagatca

SEQ ID NO: 272195 - DNA, 16 bp, P. troglodytes
tgaggtcaggagctca

SEQ ID NO: 272196 - DNA, 16 bp, P. troglodytes
tgaggtcatgttttcc

SEQ ID NO: 272197 - DNA, 16 bp, P. troglodytes
tgaggtccagagaggt

SEQ ID NO: 272198 - DNA, 16 bp, P. troglodytes
tgaggtcctgtctcaa

SEQ ID NO: 272199 - DNA, 16 bp, P. troglodytes
tgaggtcgggagttcc

SEQ ID NO: 272200 - DNA, 16 bp, P. troglodytes
tgaggtcgggagttgg

SEQ ID NO: 272201 - DNA, 16 bp, P. troglodytes
tgaggtgataaatatg

SEQ ID NO: 272202 - DNA, 16 bp, P. troglodytes
tgaggtgctgctggat

SEQ ID NO: 272203 - DNA, 16 bp, P. troglodytes
tgaggtgcttgctgaa

SEQ ID NO: 272204 - DNA, 16 bp, P. troglodytes
tgaggtggaagaatgg

SEQ ID NO: 272205 - DNA, 16 bp, P. troglodytes
tgaggtggcaggatgg

SEQ ID NO: 272206 - DNA, 16 bp, P. troglodytes
tgaggtgggaagattg

SEQ ID NO: 272207 - DNA, 16 bp, P. troglodytes
tgaggtgggaggctgg

SEQ ID NO: 272208 - DNA, 16 bp, P. troglodytes
tgaggtgggagggctg

SEQ ID NO: 272209 - DNA, 23 bp, P. troglodytes
tgaggtgggcggatcacttgagc

SEQ ID NO: 272210 - DNA, 16 bp, P. troglodytes
tgaggtgggtctcctg

SEQ ID NO: 272211 - DNA, 16 bp, P. troglodytes
tgaggtggtgtcagat

SEQ ID NO: 272212 - DNA, 16 bp, P. troglodytes
tgaggttagaggatca

SEQ ID NO: 272213 - DNA, 16 bp, P. troglodytes
tgaggttgagcatctt

SEQ ID NO: 272214 - DNA, 16 bp, P. troglodytes
tgaggttgaggtggga

SEQ ID NO: 272215 - DNA, 16 bp, P. troglodytes
tgaggttgcaaagaaa

SEQ ID NO: 272216 - DNA, 16 bp, P. troglodytes
tgaggttgcagagaaa

SEQ ID NO: 272217 - DNA, 16 bp, P. troglodytes
tgaggttgggagtttg

SEQ ID NO: 272218 - DNA, 16 bp, P. troglodytes
tgaggtttcagagaaa

SEQ ID NO: 272219 - DNA, 16 bp, P. troglodytes
tgaggtttgaggtaca

SEQ ID NO: 272220 - DNA, 16 bp, P. troglodytes
tgaggtttgggaacct

SEQ ID NO: 272221 - DNA, 16 bp, P. troglodytes
tgagtaaaagctccct

SEQ ID NO: 272222 - DNA, 16 bp, P. troglodytes
tgagtaaagaaaatgt

SEQ ID NO: 272223 - DNA, 16 bp, P. troglodytes
tgagtaaatatttgtt

SEQ ID NO: 272224 - DNA, 16 bp, P. troglodytes
tgagtaaatgaataaa

SEQ ID NO: 272225 - DNA, 16 bp, P. troglodytes
tgagtaaatgaatgaa

SEQ ID NO: 272226 - DNA, 16 bp, P. troglodytes
tgagtaaattaaattt

SEQ ID NO: 272227 - DNA, 16 bp, P. troglodytes
tgagtaagttctggag

SEQ ID NO: 272228 - DNA, 16 bp, P. troglodytes
tgagtaattttggatt

SEQ ID NO: 272229 - DNA, 16 bp, P. troglodytes
tgagtacctactctgt

SEQ ID NO: 272230 - DNA, 16 bp, P. troglodytes
tgagtacctattatgt

SEQ ID NO: 272231 - DNA, 16 bp, P. troglodytes
tgagtactttgaactg

SEQ ID NO: 272232 - DNA, 16 bp, P. troglodytes
tgagtagcagggactg

SEQ ID NO: 272233 - DNA, 16 bp, P. troglodytes
tgagtagcatgataaa

SEQ ID NO: 272234 - DNA, 16 bp, P. troglodytes
tgagtagctgcgacta

SEQ ID NO: 272235 - DNA, 16 bp, P. troglodytes
tgagtagctgggacta

SEQ ID NO: 272236 - DNA, 16 bp, P. troglodytes
tgagtagttgcaatag

SEQ ID NO: 272237 - DNA, 16 bp, P. troglodytes
tgagtagttgtgatag

SEQ ID NO: 272238 - DNA, 16 bp, P. troglodytes
tgagtataacagcttt

SEQ ID NO: 272239 - DNA, 16 bp, P. troglodytes
tgagtatctactgtgt

SEQ ID NO: 272240 - DNA, 16 bp, P. troglodytes
tgagtatttttgcatc

SEQ ID NO: 272241 - DNA, 16 bp, P. troglodytes
tgagtcaattaaacct

SEQ ID NO: 272242 - DNA, 16 bp, P. troglodytes
tgagtcaattaagcct

SEQ ID NO: 272243 - DNA, 16 bp, P. troglodytes
tgagtcaccgtgcctg

SEQ ID NO: 272244 - DNA, 16 bp, P. troglodytes
tgagtcactgcactcc

SEQ ID NO: 272245 - DNA, 16 bp, P. troglodytes
tgagtcattgcacctg

SEQ ID NO: 272246 - DNA, 16 bp, P. troglodytes
tgagtcattttttaat

SEQ ID NO: 272247 - DNA, 16 bp, P. troglodytes
tgagtccaggaggtgg

SEQ ID NO: 272248 - DNA, 16 bp, P. troglodytes
tgagtccattgaacct

SEQ ID NO: 272249 - DNA, 16 bp, P. troglodytes
tgagtcctggctctgc

SEQ ID NO: 272250 - DNA, 17 bp, P. troglodytes
tgagtccttgtggacaa

SEQ ID NO: 272251 - DNA, 17 bp, P. troglodytes
tgagtctcactctgttg

SEQ ID NO: 272252 - DNA, 16 bp, P. troglodytes
tgagtctcatgaaatc

SEQ ID NO: 272253 - DNA, 16 bp, P. troglodytes
tgagtctcatgcctca

SEQ ID NO: 272254 - DNA, 16 bp, P. troglodytes
tgagtctccagcctgc

SEQ ID NO: 272255 - DNA, 16 bp, P. troglodytes
tgagtctctgtctcaa

SEQ ID NO: 272256 - DNA, 16 bp, P. troglodytes
tgagtctgctgttgaa

SEQ ID NO: 272257 - DNA, 16 bp, P. troglodytes
tgagtcttcctattca

SEQ ID NO: 272258 - DNA, 16 bp, P. troglodytes
tgagtctttgctgaag

SEQ ID NO: 272259 - DNA, 16 bp, P. troglodytes
tgagtgaaagaagcca

SEQ ID NO: 272260 - DNA, 16 bp, P. troglodytes
tgagtgaatgaaagaa

SEQ ID NO: 272261 - DNA, 16 bp, P. troglodytes
tgagtgaatgtgaagg

SEQ ID NO: 272262 - DNA, 16 bp, P. troglodytes
tgagtgaatttcttag

SEQ ID NO: 272263 - DNA, 16 bp, P. troglodytes
tgagtgaccaatggcc

SEQ ID NO: 272264 - DNA, 16 bp, P. troglodytes
tgagtgagaaataaac

SEQ ID NO: 272265 - DNA, 16 bp, P. troglodytes
tgagtgagaacatggc

SEQ ID NO: 272266 - DNA, 16 bp, P. troglodytes
tgagtgaggacatgca

SEQ ID NO: 272267 - DNA, 16 bp, P. troglodytes
tgagtgagtcagtgag

SEQ ID NO: 272268 - DNA, 16 bp, P. troglodytes
tgagtgagtttcctaa

SEQ ID NO: 272269 - DNA, 16 bp, P. troglodytes
tgagtgatcctcccac

SEQ ID NO: 272270 - DNA, 16 bp, P. troglodytes
tgagtgcagcctgcca

SEQ ID NO: 272271 - DNA, 16 bp, P. troglodytes
tgagtgcctactatgt

SEQ ID NO: 272272 - DNA, 16 bp, P. troglodytes
tgagtgcctactgtgt

SEQ ID NO: 272273 - DNA, 16 bp, P. troglodytes
tgagtgcgtgtgtgtg

SEQ ID NO: 272274 - DNA, 16 bp, P. troglodytes
tgagtgctccagtgtt

SEQ ID NO: 272275 - DNA, 16 bp, P. troglodytes
tgagtgctgtggctca

SEQ ID NO: 272276 - DNA, 16 bp, P. troglodytes
tgagtgcttgaaatgt

SEQ ID NO: 272277 - DNA, 16 bp, P. troglodytes
tgagtggctgggacta

SEQ ID NO: 272278 - DNA, 16 bp, P. troglodytes
tgagtgggggaaaaaa

SEQ ID NO: 272279 - DNA, 16 bp, P. troglodytes
tgagtgtatatatatt

SEQ ID NO: 272280 - DNA, 16 bp, P. troglodytes
tgagtgtgagtgtgtg

SEQ ID NO: 272281 - DNA, 16 bp, P. troglodytes
tgagtgtgcgtgtgtg

SEQ ID NO: 272282 - DNA, 16 bp, P. troglodytes
tgagtgtggtggttca

SEQ ID NO: 272283 - DNA, 16 bp, P. troglodytes
tgagtgtgtctgtgag

SEQ ID NO: 272284 - DNA, 16 bp, P. troglodytes
tgagtgtgtgagtgtg

SEQ ID NO: 272285 - DNA, 16 bp, P. troglodytes
tgagtgtgtgtgagtg

SEQ ID NO: 272286 - DNA, 16 bp, P. troglodytes
tgagtgtgtgtgcctg

SEQ ID NO: 272287 - DNA, 16 bp, P. troglodytes
tgagtgttacagttca

SEQ ID NO: 272288 - DNA, 20 bp, P. troglodytes
tgagtgttacagttcttaaa

SEQ ID NO: 272289 - DNA, 16 bp, P. troglodytes
tgagtgttcagctcct

SEQ ID NO: 272290 - DNA, 16 bp, P. troglodytes
tgagttaatatttaat

SEQ ID NO: 272291 - DNA, 17 bp, P. troglodytes
tgagttaatgctgaaat

SEQ ID NO: 272292 - DNA, 16 bp, P. troglodytes
tgagttaatttatgta

SEQ ID NO: 272293 - DNA, 16 bp, P. troglodytes
tgagttaggtattatt

SEQ ID NO: 272294 - DNA, 16 bp, P. troglodytes
tgagttatgttccttc

SEQ ID NO: 272295 - DNA, 16 bp, P. troglodytes
tgagttatttagaaat

SEQ ID NO: 272296 - DNA, 16 bp, P. troglodytes
tgagttatttatcttt

SEQ ID NO: 272297 - DNA, 16 bp, P. troglodytes
tgagttatttcaaaag

SEQ ID NO: 272298 - DNA, 16 bp, P. troglodytes
tgagttcaaaaccagc

SEQ ID NO: 272299 - DNA, 16 bp, P. troglodytes
tgagttcaagttctga

SEQ ID NO: 272300 - DNA, 17 bp, P. troglodytes
tgagttccctcagtttt

SEQ ID NO: 272301 - DNA, 16 bp, P. troglodytes
tgagttctagccaatg

SEQ ID NO: 272302 - DNA, 16 bp, P. troglodytes
tgagttctccattctg

SEQ ID NO: 272303 - DNA, 16 bp, P. troglodytes
tgagttctgtgagcta

SEQ ID NO: 272304 - DNA, 16 bp, P. troglodytes
tgagttctgtgagtca

SEQ ID NO: 272305 - DNA, 16 bp, P. troglodytes
tgagttctgtgagtcc

SEQ ID NO: 272306 - DNA, 16 bp, P. troglodytes
tgagttctttgagaaa

SEQ ID NO: 272307 - DNA, 16 bp, P. troglodytes
tgagttctttgcagat

SEQ ID NO: 272308 - DNA, 16 bp, P. troglodytes
tgagttctttgtggat

SEQ ID NO: 272309 - DNA, 18 bp, P. troglodytes
tgagttgagatcgtgcca

SEQ ID NO: 272310 - DNA, 16 bp, P. troglodytes
tgagttgcaagctgaa

SEQ ID NO: 272311 - DNA, 16 bp, P. troglodytes
tgagttgggaggatgg

SEQ ID NO: 272312 - DNA, 16 bp, P. troglodytes
tgagttgtcttttcac

SEQ ID NO: 272313 - DNA, 16 bp, P. troglodytes
tgagttgttttcagtt

SEQ ID NO: 272314 - DNA, 16 bp, P. troglodytes
tgagtttcagttcttt

SEQ ID NO: 272315 - DNA, 16 bp, P. troglodytes
tgagtttcctaatcct

SEQ ID NO: 272316 - DNA, 16 bp, P. troglodytes
tgagtttcttaaccct

SEQ ID NO: 272317 - DNA, 16 bp, P. troglodytes
tgagtttcttgtaaat

SEQ ID NO: 272318 - DNA, 16 bp, P. troglodytes
tgagtttgacattttt

SEQ ID NO: 272319 - DNA, 16 bp, P. troglodytes
tgagtttgagatgcct

SEQ ID NO: 272320 - DNA, 16 bp, P. troglodytes
tgagttttctcatgct

SEQ ID NO: 272321 - DNA, 16 bp, P. troglodytes
tgagttttgaaggatg

SEQ ID NO: 272322 - DNA, 16 bp, P. troglodytes
tgagttttgacaaata

SEQ ID NO: 272323 - DNA, 16 bp, P. troglodytes
tgataaaaaatgtttt

SEQ ID NO: 272324 - DNA, 16 bp, P. troglodytes
tgataaaaaccttcaa

SEQ ID NO: 272325 - DNA, 16 bp, P. troglodytes
tgataaaacaaacttt

SEQ ID NO: 272326 - DNA, 16 bp, P. troglodytes
tgataaaactgacttt

SEQ ID NO: 272327 - DNA, 16 bp, P. troglodytes
tgataaaactttattt

SEQ ID NO: 272328 - DNA, 16 bp, P. troglodytes
tgataaaatacatata

SEQ ID NO: 272329 - DNA, 16 bp, P. troglodytes
tgataaaatgtttaaa

SEQ ID NO: 272330 - DNA, 16 bp, P. troglodytes
tgataaaattcaacag

SEQ ID NO: 272331 - DNA, 16 bp, P. troglodytes
tgataaacaacttcaa

SEQ ID NO: 272332 - DNA, 16 bp, P. troglodytes
tgataaacatatgcat

SEQ ID NO: 272333 - DNA, 16 bp, P. troglodytes
tgataaagcagaagaa

SEQ ID NO: 272334 - DNA, 16 bp, P. troglodytes
tgataaagcagtagca

SEQ ID NO: 272335 - DNA, 16 bp, P. troglodytes
tgataaagctgaaaaa

SEQ ID NO: 272336 - DNA, 16 bp, P. troglodytes
tgataaaggacttgta

SEQ ID NO: 272337 - DNA, 16 bp, P. troglodytes
tgataaaggtgacatt

SEQ ID NO: 272338 - DNA, 16 bp, P. troglodytes
tgataaatatatatga

SEQ ID NO: 272339 - DNA, 16 bp, P. troglodytes
tgataaatcacattta

SEQ ID NO: 272340 - DNA, 16 bp, P. troglodytes
tgataaatgaattcag

SEQ ID NO: 272341 - DNA, 16 bp, P. troglodytes
tgataaatgatgttga

SEQ ID NO: 272342 - DNA, 16 bp, P. troglodytes
tgataaatgtatacaa

SEQ ID NO: 272343 - DNA, 16 bp, P. troglodytes
tgataaatgttcaagg

SEQ ID NO: 272344 - DNA, 16 bp, P. troglodytes
tgataaatttctgaat

SEQ ID NO: 272345 - DNA, 16 bp, P. troglodytes
tgataagaaacttcag

SEQ ID NO: 272346 - DNA, 16 bp, P. troglodytes
tgataagagcaaaact

SEQ ID NO: 272347 - DNA, 16 bp, P. troglodytes
tgataagcaagttcag

SEQ ID NO: 272348 - DNA, 16 bp, P. troglodytes
tgataagtgcagcaaa

SEQ ID NO: 272349 - DNA, 16 bp, P. troglodytes
tgataatgaagatgat

SEQ ID NO: 272350 - DNA, 16 bp, P. troglodytes
tgataatgacaataaa

SEQ ID NO: 272351 - DNA, 16 bp, P. troglodytes
tgataatgtgattttt

SEQ ID NO: 272352 - DNA, 18 bp, P. troglodytes
tgatacaaacaaatggaa

SEQ ID NO: 272353 - DNA, 16 bp, P. troglodytes
tgatacaaagttaaaa

SEQ ID NO: 272354 - DNA, 17 bp, P. troglodytes
tgatacagtttggctgt

SEQ ID NO: 272355 - DNA, 16 bp, P. troglodytes
tgatacataaaattaa

SEQ ID NO: 272356 - DNA, 16 bp, P. troglodytes
tgatacatattttttt

SEQ ID NO: 272357 - DNA, 16 bp, P. troglodytes
tgatacatgcatataa

SEQ ID NO: 272358 - DNA, 16 bp, P. troglodytes
tgatacatgctacaac

SEQ ID NO: 272359 - DNA, 16 bp, P. troglodytes
tgatacattaaaaaaa

SEQ ID NO: 272360 - DNA, 16 bp, P. troglodytes
tgatacattgtatttt

SEQ ID NO: 272361 - DNA, 16 bp, P. troglodytes
tgataccaaaacctga

SEQ ID NO: 272362 - DNA, 16 bp, P. troglodytes
tgataccctgtctcaa

SEQ ID NO: 272363 - DNA, 16 bp, P. troglodytes
tgatacctaatacaat

SEQ ID NO: 272364 - DNA, 16 bp, P. troglodytes
tgatacctccaggtat

SEQ ID NO: 272365 - DNA, 16 bp, P. troglodytes
tgatactggcatctgc

SEQ ID NO: 272366 - DNA, 16 bp, P. troglodytes
tgatactttttttgag

SEQ ID NO: 272367 - DNA, 16 bp, P. troglodytes
tgatagagcaaaactc

SEQ ID NO: 272368 - DNA, 16 bp, P. troglodytes
tgatagagcaagacct

SEQ ID NO: 272369 - DNA, 16 bp, P. troglodytes
tgatagagtgagactt

SEQ ID NO: 272370 - DNA, 17 bp, P. troglodytes
tgatagatagatagatg

SEQ ID NO: 272371 - DNA, 16 bp, P. troglodytes
tgatagctttattttt

SEQ ID NO: 272372 - DNA, 16 bp, P. troglodytes
tgatagggtttggctg

SEQ ID NO: 272373 - DNA, 16 bp, P. troglodytes
tgatagtatttggaga

SEQ ID NO: 272374 - DNA, 17 bp, P. troglodytes
tgatagtgaatgagtct

SEQ ID NO: 272375 - DNA, 16 bp, P. troglodytes
tgatagtgatgatgat

SEQ ID NO: 272376 - DNA, 16 bp, P. troglodytes
tgatagtgattaagtc

SEQ ID NO: 272377 - DNA, 16 bp, P. troglodytes
tgatagttttaaaatt

SEQ ID NO: 272378 - DNA, 16 bp, P. troglodytes
tgatagttttctgaga

SEQ ID NO: 272379 - DNA, 16 bp, P. troglodytes
tgatataaagaaatac

SEQ ID NO: 272380 - DNA, 16 bp, P. troglodytes
tgatataattcagctg

SEQ ID NO: 272381 - DNA, 16 bp, P. troglodytes
tgatataggagttaag

SEQ ID NO: 272382 - DNA, 16 bp, P. troglodytes
tgatatataatagttg

SEQ ID NO: 272383 - DNA, 16 bp, P. troglodytes
tgatatataatcatat

SEQ ID NO: 272384 - DNA, 16 bp, P. troglodytes
tgatatatcatgttta

SEQ ID NO: 272385 - DNA, 16 bp, P. troglodytes
tgatatgattgtatac

SEQ ID NO: 272386 - DNA, 16 bp, P. troglodytes
tgatatgctaagaaag

SEQ ID NO: 272387 - DNA, 16 bp, P. troglodytes
tgatatggtttggctg

SEQ ID NO: 272388 - DNA, 17 bp, P. troglodytes
tgatatggtttggctgt

SEQ ID NO: 272389 - DNA, 16 bp, P. troglodytes
tgatatgtatgtatat

SEQ ID NO: 272390 - DNA, 16 bp, P. troglodytes
tgatatgtgtggattt

SEQ ID NO: 272391 - DNA, 16 bp, P. troglodytes
tgatattaatgaatgt

SEQ ID NO: 272392 - DNA, 17 bp, P. troglodytes
tgatattccccttcctg

SEQ ID NO: 272393 - DNA, 16 bp, P. troglodytes
tgatattgataatttg

SEQ ID NO: 272394 - DNA, 16 bp, P. troglodytes
tgatatttataaaaca

SEQ ID NO: 272395 - DNA, 16 bp, P. troglodytes
tgatatttatagaaca

SEQ ID NO: 272396 - DNA, 16 bp, P. troglodytes
tgatatttctttgttg

SEQ ID NO: 272397 - DNA, 16 bp, P. troglodytes
tgatattttgaagggt

SEQ ID NO: 272398 - DNA, 16 bp, P. troglodytes
tgatattttgaccttc

SEQ ID NO: 272399 - DNA, 16 bp, P. troglodytes
tgatattttgatataa

SEQ ID NO: 272400 - DNA, 16 bp, P. troglodytes
tgatattttgttatgg

SEQ ID NO: 272401 - DNA, 16 bp, P. troglodytes
tgatatttttagtaga

SEQ ID NO: 272402 - DNA, 16 bp, P. troglodytes
tgatcaaattggctac

SEQ ID NO: 272403 - DNA, 16 bp, P. troglodytes
tgatcaataaaataaa

SEQ ID NO: 272404 - DNA, 16 bp, P. troglodytes
tgatcacaccactgcg

SEQ ID NO: 272405 - DNA, 16 bp, P. troglodytes
tgatcacaccattgca

SEQ ID NO: 272406 - DNA, 16 bp, P. troglodytes
tgatcacactgctgca

SEQ ID NO: 272407 - DNA, 16 bp, P. troglodytes
tgatcacttgagccca

SEQ ID NO: 272408 - DNA, 16 bp, P. troglodytes
tgatcagcccgcctcg

SEQ ID NO: 272409 - DNA, 16 bp, P. troglodytes
tgatcaggctggtttt

SEQ ID NO: 272410 - DNA, 16 bp, P. troglodytes
tgatcatacagttttt

SEQ ID NO: 272411 - DNA, 16 bp, P. troglodytes
tgatcatagctcactc

SEQ ID NO: 272412 - DNA, 16 bp, P. troglodytes
tgatcatagcttactg

SEQ ID NO: 272413 - DNA, 16 bp, P. troglodytes
tgatcatcccactgca

SEQ ID NO: 272414 - DNA, 16 bp, P. troglodytes
tgatcatctcaataga

SEQ ID NO: 272415 - DNA, 16 bp, P. troglodytes
tgatcatgccactgca

SEQ ID NO: 272416 - DNA, 16 bp, P. troglodytes
tgatcatgctgggagc

SEQ ID NO: 272417 - DNA, 16 bp, P. troglodytes
tgatcatggtgaatta

SEQ ID NO: 272418 - DNA, 16 bp, P. troglodytes
tgatcattttaatgtg

SEQ ID NO: 272419 - DNA, 16 bp, P. troglodytes
tgatcattttcctttt

SEQ ID NO: 272420 - DNA, 16 bp, P. troglodytes
tgatccacatgcctca

SEQ ID NO: 272421 - DNA, 17 bp, P. troglodytes
tgatccaccacctcggc

SEQ ID NO: 272422 - DNA, 21 bp, P. troglodytes
tgatccacccacctcagcctc

SEQ ID NO: 272423 - DNA, 16 bp, P. troglodytes
tgatccacccacctcc

SEQ ID NO: 272424 - DNA, 16 bp, P. troglodytes
tgatccacccacttcc

SEQ ID NO: 272425 - DNA, 17 bp, P. troglodytes
tgatccacccgctttgg

SEQ ID NO: 272426 - DNA, 16 bp, P. troglodytes
tgatccacctcagcct

SEQ ID NO: 272427 - DNA, 16 bp, P. troglodytes
tgatccaccttcctcg

SEQ ID NO: 272428 - DNA, 16 bp, P. troglodytes
tgatccaccttccttg

SEQ ID NO: 272429 - DNA, 16 bp, P. troglodytes
tgatccagagctgagt

SEQ ID NO: 272430 - DNA, 16 bp, P. troglodytes
tgatccagcagcagga

SEQ ID NO: 272431 - DNA, 16 bp, P. troglodytes
tgatccagtttcttca

SEQ ID NO: 272432 - DNA, 16 bp, P. troglodytes
tgatccatgtgctgaa

SEQ ID NO: 272433 - DNA, 16 bp, P. troglodytes
tgatccattccaacca

SEQ ID NO: 272434 - DNA, 16 bp, P. troglodytes
tgatccattttaattt

SEQ ID NO: 272435 - DNA, 16 bp, P. troglodytes
tgatcccactactgat

SEQ ID NO: 272436 - DNA, 16 bp, P. troglodytes
tgatcccagaactttg

SEQ ID NO: 272437 - DNA, 16 bp, P. troglodytes
tgatcccagcactttg

SEQ ID NO: 272438 - DNA, 16 bp, P. troglodytes
tgatcccaggagttca

SEQ ID NO: 272439 - DNA, 19 bp, P. troglodytes
tgatccgcccgcctcagcc

SEQ ID NO: 272440 - DNA, 16 bp, P. troglodytes
tgatccgcccgcctcc

SEQ ID NO: 272441 - DNA, 16 bp, P. troglodytes
tgatccgcctgcctct

SEQ ID NO: 272442 - DNA, 17 bp, P. troglodytes
tgatcctagctacttgg

SEQ ID NO: 272443 - DNA, 16 bp, P. troglodytes
tgatcctcagcttgca

SEQ ID NO: 272444 - DNA, 16 bp, P. troglodytes
tgatcctcccacttca

SEQ ID NO: 272445 - DNA, 16 bp, P. troglodytes
tgatcctcccacttcc

SEQ ID NO: 272446 - DNA, 16 bp, P. troglodytes
tgatcctcccgccttg

SEQ ID NO: 272447 - DNA, 16 bp, P. troglodytes
tgatcctcctacctca

SEQ ID NO: 272448 - DNA, 16 bp, P. troglodytes
tgatcctcctgcttgg

SEQ ID NO: 272449 - DNA, 16 bp, P. troglodytes
tgatcctctccttcct

SEQ ID NO: 272450 - DNA, 16 bp, P. troglodytes
tgatcctgccattatg

SEQ ID NO: 272451 - DNA, 16 bp, P. troglodytes
tgatccttccatcttg

SEQ ID NO: 272452 - DNA, 16 bp, P. troglodytes
tgatcctttcagaaaa

SEQ ID NO: 272453 - DNA, 16 bp, P. troglodytes
tgatccttttgcctca

SEQ ID NO: 272454 - DNA, 16 bp, P. troglodytes
tgatctaccctcctca

SEQ ID NO: 272455 - DNA, 16 bp, P. troglodytes
tgatctcacctcactg

SEQ ID NO: 272456 - DNA, 16 bp, P. troglodytes
tgatctcaggtaatcc

SEQ ID NO: 272457 - DNA, 16 bp, P. troglodytes
tgatctcaggtcactg

SEQ ID NO: 272458 - DNA, 17 bp, P. troglodytes
tgatctcatgatctgcc

SEQ ID NO: 272459 - DNA, 16 bp, P. troglodytes
tgatctcattttattt

SEQ ID NO: 272460 - DNA, 16 bp, P. troglodytes
tgatctcctgacctgg

SEQ ID NO: 272461 - DNA, 18 bp, P. troglodytes
tgatctcgactcactgca

SEQ ID NO: 272462 - DNA, 21 bp, P. troglodytes
tgatctcggctcactgcaaat

SEQ ID NO: 272463 - DNA, 22 bp, P. troglodytes
tgatctcggctcactgcaagct

SEQ ID NO: 272464 - DNA, 19 bp, P. troglodytes
tgatctcggctcactgcac

SEQ ID NO: 272465 - DNA, 19 bp, P. troglodytes
tgatctcggctcactgcag

SEQ ID NO: 272466 - DNA, 16 bp, P. troglodytes
tgatctctgactgctg

SEQ ID NO: 272467 - DNA, 17 bp, P. troglodytes
tgatctctgtgacccac

SEQ ID NO: 272468 - DNA, 16 bp, P. troglodytes
tgatctcttgacctcg

SEQ ID NO: 272469 - DNA, 16 bp, P. troglodytes
tgatctcttgaccttg

SEQ ID NO: 272470 - DNA, 16 bp, P. troglodytes
tgatctgccagccttg

SEQ ID NO: 272471 - DNA, 33 bp, P. troglodytes
tgatctgcccaccttggcctcccaaagtgctga

SEQ ID NO: 272472 - DNA, 16 bp, P. troglodytes
tgatctgcccgcctct

SEQ ID NO: 272473 - DNA, 16 bp, P. troglodytes
tgatctgcccgccttg

SEQ ID NO: 272474 - DNA, 16 bp, P. troglodytes
tgatctgcctgcccca

SEQ ID NO: 272475 - DNA, 21 bp, P. troglodytes
tgatctgcctgcctcggcctc

SEQ ID NO: 272476 - DNA, 16 bp, P. troglodytes
tgatctgcctgccttg

SEQ ID NO: 272477 - DNA, 16 bp, P. troglodytes
tgatctgcctgccttt

SEQ ID NO: 272478 - DNA, 16 bp, P. troglodytes
tgatctgccttcctcg

SEQ ID NO: 272479 - DNA, 16 bp, P. troglodytes
tgatctgctgtctgca

SEQ ID NO: 272480 - DNA, 16 bp, P. troglodytes
tgatctgctttttgtc

SEQ ID NO: 272481 - DNA, 16 bp, P. troglodytes
tgatctggcccctgcc

SEQ ID NO: 272482 - DNA, 16 bp, P. troglodytes
tgatctggggcaagtt

SEQ ID NO: 272483 - DNA, 16 bp, P. troglodytes
tgatctgtccacctca

SEQ ID NO: 272484 - DNA, 16 bp, P. troglodytes
tgatctgtctgcctcg

SEQ ID NO: 272485 - DNA, 16 bp, P. troglodytes
tgatctgtggtcagtg

SEQ ID NO: 272486 - DNA, 16 bp, P. troglodytes
tgatcttaaaattcat

SEQ ID NO: 272487 - DNA, 16 bp, P. troglodytes
tgatcttatatttgaa

SEQ ID NO: 272488 - DNA, 16 bp, P. troglodytes
tgatcttatttttaaa

SEQ ID NO: 272489 - DNA, 16 bp, P. troglodytes
tgatcttcagcaaagc

SEQ ID NO: 272490 - DNA, 17 bp, P. troglodytes
tgatcttcagtctctga

SEQ ID NO: 272491 - DNA, 16 bp, P. troglodytes
tgatcttccagcctca

SEQ ID NO: 272492 - DNA, 16 bp, P. troglodytes
tgatcttcccacttca

SEQ ID NO: 272493 - DNA, 16 bp, P. troglodytes
tgatcttctatccaga

SEQ ID NO: 272494 - DNA, 16 bp, P. troglodytes
tgatcttgaactcctg

SEQ ID NO: 272495 - DNA, 16 bp, P. troglodytes
tgatcttgaattcctg

SEQ ID NO: 272496 - DNA, 16 bp, P. troglodytes
tgatcttgagcaagtt

SEQ ID NO: 272497 - DNA, 16 bp, P. troglodytes
tgatcttgcctcactg

SEQ ID NO: 272498 - DNA, 18 bp, P. troglodytes
tgatcttggctcactgca

SEQ ID NO: 272499 - DNA, 16 bp, P. troglodytes
tgatcttgggcaaatt

SEQ ID NO: 272500 - DNA, 16 bp, P. troglodytes
tgatcttgggcaagta

SEQ ID NO: 272501 - DNA, 16 bp, P. troglodytes
tgatctttcttttccc

SEQ ID NO: 272502 - DNA, 16 bp, P. troglodytes
tgatcttttcaagaaa

SEQ ID NO: 272503 - DNA, 16 bp, P. troglodytes
tgatcttttgcatttc

SEQ ID NO: 272504 - DNA, 16 bp, P. troglodytes
tgatgaaaaactgaat

SEQ ID NO: 272505 - DNA, 16 bp, P. troglodytes
tgatgaaaaagttctg

SEQ ID NO: 272506 - DNA, 16 bp, P. troglodytes
tgatgaaaagaatgtg

SEQ ID NO: 272507 - DNA, 16 bp, P. troglodytes
tgatgaaaataattta

SEQ ID NO: 272508 - DNA, 16 bp, P. troglodytes
tgatgaaaataatttt

SEQ ID NO: 272509 - DNA, 16 bp, P. troglodytes
tgatgaaaatattctg

SEQ ID NO: 272510 - DNA, 16 bp, P. troglodytes
tgatgaaaatgttcta

SEQ ID NO: 272511 - DNA, 16 bp, P. troglodytes
tgatgaaagacataaa

SEQ ID NO: 272512 - DNA, 16 bp, P. troglodytes
tgatgaaagcctgtct

SEQ ID NO: 272513 - DNA, 16 bp, P. troglodytes
tgatgaaagtggctct

SEQ ID NO: 272514 - DNA, 17 bp, P. troglodytes
tgatgaaataatctgta

SEQ ID NO: 272515 - DNA, 16 bp, P. troglodytes
tgatgaaatcatttgt

SEQ ID NO: 272516 - DNA, 16 bp, P. troglodytes
tgatgaaatgaaatga

SEQ ID NO: 272517 - DNA, 16 bp, P. troglodytes
tgatgaaattcaaaat

SEQ ID NO: 272518 - DNA, 16 bp, P. troglodytes
tgatgaaattcaacat

SEQ ID NO: 272519 - DNA, 16 bp, P. troglodytes
tgatgaaattgccaaa

SEQ ID NO: 272520 - DNA, 16 bp, P. troglodytes
tgatgaacatagatgc

SEQ ID NO: 272521 - DNA, 16 bp, P. troglodytes
tgatgaacatctttgt

SEQ ID NO: 272522 - DNA, 16 bp, P. troglodytes
tgatgaacatggagaa

SEQ ID NO: 272523 - DNA, 16 bp, P. troglodytes
tgatgaagaaaatgtt

SEQ ID NO: 272524 - DNA, 16 bp, P. troglodytes
tgatgaagaaattgaa

SEQ ID NO: 272525 - DNA, 16 bp, P. troglodytes
tgatgaagatgtggag

SEQ ID NO: 272526 - DNA, 16 bp, P. troglodytes
tgatgaagtccagttt

SEQ ID NO: 272527 - DNA, 16 bp, P. troglodytes
tgatgaagtttaattt

SEQ ID NO: 272528 - DNA, 16 bp, P. troglodytes
tgatgaatatgttaat

SEQ ID NO: 272529 - DNA, 16 bp, P. troglodytes
tgatgaatatgttcat

SEQ ID NO: 272530 - DNA, 16 bp, P. troglodytes
tgatgaatgaatgcat

SEQ ID NO: 272531 - DNA, 16 bp, P. troglodytes
tgatgacaatggcagt

SEQ ID NO: 272532 - DNA, 16 bp, P. troglodytes
tgatgacaatggtgat

SEQ ID NO: 272533 - DNA, 16 bp, P. troglodytes
tgatgacatgagctgg

SEQ ID NO: 272534 - DNA, 16 bp, P. troglodytes
tgatgacattttcttt

SEQ ID NO: 272535 - DNA, 16 bp, P. troglodytes
tgatgacctgaggtgg

SEQ ID NO: 272536 - DNA, 16 bp, P. troglodytes
tgatgacgatgatgac

SEQ ID NO: 272537 - DNA, 16 bp, P. troglodytes
tgatgactaaatgcaa

SEQ ID NO: 272538 - DNA, 16 bp, P. troglodytes
tgatgagaatgtaaat

SEQ ID NO: 272539 - DNA, 16 bp, P. troglodytes
tgatgagcatttggat

SEQ ID NO: 272540 - DNA, 16 bp, P. troglodytes
tgatgagctgctggat

SEQ ID NO: 272541 - DNA, 16 bp, P. troglodytes
tgatgaggatgaagat

SEQ ID NO: 272542 - DNA, 16 bp, P. troglodytes
tgatgaggatggcatt

SEQ ID NO: 272543 - DNA, 16 bp, P. troglodytes
tgatgaggatgtagag

SEQ ID NO: 272544 - DNA, 16 bp, P. troglodytes
tgatgaggatgtggaa

SEQ ID NO: 272545 - DNA, 16 bp, P. troglodytes
tgatgaggattttttc

SEQ ID NO: 272546 - DNA, 16 bp, P. troglodytes
tgatgagggtgtggag

SEQ ID NO: 272547 - DNA, 16 bp, P. troglodytes
tgatgaggtcatgtcc

SEQ ID NO: 272548 - DNA, 16 bp, P. troglodytes
tgatgagttaatggat

SEQ ID NO: 272549 - DNA, 16 bp, P. troglodytes
tgatgataatgaaaat

SEQ ID NO: 272550 - DNA, 16 bp, P. troglodytes
tgatgatatatatgat

SEQ ID NO: 272551 - DNA, 16 bp, P. troglodytes
tgatgatatttggaga

SEQ ID NO: 272552 - DNA, 16 bp, P. troglodytes
tgatgatcttgaccct

SEQ ID NO: 272553 - DNA, 16 bp, P. troglodytes
tgatgatgaaaatgat

SEQ ID NO: 272554 - DNA, 16 bp, P. troglodytes
tgatgatgacagtgat

SEQ ID NO: 272555 - DNA, 16 bp, P. troglodytes
tgatgatgagaatttt

SEQ ID NO: 272556 - DNA, 16 bp, P. troglodytes
tgatgatgaggaggag

SEQ ID NO: 272557 - DNA, 16 bp, P. troglodytes
tgatgatgaggatgat

SEQ ID NO: 272558 - DNA, 16 bp, P. troglodytes
tgatgatgaggttttt

SEQ ID NO: 272559 - DNA, 16 bp, P. troglodytes
tgatgatgagtatttt

SEQ ID NO: 272560 - DNA, 16 bp, P. troglodytes
tgatgatgataaagat

SEQ ID NO: 272561 - DNA, 16 bp, P. troglodytes
tgatgatgataatgaa

SEQ ID NO: 272562 - DNA, 16 bp, P. troglodytes
tgatgatgatcatgat

SEQ ID NO: 272563 - DNA, 16 bp, P. troglodytes
tgatgatgatgaaaat

SEQ ID NO: 272564 - DNA, 16 bp, P. troglodytes
tgatgatgatgaataa

SEQ ID NO: 272565 - DNA, 16 bp, P. troglodytes
tgatgatgatgacaaa

SEQ ID NO: 272566 - DNA, 16 bp, P. troglodytes
tgatgatgatgatact

SEQ ID NO: 272567 - DNA, 16 bp, P. troglodytes
tgatgatgatgatgag

SEQ ID NO: 272568 - DNA, 16 bp, P. troglodytes
tgatgatgatgatgat

SEQ ID NO: 272569 - DNA, 16 bp, P. troglodytes
tgatgatgatgatggg

SEQ ID NO: 272570 - DNA, 16 bp, P. troglodytes
tgatgatgatgatggt

SEQ ID NO: 272571 - DNA, 16 bp, P. troglodytes
tgatgatgatgatgtg

SEQ ID NO: 272572 - DNA, 16 bp, P. troglodytes
tgatgatgatgatgtt

SEQ ID NO: 272573 - DNA, 16 bp, P. troglodytes
tgatgatgatgctgat

SEQ ID NO: 272574 - DNA, 16 bp, P. troglodytes
tgatgatgatggtgac

SEQ ID NO: 272575 - DNA, 16 bp, P. troglodytes
tgatgatgatggtgat

SEQ ID NO: 272576 - DNA, 16 bp, P. troglodytes
tgatgatggacactta

SEQ ID NO: 272577 - DNA, 16 bp, P. troglodytes
tgatgatggtggtggt

SEQ ID NO: 272578 - DNA, 16 bp, P. troglodytes
tgatgattcagatgat

SEQ ID NO: 272579 - DNA, 16 bp, P. troglodytes
tgatgatttgggaaat

SEQ ID NO: 272580 - DNA, 16 bp, P. troglodytes
tgatgattttttaaaa

SEQ ID NO: 272581 - DNA, 16 bp, P. troglodytes
tgatgcaaaatcctca

SEQ ID NO: 272582 - DNA, 16 bp, P. troglodytes
tgatgcaagaccagca

SEQ ID NO: 272583 - DNA, 16 bp, P. troglodytes
tgatgcaagaggtagg

SEQ ID NO: 272584 - DNA, 16 bp, P. troglodytes
tgatgcaatcttggct

SEQ ID NO: 272585 - DNA, 16 bp, P. troglodytes
tgatgcaatgtgagaa

SEQ ID NO: 272586 - DNA, 16 bp, P. troglodytes
tgatgcacacttgtag

SEQ ID NO: 272587 - DNA, 16 bp, P. troglodytes
tgatgcagaagatggg

SEQ ID NO: 272588 - DNA, 16 bp, P. troglodytes
tgatgcaggaggatca

SEQ ID NO: 272589 - DNA, 24 bp, P. troglodytes
tgatgcctccagctttgttctttt

SEQ ID NO: 272590 - DNA, 16 bp, P. troglodytes
tgatgcctcctgcttt

SEQ ID NO: 272591 - DNA, 16 bp, P. troglodytes
tgatgctcctgctctg

SEQ ID NO: 272592 - DNA, 16 bp, P. troglodytes
tgatgctcctgcttca

SEQ ID NO: 272593 - DNA, 16 bp, P. troglodytes
tgatgctgagcttttt

SEQ ID NO: 272594 - DNA, 16 bp, P. troglodytes
tgatgctgatgatgct

SEQ ID NO: 272595 - DNA, 16 bp, P. troglodytes
tgatgctgatgctatt

SEQ ID NO: 272596 - DNA, 16 bp, P. troglodytes
tgatgctgatgctgtt

SEQ ID NO: 272597 - DNA, 16 bp, P. troglodytes
tgatgctgctgctgat

SEQ ID NO: 272598 - DNA, 16 bp, P. troglodytes
tgatgctgctgctgct

SEQ ID NO: 272599 - DNA, 16 bp, P. troglodytes
tgatgctgctggcctg

SEQ ID NO: 272600 - DNA, 16 bp, P. troglodytes
tgatgctgctggtttg

SEQ ID NO: 272601 - DNA, 16 bp, P. troglodytes
tgatgctggcctaata

SEQ ID NO: 272602 - DNA, 16 bp, P. troglodytes
tgatgctggcctcaaa

SEQ ID NO: 272603 - DNA, 16 bp, P. troglodytes
tgatgctggcctcaca

SEQ ID NO: 272604 - DNA, 16 bp, P. troglodytes
tgatgctgggagaact

SEQ ID NO: 272605 - DNA, 16 bp, P. troglodytes
tgatgctgtccctccc

SEQ ID NO: 272606 - DNA, 16 bp, P. troglodytes
tgatgctttctgactg

SEQ ID NO: 272607 - DNA, 16 bp, P. troglodytes
tgatggaaaaggaaat

SEQ ID NO: 272608 - DNA, 16 bp, P. troglodytes
tgatggaaaccactgg

SEQ ID NO: 272609 - DNA, 16 bp, P. troglodytes
tgatggaaatgtccta

SEQ ID NO: 272610 - DNA, 16 bp, P. troglodytes
tgatggaacatatctt

SEQ ID NO: 272611 - DNA, 16 bp, P. troglodytes
tgatggaactgaaaaa

SEQ ID NO: 272612 - DNA, 16 bp, P. troglodytes
tgatggaactgttcta

SEQ ID NO: 272613 - DNA, 16 bp, P. troglodytes
tgatggaagaaattga

SEQ ID NO: 272614 - DNA, 16 bp, P. troglodytes
tgatggaagttcattt

SEQ ID NO: 272615 - DNA, 16 bp, P. troglodytes
tgatggaattacaggt

SEQ ID NO: 272616 - DNA, 16 bp, P. troglodytes
tgatggacacataggt

SEQ ID NO: 272617 - DNA, 16 bp, P. troglodytes
tgatggacacctgggt

SEQ ID NO: 272618 - DNA, 16 bp, P. troglodytes
tgatggacatctgggt

SEQ ID NO: 272619 - DNA, 16 bp, P. troglodytes
tgatggacatttgagt

SEQ ID NO: 272620 - DNA, 16 bp, P. troglodytes
tgatggacatttgggt

SEQ ID NO: 272621 - DNA, 17 bp, P. troglodytes
tgatggacatttgggtt

SEQ ID NO: 272622 - DNA, 16 bp, P. troglodytes
tgatggacatttgtgt

SEQ ID NO: 272623 - DNA, 16 bp, P. troglodytes
tgatggacatttgttt

SEQ ID NO: 272624 - DNA, 16 bp, P. troglodytes
tgatggaccacatata

SEQ ID NO: 272625 - DNA, 16 bp, P. troglodytes
tgatggagctgagaaa

SEQ ID NO: 272626 - DNA, 16 bp, P. troglodytes
tgatggagctgggatt

SEQ ID NO: 272627 - DNA, 16 bp, P. troglodytes
tgatggatattccaat

SEQ ID NO: 272628 - DNA, 16 bp, P. troglodytes
tgatggatatttagat

SEQ ID NO: 272629 - DNA, 16 bp, P. troglodytes
tgatggatctgggcaa

SEQ ID NO: 272630 - DNA, 16 bp, P. troglodytes
tgatggattgcattta

SEQ ID NO: 272631 - DNA, 16 bp, P. troglodytes
tgatggcaatgatgat

SEQ ID NO: 272632 - DNA, 16 bp, P. troglodytes
tgatggcagcagcagc

SEQ ID NO: 272633 - DNA, 16 bp, P. troglodytes
tgatggcaggagcctg

SEQ ID NO: 272634 - DNA, 16 bp, P. troglodytes
tgatggcagtggctgc

SEQ ID NO: 272635 - DNA, 16 bp, P. troglodytes
tgatggccaggctgat

SEQ ID NO: 272636 - DNA, 16 bp, P. troglodytes
tgatggctcacacctg

SEQ ID NO: 272637 - DNA, 16 bp, P. troglodytes
tgatggctcatgcctg

SEQ ID NO: 272638 - DNA, 16 bp, P. troglodytes
tgatggctctgaagag

SEQ ID NO: 272639 - DNA, 16 bp, P. troglodytes
tgatggctggagctct

SEQ ID NO: 272640 - DNA, 16 bp, P. troglodytes
tgatggcttctatttt

SEQ ID NO: 272641 - DNA, 16 bp, P. troglodytes
tgatggcttggaaaaa

SEQ ID NO: 272642 - DNA, 16 bp, P. troglodytes
tgatgggagacagtga

SEQ ID NO: 272643 - DNA, 16 bp, P. troglodytes
tgatgggaggcagtga

SEQ ID NO: 272644 - DNA, 16 bp, P. troglodytes
tgatgggcctttgggt

SEQ ID NO: 272645 - DNA, 22 bp, P. troglodytes
tgatggggatggcattgaatct

SEQ ID NO: 272646 - DNA, 16 bp, P. troglodytes
tgatggggttgttttc

SEQ ID NO: 272647 - DNA, 16 bp, P. troglodytes
tgatgggtacagcaaa

SEQ ID NO: 272648 - DNA, 17 bp, P. troglodytes
tgatgggtgcagcaaaa

SEQ ID NO: 272649 - DNA, 16 bp, P. troglodytes
tgatgggtgcaggaaa

SEQ ID NO: 272650 - DNA, 16 bp, P. troglodytes
tgatgggttgacaggt

SEQ ID NO: 272651 - DNA, 16 bp, P. troglodytes
tgatggtgatgatgaa

SEQ ID NO: 272652 - DNA, 16 bp, P. troglodytes
tgatggtgatgatgat

SEQ ID NO: 272653 - DNA, 16 bp, P. troglodytes
tgatggtgatggtgtt

SEQ ID NO: 272654 - DNA, 16 bp, P. troglodytes
tgatggtgcaggcctg

SEQ ID NO: 272655 - DNA, 16 bp, P. troglodytes
tgatggtgccattgca

SEQ ID NO: 272656 - DNA, 16 bp, P. troglodytes
tgatggtggtgatggt

SEQ ID NO: 272657 - DNA, 16 bp, P. troglodytes
tgatggtggtggtagt

SEQ ID NO: 272658 - DNA, 16 bp, P. troglodytes
tgatggtggtttcttt

SEQ ID NO: 272659 - DNA, 16 bp, P. troglodytes
tgatggttaattttat

SEQ ID NO: 272660 - DNA, 16 bp, P. troglodytes
tgatggtttaaaaatg

SEQ ID NO: 272661 - DNA, 17 bp, P. troglodytes
tgatggttttataaaga

SEQ ID NO: 272662 - DNA, 16 bp, P. troglodytes
tgatggttttataagc

SEQ ID NO: 272663 - DNA, 16 bp, P. troglodytes
tgatggttttatgagg

SEQ ID NO: 272664 - DNA, 16 bp, P. troglodytes
tgatgtacattctcag

SEQ ID NO: 272665 - DNA, 16 bp, P. troglodytes
tgatgtatttctccat

SEQ ID NO: 272666 - DNA, 16 bp, P. troglodytes
tgatgtcaagagttca

SEQ ID NO: 272667 - DNA, 16 bp, P. troglodytes
tgatgtcaggagttcg

SEQ ID NO: 272668 - DNA, 21 bp, P. troglodytes
tgatgtccactataacacagg

SEQ ID NO: 272669 - DNA, 16 bp, P. troglodytes
tgatgtctttggtttt

SEQ ID NO: 272670 - DNA, 16 bp, P. troglodytes
tgatgtgatgaattac

SEQ ID NO: 272671 - DNA, 16 bp, P. troglodytes
tgatgtgcatttctct

SEQ ID NO: 272672 - DNA, 16 bp, P. troglodytes
tgatgtgcttcccttt

SEQ ID NO: 272673 - DNA, 16 bp, P. troglodytes
tgatgtgggaggatgg

SEQ ID NO: 272674 - DNA, 16 bp, P. troglodytes
tgatgtggtctcagat

SEQ ID NO: 272675 - DNA, 16 bp, P. troglodytes
tgatgtggtgctggat

SEQ ID NO: 272676 - DNA, 16 bp, P. troglodytes
tgatgtgtcacattta

SEQ ID NO: 272677 - DNA, 16 bp, P. troglodytes
tgatgttaacattgtt

SEQ ID NO: 272678 - DNA, 16 bp, P. troglodytes
tgatgttaactgtagg

SEQ ID NO: 272679 - DNA, 16 bp, P. troglodytes
tgatgttaactttgat

SEQ ID NO: 272680 - DNA, 16 bp, P. troglodytes
tgatgttaagcatttt

SEQ ID NO: 272681 - DNA, 16 bp, P. troglodytes
tgatgttaagcttttt

SEQ ID NO: 272682 - DNA, 21 bp, P. troglodytes
tgatgttaaggtgtcaatttt

SEQ ID NO: 272683 - DNA, 16 bp, P. troglodytes
tgatgttacaaaatca

SEQ ID NO: 272684 - DNA, 16 bp, P. troglodytes
tgatgttatctataga

SEQ ID NO: 272685 - DNA, 16 bp, P. troglodytes
tgatgttgactttgat

SEQ ID NO: 272686 - DNA, 16 bp, P. troglodytes
tgatgttgagcttctt

SEQ ID NO: 272687 - DNA, 16 bp, P. troglodytes
tgatgttgagctttct

SEQ ID NO: 272688 - DNA, 16 bp, P. troglodytes
tgatgttgagtatttt

SEQ ID NO: 272689 - DNA, 16 bp, P. troglodytes
tgatgttggtaatttg

SEQ ID NO: 272690 - DNA, 16 bp, P. troglodytes
tgatgtttacatttca

SEQ ID NO: 272691 - DNA, 16 bp, P. troglodytes
tgatgtttatggtttc

SEQ ID NO: 272692 - DNA, 16 bp, P. troglodytes
tgatgtttattatttc

SEQ ID NO: 272693 - DNA, 16 bp, P. troglodytes
tgatgtttcaatacat

SEQ ID NO: 272694 - DNA, 16 bp, P. troglodytes
tgatgttttaaaatgt

SEQ ID NO: 272695 - DNA, 37 bp, P. troglodytes
tgatgttttacaagggttaggacaatcctttgatctg

SEQ ID NO: 272696 - DNA, 16 bp, P. troglodytes
tgatgttttgatacat

SEQ ID NO: 272697 - DNA, 16 bp, P. troglodytes
tgatgttttttaaaaa

SEQ ID NO: 272698 - DNA, 16 bp, P. troglodytes
tgattaaaacaaaaca

SEQ ID NO: 272699 - DNA, 16 bp, P. troglodytes
tgattaaacttagtga

SEQ ID NO: 272700 - DNA, 16 bp, P. troglodytes
tgattaatgatgttga

SEQ ID NO: 272701 - DNA, 16 bp, P. troglodytes
tgattacagaggctga

SEQ ID NO: 272702 - DNA, 16 bp, P. troglodytes
tgattacaggcgtgag

SEQ ID NO: 272703 - DNA, 17 bp, P. troglodytes
tgattacaggcgtgagt

SEQ ID NO: 272704 - DNA, 16 bp, P. troglodytes
tgattacatgttgaaa

SEQ ID NO: 272705 - DNA, 16 bp, P. troglodytes
tgattactacaatcaa

SEQ ID NO: 272706 - DNA, 16 bp, P. troglodytes
tgattagctaggacta

SEQ ID NO: 272707 - DNA, 16 bp, P. troglodytes
tgattagtgatgttga

SEQ ID NO: 272708 - DNA, 16 bp, P. troglodytes
tgattagtgatgttgg

SEQ ID NO: 272709 - DNA, 16 bp, P. troglodytes
tgattatcttgcctca

SEQ ID NO: 272710 - DNA, 16 bp, P. troglodytes
tgattatgattatgat

SEQ ID NO: 272711 - DNA, 16 bp, P. troglodytes
tgattattacacattg

SEQ ID NO: 272712 - DNA, 16 bp, P. troglodytes
tgattattagagaaat

SEQ ID NO: 272713 - DNA, 16 bp, P. troglodytes
tgattatttgaaaaga

SEQ ID NO: 272714 - DNA, 16 bp, P. troglodytes
tgattattttaagaaa

SEQ ID NO: 272715 - DNA, 16 bp, P. troglodytes
tgattattttgagaaa

SEQ ID NO: 272716 - DNA, 16 bp, P. troglodytes
tgattcaatcttggga

SEQ ID NO: 272717 - DNA, 16 bp, P. troglodytes
tgattcacagttcagc

SEQ ID NO: 272718 - DNA, 16 bp, P. troglodytes
tgattcacatcccagg

SEQ ID NO: 272719 - DNA, 16 bp, P. troglodytes
tgattcagtttcagaa

SEQ ID NO: 272720 - DNA, 16 bp, P. troglodytes
tgattcagtttcttca

SEQ ID NO: 272721 - DNA, 16 bp, P. troglodytes
tgattcatgggaggag

SEQ ID NO: 272722 - DNA, 16 bp, P. troglodytes
tgattcatgtcccagg

SEQ ID NO: 272723 - DNA, 16 bp, P. troglodytes
tgattccaaagcctgg

SEQ ID NO: 272724 - DNA, 16 bp, P. troglodytes
tgattccattccattc

SEQ ID NO: 272725 - DNA, 16 bp, P. troglodytes
tgattccattttctct

SEQ ID NO: 272726 - DNA, 16 bp, P. troglodytes
tgattctaaaatctat

SEQ ID NO: 272727 - DNA, 16 bp, P. troglodytes
tgattctatttatatt

SEQ ID NO: 272728 - DNA, 16 bp, P. troglodytes
tgattctatttatgtg

SEQ ID NO: 272729 - DNA, 16 bp, P. troglodytes
tgattctatttttaaa

SEQ ID NO: 272730 - DNA, 16 bp, P. troglodytes
tgattctcagtttggt

SEQ ID NO: 272731 - DNA, 17 bp, P. troglodytes
tgattctcccgcctcag

SEQ ID NO: 272732 - DNA, 16 bp, P. troglodytes
tgattctcctgattca

SEQ ID NO: 272733 - DNA, 16 bp, P. troglodytes
tgattctcctgccaca

SEQ ID NO: 272734 - DNA, 16 bp, P. troglodytes
tgattctcctgcctcc

SEQ ID NO: 272735 - DNA, 16 bp, P. troglodytes
tgattctcctgcctga

SEQ ID NO: 272736 - DNA, 16 bp, P. troglodytes
tgattcttctctttct

SEQ ID NO: 272737 - DNA, 16 bp, P. troglodytes
tgattcttctgcttca

SEQ ID NO: 272738 - DNA, 16 bp, P. troglodytes
tgattcttctgtctca

SEQ ID NO: 272739 - DNA, 16 bp, P. troglodytes
tgattctttaaaatta

SEQ ID NO: 272740 - DNA, 16 bp, P. troglodytes
tgattctttcaatcca

SEQ ID NO: 272741 - DNA, 16 bp, P. troglodytes
tgattgagcagtttga

SEQ ID NO: 272742 - DNA, 16 bp, P. troglodytes
tgattgagcccaggag

SEQ ID NO: 272743 - DNA, 16 bp, P. troglodytes
tgattgagtcactgca

SEQ ID NO: 272744 - DNA, 16 bp, P. troglodytes
tgattgatgcagaaga

SEQ ID NO: 272745 - DNA, 16 bp, P. troglodytes
tgattgattgaatcat

SEQ ID NO: 272746 - DNA, 16 bp, P. troglodytes
tgattgattgatttag

SEQ ID NO: 272747 - DNA, 16 bp, P. troglodytes
tgattgcaccactaca

SEQ ID NO: 272748 - DNA, 18 bp, P. troglodytes
tgattgcaccactgcacc

SEQ ID NO: 272749 - DNA, 17 bp, P. troglodytes
tgattgcaccactgcat

SEQ ID NO: 272750 - DNA, 16 bp, P. troglodytes
tgattgcaccactgcc

SEQ ID NO: 272751 - DNA, 16 bp, P. troglodytes
tgattgcactactgca

SEQ ID NO: 272752 - DNA, 16 bp, P. troglodytes
tgattgcactattgca

SEQ ID NO: 272753 - DNA, 17 bp, P. troglodytes
tgattgcctcctttgga

SEQ ID NO: 272754 - DNA, 16 bp, P. troglodytes
tgattgctttaaaaat

SEQ ID NO: 272755 - DNA, 17 bp, P. troglodytes
tgattggagtacctgaa

SEQ ID NO: 272756 - DNA, 16 bp, P. troglodytes
tgattggattaaaaaa

SEQ ID NO: 272757 - DNA, 17 bp, P. troglodytes
tgattggtagagcccag

SEQ ID NO: 272758 - DNA, 16 bp, P. troglodytes
tgattgtaacaaatgt

SEQ ID NO: 272759 - DNA, 16 bp, P. troglodytes
tgattgtacttatttg

SEQ ID NO: 272760 - DNA, 16 bp, P. troglodytes
tgattgtgaggcttct

SEQ ID NO: 272761 - DNA, 16 bp, P. troglodytes
tgattgtgatggtggt

SEQ ID NO: 272762 - DNA, 16 bp, P. troglodytes
tgattgtgccactgca

SEQ ID NO: 272763 - DNA, 19 bp, P. troglodytes
tgattgtgccactgcactt

SEQ ID NO: 272764 - DNA, 16 bp, P. troglodytes
tgattgtgccacttca

SEQ ID NO: 272765 - DNA, 16 bp, P. troglodytes
tgattgttagagaaat

SEQ ID NO: 272766 - DNA, 16 bp, P. troglodytes
tgatttaaaaaatcaa

SEQ ID NO: 272767 - DNA, 16 bp, P. troglodytes
tgatttaaaaactttt

SEQ ID NO: 272768 - DNA, 16 bp, P. troglodytes
tgatttaaaacatttt

SEQ ID NO: 272769 - DNA, 16 bp, P. troglodytes
tgatttaaaaggaaaa

SEQ ID NO: 272770 - DNA, 16 bp, P. troglodytes
tgatttaaaatatctt

SEQ ID NO: 272771 - DNA, 16 bp, P. troglodytes
tgatttaaagaaaact

SEQ ID NO: 272772 - DNA, 16 bp, P. troglodytes
tgatttaaagtatact

SEQ ID NO: 272773 - DNA, 16 bp, P. troglodytes
tgatttacaaatattt

SEQ ID NO: 272774 - DNA, 16 bp, P. troglodytes
tgatttaggagtcatg

SEQ ID NO: 272775 - DNA, 16 bp, P. troglodytes
tgatttaggtaaaaac

SEQ ID NO: 272776 - DNA, 16 bp, P. troglodytes
tgatttatattcattt

SEQ ID NO: 272777 - DNA, 16 bp, P. troglodytes
tgatttatgtctttgc

SEQ ID NO: 272778 - DNA, 16 bp, P. troglodytes
tgatttattctttaac

SEQ ID NO: 272779 - DNA, 16 bp, P. troglodytes
tgatttcaaaaataaa

SEQ ID NO: 272780 - DNA, 16 bp, P. troglodytes
tgatttcaaactatgc

SEQ ID NO: 272781 - DNA, 16 bp, P. troglodytes
tgatttcaattatttt

SEQ ID NO: 272782 - DNA, 16 bp, P. troglodytes
tgatttcacaggctca

SEQ ID NO: 272783 - DNA, 16 bp, P. troglodytes
tgatttcaccattctt

SEQ ID NO: 272784 - DNA, 16 bp, P. troglodytes
tgatttcactggtgaa

SEQ ID NO: 272785 - DNA, 16 bp, P. troglodytes
tgatttcagatttcta

SEQ ID NO: 272786 - DNA, 16 bp, P. troglodytes
tgatttcagctcattg

SEQ ID NO: 272787 - DNA, 16 bp, P. troglodytes
tgatttcatatcctga

SEQ ID NO: 272788 - DNA, 16 bp, P. troglodytes
tgatttcatatgaaat

SEQ ID NO: 272789 - DNA, 16 bp, P. troglodytes
tgatttcatcattgtg

SEQ ID NO: 272790 - DNA, 16 bp, P. troglodytes
tgatttcattgatttt

SEQ ID NO: 272791 - DNA, 16 bp, P. troglodytes
tgatttcattttttaa

SEQ ID NO: 272792 - DNA, 16 bp, P. troglodytes
tgatttccatatgttg

SEQ ID NO: 272793 - DNA, 16 bp, P. troglodytes
tgatttcccttctttt

SEQ ID NO: 272794 - DNA, 16 bp, P. troglodytes
tgatttctaatttaat

SEQ ID NO: 272795 - DNA, 16 bp, P. troglodytes
tgatttctactttaat

SEQ ID NO: 272796 - DNA, 16 bp, P. troglodytes
tgatttctacttttat

SEQ ID NO: 272797 - DNA, 16 bp, P. troglodytes
tgatttctattccttt

SEQ ID NO: 272798 - DNA, 16 bp, P. troglodytes
tgatttctgagatttt

SEQ ID NO: 272799 - DNA, 17 bp, P. troglodytes
tgatttctgcatttcca

SEQ ID NO: 272800 - DNA, 16 bp, P. troglodytes
tgatttctgctctttt

SEQ ID NO: 272801 - DNA, 16 bp, P. troglodytes
tgatttctgtatgttg

SEQ ID NO: 272802 - DNA, 16 bp, P. troglodytes
tgatttctgttctttc

SEQ ID NO: 272803 - DNA, 16 bp, P. troglodytes
tgatttcttccttcct

SEQ ID NO: 272804 - DNA, 16 bp, P. troglodytes
tgatttcttcctttcc

SEQ ID NO: 272805 - DNA, 16 bp, P. troglodytes
tgatttcttcttgctc

SEQ ID NO: 272806 - DNA, 16 bp, P. troglodytes
tgatttcttctttgac

SEQ ID NO: 272807 - DNA, 16 bp, P. troglodytes
tgatttcttgaatatg

SEQ ID NO: 272808 - DNA, 16 bp, P. troglodytes
tgatttcttgatttga

SEQ ID NO: 272809 - DNA, 16 bp, P. troglodytes
tgatttctttaatcag

SEQ ID NO: 272810 - DNA, 16 bp, P. troglodytes
tgatttctttcattag

SEQ ID NO: 272811 - DNA, 16 bp, P. troglodytes
tgatttctttggggca

SEQ ID NO: 272812 - DNA, 16 bp, P. troglodytes
tgatttctttgtatta

SEQ ID NO: 272813 - DNA, 16 bp, P. troglodytes
tgatttgaatgagaaa

SEQ ID NO: 272814 - DNA, 16 bp, P. troglodytes
tgatttgatctttaca

SEQ ID NO: 272815 - DNA, 16 bp, P. troglodytes
tgatttgcaaacattt

SEQ ID NO: 272816 - DNA, 16 bp, P. troglodytes
tgatttgcattttaaa

SEQ ID NO: 272817 - DNA, 16 bp, P. troglodytes
tgatttgcatttttta

SEQ ID NO: 272818 - DNA, 16 bp, P. troglodytes
tgatttgctttattgt

SEQ ID NO: 272819 - DNA, 16 bp, P. troglodytes
tgatttgcttttctct

SEQ ID NO: 272820 - DNA, 16 bp, P. troglodytes
tgatttggatctgtgt

SEQ ID NO: 272821 - DNA, 17 bp, P. troglodytes
tgatttgggggctgctt

SEQ ID NO: 272822 - DNA, 21 bp, P. troglodytes
tgatttggggtggagagttcc

SEQ ID NO: 272823 - DNA, 16 bp, P. troglodytes
tgatttgtaagatttt

SEQ ID NO: 272824 - DNA, 16 bp, P. troglodytes
tgatttgtttgaattc

SEQ ID NO: 272825 - DNA, 16 bp, P. troglodytes
tgattttaaaatgttg

SEQ ID NO: 272826 - DNA, 16 bp, P. troglodytes
tgattttaaattttct

SEQ ID NO: 272827 - DNA, 16 bp, P. troglodytes
tgattttaatctgtat

SEQ ID NO: 272828 - DNA, 16 bp, P. troglodytes
tgattttaatttgctt

SEQ ID NO: 272829 - DNA, 16 bp, P. troglodytes
tgattttacattttat

SEQ ID NO: 272830 - DNA, 16 bp, P. troglodytes
tgattttagaagaaaa

SEQ ID NO: 272831 - DNA, 16 bp, P. troglodytes
tgattttagatctttc

SEQ ID NO: 272832 - DNA, 16 bp, P. troglodytes
tgattttagtccagtg

SEQ ID NO: 272833 - DNA, 16 bp, P. troglodytes
tgattttagttgtttc

SEQ ID NO: 272834 - DNA, 16 bp, P. troglodytes
tgattttatacttaga

SEQ ID NO: 272835 - DNA, 16 bp, P. troglodytes
tgattttatttgaaaa

SEQ ID NO: 272836 - DNA, 16 bp, P. troglodytes
tgattttattttcaaa

SEQ ID NO: 272837 - DNA, 16 bp, P. troglodytes
tgattttcaaagggaa

SEQ ID NO: 272838 - DNA, 16 bp, P. troglodytes
tgattttctgtctagt

SEQ ID NO: 272839 - DNA, 16 bp, P. troglodytes
tgattttgcaattgtg

SEQ ID NO: 272840 - DNA, 16 bp, P. troglodytes
tgattttggacttgca

SEQ ID NO: 272841 - DNA, 16 bp, P. troglodytes
tgattttggctgtggg

SEQ ID NO: 272842 - DNA, 31 bp, P. troglodytes
tgattttgtatcctgagactttgctgaagtt

SEQ ID NO: 272843 - DNA, 16 bp, P. troglodytes
tgattttgttgaagat

SEQ ID NO: 272844 - DNA, 16 bp, P. troglodytes
tgatttttaaaaaatc

SEQ ID NO: 272845 - DNA, 16 bp, P. troglodytes
tgatttttaaaagtta

SEQ ID NO: 272846 - DNA, 16 bp, P. troglodytes
tgatttttaaaatctt

SEQ ID NO: 272847 - DNA, 16 bp, P. troglodytes
tgatttttaaactttt

SEQ ID NO: 272848 - DNA, 16 bp, P. troglodytes
tgatttttacatattt

SEQ ID NO: 272849 - DNA, 16 bp, P. troglodytes
tgatttttataccaaa

SEQ ID NO: 272850 - DNA, 16 bp, P. troglodytes
tgatttttatccttca

SEQ ID NO: 272851 - DNA, 16 bp, P. troglodytes
tgatttttattttcaa

SEQ ID NO: 272852 - DNA, 16 bp, P. troglodytes
tgatttttcaaaaaat

SEQ ID NO: 272853 - DNA, 16 bp, P. troglodytes
tgatttttcaaaataa

SEQ ID NO: 272854 - DNA, 16 bp, P. troglodytes
tgatttttctcaattt

SEQ ID NO: 272855 - DNA, 16 bp, P. troglodytes
tgatttttctctttca

SEQ ID NO: 272856 - DNA, 16 bp, P. troglodytes
tgatttttcttcttca

SEQ ID NO: 272857 - DNA, 16 bp, P. troglodytes
tgatttttctttaaaa

SEQ ID NO: 272858 - DNA, 16 bp, P. troglodytes
tgatttttcttttgaa

SEQ ID NO: 272859 - DNA, 16 bp, P. troglodytes
tgatttttgaaaaaat

SEQ ID NO: 272860 - DNA, 16 bp, P. troglodytes
tgatttttgacaatgg

SEQ ID NO: 272861 - DNA, 16 bp, P. troglodytes
tgatttttgtacatgg

SEQ ID NO: 272862 - DNA, 16 bp, P. troglodytes
tgatttttgtcattgg

SEQ ID NO: 272863 - DNA, 16 bp, P. troglodytes
tgatttttgtgtaagg

SEQ ID NO: 272864 - DNA, 16 bp, P. troglodytes
tgattttttaaaaagc

SEQ ID NO: 272865 - DNA, 16 bp, P. troglodytes
tgattttttaaataca

SEQ ID NO: 272866 - DNA, 16 bp, P. troglodytes
tgattttttccccctt

SEQ ID NO: 272867 - DNA, 16 bp, P. troglodytes
tgattttttgtacatt

SEQ ID NO: 272868 - DNA, 16 bp, P. troglodytes
tgatttttttaaaact

SEQ ID NO: 272869 - DNA, 16 bp, P. troglodytes
tgatttttttccttcc

SEQ ID NO: 272870 - DNA, 16 bp, P. troglodytes
tgatttttttccttga

SEQ ID NO: 272871 - DNA, 16 bp, P. troglodytes
tgatttttttgaaggg

SEQ ID NO: 272872 - DNA, 16 bp, P. troglodytes
tgattttttttcactc

SEQ ID NO: 272873 - DNA, 16 bp, P. troglodytes
tgattttttttcccct

SEQ ID NO: 272874 - DNA, 16 bp, P. troglodytes
tgcaaaaaataataat

SEQ ID NO: 272875 - DNA, 16 bp, P. troglodytes
tgcaaaaactgtggga

SEQ ID NO: 272876 - DNA, 16 bp, P. troglodytes
tgcaaaaatatggaac

SEQ ID NO: 272877 - DNA, 16 bp, P. troglodytes
tgcaaaaatcaaaagc

SEQ ID NO: 272878 - DNA, 16 bp, P. troglodytes
tgcaaaaatcatcaat

SEQ ID NO: 272879 - DNA, 16 bp, P. troglodytes
tgcaaaaatggttcaa

SEQ ID NO: 272880 - DNA, 16 bp, P. troglodytes
tgcaaaaattttcccc

SEQ ID NO: 272881 - DNA, 16 bp, P. troglodytes
tgcaaaacaactgaaa

SEQ ID NO: 272882 - DNA, 16 bp, P. troglodytes
tgcaaaacagcaaaga

SEQ ID NO: 272883 - DNA, 16 bp, P. troglodytes
tgcaaaagaaatagca

SEQ ID NO: 272884 - DNA, 16 bp, P. troglodytes
tgcaaaagaagtgaaa

SEQ ID NO: 272885 - DNA, 16 bp, P. troglodytes
tgcaaaataatgattt

SEQ ID NO: 272886 - DNA, 16 bp, P. troglodytes
tgcaaaatgctctgga

SEQ ID NO: 272887 - DNA, 16 bp, P. troglodytes
tgcaaaatgggaacaa

SEQ ID NO: 272888 - DNA, 16 bp, P. troglodytes
tgcaaaatggggataa

SEQ ID NO: 272889 - DNA, 16 bp, P. troglodytes
tgcaaacagtgctgca

SEQ ID NO: 272890 - DNA, 17 bp, P. troglodytes
tgcaaaccccaagcctt

SEQ ID NO: 272891 - DNA, 16 bp, P. troglodytes
tgcaaactatgcttct

SEQ ID NO: 272892 - DNA, 16 bp, P. troglodytes
tgcaaactctgcctcc

SEQ ID NO: 272893 - DNA, 16 bp, P. troglodytes
tgcaaactgttggtgg

SEQ ID NO: 272894 - DNA, 16 bp, P. troglodytes
tgcaaagaaaaatgaa

SEQ ID NO: 272895 - DNA, 16 bp, P. troglodytes
tgcaaagaaaagggaa

SEQ ID NO: 272896 - DNA, 16 bp, P. troglodytes
tgcaaagaaataggaa

SEQ ID NO: 272897 - DNA, 16 bp, P. troglodytes
tgcaaagaccctgagg

SEQ ID NO: 272898 - DNA, 16 bp, P. troglodytes
tgcaaagacctttgtt

SEQ ID NO: 272899 - DNA, 16 bp, P. troglodytes
tgcaaagatatggaat

SEQ ID NO: 272900 - DNA, 16 bp, P. troglodytes
tgcaaagatggtttca

SEQ ID NO: 272901 - DNA, 16 bp, P. troglodytes
tgcaaagccacaggga

SEQ ID NO: 272902 - DNA, 16 bp, P. troglodytes
tgcaaagcctgaaata

SEQ ID NO: 272903 - DNA, 16 bp, P. troglodytes
tgcaaagctgtccttt

SEQ ID NO: 272904 - DNA, 16 bp, P. troglodytes
tgcaaagcttaaaata

SEQ ID NO: 272905 - DNA, 16 bp, P. troglodytes
tgcaaaggaaaataat

SEQ ID NO: 272906 - DNA, 16 bp, P. troglodytes
tgcaaaggagacgaga

SEQ ID NO: 272907 - DNA, 16 bp, P. troglodytes
tgcaaaggccctgagg

SEQ ID NO: 272908 - DNA, 16 bp, P. troglodytes
tgcaaaggccctgggg

SEQ ID NO: 272909 - DNA, 16 bp, P. troglodytes
tgcaaaggccctgtgg

SEQ ID NO: 272910 - DNA, 16 bp, P. troglodytes
tgcaaagtctcttgtg

SEQ ID NO: 272911 - DNA, 16 bp, P. troglodytes
tgcaaagtgactctga

SEQ ID NO: 272912 - DNA, 16 bp, P. troglodytes
tgcaaataacagaaaa

SEQ ID NO: 272913 - DNA, 16 bp, P. troglodytes
tgcaaatactatgcta

SEQ ID NO: 272914 - DNA, 16 bp, P. troglodytes
tgcaaatatatgtata

SEQ ID NO: 272915 - DNA, 16 bp, P. troglodytes
tgcaaatatcttcttt

SEQ ID NO: 272916 - DNA, 16 bp, P. troglodytes
tgcaaatatgtatata

SEQ ID NO: 272917 - DNA, 16 bp, P. troglodytes
tgcaaatattttcacc

SEQ ID NO: 272918 - DNA, 16 bp, P. troglodytes
tgcaaatatttttcct

SEQ ID NO: 272919 - DNA, 16 bp, P. troglodytes
tgcaaatgaaaaccaa

SEQ ID NO: 272920 - DNA, 16 bp, P. troglodytes
tgcaaatgaaaaccac

SEQ ID NO: 272921 - DNA, 16 bp, P. troglodytes
tgcaaatgacagaatt

SEQ ID NO: 272922 - DNA, 16 bp, P. troglodytes
tgcaaatggcctaaat

SEQ ID NO: 272923 - DNA, 16 bp, P. troglodytes
tgcaaattaaaactaa

SEQ ID NO: 272924 - DNA, 16 bp, P. troglodytes
tgcaaattaaaatgag

SEQ ID NO: 272925 - DNA, 16 bp, P. troglodytes
tgcaaattcttttttt

SEQ ID NO: 272926 - DNA, 16 bp, P. troglodytes
tgcaaattgattttgt

SEQ ID NO: 272927 - DNA, 16 bp, P. troglodytes
tgcaaattttttccta

SEQ ID NO: 272928 - DNA, 16 bp, P. troglodytes
tgcaacaaacacaaaa

SEQ ID NO: 272929 - DNA, 16 bp, P. troglodytes
tgcaacaaaccaacat

SEQ ID NO: 272930 - DNA, 16 bp, P. troglodytes
tgcaacaacatgtatg

SEQ ID NO: 272931 - DNA, 16 bp, P. troglodytes
tgcaacagacctgcag

SEQ ID NO: 272932 - DNA, 16 bp, P. troglodytes
tgcaacatcactgcaa

SEQ ID NO: 272933 - DNA, 16 bp, P. troglodytes
tgcaaccaaaacaaaa

SEQ ID NO: 272934 - DNA, 16 bp, P. troglodytes
tgcaaccaaacaccac

SEQ ID NO: 272935 - DNA, 16 bp, P. troglodytes
tgcaaccatcacctcc

SEQ ID NO: 272936 - DNA, 16 bp, P. troglodytes
tgcaacccctgcttta

SEQ ID NO: 272937 - DNA, 16 bp, P. troglodytes
tgcaaccctctgcctc

SEQ ID NO: 272938 - DNA, 16 bp, P. troglodytes
tgcaacccttgctgac

SEQ ID NO: 272939 - DNA, 16 bp, P. troglodytes
tgcaacctagatccct

SEQ ID NO: 272940 - DNA, 16 bp, P. troglodytes
tgcaacctccgctgcc

SEQ ID NO: 272941 - DNA, 16 bp, P. troglodytes
tgcaacctcctcctgc

SEQ ID NO: 272942 - DNA, 16 bp, P. troglodytes
tgcaacctgggtgaca

SEQ ID NO: 272943 - DNA, 16 bp, P. troglodytes
tgcaaccttccaagtg

SEQ ID NO: 272944 - DNA, 16 bp, P. troglodytes
tgcaaccttgaactcc

SEQ ID NO: 272945 - DNA, 16 bp, P. troglodytes
tgcaactcctgcctcc

SEQ ID NO: 272946 - DNA, 16 bp, P. troglodytes
tgcaactgatttttat

SEQ ID NO: 272947 - DNA, 16 bp, P. troglodytes
tgcaactgtagtccca

SEQ ID NO: 272948 - DNA, 16 bp, P. troglodytes
tgcaacttccacttcc

SEQ ID NO: 272949 - DNA, 16 bp, P. troglodytes
tgcaacttctctgtaa

SEQ ID NO: 272950 - DNA, 16 bp, P. troglodytes
tgcaacttttaaaaaa

SEQ ID NO: 272951 - DNA, 16 bp, P. troglodytes
tgcaacttttctataa

SEQ ID NO: 272952 - DNA, 16 bp, P. troglodytes
tgcaagaaactgcctt

SEQ ID NO: 272953 - DNA, 16 bp, P. troglodytes
tgcaagaaagaatttg

SEQ ID NO: 272954 - DNA, 16 bp, P. troglodytes
tgcaagaactcctgaa

SEQ ID NO: 272955 - DNA, 16 bp, P. troglodytes
tgcaagaagaaaaata

SEQ ID NO: 272956 - DNA, 16 bp, P. troglodytes
tgcaagaaggaattca

SEQ ID NO: 272957 - DNA, 16 bp, P. troglodytes
tgcaagaatgacctaa

SEQ ID NO: 272958 - DNA, 16 bp, P. troglodytes
tgcaagagaaaggaga

SEQ ID NO: 272959 - DNA, 16 bp, P. troglodytes
tgcaagatgaaaaaat

SEQ ID NO: 272960 - DNA, 16 bp, P. troglodytes
tgcaagccaggaagaa

SEQ ID NO: 272961 - DNA, 16 bp, P. troglodytes
tgcaagccccaagact

SEQ ID NO: 272962 - DNA, 16 bp, P. troglodytes
tgcaaggcagcagtga

SEQ ID NO: 272963 - DNA, 16 bp, P. troglodytes
tgcaaggctgcttcaa

SEQ ID NO: 272964 - DNA, 16 bp, P. troglodytes
tgcaaggttggttcag

SEQ ID NO: 272965 - DNA, 16 bp, P. troglodytes
tgcaaggttgtggttt

SEQ ID NO: 272966 - DNA, 16 bp, P. troglodytes
tgcaagtctgaaacct

SEQ ID NO: 272967 - DNA, 16 bp, P. troglodytes
tgcaagtgagctatga

SEQ ID NO: 272968 - DNA, 16 bp, P. troglodytes
tgcaagtgatggggag

SEQ ID NO: 272969 - DNA, 16 bp, P. troglodytes
tgcaataaaaaaagat

SEQ ID NO: 272970 - DNA, 16 bp, P. troglodytes
tgcaataaaaaatgat

SEQ ID NO: 272971 - DNA, 16 bp, P. troglodytes
tgcaataaaaatgata

SEQ ID NO: 272972 - DNA, 16 bp, P. troglodytes
tgcaataaaacaagaa

SEQ ID NO: 272973 - DNA, 16 bp, P. troglodytes
tgcaataaacatatgt

SEQ ID NO: 272974 - DNA, 16 bp, P. troglodytes
tgcaataaatatttgt

SEQ ID NO: 272975 - DNA, 16 bp, P. troglodytes
tgcaataaatgtggga

SEQ ID NO: 272976 - DNA, 16 bp, P. troglodytes
tgcaatagagaaatag

SEQ ID NO: 272977 - DNA, 16 bp, P. troglodytes
tgcaatatttgcttta

SEQ ID NO: 272978 - DNA, 16 bp, P. troglodytes
tgcaatatttgggaca

SEQ ID NO: 272979 - DNA, 16 bp, P. troglodytes
tgcaatattttaaaaa

SEQ ID NO: 272980 - DNA, 16 bp, P. troglodytes
tgcaatatttttaaat

SEQ ID NO: 272981 - DNA, 16 bp, P. troglodytes
tgcaatccagcctggg

SEQ ID NO: 272982 - DNA, 16 bp, P. troglodytes
tgcaatcccagctact

SEQ ID NO: 272983 - DNA, 16 bp, P. troglodytes
tgcaatgaaaatattt

SEQ ID NO: 272984 - DNA, 16 bp, P. troglodytes
tgcaatgaacatttgc

SEQ ID NO: 272985 - DNA, 17 bp, P. troglodytes
tgcaatgaacatttgca

SEQ ID NO: 272986 - DNA, 16 bp, P. troglodytes
tgcaatgaatgtggga

SEQ ID NO: 272987 - DNA, 18 bp, P. troglodytes
tgcaatgagccaagatca

SEQ ID NO: 272988 - DNA, 17 bp, P. troglodytes
tgcaatgagccaagatt

SEQ ID NO: 272989 - DNA, 16 bp, P. troglodytes
tgcaatgagctatgat

SEQ ID NO: 272990 - DNA, 16 bp, P. troglodytes
tgcaatgagctgagat

SEQ ID NO: 272991 - DNA, 16 bp, P. troglodytes
tgcaatgagctgtgat

SEQ ID NO: 272992 - DNA, 16 bp, P. troglodytes
tgcaatggccccatct

SEQ ID NO: 272993 - DNA, 16 bp, P. troglodytes
tgcaatggcgcaatct

SEQ ID NO: 272994 - DNA, 16 bp, P. troglodytes
tgcaatggtggtttgc

SEQ ID NO: 272995 - DNA, 16 bp, P. troglodytes
tgcaatggtgtgacct

SEQ ID NO: 272996 - DNA, 16 bp, P. troglodytes
tgcaatgtgctatgat

SEQ ID NO: 272997 - DNA, 16 bp, P. troglodytes
tgcaattatttaaaaa

SEQ ID NO: 272998 - DNA, 16 bp, P. troglodytes
tgcaattcctatcaaa

SEQ ID NO: 272999 - DNA, 16 bp, P. troglodytes
tgcacaaagatgttca

SEQ ID NO: 273000 - DNA, 16 bp, P. troglodytes
tgcacaaagccctctt

SEQ ID NO: 273001 - DNA, 16 bp, P. troglodytes
tgcacaacaaaagaaa

SEQ ID NO: 273002 - DNA, 16 bp, P. troglodytes
tgcacaacatgcagat

SEQ ID NO: 273003 - DNA, 16 bp, P. troglodytes
tgcacaagcacacaca

SEQ ID NO: 273004 - DNA, 16 bp, P. troglodytes
tgcacaatattatgaa

SEQ ID NO: 273005 - DNA, 16 bp, P. troglodytes
tgcacacacacaaaaa

SEQ ID NO: 273006 - DNA, 17 bp, P. troglodytes
tgcacacacacacacag

SEQ ID NO: 273007 - DNA, 16 bp, P. troglodytes
tgcacacacacatcca

SEQ ID NO: 273008 - DNA, 16 bp, P. troglodytes
tgcacacacactcaca

SEQ ID NO: 273009 - DNA, 16 bp, P. troglodytes
tgcacacacaggcatg

SEQ ID NO: 273010 - DNA, 16 bp, P. troglodytes
tgcacacacatgcata

SEQ ID NO: 273011 - DNA, 16 bp, P. troglodytes
tgcacacacattcaca

SEQ ID NO: 273012 - DNA, 16 bp, P. troglodytes
tgcacacacgcacacg

SEQ ID NO: 273013 - DNA, 16 bp, P. troglodytes
tgcacacactcacaca

SEQ ID NO: 273014 - DNA, 16 bp, P. troglodytes
tgcacacactggctcc

SEQ ID NO: 273015 - DNA, 16 bp, P. troglodytes
tgcacacagcatggag

SEQ ID NO: 273016 - DNA, 16 bp, P. troglodytes
tgcacacagcatgggg

SEQ ID NO: 273017 - DNA, 16 bp, P. troglodytes
tgcacacaggcatgca

SEQ ID NO: 273018 - DNA, 16 bp, P. troglodytes
tgcacacatacacaca

SEQ ID NO: 273019 - DNA, 16 bp, P. troglodytes
tgcacacatacataca

SEQ ID NO: 273020 - DNA, 16 bp, P. troglodytes
tgcacacatgcgcaca

SEQ ID NO: 273021 - DNA, 16 bp, P. troglodytes
tgcacacatgtaccct

SEQ ID NO: 273022 - DNA, 16 bp, P. troglodytes
tgcacaccaccatgct

SEQ ID NO: 273023 - DNA, 16 bp, P. troglodytes
tgcacaccactgtgcc

SEQ ID NO: 273024 - DNA, 16 bp, P. troglodytes
tgcacacctatggtcc

SEQ ID NO: 273025 - DNA, 16 bp, P. troglodytes
tgcacacctggctggg

SEQ ID NO: 273026 - DNA, 16 bp, P. troglodytes
tgcacacgcacacaca

SEQ ID NO: 273027 - DNA, 16 bp, P. troglodytes
tgcacacgcatgttta

SEQ ID NO: 273028 - DNA, 16 bp, P. troglodytes
tgcacactcacacatg

SEQ ID NO: 273029 - DNA, 16 bp, P. troglodytes
tgcacagaaaaataaa

SEQ ID NO: 273030 - DNA, 16 bp, P. troglodytes
tgcacagaaactagaa

SEQ ID NO: 273031 - DNA, 17 bp, P. troglodytes
tgcacagaagtcaagaa

SEQ ID NO: 273032 - DNA, 16 bp, P. troglodytes
tgcacagcaatatgaa

SEQ ID NO: 273033 - DNA, 16 bp, P. troglodytes
tgcacagccaaggaaa

SEQ ID NO: 273034 - DNA, 16 bp, P. troglodytes
tgcacagcctccccca

SEQ ID NO: 273035 - DNA, 16 bp, P. troglodytes
tgcacaggacagcccc

SEQ ID NO: 273036 - DNA, 16 bp, P. troglodytes
tgcacagtggcctgct

SEQ ID NO: 273037 - DNA, 16 bp, P. troglodytes
tgcacagtggtctgag

SEQ ID NO: 273038 - DNA, 16 bp, P. troglodytes
tgcacataaactaaaa

SEQ ID NO: 273039 - DNA, 16 bp, P. troglodytes
tgcacatatacacata

SEQ ID NO: 273040 - DNA, 16 bp, P. troglodytes
tgcacatatgtacaca

SEQ ID NO: 273041 - DNA, 16 bp, P. troglodytes
tgcacatccttcacat

SEQ ID NO: 273042 - DNA, 16 bp, P. troglodytes
tgcacatctgtagtcc

SEQ ID NO: 273043 - DNA, 16 bp, P. troglodytes
tgcacatgagatgggt

SEQ ID NO: 273044 - DNA, 16 bp, P. troglodytes
tgcacatgagattggt

SEQ ID NO: 273045 - DNA, 16 bp, P. troglodytes
tgcacatgtacacctg

SEQ ID NO: 273046 - DNA, 18 bp, P. troglodytes
tgcacatgtaccccagaa

SEQ ID NO: 273047 - DNA, 16 bp, P. troglodytes
tgcacatgtgcacaca

SEQ ID NO: 273048 - DNA, 16 bp, P. troglodytes
tgcacatgtgcacata

SEQ ID NO: 273049 - DNA, 16 bp, P. troglodytes
tgcacatgtgtgtgtt

SEQ ID NO: 273050 - DNA, 16 bp, P. troglodytes
tgcacatgtgtgttca

SEQ ID NO: 273051 - DNA, 16 bp, P. troglodytes
tgcacattcccagctg

SEQ ID NO: 273052 - DNA, 25 bp, P. troglodytes
tgcacattgattttgtatcctgaga

SEQ ID NO: 273053 - DNA, 16 bp, P. troglodytes
tgcaccaaaataaact

SEQ ID NO: 273054 - DNA, 16 bp, P. troglodytes
tgcaccaacacacctg

SEQ ID NO: 273055 - DNA, 16 bp, P. troglodytes
tgcaccaatccccaac

SEQ ID NO: 273056 - DNA, 16 bp, P. troglodytes
tgcaccaccacaccag

SEQ ID NO: 273057 - DNA, 16 bp, P. troglodytes
tgcaccaccacacctg

SEQ ID NO: 273058 - DNA, 16 bp, P. troglodytes
tgcaccaccactccca

SEQ ID NO: 273059 - DNA, 16 bp, P. troglodytes
tgcaccaccatgactg

SEQ ID NO: 273060 - DNA, 16 bp, P. troglodytes
tgcaccactatgccag

SEQ ID NO: 273061 - DNA, 16 bp, P. troglodytes
tgcaccatgttggtgt

SEQ ID NO: 273062 - DNA, 16 bp, P. troglodytes
tgcaccattgcactct

SEQ ID NO: 273063 - DNA, 16 bp, P. troglodytes
tgcacccaagcctggg

SEQ ID NO: 273064 - DNA, 16 bp, P. troglodytes
tgcacccacagccgcc

SEQ ID NO: 273065 - DNA, 18 bp, P. troglodytes
tgcacccactgtccgaca

SEQ ID NO: 273066 - DNA, 16 bp, P. troglodytes
tgcacccagcccagat

SEQ ID NO: 273067 - DNA, 16 bp, P. troglodytes
tgcacccagccccagc

SEQ ID NO: 273068 - DNA, 16 bp, P. troglodytes
tgcaccccaacctggg

SEQ ID NO: 273069 - DNA, 16 bp, P. troglodytes
tgcaccccagcctagg

SEQ ID NO: 273070 - DNA, 16 bp, P. troglodytes
tgcaccccagcctgga

SEQ ID NO: 273071 - DNA, 16 bp, P. troglodytes
tgcaccccagcctggg

SEQ ID NO: 273072 - DNA, 16 bp, P. troglodytes
tgcaccccagccttgg

SEQ ID NO: 273073 - DNA, 16 bp, P. troglodytes
tgcacccccacaccca

SEQ ID NO: 273074 - DNA, 16 bp, P. troglodytes
tgcacccccagcctgg

SEQ ID NO: 273075 - DNA, 16 bp, P. troglodytes
tgcaccctgtgcctgg

SEQ ID NO: 273076 - DNA, 16 bp, P. troglodytes
tgcacctcagcctccc

SEQ ID NO: 273077 - DNA, 16 bp, P. troglodytes
tgcacctcagtttcct

SEQ ID NO: 273078 - DNA, 16 bp, P. troglodytes
tgcacctgaaaaagct

SEQ ID NO: 273079 - DNA, 16 bp, P. troglodytes
tgcacctggccaaaat

SEQ ID NO: 273080 - DNA, 16 bp, P. troglodytes
tgcacctggccaagag

SEQ ID NO: 273081 - DNA, 16 bp, P. troglodytes
tgcacctggccaggaa

SEQ ID NO: 273082 - DNA, 16 bp, P. troglodytes
tgcacctggcctccat

SEQ ID NO: 273083 - DNA, 16 bp, P. troglodytes
tgcacctggcctgttc

SEQ ID NO: 273084 - DNA, 16 bp, P. troglodytes
tgcacctgtggtccca

SEQ ID NO: 273085 - DNA, 16 bp, P. troglodytes
tgcaccttcttagggg

SEQ ID NO: 273086 - DNA, 16 bp, P. troglodytes
tgcacgagctgaagca

SEQ ID NO: 273087 - DNA, 17 bp, P. troglodytes
tgcacgcacacacacac

SEQ ID NO: 273088 - DNA, 16 bp, P. troglodytes
tgcacgcacgcacgca

SEQ ID NO: 273089 - DNA, 16 bp, P. troglodytes
tgcacgcacgtgtgtg

SEQ ID NO: 273090 - DNA, 16 bp, P. troglodytes
tgcacgccaccacgcc

SEQ ID NO: 273091 - DNA, 16 bp, P. troglodytes
tgcacggtctccctct

SEQ ID NO: 273092 - DNA, 16 bp, P. troglodytes
tgcacggtggctcacg

SEQ ID NO: 273093 - DNA, 16 bp, P. troglodytes
tgcactaatttacatt

SEQ ID NO: 273094 - DNA, 16 bp, P. troglodytes
tgcactacagcctggg

SEQ ID NO: 273095 - DNA, 16 bp, P. troglodytes
tgcactacagtctggg

SEQ ID NO: 273096 - DNA, 16 bp, P. troglodytes
tgcactatgatcacac

SEQ ID NO: 273097 - DNA, 16 bp, P. troglodytes
tgcactatgattgtgc

SEQ ID NO: 273098 - DNA, 16 bp, P. troglodytes
tgcactcaaacctggg

SEQ ID NO: 273099 - DNA, 16 bp, P. troglodytes
tgcactcaagcctggg

SEQ ID NO: 273100 - DNA, 16 bp, P. troglodytes
tgcactcatcacaaag

SEQ ID NO: 273101 - DNA, 16 bp, P. troglodytes
tgcactccaacctgga

SEQ ID NO: 273102 - DNA, 16 bp, P. troglodytes
tgcactccaacctggg

SEQ ID NO: 273103 - DNA, 16 bp, P. troglodytes
tgcactccaatctggg

SEQ ID NO: 273104 - DNA, 16 bp, P. troglodytes
tgcactccaccctggg

SEQ ID NO: 273105 - DNA, 16 bp, P. troglodytes
tgcactccagacaggg

SEQ ID NO: 273106 - DNA, 16 bp, P. troglodytes
tgcactccagactggg

SEQ ID NO: 273107 - DNA, 16 bp, P. troglodytes
tgcactccagagcctg

SEQ ID NO: 273108 - DNA, 16 bp, P. troglodytes
tgcactccagcatgga

SEQ ID NO: 273109 - DNA, 16 bp, P. troglodytes
tgcactccagcccagg

SEQ ID NO: 273110 - DNA, 16 bp, P. troglodytes
tgcactccagcctaag

SEQ ID NO: 273111 - DNA, 16 bp, P. troglodytes
tgcactccagcctagg

SEQ ID NO: 273112 - DNA, 16 bp, P. troglodytes
tgcactccagcctgaa

SEQ ID NO: 273113 - DNA, 16 bp, P. troglodytes
tgcactccagcctgac

SEQ ID NO: 273114 - DNA, 16 bp, P. troglodytes
tgcactccagcctgag

SEQ ID NO: 273115 - DNA, 16 bp, P. troglodytes
tgcactccagcctgga

SEQ ID NO: 273116 - DNA, 16 bp, P. troglodytes
tgcactccagcctggc

SEQ ID NO: 273117 - DNA, 17 bp, P. troglodytes
tgcactccagcctggca

SEQ ID NO: 273118 - DNA, 16 bp, P. troglodytes
tgcactccagcctggg

SEQ ID NO: 273119 - DNA, 16 bp, P. troglodytes
tgcactccagcctggt

SEQ ID NO: 273120 - DNA, 16 bp, P. troglodytes
tgcactccagcctgtg

SEQ ID NO: 273121 - DNA, 16 bp, P. troglodytes
tgcactccagccttga

SEQ ID NO: 273122 - DNA, 16 bp, P. troglodytes
tgcactccagccttgg

SEQ ID NO: 273123 - DNA, 16 bp, P. troglodytes
tgcactccagcgtggg

SEQ ID NO: 273124 - DNA, 16 bp, P. troglodytes
tgcactccagctaggg

SEQ ID NO: 273125 - DNA, 16 bp, P. troglodytes
tgcactccagcttcgg

SEQ ID NO: 273126 - DNA, 16 bp, P. troglodytes
tgcactccagcttgga

SEQ ID NO: 273127 - DNA, 16 bp, P. troglodytes
tgcactccaggctggg

SEQ ID NO: 273128 - DNA, 16 bp, P. troglodytes
tgcactccagtctggg

SEQ ID NO: 273129 - DNA, 16 bp, P. troglodytes
tgcactccatcctgag

SEQ ID NO: 273130 - DNA, 16 bp, P. troglodytes
tgcactccatcctgga

SEQ ID NO: 273131 - DNA, 16 bp, P. troglodytes
tgcactcccagctact

SEQ ID NO: 273132 - DNA, 16 bp, P. troglodytes
tgcactcccatgttca

SEQ ID NO: 273133 - DNA, 16 bp, P. troglodytes
tgcactccggcctagg

SEQ ID NO: 273134 - DNA, 16 bp, P. troglodytes
tgcactccggcctggg

SEQ ID NO: 273135 - DNA, 16 bp, P. troglodytes
tgcactcgagcctggg

SEQ ID NO: 273136 - DNA, 16 bp, P. troglodytes
tgcactctaacctggg

SEQ ID NO: 273137 - DNA, 16 bp, P. troglodytes
tgcactctagcctagg

SEQ ID NO: 273138 - DNA, 16 bp, P. troglodytes
tgcactctagcctgag

SEQ ID NO: 273139 - DNA, 16 bp, P. troglodytes
tgcactctagcctggc

SEQ ID NO: 273140 - DNA, 16 bp, P. troglodytes
tgcactctagcctggg

SEQ ID NO: 273141 - DNA, 16 bp, P. troglodytes
tgcactctatcctggg

SEQ ID NO: 273142 - DNA, 16 bp, P. troglodytes
tgcactctctgcctcc

SEQ ID NO: 273143 - DNA, 16 bp, P. troglodytes
tgcactctggcctggg

SEQ ID NO: 273144 - DNA, 17 bp, P. troglodytes
tgcactgagccaagatc

SEQ ID NO: 273145 - DNA, 17 bp, P. troglodytes
tgcactgagccgagatc

SEQ ID NO: 273146 - DNA, 16 bp, P. troglodytes
tgcactgagctgagac

SEQ ID NO: 273147 - DNA, 16 bp, P. troglodytes
tgcactgagctgagat

SEQ ID NO: 273148 - DNA, 16 bp, P. troglodytes
tgcactgatttttttt

SEQ ID NO: 273149 - DNA, 16 bp, P. troglodytes
tgcactgcaaaagaaa

SEQ ID NO: 273150 - DNA, 16 bp, P. troglodytes
tgcactgcagcctgag

SEQ ID NO: 273151 - DNA, 16 bp, P. troglodytes
tgcactgcagcctggg

SEQ ID NO: 273152 - DNA, 16 bp, P. troglodytes
tgcactgtagcctggg

SEQ ID NO: 273153 - DNA, 16 bp, P. troglodytes
tgcactgtgctgggag

SEQ ID NO: 273154 - DNA, 16 bp, P. troglodytes
tgcactgtggtcagag

SEQ ID NO: 273155 - DNA, 16 bp, P. troglodytes
tgcactgtggtgtgag

SEQ ID NO: 273156 - DNA, 16 bp, P. troglodytes
tgcacttaaaaaaaaa

SEQ ID NO: 273157 - DNA, 16 bp, P. troglodytes
tgcacttaacactgga

SEQ ID NO: 273158 - DNA, 16 bp, P. troglodytes
tgcacttaacattttt

SEQ ID NO: 273159 - DNA, 16 bp, P. troglodytes
tgcacttatttattta

SEQ ID NO: 273160 - DNA, 16 bp, P. troglodytes
tgcacttcaacctggg

SEQ ID NO: 273161 - DNA, 16 bp, P. troglodytes
tgcacttcaccctggg

SEQ ID NO: 273162 - DNA, 16 bp, P. troglodytes
tgcacttcagcatggg

SEQ ID NO: 273163 - DNA, 16 bp, P. troglodytes
tgcacttcagcctgag

SEQ ID NO: 273164 - DNA, 16 bp, P. troglodytes
tgcacttcagcctggc

SEQ ID NO: 273165 - DNA, 16 bp, P. troglodytes
tgcacttcagcctggg

SEQ ID NO: 273166 - DNA, 16 bp, P. troglodytes
tgcacttctctctcct

SEQ ID NO: 273167 - DNA, 16 bp, P. troglodytes
tgcactttaaaaaaaa

SEQ ID NO: 273168 - DNA, 16 bp, P. troglodytes
tgcactttagcctgga

SEQ ID NO: 273169 - DNA, 16 bp, P. troglodytes
tgcactttattttatt

SEQ ID NO: 273170 - DNA, 21 bp, P. troglodytes
tgcactttgggaggccaaggc

SEQ ID NO: 273171 - DNA, 16 bp, P. troglodytes
tgcactttggggccat

SEQ ID NO: 273172 - DNA, 16 bp, P. troglodytes
tgcactttttaaaaaa

SEQ ID NO: 273173 - DNA, 16 bp, P. troglodytes
tgcagaaaaaagggaa

SEQ ID NO: 273174 - DNA, 16 bp, P. troglodytes
tgcagaaaatcaaaga

SEQ ID NO: 273175 - DNA, 16 bp, P. troglodytes
tgcagaaacagaaaaa

SEQ ID NO: 273176 - DNA, 16 bp, P. troglodytes
tgcagaaacttggatg

SEQ ID NO: 273177 - DNA, 16 bp, P. troglodytes
tgcagaaagtataaaa

SEQ ID NO: 273178 - DNA, 16 bp, P. troglodytes
tgcagaaatttatttt

SEQ ID NO: 273179 - DNA, 16 bp, P. troglodytes
tgcagaacagcaaaaa

SEQ ID NO: 273180 - DNA, 16 bp, P. troglodytes
tgcagaacagtgagcc

SEQ ID NO: 273181 - DNA, 17 bp, P. troglodytes
tgcagaacgtgcagatt

SEQ ID NO: 273182 - DNA, 16 bp, P. troglodytes
tgcagaactttgaact

SEQ ID NO: 273183 - DNA, 16 bp, P. troglodytes
tgcagaagcctcagga

SEQ ID NO: 273184 - DNA, 16 bp, P. troglodytes
tgcagaagctgcagca

SEQ ID NO: 273185 - DNA, 16 bp, P. troglodytes
tgcagaagcttttaaa

SEQ ID NO: 273186 - DNA, 16 bp, P. troglodytes
tgcagaagttctttgg

SEQ ID NO: 273187 - DNA, 16 bp, P. troglodytes
tgcagaatgtgcagat

SEQ ID NO: 273188 - DNA, 16 bp, P. troglodytes
tgcagacactgctgct

SEQ ID NO: 273189 - DNA, 16 bp, P. troglodytes
tgcagacaggagctgt

SEQ ID NO: 273190 - DNA, 16 bp, P. troglodytes
tgcagacatttttggt

SEQ ID NO: 273191 - DNA, 16 bp, P. troglodytes
tgcagaccatcctggc

SEQ ID NO: 273192 - DNA, 16 bp, P. troglodytes
tgcagaccctgcactt

SEQ ID NO: 273193 - DNA, 16 bp, P. troglodytes
tgcagactgctgactt

SEQ ID NO: 273194 - DNA, 16 bp, P. troglodytes
tgcagagaaaaaggga

SEQ ID NO: 273195 - DNA, 16 bp, P. troglodytes
tgcagagaaaatggaa

SEQ ID NO: 273196 - DNA, 16 bp, P. troglodytes
tgcagagacacacaca

SEQ ID NO: 273197 - DNA, 16 bp, P. troglodytes
tgcagagagccaagat

SEQ ID NO: 273198 - DNA, 16 bp, P. troglodytes
tgcagagagccatgat

SEQ ID NO: 273199 - DNA, 16 bp, P. troglodytes
tgcagagagctgcctt

SEQ ID NO: 273200 - DNA, 16 bp, P. troglodytes
tgcagagattttgttt

SEQ ID NO: 273201 - DNA, 16 bp, P. troglodytes
tgcagagcaaaataaa

SEQ ID NO: 273202 - DNA, 16 bp, P. troglodytes
tgcagagcagcaaaga

SEQ ID NO: 273203 - DNA, 16 bp, P. troglodytes
tgcagagcccagaggg

SEQ ID NO: 273204 - DNA, 16 bp, P. troglodytes
tgcagagcgtgcaggt

SEQ ID NO: 273205 - DNA, 16 bp, P. troglodytes
tgcagagctgctactg

SEQ ID NO: 273206 - DNA, 16 bp, P. troglodytes
tgcagagctgtgttca

SEQ ID NO: 273207 - DNA, 16 bp, P. troglodytes
tgcagaggaatgaaac

SEQ ID NO: 273208 - DNA, 16 bp, P. troglodytes
tgcagaggaatgaaat

SEQ ID NO: 273209 - DNA, 16 bp, P. troglodytes
tgcagaggaggaggag

SEQ ID NO: 273210 - DNA, 16 bp, P. troglodytes
tgcagaggtgcaatca

SEQ ID NO: 273211 - DNA, 16 bp, P. troglodytes
tgcagagtttcagttt

SEQ ID NO: 273212 - DNA, 16 bp, P. troglodytes
tgcagatacagctgca

SEQ ID NO: 273213 - DNA, 16 bp, P. troglodytes
tgcagatattttctct

SEQ ID NO: 273214 - DNA, 17 bp, P. troglodytes
tgcagatcacctgaggt

SEQ ID NO: 273215 - DNA, 16 bp, P. troglodytes
tgcagatgaaaaaact

SEQ ID NO: 273216 - DNA, 16 bp, P. troglodytes
tgcagatgaagaaaat

SEQ ID NO: 273217 - DNA, 16 bp, P. troglodytes
tgcagatgagaaaaca

SEQ ID NO: 273218 - DNA, 16 bp, P. troglodytes
tgcagatgagaaaagt

SEQ ID NO: 273219 - DNA, 16 bp, P. troglodytes
tgcagatgatgaaact

SEQ ID NO: 273220 - DNA, 16 bp, P. troglodytes
tgcagatgccagggag

SEQ ID NO: 273221 - DNA, 16 bp, P. troglodytes
tgcagatgctgctggt

SEQ ID NO: 273222 - DNA, 16 bp, P. troglodytes
tgcagatggcagagct

SEQ ID NO: 273223 - DNA, 16 bp, P. troglodytes
tgcagatggccacctt

SEQ ID NO: 273224 - DNA, 16 bp, P. troglodytes
tgcagatggccacttt

SEQ ID NO: 273225 - DNA, 16 bp, P. troglodytes
tgcagatgtcattaag

SEQ ID NO: 273226 - DNA, 16 bp, P. troglodytes
tgcagatgtggtggaa

SEQ ID NO: 273227 - DNA, 16 bp, P. troglodytes
tgcagattcctgggcc

SEQ ID NO: 273228 - DNA, 16 bp, P. troglodytes
tgcagattctgactca

SEQ ID NO: 273229 - DNA, 16 bp, P. troglodytes
tgcagcaaaaacaaaa

SEQ ID NO: 273230 - DNA, 16 bp, P. troglodytes
tgcagcaaaattctgc

SEQ ID NO: 273231 - DNA, 16 bp, P. troglodytes
tgcagcacacgaacat

SEQ ID NO: 273232 - DNA, 16 bp, P. troglodytes
tgcagcaccacacctg

SEQ ID NO: 273233 - DNA, 16 bp, P. troglodytes
tgcagcactgtttgta

SEQ ID NO: 273234 - DNA, 16 bp, P. troglodytes
tgcagcagagaaagag

SEQ ID NO: 273235 - DNA, 16 bp, P. troglodytes
tgcagcagcagaaaca

SEQ ID NO: 273236 - DNA, 16 bp, P. troglodytes
tgcagcagccatcttg

SEQ ID NO: 273237 - DNA, 16 bp, P. troglodytes
tgcagcagctcacgcc

SEQ ID NO: 273238 - DNA, 16 bp, P. troglodytes
tgcagcagctgctcca

SEQ ID NO: 273239 - DNA, 16 bp, P. troglodytes
tgcagcagctgctgct

SEQ ID NO: 273240 - DNA, 16 bp, P. troglodytes
tgcagcattattcaca

SEQ ID NO: 273241 - DNA, 16 bp, P. troglodytes
tgcagccaaaaaccac

SEQ ID NO: 273242 - DNA, 16 bp, P. troglodytes
tgcagccactgcctcc

SEQ ID NO: 273243 - DNA, 16 bp, P. troglodytes
tgcagccatataaaag

SEQ ID NO: 273244 - DNA, 16 bp, P. troglodytes
tgcagccatgaactcc

SEQ ID NO: 273245 - DNA, 16 bp, P. troglodytes
tgcagccattaaaatg

SEQ ID NO: 273246 - DNA, 16 bp, P. troglodytes
tgcagcccacagagga

SEQ ID NO: 273247 - DNA, 16 bp, P. troglodytes
tgcagcccactgagca

SEQ ID NO: 273248 - DNA, 16 bp, P. troglodytes
tgcagcccctgcctcc

SEQ ID NO: 273249 - DNA, 16 bp, P. troglodytes
tgcagccctgttcaca

SEQ ID NO: 273250 - DNA, 16 bp, P. troglodytes
tgcagccgctggcccg

SEQ ID NO: 273251 - DNA, 16 bp, P. troglodytes
tgcagcctcaactccc

SEQ ID NO: 273252 - DNA, 16 bp, P. troglodytes
tgcagcctcagccttc

SEQ ID NO: 273253 - DNA, 16 bp, P. troglodytes
tgcagcctcagcttcc

SEQ ID NO: 273254 - DNA, 16 bp, P. troglodytes
tgcagcctcagtctct

SEQ ID NO: 273255 - DNA, 16 bp, P. troglodytes
tgcagcctccagctcc

SEQ ID NO: 273256 - DNA, 16 bp, P. troglodytes
tgcagcctccatcttc

SEQ ID NO: 273257 - DNA, 16 bp, P. troglodytes
tgcagcctcccaagta

SEQ ID NO: 273258 - DNA, 16 bp, P. troglodytes
tgcagcctccctgcct

SEQ ID NO: 273259 - DNA, 16 bp, P. troglodytes
tgcagcctccgactcc

SEQ ID NO: 273260 - DNA, 18 bp, P. troglodytes
tgcagcctcgacctccca

SEQ ID NO: 273261 - DNA, 16 bp, P. troglodytes
tgcagcctctgcctct

SEQ ID NO: 273262 - DNA, 16 bp, P. troglodytes
tgcagcctgcagaact

SEQ ID NO: 273263 - DNA, 16 bp, P. troglodytes
tgcagcctgggtgaca

SEQ ID NO: 273264 - DNA, 16 bp, P. troglodytes
tgcagccttaacctcc

SEQ ID NO: 273265 - DNA, 16 bp, P. troglodytes
tgcagccttcacctct

SEQ ID NO: 273266 - DNA, 16 bp, P. troglodytes
tgcagccttgacctct

SEQ ID NO: 273267 - DNA, 16 bp, P. troglodytes
tgcagcgagccaagat

SEQ ID NO: 273268 - DNA, 16 bp, P. troglodytes
tgcagcgagccgagat

SEQ ID NO: 273269 - DNA, 18 bp, P. troglodytes
tgcagcgagctgagatca

SEQ ID NO: 273270 - DNA, 16 bp, P. troglodytes
tgcagctagaggccat

SEQ ID NO: 273271 - DNA, 16 bp, P. troglodytes
tgcagctagctcggtg

SEQ ID NO: 273272 - DNA, 16 bp, P. troglodytes
tgcagctatgccagca

SEQ ID NO: 273273 - DNA, 16 bp, P. troglodytes
tgcagctattgtaaat

SEQ ID NO: 273274 - DNA, 16 bp, P. troglodytes
tgcagctcaccaacat

SEQ ID NO: 273275 - DNA, 16 bp, P. troglodytes
tgcagctcagaagaaa

SEQ ID NO: 273276 - DNA, 16 bp, P. troglodytes
tgcagctcccactcag

SEQ ID NO: 273277 - DNA, 16 bp, P. troglodytes
tgcagctgaaggtcct

SEQ ID NO: 273278 - DNA, 16 bp, P. troglodytes
tgcagctgcaaggtca

SEQ ID NO: 273279 - DNA, 16 bp, P. troglodytes
tgcagctgcagaaaga

SEQ ID NO: 273280 - DNA, 16 bp, P. troglodytes
tgcagctgcagccgcc

SEQ ID NO: 273281 - DNA, 16 bp, P. troglodytes
tgcagctgcagctgcc

SEQ ID NO: 273282 - DNA, 16 bp, P. troglodytes
tgcagctgctgctgct

SEQ ID NO: 273283 - DNA, 16 bp, P. troglodytes
tgcagctgctgctggg

SEQ ID NO: 273284 - DNA, 16 bp, P. troglodytes
tgcagctgctggcact

SEQ ID NO: 273285 - DNA, 16 bp, P. troglodytes
tgcagctgctgtacca

SEQ ID NO: 273286 - DNA, 16 bp, P. troglodytes
tgcagctgctgtggga

SEQ ID NO: 273287 - DNA, 16 bp, P. troglodytes
tgcagctggaggccac

SEQ ID NO: 273288 - DNA, 16 bp, P. troglodytes
tgcagctggaggccat

SEQ ID NO: 273289 - DNA, 16 bp, P. troglodytes
tgcagctggaggctat

SEQ ID NO: 273290 - DNA, 16 bp, P. troglodytes
tgcagctggaggctgc

SEQ ID NO: 273291 - DNA, 16 bp, P. troglodytes
tgcagctggaggtcat

SEQ ID NO: 273292 - DNA, 16 bp, P. troglodytes
tgcagctgtgagaaga

SEQ ID NO: 273293 - DNA, 16 bp, P. troglodytes
tgcagcttctgctggt

SEQ ID NO: 273294 - DNA, 16 bp, P. troglodytes
tgcagcttctgcttcc

SEQ ID NO: 273295 - DNA, 16 bp, P. troglodytes
tgcagcttcttcacct

SEQ ID NO: 273296 - DNA, 16 bp, P. troglodytes
tgcagctttgacctcc

SEQ ID NO: 273297 - DNA, 16 bp, P. troglodytes
tgcagctttgacttcc

SEQ ID NO: 273298 - DNA, 16 bp, P. troglodytes
tgcagctttgttacat

SEQ ID NO: 273299 - DNA, 16 bp, P. troglodytes
tgcaggaagcatggtg

SEQ ID NO: 273300 - DNA, 16 bp, P. troglodytes
tgcaggaagctgagat

SEQ ID NO: 273301 - DNA, 16 bp, P. troglodytes
tgcaggaagtcaggga

SEQ ID NO: 273302 - DNA, 16 bp, P. troglodytes
tgcaggaatggtttaa

SEQ ID NO: 273303 - DNA, 16 bp, P. troglodytes
tgcaggaccatttcaa

SEQ ID NO: 273304 - DNA, 16 bp, P. troglodytes
tgcaggagcagagccc

SEQ ID NO: 273305 - DNA, 16 bp, P. troglodytes
tgcaggaggtggaggt

SEQ ID NO: 273306 - DNA, 16 bp, P. troglodytes
tgcaggagtggagccc

SEQ ID NO: 273307 - DNA, 16 bp, P. troglodytes
tgcaggatataaggtt

SEQ ID NO: 273308 - DNA, 16 bp, P. troglodytes
tgcaggatgtgccttg

SEQ ID NO: 273309 - DNA, 16 bp, P. troglodytes
tgcaggcaaactccca

SEQ ID NO: 273310 - DNA, 17 bp, P. troglodytes
tgcaggcatgagccacc

SEQ ID NO: 273311 - DNA, 16 bp, P. troglodytes
tgcaggccaccatgcc

SEQ ID NO: 273312 - DNA, 16 bp, P. troglodytes
tgcaggccaggagaga

SEQ ID NO: 273313 - DNA, 16 bp, P. troglodytes
tgcaggccagtgccaa

SEQ ID NO: 273314 - DNA, 16 bp, P. troglodytes
tgcaggcgtgagctac

SEQ ID NO: 273315 - DNA, 16 bp, P. troglodytes
tgcaggctcagaagtg

SEQ ID NO: 273316 - DNA, 16 bp, P. troglodytes
tgcaggctccgccccc

SEQ ID NO: 273317 - DNA, 16 bp, P. troglodytes
tgcaggctgaggcagg

SEQ ID NO: 273318 - DNA, 16 bp, P. troglodytes
tgcaggctgaggtggg

SEQ ID NO: 273319 - DNA, 16 bp, P. troglodytes
tgcaggctgcactgcc

SEQ ID NO: 273320 - DNA, 16 bp, P. troglodytes
tgcaggctgtgcagcc

SEQ ID NO: 273321 - DNA, 16 bp, P. troglodytes
tgcaggctttacagga

SEQ ID NO: 273322 - DNA, 16 bp, P. troglodytes
tgcagggaaactcccc

SEQ ID NO: 273323 - DNA, 16 bp, P. troglodytes
tgcagggacagagccc

SEQ ID NO: 273324 - DNA, 19 bp, P. troglodytes
tgcagggacgcctctctga

SEQ ID NO: 273325 - DNA, 16 bp, P. troglodytes
tgcagggattacaggt

SEQ ID NO: 273326 - DNA, 16 bp, P. troglodytes
tgcagggcatggtggc

SEQ ID NO: 273327 - DNA, 16 bp, P. troglodytes
tgcaggggaggctggg

SEQ ID NO: 273328 - DNA, 16 bp, P. troglodytes
tgcaggggtcctggaa

SEQ ID NO: 273329 - DNA, 16 bp, P. troglodytes
tgcagggtacagcctc

SEQ ID NO: 273330 - DNA, 21 bp, P. troglodytes
tgcaggtccggagccctgccc

SEQ ID NO: 273331 - DNA, 16 bp, P. troglodytes
tgcaggtctgttacat

SEQ ID NO: 273332 - DNA, 17 bp, P. troglodytes
tgcaggtgcacagaagt

SEQ ID NO: 273333 - DNA, 16 bp, P. troglodytes
tgcaggtttggttcca

SEQ ID NO: 273334 - DNA, 16 bp, P. troglodytes
tgcaggtttgttacat

SEQ ID NO: 273335 - DNA, 16 bp, P. troglodytes
tgcagtaaaaacaaag

SEQ ID NO: 273336 - DNA, 17 bp, P. troglodytes
tgcagtaagccgagatt

SEQ ID NO: 273337 - DNA, 16 bp, P. troglodytes
tgcagtaagctatgat

SEQ ID NO: 273338 - DNA, 16 bp, P. troglodytes
tgcagtaagctgagat

SEQ ID NO: 273339 - DNA, 16 bp, P. troglodytes
tgcagtatttggtttc

SEQ ID NO: 273340 - DNA, 16 bp, P. troglodytes
tgcagtatttgttttt

SEQ ID NO: 273341 - DNA, 16 bp, P. troglodytes
tgcagtattttaaaaa

SEQ ID NO: 273342 - DNA, 16 bp, P. troglodytes
tgcagtcacagctact

SEQ ID NO: 273343 - DNA, 16 bp, P. troglodytes
tgcagtcaccttccca

SEQ ID NO: 273344 - DNA, 16 bp, P. troglodytes
tgcagtcagccaagat

SEQ ID NO: 273345 - DNA, 17 bp, P. troglodytes
tgcagtcagccgagatc

SEQ ID NO: 273346 - DNA, 16 bp, P. troglodytes
tgcagtcagctatgat

SEQ ID NO: 273347 - DNA, 16 bp, P. troglodytes
tgcagtcagctcctct

SEQ ID NO: 273348 - DNA, 16 bp, P. troglodytes
tgcagtcagctgagat

SEQ ID NO: 273349 - DNA, 16 bp, P. troglodytes
tgcagtccagcctgag

SEQ ID NO: 273350 - DNA, 16 bp, P. troglodytes
tgcagtccagcctggg

SEQ ID NO: 273351 - DNA, 16 bp, P. troglodytes
tgcagtcccagcaact

SEQ ID NO: 273352 - DNA, 16 bp, P. troglodytes
tgcagtcccagctact

SEQ ID NO: 273353 - DNA, 16 bp, P. troglodytes
tgcagtcctagctact

SEQ ID NO: 273354 - DNA, 16 bp, P. troglodytes
tgcagtccttgtggcc

SEQ ID NO: 273355 - DNA, 16 bp, P. troglodytes
tgcagtctcagctcat

SEQ ID NO: 273356 - DNA, 16 bp, P. troglodytes
tgcagtctctctctgt

SEQ ID NO: 273357 - DNA, 18 bp, P. troglodytes
tgcagtgaaccgagatcg

SEQ ID NO: 273358 - DNA, 16 bp, P. troglodytes
tgcagtgaaccgtgat

SEQ ID NO: 273359 - DNA, 16 bp, P. troglodytes
tgcagtgaacggagat

SEQ ID NO: 273360 - DNA, 16 bp, P. troglodytes
tgcagtgaactgagag

SEQ ID NO: 273361 - DNA, 16 bp, P. troglodytes
tgcagtgaactgagat

SEQ ID NO: 273362 - DNA, 16 bp, P. troglodytes
tgcagtgaatgtggga

SEQ ID NO: 273363 - DNA, 16 bp, P. troglodytes
tgcagtgacccaagat

SEQ ID NO: 273364 - DNA, 17 bp, P. troglodytes
tgcagtgagacgagatc

SEQ ID NO: 273365 - DNA, 19 bp, P. troglodytes
tgcagtgagacgagattgc

SEQ ID NO: 273366 - DNA, 16 bp, P. troglodytes
tgcagtgagcagacat

SEQ ID NO: 273367 - DNA, 16 bp, P. troglodytes
tgcagtgagcagagat

SEQ ID NO: 273368 - DNA, 16 bp, P. troglodytes
tgcagtgagcagtaat

SEQ ID NO: 273369 - DNA, 24 bp, P. troglodytes
tgcagtgagccaagatcgcaccat

SEQ ID NO: 273370 - DNA, 29 bp, P. troglodytes
tgcagtgagccaagattgcaccattgcac

SEQ ID NO: 273371 - DNA, 16 bp, P. troglodytes
tgcagtgagccgagat

SEQ ID NO: 273372 - DNA, 24 bp, P. troglodytes
tgcagtgagccgagatcgcgccac

SEQ ID NO: 273373 - DNA, 16 bp, P. troglodytes
tgcagtgagccgatac

SEQ ID NO: 273374 - DNA, 21 bp, P. troglodytes
tgcagtgagccgggatcgcgc

SEQ ID NO: 273375 - DNA, 16 bp, P. troglodytes
tgcagtgagcggagat

SEQ ID NO: 273376 - DNA, 16 bp, P. troglodytes
tgcagtgagctaggat

SEQ ID NO: 273377 - DNA, 16 bp, P. troglodytes
tgcagtgagctatcat

SEQ ID NO: 273378 - DNA, 17 bp, P. troglodytes
tgcagtgagctatggtc

SEQ ID NO: 273379 - DNA, 16 bp, P. troglodytes
tgcagtgagctgaaat

SEQ ID NO: 273380 - DNA, 16 bp, P. troglodytes
tgcagtgagctgaaga

SEQ ID NO: 273381 - DNA, 16 bp, P. troglodytes
tgcagtgagctgagaa

SEQ ID NO: 273382 - DNA, 16 bp, P. troglodytes
tgcagtgagctgagac

SEQ ID NO: 273383 - DNA, 16 bp, P. troglodytes
tgcagtgagctgagat

SEQ ID NO: 273384 - DNA, 16 bp, P. troglodytes
tgcagtgagctgaggt

SEQ ID NO: 273385 - DNA, 16 bp, P. troglodytes
tgcagtgagctgggat

SEQ ID NO: 273386 - DNA, 16 bp, P. troglodytes
tgcagtgagctgtaat

SEQ ID NO: 273387 - DNA, 16 bp, P. troglodytes
tgcagtgagctgtgat

SEQ ID NO: 273388 - DNA, 16 bp, P. troglodytes
tgcagtgagctgtgtt

SEQ ID NO: 273389 - DNA, 16 bp, P. troglodytes
tgcagtgaggcgagat

SEQ ID NO: 273390 - DNA, 16 bp, P. troglodytes
tgcagtgaggggagat

SEQ ID NO: 273391 - DNA, 16 bp, P. troglodytes
tgcagtgagtcatgat

SEQ ID NO: 273392 - DNA, 17 bp, P. troglodytes
tgcagtgagttatgatc

SEQ ID NO: 273393 - DNA, 16 bp, P. troglodytes
tgcagtgatctgagat

SEQ ID NO: 273394 - DNA, 16 bp, P. troglodytes
tgcagtgatgtgatca

SEQ ID NO: 273395 - DNA, 16 bp, P. troglodytes
tgcagtgattgtggga

SEQ ID NO: 273396 - DNA, 16 bp, P. troglodytes
tgcagtgcacagcctg

SEQ ID NO: 273397 - DNA, 16 bp, P. troglodytes
tgcagtgcagtggcgt

SEQ ID NO: 273398 - DNA, 16 bp, P. troglodytes
tgcagtgccagctact

SEQ ID NO: 273399 - DNA, 16 bp, P. troglodytes
tgcagtgccatgatct

SEQ ID NO: 273400 - DNA, 17 bp, P. troglodytes
tgcagtggcacaatcac

SEQ ID NO: 273401 - DNA, 16 bp, P. troglodytes
tgcagtggcacactca

SEQ ID NO: 273402 - DNA, 17 bp, P. troglodytes
tgcagtggcacgatctg

SEQ ID NO: 273403 - DNA, 17 bp, P. troglodytes
tgcagtggcactatctt

SEQ ID NO: 273404 - DNA, 16 bp, P. troglodytes
tgcagtggcatgacca

SEQ ID NO: 273405 - DNA, 16 bp, P. troglodytes
tgcagtggcctgatca

SEQ ID NO: 273406 - DNA, 17 bp, P. troglodytes
tgcagtggcctgatctc

SEQ ID NO: 273407 - DNA, 16 bp, P. troglodytes
tgcagtggcgcaaaca

SEQ ID NO: 273408 - DNA, 16 bp, P. troglodytes
tgcagtggcgcaatca

SEQ ID NO: 273409 - DNA, 17 bp, P. troglodytes
tgcagtggcgcgatttc

SEQ ID NO: 273410 - DNA, 16 bp, P. troglodytes
tgcagtggcgtgattc

SEQ ID NO: 273411 - DNA, 16 bp, P. troglodytes
tgcagtggctcatgct

SEQ ID NO: 273412 - DNA, 16 bp, P. troglodytes
tgcagtggctcattct

SEQ ID NO: 273413 - DNA, 16 bp, P. troglodytes
tgcagtggctggtgcc

SEQ ID NO: 273414 - DNA, 16 bp, P. troglodytes
tgcagtgggctgagat

SEQ ID NO: 273415 - DNA, 16 bp, P. troglodytes
tgcagtggggcagtca

SEQ ID NO: 273416 - DNA, 16 bp, P. troglodytes
tgcagtggtgacatct

SEQ ID NO: 273417 - DNA, 16 bp, P. troglodytes
tgcagtggtgcagtat

SEQ ID NO: 273418 - DNA, 16 bp, P. troglodytes
tgcagtggtggtggtg

SEQ ID NO: 273419 - DNA, 16 bp, P. troglodytes
tgcagtggtggttcaa

SEQ ID NO: 273420 - DNA, 16 bp, P. troglodytes
tgcagtgtggatggca

SEQ ID NO: 273421 - DNA, 16 bp, P. troglodytes
tgcagtgttatttctg

SEQ ID NO: 273422 - DNA, 16 bp, P. troglodytes
tgcagtgtttctcaaa

SEQ ID NO: 273423 - DNA, 16 bp, P. troglodytes
tgcagtgtttttattt

SEQ ID NO: 273424 - DNA, 16 bp, P. troglodytes
tgcagttagctatgat

SEQ ID NO: 273425 - DNA, 16 bp, P. troglodytes
tgcagttagctgagat

SEQ ID NO: 273426 - DNA, 16 bp, P. troglodytes
tgcagttattttaaaa

SEQ ID NO: 273427 - DNA, 16 bp, P. troglodytes
tgcagttcaaacccat

SEQ ID NO: 273428 - DNA, 16 bp, P. troglodytes
tgcagttcaagtctga

SEQ ID NO: 273429 - DNA, 16 bp, P. troglodytes
tgcagttcacagtagg

SEQ ID NO: 273430 - DNA, 16 bp, P. troglodytes
tgcagttccctgatga

SEQ ID NO: 273431 - DNA, 16 bp, P. troglodytes
tgcagttctcatgata

SEQ ID NO: 273432 - DNA, 19 bp, P. troglodytes
tgcagttgagataagagga

SEQ ID NO: 273433 - DNA, 23 bp, P. troglodytes
tgcagttgagataagaggaaggc

SEQ ID NO: 273434 - DNA, 16 bp, P. troglodytes
tgcagttgctgggtca

SEQ ID NO: 273435 - DNA, 16 bp, P. troglodytes
tgcagttggcaagctg

SEQ ID NO: 273436 - DNA, 16 bp, P. troglodytes
tgcagtttcttcccag

SEQ ID NO: 273437 - DNA, 16 bp, P. troglodytes
tgcagtttgaaaaaca

SEQ ID NO: 273438 - DNA, 16 bp, P. troglodytes
tgcagttttcttttct

SEQ ID NO: 273439 - DNA, 16 bp, P. troglodytes
tgcagttttgttttct

SEQ ID NO: 273440 - DNA, 16 bp, P. troglodytes
tgcagtttttgtttgt

SEQ ID NO: 273441 - DNA, 16 bp, P. troglodytes
tgcataataaccagct

SEQ ID NO: 273442 - DNA, 16 bp, P. troglodytes
tgcatacacacacaca

SEQ ID NO: 273443 - DNA, 16 bp, P. troglodytes
tgcatacatatatatt

SEQ ID NO: 273444 - DNA, 16 bp, P. troglodytes
tgcatacatcacaaag

SEQ ID NO: 273445 - DNA, 16 bp, P. troglodytes
tgcatacattgtggaa

SEQ ID NO: 273446 - DNA, 16 bp, P. troglodytes
tgcatacatttgcata

SEQ ID NO: 273447 - DNA, 16 bp, P. troglodytes
tgcatacttaaaaatg

SEQ ID NO: 273448 - DNA, 18 bp, P. troglodytes
tgcatagtattccgtggt

SEQ ID NO: 273449 - DNA, 16 bp, P. troglodytes
tgcatataaaatgctt

SEQ ID NO: 273450 - DNA, 16 bp, P. troglodytes
tgcatataaaatttat

SEQ ID NO: 273451 - DNA, 16 bp, P. troglodytes
tgcatatatactacat

SEQ ID NO: 273452 - DNA, 16 bp, P. troglodytes
tgcatatatatacaca

SEQ ID NO: 273453 - DNA, 16 bp, P. troglodytes
tgcatatatatgtatg

SEQ ID NO: 273454 - DNA, 16 bp, P. troglodytes
tgcatatatgtgtgtg

SEQ ID NO: 273455 - DNA, 16 bp, P. troglodytes
tgcatatgcatataca

SEQ ID NO: 273456 - DNA, 16 bp, P. troglodytes
tgcatatgtacataca

SEQ ID NO: 273457 - DNA, 16 bp, P. troglodytes
tgcatatgtgtgtaca

SEQ ID NO: 273458 - DNA, 16 bp, P. troglodytes
tgcatatgtgtgtgtt

SEQ ID NO: 273459 - DNA, 16 bp, P. troglodytes
tgcatatgtgtttgtg

SEQ ID NO: 273460 - DNA, 16 bp, P. troglodytes
tgcatattatatatgt

SEQ ID NO: 273461 - DNA, 16 bp, P. troglodytes
tgcatatttattgaat

SEQ ID NO: 273462 - DNA, 16 bp, P. troglodytes
tgcatattttcactta

SEQ ID NO: 273463 - DNA, 16 bp, P. troglodytes
tgcatcaaaaagtctg

SEQ ID NO: 273464 - DNA, 16 bp, P. troglodytes
tgcatcagaatcacct

SEQ ID NO: 273465 - DNA, 16 bp, P. troglodytes
tgcatcccagaaataa

SEQ ID NO: 273466 - DNA, 16 bp, P. troglodytes
tgcatcccagcctggg

SEQ ID NO: 273467 - DNA, 16 bp, P. troglodytes
tgcatcccagggacaa

SEQ ID NO: 273468 - DNA, 16 bp, P. troglodytes
tgcatccccagtgcct

SEQ ID NO: 273469 - DNA, 16 bp, P. troglodytes
tgcatcccttccttac

SEQ ID NO: 273470 - DNA, 16 bp, P. troglodytes
tgcatctattgacata

SEQ ID NO: 273471 - DNA, 16 bp, P. troglodytes
tgcatctcttccatct

SEQ ID NO: 273472 - DNA, 16 bp, P. troglodytes
tgcatctgttgaaatg

SEQ ID NO: 273473 - DNA, 17 bp, P. troglodytes
tgcatcttcctcatttt

SEQ ID NO: 273474 - DNA, 16 bp, P. troglodytes
tgcatgaaaatatttt

SEQ ID NO: 273475 - DNA, 16 bp, P. troglodytes
tgcatgatatatcttt

SEQ ID NO: 273476 - DNA, 16 bp, P. troglodytes
tgcatgcacacacaca

SEQ ID NO: 273477 - DNA, 16 bp, P. troglodytes
tgcatgcacacatgtg

SEQ ID NO: 273478 - DNA, 16 bp, P. troglodytes
tgcatgcacagccttg

SEQ ID NO: 273479 - DNA, 16 bp, P. troglodytes
tgcatgcaggtgtctt

SEQ ID NO: 273480 - DNA, 16 bp, P. troglodytes
tgcatgcatgtatgta

SEQ ID NO: 273481 - DNA, 16 bp, P. troglodytes
tgcatgccaccacgcc

SEQ ID NO: 273482 - DNA, 16 bp, P. troglodytes
tgcatgccactgcact

SEQ ID NO: 273483 - DNA, 16 bp, P. troglodytes
tgcatgcctgcaggtc

SEQ ID NO: 273484 - DNA, 16 bp, P. troglodytes
tgcatgcctgtaatct

SEQ ID NO: 273485 - DNA, 16 bp, P. troglodytes
tgcatgcctgtgatcc

SEQ ID NO: 273486 - DNA, 16 bp, P. troglodytes
tgcatgcgtgtgcgtg

SEQ ID NO: 273487 - DNA, 16 bp, P. troglodytes
tgcatggatttttttt

SEQ ID NO: 273488 - DNA, 16 bp, P. troglodytes
tgcatgtagtcccagc

SEQ ID NO: 273489 - DNA, 16 bp, P. troglodytes
tgcatgtatctttata

SEQ ID NO: 273490 - DNA, 16 bp, P. troglodytes
tgcatgtatttgtgtg

SEQ ID NO: 273491 - DNA, 16 bp, P. troglodytes
tgcatgtatttttata

SEQ ID NO: 273492 - DNA, 16 bp, P. troglodytes
tgcatgtctgaaaatg

SEQ ID NO: 273493 - DNA, 16 bp, P. troglodytes
tgcatgtgcacacaca

SEQ ID NO: 273494 - DNA, 16 bp, P. troglodytes
tgcatgtgtatacata

SEQ ID NO: 273495 - DNA, 16 bp, P. troglodytes
tgcatgtgtatatatg

SEQ ID NO: 273496 - DNA, 16 bp, P. troglodytes
tgcatgtgtcatgaag

SEQ ID NO: 273497 - DNA, 16 bp, P. troglodytes
tgcatgtgtctctgtg

SEQ ID NO: 273498 - DNA, 16 bp, P. troglodytes
tgcatgtgtcttcatg

SEQ ID NO: 273499 - DNA, 16 bp, P. troglodytes
tgcatgtgtgtgcaca

SEQ ID NO: 273500 - DNA, 16 bp, P. troglodytes
tgcatgtgtgtgtgga

SEQ ID NO: 273501 - DNA, 16 bp, P. troglodytes
tgcatgtgtgtgtgtg

SEQ ID NO: 273502 - DNA, 16 bp, P. troglodytes
tgcatgtgtgtttatg

SEQ ID NO: 273503 - DNA, 16 bp, P. troglodytes
tgcatgttgattttgt

SEQ ID NO: 273504 - DNA, 16 bp, P. troglodytes
tgcatgtttattttta

SEQ ID NO: 273505 - DNA, 16 bp, P. troglodytes
tgcattaaaaaaagaa

SEQ ID NO: 273506 - DNA, 16 bp, P. troglodytes
tgcattaaaaacctgt

SEQ ID NO: 273507 - DNA, 16 bp, P. troglodytes
tgcattaaagatttaa

SEQ ID NO: 273508 - DNA, 16 bp, P. troglodytes
tgcattaatgttcatc

SEQ ID NO: 273509 - DNA, 16 bp, P. troglodytes
tgcattaatttaaaaa

SEQ ID NO: 273510 - DNA, 16 bp, P. troglodytes
tgcattacatttactg

SEQ ID NO: 273511 - DNA, 16 bp, P. troglodytes
tgcattacttttgtaa

SEQ ID NO: 273512 - DNA, 16 bp, P. troglodytes
tgcattactttttaaa

SEQ ID NO: 273513 - DNA, 16 bp, P. troglodytes
tgcattagccacattt

SEQ ID NO: 273514 - DNA, 16 bp, P. troglodytes
tgcattatttatttat

SEQ ID NO: 273515 - DNA, 16 bp, P. troglodytes
tgcattatttctttct

SEQ ID NO: 273516 - DNA, 16 bp, P. troglodytes
tgcattattttatttg

SEQ ID NO: 273517 - DNA, 16 bp, P. troglodytes
tgcattcattcactca

SEQ ID NO: 273518 - DNA, 17 bp, P. troglodytes
tgcattccaacctgggc

SEQ ID NO: 273519 - DNA, 16 bp, P. troglodytes
tgcattccagcctgga

SEQ ID NO: 273520 - DNA, 16 bp, P. troglodytes
tgcattccagcctggc

SEQ ID NO: 273521 - DNA, 16 bp, P. troglodytes
tgcattccagcctggg

SEQ ID NO: 273522 - DNA, 16 bp, P. troglodytes
tgcattccagccttgg

SEQ ID NO: 273523 - DNA, 16 bp, P. troglodytes
tgcattccagtctggg

SEQ ID NO: 273524 - DNA, 16 bp, P. troglodytes
tgcattcctaacaagc

SEQ ID NO: 273525 - DNA, 16 bp, P. troglodytes
tgcattctctttctca

SEQ ID NO: 273526 - DNA, 16 bp, P. troglodytes
tgcattctggcaactg

SEQ ID NO: 273527 - DNA, 16 bp, P. troglodytes
tgcattcttttcccag

SEQ ID NO: 273528 - DNA, 17 bp, P. troglodytes
tgcattgaatttgtaga

SEQ ID NO: 273529 - DNA, 16 bp, P. troglodytes
tgcattgagcagagat

SEQ ID NO: 273530 - DNA, 16 bp, P. troglodytes
tgcattgagccaagat

SEQ ID NO: 273531 - DNA, 16 bp, P. troglodytes
tgcattgagctgagat

SEQ ID NO: 273532 - DNA, 16 bp, P. troglodytes
tgcattgatgttcatc

SEQ ID NO: 273533 - DNA, 16 bp, P. troglodytes
tgcattgctggtggga

SEQ ID NO: 273534 - DNA, 16 bp, P. troglodytes
tgcattgtgaagttct

SEQ ID NO: 273535 - DNA, 16 bp, P. troglodytes
tgcattgttttttaaa

SEQ ID NO: 273536 - DNA, 16 bp, P. troglodytes
tgcatttaaaaaaatt

SEQ ID NO: 273537 - DNA, 16 bp, P. troglodytes
tgcatttaaaaacatt

SEQ ID NO: 273538 - DNA, 16 bp, P. troglodytes
tgcatttaaatattta

SEQ ID NO: 273539 - DNA, 16 bp, P. troglodytes
tgcatttaagtttcct

SEQ ID NO: 273540 - DNA, 16 bp, P. troglodytes
tgcatttacaacttgg

SEQ ID NO: 273541 - DNA, 16 bp, P. troglodytes
tgcatttataatttta

SEQ ID NO: 273542 - DNA, 16 bp, P. troglodytes
tgcatttataattttg

SEQ ID NO: 273543 - DNA, 16 bp, P. troglodytes
tgcatttatatatgta

SEQ ID NO: 273544 - DNA, 16 bp, P. troglodytes
tgcatttatttcattt

SEQ ID NO: 273545 - DNA, 16 bp, P. troglodytes
tgcatttattttataa

SEQ ID NO: 273546 - DNA, 16 bp, P. troglodytes
tgcatttattttatta

SEQ ID NO: 273547 - DNA, 16 bp, P. troglodytes
tgcatttatttttata

SEQ ID NO: 273548 - DNA, 16 bp, P. troglodytes
tgcatttcagcctggg

SEQ ID NO: 273549 - DNA, 16 bp, P. troglodytes
tgcatttccacatgaa

SEQ ID NO: 273550 - DNA, 17 bp, P. troglodytes
tgcatttccctgatgat

SEQ ID NO: 273551 - DNA, 16 bp, P. troglodytes
tgcatttccctgatgg

SEQ ID NO: 273552 - DNA, 16 bp, P. troglodytes
tgcatttcctgaattt

SEQ ID NO: 273553 - DNA, 16 bp, P. troglodytes
tgcatttctaacaagc

SEQ ID NO: 273554 - DNA, 16 bp, P. troglodytes
tgcatttctaacaagt

SEQ ID NO: 273555 - DNA, 16 bp, P. troglodytes
tgcatttctaaccagc

SEQ ID NO: 273556 - DNA, 16 bp, P. troglodytes
tgcatttctctaacaa

SEQ ID NO: 273557 - DNA, 16 bp, P. troglodytes
tgcatttctctgggat

SEQ ID NO: 273558 - DNA, 16 bp, P. troglodytes
tgcatttctctggggt

SEQ ID NO: 273559 - DNA, 16 bp, P. troglodytes
tgcatttgacaaaggt

SEQ ID NO: 273560 - DNA, 16 bp, P. troglodytes
tgcatttggcccagga

SEQ ID NO: 273561 - DNA, 16 bp, P. troglodytes
tgcatttgtgaaagat

SEQ ID NO: 273562 - DNA, 16 bp, P. troglodytes
tgcattttaacaagac

SEQ ID NO: 273563 - DNA, 16 bp, P. troglodytes
tgcattttaacaagat

SEQ ID NO: 273564 - DNA, 16 bp, P. troglodytes
tgcattttaattttaa

SEQ ID NO: 273565 - DNA, 16 bp, P. troglodytes
tgcattttatatatat

SEQ ID NO: 273566 - DNA, 16 bp, P. troglodytes
tgcattttcaatatga

SEQ ID NO: 273567 - DNA, 16 bp, P. troglodytes
tgcattttcattttaa

SEQ ID NO: 273568 - DNA, 16 bp, P. troglodytes
tgcattttctaatttt

SEQ ID NO: 273569 - DNA, 16 bp, P. troglodytes
tgcattttctcattta

SEQ ID NO: 273570 - DNA, 16 bp, P. troglodytes
tgcattttcttccttt

SEQ ID NO: 273571 - DNA, 16 bp, P. troglodytes
tgcatttttaaaaaaa

SEQ ID NO: 273572 - DNA, 16 bp, P. troglodytes
tgcatttttaaaaggt

SEQ ID NO: 273573 - DNA, 16 bp, P. troglodytes
tgcatttttaataagc

SEQ ID NO: 273574 - DNA, 16 bp, P. troglodytes
tgcatttttacatttg

SEQ ID NO: 273575 - DNA, 16 bp, P. troglodytes
tgcatttttagaagag

SEQ ID NO: 273576 - DNA, 16 bp, P. troglodytes
tgcatttttctaatgg

SEQ ID NO: 273577 - DNA, 16 bp, P. troglodytes
tgcatttttgataact

SEQ ID NO: 273578 - DNA, 16 bp, P. troglodytes
tgcattttttaaaaaa

SEQ ID NO: 273579 - DNA, 16 bp, P. troglodytes
tgcattttttacaaat

SEQ ID NO: 273580 - DNA, 16 bp, P. troglodytes
tgccaaaaactggaag

SEQ ID NO: 273581 - DNA, 16 bp, P. troglodytes
tgccaaaaagaaagaa

SEQ ID NO: 273582 - DNA, 16 bp, P. troglodytes
tgccaaaaaggttggg

SEQ ID NO: 273583 - DNA, 16 bp, P. troglodytes
tgccaaaaccccatct

SEQ ID NO: 273584 - DNA, 16 bp, P. troglodytes
tgccaaaacttggaag

SEQ ID NO: 273585 - DNA, 16 bp, P. troglodytes
tgccaaaagagattaa

SEQ ID NO: 273586 - DNA, 16 bp, P. troglodytes
tgccaaacccattctt

SEQ ID NO: 273587 - DNA, 16 bp, P. troglodytes
tgccaaagaagaaaac

SEQ ID NO: 273588 - DNA, 16 bp, P. troglodytes
tgccaaagagaagctg

SEQ ID NO: 273589 - DNA, 16 bp, P. troglodytes
tgccaaaggtaattta

SEQ ID NO: 273590 - DNA, 16 bp, P. troglodytes
tgccaaagtcacacag

SEQ ID NO: 273591 - DNA, 16 bp, P. troglodytes
tgccaaagttgagaaa

SEQ ID NO: 273592 - DNA, 16 bp, P. troglodytes
tgccaaatctactctg

SEQ ID NO: 273593 - DNA, 16 bp, P. troglodytes
tgccaaatgttccctg

SEQ ID NO: 273594 - DNA, 16 bp, P. troglodytes
tgccaaattgcaaaga

SEQ ID NO: 273595 - DNA, 16 bp, P. troglodytes
tgccaaatttgggaaa

SEQ ID NO: 273596 - DNA, 16 bp, P. troglodytes
tgccaacaccttgatt

SEQ ID NO: 273597 - DNA, 16 bp, P. troglodytes
tgccaacatcattttt

SEQ ID NO: 273598 - DNA, 16 bp, P. troglodytes
tgccaacatcctgctt

SEQ ID NO: 273599 - DNA, 16 bp, P. troglodytes
tgccaacatggtgaaa

SEQ ID NO: 273600 - DNA, 16 bp, P. troglodytes
tgccaagaccattcag

SEQ ID NO: 273601 - DNA, 16 bp, P. troglodytes
tgccaagattgagaaa

SEQ ID NO: 273602 - DNA, 16 bp, P. troglodytes
tgccaagcactgagct

SEQ ID NO: 273603 - DNA, 16 bp, P. troglodytes
tgccaagcactgctct

SEQ ID NO: 273604 - DNA, 16 bp, P. troglodytes
tgccaagccctgtgct

SEQ ID NO: 273605 - DNA, 17 bp, P. troglodytes
tgccaaggcaggcggat

SEQ ID NO: 273606 - DNA, 16 bp, P. troglodytes
tgccaagtgaaggggg

SEQ ID NO: 273607 - DNA, 16 bp, P. troglodytes
tgccaatagacttgct

SEQ ID NO: 273608 - DNA, 16 bp, P. troglodytes
tgccaatatcacactg

SEQ ID NO: 273609 - DNA, 16 bp, P. troglodytes
tgccaatatttaaaaa

SEQ ID NO: 273610 - DNA, 16 bp, P. troglodytes
tgccaatttttgtttt

SEQ ID NO: 273611 - DNA, 16 bp, P. troglodytes
tgccacaaaagcaaaa

SEQ ID NO: 273612 - DNA, 16 bp, P. troglodytes
tgccacaacgcccggc

SEQ ID NO: 273613 - DNA, 16 bp, P. troglodytes
tgccacaataaacata

SEQ ID NO: 273614 - DNA, 16 bp, P. troglodytes
tgccacacacctttaa

SEQ ID NO: 273615 - DNA, 16 bp, P. troglodytes
tgccacactgcactcc

SEQ ID NO: 273616 - DNA, 16 bp, P. troglodytes
tgccacagaaatacaa

SEQ ID NO: 273617 - DNA, 16 bp, P. troglodytes
tgccacagcactgcag

SEQ ID NO: 273618 - DNA, 16 bp, P. troglodytes
tgccacagcattccag

SEQ ID NO: 273619 - DNA, 16 bp, P. troglodytes
tgccacagtaaacata

SEQ ID NO: 273620 - DNA, 16 bp, P. troglodytes
tgccacataatgatgt

SEQ ID NO: 273621 - DNA, 16 bp, P. troglodytes
tgccacattgtcttcc

SEQ ID NO: 273622 - DNA, 16 bp, P. troglodytes
tgccacatttacttta

SEQ ID NO: 273623 - DNA, 16 bp, P. troglodytes
tgccacattttctcta

SEQ ID NO: 273624 - DNA, 26 bp, P. troglodytes
tgccacattttcttaatccagtctac

SEQ ID NO: 273625 - DNA, 16 bp, P. troglodytes
tgccacattttcttat

SEQ ID NO: 273626 - DNA, 16 bp, P. troglodytes
tgccaccaagcccagc

SEQ ID NO: 273627 - DNA, 17 bp, P. troglodytes
tgccaccaagcccagct

SEQ ID NO: 273628 - DNA, 17 bp, P. troglodytes
tgccaccacacctggct

SEQ ID NO: 273629 - DNA, 16 bp, P. troglodytes
tgccaccacatctagc

SEQ ID NO: 273630 - DNA, 16 bp, P. troglodytes
tgccaccacccccagc

SEQ ID NO: 273631 - DNA, 16 bp, P. troglodytes
tgccaccacccccggc

SEQ ID NO: 273632 - DNA, 16 bp, P. troglodytes
tgccaccacgcccacc

SEQ ID NO: 273633 - DNA, 19 bp, P. troglodytes
tgccaccacgcctggctag

SEQ ID NO: 273634 - DNA, 16 bp, P. troglodytes
tgccaccacggccagc

SEQ ID NO: 273635 - DNA, 16 bp, P. troglodytes
tgccaccactgctgct

SEQ ID NO: 273636 - DNA, 16 bp, P. troglodytes
tgccaccagaggtgga

SEQ ID NO: 273637 - DNA, 16 bp, P. troglodytes
tgccaccaggcctggt

SEQ ID NO: 273638 - DNA, 17 bp, P. troglodytes
tgccaccatacccagct

SEQ ID NO: 273639 - DNA, 17 bp, P. troglodytes
tgccaccatccacataa

SEQ ID NO: 273640 - DNA, 16 bp, P. troglodytes
tgccaccatgaccagc

SEQ ID NO: 273641 - DNA, 17 bp, P. troglodytes
tgccaccatgcccagcc

SEQ ID NO: 273642 - DNA, 16 bp, P. troglodytes
tgccaccatgtaaaaa

SEQ ID NO: 273643 - DNA, 16 bp, P. troglodytes
tgccacccttccccca

SEQ ID NO: 273644 - DNA, 16 bp, P. troglodytes
tgccaccgtgcccagc

SEQ ID NO: 273645 - DNA, 16 bp, P. troglodytes
tgccacctcagccttc

SEQ ID NO: 273646 - DNA, 16 bp, P. troglodytes
tgccacctccaccttc

SEQ ID NO: 273647 - DNA, 16 bp, P. troglodytes
tgccacctcctcctcc

SEQ ID NO: 273648 - DNA, 16 bp, P. troglodytes
tgccacctttgcctcc

SEQ ID NO: 273649 - DNA, 16 bp, P. troglodytes
tgccactacacttcag

SEQ ID NO: 273650 - DNA, 16 bp, P. troglodytes
tgccactaccatgctg

SEQ ID NO: 273651 - DNA, 16 bp, P. troglodytes
tgccactatgccaggc

SEQ ID NO: 273652 - DNA, 16 bp, P. troglodytes
tgccactccactccag

SEQ ID NO: 273653 - DNA, 16 bp, P. troglodytes
tgccactcccagctaa

SEQ ID NO: 273654 - DNA, 16 bp, P. troglodytes
tgccactgaactgcac

SEQ ID NO: 273655 - DNA, 16 bp, P. troglodytes
tgccactgaattgtat

SEQ ID NO: 273656 - DNA, 16 bp, P. troglodytes
tgccactgcaccctgc

SEQ ID NO: 273657 - DNA, 16 bp, P. troglodytes
tgccactgcacgccag

SEQ ID NO: 273658 - DNA, 16 bp, P. troglodytes
tgccactgcactccta

SEQ ID NO: 273659 - DNA, 16 bp, P. troglodytes
tgccactgctctccag

SEQ ID NO: 273660 - DNA, 16 bp, P. troglodytes
tgccactgctgctggc

SEQ ID NO: 273661 - DNA, 16 bp, P. troglodytes
tgccactgctggcttg

SEQ ID NO: 273662 - DNA, 16 bp, P. troglodytes
tgccactggactccag

SEQ ID NO: 273663 - DNA, 16 bp, P. troglodytes
tgccactggcatctag

SEQ ID NO: 273664 - DNA, 16 bp, P. troglodytes
tgccactgtgcccagc

SEQ ID NO: 273665 - DNA, 16 bp, P. troglodytes
tgccactgtgcccggc

SEQ ID NO: 273666 - DNA, 16 bp, P. troglodytes
tgccactgtgctccag

SEQ ID NO: 273667 - DNA, 16 bp, P. troglodytes
tgccacttcctagctg

SEQ ID NO: 273668 - DNA, 16 bp, P. troglodytes
tgccagaattcttgtg

SEQ ID NO: 273669 - DNA, 16 bp, P. troglodytes
tgccagaccctgtgct

SEQ ID NO: 273670 - DNA, 16 bp, P. troglodytes
tgccagaggagattga

SEQ ID NO: 273671 - DNA, 16 bp, P. troglodytes
tgccagatactgtgct

SEQ ID NO: 273672 - DNA, 19 bp, P. troglodytes
tgccagcacagcagtctga

SEQ ID NO: 273673 - DNA, 16 bp, P. troglodytes
tgccagcaccatgctg

SEQ ID NO: 273674 - DNA, 16 bp, P. troglodytes
tgccagcacctggagc

SEQ ID NO: 273675 - DNA, 16 bp, P. troglodytes
tgccagcagctgtgcc

SEQ ID NO: 273676 - DNA, 16 bp, P. troglodytes
tgccagcatacatttt

SEQ ID NO: 273677 - DNA, 16 bp, P. troglodytes
tgccagcatctgctgt

SEQ ID NO: 273678 - DNA, 16 bp, P. troglodytes
tgccagcatctgcttg

SEQ ID NO: 273679 - DNA, 16 bp, P. troglodytes
tgccagcctccacaat

SEQ ID NO: 273680 - DNA, 16 bp, P. troglodytes
tgccagcctcggcctc

SEQ ID NO: 273681 - DNA, 16 bp, P. troglodytes
tgccagcctctttgct

SEQ ID NO: 273682 - DNA, 16 bp, P. troglodytes
tgccagcctgagcaac

SEQ ID NO: 273683 - DNA, 16 bp, P. troglodytes
tgccagcctgggcgac

SEQ ID NO: 273684 - DNA, 16 bp, P. troglodytes
tgccagctacttggga

SEQ ID NO: 273685 - DNA, 16 bp, P. troglodytes
tgccagctcatgtcat

SEQ ID NO: 273686 - DNA, 16 bp, P. troglodytes
tgccagctcctctttg

SEQ ID NO: 273687 - DNA, 16 bp, P. troglodytes
tgccagctgaggacag

SEQ ID NO: 273688 - DNA, 16 bp, P. troglodytes
tgccagctgcagtggg

SEQ ID NO: 273689 - DNA, 16 bp, P. troglodytes
tgccaggaactggggg

SEQ ID NO: 273690 - DNA, 16 bp, P. troglodytes
tgccaggagctgaggg

SEQ ID NO: 273691 - DNA, 16 bp, P. troglodytes
tgccaggagctggggg

SEQ ID NO: 273692 - DNA, 16 bp, P. troglodytes
tgccaggagtttgaga

SEQ ID NO: 273693 - DNA, 16 bp, P. troglodytes
tgccaggcaccgtgct

SEQ ID NO: 273694 - DNA, 16 bp, P. troglodytes
tgccaggcactatcct

SEQ ID NO: 273695 - DNA, 16 bp, P. troglodytes
tgccaggcactgagct

SEQ ID NO: 273696 - DNA, 16 bp, P. troglodytes
tgccaggcactgtgct

SEQ ID NO: 273697 - DNA, 16 bp, P. troglodytes
tgccaggcactgtggc

SEQ ID NO: 273698 - DNA, 16 bp, P. troglodytes
tgccaggcactgttct

SEQ ID NO: 273699 - DNA, 16 bp, P. troglodytes
tgccaggcagggtggc

SEQ ID NO: 273700 - DNA, 16 bp, P. troglodytes
tgccaggcatggtggc

SEQ ID NO: 273701 - DNA, 16 bp, P. troglodytes
tgccaggcatttttct

SEQ ID NO: 273702 - DNA, 16 bp, P. troglodytes
tgccaggccccacctc

SEQ ID NO: 273703 - DNA, 16 bp, P. troglodytes
tgccaggctcaagcga

SEQ ID NO: 273704 - DNA, 16 bp, P. troglodytes
tgccaggctctgtgct

SEQ ID NO: 273705 - DNA, 16 bp, P. troglodytes
tgccaggctgcagtgc

SEQ ID NO: 273706 - DNA, 16 bp, P. troglodytes
tgccaggctggagtgt

SEQ ID NO: 273707 - DNA, 16 bp, P. troglodytes
tgccaggctggcctca

SEQ ID NO: 273708 - DNA, 16 bp, P. troglodytes
tgccagggagaagcaa

SEQ ID NO: 273709 - DNA, 16 bp, P. troglodytes
tgccagggcctggagg

SEQ ID NO: 273710 - DNA, 16 bp, P. troglodytes
tgccaggggctgagga

SEQ ID NO: 273711 - DNA, 16 bp, P. troglodytes
tgccaggggctggggg

SEQ ID NO: 273712 - DNA, 16 bp, P. troglodytes
tgccaggggctgtggg

SEQ ID NO: 273713 - DNA, 16 bp, P. troglodytes
tgccagtagcaccccc

SEQ ID NO: 273714 - DNA, 16 bp, P. troglodytes
tgccagtgccctccag

SEQ ID NO: 273715 - DNA, 16 bp, P. troglodytes
tgccagtttttaaaat

SEQ ID NO: 273716 - DNA, 16 bp, P. troglodytes
tgccagtttttcaaag

SEQ ID NO: 273717 - DNA, 16 bp, P. troglodytes
tgccataagaaaatac

SEQ ID NO: 273718 - DNA, 16 bp, P. troglodytes
tgccatattttctttt

SEQ ID NO: 273719 - DNA, 16 bp, P. troglodytes
tgccatattttgtttt

SEQ ID NO: 273720 - DNA, 19 bp, P. troglodytes
tgccatcacgcccggctaa

SEQ ID NO: 273721 - DNA, 16 bp, P. troglodytes
tgccatcactttggga

SEQ ID NO: 273722 - DNA, 16 bp, P. troglodytes
tgccatcatgtgaaga

SEQ ID NO: 273723 - DNA, 16 bp, P. troglodytes
tgccatcctcctgcct

SEQ ID NO: 273724 - DNA, 16 bp, P. troglodytes
tgccatcttcttctgg

SEQ ID NO: 273725 - DNA, 16 bp, P. troglodytes
tgccatgatcacagct

SEQ ID NO: 273726 - DNA, 16 bp, P. troglodytes
tgccatgcccagctaa

SEQ ID NO: 273727 - DNA, 16 bp, P. troglodytes
tgccatggcatttata

SEQ ID NO: 273728 - DNA, 16 bp, P. troglodytes
tgccatggtctcagtg

SEQ ID NO: 273729 - DNA, 16 bp, P. troglodytes
tgccatgttgtccaag

SEQ ID NO: 273730 - DNA, 16 bp, P. troglodytes
tgccatgtttattgca

SEQ ID NO: 273731 - DNA, 16 bp, P. troglodytes
tgccattaatttgttc

SEQ ID NO: 273732 - DNA, 16 bp, P. troglodytes
tgccattatttttatt

SEQ ID NO: 273733 - DNA, 16 bp, P. troglodytes
tgccattgcaccccag

SEQ ID NO: 273734 - DNA, 16 bp, P. troglodytes
tgccattgcactccag

SEQ ID NO: 273735 - DNA, 16 bp, P. troglodytes
tgccattgccaaggct

SEQ ID NO: 273736 - DNA, 16 bp, P. troglodytes
tgccattgtactccag

SEQ ID NO: 273737 - DNA, 16 bp, P. troglodytes
tgccatttgcagcaac

SEQ ID NO: 273738 - DNA, 16 bp, P. troglodytes
tgccatttgccacaac

SEQ ID NO: 273739 - DNA, 16 bp, P. troglodytes
tgccattttatatcag

SEQ ID NO: 273740 - DNA, 16 bp, P. troglodytes
tgccattttattttta

SEQ ID NO: 273741 - DNA, 16 bp, P. troglodytes
tgccattttcccaaca

SEQ ID NO: 273742 - DNA, 16 bp, P. troglodytes
tgccatttttcaaagg

SEQ ID NO: 273743 - DNA, 16 bp, P. troglodytes
tgcccaaaatgctgat

SEQ ID NO: 273744 - DNA, 16 bp, P. troglodytes
tgcccaaagtcacaca

SEQ ID NO: 273745 - DNA, 16 bp, P. troglodytes
tgcccaaagtgctagg

SEQ ID NO: 273746 - DNA, 16 bp, P. troglodytes
tgcccaagaagctgct

SEQ ID NO: 273747 - DNA, 16 bp, P. troglodytes
tgcccaagctggagag

SEQ ID NO: 273748 - DNA, 16 bp, P. troglodytes
tgcccaataaatgttt

SEQ ID NO: 273749 - DNA, 16 bp, P. troglodytes
tgcccacaagaaaaag

SEQ ID NO: 273750 - DNA, 17 bp, P. troglodytes
tgcccacaagggaaagc

SEQ ID NO: 273751 - DNA, 16 bp, P. troglodytes
tgcccacacctatgtc

SEQ ID NO: 273752 - DNA, 16 bp, P. troglodytes
tgcccaccacacccag

SEQ ID NO: 273753 - DNA, 16 bp, P. troglodytes
tgcccaccaccaccac

SEQ ID NO: 273754 - DNA, 16 bp, P. troglodytes
tgcccaccaccaggcc

SEQ ID NO: 273755 - DNA, 16 bp, P. troglodytes
tgcccaccaccatgca

SEQ ID NO: 273756 - DNA, 17 bp, P. troglodytes
tgcccaccaccatgccc

SEQ ID NO: 273757 - DNA, 16 bp, P. troglodytes
tgcccaccacctcacc

SEQ ID NO: 273758 - DNA, 16 bp, P. troglodytes
tgcccaccacggcctc

SEQ ID NO: 273759 - DNA, 16 bp, P. troglodytes
tgcccaccatcacacc

SEQ ID NO: 273760 - DNA, 16 bp, P. troglodytes
tgcccacccacactga

SEQ ID NO: 273761 - DNA, 16 bp, P. troglodytes
tgcccaccctgctgca

SEQ ID NO: 273762 - DNA, 16 bp, P. troglodytes
tgcccaccctggctcc

SEQ ID NO: 273763 - DNA, 16 bp, P. troglodytes
tgcccacctccacctc

SEQ ID NO: 273764 - DNA, 16 bp, P. troglodytes
tgcccacctgagccac

SEQ ID NO: 273765 - DNA, 16 bp, P. troglodytes
tgcccaccttgcctcc

SEQ ID NO: 273766 - DNA, 16 bp, P. troglodytes
tgcccacgctggaatg

SEQ ID NO: 273767 - DNA, 16 bp, P. troglodytes
tgcccagacagggcca

SEQ ID NO: 273768 - DNA, 16 bp, P. troglodytes
tgcccagactggcctt

SEQ ID NO: 273769 - DNA, 16 bp, P. troglodytes
tgcccagactggtttc

SEQ ID NO: 273770 - DNA, 16 bp, P. troglodytes
tgcccagacttcaggg

SEQ ID NO: 273771 - DNA, 16 bp, P. troglodytes
tgcccagatcttggtt

SEQ ID NO: 273772 - DNA, 17 bp, P. troglodytes
tgcccagatttcatatt

SEQ ID NO: 273773 - DNA, 16 bp, P. troglodytes
tgcccagcacacagta

SEQ ID NO: 273774 - DNA, 16 bp, P. troglodytes
tgcccagcacagagcc

SEQ ID NO: 273775 - DNA, 16 bp, P. troglodytes
tgcccagcactgtgct

SEQ ID NO: 273776 - DNA, 16 bp, P. troglodytes
tgcccagccaagaata

SEQ ID NO: 273777 - DNA, 16 bp, P. troglodytes
tgcccagcccagccca

SEQ ID NO: 273778 - DNA, 16 bp, P. troglodytes
tgcccagcccagccct

SEQ ID NO: 273779 - DNA, 16 bp, P. troglodytes
tgcccagcccctggca

SEQ ID NO: 273780 - DNA, 16 bp, P. troglodytes
tgcccagccctgattt

SEQ ID NO: 273781 - DNA, 16 bp, P. troglodytes
tgcccagccctgtgct

SEQ ID NO: 273782 - DNA, 16 bp, P. troglodytes
tgcccagcctcaattt

SEQ ID NO: 273783 - DNA, 16 bp, P. troglodytes
tgcccagcctcaggta

SEQ ID NO: 273784 - DNA, 16 bp, P. troglodytes
tgcccagcctccagaa

SEQ ID NO: 273785 - DNA, 16 bp, P. troglodytes
tgcccagcctctttct

SEQ ID NO: 273786 - DNA, 16 bp, P. troglodytes
tgcccagcctggcctg

SEQ ID NO: 273787 - DNA, 16 bp, P. troglodytes
tgcccagcctgtcttt

SEQ ID NO: 273788 - DNA, 16 bp, P. troglodytes
tgcccagcctttcttt

SEQ ID NO: 273789 - DNA, 16 bp, P. troglodytes
tgcccagctaatattt

SEQ ID NO: 273790 - DNA, 16 bp, P. troglodytes
tgcccagctctgtgcc

SEQ ID NO: 273791 - DNA, 16 bp, P. troglodytes
tgcccagctctgtgct

SEQ ID NO: 273792 - DNA, 16 bp, P. troglodytes
tgcccagcttggagtg

SEQ ID NO: 273793 - DNA, 16 bp, P. troglodytes
tgcccaggaggctgag

SEQ ID NO: 273794 - DNA, 16 bp, P. troglodytes
tgcccaggctagaggg

SEQ ID NO: 273795 - DNA, 16 bp, P. troglodytes
tgcccaggctgacctt

SEQ ID NO: 273796 - DNA, 16 bp, P. troglodytes
tgcccaggctgaggtg

SEQ ID NO: 273797 - DNA, 16 bp, P. troglodytes
tgcccaggctgatctg

SEQ ID NO: 273798 - DNA, 16 bp, P. troglodytes
tgcccaggctgccctc

SEQ ID NO: 273799 - DNA, 16 bp, P. troglodytes
tgcccaggctggcaca

SEQ ID NO: 273800 - DNA, 16 bp, P. troglodytes
tgcccaggctggcctc

SEQ ID NO: 273801 - DNA, 16 bp, P. troglodytes
tgcccaggctggcctg

SEQ ID NO: 273802 - DNA, 16 bp, P. troglodytes
tgcccaggctgggctt

SEQ ID NO: 273803 - DNA, 16 bp, P. troglodytes
tgcccaggctggtcag

SEQ ID NO: 273804 - DNA, 16 bp, P. troglodytes
tgcccaggctggtcgc

SEQ ID NO: 273805 - DNA, 16 bp, P. troglodytes
tgcccaggctggtttg

SEQ ID NO: 273806 - DNA, 16 bp, P. troglodytes
tgcccagggccagcag

SEQ ID NO: 273807 - DNA, 16 bp, P. troglodytes
tgcccaggtatttttt

SEQ ID NO: 273808 - DNA, 16 bp, P. troglodytes
tgcccaggtccacagc

SEQ ID NO: 273809 - DNA, 16 bp, P. troglodytes
tgcccaggttgcagtg

SEQ ID NO: 273810 - DNA, 16 bp, P. troglodytes
tgcccagtgaaggggg

SEQ ID NO: 273811 - DNA, 16 bp, P. troglodytes
tgcccagttcattttt

SEQ ID NO: 273812 - DNA, 16 bp, P. troglodytes
tgcccagttccaaagt

SEQ ID NO: 273813 - DNA, 16 bp, P. troglodytes
tgcccagttgtttggt

SEQ ID NO: 273814 - DNA, 16 bp, P. troglodytes
tgcccatactgcccaa

SEQ ID NO: 273815 - DNA, 16 bp, P. troglodytes
tgcccatcaatggtgg

SEQ ID NO: 273816 - DNA, 16 bp, P. troglodytes
tgcccatcagtgacag

SEQ ID NO: 273817 - DNA, 16 bp, P. troglodytes
tgcccatctcagcttc

SEQ ID NO: 273818 - DNA, 16 bp, P. troglodytes
tgcccatctctgcctc

SEQ ID NO: 273819 - DNA, 16 bp, P. troglodytes
tgcccatctgtaaaat

SEQ ID NO: 273820 - DNA, 16 bp, P. troglodytes
tgcccatctgtgtgct

SEQ ID NO: 273821 - DNA, 16 bp, P. troglodytes
tgcccatgcctatgcc

SEQ ID NO: 273822 - DNA, 16 bp, P. troglodytes
tgcccatgctgaaggt

SEQ ID NO: 273823 - DNA, 16 bp, P. troglodytes
tgcccatgctggtctg

SEQ ID NO: 273824 - DNA, 16 bp, P. troglodytes
tgcccatggagcctca

SEQ ID NO: 273825 - DNA, 16 bp, P. troglodytes
tgcccattatttcttt

SEQ ID NO: 273826 - DNA, 16 bp, P. troglodytes
tgcccattttctaatc

SEQ ID NO: 273827 - DNA, 16 bp, P. troglodytes
tgcccattttgcagat

SEQ ID NO: 273828 - DNA, 16 bp, P. troglodytes
tgccccactaattttt

SEQ ID NO: 273829 - DNA, 16 bp, P. troglodytes
tgccccactcatgcct

SEQ ID NO: 273830 - DNA, 17 bp, P. troglodytes
tgccccactgcactcca

SEQ ID NO: 273831 - DNA, 16 bp, P. troglodytes
tgccccagaacttaaa

SEQ ID NO: 273832 - DNA, 16 bp, P. troglodytes
tgccccagccagcagt

SEQ ID NO: 273833 - DNA, 16 bp, P. troglodytes
tgccccagcccccagc

SEQ ID NO: 273834 - DNA, 16 bp, P. troglodytes
tgccccagcccctggc

SEQ ID NO: 273835 - DNA, 16 bp, P. troglodytes
tgccccagcctcccaa

SEQ ID NO: 273836 - DNA, 16 bp, P. troglodytes
tgccccagctcctgca

SEQ ID NO: 273837 - DNA, 16 bp, P. troglodytes
tgccccagctggagta

SEQ ID NO: 273838 - DNA, 16 bp, P. troglodytes
tgcccccacacctggc

SEQ ID NO: 273839 - DNA, 16 bp, P. troglodytes
tgcccccacctcagcc

SEQ ID NO: 273840 - DNA, 16 bp, P. troglodytes
tgccccccagcctggg

SEQ ID NO: 273841 - DNA, 16 bp, P. troglodytes
tgccccctgacccctt

SEQ ID NO: 273842 - DNA, 16 bp, P. troglodytes
tgcccctcacctccca

SEQ ID NO: 273843 - DNA, 16 bp, P. troglodytes
tgcccctcctccagcc

SEQ ID NO: 273844 - DNA, 16 bp, P. troglodytes
tgcccctctcccagaa

SEQ ID NO: 273845 - DNA, 16 bp, P. troglodytes
tgcccctctgagacaa

SEQ ID NO: 273846 - DNA, 16 bp, P. troglodytes
tgcccctgaagacctt

SEQ ID NO: 273847 - DNA, 16 bp, P. troglodytes
tgcccctgacccctcc

SEQ ID NO: 273848 - DNA, 16 bp, P. troglodytes
tgcccctgcctctgcc

SEQ ID NO: 273849 - DNA, 16 bp, P. troglodytes
tgcccctggcctctcc

SEQ ID NO: 273850 - DNA, 16 bp, P. troglodytes
tgcccctggctcctcc

SEQ ID NO: 273851 - DNA, 16 bp, P. troglodytes
tgcccctgtcctagag

SEQ ID NO: 273852 - DNA, 16 bp, P. troglodytes
tgcccctgtttgcaga

SEQ ID NO: 273853 - DNA, 16 bp, P. troglodytes
tgcccgactgattttt

SEQ ID NO: 273854 - DNA, 16 bp, P. troglodytes
tgcccggccaccccat

SEQ ID NO: 273855 - DNA, 16 bp, P. troglodytes
tgccctaaaagacctc

SEQ ID NO: 273856 - DNA, 16 bp, P. troglodytes
tgccctcaaagagctc

SEQ ID NO: 273857 - DNA, 16 bp, P. troglodytes
tgccctcatgaagttt

SEQ ID NO: 273858 - DNA, 16 bp, P. troglodytes
tgccctccagacccca

SEQ ID NO: 273859 - DNA, 16 bp, P. troglodytes
tgccctccagcctgga

SEQ ID NO: 273860 - DNA, 16 bp, P. troglodytes
tgccctccagcctggg

SEQ ID NO: 273861 - DNA, 16 bp, P. troglodytes
tgccctccagctccat

SEQ ID NO: 273862 - DNA, 16 bp, P. troglodytes
tgccctccaggagctt

SEQ ID NO: 273863 - DNA, 16 bp, P. troglodytes
tgccctccagtctggg

SEQ ID NO: 273864 - DNA, 16 bp, P. troglodytes
tgccctccatgggctg

SEQ ID NO: 273865 - DNA, 16 bp, P. troglodytes
tgccctccctcaccac

SEQ ID NO: 273866 - DNA, 17 bp, P. troglodytes
tgccctcctcagcctcc

SEQ ID NO: 273867 - DNA, 16 bp, P. troglodytes
tgccctcctctaccca

SEQ ID NO: 273868 - DNA, 16 bp, P. troglodytes
tgccctcctgggcctc

SEQ ID NO: 273869 - DNA, 16 bp, P. troglodytes
tgccctcgaacattgg

SEQ ID NO: 273870 - DNA, 16 bp, P. troglodytes
tgccctctctgggcct

SEQ ID NO: 273871 - DNA, 16 bp, P. troglodytes
tgccctctggtggcca

SEQ ID NO: 273872 - DNA, 16 bp, P. troglodytes
tgccctgcacagcctc

SEQ ID NO: 273873 - DNA, 16 bp, P. troglodytes
tgccctgcagcctggg

SEQ ID NO: 273874 - DNA, 16 bp, P. troglodytes
tgccctgcagggaggc

SEQ ID NO: 273875 - DNA, 16 bp, P. troglodytes
tgccctgcccacagag

SEQ ID NO: 273876 - DNA, 16 bp, P. troglodytes
tgccctgcccagaaag

SEQ ID NO: 273877 - DNA, 16 bp, P. troglodytes
tgccctgcccccagag

SEQ ID NO: 273878 - DNA, 16 bp, P. troglodytes
tgccctgcctccagag

SEQ ID NO: 273879 - DNA, 16 bp, P. troglodytes
tgccctgctgcccagg

SEQ ID NO: 273880 - DNA, 16 bp, P. troglodytes
tgccctgctgctcaaa

SEQ ID NO: 273881 - DNA, 16 bp, P. troglodytes
tgccctggctgaagtg

SEQ ID NO: 273882 - DNA, 16 bp, P. troglodytes
tgccctggctggtctt

SEQ ID NO: 273883 - DNA, 16 bp, P. troglodytes
tgccctggctggtgtc

SEQ ID NO: 273884 - DNA, 16 bp, P. troglodytes
tgccctgggcaccctc

SEQ ID NO: 273885 - DNA, 16 bp, P. troglodytes
tgcccttatggagctt

SEQ ID NO: 273886 - DNA, 16 bp, P. troglodytes
tgcccttctcctgcct

SEQ ID NO: 273887 - DNA, 16 bp, P. troglodytes
tgcccttgaacattgg

SEQ ID NO: 273888 - DNA, 16 bp, P. troglodytes
tgcccttgaattcttt

SEQ ID NO: 273889 - DNA, 16 bp, P. troglodytes
tgcccttggacattgg

SEQ ID NO: 273890 - DNA, 16 bp, P. troglodytes
tgccctttctccacta

SEQ ID NO: 273891 - DNA, 16 bp, P. troglodytes
tgccctttgcaggaac

SEQ ID NO: 273892 - DNA, 16 bp, P. troglodytes
tgccctttgtcttcca

SEQ ID NO: 273893 - DNA, 16 bp, P. troglodytes
tgccgcaataaacata

SEQ ID NO: 273894 - DNA, 16 bp, P. troglodytes
tgccgccacgcccagc

SEQ ID NO: 273895 - DNA, 16 bp, P. troglodytes
tgccgccatgcccagc

SEQ ID NO: 273896 - DNA, 16 bp, P. troglodytes
tgccgcccaggctgga

SEQ ID NO: 273897 - DNA, 16 bp, P. troglodytes
tgccgcgatctcggct

SEQ ID NO: 273898 - DNA, 16 bp, P. troglodytes
tgccggcagctgtgcc

SEQ ID NO: 273899 - DNA, 16 bp, P. troglodytes
tgccggtgcaggtcct

SEQ ID NO: 273900 - DNA, 18 bp, P. troglodytes
tgccgtgagccgagatca

SEQ ID NO: 273901 - DNA, 16 bp, P. troglodytes
tgcctaattcttcctg

SEQ ID NO: 273902 - DNA, 16 bp, P. troglodytes
tgcctaatttgtaaat

SEQ ID NO: 273903 - DNA, 16 bp, P. troglodytes
tgcctaatttttgtat

SEQ ID NO: 273904 - DNA, 16 bp, P. troglodytes
tgcctacaatcccagc

SEQ ID NO: 273905 - DNA, 16 bp, P. troglodytes
tgcctacagtattcag

SEQ ID NO: 273906 - DNA, 16 bp, P. troglodytes
tgcctacatcaaaaat

SEQ ID NO: 273907 - DNA, 16 bp, P. troglodytes
tgcctacatttaaaaa

SEQ ID NO: 273908 - DNA, 16 bp, P. troglodytes
tgcctagcacatagtg

SEQ ID NO: 273909 - DNA, 16 bp, P. troglodytes
tgcctagcatagtgcc

SEQ ID NO: 273910 - DNA, 16 bp, P. troglodytes
tgcctaggctgatctc

SEQ ID NO: 273911 - DNA, 16 bp, P. troglodytes
tgcctaggctggactt

SEQ ID NO: 273912 - DNA, 27 bp, P. troglodytes
tgcctaggttttcttctagggttttta

SEQ ID NO: 273913 - DNA, 16 bp, P. troglodytes
tgcctagtacatagta

SEQ ID NO: 273914 - DNA, 16 bp, P. troglodytes
tgcctagtggagcttt

SEQ ID NO: 273915 - DNA, 17 bp, P. troglodytes
tgcctataatcccagcc

SEQ ID NO: 273916 - DNA, 16 bp, P. troglodytes
tgcctataatcccatc

SEQ ID NO: 273917 - DNA, 16 bp, P. troglodytes
tgcctatggagtagcc

SEQ ID NO: 273918 - DNA, 16 bp, P. troglodytes
tgcctcaaaaagaaaa

SEQ ID NO: 273919 - DNA, 16 bp, P. troglodytes
tgcctcaacctctcca

SEQ ID NO: 273920 - DNA, 16 bp, P. troglodytes
tgcctcaatttcagaa

SEQ ID NO: 273921 - DNA, 16 bp, P. troglodytes
tgcctcaccagggaag

SEQ ID NO: 273922 - DNA, 16 bp, P. troglodytes
tgcctcacctcccgag

SEQ ID NO: 273923 - DNA, 16 bp, P. troglodytes
tgcctcactctcctga

SEQ ID NO: 273924 - DNA, 16 bp, P. troglodytes
tgcctcagaaaaaaaa

SEQ ID NO: 273925 - DNA, 16 bp, P. troglodytes
tgcctcagcccccaca

SEQ ID NO: 273926 - DNA, 16 bp, P. troglodytes
tgcctcagccccccaa

SEQ ID NO: 273927 - DNA, 16 bp, P. troglodytes
tgcctcagcctccaca

SEQ ID NO: 273928 - DNA, 16 bp, P. troglodytes
tgcctcagcctccatg

SEQ ID NO: 273929 - DNA, 17 bp, P. troglodytes
tgcctcagcctcccaac

SEQ ID NO: 273930 - DNA, 16 bp, P. troglodytes
tgcctcagcctccgaa

SEQ ID NO: 273931 - DNA, 16 bp, P. troglodytes
tgcctcagcctcctac

SEQ ID NO: 273932 - DNA, 16 bp, P. troglodytes
tgcctcagcctcggga

SEQ ID NO: 273933 - DNA, 16 bp, P. troglodytes
tgcctcagcctcttca

SEQ ID NO: 273934 - DNA, 16 bp, P. troglodytes
tgcctcagccttctca

SEQ ID NO: 273935 - DNA, 16 bp, P. troglodytes
tgcctcagctacctga

SEQ ID NO: 273936 - DNA, 16 bp, P. troglodytes
tgcctcagctgcctga

SEQ ID NO: 273937 - DNA, 16 bp, P. troglodytes
tgcctcagcttcccga

SEQ ID NO: 273938 - DNA, 16 bp, P. troglodytes
tgcctcaggctcccag

SEQ ID NO: 273939 - DNA, 16 bp, P. troglodytes
tgcctcagggccttgg

SEQ ID NO: 273940 - DNA, 16 bp, P. troglodytes
tgcctcagggcctttg

SEQ ID NO: 273941 - DNA, 16 bp, P. troglodytes
tgcctcagtcccccaa

SEQ ID NO: 273942 - DNA, 16 bp, P. troglodytes
tgcctcagtttattca

SEQ ID NO: 273943 - DNA, 16 bp, P. troglodytes
tgcctcagtttcccag

SEQ ID NO: 273944 - DNA, 16 bp, P. troglodytes
tgcctcagtttcccca

SEQ ID NO: 273945 - DNA, 17 bp, P. troglodytes
tgcctcagtttccccac

SEQ ID NO: 273946 - DNA, 17 bp, P. troglodytes
tgcctcagtttccccag

SEQ ID NO: 273947 - DNA, 16 bp, P. troglodytes
tgcctcagtttcccct

SEQ ID NO: 273948 - DNA, 16 bp, P. troglodytes
tgcctcagtttcccta

SEQ ID NO: 273949 - DNA, 16 bp, P. troglodytes
tgcctcagtttccctt

SEQ ID NO: 273950 - DNA, 16 bp, P. troglodytes
tgcctcagtttcctca

SEQ ID NO: 273951 - DNA, 16 bp, P. troglodytes
tgcctcagtttcctga

SEQ ID NO: 273952 - DNA, 16 bp, P. troglodytes
tgcctcagtttcctgt

SEQ ID NO: 273953 - DNA, 16 bp, P. troglodytes
tgcctcagtttctccc

SEQ ID NO: 273954 - DNA, 16 bp, P. troglodytes
tgcctccatgatccaa

SEQ ID NO: 273955 - DNA, 16 bp, P. troglodytes
tgcctccatttgcctt

SEQ ID NO: 273956 - DNA, 16 bp, P. troglodytes
tgcctcccaaagttct

SEQ ID NO: 273957 - DNA, 16 bp, P. troglodytes
tgcctcccaagcagct

SEQ ID NO: 273958 - DNA, 16 bp, P. troglodytes
tgcctcccacccccag

SEQ ID NO: 273959 - DNA, 16 bp, P. troglodytes
tgcctcccactgccat

SEQ ID NO: 273960 - DNA, 16 bp, P. troglodytes
tgcctcccaggttcga

SEQ ID NO: 273961 - DNA, 16 bp, P. troglodytes
tgcctcccctgctgca

SEQ ID NO: 273962 - DNA, 16 bp, P. troglodytes
tgcctcctctcctcca

SEQ ID NO: 273963 - DNA, 16 bp, P. troglodytes
tgcctcctgaagtgct

SEQ ID NO: 273964 - DNA, 16 bp, P. troglodytes
tgcctcctgagcagct

SEQ ID NO: 273965 - DNA, 16 bp, P. troglodytes
tgcctcctgagctcaa

SEQ ID NO: 273966 - DNA, 17 bp, P. troglodytes
tgcctcctggattccag

SEQ ID NO: 273967 - DNA, 16 bp, P. troglodytes
tgcctcctgtctgcca

SEQ ID NO: 273968 - DNA, 16 bp, P. troglodytes
tgcctcctgtgctcaa

SEQ ID NO: 273969 - DNA, 16 bp, P. troglodytes
tgcctccttgcagttt

SEQ ID NO: 273970 - DNA, 16 bp, P. troglodytes
tgcctcctttggaaaa

SEQ ID NO: 273971 - DNA, 16 bp, P. troglodytes
tgcctcgccctgcttc

SEQ ID NO: 273972 - DNA, 16 bp, P. troglodytes
tgcctcggcctccaga

SEQ ID NO: 273973 - DNA, 16 bp, P. troglodytes
tgcctcggcctcccca

SEQ ID NO: 273974 - DNA, 16 bp, P. troglodytes
tgcctcggcctcctga

SEQ ID NO: 273975 - DNA, 16 bp, P. troglodytes
tgcctcggcctctcaa

SEQ ID NO: 273976 - DNA, 16 bp, P. troglodytes
tgcctcgtggtcagaa

SEQ ID NO: 273977 - DNA, 16 bp, P. troglodytes
tgcctctaaaataaat

SEQ ID NO: 273978 - DNA, 16 bp, P. troglodytes
tgcctctacactccag

SEQ ID NO: 273979 - DNA, 16 bp, P. troglodytes
tgcctctcaaagtgct

SEQ ID NO: 273980 - DNA, 16 bp, P. troglodytes
tgcctctgcccagctg

SEQ ID NO: 273981 - DNA, 16 bp, P. troglodytes
tgcctctgcctcctga

SEQ ID NO: 273982 - DNA, 16 bp, P. troglodytes
tgcctctgccttccaa

SEQ ID NO: 273983 - DNA, 16 bp, P. troglodytes
tgcctctgccttctga

SEQ ID NO: 273984 - DNA, 16 bp, P. troglodytes
tgcctctgcttcccag

SEQ ID NO: 273985 - DNA, 16 bp, P. troglodytes
tgcctctgggcctgtg

SEQ ID NO: 273986 - DNA, 16 bp, P. troglodytes
tgcctctggtcccagc

SEQ ID NO: 273987 - DNA, 16 bp, P. troglodytes
tgcctctgtgtctttg

SEQ ID NO: 273988 - DNA, 16 bp, P. troglodytes
tgcctctgtgtgtgtg

SEQ ID NO: 273989 - DNA, 16 bp, P. troglodytes
tgcctcttccaggaag

SEQ ID NO: 273990 - DNA, 16 bp, P. troglodytes
tgcctcttcctccagg

SEQ ID NO: 273991 - DNA, 16 bp, P. troglodytes
tgcctcttctccttca

SEQ ID NO: 273992 - DNA, 16 bp, P. troglodytes
tgcctcttcttctcca

SEQ ID NO: 273993 - DNA, 16 bp, P. troglodytes
tgcctcttttcctcca

SEQ ID NO: 273994 - DNA, 16 bp, P. troglodytes
tgcctgaacccaagag

SEQ ID NO: 273995 - DNA, 16 bp, P. troglodytes
tgcctgaagccaggag

SEQ ID NO: 273996 - DNA, 16 bp, P. troglodytes
tgcctgacctcaggtg

SEQ ID NO: 273997 - DNA, 16 bp, P. troglodytes
tgcctgagaaaccaga

SEQ ID NO: 273998 - DNA, 16 bp, P. troglodytes
tgcctgagctcaggaa

SEQ ID NO: 273999 - DNA, 16 bp, P. troglodytes
tgcctgaggctgcttt

SEQ ID NO: 274000 - DNA, 16 bp, P. troglodytes
tgcctgaggtcacaca

SEQ ID NO: 274001 - DNA, 16 bp, P. troglodytes
tgcctgaggtcaggag

SEQ ID NO: 274002 - DNA, 16 bp, P. troglodytes
tgcctgagtcccagct

SEQ ID NO: 274003 - DNA, 16 bp, P. troglodytes
tgcctgagtggctgct

SEQ ID NO: 274004 - DNA, 16 bp, P. troglodytes
tgcctgattgcccttg

SEQ ID NO: 274005 - DNA, 16 bp, P. troglodytes
tgcctgattgctgtgg

SEQ ID NO: 274006 - DNA, 16 bp, P. troglodytes
tgcctgcaataccagc

SEQ ID NO: 274007 - DNA, 16 bp, P. troglodytes
tgcctgcactcctcag

SEQ ID NO: 274008 - DNA, 16 bp, P. troglodytes
tgcctgcagacccagc

SEQ ID NO: 274009 - DNA, 16 bp, P. troglodytes
tgcctgcagcccagga

SEQ ID NO: 274010 - DNA, 16 bp, P. troglodytes
tgcctgcattctttgg

SEQ ID NO: 274011 - DNA, 16 bp, P. troglodytes
tgcctgccaacacgcc

SEQ ID NO: 274012 - DNA, 16 bp, P. troglodytes
tgcctgccaccacgtc

SEQ ID NO: 274013 - DNA, 16 bp, P. troglodytes
tgcctgccactgtgcc

SEQ ID NO: 274014 - DNA, 16 bp, P. troglodytes
tgcctgcccacattgg

SEQ ID NO: 274015 - DNA, 16 bp, P. troglodytes
tgcctgccccagcctc

SEQ ID NO: 274016 - DNA, 16 bp, P. troglodytes
tgcctgcctcagcttc

SEQ ID NO: 274017 - DNA, 16 bp, P. troglodytes
tgcctgcctcatcctc

SEQ ID NO: 274018 - DNA, 16 bp, P. troglodytes
tgcctgcctctccagc

SEQ ID NO: 274019 - DNA, 16 bp, P. troglodytes
tgcctgcctctgcctg

SEQ ID NO: 274020 - DNA, 16 bp, P. troglodytes
tgcctgcctctgtctc

SEQ ID NO: 274021 - DNA, 16 bp, P. troglodytes
tgcctgcctgcctccc

SEQ ID NO: 274022 - DNA, 16 bp, P. troglodytes
tgcctgcctgccttcc

SEQ ID NO: 274023 - DNA, 16 bp, P. troglodytes
tgcctgccttatttca

SEQ ID NO: 274024 - DNA, 16 bp, P. troglodytes
tgcctgccttcccttc

SEQ ID NO: 274025 - DNA, 16 bp, P. troglodytes
tgcctgccttcctttc

SEQ ID NO: 274026 - DNA, 16 bp, P. troglodytes
tgcctgccttggcctt

SEQ ID NO: 274027 - DNA, 16 bp, P. troglodytes
tgcctgccttggcttt

SEQ ID NO: 274028 - DNA, 16 bp, P. troglodytes
tgcctgctccctcttc

SEQ ID NO: 274029 - DNA, 16 bp, P. troglodytes
tgcctgctcctgctcc

SEQ ID NO: 274030 - DNA, 16 bp, P. troglodytes
tgcctgctctttcctc

SEQ ID NO: 274031 - DNA, 16 bp, P. troglodytes
tgcctgctgcagcctc

SEQ ID NO: 274032 - DNA, 16 bp, P. troglodytes
tgcctgctgccatcca

SEQ ID NO: 274033 - DNA, 16 bp, P. troglodytes
tgcctgctgccttcca

SEQ ID NO: 274034 - DNA, 16 bp, P. troglodytes
tgcctgctgctcacct

SEQ ID NO: 274035 - DNA, 16 bp, P. troglodytes
tgcctgctggctctgg

SEQ ID NO: 274036 - DNA, 16 bp, P. troglodytes
tgcctgctttatttca

SEQ ID NO: 274037 - DNA, 16 bp, P. troglodytes
tgcctgcttttgtaaa

SEQ ID NO: 274038 - DNA, 16 bp, P. troglodytes
tgcctggaaataaact

SEQ ID NO: 274039 - DNA, 16 bp, P. troglodytes
tgcctggaacaccagc

SEQ ID NO: 274040 - DNA, 16 bp, P. troglodytes
tgcctggaacatagta

SEQ ID NO: 274041 - DNA, 16 bp, P. troglodytes
tgcctggaatcccagc

SEQ ID NO: 274042 - DNA, 16 bp, P. troglodytes
tgcctggaatcccagg

SEQ ID NO: 274043 - DNA, 16 bp, P. troglodytes
tgcctggaatcctagc

SEQ ID NO: 274044 - DNA, 16 bp, P. troglodytes
tgcctggaattttttt

SEQ ID NO: 274045 - DNA, 16 bp, P. troglodytes
tgcctggagctgaggc

SEQ ID NO: 274046 - DNA, 16 bp, P. troglodytes
tgcctggagctgctgc

SEQ ID NO: 274047 - DNA, 16 bp, P. troglodytes
tgcctggatacccagg

SEQ ID NO: 274048 - DNA, 16 bp, P. troglodytes
tgcctggattcaaatc

SEQ ID NO: 274049 - DNA, 16 bp, P. troglodytes
tgcctggcacacagca

SEQ ID NO: 274050 - DNA, 16 bp, P. troglodytes
tgcctggcacacagta

SEQ ID NO: 274051 - DNA, 16 bp, P. troglodytes
tgcctggcacagagcc

SEQ ID NO: 274052 - DNA, 16 bp, P. troglodytes
tgcctggcacagagtg

SEQ ID NO: 274053 - DNA, 16 bp, P. troglodytes
tgcctggcacatagga

SEQ ID NO: 274054 - DNA, 16 bp, P. troglodytes
tgcctggcacatagta

SEQ ID NO: 274055 - DNA, 16 bp, P. troglodytes
tgcctggcacatggta

SEQ ID NO: 274056 - DNA, 16 bp, P. troglodytes
tgcctggcatatacta

SEQ ID NO: 274057 - DNA, 16 bp, P. troglodytes
tgcctggcatgcagca

SEQ ID NO: 274058 - DNA, 16 bp, P. troglodytes
tgcctggccaaaatat

SEQ ID NO: 274059 - DNA, 21 bp, P. troglodytes
tgcctggccaacatggtgaaa

SEQ ID NO: 274060 - DNA, 16 bp, P. troglodytes
tgcctggccaacattt

SEQ ID NO: 274061 - DNA, 16 bp, P. troglodytes
tgcctggccaccaccc

SEQ ID NO: 274062 - DNA, 16 bp, P. troglodytes
tgcctggcccagaatt

SEQ ID NO: 274063 - DNA, 16 bp, P. troglodytes
tgcctggccgccccgt

SEQ ID NO: 274064 - DNA, 16 bp, P. troglodytes
tgcctggcctcatttt

SEQ ID NO: 274065 - DNA, 16 bp, P. troglodytes
tgcctggcctccattt

SEQ ID NO: 274066 - DNA, 16 bp, P. troglodytes
tgcctggcctctctct

SEQ ID NO: 274067 - DNA, 16 bp, P. troglodytes
tgcctggcctcttttg

SEQ ID NO: 274068 - DNA, 16 bp, P. troglodytes
tgcctggcctggaact

SEQ ID NO: 274069 - DNA, 16 bp, P. troglodytes
tgcctggcctgggact

SEQ ID NO: 274070 - DNA, 16 bp, P. troglodytes
tgcctggccttatttt

SEQ ID NO: 274071 - DNA, 16 bp, P. troglodytes
tgcctggccttttttt

SEQ ID NO: 274072 - DNA, 16 bp, P. troglodytes
tgcctggctaagtttt

SEQ ID NO: 274073 - DNA, 16 bp, P. troglodytes
tgcctggctcatagta

SEQ ID NO: 274074 - DNA, 16 bp, P. troglodytes
tgcctggctgattttc

SEQ ID NO: 274075 - DNA, 16 bp, P. troglodytes
tgcctggctgcctggc

SEQ ID NO: 274076 - DNA, 16 bp, P. troglodytes
tgcctggcttgtttca

SEQ ID NO: 274077 - DNA, 16 bp, P. troglodytes
tgcctgggccctgccc

SEQ ID NO: 274078 - DNA, 16 bp, P. troglodytes
tgcctgggctggtctc

SEQ ID NO: 274079 - DNA, 16 bp, P. troglodytes
tgcctggggaccagac

SEQ ID NO: 274080 - DNA, 16 bp, P. troglodytes
tgcctggggtcaccca

SEQ ID NO: 274081 - DNA, 16 bp, P. troglodytes
tgcctggggtttatat

SEQ ID NO: 274082 - DNA, 16 bp, P. troglodytes
tgcctgggtcccaccc

SEQ ID NO: 274083 - DNA, 16 bp, P. troglodytes
tgcctgggttcaaatc

SEQ ID NO: 274084 - DNA, 16 bp, P. troglodytes
tgcctgggtttaaatc

SEQ ID NO: 274085 - DNA, 16 bp, P. troglodytes
tgcctggtccagctgc

SEQ ID NO: 274086 - DNA, 16 bp, P. troglodytes
tgcctggtgcatagta

SEQ ID NO: 274087 - DNA, 16 bp, P. troglodytes
tgcctggtgccaaaaa

SEQ ID NO: 274088 - DNA, 16 bp, P. troglodytes
tgcctgtaaacccagc

SEQ ID NO: 274089 - DNA, 16 bp, P. troglodytes
tgcctgtaacctcagc

SEQ ID NO: 274090 - DNA, 16 bp, P. troglodytes
tgcctgtaatcacagc

SEQ ID NO: 274091 - DNA, 16 bp, P. troglodytes
tgcctgtaatccagct

SEQ ID NO: 274092 - DNA, 20 bp, P. troglodytes
tgcctgtaatcccagcactg

SEQ ID NO: 274093 - DNA, 16 bp, P. troglodytes
tgcctgtaatcccagg

SEQ ID NO: 274094 - DNA, 16 bp, P. troglodytes
tgcctgtaatcccatc

SEQ ID NO: 274095 - DNA, 16 bp, P. troglodytes
tgcctgtaatccgagc

SEQ ID NO: 274096 - DNA, 16 bp, P. troglodytes
tgcctgtaatcctagc

SEQ ID NO: 274097 - DNA, 16 bp, P. troglodytes
tgcctgtaatcgcagc

SEQ ID NO: 274098 - DNA, 16 bp, P. troglodytes
tgcctgtaatctcagt

SEQ ID NO: 274099 - DNA, 16 bp, P. troglodytes
tgcctgtaatcttagc

SEQ ID NO: 274100 - DNA, 16 bp, P. troglodytes
tgcctgtagccccagt

SEQ ID NO: 274101 - DNA, 16 bp, P. troglodytes
tgcctgtatcctcatt

SEQ ID NO: 274102 - DNA, 16 bp, P. troglodytes
tgcctgtattcctagc

SEQ ID NO: 274103 - DNA, 16 bp, P. troglodytes
tgcctgtcaccacacc

SEQ ID NO: 274104 - DNA, 16 bp, P. troglodytes
tgcctgtctctcctgc

SEQ ID NO: 274105 - DNA, 16 bp, P. troglodytes
tgcctgtctgtctgtc

SEQ ID NO: 274106 - DNA, 16 bp, P. troglodytes
tgcctgtctgtgtgtg

SEQ ID NO: 274107 - DNA, 16 bp, P. troglodytes
tgcctgtgaatagtca

SEQ ID NO: 274108 - DNA, 16 bp, P. troglodytes
tgcctgtgaccccagc

SEQ ID NO: 274109 - DNA, 16 bp, P. troglodytes
tgcctgtgagcatgtc

SEQ ID NO: 274110 - DNA, 16 bp, P. troglodytes
tgcctgtgatcccagc

SEQ ID NO: 274111 - DNA, 16 bp, P. troglodytes
tgcctgtgcccccatt

SEQ ID NO: 274112 - DNA, 16 bp, P. troglodytes
tgcctgtgcctgtgtg

SEQ ID NO: 274113 - DNA, 16 bp, P. troglodytes
tgcctgtgctcccagc

SEQ ID NO: 274114 - DNA, 16 bp, P. troglodytes
tgcctgtgcttttggg

SEQ ID NO: 274115 - DNA, 16 bp, P. troglodytes
tgcctgtggaaaggag

SEQ ID NO: 274116 - DNA, 16 bp, P. troglodytes
tgcctgtggccccagc

SEQ ID NO: 274117 - DNA, 16 bp, P. troglodytes
tgcctgtgtactttgt

SEQ ID NO: 274118 - DNA, 16 bp, P. troglodytes
tgcctgtgtatgtgtg

SEQ ID NO: 274119 - DNA, 16 bp, P. troglodytes
tgcctgtgtcccagct

SEQ ID NO: 274120 - DNA, 16 bp, P. troglodytes
tgcctgtgtgtgtgtg

SEQ ID NO: 274121 - DNA, 16 bp, P. troglodytes
tgcctgttctccagat

SEQ ID NO: 274122 - DNA, 16 bp, P. troglodytes
tgcctgtttccccttc

SEQ ID NO: 274123 - DNA, 16 bp, P. troglodytes
tgccttaacctcccaa

SEQ ID NO: 274124 - DNA, 16 bp, P. troglodytes
tgccttagcttcccca

SEQ ID NO: 274125 - DNA, 16 bp, P. troglodytes
tgccttattgccctgg

SEQ ID NO: 274126 - DNA, 16 bp, P. troglodytes
tgccttcaaggagctt

SEQ ID NO: 274127 - DNA, 16 bp, P. troglodytes
tgccttcatggagctt

SEQ ID NO: 274128 - DNA, 16 bp, P. troglodytes
tgccttcatttaaaaa

SEQ ID NO: 274129 - DNA, 16 bp, P. troglodytes
tgccttccagcctggg

SEQ ID NO: 274130 - DNA, 16 bp, P. troglodytes
tgccttctccagaatg

SEQ ID NO: 274131 - DNA, 16 bp, P. troglodytes
tgccttctctctccca

SEQ ID NO: 274132 - DNA, 16 bp, P. troglodytes
tgccttctctggtttt

SEQ ID NO: 274133 - DNA, 16 bp, P. troglodytes
tgccttctgccatgga

SEQ ID NO: 274134 - DNA, 16 bp, P. troglodytes
tgccttctgggttcac

SEQ ID NO: 274135 - DNA, 16 bp, P. troglodytes
tgccttcttcactaag

SEQ ID NO: 274136 - DNA, 16 bp, P. troglodytes
tgccttcttctagaat

SEQ ID NO: 274137 - DNA, 16 bp, P. troglodytes
tgccttgaaaatggac

SEQ ID NO: 274138 - DNA, 16 bp, P. troglodytes
tgccttgctctgtcac

SEQ ID NO: 274139 - DNA, 16 bp, P. troglodytes
tgccttggccacccaa

SEQ ID NO: 274140 - DNA, 24 bp, P. troglodytes
tgccttggcctcccaaagtgctga

SEQ ID NO: 274141 - DNA, 21 bp, P. troglodytes
tgccttggcctcccaaagtgt

SEQ ID NO: 274142 - DNA, 17 bp, P. troglodytes
tgccttggccttccaaa

SEQ ID NO: 274143 - DNA, 16 bp, P. troglodytes
tgccttggctgccagg

SEQ ID NO: 274144 - DNA, 17 bp, P. troglodytes
tgccttggcttcccaaa

SEQ ID NO: 274145 - DNA, 16 bp, P. troglodytes
tgccttggggcaggtg

SEQ ID NO: 274146 - DNA, 17 bp, P. troglodytes
tgccttggtctcccaaa

SEQ ID NO: 274147 - DNA, 16 bp, P. troglodytes
tgccttggtggtcttg

SEQ ID NO: 274148 - DNA, 24 bp, P. troglodytes
tgccttgttaacaaaatgtttaca

SEQ ID NO: 274149 - DNA, 16 bp, P. troglodytes
tgcctttaagattttt

SEQ ID NO: 274150 - DNA, 16 bp, P. troglodytes
tgcctttcagtgggaa

SEQ ID NO: 274151 - DNA, 16 bp, P. troglodytes
tgcctttcatcttcca

SEQ ID NO: 274152 - DNA, 16 bp, P. troglodytes
tgcctttccatttgtt

SEQ ID NO: 274153 - DNA, 16 bp, P. troglodytes
tgcctttcccagccca

SEQ ID NO: 274154 - DNA, 16 bp, P. troglodytes
tgcctttgaggcattt

SEQ ID NO: 274155 - DNA, 16 bp, P. troglodytes
tgcctttgcaaagatt

SEQ ID NO: 274156 - DNA, 16 bp, P. troglodytes
tgcctttgcacatgct

SEQ ID NO: 274157 - DNA, 16 bp, P. troglodytes
tgcctttgctgtgtcc

SEQ ID NO: 274158 - DNA, 16 bp, P. troglodytes
tgcctttgtgttctca

SEQ ID NO: 274159 - DNA, 16 bp, P. troglodytes
tgcctttgtttcctca

SEQ ID NO: 274160 - DNA, 16 bp, P. troglodytes
tgccttttaaaaaatt

SEQ ID NO: 274161 - DNA, 16 bp, P. troglodytes
tgccttttaaaaattt

SEQ ID NO: 274162 - DNA, 16 bp, P. troglodytes
tgccttttaaaatatt

SEQ ID NO: 274163 - DNA, 16 bp, P. troglodytes
tgccttttacccagtt

SEQ ID NO: 274164 - DNA, 16 bp, P. troglodytes
tgccttttattccttt

SEQ ID NO: 274165 - DNA, 16 bp, P. troglodytes
tgccttttcactgtgt

SEQ ID NO: 274166 - DNA, 16 bp, P. troglodytes
tgccttttccaaaatg

SEQ ID NO: 274167 - DNA, 16 bp, P. troglodytes
tgccttttccagaaag

SEQ ID NO: 274168 - DNA, 16 bp, P. troglodytes
tgcctttttactttct

SEQ ID NO: 274169 - DNA, 16 bp, P. troglodytes
tgcctttttattattg

SEQ ID NO: 274170 - DNA, 16 bp, P. troglodytes
tgcgcaggctggagtg

SEQ ID NO: 274171 - DNA, 16 bp, P. troglodytes
tgcgcatcaccatgcc

SEQ ID NO: 274172 - DNA, 18 bp, P. troglodytes
tgcgccaccacgcccagg

SEQ ID NO: 274173 - DNA, 16 bp, P. troglodytes
tgcgccactatgcctg

SEQ ID NO: 274174 - DNA, 16 bp, P. troglodytes
tgcgccactgcactct

SEQ ID NO: 274175 - DNA, 17 bp, P. troglodytes
tgcgcctataatcccag

SEQ ID NO: 274176 - DNA, 19 bp, P. troglodytes
tgcgcctatagtcccagct

SEQ ID NO: 274177 - DNA, 16 bp, P. troglodytes
tgcgcctctccctcca

SEQ ID NO: 274178 - DNA, 16 bp, P. troglodytes
tgcgcctgccttggcc

SEQ ID NO: 274179 - DNA, 16 bp, P. troglodytes
tgcgcgcacacacaca

SEQ ID NO: 274180 - DNA, 19 bp, P. troglodytes
tgcgcgcgcacacacacac

SEQ ID NO: 274181 - DNA, 16 bp, P. troglodytes
tgcgctccagcctggg

SEQ ID NO: 274182 - DNA, 16 bp, P. troglodytes
tgcgctccaggctggg

SEQ ID NO: 274183 - DNA, 17 bp, P. troglodytes
tgcgctgttttttaagc

SEQ ID NO: 274184 - DNA, 16 bp, P. troglodytes
tgcggcaggagaatgg

SEQ ID NO: 274185 - DNA, 16 bp, P. troglodytes
tgcggggtgctgggag

SEQ ID NO: 274186 - DNA, 16 bp, P. troglodytes
tgcggtcaggagttcg

SEQ ID NO: 274187 - DNA, 17 bp, P. troglodytes
tgcggtcccagctactc

SEQ ID NO: 274188 - DNA, 16 bp, P. troglodytes
tgcggtgaaccgagat

SEQ ID NO: 274189 - DNA, 16 bp, P. troglodytes
tgcggtgagccgagac

SEQ ID NO: 274190 - DNA, 19 bp, P. troglodytes
tgcggtgagccgagattgc

SEQ ID NO: 274191 - DNA, 16 bp, P. troglodytes
tgcggtgagctgagat

SEQ ID NO: 274192 - DNA, 20 bp, P. troglodytes
tgcggtggctcaagcctgta

SEQ ID NO: 274193 - DNA, 17 bp, P. troglodytes
tgcggtggctcacgcct

SEQ ID NO: 274194 - DNA, 17 bp, P. troglodytes
tgcggtgtctcacgcct

SEQ ID NO: 274195 - DNA, 16 bp, P. troglodytes
tgcgtgccactatgcc

SEQ ID NO: 274196 - DNA, 16 bp, P. troglodytes
tgcgtgccatcacacc

SEQ ID NO: 274197 - DNA, 16 bp, P. troglodytes
tgcgtgcctgtgtgtg

SEQ ID NO: 274198 - DNA, 16 bp, P. troglodytes
tgcgtggtggtgcatg

SEQ ID NO: 274199 - DNA, 16 bp, P. troglodytes
tgcgtgtgcacgtgtg

SEQ ID NO: 274200 - DNA, 16 bp, P. troglodytes
tgcgtgtgcgtgtgcg

SEQ ID NO: 274201 - DNA, 16 bp, P. troglodytes
tgcgtgtgcgtgtgtg

SEQ ID NO: 274202 - DNA, 16 bp, P. troglodytes
tgcgtgtgtgcatgtg

SEQ ID NO: 274203 - DNA, 16 bp, P. troglodytes
tgcgtgtgtgcctgtg

SEQ ID NO: 274204 - DNA, 16 bp, P. troglodytes
tgcgttccagcctggg

SEQ ID NO: 274205 - DNA, 16 bp, P. troglodytes
tgcgttggcctcccaa

SEQ ID NO: 274206 - DNA, 16 bp, P. troglodytes
tgcgtttccctaatga

SEQ ID NO: 274207 - DNA, 16 bp, P. troglodytes
tgctaaaaaattattt

SEQ ID NO: 274208 - DNA, 16 bp, P. troglodytes
tgctaaaaatactaaa

SEQ ID NO: 274209 - DNA, 16 bp, P. troglodytes
tgctaaaaatataaaa

SEQ ID NO: 274210 - DNA, 16 bp, P. troglodytes
tgctaaaaatgagctt

SEQ ID NO: 274211 - DNA, 16 bp, P. troglodytes
tgctaaaaggggccaa

SEQ ID NO: 274212 - DNA, 16 bp, P. troglodytes
tgctaaacattttaca

SEQ ID NO: 274213 - DNA, 16 bp, P. troglodytes
tgctaaaccattcacg

SEQ ID NO: 274214 - DNA, 16 bp, P. troglodytes
tgctaaatattttatt

SEQ ID NO: 274215 - DNA, 16 bp, P. troglodytes
tgctaaatcaaaagaa

SEQ ID NO: 274216 - DNA, 16 bp, P. troglodytes
tgctaacatggtgaaa

SEQ ID NO: 274217 - DNA, 17 bp, P. troglodytes
tgctaactggttatttt

SEQ ID NO: 274218 - DNA, 17 bp, P. troglodytes
tgctaacttttgtattt

SEQ ID NO: 274219 - DNA, 16 bp, P. troglodytes
tgctaagaggaaagtt

SEQ ID NO: 274220 - DNA, 16 bp, P. troglodytes
tgctaagtgaaataaa

SEQ ID NO: 274221 - DNA, 16 bp, P. troglodytes
tgctaataaagacata

SEQ ID NO: 274222 - DNA, 16 bp, P. troglodytes
tgctaatattttattg

SEQ ID NO: 274223 - DNA, 16 bp, P. troglodytes
tgctaatattttgtta

SEQ ID NO: 274224 - DNA, 16 bp, P. troglodytes
tgctaatgagcagtga

SEQ ID NO: 274225 - DNA, 16 bp, P. troglodytes
tgctaatgtaaataat

SEQ ID NO: 274226 - DNA, 16 bp, P. troglodytes
tgctaatttttttgtg

SEQ ID NO: 274227 - DNA, 16 bp, P. troglodytes
tgctacaaaaagagtg

SEQ ID NO: 274228 - DNA, 16 bp, P. troglodytes
tgctacaaatcagggc

SEQ ID NO: 274229 - DNA, 16 bp, P. troglodytes
tgctacaaatgccatt

SEQ ID NO: 274230 - DNA, 16 bp, P. troglodytes
tgctacaacagcagag

SEQ ID NO: 274231 - DNA, 16 bp, P. troglodytes
tgctacaacatgggtg

SEQ ID NO: 274232 - DNA, 17 bp, P. troglodytes
tgctacaagtgccagaa

SEQ ID NO: 274233 - DNA, 16 bp, P. troglodytes
tgctacactcccacca

SEQ ID NO: 274234 - DNA, 16 bp, P. troglodytes
tgctacagagggcccc

SEQ ID NO: 274235 - DNA, 17 bp, P. troglodytes
tgctaccaaaacagaga

SEQ ID NO: 274236 - DNA, 16 bp, P. troglodytes
tgctaccacatccagc

SEQ ID NO: 274237 - DNA, 16 bp, P. troglodytes
tgctaccactcctggc

SEQ ID NO: 274238 - DNA, 16 bp, P. troglodytes
tgctaccgtgcctggc

SEQ ID NO: 274239 - DNA, 20 bp, P. troglodytes
tgctacctgacttcaaacta

SEQ ID NO: 274240 - DNA, 16 bp, P. troglodytes
tgctacctggaagctt

SEQ ID NO: 274241 - DNA, 16 bp, P. troglodytes
tgctactcagcctgag

SEQ ID NO: 274242 - DNA, 16 bp, P. troglodytes
tgctactgccctccag

SEQ ID NO: 274243 - DNA, 16 bp, P. troglodytes
tgctactgctatctag

SEQ ID NO: 274244 - DNA, 16 bp, P. troglodytes
tgctactgctgcctgg

SEQ ID NO: 274245 - DNA, 16 bp, P. troglodytes
tgctactggcatctag

SEQ ID NO: 274246 - DNA, 16 bp, P. troglodytes
tgctactggcatctgg

SEQ ID NO: 274247 - DNA, 16 bp, P. troglodytes
tgctagaaacatttga

SEQ ID NO: 274248 - DNA, 16 bp, P. troglodytes
tgctagaacagctcac

SEQ ID NO: 274249 - DNA, 16 bp, P. troglodytes
tgctagacactgtgct

SEQ ID NO: 274250 - DNA, 16 bp, P. troglodytes
tgctagagaggatgtg

SEQ ID NO: 274251 - DNA, 16 bp, P. troglodytes
tgctagcatatagaaa

SEQ ID NO: 274252 - DNA, 16 bp, P. troglodytes
tgctaggattacagac

SEQ ID NO: 274253 - DNA, 16 bp, P. troglodytes
tgctaggtgctgggga

SEQ ID NO: 274254 - DNA, 16 bp, P. troglodytes
tgctagtatacagaaa

SEQ ID NO: 274255 - DNA, 16 bp, P. troglodytes
tgctataaaatttcct

SEQ ID NO: 274256 - DNA, 16 bp, P. troglodytes
tgctataaacatgcat

SEQ ID NO: 274257 - DNA, 16 bp, P. troglodytes
tgctataaacttcctt

SEQ ID NO: 274258 - DNA, 16 bp, P. troglodytes
tgctataaagaaatac

SEQ ID NO: 274259 - DNA, 16 bp, P. troglodytes
tgctataaagaaatat

SEQ ID NO: 274260 - DNA, 16 bp, P. troglodytes
tgctataaagaacatt

SEQ ID NO: 274261 - DNA, 16 bp, P. troglodytes
tgctataaagaactat

SEQ ID NO: 274262 - DNA, 16 bp, P. troglodytes
tgctataaagatacta

SEQ ID NO: 274263 - DNA, 16 bp, P. troglodytes
tgctataacagaatac

SEQ ID NO: 274264 - DNA, 16 bp, P. troglodytes
tgctataataaaaata

SEQ ID NO: 274265 - DNA, 16 bp, P. troglodytes
tgctataataaataaa

SEQ ID NO: 274266 - DNA, 16 bp, P. troglodytes
tgctatataaatggaa

SEQ ID NO: 274267 - DNA, 16 bp, P. troglodytes
tgctatatatatattt

SEQ ID NO: 274268 - DNA, 16 bp, P. troglodytes
tgctatcaaatattag

SEQ ID NO: 274269 - DNA, 16 bp, P. troglodytes
tgctatctcagttcac

SEQ ID NO: 274270 - DNA, 16 bp, P. troglodytes
tgctatgaaaaaaata

SEQ ID NO: 274271 - DNA, 16 bp, P. troglodytes
tgctatgaaaagaaaa

SEQ ID NO: 274272 - DNA, 16 bp, P. troglodytes
tgctatgacaaaatat

SEQ ID NO: 274273 - DNA, 16 bp, P. troglodytes
tgctatgcaagctgct

SEQ ID NO: 274274 - DNA, 16 bp, P. troglodytes
tgctatggcagcctga

SEQ ID NO: 274275 - DNA, 16 bp, P. troglodytes
tgctatggtgtgaatg

SEQ ID NO: 274276 - DNA, 16 bp, P. troglodytes
tgctatggtttgaatg

SEQ ID NO: 274277 - DNA, 16 bp, P. troglodytes
tgctatgtgcccaggc

SEQ ID NO: 274278 - DNA, 16 bp, P. troglodytes
tgctatgttgccctgg

SEQ ID NO: 274279 - DNA, 16 bp, P. troglodytes
tgctatgttggggaag

SEQ ID NO: 274280 - DNA, 16 bp, P. troglodytes
tgctattaaaaaatac

SEQ ID NO: 274281 - DNA, 16 bp, P. troglodytes
tgctattacaaaatac

SEQ ID NO: 274282 - DNA, 16 bp, P. troglodytes
tgctattatttttaaa

SEQ ID NO: 274283 - DNA, 16 bp, P. troglodytes
tgctattctcgtgata

SEQ ID NO: 274284 - DNA, 16 bp, P. troglodytes
tgctattgcctgtctt

SEQ ID NO: 274285 - DNA, 16 bp, P. troglodytes
tgctattgcttttggt

SEQ ID NO: 274286 - DNA, 16 bp, P. troglodytes
tgctatttctttgtgg

SEQ ID NO: 274287 - DNA, 16 bp, P. troglodytes
tgctattttatattat

SEQ ID NO: 274288 - DNA, 16 bp, P. troglodytes
tgctattttttaaaaa

SEQ ID NO: 274289 - DNA, 16 bp, P. troglodytes
tgctcaaattgtccca

SEQ ID NO: 274290 - DNA, 16 bp, P. troglodytes
tgctcaaatttttcca

SEQ ID NO: 274291 - DNA, 16 bp, P. troglodytes
tgctcaaggccacaga

SEQ ID NO: 274292 - DNA, 16 bp, P. troglodytes
tgctcaataaatatct

SEQ ID NO: 274293 - DNA, 16 bp, P. troglodytes
tgctcaataaatattt

SEQ ID NO: 274294 - DNA, 16 bp, P. troglodytes
tgctcaataaatgtaa

SEQ ID NO: 274295 - DNA, 16 bp, P. troglodytes
tgctcaataaatgtca

SEQ ID NO: 274296 - DNA, 16 bp, P. troglodytes
tgctcaataaattttg

SEQ ID NO: 274297 - DNA, 16 bp, P. troglodytes
tgctcaataagtattt

SEQ ID NO: 274298 - DNA, 18 bp, P. troglodytes
tgctcacacaaagcctgt

SEQ ID NO: 274299 - DNA, 16 bp, P. troglodytes
tgctcacattactgcc

SEQ ID NO: 274300 - DNA, 16 bp, P. troglodytes
tgctcaccagctgcct

SEQ ID NO: 274301 - DNA, 16 bp, P. troglodytes
tgctcactcacctgcc

SEQ ID NO: 274302 - DNA, 17 bp, P. troglodytes
tgctcactctttgggtc

SEQ ID NO: 274303 - DNA, 16 bp, P. troglodytes
tgctcactgccagctc

SEQ ID NO: 274304 - DNA, 16 bp, P. troglodytes
tgctcacttcctgggt

SEQ ID NO: 274305 - DNA, 16 bp, P. troglodytes
tgctcagagaaatcag

SEQ ID NO: 274306 - DNA, 16 bp, P. troglodytes
tgctcagagaggagga

SEQ ID NO: 274307 - DNA, 16 bp, P. troglodytes
tgctcagagaggccaa

SEQ ID NO: 274308 - DNA, 16 bp, P. troglodytes
tgctcagcaaaagaaa

SEQ ID NO: 274309 - DNA, 16 bp, P. troglodytes
tgctcagcatcactgg

SEQ ID NO: 274310 - DNA, 17 bp, P. troglodytes
tgctcaggctgatctca

SEQ ID NO: 274311 - DNA, 16 bp, P. troglodytes
tgctcaggctgctctt

SEQ ID NO: 274312 - DNA, 16 bp, P. troglodytes
tgctcaggctgggctc

SEQ ID NO: 274313 - DNA, 16 bp, P. troglodytes
tgctcagtaaataatt

SEQ ID NO: 274314 - DNA, 16 bp, P. troglodytes
tgctcatatatatata

SEQ ID NO: 274315 - DNA, 16 bp, P. troglodytes
tgctcatcaccactgg

SEQ ID NO: 274316 - DNA, 16 bp, P. troglodytes
tgctcatctgattttt

SEQ ID NO: 274317 - DNA, 16 bp, P. troglodytes
tgctcatgcctgtaat

SEQ ID NO: 274318 - DNA, 16 bp, P. troglodytes
tgctcattacccagtt

SEQ ID NO: 274319 - DNA, 16 bp, P. troglodytes
tgctcattcattcatt

SEQ ID NO: 274320 - DNA, 16 bp, P. troglodytes
tgctcattgctactgg

SEQ ID NO: 274321 - DNA, 16 bp, P. troglodytes
tgctcatttgtttatg

SEQ ID NO: 274322 - DNA, 16 bp, P. troglodytes
tgctcatttttaaaaa

SEQ ID NO: 274323 - DNA, 16 bp, P. troglodytes
tgctccacagcctgct

SEQ ID NO: 274324 - DNA, 16 bp, P. troglodytes
tgctccagaatcccaa

SEQ ID NO: 274325 - DNA, 16 bp, P. troglodytes
tgctccagcctgggtg

SEQ ID NO: 274326 - DNA, 16 bp, P. troglodytes
tgctccagctccagct

SEQ ID NO: 274327 - DNA, 16 bp, P. troglodytes
tgctccagctgtggct

SEQ ID NO: 274328 - DNA, 16 bp, P. troglodytes
tgctccaggctgggca

SEQ ID NO: 274329 - DNA, 16 bp, P. troglodytes
tgctcccactctcacc

SEQ ID NO: 274330 - DNA, 16 bp, P. troglodytes
tgctcccatctcagcc

SEQ ID NO: 274331 - DNA, 16 bp, P. troglodytes
tgctcccatgagaatc

SEQ ID NO: 274332 - DNA, 16 bp, P. troglodytes
tgctccccaccctgtg

SEQ ID NO: 274333 - DNA, 16 bp, P. troglodytes
tgctccccacctccca

SEQ ID NO: 274334 - DNA, 16 bp, P. troglodytes
tgctcctaaactcctc

SEQ ID NO: 274335 - DNA, 17 bp, P. troglodytes
tgctcctataattgagg

SEQ ID NO: 274336 - DNA, 16 bp, P. troglodytes
tgctcctatgaacatt

SEQ ID NO: 274337 - DNA, 16 bp, P. troglodytes
tgctcctcctgccttg

SEQ ID NO: 274338 - DNA, 16 bp, P. troglodytes
tgctcctccttcatct

SEQ ID NO: 274339 - DNA, 16 bp, P. troglodytes
tgctcctccttgtctt

SEQ ID NO: 274340 - DNA, 16 bp, P. troglodytes
tgctcctcggcttgca

SEQ ID NO: 274341 - DNA, 16 bp, P. troglodytes
tgctcctctttgcctt

SEQ ID NO: 274342 - DNA, 16 bp, P. troglodytes
tgctcctgaatgactc

SEQ ID NO: 274343 - DNA, 16 bp, P. troglodytes
tgctcctgatccagtg

SEQ ID NO: 274344 - DNA, 16 bp, P. troglodytes
tgctcctgctctggcc

SEQ ID NO: 274345 - DNA, 16 bp, P. troglodytes
tgctcctgctttggcc

SEQ ID NO: 274346 - DNA, 16 bp, P. troglodytes
tgctcctggcatctgg

SEQ ID NO: 274347 - DNA, 16 bp, P. troglodytes
tgctccttaattttct

SEQ ID NO: 274348 - DNA, 16 bp, P. troglodytes
tgctcgctgcaacctc

SEQ ID NO: 274349 - DNA, 16 bp, P. troglodytes
tgctcgggctggtctc

SEQ ID NO: 274350 - DNA, 16 bp, P. troglodytes
tgctctaaaaagtaaa

SEQ ID NO: 274351 - DNA, 16 bp, P. troglodytes
tgctctaattttagtt

SEQ ID NO: 274352 - DNA, 16 bp, P. troglodytes
tgctctcaaaccctgt

SEQ ID NO: 274353 - DNA, 16 bp, P. troglodytes
tgctctcaccattgct

SEQ ID NO: 274354 - DNA, 16 bp, P. troglodytes
tgctctcacttgtaag

SEQ ID NO: 274355 - DNA, 16 bp, P. troglodytes
tgctctccagcctgga

SEQ ID NO: 274356 - DNA, 16 bp, P. troglodytes
tgctctccagcctggc

SEQ ID NO: 274357 - DNA, 16 bp, P. troglodytes
tgctctccagcctggg

SEQ ID NO: 274358 - DNA, 16 bp, P. troglodytes
tgctctccagcttggg

SEQ ID NO: 274359 - DNA, 16 bp, P. troglodytes
tgctctccctgctgat

SEQ ID NO: 274360 - DNA, 16 bp, P. troglodytes
tgctctccttccccca

SEQ ID NO: 274361 - DNA, 16 bp, P. troglodytes
tgctctctcaccaggc

SEQ ID NO: 274362 - DNA, 16 bp, P. troglodytes
tgctctctctctctgt

SEQ ID NO: 274363 - DNA, 16 bp, P. troglodytes
tgctctctctgtctct

SEQ ID NO: 274364 - DNA, 22 bp, P. troglodytes
tgctctctgaaacatgtgctgt

SEQ ID NO: 274365 - DNA, 16 bp, P. troglodytes
tgctctctgcttccaa

SEQ ID NO: 274366 - DNA, 16 bp, P. troglodytes
tgctctgcacttctcc

SEQ ID NO: 274367 - DNA, 16 bp, P. troglodytes
tgctctgcccacctca

SEQ ID NO: 274368 - DNA, 16 bp, P. troglodytes
tgctctgcctgtggag

SEQ ID NO: 274369 - DNA, 16 bp, P. troglodytes
tgctctgcttcctctt

SEQ ID NO: 274370 - DNA, 17 bp, P. troglodytes
tgctctggctaggactt

SEQ ID NO: 274371 - DNA, 16 bp, P. troglodytes
tgctctggtttctctc

SEQ ID NO: 274372 - DNA, 16 bp, P. troglodytes
tgctctgtcccccaag

SEQ ID NO: 274373 - DNA, 16 bp, P. troglodytes
tgctctgtcctccagg

SEQ ID NO: 274374 - DNA, 16 bp, P. troglodytes
tgctctgtgaccctgg

SEQ ID NO: 274375 - DNA, 16 bp, P. troglodytes
tgctctgtgatgtgtg

SEQ ID NO: 274376 - DNA, 16 bp, P. troglodytes
tgctctgtggcctagg

SEQ ID NO: 274377 - DNA, 16 bp, P. troglodytes
tgctctgttactcagg

SEQ ID NO: 274378 - DNA, 16 bp, P. troglodytes
tgctctgtttccctta

SEQ ID NO: 274379 - DNA, 16 bp, P. troglodytes
tgctcttaaaagcatt

SEQ ID NO: 274380 - DNA, 16 bp, P. troglodytes
tgctcttcccacctca

SEQ ID NO: 274381 - DNA, 16 bp, P. troglodytes
tgctcttccctctgct

SEQ ID NO: 274382 - DNA, 16 bp, P. troglodytes
tgctcttgtggagctt

SEQ ID NO: 274383 - DNA, 16 bp, P. troglodytes
tgctcttgttttccag

SEQ ID NO: 274384 - DNA, 16 bp, P. troglodytes
tgctcttttcaaaaaa

SEQ ID NO: 274385 - DNA, 16 bp, P. troglodytes
tgctctttttttaaaa

SEQ ID NO: 274386 - DNA, 16 bp, P. troglodytes
tgctgaaaaaatattt

SEQ ID NO: 274387 - DNA, 16 bp, P. troglodytes
tgctgaaaaatctgct

SEQ ID NO: 274388 - DNA, 16 bp, P. troglodytes
tgctgaaaactctcaa

SEQ ID NO: 274389 - DNA, 16 bp, P. troglodytes
tgctgaaaggaaaaaa

SEQ ID NO: 274390 - DNA, 16 bp, P. troglodytes
tgctgaagaaaaaaaa

SEQ ID NO: 274391 - DNA, 16 bp, P. troglodytes
tgctgaagatgatggt

SEQ ID NO: 274392 - DNA, 16 bp, P. troglodytes
tgctgaaggaaaagaa

SEQ ID NO: 274393 - DNA, 16 bp, P. troglodytes
tgctgaaggagaaaaa

SEQ ID NO: 274394 - DNA, 16 bp, P. troglodytes
tgctgaaggcaggcca

SEQ ID NO: 274395 - DNA, 16 bp, P. troglodytes
tgctgaagtttcttat

SEQ ID NO: 274396 - DNA, 16 bp, P. troglodytes
tgctgaatgggcaaaa

SEQ ID NO: 274397 - DNA, 16 bp, P. troglodytes
tgctgacaaagacata

SEQ ID NO: 274398 - DNA, 16 bp, P. troglodytes
tgctgactctcttttc

SEQ ID NO: 274399 - DNA, 20 bp, P. troglodytes
tgctgagaaaaagaattcag

SEQ ID NO: 274400 - DNA, 16 bp, P. troglodytes
tgctgagaataatggc

SEQ ID NO: 274401 - DNA, 16 bp, P. troglodytes
tgctgagagaattcac

SEQ ID NO: 274402 - DNA, 16 bp, P. troglodytes
tgctgagagtagattt

SEQ ID NO: 274403 - DNA, 16 bp, P. troglodytes
tgctgagattccaggc

SEQ ID NO: 274404 - DNA, 16 bp, P. troglodytes
tgctgagcaaaaagaa

SEQ ID NO: 274405 - DNA, 16 bp, P. troglodytes
tgctgagcaagaccac

SEQ ID NO: 274406 - DNA, 16 bp, P. troglodytes
tgctgagcagcatccc

SEQ ID NO: 274407 - DNA, 16 bp, P. troglodytes
tgctgagcagctggga

SEQ ID NO: 274408 - DNA, 16 bp, P. troglodytes
tgctgagcattttttt

SEQ ID NO: 274409 - DNA, 16 bp, P. troglodytes
tgctgagccacctgga

SEQ ID NO: 274410 - DNA, 16 bp, P. troglodytes
tgctgagcccaggagt

SEQ ID NO: 274411 - DNA, 16 bp, P. troglodytes
tgctgagcctgatggg

SEQ ID NO: 274412 - DNA, 16 bp, P. troglodytes
tgctgagcgccggtcc

SEQ ID NO: 274413 - DNA, 16 bp, P. troglodytes
tgctgagctcaggagt

SEQ ID NO: 274414 - DNA, 16 bp, P. troglodytes
tgctgagctgcctgga

SEQ ID NO: 274415 - DNA, 16 bp, P. troglodytes
tgctgagcttgatggg

SEQ ID NO: 274416 - DNA, 16 bp, P. troglodytes
tgctgaggaaattaaa

SEQ ID NO: 274417 - DNA, 16 bp, P. troglodytes
tgctgaggagaaaaat

SEQ ID NO: 274418 - DNA, 16 bp, P. troglodytes
tgctgaggatgatgac

SEQ ID NO: 274419 - DNA, 16 bp, P. troglodytes
tgctgaggctgcagtg

SEQ ID NO: 274420 - DNA, 16 bp, P. troglodytes
tgctgaggtgggagga

SEQ ID NO: 274421 - DNA, 16 bp, P. troglodytes
tgctgaggttgagaaa

SEQ ID NO: 274422 - DNA, 16 bp, P. troglodytes
tgctgaggtttgggat

SEQ ID NO: 274423 - DNA, 16 bp, P. troglodytes
tgctgagtcctgtgag

SEQ ID NO: 274424 - DNA, 16 bp, P. troglodytes
tgctgagtctcacctg

SEQ ID NO: 274425 - DNA, 16 bp, P. troglodytes
tgctgagtgaaggaag

SEQ ID NO: 274426 - DNA, 16 bp, P. troglodytes
tgctgagtgcctggga

SEQ ID NO: 274427 - DNA, 16 bp, P. troglodytes
tgctgagtgtttttat

SEQ ID NO: 274428 - DNA, 16 bp, P. troglodytes
tgctgagtttgggttt

SEQ ID NO: 274429 - DNA, 16 bp, P. troglodytes
tgctgataaaacaggt

SEQ ID NO: 274430 - DNA, 16 bp, P. troglodytes
tgctgataaagacata

SEQ ID NO: 274431 - DNA, 16 bp, P. troglodytes
tgctgataatgatggt

SEQ ID NO: 274432 - DNA, 16 bp, P. troglodytes
tgctgatacggagaaa

SEQ ID NO: 274433 - DNA, 16 bp, P. troglodytes
tgctgatagacactta

SEQ ID NO: 274434 - DNA, 16 bp, P. troglodytes
tgctgatctgacagga

SEQ ID NO: 274435 - DNA, 16 bp, P. troglodytes
tgctgatgaaaaaaat

SEQ ID NO: 274436 - DNA, 16 bp, P. troglodytes
tgctgatgaacatttg

SEQ ID NO: 274437 - DNA, 16 bp, P. troglodytes
tgctgatgttgatgct

SEQ ID NO: 274438 - DNA, 16 bp, P. troglodytes
tgctgattatttattt

SEQ ID NO: 274439 - DNA, 16 bp, P. troglodytes
tgctgattggtgcctt

SEQ ID NO: 274440 - DNA, 16 bp, P. troglodytes
tgctgcaaaaaacatg

SEQ ID NO: 274441 - DNA, 16 bp, P. troglodytes
tgctgcaaaagacata

SEQ ID NO: 274442 - DNA, 16 bp, P. troglodytes
tgctgcaaagaacata

SEQ ID NO: 274443 - DNA, 16 bp, P. troglodytes
tgctgcaaaggatata

SEQ ID NO: 274444 - DNA, 16 bp, P. troglodytes
tgctgcaacaaacata

SEQ ID NO: 274445 - DNA, 16 bp, P. troglodytes
tgctgcaatacacatg

SEQ ID NO: 274446 - DNA, 16 bp, P. troglodytes
tgctgcaatgaacatg

SEQ ID NO: 274447 - DNA, 16 bp, P. troglodytes
tgctgcaattaaaaga

SEQ ID NO: 274448 - DNA, 26 bp, P. troglodytes
tgctgcacccattaacttgtcattta

SEQ ID NO: 274449 - DNA, 16 bp, P. troglodytes
tgctgcactgtgggag

SEQ ID NO: 274450 - DNA, 28 bp, P. troglodytes
tgctgcagagattttgtttatggccagt

SEQ ID NO: 274451 - DNA, 16 bp, P. troglodytes
tgctgcagaggatgtg

SEQ ID NO: 274452 - DNA, 16 bp, P. troglodytes
tgctgcagctgaggag

SEQ ID NO: 274453 - DNA, 16 bp, P. troglodytes
tgctgcagctgctgtg

SEQ ID NO: 274454 - DNA, 16 bp, P. troglodytes
tgctgcagctgtccac

SEQ ID NO: 274455 - DNA, 16 bp, P. troglodytes
tgctgcaggagcagag

SEQ ID NO: 274456 - DNA, 16 bp, P. troglodytes
tgctgcaggagtggag

SEQ ID NO: 274457 - DNA, 16 bp, P. troglodytes
tgctgcagggatggag

SEQ ID NO: 274458 - DNA, 16 bp, P. troglodytes
tgctgcaggggcaggg

SEQ ID NO: 274459 - DNA, 16 bp, P. troglodytes
tgctgcaggggtggag

SEQ ID NO: 274460 - DNA, 16 bp, P. troglodytes
tgctgcatgggcatgg

SEQ ID NO: 274461 - DNA, 16 bp, P. troglodytes
tgctgcatttccttac

SEQ ID NO: 274462 - DNA, 16 bp, P. troglodytes
tgctgccaaagcaagc

SEQ ID NO: 274463 - DNA, 16 bp, P. troglodytes
tgctgccaaaggagat

SEQ ID NO: 274464 - DNA, 16 bp, P. troglodytes
tgctgccaaggccctc

SEQ ID NO: 274465 - DNA, 16 bp, P. troglodytes
tgctgccacctgctgg

SEQ ID NO: 274466 - DNA, 16 bp, P. troglodytes
tgctgccactgcccag

SEQ ID NO: 274467 - DNA, 16 bp, P. troglodytes
tgctgccactgctgct

SEQ ID NO: 274468 - DNA, 16 bp, P. troglodytes
tgctgccagctgagga

SEQ ID NO: 274469 - DNA, 16 bp, P. troglodytes
tgctgccatgtgaaga

SEQ ID NO: 274470 - DNA, 16 bp, P. troglodytes
tgctgcccaagctgga

SEQ ID NO: 274471 - DNA, 16 bp, P. troglodytes
tgctgcccagcctgga

SEQ ID NO: 274472 - DNA, 16 bp, P. troglodytes
tgctgcccaggatgga

SEQ ID NO: 274473 - DNA, 16 bp, P. troglodytes
tgctgcccaggctggc

SEQ ID NO: 274474 - DNA, 16 bp, P. troglodytes
tgctgccccctgctgg

SEQ ID NO: 274475 - DNA, 16 bp, P. troglodytes
tgctgccccctggtgg

SEQ ID NO: 274476 - DNA, 16 bp, P. troglodytes
tgctgccctctcctgg

SEQ ID NO: 274477 - DNA, 16 bp, P. troglodytes
tgctgcctcagcctcc

SEQ ID NO: 274478 - DNA, 16 bp, P. troglodytes
tgctgcctcctgggtt

SEQ ID NO: 274479 - DNA, 16 bp, P. troglodytes
tgctgcctcttggtca

SEQ ID NO: 274480 - DNA, 16 bp, P. troglodytes
tgctgccttcaagaga

SEQ ID NO: 274481 - DNA, 41 bp, P. troglodytes
tgctgccttcaagcatctgtttaacaaagcacatcttgcac

SEQ ID NO: 274482 - DNA, 16 bp, P. troglodytes
tgctgctactgctgct

SEQ ID NO: 274483 - DNA, 16 bp, P. troglodytes
tgctgctatgaacttt

SEQ ID NO: 274484 - DNA, 16 bp, P. troglodytes
tgctgctatgaatgtg

SEQ ID NO: 274485 - DNA, 16 bp, P. troglodytes
tgctgctcaaggaaat

SEQ ID NO: 274486 - DNA, 16 bp, P. troglodytes
tgctgctcctgctgct

SEQ ID NO: 274487 - DNA, 16 bp, P. troglodytes
tgctgctgatgaagac

SEQ ID NO: 274488 - DNA, 16 bp, P. troglodytes
tgctgctgatgctgct

SEQ ID NO: 274489 - DNA, 16 bp, P. troglodytes
tgctgctgccactgga

SEQ ID NO: 274490 - DNA, 16 bp, P. troglodytes
tgctgctgccatgtga

SEQ ID NO: 274491 - DNA, 16 bp, P. troglodytes
tgctgctgccgctgcc

SEQ ID NO: 274492 - DNA, 17 bp, P. troglodytes
tgctgctgccgctgctg

SEQ ID NO: 274493 - DNA, 16 bp, P. troglodytes
tgctgctgctactact

SEQ ID NO: 274494 - DNA, 16 bp, P. troglodytes
tgctgctgctcactct

SEQ ID NO: 274495 - DNA, 16 bp, P. troglodytes
tgctgctgctcagtct

SEQ ID NO: 274496 - DNA, 16 bp, P. troglodytes
tgctgctgctcctctg

SEQ ID NO: 274497 - DNA, 16 bp, P. troglodytes
tgctgctgctctgcct

SEQ ID NO: 274498 - DNA, 16 bp, P. troglodytes
tgctgctgctgccact

SEQ ID NO: 274499 - DNA, 16 bp, P. troglodytes
tgctgctgctgccgct

SEQ ID NO: 274500 - DNA, 16 bp, P. troglodytes
tgctgctgctgcctct

SEQ ID NO: 274501 - DNA, 16 bp, P. troglodytes
tgctgctgctgcctgg

SEQ ID NO: 274502 - DNA, 16 bp, P. troglodytes
tgctgctgctgctact

SEQ ID NO: 274503 - DNA, 16 bp, P. troglodytes
tgctgctgctgctccc

SEQ ID NO: 274504 - DNA, 16 bp, P. troglodytes
tgctgctgctgctcct

SEQ ID NO: 274505 - DNA, 16 bp, P. troglodytes
tgctgctgctgctgca

SEQ ID NO: 274506 - DNA, 17 bp, P. troglodytes
tgctgctgctgctgccc

SEQ ID NO: 274507 - DNA, 16 bp, P. troglodytes
tgctgctgctgctgct

SEQ ID NO: 274508 - DNA, 16 bp, P. troglodytes
tgctgctgctggctgg

SEQ ID NO: 274509 - DNA, 16 bp, P. troglodytes
tgctgctgctggtggt

SEQ ID NO: 274510 - DNA, 16 bp, P. troglodytes
tgctgctgctgtgtgt

SEQ ID NO: 274511 - DNA, 16 bp, P. troglodytes
tgctgctgctgttgct

SEQ ID NO: 274512 - DNA, 16 bp, P. troglodytes
tgctgctggattcagt

SEQ ID NO: 274513 - DNA, 16 bp, P. troglodytes
tgctgctggcctgggg

SEQ ID NO: 274514 - DNA, 16 bp, P. troglodytes
tgctgctggtccaggg

SEQ ID NO: 274515 - DNA, 16 bp, P. troglodytes
tgctgctggtcctggg

SEQ ID NO: 274516 - DNA, 16 bp, P. troglodytes
tgctgctggtctggga

SEQ ID NO: 274517 - DNA, 16 bp, P. troglodytes
tgctgctggtgctgct

SEQ ID NO: 274518 - DNA, 16 bp, P. troglodytes
tgctgctgtaacaaat

SEQ ID NO: 274519 - DNA, 16 bp, P. troglodytes
tgctgctgtaacagaa

SEQ ID NO: 274520 - DNA, 16 bp, P. troglodytes
tgctgctgtaagaaat

SEQ ID NO: 274521 - DNA, 16 bp, P. troglodytes
tgctgctgtacactgc

SEQ ID NO: 274522 - DNA, 16 bp, P. troglodytes
tgctgctgtgaacact

SEQ ID NO: 274523 - DNA, 16 bp, P. troglodytes
tgctgctgtgaacatg

SEQ ID NO: 274524 - DNA, 16 bp, P. troglodytes
tgctgctgtgtgtgtg

SEQ ID NO: 274525 - DNA, 16 bp, P. troglodytes
tgctgctgttattatt

SEQ ID NO: 274526 - DNA, 16 bp, P. troglodytes
tgctgctgttgagaaa

SEQ ID NO: 274527 - DNA, 16 bp, P. troglodytes
tgctgctgttgctgct

SEQ ID NO: 274528 - DNA, 16 bp, P. troglodytes
tgctgctgttgctgtt

SEQ ID NO: 274529 - DNA, 16 bp, P. troglodytes
tgctgcttacaagaaa

SEQ ID NO: 274530 - DNA, 16 bp, P. troglodytes
tgctgcttctgctttt

SEQ ID NO: 274531 - DNA, 16 bp, P. troglodytes
tgctgctttcaaaatt

SEQ ID NO: 274532 - DNA, 16 bp, P. troglodytes
tgctgcttttaaaaaa

SEQ ID NO: 274533 - DNA, 16 bp, P. troglodytes
tgctggaaacccaggg

SEQ ID NO: 274534 - DNA, 16 bp, P. troglodytes
tgctggaaatgcagaa

SEQ ID NO: 274535 - DNA, 16 bp, P. troglodytes
tgctggaacccaggag

SEQ ID NO: 274536 - DNA, 16 bp, P. troglodytes
tgctggaatagtgagc

SEQ ID NO: 274537 - DNA, 16 bp, P. troglodytes
tgctggaattacaggt

SEQ ID NO: 274538 - DNA, 16 bp, P. troglodytes
tgctggaattagaggt

SEQ ID NO: 274539 - DNA, 16 bp, P. troglodytes
tgctggaattatagat

SEQ ID NO: 274540 - DNA, 16 bp, P. troglodytes
tgctggaatttttatt

SEQ ID NO: 274541 - DNA, 16 bp, P. troglodytes
tgctggactcagtttg

SEQ ID NO: 274542 - DNA, 16 bp, P. troglodytes
tgctggactgcagtgg

SEQ ID NO: 274543 - DNA, 16 bp, P. troglodytes
tgctggagaaactgga

SEQ ID NO: 274544 - DNA, 16 bp, P. troglodytes
tgctggagagaatgtg

SEQ ID NO: 274545 - DNA, 17 bp, P. troglodytes
tgctggagaggacgtgg

SEQ ID NO: 274546 - DNA, 16 bp, P. troglodytes
tgctggagcccaggag

SEQ ID NO: 274547 - DNA, 16 bp, P. troglodytes
tgctggaggctcagtg

SEQ ID NO: 274548 - DNA, 16 bp, P. troglodytes
tgctggaggtcctctc

SEQ ID NO: 274549 - DNA, 16 bp, P. troglodytes
tgctggagtgcagtgg

SEQ ID NO: 274550 - DNA, 16 bp, P. troglodytes
tgctggatccttcctg

SEQ ID NO: 274551 - DNA, 16 bp, P. troglodytes
tgctggatgcctcctg

SEQ ID NO: 274552 - DNA, 16 bp, P. troglodytes
tgctggattacattga

SEQ ID NO: 274553 - DNA, 16 bp, P. troglodytes
tgctggatttggtgtg

SEQ ID NO: 274554 - DNA, 16 bp, P. troglodytes
tgctggcaaggctggt

SEQ ID NO: 274555 - DNA, 16 bp, P. troglodytes
tgctggcacaaggctt

SEQ ID NO: 274556 - DNA, 16 bp, P. troglodytes
tgctggcacctggagc

SEQ ID NO: 274557 - DNA, 16 bp, P. troglodytes
tgctggcagcaagaat

SEQ ID NO: 274558 - DNA, 16 bp, P. troglodytes
tgctggcaggccactg

SEQ ID NO: 274559 - DNA, 18 bp, P. troglodytes
tgctggcagtcctcacag

SEQ ID NO: 274560 - DNA, 16 bp, P. troglodytes
tgctggcatctggcaa

SEQ ID NO: 274561 - DNA, 16 bp, P. troglodytes
tgctggcattacagac

SEQ ID NO: 274562 - DNA, 16 bp, P. troglodytes
tgctggccgggcacag

SEQ ID NO: 274563 - DNA, 16 bp, P. troglodytes
tgctggcctcaaagaa

SEQ ID NO: 274564 - DNA, 16 bp, P. troglodytes
tgctggctctgaggaa

SEQ ID NO: 274565 - DNA, 16 bp, P. troglodytes
tgctggctcttttttg

SEQ ID NO: 274566 - DNA, 16 bp, P. troglodytes
tgctggctgccttccc

SEQ ID NO: 274567 - DNA, 16 bp, P. troglodytes
tgctggctgctgcccc

SEQ ID NO: 274568 - DNA, 16 bp, P. troglodytes
tgctggctgctggctg

SEQ ID NO: 274569 - DNA, 16 bp, P. troglodytes
tgctggctgtgaccaa

SEQ ID NO: 274570 - DNA, 16 bp, P. troglodytes
tgctggcttcaggtct

SEQ ID NO: 274571 - DNA, 16 bp, P. troglodytes
tgctggcttccccttc

SEQ ID NO: 274572 - DNA, 16 bp, P. troglodytes
tgctgggaaaactgcc

SEQ ID NO: 274573 - DNA, 16 bp, P. troglodytes
tgctgggaaaactggg

SEQ ID NO: 274574 - DNA, 16 bp, P. troglodytes
tgctgggacaccccac

SEQ ID NO: 274575 - DNA, 16 bp, P. troglodytes
tgctgggactacaggt

SEQ ID NO: 274576 - DNA, 16 bp, P. troglodytes
tgctgggagaaccact

SEQ ID NO: 274577 - DNA, 16 bp, P. troglodytes
tgctgggagaactgga

SEQ ID NO: 274578 - DNA, 16 bp, P. troglodytes
tgctgggagcagtggc

SEQ ID NO: 274579 - DNA, 16 bp, P. troglodytes
tgctgggagctacaga

SEQ ID NO: 274580 - DNA, 16 bp, P. troglodytes
tgctgggaggtgattg

SEQ ID NO: 274581 - DNA, 16 bp, P. troglodytes
tgctgggaggtgtctt

SEQ ID NO: 274582 - DNA, 18 bp, P. troglodytes
tgctgggattacaggcac

SEQ ID NO: 274583 - DNA, 16 bp, P. troglodytes
tgctgggattacagtc

SEQ ID NO: 274584 - DNA, 16 bp, P. troglodytes
tgctgggattacagtg

SEQ ID NO: 274585 - DNA, 16 bp, P. troglodytes
tgctgggattactgga

SEQ ID NO: 274586 - DNA, 16 bp, P. troglodytes
tgctgggattatacac

SEQ ID NO: 274587 - DNA, 16 bp, P. troglodytes
tgctgggattccaggt

SEQ ID NO: 274588 - DNA, 16 bp, P. troglodytes
tgctgggattgcaggg

SEQ ID NO: 274589 - DNA, 16 bp, P. troglodytes
tgctgggattggaggc

SEQ ID NO: 274590 - DNA, 16 bp, P. troglodytes
tgctgggcagaagctt

SEQ ID NO: 274591 - DNA, 16 bp, P. troglodytes
tgctgggcagatgtcc

SEQ ID NO: 274592 - DNA, 16 bp, P. troglodytes
tgctgggcagtggcag

SEQ ID NO: 274593 - DNA, 16 bp, P. troglodytes
tgctgggcatggtggc

SEQ ID NO: 274594 - DNA, 16 bp, P. troglodytes
tgctgggccccagccc

SEQ ID NO: 274595 - DNA, 16 bp, P. troglodytes
tgctgggccctgggga

SEQ ID NO: 274596 - DNA, 16 bp, P. troglodytes
tgctgggctctgtggg

SEQ ID NO: 274597 - DNA, 16 bp, P. troglodytes
tgctggggaaaaaaaa

SEQ ID NO: 274598 - DNA, 16 bp, P. troglodytes
tgctggggacacagca

SEQ ID NO: 274599 - DNA, 16 bp, P. troglodytes
tgctggggaggagctg

SEQ ID NO: 274600 - DNA, 16 bp, P. troglodytes
tgctggggctggagtg

SEQ ID NO: 274601 - DNA, 16 bp, P. troglodytes
tgctgggggaaaaaaa

SEQ ID NO: 274602 - DNA, 16 bp, P. troglodytes
tgctgggggtccactc

SEQ ID NO: 274603 - DNA, 16 bp, P. troglodytes
tgctggggttacagtc

SEQ ID NO: 274604 - DNA, 16 bp, P. troglodytes
tgctgggtccttcctg

SEQ ID NO: 274605 - DNA, 16 bp, P. troglodytes
tgctgggtgctgggga

SEQ ID NO: 274606 - DNA, 16 bp, P. troglodytes
tgctgggttacaggcg

SEQ ID NO: 274607 - DNA, 16 bp, P. troglodytes
tgctgggtttacaggc

SEQ ID NO: 274608 - DNA, 16 bp, P. troglodytes
tgctggtagaaatgta

SEQ ID NO: 274609 - DNA, 16 bp, P. troglodytes
tgctggtataaaaaca

SEQ ID NO: 274610 - DNA, 16 bp, P. troglodytes
tgctggtctcaaactc

SEQ ID NO: 274611 - DNA, 16 bp, P. troglodytes
tgctggtctcagactc

SEQ ID NO: 274612 - DNA, 16 bp, P. troglodytes
tgctggtgaagatgca

SEQ ID NO: 274613 - DNA, 16 bp, P. troglodytes
tgctggtgctgctggt

SEQ ID NO: 274614 - DNA, 16 bp, P. troglodytes
tgctggtggaggatct

SEQ ID NO: 274615 - DNA, 16 bp, P. troglodytes
tgctggtgtaaataaa

SEQ ID NO: 274616 - DNA, 16 bp, P. troglodytes
tgctggttttgcggct

SEQ ID NO: 274617 - DNA, 16 bp, P. troglodytes
tgctgtaaagaaatat

SEQ ID NO: 274618 - DNA, 16 bp, P. troglodytes
tgctgtaaaggacatg

SEQ ID NO: 274619 - DNA, 16 bp, P. troglodytes
tgctgtacccattaac

SEQ ID NO: 274620 - DNA, 16 bp, P. troglodytes
tgctgtagaggatgtg

SEQ ID NO: 274621 - DNA, 16 bp, P. troglodytes
tgctgtatcaaaagaa

SEQ ID NO: 274622 - DNA, 16 bp, P. troglodytes
tgctgtatttttcagc

SEQ ID NO: 274623 - DNA, 16 bp, P. troglodytes
tgctgtattttttaaa

SEQ ID NO: 274624 - DNA, 16 bp, P. troglodytes
tgctgtcactgcagaa

SEQ ID NO: 274625 - DNA, 16 bp, P. troglodytes
tgctgtcaggtgcatc

SEQ ID NO: 274626 - DNA, 16 bp, P. troglodytes
tgctgtccaatagaaa

SEQ ID NO: 274627 - DNA, 16 bp, P. troglodytes
tgctgtccaggctggt

SEQ ID NO: 274628 - DNA, 16 bp, P. troglodytes
tgctgtccttgtggta

SEQ ID NO: 274629 - DNA, 16 bp, P. troglodytes
tgctgtctgggagcca

SEQ ID NO: 274630 - DNA, 16 bp, P. troglodytes
tgctgtctttgttctg

SEQ ID NO: 274631 - DNA, 16 bp, P. troglodytes
tgctgtgaatgatggt

SEQ ID NO: 274632 - DNA, 16 bp, P. troglodytes
tgctgtgactcatgcc

SEQ ID NO: 274633 - DNA, 16 bp, P. troglodytes
tgctgtgagatggtat

SEQ ID NO: 274634 - DNA, 16 bp, P. troglodytes
tgctgtgagctatgat

SEQ ID NO: 274635 - DNA, 16 bp, P. troglodytes
tgctgtgattataggc

SEQ ID NO: 274636 - DNA, 16 bp, P. troglodytes
tgctgtgcagaagatt

SEQ ID NO: 274637 - DNA, 16 bp, P. troglodytes
tgctgtgcagaaggtt

SEQ ID NO: 274638 - DNA, 18 bp, P. troglodytes
tgctgtgctagcaatcag

SEQ ID NO: 274639 - DNA, 16 bp, P. troglodytes
tgctgtgctccagcct

SEQ ID NO: 274640 - DNA, 16 bp, P. troglodytes
tgctgtgctctctgct

SEQ ID NO: 274641 - DNA, 16 bp, P. troglodytes
tgctgtgctggcagtg

SEQ ID NO: 274642 - DNA, 16 bp, P. troglodytes
tgctgtgctgggaggt

SEQ ID NO: 274643 - DNA, 16 bp, P. troglodytes
tgctgtgctgtgctgt

SEQ ID NO: 274644 - DNA, 16 bp, P. troglodytes
tgctgtggctgagctg

SEQ ID NO: 274645 - DNA, 16 bp, P. troglodytes
tgctgtggctgctgtg

SEQ ID NO: 274646 - DNA, 16 bp, P. troglodytes
tgctgtggcttctgtg

SEQ ID NO: 274647 - DNA, 16 bp, P. troglodytes
tgctgtggtcccagct

SEQ ID NO: 274648 - DNA, 16 bp, P. troglodytes
tgctgtggtgccatct

SEQ ID NO: 274649 - DNA, 17 bp, P. troglodytes
tgctgtggtggtttgct

SEQ ID NO: 274650 - DNA, 16 bp, P. troglodytes
tgctgtggttcatgcc

SEQ ID NO: 274651 - DNA, 16 bp, P. troglodytes
tgctgtggtttctccc

SEQ ID NO: 274652 - DNA, 16 bp, P. troglodytes
tgctgtggtttgaata

SEQ ID NO: 274653 - DNA, 16 bp, P. troglodytes
tgctgtggtttgaatg

SEQ ID NO: 274654 - DNA, 16 bp, P. troglodytes
tgctgtgtccactcag

SEQ ID NO: 274655 - DNA, 16 bp, P. troglodytes
tgctgtgtgactttgg

SEQ ID NO: 274656 - DNA, 16 bp, P. troglodytes
tgctgtgtgcagccta

SEQ ID NO: 274657 - DNA, 16 bp, P. troglodytes
tgctgtgtgtgccctg

SEQ ID NO: 274658 - DNA, 16 bp, P. troglodytes
tgctgtgtgtgtctgt

SEQ ID NO: 274659 - DNA, 16 bp, P. troglodytes
tgctgtgttttgatta

SEQ ID NO: 274660 - DNA, 16 bp, P. troglodytes
tgctgtgtttttcaac

SEQ ID NO: 274661 - DNA, 16 bp, P. troglodytes
tgctgttaataaatac

SEQ ID NO: 274662 - DNA, 16 bp, P. troglodytes
tgctgttattattatt

SEQ ID NO: 274663 - DNA, 16 bp, P. troglodytes
tgctgttcccactgcc

SEQ ID NO: 274664 - DNA, 16 bp, P. troglodytes
tgctgttccctctgct

SEQ ID NO: 274665 - DNA, 16 bp, P. troglodytes
tgctgttccctttgct

SEQ ID NO: 274666 - DNA, 16 bp, P. troglodytes
tgctgttcctgctgcc

SEQ ID NO: 274667 - DNA, 16 bp, P. troglodytes
tgctgttccttgaaca

SEQ ID NO: 274668 - DNA, 16 bp, P. troglodytes
tgctgttctcaggata

SEQ ID NO: 274669 - DNA, 16 bp, P. troglodytes
tgctgttctcatgaca

SEQ ID NO: 274670 - DNA, 16 bp, P. troglodytes
tgctgttctcgtgata

SEQ ID NO: 274671 - DNA, 16 bp, P. troglodytes
tgctgttgaattctgt

SEQ ID NO: 274672 - DNA, 16 bp, P. troglodytes
tgctgttgagatgttt

SEQ ID NO: 274673 - DNA, 16 bp, P. troglodytes
tgctgttgctgctgcc

SEQ ID NO: 274674 - DNA, 16 bp, P. troglodytes
tgctgttgctgctgct

SEQ ID NO: 274675 - DNA, 16 bp, P. troglodytes
tgctgttggatttgat

SEQ ID NO: 274676 - DNA, 16 bp, P. troglodytes
tgctgttgggaatgta

SEQ ID NO: 274677 - DNA, 16 bp, P. troglodytes
tgctgttgttgctgct

SEQ ID NO: 274678 - DNA, 16 bp, P. troglodytes
tgctgttgtttcttat

SEQ ID NO: 274679 - DNA, 16 bp, P. troglodytes
tgctgttgttttaaag

SEQ ID NO: 274680 - DNA, 16 bp, P. troglodytes
tgctgtttagaaattt

SEQ ID NO: 274681 - DNA, 16 bp, P. troglodytes
tgctgtttgttgcctg

SEQ ID NO: 274682 - DNA, 16 bp, P. troglodytes
tgctgttttctctgct

SEQ ID NO: 274683 - DNA, 16 bp, P. troglodytes
tgctgttttttaaaat

SEQ ID NO: 274684 - DNA, 16 bp, P. troglodytes
tgcttaaaaaacaaaa

SEQ ID NO: 274685 - DNA, 16 bp, P. troglodytes
tgcttaaaaatgcaga

SEQ ID NO: 274686 - DNA, 16 bp, P. troglodytes
tgcttaaaacccttca

SEQ ID NO: 274687 - DNA, 16 bp, P. troglodytes
tgcttaaaatccttca

SEQ ID NO: 274688 - DNA, 16 bp, P. troglodytes
tgcttaacattactaa

SEQ ID NO: 274689 - DNA, 16 bp, P. troglodytes
tgcttaagatcacaca

SEQ ID NO: 274690 - DNA, 16 bp, P. troglodytes
tgcttaagattgtctt

SEQ ID NO: 274691 - DNA, 16 bp, P. troglodytes
tgcttaatggtgtccc

SEQ ID NO: 274692 - DNA, 16 bp, P. troglodytes
tgcttaattttcatgt

SEQ ID NO: 274693 - DNA, 16 bp, P. troglodytes
tgcttactatgtgcca

SEQ ID NO: 274694 - DNA, 16 bp, P. troglodytes
tgcttactatgtgcct

SEQ ID NO: 274695 - DNA, 16 bp, P. troglodytes
tgcttactgcagcctt

SEQ ID NO: 274696 - DNA, 16 bp, P. troglodytes
tgcttagaaaattctt

SEQ ID NO: 274697 - DNA, 16 bp, P. troglodytes
tgcttagaaatttctt

SEQ ID NO: 274698 - DNA, 16 bp, P. troglodytes
tgcttagcttccaaga

SEQ ID NO: 274699 - DNA, 16 bp, P. troglodytes
tgcttataatcccagc

SEQ ID NO: 274700 - DNA, 16 bp, P. troglodytes
tgcttatcaagttgct

SEQ ID NO: 274701 - DNA, 16 bp, P. troglodytes
tgcttatctttttaaa

SEQ ID NO: 274702 - DNA, 16 bp, P. troglodytes
tgcttattggctattt

SEQ ID NO: 274703 - DNA, 16 bp, P. troglodytes
tgcttatttcacattg

SEQ ID NO: 274704 - DNA, 16 bp, P. troglodytes
tgcttattttacagat

SEQ ID NO: 274705 - DNA, 16 bp, P. troglodytes
tgcttatttttaaaat

SEQ ID NO: 274706 - DNA, 16 bp, P. troglodytes
tgcttatttttattga

SEQ ID NO: 274707 - DNA, 16 bp, P. troglodytes
tgcttcaaagatggca

SEQ ID NO: 274708 - DNA, 16 bp, P. troglodytes
tgcttcactgtcttct

SEQ ID NO: 274709 - DNA, 16 bp, P. troglodytes
tgcttcagaaggtgca

SEQ ID NO: 274710 - DNA, 17 bp, P. troglodytes
tgcttcagcacaagtgt

SEQ ID NO: 274711 - DNA, 16 bp, P. troglodytes
tgcttcagccgccgcc

SEQ ID NO: 274712 - DNA, 16 bp, P. troglodytes
tgcttcagcctcctca

SEQ ID NO: 274713 - DNA, 16 bp, P. troglodytes
tgcttcagcctctcaa

SEQ ID NO: 274714 - DNA, 16 bp, P. troglodytes
tgcttcagtttcttta

SEQ ID NO: 274715 - DNA, 16 bp, P. troglodytes
tgcttcattcaggagc

SEQ ID NO: 274716 - DNA, 16 bp, P. troglodytes
tgcttccaaaatacag

SEQ ID NO: 274717 - DNA, 16 bp, P. troglodytes
tgcttccagctgcttc

SEQ ID NO: 274718 - DNA, 16 bp, P. troglodytes
tgcttccatcttttgc

SEQ ID NO: 274719 - DNA, 16 bp, P. troglodytes
tgcttccattgtcaca

SEQ ID NO: 274720 - DNA, 16 bp, P. troglodytes
tgcttcccaggttcaa

SEQ ID NO: 274721 - DNA, 16 bp, P. troglodytes
tgcttccccttcaccc

SEQ ID NO: 274722 - DNA, 16 bp, P. troglodytes
tgcttccccttctacc

SEQ ID NO: 274723 - DNA, 16 bp, P. troglodytes
tgcttccccttctgcc

SEQ ID NO: 274724 - DNA, 16 bp, P. troglodytes
tgcttcctctcattct

SEQ ID NO: 274725 - DNA, 16 bp, P. troglodytes
tgcttcctctctcacc

SEQ ID NO: 274726 - DNA, 16 bp, P. troglodytes
tgcttcctcttccacc

SEQ ID NO: 274727 - DNA, 16 bp, P. troglodytes
tgcttcctcttctgcc

SEQ ID NO: 274728 - DNA, 16 bp, P. troglodytes
tgcttcctgccctcca

SEQ ID NO: 274729 - DNA, 16 bp, P. troglodytes
tgcttcctgtaaagcc

SEQ ID NO: 274730 - DNA, 16 bp, P. troglodytes
tgcttcctgtacagcc

SEQ ID NO: 274731 - DNA, 16 bp, P. troglodytes
tgcttcctgtcctcaa

SEQ ID NO: 274732 - DNA, 16 bp, P. troglodytes
tgcttctaaccaacag

SEQ ID NO: 274733 - DNA, 16 bp, P. troglodytes
tgcttctccttctgcc

SEQ ID NO: 274734 - DNA, 16 bp, P. troglodytes
tgcttctctccaccca

SEQ ID NO: 274735 - DNA, 16 bp, P. troglodytes
tgcttctgatcacaga

SEQ ID NO: 274736 - DNA, 16 bp, P. troglodytes
tgcttctgctgctgct

SEQ ID NO: 274737 - DNA, 16 bp, P. troglodytes
tgcttctgtctggttt

SEQ ID NO: 274738 - DNA, 16 bp, P. troglodytes
tgcttctgtttatatg

SEQ ID NO: 274739 - DNA, 16 bp, P. troglodytes
tgcttcttaattcagt

SEQ ID NO: 274740 - DNA, 16 bp, P. troglodytes
tgcttcttctacatct

SEQ ID NO: 274741 - DNA, 16 bp, P. troglodytes
tgcttgaaccaaggag

SEQ ID NO: 274742 - DNA, 18 bp, P. troglodytes
tgcttgaacccaagaggt

SEQ ID NO: 274743 - DNA, 16 bp, P. troglodytes
tgcttgaacccagagg

SEQ ID NO: 274744 - DNA, 16 bp, P. troglodytes
tgcttgaacccaggag

SEQ ID NO: 274745 - DNA, 16 bp, P. troglodytes
tgcttgaaccggggag

SEQ ID NO: 274746 - DNA, 16 bp, P. troglodytes
tgcttgaacctggagg

SEQ ID NO: 274747 - DNA, 17 bp, P. troglodytes
tgcttgaacctgtgagg

SEQ ID NO: 274748 - DNA, 16 bp, P. troglodytes
tgcttgaactcagaag

SEQ ID NO: 274749 - DNA, 18 bp, P. troglodytes
tgcttgaactcaggaggt

SEQ ID NO: 274750 - DNA, 16 bp, P. troglodytes
tgcttgaactcatgag

SEQ ID NO: 274751 - DNA, 16 bp, P. troglodytes
tgcttgaacttgggag

SEQ ID NO: 274752 - DNA, 16 bp, P. troglodytes
tgcttgactaattttt

SEQ ID NO: 274753 - DNA, 16 bp, P. troglodytes
tgcttgagcacaggag

SEQ ID NO: 274754 - DNA, 16 bp, P. troglodytes
tgcttgagccaaggaa

SEQ ID NO: 274755 - DNA, 16 bp, P. troglodytes
tgcttgagcccaggca

SEQ ID NO: 274756 - DNA, 16 bp, P. troglodytes
tgcttgagcccatgag

SEQ ID NO: 274757 - DNA, 16 bp, P. troglodytes
tgcttgagcctaggtg

SEQ ID NO: 274758 - DNA, 16 bp, P. troglodytes
tgcttgagctgggagg

SEQ ID NO: 274759 - DNA, 16 bp, P. troglodytes
tgcttgaggtattttg

SEQ ID NO: 274760 - DNA, 16 bp, P. troglodytes
tgcttgagtccagaaa

SEQ ID NO: 274761 - DNA, 16 bp, P. troglodytes
tgcttgataaatatta

SEQ ID NO: 274762 - DNA, 16 bp, P. troglodytes
tgcttgattttccaaa

SEQ ID NO: 274763 - DNA, 16 bp, P. troglodytes
tgcttgatttttctcc

SEQ ID NO: 274764 - DNA, 16 bp, P. troglodytes
tgcttgcagtgcagcc

SEQ ID NO: 274765 - DNA, 17 bp, P. troglodytes
tgcttgctgccatgtaa

SEQ ID NO: 274766 - DNA, 16 bp, P. troglodytes
tgcttgcttgctttcc

SEQ ID NO: 274767 - DNA, 16 bp, P. troglodytes
tgcttggaaaaaaaaa

SEQ ID NO: 274768 - DNA, 16 bp, P. troglodytes
tgcttggcacacagca

SEQ ID NO: 274769 - DNA, 16 bp, P. troglodytes
tgcttggctcagagcc

SEQ ID NO: 274770 - DNA, 16 bp, P. troglodytes
tgcttggtgttctctg

SEQ ID NO: 274771 - DNA, 16 bp, P. troglodytes
tgcttggtttatttca

SEQ ID NO: 274772 - DNA, 16 bp, P. troglodytes
tgcttgtaaatatttt

SEQ ID NO: 274773 - DNA, 16 bp, P. troglodytes
tgcttgtagtcccacc

SEQ ID NO: 274774 - DNA, 16 bp, P. troglodytes
tgcttgtgcccaggag

SEQ ID NO: 274775 - DNA, 16 bp, P. troglodytes
tgcttgtgtgcatgtg

SEQ ID NO: 274776 - DNA, 16 bp, P. troglodytes
tgcttgtgtttttgca

SEQ ID NO: 274777 - DNA, 16 bp, P. troglodytes
tgcttgttgagttgtt

SEQ ID NO: 274778 - DNA, 16 bp, P. troglodytes
tgcttgtttgtttgag

SEQ ID NO: 274779 - DNA, 16 bp, P. troglodytes
tgcttgttttttgtca

SEQ ID NO: 274780 - DNA, 16 bp, P. troglodytes
tgctttaaaaaacaaa

SEQ ID NO: 274781 - DNA, 16 bp, P. troglodytes
tgctttaaaaagatta

SEQ ID NO: 274782 - DNA, 16 bp, P. troglodytes
tgctttaaaatgttta

SEQ ID NO: 274783 - DNA, 16 bp, P. troglodytes
tgctttaaagaaaata

SEQ ID NO: 274784 - DNA, 16 bp, P. troglodytes
tgctttacaaaaagtt

SEQ ID NO: 274785 - DNA, 16 bp, P. troglodytes
tgctttacatgcatta

SEQ ID NO: 274786 - DNA, 16 bp, P. troglodytes
tgctttactcagtcta

SEQ ID NO: 274787 - DNA, 16 bp, P. troglodytes
tgctttagctattcag

SEQ ID NO: 274788 - DNA, 16 bp, P. troglodytes
tgctttagctgcattc

SEQ ID NO: 274789 - DNA, 16 bp, P. troglodytes
tgctttatatatttta

SEQ ID NO: 274790 - DNA, 16 bp, P. troglodytes
tgctttatgtatatta

SEQ ID NO: 274791 - DNA, 16 bp, P. troglodytes
tgctttattctttcct

SEQ ID NO: 274792 - DNA, 16 bp, P. troglodytes
tgctttattttctcca

SEQ ID NO: 274793 - DNA, 16 bp, P. troglodytes
tgctttcaaggagctc

SEQ ID NO: 274794 - DNA, 16 bp, P. troglodytes
tgctttcaatattttt

SEQ ID NO: 274795 - DNA, 16 bp, P. troglodytes
tgctttcaattctttt

SEQ ID NO: 274796 - DNA, 16 bp, P. troglodytes
tgctttcagtgtttta

SEQ ID NO: 274797 - DNA, 16 bp, P. troglodytes
tgctttcagtttttcc

SEQ ID NO: 274798 - DNA, 16 bp, P. troglodytes
tgctttcatggtcatt

SEQ ID NO: 274799 - DNA, 16 bp, P. troglodytes
tgctttcattgcttca

SEQ ID NO: 274800 - DNA, 16 bp, P. troglodytes
tgctttcattttcctt

SEQ ID NO: 274801 - DNA, 16 bp, P. troglodytes
tgctttccagagagca

SEQ ID NO: 274802 - DNA, 16 bp, P. troglodytes
tgctttccagggaaca

SEQ ID NO: 274803 - DNA, 16 bp, P. troglodytes
tgctttccatttcctt

SEQ ID NO: 274804 - DNA, 16 bp, P. troglodytes
tgctttccttctggga

SEQ ID NO: 274805 - DNA, 16 bp, P. troglodytes
tgctttccttttaaaa

SEQ ID NO: 274806 - DNA, 16 bp, P. troglodytes
tgctttctgccatgat

SEQ ID NO: 274807 - DNA, 16 bp, P. troglodytes
tgctttctgccatgtg

SEQ ID NO: 274808 - DNA, 16 bp, P. troglodytes
tgctttctgtctctac

SEQ ID NO: 274809 - DNA, 16 bp, P. troglodytes
tgctttcttaatttct

SEQ ID NO: 274810 - DNA, 16 bp, P. troglodytes
tgctttctttcctcca

SEQ ID NO: 274811 - DNA, 16 bp, P. troglodytes
tgctttgaaaatattt

SEQ ID NO: 274812 - DNA, 16 bp, P. troglodytes
tgctttgcatgtatta

SEQ ID NO: 274813 - DNA, 16 bp, P. troglodytes
tgctttgctgtctgtg

SEQ ID NO: 274814 - DNA, 16 bp, P. troglodytes
tgctttggatgttgcc

SEQ ID NO: 274815 - DNA, 18 bp, P. troglodytes
tgctttggcctcccaaag

SEQ ID NO: 274816 - DNA, 16 bp, P. troglodytes
tgctttggctgcctgt

SEQ ID NO: 274817 - DNA, 16 bp, P. troglodytes
tgctttgggaagctga

SEQ ID NO: 274818 - DNA, 16 bp, P. troglodytes
tgctttgggaagtatg

SEQ ID NO: 274819 - DNA, 16 bp, P. troglodytes
tgctttgggaggttga

SEQ ID NO: 274820 - DNA, 16 bp, P. troglodytes
tgctttgggcagtatt

SEQ ID NO: 274821 - DNA, 16 bp, P. troglodytes
tgctttgtcacccaag

SEQ ID NO: 274822 - DNA, 16 bp, P. troglodytes
tgctttgtctcttcag

SEQ ID NO: 274823 - DNA, 16 bp, P. troglodytes
tgctttgtgcattttg

SEQ ID NO: 274824 - DNA, 16 bp, P. troglodytes
tgctttgtgcctcagt

SEQ ID NO: 274825 - DNA, 16 bp, P. troglodytes
tgctttgttccccagg

SEQ ID NO: 274826 - DNA, 16 bp, P. troglodytes
tgcttttaaaaaaaaa

SEQ ID NO: 274827 - DNA, 16 bp, P. troglodytes
tgcttttaaaaaaaat

SEQ ID NO: 274828 - DNA, 16 bp, P. troglodytes
tgcttttaaaataaag

SEQ ID NO: 274829 - DNA, 16 bp, P. troglodytes
tgcttttaaaattctt

SEQ ID NO: 274830 - DNA, 16 bp, P. troglodytes
tgcttttaaaatttct

SEQ ID NO: 274831 - DNA, 16 bp, P. troglodytes
tgcttttaaggttttc

SEQ ID NO: 274832 - DNA, 16 bp, P. troglodytes
tgcttttaatggcaaa

SEQ ID NO: 274833 - DNA, 16 bp, P. troglodytes
tgcttttaatttaatt

SEQ ID NO: 274834 - DNA, 16 bp, P. troglodytes
tgcttttaattttaaa

SEQ ID NO: 274835 - DNA, 16 bp, P. troglodytes
tgcttttataacaaac

SEQ ID NO: 274836 - DNA, 16 bp, P. troglodytes
tgcttttatacatttt

SEQ ID NO: 274837 - DNA, 16 bp, P. troglodytes
tgcttttatattttaa

SEQ ID NO: 274838 - DNA, 16 bp, P. troglodytes
tgcttttatgagtttg

SEQ ID NO: 274839 - DNA, 16 bp, P. troglodytes
tgcttttattgcaatt

SEQ ID NO: 274840 - DNA, 16 bp, P. troglodytes
tgcttttattgcccag

SEQ ID NO: 274841 - DNA, 16 bp, P. troglodytes
tgcttttatttcctta

SEQ ID NO: 274842 - DNA, 16 bp, P. troglodytes
tgcttttattttgaaa

SEQ ID NO: 274843 - DNA, 16 bp, P. troglodytes
tgcttttcattcattt

SEQ ID NO: 274844 - DNA, 16 bp, P. troglodytes
tgcttttcatttttca

SEQ ID NO: 274845 - DNA, 16 bp, P. troglodytes
tgcttttccagttctt

SEQ ID NO: 274846 - DNA, 16 bp, P. troglodytes
tgcttttccttctgcc

SEQ ID NO: 274847 - DNA, 16 bp, P. troglodytes
tgcttttctatacaat

SEQ ID NO: 274848 - DNA, 16 bp, P. troglodytes
tgcttttctcttgctg

SEQ ID NO: 274849 - DNA, 16 bp, P. troglodytes
tgcttttcttcattct

SEQ ID NO: 274850 - DNA, 16 bp, P. troglodytes
tgcttttcttttctaa

SEQ ID NO: 274851 - DNA, 16 bp, P. troglodytes
tgcttttgacagtatg

SEQ ID NO: 274852 - DNA, 16 bp, P. troglodytes
tgcttttgatgtgcat

SEQ ID NO: 274853 - DNA, 16 bp, P. troglodytes
tgcttttgcaccattg

SEQ ID NO: 274854 - DNA, 16 bp, P. troglodytes
tgcttttgcacctttg

SEQ ID NO: 274855 - DNA, 16 bp, P. troglodytes
tgcttttgcatttttg

SEQ ID NO: 274856 - DNA, 16 bp, P. troglodytes
tgcttttggcagtatg

SEQ ID NO: 274857 - DNA, 16 bp, P. troglodytes
tgcttttggtgatttt

SEQ ID NO: 274858 - DNA, 16 bp, P. troglodytes
tgcttttggtgtcttc

SEQ ID NO: 274859 - DNA, 16 bp, P. troglodytes
tgcttttgttgcttca

SEQ ID NO: 274860 - DNA, 16 bp, P. troglodytes
tgctttttaaaaaaca

SEQ ID NO: 274861 - DNA, 16 bp, P. troglodytes
tgctttttaaaaaata

SEQ ID NO: 274862 - DNA, 16 bp, P. troglodytes
tgctttttaaaaaatt

SEQ ID NO: 274863 - DNA, 16 bp, P. troglodytes
tgctttttaaaaatca

SEQ ID NO: 274864 - DNA, 16 bp, P. troglodytes
tgctttttaaatattt

SEQ ID NO: 274865 - DNA, 16 bp, P. troglodytes
tgctttttattaaaag

SEQ ID NO: 274866 - DNA, 16 bp, P. troglodytes
tgctttttcaagttta

SEQ ID NO: 274867 - DNA, 16 bp, P. troglodytes
tgctttttctgtatcc

SEQ ID NO: 274868 - DNA, 16 bp, P. troglodytes
tgctttttgcaaccaa

SEQ ID NO: 274869 - DNA, 16 bp, P. troglodytes
tgcttttttaaaaaaa

SEQ ID NO: 274870 - DNA, 16 bp, P. troglodytes
tgcttttttcacttaa

SEQ ID NO: 274871 - DNA, 17 bp, P. troglodytes
tgcttttttcttgtaaa

SEQ ID NO: 274872 - DNA, 16 bp, P. troglodytes
tggaaaaaaaatcact

SEQ ID NO: 274873 - DNA, 16 bp, P. troglodytes
tggaaaaaaaattcca

SEQ ID NO: 274874 - DNA, 16 bp, P. troglodytes
tggaaaaaaatgttca

SEQ ID NO: 274875 - DNA, 16 bp, P. troglodytes
tggaaaaaaattacaa

SEQ ID NO: 274876 - DNA, 16 bp, P. troglodytes
tggaaaaaatgctcaa

SEQ ID NO: 274877 - DNA, 16 bp, P. troglodytes
tggaaaaacctttcta

SEQ ID NO: 274878 - DNA, 16 bp, P. troglodytes
tggaaaaactggaaaa

SEQ ID NO: 274879 - DNA, 16 bp, P. troglodytes
tggaaaaactggatat

SEQ ID NO: 274880 - DNA, 16 bp, P. troglodytes
tggaaaaactgttttt

SEQ ID NO: 274881 - DNA, 16 bp, P. troglodytes
tggaaaaagaaaaact

SEQ ID NO: 274882 - DNA, 16 bp, P. troglodytes
tggaaaaagaagaatt

SEQ ID NO: 274883 - DNA, 16 bp, P. troglodytes
tggaaaaagacaagga

SEQ ID NO: 274884 - DNA, 16 bp, P. troglodytes
tggaaaaagagggaat

SEQ ID NO: 274885 - DNA, 16 bp, P. troglodytes
tggaaaaatattttct

SEQ ID NO: 274886 - DNA, 16 bp, P. troglodytes
tggaaaaatcctcaac

SEQ ID NO: 274887 - DNA, 16 bp, P. troglodytes
tggaaaaatccttcta

SEQ ID NO: 274888 - DNA, 16 bp, P. troglodytes
tggaaaaatctaaaga

SEQ ID NO: 274889 - DNA, 16 bp, P. troglodytes
tggaaaaatgaaatat

SEQ ID NO: 274890 - DNA, 16 bp, P. troglodytes
tggaaaaattatcttc

SEQ ID NO: 274891 - DNA, 16 bp, P. troglodytes
tggaaaaattgtcttc

SEQ ID NO: 274892 - DNA, 16 bp, P. troglodytes
tggaaaacaaaacatt

SEQ ID NO: 274893 - DNA, 16 bp, P. troglodytes
tggaaaacaatgaaaa

SEQ ID NO: 274894 - DNA, 17 bp, P. troglodytes
tggaaaacactcttcag

SEQ ID NO: 274895 - DNA, 16 bp, P. troglodytes
tggaaaacagaagaaa

SEQ ID NO: 274896 - DNA, 16 bp, P. troglodytes
tggaaaacagaatgga

SEQ ID NO: 274897 - DNA, 16 bp, P. troglodytes
tggaaaacagaatggt

SEQ ID NO: 274898 - DNA, 16 bp, P. troglodytes
tggaaaacagtatttt

SEQ ID NO: 274899 - DNA, 16 bp, P. troglodytes
tggaaaacagtttggc

SEQ ID NO: 274900 - DNA, 16 bp, P. troglodytes
tggaaaacatggaaaa

SEQ ID NO: 274901 - DNA, 16 bp, P. troglodytes
tggaaaacattaaaaa

SEQ ID NO: 274902 - DNA, 16 bp, P. troglodytes
tggaaaacattttaaa

SEQ ID NO: 274903 - DNA, 16 bp, P. troglodytes
tggaaaacatttttat

SEQ ID NO: 274904 - DNA, 16 bp, P. troglodytes
tggaaaaccaaatatt

SEQ ID NO: 274905 - DNA, 16 bp, P. troglodytes
tggaaaaccacttaaa

SEQ ID NO: 274906 - DNA, 16 bp, P. troglodytes
tggaaaacctggaaga

SEQ ID NO: 274907 - DNA, 16 bp, P. troglodytes
tggaaaacggtatgga

SEQ ID NO: 274908 - DNA, 16 bp, P. troglodytes
tggaaaagaaaatgtg

SEQ ID NO: 274909 - DNA, 16 bp, P. troglodytes
tggaaaagaacagagg

SEQ ID NO: 274910 - DNA, 16 bp, P. troglodytes
tggaaaagaacagata

SEQ ID NO: 274911 - DNA, 16 bp, P. troglodytes
tggaaaagacagaaaa

SEQ ID NO: 274912 - DNA, 17 bp, P. troglodytes
tggaaaagaggaagtca

SEQ ID NO: 274913 - DNA, 16 bp, P. troglodytes
tggaaaagagtgtgga

SEQ ID NO: 274914 - DNA, 16 bp, P. troglodytes
tggaaaagcaaaatgt

SEQ ID NO: 274915 - DNA, 16 bp, P. troglodytes
tggaaaagcaagaaaa

SEQ ID NO: 274916 - DNA, 16 bp, P. troglodytes
tggaaaagcctcagac

SEQ ID NO: 274917 - DNA, 16 bp, P. troglodytes
tggaaaaggaaaaact

SEQ ID NO: 274918 - DNA, 16 bp, P. troglodytes
tggaaaaggcaaaaaa

SEQ ID NO: 274919 - DNA, 16 bp, P. troglodytes
tggaaaaggcaaagaa

SEQ ID NO: 274920 - DNA, 16 bp, P. troglodytes
tggaaaaggcaagaaa

SEQ ID NO: 274921 - DNA, 16 bp, P. troglodytes
tggaaaagtaaaatat

SEQ ID NO: 274922 - DNA, 16 bp, P. troglodytes
tggaaaagtttgaaat

SEQ ID NO: 274923 - DNA, 16 bp, P. troglodytes
tggaaaataatacaaa

SEQ ID NO: 274924 - DNA, 16 bp, P. troglodytes
tggaaaataatatttt

SEQ ID NO: 274925 - DNA, 16 bp, P. troglodytes
tggaaaatacagaaaa

SEQ ID NO: 274926 - DNA, 16 bp, P. troglodytes
tggaaaatacagaaga

SEQ ID NO: 274927 - DNA, 16 bp, P. troglodytes
tggaaaatagaaaatg

SEQ ID NO: 274928 - DNA, 16 bp, P. troglodytes
tggaaaatatatttca

SEQ ID NO: 274929 - DNA, 16 bp, P. troglodytes
tggaaaatattagaaa

SEQ ID NO: 274930 - DNA, 16 bp, P. troglodytes
tggaaaatattatttt

SEQ ID NO: 274931 - DNA, 16 bp, P. troglodytes
tggaaaatattttaaa

SEQ ID NO: 274932 - DNA, 16 bp, P. troglodytes
tggaaaatcacttgaa

SEQ ID NO: 274933 - DNA, 16 bp, P. troglodytes
tggaaaatcccaaaat

SEQ ID NO: 274934 - DNA, 16 bp, P. troglodytes
tggaaaatcccagaaa

SEQ ID NO: 274935 - DNA, 16 bp, P. troglodytes
tggaaaatcgggacac

SEQ ID NO: 274936 - DNA, 16 bp, P. troglodytes
tggaaaatctcagcaa

SEQ ID NO: 274937 - DNA, 16 bp, P. troglodytes
tggaaaatgcaaaact

SEQ ID NO: 274938 - DNA, 16 bp, P. troglodytes
tggaaaatggaaaaat

SEQ ID NO: 274939 - DNA, 16 bp, P. troglodytes
tggaaaattatttcaa

SEQ ID NO: 274940 - DNA, 16 bp, P. troglodytes
tggaaaattcaaaaat

SEQ ID NO: 274941 - DNA, 16 bp, P. troglodytes
tggaaaatttgaagcc

SEQ ID NO: 274942 - DNA, 16 bp, P. troglodytes
tggaaaatttgcagca

SEQ ID NO: 274943 - DNA, 16 bp, P. troglodytes
tggaaaatttgcagcc

SEQ ID NO: 274944 - DNA, 16 bp, P. troglodytes
tggaaacaaaagaaca

SEQ ID NO: 274945 - DNA, 16 bp, P. troglodytes
tggaaacaaatggaaa

SEQ ID NO: 274946 - DNA, 16 bp, P. troglodytes
tggaaacaacccatat

SEQ ID NO: 274947 - DNA, 16 bp, P. troglodytes
tggaaacaacctaagt

SEQ ID NO: 274948 - DNA, 16 bp, P. troglodytes
tggaaacaatccaagt

SEQ ID NO: 274949 - DNA, 16 bp, P. troglodytes
tggaaacaatcttttt

SEQ ID NO: 274950 - DNA, 16 bp, P. troglodytes
tggaaacacacacaca

SEQ ID NO: 274951 - DNA, 16 bp, P. troglodytes
tggaaacacatcaaaa

SEQ ID NO: 274952 - DNA, 16 bp, P. troglodytes
tggaaacactgatttt

SEQ ID NO: 274953 - DNA, 16 bp, P. troglodytes
tggaaacactgtattt

SEQ ID NO: 274954 - DNA, 16 bp, P. troglodytes
tggaaacagaaaatca

SEQ ID NO: 274955 - DNA, 16 bp, P. troglodytes
tggaaacagaagaaaa

SEQ ID NO: 274956 - DNA, 16 bp, P. troglodytes
tggaaacagtgttttt

SEQ ID NO: 274957 - DNA, 16 bp, P. troglodytes
tggaaacattccaaat

SEQ ID NO: 274958 - DNA, 16 bp, P. troglodytes
tggaaacattttcttt

SEQ ID NO: 274959 - DNA, 16 bp, P. troglodytes
tggaaacatttttatt

SEQ ID NO: 274960 - DNA, 16 bp, P. troglodytes
tggaaacatttttgat

SEQ ID NO: 274961 - DNA, 16 bp, P. troglodytes
tggaaaccaacattct

SEQ ID NO: 274962 - DNA, 16 bp, P. troglodytes
tggaaaccactgatct

SEQ ID NO: 274963 - DNA, 16 bp, P. troglodytes
tggaaaccactggagt

SEQ ID NO: 274964 - DNA, 16 bp, P. troglodytes
tggaaaccagcattct

SEQ ID NO: 274965 - DNA, 31 bp, P. troglodytes
tggaaaccatcattctcagcaaactatcgca

SEQ ID NO: 274966 - DNA, 16 bp, P. troglodytes
tggaaactcagaaatg

SEQ ID NO: 274967 - DNA, 31 bp, P. troglodytes
tggaaactgaacaacctgctcctgaatgact

SEQ ID NO: 274968 - DNA, 16 bp, P. troglodytes
tggaaactgaacaagc

SEQ ID NO: 274969 - DNA, 16 bp, P. troglodytes
tggaaactgaggcaga

SEQ ID NO: 274970 - DNA, 16 bp, P. troglodytes
tggaaactggaataaa

SEQ ID NO: 274971 - DNA, 16 bp, P. troglodytes
tggaaacttaattccc

SEQ ID NO: 274972 - DNA, 16 bp, P. troglodytes
tggaaacttcctgagg

SEQ ID NO: 274973 - DNA, 16 bp, P. troglodytes
tggaaagaaaagacca

SEQ ID NO: 274974 - DNA, 16 bp, P. troglodytes
tggaaagaaaataatt

SEQ ID NO: 274975 - DNA, 16 bp, P. troglodytes
tggaaagaaacaaccg

SEQ ID NO: 274976 - DNA, 16 bp, P. troglodytes
tggaaagaaggaagtc

SEQ ID NO: 274977 - DNA, 16 bp, P. troglodytes
tggaaagagcactgga

SEQ ID NO: 274978 - DNA, 16 bp, P. troglodytes
tggaaagatatttcat

SEQ ID NO: 274979 - DNA, 16 bp, P. troglodytes
tggaaagcaaaaaaga

SEQ ID NO: 274980 - DNA, 16 bp, P. troglodytes
tggaaagcaaaataaa

SEQ ID NO: 274981 - DNA, 16 bp, P. troglodytes
tggaaagcagaaaaaa

SEQ ID NO: 274982 - DNA, 16 bp, P. troglodytes
tggaaagcagtctggc

SEQ ID NO: 274983 - DNA, 16 bp, P. troglodytes
tggaaagccactgaag

SEQ ID NO: 274984 - DNA, 16 bp, P. troglodytes
tggaaaggaagaattc

SEQ ID NO: 274985 - DNA, 16 bp, P. troglodytes
tggaaaggagatggag

SEQ ID NO: 274986 - DNA, 16 bp, P. troglodytes
tggaaaggaggaagtc

SEQ ID NO: 274987 - DNA, 16 bp, P. troglodytes
tggaaaggaggctgaa

SEQ ID NO: 274988 - DNA, 16 bp, P. troglodytes
tggaaagtctcagcaa

SEQ ID NO: 274989 - DNA, 16 bp, P. troglodytes
tggaaataaaatttct

SEQ ID NO: 274990 - DNA, 16 bp, P. troglodytes
tggaaataataccaca

SEQ ID NO: 274991 - DNA, 16 bp, P. troglodytes
tggaaataatttcaaa

SEQ ID NO: 274992 - DNA, 16 bp, P. troglodytes
tggaaatacaaaatgg

SEQ ID NO: 274993 - DNA, 16 bp, P. troglodytes
tggaaatacaggtgtg

SEQ ID NO: 274994 - DNA, 16 bp, P. troglodytes
tggaaatactgttttt

SEQ ID NO: 274995 - DNA, 16 bp, P. troglodytes
tggaaatagagtcttt

SEQ ID NO: 274996 - DNA, 16 bp, P. troglodytes
tggaaatattctggaa

SEQ ID NO: 274997 - DNA, 16 bp, P. troglodytes
tggaaatattttgaaa

SEQ ID NO: 274998 - DNA, 16 bp, P. troglodytes
tggaaatcataataaa

SEQ ID NO: 274999 - DNA, 17 bp, P. troglodytes
tggaaatcatcattctt

SEQ ID NO: 275000 - DNA, 16 bp, P. troglodytes
tggaaatcattattct

SEQ ID NO: 275001 - DNA, 16 bp, P. troglodytes
tggaaatcattttttt

SEQ ID NO: 275002 - DNA, 16 bp, P. troglodytes
tggaaatctatcctca

SEQ ID NO: 275003 - DNA, 16 bp, P. troglodytes
tggaaatgaaaaatgg

SEQ ID NO: 275004 - DNA, 16 bp, P. troglodytes
tggaaatgaaagacat

SEQ ID NO: 275005 - DNA, 16 bp, P. troglodytes
tggaaatgaaattaaa

SEQ ID NO: 275006 - DNA, 16 bp, P. troglodytes
tggaaatgacccaaat

SEQ ID NO: 275007 - DNA, 16 bp, P. troglodytes
tggaaatgcaaaggac

SEQ ID NO: 275008 - DNA, 17 bp, P. troglodytes
tggaaatgcagaaatca

SEQ ID NO: 275009 - DNA, 16 bp, P. troglodytes
tggaaatgcctggatt

SEQ ID NO: 275010 - DNA, 16 bp, P. troglodytes
tggaaatgctcttttt

SEQ ID NO: 275011 - DNA, 16 bp, P. troglodytes
tggaaatggcttcttt

SEQ ID NO: 275012 - DNA, 16 bp, P. troglodytes
tggaaatgtaaaatta

SEQ ID NO: 275013 - DNA, 16 bp, P. troglodytes
tggaaatgtaaacttt

SEQ ID NO: 275014 - DNA, 16 bp, P. troglodytes
tggaaatgtaaattaa

SEQ ID NO: 275015 - DNA, 16 bp, P. troglodytes
tggaaattaaaatttt

SEQ ID NO: 275016 - DNA, 16 bp, P. troglodytes
tggaaattaaagaaca

SEQ ID NO: 275017 - DNA, 16 bp, P. troglodytes
tggaaattcaagatga

SEQ ID NO: 275018 - DNA, 16 bp, P. troglodytes
tggaaattgaacaact

SEQ ID NO: 275019 - DNA, 16 bp, P. troglodytes
tggaaattttaaaatt

SEQ ID NO: 275020 - DNA, 16 bp, P. troglodytes
tggaaattttaaattt

SEQ ID NO: 275021 - DNA, 16 bp, P. troglodytes
tggaacaaaagagaga

SEQ ID NO: 275022 - DNA, 16 bp, P. troglodytes
tggaacacagccatgc

SEQ ID NO: 275023 - DNA, 16 bp, P. troglodytes
tggaacacccagatat

SEQ ID NO: 275024 - DNA, 16 bp, P. troglodytes
tggaacactatgcagt

SEQ ID NO: 275025 - DNA, 16 bp, P. troglodytes
tggaacagaaagagaa

SEQ ID NO: 275026 - DNA, 16 bp, P. troglodytes
tggaacagaaagagga

SEQ ID NO: 275027 - DNA, 16 bp, P. troglodytes
tggaacagaatagaaa

SEQ ID NO: 275028 - DNA, 16 bp, P. troglodytes
tggaacagaatgaaga

SEQ ID NO: 275029 - DNA, 16 bp, P. troglodytes
tggaacagagaaagga

SEQ ID NO: 275030 - DNA, 16 bp, P. troglodytes
tggaacatgacaagga

SEQ ID NO: 275031 - DNA, 16 bp, P. troglodytes
tggaacattctccaga

SEQ ID NO: 275032 - DNA, 16 bp, P. troglodytes
tggaacattctctagg

SEQ ID NO: 275033 - DNA, 16 bp, P. troglodytes
tggaaccaaagagagc

SEQ ID NO: 275034 - DNA, 16 bp, P. troglodytes
tggaaccaacacaaat

SEQ ID NO: 275035 - DNA, 17 bp, P. troglodytes
tggaaccaacccaaatg

SEQ ID NO: 275036 - DNA, 16 bp, P. troglodytes
tggaaccagcccaaat

SEQ ID NO: 275037 - DNA, 16 bp, P. troglodytes
tggaacgatctcagct

SEQ ID NO: 275038 - DNA, 16 bp, P. troglodytes
tggaactacagatgca

SEQ ID NO: 275039 - DNA, 16 bp, P. troglodytes
tggaactacaggcgcc

SEQ ID NO: 275040 - DNA, 16 bp, P. troglodytes
tggaactacaggtgtg

SEQ ID NO: 275041 - DNA, 16 bp, P. troglodytes
tggaactccagcctgg

SEQ ID NO: 275042 - DNA, 16 bp, P. troglodytes
tggaactggaaatcat

SEQ ID NO: 275043 - DNA, 16 bp, P. troglodytes
tggaactggcagcctg

SEQ ID NO: 275044 - DNA, 16 bp, P. troglodytes
tggaactgggaaacag

SEQ ID NO: 275045 - DNA, 16 bp, P. troglodytes
tggaactgggtagcag

SEQ ID NO: 275046 - DNA, 16 bp, P. troglodytes
tggaactgtgagaaga

SEQ ID NO: 275047 - DNA, 16 bp, P. troglodytes
tggaactgtgagtgaa

SEQ ID NO: 275048 - DNA, 16 bp, P. troglodytes
tggaactgttctgtat

SEQ ID NO: 275049 - DNA, 16 bp, P. troglodytes
tggaacttcctggaga

SEQ ID NO: 275050 - DNA, 16 bp, P. troglodytes
tggaacttgaacccag

SEQ ID NO: 275051 - DNA, 16 bp, P. troglodytes
tggaactttaaaaaat

SEQ ID NO: 275052 - DNA, 16 bp, P. troglodytes
tggaagaaaaaaatct

SEQ ID NO: 275053 - DNA, 16 bp, P. troglodytes
tggaagaaaaaatatt

SEQ ID NO: 275054 - DNA, 16 bp, P. troglodytes
tggaagaaaacataga

SEQ ID NO: 275055 - DNA, 16 bp, P. troglodytes
tggaagaaaacatttc

SEQ ID NO: 275056 - DNA, 16 bp, P. troglodytes
tggaagaaaagaaatt

SEQ ID NO: 275057 - DNA, 16 bp, P. troglodytes
tggaagaaaatgtttt

SEQ ID NO: 275058 - DNA, 16 bp, P. troglodytes
tggaagaaacttctaa

SEQ ID NO: 275059 - DNA, 16 bp, P. troglodytes
tggaagaaagaattca

SEQ ID NO: 275060 - DNA, 16 bp, P. troglodytes
tggaagaaagagtatc

SEQ ID NO: 275061 - DNA, 18 bp, P. troglodytes
tggaagaaagggtatcag

SEQ ID NO: 275062 - DNA, 16 bp, P. troglodytes
tggaagaaagtgtatc

SEQ ID NO: 275063 - DNA, 16 bp, P. troglodytes
tggaagaagaagaatt

SEQ ID NO: 275064 - DNA, 16 bp, P. troglodytes
tggaagaagcaaggaa

SEQ ID NO: 275065 - DNA, 16 bp, P. troglodytes
tggaagaagtgactgt

SEQ ID NO: 275066 - DNA, 16 bp, P. troglodytes
tggaagaatggcttga

SEQ ID NO: 275067 - DNA, 16 bp, P. troglodytes
tggaagaattacttga

SEQ ID NO: 275068 - DNA, 16 bp, P. troglodytes
tggaagaatttgagaa

SEQ ID NO: 275069 - DNA, 16 bp, P. troglodytes
tggaagaatttgtgaa

SEQ ID NO: 275070 - DNA, 16 bp, P. troglodytes
tggaagacaacatagg

SEQ ID NO: 275071 - DNA, 16 bp, P. troglodytes
tggaagacagtgtgat

SEQ ID NO: 275072 - DNA, 16 bp, P. troglodytes
tggaagacagtgttgc

SEQ ID NO: 275073 - DNA, 16 bp, P. troglodytes
tggaagacatttctaa

SEQ ID NO: 275074 - DNA, 16 bp, P. troglodytes
tggaagaccgaggtgg

SEQ ID NO: 275075 - DNA, 16 bp, P. troglodytes
tggaagactcaatatt

SEQ ID NO: 275076 - DNA, 16 bp, P. troglodytes
tggaagagacccaagt

SEQ ID NO: 275077 - DNA, 16 bp, P. troglodytes
tggaagagagtgtggt

SEQ ID NO: 275078 - DNA, 16 bp, P. troglodytes
tggaagaggaagcaaa

SEQ ID NO: 275079 - DNA, 16 bp, P. troglodytes
tggaagaggcaaagaa

SEQ ID NO: 275080 - DNA, 16 bp, P. troglodytes
tggaagagtttaagaa

SEQ ID NO: 275081 - DNA, 16 bp, P. troglodytes
tggaagagtttgagga

SEQ ID NO: 275082 - DNA, 16 bp, P. troglodytes
tggaagagtttgtgaa

SEQ ID NO: 275083 - DNA, 16 bp, P. troglodytes
tggaagagtttgtgta

SEQ ID NO: 275084 - DNA, 16 bp, P. troglodytes
tggaagatgaaaggca

SEQ ID NO: 275085 - DNA, 16 bp, P. troglodytes
tggaagatggtgtggc

SEQ ID NO: 275086 - DNA, 16 bp, P. troglodytes
tggaagatttaatatt

SEQ ID NO: 275087 - DNA, 16 bp, P. troglodytes
tggaagcaaccaaaat

SEQ ID NO: 275088 - DNA, 16 bp, P. troglodytes
tggaagcaacccaaat

SEQ ID NO: 275089 - DNA, 16 bp, P. troglodytes
tggaagcaattttgga

SEQ ID NO: 275090 - DNA, 16 bp, P. troglodytes
tggaagcagagagaag

SEQ ID NO: 275091 - DNA, 16 bp, P. troglodytes
tggaagcagatgctgg

SEQ ID NO: 275092 - DNA, 16 bp, P. troglodytes
tggaagcagccaagat

SEQ ID NO: 275093 - DNA, 16 bp, P. troglodytes
tggaagcagctggagg

SEQ ID NO: 275094 - DNA, 16 bp, P. troglodytes
tggaagcaggaagacc

SEQ ID NO: 275095 - DNA, 16 bp, P. troglodytes
tggaagcagtggctca

SEQ ID NO: 275096 - DNA, 16 bp, P. troglodytes
tggaagccctgacccc

SEQ ID NO: 275097 - DNA, 16 bp, P. troglodytes
tggaagctacagtgag

SEQ ID NO: 275098 - DNA, 16 bp, P. troglodytes
tggaagctctgcctcc

SEQ ID NO: 275099 - DNA, 16 bp, P. troglodytes
tggaagctgagcagat

SEQ ID NO: 275100 - DNA, 16 bp, P. troglodytes
tggaagcttcatctca

SEQ ID NO: 275101 - DNA, 16 bp, P. troglodytes
tggaagcttcctccca

SEQ ID NO: 275102 - DNA, 16 bp, P. troglodytes
tggaagcttcctgaag

SEQ ID NO: 275103 - DNA, 16 bp, P. troglodytes
tggaagcttgtgcctg

SEQ ID NO: 275104 - DNA, 16 bp, P. troglodytes
tggaagctttattctt

SEQ ID NO: 275105 - DNA, 17 bp, P. troglodytes
tggaagctttgttcttt

SEQ ID NO: 275106 - DNA, 16 bp, P. troglodytes
tggaaggaaggagtct

SEQ ID NO: 275107 - DNA, 16 bp, P. troglodytes
tggaaggaccacttga

SEQ ID NO: 275108 - DNA, 16 bp, P. troglodytes
tggaaggatcagttga

SEQ ID NO: 275109 - DNA, 16 bp, P. troglodytes
tggaaggatttttttt

SEQ ID NO: 275110 - DNA, 16 bp, P. troglodytes
tggaaggcagaagtga

SEQ ID NO: 275111 - DNA, 16 bp, P. troglodytes
tggaaggcagaggctg

SEQ ID NO: 275112 - DNA, 16 bp, P. troglodytes
tggaaggcagcaggca

SEQ ID NO: 275113 - DNA, 16 bp, P. troglodytes
tggaaggccaagatgg

SEQ ID NO: 275114 - DNA, 16 bp, P. troglodytes
tggaaggcccaggtgg

SEQ ID NO: 275115 - DNA, 16 bp, P. troglodytes
tggaaggctgaggaag

SEQ ID NO: 275116 - DNA, 16 bp, P. troglodytes
tggaaggctgatgtgg

SEQ ID NO: 275117 - DNA, 16 bp, P. troglodytes
tggaagggaaatgtgg

SEQ ID NO: 275118 - DNA, 16 bp, P. troglodytes
tggaagggcaaaaagg

SEQ ID NO: 275119 - DNA, 16 bp, P. troglodytes
tggaaggggaagtaaa

SEQ ID NO: 275120 - DNA, 16 bp, P. troglodytes
tggaaggtgaaaagca

SEQ ID NO: 275121 - DNA, 16 bp, P. troglodytes
tggaaggtgaaagagg

SEQ ID NO: 275122 - DNA, 16 bp, P. troglodytes
tggaaggtgaaaggga

SEQ ID NO: 275123 - DNA, 16 bp, P. troglodytes
tggaaggttttaagca

SEQ ID NO: 275124 - DNA, 17 bp, P. troglodytes
tggaagtaaagcactct

SEQ ID NO: 275125 - DNA, 16 bp, P. troglodytes
tggaagtcaaggctgc

SEQ ID NO: 275126 - DNA, 16 bp, P. troglodytes
tggaagtcttggccag

SEQ ID NO: 275127 - DNA, 16 bp, P. troglodytes
tggaagtgactttgaa

SEQ ID NO: 275128 - DNA, 16 bp, P. troglodytes
tggaagtgcctgctcc

SEQ ID NO: 275129 - DNA, 16 bp, P. troglodytes
tggaagtggaattgct

SEQ ID NO: 275130 - DNA, 16 bp, P. troglodytes
tggaagtggagcctga

SEQ ID NO: 275131 - DNA, 17 bp, P. troglodytes
tggaagtggctttggaa

SEQ ID NO: 275132 - DNA, 16 bp, P. troglodytes
tggaagtggtggtgca

SEQ ID NO: 275133 - DNA, 16 bp, P. troglodytes
tggaagttcgagacca

SEQ ID NO: 275134 - DNA, 16 bp, P. troglodytes
tggaagttctcgccag

SEQ ID NO: 275135 - DNA, 16 bp, P. troglodytes
tggaagttctggccaa

SEQ ID NO: 275136 - DNA, 16 bp, P. troglodytes
tggaagttctggccac

SEQ ID NO: 275137 - DNA, 16 bp, P. troglodytes
tggaagttgaggctgc

SEQ ID NO: 275138 - DNA, 20 bp, P. troglodytes
tggaagttgcagtgagctga

SEQ ID NO: 275139 - DNA, 16 bp, P. troglodytes
tggaagttttggccag

SEQ ID NO: 275140 - DNA, 16 bp, P. troglodytes
tggaagttttgtccca

SEQ ID NO: 275141 - DNA, 16 bp, P. troglodytes
tggaataaaaatggaa

SEQ ID NO: 275142 - DNA, 16 bp, P. troglodytes
tggaataaaatccaaa

SEQ ID NO: 275143 - DNA, 16 bp, P. troglodytes
tggaataaaattgaga

SEQ ID NO: 275144 - DNA, 17 bp, P. troglodytes
tggaatacgatgcagcc

SEQ ID NO: 275145 - DNA, 16 bp, P. troglodytes
tggaatacttcctgaa

SEQ ID NO: 275146 - DNA, 16 bp, P. troglodytes
tggaatagttctgtat

SEQ ID NO: 275147 - DNA, 16 bp, P. troglodytes
tggaatatacattctt

SEQ ID NO: 275148 - DNA, 16 bp, P. troglodytes
tggaatatattgatac

SEQ ID NO: 275149 - DNA, 16 bp, P. troglodytes
tggaatatattttctt

SEQ ID NO: 275150 - DNA, 16 bp, P. troglodytes
tggaatatccatcacc

SEQ ID NO: 275151 - DNA, 16 bp, P. troglodytes
tggaatatcttttttc

SEQ ID NO: 275152 - DNA, 16 bp, P. troglodytes
tggaatattatatagc

SEQ ID NO: 275153 - DNA, 16 bp, P. troglodytes
tggaatattatttggt

SEQ ID NO: 275154 - DNA, 16 bp, P. troglodytes
tggaatatttaaaatt

SEQ ID NO: 275155 - DNA, 16 bp, P. troglodytes
tggaatatttgcattt

SEQ ID NO: 275156 - DNA, 16 bp, P. troglodytes
tggaatatttgtcttt

SEQ ID NO: 275157 - DNA, 16 bp, P. troglodytes
tggaatattttcagaa

SEQ ID NO: 275158 - DNA, 16 bp, P. troglodytes
tggaatattttttaaa

SEQ ID NO: 275159 - DNA, 16 bp, P. troglodytes
tggaatcaaacaatat

SEQ ID NO: 275160 - DNA, 16 bp, P. troglodytes
tggaatcaacccaaat

SEQ ID NO: 275161 - DNA, 16 bp, P. troglodytes
tggaatcaatctaaat

SEQ ID NO: 275162 - DNA, 16 bp, P. troglodytes
tggaatcaatgtaaat

SEQ ID NO: 275163 - DNA, 16 bp, P. troglodytes
tggaatcaatgtcagc

SEQ ID NO: 275164 - DNA, 16 bp, P. troglodytes
tggaatcagcttcttc

SEQ ID NO: 275165 - DNA, 16 bp, P. troglodytes
tggaatcataaagtat

SEQ ID NO: 275166 - DNA, 16 bp, P. troglodytes
tggaatcatacaatat

SEQ ID NO: 275167 - DNA, 16 bp, P. troglodytes
tggaatcatacagtat

SEQ ID NO: 275168 - DNA, 16 bp, P. troglodytes
tggaatcccagctact

SEQ ID NO: 275169 - DNA, 16 bp, P. troglodytes
tggaatcggtggtgat

SEQ ID NO: 275170 - DNA, 16 bp, P. troglodytes
tggaatctacaaaaaa

SEQ ID NO: 275171 - DNA, 16 bp, P. troglodytes
tggaatctcagctcac

SEQ ID NO: 275172 - DNA, 16 bp, P. troglodytes
tggaatctctctctct

SEQ ID NO: 275173 - DNA, 16 bp, P. troglodytes
tggaatctctgggaca

SEQ ID NO: 275174 - DNA, 16 bp, P. troglodytes
tggaatctgtgaaggg

SEQ ID NO: 275175 - DNA, 16 bp, P. troglodytes
tggaatgaatgtattt

SEQ ID NO: 275176 - DNA, 16 bp, P. troglodytes
tggaatgatcaaatca

SEQ ID NO: 275177 - DNA, 17 bp, P. troglodytes
tggaatgcaatggcgca

SEQ ID NO: 275178 - DNA, 17 bp, P. troglodytes
tggaatgcagtggcgca

SEQ ID NO: 275179 - DNA, 16 bp, P. troglodytes
tggaatgctaagcatg

SEQ ID NO: 275180 - DNA, 16 bp, P. troglodytes
tggaatggttttccat

SEQ ID NO: 275181 - DNA, 16 bp, P. troglodytes
tggaattaaatgagaa

SEQ ID NO: 275182 - DNA, 16 bp, P. troglodytes
tggaattacagatgca

SEQ ID NO: 275183 - DNA, 16 bp, P. troglodytes
tggaattacaggaatg

SEQ ID NO: 275184 - DNA, 16 bp, P. troglodytes
tggaattacaggagtg

SEQ ID NO: 275185 - DNA, 16 bp, P. troglodytes
tggaattacaggtgca

SEQ ID NO: 275186 - DNA, 16 bp, P. troglodytes
tggaattacagtcatg

SEQ ID NO: 275187 - DNA, 16 bp, P. troglodytes
tggaattataaaatat

SEQ ID NO: 275188 - DNA, 16 bp, P. troglodytes
tggaattatatcaaac

SEQ ID NO: 275189 - DNA, 16 bp, P. troglodytes
tggaattgaaaaactc

SEQ ID NO: 275190 - DNA, 16 bp, P. troglodytes
tggaattgatttttgt

SEQ ID NO: 275191 - DNA, 16 bp, P. troglodytes
tggaattgctggattg

SEQ ID NO: 275192 - DNA, 16 bp, P. troglodytes
tggaattgctgggtca

SEQ ID NO: 275193 - DNA, 16 bp, P. troglodytes
tggaattggagaccat

SEQ ID NO: 275194 - DNA, 16 bp, P. troglodytes
tggaattgtaagtcca

SEQ ID NO: 275195 - DNA, 16 bp, P. troglodytes
tggaattgtacagtat

SEQ ID NO: 275196 - DNA, 16 bp, P. troglodytes
tggaatttaaaattaa

SEQ ID NO: 275197 - DNA, 16 bp, P. troglodytes
tggaatttatttaaaa

SEQ ID NO: 275198 - DNA, 16 bp, P. troglodytes
tggaatttctgagtca

SEQ ID NO: 275199 - DNA, 16 bp, P. troglodytes
tggaatttctgggtca

SEQ ID NO: 275200 - DNA, 16 bp, P. troglodytes
tggaatttgctggagg

SEQ ID NO: 275201 - DNA, 16 bp, P. troglodytes
tggaattttattttct

SEQ ID NO: 275202 - DNA, 16 bp, P. troglodytes
tggaattttgccatgt

SEQ ID NO: 275203 - DNA, 16 bp, P. troglodytes
tggaatttttaaaatg

SEQ ID NO: 275204 - DNA, 16 bp, P. troglodytes
tggaatttttttctaa

SEQ ID NO: 275205 - DNA, 16 bp, P. troglodytes
tggacaaagaacatga

SEQ ID NO: 275206 - DNA, 16 bp, P. troglodytes
tggacaaattcctgga

SEQ ID NO: 275207 - DNA, 16 bp, P. troglodytes
tggacaacacagtgaa

SEQ ID NO: 275208 - DNA, 16 bp, P. troglodytes
tggacaacatggtgag

SEQ ID NO: 275209 - DNA, 16 bp, P. troglodytes
tggacaactggagggt

SEQ ID NO: 275210 - DNA, 17 bp, P. troglodytes
tggacaatacttttacc

SEQ ID NO: 275211 - DNA, 16 bp, P. troglodytes
tggacacacacacaca

SEQ ID NO: 275212 - DNA, 16 bp, P. troglodytes
tggacacagacatgca

SEQ ID NO: 275213 - DNA, 16 bp, P. troglodytes
tggacacagagacaga

SEQ ID NO: 275214 - DNA, 17 bp, P. troglodytes
tggacacagagagggga

SEQ ID NO: 275215 - DNA, 18 bp, P. troglodytes
tggacacaggaaggggaa

SEQ ID NO: 275216 - DNA, 16 bp, P. troglodytes
tggacacaggaatggg

SEQ ID NO: 275217 - DNA, 16 bp, P. troglodytes
tggacacccctgctct

SEQ ID NO: 275218 - DNA, 16 bp, P. troglodytes
tggacacctataatcc

SEQ ID NO: 275219 - DNA, 16 bp, P. troglodytes
tggacactgattcaga

SEQ ID NO: 275220 - DNA, 16 bp, P. troglodytes
tggacacttcatataa

SEQ ID NO: 275221 - DNA, 16 bp, P. troglodytes
tggacagatggataga

SEQ ID NO: 275222 - DNA, 16 bp, P. troglodytes
tggacagggcatctct

SEQ ID NO: 275223 - DNA, 16 bp, P. troglodytes
tggacagttttttttt

SEQ ID NO: 275224 - DNA, 16 bp, P. troglodytes
tggacataaagatggc

SEQ ID NO: 275225 - DNA, 16 bp, P. troglodytes
tggacataaattttca

SEQ ID NO: 275226 - DNA, 16 bp, P. troglodytes
tggacataggaagggg

SEQ ID NO: 275227 - DNA, 16 bp, P. troglodytes
tggacatggtggccca

SEQ ID NO: 275228 - DNA, 17 bp, P. troglodytes
tggacattaaagtaaaa

SEQ ID NO: 275229 - DNA, 16 bp, P. troglodytes
tggacatttcatatga

SEQ ID NO: 275230 - DNA, 16 bp, P. troglodytes
tggaccaaaccaatgt

SEQ ID NO: 275231 - DNA, 16 bp, P. troglodytes
tggaccaatcagcaca

SEQ ID NO: 275232 - DNA, 17 bp, P. troglodytes
tggaccactgtatacat

SEQ ID NO: 275233 - DNA, 16 bp, P. troglodytes
tggaccagaagagtgc

SEQ ID NO: 275234 - DNA, 16 bp, P. troglodytes
tggaccagcagcatca

SEQ ID NO: 275235 - DNA, 16 bp, P. troglodytes
tggaccaggcactgtg

SEQ ID NO: 275236 - DNA, 16 bp, P. troglodytes
tggaccagtcagcttc

SEQ ID NO: 275237 - DNA, 16 bp, P. troglodytes
tggacccaggaggcgg

SEQ ID NO: 275238 - DNA, 16 bp, P. troglodytes
tggacccaggaggtgg

SEQ ID NO: 275239 - DNA, 16 bp, P. troglodytes
tggacccctcctctca

SEQ ID NO: 275240 - DNA, 16 bp, P. troglodytes
tggacctccagcctcc

SEQ ID NO: 275241 - DNA, 16 bp, P. troglodytes
tggacctggaggacat

SEQ ID NO: 275242 - DNA, 16 bp, P. troglodytes
tggacgcccctccccc

SEQ ID NO: 275243 - DNA, 16 bp, P. troglodytes
tggacggggcggctgg

SEQ ID NO: 275244 - DNA, 17 bp, P. troglodytes
tggactacagagtgaga

SEQ ID NO: 275245 - DNA, 16 bp, P. troglodytes
tggactcaagcaattc

SEQ ID NO: 275246 - DNA, 16 bp, P. troglodytes
tggactccagaactgt

SEQ ID NO: 275247 - DNA, 16 bp, P. troglodytes
tggactccagcctggg

SEQ ID NO: 275248 - DNA, 17 bp, P. troglodytes
tggactccagcctgggc

SEQ ID NO: 275249 - DNA, 16 bp, P. troglodytes
tggactccagcttggg

SEQ ID NO: 275250 - DNA, 16 bp, P. troglodytes
tggactcccattcaca

SEQ ID NO: 275251 - DNA, 16 bp, P. troglodytes
tggactcgagcaatcc

SEQ ID NO: 275252 - DNA, 16 bp, P. troglodytes
tggactctctcccctg

SEQ ID NO: 275253 - DNA, 16 bp, P. troglodytes
tggactctgggactta

SEQ ID NO: 275254 - DNA, 16 bp, P. troglodytes
tggactgaatgtttat

SEQ ID NO: 275255 - DNA, 16 bp, P. troglodytes
tggactgcacccactg

SEQ ID NO: 275256 - DNA, 16 bp, P. troglodytes
tggactgcagtgacat

SEQ ID NO: 275257 - DNA, 16 bp, P. troglodytes
tggactgcagtggtgc

SEQ ID NO: 275258 - DNA, 17 bp, P. troglodytes
tggactgcctgaggtca

SEQ ID NO: 275259 - DNA, 16 bp, P. troglodytes
tggactggaagaggca

SEQ ID NO: 275260 - DNA, 16 bp, P. troglodytes
tggactgggagaagca

SEQ ID NO: 275261 - DNA, 16 bp, P. troglodytes
tggactgtatagaggt

SEQ ID NO: 275262 - DNA, 16 bp, P. troglodytes
tggacttaattttttt

SEQ ID NO: 275263 - DNA, 16 bp, P. troglodytes
tggacttacagttcca

SEQ ID NO: 275264 - DNA, 16 bp, P. troglodytes
tggacttcattaaaat

SEQ ID NO: 275265 - DNA, 16 bp, P. troglodytes
tggacttcccagcccc

SEQ ID NO: 275266 - DNA, 16 bp, P. troglodytes
tggacttcctgcctcc

SEQ ID NO: 275267 - DNA, 16 bp, P. troglodytes
tggacttgaacccagg

SEQ ID NO: 275268 - DNA, 16 bp, P. troglodytes
tggactttagttaata

SEQ ID NO: 275269 - DNA, 16 bp, P. troglodytes
tggactttatcctgag

SEQ ID NO: 275270 - DNA, 16 bp, P. troglodytes
tggactttggagtcag

SEQ ID NO: 275271 - DNA, 16 bp, P. troglodytes
tggactttgggaactc

SEQ ID NO: 275272 - DNA, 16 bp, P. troglodytes
tggactttgggcactg

SEQ ID NO: 275273 - DNA, 16 bp, P. troglodytes
tggagaaaaaaattca

SEQ ID NO: 275274 - DNA, 16 bp, P. troglodytes
tggagaaaaattaaat

SEQ ID NO: 275275 - DNA, 16 bp, P. troglodytes
tggagaaaaggaaact

SEQ ID NO: 275276 - DNA, 16 bp, P. troglodytes
tggagaaaagggaacc

SEQ ID NO: 275277 - DNA, 16 bp, P. troglodytes
tggagaaaataaaatt

SEQ ID NO: 275278 - DNA, 16 bp, P. troglodytes
tggagaaaataaagca

SEQ ID NO: 275279 - DNA, 16 bp, P. troglodytes
tggagaaaatggaatt

SEQ ID NO: 275280 - DNA, 16 bp, P. troglodytes
tggagaaaatggagaa

SEQ ID NO: 275281 - DNA, 16 bp, P. troglodytes
tggagaaaattttaaa

SEQ ID NO: 275282 - DNA, 16 bp, P. troglodytes
tggagaaacaagaaca

SEQ ID NO: 275283 - DNA, 16 bp, P. troglodytes
tggagaaacacaagca

SEQ ID NO: 275284 - DNA, 16 bp, P. troglodytes
tggagaaacagaaata

SEQ ID NO: 275285 - DNA, 16 bp, P. troglodytes
tggagaaaccctgtct

SEQ ID NO: 275286 - DNA, 16 bp, P. troglodytes
tggagaaactgaggca

SEQ ID NO: 275287 - DNA, 16 bp, P. troglodytes
tggagaaactgaggcc

SEQ ID NO: 275288 - DNA, 16 bp, P. troglodytes
tggagaaactggaaac

SEQ ID NO: 275289 - DNA, 16 bp, P. troglodytes
tggagaaactggaagc

SEQ ID NO: 275290 - DNA, 16 bp, P. troglodytes
tggagaaactggatca

SEQ ID NO: 275291 - DNA, 16 bp, P. troglodytes
tggagaaaggagaacc

SEQ ID NO: 275292 - DNA, 16 bp, P. troglodytes
tggagaaaggattccc

SEQ ID NO: 275293 - DNA, 16 bp, P. troglodytes
tggagaaaggggaatg

SEQ ID NO: 275294 - DNA, 16 bp, P. troglodytes
tggagaaatatgaaca

SEQ ID NO: 275295 - DNA, 16 bp, P. troglodytes
tggagaaattaaaacc

SEQ ID NO: 275296 - DNA, 16 bp, P. troglodytes
tggagaaattgaaacc

SEQ ID NO: 275297 - DNA, 16 bp, P. troglodytes
tggagaaattgaaatc

SEQ ID NO: 275298 - DNA, 16 bp, P. troglodytes
tggagaacattatgct

SEQ ID NO: 275299 - DNA, 16 bp, P. troglodytes
tggagaaccaggaaaa

SEQ ID NO: 275300 - DNA, 16 bp, P. troglodytes
tggagaacctcttcta

SEQ ID NO: 275301 - DNA, 18 bp, P. troglodytes
tggagaacctttatgtct

SEQ ID NO: 275302 - DNA, 16 bp, P. troglodytes
tggagaactgtttgga

SEQ ID NO: 275303 - DNA, 16 bp, P. troglodytes
tggagaagaggcattc

SEQ ID NO: 275304 - DNA, 16 bp, P. troglodytes
tggagaagatgtggag

SEQ ID NO: 275305 - DNA, 16 bp, P. troglodytes
tggagaagctgaggca

SEQ ID NO: 275306 - DNA, 16 bp, P. troglodytes
tggagaagctgcagca

SEQ ID NO: 275307 - DNA, 16 bp, P. troglodytes
tggagaaggcaaggaa

SEQ ID NO: 275308 - DNA, 16 bp, P. troglodytes
tggagaagttaaataa

SEQ ID NO: 275309 - DNA, 16 bp, P. troglodytes
tggagaatatatttta

SEQ ID NO: 275310 - DNA, 16 bp, P. troglodytes
tggagaatccagaaat

SEQ ID NO: 275311 - DNA, 16 bp, P. troglodytes
tggagaatggactgga

SEQ ID NO: 275312 - DNA, 16 bp, P. troglodytes
tggagaatggtattta

SEQ ID NO: 275313 - DNA, 16 bp, P. troglodytes
tggagaatgtgggaaa

SEQ ID NO: 275314 - DNA, 16 bp, P. troglodytes
tggagaatttaattca

SEQ ID NO: 275315 - DNA, 16 bp, P. troglodytes
tggagacacagtctca

SEQ ID NO: 275316 - DNA, 16 bp, P. troglodytes
tggagacagagtctca

SEQ ID NO: 275317 - DNA, 16 bp, P. troglodytes
tggagacagagtgaga

SEQ ID NO: 275318 - DNA, 16 bp, P. troglodytes
tggagacagggccttg

SEQ ID NO: 275319 - DNA, 16 bp, P. troglodytes
tggagacaggggtctc

SEQ ID NO: 275320 - DNA, 16 bp, P. troglodytes
tggagacagggtcttg

SEQ ID NO: 275321 - DNA, 16 bp, P. troglodytes
tggagacattttggtt

SEQ ID NO: 275322 - DNA, 16 bp, P. troglodytes
tggagaccaaagtttt

SEQ ID NO: 275323 - DNA, 16 bp, P. troglodytes
tggagaccaacctggc

SEQ ID NO: 275324 - DNA, 16 bp, P. troglodytes
tggagaccagcatggc

SEQ ID NO: 275325 - DNA, 16 bp, P. troglodytes
tggagaccagcctgag

SEQ ID NO: 275326 - DNA, 16 bp, P. troglodytes
tggagaccagcctgga

SEQ ID NO: 275327 - DNA, 16 bp, P. troglodytes
tggagaccaggctggg

SEQ ID NO: 275328 - DNA, 16 bp, P. troglodytes
tggagaccatcctggt

SEQ ID NO: 275329 - DNA, 16 bp, P. troglodytes
tggagacccagaaaag

SEQ ID NO: 275330 - DNA, 16 bp, P. troglodytes
tggagacccaggagag

SEQ ID NO: 275331 - DNA, 16 bp, P. troglodytes
tggagacggggtttcc

SEQ ID NO: 275332 - DNA, 16 bp, P. troglodytes
tggagactcagaagag

SEQ ID NO: 275333 - DNA, 16 bp, P. troglodytes
tggagactcagaaggg

SEQ ID NO: 275334 - DNA, 16 bp, P. troglodytes
tggagactgagtcttg

SEQ ID NO: 275335 - DNA, 16 bp, P. troglodytes
tggagactgcaatgag

SEQ ID NO: 275336 - DNA, 16 bp, P. troglodytes
tggagacttaacattt

SEQ ID NO: 275337 - DNA, 16 bp, P. troglodytes
tggagagaaagggaat

SEQ ID NO: 275338 - DNA, 16 bp, P. troglodytes
tggagagaagaaggca

SEQ ID NO: 275339 - DNA, 16 bp, P. troglodytes
tggagagacagagtct

SEQ ID NO: 275340 - DNA, 16 bp, P. troglodytes
tggagagagacagaaa

SEQ ID NO: 275341 - DNA, 16 bp, P. troglodytes
tggagagatggagaga

SEQ ID NO: 275342 - DNA, 16 bp, P. troglodytes
tggagagcagcctggc

SEQ ID NO: 275343 - DNA, 16 bp, P. troglodytes
tggagagcagcctggg

SEQ ID NO: 275344 - DNA, 16 bp, P. troglodytes
tggagagcagtggcgt

SEQ ID NO: 275345 - DNA, 16 bp, P. troglodytes
tggagagcagtggtgt

SEQ ID NO: 275346 - DNA, 16 bp, P. troglodytes
tggagaggagttgcaa

SEQ ID NO: 275347 - DNA, 16 bp, P. troglodytes
tggagaggctgcagag

SEQ ID NO: 275348 - DNA, 16 bp, P. troglodytes
tggagaggtgggcagg

SEQ ID NO: 275349 - DNA, 16 bp, P. troglodytes
tggagatagaaatttg

SEQ ID NO: 275350 - DNA, 16 bp, P. troglodytes
tggagatagggtctta

SEQ ID NO: 275351 - DNA, 16 bp, P. troglodytes
tggagatatatatata

SEQ ID NO: 275352 - DNA, 16 bp, P. troglodytes
tggagatatatatgta

SEQ ID NO: 275353 - DNA, 16 bp, P. troglodytes
tggagatatttccttt

SEQ ID NO: 275354 - DNA, 16 bp, P. troglodytes
tggagatgagaaactt

SEQ ID NO: 275355 - DNA, 16 bp, P. troglodytes
tggagatgagatttca

SEQ ID NO: 275356 - DNA, 16 bp, P. troglodytes
tggagatgccaggaac

SEQ ID NO: 275357 - DNA, 16 bp, P. troglodytes
tggagatgcccctgac

SEQ ID NO: 275358 - DNA, 16 bp, P. troglodytes
tggagatggagaagag

SEQ ID NO: 275359 - DNA, 16 bp, P. troglodytes
tggagatggagatgga

SEQ ID NO: 275360 - DNA, 16 bp, P. troglodytes
tggagatgtacaagga

SEQ ID NO: 275361 - DNA, 16 bp, P. troglodytes
tggagattgagttcaa

SEQ ID NO: 275362 - DNA, 16 bp, P. troglodytes
tggagcaaccagaact

SEQ ID NO: 275363 - DNA, 16 bp, P. troglodytes
tggagcaactgaagaa

SEQ ID NO: 275364 - DNA, 16 bp, P. troglodytes
tggagcaataggaaca

SEQ ID NO: 275365 - DNA, 16 bp, P. troglodytes
tggagcagcactttta

SEQ ID NO: 275366 - DNA, 16 bp, P. troglodytes
tggagcagctggaaca

SEQ ID NO: 275367 - DNA, 16 bp, P. troglodytes
tggagcagggtgcctg

SEQ ID NO: 275368 - DNA, 16 bp, P. troglodytes
tggagcaggtgattgg

SEQ ID NO: 275369 - DNA, 16 bp, P. troglodytes
tggagccaacccaaat

SEQ ID NO: 275370 - DNA, 16 bp, P. troglodytes
tggagccaggagttca

SEQ ID NO: 275371 - DNA, 16 bp, P. troglodytes
tggagccagtggactt

SEQ ID NO: 275372 - DNA, 16 bp, P. troglodytes
tggagcccatcctggc

SEQ ID NO: 275373 - DNA, 16 bp, P. troglodytes
tggagcctcattctgt

SEQ ID NO: 275374 - DNA, 16 bp, P. troglodytes
tggagcctggctctgt

SEQ ID NO: 275375 - DNA, 16 bp, P. troglodytes
tggagcctgggaggtg

SEQ ID NO: 275376 - DNA, 16 bp, P. troglodytes
tggagcctgggcaaca

SEQ ID NO: 275377 - DNA, 16 bp, P. troglodytes
tggagcctttgggaag

SEQ ID NO: 275378 - DNA, 16 bp, P. troglodytes
tggagctcaggtggta

SEQ ID NO: 275379 - DNA, 16 bp, P. troglodytes
tggagctcccagagga

SEQ ID NO: 275380 - DNA, 16 bp, P. troglodytes
tggagctcctggcctc

SEQ ID NO: 275381 - DNA, 16 bp, P. troglodytes
tggagctgaagaagct

SEQ ID NO: 275382 - DNA, 16 bp, P. troglodytes
tggagctgcccaagac

SEQ ID NO: 275383 - DNA, 16 bp, P. troglodytes
tggagctgcttgccag

SEQ ID NO: 275384 - DNA, 16 bp, P. troglodytes
tggagctggaatttga

SEQ ID NO: 275385 - DNA, 16 bp, P. troglodytes
tggagctggagcagcc

SEQ ID NO: 275386 - DNA, 16 bp, P. troglodytes
tggagctggagcagct

SEQ ID NO: 275387 - DNA, 16 bp, P. troglodytes
tggagctggagctggg

SEQ ID NO: 275388 - DNA, 16 bp, P. troglodytes
tggagctggaggccat

SEQ ID NO: 275389 - DNA, 16 bp, P. troglodytes
tggagctggaggccgt

SEQ ID NO: 275390 - DNA, 16 bp, P. troglodytes
tggagctggaggtcat

SEQ ID NO: 275391 - DNA, 16 bp, P. troglodytes
tggagctgggaaaact

SEQ ID NO: 275392 - DNA, 16 bp, P. troglodytes
tggagctggggcctgg

SEQ ID NO: 275393 - DNA, 17 bp, P. troglodytes
tggagctgtgagaagaa

SEQ ID NO: 275394 - DNA, 16 bp, P. troglodytes
tggagcttatattcta

SEQ ID NO: 275395 - DNA, 21 bp, P. troglodytes
tggagcttgcagtgagcagag

SEQ ID NO: 275396 - DNA, 16 bp, P. troglodytes
tggagctttaagattt

SEQ ID NO: 275397 - DNA, 16 bp, P. troglodytes
tggaggaaaaaaatca

SEQ ID NO: 275398 - DNA, 16 bp, P. troglodytes
tggaggaaagaagaca

SEQ ID NO: 275399 - DNA, 16 bp, P. troglodytes
tggaggaagatctgcc

SEQ ID NO: 275400 - DNA, 16 bp, P. troglodytes
tggaggaaggagcagg

SEQ ID NO: 275401 - DNA, 16 bp, P. troglodytes
tggaggacaagagtga

SEQ ID NO: 275402 - DNA, 16 bp, P. troglodytes
tggaggagaaggggca

SEQ ID NO: 275403 - DNA, 16 bp, P. troglodytes
tggaggagaggcctgg

SEQ ID NO: 275404 - DNA, 16 bp, P. troglodytes
tggaggaggagaggcg

SEQ ID NO: 275405 - DNA, 16 bp, P. troglodytes
tggaggaggagcctgg

SEQ ID NO: 275406 - DNA, 16 bp, P. troglodytes
tggaggaggaggaggc

SEQ ID NO: 275407 - DNA, 16 bp, P. troglodytes
tggaggaggaggttgc

SEQ ID NO: 275408 - DNA, 16 bp, P. troglodytes
tggaggaggggcctga

SEQ ID NO: 275409 - DNA, 17 bp, P. troglodytes
tggaggatcacttgagg

SEQ ID NO: 275410 - DNA, 16 bp, P. troglodytes
tggaggatgagatgga

SEQ ID NO: 275411 - DNA, 17 bp, P. troglodytes
tggaggatggtggccct

SEQ ID NO: 275412 - DNA, 16 bp, P. troglodytes
tggaggcaagaccctc

SEQ ID NO: 275413 - DNA, 16 bp, P. troglodytes
tggaggcagagagaga

SEQ ID NO: 275414 - DNA, 16 bp, P. troglodytes
tggaggcagagcttgc

SEQ ID NO: 275415 - DNA, 17 bp, P. troglodytes
tggaggcagagcttgca

SEQ ID NO: 275416 - DNA, 16 bp, P. troglodytes
tggaggcagaggttgc

SEQ ID NO: 275417 - DNA, 16 bp, P. troglodytes
tggaggcagagtttgc

SEQ ID NO: 275418 - DNA, 16 bp, P. troglodytes
tggaggcagatgttgc

SEQ ID NO: 275419 - DNA, 16 bp, P. troglodytes
tggaggcagcagggga

SEQ ID NO: 275420 - DNA, 16 bp, P. troglodytes
tggaggcagcagtgag

SEQ ID NO: 275421 - DNA, 25 bp, P. troglodytes
tggaggcagggcgagatcacaggac

SEQ ID NO: 275422 - DNA, 16 bp, P. troglodytes
tggaggcatcacatta

SEQ ID NO: 275423 - DNA, 16 bp, P. troglodytes
tggaggcatcagacta

SEQ ID NO: 275424 - DNA, 16 bp, P. troglodytes
tggaggcattttcccc

SEQ ID NO: 275425 - DNA, 16 bp, P. troglodytes
tggaggccagaaggaa

SEQ ID NO: 275426 - DNA, 16 bp, P. troglodytes
tggaggccaggtgcag

SEQ ID NO: 275427 - DNA, 16 bp, P. troglodytes
tggaggccaggtgcgg

SEQ ID NO: 275428 - DNA, 16 bp, P. troglodytes
tggaggccatcctggc

SEQ ID NO: 275429 - DNA, 16 bp, P. troglodytes
tggaggccgaggcagg

SEQ ID NO: 275430 - DNA, 16 bp, P. troglodytes
tggaggctacagaaca

SEQ ID NO: 275431 - DNA, 16 bp, P. troglodytes
tggaggctattatctt

SEQ ID NO: 275432 - DNA, 16 bp, P. troglodytes
tggaggctcacacctg

SEQ ID NO: 275433 - DNA, 16 bp, P. troglodytes
tggaggctcccaagcc

SEQ ID NO: 275434 - DNA, 16 bp, P. troglodytes
tggaggctctagggga

SEQ ID NO: 275435 - DNA, 16 bp, P. troglodytes
tggaggctctggggag

SEQ ID NO: 275436 - DNA, 16 bp, P. troglodytes
tggaggctgaaagtct

SEQ ID NO: 275437 - DNA, 16 bp, P. troglodytes
tggaggctgagctggg

SEQ ID NO: 275438 - DNA, 16 bp, P. troglodytes
tggaggctgaggaagg

SEQ ID NO: 275439 - DNA, 16 bp, P. troglodytes
tggaggctgaggcatg

SEQ ID NO: 275440 - DNA, 16 bp, P. troglodytes
tggaggctgaggcggg

SEQ ID NO: 275441 - DNA, 16 bp, P. troglodytes
tggaggctgagggagg

SEQ ID NO: 275442 - DNA, 16 bp, P. troglodytes
tggaggctgcaagtcc

SEQ ID NO: 275443 - DNA, 16 bp, P. troglodytes
tggaggctgcagagag

SEQ ID NO: 275444 - DNA, 16 bp, P. troglodytes
tggaggctggaagtct

SEQ ID NO: 275445 - DNA, 16 bp, P. troglodytes
tggaggctgggcatgg

SEQ ID NO: 275446 - DNA, 16 bp, P. troglodytes
tggaggctgggcgtgg

SEQ ID NO: 275447 - DNA, 16 bp, P. troglodytes
tggaggctgtgaaggc

SEQ ID NO: 275448 - DNA, 16 bp, P. troglodytes
tggaggctgtggcagg

SEQ ID NO: 275449 - DNA, 16 bp, P. troglodytes
tggaggcttggaagtc

SEQ ID NO: 275450 - DNA, 16 bp, P. troglodytes
tggagggagaggcaca

SEQ ID NO: 275451 - DNA, 16 bp, P. troglodytes
tggagggcaggaagca

SEQ ID NO: 275452 - DNA, 16 bp, P. troglodytes
tggagggctaggggag

SEQ ID NO: 275453 - DNA, 16 bp, P. troglodytes
tggagggctcagaaga

SEQ ID NO: 275454 - DNA, 16 bp, P. troglodytes
tggaggggctgctgtg

SEQ ID NO: 275455 - DNA, 16 bp, P. troglodytes
tggaggtagggcctgg

SEQ ID NO: 275456 - DNA, 16 bp, P. troglodytes
tggaggtgccagggcc

SEQ ID NO: 275457 - DNA, 16 bp, P. troglodytes
tggaggtggaggtggc

SEQ ID NO: 275458 - DNA, 16 bp, P. troglodytes
tggaggtggcagtgaa

SEQ ID NO: 275459 - DNA, 16 bp, P. troglodytes
tggaggtggggcctgg

SEQ ID NO: 275460 - DNA, 16 bp, P. troglodytes
tggaggtggggccttt

SEQ ID NO: 275461 - DNA, 16 bp, P. troglodytes
tggaggttgcagtggc

SEQ ID NO: 275462 - DNA, 16 bp, P. troglodytes
tggagtaatgaaaatg

SEQ ID NO: 275463 - DNA, 17 bp, P. troglodytes
tggagtacagtggcact

SEQ ID NO: 275464 - DNA, 17 bp, P. troglodytes
tggagtagccattcttt

SEQ ID NO: 275465 - DNA, 16 bp, P. troglodytes
tggagtagggtgggcc

SEQ ID NO: 275466 - DNA, 16 bp, P. troglodytes
tggagtattattcagc

SEQ ID NO: 275467 - DNA, 16 bp, P. troglodytes
tggagtcaaaggagat

SEQ ID NO: 275468 - DNA, 16 bp, P. troglodytes
tggagtcaaaggggat

SEQ ID NO: 275469 - DNA, 16 bp, P. troglodytes
tggagtcagacagacc

SEQ ID NO: 275470 - DNA, 16 bp, P. troglodytes
tggagtcaggcggctg

SEQ ID NO: 275471 - DNA, 16 bp, P. troglodytes
tggagtccagtggcat

SEQ ID NO: 275472 - DNA, 16 bp, P. troglodytes
tggagtcccagaagga

SEQ ID NO: 275473 - DNA, 16 bp, P. troglodytes
tggagtcctgctctgt

SEQ ID NO: 275474 - DNA, 16 bp, P. troglodytes
tggagtctcactgtcg

SEQ ID NO: 275475 - DNA, 16 bp, P. troglodytes
tggagtctcactgtgt

SEQ ID NO: 275476 - DNA, 16 bp, P. troglodytes
tggagtctccctctgt

SEQ ID NO: 275477 - DNA, 18 bp, P. troglodytes
tggagtctcgctctgtca

SEQ ID NO: 275478 - DNA, 17 bp, P. troglodytes
tggagtctcgctttgtt

SEQ ID NO: 275479 - DNA, 16 bp, P. troglodytes
tggagtctctctcttg

SEQ ID NO: 275480 - DNA, 16 bp, P. troglodytes
tggagtctctgttgcc

SEQ ID NO: 275481 - DNA, 16 bp, P. troglodytes
tggagtctggagtgca

SEQ ID NO: 275482 - DNA, 16 bp, P. troglodytes
tggagtctgtctctgt

SEQ ID NO: 275483 - DNA, 16 bp, P. troglodytes
tggagtcttgccttgt

SEQ ID NO: 275484 - DNA, 16 bp, P. troglodytes
tggagtcttgcttttg

SEQ ID NO: 275485 - DNA, 16 bp, P. troglodytes
tggagtgaaatattta

SEQ ID NO: 275486 - DNA, 16 bp, P. troglodytes
tggagtgcaatagcac

SEQ ID NO: 275487 - DNA, 17 bp, P. troglodytes
tggagtgcaatgatgtg

SEQ ID NO: 275488 - DNA, 17 bp, P. troglodytes
tggagtgcaatggcaca

SEQ ID NO: 275489 - DNA, 16 bp, P. troglodytes
tggagtgcaatggcat

SEQ ID NO: 275490 - DNA, 19 bp, P. troglodytes
tggagtgcaatggtgtgat

SEQ ID NO: 275491 - DNA, 16 bp, P. troglodytes
tggagtgcaattgtgt

SEQ ID NO: 275492 - DNA, 16 bp, P. troglodytes
tggagtgcagagacac

SEQ ID NO: 275493 - DNA, 16 bp, P. troglodytes
tggagtgcagaggcag

SEQ ID NO: 275494 - DNA, 16 bp, P. troglodytes
tggagtgcagcagtgt

SEQ ID NO: 275495 - DNA, 16 bp, P. troglodytes
tggagtgcagcggcac

SEQ ID NO: 275496 - DNA, 16 bp, P. troglodytes
tggagtgcagtcatgc

SEQ ID NO: 275497 - DNA, 16 bp, P. troglodytes
tggagtgcagtgacaa

SEQ ID NO: 275498 - DNA, 17 bp, P. troglodytes
tggagtgcagtggcaga

SEQ ID NO: 275499 - DNA, 17 bp, P. troglodytes
tggagtgcagtggccca

SEQ ID NO: 275500 - DNA, 20 bp, P. troglodytes
tggagtgcagtggcgccatc

SEQ ID NO: 275501 - DNA, 16 bp, P. troglodytes
tggagtgcagtggggt

SEQ ID NO: 275502 - DNA, 16 bp, P. troglodytes
tggagtgcagtggtac

SEQ ID NO: 275503 - DNA, 19 bp, P. troglodytes
tggagtgcagtggtgcgat

SEQ ID NO: 275504 - DNA, 16 bp, P. troglodytes
tggagtgcagtggtgg

SEQ ID NO: 275505 - DNA, 16 bp, P. troglodytes
tggagtgcagtgttga

SEQ ID NO: 275506 - DNA, 16 bp, P. troglodytes
tggagtgccatggcac

SEQ ID NO: 275507 - DNA, 16 bp, P. troglodytes
tggagtgctgtggctc

SEQ ID NO: 275508 - DNA, 16 bp, P. troglodytes
tggagtggacttccag

SEQ ID NO: 275509 - DNA, 16 bp, P. troglodytes
tggagtggagtggtgc

SEQ ID NO: 275510 - DNA, 16 bp, P. troglodytes
tggagttactcttctc

SEQ ID NO: 275511 - DNA, 17 bp, P. troglodytes
tggagttcagtggtgca

SEQ ID NO: 275512 - DNA, 16 bp, P. troglodytes
tggagttcagtggtgg

SEQ ID NO: 275513 - DNA, 17 bp, P. troglodytes
tggagttcctgcaggga

SEQ ID NO: 275514 - DNA, 16 bp, P. troglodytes
tggagttgaaaaattc

SEQ ID NO: 275515 - DNA, 16 bp, P. troglodytes
tggagttgctgaaatt

SEQ ID NO: 275516 - DNA, 16 bp, P. troglodytes
tggagttggagccccc

SEQ ID NO: 275517 - DNA, 16 bp, P. troglodytes
tggagtttctttcttg

SEQ ID NO: 275518 - DNA, 16 bp, P. troglodytes
tggagtttgatggcct

SEQ ID NO: 275519 - DNA, 16 bp, P. troglodytes
tggagtttgcagtaag

SEQ ID NO: 275520 - DNA, 16 bp, P. troglodytes
tggagtttgcagtggg

SEQ ID NO: 275521 - DNA, 16 bp, P. troglodytes
tggagtttgctgaagg

SEQ ID NO: 275522 - DNA, 16 bp, P. troglodytes
tggagttttaaatttt

SEQ ID NO: 275523 - DNA, 16 bp, P. troglodytes
tggagttttctttgta

SEQ ID NO: 275524 - DNA, 16 bp, P. troglodytes
tggagttttgctctgt

SEQ ID NO: 275525 - DNA, 16 bp, P. troglodytes
tggagtttttaactct

SEQ ID NO: 275526 - DNA, 16 bp, P. troglodytes
tggataaacaaaatat

SEQ ID NO: 275527 - DNA, 16 bp, P. troglodytes
tggataaagaaaatat

SEQ ID NO: 275528 - DNA, 16 bp, P. troglodytes
tggataaagaaaatgt

SEQ ID NO: 275529 - DNA, 16 bp, P. troglodytes
tggataaagaaaattt

SEQ ID NO: 275530 - DNA, 16 bp, P. troglodytes
tggataaagaaactct

SEQ ID NO: 275531 - DNA, 16 bp, P. troglodytes
tggataaagaatatgt

SEQ ID NO: 275532 - DNA, 21 bp, P. troglodytes
tggataaagagtcaagaccca

SEQ ID NO: 275533 - DNA, 16 bp, P. troglodytes
tggataaataaactat

SEQ ID NO: 275534 - DNA, 16 bp, P. troglodytes
tggataaataaattat

SEQ ID NO: 275535 - DNA, 22 bp, P. troglodytes
tggataagctttttgatgtgct

SEQ ID NO: 275536 - DNA, 16 bp, P. troglodytes
tggataaggtggagga

SEQ ID NO: 275537 - DNA, 16 bp, P. troglodytes
tggataattctttgtt

SEQ ID NO: 275538 - DNA, 16 bp, P. troglodytes
tggatacacaaaatgt

SEQ ID NO: 275539 - DNA, 16 bp, P. troglodytes
tggatacagagtcaag

SEQ ID NO: 275540 - DNA, 16 bp, P. troglodytes
tggatacttgggttgt

SEQ ID NO: 275541 - DNA, 16 bp, P. troglodytes
tggatagaatcaatat

SEQ ID NO: 275542 - DNA, 16 bp, P. troglodytes
tggatagatagacaga

SEQ ID NO: 275543 - DNA, 16 bp, P. troglodytes
tggatagatggaagga

SEQ ID NO: 275544 - DNA, 16 bp, P. troglodytes
tggatagtgatgatgg

SEQ ID NO: 275545 - DNA, 16 bp, P. troglodytes
tggatataagccattt

SEQ ID NO: 275546 - DNA, 16 bp, P. troglodytes
tggatataccataatt

SEQ ID NO: 275547 - DNA, 16 bp, P. troglodytes
tggatatatacacaaa

SEQ ID NO: 275548 - DNA, 16 bp, P. troglodytes
tggatatccatattca

SEQ ID NO: 275549 - DNA, 16 bp, P. troglodytes
tggatatggagggctg

SEQ ID NO: 275550 - DNA, 16 bp, P. troglodytes
tggatatggatatata

SEQ ID NO: 275551 - DNA, 16 bp, P. troglodytes
tggatatgtgtatata

SEQ ID NO: 275552 - DNA, 16 bp, P. troglodytes
tggatattaattcctt

SEQ ID NO: 275553 - DNA, 16 bp, P. troglodytes
tggatattagaccttt

SEQ ID NO: 275554 - DNA, 16 bp, P. troglodytes
tggatatttagttttc

SEQ ID NO: 275555 - DNA, 16 bp, P. troglodytes
tggatatttcatataa

SEQ ID NO: 275556 - DNA, 16 bp, P. troglodytes
tggatcaaaaaagaaa

SEQ ID NO: 275557 - DNA, 16 bp, P. troglodytes
tggatcaaatggtatt

SEQ ID NO: 275558 - DNA, 16 bp, P. troglodytes
tggatcaactgaggtc

SEQ ID NO: 275559 - DNA, 16 bp, P. troglodytes
tggatcacagacttaa

SEQ ID NO: 275560 - DNA, 19 bp, P. troglodytes
tggatcacctgaggtcagc

SEQ ID NO: 275561 - DNA, 16 bp, P. troglodytes
tggatcactgctgcag

SEQ ID NO: 275562 - DNA, 24 bp, P. troglodytes
tggatcacttgaggtcgggagttc

SEQ ID NO: 275563 - DNA, 16 bp, P. troglodytes
tggatcacttgaggtt

SEQ ID NO: 275564 - DNA, 17 bp, P. troglodytes
tggatcagctgacacca

SEQ ID NO: 275565 - DNA, 16 bp, P. troglodytes
tggatcatagatttaa

SEQ ID NO: 275566 - DNA, 16 bp, P. troglodytes
tggatcgtgggggtgg

SEQ ID NO: 275567 - DNA, 16 bp, P. troglodytes
tggatctaccattctg

SEQ ID NO: 275568 - DNA, 26 bp, P. troglodytes
tggatctcacaaagtacattctcaag

SEQ ID NO: 275569 - DNA, 16 bp, P. troglodytes
tggatctctgtcccca

SEQ ID NO: 275570 - DNA, 16 bp, P. troglodytes
tggatctgctgggtca

SEQ ID NO: 275571 - DNA, 16 bp, P. troglodytes
tggatctggaggccat

SEQ ID NO: 275572 - DNA, 16 bp, P. troglodytes
tggatcttggagaatg

SEQ ID NO: 275573 - DNA, 17 bp, P. troglodytes
tggatgaaactggaaat

SEQ ID NO: 275574 - DNA, 16 bp, P. troglodytes
tggatgaaacttgaaa

SEQ ID NO: 275575 - DNA, 16 bp, P. troglodytes
tggatgaaattagaaa

SEQ ID NO: 275576 - DNA, 16 bp, P. troglodytes
tggatgaaattggaga

SEQ ID NO: 275577 - DNA, 16 bp, P. troglodytes
tggatgaacagataaa

SEQ ID NO: 275578 - DNA, 16 bp, P. troglodytes
tggatgaacagatgga

SEQ ID NO: 275579 - DNA, 16 bp, P. troglodytes
tggatgaacctcaaaa

SEQ ID NO: 275580 - DNA, 16 bp, P. troglodytes
tggatgaagaaactgt

SEQ ID NO: 275581 - DNA, 16 bp, P. troglodytes
tggatgaagctgaaaa

SEQ ID NO: 275582 - DNA, 16 bp, P. troglodytes
tggatgaagctggata

SEQ ID NO: 275583 - DNA, 16 bp, P. troglodytes
tggatgaataaataaa

SEQ ID NO: 275584 - DNA, 16 bp, P. troglodytes
tggatgaatctcacaa

SEQ ID NO: 275585 - DNA, 16 bp, P. troglodytes
tggatgaatctgaaaa

SEQ ID NO: 275586 - DNA, 16 bp, P. troglodytes
tggatgaatcttgaaa

SEQ ID NO: 275587 - DNA, 16 bp, P. troglodytes
tggatgaatgaatgaa

SEQ ID NO: 275588 - DNA, 16 bp, P. troglodytes
tggatgaatggaagga

SEQ ID NO: 275589 - DNA, 16 bp, P. troglodytes
tggatgaatggatgga

SEQ ID NO: 275590 - DNA, 16 bp, P. troglodytes
tggatgaatggatttt

SEQ ID NO: 275591 - DNA, 16 bp, P. troglodytes
tggatgaattaatgaa

SEQ ID NO: 275592 - DNA, 16 bp, P. troglodytes
tggatgacactggaaa

SEQ ID NO: 275593 - DNA, 16 bp, P. troglodytes
tggatgactttgagaa

SEQ ID NO: 275594 - DNA, 16 bp, P. troglodytes
tggatgactttgagga

SEQ ID NO: 275595 - DNA, 16 bp, P. troglodytes
tggatgacttttattt

SEQ ID NO: 275596 - DNA, 16 bp, P. troglodytes
tggatgagaaaactaa

SEQ ID NO: 275597 - DNA, 16 bp, P. troglodytes
tggatgagatcctgga

SEQ ID NO: 275598 - DNA, 16 bp, P. troglodytes
tggatgaggaaaatgt

SEQ ID NO: 275599 - DNA, 16 bp, P. troglodytes
tggatgatggatggat

SEQ ID NO: 275600 - DNA, 16 bp, P. troglodytes
tggatgattttgaggg

SEQ ID NO: 275601 - DNA, 16 bp, P. troglodytes
tggatgatttttttaa

SEQ ID NO: 275602 - DNA, 16 bp, P. troglodytes
tggatgcagcaaacca

SEQ ID NO: 275603 - DNA, 16 bp, P. troglodytes
tggatgcagctagagg

SEQ ID NO: 275604 - DNA, 16 bp, P. troglodytes
tggatgcagctggaga

SEQ ID NO: 275605 - DNA, 16 bp, P. troglodytes
tggatgctgtggctca

SEQ ID NO: 275606 - DNA, 16 bp, P. troglodytes
tggatggacctggaag

SEQ ID NO: 275607 - DNA, 16 bp, P. troglodytes
tggatggagatggagg

SEQ ID NO: 275608 - DNA, 16 bp, P. troglodytes
tggatggagcaggagg

SEQ ID NO: 275609 - DNA, 16 bp, P. troglodytes
tggatggagctggagg

SEQ ID NO: 275610 - DNA, 16 bp, P. troglodytes
tggatggagttggagg

SEQ ID NO: 275611 - DNA, 16 bp, P. troglodytes
tggatggataaataga

SEQ ID NO: 275612 - DNA, 16 bp, P. troglodytes
tggatggatagatgga

SEQ ID NO: 275613 - DNA, 16 bp, P. troglodytes
tggatggatcatctga

SEQ ID NO: 275614 - DNA, 16 bp, P. troglodytes
tggatggatgaatgga

SEQ ID NO: 275615 - DNA, 16 bp, P. troglodytes
tggatggatgcatgca

SEQ ID NO: 275616 - DNA, 16 bp, P. troglodytes
tggatggatgcatggg

SEQ ID NO: 275617 - DNA, 16 bp, P. troglodytes
tggatggatggacaga

SEQ ID NO: 275618 - DNA, 16 bp, P. troglodytes
tggatggatggactga

SEQ ID NO: 275619 - DNA, 16 bp, P. troglodytes
tggatggatggatgga

SEQ ID NO: 275620 - DNA, 16 bp, P. troglodytes
tggatggattacttga

SEQ ID NO: 275621 - DNA, 16 bp, P. troglodytes
tggatggccctcaggg

SEQ ID NO: 275622 - DNA, 16 bp, P. troglodytes
tggatgggcaccatct

SEQ ID NO: 275623 - DNA, 16 bp, P. troglodytes
tggatggggacacagc

SEQ ID NO: 275624 - DNA, 16 bp, P. troglodytes
tggatggggagctgga

SEQ ID NO: 275625 - DNA, 16 bp, P. troglodytes
tggatggggtttctgt

SEQ ID NO: 275626 - DNA, 16 bp, P. troglodytes
tggatgggtggatgga

SEQ ID NO: 275627 - DNA, 17 bp, P. troglodytes
tggatggtggcaggcaa

SEQ ID NO: 275628 - DNA, 16 bp, P. troglodytes
tggatgtaccacagtt

SEQ ID NO: 275629 - DNA, 16 bp, P. troglodytes
tggatgtatctcaaaa

SEQ ID NO: 275630 - DNA, 16 bp, P. troglodytes
tggatgtatttaccca

SEQ ID NO: 275631 - DNA, 16 bp, P. troglodytes
tggatgtccagacaga

SEQ ID NO: 275632 - DNA, 16 bp, P. troglodytes
tggatgtccaggcaga

SEQ ID NO: 275633 - DNA, 16 bp, P. troglodytes
tggatgtcctttctgt

SEQ ID NO: 275634 - DNA, 16 bp, P. troglodytes
tggatgtggtaaaaag

SEQ ID NO: 275635 - DNA, 16 bp, P. troglodytes
tggatgtggtgaaagg

SEQ ID NO: 275636 - DNA, 16 bp, P. troglodytes
tggatgtggtggcaca

SEQ ID NO: 275637 - DNA, 16 bp, P. troglodytes
tggattaaaaaaatgt

SEQ ID NO: 275638 - DNA, 16 bp, P. troglodytes
tggattaaaacaacac

SEQ ID NO: 275639 - DNA, 16 bp, P. troglodytes
tggattaatgggttat

SEQ ID NO: 275640 - DNA, 20 bp, P. troglodytes
tggattacatttattgattt

SEQ ID NO: 275641 - DNA, 16 bp, P. troglodytes
tggattacctttttga

SEQ ID NO: 275642 - DNA, 16 bp, P. troglodytes
tggattataagatagt

SEQ ID NO: 275643 - DNA, 16 bp, P. troglodytes
tggattcaaccaacct

SEQ ID NO: 275644 - DNA, 16 bp, P. troglodytes
tggattcaagccattc

SEQ ID NO: 275645 - DNA, 16 bp, P. troglodytes
tggattccttggattg

SEQ ID NO: 275646 - DNA, 16 bp, P. troglodytes
tggattcgaactcctg

SEQ ID NO: 275647 - DNA, 16 bp, P. troglodytes
tggattctcaattcta

SEQ ID NO: 275648 - DNA, 16 bp, P. troglodytes
tggattctccttcaat

SEQ ID NO: 275649 - DNA, 16 bp, P. troglodytes
tggattcttgctctgt

SEQ ID NO: 275650 - DNA, 16 bp, P. troglodytes
tggattctttgatttt

SEQ ID NO: 275651 - DNA, 16 bp, P. troglodytes
tggattgaaggatgaa

SEQ ID NO: 275652 - DNA, 16 bp, P. troglodytes
tggattgcaatggtgt

SEQ ID NO: 275653 - DNA, 16 bp, P. troglodytes
tggattgcttgagctc

SEQ ID NO: 275654 - DNA, 16 bp, P. troglodytes
tggattggggcccacc

SEQ ID NO: 275655 - DNA, 16 bp, P. troglodytes
tggattgttcttgttt

SEQ ID NO: 275656 - DNA, 16 bp, P. troglodytes
tggattgtttccacct

SEQ ID NO: 275657 - DNA, 16 bp, P. troglodytes
tggattgttttcagtt

SEQ ID NO: 275658 - DNA, 16 bp, P. troglodytes
tggatttcaagcacaa

SEQ ID NO: 275659 - DNA, 16 bp, P. troglodytes
tggatttccagcttct

SEQ ID NO: 275660 - DNA, 16 bp, P. troglodytes
tggatttcccccttgc

SEQ ID NO: 275661 - DNA, 16 bp, P. troglodytes
tggatttcttcatggt

SEQ ID NO: 275662 - DNA, 16 bp, P. troglodytes
tggatttgaagaatca

SEQ ID NO: 275663 - DNA, 16 bp, P. troglodytes
tggatttggcagtgat

SEQ ID NO: 275664 - DNA, 16 bp, P. troglodytes
tggatttggcttgcta

SEQ ID NO: 275665 - DNA, 16 bp, P. troglodytes
tggatttggtaatgat

SEQ ID NO: 275666 - DNA, 16 bp, P. troglodytes
tggatttgtctatttc

SEQ ID NO: 275667 - DNA, 16 bp, P. troglodytes
tggatttgtctgattg

SEQ ID NO: 275668 - DNA, 16 bp, P. troglodytes
tggatttgtttctgtg

SEQ ID NO: 275669 - DNA, 16 bp, P. troglodytes
tggattttaaaaatat

SEQ ID NO: 275670 - DNA, 16 bp, P. troglodytes
tggattttaaaatagt

SEQ ID NO: 275671 - DNA, 16 bp, P. troglodytes
tggattttattaaatg

SEQ ID NO: 275672 - DNA, 16 bp, P. troglodytes
tggattttattctgtg

SEQ ID NO: 275673 - DNA, 16 bp, P. troglodytes
tggattttctgtttct

SEQ ID NO: 275674 - DNA, 16 bp, P. troglodytes
tggattttgccaaatg

SEQ ID NO: 275675 - DNA, 16 bp, P. troglodytes
tggattttggacttac

SEQ ID NO: 275676 - DNA, 16 bp, P. troglodytes
tggattttggacttgc

SEQ ID NO: 275677 - DNA, 16 bp, P. troglodytes
tggatttttaaaataa

SEQ ID NO: 275678 - DNA, 16 bp, P. troglodytes
tggatttttaaaatgt

SEQ ID NO: 275679 - DNA, 16 bp, P. troglodytes
tggatttttaaaatta

SEQ ID NO: 275680 - DNA, 16 bp, P. troglodytes
tggatttttccatttt

SEQ ID NO: 275681 - DNA, 16 bp, P. troglodytes
tggcaaaaaatttgag

SEQ ID NO: 275682 - DNA, 16 bp, P. troglodytes
tggcaaaacactgtct

SEQ ID NO: 275683 - DNA, 16 bp, P. troglodytes
tggcaaaaccacaatt

SEQ ID NO: 275684 - DNA, 16 bp, P. troglodytes
tggcaaaaccccagct

SEQ ID NO: 275685 - DNA, 16 bp, P. troglodytes
tggcaaaaccctgtct

SEQ ID NO: 275686 - DNA, 16 bp, P. troglodytes
tggcaaaacctcattt

SEQ ID NO: 275687 - DNA, 16 bp, P. troglodytes
tggcaaaagagcgaga

SEQ ID NO: 275688 - DNA, 16 bp, P. troglodytes
tggcaaaaggaacttt

SEQ ID NO: 275689 - DNA, 16 bp, P. troglodytes
tggcaaaatcatggct

SEQ ID NO: 275690 - DNA, 16 bp, P. troglodytes
tggcaaaatggacttt

SEQ ID NO: 275691 - DNA, 16 bp, P. troglodytes
tggcaaacatggagaa

SEQ ID NO: 275692 - DNA, 16 bp, P. troglodytes
tggcaaaccacatgta

SEQ ID NO: 275693 - DNA, 16 bp, P. troglodytes
tggcaaagatgcagag

SEQ ID NO: 275694 - DNA, 16 bp, P. troglodytes
tggcaaagcaagaccc

SEQ ID NO: 275695 - DNA, 16 bp, P. troglodytes
tggcaaatccagccag

SEQ ID NO: 275696 - DNA, 16 bp, P. troglodytes
tggcaaattttatttt

SEQ ID NO: 275697 - DNA, 16 bp, P. troglodytes
tggcaacaaaaccaaa

SEQ ID NO: 275698 - DNA, 16 bp, P. troglodytes
tggcaacaaaagtgac

SEQ ID NO: 275699 - DNA, 16 bp, P. troglodytes
tggcaacaccatcaca

SEQ ID NO: 275700 - DNA, 19 bp, P. troglodytes
tggcaacatagcaagaccc

SEQ ID NO: 275701 - DNA, 16 bp, P. troglodytes
tggcaacatcttggct

SEQ ID NO: 275702 - DNA, 16 bp, P. troglodytes
tggcaaccacaaatct

SEQ ID NO: 275703 - DNA, 16 bp, P. troglodytes
tggcaaccactgatct

SEQ ID NO: 275704 - DNA, 16 bp, P. troglodytes
tggcaagaccccatct

SEQ ID NO: 275705 - DNA, 16 bp, P. troglodytes
tggcaagaccctgttt

SEQ ID NO: 275706 - DNA, 16 bp, P. troglodytes
tggcaagactgtggag

SEQ ID NO: 275707 - DNA, 16 bp, P. troglodytes
tggcaagagaaaatga

SEQ ID NO: 275708 - DNA, 16 bp, P. troglodytes
tggcaaggatgaggag

SEQ ID NO: 275709 - DNA, 16 bp, P. troglodytes
tggcaaggtctggaga

SEQ ID NO: 275710 - DNA, 16 bp, P. troglodytes
tggcaattaaatttca

SEQ ID NO: 275711 - DNA, 17 bp, P. troglodytes
tggcaattcctcaaaga

SEQ ID NO: 275712 - DNA, 16 bp, P. troglodytes
tggcaattgtgaatgg

SEQ ID NO: 275713 - DNA, 16 bp, P. troglodytes
tggcaatttattaaaa

SEQ ID NO: 275714 - DNA, 16 bp, P. troglodytes
tggcaattttaaaatt

SEQ ID NO: 275715 - DNA, 16 bp, P. troglodytes
tggcacaaacatggct

SEQ ID NO: 275716 - DNA, 16 bp, P. troglodytes
tggcacaactgctggc

SEQ ID NO: 275717 - DNA, 16 bp, P. troglodytes
tggcacaatcagagct

SEQ ID NO: 275718 - DNA, 16 bp, P. troglodytes
tggcacaatcatagct

SEQ ID NO: 275719 - DNA, 16 bp, P. troglodytes
tggcacaatcatagtt

SEQ ID NO: 275720 - DNA, 16 bp, P. troglodytes
tggcacaatcgtggct

SEQ ID NO: 275721 - DNA, 18 bp, P. troglodytes
tggcacaatctcaactca

SEQ ID NO: 275722 - DNA, 20 bp, P. troglodytes
tggcacaatctcggctcacg

SEQ ID NO: 275723 - DNA, 18 bp, P. troglodytes
tggcacaatcttggctca

SEQ ID NO: 275724 - DNA, 17 bp, P. troglodytes
tggcacaatcttggctt

SEQ ID NO: 275725 - DNA, 18 bp, P. troglodytes
tggcacacacctgtaatt

SEQ ID NO: 275726 - DNA, 16 bp, P. troglodytes
tggcacacgcctgcaa

SEQ ID NO: 275727 - DNA, 16 bp, P. troglodytes
tggcacacgcctgtat

SEQ ID NO: 275728 - DNA, 16 bp, P. troglodytes
tggcacagagagagaa

SEQ ID NO: 275729 - DNA, 16 bp, P. troglodytes
tggcacagagcaggtg

SEQ ID NO: 275730 - DNA, 18 bp, P. troglodytes
tggcacagtcacggctca

SEQ ID NO: 275731 - DNA, 18 bp, P. troglodytes
tggcacagtctcagctca

SEQ ID NO: 275732 - DNA, 16 bp, P. troglodytes
tggcacataataaaca

SEQ ID NO: 275733 - DNA, 16 bp, P. troglodytes
tggcacatctcagctc

SEQ ID NO: 275734 - DNA, 17 bp, P. troglodytes
tggcacatgcctgtaac

SEQ ID NO: 275735 - DNA, 16 bp, P. troglodytes
tggcacatttgttaca

SEQ ID NO: 275736 - DNA, 16 bp, P. troglodytes
tggcaccactgcactg

SEQ ID NO: 275737 - DNA, 16 bp, P. troglodytes
tggcaccactgctctc

SEQ ID NO: 275738 - DNA, 16 bp, P. troglodytes
tggcaccagggactgg

SEQ ID NO: 275739 - DNA, 16 bp, P. troglodytes
tggcaccatcctggct

SEQ ID NO: 275740 - DNA, 16 bp, P. troglodytes
tggcacccactctctt

SEQ ID NO: 275741 - DNA, 16 bp, P. troglodytes
tggcacccactctggc

SEQ ID NO: 275742 - DNA, 16 bp, P. troglodytes
tggcacctggagctgc

SEQ ID NO: 275743 - DNA, 16 bp, P. troglodytes
tggcacctttgtcaaa

SEQ ID NO: 275744 - DNA, 16 bp, P. troglodytes
tggcacgatcacggct

SEQ ID NO: 275745 - DNA, 20 bp, P. troglodytes
tggcacgatctcagctcacg

SEQ ID NO: 275746 - DNA, 17 bp, P. troglodytes
tggcacgatctcggctt

SEQ ID NO: 275747 - DNA, 27 bp, P. troglodytes
tggcacgatcttggctcactgcaagct

SEQ ID NO: 275748 - DNA, 16 bp, P. troglodytes
tggcacgatcttggtt

SEQ ID NO: 275749 - DNA, 16 bp, P. troglodytes
tggcacggtctctgct

SEQ ID NO: 275750 - DNA, 16 bp, P. troglodytes
tggcactacaagatgc

SEQ ID NO: 275751 - DNA, 16 bp, P. troglodytes
tggcactgctgcactc

SEQ ID NO: 275752 - DNA, 16 bp, P. troglodytes
tggcactggctgtgac

SEQ ID NO: 275753 - DNA, 16 bp, P. troglodytes
tggcacttattctaaa

SEQ ID NO: 275754 - DNA, 16 bp, P. troglodytes
tggcagaaaagcagaa

SEQ ID NO: 275755 - DNA, 16 bp, P. troglodytes
tggcagaactggaatt

SEQ ID NO: 275756 - DNA, 16 bp, P. troglodytes
tggcagaactgggatt

SEQ ID NO: 275757 - DNA, 16 bp, P. troglodytes
tggcagaagaattgct

SEQ ID NO: 275758 - DNA, 16 bp, P. troglodytes
tggcagaagacatttc

SEQ ID NO: 275759 - DNA, 16 bp, P. troglodytes
tggcagaagatgaaag

SEQ ID NO: 275760 - DNA, 16 bp, P. troglodytes
tggcagaagattttaa

SEQ ID NO: 275761 - DNA, 16 bp, P. troglodytes
tggcagaagcattgtg

SEQ ID NO: 275762 - DNA, 16 bp, P. troglodytes
tggcagaaggagaagg

SEQ ID NO: 275763 - DNA, 16 bp, P. troglodytes
tggcagaaggcagaga

SEQ ID NO: 275764 - DNA, 16 bp, P. troglodytes
tggcagaaggggtgaa

SEQ ID NO: 275765 - DNA, 16 bp, P. troglodytes
tggcagaaggtgatgg

SEQ ID NO: 275766 - DNA, 16 bp, P. troglodytes
tggcagaaggtggaag

SEQ ID NO: 275767 - DNA, 16 bp, P. troglodytes
tggcagaagtaggctt

SEQ ID NO: 275768 - DNA, 16 bp, P. troglodytes
tggcagaagtgatggt

SEQ ID NO: 275769 - DNA, 16 bp, P. troglodytes
tggcagaatctgtctg

SEQ ID NO: 275770 - DNA, 16 bp, P. troglodytes
tggcagacaagaaaga

SEQ ID NO: 275771 - DNA, 16 bp, P. troglodytes
tggcagagaaagaaaa

SEQ ID NO: 275772 - DNA, 16 bp, P. troglodytes
tggcagagacacagca

SEQ ID NO: 275773 - DNA, 16 bp, P. troglodytes
tggcagagaggctttc

SEQ ID NO: 275774 - DNA, 16 bp, P. troglodytes
tggcagagcaacacaa

SEQ ID NO: 275775 - DNA, 16 bp, P. troglodytes
tggcagagccaggacc

SEQ ID NO: 275776 - DNA, 16 bp, P. troglodytes
tggcagagctgagatt

SEQ ID NO: 275777 - DNA, 16 bp, P. troglodytes
tggcagagctggaatt

SEQ ID NO: 275778 - DNA, 16 bp, P. troglodytes
tggcagaggcagggaa

SEQ ID NO: 275779 - DNA, 16 bp, P. troglodytes
tggcagaggctgcagt

SEQ ID NO: 275780 - DNA, 16 bp, P. troglodytes
tggcagaggtggaaga

SEQ ID NO: 275781 - DNA, 16 bp, P. troglodytes
tggcagatgacatgat

SEQ ID NO: 275782 - DNA, 16 bp, P. troglodytes
tggcagcaactgccct

SEQ ID NO: 275783 - DNA, 16 bp, P. troglodytes
tggcagcagaagagag

SEQ ID NO: 275784 - DNA, 17 bp, P. troglodytes
tggcagcagacaagaga

SEQ ID NO: 275785 - DNA, 16 bp, P. troglodytes
tggcagcaggcacctg

SEQ ID NO: 275786 - DNA, 16 bp, P. troglodytes
tggcagcaggcgagag

SEQ ID NO: 275787 - DNA, 16 bp, P. troglodytes
tggcagcaggggagag

SEQ ID NO: 275788 - DNA, 16 bp, P. troglodytes
tggcagcagtgactct

SEQ ID NO: 275789 - DNA, 16 bp, P. troglodytes
tggcagcagtggccca

SEQ ID NO: 275790 - DNA, 16 bp, P. troglodytes
tggcagcagtgggctg

SEQ ID NO: 275791 - DNA, 16 bp, P. troglodytes
tggcagcatcagcatc

SEQ ID NO: 275792 - DNA, 16 bp, P. troglodytes
tggcagcatgagaaca

SEQ ID NO: 275793 - DNA, 16 bp, P. troglodytes
tggcagccacaggcct

SEQ ID NO: 275794 - DNA, 16 bp, P. troglodytes
tggcagccaggctggg

SEQ ID NO: 275795 - DNA, 16 bp, P. troglodytes
tggcagccatttcaaa

SEQ ID NO: 275796 - DNA, 16 bp, P. troglodytes
tggcagcccagaggga

SEQ ID NO: 275797 - DNA, 16 bp, P. troglodytes
tggcagccccagaaaa

SEQ ID NO: 275798 - DNA, 16 bp, P. troglodytes
tggcagcccctcccat

SEQ ID NO: 275799 - DNA, 16 bp, P. troglodytes
tggcagcctgggcaac

SEQ ID NO: 275800 - DNA, 16 bp, P. troglodytes
tggcagctcacacctg

SEQ ID NO: 275801 - DNA, 16 bp, P. troglodytes
tggcagctccatcttc

SEQ ID NO: 275802 - DNA, 16 bp, P. troglodytes
tggcagctggcaccag

SEQ ID NO: 275803 - DNA, 16 bp, P. troglodytes
tggcagctggcttcct

SEQ ID NO: 275804 - DNA, 16 bp, P. troglodytes
tggcagcttgatgggg

SEQ ID NO: 275805 - DNA, 16 bp, P. troglodytes
tggcaggagagaggga

SEQ ID NO: 275806 - DNA, 16 bp, P. troglodytes
tggcaggagcaggagc

SEQ ID NO: 275807 - DNA, 16 bp, P. troglodytes
tggcaggaggcaaaga

SEQ ID NO: 275808 - DNA, 16 bp, P. troglodytes
tggcaggagggagaga

SEQ ID NO: 275809 - DNA, 16 bp, P. troglodytes
tggcaggatttgcagg

SEQ ID NO: 275810 - DNA, 16 bp, P. troglodytes
tggcaggcagaggttg

SEQ ID NO: 275811 - DNA, 16 bp, P. troglodytes
tggcaggcagagtggg

SEQ ID NO: 275812 - DNA, 16 bp, P. troglodytes
tggcaggcagctgtgc

SEQ ID NO: 275813 - DNA, 16 bp, P. troglodytes
tggcaggcatctgtaa

SEQ ID NO: 275814 - DNA, 16 bp, P. troglodytes
tggcaggccaaggtgg

SEQ ID NO: 275815 - DNA, 16 bp, P. troglodytes
tggcaggccgaggtgg

SEQ ID NO: 275816 - DNA, 17 bp, P. troglodytes
tggcaggcgcccgtaat

SEQ ID NO: 275817 - DNA, 16 bp, P. troglodytes
tggcagggagtgggga

SEQ ID NO: 275818 - DNA, 16 bp, P. troglodytes
tggcagggcacagtgg

SEQ ID NO: 275819 - DNA, 16 bp, P. troglodytes
tggcagggcagggcag

SEQ ID NO: 275820 - DNA, 16 bp, P. troglodytes
tggcaggggcaggggc

SEQ ID NO: 275821 - DNA, 16 bp, P. troglodytes
tggcaggggccagggg

SEQ ID NO: 275822 - DNA, 16 bp, P. troglodytes
tggcagggttggtttc

SEQ ID NO: 275823 - DNA, 21 bp, P. troglodytes
tggcaggtgcctgtaatcccg

SEQ ID NO: 275824 - DNA, 16 bp, P. troglodytes
tggcaggtgtgggatc

SEQ ID NO: 275825 - DNA, 16 bp, P. troglodytes
tggcagtaggcaaaga

SEQ ID NO: 275826 - DNA, 16 bp, P. troglodytes
tggcagtggcagcagc

SEQ ID NO: 275827 - DNA, 16 bp, P. troglodytes
tggcagtggcagtggc

SEQ ID NO: 275828 - DNA, 16 bp, P. troglodytes
tggcagtgggctggac

SEQ ID NO: 275829 - DNA, 16 bp, P. troglodytes
tggcagtgggtttgtc

SEQ ID NO: 275830 - DNA, 16 bp, P. troglodytes
tggcagtgtgggctct

SEQ ID NO: 275831 - DNA, 16 bp, P. troglodytes
tggcagttggtgctgg

SEQ ID NO: 275832 - DNA, 16 bp, P. troglodytes
tggcagttttattttt

SEQ ID NO: 275833 - DNA, 16 bp, P. troglodytes
tggcagtttttaaaaa

SEQ ID NO: 275834 - DNA, 16 bp, P. troglodytes
tggcataaaaacagaa

SEQ ID NO: 275835 - DNA, 16 bp, P. troglodytes
tggcataaacccagga

SEQ ID NO: 275836 - DNA, 16 bp, P. troglodytes
tggcataatcacggct

SEQ ID NO: 275837 - DNA, 16 bp, P. troglodytes
tggcataatgtttttg

SEQ ID NO: 275838 - DNA, 16 bp, P. troglodytes
tggcatacagtaagtg

SEQ ID NO: 275839 - DNA, 16 bp, P. troglodytes
tggcatatataaatgc

SEQ ID NO: 275840 - DNA, 16 bp, P. troglodytes
tggcatccaggaagaa

SEQ ID NO: 275841 - DNA, 16 bp, P. troglodytes
tggcatccctggcctc

SEQ ID NO: 275842 - DNA, 16 bp, P. troglodytes
tggcatctctggacct

SEQ ID NO: 275843 - DNA, 16 bp, P. troglodytes
tggcatctgaagtggg

SEQ ID NO: 275844 - DNA, 16 bp, P. troglodytes
tggcatctgggaactt

SEQ ID NO: 275845 - DNA, 16 bp, P. troglodytes
tggcatgaatccagga

SEQ ID NO: 275846 - DNA, 17 bp, P. troglodytes
tggcatgatctcagctt

SEQ ID NO: 275847 - DNA, 16 bp, P. troglodytes
tggcatgatctcaggt

SEQ ID NO: 275848 - DNA, 16 bp, P. troglodytes
tggcatgatctcagtt

SEQ ID NO: 275849 - DNA, 17 bp, P. troglodytes
tggcatgatctcggctt

SEQ ID NO: 275850 - DNA, 18 bp, P. troglodytes
tggcatgatctcggttca

SEQ ID NO: 275851 - DNA, 20 bp, P. troglodytes
tggcatgatcttggctcacc

SEQ ID NO: 275852 - DNA, 16 bp, P. troglodytes
tggcatgcatctgtgg

SEQ ID NO: 275853 - DNA, 16 bp, P. troglodytes
tggcatgcgccaccat

SEQ ID NO: 275854 - DNA, 16 bp, P. troglodytes
tggcatggctggggag

SEQ ID NO: 275855 - DNA, 16 bp, P. troglodytes
tggcatgggcctgtgg

SEQ ID NO: 275856 - DNA, 18 bp, P. troglodytes
tggcatggtctcagctca

SEQ ID NO: 275857 - DNA, 16 bp, P. troglodytes
tggcatggtggtgtgc

SEQ ID NO: 275858 - DNA, 16 bp, P. troglodytes
tggcattaaaaaaaaa

SEQ ID NO: 275859 - DNA, 16 bp, P. troglodytes
tggcatttagtgggta

SEQ ID NO: 275860 - DNA, 16 bp, P. troglodytes
tggcatttcccctact

SEQ ID NO: 275861 - DNA, 16 bp, P. troglodytes
tggcatttttaaaaaa

SEQ ID NO: 275862 - DNA, 16 bp, P. troglodytes
tggccaaaatggagaa

SEQ ID NO: 275863 - DNA, 16 bp, P. troglodytes
tggccaaacatggtga

SEQ ID NO: 275864 - DNA, 16 bp, P. troglodytes
tggccaaagtggtgaa

SEQ ID NO: 275865 - DNA, 16 bp, P. troglodytes
tggccaaattggtgaa

SEQ ID NO: 275866 - DNA, 16 bp, P. troglodytes
tggccaacaaacatat

SEQ ID NO: 275867 - DNA, 17 bp, P. troglodytes
tggccaacactgtgaaa

SEQ ID NO: 275868 - DNA, 16 bp, P. troglodytes
tggccaacagggagaa

SEQ ID NO: 275869 - DNA, 16 bp, P. troglodytes
tggccaacatgaggaa

SEQ ID NO: 275870 - DNA, 20 bp, P. troglodytes
tggccaacatggcgaaacct

SEQ ID NO: 275871 - DNA, 16 bp, P. troglodytes
tggccaacatggggaa

SEQ ID NO: 275872 - DNA, 16 bp, P. troglodytes
tggccaacctggagaa

SEQ ID NO: 275873 - DNA, 17 bp, P. troglodytes
tggccaacctggcaaaa

SEQ ID NO: 275874 - DNA, 16 bp, P. troglodytes
tggccaacgtggagaa

SEQ ID NO: 275875 - DNA, 17 bp, P. troglodytes
tggccaacgtggtgaaa

SEQ ID NO: 275876 - DNA, 16 bp, P. troglodytes
tggccaacttggcaaa

SEQ ID NO: 275877 - DNA, 16 bp, P. troglodytes
tggccaagaaggtgaa

SEQ ID NO: 275878 - DNA, 16 bp, P. troglodytes
tggccaagaagtatat

SEQ ID NO: 275879 - DNA, 16 bp, P. troglodytes
tggccaagagcatgct

SEQ ID NO: 275880 - DNA, 16 bp, P. troglodytes
tggccaagatggcaaa

SEQ ID NO: 275881 - DNA, 16 bp, P. troglodytes
tggccaagatggccaa

SEQ ID NO: 275882 - DNA, 16 bp, P. troglodytes
tggccaagctggtgtc

SEQ ID NO: 275883 - DNA, 16 bp, P. troglodytes
tggccaaggagaagca

SEQ ID NO: 275884 - DNA, 16 bp, P. troglodytes
tggccaaggagacccc

SEQ ID NO: 275885 - DNA, 16 bp, P. troglodytes
tggccaaggggacccc

SEQ ID NO: 275886 - DNA, 16 bp, P. troglodytes
tggccaaggtcacata

SEQ ID NO: 275887 - DNA, 16 bp, P. troglodytes
tggccaaggtgggcag

SEQ ID NO: 275888 - DNA, 16 bp, P. troglodytes
tggccaatggtttaat

SEQ ID NO: 275889 - DNA, 18 bp, P. troglodytes
tggccacactgacttcca

SEQ ID NO: 275890 - DNA, 16 bp, P. troglodytes
tggccacactggtctt

SEQ ID NO: 275891 - DNA, 16 bp, P. troglodytes
tggccacattttggta

SEQ ID NO: 275892 - DNA, 16 bp, P. troglodytes
tggccaccaccaccac

SEQ ID NO: 275893 - DNA, 16 bp, P. troglodytes
tggccaccaggtggca

SEQ ID NO: 275894 - DNA, 16 bp, P. troglodytes
tggccaccatgatgaa

SEQ ID NO: 275895 - DNA, 16 bp, P. troglodytes
tggccactggtgatca

SEQ ID NO: 275896 - DNA, 16 bp, P. troglodytes
tggccacttggtgttc

SEQ ID NO: 275897 - DNA, 16 bp, P. troglodytes
tggccagaaaaaaaaa

SEQ ID NO: 275898 - DNA, 16 bp, P. troglodytes
tggccagaacttccca

SEQ ID NO: 275899 - DNA, 16 bp, P. troglodytes
tggccagaactttcaa

SEQ ID NO: 275900 - DNA, 16 bp, P. troglodytes
tggccagactggcctc

SEQ ID NO: 275901 - DNA, 16 bp, P. troglodytes
tggccagagcaggagc

SEQ ID NO: 275902 - DNA, 16 bp, P. troglodytes
tggccagcagcccaca

SEQ ID NO: 275903 - DNA, 17 bp, P. troglodytes
tggccagcatggtaaaa

SEQ ID NO: 275904 - DNA, 16 bp, P. troglodytes
tggccagccaggctgg

SEQ ID NO: 275905 - DNA, 16 bp, P. troglodytes
tggccagctctgtctc

SEQ ID NO: 275906 - DNA, 17 bp, P. troglodytes
tggccagctggtctcga

SEQ ID NO: 275907 - DNA, 16 bp, P. troglodytes
tggccaggacttctag

SEQ ID NO: 275908 - DNA, 16 bp, P. troglodytes
tggccaggcacggtga

SEQ ID NO: 275909 - DNA, 16 bp, P. troglodytes
tggccaggcactgtgg

SEQ ID NO: 275910 - DNA, 16 bp, P. troglodytes
tggccaggccagtctc

SEQ ID NO: 275911 - DNA, 16 bp, P. troglodytes
tggccaggcctggtgg

SEQ ID NO: 275912 - DNA, 21 bp, P. troglodytes
tggccaggcgtggtggctcat

SEQ ID NO: 275913 - DNA, 16 bp, P. troglodytes
tggccaggctggactt

SEQ ID NO: 275914 - DNA, 16 bp, P. troglodytes
tggccaggctggagtg

SEQ ID NO: 275915 - DNA, 18 bp, P. troglodytes
tggccaggctggcctcaa

SEQ ID NO: 275916 - DNA, 16 bp, P. troglodytes
tggccaggcttggtct

SEQ ID NO: 275917 - DNA, 16 bp, P. troglodytes
tggccagggcaaacag

SEQ ID NO: 275918 - DNA, 16 bp, P. troglodytes
tggccaggtgtagtgg

SEQ ID NO: 275919 - DNA, 16 bp, P. troglodytes
tggccaggttggcctc

SEQ ID NO: 275920 - DNA, 16 bp, P. troglodytes
tggccagtctgatctt

SEQ ID NO: 275921 - DNA, 16 bp, P. troglodytes
tggccataaagcaagt

SEQ ID NO: 275922 - DNA, 16 bp, P. troglodytes
tggccatagaattctc

SEQ ID NO: 275923 - DNA, 16 bp, P. troglodytes
tggccatcatggtgaa

SEQ ID NO: 275924 - DNA, 16 bp, P. troglodytes
tggccatccttgtctt

SEQ ID NO: 275925 - DNA, 16 bp, P. troglodytes
tggccatctgcaaacc

SEQ ID NO: 275926 - DNA, 16 bp, P. troglodytes
tggccatctgcaaccc

SEQ ID NO: 275927 - DNA, 16 bp, P. troglodytes
tggccatctgcaagct

SEQ ID NO: 275928 - DNA, 16 bp, P. troglodytes
tggccatcttcttgct

SEQ ID NO: 275929 - DNA, 17 bp, P. troglodytes
tggccatgatggtgaaa

SEQ ID NO: 275930 - DNA, 16 bp, P. troglodytes
tggccatgggacaaag

SEQ ID NO: 275931 - DNA, 16 bp, P. troglodytes
tggccatgggcaggcc

SEQ ID NO: 275932 - DNA, 16 bp, P. troglodytes
tggccatgtccccacc

SEQ ID NO: 275933 - DNA, 16 bp, P. troglodytes
tggccatgtgactgag

SEQ ID NO: 275934 - DNA, 16 bp, P. troglodytes
tggccattatggtgaa

SEQ ID NO: 275935 - DNA, 16 bp, P. troglodytes
tggccattctccacca

SEQ ID NO: 275936 - DNA, 16 bp, P. troglodytes
tggccattcttgtggg

SEQ ID NO: 275937 - DNA, 16 bp, P. troglodytes
tggccattgatgatga

SEQ ID NO: 275938 - DNA, 16 bp, P. troglodytes
tggccatttctccttc

SEQ ID NO: 275939 - DNA, 16 bp, P. troglodytes
tggccatttgtatgcc

SEQ ID NO: 275940 - DNA, 16 bp, P. troglodytes
tggccattttcaagat

SEQ ID NO: 275941 - DNA, 16 bp, P. troglodytes
tggccattttcataat

SEQ ID NO: 275942 - DNA, 16 bp, P. troglodytes
tggccattttcatatt

SEQ ID NO: 275943 - DNA, 16 bp, P. troglodytes
tggccattttcattat

SEQ ID NO: 275944 - DNA, 16 bp, P. troglodytes
tggcccaagccattca

SEQ ID NO: 275945 - DNA, 16 bp, P. troglodytes
tggcccaaggaagcca

SEQ ID NO: 275946 - DNA, 16 bp, P. troglodytes
tggcccaagtggcaga

SEQ ID NO: 275947 - DNA, 16 bp, P. troglodytes
tggcccacctcagcct

SEQ ID NO: 275948 - DNA, 16 bp, P. troglodytes
tggcccagccatccca

SEQ ID NO: 275949 - DNA, 16 bp, P. troglodytes
tggcccaggagttggg

SEQ ID NO: 275950 - DNA, 16 bp, P. troglodytes
tggcccaggctgaagt

SEQ ID NO: 275951 - DNA, 16 bp, P. troglodytes
tggcccaggctggcct

SEQ ID NO: 275952 - DNA, 16 bp, P. troglodytes
tggcccaggctggtct

SEQ ID NO: 275953 - DNA, 16 bp, P. troglodytes
tggcccaggggctggg

SEQ ID NO: 275954 - DNA, 16 bp, P. troglodytes
tggcccagtcttggct

SEQ ID NO: 275955 - DNA, 16 bp, P. troglodytes
tggcccatgcccagga

SEQ ID NO: 275956 - DNA, 16 bp, P. troglodytes
tggccccaaactcctg

SEQ ID NO: 275957 - DNA, 23 bp, P. troglodytes
tggccccacccacatcctgctga

SEQ ID NO: 275958 - DNA, 16 bp, P. troglodytes
tggccccagctctgcc

SEQ ID NO: 275959 - DNA, 16 bp, P. troglodytes
tggccccccaaaatgc

SEQ ID NO: 275960 - DNA, 16 bp, P. troglodytes
tggccccctaaaatct

SEQ ID NO: 275961 - DNA, 16 bp, P. troglodytes
tggcccctttcagcca

SEQ ID NO: 275962 - DNA, 16 bp, P. troglodytes
tggccctgcccaccac

SEQ ID NO: 275963 - DNA, 16 bp, P. troglodytes
tggccctggcttctgg

SEQ ID NO: 275964 - DNA, 16 bp, P. troglodytes
tggccctttgcagaaa

SEQ ID NO: 275965 - DNA, 17 bp, P. troglodytes
tggccgagcatggtggc

SEQ ID NO: 275966 - DNA, 16 bp, P. troglodytes
tggccgaggcgggcgg

SEQ ID NO: 275967 - DNA, 16 bp, P. troglodytes
tggccgaggtgggcag

SEQ ID NO: 275968 - DNA, 16 bp, P. troglodytes
tggccgatatggtgaa

SEQ ID NO: 275969 - DNA, 16 bp, P. troglodytes
tggccgccaccacgcc

SEQ ID NO: 275970 - DNA, 22 bp, P. troglodytes
tggccgggcacagtggctcaca

SEQ ID NO: 275971 - DNA, 20 bp, P. troglodytes
tggccgggcgaggtggctca

SEQ ID NO: 275972 - DNA, 16 bp, P. troglodytes
tggccgggcgcagcgg

SEQ ID NO: 275973 - DNA, 16 bp, P. troglodytes
tggcctaaaattttct

SEQ ID NO: 275974 - DNA, 16 bp, P. troglodytes
tggcctagccttccag

SEQ ID NO: 275975 - DNA, 16 bp, P. troglodytes
tggcctcaaagtgctg

SEQ ID NO: 275976 - DNA, 21 bp, P. troglodytes
tggcctcaagtgatccaccca

SEQ ID NO: 275977 - DNA, 16 bp, P. troglodytes
tggcctcagccagccc

SEQ ID NO: 275978 - DNA, 16 bp, P. troglodytes
tggcctcagcctcctg

SEQ ID NO: 275979 - DNA, 41 bp, P. troglodytes
tggcctcataaaatgagttagggaggattccctctttttct

SEQ ID NO: 275980 - DNA, 16 bp, P. troglodytes
tggcctcataccttgt

SEQ ID NO: 275981 - DNA, 16 bp, P. troglodytes
tggcctccagccagga

SEQ ID NO: 275982 - DNA, 16 bp, P. troglodytes
tggcctccagctccct

SEQ ID NO: 275983 - DNA, 16 bp, P. troglodytes
tggcctcccaaagaac

SEQ ID NO: 275984 - DNA, 16 bp, P. troglodytes
tggcctcccaagatgc

SEQ ID NO: 275985 - DNA, 16 bp, P. troglodytes
tggcctcccagactgc

SEQ ID NO: 275986 - DNA, 16 bp, P. troglodytes
tggcctcccagtgctg

SEQ ID NO: 275987 - DNA, 16 bp, P. troglodytes
tggcctccccaggtgc

SEQ ID NO: 275988 - DNA, 17 bp, P. troglodytes
tggcctcgaactcctgg

SEQ ID NO: 275989 - DNA, 16 bp, P. troglodytes
tggcctctacccagta

SEQ ID NO: 275990 - DNA, 16 bp, P. troglodytes
tggcctctcccaaatc

SEQ ID NO: 275991 - DNA, 16 bp, P. troglodytes
tggcctctccctgctc

SEQ ID NO: 275992 - DNA, 16 bp, P. troglodytes
tggcctgaagcctgaa

SEQ ID NO: 275993 - DNA, 16 bp, P. troglodytes
tggcctgatcatggct

SEQ ID NO: 275994 - DNA, 16 bp, P. troglodytes
tggcctgcaggagcca

SEQ ID NO: 275995 - DNA, 16 bp, P. troglodytes
tggcctgcaggctgca

SEQ ID NO: 275996 - DNA, 16 bp, P. troglodytes
tggcctggacaacaga

SEQ ID NO: 275997 - DNA, 16 bp, P. troglodytes
tggcctggagcctggg

SEQ ID NO: 275998 - DNA, 16 bp, P. troglodytes
tggcctggatctcctg

SEQ ID NO: 275999 - DNA, 16 bp, P. troglodytes
tggcctggatgtggtt

SEQ ID NO: 276000 - DNA, 16 bp, P. troglodytes
tggcctggcgcagtgg

SEQ ID NO: 276001 - DNA, 16 bp, P. troglodytes
tggcctggctggtttc

SEQ ID NO: 276002 - DNA, 16 bp, P. troglodytes
tggcctggtggctcat

SEQ ID NO: 276003 - DNA, 16 bp, P. troglodytes
tggcctgtactcttca

SEQ ID NO: 276004 - DNA, 16 bp, P. troglodytes
tggcctgtggttttct

SEQ ID NO: 276005 - DNA, 16 bp, P. troglodytes
tggcctgttaggagcc

SEQ ID NO: 276006 - DNA, 16 bp, P. troglodytes
tggccttccacagtgc

SEQ ID NO: 276007 - DNA, 16 bp, P. troglodytes
tggccttgacctccca

SEQ ID NO: 276008 - DNA, 16 bp, P. troglodytes
tggccttgctgagctg

SEQ ID NO: 276009 - DNA, 16 bp, P. troglodytes
tggccttgtctctttt

SEQ ID NO: 276010 - DNA, 16 bp, P. troglodytes
tggcctttattatttt

SEQ ID NO: 276011 - DNA, 16 bp, P. troglodytes
tggcctttcaaagtgt

SEQ ID NO: 276012 - DNA, 16 bp, P. troglodytes
tggcctttccttggtg

SEQ ID NO: 276013 - DNA, 16 bp, P. troglodytes
tggccttttatgtctg

SEQ ID NO: 276014 - DNA, 16 bp, P. troglodytes
tggcgaaacaccatct

SEQ ID NO: 276015 - DNA, 16 bp, P. troglodytes
tggcgaaaccccatct

SEQ ID NO: 276016 - DNA, 17 bp, P. troglodytes
tggcgaaaccccgtcta

SEQ ID NO: 276017 - DNA, 16 bp, P. troglodytes
tggcgaaaccctgtgt

SEQ ID NO: 276018 - DNA, 17 bp, P. troglodytes
tggcgaacacggtgaaa

SEQ ID NO: 276019 - DNA, 16 bp, P. troglodytes
tggcgaggctgcagag

SEQ ID NO: 276020 - DNA, 16 bp, P. troglodytes
tggcgagggctccacc

SEQ ID NO: 276021 - DNA, 16 bp, P. troglodytes
tggcgcaaccttggct

SEQ ID NO: 276022 - DNA, 16 bp, P. troglodytes
tggcgcaatctcgact

SEQ ID NO: 276023 - DNA, 16 bp, P. troglodytes
tggcgcaatcttggct

SEQ ID NO: 276024 - DNA, 17 bp, P. troglodytes
tggcgcatgcctgtaaa

SEQ ID NO: 276025 - DNA, 16 bp, P. troglodytes
tggcgcctgcctgtag

SEQ ID NO: 276026 - DNA, 17 bp, P. troglodytes
tggcgcgatcatggctc

SEQ ID NO: 276027 - DNA, 16 bp, P. troglodytes
tggcgcgatctcggca

SEQ ID NO: 276028 - DNA, 18 bp, P. troglodytes
tggcgcgatctcggctct

SEQ ID NO: 276029 - DNA, 16 bp, P. troglodytes
tggcgcgatcttggcc

SEQ ID NO: 276030 - DNA, 18 bp, P. troglodytes
tggcgcgatcttggctca

SEQ ID NO: 276031 - DNA, 20 bp, P. troglodytes
tggcgcgatcttggctcacc

SEQ ID NO: 276032 - DNA, 16 bp, P. troglodytes
tggcggcagcaaggag

SEQ ID NO: 276033 - DNA, 16 bp, P. troglodytes
tggcggccgggcagag

SEQ ID NO: 276034 - DNA, 16 bp, P. troglodytes
tggcggctcacgcctg

SEQ ID NO: 276035 - DNA, 16 bp, P. troglodytes
tggcggctcatgcctg

SEQ ID NO: 276036 - DNA, 16 bp, P. troglodytes
tggcggctgggcagag

SEQ ID NO: 276037 - DNA, 18 bp, P. troglodytes
tggcgggcacctataatc

SEQ ID NO: 276038 - DNA, 16 bp, P. troglodytes
tggcgggcagagtggg

SEQ ID NO: 276039 - DNA, 16 bp, P. troglodytes
tggcgggcgcctgcag

SEQ ID NO: 276040 - DNA, 16 bp, P. troglodytes
tggcggtgtgtgcctg

SEQ ID NO: 276041 - DNA, 17 bp, P. troglodytes
tggcgtgaacccagaag

SEQ ID NO: 276042 - DNA, 16 bp, P. troglodytes
tggcgtgaacctggag

SEQ ID NO: 276043 - DNA, 19 bp, P. troglodytes
tggcgtgatctaggctcac

SEQ ID NO: 276044 - DNA, 19 bp, P. troglodytes
tggcgtgatctcggctcat

SEQ ID NO: 276045 - DNA, 17 bp, P. troglodytes
tggcgtgatcttggctt

SEQ ID NO: 276046 - DNA, 16 bp, P. troglodytes
tggcgtgcagtggtgt

SEQ ID NO: 276047 - DNA, 16 bp, P. troglodytes
tggctaaaaggggcca

SEQ ID NO: 276048 - DNA, 16 bp, P. troglodytes
tggctaaaatgggcca

SEQ ID NO: 276049 - DNA, 16 bp, P. troglodytes
tggctaaatttgtatt

SEQ ID NO: 276050 - DNA, 19 bp, P. troglodytes
tggctaacttttgtatttt

SEQ ID NO: 276051 - DNA, 16 bp, P. troglodytes
tggctaagtcctcaaa

SEQ ID NO: 276052 - DNA, 16 bp, P. troglodytes
tggctaagtttttatt

SEQ ID NO: 276053 - DNA, 16 bp, P. troglodytes
tggctaatatttttat

SEQ ID NO: 276054 - DNA, 16 bp, P. troglodytes
tggctaatgatgttga

SEQ ID NO: 276055 - DNA, 16 bp, P. troglodytes
tggctaatttattatt

SEQ ID NO: 276056 - DNA, 16 bp, P. troglodytes
tggctaatttcttatt

SEQ ID NO: 276057 - DNA, 16 bp, P. troglodytes
tggctaattttctttt

SEQ ID NO: 276058 - DNA, 16 bp, P. troglodytes
tggctaattttttaat

SEQ ID NO: 276059 - DNA, 16 bp, P. troglodytes
tggctactataaataa

SEQ ID NO: 276060 - DNA, 16 bp, P. troglodytes
tggctactctgggtct

SEQ ID NO: 276061 - DNA, 16 bp, P. troglodytes
tggctactgcaacctc

SEQ ID NO: 276062 - DNA, 16 bp, P. troglodytes
tggctaggaaagggaa

SEQ ID NO: 276063 - DNA, 16 bp, P. troglodytes
tggctagtgtgactga

SEQ ID NO: 276064 - DNA, 16 bp, P. troglodytes
tggctatgcagactct

SEQ ID NO: 276065 - DNA, 16 bp, P. troglodytes
tggctattctgtgtct

SEQ ID NO: 276066 - DNA, 16 bp, P. troglodytes
tggctattcttgcagg

SEQ ID NO: 276067 - DNA, 16 bp, P. troglodytes
tggctattttatttat

SEQ ID NO: 276068 - DNA, 16 bp, P. troglodytes
tggctatttttttaat

SEQ ID NO: 276069 - DNA, 16 bp, P. troglodytes
tggctcaaaggggccc

SEQ ID NO: 276070 - DNA, 17 bp, P. troglodytes
tggctcaagcctataat

SEQ ID NO: 276071 - DNA, 16 bp, P. troglodytes
tggctcaagcctggaa

SEQ ID NO: 276072 - DNA, 17 bp, P. troglodytes
tggctcacaactgtaat

SEQ ID NO: 276073 - DNA, 17 bp, P. troglodytes
tggctcacaccagtaat

SEQ ID NO: 276074 - DNA, 17 bp, P. troglodytes
tggctcacacctgtaaa

SEQ ID NO: 276075 - DNA, 17 bp, P. troglodytes
tggctcacagctgtaat

SEQ ID NO: 276076 - DNA, 16 bp, P. troglodytes
tggctcacgcctataa

SEQ ID NO: 276077 - DNA, 16 bp, P. troglodytes
tggctcactgaagctt

SEQ ID NO: 276078 - DNA, 16 bp, P. troglodytes
tggctcactgcagccc

SEQ ID NO: 276079 - DNA, 16 bp, P. troglodytes
tggctcactgtagcct

SEQ ID NO: 276080 - DNA, 16 bp, P. troglodytes
tggctcactgtgacct

SEQ ID NO: 276081 - DNA, 16 bp, P. troglodytes
tggctcaggtgattct

SEQ ID NO: 276082 - DNA, 16 bp, P. troglodytes
tggctcaggtggccag

SEQ ID NO: 276083 - DNA, 16 bp, P. troglodytes
tggctcagtgtcccca

SEQ ID NO: 276084 - DNA, 16 bp, P. troglodytes
tggctcatccctgtaa

SEQ ID NO: 276085 - DNA, 16 bp, P. troglodytes
tggctcatgcatataa

SEQ ID NO: 276086 - DNA, 16 bp, P. troglodytes
tggctcatgcctataa

SEQ ID NO: 276087 - DNA, 16 bp, P. troglodytes
tggctcatgcctgtgg

SEQ ID NO: 276088 - DNA, 17 bp, P. troglodytes
tggctcatggctgtaat

SEQ ID NO: 276089 - DNA, 16 bp, P. troglodytes
tggctcatgtctgaaa

SEQ ID NO: 276090 - DNA, 16 bp, P. troglodytes
tggctcattgcagcct

SEQ ID NO: 276091 - DNA, 16 bp, P. troglodytes
tggctccaaaagagac

SEQ ID NO: 276092 - DNA, 16 bp, P. troglodytes
tggctccacctggacc

SEQ ID NO: 276093 - DNA, 16 bp, P. troglodytes
tggctccagagcccac

SEQ ID NO: 276094 - DNA, 16 bp, P. troglodytes
tggctccagagcccat

SEQ ID NO: 276095 - DNA, 16 bp, P. troglodytes
tggctccagagtctgt

SEQ ID NO: 276096 - DNA, 16 bp, P. troglodytes
tggctccatctctgct

SEQ ID NO: 276097 - DNA, 16 bp, P. troglodytes
tggctccccaaagtgc

SEQ ID NO: 276098 - DNA, 16 bp, P. troglodytes
tggctccccagtgcct

SEQ ID NO: 276099 - DNA, 16 bp, P. troglodytes
tggctccccattgcct

SEQ ID NO: 276100 - DNA, 16 bp, P. troglodytes
tggctcctgcacctgc

SEQ ID NO: 276101 - DNA, 16 bp, P. troglodytes
tggctcctggacagca

SEQ ID NO: 276102 - DNA, 16 bp, P. troglodytes
tggctcctttttactt

SEQ ID NO: 276103 - DNA, 16 bp, P. troglodytes
tggctctcaaacttta

SEQ ID NO: 276104 - DNA, 16 bp, P. troglodytes
tggctctcattatttt

SEQ ID NO: 276105 - DNA, 16 bp, P. troglodytes
tggctctctgtttctc

SEQ ID NO: 276106 - DNA, 16 bp, P. troglodytes
tggctctgccactgac

SEQ ID NO: 276107 - DNA, 16 bp, P. troglodytes
tggctctggaggctgg

SEQ ID NO: 276108 - DNA, 16 bp, P. troglodytes
tggctctgggtcccca

SEQ ID NO: 276109 - DNA, 16 bp, P. troglodytes
tggctctgtgtcccac

SEQ ID NO: 276110 - DNA, 16 bp, P. troglodytes
tggctctgtttcccca

SEQ ID NO: 276111 - DNA, 16 bp, P. troglodytes
tggctcttactatttt

SEQ ID NO: 276112 - DNA, 16 bp, P. troglodytes
tggctcttggttctgc

SEQ ID NO: 276113 - DNA, 17 bp, P. troglodytes
tggctctttcactggca

SEQ ID NO: 276114 - DNA, 16 bp, P. troglodytes
tggctgaaaggggcca

SEQ ID NO: 276115 - DNA, 16 bp, P. troglodytes
tggctgaaataacaga

SEQ ID NO: 276116 - DNA, 16 bp, P. troglodytes
tggctgaaatgacaaa

SEQ ID NO: 276117 - DNA, 16 bp, P. troglodytes
tggctgaaatgacaga

SEQ ID NO: 276118 - DNA, 16 bp, P. troglodytes
tggctgaacctgggag

SEQ ID NO: 276119 - DNA, 16 bp, P. troglodytes
tggctgaactcattta

SEQ ID NO: 276120 - DNA, 16 bp, P. troglodytes
tggctgaagctcagct

SEQ ID NO: 276121 - DNA, 16 bp, P. troglodytes
tggctgaatccacaga

SEQ ID NO: 276122 - DNA, 17 bp, P. troglodytes
tggctgacacctgtaat

SEQ ID NO: 276123 - DNA, 16 bp, P. troglodytes
tggctgacaccttgat

SEQ ID NO: 276124 - DNA, 16 bp, P. troglodytes
tggctgacatctgtaa

SEQ ID NO: 276125 - DNA, 16 bp, P. troglodytes
tggctgactgcaatct

SEQ ID NO: 276126 - DNA, 16 bp, P. troglodytes
tggctgagctgatatc

SEQ ID NO: 276127 - DNA, 16 bp, P. troglodytes
tggctgaggaggcctc

SEQ ID NO: 276128 - DNA, 16 bp, P. troglodytes
tggctgatttcaagct

SEQ ID NO: 276129 - DNA, 16 bp, P. troglodytes
tggctgatttttttgt

SEQ ID NO: 276130 - DNA, 16 bp, P. troglodytes
tggctgcacatcagaa

SEQ ID NO: 276131 - DNA, 16 bp, P. troglodytes
tggctgcacctgctgt

SEQ ID NO: 276132 - DNA, 16 bp, P. troglodytes
tggctgcagaaatttg

SEQ ID NO: 276133 - DNA, 16 bp, P. troglodytes
tggctgcagccccagc

SEQ ID NO: 276134 - DNA, 16 bp, P. troglodytes
tggctgcagctggagg

SEQ ID NO: 276135 - DNA, 16 bp, P. troglodytes
tggctgcatatgaaat

SEQ ID NO: 276136 - DNA, 16 bp, P. troglodytes
tggctgcatgtggtgg

SEQ ID NO: 276137 - DNA, 16 bp, P. troglodytes
tggctgccaggaagct

SEQ ID NO: 276138 - DNA, 16 bp, P. troglodytes
tggctgccaggagctg

SEQ ID NO: 276139 - DNA, 16 bp, P. troglodytes
tggctgccaggcagag

SEQ ID NO: 276140 - DNA, 16 bp, P. troglodytes
tggctgccaggcggag

SEQ ID NO: 276141 - DNA, 16 bp, P. troglodytes
tggctgcccagtctgg

SEQ ID NO: 276142 - DNA, 16 bp, P. troglodytes
tggctgccctgctgga

SEQ ID NO: 276143 - DNA, 16 bp, P. troglodytes
tggctgccctgctggg

SEQ ID NO: 276144 - DNA, 16 bp, P. troglodytes
tggctgcctcctgctg

SEQ ID NO: 276145 - DNA, 16 bp, P. troglodytes
tggctgcctcctgtca

SEQ ID NO: 276146 - DNA, 16 bp, P. troglodytes
tggctgcctctgctgc

SEQ ID NO: 276147 - DNA, 16 bp, P. troglodytes
tggctgcctgtgggct

SEQ ID NO: 276148 - DNA, 17 bp, P. troglodytes
tggctgctgctgctgct

SEQ ID NO: 276149 - DNA, 16 bp, P. troglodytes
tggctgcttccaagtt

SEQ ID NO: 276150 - DNA, 16 bp, P. troglodytes
tggctgcttttgcact

SEQ ID NO: 276151 - DNA, 16 bp, P. troglodytes
tggctggaagcagaag

SEQ ID NO: 276152 - DNA, 16 bp, P. troglodytes
tggctggaatggctgg

SEQ ID NO: 276153 - DNA, 16 bp, P. troglodytes
tggctggagaaaaaca

SEQ ID NO: 276154 - DNA, 16 bp, P. troglodytes
tggctggagaaagagg

SEQ ID NO: 276155 - DNA, 16 bp, P. troglodytes
tggctggagcacagtg

SEQ ID NO: 276156 - DNA, 16 bp, P. troglodytes
tggctggagcagaggg

SEQ ID NO: 276157 - DNA, 16 bp, P. troglodytes
tggctggagccagacc

SEQ ID NO: 276158 - DNA, 16 bp, P. troglodytes
tggctggagctgcagc

SEQ ID NO: 276159 - DNA, 16 bp, P. troglodytes
tggctggagctgctgg

SEQ ID NO: 276160 - DNA, 16 bp, P. troglodytes
tggctggagctgtggc

SEQ ID NO: 276161 - DNA, 16 bp, P. troglodytes
tggctggaggcccagg

SEQ ID NO: 276162 - DNA, 16 bp, P. troglodytes
tggctggaggccctgg

SEQ ID NO: 276163 - DNA, 16 bp, P. troglodytes
tggctggaggcctcag

SEQ ID NO: 276164 - DNA, 16 bp, P. troglodytes
tggctggagtgcagtg

SEQ ID NO: 276165 - DNA, 17 bp, P. troglodytes
tggctggatgtgaaatt

SEQ ID NO: 276166 - DNA, 16 bp, P. troglodytes
tggctggcacatagta

SEQ ID NO: 276167 - DNA, 16 bp, P. troglodytes
tggctggcagagaagg

SEQ ID NO: 276168 - DNA, 16 bp, P. troglodytes
tggctggcagaggcag

SEQ ID NO: 276169 - DNA, 16 bp, P. troglodytes
tggctggcagccccta

SEQ ID NO: 276170 - DNA, 16 bp, P. troglodytes
tggctggccagttatc

SEQ ID NO: 276171 - DNA, 16 bp, P. troglodytes
tggctggctccttctc

SEQ ID NO: 276172 - DNA, 16 bp, P. troglodytes
tggctggctccttctt

SEQ ID NO: 276173 - DNA, 16 bp, P. troglodytes
tggctggctggctgga

SEQ ID NO: 276174 - DNA, 17 bp, P. troglodytes
tggctggctggctggct

SEQ ID NO: 276175 - DNA, 16 bp, P. troglodytes
tggctggctgggtggc

SEQ ID NO: 276176 - DNA, 16 bp, P. troglodytes
tggctggctttgggga

SEQ ID NO: 276177 - DNA, 16 bp, P. troglodytes
tggctgggaacagtgg

SEQ ID NO: 276178 - DNA, 16 bp, P. troglodytes
tggctgggaagcaggg

SEQ ID NO: 276179 - DNA, 16 bp, P. troglodytes
tggctgggaccacaga

SEQ ID NO: 276180 - DNA, 16 bp, P. troglodytes
tggctgggagcagcct

SEQ ID NO: 276181 - DNA, 16 bp, P. troglodytes
tggctgggagcggtgg

SEQ ID NO: 276182 - DNA, 16 bp, P. troglodytes
tggctgggattacagg

SEQ ID NO: 276183 - DNA, 16 bp, P. troglodytes
tggctgggcagggtgg

SEQ ID NO: 276184 - DNA, 16 bp, P. troglodytes
tggctgggctcagctg

SEQ ID NO: 276185 - DNA, 16 bp, P. troglodytes
tggctggggacacaga

SEQ ID NO: 276186 - DNA, 16 bp, P. troglodytes
tggctggggaggcccc

SEQ ID NO: 276187 - DNA, 16 bp, P. troglodytes
tggctggggaggcttc

SEQ ID NO: 276188 - DNA, 16 bp, P. troglodytes
tggctggggcaggagg

SEQ ID NO: 276189 - DNA, 16 bp, P. troglodytes
tggctgggggaggcct

SEQ ID NO: 276190 - DNA, 16 bp, P. troglodytes
tggctgggggcagtgg

SEQ ID NO: 276191 - DNA, 16 bp, P. troglodytes
tggctggggtggcctc

SEQ ID NO: 276192 - DNA, 16 bp, P. troglodytes
tggctggtttgatctt

SEQ ID NO: 276193 - DNA, 16 bp, P. troglodytes
tggctgtaaacacaga

SEQ ID NO: 276194 - DNA, 16 bp, P. troglodytes
tggctgtactagttta

SEQ ID NO: 276195 - DNA, 16 bp, P. troglodytes
tggctgtaggtatgtg

SEQ ID NO: 276196 - DNA, 16 bp, P. troglodytes
tggctgtaggtgtgca

SEQ ID NO: 276197 - DNA, 16 bp, P. troglodytes
tggctgtcagcttgga

SEQ ID NO: 276198 - DNA, 16 bp, P. troglodytes
tggctgtctgcaagcc

SEQ ID NO: 276199 - DNA, 16 bp, P. troglodytes
tggctgtctgtctgtt

SEQ ID NO: 276200 - DNA, 16 bp, P. troglodytes
tggctgtgaatccatc

SEQ ID NO: 276201 - DNA, 16 bp, P. troglodytes
tggctgtgaatttgtc

SEQ ID NO: 276202 - DNA, 16 bp, P. troglodytes
tggctgtgcagaagct

SEQ ID NO: 276203 - DNA, 16 bp, P. troglodytes
tggctgtgccccaccc

SEQ ID NO: 276204 - DNA, 16 bp, P. troglodytes
tggctgtgctggagtc

SEQ ID NO: 276205 - DNA, 16 bp, P. troglodytes
tggctgtggccccacc

SEQ ID NO: 276206 - DNA, 16 bp, P. troglodytes
tggctgtggctgtggc

SEQ ID NO: 276207 - DNA, 17 bp, P. troglodytes
tggctgtgggtgtgtca

SEQ ID NO: 276208 - DNA, 19 bp, P. troglodytes
tggctgtgggtttgtcata

SEQ ID NO: 276209 - DNA, 16 bp, P. troglodytes
tggctgtgtcacccag

SEQ ID NO: 276210 - DNA, 16 bp, P. troglodytes
tggctgtgtctccatc

SEQ ID NO: 276211 - DNA, 16 bp, P. troglodytes
tggctgtgtctgcacc

SEQ ID NO: 276212 - DNA, 16 bp, P. troglodytes
tggctgtgtgcccacc

SEQ ID NO: 276213 - DNA, 16 bp, P. troglodytes
tggctgtgtggccttg

SEQ ID NO: 276214 - DNA, 16 bp, P. troglodytes
tggctgttatgaataa

SEQ ID NO: 276215 - DNA, 16 bp, P. troglodytes
tggctgttggccagag

SEQ ID NO: 276216 - DNA, 16 bp, P. troglodytes
tggctgtttcctctgc

SEQ ID NO: 276217 - DNA, 16 bp, P. troglodytes
tggctgtttctgagtt

SEQ ID NO: 276218 - DNA, 16 bp, P. troglodytes
tggcttaaaacaatat

SEQ ID NO: 276219 - DNA, 16 bp, P. troglodytes
tggcttaaaatatttt

SEQ ID NO: 276220 - DNA, 16 bp, P. troglodytes
tggcttaaacaataaa

SEQ ID NO: 276221 - DNA, 16 bp, P. troglodytes
tggcttaagcaacaaa

SEQ ID NO: 276222 - DNA, 16 bp, P. troglodytes
tggcttaagtgttaac

SEQ ID NO: 276223 - DNA, 17 bp, P. troglodytes
tggcttacacctgtagt

SEQ ID NO: 276224 - DNA, 16 bp, P. troglodytes
tggcttacgcctgtta

SEQ ID NO: 276225 - DNA, 16 bp, P. troglodytes
tggcttactgcagcct

SEQ ID NO: 276226 - DNA, 16 bp, P. troglodytes
tggcttacttcactta

SEQ ID NO: 276227 - DNA, 16 bp, P. troglodytes
tggcttagaacaacag

SEQ ID NO: 276228 - DNA, 17 bp, P. troglodytes
tggcttatgcctgtaat

SEQ ID NO: 276229 - DNA, 16 bp, P. troglodytes
tggcttatttatttat

SEQ ID NO: 276230 - DNA, 16 bp, P. troglodytes
tggcttatttcactta

SEQ ID NO: 276231 - DNA, 16 bp, P. troglodytes
tggcttattttgctta

SEQ ID NO: 276232 - DNA, 16 bp, P. troglodytes
tggcttcagaagtgaa

SEQ ID NO: 276233 - DNA, 16 bp, P. troglodytes
tggcttcagaggatgc

SEQ ID NO: 276234 - DNA, 21 bp, P. troglodytes
tggcttcaggagtgaagctgc

SEQ ID NO: 276235 - DNA, 16 bp, P. troglodytes
tggcttcatagaatga

SEQ ID NO: 276236 - DNA, 16 bp, P. troglodytes
tggcttcatccttggg

SEQ ID NO: 276237 - DNA, 16 bp, P. troglodytes
tggcttcattgatttt

SEQ ID NO: 276238 - DNA, 16 bp, P. troglodytes
tggcttccaccttcat

SEQ ID NO: 276239 - DNA, 16 bp, P. troglodytes
tggcttccatgtggtg

SEQ ID NO: 276240 - DNA, 16 bp, P. troglodytes
tggcttcccccaaccc

SEQ ID NO: 276241 - DNA, 16 bp, P. troglodytes
tggcttccctggttct

SEQ ID NO: 276242 - DNA, 16 bp, P. troglodytes
tggcttccttgcccct

SEQ ID NO: 276243 - DNA, 16 bp, P. troglodytes
tggcttctctggttct

SEQ ID NO: 276244 - DNA, 16 bp, P. troglodytes
tggcttctctttggca

SEQ ID NO: 276245 - DNA, 16 bp, P. troglodytes
tggcttcttcagctcc

SEQ ID NO: 276246 - DNA, 16 bp, P. troglodytes
tggcttcttcctgctg

SEQ ID NO: 276247 - DNA, 16 bp, P. troglodytes
tggcttctttcaaaat

SEQ ID NO: 276248 - DNA, 16 bp, P. troglodytes
tggcttctttcacgta

SEQ ID NO: 276249 - DNA, 16 bp, P. troglodytes
tggcttctttcactta

SEQ ID NO: 276250 - DNA, 16 bp, P. troglodytes
tggcttctttcagtta

SEQ ID NO: 276251 - DNA, 16 bp, P. troglodytes
tggcttctttccctca

SEQ ID NO: 276252 - DNA, 16 bp, P. troglodytes
tggcttgaaggtgggg

SEQ ID NO: 276253 - DNA, 16 bp, P. troglodytes
tggcttgcagacagct

SEQ ID NO: 276254 - DNA, 16 bp, P. troglodytes
tggcttgggaggctgc

SEQ ID NO: 276255 - DNA, 16 bp, P. troglodytes
tggcttgggtgccagc

SEQ ID NO: 276256 - DNA, 16 bp, P. troglodytes
tggcttggtgccctcc

SEQ ID NO: 276257 - DNA, 16 bp, P. troglodytes
tggctttaagttgaag

SEQ ID NO: 276258 - DNA, 16 bp, P. troglodytes
tggctttatctctggg

SEQ ID NO: 276259 - DNA, 16 bp, P. troglodytes
tggctttcctgggcca

SEQ ID NO: 276260 - DNA, 16 bp, P. troglodytes
tggctttctgattttt

SEQ ID NO: 276261 - DNA, 16 bp, P. troglodytes
tggctttgctgagctg

SEQ ID NO: 276262 - DNA, 16 bp, P. troglodytes
tggctttgtgttccca

SEQ ID NO: 276263 - DNA, 16 bp, P. troglodytes
tggctttgttcatttt

SEQ ID NO: 276264 - DNA, 16 bp, P. troglodytes
tggctttgttgatttt

SEQ ID NO: 276265 - DNA, 16 bp, P. troglodytes
tggctttgtttaccta

SEQ ID NO: 276266 - DNA, 16 bp, P. troglodytes
tggcttttaaaggaat

SEQ ID NO: 276267 - DNA, 16 bp, P. troglodytes
tggcttttctgggcag

SEQ ID NO: 276268 - DNA, 16 bp, P. troglodytes
tggcttttgaaaattg

SEQ ID NO: 276269 - DNA, 16 bp, P. troglodytes
tggcttttgagcactt

SEQ ID NO: 276270 - DNA, 16 bp, P. troglodytes
tggcttttgtggccat

SEQ ID NO: 276271 - DNA, 16 bp, P. troglodytes
tggcttttgtttccat

SEQ ID NO: 276272 - DNA, 16 bp, P. troglodytes
tggctttttaaatttt

SEQ ID NO: 276273 - DNA, 16 bp, P. troglodytes
tgggaaaaaaaaaact

SEQ ID NO: 276274 - DNA, 16 bp, P. troglodytes
tgggaaaaaaaatcta

SEQ ID NO: 276275 - DNA, 16 bp, P. troglodytes
tgggaaaaaacaaaca

SEQ ID NO: 276276 - DNA, 16 bp, P. troglodytes
tgggaaaaaatgtttg

SEQ ID NO: 276277 - DNA, 16 bp, P. troglodytes
tgggaaaaacaaaaca

SEQ ID NO: 276278 - DNA, 16 bp, P. troglodytes
tgggaaaaccactgct

SEQ ID NO: 276279 - DNA, 16 bp, P. troglodytes
tgggaaaactgaagct

SEQ ID NO: 276280 - DNA, 20 bp, P. troglodytes
tgggaaaactggctagccat

SEQ ID NO: 276281 - DNA, 18 bp, P. troglodytes
tgggaaaactggctagct

SEQ ID NO: 276282 - DNA, 16 bp, P. troglodytes
tgggaaaagcgtagta

SEQ ID NO: 276283 - DNA, 16 bp, P. troglodytes
tgggaaaaggattccc

SEQ ID NO: 276284 - DNA, 16 bp, P. troglodytes
tgggaaaagtgtagta

SEQ ID NO: 276285 - DNA, 16 bp, P. troglodytes
tgggaaacacagcaag

SEQ ID NO: 276286 - DNA, 16 bp, P. troglodytes
tgggaaacagtgagac

SEQ ID NO: 276287 - DNA, 16 bp, P. troglodytes
tgggaaacatggaaaa

SEQ ID NO: 276288 - DNA, 16 bp, P. troglodytes
tgggaaaccaaaaatt

SEQ ID NO: 276289 - DNA, 16 bp, P. troglodytes
tgggaaaccaaaatat

SEQ ID NO: 276290 - DNA, 16 bp, P. troglodytes
tgggaaagaatatttg

SEQ ID NO: 276291 - DNA, 16 bp, P. troglodytes
tgggaaagaatttatg

SEQ ID NO: 276292 - DNA, 16 bp, P. troglodytes
tgggaaagacccaccc

SEQ ID NO: 276293 - DNA, 16 bp, P. troglodytes
tgggaaagattttatt

SEQ ID NO: 276294 - DNA, 16 bp, P. troglodytes
tgggaaagctttccag

SEQ ID NO: 276295 - DNA, 16 bp, P. troglodytes
tgggaaagcttttata

SEQ ID NO: 276296 - DNA, 16 bp, P. troglodytes
tgggaaaggggccagc

SEQ ID NO: 276297 - DNA, 16 bp, P. troglodytes
tgggaaagttacttaa

SEQ ID NO: 276298 - DNA, 16 bp, P. troglodytes
tgggaaataatttgaa

SEQ ID NO: 276299 - DNA, 16 bp, P. troglodytes
tgggaaatggagtaaa

SEQ ID NO: 276300 - DNA, 16 bp, P. troglodytes
tgggaacacaggtgca

SEQ ID NO: 276301 - DNA, 16 bp, P. troglodytes
tgggaacagagcaaga

SEQ ID NO: 276302 - DNA, 16 bp, P. troglodytes
tgggaacaggcattcc

SEQ ID NO: 276303 - DNA, 16 bp, P. troglodytes
tgggaacccacctctt

SEQ ID NO: 276304 - DNA, 16 bp, P. troglodytes
tgggaactcattgagg

SEQ ID NO: 276305 - DNA, 16 bp, P. troglodytes
tgggaactctctgtac

SEQ ID NO: 276306 - DNA, 16 bp, P. troglodytes
tgggaactggaataaa

SEQ ID NO: 276307 - DNA, 16 bp, P. troglodytes
tgggaactggagtgca

SEQ ID NO: 276308 - DNA, 16 bp, P. troglodytes
tgggaacttgttagaa

SEQ ID NO: 276309 - DNA, 16 bp, P. troglodytes
tgggaacttttttttt

SEQ ID NO: 276310 - DNA, 16 bp, P. troglodytes
tgggaagaatcaatat

SEQ ID NO: 276311 - DNA, 16 bp, P. troglodytes
tgggaagaccctgatg

SEQ ID NO: 276312 - DNA, 16 bp, P. troglodytes
tgggaagactgaggca

SEQ ID NO: 276313 - DNA, 16 bp, P. troglodytes
tgggaagatcacttgg

SEQ ID NO: 276314 - DNA, 16 bp, P. troglodytes
tgggaagatcatctga

SEQ ID NO: 276315 - DNA, 16 bp, P. troglodytes
tgggaagatgaaaagt

SEQ ID NO: 276316 - DNA, 16 bp, P. troglodytes
tgggaagcagaggcgg

SEQ ID NO: 276317 - DNA, 16 bp, P. troglodytes
tgggaagcagaggctg

SEQ ID NO: 276318 - DNA, 16 bp, P. troglodytes
tgggaagcaggtttgc

SEQ ID NO: 276319 - DNA, 16 bp, P. troglodytes
tgggaagccaaagcag

SEQ ID NO: 276320 - DNA, 16 bp, P. troglodytes
tgggaagctaaggtag

SEQ ID NO: 276321 - DNA, 16 bp, P. troglodytes
tgggaagctgaagcgg

SEQ ID NO: 276322 - DNA, 16 bp, P. troglodytes
tgggaagctgaggctg

SEQ ID NO: 276323 - DNA, 20 bp, P. troglodytes
tgggaagggaaagacctgac

SEQ ID NO: 276324 - DNA, 16 bp, P. troglodytes
tgggaaggtctttatt

SEQ ID NO: 276325 - DNA, 16 bp, P. troglodytes
tgggaaggtgactgca

SEQ ID NO: 276326 - DNA, 16 bp, P. troglodytes
tgggaagttttcattt

SEQ ID NO: 276327 - DNA, 16 bp, P. troglodytes
tgggaataataatatt

SEQ ID NO: 276328 - DNA, 16 bp, P. troglodytes
tgggaataataatggt

SEQ ID NO: 276329 - DNA, 16 bp, P. troglodytes
tgggaatacaggggtg

SEQ ID NO: 276330 - DNA, 16 bp, P. troglodytes
tgggaatacaggtgtg

SEQ ID NO: 276331 - DNA, 16 bp, P. troglodytes
tgggaatgtaaattag

SEQ ID NO: 276332 - DNA, 16 bp, P. troglodytes
tgggaattcaaaatga

SEQ ID NO: 276333 - DNA, 16 bp, P. troglodytes
tgggaattctgagaga

SEQ ID NO: 276334 - DNA, 16 bp, P. troglodytes
tgggaattctgggaaa

SEQ ID NO: 276335 - DNA, 16 bp, P. troglodytes
tgggaatttgttagaa

SEQ ID NO: 276336 - DNA, 16 bp, P. troglodytes
tgggaattttttttaa

SEQ ID NO: 276337 - DNA, 16 bp, P. troglodytes
tgggacaatttgaaca

SEQ ID NO: 276338 - DNA, 17 bp, P. troglodytes
tgggacacagggcacca

SEQ ID NO: 276339 - DNA, 16 bp, P. troglodytes
tgggacagattctccc

SEQ ID NO: 276340 - DNA, 16 bp, P. troglodytes
tgggacatatttcaaa

SEQ ID NO: 276341 - DNA, 16 bp, P. troglodytes
tgggaccacaggtaca

SEQ ID NO: 276342 - DNA, 17 bp, P. troglodytes
tgggaccacaggtgtgc

SEQ ID NO: 276343 - DNA, 16 bp, P. troglodytes
tgggaccagggggcca

SEQ ID NO: 276344 - DNA, 16 bp, P. troglodytes
tgggacccaggaatct

SEQ ID NO: 276345 - DNA, 16 bp, P. troglodytes
tgggaccccaaactca

SEQ ID NO: 276346 - DNA, 16 bp, P. troglodytes
tgggacctgcagcctg

SEQ ID NO: 276347 - DNA, 16 bp, P. troglodytes
tgggactacaggcaca

SEQ ID NO: 276348 - DNA, 23 bp, P. troglodytes
tgggactacaggcgcccgctacc

SEQ ID NO: 276349 - DNA, 17 bp, P. troglodytes
tgggactacaggtgccc

SEQ ID NO: 276350 - DNA, 16 bp, P. troglodytes
tgggactacgggcaca

SEQ ID NO: 276351 - DNA, 16 bp, P. troglodytes
tgggactagaaaaaaa

SEQ ID NO: 276352 - DNA, 16 bp, P. troglodytes
tgggactatagacatg

SEQ ID NO: 276353 - DNA, 17 bp, P. troglodytes
tgggactataggcatgt

SEQ ID NO: 276354 - DNA, 17 bp, P. troglodytes
tgggactataggtgtgc

SEQ ID NO: 276355 - DNA, 16 bp, P. troglodytes
tgggactatgggcgcc

SEQ ID NO: 276356 - DNA, 16 bp, P. troglodytes
tgggactccaggcacc

SEQ ID NO: 276357 - DNA, 16 bp, P. troglodytes
tgggactgcaggtgca

SEQ ID NO: 276358 - DNA, 16 bp, P. troglodytes
tgggactggctggaca

SEQ ID NO: 276359 - DNA, 16 bp, P. troglodytes
tgggactggcttattt

SEQ ID NO: 276360 - DNA, 16 bp, P. troglodytes
tgggactgggcctgag

SEQ ID NO: 276361 - DNA, 16 bp, P. troglodytes
tgggactttgccttgt

SEQ ID NO: 276362 - DNA, 16 bp, P. troglodytes
tgggagaaaaaaattt

SEQ ID NO: 276363 - DNA, 16 bp, P. troglodytes
tgggagaaaatatttt

SEQ ID NO: 276364 - DNA, 16 bp, P. troglodytes
tgggagaaacctccca

SEQ ID NO: 276365 - DNA, 16 bp, P. troglodytes
tgggagaaactttttg

SEQ ID NO: 276366 - DNA, 16 bp, P. troglodytes
tgggagaagcacttga

SEQ ID NO: 276367 - DNA, 16 bp, P. troglodytes
tgggagaagctgaggc

SEQ ID NO: 276368 - DNA, 16 bp, P. troglodytes
tgggagacaagagcaa

SEQ ID NO: 276369 - DNA, 16 bp, P. troglodytes
tgggagacagaggaag

SEQ ID NO: 276370 - DNA, 16 bp, P. troglodytes
tgggagacagaggagg

SEQ ID NO: 276371 - DNA, 16 bp, P. troglodytes
tgggagacagaggtgg

SEQ ID NO: 276372 - DNA, 16 bp, P. troglodytes
tgggagacagtggcag

SEQ ID NO: 276373 - DNA, 16 bp, P. troglodytes
tgggagaccaagacag

SEQ ID NO: 276374 - DNA, 16 bp, P. troglodytes
tgggagaccaaggtgg

SEQ ID NO: 276375 - DNA, 16 bp, P. troglodytes
tgggagactccatctc

SEQ ID NO: 276376 - DNA, 16 bp, P. troglodytes
tgggagactgaggtgg

SEQ ID NO: 276377 - DNA, 27 bp, P. troglodytes
tgggagactttaacaccccactgtcaa

SEQ ID NO: 276378 - DNA, 16 bp, P. troglodytes
tgggagactttgctct

SEQ ID NO: 276379 - DNA, 16 bp, P. troglodytes
tgggagagaagctgag

SEQ ID NO: 276380 - DNA, 16 bp, P. troglodytes
tgggagagaatatttg

SEQ ID NO: 276381 - DNA, 16 bp, P. troglodytes
tgggagaggagggtct

SEQ ID NO: 276382 - DNA, 16 bp, P. troglodytes
tgggagaggccagcag

SEQ ID NO: 276383 - DNA, 16 bp, P. troglodytes
tgggagagtgaggcag

SEQ ID NO: 276384 - DNA, 16 bp, P. troglodytes
tgggagagttccctga

SEQ ID NO: 276385 - DNA, 16 bp, P. troglodytes
tgggagatgaggctgg

SEQ ID NO: 276386 - DNA, 16 bp, P. troglodytes
tgggagatgtctccca

SEQ ID NO: 276387 - DNA, 16 bp, P. troglodytes
tgggagcaagagagag

SEQ ID NO: 276388 - DNA, 16 bp, P. troglodytes
tgggagcagaggcagg

SEQ ID NO: 276389 - DNA, 16 bp, P. troglodytes
tgggagcagatccctc

SEQ ID NO: 276390 - DNA, 16 bp, P. troglodytes
tgggagcagcttcatg

SEQ ID NO: 276391 - DNA, 16 bp, P. troglodytes
tgggagcatcacttga

SEQ ID NO: 276392 - DNA, 16 bp, P. troglodytes
tgggagcatttacacc

SEQ ID NO: 276393 - DNA, 16 bp, P. troglodytes
tgggagccaaacattg

SEQ ID NO: 276394 - DNA, 16 bp, P. troglodytes
tgggagccatggaggg

SEQ ID NO: 276395 - DNA, 16 bp, P. troglodytes
tgggagcccagaggag

SEQ ID NO: 276396 - DNA, 29 bp, P. troglodytes
tgggagcccctttctgggctggccaaggc

SEQ ID NO: 276397 - DNA, 16 bp, P. troglodytes
tgggagccctgagttt

SEQ ID NO: 276398 - DNA, 16 bp, P. troglodytes
tgggagcctcccaagg

SEQ ID NO: 276399 - DNA, 17 bp, P. troglodytes
tgggagctacagttcaa

SEQ ID NO: 276400 - DNA, 16 bp, P. troglodytes
tgggagctaccattca

SEQ ID NO: 276401 - DNA, 16 bp, P. troglodytes
tgggagctccctgggt

SEQ ID NO: 276402 - DNA, 16 bp, P. troglodytes
tgggagctgggagagg

SEQ ID NO: 276403 - DNA, 17 bp, P. troglodytes
tgggagctgtagaccag

SEQ ID NO: 276404 - DNA, 16 bp, P. troglodytes
tgggagcttgaggcag

SEQ ID NO: 276405 - DNA, 16 bp, P. troglodytes
tgggagctttgttctt

SEQ ID NO: 276406 - DNA, 16 bp, P. troglodytes
tgggaggaaactggag

SEQ ID NO: 276407 - DNA, 16 bp, P. troglodytes
tgggaggaagaggcag

SEQ ID NO: 276408 - DNA, 16 bp, P. troglodytes
tgggaggacgaggcgg

SEQ ID NO: 276409 - DNA, 16 bp, P. troglodytes
tgggaggactcaggaa

SEQ ID NO: 276410 - DNA, 16 bp, P. troglodytes
tgggaggactgtttga

SEQ ID NO: 276411 - DNA, 16 bp, P. troglodytes
tgggaggagagcttga

SEQ ID NO: 276412 - DNA, 16 bp, P. troglodytes
tgggaggagagggcag

SEQ ID NO: 276413 - DNA, 16 bp, P. troglodytes
tgggaggagggcaagg

SEQ ID NO: 276414 - DNA, 16 bp, P. troglodytes
tgggaggataatttga

SEQ ID NO: 276415 - DNA, 16 bp, P. troglodytes
tgggaggcaaggggag

SEQ ID NO: 276416 - DNA, 16 bp, P. troglodytes
tgggaggcagaagctg

SEQ ID NO: 276417 - DNA, 16 bp, P. troglodytes
tgggaggcagagatgg

SEQ ID NO: 276418 - DNA, 16 bp, P. troglodytes
tgggaggcagagcctg

SEQ ID NO: 276419 - DNA, 16 bp, P. troglodytes
tgggaggcagagctgg

SEQ ID NO: 276420 - DNA, 16 bp, P. troglodytes
tgggaggcagaggtgc

SEQ ID NO: 276421 - DNA, 16 bp, P. troglodytes
tgggaggcagggctgg

SEQ ID NO: 276422 - DNA, 16 bp, P. troglodytes
tgggaggccaagaccg

SEQ ID NO: 276423 - DNA, 16 bp, P. troglodytes
tgggaggccaagatag

SEQ ID NO: 276424 - DNA, 16 bp, P. troglodytes
tgggaggccaaggaga

SEQ ID NO: 276425 - DNA, 16 bp, P. troglodytes
tgggaggccaaggcac

SEQ ID NO: 276426 - DNA, 16 bp, P. troglodytes
tgggaggccaaggtcg

SEQ ID NO: 276427 - DNA, 16 bp, P. troglodytes
tgggaggccagggagg

SEQ ID NO: 276428 - DNA, 16 bp, P. troglodytes
tgggaggccatggagg

SEQ ID NO: 276429 - DNA, 16 bp, P. troglodytes
tgggaggccatggtgg

SEQ ID NO: 276430 - DNA, 18 bp, P. troglodytes
tgggaggcccaggcaggt

SEQ ID NO: 276431 - DNA, 16 bp, P. troglodytes
tgggaggcccaggtga

SEQ ID NO: 276432 - DNA, 16 bp, P. troglodytes
tgggaggccgaggagg

SEQ ID NO: 276433 - DNA, 16 bp, P. troglodytes
tgggaggccgagggag

SEQ ID NO: 276434 - DNA, 16 bp, P. troglodytes
tgggaggccgcggcgg

SEQ ID NO: 276435 - DNA, 16 bp, P. troglodytes
tgggaggccgtggtgg

SEQ ID NO: 276436 - DNA, 16 bp, P. troglodytes
tgggaggcctcacaat

SEQ ID NO: 276437 - DNA, 16 bp, P. troglodytes
tgggaggcggaggccg

SEQ ID NO: 276438 - DNA, 16 bp, P. troglodytes
tgggaggcggaggctg

SEQ ID NO: 276439 - DNA, 16 bp, P. troglodytes
tgggaggctgagaagg

SEQ ID NO: 276440 - DNA, 16 bp, P. troglodytes
tgggaggctgagcaga

SEQ ID NO: 276441 - DNA, 16 bp, P. troglodytes
tgggaggctgagccgg

SEQ ID NO: 276442 - DNA, 16 bp, P. troglodytes
tgggaggctgaggtga

SEQ ID NO: 276443 - DNA, 16 bp, P. troglodytes
tgggaggctgagtcag

SEQ ID NO: 276444 - DNA, 16 bp, P. troglodytes
tgggaggctgcagctg

SEQ ID NO: 276445 - DNA, 16 bp, P. troglodytes
tgggaggctgtggagg

SEQ ID NO: 276446 - DNA, 16 bp, P. troglodytes
tgggaggctgtggctg

SEQ ID NO: 276447 - DNA, 16 bp, P. troglodytes
tgggaggctgtgggag

SEQ ID NO: 276448 - DNA, 16 bp, P. troglodytes
tgggaggctgtgggtg

SEQ ID NO: 276449 - DNA, 16 bp, P. troglodytes
tgggagggacccagga

SEQ ID NO: 276450 - DNA, 16 bp, P. troglodytes
tgggagggatccagtg

SEQ ID NO: 276451 - DNA, 16 bp, P. troglodytes
tgggagggcaaggagg

SEQ ID NO: 276452 - DNA, 16 bp, P. troglodytes
tgggagggccaggcag

SEQ ID NO: 276453 - DNA, 16 bp, P. troglodytes
tgggaggggacaaata

SEQ ID NO: 276454 - DNA, 16 bp, P. troglodytes
tgggagggtgagacag

SEQ ID NO: 276455 - DNA, 16 bp, P. troglodytes
tgggagggtggtgcac

SEQ ID NO: 276456 - DNA, 16 bp, P. troglodytes
tgggaggtaattgaat

SEQ ID NO: 276457 - DNA, 16 bp, P. troglodytes
tgggaggtcgagatgg

SEQ ID NO: 276458 - DNA, 16 bp, P. troglodytes
tgggaggtgattgaat

SEQ ID NO: 276459 - DNA, 16 bp, P. troglodytes
tgggaggtggagttgc

SEQ ID NO: 276460 - DNA, 16 bp, P. troglodytes
tgggaggtggcagagg

SEQ ID NO: 276461 - DNA, 16 bp, P. troglodytes
tgggaggtggggagca

SEQ ID NO: 276462 - DNA, 16 bp, P. troglodytes
tgggaggtgtcttcca

SEQ ID NO: 276463 - DNA, 16 bp, P. troglodytes
tgggaggttgaagcag

SEQ ID NO: 276464 - DNA, 16 bp, P. troglodytes
tgggagtacaggtgca

SEQ ID NO: 276465 - DNA, 16 bp, P. troglodytes
tgggagtctaagtctc

SEQ ID NO: 276466 - DNA, 16 bp, P. troglodytes
tgggagtgatgggaga

SEQ ID NO: 276467 - DNA, 16 bp, P. troglodytes
tgggagttattgttta

SEQ ID NO: 276468 - DNA, 16 bp, P. troglodytes
tgggagttcaagacca

SEQ ID NO: 276469 - DNA, 16 bp, P. troglodytes
tgggagttcagtcagg

SEQ ID NO: 276470 - DNA, 16 bp, P. troglodytes
tgggagttctcacttt

SEQ ID NO: 276471 - DNA, 16 bp, P. troglodytes
tgggagttttatctat

SEQ ID NO: 276472 - DNA, 16 bp, P. troglodytes
tgggataaaatttttg

SEQ ID NO: 276473 - DNA, 16 bp, P. troglodytes
tgggatacagtgaaag

SEQ ID NO: 276474 - DNA, 16 bp, P. troglodytes
tgggatacctgtgcag

SEQ ID NO: 276475 - DNA, 16 bp, P. troglodytes
tgggatattggcattg

SEQ ID NO: 276476 - DNA, 16 bp, P. troglodytes
tgggatcaaattaaac

SEQ ID NO: 276477 - DNA, 16 bp, P. troglodytes
tgggatcactggatca

SEQ ID NO: 276478 - DNA, 16 bp, P. troglodytes
tgggatcagaagtgtt

SEQ ID NO: 276479 - DNA, 16 bp, P. troglodytes
tgggatcatgtccttt

SEQ ID NO: 276480 - DNA, 16 bp, P. troglodytes
tgggatccccttggcc

SEQ ID NO: 276481 - DNA, 16 bp, P. troglodytes
tgggatctcattgtgg

SEQ ID NO: 276482 - DNA, 19 bp, P. troglodytes
tgggatgagaaagacctga

SEQ ID NO: 276483 - DNA, 17 bp, P. troglodytes
tgggatgattgtcagca

SEQ ID NO: 276484 - DNA, 16 bp, P. troglodytes
tgggatgcaaggatga

SEQ ID NO: 276485 - DNA, 16 bp, P. troglodytes
tgggatggcccttcag

SEQ ID NO: 276486 - DNA, 16 bp, P. troglodytes
tgggatgggagaaaat

SEQ ID NO: 276487 - DNA, 16 bp, P. troglodytes
tgggattacagaagtg

SEQ ID NO: 276488 - DNA, 16 bp, P. troglodytes
tgggattacagctgtg

SEQ ID NO: 276489 - DNA, 16 bp, P. troglodytes
tgggattacaggcacg

SEQ ID NO: 276490 - DNA, 23 bp, P. troglodytes
tgggattacaggcataagccacc

SEQ ID NO: 276491 - DNA, 17 bp, P. troglodytes
tgggattacaggcatac

SEQ ID NO: 276492 - DNA, 16 bp, P. troglodytes
tgggattacaggcatc

SEQ ID NO: 276493 - DNA, 18 bp, P. troglodytes
tgggattacaggcgccca

SEQ ID NO: 276494 - DNA, 17 bp, P. troglodytes
tgggattacaggcgcgc

SEQ ID NO: 276495 - DNA, 16 bp, P. troglodytes
tgggattacaggtgta

SEQ ID NO: 276496 - DNA, 16 bp, P. troglodytes
tgggattaccaggcat

SEQ ID NO: 276497 - DNA, 16 bp, P. troglodytes
tgggattactggcgtg

SEQ ID NO: 276498 - DNA, 16 bp, P. troglodytes
tgggattagaggcatg

SEQ ID NO: 276499 - DNA, 16 bp, P. troglodytes
tgggattagtaccctt

SEQ ID NO: 276500 - DNA, 16 bp, P. troglodytes
tgggattagtgccctt

SEQ ID NO: 276501 - DNA, 16 bp, P. troglodytes
tgggattatgagtgtg

SEQ ID NO: 276502 - DNA, 16 bp, P. troglodytes
tgggattcagcaaaag

SEQ ID NO: 276503 - DNA, 16 bp, P. troglodytes
tgggattcagtctgtg

SEQ ID NO: 276504 - DNA, 16 bp, P. troglodytes
tgggattccaggtgtg

SEQ ID NO: 276505 - DNA, 16 bp, P. troglodytes
tgggattgctgagtca

SEQ ID NO: 276506 - DNA, 16 bp, P. troglodytes
tgggattgtgccactg

SEQ ID NO: 276507 - DNA, 16 bp, P. troglodytes
tgggatttcaccatat

SEQ ID NO: 276508 - DNA, 16 bp, P. troglodytes
tgggatttgaacccca

SEQ ID NO: 276509 - DNA, 17 bp, P. troglodytes
tgggcaaaaagtagttg

SEQ ID NO: 276510 - DNA, 16 bp, P. troglodytes
tgggcaaagatttcct

SEQ ID NO: 276511 - DNA, 16 bp, P. troglodytes
tgggcaaaggaaatga

SEQ ID NO: 276512 - DNA, 16 bp, P. troglodytes
tgggcaaaggacagga

SEQ ID NO: 276513 - DNA, 16 bp, P. troglodytes
tgggcaaaggagatga

SEQ ID NO: 276514 - DNA, 16 bp, P. troglodytes
tgggcaaatgacctga

SEQ ID NO: 276515 - DNA, 16 bp, P. troglodytes
tgggcaacaaaatgaa

SEQ ID NO: 276516 - DNA, 16 bp, P. troglodytes
tgggcaacaaagctag

SEQ ID NO: 276517 - DNA, 16 bp, P. troglodytes
tgggcaacaacagagt

SEQ ID NO: 276518 - DNA, 16 bp, P. troglodytes
tgggcaacaagaacaa

SEQ ID NO: 276519 - DNA, 16 bp, P. troglodytes
tgggcaacaagaccga

SEQ ID NO: 276520 - DNA, 16 bp, P. troglodytes
tgggcaacaagagcga

SEQ ID NO: 276521 - DNA, 18 bp, P. troglodytes
tgggcaacaagagtgaaa

SEQ ID NO: 276522 - DNA, 16 bp, P. troglodytes
tgggcaacaagattga

SEQ ID NO: 276523 - DNA, 16 bp, P. troglodytes
tgggcaacaagtgcga

SEQ ID NO: 276524 - DNA, 16 bp, P. troglodytes
tgggcaacaatagcga

SEQ ID NO: 276525 - DNA, 17 bp, P. troglodytes
tgggcaacagagtgaga

SEQ ID NO: 276526 - DNA, 16 bp, P. troglodytes
tgggcaacagcgcgag

SEQ ID NO: 276527 - DNA, 16 bp, P. troglodytes
tgggcaacataaccag

SEQ ID NO: 276528 - DNA, 17 bp, P. troglodytes
tgggcaacatggcaaaa

SEQ ID NO: 276529 - DNA, 22 bp, P. troglodytes
tgggcaacatggcgaaaccctg

SEQ ID NO: 276530 - DNA, 16 bp, P. troglodytes
tgggcaacattgcaag

SEQ ID NO: 276531 - DNA, 16 bp, P. troglodytes
tgggcaactggagtga

SEQ ID NO: 276532 - DNA, 16 bp, P. troglodytes
tgggcaagagtgagat

SEQ ID NO: 276533 - DNA, 20 bp, P. troglodytes
tgggcaaggacttcatgtcc

SEQ ID NO: 276534 - DNA, 17 bp, P. troglodytes
tgggcaaggacttcgtg

SEQ ID NO: 276535 - DNA, 16 bp, P. troglodytes
tgggcaaggtgactca

SEQ ID NO: 276536 - DNA, 16 bp, P. troglodytes
tgggcaagttacttaa

SEQ ID NO: 276537 - DNA, 16 bp, P. troglodytes
tgggcaagttatttaa

SEQ ID NO: 276538 - DNA, 16 bp, P. troglodytes
tgggcaagttgcttaa

SEQ ID NO: 276539 - DNA, 16 bp, P. troglodytes
tgggcaataagagtga

SEQ ID NO: 276540 - DNA, 16 bp, P. troglodytes
tgggcaatcagcagcc

SEQ ID NO: 276541 - DNA, 16 bp, P. troglodytes
tgggcaatgtctggag

SEQ ID NO: 276542 - DNA, 16 bp, P. troglodytes
tgggcaatttagaaaa

SEQ ID NO: 276543 - DNA, 16 bp, P. troglodytes
tgggcaatttgcaaaa

SEQ ID NO: 276544 - DNA, 16 bp, P. troglodytes
tgggcacagcagctca

SEQ ID NO: 276545 - DNA, 16 bp, P. troglodytes
tgggcacagggagagg

SEQ ID NO: 276546 - DNA, 16 bp, P. troglodytes
tgggcacagtggcaca

SEQ ID NO: 276547 - DNA, 16 bp, P. troglodytes
tgggcacagtggcttg

SEQ ID NO: 276548 - DNA, 16 bp, P. troglodytes
tgggcaccatgaacag

SEQ ID NO: 276549 - DNA, 16 bp, P. troglodytes
tgggcaccatggccca

SEQ ID NO: 276550 - DNA, 16 bp, P. troglodytes
tgggcactgcagggtg

SEQ ID NO: 276551 - DNA, 16 bp, P. troglodytes
tgggcactgtggccca

SEQ ID NO: 276552 - DNA, 16 bp, P. troglodytes
tgggcagaagagggtg

SEQ ID NO: 276553 - DNA, 16 bp, P. troglodytes
tgggcagagactgtgg

SEQ ID NO: 276554 - DNA, 16 bp, P. troglodytes
tgggcagaggaagagg

SEQ ID NO: 276555 - DNA, 16 bp, P. troglodytes
tgggcagatacccagt

SEQ ID NO: 276556 - DNA, 16 bp, P. troglodytes
tgggcagatcaactga

SEQ ID NO: 276557 - DNA, 16 bp, P. troglodytes
tgggcagatcaccctg

SEQ ID NO: 276558 - DNA, 22 bp, P. troglodytes
tgggcagatcacttgaggccaa

SEQ ID NO: 276559 - DNA, 16 bp, P. troglodytes
tgggcagatcatttga

SEQ ID NO: 276560 - DNA, 16 bp, P. troglodytes
tgggcagcaagagcga

SEQ ID NO: 276561 - DNA, 16 bp, P. troglodytes
tgggcagcacagtgaa

SEQ ID NO: 276562 - DNA, 16 bp, P. troglodytes
tgggcagccagcagcc

SEQ ID NO: 276563 - DNA, 16 bp, P. troglodytes
tgggcagctccacccc

SEQ ID NO: 276564 - DNA, 16 bp, P. troglodytes
tgggcagctctgcccc

SEQ ID NO: 276565 - DNA, 16 bp, P. troglodytes
tgggcagctgcagctg

SEQ ID NO: 276566 - DNA, 16 bp, P. troglodytes
tgggcagctgcatctg

SEQ ID NO: 276567 - DNA, 16 bp, P. troglodytes
tgggcaggacctgtga

SEQ ID NO: 276568 - DNA, 16 bp, P. troglodytes
tgggcaggcaggcagg

SEQ ID NO: 276569 - DNA, 16 bp, P. troglodytes
tgggcaggctgtgggg

SEQ ID NO: 276570 - DNA, 16 bp, P. troglodytes
tgggcagggccctaga

SEQ ID NO: 276571 - DNA, 16 bp, P. troglodytes
tgggcagggtggtgtg

SEQ ID NO: 276572 - DNA, 16 bp, P. troglodytes
tgggcatcacagcaag

SEQ ID NO: 276573 - DNA, 16 bp, P. troglodytes
tgggcatcatggccat

SEQ ID NO: 276574 - DNA, 16 bp, P. troglodytes
tgggcatgggcttggt

SEQ ID NO: 276575 - DNA, 16 bp, P. troglodytes
tgggcatggtcgctca

SEQ ID NO: 276576 - DNA, 16 bp, P. troglodytes
tgggcatggtgatggg

SEQ ID NO: 276577 - DNA, 16 bp, P. troglodytes
tgggcatggtggctca

SEQ ID NO: 276578 - DNA, 16 bp, P. troglodytes
tgggcatggtggctgg

SEQ ID NO: 276579 - DNA, 16 bp, P. troglodytes
tgggcatggtggtgca

SEQ ID NO: 276580 - DNA, 18 bp, P. troglodytes
tgggcatggtggtgcacg

SEQ ID NO: 276581 - DNA, 16 bp, P. troglodytes
tgggcatggtggtgcc

SEQ ID NO: 276582 - DNA, 16 bp, P. troglodytes
tgggcatggtggtgct

SEQ ID NO: 276583 - DNA, 16 bp, P. troglodytes
tgggcatggtggtgta

SEQ ID NO: 276584 - DNA, 16 bp, P. troglodytes
tgggcatgttggcatg

SEQ ID NO: 276585 - DNA, 16 bp, P. troglodytes
tgggcatttgggtggg

SEQ ID NO: 276586 - DNA, 17 bp, P. troglodytes
tgggcatttgggttggt

SEQ ID NO: 276587 - DNA, 16 bp, P. troglodytes
tgggcatttgggtttg

SEQ ID NO: 276588 - DNA, 16 bp, P. troglodytes
tgggcatttggtgcta

SEQ ID NO: 276589 - DNA, 16 bp, P. troglodytes
tgggccaaatccagcc

SEQ ID NO: 276590 - DNA, 16 bp, P. troglodytes
tgggccaaatctggcc

SEQ ID NO: 276591 - DNA, 16 bp, P. troglodytes
tgggccaaatttggcc

SEQ ID NO: 276592 - DNA, 16 bp, P. troglodytes
tgggccaagcccaggg

SEQ ID NO: 276593 - DNA, 16 bp, P. troglodytes
tgggccacaatggaag

SEQ ID NO: 276594 - DNA, 16 bp, P. troglodytes
tgggccacactggaag

SEQ ID NO: 276595 - DNA, 16 bp, P. troglodytes
tgggccacatgcggcc

SEQ ID NO: 276596 - DNA, 16 bp, P. troglodytes
tgggccactgcacctg

SEQ ID NO: 276597 - DNA, 16 bp, P. troglodytes
tgggccagcactgctg

SEQ ID NO: 276598 - DNA, 16 bp, P. troglodytes
tgggccagcagcagca

SEQ ID NO: 276599 - DNA, 16 bp, P. troglodytes
tgggccaggcacagtg

SEQ ID NO: 276600 - DNA, 16 bp, P. troglodytes
tgggccaggcagggtg

SEQ ID NO: 276601 - DNA, 16 bp, P. troglodytes
tgggccaggcatgatg

SEQ ID NO: 276602 - DNA, 16 bp, P. troglodytes
tgggccaggcccaggg

SEQ ID NO: 276603 - DNA, 16 bp, P. troglodytes
tgggccaggctagtct

SEQ ID NO: 276604 - DNA, 16 bp, P. troglodytes
tgggccaggctctgtg

SEQ ID NO: 276605 - DNA, 16 bp, P. troglodytes
tgggccaggctggtct

SEQ ID NO: 276606 - DNA, 16 bp, P. troglodytes
tgggccaggtccaggg

SEQ ID NO: 276607 - DNA, 16 bp, P. troglodytes
tgggccaggtgcagtg

SEQ ID NO: 276608 - DNA, 16 bp, P. troglodytes
tgggccagtgcctgac

SEQ ID NO: 276609 - DNA, 16 bp, P. troglodytes
tgggccatggtgccca

SEQ ID NO: 276610 - DNA, 16 bp, P. troglodytes
tgggcccaatctaatc

SEQ ID NO: 276611 - DNA, 16 bp, P. troglodytes
tgggcccaggaggtgg

SEQ ID NO: 276612 - DNA, 16 bp, P. troglodytes
tgggcccagggtcccc

SEQ ID NO: 276613 - DNA, 16 bp, P. troglodytes
tgggccccaccccaga

SEQ ID NO: 276614 - DNA, 16 bp, P. troglodytes
tgggccccatcccaga

SEQ ID NO: 276615 - DNA, 16 bp, P. troglodytes
tgggccctgggccctg

SEQ ID NO: 276616 - DNA, 16 bp, P. troglodytes
tgggccctggtgggag

SEQ ID NO: 276617 - DNA, 16 bp, P. troglodytes
tgggccgggcctggtg

SEQ ID NO: 276618 - DNA, 16 bp, P. troglodytes
tgggcctcaatttccc

SEQ ID NO: 276619 - DNA, 16 bp, P. troglodytes
tgggcctcaccccaga

SEQ ID NO: 276620 - DNA, 16 bp, P. troglodytes
tgggcctcagcttcct

SEQ ID NO: 276621 - DNA, 16 bp, P. troglodytes
tgggcctcagtgtccc

SEQ ID NO: 276622 - DNA, 16 bp, P. troglodytes
tgggcctcagtttcct

SEQ ID NO: 276623 - DNA, 16 bp, P. troglodytes
tgggcctcagtttctc

SEQ ID NO: 276624 - DNA, 16 bp, P. troglodytes
tgggcctccctttgtg

SEQ ID NO: 276625 - DNA, 16 bp, P. troglodytes
tgggcctgcctttccc

SEQ ID NO: 276626 - DNA, 16 bp, P. troglodytes
tgggcctgggaggtgg

SEQ ID NO: 276627 - DNA, 16 bp, P. troglodytes
tgggcctggtgcagtg

SEQ ID NO: 276628 - DNA, 16 bp, P. troglodytes
tgggcctggtggtaca

SEQ ID NO: 276629 - DNA, 16 bp, P. troglodytes
tgggcctgtggtccca

SEQ ID NO: 276630 - DNA, 16 bp, P. troglodytes
tgggcctgtggtggga

SEQ ID NO: 276631 - DNA, 16 bp, P. troglodytes
tgggccttgaaggatg

SEQ ID NO: 276632 - DNA, 16 bp, P. troglodytes
tgggccttttatggag

SEQ ID NO: 276633 - DNA, 16 bp, P. troglodytes
tgggcgacaaaagtga

SEQ ID NO: 276634 - DNA, 16 bp, P. troglodytes
tgggcgacatggcaaa

SEQ ID NO: 276635 - DNA, 16 bp, P. troglodytes
tgggcgccatggctca

SEQ ID NO: 276636 - DNA, 16 bp, P. troglodytes
tgggcgcggtagctca

SEQ ID NO: 276637 - DNA, 16 bp, P. troglodytes
tgggcggagtggctca

SEQ ID NO: 276638 - DNA, 18 bp, P. troglodytes
tgggcggatcacgaggtc

SEQ ID NO: 276639 - DNA, 16 bp, P. troglodytes
tgggcgtaggaccctc

SEQ ID NO: 276640 - DNA, 16 bp, P. troglodytes
tgggcgtggcggcaca

SEQ ID NO: 276641 - DNA, 17 bp, P. troglodytes
tgggcgtggtggcaggt

SEQ ID NO: 276642 - DNA, 17 bp, P. troglodytes
tgggctacagagtgaga

SEQ ID NO: 276643 - DNA, 16 bp, P. troglodytes
tgggctaggcccaggg

SEQ ID NO: 276644 - DNA, 16 bp, P. troglodytes
tgggctcaaactcctg

SEQ ID NO: 276645 - DNA, 16 bp, P. troglodytes
tgggctcaagcaatct

SEQ ID NO: 276646 - DNA, 19 bp, P. troglodytes
tgggctcaagcgattctcc

SEQ ID NO: 276647 - DNA, 16 bp, P. troglodytes
tgggctcaagctttcc

SEQ ID NO: 276648 - DNA, 16 bp, P. troglodytes
tgggctcagaaatgtc

SEQ ID NO: 276649 - DNA, 16 bp, P. troglodytes
tgggctcagaggcctg

SEQ ID NO: 276650 - DNA, 16 bp, P. troglodytes
tgggctcagatgatct

SEQ ID NO: 276651 - DNA, 16 bp, P. troglodytes
tgggctcaggaagttt

SEQ ID NO: 276652 - DNA, 16 bp, P. troglodytes
tgggctccaacaatcc

SEQ ID NO: 276653 - DNA, 16 bp, P. troglodytes
tgggctccacccaatt

SEQ ID NO: 276654 - DNA, 16 bp, P. troglodytes
tgggctccagcaattc

SEQ ID NO: 276655 - DNA, 16 bp, P. troglodytes
tgggctcctgagtcag

SEQ ID NO: 276656 - DNA, 16 bp, P. troglodytes
tgggctcctgtgcggc

SEQ ID NO: 276657 - DNA, 16 bp, P. troglodytes
tgggctctctgtttgt

SEQ ID NO: 276658 - DNA, 16 bp, P. troglodytes
tgggctctggggccag

SEQ ID NO: 276659 - DNA, 16 bp, P. troglodytes
tgggctgagatggctg

SEQ ID NO: 276660 - DNA, 16 bp, P. troglodytes
tgggctgaggacatga

SEQ ID NO: 276661 - DNA, 16 bp, P. troglodytes
tgggctgcacaggagc

SEQ ID NO: 276662 - DNA, 16 bp, P. troglodytes
tgggctgcactcactg

SEQ ID NO: 276663 - DNA, 16 bp, P. troglodytes
tgggctgcaggtcctg

SEQ ID NO: 276664 - DNA, 16 bp, P. troglodytes
tgggctgcaggtggag

SEQ ID NO: 276665 - DNA, 16 bp, P. troglodytes
tgggctgcatgcagcc

SEQ ID NO: 276666 - DNA, 16 bp, P. troglodytes
tgggctgccaggggtg

SEQ ID NO: 276667 - DNA, 16 bp, P. troglodytes
tgggctgctggccaga

SEQ ID NO: 276668 - DNA, 16 bp, P. troglodytes
tgggctggaacctgac

SEQ ID NO: 276669 - DNA, 16 bp, P. troglodytes
tgggctggagttcagt

SEQ ID NO: 276670 - DNA, 19 bp, P. troglodytes
tgggctggcactgctgggg

SEQ ID NO: 276671 - DNA, 16 bp, P. troglodytes
tgggctggctgaggcc

SEQ ID NO: 276672 - DNA, 16 bp, P. troglodytes
tgggctgggcacagtg

SEQ ID NO: 276673 - DNA, 16 bp, P. troglodytes
tgggctgggcccaggg

SEQ ID NO: 276674 - DNA, 16 bp, P. troglodytes
tgggctgggtccaggg

SEQ ID NO: 276675 - DNA, 16 bp, P. troglodytes
tgggctgttgtgagga

SEQ ID NO: 276676 - DNA, 16 bp, P. troglodytes
tgggcttcatccctgt

SEQ ID NO: 276677 - DNA, 16 bp, P. troglodytes
tgggcttccagcctcc

SEQ ID NO: 276678 - DNA, 16 bp, P. troglodytes
tgggcttcccagaaga

SEQ ID NO: 276679 - DNA, 16 bp, P. troglodytes
tgggcttccccaaagc

SEQ ID NO: 276680 - DNA, 16 bp, P. troglodytes
tgggcttggcgggccc

SEQ ID NO: 276681 - DNA, 16 bp, P. troglodytes
tgggctttggagtcag

SEQ ID NO: 276682 - DNA, 16 bp, P. troglodytes
tggggaaaaaaaaatc

SEQ ID NO: 276683 - DNA, 16 bp, P. troglodytes
tggggaaaaaaatgtc

SEQ ID NO: 276684 - DNA, 16 bp, P. troglodytes
tggggaaaaacaaaaa

SEQ ID NO: 276685 - DNA, 16 bp, P. troglodytes
tggggaaaaacagagc

SEQ ID NO: 276686 - DNA, 16 bp, P. troglodytes
tggggaaaaataaaat

SEQ ID NO: 276687 - DNA, 16 bp, P. troglodytes
tggggaaaagacttcc

SEQ ID NO: 276688 - DNA, 16 bp, P. troglodytes
tggggaaaattatttt

SEQ ID NO: 276689 - DNA, 16 bp, P. troglodytes
tggggaaaccaaggca

SEQ ID NO: 276690 - DNA, 16 bp, P. troglodytes
tggggaaaccaaggcc

SEQ ID NO: 276691 - DNA, 16 bp, P. troglodytes
tggggaaaccgaggca

SEQ ID NO: 276692 - DNA, 16 bp, P. troglodytes
tggggaaaccgaggcc

SEQ ID NO: 276693 - DNA, 16 bp, P. troglodytes
tggggaaactgaggca

SEQ ID NO: 276694 - DNA, 16 bp, P. troglodytes
tggggaaactgaggcc

SEQ ID NO: 276695 - DNA, 16 bp, P. troglodytes
tggggaaactgaggct

SEQ ID NO: 276696 - DNA, 16 bp, P. troglodytes
tggggaaaggaatccc

SEQ ID NO: 276697 - DNA, 16 bp, P. troglodytes
tggggaaaggacagtt

SEQ ID NO: 276698 - DNA, 16 bp, P. troglodytes
tggggaaaggatctcc

SEQ ID NO: 276699 - DNA, 16 bp, P. troglodytes
tggggaaatgttgaaa

SEQ ID NO: 276700 - DNA, 16 bp, P. troglodytes
tggggaaatttttttt

SEQ ID NO: 276701 - DNA, 16 bp, P. troglodytes
tggggaacaagagtga

SEQ ID NO: 276702 - DNA, 16 bp, P. troglodytes
tggggaacaaggcctc

SEQ ID NO: 276703 - DNA, 16 bp, P. troglodytes
tggggaacagagagag

SEQ ID NO: 276704 - DNA, 16 bp, P. troglodytes
tggggaagaaaaacaa

SEQ ID NO: 276705 - DNA, 16 bp, P. troglodytes
tggggaagaaacaaag

SEQ ID NO: 276706 - DNA, 16 bp, P. troglodytes
tggggaagaatctgct

SEQ ID NO: 276707 - DNA, 16 bp, P. troglodytes
tggggaagctgaagca

SEQ ID NO: 276708 - DNA, 16 bp, P. troglodytes
tggggaaggaggcagg

SEQ ID NO: 276709 - DNA, 16 bp, P. troglodytes
tggggaagggcaggaa

SEQ ID NO: 276710 - DNA, 16 bp, P. troglodytes
tggggaagtcaaaagt

SEQ ID NO: 276711 - DNA, 16 bp, P. troglodytes
tggggaagtgagacag

SEQ ID NO: 276712 - DNA, 30 bp, P. troglodytes; identical to SEQ ID NO: 152219

SEQ ID NO: 276713 - DNA, 27 bp, P. troglodytes
tggggaagttctcctggataatatcct

SEQ ID NO: 276714 - DNA, 16 bp, P. troglodytes
tggggaagttgtcctg

SEQ ID NO: 276715 - DNA, 16 bp, P. troglodytes
tggggaatttctcctg

SEQ ID NO: 276716 - DNA, 16 bp, P. troglodytes
tggggacacacatcca

SEQ ID NO: 276717 - DNA, 16 bp, P. troglodytes
tggggacacagagcca

SEQ ID NO: 276718 - DNA, 16 bp, P. troglodytes
tggggacacagaggca

SEQ ID NO: 276719 - DNA, 16 bp, P. troglodytes
tggggacacagcagtg

SEQ ID NO: 276720 - DNA, 16 bp, P. troglodytes
tggggacacagccaag

SEQ ID NO: 276721 - DNA, 16 bp, P. troglodytes
tggggacagatcaaga

SEQ ID NO: 276722 - DNA, 16 bp, P. troglodytes
tggggacatggagaac

SEQ ID NO: 276723 - DNA, 16 bp, P. troglodytes
tggggacatgtgggag

SEQ ID NO: 276724 - DNA, 16 bp, P. troglodytes
tggggaccacaggcat

SEQ ID NO: 276725 - DNA, 16 bp, P. troglodytes
tggggaccatctgtat

SEQ ID NO: 276726 - DNA, 16 bp, P. troglodytes
tggggacccctgctct

SEQ ID NO: 276727 - DNA, 16 bp, P. troglodytes
tggggacccctgcttt

SEQ ID NO: 276728 - DNA, 16 bp, P. troglodytes
tggggaccctgggcct

SEQ ID NO: 276729 - DNA, 16 bp, P. troglodytes
tggggacctggagaac

SEQ ID NO: 276730 - DNA, 20 bp, P. troglodytes
tggggacgtggagaaccttt

SEQ ID NO: 276731 - DNA, 16 bp, P. troglodytes
tggggactcagaggga

SEQ ID NO: 276732 - DNA, 16 bp, P. troglodytes
tggggactctgtgtgg

SEQ ID NO: 276733 - DNA, 16 bp, P. troglodytes
tggggactgctgctct

SEQ ID NO: 276734 - DNA, 16 bp, P. troglodytes
tggggactgttgtgag

SEQ ID NO: 276735 - DNA, 16 bp, P. troglodytes
tggggactgttgttgg

SEQ ID NO: 276736 - DNA, 16 bp, P. troglodytes
tggggagaatggaacc

SEQ ID NO: 276737 - DNA, 16 bp, P. troglodytes
tggggagacagaggtt

SEQ ID NO: 276738 - DNA, 16 bp, P. troglodytes
tggggagaggcagagg

SEQ ID NO: 276739 - DNA, 16 bp, P. troglodytes
tggggagatgatcctg

SEQ ID NO: 276740 - DNA, 16 bp, P. troglodytes
tggggagcaggaggcc

SEQ ID NO: 276741 - DNA, 16 bp, P. troglodytes
tggggagccacagaag

SEQ ID NO: 276742 - DNA, 16 bp, P. troglodytes
tggggagcctcagaaa

SEQ ID NO: 276743 - DNA, 16 bp, P. troglodytes
tggggaggcagaggtg

SEQ ID NO: 276744 - DNA, 16 bp, P. troglodytes
tggggaggccccagga

SEQ ID NO: 276745 - DNA, 16 bp, P. troglodytes
tggggaggctgagaca

SEQ ID NO: 276746 - DNA, 16 bp, P. troglodytes
tggggaggctgcagtg

SEQ ID NO: 276747 - DNA, 16 bp, P. troglodytes
tggggaggggaacatc

SEQ ID NO: 276748 - DNA, 16 bp, P. troglodytes
tggggagggggcttcc

SEQ ID NO: 276749 - DNA, 16 bp, P. troglodytes
tggggagggtgaggca

SEQ ID NO: 276750 - DNA, 16 bp, P. troglodytes
tggggagttttaaaaa

SEQ ID NO: 276751 - DNA, 16 bp, P. troglodytes
tggggatacagagcca

SEQ ID NO: 276752 - DNA, 16 bp, P. troglodytes
tggggatattcagttt

SEQ ID NO: 276753 - DNA, 16 bp, P. troglodytes
tggggatccaatttca

SEQ ID NO: 276754 - DNA, 16 bp, P. troglodytes
tggggatgcagcagtg

SEQ ID NO: 276755 - DNA, 16 bp, P. troglodytes
tggggatgcctcagaa

SEQ ID NO: 276756 - DNA, 16 bp, P. troglodytes
tggggatggggcccag

SEQ ID NO: 276757 - DNA, 16 bp, P. troglodytes
tggggatgtggagaaa

SEQ ID NO: 276758 - DNA, 16 bp, P. troglodytes
tggggatgtggagaac

SEQ ID NO: 276759 - DNA, 16 bp, P. troglodytes
tggggattaagtttca

SEQ ID NO: 276760 - DNA, 16 bp, P. troglodytes
tggggattacagtttg

SEQ ID NO: 276761 - DNA, 17 bp, P. troglodytes
tggggattacatttcaa

SEQ ID NO: 276762 - DNA, 16 bp, P. troglodytes
tggggattaccattca

SEQ ID NO: 276763 - DNA, 16 bp, P. troglodytes
tggggattagaatgtg

SEQ ID NO: 276764 - DNA, 16 bp, P. troglodytes
tggggattagatttca

SEQ ID NO: 276765 - DNA, 16 bp, P. troglodytes
tggggattcctcaggg

SEQ ID NO: 276766 - DNA, 16 bp, P. troglodytes
tggggcaaagtggctg

SEQ ID NO: 276767 - DNA, 16 bp, P. troglodytes
tggggcaacacagtga

SEQ ID NO: 276768 - DNA, 16 bp, P. troglodytes
tggggcaatcttggct

SEQ ID NO: 276769 - DNA, 16 bp, P. troglodytes
tggggcaggaggactg

SEQ ID NO: 276770 - DNA, 16 bp, P. troglodytes
tggggcaggaggagag

SEQ ID NO: 276771 - DNA, 16 bp, P. troglodytes
tggggcagggcacaga

SEQ ID NO: 276772 - DNA, 16 bp, P. troglodytes
tggggcagggcagggc

SEQ ID NO: 276773 - DNA, 16 bp, P. troglodytes
tggggcagggcctgag

SEQ ID NO: 276774 - DNA, 16 bp, P. troglodytes
tggggcagggcttggg

SEQ ID NO: 276775 - DNA, 16 bp, P. troglodytes
tggggcaggggaatca

SEQ ID NO: 276776 - DNA, 16 bp, P. troglodytes
tggggcaggggccagg

SEQ ID NO: 276777 - DNA, 16 bp, P. troglodytes
tggggcagtggtggcc

SEQ ID NO: 276778 - DNA, 16 bp, P. troglodytes
tggggcagttggagga

SEQ ID NO: 276779 - DNA, 16 bp, P. troglodytes
tggggccagagcccag

SEQ ID NO: 276780 - DNA, 16 bp, P. troglodytes
tggggccaggagtttg

SEQ ID NO: 276781 - DNA, 16 bp, P. troglodytes
tggggccaggtgggag

SEQ ID NO: 276782 - DNA, 16 bp, P. troglodytes
tggggccggcagggcc

SEQ ID NO: 276783 - DNA, 16 bp, P. troglodytes
tggggcctatctctct

SEQ ID NO: 276784 - DNA, 16 bp, P. troglodytes
tggggcctcagtttcc

SEQ ID NO: 276785 - DNA, 16 bp, P. troglodytes
tggggcctccagccac

SEQ ID NO: 276786 - DNA, 16 bp, P. troglodytes
tggggcctccccagcc

SEQ ID NO: 276787 - DNA, 16 bp, P. troglodytes
tggggcctcctcagcc

SEQ ID NO: 276788 - DNA, 16 bp, P. troglodytes
tggggcctccttcctg

SEQ ID NO: 276789 - DNA, 16 bp, P. troglodytes
tggggcctctgttctg

SEQ ID NO: 276790 - DNA, 16 bp, P. troglodytes
tggggcctgatgggaa

SEQ ID NO: 276791 - DNA, 16 bp, P. troglodytes
tggggcctggcgggag

SEQ ID NO: 276792 - DNA, 16 bp, P. troglodytes
tggggcctgtcagagg

SEQ ID NO: 276793 - DNA, 16 bp, P. troglodytes
tggggcctgtcgggga

SEQ ID NO: 276794 - DNA, 16 bp, P. troglodytes
tggggcctgtgggagg

SEQ ID NO: 276795 - DNA, 16 bp, P. troglodytes
tggggcctttgccagg

SEQ ID NO: 276796 - DNA, 16 bp, P. troglodytes
tggggcctttgggaag

SEQ ID NO: 276797 - DNA, 16 bp, P. troglodytes
tggggcgtggtggctc

SEQ ID NO: 276798 - DNA, 16 bp, P. troglodytes
tggggctccctgagga

SEQ ID NO: 276799 - DNA, 16 bp, P. troglodytes
tggggctcctggacct

SEQ ID NO: 276800 - DNA, 16 bp, P. troglodytes
tggggctctctctttg

SEQ ID NO: 276801 - DNA, 16 bp, P. troglodytes
tggggctgcaggtgga

SEQ ID NO: 276802 - DNA, 16 bp, P. troglodytes
tggggctggagccagg

SEQ ID NO: 276803 - DNA, 16 bp, P. troglodytes
tggggctggaggatcc

SEQ ID NO: 276804 - DNA, 16 bp, P. troglodytes
tggggctggaggccat

SEQ ID NO: 276805 - DNA, 16 bp, P. troglodytes
tggggctgggagcagt

SEQ ID NO: 276806 - DNA, 16 bp, P. troglodytes
tggggctgggctggag

SEQ ID NO: 276807 - DNA, 16 bp, P. troglodytes
tggggctggggcagga

SEQ ID NO: 276808 - DNA, 16 bp, P. troglodytes
tggggctggggccagg

SEQ ID NO: 276809 - DNA, 16 bp, P. troglodytes
tggggcttagcccagg

SEQ ID NO: 276810 - DNA, 16 bp, P. troglodytes
tggggcttcaggagct

SEQ ID NO: 276811 - DNA, 16 bp, P. troglodytes
tggggcttttgggagg

SEQ ID NO: 276812 - DNA, 16 bp, P. troglodytes
tgggggaaaaaaaatc

SEQ ID NO: 276813 - DNA, 16 bp, P. troglodytes
tgggggaaaaaaacaa

SEQ ID NO: 276814 - DNA, 16 bp, P. troglodytes
tgggggaaaccacccc

SEQ ID NO: 276815 - DNA, 16 bp, P. troglodytes
tgggggaaaccagccc

SEQ ID NO: 276816 - DNA, 16 bp, P. troglodytes
tgggggaaactgaggc

SEQ ID NO: 276817 - DNA, 16 bp, P. troglodytes
tgggggaaatttgcat

SEQ ID NO: 276818 - DNA, 16 bp, P. troglodytes
tgggggaagccagtga

SEQ ID NO: 276819 - DNA, 16 bp, P. troglodytes
tgggggacagagccag

SEQ ID NO: 276820 - DNA, 16 bp, P. troglodytes
tgggggacccagtgca

SEQ ID NO: 276821 - DNA, 16 bp, P. troglodytes
tgggggacccggcgca

SEQ ID NO: 276822 - DNA, 16 bp, P. troglodytes
tgggggagacagacaa

SEQ ID NO: 276823 - DNA, 16 bp, P. troglodytes
tgggggagccagaagg

SEQ ID NO: 276824 - DNA, 16 bp, P. troglodytes
tgggggagcttttgag

SEQ ID NO: 276825 - DNA, 16 bp, P. troglodytes
tgggggagggaaagca

SEQ ID NO: 276826 - DNA, 16 bp, P. troglodytes
tgggggcagggagaag

SEQ ID NO: 276827 - DNA, 16 bp, P. troglodytes
tgggggcagggccagg

SEQ ID NO: 276828 - DNA, 16 bp, P. troglodytes
tgggggcaggtccctc

SEQ ID NO: 276829 - DNA, 16 bp, P. troglodytes
tgggggcatggtggga

SEQ ID NO: 276830 - DNA, 16 bp, P. troglodytes
tgggggccacaggacc

SEQ ID NO: 276831 - DNA, 16 bp, P. troglodytes
tgggggcctgggaagg

SEQ ID NO: 276832 - DNA, 16 bp, P. troglodytes
tgggggcgctgcagga

SEQ ID NO: 276833 - DNA, 16 bp, P. troglodytes
tgggggctcacacctg

SEQ ID NO: 276834 - DNA, 16 bp, P. troglodytes
tgggggctcatgcctg

SEQ ID NO: 276835 - DNA, 16 bp, P. troglodytes
tgggggctccacccca

SEQ ID NO: 276836 - DNA, 16 bp, P. troglodytes
tgggggctcccctgcc

SEQ ID NO: 276837 - DNA, 16 bp, P. troglodytes
tgggggctggggacag

SEQ ID NO: 276838 - DNA, 16 bp, P. troglodytes
tgggggctggttgcca

SEQ ID NO: 276839 - DNA, 16 bp, P. troglodytes
tgggggctgttctgtg

SEQ ID NO: 276840 - DNA, 16 bp, P. troglodytes
tggggggcagccccca

SEQ ID NO: 276841 - DNA, 16 bp, P. troglodytes
tgggggtcctggaacc

SEQ ID NO: 276842 - DNA, 16 bp, P. troglodytes
tgggggtggatttcct

SEQ ID NO: 276843 - DNA, 16 bp, P. troglodytes
tgggggtggggaagca

SEQ ID NO: 276844 - DNA, 16 bp, P. troglodytes
tgggggtggggctcag

SEQ ID NO: 276845 - DNA, 16 bp, P. troglodytes
tgggggtttcaccata

SEQ ID NO: 276846 - DNA, 16 bp, P. troglodytes
tggggtacacgtgcag

SEQ ID NO: 276847 - DNA, 16 bp, P. troglodytes
tggggtacctgtgcag

SEQ ID NO: 276848 - DNA, 16 bp, P. troglodytes
tggggtcagagtcccc

SEQ ID NO: 276849 - DNA, 16 bp, P. troglodytes
tggggtccggccactg

SEQ ID NO: 276850 - DNA, 16 bp, P. troglodytes
tggggtctcactgtca

SEQ ID NO: 276851 - DNA, 16 bp, P. troglodytes
tggggtctctccatgt

SEQ ID NO: 276852 - DNA, 16 bp, P. troglodytes
tggggtctggctgtgt

SEQ ID NO: 276853 - DNA, 16 bp, P. troglodytes
tggggtgcagtggcac

SEQ ID NO: 276854 - DNA, 17 bp, P. troglodytes
tggggtggagagttctg

SEQ ID NO: 276855 - DNA, 16 bp, P. troglodytes
tggggtgggcctgaga

SEQ ID NO: 276856 - DNA, 16 bp, P. troglodytes
tggggtggggcctgag

SEQ ID NO: 276857 - DNA, 16 bp, P. troglodytes
tggggttgctgggtca

SEQ ID NO: 276858 - DNA, 16 bp, P. troglodytes
tggggttgggactgag

SEQ ID NO: 276859 - DNA, 16 bp, P. troglodytes
tggggtttaaataccc

SEQ ID NO: 276860 - DNA, 19 bp, P. troglodytes
tggggtttcaccacgttgg

SEQ ID NO: 276861 - DNA, 22 bp, P. troglodytes
tggggtttcaccatgttggccg

SEQ ID NO: 276862 - DNA, 20 bp, P. troglodytes
tggggtttcaccatgttggt

SEQ ID NO: 276863 - DNA, 19 bp, P. troglodytes
tggggtttcaccatgttgt

SEQ ID NO: 276864 - DNA, 19 bp, P. troglodytes
tggggtttcaccattttgg

SEQ ID NO: 276865 - DNA, 16 bp, P. troglodytes
tggggtttcaccgtat

SEQ ID NO: 276866 - DNA, 24 bp, P. troglodytes
tggggtttcatcatgttggccaga

SEQ ID NO: 276867 - DNA, 18 bp, P. troglodytes
tggggtttcgccatgtta

SEQ ID NO: 276868 - DNA, 23 bp, P. troglodytes
tggggtttctccatgttggccaa

SEQ ID NO: 276869 - DNA, 16 bp, P. troglodytes
tggggttttctagata

SEQ ID NO: 276870 - DNA, 16 bp, P. troglodytes
tggggttttgcatgtt

SEQ ID NO: 276871 - DNA, 16 bp, P. troglodytes
tggggttttgccaggg

SEQ ID NO: 276872 - DNA, 16 bp, P. troglodytes
tgggtaaatgatgaaa

SEQ ID NO: 276873 - DNA, 16 bp, P. troglodytes
tgggtaaattatttaa

SEQ ID NO: 276874 - DNA, 16 bp, P. troglodytes
tgggtaagttgaaatt

SEQ ID NO: 276875 - DNA, 16 bp, P. troglodytes
tgggtaatttataaaa

SEQ ID NO: 276876 - DNA, 16 bp, P. troglodytes
tgggtaatttataaca

SEQ ID NO: 276877 - DNA, 16 bp, P. troglodytes
tgggtaatttatacaa

SEQ ID NO: 276878 - DNA, 16 bp, P. troglodytes
tgggtacaaaaataaa

SEQ ID NO: 276879 - DNA, 16 bp, P. troglodytes
tgggtacagcccacag

SEQ ID NO: 276880 - DNA, 16 bp, P. troglodytes
tgggtacatagtaggt

SEQ ID NO: 276881 - DNA, 16 bp, P. troglodytes
tgggtacttaataaat

SEQ ID NO: 276882 - DNA, 16 bp, P. troglodytes
tgggtagctgaggcag

SEQ ID NO: 276883 - DNA, 16 bp, P. troglodytes
tgggtatatacccaca

SEQ ID NO: 276884 - DNA, 16 bp, P. troglodytes
tgggtatatacccagg

SEQ ID NO: 276885 - DNA, 16 bp, P. troglodytes
tgggtcacaggggcag

SEQ ID NO: 276886 - DNA, 16 bp, P. troglodytes
tgggtcacatgtccac

SEQ ID NO: 276887 - DNA, 16 bp, P. troglodytes
tgggtcacttgataaa

SEQ ID NO: 276888 - DNA, 16 bp, P. troglodytes
tgggtcagaaattcag

SEQ ID NO: 276889 - DNA, 16 bp, P. troglodytes
tgggtcaggaatttgg

SEQ ID NO: 276890 - DNA, 16 bp, P. troglodytes
tgggtcatgggggtgg

SEQ ID NO: 276891 - DNA, 16 bp, P. troglodytes
tgggtccctcccacag

SEQ ID NO: 276892 - DNA, 16 bp, P. troglodytes
tgggtccctgaccccc

SEQ ID NO: 276893 - DNA, 16 bp, P. troglodytes
tgggtccctgatccca

SEQ ID NO: 276894 - DNA, 16 bp, P. troglodytes
tgggtcctaaatccaa

SEQ ID NO: 276895 - DNA, 16 bp, P. troglodytes
tgggtctacaggcacg

SEQ ID NO: 276896 - DNA, 16 bp, P. troglodytes
tgggtctccagtttgc

SEQ ID NO: 276897 - DNA, 16 bp, P. troglodytes
tgggtctctgaccccc

SEQ ID NO: 276898 - DNA, 16 bp, P. troglodytes
tgggtctctgtgtgtg

SEQ ID NO: 276899 - DNA, 16 bp, P. troglodytes
tgggtctcttgcattt

SEQ ID NO: 276900 - DNA, 16 bp, P. troglodytes
tgggtcttcattttct

SEQ ID NO: 276901 - DNA, 16 bp, P. troglodytes
tgggtctttattctga

SEQ ID NO: 276902 - DNA, 16 bp, P. troglodytes
tgggtgaaaaaataat

SEQ ID NO: 276903 - DNA, 16 bp, P. troglodytes
tgggtgaaaaagtgag

SEQ ID NO: 276904 - DNA, 16 bp, P. troglodytes
tgggtgaaccttgaag

SEQ ID NO: 276905 - DNA, 16 bp, P. troglodytes
tgggtgacagagacct

SEQ ID NO: 276906 - DNA, 16 bp, P. troglodytes
tgggtgacagagagaa

SEQ ID NO: 276907 - DNA, 16 bp, P. troglodytes
tgggtgacagagcgaa

SEQ ID NO: 276908 - DNA, 16 bp, P. troglodytes
tgggtgacagaggaga

SEQ ID NO: 276909 - DNA, 16 bp, P. troglodytes
tgggtgacagagtgag

SEQ ID NO: 276910 - DNA, 16 bp, P. troglodytes
tgggtgacagtgggag

SEQ ID NO: 276911 - DNA, 16 bp, P. troglodytes
tgggtgaggcaggaga

SEQ ID NO: 276912 - DNA, 16 bp, P. troglodytes
tgggtgagggataaaa

SEQ ID NO: 276913 - DNA, 16 bp, P. troglodytes
tgggtgagttacttaa

SEQ ID NO: 276914 - DNA, 16 bp, P. troglodytes
tgggtgatgaaaatgt

SEQ ID NO: 276915 - DNA, 16 bp, P. troglodytes
tgggtgatgaaataat

SEQ ID NO: 276916 - DNA, 16 bp, P. troglodytes
tgggtgcaagtgattc

SEQ ID NO: 276917 - DNA, 16 bp, P. troglodytes
tgggtgcagctggagg

SEQ ID NO: 276918 - DNA, 17 bp, P. troglodytes
tgggtgcaggacagtgg

SEQ ID NO: 276919 - DNA, 16 bp, P. troglodytes
tgggtgcagtggatca

SEQ ID NO: 276920 - DNA, 16 bp, P. troglodytes
tgggtgccagagtgag

SEQ ID NO: 276921 - DNA, 16 bp, P. troglodytes
tgggtgccagctcagc

SEQ ID NO: 276922 - DNA, 16 bp, P. troglodytes
tgggtgccaggccctg

SEQ ID NO: 276923 - DNA, 16 bp, P. troglodytes
tgggtgccaggggctg

SEQ ID NO: 276924 - DNA, 16 bp, P. troglodytes
tgggtgcccaggcaga

SEQ ID NO: 276925 - DNA, 16 bp, P. troglodytes
tgggtgcggaggctca

SEQ ID NO: 276926 - DNA, 16 bp, P. troglodytes
tgggtgcggcggctca

SEQ ID NO: 276927 - DNA, 17 bp, P. troglodytes
tgggtgctatcaatgcc

SEQ ID NO: 276928 - DNA, 16 bp, P. troglodytes
tgggtgctgttaaaaa

SEQ ID NO: 276929 - DNA, 16 bp, P. troglodytes
tgggtggaccacgagg

SEQ ID NO: 276930 - DNA, 16 bp, P. troglodytes
tgggtggagctgccca

SEQ ID NO: 276931 - DNA, 16 bp, P. troglodytes
tgggtggagtggggac

SEQ ID NO: 276932 - DNA, 16 bp, P. troglodytes
tgggtggataaagaaa

SEQ ID NO: 276933 - DNA, 16 bp, P. troglodytes
tgggtggatcacctga

SEQ ID NO: 276934 - DNA, 16 bp, P. troglodytes
tgggtggcacatgcct

SEQ ID NO: 276935 - DNA, 16 bp, P. troglodytes
tgggtggcaccagctg

SEQ ID NO: 276936 - DNA, 16 bp, P. troglodytes
tgggtggcagagcaaa

SEQ ID NO: 276937 - DNA, 16 bp, P. troglodytes
tgggtggccaggcaga

SEQ ID NO: 276938 - DNA, 18 bp, P. troglodytes
tgggtggctgaggcaggc

SEQ ID NO: 276939 - DNA, 16 bp, P. troglodytes
tgggtggctgcagctg

SEQ ID NO: 276940 - DNA, 16 bp, P. troglodytes
tgggtgggcacagtgg

SEQ ID NO: 276941 - DNA, 16 bp, P. troglodytes
tgggtggggaaacagc

SEQ ID NO: 276942 - DNA, 16 bp, P. troglodytes
tgggtggggacacacc

SEQ ID NO: 276943 - DNA, 16 bp, P. troglodytes
tgggtggggacccaga

SEQ ID NO: 276944 - DNA, 16 bp, P. troglodytes
tgggtggggccacaga

SEQ ID NO: 276945 - DNA, 16 bp, P. troglodytes
tgggtggtcagggaag

SEQ ID NO: 276946 - DNA, 16 bp, P. troglodytes
tgggtgtcaccagcag

SEQ ID NO: 276947 - DNA, 16 bp, P. troglodytes
tgggtgtgagccactg

SEQ ID NO: 276948 - DNA, 16 bp, P. troglodytes
tgggtgtgatggctca

SEQ ID NO: 276949 - DNA, 16 bp, P. troglodytes
tgggtgtgggggctca

SEQ ID NO: 276950 - DNA, 16 bp, P. troglodytes
tgggtgtggtcaggag

SEQ ID NO: 276951 - DNA, 16 bp, P. troglodytes
tgggtgtggtggcgca

SEQ ID NO: 276952 - DNA, 16 bp, P. troglodytes
tgggtgtggtggctta

SEQ ID NO: 276953 - DNA, 16 bp, P. troglodytes
tgggtgtgtgtgcaca

SEQ ID NO: 276954 - DNA, 16 bp, P. troglodytes
tgggttaaataaaatg

SEQ ID NO: 276955 - DNA, 16 bp, P. troglodytes
tgggttcaaattccag

SEQ ID NO: 276956 - DNA, 16 bp, P. troglodytes
tgggttcaagaaattc

SEQ ID NO: 276957 - DNA, 19 bp, P. troglodytes
tgggttcaagcaattctcc

SEQ ID NO: 276958 - DNA, 16 bp, P. troglodytes
tgggttcaaggaatcc

SEQ ID NO: 276959 - DNA, 16 bp, P. troglodytes
tgggttcaagtcccag

SEQ ID NO: 276960 - DNA, 16 bp, P. troglodytes
tgggttcagttccaga

SEQ ID NO: 276961 - DNA, 16 bp, P. troglodytes
tgggttcccatggtct

SEQ ID NO: 276962 - DNA, 16 bp, P. troglodytes
tgggttcccttctggc

SEQ ID NO: 276963 - DNA, 16 bp, P. troglodytes
tgggttgcagtgagcc

SEQ ID NO: 276964 - DNA, 16 bp, P. troglodytes
tgggttgcttctgcct

SEQ ID NO: 276965 - DNA, 16 bp, P. troglodytes
tgggttgtttccagtt

SEQ ID NO: 276966 - DNA, 17 bp, P. troglodytes
tgggtttacaggtgtgt

SEQ ID NO: 276967 - DNA, 16 bp, P. troglodytes
tgggtttatttctgaa

SEQ ID NO: 276968 - DNA, 16 bp, P. troglodytes
tgggtttcatcccagg

SEQ ID NO: 276969 - DNA, 16 bp, P. troglodytes
tgggtttcctcatctg

SEQ ID NO: 276970 - DNA, 17 bp, P. troglodytes
tgggtttctccatgttg

SEQ ID NO: 276971 - DNA, 16 bp, P. troglodytes
tgggtttgaatctcag

SEQ ID NO: 276972 - DNA, 16 bp, P. troglodytes
tgggtttggacaaatg

SEQ ID NO: 276973 - DNA, 17 bp, P. troglodytes
tgggtttgtcatagatg

SEQ ID NO: 276974 - DNA, 16 bp, P. troglodytes
tgggttttaaaaaatt

SEQ ID NO: 276975 - DNA, 16 bp, P. troglodytes
tgggttttctccaggt

SEQ ID NO: 276976 - DNA, 16 bp, P. troglodytes
tgggttttgactcttt

SEQ ID NO: 276977 - DNA, 17 bp, P. troglodytes
tgggttttgtccttcat

SEQ ID NO: 276978 - DNA, 16 bp, P. troglodytes
tgggtttttaaaaata

SEQ ID NO: 276979 - DNA, 16 bp, P. troglodytes
tgggtttttcacagat

SEQ ID NO: 276980 - DNA, 16 bp, P. troglodytes
tgggtttttctaaata

SEQ ID NO: 276981 - DNA, 16 bp, P. troglodytes
tgggtttttttccccc

SEQ ID NO: 276982 - DNA, 16 bp, P. troglodytes
tggtaaaaagattata

SEQ ID NO: 276983 - DNA, 16 bp, P. troglodytes
tggtaaaacattactt

SEQ ID NO: 276984 - DNA, 16 bp, P. troglodytes
tggtaaaacattattt

SEQ ID NO: 276985 - DNA, 23 bp, P. troglodytes
tggtaaaagtcatcgccattctc

SEQ ID NO: 276986 - DNA, 16 bp, P. troglodytes
tggtaaaatatacata

SEQ ID NO: 276987 - DNA, 16 bp, P. troglodytes
tggtaaagtctgggct

SEQ ID NO: 276988 - DNA, 16 bp, P. troglodytes
tggtaaatgtgtttcc

SEQ ID NO: 276989 - DNA, 16 bp, P. troglodytes
tggtaaatgtttaaca

SEQ ID NO: 276990 - DNA, 16 bp, P. troglodytes
tggtaaatgtttcttt

SEQ ID NO: 276991 - DNA, 16 bp, P. troglodytes
tggtaacaggatgatg

SEQ ID NO: 276992 - DNA, 16 bp, P. troglodytes
tggtaaccactgttct

SEQ ID NO: 276993 - DNA, 16 bp, P. troglodytes
tggtaaccattcttct

SEQ ID NO: 276994 - DNA, 16 bp, P. troglodytes
tggtaacttctgggtt

SEQ ID NO: 276995 - DNA, 16 bp, P. troglodytes
tggtaataataatagt

SEQ ID NO: 276996 - DNA, 16 bp, P. troglodytes
tggtaatatgacaaaa

SEQ ID NO: 276997 - DNA, 16 bp, P. troglodytes
tggtaatttattacag

SEQ ID NO: 276998 - DNA, 16 bp, P. troglodytes
tggtacagcctgcaga

SEQ ID NO: 276999 - DNA, 16 bp, P. troglodytes
tggtacatgtgatatt

SEQ ID NO: 277000 - DNA, 16 bp, P. troglodytes
tggtacatttgttaca

SEQ ID NO: 277001 - DNA, 16 bp, P. troglodytes
tggtaccaaaacagag

SEQ ID NO: 277002 - DNA, 17 bp, P. troglodytes
tggtaccagtttctcct

SEQ ID NO: 277003 - DNA, 29 bp, P. troglodytes
tggtaccattccttctgaaactattccaa

SEQ ID NO: 277004 - DNA, 16 bp, P. troglodytes
tggtacctggtatgca

SEQ ID NO: 277005 - DNA, 16 bp, P. troglodytes
tggtactggaaaaact

SEQ ID NO: 277006 - DNA, 16 bp, P. troglodytes
tggtactgtcataaaa

SEQ ID NO: 277007 - DNA, 16 bp, P. troglodytes
tggtagaaatgcagaa

SEQ ID NO: 277008 - DNA, 16 bp, P. troglodytes
tggtagaaggggcaaa

SEQ ID NO: 277009 - DNA, 16 bp, P. troglodytes
tggtagaattcagcaa

SEQ ID NO: 277010 - DNA, 16 bp, P. troglodytes
tggtagagctgagatt

SEQ ID NO: 277011 - DNA, 16 bp, P. troglodytes
tggtagataagctttt

SEQ ID NO: 277012 - DNA, 16 bp, P. troglodytes
tggtagccaaagacaa

SEQ ID NO: 277013 - DNA, 16 bp, P. troglodytes
tggtagctattattat

SEQ ID NO: 277014 - DNA, 16 bp, P. troglodytes
tggtagctcacacctg

SEQ ID NO: 277015 - DNA, 16 bp, P. troglodytes
tggtagctcatacctg

SEQ ID NO: 277016 - DNA, 16 bp, P. troglodytes
tggtagctcatgcctg

SEQ ID NO: 277017 - DNA, 16 bp, P. troglodytes
tggtagcttatgcctg

SEQ ID NO: 277018 - DNA, 16 bp, P. troglodytes
tggtaggcagaataat

SEQ ID NO: 277019 - DNA, 16 bp, P. troglodytes
tggtaggcagaggcag

SEQ ID NO: 277020 - DNA, 16 bp, P. troglodytes
tggtagtttggtagga

SEQ ID NO: 277021 - DNA, 16 bp, P. troglodytes
tggtatacatacacaa

SEQ ID NO: 277022 - DNA, 18 bp, P. troglodytes
tggtatacctgaaagtga

SEQ ID NO: 277023 - DNA, 16 bp, P. troglodytes
tggtatatattttaaa

SEQ ID NO: 277024 - DNA, 16 bp, P. troglodytes
tggtatcacagtgctt

SEQ ID NO: 277025 - DNA, 16 bp, P. troglodytes
tggtatcagttcttct

SEQ ID NO: 277026 - DNA, 16 bp, P. troglodytes
tggtatctcttcctct

SEQ ID NO: 277027 - DNA, 16 bp, P. troglodytes
tggtatggtggcacat

SEQ ID NO: 277028 - DNA, 16 bp, P. troglodytes
tggtatgtgaattcta

SEQ ID NO: 277029 - DNA, 16 bp, P. troglodytes
tggtattaaaatttca

SEQ ID NO: 277030 - DNA, 16 bp, P. troglodytes
tggtattgagtgtctg

SEQ ID NO: 277031 - DNA, 16 bp, P. troglodytes
tggtatttggagatga

SEQ ID NO: 277032 - DNA, 16 bp, P. troglodytes
tggtatttggttacat

SEQ ID NO: 277033 - DNA, 16 bp, P. troglodytes
tggtattttgttatga

SEQ ID NO: 277034 - DNA, 16 bp, P. troglodytes
tggtatttttagttct

SEQ ID NO: 277035 - DNA, 16 bp, P. troglodytes
tggtcaaagcagtcac

SEQ ID NO: 277036 - DNA, 16 bp, P. troglodytes
tggtcaaatggtattt

SEQ ID NO: 277037 - DNA, 16 bp, P. troglodytes
tggtcaacagaaaggg

SEQ ID NO: 277038 - DNA, 16 bp, P. troglodytes
tggtcaaggaaggcct

SEQ ID NO: 277039 - DNA, 16 bp, P. troglodytes
tggtcaatgaagaaat

SEQ ID NO: 277040 - DNA, 16 bp, P. troglodytes
tggtcaattttggctt

SEQ ID NO: 277041 - DNA, 16 bp, P. troglodytes
tggtcacagccattca

SEQ ID NO: 277042 - DNA, 16 bp, P. troglodytes
tggtcaccagaggctg

SEQ ID NO: 277043 - DNA, 16 bp, P. troglodytes
tggtcaccccacccta

SEQ ID NO: 277044 - DNA, 17 bp, P. troglodytes
tggtcacgctcctagtc

SEQ ID NO: 277045 - DNA, 16 bp, P. troglodytes
tggtcacggtggctca

SEQ ID NO: 277046 - DNA, 16 bp, P. troglodytes
tggtcactgcagctgt

SEQ ID NO: 277047 - DNA, 16 bp, P. troglodytes
tggtcagactggtctg

SEQ ID NO: 277048 - DNA, 16 bp, P. troglodytes
tggtcagcatggtgaa

SEQ ID NO: 277049 - DNA, 16 bp, P. troglodytes
tggtcagctgtgcctg

SEQ ID NO: 277050 - DNA, 17 bp, P. troglodytes
tggtcaggagttcaaga

SEQ ID NO: 277051 - DNA, 16 bp, P. troglodytes
tggtcaggctgctctg

SEQ ID NO: 277052 - DNA, 16 bp, P. troglodytes
tggtcagggaagacct

SEQ ID NO: 277053 - DNA, 16 bp, P. troglodytes
tggtcagggagatgga

SEQ ID NO: 277054 - DNA, 16 bp, P. troglodytes
tggtcagggctggtct

SEQ ID NO: 277055 - DNA, 16 bp, P. troglodytes
tggtcatcagagaaac

SEQ ID NO: 277056 - DNA, 16 bp, P. troglodytes
tggtcatgcaggatga

SEQ ID NO: 277057 - DNA, 16 bp, P. troglodytes
tggtcattttcacagt

SEQ ID NO: 277058 - DNA, 16 bp, P. troglodytes
tggtccagccacagcc

SEQ ID NO: 277059 - DNA, 16 bp, P. troglodytes
tggtccagctgcagcc

SEQ ID NO: 277060 - DNA, 16 bp, P. troglodytes
tggtcccagctacctg

SEQ ID NO: 277061 - DNA, 16 bp, P. troglodytes
tggtcccagctacttg

SEQ ID NO: 277062 - DNA, 16 bp, P. troglodytes
tggtcccagctatttg

SEQ ID NO: 277063 - DNA, 16 bp, P. troglodytes
tggtccctgccctcat

SEQ ID NO: 277064 - DNA, 16 bp, P. troglodytes
tggtccctggaccctg

SEQ ID NO: 277065 - DNA, 16 bp, P. troglodytes
tggtccctttaaatga

SEQ ID NO: 277066 - DNA, 16 bp, P. troglodytes
tggtcctgaacttttt

SEQ ID NO: 277067 - DNA, 16 bp, P. troglodytes
tggtcctgacctcaag

SEQ ID NO: 277068 - DNA, 18 bp, P. troglodytes
tggtcctggactttattt

SEQ ID NO: 277069 - DNA, 16 bp, P. troglodytes
tggtcctgggattttt

SEQ ID NO: 277070 - DNA, 16 bp, P. troglodytes
tggtcgtgcatgcctg

SEQ ID NO: 277071 - DNA, 16 bp, P. troglodytes
tggtctatatatctgt

SEQ ID NO: 277072 - DNA, 16 bp, P. troglodytes
tggtctatcctagaga

SEQ ID NO: 277073 - DNA, 16 bp, P. troglodytes
tggtctcaaaatccta

SEQ ID NO: 277074 - DNA, 16 bp, P. troglodytes
tggtctcaaacacctg

SEQ ID NO: 277075 - DNA, 17 bp, P. troglodytes
tggtctcaaactcccga

SEQ ID NO: 277076 - DNA, 16 bp, P. troglodytes
tggtctcaaactccta

SEQ ID NO: 277077 - DNA, 17 bp, P. troglodytes
tggtctcaaacttctgg

SEQ ID NO: 277078 - DNA, 16 bp, P. troglodytes
tggtctcaagcatttc

SEQ ID NO: 277079 - DNA, 17 bp, P. troglodytes
tggtctcaagctcctgg

SEQ ID NO: 277080 - DNA, 16 bp, P. troglodytes
tggtctcaatttcctg

SEQ ID NO: 277081 - DNA, 16 bp, P. troglodytes
tggtctcagactcctg

SEQ ID NO: 277082 - DNA, 16 bp, P. troglodytes
tggtctcagcccaaaa

SEQ ID NO: 277083 - DNA, 16 bp, P. troglodytes
tggtctcataagatta

SEQ ID NO: 277084 - DNA, 16 bp, P. troglodytes
tggtctcatgatagtg

SEQ ID NO: 277085 - DNA, 16 bp, P. troglodytes
tggtctccaatttctg

SEQ ID NO: 277086 - DNA, 16 bp, P. troglodytes
tggtctcctgggctca

SEQ ID NO: 277087 - DNA, 16 bp, P. troglodytes
tggtctcgaactccca

SEQ ID NO: 277088 - DNA, 17 bp, P. troglodytes
tggtctcgaactcctgg

SEQ ID NO: 277089 - DNA, 17 bp, P. troglodytes
tggtctcgctgacttca

SEQ ID NO: 277090 - DNA, 16 bp, P. troglodytes
tggtctcgctggcttc

SEQ ID NO: 277091 - DNA, 19 bp, P. troglodytes
tggtctcggtctcctgacc

SEQ ID NO: 277092 - DNA, 17 bp, P. troglodytes
tggtctctaactcctgg

SEQ ID NO: 277093 - DNA, 16 bp, P. troglodytes
tggtctctacaaaaaa

SEQ ID NO: 277094 - DNA, 16 bp, P. troglodytes
tggtctctctgcttct

SEQ ID NO: 277095 - DNA, 16 bp, P. troglodytes
tggtctctctggcttc

SEQ ID NO: 277096 - DNA, 16 bp, P. troglodytes
tggtctcttcaataaa

SEQ ID NO: 277097 - DNA, 17 bp, P. troglodytes
tggtctcttcacacaga

SEQ ID NO: 277098 - DNA, 16 bp, P. troglodytes
tggtctgagctccctg

SEQ ID NO: 277099 - DNA, 16 bp, P. troglodytes
tggtctgcagaccagc

SEQ ID NO: 277100 - DNA, 16 bp, P. troglodytes
tggtctgcagctccca

SEQ ID NO: 277101 - DNA, 16 bp, P. troglodytes
tggtctggaacacctg

SEQ ID NO: 277102 - DNA, 16 bp, P. troglodytes
tggtctgggcaaggat

SEQ ID NO: 277103 - DNA, 16 bp, P. troglodytes
tggtctgtgtacttaa

SEQ ID NO: 277104 - DNA, 16 bp, P. troglodytes
tggtctgtgtgtctgt

SEQ ID NO: 277105 - DNA, 16 bp, P. troglodytes
tggtctgtttagattt

SEQ ID NO: 277106 - DNA, 16 bp, P. troglodytes
tggtctgttttgacag

SEQ ID NO: 277107 - DNA, 18 bp, P. troglodytes
tggtctgttttgacaggg

SEQ ID NO: 277108 - DNA, 16 bp, P. troglodytes
tggtcttcaacttctg

SEQ ID NO: 277109 - DNA, 16 bp, P. troglodytes
tggtcttgaacccctg

SEQ ID NO: 277110 - DNA, 16 bp, P. troglodytes
tggtcttgaactcctc

SEQ ID NO: 277111 - DNA, 18 bp, P. troglodytes
tggtcttgaactcctgat

SEQ ID NO: 277112 - DNA, 16 bp, P. troglodytes
tggtcttgaactcttt

SEQ ID NO: 277113 - DNA, 16 bp, P. troglodytes
tggtcttgaattccta

SEQ ID NO: 277114 - DNA, 16 bp, P. troglodytes
tggtcttgctctctca

SEQ ID NO: 277115 - DNA, 16 bp, P. troglodytes
tggtcttggcctccca

SEQ ID NO: 277116 - DNA, 16 bp, P. troglodytes
tggtgaaaaatgaaat

SEQ ID NO: 277117 - DNA, 16 bp, P. troglodytes
tggtgaaaacccttct

SEQ ID NO: 277118 - DNA, 16 bp, P. troglodytes
tggtgaaaacctgttt

SEQ ID NO: 277119 - DNA, 16 bp, P. troglodytes
tggtgaaaagggaaat

SEQ ID NO: 277120 - DNA, 16 bp, P. troglodytes
tggtgaaaaggggaca

SEQ ID NO: 277121 - DNA, 16 bp, P. troglodytes
tggtgaaaatgcaaaa

SEQ ID NO: 277122 - DNA, 16 bp, P. troglodytes
tggtgaaacaccctct

SEQ ID NO: 277123 - DNA, 16 bp, P. troglodytes
tggtgaaaccatgtct

SEQ ID NO: 277124 - DNA, 19 bp, P. troglodytes
tggtgaaaccccatctcta

SEQ ID NO: 277125 - DNA, 19 bp, P. troglodytes
tggtgaaaccccgactcta

SEQ ID NO: 277126 - DNA, 16 bp, P. troglodytes
tggtgaaaccctgtcg

SEQ ID NO: 277127 - DNA, 19 bp, P. troglodytes
tggtgaaaccctgtctaca

SEQ ID NO: 277128 - DNA, 27 bp, P. troglodytes
tggtgaaaccctgtctctactaaaaaa

SEQ ID NO: 277129 - DNA, 16 bp, P. troglodytes
tggtgaaacctcacct

SEQ ID NO: 277130 - DNA, 16 bp, P. troglodytes
tggtgaaacctcattt

SEQ ID NO: 277131 - DNA, 16 bp, P. troglodytes
tggtgaaactctttct

SEQ ID NO: 277132 - DNA, 16 bp, P. troglodytes
tggtgaaacttcatct

SEQ ID NO: 277133 - DNA, 16 bp, P. troglodytes
tggtgaaagcaggagc

SEQ ID NO: 277134 - DNA, 16 bp, P. troglodytes
tggtgaaaggcaagga

SEQ ID NO: 277135 - DNA, 16 bp, P. troglodytes
tggtgaaagtgggcat

SEQ ID NO: 277136 - DNA, 16 bp, P. troglodytes
tggtgaaatcacatct

SEQ ID NO: 277137 - DNA, 16 bp, P. troglodytes
tggtgaaatcattgat

SEQ ID NO: 277138 - DNA, 16 bp, P. troglodytes
tggtgaacaaaacaga

SEQ ID NO: 277139 - DNA, 16 bp, P. troglodytes
tggtgaacagcaaatg

SEQ ID NO: 277140 - DNA, 16 bp, P. troglodytes
tggtgaacagtgctgc

SEQ ID NO: 277141 - DNA, 16 bp, P. troglodytes
tggtgaagccccacct

SEQ ID NO: 277142 - DNA, 16 bp, P. troglodytes
tggtgaagtgtctgtt

SEQ ID NO: 277143 - DNA, 16 bp, P. troglodytes
tggtgaatatgtacca

SEQ ID NO: 277144 - DNA, 16 bp, P. troglodytes
tggtgaatgaatggat

SEQ ID NO: 277145 - DNA, 16 bp, P. troglodytes
tggtgaattacattta

SEQ ID NO: 277146 - DNA, 16 bp, P. troglodytes
tggtgacaaaatctgt

SEQ ID NO: 277147 - DNA, 16 bp, P. troglodytes
tggtgacaaagtgaga

SEQ ID NO: 277148 - DNA, 16 bp, P. troglodytes
tggtgacaacatctct

SEQ ID NO: 277149 - DNA, 16 bp, P. troglodytes
tggtgacagaatgaga

SEQ ID NO: 277150 - DNA, 16 bp, P. troglodytes
tggtgacagagcaaaa

SEQ ID NO: 277151 - DNA, 16 bp, P. troglodytes
tggtgacaggcaccta

SEQ ID NO: 277152 - DNA, 16 bp, P. troglodytes
tggtgacagtgggcat

SEQ ID NO: 277153 - DNA, 16 bp, P. troglodytes
tggtgaccagcctggc

SEQ ID NO: 277154 - DNA, 16 bp, P. troglodytes
tggtgaccatggcctt

SEQ ID NO: 277155 - DNA, 16 bp, P. troglodytes
tggtgactcacacctg

SEQ ID NO: 277156 - DNA, 16 bp, P. troglodytes
tggtgactcatgcctg

SEQ ID NO: 277157 - DNA, 16 bp, P. troglodytes
tggtgacttatgcctg

SEQ ID NO: 277158 - DNA, 16 bp, P. troglodytes
tggtgactttatagaa

SEQ ID NO: 277159 - DNA, 16 bp, P. troglodytes
tggtgagatcttggct

SEQ ID NO: 277160 - DNA, 21 bp, P. troglodytes
tggtgagccaagatcacgcca

SEQ ID NO: 277161 - DNA, 16 bp, P. troglodytes
tggtgagccgaaatca

SEQ ID NO: 277162 - DNA, 16 bp, P. troglodytes
tggtgaggacgtggag

SEQ ID NO: 277163 - DNA, 16 bp, P. troglodytes
tggtgaggctgcagag

SEQ ID NO: 277164 - DNA, 16 bp, P. troglodytes
tggtgagggccctctt

SEQ ID NO: 277165 - DNA, 16 bp, P. troglodytes
tggtgagggccttctt

SEQ ID NO: 277166 - DNA, 16 bp, P. troglodytes
tggtgagggctctttt

SEQ ID NO: 277167 - DNA, 16 bp, P. troglodytes
tggtgaggtgtgctca

SEQ ID NO: 277168 - DNA, 16 bp, P. troglodytes
tggtgagtatttgtgt

SEQ ID NO: 277169 - DNA, 16 bp, P. troglodytes
tggtgagttatataat

SEQ ID NO: 277170 - DNA, 16 bp, P. troglodytes
tggtgatatggtttgg

SEQ ID NO: 277171 - DNA, 18 bp, P. troglodytes
tggtgatcaaacaaagaa

SEQ ID NO: 277172 - DNA, 18 bp, P. troglodytes
tggtgatccacctgcctc

SEQ ID NO: 277173 - DNA, 17 bp, P. troglodytes
tggtgatccgcccgcct

SEQ ID NO: 277174 - DNA, 16 bp, P. troglodytes
tggtgatgagaagaat

SEQ ID NO: 277175 - DNA, 16 bp, P. troglodytes
tggtgatgatgatgac

SEQ ID NO: 277176 - DNA, 16 bp, P. troglodytes
tggtgatgatgatgat

SEQ ID NO: 277177 - DNA, 16 bp, P. troglodytes
tggtgatgatggtgat

SEQ ID NO: 277178 - DNA, 16 bp, P. troglodytes
tggtgatgattgcaca

SEQ ID NO: 277179 - DNA, 16 bp, P. troglodytes
tggtgatggttataca

SEQ ID NO: 277180 - DNA, 16 bp, P. troglodytes
tggtgatggttgcaca

SEQ ID NO: 277181 - DNA, 16 bp, P. troglodytes
tggtgatgtccccttt

SEQ ID NO: 277182 - DNA, 16 bp, P. troglodytes
tggtgatgtgagcctg

SEQ ID NO: 277183 - DNA, 16 bp, P. troglodytes
tggtgatgttcatttt

SEQ ID NO: 277184 - DNA, 16 bp, P. troglodytes
tggtgatgttgaacat

SEQ ID NO: 277185 - DNA, 16 bp, P. troglodytes
tggtgattgcaccact

SEQ ID NO: 277186 - DNA, 16 bp, P. troglodytes
tggtgattgctgaagg

SEQ ID NO: 277187 - DNA, 16 bp, P. troglodytes
tggtgatttctgatat

SEQ ID NO: 277188 - DNA, 16 bp, P. troglodytes
tggtgattttaagttg

SEQ ID NO: 277189 - DNA, 17 bp, P. troglodytes
tggtgcaaaagtaactg

SEQ ID NO: 277190 - DNA, 16 bp, P. troglodytes
tggtgcaatcactgct

SEQ ID NO: 277191 - DNA, 16 bp, P. troglodytes
tggtgcaatctcaact

SEQ ID NO: 277192 - DNA, 16 bp, P. troglodytes
tggtgcacacccgtag

SEQ ID NO: 277193 - DNA, 16 bp, P. troglodytes
tggtgcacatgcctgt

SEQ ID NO: 277194 - DNA, 16 bp, P. troglodytes
tggtgcagagctcagt

SEQ ID NO: 277195 - DNA, 16 bp, P. troglodytes
tggtgcagcacaccaa

SEQ ID NO: 277196 - DNA, 16 bp, P. troglodytes
tggtgcaggcctgtgg

SEQ ID NO: 277197 - DNA, 17 bp, P. troglodytes
tggtgcagtcttggctt

SEQ ID NO: 277198 - DNA, 16 bp, P. troglodytes
tggtgccatcatagct

SEQ ID NO: 277199 - DNA, 16 bp, P. troglodytes
tggtgccattgcactt

SEQ ID NO: 277200 - DNA, 16 bp, P. troglodytes
tggtgcccaggcagct

SEQ ID NO: 277201 - DNA, 16 bp, P. troglodytes
tggtgccctgcgtccc

SEQ ID NO: 277202 - DNA, 18 bp, P. troglodytes
tggtgcctcatgcctgta

SEQ ID NO: 277203 - DNA, 16 bp, P. troglodytes
tggtgcgatcacagct

SEQ ID NO: 277204 - DNA, 19 bp, P. troglodytes
tggtgcgatctcggctcac

SEQ ID NO: 277205 - DNA, 17 bp, P. troglodytes
tggtgcgatctcggctg

SEQ ID NO: 277206 - DNA, 19 bp, P. troglodytes
tggtgcgatctcggttcac

SEQ ID NO: 277207 - DNA, 19 bp, P. troglodytes
tggtgcgatcttggctcaa

SEQ ID NO: 277208 - DNA, 16 bp, P. troglodytes
tggtgctgcacacctg

SEQ ID NO: 277209 - DNA, 16 bp, P. troglodytes
tggtgctgctgcactc

SEQ ID NO: 277210 - DNA, 16 bp, P. troglodytes
tggtgctggaaaaact

SEQ ID NO: 277211 - DNA, 16 bp, P. troglodytes
tggtgctggagcaatt

SEQ ID NO: 277212 - DNA, 16 bp, P. troglodytes
tggtgctggctgttgg

SEQ ID NO: 277213 - DNA, 16 bp, P. troglodytes
tggtgctgggaaaatg

SEQ ID NO: 277214 - DNA, 16 bp, P. troglodytes
tggtgctgggacagct

SEQ ID NO: 277215 - DNA, 16 bp, P. troglodytes
tggtgctgggcgcctg

SEQ ID NO: 277216 - DNA, 16 bp, P. troglodytes
tggtgctggggaaact

SEQ ID NO: 277217 - DNA, 16 bp, P. troglodytes
tggtgctgtcctcgtg

SEQ ID NO: 277218 - DNA, 16 bp, P. troglodytes
tggtgctgtctttgtg

SEQ ID NO: 277219 - DNA, 16 bp, P. troglodytes
tggtgcttacattcta

SEQ ID NO: 277220 - DNA, 16 bp, P. troglodytes
tggtgcttggcacaca

SEQ ID NO: 277221 - DNA, 16 bp, P. troglodytes
tggtggaaaaggaaat

SEQ ID NO: 277222 - DNA, 16 bp, P. troglodytes
tggtggaaagcaaaag

SEQ ID NO: 277223 - DNA, 16 bp, P. troglodytes
tggtggaaatgcaaaa

SEQ ID NO: 277224 - DNA, 16 bp, P. troglodytes
tggtggaactaattta

SEQ ID NO: 277225 - DNA, 16 bp, P. troglodytes
tggtggaaggaaagga

SEQ ID NO: 277226 - DNA, 16 bp, P. troglodytes
tggtggaaggagaaag

SEQ ID NO: 277227 - DNA, 16 bp, P. troglodytes
tggtggaaggagaagc

SEQ ID NO: 277228 - DNA, 16 bp, P. troglodytes
tggtggaaggcaaagt

SEQ ID NO: 277229 - DNA, 16 bp, P. troglodytes
tggtggaaggcaagag

SEQ ID NO: 277230 - DNA, 16 bp, P. troglodytes
tggtggaagggcaaag

SEQ ID NO: 277231 - DNA, 16 bp, P. troglodytes
tggtggaaggtgaaag

SEQ ID NO: 277232 - DNA, 16 bp, P. troglodytes
tggtggaaggtgatgg

SEQ ID NO: 277233 - DNA, 16 bp, P. troglodytes
tggtggaaggtgattg

SEQ ID NO: 277234 - DNA, 16 bp, P. troglodytes
tggtggaaggtggaag

SEQ ID NO: 277235 - DNA, 16 bp, P. troglodytes
tggtggagaaggactc

SEQ ID NO: 277236 - DNA, 16 bp, P. troglodytes
tggtggagacagggtt

SEQ ID NO: 277237 - DNA, 16 bp, P. troglodytes
tggtggaggatgagga

SEQ ID NO: 277238 - DNA, 16 bp, P. troglodytes
tggtggaggtggcttt

SEQ ID NO: 277239 - DNA, 16 bp, P. troglodytes
tggtggagtctttaga

SEQ ID NO: 277240 - DNA, 16 bp, P. troglodytes
tggtggataacctttt

SEQ ID NO: 277241 - DNA, 16 bp, P. troglodytes
tggtggataaggcatt

SEQ ID NO: 277242 - DNA, 16 bp, P. troglodytes
tggtggatcagctttt

SEQ ID NO: 277243 - DNA, 16 bp, P. troglodytes
tggtggcacatgccag

SEQ ID NO: 277244 - DNA, 16 bp, P. troglodytes
tggtggcacatgcttg

SEQ ID NO: 277245 - DNA, 16 bp, P. troglodytes
tggtggcacctacctg

SEQ ID NO: 277246 - DNA, 17 bp, P. troglodytes
tggtggcacgtgcctgt

SEQ ID NO: 277247 - DNA, 16 bp, P. troglodytes
tggtggcagacaagaa

SEQ ID NO: 277248 - DNA, 16 bp, P. troglodytes
tggtggcagagatgga

SEQ ID NO: 277249 - DNA, 16 bp, P. troglodytes
tggtggcagatacctg

SEQ ID NO: 277250 - DNA, 16 bp, P. troglodytes
tggtggcagcaagaga

SEQ ID NO: 277251 - DNA, 16 bp, P. troglodytes
tggtggcagcagcagc

SEQ ID NO: 277252 - DNA, 16 bp, P. troglodytes
tggtggcaggaggctg

SEQ ID NO: 277253 - DNA, 16 bp, P. troglodytes
tggtggcaggcgccca

SEQ ID NO: 277254 - DNA, 20 bp, P. troglodytes
tggtggcaggtgcctgtaat

SEQ ID NO: 277255 - DNA, 16 bp, P. troglodytes
tggtggcatctgcttc

SEQ ID NO: 277256 - DNA, 16 bp, P. troglodytes
tggtggcatgagcctg

SEQ ID NO: 277257 - DNA, 16 bp, P. troglodytes
tggtggccacagggtg

SEQ ID NO: 277258 - DNA, 16 bp, P. troglodytes
tggtggccaggctggt

SEQ ID NO: 277259 - DNA, 16 bp, P. troglodytes
tggtggcccacgccta

SEQ ID NO: 277260 - DNA, 16 bp, P. troglodytes
tggtggcccacgcctg

SEQ ID NO: 277261 - DNA, 16 bp, P. troglodytes
tggtggcctgtgtctg

SEQ ID NO: 277262 - DNA, 17 bp, P. troglodytes
tggtggcgcacacctgc

SEQ ID NO: 277263 - DNA, 16 bp, P. troglodytes
tggtggcgctcacctg

SEQ ID NO: 277264 - DNA, 16 bp, P. troglodytes
tggtggcggtcgcctg

SEQ ID NO: 277265 - DNA, 17 bp, P. troglodytes
tggtggcgtgcacctgt

SEQ ID NO: 277266 - DNA, 16 bp, P. troglodytes
tggtggctcacaccta

SEQ ID NO: 277267 - DNA, 16 bp, P. troglodytes
tggtggctcacacctc

SEQ ID NO: 277268 - DNA, 16 bp, P. troglodytes
tggtggctcacacctg

SEQ ID NO: 277269 - DNA, 16 bp, P. troglodytes
tggtggctcacacttg

SEQ ID NO: 277270 - DNA, 16 bp, P. troglodytes
tggtggctcacgccca

SEQ ID NO: 277271 - DNA, 16 bp, P. troglodytes
tggtggctcacgcctg

SEQ ID NO: 277272 - DNA, 16 bp, P. troglodytes
tggtggctcacgcttg

SEQ ID NO: 277273 - DNA, 16 bp, P. troglodytes
tggtggctcacgtctg

SEQ ID NO: 277274 - DNA, 16 bp, P. troglodytes
tggtggctcactcctg

SEQ ID NO: 277275 - DNA, 16 bp, P. troglodytes
tggtggctcacttctg

SEQ ID NO: 277276 - DNA, 16 bp, P. troglodytes
tggtggctcaggcctg

SEQ ID NO: 277277 - DNA, 16 bp, P. troglodytes
tggtggctcaggtctg

SEQ ID NO: 277278 - DNA, 16 bp, P. troglodytes
tggtggctcatgccag

SEQ ID NO: 277279 - DNA, 16 bp, P. troglodytes
tggtggctcatgcctg

SEQ ID NO: 277280 - DNA, 16 bp, P. troglodytes
tggtggctcatgtcta

SEQ ID NO: 277281 - DNA, 16 bp, P. troglodytes
tggtggctcccacctg

SEQ ID NO: 277282 - DNA, 16 bp, P. troglodytes
tggtggctccctcctg

SEQ ID NO: 277283 - DNA, 16 bp, P. troglodytes
tggtggctcgtgcctg

SEQ ID NO: 277284 - DNA, 17 bp, P. troglodytes
tggtggctgacacctgt

SEQ ID NO: 277285 - DNA, 16 bp, P. troglodytes
tggtggctgacgcctg

SEQ ID NO: 277286 - DNA, 16 bp, P. troglodytes
tggtggctgaggcctg

SEQ ID NO: 277287 - DNA, 16 bp, P. troglodytes
tggtggctgctgcctg

SEQ ID NO: 277288 - DNA, 16 bp, P. troglodytes
tggtggctggcaagat

SEQ ID NO: 277289 - DNA, 16 bp, P. troglodytes
tggtggcttacacctg

SEQ ID NO: 277290 - DNA, 16 bp, P. troglodytes
tggtggcttatgcctg

SEQ ID NO: 277291 - DNA, 16 bp, P. troglodytes
tggtggctttggtggc

SEQ ID NO: 277292 - DNA, 16 bp, P. troglodytes
tggtgggaacccagga

SEQ ID NO: 277293 - DNA, 16 bp, P. troglodytes
tggtgggaatgtgaaa

SEQ ID NO: 277294 - DNA, 16 bp, P. troglodytes
tggtgggaggcctcag

SEQ ID NO: 277295 - DNA, 16 bp, P. troglodytes
tggtgggaggtggctg

SEQ ID NO: 277296 - DNA, 16 bp, P. troglodytes
tggtgggcacctgtac

SEQ ID NO: 277297 - DNA, 16 bp, P. troglodytes
tggtgggccagatttg

SEQ ID NO: 277298 - DNA, 17 bp, P. troglodytes
tggtgggccccgcactc

SEQ ID NO: 277299 - DNA, 16 bp, P. troglodytes
tggtgggctgggcagg

SEQ ID NO: 277300 - DNA, 16 bp, P. troglodytes
tggtggggaatgttga

SEQ ID NO: 277301 - DNA, 16 bp, P. troglodytes
tggtgggtcacacctg

SEQ ID NO: 277302 - DNA, 16 bp, P. troglodytes
tggtgggtccaggtgg

SEQ ID NO: 277303 - DNA, 16 bp, P. troglodytes
tggtgggtggggccct

SEQ ID NO: 277304 - DNA, 16 bp, P. troglodytes
tggtgggtgtgtaaat

SEQ ID NO: 277305 - DNA, 16 bp, P. troglodytes
tggtggtaatgtaaaa

SEQ ID NO: 277306 - DNA, 16 bp, P. troglodytes
tggtggtgagggcctg

SEQ ID NO: 277307 - DNA, 16 bp, P. troglodytes
tggtggtgattgcaca

SEQ ID NO: 277308 - DNA, 16 bp, P. troglodytes
tggtggtgcagcctgt

SEQ ID NO: 277309 - DNA, 16 bp, P. troglodytes
tggtggtgcatgcctc

SEQ ID NO: 277310 - DNA, 17 bp, P. troglodytes
tggtggtgcatgcctgt

SEQ ID NO: 277311 - DNA, 16 bp, P. troglodytes
tggtggtggactcctg

SEQ ID NO: 277312 - DNA, 16 bp, P. troglodytes
tggtggtggcagcagc

SEQ ID NO: 277313 - DNA, 16 bp, P. troglodytes
tggtggtggcagtggg

SEQ ID NO: 277314 - DNA, 16 bp, P. troglodytes
tggtggtggccacaag

SEQ ID NO: 277315 - DNA, 16 bp, P. troglodytes
tggtggtgggaatgta

SEQ ID NO: 277316 - DNA, 16 bp, P. troglodytes
tggtggtgggaggcag

SEQ ID NO: 277317 - DNA, 16 bp, P. troglodytes
tggtggtgggcaccta

SEQ ID NO: 277318 - DNA, 16 bp, P. troglodytes
tggtggtgggcccctg

SEQ ID NO: 277319 - DNA, 16 bp, P. troglodytes
tggtggtgggtgccag

SEQ ID NO: 277320 - DNA, 16 bp, P. troglodytes
tggtggtgggtgccca

SEQ ID NO: 277321 - DNA, 16 bp, P. troglodytes
tggtggtggtagtagt

SEQ ID NO: 277322 - DNA, 16 bp, P. troglodytes
tggtggtggtgatgat

SEQ ID NO: 277323 - DNA, 16 bp, P. troglodytes
tggtggtggtgcctgt

SEQ ID NO: 277324 - DNA, 16 bp, P. troglodytes
tggtggtgtgaacctg

SEQ ID NO: 277325 - DNA, 17 bp, P. troglodytes
tggtggtgtgcacctgt

SEQ ID NO: 277326 - DNA, 18 bp, P. troglodytes
tggtggttcacacctgta

SEQ ID NO: 277327 - DNA, 16 bp, P. troglodytes
tggtggttcacgcctg

SEQ ID NO: 277328 - DNA, 16 bp, P. troglodytes
tggtggttcatgcctg

SEQ ID NO: 277329 - DNA, 16 bp, P. troglodytes
tggtggttcattcctg

SEQ ID NO: 277330 - DNA, 16 bp, P. troglodytes
tggtggttcctcaaaa

SEQ ID NO: 277331 - DNA, 16 bp, P. troglodytes
tggtggttctattttt

SEQ ID NO: 277332 - DNA, 16 bp, P. troglodytes
tggtggttgccagcaa

SEQ ID NO: 277333 - DNA, 17 bp, P. troglodytes
tggtggtttgctgcacc

SEQ ID NO: 277334 - DNA, 16 bp, P. troglodytes
tggtgtacacctgtag

SEQ ID NO: 277335 - DNA, 18 bp, P. troglodytes
tggtgtaccggaaagtga

SEQ ID NO: 277336 - DNA, 18 bp, P. troglodytes
tggtgtacctgaaagtga

SEQ ID NO: 277337 - DNA, 16 bp, P. troglodytes
tggtgtaggcacccaa

SEQ ID NO: 277338 - DNA, 16 bp, P. troglodytes
tggtgtatatgtatca

SEQ ID NO: 277339 - DNA, 16 bp, P. troglodytes
tggtgtatctgtgcca

SEQ ID NO: 277340 - DNA, 16 bp, P. troglodytes
tggtgtcagagaaggc

SEQ ID NO: 277341 - DNA, 16 bp, P. troglodytes
tggtgtccactgcttg

SEQ ID NO: 277342 - DNA, 16 bp, P. troglodytes
tggtgtccaggaagaa

SEQ ID NO: 277343 - DNA, 16 bp, P. troglodytes
tggtgtcctcataaga

SEQ ID NO: 277344 - DNA, 16 bp, P. troglodytes
tggtgtctcacacctg

SEQ ID NO: 277345 - DNA, 16 bp, P. troglodytes
tggtgtctctgccagg

SEQ ID NO: 277346 - DNA, 16 bp, P. troglodytes
tggtgtctcttcctct

SEQ ID NO: 277347 - DNA, 16 bp, P. troglodytes
tggtgtctcttcttct

SEQ ID NO: 277348 - DNA, 16 bp, P. troglodytes
tggtgtctgctgaggg

SEQ ID NO: 277349 - DNA, 16 bp, P. troglodytes
tggtgtctggcgaggg

SEQ ID NO: 277350 - DNA, 16 bp, P. troglodytes
tggtgtctgggaactt

SEQ ID NO: 277351 - DNA, 16 bp, P. troglodytes
tggtgtcttatgcctg

SEQ ID NO: 277352 - DNA, 17 bp, P. troglodytes
tggtgtgagatggtatg

SEQ ID NO: 277353 - DNA, 16 bp, P. troglodytes
tggtgtgagcctggga

SEQ ID NO: 277354 - DNA, 16 bp, P. troglodytes
tggtgtgatcacggct

SEQ ID NO: 277355 - DNA, 16 bp, P. troglodytes
tggtgtgatctcagca

SEQ ID NO: 277356 - DNA, 16 bp, P. troglodytes
tggtgtgcgcctgcag

SEQ ID NO: 277357 - DNA, 16 bp, P. troglodytes
tggtgtgctgagtgcc

SEQ ID NO: 277358 - DNA, 22 bp, P. troglodytes
tggtgtgctgcacccattaact

SEQ ID NO: 277359 - DNA, 16 bp, P. troglodytes
tggtgtgctgcacctg

SEQ ID NO: 277360 - DNA, 16 bp, P. troglodytes
tggtgtgctgcgccca

SEQ ID NO: 277361 - DNA, 16 bp, P. troglodytes
tggtgtggacccaaag

SEQ ID NO: 277362 - DNA, 17 bp, P. troglodytes
tggtgtggatgcagtga

SEQ ID NO: 277363 - DNA, 16 bp, P. troglodytes
tggtgtggctggagca

SEQ ID NO: 277364 - DNA, 16 bp, P. troglodytes
tggtgtggtgctgaaa

SEQ ID NO: 277365 - DNA, 16 bp, P. troglodytes
tggtgtggtggaaaga

SEQ ID NO: 277366 - DNA, 16 bp, P. troglodytes
tggtgtgtatatatat

SEQ ID NO: 277367 - DNA, 16 bp, P. troglodytes
tggtgtgtccagagtt

SEQ ID NO: 277368 - DNA, 16 bp, P. troglodytes
tggtgttagatggtat

SEQ ID NO: 277369 - DNA, 16 bp, P. troglodytes
tggtgttgagaagaat

SEQ ID NO: 277370 - DNA, 16 bp, P. troglodytes
tggtgttgagcctaca

SEQ ID NO: 277371 - DNA, 16 bp, P. troglodytes
tggtgttgggaaaact

SEQ ID NO: 277372 - DNA, 16 bp, P. troglodytes
tggtgttgggacaact

SEQ ID NO: 277373 - DNA, 16 bp, P. troglodytes
tggtgttgtcagtatt

SEQ ID NO: 277374 - DNA, 16 bp, P. troglodytes
tggtgtttggctggag

SEQ ID NO: 277375 - DNA, 16 bp, P. troglodytes
tggttaaaaaaatcaa

SEQ ID NO: 277376 - DNA, 16 bp, P. troglodytes
tggttaaataaattat

SEQ ID NO: 277377 - DNA, 16 bp, P. troglodytes
tggttaacagatacaa

SEQ ID NO: 277378 - DNA, 16 bp, P. troglodytes
tggttaaggtggtatc

SEQ ID NO: 277379 - DNA, 16 bp, P. troglodytes
tggttaattttatgtg

SEQ ID NO: 277380 - DNA, 16 bp, P. troglodytes
tggttaccagaggctg

SEQ ID NO: 277381 - DNA, 16 bp, P. troglodytes
tggttaccagagggtg

SEQ ID NO: 277382 - DNA, 16 bp, P. troglodytes
tggttaccatggggat

SEQ ID NO: 277383 - DNA, 16 bp, P. troglodytes
tggttacccacgaggc

SEQ ID NO: 277384 - DNA, 16 bp, P. troglodytes
tggttactatgaggct

SEQ ID NO: 277385 - DNA, 16 bp, P. troglodytes
tggttactgtggcttt

SEQ ID NO: 277386 - DNA, 16 bp, P. troglodytes
tggttattgagcactt

SEQ ID NO: 277387 - DNA, 16 bp, P. troglodytes
tggttattgtagcttt

SEQ ID NO: 277388 - DNA, 16 bp, P. troglodytes
tggttatttaaaagtg

SEQ ID NO: 277389 - DNA, 16 bp, P. troglodytes
tggttattttgcacat

SEQ ID NO: 277390 - DNA, 17 bp, P. troglodytes
tggttcaatatacacaa

SEQ ID NO: 277391 - DNA, 16 bp, P. troglodytes
tggttcaatcttagta

SEQ ID NO: 277392 - DNA, 16 bp, P. troglodytes
tggttcagtctggaaa

SEQ ID NO: 277393 - DNA, 17 bp, P. troglodytes
tggttcatacctgtaat

SEQ ID NO: 277394 - DNA, 16 bp, P. troglodytes
tggttcatcagttgta

SEQ ID NO: 277395 - DNA, 16 bp, P. troglodytes
tggttcatgcctgtga

SEQ ID NO: 277396 - DNA, 16 bp, P. troglodytes
tggttcattttatgtg

SEQ ID NO: 277397 - DNA, 16 bp, P. troglodytes
tggttccagctactca

SEQ ID NO: 277398 - DNA, 16 bp, P. troglodytes
tggttccagcttttgc

SEQ ID NO: 277399 - DNA, 16 bp, P. troglodytes
tggttccaggaccttc

SEQ ID NO: 277400 - DNA, 16 bp, P. troglodytes
tggttccagtgattct

SEQ ID NO: 277401 - DNA, 16 bp, P. troglodytes
tggttccataagatta

SEQ ID NO: 277402 - DNA, 16 bp, P. troglodytes
tggttccatatgaact

SEQ ID NO: 277403 - DNA, 16 bp, P. troglodytes
tggttccattccttct

SEQ ID NO: 277404 - DNA, 16 bp, P. troglodytes
tggttcccagaccagc

SEQ ID NO: 277405 - DNA, 16 bp, P. troglodytes
tggttcccttttctcc

SEQ ID NO: 277406 - DNA, 16 bp, P. troglodytes
tggttcctgacacaga

SEQ ID NO: 277407 - DNA, 16 bp, P. troglodytes
tggttcctgccctcag

SEQ ID NO: 277408 - DNA, 16 bp, P. troglodytes
tggttcctttctcccc

SEQ ID NO: 277409 - DNA, 16 bp, P. troglodytes
tggttctattctccct

SEQ ID NO: 277410 - DNA, 16 bp, P. troglodytes
tggttctcaaacatta

SEQ ID NO: 277411 - DNA, 16 bp, P. troglodytes
tggttctcaaacctta

SEQ ID NO: 277412 - DNA, 16 bp, P. troglodytes
tggttctcagccttgg

SEQ ID NO: 277413 - DNA, 16 bp, P. troglodytes
tggttctcagctgggg

SEQ ID NO: 277414 - DNA, 16 bp, P. troglodytes
tggttctcagcttgaa

SEQ ID NO: 277415 - DNA, 16 bp, P. troglodytes
tggttctcaggctttt

SEQ ID NO: 277416 - DNA, 16 bp, P. troglodytes
tggttctccagttctt

SEQ ID NO: 277417 - DNA, 16 bp, P. troglodytes
tggttctgatttgtat

SEQ ID NO: 277418 - DNA, 16 bp, P. troglodytes
tggttctgctttttgc

SEQ ID NO: 277419 - DNA, 16 bp, P. troglodytes
tggttctggaggctgg

SEQ ID NO: 277420 - DNA, 18 bp, P. troglodytes
tggttctgtttatgtgat

SEQ ID NO: 277421 - DNA, 16 bp, P. troglodytes
tggttctttgaaaaaa

SEQ ID NO: 277422 - DNA, 16 bp, P. troglodytes
tggttgaatgaataaa

SEQ ID NO: 277423 - DNA, 16 bp, P. troglodytes
tggttgagaaccactg

SEQ ID NO: 277424 - DNA, 16 bp, P. troglodytes
tggttgcacaacagtg

SEQ ID NO: 277425 - DNA, 17 bp, P. troglodytes
tggttgccagtgaagga

SEQ ID NO: 277426 - DNA, 16 bp, P. troglodytes
tggttgctcacgcctg

SEQ ID NO: 277427 - DNA, 16 bp, P. troglodytes
tggttgctttccacaa

SEQ ID NO: 277428 - DNA, 16 bp, P. troglodytes
tggttggaatttcttt

SEQ ID NO: 277429 - DNA, 16 bp, P. troglodytes
tggttggagatgttat

SEQ ID NO: 277430 - DNA, 16 bp, P. troglodytes
tggttggttcccctgg

SEQ ID NO: 277431 - DNA, 16 bp, P. troglodytes
tggttgtcacagctgg

SEQ ID NO: 277432 - DNA, 16 bp, P. troglodytes
tggttgtttttgagac

SEQ ID NO: 277433 - DNA, 16 bp, P. troglodytes
tggtttaaaacaacac

SEQ ID NO: 277434 - DNA, 16 bp, P. troglodytes
tggtttaaacaacaga

SEQ ID NO: 277435 - DNA, 16 bp, P. troglodytes
tggtttagtcttgtga

SEQ ID NO: 277436 - DNA, 16 bp, P. troglodytes
tggtttatagttttct

SEQ ID NO: 277437 - DNA, 16 bp, P. troglodytes
tggtttatgcagaaat

SEQ ID NO: 277438 - DNA, 16 bp, P. troglodytes
tggtttatgctgaaca

SEQ ID NO: 277439 - DNA, 16 bp, P. troglodytes
tggtttattataaaag

SEQ ID NO: 277440 - DNA, 17 bp, P. troglodytes
tggtttattcagggatt

SEQ ID NO: 277441 - DNA, 16 bp, P. troglodytes
tggtttcaaataactt

SEQ ID NO: 277442 - DNA, 16 bp, P. troglodytes
tggtttcaaatcccag

SEQ ID NO: 277443 - DNA, 16 bp, P. troglodytes
tggtttcaagcttcat

SEQ ID NO: 277444 - DNA, 16 bp, P. troglodytes
tggtttcaagtgatcc

SEQ ID NO: 277445 - DNA, 16 bp, P. troglodytes
tggtttcaccatgttg

SEQ ID NO: 277446 - DNA, 16 bp, P. troglodytes
tggtttcatataaatt

SEQ ID NO: 277447 - DNA, 16 bp, P. troglodytes
tggtttcatgggctgg

SEQ ID NO: 277448 - DNA, 16 bp, P. troglodytes
tggtttcctccatgct

SEQ ID NO: 277449 - DNA, 16 bp, P. troglodytes
tggtttcctgggctgg

SEQ ID NO: 277450 - DNA, 16 bp, P. troglodytes
tggtttcctggggctg

SEQ ID NO: 277451 - DNA, 16 bp, P. troglodytes
tggtttctatctcctg

SEQ ID NO: 277452 - DNA, 16 bp, P. troglodytes
tggtttctgtttgcat

SEQ ID NO: 277453 - DNA, 16 bp, P. troglodytes
tggtttcttagatatg

SEQ ID NO: 277454 - DNA, 16 bp, P. troglodytes
tggtttcttgagatga

SEQ ID NO: 277455 - DNA, 16 bp, P. troglodytes
tggtttcttttactta

SEQ ID NO: 277456 - DNA, 16 bp, P. troglodytes
tggtttgaatatgtcc

SEQ ID NO: 277457 - DNA, 16 bp, P. troglodytes
tggtttgagcccagaa

SEQ ID NO: 277458 - DNA, 16 bp, P. troglodytes
tggtttgaggtcttag

SEQ ID NO: 277459 - DNA, 16 bp, P. troglodytes
tggtttgcagacagct

SEQ ID NO: 277460 - DNA, 16 bp, P. troglodytes
tggtttgcattttcct

SEQ ID NO: 277461 - DNA, 16 bp, P. troglodytes
tggtttgcctctgtgt

SEQ ID NO: 277462 - DNA, 16 bp, P. troglodytes
tggtttgctgcatcta

SEQ ID NO: 277463 - DNA, 16 bp, P. troglodytes
tggtttggaattggaa

SEQ ID NO: 277464 - DNA, 16 bp, P. troglodytes
tggtttggctatgttc

SEQ ID NO: 277465 - DNA, 16 bp, P. troglodytes
tggtttggctgtttcc

SEQ ID NO: 277466 - DNA, 16 bp, P. troglodytes
tggtttggttactgta

SEQ ID NO: 277467 - DNA, 16 bp, P. troglodytes
tggtttggttgtgtcc

SEQ ID NO: 277468 - DNA, 16 bp, P. troglodytes
tggtttgtaaatattt

SEQ ID NO: 277469 - DNA, 16 bp, P. troglodytes
tggtttgttcttactt

SEQ ID NO: 277470 - DNA, 17 bp, P. troglodytes
tggttttaaaaatggga

SEQ ID NO: 277471 - DNA, 16 bp, P. troglodytes
tggttttaaaatatgt

SEQ ID NO: 277472 - DNA, 16 bp, P. troglodytes
tggttttaatgtgcat

SEQ ID NO: 277473 - DNA, 16 bp, P. troglodytes
tggttttagttcttac

SEQ ID NO: 277474 - DNA, 16 bp, P. troglodytes
tggttttataaatgtt

SEQ ID NO: 277475 - DNA, 16 bp, P. troglodytes
tggttttatgtccttg

SEQ ID NO: 277476 - DNA, 16 bp, P. troglodytes
tggttttcatttgctt

SEQ ID NO: 277477 - DNA, 16 bp, P. troglodytes
tggttttcctcctacc

SEQ ID NO: 277478 - DNA, 16 bp, P. troglodytes
tggttttctaaggggc

SEQ ID NO: 277479 - DNA, 16 bp, P. troglodytes
tggttttctcatctat

SEQ ID NO: 277480 - DNA, 16 bp, P. troglodytes
tggttttgtgggccag

SEQ ID NO: 277481 - DNA, 16 bp, P. troglodytes
tggttttgttgccatt

SEQ ID NO: 277482 - DNA, 16 bp, P. troglodytes
tggtttttaattaaaa

SEQ ID NO: 277483 - DNA, 16 bp, P. troglodytes
tggtttttaattctgt

SEQ ID NO: 277484 - DNA, 16 bp, P. troglodytes
tggtttttagtacatt

SEQ ID NO: 277485 - DNA, 16 bp, P. troglodytes
tggtttttagtatagt

SEQ ID NO: 277486 - DNA, 16 bp, P. troglodytes
tggtttttatccaaaa

SEQ ID NO: 277487 - DNA, 16 bp, P. troglodytes
tggtttttctgcatct

SEQ ID NO: 277488 - DNA, 16 bp, P. troglodytes
tggtttttctttaaaa

SEQ ID NO: 277489 - DNA, 16 bp, P. troglodytes
tggttttttaaaaaaa

SEQ ID NO: 277490 - DNA, 16 bp, P. troglodytes
tggtttttttaaaaaa

SEQ ID NO: 277491 - DNA, 16 bp, P. troglodytes
tggtttttttccccca

SEQ ID NO: 277492 - DNA, 16 bp, P. troglodytes
tgtaaaaaaatcaatt

SEQ ID NO: 277493 - DNA, 16 bp, P. troglodytes
tgtaaaaacaattttt

SEQ ID NO: 277494 - DNA, 16 bp, P. troglodytes
tgtaaaaattaatctt

SEQ ID NO: 277495 - DNA, 16 bp, P. troglodytes
tgtaaaacacttagaa

SEQ ID NO: 277496 - DNA, 16 bp, P. troglodytes
tgtaaaacagggataa

SEQ ID NO: 277497 - DNA, 16 bp, P. troglodytes
tgtaaaacatgccttt

SEQ ID NO: 277498 - DNA, 16 bp, P. troglodytes
tgtaaaacattgatga

SEQ ID NO: 277499 - DNA, 16 bp, P. troglodytes
tgtaaaacatttagaa

SEQ ID NO: 277500 - DNA, 16 bp, P. troglodytes
tgtaaaacatttgaag

SEQ ID NO: 277501 - DNA, 16 bp, P. troglodytes
tgtaaaacattttttt

SEQ ID NO: 277502 - DNA, 16 bp, P. troglodytes
tgtaaaaccatcagat

SEQ ID NO: 277503 - DNA, 16 bp, P. troglodytes
tgtaaaacttaaaact

SEQ ID NO: 277504 - DNA, 16 bp, P. troglodytes
tgtaaaagaactgaaa

SEQ ID NO: 277505 - DNA, 16 bp, P. troglodytes
tgtaaaagaagtcaaa

SEQ ID NO: 277506 - DNA, 16 bp, P. troglodytes
tgtaaaagatcagatg

SEQ ID NO: 277507 - DNA, 16 bp, P. troglodytes
tgtaaaagccaaaact

SEQ ID NO: 277508 - DNA, 16 bp, P. troglodytes
tgtaaaataaaagttg

SEQ ID NO: 277509 - DNA, 16 bp, P. troglodytes
tgtaaaatagagataa

SEQ ID NO: 277510 - DNA, 16 bp, P. troglodytes
tgtaaaatatgtaaat

SEQ ID NO: 277511 - DNA, 16 bp, P. troglodytes
tgtaaaatattaaatg

SEQ ID NO: 277512 - DNA, 16 bp, P. troglodytes
tgtaaaatatttcaaa

SEQ ID NO: 277513 - DNA, 16 bp, P. troglodytes
tgtaaaatattttaca

SEQ ID NO: 277514 - DNA, 16 bp, P. troglodytes
tgtaaaatcaaagcaa

SEQ ID NO: 277515 - DNA, 16 bp, P. troglodytes
tgtaaaatgagaataa

SEQ ID NO: 277516 - DNA, 16 bp, P. troglodytes
tgtaaaatgagggaaa

SEQ ID NO: 277517 - DNA, 16 bp, P. troglodytes
tgtaaaatgaggttaa

SEQ ID NO: 277518 - DNA, 16 bp, P. troglodytes
tgtaaaatgagtataa

SEQ ID NO: 277519 - DNA, 16 bp, P. troglodytes
tgtaaaatgcaaaact

SEQ ID NO: 277520 - DNA, 16 bp, P. troglodytes
tgtaaaatggaccaat

SEQ ID NO: 277521 - DNA, 16 bp, P. troglodytes
tgtaaaatgggaaaaa

SEQ ID NO: 277522 - DNA, 16 bp, P. troglodytes
tgtaaaatgtaaatat

SEQ ID NO: 277523 - DNA, 16 bp, P. troglodytes
tgtaaaatgtatttgt

SEQ ID NO: 277524 - DNA, 16 bp, P. troglodytes
tgtaaaatgtgaataa

SEQ ID NO: 277525 - DNA, 16 bp, P. troglodytes
tgtaaaatgttttaaa

SEQ ID NO: 277526 - DNA, 16 bp, P. troglodytes
tgtaaaattatttcat

SEQ ID NO: 277527 - DNA, 16 bp, P. troglodytes
tgtaaaatttattctt

SEQ ID NO: 277528 - DNA, 16 bp, P. troglodytes
tgtaaacaagggtgta

SEQ ID NO: 277529 - DNA, 16 bp, P. troglodytes
tgtaaacagatgtgtt

SEQ ID NO: 277530 - DNA, 16 bp, P. troglodytes
tgtaaacattgttgaa

SEQ ID NO: 277531 - DNA, 16 bp, P. troglodytes
tgtaaacatttttaaa

SEQ ID NO: 277532 - DNA, 16 bp, P. troglodytes
tgtaaaccaaaaagta

SEQ ID NO: 277533 - DNA, 16 bp, P. troglodytes
tgtaaaccagccagaa

SEQ ID NO: 277534 - DNA, 16 bp, P. troglodytes
tgtaaagaaaatattt

SEQ ID NO: 277535 - DNA, 16 bp, P. troglodytes
tgtaaagaacagaaat

SEQ ID NO: 277536 - DNA, 16 bp, P. troglodytes
tgtaaagaactgcctg

SEQ ID NO: 277537 - DNA, 16 bp, P. troglodytes
tgtaaagaatgtcatt

SEQ ID NO: 277538 - DNA, 16 bp, P. troglodytes
tgtaaagcactcagaa

SEQ ID NO: 277539 - DNA, 16 bp, P. troglodytes
tgtaaagctttttttt

SEQ ID NO: 277540 - DNA, 16 bp, P. troglodytes
tgtaaagtaaaattta

SEQ ID NO: 277541 - DNA, 16 bp, P. troglodytes
tgtaaagtatttagaa

SEQ ID NO: 277542 - DNA, 16 bp, P. troglodytes
tgtaaagtgcttagca

SEQ ID NO: 277543 - DNA, 16 bp, P. troglodytes
tgtaaagtgttttatt

SEQ ID NO: 277544 - DNA, 16 bp, P. troglodytes
tgtaaataatgttgca

SEQ ID NO: 277545 - DNA, 16 bp, P. troglodytes
tgtaaatatactaaaa

SEQ ID NO: 277546 - DNA, 16 bp, P. troglodytes
tgtaaatatatgtgca

SEQ ID NO: 277547 - DNA, 16 bp, P. troglodytes
tgtaaatatctgttag

SEQ ID NO: 277548 - DNA, 16 bp, P. troglodytes
tgtaaatatcttttaa

SEQ ID NO: 277549 - DNA, 16 bp, P. troglodytes
tgtaaatatgcatata

SEQ ID NO: 277550 - DNA, 16 bp, P. troglodytes
tgtaaatatgtacaat

SEQ ID NO: 277551 - DNA, 16 bp, P. troglodytes
tgtaaatatgtatgta

SEQ ID NO: 277552 - DNA, 16 bp, P. troglodytes
tgtaaatatttcaata

SEQ ID NO: 277553 - DNA, 16 bp, P. troglodytes
tgtaaatatttcttat

SEQ ID NO: 277554 - DNA, 16 bp, P. troglodytes
tgtaaatattttgaaa

SEQ ID NO: 277555 - DNA, 16 bp, P. troglodytes
tgtaaatatttttccc

SEQ ID NO: 277556 - DNA, 16 bp, P. troglodytes
tgtaaatatttttctt

SEQ ID NO: 277557 - DNA, 16 bp, P. troglodytes
tgtaaatcaaaactac

SEQ ID NO: 277558 - DNA, 16 bp, P. troglodytes
tgtaaatcattctact

SEQ ID NO: 277559 - DNA, 16 bp, P. troglodytes
tgtaaatggaattata

SEQ ID NO: 277560 - DNA, 16 bp, P. troglodytes
tgtaaatggtatttta

SEQ ID NO: 277561 - DNA, 16 bp, P. troglodytes
tgtaaattagctcaac

SEQ ID NO: 277562 - DNA, 17 bp, P. troglodytes
tgtaaattagtatagct

SEQ ID NO: 277563 - DNA, 16 bp, P. troglodytes
tgtaaattggtacagt

SEQ ID NO: 277564 - DNA, 16 bp, P. troglodytes
tgtaaatttaaaaaac

SEQ ID NO: 277565 - DNA, 16 bp, P. troglodytes
tgtaaatttgtacaac

SEQ ID NO: 277566 - DNA, 16 bp, P. troglodytes
tgtaaatttgtttaaa

SEQ ID NO: 277567 - DNA, 16 bp, P. troglodytes
tgtaaattttacctca

SEQ ID NO: 277568 - DNA, 16 bp, P. troglodytes
tgtaaattttacttta

SEQ ID NO: 277569 - DNA, 16 bp, P. troglodytes
tgtaaattttactttt

SEQ ID NO: 277570 - DNA, 16 bp, P. troglodytes
tgtaaattttagaatc

SEQ ID NO: 277571 - DNA, 16 bp, P. troglodytes
tgtaaatttttgcttt

SEQ ID NO: 277572 - DNA, 16 bp, P. troglodytes
tgtaacaaaatattta

SEQ ID NO: 277573 - DNA, 16 bp, P. troglodytes
tgtaacacaatggtaa

SEQ ID NO: 277574 - DNA, 16 bp, P. troglodytes
tgtaacatatatttta

SEQ ID NO: 277575 - DNA, 16 bp, P. troglodytes
tgtaacattttaaatt

SEQ ID NO: 277576 - DNA, 16 bp, P. troglodytes
tgtaaccaaaagccac

SEQ ID NO: 277577 - DNA, 17 bp, P. troglodytes
tgtaaccccagcacttc

SEQ ID NO: 277578 - DNA, 16 bp, P. troglodytes
tgtaactggattgttt

SEQ ID NO: 277579 - DNA, 16 bp, P. troglodytes
tgtaagaatatagtat

SEQ ID NO: 277580 - DNA, 16 bp, P. troglodytes
tgtaagaattaaatga

SEQ ID NO: 277581 - DNA, 16 bp, P. troglodytes
tgtaagagaataaatg

SEQ ID NO: 277582 - DNA, 16 bp, P. troglodytes
tgtaagagacagaaga

SEQ ID NO: 277583 - DNA, 16 bp, P. troglodytes
tgtaagctctgcctcc

SEQ ID NO: 277584 - DNA, 16 bp, P. troglodytes
tgtaaggaaagtaaaa

SEQ ID NO: 277585 - DNA, 17 bp, P. troglodytes
tgtaaggaatgtgggaa

SEQ ID NO: 277586 - DNA, 16 bp, P. troglodytes
tgtaagtggaataata

SEQ ID NO: 277587 - DNA, 16 bp, P. troglodytes
tgtaagtttatataat

SEQ ID NO: 277588 - DNA, 16 bp, P. troglodytes
tgtaagtttttaaaat

SEQ ID NO: 277589 - DNA, 16 bp, P. troglodytes
tgtaataacagctact

SEQ ID NO: 277590 - DNA, 16 bp, P. troglodytes
tgtaataatcacatca

SEQ ID NO: 277591 - DNA, 16 bp, P. troglodytes
tgtaatagcactttgg

SEQ ID NO: 277592 - DNA, 16 bp, P. troglodytes
tgtaatagccttcttt

SEQ ID NO: 277593 - DNA, 16 bp, P. troglodytes
tgtaatataatttgaa

SEQ ID NO: 277594 - DNA, 16 bp, P. troglodytes
tgtaatatacatgtat

SEQ ID NO: 277595 - DNA, 16 bp, P. troglodytes
tgtaatatatatgtat

SEQ ID NO: 277596 - DNA, 16 bp, P. troglodytes
tgtaatatctcctgtt

SEQ ID NO: 277597 - DNA, 16 bp, P. troglodytes
tgtaatattctaaatc

SEQ ID NO: 277598 - DNA, 16 bp, P. troglodytes
tgtaatattctctgat

SEQ ID NO: 277599 - DNA, 16 bp, P. troglodytes
tgtaatatttttgaaa

SEQ ID NO: 277600 - DNA, 16 bp, P. troglodytes
tgtaatcaacataaaa

SEQ ID NO: 277601 - DNA, 16 bp, P. troglodytes
tgtaatcacaagtatt

SEQ ID NO: 277602 - DNA, 17 bp, P. troglodytes
tgtaatcacagcacttt

SEQ ID NO: 277603 - DNA, 16 bp, P. troglodytes
tgtaatccaagctact

SEQ ID NO: 277604 - DNA, 16 bp, P. troglodytes
tgtaatcccaaaattt

SEQ ID NO: 277605 - DNA, 16 bp, P. troglodytes
tgtaatcccaacatct

SEQ ID NO: 277606 - DNA, 17 bp, P. troglodytes
tgtaatcccaatacttt

SEQ ID NO: 277607 - DNA, 16 bp, P. troglodytes
tgtaatcccagctaca

SEQ ID NO: 277608 - DNA, 16 bp, P. troglodytes
tgtaatcccagctacg

SEQ ID NO: 277609 - DNA, 16 bp, P. troglodytes
tgtaatcccagttact

SEQ ID NO: 277610 - DNA, 16 bp, P. troglodytes
tgtaatccccaatgtt

SEQ ID NO: 277611 - DNA, 16 bp, P. troglodytes
tgtaatcctagcacta

SEQ ID NO: 277612 - DNA, 16 bp, P. troglodytes
tgtaatcctagctact

SEQ ID NO: 277613 - DNA, 16 bp, P. troglodytes
tgtaatctcagctacc

SEQ ID NO: 277614 - DNA, 17 bp, P. troglodytes
tgtaatctcagtacttt

SEQ ID NO: 277615 - DNA, 16 bp, P. troglodytes
tgtaatgagctagaaa

SEQ ID NO: 277616 - DNA, 17 bp, P. troglodytes
tgtaatgagtgtggcaa

SEQ ID NO: 277617 - DNA, 16 bp, P. troglodytes
tgtaattaaaaacaaa

SEQ ID NO: 277618 - DNA, 16 bp, P. troglodytes
tgtaattacagctact

SEQ ID NO: 277619 - DNA, 16 bp, P. troglodytes
tgtaattatttcatta

SEQ ID NO: 277620 - DNA, 16 bp, P. troglodytes
tgtaattattttcctt

SEQ ID NO: 277621 - DNA, 16 bp, P. troglodytes
tgtaattccaaaactt

SEQ ID NO: 277622 - DNA, 17 bp, P. troglodytes
tgtaattccagcagttt

SEQ ID NO: 277623 - DNA, 16 bp, P. troglodytes
tgtaattccagctact

SEQ ID NO: 277624 - DNA, 16 bp, P. troglodytes
tgtaattccagtactt

SEQ ID NO: 277625 - DNA, 16 bp, P. troglodytes
tgtaattccagtgact

SEQ ID NO: 277626 - DNA, 16 bp, P. troglodytes
tgtaattctcattata

SEQ ID NO: 277627 - DNA, 16 bp, P. troglodytes
tgtaattgtacattta

SEQ ID NO: 277628 - DNA, 16 bp, P. troglodytes
tgtaatttaaaaaaca

SEQ ID NO: 277629 - DNA, 16 bp, P. troglodytes
tgtaatttcaaatttt

SEQ ID NO: 277630 - DNA, 16 bp, P. troglodytes
tgtaattttaaatttc

SEQ ID NO: 277631 - DNA, 16 bp, P. troglodytes
tgtaattttaactttt

SEQ ID NO: 277632 - DNA, 16 bp, P. troglodytes
tgtaattttgcctttt

SEQ ID NO: 277633 - DNA, 16 bp, P. troglodytes
tgtaatttttcagttt

SEQ ID NO: 277634 - DNA, 16 bp, P. troglodytes
tgtacaaaaacagaca

SEQ ID NO: 277635 - DNA, 16 bp, P. troglodytes
tgtacaaatattattt

SEQ ID NO: 277636 - DNA, 16 bp, P. troglodytes
tgtacaaattagaaaa

SEQ ID NO: 277637 - DNA, 16 bp, P. troglodytes
tgtacaaattattttg

SEQ ID NO: 277638 - DNA, 16 bp, P. troglodytes
tgtacaacaatgtgaa

SEQ ID NO: 277639 - DNA, 16 bp, P. troglodytes
tgtacaaccaccacca

SEQ ID NO: 277640 - DNA, 16 bp, P. troglodytes
tgtacaactctgaata

SEQ ID NO: 277641 - DNA, 16 bp, P. troglodytes
tgtacaatatggtgac

SEQ ID NO: 277642 - DNA, 16 bp, P. troglodytes
tgtacaattcagtgtt

SEQ ID NO: 277643 - DNA, 16 bp, P. troglodytes
tgtacaattttaaaat

SEQ ID NO: 277644 - DNA, 16 bp, P. troglodytes
tgtacacacacacgca

SEQ ID NO: 277645 - DNA, 16 bp, P. troglodytes
tgtacacacatacaca

SEQ ID NO: 277646 - DNA, 16 bp, P. troglodytes
tgtacacacatacata

SEQ ID NO: 277647 - DNA, 16 bp, P. troglodytes
tgtacacacatatata

SEQ ID NO: 277648 - DNA, 16 bp, P. troglodytes
tgtacacatacacaaa

SEQ ID NO: 277649 - DNA, 16 bp, P. troglodytes
tgtacacattttcttt

SEQ ID NO: 277650 - DNA, 16 bp, P. troglodytes
tgtacaccaataacag

SEQ ID NO: 277651 - DNA, 16 bp, P. troglodytes
tgtacaccagtgttca

SEQ ID NO: 277652 - DNA, 16 bp, P. troglodytes
tgtacacccattggaa

SEQ ID NO: 277653 - DNA, 16 bp, P. troglodytes
tgtacactgaaaactg

SEQ ID NO: 277654 - DNA, 16 bp, P. troglodytes
tgtacagaaacctaaa

SEQ ID NO: 277655 - DNA, 16 bp, P. troglodytes
tgtacagactttttct

SEQ ID NO: 277656 - DNA, 16 bp, P. troglodytes
tgtacagattatttaa

SEQ ID NO: 277657 - DNA, 16 bp, P. troglodytes
tgtacagatttttcac

SEQ ID NO: 277658 - DNA, 16 bp, P. troglodytes
tgtacagcaaagaaaa

SEQ ID NO: 277659 - DNA, 16 bp, P. troglodytes
tgtacagcatgatgac

SEQ ID NO: 277660 - DNA, 16 bp, P. troglodytes
tgtacagcctgcagaa

SEQ ID NO: 277661 - DNA, 16 bp, P. troglodytes
tgtacagggcacttac

SEQ ID NO: 277662 - DNA, 16 bp, P. troglodytes
tgtacaggtttgttat

SEQ ID NO: 277663 - DNA, 16 bp, P. troglodytes
tgtacagttcagtaat

SEQ ID NO: 277664 - DNA, 16 bp, P. troglodytes
tgtacagttcagtgat

SEQ ID NO: 277665 - DNA, 16 bp, P. troglodytes
tgtacagttcagtggc

SEQ ID NO: 277666 - DNA, 16 bp, P. troglodytes
tgtacataaatgttca

SEQ ID NO: 277667 - DNA, 16 bp, P. troglodytes
tgtacataattgcatg

SEQ ID NO: 277668 - DNA, 16 bp, P. troglodytes
tgtacatacaatggaa

SEQ ID NO: 277669 - DNA, 16 bp, P. troglodytes
tgtacatacacatgca

SEQ ID NO: 277670 - DNA, 16 bp, P. troglodytes
tgtacatatataaaat

SEQ ID NO: 277671 - DNA, 16 bp, P. troglodytes
tgtacatatataaata

SEQ ID NO: 277672 - DNA, 16 bp, P. troglodytes
tgtacatatatatggg

SEQ ID NO: 277673 - DNA, 16 bp, P. troglodytes
tgtacatatatattca

SEQ ID NO: 277674 - DNA, 16 bp, P. troglodytes
tgtacatatatgtata

SEQ ID NO: 277675 - DNA, 16 bp, P. troglodytes
tgtacatatgtataaa

SEQ ID NO: 277676 - DNA, 16 bp, P. troglodytes
tgtacatatgtattta

SEQ ID NO: 277677 - DNA, 16 bp, P. troglodytes
tgtacatatgtgtgtg

SEQ ID NO: 277678 - DNA, 16 bp, P. troglodytes
tgtacatattaaatat

SEQ ID NO: 277679 - DNA, 16 bp, P. troglodytes
tgtacatattttgggg

SEQ ID NO: 277680 - DNA, 16 bp, P. troglodytes
tgtacatgtatcttta

SEQ ID NO: 277681 - DNA, 16 bp, P. troglodytes
tgtacatgttttgtta

SEQ ID NO: 277682 - DNA, 16 bp, P. troglodytes
tgtacattgtacccaa

SEQ ID NO: 277683 - DNA, 16 bp, P. troglodytes
tgtacatttaaaatat

SEQ ID NO: 277684 - DNA, 16 bp, P. troglodytes
tgtacatttatttatt

SEQ ID NO: 277685 - DNA, 16 bp, P. troglodytes
tgtacatttattttta

SEQ ID NO: 277686 - DNA, 16 bp, P. troglodytes
tgtacatttatttttg

SEQ ID NO: 277687 - DNA, 16 bp, P. troglodytes
tgtacatttttataca

SEQ ID NO: 277688 - DNA, 16 bp, P. troglodytes
tgtaccaatttacatt

SEQ ID NO: 277689 - DNA, 16 bp, P. troglodytes
tgtaccacataaatat

SEQ ID NO: 277690 - DNA, 16 bp, P. troglodytes
tgtaccatattttatt

SEQ ID NO: 277691 - DNA, 16 bp, P. troglodytes
tgtaccatgcacctgg

SEQ ID NO: 277692 - DNA, 16 bp, P. troglodytes
tgtaccattttatgtt

SEQ ID NO: 277693 - DNA, 16 bp, P. troglodytes
tgtacccattaagtaa

SEQ ID NO: 277694 - DNA, 16 bp, P. troglodytes
tgtaccccataagtat

SEQ ID NO: 277695 - DNA, 16 bp, P. troglodytes
tgtaccctaaaaccta

SEQ ID NO: 277696 - DNA, 17 bp, P. troglodytes
tgtaccctgcagagcca

SEQ ID NO: 277697 - DNA, 16 bp, P. troglodytes
tgtaccctttgaccat

SEQ ID NO: 277698 - DNA, 16 bp, P. troglodytes
tgtacctggtcaccca

SEQ ID NO: 277699 - DNA, 16 bp, P. troglodytes
tgtacgtgtgcatgtg

SEQ ID NO: 277700 - DNA, 16 bp, P. troglodytes
tgtactattttatatt

SEQ ID NO: 277701 - DNA, 16 bp, P. troglodytes
tgtactcagcctgggc

SEQ ID NO: 277702 - DNA, 16 bp, P. troglodytes
tgtactccagcctagg

SEQ ID NO: 277703 - DNA, 16 bp, P. troglodytes
tgtactccagcctggg

SEQ ID NO: 277704 - DNA, 16 bp, P. troglodytes
tgtactccagcctggt

SEQ ID NO: 277705 - DNA, 17 bp, P. troglodytes
tgtactccagcttgggt

SEQ ID NO: 277706 - DNA, 16 bp, P. troglodytes
tgtactccagtctggg

SEQ ID NO: 277707 - DNA, 16 bp, P. troglodytes
tgtactcccagctact

SEQ ID NO: 277708 - DNA, 16 bp, P. troglodytes
tgtactctagcctggg

SEQ ID NO: 277709 - DNA, 16 bp, P. troglodytes
tgtactctggcctggg

SEQ ID NO: 277710 - DNA, 16 bp, P. troglodytes
tgtactctttatttct

SEQ ID NO: 277711 - DNA, 16 bp, P. troglodytes
tgtactggcttcaggt

SEQ ID NO: 277712 - DNA, 16 bp, P. troglodytes
tgtactgttgaatttg

SEQ ID NO: 277713 - DNA, 16 bp, P. troglodytes
tgtacttaaaataaaa

SEQ ID NO: 277714 - DNA, 16 bp, P. troglodytes
tgtacttaatgccaat

SEQ ID NO: 277715 - DNA, 16 bp, P. troglodytes
tgtacttatttattta

SEQ ID NO: 277716 - DNA, 16 bp, P. troglodytes
tgtacttcaacctggg

SEQ ID NO: 277717 - DNA, 16 bp, P. troglodytes
tgtacttgaaaagaat

SEQ ID NO: 277718 - DNA, 16 bp, P. troglodytes
tgtacttgaaaataat

SEQ ID NO: 277719 - DNA, 16 bp, P. troglodytes
tgtactttaaaaattt

SEQ ID NO: 277720 - DNA, 16 bp, P. troglodytes
tgtactttatataaat

SEQ ID NO: 277721 - DNA, 16 bp, P. troglodytes
tgtactttctgctcag

SEQ ID NO: 277722 - DNA, 17 bp, P. troglodytes
tgtactttgtagggaca

SEQ ID NO: 277723 - DNA, 16 bp, P. troglodytes
tgtagaaaatttggaa

SEQ ID NO: 277724 - DNA, 16 bp, P. troglodytes
tgtagaaagttgaaac

SEQ ID NO: 277725 - DNA, 16 bp, P. troglodytes
tgtagaataatttgaa

SEQ ID NO: 277726 - DNA, 16 bp, P. troglodytes
tgtagaatggggataa

SEQ ID NO: 277727 - DNA, 16 bp, P. troglodytes
tgtagacatgttttca

SEQ ID NO: 277728 - DNA, 16 bp, P. troglodytes
tgtagacccagctact

SEQ ID NO: 277729 - DNA, 16 bp, P. troglodytes
tgtagacttttcagat

SEQ ID NO: 277730 - DNA, 16 bp, P. troglodytes
tgtagagaaattagaa

SEQ ID NO: 277731 - DNA, 16 bp, P. troglodytes
tgtagagaaattgaaa

SEQ ID NO: 277732 - DNA, 16 bp, P. troglodytes
tgtagagacgaggtct

SEQ ID NO: 277733 - DNA, 16 bp, P. troglodytes
tgtagagatggagtct

SEQ ID NO: 277734 - DNA, 20 bp, P. troglodytes
tgtagagatggggtttctcc

SEQ ID NO: 277735 - DNA, 16 bp, P. troglodytes
tgtagagatgtttata

SEQ ID NO: 277736 - DNA, 16 bp, P. troglodytes
tgtagatattgacaaa

SEQ ID NO: 277737 - DNA, 16 bp, P. troglodytes
tgtagattctgattca

SEQ ID NO: 277738 - DNA, 32 bp, P. troglodytes
tgtagattctggatattagccctttgtcagat

SEQ ID NO: 277739 - DNA, 16 bp, P. troglodytes
tgtagatttttaaata

SEQ ID NO: 277740 - DNA, 16 bp, P. troglodytes
tgtagcacaggctgga

SEQ ID NO: 277741 - DNA, 16 bp, P. troglodytes
tgtagcagcagcagca

SEQ ID NO: 277742 - DNA, 16 bp, P. troglodytes
tgtagcattttatttt

SEQ ID NO: 277743 - DNA, 16 bp, P. troglodytes
tgtagccccagctact

SEQ ID NO: 277744 - DNA, 16 bp, P. troglodytes
tgtagccccttcgttt

SEQ ID NO: 277745 - DNA, 19 bp, P. troglodytes
tgtagctgggactacaggc

SEQ ID NO: 277746 - DNA, 16 bp, P. troglodytes
tgtagctgggattaca

SEQ ID NO: 277747 - DNA, 16 bp, P. troglodytes
tgtaggaagttccaaa

SEQ ID NO: 277748 - DNA, 16 bp, P. troglodytes
tgtaggcatagttaaa

SEQ ID NO: 277749 - DNA, 16 bp, P. troglodytes
tgtagggacagagtct

SEQ ID NO: 277750 - DNA, 16 bp, P. troglodytes
tgtagggacagggtct

SEQ ID NO: 277751 - DNA, 16 bp, P. troglodytes
tgtagggttattaatt

SEQ ID NO: 277752 - DNA, 16 bp, P. troglodytes
tgtagggttgccagat

SEQ ID NO: 277753 - DNA, 16 bp, P. troglodytes
tgtagggtttctgttg

SEQ ID NO: 277754 - DNA, 16 bp, P. troglodytes
tgtaggttgctttttc

SEQ ID NO: 277755 - DNA, 16 bp, P. troglodytes
tgtaggtttgttacat

SEQ ID NO: 277756 - DNA, 16 bp, P. troglodytes
tgtagtaccagctact

SEQ ID NO: 277757 - DNA, 16 bp, P. troglodytes
tgtagtcccaactact

SEQ ID NO: 277758 - DNA, 16 bp, P. troglodytes
tgtagtcccacctact

SEQ ID NO: 277759 - DNA, 16 bp, P. troglodytes
tgtagtcccagatact

SEQ ID NO: 277760 - DNA, 16 bp, P. troglodytes
tgtagtcccagctaca

SEQ ID NO: 277761 - DNA, 16 bp, P. troglodytes
tgtagtcccagctacc

SEQ ID NO: 277762 - DNA, 16 bp, P. troglodytes
tgtagtcccagctacg

SEQ ID NO: 277763 - DNA, 16 bp, P. troglodytes
tgtagtcccagttact

SEQ ID NO: 277764 - DNA, 16 bp, P. troglodytes
tgtagtccctgctact

SEQ ID NO: 277765 - DNA, 16 bp, P. troglodytes
tgtagtcctagcaact

SEQ ID NO: 277766 - DNA, 16 bp, P. troglodytes
tgtagtcctagctact

SEQ ID NO: 277767 - DNA, 16 bp, P. troglodytes
tgtagtcctagttact

SEQ ID NO: 277768 - DNA, 16 bp, P. troglodytes
tgtagtctcagctact

SEQ ID NO: 277769 - DNA, 16 bp, P. troglodytes
tgtagtcttgtagtat

SEQ ID NO: 277770 - DNA, 17 bp, P. troglodytes
tgtagtcttttatccct

SEQ ID NO: 277771 - DNA, 16 bp, P. troglodytes
tgtagtgagcagagat

SEQ ID NO: 277772 - DNA, 16 bp, P. troglodytes
tgtagtgagccttgat

SEQ ID NO: 277773 - DNA, 16 bp, P. troglodytes
tgtagtgagctgagat

SEQ ID NO: 277774 - DNA, 16 bp, P. troglodytes
tgtagtgcagtggcac

SEQ ID NO: 277775 - DNA, 16 bp, P. troglodytes
tgtagtgccagctact

SEQ ID NO: 277776 - DNA, 16 bp, P. troglodytes
tgtagtgcccttcttt

SEQ ID NO: 277777 - DNA, 17 bp, P. troglodytes
tgtagtggctcacacct

SEQ ID NO: 277778 - DNA, 16 bp, P. troglodytes
tgtagtgtgaaagcag

SEQ ID NO: 277779 - DNA, 16 bp, P. troglodytes
tgtagttccagctact

SEQ ID NO: 277780 - DNA, 16 bp, P. troglodytes
tgtagttccagctcct

SEQ ID NO: 277781 - DNA, 16 bp, P. troglodytes
tgtagttctctttgta

SEQ ID NO: 277782 - DNA, 16 bp, P. troglodytes
tgtataaaaccaagct

SEQ ID NO: 277783 - DNA, 16 bp, P. troglodytes
tgtataaaagtcaagt

SEQ ID NO: 277784 - DNA, 16 bp, P. troglodytes
tgtataaaattatctt

SEQ ID NO: 277785 - DNA, 16 bp, P. troglodytes
tgtataaatggaatca

SEQ ID NO: 277786 - DNA, 16 bp, P. troglodytes
tgtataaatgtatgta

SEQ ID NO: 277787 - DNA, 16 bp, P. troglodytes
tgtataaattactttg

SEQ ID NO: 277788 - DNA, 16 bp, P. troglodytes
tgtataagcattccat

SEQ ID NO: 277789 - DNA, 16 bp, P. troglodytes
tgtataaggtgtaaag

SEQ ID NO: 277790 - DNA, 16 bp, P. troglodytes
tgtataaggtgtatat

SEQ ID NO: 277791 - DNA, 16 bp, P. troglodytes
tgtataatattccatg

SEQ ID NO: 277792 - DNA, 16 bp, P. troglodytes
tgtataatggggataa

SEQ ID NO: 277793 - DNA, 16 bp, P. troglodytes
tgtataatttatgtaa

SEQ ID NO: 277794 - DNA, 16 bp, P. troglodytes
tgtatacaaatattta

SEQ ID NO: 277795 - DNA, 16 bp, P. troglodytes
tgtatacaatttttat

SEQ ID NO: 277796 - DNA, 16 bp, P. troglodytes
tgtatacacatatatt

SEQ ID NO: 277797 - DNA, 16 bp, P. troglodytes
tgtatacacatatgta

SEQ ID NO: 277798 - DNA, 16 bp, P. troglodytes
tgtatacacgtataca

SEQ ID NO: 277799 - DNA, 16 bp, P. troglodytes
tgtatacatacacatt

SEQ ID NO: 277800 - DNA, 16 bp, P. troglodytes
tgtatacatatataca

SEQ ID NO: 277801 - DNA, 16 bp, P. troglodytes
tgtatacatatatttg

SEQ ID NO: 277802 - DNA, 16 bp, P. troglodytes
tgtatacatatgtgta

SEQ ID NO: 277803 - DNA, 16 bp, P. troglodytes
tgtatacatgtctaga

SEQ ID NO: 277804 - DNA, 16 bp, P. troglodytes
tgtatacatgtgcaca

SEQ ID NO: 277805 - DNA, 16 bp, P. troglodytes
tgtatacattttaaaa

SEQ ID NO: 277806 - DNA, 16 bp, P. troglodytes
tgtataccttaaatat

SEQ ID NO: 277807 - DNA, 16 bp, P. troglodytes
tgtatacttaaaaata

SEQ ID NO: 277808 - DNA, 16 bp, P. troglodytes
tgtatacttttttaaa

SEQ ID NO: 277809 - DNA, 16 bp, P. troglodytes
tgtatagaaaagctac

SEQ ID NO: 277810 - DNA, 16 bp, P. troglodytes
tgtatagacatttctc

SEQ ID NO: 277811 - DNA, 16 bp, P. troglodytes
tgtatagcctgcagaa

SEQ ID NO: 277812 - DNA, 16 bp, P. troglodytes
tgtatagtatcttgca

SEQ ID NO: 277813 - DNA, 16 bp, P. troglodytes
tgtatagtatttcatg

SEQ ID NO: 277814 - DNA, 16 bp, P. troglodytes
tgtatataaatatgtg

SEQ ID NO: 277815 - DNA, 16 bp, P. troglodytes
tgtatataatatacat

SEQ ID NO: 277816 - DNA, 16 bp, P. troglodytes
tgtatatacacataga

SEQ ID NO: 277817 - DNA, 16 bp, P. troglodytes
tgtatatacatatata

SEQ ID NO: 277818 - DNA, 16 bp, P. troglodytes
tgtatatacatattat

SEQ ID NO: 277819 - DNA, 16 bp, P. troglodytes
tgtatatacatgtata

SEQ ID NO: 277820 - DNA, 16 bp, P. troglodytes
tgtatatacctgtata

SEQ ID NO: 277821 - DNA, 16 bp, P. troglodytes
tgtatatacttatggg

SEQ ID NO: 277822 - DNA, 16 bp, P. troglodytes
tgtatatagacatata

SEQ ID NO: 277823 - DNA, 16 bp, P. troglodytes
tgtatatagatgtata

SEQ ID NO: 277824 - DNA, 16 bp, P. troglodytes
tgtatatataaacaca

SEQ ID NO: 277825 - DNA, 19 bp, P. troglodytes
tgtatatatatacacacac

SEQ ID NO: 277826 - DNA, 16 bp, P. troglodytes
tgtatatatatccata

SEQ ID NO: 277827 - DNA, 16 bp, P. troglodytes
tgtatatatatgtata

SEQ ID NO: 277828 - DNA, 16 bp, P. troglodytes
tgtatatatctgtata

SEQ ID NO: 277829 - DNA, 16 bp, P. troglodytes
tgtatatatgcatata

SEQ ID NO: 277830 - DNA, 16 bp, P. troglodytes
tgtatatatgccatat

SEQ ID NO: 277831 - DNA, 16 bp, P. troglodytes
tgtatatatgtaaaat

SEQ ID NO: 277832 - DNA, 16 bp, P. troglodytes
tgtatatatgtacata

SEQ ID NO: 277833 - DNA, 16 bp, P. troglodytes
tgtatatatgtataaa

SEQ ID NO: 277834 - DNA, 16 bp, P. troglodytes
tgtatatatgtgtgca

SEQ ID NO: 277835 - DNA, 18 bp, P. troglodytes
tgtatatatgtgtgtata

SEQ ID NO: 277836 - DNA, 16 bp, P. troglodytes
tgtatatatttacggg

SEQ ID NO: 277837 - DNA, 16 bp, P. troglodytes
tgtatatatttatggg

SEQ ID NO: 277838 - DNA, 16 bp, P. troglodytes
tgtatatatttttcca

SEQ ID NO: 277839 - DNA, 16 bp, P. troglodytes
tgtatatatttttgca

SEQ ID NO: 277840 - DNA, 16 bp, P. troglodytes
tgtatatctcctttgg

SEQ ID NO: 277841 - DNA, 16 bp, P. troglodytes
tgtatatctgcttttg

SEQ ID NO: 277842 - DNA, 16 bp, P. troglodytes
tgtatatctgtatata

SEQ ID NO: 277843 - DNA, 16 bp, P. troglodytes
tgtatatctttggaga

SEQ ID NO: 277844 - DNA, 16 bp, P. troglodytes
tgtatatgtaatatat

SEQ ID NO: 277845 - DNA, 16 bp, P. troglodytes
tgtatatgtaatgtat

SEQ ID NO: 277846 - DNA, 16 bp, P. troglodytes
tgtatatgtactgcat

SEQ ID NO: 277847 - DNA, 16 bp, P. troglodytes
tgtatatgtatacata

SEQ ID NO: 277848 - DNA, 16 bp, P. troglodytes
tgtatatgtgtatata

SEQ ID NO: 277849 - DNA, 16 bp, P. troglodytes
tgtatatgtgtatgtt

SEQ ID NO: 277850 - DNA, 16 bp, P. troglodytes
tgtatatgtgtggtgt

SEQ ID NO: 277851 - DNA, 16 bp, P. troglodytes
tgtatatgtgtgtata

SEQ ID NO: 277852 - DNA, 16 bp, P. troglodytes
tgtatatgtgtgttta

SEQ ID NO: 277853 - DNA, 16 bp, P. troglodytes
tgtatatgttcagtac

SEQ ID NO: 277854 - DNA, 16 bp, P. troglodytes
tgtatatgtttatgta

SEQ ID NO: 277855 - DNA, 16 bp, P. troglodytes
tgtatattacatatat

SEQ ID NO: 277856 - DNA, 16 bp, P. troglodytes
tgtatattctatgggt

SEQ ID NO: 277857 - DNA, 16 bp, P. troglodytes
tgtatattctgtatat

SEQ ID NO: 277858 - DNA, 16 bp, P. troglodytes
tgtatattgtgttgat

SEQ ID NO: 277859 - DNA, 16 bp, P. troglodytes
tgtatatttaagaaaa

SEQ ID NO: 277860 - DNA, 16 bp, P. troglodytes
tgtatatttatgggat

SEQ ID NO: 277861 - DNA, 16 bp, P. troglodytes
tgtatatttcaaaaga

SEQ ID NO: 277862 - DNA, 16 bp, P. troglodytes
tgtatattttaaaaga

SEQ ID NO: 277863 - DNA, 16 bp, P. troglodytes
tgtatattttaatgaa

SEQ ID NO: 277864 - DNA, 16 bp, P. troglodytes
tgtatattttacattt

SEQ ID NO: 277865 - DNA, 16 bp, P. troglodytes
tgtatattttcaaaaa

SEQ ID NO: 277866 - DNA, 16 bp, P. troglodytes
tgtatattttccattt

SEQ ID NO: 277867 - DNA, 16 bp, P. troglodytes
tgtatattttctttgg

SEQ ID NO: 277868 - DNA, 16 bp, P. troglodytes
tgtatattttgcagtt

SEQ ID NO: 277869 - DNA, 16 bp, P. troglodytes
tgtatatttttcaaaa

SEQ ID NO: 277870 - DNA, 16 bp, P. troglodytes
tgtatatttttcttaa

SEQ ID NO: 277871 - DNA, 16 bp, P. troglodytes
tgtatattttttgaga

SEQ ID NO: 277872 - DNA, 16 bp, P. troglodytes
tgtatcaaaacatcac

SEQ ID NO: 277873 - DNA, 16 bp, P. troglodytes
tgtatcaaaagcctta

SEQ ID NO: 277874 - DNA, 16 bp, P. troglodytes
tgtatcaaaatatgtc

SEQ ID NO: 277875 - DNA, 16 bp, P. troglodytes
tgtatcaatttacatt

SEQ ID NO: 277876 - DNA, 16 bp, P. troglodytes
tgtatcataatttatt

SEQ ID NO: 277877 - DNA, 16 bp, P. troglodytes
tgtatcccaacacttt

SEQ ID NO: 277878 - DNA, 16 bp, P. troglodytes
tgtatccccaaaatat

SEQ ID NO: 277879 - DNA, 16 bp, P. troglodytes
tgtatccccagagcct

SEQ ID NO: 277880 - DNA, 16 bp, P. troglodytes
tgtatccccagtgcct

SEQ ID NO: 277881 - DNA, 16 bp, P. troglodytes
tgtatcctgcaaattt

SEQ ID NO: 277882 - DNA, 16 bp, P. troglodytes
tgtatccttcagtcca

SEQ ID NO: 277883 - DNA, 16 bp, P. troglodytes
tgtatcctttaaaata

SEQ ID NO: 277884 - DNA, 16 bp, P. troglodytes
tgtatctaaaaaataa

SEQ ID NO: 277885 - DNA, 16 bp, P. troglodytes
tgtatctacaaaaaat

SEQ ID NO: 277886 - DNA, 16 bp, P. troglodytes
tgtatctacaaaaata

SEQ ID NO: 277887 - DNA, 19 bp, P. troglodytes
tgtatctagctcaaggttt

SEQ ID NO: 277888 - DNA, 16 bp, P. troglodytes
tgtatctatgtatcta

SEQ ID NO: 277889 - DNA, 16 bp, P. troglodytes
tgtatctcaataaagc

SEQ ID NO: 277890 - DNA, 16 bp, P. troglodytes
tgtatctgacaaaggt

SEQ ID NO: 277891 - DNA, 16 bp, P. troglodytes
tgtatcttctatttct

SEQ ID NO: 277892 - DNA, 16 bp, P. troglodytes
tgtatcttgaaagtaa

SEQ ID NO: 277893 - DNA, 16 bp, P. troglodytes
tgtatcttgaaatttt

SEQ ID NO: 277894 - DNA, 16 bp, P. troglodytes
tgtatctttaaaaaaa

SEQ ID NO: 277895 - DNA, 16 bp, P. troglodytes
tgtatctttattttca

SEQ ID NO: 277896 - DNA, 16 bp, P. troglodytes
tgtatctttgttttca

SEQ ID NO: 277897 - DNA, 16 bp, P. troglodytes
tgtatctttttaaaaa

SEQ ID NO: 277898 - DNA, 16 bp, P. troglodytes
tgtatctttttaaaat

SEQ ID NO: 277899 - DNA, 16 bp, P. troglodytes
tgtatcttttttggta

SEQ ID NO: 277900 - DNA, 16 bp, P. troglodytes
tgtatgaacagggagt

SEQ ID NO: 277901 - DNA, 16 bp, P. troglodytes
tgtatgaagaaataaa

SEQ ID NO: 277902 - DNA, 16 bp, P. troglodytes
tgtatgagggtgaagt

SEQ ID NO: 277903 - DNA, 16 bp, P. troglodytes
tgtatgagtatgtgtg

SEQ ID NO: 277904 - DNA, 16 bp, P. troglodytes
tgtatgatcatctcaa

SEQ ID NO: 277905 - DNA, 16 bp, P. troglodytes
tgtatgatttttatac

SEQ ID NO: 277906 - DNA, 16 bp, P. troglodytes
tgtatgcaatgtgtaa

SEQ ID NO: 277907 - DNA, 16 bp, P. troglodytes
tgtatgcacacacaca

SEQ ID NO: 277908 - DNA, 16 bp, P. troglodytes
tgtatgcgtgtgtgtg

SEQ ID NO: 277909 - DNA, 16 bp, P. troglodytes
tgtatgctaatgagat

SEQ ID NO: 277910 - DNA, 21 bp, P. troglodytes
tgtatggaaatgcctggatgc

SEQ ID NO: 277911 - DNA, 16 bp, P. troglodytes
tgtatggattatttca

SEQ ID NO: 277912 - DNA, 16 bp, P. troglodytes
tgtatgtaaaactgtt

SEQ ID NO: 277913 - DNA, 16 bp, P. troglodytes
tgtatgtaaatataaa

SEQ ID NO: 277914 - DNA, 16 bp, P. troglodytes
tgtatgtaaatatata

SEQ ID NO: 277915 - DNA, 16 bp, P. troglodytes
tgtatgtaagaaaacc

SEQ ID NO: 277916 - DNA, 16 bp, P. troglodytes
tgtatgtactacattt

SEQ ID NO: 277917 - DNA, 16 bp, P. troglodytes
tgtatgtatacataca

SEQ ID NO: 277918 - DNA, 16 bp, P. troglodytes
tgtatgtatacatata

SEQ ID NO: 277919 - DNA, 16 bp, P. troglodytes
tgtatgtatagatata

SEQ ID NO: 277920 - DNA, 16 bp, P. troglodytes
tgtatgtatatataca

SEQ ID NO: 277921 - DNA, 16 bp, P. troglodytes
tgtatgtatatatatg

SEQ ID NO: 277922 - DNA, 16 bp, P. troglodytes
tgtatgtatatattca

SEQ ID NO: 277923 - DNA, 16 bp, P. troglodytes
tgtatgtatattgtat

SEQ ID NO: 277924 - DNA, 16 bp, P. troglodytes
tgtatgtatctgtgtg

SEQ ID NO: 277925 - DNA, 16 bp, P. troglodytes
tgtatgtatgcacaca

SEQ ID NO: 277926 - DNA, 16 bp, P. troglodytes
tgtatgtatgcatgta

SEQ ID NO: 277927 - DNA, 16 bp, P. troglodytes
tgtatgtatgtgcata

SEQ ID NO: 277928 - DNA, 16 bp, P. troglodytes
tgtatgtatgtgtgtc

SEQ ID NO: 277929 - DNA, 16 bp, P. troglodytes
tgtatgtatgtgtgtg

SEQ ID NO: 277930 - DNA, 16 bp, P. troglodytes
tgtatgtatttaaaat

SEQ ID NO: 277931 - DNA, 16 bp, P. troglodytes
tgtatgtatttaccat

SEQ ID NO: 277932 - DNA, 16 bp, P. troglodytes
tgtatgtatttatggt

SEQ ID NO: 277933 - DNA, 16 bp, P. troglodytes
tgtatgtattttacca

SEQ ID NO: 277934 - DNA, 16 bp, P. troglodytes
tgtatgtctatatgtg

SEQ ID NO: 277935 - DNA, 16 bp, P. troglodytes
tgtatgtctgtgtatg

SEQ ID NO: 277936 - DNA, 16 bp, P. troglodytes
tgtatgtctgtgtctg

SEQ ID NO: 277937 - DNA, 16 bp, P. troglodytes
tgtatgtctgtttttg

SEQ ID NO: 277938 - DNA, 16 bp, P. troglodytes
tgtatgtcttcttttg

SEQ ID NO: 277939 - DNA, 16 bp, P. troglodytes
tgtatgtgaatattca

SEQ ID NO: 277940 - DNA, 16 bp, P. troglodytes
tgtatgtgaatgttta

SEQ ID NO: 277941 - DNA, 16 bp, P. troglodytes
tgtatgtgattgtgtg

SEQ ID NO: 277942 - DNA, 16 bp, P. troglodytes
tgtatgtgcatgtgta

SEQ ID NO: 277943 - DNA, 16 bp, P. troglodytes
tgtatgtgccacattt

SEQ ID NO: 277944 - DNA, 16 bp, P. troglodytes
tgtatgtgtatatgca

SEQ ID NO: 277945 - DNA, 16 bp, P. troglodytes
tgtatgtgtatctata

SEQ ID NO: 277946 - DNA, 16 bp, P. troglodytes
tgtatgtgtatgcata

SEQ ID NO: 277947 - DNA, 16 bp, P. troglodytes
tgtatgtgtatttata

SEQ ID NO: 277948 - DNA, 16 bp, P. troglodytes
tgtatgtgtcgaggaa

SEQ ID NO: 277949 - DNA, 16 bp, P. troglodytes
tgtatgtgtctgtgtg

SEQ ID NO: 277950 - DNA, 16 bp, P. troglodytes
tgtatgtgtgaatgtg

SEQ ID NO: 277951 - DNA, 16 bp, P. troglodytes
tgtatgtgtgcctgtg

SEQ ID NO: 277952 - DNA, 16 bp, P. troglodytes
tgtatgtgtgtacatg

SEQ ID NO: 277953 - DNA, 16 bp, P. troglodytes
tgtatgtgtgtatata

SEQ ID NO: 277954 - DNA, 16 bp, P. troglodytes
tgtatgtgtgtctttg

SEQ ID NO: 277955 - DNA, 16 bp, P. troglodytes
tgtatgttatgtatat

SEQ ID NO: 277956 - DNA, 16 bp, P. troglodytes
tgtatgtttaactttt

SEQ ID NO: 277957 - DNA, 16 bp, P. troglodytes
tgtatgtttacatata

SEQ ID NO: 277958 - DNA, 16 bp, P. troglodytes
tgtatgtttgtatata

SEQ ID NO: 277959 - DNA, 16 bp, P. troglodytes
tgtatgttttcagaaa

SEQ ID NO: 277960 - DNA, 16 bp, P. troglodytes
tgtattaaatgcattt

SEQ ID NO: 277961 - DNA, 16 bp, P. troglodytes
tgtattaattttctat

SEQ ID NO: 277962 - DNA, 16 bp, P. troglodytes
tgtattactttttaaa

SEQ ID NO: 277963 - DNA, 16 bp, P. troglodytes
tgtattaggccgttct

SEQ ID NO: 277964 - DNA, 16 bp, P. troglodytes
tgtattagtccattct

SEQ ID NO: 277965 - DNA, 16 bp, P. troglodytes
tgtattagttcatttt

SEQ ID NO: 277966 - DNA, 16 bp, P. troglodytes
tgtattagttcgttct

SEQ ID NO: 277967 - DNA, 16 bp, P. troglodytes
tgtattagtttcctag

SEQ ID NO: 277968 - DNA, 16 bp, P. troglodytes
tgtattatgtatgtat

SEQ ID NO: 277969 - DNA, 16 bp, P. troglodytes
tgtattatgtgtatat

SEQ ID NO: 277970 - DNA, 16 bp, P. troglodytes
tgtattatttcttaca

SEQ ID NO: 277971 - DNA, 16 bp, P. troglodytes
tgtattattttcttaa

SEQ ID NO: 277972 - DNA, 16 bp, P. troglodytes
tgtattcaggaaacct

SEQ ID NO: 277973 - DNA, 16 bp, P. troglodytes
tgtattcattcagcaa

SEQ ID NO: 277974 - DNA, 16 bp, P. troglodytes
tgtattcatttattca

SEQ ID NO: 277975 - DNA, 16 bp, P. troglodytes
tgtattcatttgttct

SEQ ID NO: 277976 - DNA, 16 bp, P. troglodytes
tgtattcatttttaaa

SEQ ID NO: 277977 - DNA, 16 bp, P. troglodytes
tgtattccagcctggg

SEQ ID NO: 277978 - DNA, 16 bp, P. troglodytes
tgtattccagtctggg

SEQ ID NO: 277979 - DNA, 16 bp, P. troglodytes
tgtattcccagcactc

SEQ ID NO: 277980 - DNA, 16 bp, P. troglodytes
tgtattcccagctact

SEQ ID NO: 277981 - DNA, 16 bp, P. troglodytes
tgtattctgaaacttt

SEQ ID NO: 277982 - DNA, 16 bp, P. troglodytes
tgtattcttgaaaact

SEQ ID NO: 277983 - DNA, 16 bp, P. troglodytes
tgtattgctttttaat

SEQ ID NO: 277984 - DNA, 16 bp, P. troglodytes
tgtattggtcaggctg

SEQ ID NO: 277985 - DNA, 16 bp, P. troglodytes
tgtattggttattcta

SEQ ID NO: 277986 - DNA, 16 bp, P. troglodytes
tgtatttaaaaataca

SEQ ID NO: 277987 - DNA, 16 bp, P. troglodytes
tgtatttaaagcattt

SEQ ID NO: 277988 - DNA, 16 bp, P. troglodytes
tgtatttactgtattt

SEQ ID NO: 277989 - DNA, 16 bp, P. troglodytes
tgtatttagaaaaccc

SEQ ID NO: 277990 - DNA, 16 bp, P. troglodytes
tgtatttaggaagtaa

SEQ ID NO: 277991 - DNA, 16 bp, P. troglodytes
tgtatttatatttcat

SEQ ID NO: 277992 - DNA, 16 bp, P. troglodytes
tgtatttatcagcagt

SEQ ID NO: 277993 - DNA, 16 bp, P. troglodytes
tgtatttattcaataa

SEQ ID NO: 277994 - DNA, 16 bp, P. troglodytes
tgtatttcaaaatttt

SEQ ID NO: 277995 - DNA, 16 bp, P. troglodytes
tgtatttcaaggattt

SEQ ID NO: 277996 - DNA, 16 bp, P. troglodytes
tgtatttcagtatttt

SEQ ID NO: 277997 - DNA, 16 bp, P. troglodytes
tgtatttcctgaaatt

SEQ ID NO: 277998 - DNA, 16 bp, P. troglodytes
tgtatttcctttctct

SEQ ID NO: 277999 - DNA, 16 bp, P. troglodytes
tgtatttccttttctg

SEQ ID NO: 278000 - DNA, 16 bp, P. troglodytes
tgtatttctataaata

SEQ ID NO: 278001 - DNA, 16 bp, P. troglodytes
tgtatttctccttgaa

SEQ ID NO: 278002 - DNA, 16 bp, P. troglodytes
tgtatttcttagtaga

SEQ ID NO: 278003 - DNA, 16 bp, P. troglodytes
tgtatttctttaaaaa

SEQ ID NO: 278004 - DNA, 16 bp, P. troglodytes
tgtatttctttataaa

SEQ ID NO: 278005 - DNA, 16 bp, P. troglodytes
tgtatttctttgtaga

SEQ ID NO: 278006 - DNA, 16 bp, P. troglodytes
tgtatttgattcttct

SEQ ID NO: 278007 - DNA, 16 bp, P. troglodytes
tgtatttgcatgtttt

SEQ ID NO: 278008 - DNA, 16 bp, P. troglodytes
tgtatttggatgtcta

SEQ ID NO: 278009 - DNA, 16 bp, P. troglodytes
tgtatttgtttcctag

SEQ ID NO: 278010 - DNA, 16 bp, P. troglodytes
tgtattttaaaagatt

SEQ ID NO: 278011 - DNA, 16 bp, P. troglodytes
tgtattttaagtaaag

SEQ ID NO: 278012 - DNA, 16 bp, P. troglodytes
tgtattttaataaaga

SEQ ID NO: 278013 - DNA, 16 bp, P. troglodytes
tgtattttatacttga

SEQ ID NO: 278014 - DNA, 16 bp, P. troglodytes
tgtattttatctggca

SEQ ID NO: 278015 - DNA, 16 bp, P. troglodytes
tgtattttcagcagag

SEQ ID NO: 278016 - DNA, 16 bp, P. troglodytes
tgtattttccaaatgt

SEQ ID NO: 278017 - DNA, 16 bp, P. troglodytes
tgtattttctcatagt

SEQ ID NO: 278018 - DNA, 16 bp, P. troglodytes
tgtattttctccataa

SEQ ID NO: 278019 - DNA, 16 bp, P. troglodytes
tgtattttcttacagt

SEQ ID NO: 278020 - DNA, 16 bp, P. troglodytes
tgtattttgatagaga

SEQ ID NO: 278021 - DNA, 16 bp, P. troglodytes
tgtattttgcagctgt

SEQ ID NO: 278022 - DNA, 16 bp, P. troglodytes
tgtatttttaaagaaa

SEQ ID NO: 278023 - DNA, 16 bp, P. troglodytes
tgtatttttaaagatg

SEQ ID NO: 278024 - DNA, 16 bp, P. troglodytes
tgtatttttaataaag

SEQ ID NO: 278025 - DNA, 16 bp, P. troglodytes
tgtatttttaatggaa

SEQ ID NO: 278026 - DNA, 16 bp, P. troglodytes
tgtatttttacaaaat

SEQ ID NO: 278027 - DNA, 16 bp, P. troglodytes
tgtatttttactatac

SEQ ID NO: 278028 - DNA, 17 bp, P. troglodytes
tgtatttttagaagaga

SEQ ID NO: 278029 - DNA, 16 bp, P. troglodytes
tgtatttttagtaaga

SEQ ID NO: 278030 - DNA, 16 bp, P. troglodytes
tgtatttttagtgaga

SEQ ID NO: 278031 - DNA, 16 bp, P. troglodytes
tgtatttttcaaatgt

SEQ ID NO: 278032 - DNA, 17 bp, P. troglodytes
tgtatttttcatagaga

SEQ ID NO: 278033 - DNA, 16 bp, P. troglodytes
tgtattttttatctca

SEQ ID NO: 278034 - DNA, 20 bp, P. troglodytes
tgtattttttgtagagacaa

SEQ ID NO: 278035 - DNA, 16 bp, P. troglodytes
tgtatttttttcaaat

SEQ ID NO: 278036 - DNA, 16 bp, P. troglodytes
tgtatttttttccaaa

SEQ ID NO: 278037 - DNA, 16 bp, P. troglodytes
tgtcaaaaaatatatt

SEQ ID NO: 278038 - DNA, 16 bp, P. troglodytes
tgtcaaaaatgtcaaa

SEQ ID NO: 278039 - DNA, 16 bp, P. troglodytes
tgtcaaaaattaattg

SEQ ID NO: 278040 - DNA, 16 bp, P. troglodytes
tgtcaaaagacaaaga

SEQ ID NO: 278041 - DNA, 16 bp, P. troglodytes
tgtcaaaattcattga

SEQ ID NO: 278042 - DNA, 16 bp, P. troglodytes
tgtcaaaggtcagatg

SEQ ID NO: 278043 - DNA, 16 bp, P. troglodytes
tgtcaaatatcaaatg

SEQ ID NO: 278044 - DNA, 21 bp, P. troglodytes
tgtcaacattagacagatcca

SEQ ID NO: 278045 - DNA, 16 bp, P. troglodytes
tgtcaagaagagtatt

SEQ ID NO: 278046 - DNA, 16 bp, P. troglodytes
tgtcaagatcagatgg

SEQ ID NO: 278047 - DNA, 16 bp, P. troglodytes
tgtcaagatttttttt

SEQ ID NO: 278048 - DNA, 16 bp, P. troglodytes
tgtcaaggaatttatc

SEQ ID NO: 278049 - DNA, 16 bp, P. troglodytes
tgtcaaggctgcagtg

SEQ ID NO: 278050 - DNA, 16 bp, P. troglodytes
tgtcaagttttggtat

SEQ ID NO: 278051 - DNA, 16 bp, P. troglodytes
tgtcaataaaatattt

SEQ ID NO: 278052 - DNA, 16 bp, P. troglodytes
tgtcaatcatacctca

SEQ ID NO: 278053 - DNA, 16 bp, P. troglodytes
tgtcaattaaaaataa

SEQ ID NO: 278054 - DNA, 16 bp, P. troglodytes
tgtcaattgcattttt

SEQ ID NO: 278055 - DNA, 16 bp, P. troglodytes
tgtcaatttaaaaatt

SEQ ID NO: 278056 - DNA, 16 bp, P. troglodytes
tgtcaatttttgcctt

SEQ ID NO: 278057 - DNA, 16 bp, P. troglodytes
tgtcacaaaataattt

SEQ ID NO: 278058 - DNA, 16 bp, P. troglodytes
tgtcacaaatggcaag

SEQ ID NO: 278059 - DNA, 16 bp, P. troglodytes
tgtcacaagaacagca

SEQ ID NO: 278060 - DNA, 16 bp, P. troglodytes
tgtcacaagacatcct

SEQ ID NO: 278061 - DNA, 16 bp, P. troglodytes
tgtcacaatcacagct

SEQ ID NO: 278062 - DNA, 16 bp, P. troglodytes
tgtcacagaaaaaaaa

SEQ ID NO: 278063 - DNA, 16 bp, P. troglodytes
tgtcacagagattctg

SEQ ID NO: 278064 - DNA, 16 bp, P. troglodytes
tgtcacagctcataaa

SEQ ID NO: 278065 - DNA, 16 bp, P. troglodytes
tgtcacatggtgacag

SEQ ID NO: 278066 - DNA, 16 bp, P. troglodytes
tgtcacattttgttta

SEQ ID NO: 278067 - DNA, 16 bp, P. troglodytes
tgtcaccaaagctgga

SEQ ID NO: 278068 - DNA, 16 bp, P. troglodytes
tgtcaccacatccagc

SEQ ID NO: 278069 - DNA, 16 bp, P. troglodytes
tgtcaccaccagccct

SEQ ID NO: 278070 - DNA, 16 bp, P. troglodytes
tgtcaccactcctatt

SEQ ID NO: 278071 - DNA, 17 bp, P. troglodytes
tgtcaccaggctggagg

SEQ ID NO: 278072 - DNA, 16 bp, P. troglodytes
tgtcaccagggctgga

SEQ ID NO: 278073 - DNA, 16 bp, P. troglodytes
tgtcaccagtggaggc

SEQ ID NO: 278074 - DNA, 16 bp, P. troglodytes
tgtcacccaagcagga

SEQ ID NO: 278075 - DNA, 16 bp, P. troglodytes
tgtcacccaagctgga

SEQ ID NO: 278076 - DNA, 16 bp, P. troglodytes
tgtcacccagactgga

SEQ ID NO: 278077 - DNA, 16 bp, P. troglodytes
tgtcacccagctggag

SEQ ID NO: 278078 - DNA, 16 bp, P. troglodytes
tgtcacccaggctgaa

SEQ ID NO: 278079 - DNA, 16 bp, P. troglodytes
tgtcacccaggctggt

SEQ ID NO: 278080 - DNA, 16 bp, P. troglodytes
tgtcaccctgtcaccc

SEQ ID NO: 278081 - DNA, 16 bp, P. troglodytes
tgtcacctaagctgga

SEQ ID NO: 278082 - DNA, 16 bp, P. troglodytes
tgtcacctccccagag

SEQ ID NO: 278083 - DNA, 16 bp, P. troglodytes
tgtcaccttgggcaag

SEQ ID NO: 278084 - DNA, 16 bp, P. troglodytes
tgtcacgcaggctgga

SEQ ID NO: 278085 - DNA, 16 bp, P. troglodytes
tgtcactatctcagcc

SEQ ID NO: 278086 - DNA, 16 bp, P. troglodytes
tgtcactcagggtgga

SEQ ID NO: 278087 - DNA, 16 bp, P. troglodytes
tgtcactccaccccca

SEQ ID NO: 278088 - DNA, 16 bp, P. troglodytes
tgtcactgtgctccag

SEQ ID NO: 278089 - DNA, 16 bp, P. troglodytes
tgtcactgtgtctgtg

SEQ ID NO: 278090 - DNA, 16 bp, P. troglodytes
tgtcagaaaaatagaa

SEQ ID NO: 278091 - DNA, 16 bp, P. troglodytes
tgtcagaaagaaagaa

SEQ ID NO: 278092 - DNA, 16 bp, P. troglodytes
tgtcagaaagagaaaa

SEQ ID NO: 278093 - DNA, 16 bp, P. troglodytes
tgtcagactcaccaaa

SEQ ID NO: 278094 - DNA, 16 bp, P. troglodytes
tgtcagataaaacaga

SEQ ID NO: 278095 - DNA, 16 bp, P. troglodytes
tgtcagatggagatga

SEQ ID NO: 278096 - DNA, 16 bp, P. troglodytes
tgtcagatttttaaaa

SEQ ID NO: 278097 - DNA, 16 bp, P. troglodytes
tgtcagcatttccatt

SEQ ID NO: 278098 - DNA, 18 bp, P. troglodytes
tgtcagccaggatggtct

SEQ ID NO: 278099 - DNA, 16 bp, P. troglodytes
tgtcaggaaaagaaaa

SEQ ID NO: 278100 - DNA, 16 bp, P. troglodytes
tgtcaggaaagacaat

SEQ ID NO: 278101 - DNA, 16 bp, P. troglodytes
tgtcaggcactgggct

SEQ ID NO: 278102 - DNA, 16 bp, P. troglodytes
tgtcaggcactgtcct

SEQ ID NO: 278103 - DNA, 22 bp, P. troglodytes
tgtcaggcctctgagcccaagc

SEQ ID NO: 278104 - DNA, 16 bp, P. troglodytes
tgtcaggctctgtgct

SEQ ID NO: 278105 - DNA, 16 bp, P. troglodytes
tgtcaggtactgtgct

SEQ ID NO: 278106 - DNA, 18 bp, P. troglodytes
tgtcagtctgcccctact

SEQ ID NO: 278107 - DNA, 16 bp, P. troglodytes
tgtcagtgattgaaga

SEQ ID NO: 278108 - DNA, 16 bp, P. troglodytes
tgtcagtgtaaacaag

SEQ ID NO: 278109 - DNA, 16 bp, P. troglodytes
tgtcagttaaaaataa

SEQ ID NO: 278110 - DNA, 16 bp, P. troglodytes
tgtcagtttttaaatt

SEQ ID NO: 278111 - DNA, 16 bp, P. troglodytes
tgtcataaataaataa

SEQ ID NO: 278112 - DNA, 16 bp, P. troglodytes
tgtcataattaatgaa

SEQ ID NO: 278113 - DNA, 16 bp, P. troglodytes
tgtcatatctaaaaaa

SEQ ID NO: 278114 - DNA, 16 bp, P. troglodytes
tgtcatattattttta

SEQ ID NO: 278115 - DNA, 16 bp, P. troglodytes
tgtcatatttaagaat

SEQ ID NO: 278116 - DNA, 16 bp, P. troglodytes
tgtcatcaggaaaatg

SEQ ID NO: 278117 - DNA, 16 bp, P. troglodytes
tgtcatcatcatcacc

SEQ ID NO: 278118 - DNA, 16 bp, P. troglodytes
tgtcatcatcattatc

SEQ ID NO: 278119 - DNA, 16 bp, P. troglodytes
tgtcatccacagacaa

SEQ ID NO: 278120 - DNA, 16 bp, P. troglodytes
tgtcatccaggctaga

SEQ ID NO: 278121 - DNA, 16 bp, P. troglodytes
tgtcatccaggctgaa

SEQ ID NO: 278122 - DNA, 16 bp, P. troglodytes
tgtcatccaggctttg

SEQ ID NO: 278123 - DNA, 16 bp, P. troglodytes
tgtcatcccaccactt

SEQ ID NO: 278124 - DNA, 16 bp, P. troglodytes
tgtcatcccagctact

SEQ ID NO: 278125 - DNA, 16 bp, P. troglodytes
tgtcatcccagctgct

SEQ ID NO: 278126 - DNA, 16 bp, P. troglodytes
tgtcatctatgacttc

SEQ ID NO: 278127 - DNA, 16 bp, P. troglodytes
tgtcatctgcaaataa

SEQ ID NO: 278128 - DNA, 16 bp, P. troglodytes
tgtcatctgcacacag

SEQ ID NO: 278129 - DNA, 16 bp, P. troglodytes
tgtcatctgtaaaatg

SEQ ID NO: 278130 - DNA, 16 bp, P. troglodytes
tgtcatggagctggtg

SEQ ID NO: 278131 - DNA, 16 bp, P. troglodytes
tgtcatgggggtttgt

SEQ ID NO: 278132 - DNA, 16 bp, P. troglodytes
tgtcatggggtcgggg

SEQ ID NO: 278133 - DNA, 16 bp, P. troglodytes
tgtcatggtgctggta

SEQ ID NO: 278134 - DNA, 16 bp, P. troglodytes
tgtcatggtgctggtg

SEQ ID NO: 278135 - DNA, 16 bp, P. troglodytes
tgtcatgttttcttgc

SEQ ID NO: 278136 - DNA, 16 bp, P. troglodytes
tgtcattaattttgga

SEQ ID NO: 278137 - DNA, 16 bp, P. troglodytes
tgtcattattccctaa

SEQ ID NO: 278138 - DNA, 16 bp, P. troglodytes
tgtcattcagaaatac

SEQ ID NO: 278139 - DNA, 28 bp, P. troglodytes
tgtcattgataacatcttatcaggagac

SEQ ID NO: 278140 - DNA, 16 bp, P. troglodytes
tgtcattgtctggttt

SEQ ID NO: 278141 - DNA, 16 bp, P. troglodytes
tgtcattgtggtcctc

SEQ ID NO: 278142 - DNA, 16 bp, P. troglodytes
tgtcatttcatttatt

SEQ ID NO: 278143 - DNA, 16 bp, P. troglodytes
tgtccaaagtcacaca

SEQ ID NO: 278144 - DNA, 16 bp, P. troglodytes
tgtccaaagtcacatg

SEQ ID NO: 278145 - DNA, 16 bp, P. troglodytes
tgtccaacaagtccca

SEQ ID NO: 278146 - DNA, 16 bp, P. troglodytes
tgtccaacatggtaaa

SEQ ID NO: 278147 - DNA, 16 bp, P. troglodytes
tgtccaagaatttatc

SEQ ID NO: 278148 - DNA, 16 bp, P. troglodytes
tgtccaagatcacaga

SEQ ID NO: 278149 - DNA, 16 bp, P. troglodytes
tgtccaagccccacct

SEQ ID NO: 278150 - DNA, 16 bp, P. troglodytes
tgtccaaggtcacaga

SEQ ID NO: 278151 - DNA, 16 bp, P. troglodytes
tgtccaaggtcacata

SEQ ID NO: 278152 - DNA, 16 bp, P. troglodytes
tgtccaaggtcacatg

SEQ ID NO: 278153 - DNA, 16 bp, P. troglodytes
tgtccaattttttggc

SEQ ID NO: 278154 - DNA, 16 bp, P. troglodytes
tgtccacacaaaggtt

SEQ ID NO: 278155 - DNA, 16 bp, P. troglodytes
tgtccactccagaccc

SEQ ID NO: 278156 - DNA, 36 bp, P. troglodytes
tgtccactggacagggggcccttccctgcctggcag

SEQ ID NO: 278157 - DNA, 16 bp, P. troglodytes
tgtccagaatctacaa

SEQ ID NO: 278158 - DNA, 16 bp, P. troglodytes
tgtccagaatggtatt

SEQ ID NO: 278159 - DNA, 16 bp, P. troglodytes
tgtccagactggtctt

SEQ ID NO: 278160 - DNA, 18 bp, P. troglodytes
tgtccagagtttgttcct

SEQ ID NO: 278161 - DNA, 16 bp, P. troglodytes
tgtccagcctggtctc

SEQ ID NO: 278162 - DNA, 16 bp, P. troglodytes
tgtccagctaattttt

SEQ ID NO: 278163 - DNA, 16 bp, P. troglodytes
tgtccaggaccagaca

SEQ ID NO: 278164 - DNA, 16 bp, P. troglodytes
tgtccaggctggactc

SEQ ID NO: 278165 - DNA, 16 bp, P. troglodytes
tgtccaggctggagta

SEQ ID NO: 278166 - DNA, 16 bp, P. troglodytes
tgtccagtgatgatga

SEQ ID NO: 278167 - DNA, 16 bp, P. troglodytes
tgtccatctacagatg

SEQ ID NO: 278168 - DNA, 16 bp, P. troglodytes
tgtccatctgtctgtc

SEQ ID NO: 278169 - DNA, 16 bp, P. troglodytes
tgtccattctgcaaat

SEQ ID NO: 278170 - DNA, 16 bp, P. troglodytes
tgtcccacattttcct

SEQ ID NO: 278171 - DNA, 16 bp, P. troglodytes
tgtcccagccctgcaa

SEQ ID NO: 278172 - DNA, 16 bp, P. troglodytes
tgtcccagctccagga

SEQ ID NO: 278173 - DNA, 16 bp, P. troglodytes
tgtcccaggcactgtg

SEQ ID NO: 278174 - DNA, 16 bp, P. troglodytes
tgtccccacccaaact

SEQ ID NO: 278175 - DNA, 16 bp, P. troglodytes
tgtccccacccacatc

SEQ ID NO: 278176 - DNA, 16 bp, P. troglodytes
tgtccccagacattgc

SEQ ID NO: 278177 - DNA, 16 bp, P. troglodytes
tgtccccagggcatgt

SEQ ID NO: 278178 - DNA, 16 bp, P. troglodytes
tgtccccataaacttt

SEQ ID NO: 278179 - DNA, 17 bp, P. troglodytes
tgtccccatccaaatct

SEQ ID NO: 278180 - DNA, 16 bp, P. troglodytes
tgtcccccaagctgga

SEQ ID NO: 278181 - DNA, 16 bp, P. troglodytes
tgtcccccacccccaa

SEQ ID NO: 278182 - DNA, 16 bp, P. troglodytes
tgtcccccaccccctg

SEQ ID NO: 278183 - DNA, 16 bp, P. troglodytes
tgtcccccagcctgga

SEQ ID NO: 278184 - DNA, 17 bp, P. troglodytes
tgtcccccaggctggac

SEQ ID NO: 278185 - DNA, 16 bp, P. troglodytes
tgtcccccaggggaca

SEQ ID NO: 278186 - DNA, 16 bp, P. troglodytes
tgtccccctggctgga

SEQ ID NO: 278187 - DNA, 16 bp, P. troglodytes
tgtcccctaggctgga

SEQ ID NO: 278188 - DNA, 16 bp, P. troglodytes
tgtcccctctgaaact

SEQ ID NO: 278189 - DNA, 16 bp, P. troglodytes
tgtccctgcaaaattc

SEQ ID NO: 278190 - DNA, 17 bp, P. troglodytes
tgtccctgcaaagggca

SEQ ID NO: 278191 - DNA, 17 bp, P. troglodytes
tgtccctgcccaaatct

SEQ ID NO: 278192 - DNA, 16 bp, P. troglodytes
tgtccctgtggctttg

SEQ ID NO: 278193 - DNA, 17 bp, P. troglodytes
tgtccctgtttgcagaa

SEQ ID NO: 278194 - DNA, 16 bp, P. troglodytes
tgtcctagctacttgg

SEQ ID NO: 278195 - DNA, 16 bp, P. troglodytes
tgtcctcaaagttcat

SEQ ID NO: 278196 - DNA, 16 bp, P. troglodytes
tgtcctcatccaaatc

SEQ ID NO: 278197 - DNA, 16 bp, P. troglodytes
tgtcctcatctcctct

SEQ ID NO: 278198 - DNA, 16 bp, P. troglodytes
tgtcctcattttacag

SEQ ID NO: 278199 - DNA, 16 bp, P. troglodytes
tgtcctccaggttcac

SEQ ID NO: 278200 - DNA, 16 bp, P. troglodytes
tgtcctgcctcagctt

SEQ ID NO: 278201 - DNA, 16 bp, P. troglodytes
tgtcctgctggatttt

SEQ ID NO: 278202 - DNA, 16 bp, P. troglodytes
tgtcctgggctgcatg

SEQ ID NO: 278203 - DNA, 16 bp, P. troglodytes
tgtcctgtcctgtcct

SEQ ID NO: 278204 - DNA, 16 bp, P. troglodytes
tgtccttaaggcacag

SEQ ID NO: 278205 - DNA, 16 bp, P. troglodytes
tgtccttaaggttcat

SEQ ID NO: 278206 - DNA, 16 bp, P. troglodytes
tgtccttacaggtgaa

SEQ ID NO: 278207 - DNA, 16 bp, P. troglodytes
tgtccttataaaaggg

SEQ ID NO: 278208 - DNA, 16 bp, P. troglodytes
tgtccttatatttaaa

SEQ ID NO: 278209 - DNA, 16 bp, P. troglodytes
tgtccttcagggatgt

SEQ ID NO: 278210 - DNA, 16 bp, P. troglodytes
tgtccttcattctttt

SEQ ID NO: 278211 - DNA, 16 bp, P. troglodytes
tgtccttgatttccag

SEQ ID NO: 278212 - DNA, 16 bp, P. troglodytes
tgtccttgcagggaca

SEQ ID NO: 278213 - DNA, 16 bp, P. troglodytes
tgtccttgttctcatt

SEQ ID NO: 278214 - DNA, 16 bp, P. troglodytes
tgtcctttccccactt

SEQ ID NO: 278215 - DNA, 16 bp, P. troglodytes
tgtcctttctccagtg

SEQ ID NO: 278216 - DNA, 16 bp, P. troglodytes
tgtcctttgcagcagc

SEQ ID NO: 278217 - DNA, 16 bp, P. troglodytes
tgtcctttgcccacct

SEQ ID NO: 278218 - DNA, 16 bp, P. troglodytes
tgtccttttgtgactg

SEQ ID NO: 278219 - DNA, 16 bp, P. troglodytes
tgtccttttgtgtctg

SEQ ID NO: 278220 - DNA, 17 bp, P. troglodytes
tgtcgcccagactggaa

SEQ ID NO: 278221 - DNA, 16 bp, P. troglodytes
tgtcgcccagactggt

SEQ ID NO: 278222 - DNA, 16 bp, P. troglodytes
tgtcgcccagctggag

SEQ ID NO: 278223 - DNA, 16 bp, P. troglodytes
tgtcgcccaggcggga

SEQ ID NO: 278224 - DNA, 16 bp, P. troglodytes
tgtcgcccaggctaca

SEQ ID NO: 278225 - DNA, 16 bp, P. troglodytes
tgtcgcccaggctggt

SEQ ID NO: 278226 - DNA, 16 bp, P. troglodytes
tgtcgtccaggctggt

SEQ ID NO: 278227 - DNA, 16 bp, P. troglodytes
tgtctaaaaaatatat

SEQ ID NO: 278228 - DNA, 16 bp, P. troglodytes
tgtctaaaaacaaaaa

SEQ ID NO: 278229 - DNA, 16 bp, P. troglodytes
tgtctaaacatagaaa

SEQ ID NO: 278230 - DNA, 16 bp, P. troglodytes
tgtctaagaaatcttt

SEQ ID NO: 278231 - DNA, 16 bp, P. troglodytes
tgtctaaggtcacaca

SEQ ID NO: 278232 - DNA, 16 bp, P. troglodytes
tgtctacactgaaaat

SEQ ID NO: 278233 - DNA, 16 bp, P. troglodytes
tgtctacccagaggaa

SEQ ID NO: 278234 - DNA, 16 bp, P. troglodytes
tgtctactaaaaaaaa

SEQ ID NO: 278235 - DNA, 16 bp, P. troglodytes
tgtctacttttgagaa

SEQ ID NO: 278236 - DNA, 16 bp, P. troglodytes
tgtctacttttgcttt

SEQ ID NO: 278237 - DNA, 16 bp, P. troglodytes
tgtctataatttcttt

SEQ ID NO: 278238 - DNA, 16 bp, P. troglodytes
tgtctatcaatggatg

SEQ ID NO: 278239 - DNA, 16 bp, P. troglodytes
tgtctatgaatttgac

SEQ ID NO: 278240 - DNA, 16 bp, P. troglodytes
tgtctatggagcagcc

SEQ ID NO: 278241 - DNA, 16 bp, P. troglodytes
tgtctatgtagaaaga

SEQ ID NO: 278242 - DNA, 16 bp, P. troglodytes
tgtctatgtatgtatg

SEQ ID NO: 278243 - DNA, 16 bp, P. troglodytes
tgtctatgtgtgtatg

SEQ ID NO: 278244 - DNA, 17 bp, P. troglodytes
tgtctattcatgttctt

SEQ ID NO: 278245 - DNA, 16 bp, P. troglodytes
tgtctatttatgtcct

SEQ ID NO: 278246 - DNA, 16 bp, P. troglodytes
tgtctatttttccatt

SEQ ID NO: 278247 - DNA, 16 bp, P. troglodytes
tgtctcaaaaagaaga

SEQ ID NO: 278248 - DNA, 16 bp, P. troglodytes
tgtctcaaaaagtaat

SEQ ID NO: 278249 - DNA, 16 bp, P. troglodytes
tgtctcaaaaataaaa

SEQ ID NO: 278250 - DNA, 16 bp, P. troglodytes
tgtctcaaaacaaaat

SEQ ID NO: 278251 - DNA, 16 bp, P. troglodytes
tgtctcaaaacaaagc

SEQ ID NO: 278252 - DNA, 16 bp, P. troglodytes
tgtctcaaagaaaata

SEQ ID NO: 278253 - DNA, 16 bp, P. troglodytes
tgtctcaaagaataaa

SEQ ID NO: 278254 - DNA, 16 bp, P. troglodytes
tgtctcaacaaaaaca

SEQ ID NO: 278255 - DNA, 16 bp, P. troglodytes
tgtctcaacaaaacaa

SEQ ID NO: 278256 - DNA, 16 bp, P. troglodytes
tgtctcaagaaacaaa

SEQ ID NO: 278257 - DNA, 16 bp, P. troglodytes
tgtctcaagaagaaaa

SEQ ID NO: 278258 - DNA, 16 bp, P. troglodytes
tgtctcacctcccacc

SEQ ID NO: 278259 - DNA, 16 bp, P. troglodytes
tgtctcagacaaacaa

SEQ ID NO: 278260 - DNA, 16 bp, P. troglodytes
tgtctcagatgggact

SEQ ID NO: 278261 - DNA, 16 bp, P. troglodytes
tgtctcagtttcccca

SEQ ID NO: 278262 - DNA, 17 bp, P. troglodytes
tgtctcatgcctgtaat

SEQ ID NO: 278263 - DNA, 16 bp, P. troglodytes
tgtctcattttaatgt

SEQ ID NO: 278264 - DNA, 16 bp, P. troglodytes
tgtctcattttccttt

SEQ ID NO: 278265 - DNA, 16 bp, P. troglodytes
tgtctccaaaaaaaag

SEQ ID NO: 278266 - DNA, 16 bp, P. troglodytes
tgtctccaaaaacaaa

SEQ ID NO: 278267 - DNA, 16 bp, P. troglodytes
tgtctccaaagaagat

SEQ ID NO: 278268 - DNA, 16 bp, P. troglodytes
tgtctccaaatacagt

SEQ ID NO: 278269 - DNA, 16 bp, P. troglodytes
tgtctccaggctgaag

SEQ ID NO: 278270 - DNA, 16 bp, P. troglodytes
tgtctccagggcatat

SEQ ID NO: 278271 - DNA, 16 bp, P. troglodytes
tgtctcccaggctgag

SEQ ID NO: 278272 - DNA, 16 bp, P. troglodytes
tgtctcccattctgtg

SEQ ID NO: 278273 - DNA, 16 bp, P. troglodytes
tgtctcctctttcatt

SEQ ID NO: 278274 - DNA, 16 bp, P. troglodytes
tgtctcctggcttcag

SEQ ID NO: 278275 - DNA, 16 bp, P. troglodytes
tgtctcctttttaaaa

SEQ ID NO: 278276 - DNA, 16 bp, P. troglodytes
tgtctcctttttcatt

SEQ ID NO: 278277 - DNA, 16 bp, P. troglodytes
tgtctcgaaaaaaaaa

SEQ ID NO: 278278 - DNA, 20 bp, P. troglodytes
tgtctcgctatgttgcccag

SEQ ID NO: 278279 - DNA, 16 bp, P. troglodytes
tgtctcggcctcctga

SEQ ID NO: 278280 - DNA, 16 bp, P. troglodytes
tgtctctaaaaaaaaa

SEQ ID NO: 278281 - DNA, 16 bp, P. troglodytes
tgtctctacaaaaaaa

SEQ ID NO: 278282 - DNA, 16 bp, P. troglodytes
tgtctctacaaaaatt

SEQ ID NO: 278283 - DNA, 16 bp, P. troglodytes
tgtctctacaaaatat

SEQ ID NO: 278284 - DNA, 16 bp, P. troglodytes
tgtctctactaagaat

SEQ ID NO: 278285 - DNA, 16 bp, P. troglodytes
tgtctctatagatttg

SEQ ID NO: 278286 - DNA, 16 bp, P. troglodytes
tgtctctcacaccaca

SEQ ID NO: 278287 - DNA, 16 bp, P. troglodytes
tgtctctcattctctc

SEQ ID NO: 278288 - DNA, 16 bp, P. troglodytes
tgtctctctctctctg

SEQ ID NO: 278289 - DNA, 16 bp, P. troglodytes
tgtctctctctctgcc

SEQ ID NO: 278290 - DNA, 16 bp, P. troglodytes
tgtctctctgtttctg

SEQ ID NO: 278291 - DNA, 17 bp, P. troglodytes
tgtctctctgtttgtct

SEQ ID NO: 278292 - DNA, 16 bp, P. troglodytes
tgtctctgaaaacaaa

SEQ ID NO: 278293 - DNA, 16 bp, P. troglodytes
tgtctctgcttgcaga

SEQ ID NO: 278294 - DNA, 16 bp, P. troglodytes
tgtctctggctgccct

SEQ ID NO: 278295 - DNA, 16 bp, P. troglodytes
tgtctctggctgtcct

SEQ ID NO: 278296 - DNA, 16 bp, P. troglodytes
tgtctctggcttcttt

SEQ ID NO: 278297 - DNA, 16 bp, P. troglodytes
tgtctctgtctctcac

SEQ ID NO: 278298 - DNA, 16 bp, P. troglodytes
tgtctctgtctctccc

SEQ ID NO: 278299 - DNA, 16 bp, P. troglodytes
tgtctctgtctctcct

SEQ ID NO: 278300 - DNA, 16 bp, P. troglodytes
tgtctctgtctctgtc

SEQ ID NO: 278301 - DNA, 16 bp, P. troglodytes
tgtctctgtttgcaga

SEQ ID NO: 278302 - DNA, 16 bp, P. troglodytes
tgtctcttaaatctct

SEQ ID NO: 278303 - DNA, 16 bp, P. troglodytes
tgtctcttaagaaaaa

SEQ ID NO: 278304 - DNA, 16 bp, P. troglodytes
tgtctcttcattctgt

SEQ ID NO: 278305 - DNA, 16 bp, P. troglodytes
tgtctcttcccagttt

SEQ ID NO: 278306 - DNA, 16 bp, P. troglodytes
tgtctcttgtggggga

SEQ ID NO: 278307 - DNA, 16 bp, P. troglodytes
tgtctctttgatctgt

SEQ ID NO: 278308 - DNA, 16 bp, P. troglodytes
tgtctgaaaaaaacaa

SEQ ID NO: 278309 - DNA, 16 bp, P. troglodytes
tgtctgaaaaggattt

SEQ ID NO: 278310 - DNA, 16 bp, P. troglodytes
tgtctgaaaataaata

SEQ ID NO: 278311 - DNA, 16 bp, P. troglodytes
tgtctgaaaggtcaca

SEQ ID NO: 278312 - DNA, 16 bp, P. troglodytes
tgtctgaaatcccagc

SEQ ID NO: 278313 - DNA, 16 bp, P. troglodytes
tgtctgaataatattc

SEQ ID NO: 278314 - DNA, 16 bp, P. troglodytes
tgtctgacccccactt

SEQ ID NO: 278315 - DNA, 16 bp, P. troglodytes
tgtctgacttcaaagc

SEQ ID NO: 278316 - DNA, 16 bp, P. troglodytes
tgtctgacttctttca

SEQ ID NO: 278317 - DNA, 16 bp, P. troglodytes
tgtctgatatttttct

SEQ ID NO: 278318 - DNA, 16 bp, P. troglodytes
tgtctgatgttttcct

SEQ ID NO: 278319 - DNA, 16 bp, P. troglodytes
tgtctgcctcctgctg

SEQ ID NO: 278320 - DNA, 16 bp, P. troglodytes
tgtctgcctctgcctc

SEQ ID NO: 278321 - DNA, 16 bp, P. troglodytes
tgtctgcttactctgt

SEQ ID NO: 278322 - DNA, 16 bp, P. troglodytes
tgtctggaaacatttt

SEQ ID NO: 278323 - DNA, 16 bp, P. troglodytes
tgtctggagacatttt

SEQ ID NO: 278324 - DNA, 16 bp, P. troglodytes
tgtctggtgaggacct

SEQ ID NO: 278325 - DNA, 16 bp, P. troglodytes
tgtctggtgagggccc

SEQ ID NO: 278326 - DNA, 16 bp, P. troglodytes
tgtctgtaaaaataaa

SEQ ID NO: 278327 - DNA, 16 bp, P. troglodytes
tgtctgtaatcctagc

SEQ ID NO: 278328 - DNA, 16 bp, P. troglodytes
tgtctgtaccattttg

SEQ ID NO: 278329 - DNA, 16 bp, P. troglodytes
tgtctgtactaaaaat

SEQ ID NO: 278330 - DNA, 16 bp, P. troglodytes
tgtctgtatttggaga

SEQ ID NO: 278331 - DNA, 16 bp, P. troglodytes
tgtctgtccatccatc

SEQ ID NO: 278332 - DNA, 16 bp, P. troglodytes
tgtctgtcgacccctg

SEQ ID NO: 278333 - DNA, 16 bp, P. troglodytes
tgtctgtctccctccc

SEQ ID NO: 278334 - DNA, 16 bp, P. troglodytes
tgtctgtctctctctg

SEQ ID NO: 278335 - DNA, 16 bp, P. troglodytes
tgtctgtctctgtttc

SEQ ID NO: 278336 - DNA, 16 bp, P. troglodytes
tgtctgtctgtctgtc

SEQ ID NO: 278337 - DNA, 16 bp, P. troglodytes
tgtctgtctgtgtctg

SEQ ID NO: 278338 - DNA, 16 bp, P. troglodytes
tgtctgtgaaagtcat

SEQ ID NO: 278339 - DNA, 16 bp, P. troglodytes
tgtctgtgaaggtgtt

SEQ ID NO: 278340 - DNA, 16 bp, P. troglodytes
tgtctgtgaataaaga

SEQ ID NO: 278341 - DNA, 16 bp, P. troglodytes
tgtctgtgagggtatt

SEQ ID NO: 278342 - DNA, 16 bp, P. troglodytes
tgtctgtgcatttgaa

SEQ ID NO: 278343 - DNA, 16 bp, P. troglodytes
tgtctgtgccaggttt

SEQ ID NO: 278344 - DNA, 16 bp, P. troglodytes
tgtctgtgccctgtcc

SEQ ID NO: 278345 - DNA, 16 bp, P. troglodytes
tgtctgtgtcacattt

SEQ ID NO: 278346 - DNA, 16 bp, P. troglodytes
tgtctgtgtccaaatt

SEQ ID NO: 278347 - DNA, 16 bp, P. troglodytes
tgtctgtgtctgtctg

SEQ ID NO: 278348 - DNA, 16 bp, P. troglodytes
tgtctgtgtgtactca

SEQ ID NO: 278349 - DNA, 16 bp, P. troglodytes
tgtctgtgtgtctgtg

SEQ ID NO: 278350 - DNA, 16 bp, P. troglodytes
tgtctgtgtgtgtgct

SEQ ID NO: 278351 - DNA, 19 bp, P. troglodytes
tgtctgttattggtgtata

SEQ ID NO: 278352 - DNA, 17 bp, P. troglodytes
tgtctgttcatatcctt

SEQ ID NO: 278353 - DNA, 16 bp, P. troglodytes
tgtctgttctcagatc

SEQ ID NO: 278354 - DNA, 16 bp, P. troglodytes
tgtctgttgttccctt

SEQ ID NO: 278355 - DNA, 16 bp, P. troglodytes
tgtctgttttcttcac

SEQ ID NO: 278356 - DNA, 16 bp, P. troglodytes
tgtctgtttttgtaac

SEQ ID NO: 278357 - DNA, 16 bp, P. troglodytes
tgtctgtttttgtaca

SEQ ID NO: 278358 - DNA, 16 bp, P. troglodytes
tgtctgtttttttaaa

SEQ ID NO: 278359 - DNA, 16 bp, P. troglodytes
tgtcttaaaaaaaatg

SEQ ID NO: 278360 - DNA, 16 bp, P. troglodytes
tgtcttaaaaacaaaa

SEQ ID NO: 278361 - DNA, 16 bp, P. troglodytes
tgtcttaaaataaaat

SEQ ID NO: 278362 - DNA, 16 bp, P. troglodytes
tgtcttaagttttcat

SEQ ID NO: 278363 - DNA, 16 bp, P. troglodytes
tgtcttaatttctccc

SEQ ID NO: 278364 - DNA, 16 bp, P. troglodytes
tgtcttactcatcttt

SEQ ID NO: 278365 - DNA, 16 bp, P. troglodytes
tgtcttagcctgtttt

SEQ ID NO: 278366 - DNA, 16 bp, P. troglodytes
tgtcttagtcatgaag

SEQ ID NO: 278367 - DNA, 16 bp, P. troglodytes
tgtcttagtttgggtt

SEQ ID NO: 278368 - DNA, 16 bp, P. troglodytes
tgtcttattcatcttt

SEQ ID NO: 278369 - DNA, 16 bp, P. troglodytes
tgtcttatttaagaaa

SEQ ID NO: 278370 - DNA, 16 bp, P. troglodytes
tgtcttcaaatatttt

SEQ ID NO: 278371 - DNA, 16 bp, P. troglodytes
tgtcttcagcttggag

SEQ ID NO: 278372 - DNA, 16 bp, P. troglodytes
tgtcttcatgttgagt

SEQ ID NO: 278373 - DNA, 16 bp, P. troglodytes
tgtcttcatttcttct

SEQ ID NO: 278374 - DNA, 16 bp, P. troglodytes
tgtcttcattttcatt

SEQ ID NO: 278375 - DNA, 16 bp, P. troglodytes
tgtcttcattttttaa

SEQ ID NO: 278376 - DNA, 16 bp, P. troglodytes
tgtcttccacaatgtt

SEQ ID NO: 278377 - DNA, 16 bp, P. troglodytes
tgtcttccattctttt

SEQ ID NO: 278378 - DNA, 16 bp, P. troglodytes
tgtcttcctcactaga

SEQ ID NO: 278379 - DNA, 16 bp, P. troglodytes
tgtcttctcttattct

SEQ ID NO: 278380 - DNA, 16 bp, P. troglodytes
tgtcttctggcctcca

SEQ ID NO: 278381 - DNA, 16 bp, P. troglodytes
tgtcttctgtgtcact

SEQ ID NO: 278382 - DNA, 16 bp, P. troglodytes
tgtcttctttcaagaa

SEQ ID NO: 278383 - DNA, 16 bp, P. troglodytes
tgtcttctttcctcca

SEQ ID NO: 278384 - DNA, 16 bp, P. troglodytes
tgtcttctttgaagaa

SEQ ID NO: 278385 - DNA, 16 bp, P. troglodytes
tgtcttcttttgaaaa

SEQ ID NO: 278386 - DNA, 16 bp, P. troglodytes
tgtcttcttttggaaa

SEQ ID NO: 278387 - DNA, 16 bp, P. troglodytes
tgtcttgaagaaaaaa

SEQ ID NO: 278388 - DNA, 16 bp, P. troglodytes
tgtcttgaagacagca

SEQ ID NO: 278389 - DNA, 16 bp, P. troglodytes
tgtcttgaattttcct

SEQ ID NO: 278390 - DNA, 16 bp, P. troglodytes
tgtcttgcctgctgcc

SEQ ID NO: 278391 - DNA, 16 bp, P. troglodytes
tgtcttgcttctttca

SEQ ID NO: 278392 - DNA, 16 bp, P. troglodytes
tgtcttggtctcccaa

SEQ ID NO: 278393 - DNA, 16 bp, P. troglodytes
tgtcttgtctgctgcc

SEQ ID NO: 278394 - DNA, 19 bp, P. troglodytes
tgtcttgtgccagttttca

SEQ ID NO: 278395 - DNA, 16 bp, P. troglodytes
tgtcttgttttaagaa

SEQ ID NO: 278396 - DNA, 16 bp, P. troglodytes
tgtctttaaaaaataa

SEQ ID NO: 278397 - DNA, 16 bp, P. troglodytes
tgtctttaaaaattaa

SEQ ID NO: 278398 - DNA, 16 bp, P. troglodytes
tgtctttaaaatattt

SEQ ID NO: 278399 - DNA, 16 bp, P. troglodytes
tgtctttacaaaaaac

SEQ ID NO: 278400 - DNA, 16 bp, P. troglodytes
tgtctttacaggtaaa

SEQ ID NO: 278401 - DNA, 16 bp, P. troglodytes
tgtctttactgaaaaa

SEQ ID NO: 278402 - DNA, 16 bp, P. troglodytes
tgtctttatatttgaa

SEQ ID NO: 278403 - DNA, 16 bp, P. troglodytes
tgtctttatcagcact

SEQ ID NO: 278404 - DNA, 16 bp, P. troglodytes
tgtctttatggtagaa

SEQ ID NO: 278405 - DNA, 16 bp, P. troglodytes
tgtctttatttgaaaa

SEQ ID NO: 278406 - DNA, 16 bp, P. troglodytes
tgtctttcaaaataaa

SEQ ID NO: 278407 - DNA, 16 bp, P. troglodytes
tgtctttcacagtggt

SEQ ID NO: 278408 - DNA, 16 bp, P. troglodytes
tgtctttcaccaaatt

SEQ ID NO: 278409 - DNA, 16 bp, P. troglodytes
tgtctttcaggattat

SEQ ID NO: 278410 - DNA, 16 bp, P. troglodytes
tgtctttcatttccag

SEQ ID NO: 278411 - DNA, 16 bp, P. troglodytes
tgtctttccatgcctg

SEQ ID NO: 278412 - DNA, 16 bp, P. troglodytes
tgtctttctgtgtctg

SEQ ID NO: 278413 - DNA, 16 bp, P. troglodytes
tgtctttcttttgtaa

SEQ ID NO: 278414 - DNA, 16 bp, P. troglodytes
tgtctttgaaatattt

SEQ ID NO: 278415 - DNA, 16 bp, P. troglodytes
tgtctttgatccattt

SEQ ID NO: 278416 - DNA, 16 bp, P. troglodytes
tgtctttgcatgtaag

SEQ ID NO: 278417 - DNA, 16 bp, P. troglodytes
tgtctttgcatgtgag

SEQ ID NO: 278418 - DNA, 16 bp, P. troglodytes
tgtctttggatattgc

SEQ ID NO: 278419 - DNA, 16 bp, P. troglodytes
tgtctttgtggtttta

SEQ ID NO: 278420 - DNA, 16 bp, P. troglodytes
tgtcttttaaaaaaat

SEQ ID NO: 278421 - DNA, 16 bp, P. troglodytes
tgtcttttaaaatgta

SEQ ID NO: 278422 - DNA, 16 bp, P. troglodytes
tgtcttttaactttta

SEQ ID NO: 278423 - DNA, 23 bp, P. troglodytes
tgtcttttaattggagcatttag

SEQ ID NO: 278424 - DNA, 16 bp, P. troglodytes
tgtcttttaattggga

SEQ ID NO: 278425 - DNA, 16 bp, P. troglodytes
tgtcttttagttggag

SEQ ID NO: 278426 - DNA, 16 bp, P. troglodytes
tgtcttttatgaccta

SEQ ID NO: 278427 - DNA, 16 bp, P. troglodytes
tgtcttttatttggag

SEQ ID NO: 278428 - DNA, 16 bp, P. troglodytes
tgtcttttcatccttt

SEQ ID NO: 278429 - DNA, 16 bp, P. troglodytes
tgtcttttgaagcaca

SEQ ID NO: 278430 - DNA, 16 bp, P. troglodytes
tgtcttttgcccactt

SEQ ID NO: 278431 - DNA, 16 bp, P. troglodytes
tgtcttttgctagctt

SEQ ID NO: 278432 - DNA, 16 bp, P. troglodytes
tgtcttttgtaaattg

SEQ ID NO: 278433 - DNA, 16 bp, P. troglodytes
tgtcttttgtccactt

SEQ ID NO: 278434 - DNA, 16 bp, P. troglodytes
tgtctttttaatattc

SEQ ID NO: 278435 - DNA, 16 bp, P. troglodytes
tgtctttttagtagaa

SEQ ID NO: 278436 - DNA, 17 bp, P. troglodytes
tgtctttttagtagaga

SEQ ID NO: 278437 - DNA, 16 bp, P. troglodytes
tgtctttttatatata

SEQ ID NO: 278438 - DNA, 16 bp, P. troglodytes
tgtctttttattactg

SEQ ID NO: 278439 - DNA, 16 bp, P. troglodytes
tgtctttttccatcct

SEQ ID NO: 278440 - DNA, 16 bp, P. troglodytes
tgtctttttccattct

SEQ ID NO: 278441 - DNA, 16 bp, P. troglodytes
tgtcttttttaaaaaa

SEQ ID NO: 278442 - DNA, 16 bp, P. troglodytes
tgtgaaaaacatggca

SEQ ID NO: 278443 - DNA, 16 bp, P. troglodytes
tgtgaaaaagatattt

SEQ ID NO: 278444 - DNA, 16 bp, P. troglodytes
tgtgaaaaatgacttt

SEQ ID NO: 278445 - DNA, 16 bp, P. troglodytes
tgtgaaaaatgtcttt

SEQ ID NO: 278446 - DNA, 16 bp, P. troglodytes
tgtgaaaacagaataa

SEQ ID NO: 278447 - DNA, 16 bp, P. troglodytes
tgtgaaaataagtttt

SEQ ID NO: 278448 - DNA, 16 bp, P. troglodytes
tgtgaaaatgaaaatg

SEQ ID NO: 278449 - DNA, 16 bp, P. troglodytes
tgtgaaaatgaactaa

SEQ ID NO: 278450 - DNA, 16 bp, P. troglodytes
tgtgaaaatggctata

SEQ ID NO: 278451 - DNA, 16 bp, P. troglodytes
tgtgaaaatgttttgt

SEQ ID NO: 278452 - DNA, 16 bp, P. troglodytes
tgtgaaaattaaatga

SEQ ID NO: 278453 - DNA, 16 bp, P. troglodytes
tgtgaaacaataaatt

SEQ ID NO: 278454 - DNA, 16 bp, P. troglodytes
tgtgaaacagcaaaga

SEQ ID NO: 278455 - DNA, 16 bp, P. troglodytes
tgtgaaactgctttct

SEQ ID NO: 278456 - DNA, 16 bp, P. troglodytes
tgtgaaagaaaaatat

SEQ ID NO: 278457 - DNA, 16 bp, P. troglodytes
tgtgaaagatcagatg

SEQ ID NO: 278458 - DNA, 16 bp, P. troglodytes
tgtgaaagcagccaga

SEQ ID NO: 278459 - DNA, 16 bp, P. troglodytes
tgtgaaagcagctgca

SEQ ID NO: 278460 - DNA, 16 bp, P. troglodytes
tgtgaaagggagttca

SEQ ID NO: 278461 - DNA, 16 bp, P. troglodytes
tgtgaaatatttttaa

SEQ ID NO: 278462 - DNA, 16 bp, P. troglodytes
tgtgaaatgattgcca

SEQ ID NO: 278463 - DNA, 16 bp, P. troglodytes
tgtgaaattaaataat

SEQ ID NO: 278464 - DNA, 16 bp, P. troglodytes
tgtgaacaaagacagt

SEQ ID NO: 278465 - DNA, 16 bp, P. troglodytes
tgtgaacagtgctgaa

SEQ ID NO: 278466 - DNA, 16 bp, P. troglodytes
tgtgaacatatgcttt

SEQ ID NO: 278467 - DNA, 16 bp, P. troglodytes
tgtgaacccagaaaat

SEQ ID NO: 278468 - DNA, 17 bp, P. troglodytes
tgtgaacctgggaggca

SEQ ID NO: 278469 - DNA, 16 bp, P. troglodytes
tgtgaacttgggcaag

SEQ ID NO: 278470 - DNA, 16 bp, P. troglodytes
tgtgaagaaagtgatt

SEQ ID NO: 278471 - DNA, 16 bp, P. troglodytes
tgtgaagaaattggaa

SEQ ID NO: 278472 - DNA, 16 bp, P. troglodytes
tgtgaagaaggaggtg

SEQ ID NO: 278473 - DNA, 16 bp, P. troglodytes
tgtgaagaaggtacct

SEQ ID NO: 278474 - DNA, 16 bp, P. troglodytes
tgtgaagaaggtgttt

SEQ ID NO: 278475 - DNA, 18 bp, P. troglodytes
tgtgaagaatgtggcaaa

SEQ ID NO: 278476 - DNA, 16 bp, P. troglodytes
tgtgaagacacagcaa

SEQ ID NO: 278477 - DNA, 16 bp, P. troglodytes
tgtgaagaggtgcctt

SEQ ID NO: 278478 - DNA, 16 bp, P. troglodytes
tgtgaagaggtgcttt

SEQ ID NO: 278479 - DNA, 16 bp, P. troglodytes
tgtgaagattaaaaga

SEQ ID NO: 278480 - DNA, 16 bp, P. troglodytes
tgtgaagattaaatga

SEQ ID NO: 278481 - DNA, 16 bp, P. troglodytes
tgtgaagatttcattt

SEQ ID NO: 278482 - DNA, 16 bp, P. troglodytes
tgtgaaggtgtttctg

SEQ ID NO: 278483 - DNA, 16 bp, P. troglodytes
tgtgaagtttttcttt

SEQ ID NO: 278484 - DNA, 16 bp, P. troglodytes
tgtgaataaagctgca

SEQ ID NO: 278485 - DNA, 16 bp, P. troglodytes
tgtgaatagcaaaatg

SEQ ID NO: 278486 - DNA, 16 bp, P. troglodytes
tgtgaatattcaacag

SEQ ID NO: 278487 - DNA, 16 bp, P. troglodytes
tgtgaatatttttctc

SEQ ID NO: 278488 - DNA, 16 bp, P. troglodytes
tgtgaatcatcccttt

SEQ ID NO: 278489 - DNA, 16 bp, P. troglodytes
tgtgaatctataatta

SEQ ID NO: 278490 - DNA, 16 bp, P. troglodytes
tgtgaatctgtgtgtg

SEQ ID NO: 278491 - DNA, 16 bp, P. troglodytes
tgtgaatgagtgtgtg

SEQ ID NO: 278492 - DNA, 16 bp, P. troglodytes
tgtgaatgcacacaca

SEQ ID NO: 278493 - DNA, 16 bp, P. troglodytes
tgtgaatgctgctgct

SEQ ID NO: 278494 - DNA, 16 bp, P. troglodytes
tgtgaatgtactgaat

SEQ ID NO: 278495 - DNA, 16 bp, P. troglodytes
tgtgaatgtgacctta

SEQ ID NO: 278496 - DNA, 16 bp, P. troglodytes
tgtgaattatttaaaa

SEQ ID NO: 278497 - DNA, 16 bp, P. troglodytes
tgtgaattattttaaa

SEQ ID NO: 278498 - DNA, 16 bp, P. troglodytes
tgtgaatttcacctca

SEQ ID NO: 278499 - DNA, 16 bp, P. troglodytes
tgtgaattttacctca

SEQ ID NO: 278500 - DNA, 16 bp, P. troglodytes
tgtgaattttagaata

SEQ ID NO: 278501 - DNA, 16 bp, P. troglodytes
tgtgaatttttaaata

SEQ ID NO: 278502 - DNA, 16 bp, P. troglodytes
tgtgacaaagccttta

SEQ ID NO: 278503 - DNA, 16 bp, P. troglodytes
tgtgacaaccagaaat

SEQ ID NO: 278504 - DNA, 16 bp, P. troglodytes
tgtgacaatcaaaaat

SEQ ID NO: 278505 - DNA, 16 bp, P. troglodytes
tgtgacagaacaagac

SEQ ID NO: 278506 - DNA, 16 bp, P. troglodytes
tgtgacagtttttcag

SEQ ID NO: 278507 - DNA, 16 bp, P. troglodytes
tgtgacatcagaatag

SEQ ID NO: 278508 - DNA, 16 bp, P. troglodytes
tgtgaccagcctggac

SEQ ID NO: 278509 - DNA, 16 bp, P. troglodytes
tgtgaccctggacaaa

SEQ ID NO: 278510 - DNA, 16 bp, P. troglodytes
tgtgaccctgggcaag

SEQ ID NO: 278511 - DNA, 16 bp, P. troglodytes
tgtgacctcagacaaa

SEQ ID NO: 278512 - DNA, 16 bp, P. troglodytes
tgtgacctcatttgga

SEQ ID NO: 278513 - DNA, 16 bp, P. troglodytes
tgtgacctggagcaag

SEQ ID NO: 278514 - DNA, 16 bp, P. troglodytes
tgtgaccttaagcaaa

SEQ ID NO: 278515 - DNA, 16 bp, P. troglodytes
tgtgaccttagaatgt

SEQ ID NO: 278516 - DNA, 16 bp, P. troglodytes
tgtgaccttgaacaag

SEQ ID NO: 278517 - DNA, 16 bp, P. troglodytes
tgtgaccttgaccaag

SEQ ID NO: 278518 - DNA, 16 bp, P. troglodytes
tgtgaccttggacaaa

SEQ ID NO: 278519 - DNA, 16 bp, P. troglodytes
tgtgaccttggacaag

SEQ ID NO: 278520 - DNA, 16 bp, P. troglodytes
tgtgaccttgggcaag

SEQ ID NO: 278521 - DNA, 16 bp, P. troglodytes
tgtgaccttgggcagg

SEQ ID NO: 278522 - DNA, 16 bp, P. troglodytes
tgtgactgcactccag

SEQ ID NO: 278523 - DNA, 16 bp, P. troglodytes
tgtgactggtgtctga

SEQ ID NO: 278524 - DNA, 16 bp, P. troglodytes
tgtgacttagaatgct

SEQ ID NO: 278525 - DNA, 16 bp, P. troglodytes
tgtgacttgctcaagg

SEQ ID NO: 278526 - DNA, 16 bp, P. troglodytes
tgtgacttgctttatt

SEQ ID NO: 278527 - DNA, 16 bp, P. troglodytes
tgtgactttgggcaaa

SEQ ID NO: 278528 - DNA, 16 bp, P. troglodytes
tgtgactttgggcaag

SEQ ID NO: 278529 - DNA, 16 bp, P. troglodytes
tgtgactttttaaaaa

SEQ ID NO: 278530 - DNA, 16 bp, P. troglodytes
tgtgagaaagagagag

SEQ ID NO: 278531 - DNA, 16 bp, P. troglodytes
tgtgagaaataaagtt

SEQ ID NO: 278532 - DNA, 16 bp, P. troglodytes
tgtgagaaatgaattt

SEQ ID NO: 278533 - DNA, 16 bp, P. troglodytes
tgtgagaacaaactaa

SEQ ID NO: 278534 - DNA, 16 bp, P. troglodytes
tgtgagaagagagaaa

SEQ ID NO: 278535 - DNA, 16 bp, P. troglodytes
tgtgagaattaaagga

SEQ ID NO: 278536 - DNA, 16 bp, P. troglodytes
tgtgagaattaaatga

SEQ ID NO: 278537 - DNA, 16 bp, P. troglodytes
tgtgagacactgtgcc

SEQ ID NO: 278538 - DNA, 16 bp, P. troglodytes
tgtgagacagagtctt

SEQ ID NO: 278539 - DNA, 16 bp, P. troglodytes
tgtgagaccccatctc

SEQ ID NO: 278540 - DNA, 16 bp, P. troglodytes
tgtgagaccctgtctc

SEQ ID NO: 278541 - DNA, 16 bp, P. troglodytes
tgtgagactgtgtgtg

SEQ ID NO: 278542 - DNA, 16 bp, P. troglodytes
tgtgagagaaagagaa

SEQ ID NO: 278543 - DNA, 16 bp, P. troglodytes
tgtgagagaatcaatt

SEQ ID NO: 278544 - DNA, 16 bp, P. troglodytes
tgtgagaggaaactgg

SEQ ID NO: 278545 - DNA, 16 bp, P. troglodytes
tgtgagcatgcatgtg

SEQ ID NO: 278546 - DNA, 16 bp, P. troglodytes
tgtgagcatgtgtgag

SEQ ID NO: 278547 - DNA, 16 bp, P. troglodytes
tgtgagcattaaataa

SEQ ID NO: 278548 - DNA, 16 bp, P. troglodytes
tgtgagccaagattgt

SEQ ID NO: 278549 - DNA, 16 bp, P. troglodytes
tgtgagccacaacacc

SEQ ID NO: 278550 - DNA, 17 bp, P. troglodytes
tgtgagccaccacaccc

SEQ ID NO: 278551 - DNA, 22 bp, P. troglodytes
tgtgagccaccacacctggcct

SEQ ID NO: 278552 - DNA, 16 bp, P. troglodytes
tgtgagccaccacact

SEQ ID NO: 278553 - DNA, 16 bp, P. troglodytes
tgtgagccaccacatc

SEQ ID NO: 278554 - DNA, 16 bp, P. troglodytes
tgtgagccaccaggct

SEQ ID NO: 278555 - DNA, 16 bp, P. troglodytes
tgtgagccaccatacc

SEQ ID NO: 278556 - DNA, 22 bp, P. troglodytes
tgtgagccaccatgcccggcct

SEQ ID NO: 278557 - DNA, 18 bp, P. troglodytes
tgtgagccaccgcaccca

SEQ ID NO: 278558 - DNA, 19 bp, P. troglodytes
tgtgagccaccgcgcccag

SEQ ID NO: 278559 - DNA, 16 bp, P. troglodytes
tgtgagccaccgtgcc

SEQ ID NO: 278560 - DNA, 16 bp, P. troglodytes
tgtgagccacggcgcc

SEQ ID NO: 278561 - DNA, 16 bp, P. troglodytes
tgtgagccactgcccc

SEQ ID NO: 278562 - DNA, 16 bp, P. troglodytes
tgtgagccactgcctg

SEQ ID NO: 278563 - DNA, 16 bp, P. troglodytes
tgtgagccagcacacc

SEQ ID NO: 278564 - DNA, 18 bp, P. troglodytes
tgtgagccaggatggtct

SEQ ID NO: 278565 - DNA, 16 bp, P. troglodytes
tgtgagccattgctcc

SEQ ID NO: 278566 - DNA, 16 bp, P. troglodytes
tgtgagcccaggagtt

SEQ ID NO: 278567 - DNA, 16 bp, P. troglodytes
tgtgagctccttgaaa

SEQ ID NO: 278568 - DNA, 16 bp, P. troglodytes
tgtgagctctttgagg

SEQ ID NO: 278569 - DNA, 18 bp, P. troglodytes
tgtgaggaaagtcattgg

SEQ ID NO: 278570 - DNA, 16 bp, P. troglodytes
tgtgaggacacagcag

SEQ ID NO: 278571 - DNA, 16 bp, P. troglodytes
tgtgaggacatggtga

SEQ ID NO: 278572 - DNA, 16 bp, P. troglodytes
tgtgaggagatggagg

SEQ ID NO: 278573 - DNA, 16 bp, P. troglodytes
tgtgaggatcaaatga

SEQ ID NO: 278574 - DNA, 16 bp, P. troglodytes
tgtgaggatgaaataa

SEQ ID NO: 278575 - DNA, 16 bp, P. troglodytes
tgtgaggatgaaatga

SEQ ID NO: 278576 - DNA, 16 bp, P. troglodytes
tgtgaggattaaatga

SEQ ID NO: 278577 - DNA, 16 bp, P. troglodytes
tgtgaggattaaatgt

SEQ ID NO: 278578 - DNA, 16 bp, P. troglodytes
tgtgaggattaagtga

SEQ ID NO: 278579 - DNA, 16 bp, P. troglodytes
tgtgaggattcaatga

SEQ ID NO: 278580 - DNA, 16 bp, P. troglodytes
tgtgaggcctccccca

SEQ ID NO: 278581 - DNA, 16 bp, P. troglodytes
tgtgaggctcaaatga

SEQ ID NO: 278582 - DNA, 16 bp, P. troglodytes
tgtgagggtgtttcca

SEQ ID NO: 278583 - DNA, 16 bp, P. troglodytes
tgtgagggttaaatga

SEQ ID NO: 278584 - DNA, 16 bp, P. troglodytes
tgtgaggtgatggata

SEQ ID NO: 278585 - DNA, 16 bp, P. troglodytes
tgtgagtatatatata

SEQ ID NO: 278586 - DNA, 16 bp, P. troglodytes
tgtgagtcaattaaac

SEQ ID NO: 278587 - DNA, 16 bp, P. troglodytes
tgtgagtgaatgtgtg

SEQ ID NO: 278588 - DNA, 16 bp, P. troglodytes
tgtgagtgcatgtgtg

SEQ ID NO: 278589 - DNA, 16 bp, P. troglodytes
tgtgagtgtatatgtg

SEQ ID NO: 278590 - DNA, 16 bp, P. troglodytes
tgtgagtgtatgtgtg

SEQ ID NO: 278591 - DNA, 16 bp, P. troglodytes
tgtgagtgtgagagtg

SEQ ID NO: 278592 - DNA, 16 bp, P. troglodytes
tgtgagtgtgagtgtg

SEQ ID NO: 278593 - DNA, 16 bp, P. troglodytes
tgtgagtgtgtgagtg

SEQ ID NO: 278594 - DNA, 16 bp, P. troglodytes
tgtgagtgtgtgcaca

SEQ ID NO: 278595 - DNA, 16 bp, P. troglodytes
tgtgagtgtgtgtgag

SEQ ID NO: 278596 - DNA, 16 bp, P. troglodytes
tgtgagttttatgctt

SEQ ID NO: 278597 - DNA, 16 bp, P. troglodytes
tgtgagttttttcaaa

SEQ ID NO: 278598 - DNA, 16 bp, P. troglodytes
tgtgataagaacattt

SEQ ID NO: 278599 - DNA, 16 bp, P. troglodytes
tgtgataagtgctata

SEQ ID NO: 278600 - DNA, 16 bp, P. troglodytes
tgtgataatttattac

SEQ ID NO: 278601 - DNA, 16 bp, P. troglodytes
tgtgatacctttcctc

SEQ ID NO: 278602 - DNA, 16 bp, P. troglodytes
tgtgatactgtgaaat

SEQ ID NO: 278603 - DNA, 16 bp, P. troglodytes
tgtgatagaaaagaaa

SEQ ID NO: 278604 - DNA, 28 bp, P. troglodytes
tgtgatagtttgctgagaatgatggttt

SEQ ID NO: 278605 - DNA, 16 bp, P. troglodytes
tgtgatattcctgcca

SEQ ID NO: 278606 - DNA, 16 bp, P. troglodytes
tgtgatattgtgaaat

SEQ ID NO: 278607 - DNA, 16 bp, P. troglodytes
tgtgatatttgacttt

SEQ ID NO: 278608 - DNA, 16 bp, P. troglodytes
tgtgatcaatgcagaa

SEQ ID NO: 278609 - DNA, 16 bp, P. troglodytes
tgtgatcagggtgagg

SEQ ID NO: 278610 - DNA, 16 bp, P. troglodytes
tgtgatcatttatttt

SEQ ID NO: 278611 - DNA, 21 bp, P. troglodytes
tgtgatccacctgcctcggcc

SEQ ID NO: 278612 - DNA, 16 bp, P. troglodytes
tgtgatcccagctact

SEQ ID NO: 278613 - DNA, 16 bp, P. troglodytes
tgtgatccgcccacct

SEQ ID NO: 278614 - DNA, 16 bp, P. troglodytes
tgtgatccgcccgcct

SEQ ID NO: 278615 - DNA, 17 bp, P. troglodytes
tgtgatccgcctgcctc

SEQ ID NO: 278616 - DNA, 16 bp, P. troglodytes
tgtgatctcagcccac

SEQ ID NO: 278617 - DNA, 24 bp, P. troglodytes
tgtgatctgcctgccttggcctcc

SEQ ID NO: 278618 - DNA, 16 bp, P. troglodytes
tgtgatcttatttctg

SEQ ID NO: 278619 - DNA, 16 bp, P. troglodytes
tgtgatcttgaacaag

SEQ ID NO: 278620 - DNA, 16 bp, P. troglodytes
tgtgatcttggacaag

SEQ ID NO: 278621 - DNA, 16 bp, P. troglodytes
tgtgatcttggctcac

SEQ ID NO: 278622 - DNA, 17 bp, P. troglodytes
tgtgatcttggctcaca

SEQ ID NO: 278623 - DNA, 16 bp, P. troglodytes
tgtgatcttgggcaag

SEQ ID NO: 278624 - DNA, 16 bp, P. troglodytes
tgtgatgaaaacactt

SEQ ID NO: 278625 - DNA, 16 bp, P. troglodytes
tgtgatgaaatcttgt

SEQ ID NO: 278626 - DNA, 16 bp, P. troglodytes
tgtgatgatggtttca

SEQ ID NO: 278627 - DNA, 16 bp, P. troglodytes
tgtgatgctgaggctt

SEQ ID NO: 278628 - DNA, 16 bp, P. troglodytes
tgtgatggcgcatgcc

SEQ ID NO: 278629 - DNA, 16 bp, P. troglodytes
tgtgatggtagggtgt

SEQ ID NO: 278630 - DNA, 16 bp, P. troglodytes
tgtgatggttaatact

SEQ ID NO: 278631 - DNA, 16 bp, P. troglodytes
tgtgatggttaatatt

SEQ ID NO: 278632 - DNA, 16 bp, P. troglodytes
tgtgatgtctggagct

SEQ ID NO: 278633 - DNA, 16 bp, P. troglodytes
tgtgattacattaggc

SEQ ID NO: 278634 - DNA, 16 bp, P. troglodytes
tgtgattattttctta

SEQ ID NO: 278635 - DNA, 16 bp, P. troglodytes
tgtgattcattcattc

SEQ ID NO: 278636 - DNA, 16 bp, P. troglodytes
tgtgattccatctggt

SEQ ID NO: 278637 - DNA, 16 bp, P. troglodytes
tgtgattctgccactg

SEQ ID NO: 278638 - DNA, 16 bp, P. troglodytes
tgtgattgcaccactt

SEQ ID NO: 278639 - DNA, 16 bp, P. troglodytes
tgtgattggcatctga

SEQ ID NO: 278640 - DNA, 16 bp, P. troglodytes
tgtgatttatcacata

SEQ ID NO: 278641 - DNA, 16 bp, P. troglodytes
tgtgatttggggcaag

SEQ ID NO: 278642 - DNA, 18 bp, P. troglodytes
tgtgatttgtttctgccc

SEQ ID NO: 278643 - DNA, 16 bp, P. troglodytes
tgtgatttttaaaaaa

SEQ ID NO: 278644 - DNA, 16 bp, P. troglodytes
tgtgatttttacacat

SEQ ID NO: 278645 - DNA, 16 bp, P. troglodytes
tgtgatttttgccatt

SEQ ID NO: 278646 - DNA, 16 bp, P. troglodytes
tgtgcaaaaataaaat

SEQ ID NO: 278647 - DNA, 16 bp, P. troglodytes
tgtgcaaaagaaaatg

SEQ ID NO: 278648 - DNA, 16 bp, P. troglodytes
tgtgcaaattagaaaa

SEQ ID NO: 278649 - DNA, 16 bp, P. troglodytes
tgtgcaaccatcacca

SEQ ID NO: 278650 - DNA, 16 bp, P. troglodytes
tgtgcaaccatcatca

SEQ ID NO: 278651 - DNA, 16 bp, P. troglodytes
tgtgcaactcttcctt

SEQ ID NO: 278652 - DNA, 16 bp, P. troglodytes
tgtgcacacacacaca

SEQ ID NO: 278653 - DNA, 16 bp, P. troglodytes
tgtgcacacacatgtg

SEQ ID NO: 278654 - DNA, 16 bp, P. troglodytes
tgtgcacacatgcaca

SEQ ID NO: 278655 - DNA, 16 bp, P. troglodytes
tgtgcacactgtgcag

SEQ ID NO: 278656 - DNA, 16 bp, P. troglodytes
tgtgcacagagaaaag

SEQ ID NO: 278657 - DNA, 16 bp, P. troglodytes
tgtgcacagctgcctg

SEQ ID NO: 278658 - DNA, 16 bp, P. troglodytes
tgtgcacatgtacaca

SEQ ID NO: 278659 - DNA, 17 bp, P. troglodytes
tgtgcacatgtacccta

SEQ ID NO: 278660 - DNA, 16 bp, P. troglodytes
tgtgcaccaacatgcc

SEQ ID NO: 278661 - DNA, 16 bp, P. troglodytes
tgtgcaccaccatccc

SEQ ID NO: 278662 - DNA, 16 bp, P. troglodytes
tgtgcaccactatgcc

SEQ ID NO: 278663 - DNA, 16 bp, P. troglodytes
tgtgcacgtgtgtgta

SEQ ID NO: 278664 - DNA, 16 bp, P. troglodytes
tgtgcacgtgtgtgtg

SEQ ID NO: 278665 - DNA, 16 bp, P. troglodytes
tgtgcagaaactttta

SEQ ID NO: 278666 - DNA, 17 bp, P. troglodytes
tgtgcagaagctcttta

SEQ ID NO: 278667 - DNA, 16 bp, P. troglodytes
tgtgcagaataggcaa

SEQ ID NO: 278668 - DNA, 16 bp, P. troglodytes
tgtgcagcaaaccaac

SEQ ID NO: 278669 - DNA, 16 bp, P. troglodytes
tgtgcagcaaagtttg

SEQ ID NO: 278670 - DNA, 16 bp, P. troglodytes
tgtgcagccaacagac

SEQ ID NO: 278671 - DNA, 16 bp, P. troglodytes
tgtgcagccatcacca

SEQ ID NO: 278672 - DNA, 16 bp, P. troglodytes
tgtgcagcctgtgggt

SEQ ID NO: 278673 - DNA, 16 bp, P. troglodytes
tgtgcagggagactcc

SEQ ID NO: 278674 - DNA, 16 bp, P. troglodytes
tgtgcagggcagcagg

SEQ ID NO: 278675 - DNA, 16 bp, P. troglodytes
tgtgcaggtttgttac

SEQ ID NO: 278676 - DNA, 16 bp, P. troglodytes
tgtgcagtcatcacca

SEQ ID NO: 278677 - DNA, 16 bp, P. troglodytes
tgtgcagttcacaata

SEQ ID NO: 278678 - DNA, 16 bp, P. troglodytes
tgtgcatacacacata

SEQ ID NO: 278679 - DNA, 16 bp, P. troglodytes
tgtgcatatgtacata

SEQ ID NO: 278680 - DNA, 16 bp, P. troglodytes
tgtgcatatgtatttt

SEQ ID NO: 278681 - DNA, 16 bp, P. troglodytes
tgtgcatatgtctttt

SEQ ID NO: 278682 - DNA, 16 bp, P. troglodytes
tgtgcatatgtgcaca

SEQ ID NO: 278683 - DNA, 16 bp, P. troglodytes
tgtgcatatttgttac

SEQ ID NO: 278684 - DNA, 16 bp, P. troglodytes
tgtgcatattttaaaa

SEQ ID NO: 278685 - DNA, 16 bp, P. troglodytes
tgtgcatgagtcttta

SEQ ID NO: 278686 - DNA, 16 bp, P. troglodytes
tgtgcatgagtgtgca

SEQ ID NO: 278687 - DNA, 16 bp, P. troglodytes
tgtgcatgcacacaca

SEQ ID NO: 278688 - DNA, 16 bp, P. troglodytes
tgtgcatgcatgtgta

SEQ ID NO: 278689 - DNA, 16 bp, P. troglodytes
tgtgcatgcatgtgtc

SEQ ID NO: 278690 - DNA, 16 bp, P. troglodytes
tgtgcatggtggtggg

SEQ ID NO: 278691 - DNA, 16 bp, P. troglodytes
tgtgcatggtggtgtg

SEQ ID NO: 278692 - DNA, 16 bp, P. troglodytes
tgtgcatgtacgtgtg

SEQ ID NO: 278693 - DNA, 16 bp, P. troglodytes
tgtgcatgtatgtgta

SEQ ID NO: 278694 - DNA, 16 bp, P. troglodytes
tgtgcatgtatgtgtt

SEQ ID NO: 278695 - DNA, 16 bp, P. troglodytes
tgtgcatgtgcctgtg

SEQ ID NO: 278696 - DNA, 16 bp, P. troglodytes
tgtgcatgtgtctgtg

SEQ ID NO: 278697 - DNA, 16 bp, P. troglodytes
tgtgcatgtgtcttta

SEQ ID NO: 278698 - DNA, 16 bp, P. troglodytes
tgtgcatgtgtgagca

SEQ ID NO: 278699 - DNA, 16 bp, P. troglodytes
tgtgcatgtgtgaggg

SEQ ID NO: 278700 - DNA, 16 bp, P. troglodytes
tgtgcatgtgtgtaca

SEQ ID NO: 278701 - DNA, 16 bp, P. troglodytes
tgtgcatgtgtgtgta

SEQ ID NO: 278702 - DNA, 16 bp, P. troglodytes
tgtgcatgtgtgtgtg

SEQ ID NO: 278703 - DNA, 16 bp, P. troglodytes
tgtgcatgtgtgtgtt

SEQ ID NO: 278704 - DNA, 16 bp, P. troglodytes
tgtgcattgctggtag

SEQ ID NO: 278705 - DNA, 16 bp, P. troglodytes
tgtgcatttgtgtgtg

SEQ ID NO: 278706 - DNA, 16 bp, P. troglodytes
tgtgcatttttaaatt

SEQ ID NO: 278707 - DNA, 16 bp, P. troglodytes
tgtgccaaagaaataa

SEQ ID NO: 278708 - DNA, 16 bp, P. troglodytes
tgtgccaacatgccca

SEQ ID NO: 278709 - DNA, 16 bp, P. troglodytes
tgtgccacagtttatt

SEQ ID NO: 278710 - DNA, 16 bp, P. troglodytes
tgtgccaccacaccca

SEQ ID NO: 278711 - DNA, 16 bp, P. troglodytes
tgtgccaccacaccta

SEQ ID NO: 278712 - DNA, 16 bp, P. troglodytes
tgtgccaccacgacca

SEQ ID NO: 278713 - DNA, 16 bp, P. troglodytes
tgtgccaccacgcttg

SEQ ID NO: 278714 - DNA, 16 bp, P. troglodytes
tgtgccaccatcacca

SEQ ID NO: 278715 - DNA, 16 bp, P. troglodytes
tgtgccaccatgcccc

SEQ ID NO: 278716 - DNA, 18 bp, P. troglodytes
tgtgccactgaactccag

SEQ ID NO: 278717 - DNA, 17 bp, P. troglodytes
tgtgccactgcactcca

SEQ ID NO: 278718 - DNA, 18 bp, P. troglodytes
tgtgccactgcactccaa

SEQ ID NO: 278719 - DNA, 16 bp, P. troglodytes
tgtgccactgctctcc

SEQ ID NO: 278720 - DNA, 16 bp, P. troglodytes
tgtgccactgtgccca

SEQ ID NO: 278721 - DNA, 16 bp, P. troglodytes
tgtgccagatgctgtg

SEQ ID NO: 278722 - DNA, 16 bp, P. troglodytes
tgtgccagatgctgtt

SEQ ID NO: 278723 - DNA, 16 bp, P. troglodytes
tgtgccagcactgtgc

SEQ ID NO: 278724 - DNA, 16 bp, P. troglodytes
tgtgccaggagctgtg

SEQ ID NO: 278725 - DNA, 16 bp, P. troglodytes
tgtgccaggcaatgtt

SEQ ID NO: 278726 - DNA, 16 bp, P. troglodytes
tgtgccaggcaccaca

SEQ ID NO: 278727 - DNA, 16 bp, P. troglodytes
tgtgccaggcaccagg

SEQ ID NO: 278728 - DNA, 16 bp, P. troglodytes
tgtgccaggcaccctg

SEQ ID NO: 278729 - DNA, 16 bp, P. troglodytes
tgtgccaggcactgag

SEQ ID NO: 278730 - DNA, 16 bp, P. troglodytes
tgtgccaggcactgtt

SEQ ID NO: 278731 - DNA, 16 bp, P. troglodytes
tgtgccaggcccaggg

SEQ ID NO: 278732 - DNA, 16 bp, P. troglodytes
tgtgccaggcctggtg

SEQ ID NO: 278733 - DNA, 16 bp, P. troglodytes
tgtgccaggctctctg

SEQ ID NO: 278734 - DNA, 16 bp, P. troglodytes
tgtgccaggctctgtg

SEQ ID NO: 278735 - DNA, 16 bp, P. troglodytes
tgtgccaggctctgtt

SEQ ID NO: 278736 - DNA, 16 bp, P. troglodytes
tgtgccaggtactatg

SEQ ID NO: 278737 - DNA, 16 bp, P. troglodytes
tgtgccaggtgctgtg

SEQ ID NO: 278738 - DNA, 16 bp, P. troglodytes
tgtgccaggtgtggtg

SEQ ID NO: 278739 - DNA, 16 bp, P. troglodytes
tgtgccatgttgatgt

SEQ ID NO: 278740 - DNA, 16 bp, P. troglodytes
tgtgccattttgcatt

SEQ ID NO: 278741 - DNA, 16 bp, P. troglodytes
tgtgccattttgtatt

SEQ ID NO: 278742 - DNA, 16 bp, P. troglodytes
tgtgcccagagtagcc

SEQ ID NO: 278743 - DNA, 16 bp, P. troglodytes
tgtgcccagccctgtt

SEQ ID NO: 278744 - DNA, 16 bp, P. troglodytes
tgtgcccagcctaaga

SEQ ID NO: 278745 - DNA, 16 bp, P. troglodytes
tgtgcccaggctggag

SEQ ID NO: 278746 - DNA, 16 bp, P. troglodytes
tgtgcccatgtgttct

SEQ ID NO: 278747 - DNA, 16 bp, P. troglodytes
tgtgccccagcctcct

SEQ ID NO: 278748 - DNA, 16 bp, P. troglodytes
tgtgccccaggctgga

SEQ ID NO: 278749 - DNA, 16 bp, P. troglodytes
tgtgcccccacaccca

SEQ ID NO: 278750 - DNA, 16 bp, P. troglodytes
tgtgcccccacacctg

SEQ ID NO: 278751 - DNA, 16 bp, P. troglodytes
tgtgccgggcactgtg

SEQ ID NO: 278752 - DNA, 16 bp, P. troglodytes
tgtgccgggcgtggtg

SEQ ID NO: 278753 - DNA, 16 bp, P. troglodytes
tgtgcctcaggctcct

SEQ ID NO: 278754 - DNA, 16 bp, P. troglodytes
tgtgcctcagtgtcct

SEQ ID NO: 278755 - DNA, 16 bp, P. troglodytes
tgtgcctcagttacct

SEQ ID NO: 278756 - DNA, 16 bp, P. troglodytes
tgtgcctcagttcctc

SEQ ID NO: 278757 - DNA, 16 bp, P. troglodytes
tgtgcctcagtttacc

SEQ ID NO: 278758 - DNA, 16 bp, P. troglodytes
tgtgcctcagtttccc

SEQ ID NO: 278759 - DNA, 16 bp, P. troglodytes
tgtgcctcataaatat

SEQ ID NO: 278760 - DNA, 16 bp, P. troglodytes
tgtgcctgaagtccca

SEQ ID NO: 278761 - DNA, 16 bp, P. troglodytes
tgtgcctgcctgcctg

SEQ ID NO: 278762 - DNA, 16 bp, P. troglodytes
tgtgcctggcacacag

SEQ ID NO: 278763 - DNA, 16 bp, P. troglodytes
tgtgcctggcactggg

SEQ ID NO: 278764 - DNA, 16 bp, P. troglodytes
tgtgcctggccaaatg

SEQ ID NO: 278765 - DNA, 16 bp, P. troglodytes
tgtgcctggcccaggt

SEQ ID NO: 278766 - DNA, 16 bp, P. troglodytes
tgtgcctggccccaag

SEQ ID NO: 278767 - DNA, 16 bp, P. troglodytes
tgtgcctggcctactt

SEQ ID NO: 278768 - DNA, 16 bp, P. troglodytes
tgtgcctggccttgtt

SEQ ID NO: 278769 - DNA, 16 bp, P. troglodytes
tgtgcctggctcagag

SEQ ID NO: 278770 - DNA, 16 bp, P. troglodytes
tgtgcctggctcattt

SEQ ID NO: 278771 - DNA, 16 bp, P. troglodytes
tgtgcctggctctgtg

SEQ ID NO: 278772 - DNA, 16 bp, P. troglodytes
tgtgcctgtaatacca

SEQ ID NO: 278773 - DNA, 16 bp, P. troglodytes
tgtgcctgtattccca

SEQ ID NO: 278774 - DNA, 16 bp, P. troglodytes
tgtgcctgtgctccca

SEQ ID NO: 278775 - DNA, 16 bp, P. troglodytes
tgtgcctgtggcccca

SEQ ID NO: 278776 - DNA, 16 bp, P. troglodytes
tgtgcctgtgtgcgtg

SEQ ID NO: 278777 - DNA, 16 bp, P. troglodytes
tgtgcctgtttcttca

SEQ ID NO: 278778 - DNA, 16 bp, P. troglodytes
tgtgccttggcctccc

SEQ ID NO: 278779 - DNA, 16 bp, P. troglodytes
tgtgcgaccttgggca

SEQ ID NO: 278780 - DNA, 16 bp, P. troglodytes
tgtgcgcacgcacaca

SEQ ID NO: 278781 - DNA, 16 bp, P. troglodytes
tgtgcgcgcgtgcgcg

SEQ ID NO: 278782 - DNA, 16 bp, P. troglodytes
tgtgcgcgcgtgtgtg

SEQ ID NO: 278783 - DNA, 16 bp, P. troglodytes
tgtgcgtgcatgtgca

SEQ ID NO: 278784 - DNA, 16 bp, P. troglodytes
tgtgcgtgtgcgtgtg

SEQ ID NO: 278785 - DNA, 16 bp, P. troglodytes
tgtgcgtgtgtcttta

SEQ ID NO: 278786 - DNA, 16 bp, P. troglodytes
tgtgcgtgtgtgagtg

SEQ ID NO: 278787 - DNA, 16 bp, P. troglodytes
tgtgcgtgtgtgcata

SEQ ID NO: 278788 - DNA, 16 bp, P. troglodytes
tgtgcgtgtgtgtctg

SEQ ID NO: 278789 - DNA, 16 bp, P. troglodytes
tgtgcgtgtgtgtgta

SEQ ID NO: 278790 - DNA, 16 bp, P. troglodytes
tgtgctaagcacttta

SEQ ID NO: 278791 - DNA, 16 bp, P. troglodytes
tgtgctaagtgaaaaa

SEQ ID NO: 278792 - DNA, 16 bp, P. troglodytes
tgtgctaagtgcttta

SEQ ID NO: 278793 - DNA, 16 bp, P. troglodytes
tgtgctacaacagcag

SEQ ID NO: 278794 - DNA, 16 bp, P. troglodytes
tgtgctaccacacctg

SEQ ID NO: 278795 - DNA, 16 bp, P. troglodytes
tgtgctaggtactgtg

SEQ ID NO: 278796 - DNA, 16 bp, P. troglodytes
tgtgctccagcctggg

SEQ ID NO: 278797 - DNA, 16 bp, P. troglodytes
tgtgctcccagctact

SEQ ID NO: 278798 - DNA, 16 bp, P. troglodytes
tgtgctctgtgtgtgt

SEQ ID NO: 278799 - DNA, 16 bp, P. troglodytes
tgtgctgaataaatgc

SEQ ID NO: 278800 - DNA, 16 bp, P. troglodytes
tgtgctgagctgcctg

SEQ ID NO: 278801 - DNA, 16 bp, P. troglodytes
tgtgctgcactgtggg

SEQ ID NO: 278802 - DNA, 16 bp, P. troglodytes
tgtgctgcagtaacaa

SEQ ID NO: 278803 - DNA, 16 bp, P. troglodytes
tgtgctgctggattct

SEQ ID NO: 278804 - DNA, 16 bp, P. troglodytes
tgtgctggacactgtg

SEQ ID NO: 278805 - DNA, 16 bp, P. troglodytes
tgtgctggagctggct

SEQ ID NO: 278806 - DNA, 16 bp, P. troglodytes
tgtgctggcttcccct

SEQ ID NO: 278807 - DNA, 16 bp, P. troglodytes
tgtgctgggattacag

SEQ ID NO: 278808 - DNA, 18 bp, P. troglodytes
tgtgctgggattacaggc

SEQ ID NO: 278809 - DNA, 16 bp, P. troglodytes
tgtgctgggcactgag

SEQ ID NO: 278810 - DNA, 16 bp, P. troglodytes
tgtgctgggcactggg

SEQ ID NO: 278811 - DNA, 16 bp, P. troglodytes
tgtgctgggcatggtg

SEQ ID NO: 278812 - DNA, 16 bp, P. troglodytes
tgtgctgggtgcagtg

SEQ ID NO: 278813 - DNA, 16 bp, P. troglodytes
tgtgctggtaaatgtt

SEQ ID NO: 278814 - DNA, 16 bp, P. troglodytes
tgtgctgtattcagga

SEQ ID NO: 278815 - DNA, 16 bp, P. troglodytes
tgtgctgtgggctgtg

SEQ ID NO: 278816 - DNA, 16 bp, P. troglodytes
tgtgctgtgtctgcac

SEQ ID NO: 278817 - DNA, 16 bp, P. troglodytes
tgtgctgtgttcagga

SEQ ID NO: 278818 - DNA, 16 bp, P. troglodytes
tgtgctgttataaaca

SEQ ID NO: 278819 - DNA, 16 bp, P. troglodytes
tgtgcttcagtttctc

SEQ ID NO: 278820 - DNA, 16 bp, P. troglodytes
tgtgcttcttggccat

SEQ ID NO: 278821 - DNA, 16 bp, P. troglodytes
tgtgcttgcttctcct

SEQ ID NO: 278822 - DNA, 16 bp, P. troglodytes
tgtgcttggcttattt

SEQ ID NO: 278823 - DNA, 16 bp, P. troglodytes
tgtgcttgtgtatgtg

SEQ ID NO: 278824 - DNA, 16 bp, P. troglodytes
tgtgcttgtgtgtatg

SEQ ID NO: 278825 - DNA, 16 bp, P. troglodytes
tgtgctttaaaaaaat

SEQ ID NO: 278826 - DNA, 16 bp, P. troglodytes
tgtgcttttaaaaaat

SEQ ID NO: 278827 - DNA, 16 bp, P. troglodytes
tgtgcttttggggtca

SEQ ID NO: 278828 - DNA, 16 bp, P. troglodytes
tgtgctttttgtgtca

SEQ ID NO: 278829 - DNA, 16 bp, P. troglodytes
tgtggaaaaactggaa

SEQ ID NO: 278830 - DNA, 16 bp, P. troglodytes
tgtggaaaaatagaaa

SEQ ID NO: 278831 - DNA, 16 bp, P. troglodytes
tgtggaaaatttggaa

SEQ ID NO: 278832 - DNA, 16 bp, P. troglodytes
tgtggaaactgaggca

SEQ ID NO: 278833 - DNA, 16 bp, P. troglodytes
tgtggaaagcagtgtg

SEQ ID NO: 278834 - DNA, 16 bp, P. troglodytes
tgtggaaagcagtttg

SEQ ID NO: 278835 - DNA, 16 bp, P. troglodytes
tgtggaaagcagtttt

SEQ ID NO: 278836 - DNA, 16 bp, P. troglodytes
tgtggaaataaatgaa

SEQ ID NO: 278837 - DNA, 16 bp, P. troglodytes
tgtggaactgtgagtt

SEQ ID NO: 278838 - DNA, 16 bp, P. troglodytes
tgtggaagacagtatg

SEQ ID NO: 278839 - DNA, 16 bp, P. troglodytes
tgtggaagacagtgta

SEQ ID NO: 278840 - DNA, 16 bp, P. troglodytes
tgtggaagacagtgtg

SEQ ID NO: 278841 - DNA, 16 bp, P. troglodytes
tgtggaagccaaggtt

SEQ ID NO: 278842 - DNA, 16 bp, P. troglodytes
tgtggaaggaaaatgt

SEQ ID NO: 278843 - DNA, 16 bp, P. troglodytes
tgtggaagggacccag

SEQ ID NO: 278844 - DNA, 16 bp, P. troglodytes
tgtggaaggggaagca

SEQ ID NO: 278845 - DNA, 16 bp, P. troglodytes
tgtggaaggggaccca

SEQ ID NO: 278846 - DNA, 16 bp, P. troglodytes
tgtggaaggggacccc

SEQ ID NO: 278847 - DNA, 16 bp, P. troglodytes
tgtggaagtagctttg

SEQ ID NO: 278848 - DNA, 16 bp, P. troglodytes
tgtggaagtgactttg

SEQ ID NO: 278849 - DNA, 16 bp, P. troglodytes
tgtggaagtggctttg

SEQ ID NO: 278850 - DNA, 16 bp, P. troglodytes
tgtggaatgaaggtcc

SEQ ID NO: 278851 - DNA, 16 bp, P. troglodytes
tgtggaattttccact

SEQ ID NO: 278852 - DNA, 16 bp, P. troglodytes
tgtggaattttttttc

SEQ ID NO: 278853 - DNA, 16 bp, P. troglodytes
tgtggacagcccaccc

SEQ ID NO: 278854 - DNA, 16 bp, P. troglodytes
tgtggacataagtttt

SEQ ID NO: 278855 - DNA, 16 bp, P. troglodytes
tgtggagaaaaagaga

SEQ ID NO: 278856 - DNA, 16 bp, P. troglodytes
tgtggagaaaagagaa

SEQ ID NO: 278857 - DNA, 16 bp, P. troglodytes
tgtggagaaactgaaa

SEQ ID NO: 278858 - DNA, 16 bp, P. troglodytes
tgtggagaaactggaa

SEQ ID NO: 278859 - DNA, 16 bp, P. troglodytes
tgtggagaaatagaaa

SEQ ID NO: 278860 - DNA, 16 bp, P. troglodytes
tgtggagaaattagaa

SEQ ID NO: 278861 - DNA, 16 bp, P. troglodytes
tgtggagaaattgaaa

SEQ ID NO: 278862 - DNA, 16 bp, P. troglodytes
tgtggagaacagggaa

SEQ ID NO: 278863 - DNA, 16 bp, P. troglodytes
tgtggagatgaggtct

SEQ ID NO: 278864 - DNA, 16 bp, P. troglodytes
tgtggagatggaagac

SEQ ID NO: 278865 - DNA, 16 bp, P. troglodytes
tgtggagatggagttt

SEQ ID NO: 278866 - DNA, 16 bp, P. troglodytes
tgtggagattgcagtg

SEQ ID NO: 278867 - DNA, 16 bp, P. troglodytes
tgtggagcaaagggaa

SEQ ID NO: 278868 - DNA, 16 bp, P. troglodytes
tgtggagcaactggaa

SEQ ID NO: 278869 - DNA, 16 bp, P. troglodytes
tgtggaggaattggaa

SEQ ID NO: 278870 - DNA, 16 bp, P. troglodytes
tgtggaggattttatt

SEQ ID NO: 278871 - DNA, 16 bp, P. troglodytes
tgtggaggctggcaag

SEQ ID NO: 278872 - DNA, 17 bp, P. troglodytes
tgtggagggcctgacat

SEQ ID NO: 278873 - DNA, 16 bp, P. troglodytes
tgtggaggtgaaagac

SEQ ID NO: 278874 - DNA, 16 bp, P. troglodytes
tgtggaggtggaagat

SEQ ID NO: 278875 - DNA, 16 bp, P. troglodytes
tgtggataccactcag

SEQ ID NO: 278876 - DNA, 16 bp, P. troglodytes
tgtggatatgttttca

SEQ ID NO: 278877 - DNA, 16 bp, P. troglodytes
tgtggatctatttctg

SEQ ID NO: 278878 - DNA, 16 bp, P. troglodytes
tgtggatgagaactaa

SEQ ID NO: 278879 - DNA, 16 bp, P. troglodytes
tgtggatggcaaggac

SEQ ID NO: 278880 - DNA, 16 bp, P. troglodytes
tgtggatggtggcagg

SEQ ID NO: 278881 - DNA, 16 bp, P. troglodytes
tgtggatgtggagaaa

SEQ ID NO: 278882 - DNA, 16 bp, P. troglodytes
tgtggatgtggatgtg

SEQ ID NO: 278883 - DNA, 16 bp, P. troglodytes
tgtggattacaatttg

SEQ ID NO: 278884 - DNA, 16 bp, P. troglodytes
tgtggattttcaactg

SEQ ID NO: 278885 - DNA, 16 bp, P. troglodytes
tgtggcaaatggcaga

SEQ ID NO: 278886 - DNA, 16 bp, P. troglodytes
tgtggcacatatatgc

SEQ ID NO: 278887 - DNA, 16 bp, P. troglodytes
tgtggcacatgcctat

SEQ ID NO: 278888 - DNA, 16 bp, P. troglodytes
tgtggcactgcctagt

SEQ ID NO: 278889 - DNA, 16 bp, P. troglodytes
tgtggcagagactgct

SEQ ID NO: 278890 - DNA, 16 bp, P. troglodytes
tgtggcagagctggga

SEQ ID NO: 278891 - DNA, 16 bp, P. troglodytes
tgtggcaggaggattg

SEQ ID NO: 278892 - DNA, 16 bp, P. troglodytes
tgtggcagggtgggga

SEQ ID NO: 278893 - DNA, 16 bp, P. troglodytes
tgtggcagtactttct

SEQ ID NO: 278894 - DNA, 16 bp, P. troglodytes
tgtggcagttcctcaa

SEQ ID NO: 278895 - DNA, 16 bp, P. troglodytes
tgtggcattatttctg

SEQ ID NO: 278896 - DNA, 16 bp, P. troglodytes
tgtggcattgtttctg

SEQ ID NO: 278897 - DNA, 16 bp, P. troglodytes
tgtggcatttgtcttt

SEQ ID NO: 278898 - DNA, 16 bp, P. troglodytes
tgtggcattttgttac

SEQ ID NO: 278899 - DNA, 16 bp, P. troglodytes
tgtggccaacatggtg

SEQ ID NO: 278900 - DNA, 16 bp, P. troglodytes
tgtggccacatcactc

SEQ ID NO: 278901 - DNA, 16 bp, P. troglodytes
tgtggccaccaccacc

SEQ ID NO: 278902 - DNA, 16 bp, P. troglodytes
tgtggccaccaccact

SEQ ID NO: 278903 - DNA, 16 bp, P. troglodytes
tgtggccaggctggag

SEQ ID NO: 278904 - DNA, 16 bp, P. troglodytes
tgtggccagtggtgcc

SEQ ID NO: 278905 - DNA, 16 bp, P. troglodytes
tgtggccattgctttt

SEQ ID NO: 278906 - DNA, 16 bp, P. troglodytes
tgtggccatttttgca

SEQ ID NO: 278907 - DNA, 16 bp, P. troglodytes
tgtggcccaacacaaa

SEQ ID NO: 278908 - DNA, 16 bp, P. troglodytes
tgtggcccagagaagc

SEQ ID NO: 278909 - DNA, 16 bp, P. troglodytes
tgtggcccaggaaagc

SEQ ID NO: 278910 - DNA, 16 bp, P. troglodytes
tgtggcccaggccaga

SEQ ID NO: 278911 - DNA, 16 bp, P. troglodytes
tgtggcccaggctggg

SEQ ID NO: 278912 - DNA, 16 bp, P. troglodytes
tgtggcccctgctgct

SEQ ID NO: 278913 - DNA, 16 bp, P. troglodytes
tgtggcctgagagact

SEQ ID NO: 278914 - DNA, 16 bp, P. troglodytes
tgtggccttgggcaag

SEQ ID NO: 278915 - DNA, 16 bp, P. troglodytes
tgtggccttttcagat

SEQ ID NO: 278916 - DNA, 16 bp, P. troglodytes
tgtggcgcacacctgt

SEQ ID NO: 278917 - DNA, 16 bp, P. troglodytes
tgtggctactgtaaat

SEQ ID NO: 278918 - DNA, 16 bp, P. troglodytes
tgtggctattttaaat

SEQ ID NO: 278919 - DNA, 16 bp, P. troglodytes
tgtggctcacgcctgt

SEQ ID NO: 278920 - DNA, 16 bp, P. troglodytes
tgtggctcagcctccc

SEQ ID NO: 278921 - DNA, 16 bp, P. troglodytes
tgtggctcaggtgggc

SEQ ID NO: 278922 - DNA, 16 bp, P. troglodytes
tgtggctcccacccag

SEQ ID NO: 278923 - DNA, 16 bp, P. troglodytes
tgtggctcccacctgt

SEQ ID NO: 278924 - DNA, 16 bp, P. troglodytes
tgtggctctgcaggat

SEQ ID NO: 278925 - DNA, 16 bp, P. troglodytes
tgtggctgaagcagag

SEQ ID NO: 278926 - DNA, 16 bp, P. troglodytes
tgtggctgagctggca

SEQ ID NO: 278927 - DNA, 16 bp, P. troglodytes
tgtggctgagctggtg

SEQ ID NO: 278928 - DNA, 16 bp, P. troglodytes
tgtggctgctctcaca

SEQ ID NO: 278929 - DNA, 16 bp, P. troglodytes
tgtggctgctgctgct

SEQ ID NO: 278930 - DNA, 16 bp, P. troglodytes
tgtggctgctttcctg

SEQ ID NO: 278931 - DNA, 16 bp, P. troglodytes
tgtggctggaccagat

SEQ ID NO: 278932 - DNA, 16 bp, P. troglodytes
tgtggctggaccaggt

SEQ ID NO: 278933 - DNA, 16 bp, P. troglodytes
tgtggctggagaagag

SEQ ID NO: 278934 - DNA, 16 bp, P. troglodytes
tgtggctggagcagaa

SEQ ID NO: 278935 - DNA, 16 bp, P. troglodytes
tgtggctggagcaggg

SEQ ID NO: 278936 - DNA, 16 bp, P. troglodytes
tgtggctggagcccag

SEQ ID NO: 278937 - DNA, 16 bp, P. troglodytes
tgtggctggggaggcc

SEQ ID NO: 278938 - DNA, 16 bp, P. troglodytes
tgtggctgtgctggag

SEQ ID NO: 278939 - DNA, 16 bp, P. troglodytes
tgtggctgtggctgtg

SEQ ID NO: 278940 - DNA, 16 bp, P. troglodytes
tgtggctgtgtcccca

SEQ ID NO: 278941 - DNA, 16 bp, P. troglodytes
tgtggcttcagagggt

SEQ ID NO: 278942 - DNA, 16 bp, P. troglodytes
tgtggcttgggcttcc

SEQ ID NO: 278943 - DNA, 16 bp, P. troglodytes
tgtggcttgtcttctc

SEQ ID NO: 278944 - DNA, 16 bp, P. troglodytes
tgtggctttgcagggt

SEQ ID NO: 278945 - DNA, 16 bp, P. troglodytes
tgtggctttttaaaaa

SEQ ID NO: 278946 - DNA, 16 bp, P. troglodytes
tgtgggaaagccttca

SEQ ID NO: 278947 - DNA, 16 bp, P. troglodytes
tgtgggaaagccttta

SEQ ID NO: 278948 - DNA, 16 bp, P. troglodytes
tgtgggaaaggcctct

SEQ ID NO: 278949 - DNA, 16 bp, P. troglodytes
tgtgggaagattttta

SEQ ID NO: 278950 - DNA, 16 bp, P. troglodytes
tgtgggaaggccttca

SEQ ID NO: 278951 - DNA, 16 bp, P. troglodytes
tgtgggaaggttttta

SEQ ID NO: 278952 - DNA, 16 bp, P. troglodytes
tgtgggagagacccgg

SEQ ID NO: 278953 - DNA, 16 bp, P. troglodytes
tgtgggagctaaaaat

SEQ ID NO: 278954 - DNA, 16 bp, P. troglodytes
tgtgggaggccaaggc

SEQ ID NO: 278955 - DNA, 16 bp, P. troglodytes
tgtgggagggaactgg

SEQ ID NO: 278956 - DNA, 16 bp, P. troglodytes
tgtgggcacagcttca

SEQ ID NO: 278957 - DNA, 16 bp, P. troglodytes
tgtgggcagggccatg

SEQ ID NO: 278958 - DNA, 16 bp, P. troglodytes
tgtgggcagggctgca

SEQ ID NO: 278959 - DNA, 16 bp, P. troglodytes
tgtgggcatctttggg

SEQ ID NO: 278960 - DNA, 25 bp, P. troglodytes
tgtgggcatttagtgctataaattt

SEQ ID NO: 278961 - DNA, 17 bp, P. troglodytes
tgtgggcatttggtgct

SEQ ID NO: 278962 - DNA, 16 bp, P. troglodytes
tgtgggccaggcatgg

SEQ ID NO: 278963 - DNA, 16 bp, P. troglodytes
tgtgggccaggcccag

SEQ ID NO: 278964 - DNA, 16 bp, P. troglodytes
tgtgggccaggccctg

SEQ ID NO: 278965 - DNA, 16 bp, P. troglodytes
tgtgggccaggctagt

SEQ ID NO: 278966 - DNA, 16 bp, P. troglodytes
tgtgggccccaagatc

SEQ ID NO: 278967 - DNA, 16 bp, P. troglodytes
tgtgggcccttttttg

SEQ ID NO: 278968 - DNA, 16 bp, P. troglodytes
tgtgggctgggcatgg

SEQ ID NO: 278969 - DNA, 16 bp, P. troglodytes
tgtgggcttttaaaaa

SEQ ID NO: 278970 - DNA, 16 bp, P. troglodytes
tgtggggaaaggaaag

SEQ ID NO: 278971 - DNA, 16 bp, P. troglodytes
tgtggggacatggatg

SEQ ID NO: 278972 - DNA, 16 bp, P. troglodytes
tgtggggagcagtgtc

SEQ ID NO: 278973 - DNA, 16 bp, P. troglodytes
tgtggggccagagccc

SEQ ID NO: 278974 - DNA, 16 bp, P. troglodytes
tgtgggggctccaaac

SEQ ID NO: 278975 - DNA, 16 bp, P. troglodytes
tgtgggggctgccctg

SEQ ID NO: 278976 - DNA, 16 bp, P. troglodytes
tgtggggttgtcatag

SEQ ID NO: 278977 - DNA, 16 bp, P. troglodytes
tgtgggtcaggaatct

SEQ ID NO: 278978 - DNA, 16 bp, P. troglodytes
tgtgggtctatttcta

SEQ ID NO: 278979 - DNA, 16 bp, P. troglodytes
tgtgggtctctcagcc

SEQ ID NO: 278980 - DNA, 16 bp, P. troglodytes
tgtgggtgggcctcat

SEQ ID NO: 278981 - DNA, 16 bp, P. troglodytes
tgtgggtgtgtatata

SEQ ID NO: 278982 - DNA, 16 bp, P. troglodytes
tgtgggttccacatct

SEQ ID NO: 278983 - DNA, 17 bp, P. troglodytes
tgtgggttgtctcttca

SEQ ID NO: 278984 - DNA, 16 bp, P. troglodytes
tgtgggtttaaaaaaa

SEQ ID NO: 278985 - DNA, 16 bp, P. troglodytes
tgtgggtttgtaataa

SEQ ID NO: 278986 - DNA, 16 bp, P. troglodytes
tgtgggttttgacaaa

SEQ ID NO: 278987 - DNA, 16 bp, P. troglodytes
tgtggtaaaacacaca

SEQ ID NO: 278988 - DNA, 16 bp, P. troglodytes
tgtggtaattctattt

SEQ ID NO: 278989 - DNA, 16 bp, P. troglodytes
tgtggtagccaggatg

SEQ ID NO: 278990 - DNA, 16 bp, P. troglodytes
tgtggtatttgctttt

SEQ ID NO: 278991 - DNA, 16 bp, P. troglodytes
tgtggtcagagaagat

SEQ ID NO: 278992 - DNA, 16 bp, P. troglodytes
tgtggtccatcattga

SEQ ID NO: 278993 - DNA, 16 bp, P. troglodytes
tgtggtcccagccact

SEQ ID NO: 278994 - DNA, 16 bp, P. troglodytes
tgtggtcccagctgct

SEQ ID NO: 278995 - DNA, 16 bp, P. troglodytes
tgtggtcccagttact

SEQ ID NO: 278996 - DNA, 16 bp, P. troglodytes
tgtggtccccacccag

SEQ ID NO: 278997 - DNA, 16 bp, P. troglodytes
tgtggtccccagacca

SEQ ID NO: 278998 - DNA, 16 bp, P. troglodytes
tgtggtccctgaacca

SEQ ID NO: 278999 - DNA, 16 bp, P. troglodytes
tgtggtccctggacca

SEQ ID NO: 279000 - DNA, 16 bp, P. troglodytes
tgtggtcctagctact

SEQ ID NO: 279001 - DNA, 16 bp, P. troglodytes
tgtggtcctagttact

SEQ ID NO: 279002 - DNA, 16 bp, P. troglodytes
tgtggtcgtgccactg

SEQ ID NO: 279003 - DNA, 16 bp, P. troglodytes
tgtggtcttggacaag

SEQ ID NO: 279004 - DNA, 16 bp, P. troglodytes
tgtggtgacaggcacc

SEQ ID NO: 279005 - DNA, 16 bp, P. troglodytes
tgtggtgagaacactt

SEQ ID NO: 279006 - DNA, 18 bp, P. troglodytes
tgtggtgagctgagatca

SEQ ID NO: 279007 - DNA, 16 bp, P. troglodytes
tgtggtgaggacactt

SEQ ID NO: 279008 - DNA, 16 bp, P. troglodytes
tgtggtgagtgttaca

SEQ ID NO: 279009 - DNA, 16 bp, P. troglodytes
tgtggtgatcatttca

SEQ ID NO: 279010 - DNA, 16 bp, P. troglodytes
tgtggtgattcctcaa

SEQ ID NO: 279011 - DNA, 16 bp, P. troglodytes
tgtggtgccagctact

SEQ ID NO: 279012 - DNA, 16 bp, P. troglodytes
tgtggtgcctcctctg

SEQ ID NO: 279013 - DNA, 16 bp, P. troglodytes
tgtggtggagcatgcc

SEQ ID NO: 279014 - DNA, 16 bp, P. troglodytes
tgtggtggagtgcacc

SEQ ID NO: 279015 - DNA, 17 bp, P. troglodytes
tgtggtggcacacacct

SEQ ID NO: 279016 - DNA, 16 bp, P. troglodytes
tgtggtggcacaggcc

SEQ ID NO: 279017 - DNA, 22 bp, P. troglodytes
tgtggtggcaggcgcctgtaat

SEQ ID NO: 279018 - DNA, 16 bp, P. troglodytes
tgtggtggcaggggcc

SEQ ID NO: 279019 - DNA, 16 bp, P. troglodytes
tgtggtggcaggtgcc

SEQ ID NO: 279020 - DNA, 16 bp, P. troglodytes
tgtggtggcatgtggc

SEQ ID NO: 279021 - DNA, 17 bp, P. troglodytes
tgtggtggctcacgcct

SEQ ID NO: 279022 - DNA, 16 bp, P. troglodytes
tgtggtggcttatgct

SEQ ID NO: 279023 - DNA, 16 bp, P. troglodytes
tgtggtggcttgtgcc

SEQ ID NO: 279024 - DNA, 16 bp, P. troglodytes
tgtggtggtgcatatc

SEQ ID NO: 279025 - DNA, 16 bp, P. troglodytes
tgtggtggtgcccgcc

SEQ ID NO: 279026 - DNA, 16 bp, P. troglodytes
tgtggtggtggacacc

SEQ ID NO: 279027 - DNA, 16 bp, P. troglodytes
tgtggtggtggctgcc

SEQ ID NO: 279028 - DNA, 16 bp, P. troglodytes
tgtggtggtgggcatc

SEQ ID NO: 279029 - DNA, 16 bp, P. troglodytes
tgtggtgtgtgtatat

SEQ ID NO: 279030 - DNA, 16 bp, P. troglodytes
tgtggtgttccccttc

SEQ ID NO: 279031 - DNA, 16 bp, P. troglodytes
tgtggtgttctctcta

SEQ ID NO: 279032 - DNA, 16 bp, P. troglodytes
tgtggttacaggtgtg

SEQ ID NO: 279033 - DNA, 16 bp, P. troglodytes
tgtggttcccagtcca

SEQ ID NO: 279034 - DNA, 16 bp, P. troglodytes
tgtggttgcaggtgcc

SEQ ID NO: 279035 - DNA, 16 bp, P. troglodytes
tgtggtttaaaaaaat

SEQ ID NO: 279036 - DNA, 16 bp, P. troglodytes
tgtggtttaacaagcc

SEQ ID NO: 279037 - DNA, 16 bp, P. troglodytes
tgtggtttcactttcc

SEQ ID NO: 279038 - DNA, 16 bp, P. troglodytes
tgtggttttaaaaata

SEQ ID NO: 279039 - DNA, 16 bp, P. troglodytes
tgtggttttatttctg

SEQ ID NO: 279040 - DNA, 16 bp, P. troglodytes
tgtggtttttgtcatt

SEQ ID NO: 279041 - DNA, 16 bp, P. troglodytes
tgtgtaaaatgaggat

SEQ ID NO: 279042 - DNA, 16 bp, P. troglodytes
tgtgtaaactactttt

SEQ ID NO: 279043 - DNA, 16 bp, P. troglodytes
tgtgtaaaggtgttca

SEQ ID NO: 279044 - DNA, 16 bp, P. troglodytes
tgtgtaaatatgtgtg

SEQ ID NO: 279045 - DNA, 16 bp, P. troglodytes
tgtgtaaattatatct

SEQ ID NO: 279046 - DNA, 16 bp, P. troglodytes
tgtgtaaatttaaaaa

SEQ ID NO: 279047 - DNA, 16 bp, P. troglodytes
tgtgtaagtatactct

SEQ ID NO: 279048 - DNA, 16 bp, P. troglodytes
tgtgtaagtctttaat

SEQ ID NO: 279049 - DNA, 16 bp, P. troglodytes
tgtgtaagtttgctga

SEQ ID NO: 279050 - DNA, 16 bp, P. troglodytes
tgtgtaatgataaaat

SEQ ID NO: 279051 - DNA, 16 bp, P. troglodytes
tgtgtaatgatcaaat

SEQ ID NO: 279052 - DNA, 16 bp, P. troglodytes
tgtgtacaagtgtgtg

SEQ ID NO: 279053 - DNA, 16 bp, P. troglodytes
tgtgtacacacataca

SEQ ID NO: 279054 - DNA, 16 bp, P. troglodytes
tgtgtacagattattt

SEQ ID NO: 279055 - DNA, 16 bp, P. troglodytes
tgtgtacagatttttg

SEQ ID NO: 279056 - DNA, 16 bp, P. troglodytes
tgtgtacatatattta

SEQ ID NO: 279057 - DNA, 16 bp, P. troglodytes
tgtgtacatatgtgtg

SEQ ID NO: 279058 - DNA, 16 bp, P. troglodytes
tgtgtacatgcacaca

SEQ ID NO: 279059 - DNA, 16 bp, P. troglodytes
tgtgtacatgtgtgca

SEQ ID NO: 279060 - DNA, 16 bp, P. troglodytes
tgtgtaccaccatgcc

SEQ ID NO: 279061 - DNA, 16 bp, P. troglodytes
tgtgtacgtgtctgtg

SEQ ID NO: 279062 - DNA, 16 bp, P. troglodytes
tgtgtactcaatattt

SEQ ID NO: 279063 - DNA, 16 bp, P. troglodytes
tgtgtactttttaaaa

SEQ ID NO: 279064 - DNA, 16 bp, P. troglodytes
tgtgtatacaaataca

SEQ ID NO: 279065 - DNA, 16 bp, P. troglodytes
tgtgtatacataaata

SEQ ID NO: 279066 - DNA, 16 bp, P. troglodytes
tgtgtatacatacata

SEQ ID NO: 279067 - DNA, 16 bp, P. troglodytes
tgtgtatataacatat

SEQ ID NO: 279068 - DNA, 16 bp, P. troglodytes
tgtgtatatacacacg

SEQ ID NO: 279069 - DNA, 16 bp, P. troglodytes
tgtgtatatacataaa

SEQ ID NO: 279070 - DNA, 16 bp, P. troglodytes
tgtgtatatacatgca

SEQ ID NO: 279071 - DNA, 16 bp, P. troglodytes
tgtgtatatataaaaa

SEQ ID NO: 279072 - DNA, 17 bp, P. troglodytes
tgtgtatatatacatat

SEQ ID NO: 279073 - DNA, 16 bp, P. troglodytes
tgtgtatatatagata

SEQ ID NO: 279074 - DNA, 16 bp, P. troglodytes
tgtgtatatatatagt

SEQ ID NO: 279075 - DNA, 16 bp, P. troglodytes
tgtgtatatatatgtc

SEQ ID NO: 279076 - DNA, 16 bp, P. troglodytes
tgtgtatatatctcta

SEQ ID NO: 279077 - DNA, 16 bp, P. troglodytes
tgtgtatatatgcata

SEQ ID NO: 279078 - DNA, 16 bp, P. troglodytes
tgtgtatatatgtata

SEQ ID NO: 279079 - DNA, 16 bp, P. troglodytes
tgtgtatatatgtatt

SEQ ID NO: 279080 - DNA, 16 bp, P. troglodytes
tgtgtatatatttgca

SEQ ID NO: 279081 - DNA, 16 bp, P. troglodytes
tgtgtatatgggtgtg

SEQ ID NO: 279082 - DNA, 16 bp, P. troglodytes
tgtgtatatgtacaca

SEQ ID NO: 279083 - DNA, 16 bp, P. troglodytes
tgtgtatatgtataaa

SEQ ID NO: 279084 - DNA, 16 bp, P. troglodytes
tgtgtatatgtgcaca

SEQ ID NO: 279085 - DNA, 16 bp, P. troglodytes
tgtgtatatgtgtata

SEQ ID NO: 279086 - DNA, 16 bp, P. troglodytes
tgtgtatatgtgtgtg

SEQ ID NO: 279087 - DNA, 16 bp, P. troglodytes
tgtgtatatttataaa

SEQ ID NO: 279088 - DNA, 16 bp, P. troglodytes
tgtgtatatttatggg

SEQ ID NO: 279089 - DNA, 16 bp, P. troglodytes
tgtgtatctatacata

SEQ ID NO: 279090 - DNA, 16 bp, P. troglodytes
tgtgtatgaatgtgtg

SEQ ID NO: 279091 - DNA, 16 bp, P. troglodytes
tgtgtatgagagtgtg

SEQ ID NO: 279092 - DNA, 16 bp, P. troglodytes
tgtgtatgagtgtgtg

SEQ ID NO: 279093 - DNA, 16 bp, P. troglodytes
tgtgtatgcatatgta

SEQ ID NO: 279094 - DNA, 16 bp, P. troglodytes
tgtgtatgcatgtgtg

SEQ ID NO: 279095 - DNA, 16 bp, P. troglodytes
tgtgtatgtaaatata

SEQ ID NO: 279096 - DNA, 16 bp, P. troglodytes
tgtgtatgtataaata

SEQ ID NO: 279097 - DNA, 16 bp, P. troglodytes
tgtgtatgtatgcatg

SEQ ID NO: 279098 - DNA, 16 bp, P. troglodytes
tgtgtatgtatgtgtg

SEQ ID NO: 279099 - DNA, 16 bp, P. troglodytes
tgtgtatgtctgtgta

SEQ ID NO: 279100 - DNA, 16 bp, P. troglodytes
tgtgtatgtctgtgtg

SEQ ID NO: 279101 - DNA, 16 bp, P. troglodytes
tgtgtatgtgcacaca

SEQ ID NO: 279102 - DNA, 16 bp, P. troglodytes
tgtgtatgtgcctgtg

SEQ ID NO: 279103 - DNA, 16 bp, P. troglodytes
tgtgtatgtgtatgca

SEQ ID NO: 279104 - DNA, 16 bp, P. troglodytes
tgtgtatgtgtatgtg

SEQ ID NO: 279105 - DNA, 16 bp, P. troglodytes
tgtgtatgtgtgcata

SEQ ID NO: 279106 - DNA, 16 bp, P. troglodytes
tgtgtatgtgtgtgac

SEQ ID NO: 279107 - DNA, 16 bp, P. troglodytes
tgtgtatgtgtgtgca

SEQ ID NO: 279108 - DNA, 16 bp, P. troglodytes
tgtgtatgtgtgtgta

SEQ ID NO: 279109 - DNA, 17 bp, P. troglodytes
tgtgtatttagtagaga

SEQ ID NO: 279110 - DNA, 16 bp, P. troglodytes
tgtgtatttatataca

SEQ ID NO: 279111 - DNA, 16 bp, P. troglodytes
tgtgtatttatttact

SEQ ID NO: 279112 - DNA, 16 bp, P. troglodytes
tgtgtatttcaaaata

SEQ ID NO: 279113 - DNA, 16 bp, P. troglodytes
tgtgtattttaccaca

SEQ ID NO: 279114 - DNA, 16 bp, P. troglodytes
tgtgtattttttaaag

SEQ ID NO: 279115 - DNA, 16 bp, P. troglodytes
tgtgtcaaagaagaaa

SEQ ID NO: 279116 - DNA, 16 bp, P. troglodytes
tgtgtcaagcactgtg

SEQ ID NO: 279117 - DNA, 16 bp, P. troglodytes
tgtgtcacatagttct

SEQ ID NO: 279118 - DNA, 17 bp, P. troglodytes
tgtgtcaccaggctgga

SEQ ID NO: 279119 - DNA, 16 bp, P. troglodytes
tgtgtcagagagagag

SEQ ID NO: 279120 - DNA, 16 bp, P. troglodytes
tgtgtcagtacttcat

SEQ ID NO: 279121 - DNA, 16 bp, P. troglodytes
tgtgtccagaattggt

SEQ ID NO: 279122 - DNA, 16 bp, P. troglodytes
tgtgtccatgtgctct

SEQ ID NO: 279123 - DNA, 17 bp, P. troglodytes
tgtgtcccagggattct

SEQ ID NO: 279124 - DNA, 16 bp, P. troglodytes
tgtgtccccacctgaa

SEQ ID NO: 279125 - DNA, 16 bp, P. troglodytes
tgtgtccccagcacct

SEQ ID NO: 279126 - DNA, 16 bp, P. troglodytes
tgtgtcccccccaaaa

SEQ ID NO: 279127 - DNA, 16 bp, P. troglodytes
tgtgtcctcatgtggt

SEQ ID NO: 279128 - DNA, 16 bp, P. troglodytes
tgtgtcctctgcctgg

SEQ ID NO: 279129 - DNA, 21 bp, P. troglodytes
tgtgtctagctcagggtttgt

SEQ ID NO: 279130 - DNA, 16 bp, P. troglodytes
tgtgtctatgtgtata

SEQ ID NO: 279131 - DNA, 16 bp, P. troglodytes
tgtgtctcaaaaataa

SEQ ID NO: 279132 - DNA, 16 bp, P. troglodytes
tgtgtctcagtgtgga

SEQ ID NO: 279133 - DNA, 16 bp, P. troglodytes
tgtgtctcccaaaatt

SEQ ID NO: 279134 - DNA, 16 bp, P. troglodytes
tgtgtctccctaaaat

SEQ ID NO: 279135 - DNA, 16 bp, P. troglodytes
tgtgtctctatttcct

SEQ ID NO: 279136 - DNA, 16 bp, P. troglodytes
tgtgtctctgcatgtg

SEQ ID NO: 279137 - DNA, 16 bp, P. troglodytes
tgtgtctctgtctcct

SEQ ID NO: 279138 - DNA, 16 bp, P. troglodytes
tgtgtctctgtgtgta

SEQ ID NO: 279139 - DNA, 16 bp, P. troglodytes
tgtgtctctgtgtgtg

SEQ ID NO: 279140 - DNA, 16 bp, P. troglodytes
tgtgtctgagtgtgtg

SEQ ID NO: 279141 - DNA, 17 bp, P. troglodytes
tgtgtctgcatgtgtgt

SEQ ID NO: 279142 - DNA, 16 bp, P. troglodytes
tgtgtctggcttcctt

SEQ ID NO: 279143 - DNA, 16 bp, P. troglodytes
tgtgtctgtatgtgtt

SEQ ID NO: 279144 - DNA, 16 bp, P. troglodytes
tgtgtctgtctctgtg

SEQ ID NO: 279145 - DNA, 16 bp, P. troglodytes
tgtgtctgtgaagatg

SEQ ID NO: 279146 - DNA, 16 bp, P. troglodytes
tgtgtctgtgatggtg

SEQ ID NO: 279147 - DNA, 16 bp, P. troglodytes
tgtgtctgtgccaggc

SEQ ID NO: 279148 - DNA, 16 bp, P. troglodytes
tgtgtctgtgcctgtg

SEQ ID NO: 279149 - DNA, 16 bp, P. troglodytes
tgtgtctgtgtccaaa

SEQ ID NO: 279150 - DNA, 16 bp, P. troglodytes
tgtgtctgtgtgcata

SEQ ID NO: 279151 - DNA, 16 bp, P. troglodytes
tgtgtctgtgtgtatg

SEQ ID NO: 279152 - DNA, 16 bp, P. troglodytes
tgtgtctgtgtgtcta

SEQ ID NO: 279153 - DNA, 16 bp, P. troglodytes
tgtgtctgtgtgtgta

SEQ ID NO: 279154 - DNA, 16 bp, P. troglodytes
tgtgtctgtgtgttta

SEQ ID NO: 279155 - DNA, 16 bp, P. troglodytes
tgtgtctgtttgcaga

SEQ ID NO: 279156 - DNA, 16 bp, P. troglodytes
tgtgtctgtttttgta

SEQ ID NO: 279157 - DNA, 16 bp, P. troglodytes
tgtgtcttcacatggt

SEQ ID NO: 279158 - DNA, 16 bp, P. troglodytes
tgtgtcttcattttta

SEQ ID NO: 279159 - DNA, 16 bp, P. troglodytes
tgtgtcttgtaatttt

SEQ ID NO: 279160 - DNA, 16 bp, P. troglodytes
tgtgtctttatagaat

SEQ ID NO: 279161 - DNA, 16 bp, P. troglodytes
tgtgtctttataggag

SEQ ID NO: 279162 - DNA, 17 bp, P. troglodytes
tgtgtctttatcataga

SEQ ID NO: 279163 - DNA, 16 bp, P. troglodytes
tgtgtctttgcatatg

SEQ ID NO: 279164 - DNA, 16 bp, P. troglodytes
tgtgtctttgtgtgta

SEQ ID NO: 279165 - DNA, 16 bp, P. troglodytes
tgtgtgaaactgcttt

SEQ ID NO: 279166 - DNA, 16 bp, P. troglodytes
tgtgtgaacatcacag

SEQ ID NO: 279167 - DNA, 16 bp, P. troglodytes
tgtgtgaacatcatag

SEQ ID NO: 279168 - DNA, 16 bp, P. troglodytes
tgtgtgaacccaggag

SEQ ID NO: 279169 - DNA, 16 bp, P. troglodytes
tgtgtgaatatgtgtg

SEQ ID NO: 279170 - DNA, 16 bp, P. troglodytes
tgtgtgaatattttct

SEQ ID NO: 279171 - DNA, 16 bp, P. troglodytes
tgtgtgaatgtatgta

SEQ ID NO: 279172 - DNA, 16 bp, P. troglodytes
tgtgtgaatgtgtatg

SEQ ID NO: 279173 - DNA, 16 bp, P. troglodytes
tgtgtgaatttgggca

SEQ ID NO: 279174 - DNA, 16 bp, P. troglodytes
tgtgtgacagagagag

SEQ ID NO: 279175 - DNA, 16 bp, P. troglodytes
tgtgtgacccaagaca

SEQ ID NO: 279176 - DNA, 16 bp, P. troglodytes
tgtgtgaccctaggca

SEQ ID NO: 279177 - DNA, 16 bp, P. troglodytes
tgtgtgaccctgggta

SEQ ID NO: 279178 - DNA, 16 bp, P. troglodytes
tgtgtgacctgggcaa

SEQ ID NO: 279179 - DNA, 16 bp, P. troglodytes
tgtgtgaccttgagaa

SEQ ID NO: 279180 - DNA, 16 bp, P. troglodytes
tgtgtgaccttgagca

SEQ ID NO: 279181 - DNA, 16 bp, P. troglodytes
tgtgtgaccttgggaa

SEQ ID NO: 279182 - DNA, 16 bp, P. troglodytes
tgtgtgaccttgggca

SEQ ID NO: 279183 - DNA, 17 bp, P. troglodytes
tgtgtgaccttgggcag

SEQ ID NO: 279184 - DNA, 16 bp, P. troglodytes
tgtgtgactggcttat

SEQ ID NO: 279185 - DNA, 16 bp, P. troglodytes
tgtgtgacttgggcaa

SEQ ID NO: 279186 - DNA, 16 bp, P. troglodytes
tgtgtgacttggggca

SEQ ID NO: 279187 - DNA, 16 bp, P. troglodytes
tgtgtgactttgagca

SEQ ID NO: 279188 - DNA, 16 bp, P. troglodytes
tgtgtgactttggaaa

SEQ ID NO: 279189 - DNA, 16 bp, P. troglodytes
tgtgtgagagggagag

SEQ ID NO: 279190 - DNA, 16 bp, P. troglodytes
tgtgtgagagtgtgtg

SEQ ID NO: 279191 - DNA, 16 bp, P. troglodytes
tgtgtgagcgtgtgtg

SEQ ID NO: 279192 - DNA, 16 bp, P. troglodytes
tgtgtgagcttgggca

SEQ ID NO: 279193 - DNA, 16 bp, P. troglodytes
tgtgtgaggtgtctgt

SEQ ID NO: 279194 - DNA, 16 bp, P. troglodytes
tgtgtgagtgcgtgtg

SEQ ID NO: 279195 - DNA, 16 bp, P. troglodytes
tgtgtgagtgtatgag

SEQ ID NO: 279196 - DNA, 16 bp, P. troglodytes
tgtgtgagtgtgtgca

SEQ ID NO: 279197 - DNA, 16 bp, P. troglodytes
tgtgtgatcctgggca

SEQ ID NO: 279198 - DNA, 16 bp, P. troglodytes
tgtgtgatgtgtgtga

SEQ ID NO: 279199 - DNA, 16 bp, P. troglodytes
tgtgtgatgtttatat

SEQ ID NO: 279200 - DNA, 16 bp, P. troglodytes
tgtgtgcaagtgtgtg

SEQ ID NO: 279201 - DNA, 16 bp, P. troglodytes
tgtgtgcacacacgca

SEQ ID NO: 279202 - DNA, 16 bp, P. troglodytes
tgtgtgcacacatgtg

SEQ ID NO: 279203 - DNA, 16 bp, P. troglodytes
tgtgtgcacatataca

SEQ ID NO: 279204 - DNA, 16 bp, P. troglodytes
tgtgtgcacatatgtg

SEQ ID NO: 279205 - DNA, 16 bp, P. troglodytes
tgtgtgcacatgtgta

SEQ ID NO: 279206 - DNA, 16 bp, P. troglodytes
tgtgtgcacgcacaca

SEQ ID NO: 279207 - DNA, 16 bp, P. troglodytes
tgtgtgcacgcgcgca

SEQ ID NO: 279208 - DNA, 16 bp, P. troglodytes
tgtgtgcacgtgcatg

SEQ ID NO: 279209 - DNA, 16 bp, P. troglodytes
tgtgtgcacgtgtgtg

SEQ ID NO: 279210 - DNA, 16 bp, P. troglodytes
tgtgtgcaggtgtgtg

SEQ ID NO: 279211 - DNA, 16 bp, P. troglodytes
tgtgtgcagtggctca

SEQ ID NO: 279212 - DNA, 16 bp, P. troglodytes
tgtgtgcatacatatg

SEQ ID NO: 279213 - DNA, 16 bp, P. troglodytes
tgtgtgcatagaggtg

SEQ ID NO: 279214 - DNA, 16 bp, P. troglodytes
tgtgtgcatctgtgca

SEQ ID NO: 279215 - DNA, 16 bp, P. troglodytes
tgtgtgcatctgtgtg

SEQ ID NO: 279216 - DNA, 16 bp, P. troglodytes
tgtgtgcatgcacatg

SEQ ID NO: 279217 - DNA, 16 bp, P. troglodytes
tgtgtgcatgtatgtg

SEQ ID NO: 279218 - DNA, 16 bp, P. troglodytes
tgtgtgcatgtgtata

SEQ ID NO: 279219 - DNA, 16 bp, P. troglodytes
tgtgtgcatgtgtgca

SEQ ID NO: 279220 - DNA, 16 bp, P. troglodytes
tgtgtgcatgtgtgct

SEQ ID NO: 279221 - DNA, 16 bp, P. troglodytes
tgtgtgcatttatttt

SEQ ID NO: 279222 - DNA, 16 bp, P. troglodytes
tgtgtgccacagaggt

SEQ ID NO: 279223 - DNA, 18 bp, P. troglodytes
tgtgtgccaccatgcccg

SEQ ID NO: 279224 - DNA, 16 bp, P. troglodytes
tgtgtgccaggccctg

SEQ ID NO: 279225 - DNA, 16 bp, P. troglodytes
tgtgtgccaggctctg

SEQ ID NO: 279226 - DNA, 16 bp, P. troglodytes
tgtgtgccatcatgcc

SEQ ID NO: 279227 - DNA, 16 bp, P. troglodytes
tgtgtgcccaggctgg

SEQ ID NO: 279228 - DNA, 16 bp, P. troglodytes
tgtgtgcccgtgtgtg

SEQ ID NO: 279229 - DNA, 16 bp, P. troglodytes
tgtgtgccctttttac

SEQ ID NO: 279230 - DNA, 16 bp, P. troglodytes
tgtgtgcctggccctg

SEQ ID NO: 279231 - DNA, 16 bp, P. troglodytes
tgtgtgcctgggtgtg

SEQ ID NO: 279232 - DNA, 17 bp, P. troglodytes
tgtgtgcctgtagtcct

SEQ ID NO: 279233 - DNA, 16 bp, P. troglodytes
tgtgtgcctgtgcctg

SEQ ID NO: 279234 - DNA, 16 bp, P. troglodytes
tgtgtgcctgtgtgta

SEQ ID NO: 279235 - DNA, 16 bp, P. troglodytes
tgtgtgcctgtgtgtg

SEQ ID NO: 279236 - DNA, 16 bp, P. troglodytes
tgtgtgcgtgcgcgcg

SEQ ID NO: 279237 - DNA, 16 bp, P. troglodytes
tgtgtgcgtgtatata

SEQ ID NO: 279238 - DNA, 16 bp, P. troglodytes
tgtgtgcgtgtgcaca

SEQ ID NO: 279239 - DNA, 16 bp, P. troglodytes
tgtgtgcgtgtgcatg

SEQ ID NO: 279240 - DNA, 16 bp, P. troglodytes
tgtgtgcgtgtgtata

SEQ ID NO: 279241 - DNA, 16 bp, P. troglodytes
tgtgtgcgtgtgtgta

SEQ ID NO: 279242 - DNA, 16 bp, P. troglodytes
tgtgtgctcagtgttt

SEQ ID NO: 279243 - DNA, 16 bp, P. troglodytes
tgtgtgctctgtgtgt

SEQ ID NO: 279244 - DNA, 16 bp, P. troglodytes
tgtgtgctgggctctg

SEQ ID NO: 279245 - DNA, 16 bp, P. troglodytes
tgtgtgctgtgtgtgc

SEQ ID NO: 279246 - DNA, 16 bp, P. troglodytes
tgtgtggaatactatg

SEQ ID NO: 279247 - DNA, 16 bp, P. troglodytes
tgtgtggacatctcat

SEQ ID NO: 279248 - DNA, 16 bp, P. troglodytes
tgtgtggagactcaca

SEQ ID NO: 279249 - DNA, 16 bp, P. troglodytes
tgtgtggccttatttt

SEQ ID NO: 279250 - DNA, 16 bp, P. troglodytes
tgtgtggccttggcca

SEQ ID NO: 279251 - DNA, 16 bp, P. troglodytes
tgtgtggctttggaca

SEQ ID NO: 279252 - DNA, 16 bp, P. troglodytes
tgtgtggctttgggca

SEQ ID NO: 279253 - DNA, 16 bp, P. troglodytes
tgtgtgggggcaggag

SEQ ID NO: 279254 - DNA, 16 bp, P. troglodytes
tgtgtggtggggccag

SEQ ID NO: 279255 - DNA, 17 bp, P. troglodytes
tgtgtggttatctaagt

SEQ ID NO: 279256 - DNA, 16 bp, P. troglodytes
tgtgtggttttgaatg

SEQ ID NO: 279257 - DNA, 16 bp, P. troglodytes
tgtgtgtaaatatata

SEQ ID NO: 279258 - DNA, 16 bp, P. troglodytes
tgtgtgtaatgtgtgt

SEQ ID NO: 279259 - DNA, 16 bp, P. troglodytes
tgtgtgtacacacatg

SEQ ID NO: 279260 - DNA, 16 bp, P. troglodytes
tgtgtgtacacatgtg

SEQ ID NO: 279261 - DNA, 16 bp, P. troglodytes
tgtgtgtacatatata

SEQ ID NO: 279262 - DNA, 16 bp, P. troglodytes
tgtgtgtacatatgtg

SEQ ID NO: 279263 - DNA, 16 bp, P. troglodytes
tgtgtgtacatatttt

SEQ ID NO: 279264 - DNA, 16 bp, P. troglodytes
tgtgtgtacctgtgtg

SEQ ID NO: 279265 - DNA, 16 bp, P. troglodytes
tgtgtgtataaaataa

SEQ ID NO: 279266 - DNA, 16 bp, P. troglodytes
tgtgtgtataaatgtg

SEQ ID NO: 279267 - DNA, 16 bp, P. troglodytes
tgtgtgtatacacata

SEQ ID NO: 279268 - DNA, 16 bp, P. troglodytes
tgtgtgtatatataat

SEQ ID NO: 279269 - DNA, 16 bp, P. troglodytes
tgtgtgtatatatatt

SEQ ID NO: 279270 - DNA, 16 bp, P. troglodytes
tgtgtgtatatatgtt

SEQ ID NO: 279271 - DNA, 16 bp, P. troglodytes
tgtgtgtatatctgta

SEQ ID NO: 279272 - DNA, 16 bp, P. troglodytes
tgtgtgtatatgcaca

SEQ ID NO: 279273 - DNA, 16 bp, P. troglodytes
tgtgtgtatatgtaca

SEQ ID NO: 279274 - DNA, 16 bp, P. troglodytes
tgtgtgtatatgtatt

SEQ ID NO: 279275 - DNA, 16 bp, P. troglodytes
tgtgtgtatatgtgtg

SEQ ID NO: 279276 - DNA, 16 bp, P. troglodytes
tgtgtgtatgactgtg

SEQ ID NO: 279277 - DNA, 16 bp, P. troglodytes
tgtgtgtatgatatat

SEQ ID NO: 279278 - DNA, 16 bp, P. troglodytes
tgtgtgtatgcacatg

SEQ ID NO: 279279 - DNA, 16 bp, P. troglodytes
tgtgtgtatgcatgtg

SEQ ID NO: 279280 - DNA, 16 bp, P. troglodytes
tgtgtgtatgcattta

SEQ ID NO: 279281 - DNA, 16 bp, P. troglodytes
tgtgtgtatgcgtgtg

SEQ ID NO: 279282 - DNA, 16 bp, P. troglodytes
tgtgtgtatgtataaa

SEQ ID NO: 279283 - DNA, 16 bp, P. troglodytes
tgtgtgtatgtatgca

SEQ ID NO: 279284 - DNA, 16 bp, P. troglodytes
tgtgtgtatgtatgta

SEQ ID NO: 279285 - DNA, 16 bp, P. troglodytes
tgtgtgtatgtgacag

SEQ ID NO: 279286 - DNA, 16 bp, P. troglodytes
tgtgtgtatgtgcatg

SEQ ID NO: 279287 - DNA, 16 bp, P. troglodytes
tgtgtgtatgtgtaag

SEQ ID NO: 279288 - DNA, 16 bp, P. troglodytes
tgtgtgtatgtgtgaa

SEQ ID NO: 279289 - DNA, 16 bp, P. troglodytes
tgtgtgtatttgtata

SEQ ID NO: 279290 - DNA, 16 bp, P. troglodytes
tgtgtgtattttaaat

SEQ ID NO: 279291 - DNA, 16 bp, P. troglodytes
tgtgtgtatttttccc

SEQ ID NO: 279292 - DNA, 16 bp, P. troglodytes
tgtgtgtctatgtgta

SEQ ID NO: 279293 - DNA, 16 bp, P. troglodytes
tgtgtgtctctatctc

SEQ ID NO: 279294 - DNA, 16 bp, P. troglodytes
tgtgtgtctgagtgtg

SEQ ID NO: 279295 - DNA, 16 bp, P. troglodytes
tgtgtgtctgcgtgtg

SEQ ID NO: 279296 - DNA, 16 bp, P. troglodytes
tgtgtgtctggcttat

SEQ ID NO: 279297 - DNA, 16 bp, P. troglodytes
tgtgtgtctgtatttt

SEQ ID NO: 279298 - DNA, 16 bp, P. troglodytes
tgtgtgtctgtgcgtg

SEQ ID NO: 279299 - DNA, 16 bp, P. troglodytes
tgtgtgtctgtgtctg

SEQ ID NO: 279300 - DNA, 16 bp, P. troglodytes
tgtgtgtctgtgtgta

SEQ ID NO: 279301 - DNA, 16 bp, P. troglodytes
tgtgtgtctttgcaca

SEQ ID NO: 279302 - DNA, 16 bp, P. troglodytes
tgtgtgtgaatatgtg

SEQ ID NO: 279303 - DNA, 16 bp, P. troglodytes
tgtgtgtgagacagag

SEQ ID NO: 279304 - DNA, 16 bp, P. troglodytes
tgtgtgtgagagagat

SEQ ID NO: 279305 - DNA, 16 bp, P. troglodytes
tgtgtgtgagggagag

SEQ ID NO: 279306 - DNA, 16 bp, P. troglodytes
tgtgtgtgagtatgca

SEQ ID NO: 279307 - DNA, 16 bp, P. troglodytes
tgtgtgtgagtgagag

SEQ ID NO: 279308 - DNA, 16 bp, P. troglodytes
tgtgtgtgagtgtgca

SEQ ID NO: 279309 - DNA, 16 bp, P. troglodytes
tgtgtgtgcaagtgtg

SEQ ID NO: 279310 - DNA, 16 bp, P. troglodytes
tgtgtgtgcacacaca

SEQ ID NO: 279311 - DNA, 16 bp, P. troglodytes
tgtgtgtgcacacgtg

SEQ ID NO: 279312 - DNA, 16 bp, P. troglodytes
tgtgtgtgcacatgtg

SEQ ID NO: 279313 - DNA, 16 bp, P. troglodytes
tgtgtgtgcacgcgtg

SEQ ID NO: 279314 - DNA, 16 bp, P. troglodytes
tgtgtgtgcaggggtg

SEQ ID NO: 279315 - DNA, 16 bp, P. troglodytes
tgtgtgtgcatatgca

SEQ ID NO: 279316 - DNA, 16 bp, P. troglodytes
tgtgtgtgcatatttt

SEQ ID NO: 279317 - DNA, 16 bp, P. troglodytes
tgtgtgtgcatgagtg

SEQ ID NO: 279318 - DNA, 16 bp, P. troglodytes
tgtgtgtgcatgcaca

SEQ ID NO: 279319 - DNA, 16 bp, P. troglodytes
tgtgtgtgcatgcctg

SEQ ID NO: 279320 - DNA, 16 bp, P. troglodytes
tgtgtgtgcatgtctg

SEQ ID NO: 279321 - DNA, 16 bp, P. troglodytes
tgtgtgtgcatgtgtg

SEQ ID NO: 279322 - DNA, 16 bp, P. troglodytes
tgtgtgtgcatgttgg

SEQ ID NO: 279323 - DNA, 16 bp, P. troglodytes
tgtgtgtgcattttaa

SEQ ID NO: 279324 - DNA, 16 bp, P. troglodytes
tgtgtgtgcattttct

SEQ ID NO: 279325 - DNA, 16 bp, P. troglodytes
tgtgtgtgcattttta

SEQ ID NO: 279326 - DNA, 16 bp, P. troglodytes
tgtgtgtgcgtgcgcg

SEQ ID NO: 279327 - DNA, 16 bp, P. troglodytes
tgtgtgtgcgtgtgtc

SEQ ID NO: 279328 - DNA, 16 bp, P. troglodytes
tgtgtgtgggagagag

SEQ ID NO: 279329 - DNA, 16 bp, P. troglodytes
tgtgtgtggtgtgcat

SEQ ID NO: 279330 - DNA, 16 bp, P. troglodytes
tgtgtgtgtaaatata

SEQ ID NO: 279331 - DNA, 16 bp, P. troglodytes
tgtgtgtgtacacaca

SEQ ID NO: 279332 - DNA, 16 bp, P. troglodytes
tgtgtgtgtacacgtg

SEQ ID NO: 279333 - DNA, 16 bp, P. troglodytes
tgtgtgtgtacctgtg

SEQ ID NO: 279334 - DNA, 16 bp, P. troglodytes
tgtgtgtgtagtgaga

SEQ ID NO: 279335 - DNA, 16 bp, P. troglodytes
tgtgtgtgtatagaga

SEQ ID NO: 279336 - DNA, 16 bp, P. troglodytes
tgtgtgtgtatattta

SEQ ID NO: 279337 - DNA, 16 bp, P. troglodytes
tgtgtgtgtatcctat

SEQ ID NO: 279338 - DNA, 16 bp, P. troglodytes
tgtgtgtgtatctctg

SEQ ID NO: 279339 - DNA, 16 bp, P. troglodytes
tgtgtgtgtatctgtc

SEQ ID NO: 279340 - DNA, 16 bp, P. troglodytes
tgtgtgtgtatgcata

SEQ ID NO: 279341 - DNA, 16 bp, P. troglodytes
tgtgtgtgtatgtgat

SEQ ID NO: 279342 - DNA, 16 bp, P. troglodytes
tgtgtgtgtatgtgta

SEQ ID NO: 279343 - DNA, 16 bp, P. troglodytes
tgtgtgtgtatttcaa

SEQ ID NO: 279344 - DNA, 16 bp, P. troglodytes
tgtgtgtgtatttctg

SEQ ID NO: 279345 - DNA, 16 bp, P. troglodytes
tgtgtgtgtatttgag

SEQ ID NO: 279346 - DNA, 16 bp, P. troglodytes
tgtgtgtgtccaggaa

SEQ ID NO: 279347 - DNA, 16 bp, P. troglodytes
tgtgtgtgtccatgtc

SEQ ID NO: 279348 - DNA, 16 bp, P. troglodytes
tgtgtgtgtccctgtg

SEQ ID NO: 279349 - DNA, 16 bp, P. troglodytes
tgtgtgtgtcctcttc

SEQ ID NO: 279350 - DNA, 16 bp, P. troglodytes
tgtgtgtgtctacaca

SEQ ID NO: 279351 - DNA, 16 bp, P. troglodytes
tgtgtgtgtctgagtg

SEQ ID NO: 279352 - DNA, 16 bp, P. troglodytes
tgtgtgtgtctgtaaa

SEQ ID NO: 279353 - DNA, 16 bp, P. troglodytes
tgtgtgtgtctgtagt

SEQ ID NO: 279354 - DNA, 16 bp, P. troglodytes
tgtgtgtgtctgtata

SEQ ID NO: 279355 - DNA, 16 bp, P. troglodytes
tgtgtgtgtctgtctg

SEQ ID NO: 279356 - DNA, 16 bp, P. troglodytes
tgtgtgtgtctgtgta

SEQ ID NO: 279357 - DNA, 16 bp, P. troglodytes
tgtgtgtgtgaaaaag

SEQ ID NO: 279358 - DNA, 16 bp, P. troglodytes
tgtgtgtgtgaaataa

SEQ ID NO: 279359 - DNA, 16 bp, P. troglodytes
tgtgtgtgtgaaggtg

SEQ ID NO: 279360 - DNA, 16 bp, P. troglodytes
tgtgtgtgtgaattat

SEQ ID NO: 279361 - DNA, 16 bp, P. troglodytes
tgtgtgtgtgactgtg

SEQ ID NO: 279362 - DNA, 16 bp, P. troglodytes
tgtgtgtgtgagagat

SEQ ID NO: 279363 - DNA, 16 bp, P. troglodytes
tgtgtgtgtgagcatg

SEQ ID NO: 279364 - DNA, 16 bp, P. troglodytes
tgtgtgtgtgagtgaa

SEQ ID NO: 279365 - DNA, 16 bp, P. troglodytes
tgtgtgtgtgagtgag

SEQ ID NO: 279366 - DNA, 16 bp, P. troglodytes
tgtgtgtgtgatggag

SEQ ID NO: 279367 - DNA, 16 bp, P. troglodytes
tgtgtgtgtgcacata

SEQ ID NO: 279368 - DNA, 16 bp, P. troglodytes
tgtgtgtgtgcacgtg

SEQ ID NO: 279369 - DNA, 16 bp, P. troglodytes
tgtgtgtgtgcagaca

SEQ ID NO: 279370 - DNA, 16 bp, P. troglodytes
tgtgtgtgtgcagata

SEQ ID NO: 279371 - DNA, 16 bp, P. troglodytes
tgtgtgtgtgcatgcc

SEQ ID NO: 279372 - DNA, 16 bp, P. troglodytes
tgtgtgtgtgcatgcg

SEQ ID NO: 279373 - DNA, 16 bp, P. troglodytes
tgtgtgtgtgcatggt

SEQ ID NO: 279374 - DNA, 16 bp, P. troglodytes
tgtgtgtgtgcatgtt

SEQ ID NO: 279375 - DNA, 16 bp, P. troglodytes
tgtgtgtgtgcgcatg

SEQ ID NO: 279376 - DNA, 16 bp, P. troglodytes
tgtgtgtgtgcgtgag

SEQ ID NO: 279377 - DNA, 16 bp, P. troglodytes
tgtgtgtgtgcgtgta

SEQ ID NO: 279378 - DNA, 16 bp, P. troglodytes
tgtgtgtgtgctggag

SEQ ID NO: 279379 - DNA, 16 bp, P. troglodytes
tgtgtgtgtggagatg

SEQ ID NO: 279380 - DNA, 16 bp, P. troglodytes
tgtgtgtgtgggcagg

SEQ ID NO: 279381 - DNA, 16 bp, P. troglodytes
tgtgtgtgtgtaaaca

SEQ ID NO: 279382 - DNA, 16 bp, P. troglodytes
tgtgtgtgtgtaagaa

SEQ ID NO: 279383 - DNA, 16 bp, P. troglodytes
tgtgtgtgtgtacaca

SEQ ID NO: 279384 - DNA, 16 bp, P. troglodytes
tgtgtgtgtgtacatg

SEQ ID NO: 279385 - DNA, 16 bp, P. troglodytes
tgtgtgtgtgtaggat

SEQ ID NO: 279386 - DNA, 16 bp, P. troglodytes
tgtgtgtgtgtataca

SEQ ID NO: 279387 - DNA, 16 bp, P. troglodytes
tgtgtgtgtgtatatg

SEQ ID NO: 279388 - DNA, 16 bp, P. troglodytes
tgtgtgtgtgtatcac

SEQ ID NO: 279389 - DNA, 16 bp, P. troglodytes
tgtgtgtgtgtctcat

SEQ ID NO: 279390 - DNA, 16 bp, P. troglodytes
tgtgtgtgtgtctctc

SEQ ID NO: 279391 - DNA, 16 bp, P. troglodytes
tgtgtgtgtgtctgga

SEQ ID NO: 279392 - DNA, 16 bp, P. troglodytes
tgtgtgtgtgtctgtc

SEQ ID NO: 279393 - DNA, 17 bp, P. troglodytes
tgtgtgtgtgtctttaa

SEQ ID NO: 279394 - DNA, 16 bp, P. troglodytes
tgtgtgtgtgtgaagg

SEQ ID NO: 279395 - DNA, 17 bp, P. troglodytes
tgtgtgtgtgtgaagtc

SEQ ID NO: 279396 - DNA, 16 bp, P. troglodytes
tgtgtgtgtgtgaata

SEQ ID NO: 279397 - DNA, 17 bp, P. troglodytes
tgtgtgtgtgtgagata

SEQ ID NO: 279398 - DNA, 16 bp, P. troglodytes
tgtgtgtgtgtgcagc

SEQ ID NO: 279399 - DNA, 16 bp, P. troglodytes
tgtgtgtgtgtgcagt

SEQ ID NO: 279400 - DNA, 16 bp, P. troglodytes
tgtgtgtgtgtgcata

SEQ ID NO: 279401 - DNA, 16 bp, P. troglodytes
tgtgtgtgtgtgccca

SEQ ID NO: 279402 - DNA, 16 bp, P. troglodytes
tgtgtgtgtgtgcgcg

SEQ ID NO: 279403 - DNA, 16 bp, P. troglodytes
tgtgtgtgtgtgctca

SEQ ID NO: 279404 - DNA, 16 bp, P. troglodytes
tgtgtgtgtgtggcag

SEQ ID NO: 279405 - DNA, 16 bp, P. troglodytes
tgtgtgtgtgtggcta

SEQ ID NO: 279406 - DNA, 16 bp, P. troglodytes
tgtgtgtgtgtgtatc

SEQ ID NO: 279407 - DNA, 16 bp, P. troglodytes
tgtgtgtgtgtgtgcc

SEQ ID NO: 279408 - DNA, 16 bp, P. troglodytes
tgtgtgtgtgttaaaa

SEQ ID NO: 279409 - DNA, 16 bp, P. troglodytes
tgtgtgtgtgttaagt

SEQ ID NO: 279410 - DNA, 16 bp, P. troglodytes
tgtgtgtgtgttgaaa

SEQ ID NO: 279411 - DNA, 16 bp, P. troglodytes
tgtgtgtgtgtttaaa

SEQ ID NO: 279412 - DNA, 16 bp, P. troglodytes
tgtgtgtgtgtttaag

SEQ ID NO: 279413 - DNA, 16 bp, P. troglodytes
tgtgtgtgttgcaggg

SEQ ID NO: 279414 - DNA, 16 bp, P. troglodytes
tgtgtgtgtttgcatg

SEQ ID NO: 279415 - DNA, 16 bp, P. troglodytes
tgtgtgtgttttaaaa

SEQ ID NO: 279416 - DNA, 16 bp, P. troglodytes
tgtgtgtgtttttaac

SEQ ID NO: 279417 - DNA, 16 bp, P. troglodytes
tgtgtgtgtttttact

SEQ ID NO: 279418 - DNA, 16 bp, P. troglodytes
tgtgtgttctcactgc

SEQ ID NO: 279419 - DNA, 16 bp, P. troglodytes
tgtgtgttgaatgaat

SEQ ID NO: 279420 - DNA, 16 bp, P. troglodytes
tgtgtgtttgcacaca

SEQ ID NO: 279421 - DNA, 16 bp, P. troglodytes
tgtgtgtttgtgtaaa

SEQ ID NO: 279422 - DNA, 16 bp, P. troglodytes
tgtgtgtttttaaaaa

SEQ ID NO: 279423 - DNA, 16 bp, P. troglodytes
tgtgttaaaaagaaaa

SEQ ID NO: 279424 - DNA, 16 bp, P. troglodytes
tgtgttacaactgcct

SEQ ID NO: 279425 - DNA, 16 bp, P. troglodytes
tgtgttagaaatttaa

SEQ ID NO: 279426 - DNA, 16 bp, P. troglodytes
tgtgttagtttcctaa

SEQ ID NO: 279427 - DNA, 16 bp, P. troglodytes
tgtgttagtttgctaa

SEQ ID NO: 279428 - DNA, 16 bp, P. troglodytes
tgtgttatccaggctg

SEQ ID NO: 279429 - DNA, 16 bp, P. troglodytes
tgtgttattgcccctg

SEQ ID NO: 279430 - DNA, 16 bp, P. troglodytes
tgtgttatttaattct

SEQ ID NO: 279431 - DNA, 16 bp, P. troglodytes
tgtgttatttcattta

SEQ ID NO: 279432 - DNA, 16 bp, P. troglodytes
tgtgttcaaggagaaa

SEQ ID NO: 279433 - DNA, 16 bp, P. troglodytes
tgtgttcactggagta

SEQ ID NO: 279434 - DNA, 16 bp, P. troglodytes
tgtgttcattctcctt

SEQ ID NO: 279435 - DNA, 16 bp, P. troglodytes
tgtgttcattgcagca

SEQ ID NO: 279436 - DNA, 16 bp, P. troglodytes
tgtgttccagatctta

SEQ ID NO: 279437 - DNA, 16 bp, P. troglodytes
tgtgttccagccactc

SEQ ID NO: 279438 - DNA, 16 bp, P. troglodytes
tgtgttcccagtgcct

SEQ ID NO: 279439 - DNA, 16 bp, P. troglodytes
tgtgttctaataaaat

SEQ ID NO: 279440 - DNA, 16 bp, P. troglodytes
tgtgttctcactgttt

SEQ ID NO: 279441 - DNA, 16 bp, P. troglodytes
tgtgttctgagaaatg

SEQ ID NO: 279442 - DNA, 16 bp, P. troglodytes
tgtgttctttataaat

SEQ ID NO: 279443 - DNA, 16 bp, P. troglodytes
tgtgttgacatttgca

SEQ ID NO: 279444 - DNA, 16 bp, P. troglodytes
tgtgttgagggaggaa

SEQ ID NO: 279445 - DNA, 16 bp, P. troglodytes
tgtgttgggaaaactg

SEQ ID NO: 279446 - DNA, 16 bp, P. troglodytes
tgtgttgtatctttgt

SEQ ID NO: 279447 - DNA, 16 bp, P. troglodytes
tgtgttgtgtatatat

SEQ ID NO: 279448 - DNA, 16 bp, P. troglodytes
tgtgttgtttaagcca

SEQ ID NO: 279449 - DNA, 16 bp, P. troglodytes
tgtgttgtttccagtt

SEQ ID NO: 279450 - DNA, 16 bp, P. troglodytes
tgtgtttacattttat

SEQ ID NO: 279451 - DNA, 16 bp, P. troglodytes
tgtgtttagtagagac

SEQ ID NO: 279452 - DNA, 16 bp, P. troglodytes
tgtgtttataaaataa

SEQ ID NO: 279453 - DNA, 16 bp, P. troglodytes
tgtgtttatatacaca

SEQ ID NO: 279454 - DNA, 16 bp, P. troglodytes
tgtgtttatctgctga

SEQ ID NO: 279455 - DNA, 16 bp, P. troglodytes
tgtgtttccatataaa

SEQ ID NO: 279456 - DNA, 16 bp, P. troglodytes
tgtgtttccttaaagt

SEQ ID NO: 279457 - DNA, 16 bp, P. troglodytes
tgtgtttctgtttaaa

SEQ ID NO: 279458 - DNA, 16 bp, P. troglodytes
tgtgtttgcatttgtt

SEQ ID NO: 279459 - DNA, 16 bp, P. troglodytes
tgtgtttgctcttgct

SEQ ID NO: 279460 - DNA, 17 bp, P. troglodytes
tgtgtttgcttcccctt

SEQ ID NO: 279461 - DNA, 16 bp, P. troglodytes
tgtgtttggagatagg

SEQ ID NO: 279462 - DNA, 16 bp, P. troglodytes
tgtgtttgtgagagag

SEQ ID NO: 279463 - DNA, 16 bp, P. troglodytes
tgtgtttgtgcatatg

SEQ ID NO: 279464 - DNA, 16 bp, P. troglodytes
tgtgtttgtgtgcatg

SEQ ID NO: 279465 - DNA, 16 bp, P. troglodytes
tgtgttttaagctgtt

SEQ ID NO: 279466 - DNA, 16 bp, P. troglodytes
tgtgttttcattcatt

SEQ ID NO: 279467 - DNA, 16 bp, P. troglodytes
tgtgttttcattttgc

SEQ ID NO: 279468 - DNA, 16 bp, P. troglodytes
tgtgttttctagttct

SEQ ID NO: 279469 - DNA, 16 bp, P. troglodytes
tgtgttttgaaaatat

SEQ ID NO: 279470 - DNA, 16 bp, P. troglodytes
tgtgttttggggagga

SEQ ID NO: 279471 - DNA, 16 bp, P. troglodytes
tgtgtttttaaaatca

SEQ ID NO: 279472 - DNA, 17 bp, P. troglodytes
tgtgtttttagtagaga

SEQ ID NO: 279473 - DNA, 16 bp, P. troglodytes
tgtgtttttcacattt

SEQ ID NO: 279474 - DNA, 16 bp, P. troglodytes
tgttaaaaaaaaaatc

SEQ ID NO: 279475 - DNA, 16 bp, P. troglodytes
tgttaaaaacattcag

SEQ ID NO: 279476 - DNA, 16 bp, P. troglodytes
tgttaaaaacattttt

SEQ ID NO: 279477 - DNA, 16 bp, P. troglodytes
tgttaaaaaccttcaa

SEQ ID NO: 279478 - DNA, 16 bp, P. troglodytes
tgttaaaacacaaatt

SEQ ID NO: 279479 - DNA, 16 bp, P. troglodytes
tgttaaaagaaaaaca

SEQ ID NO: 279480 - DNA, 16 bp, P. troglodytes
tgttaaaagaaaaact

SEQ ID NO: 279481 - DNA, 16 bp, P. troglodytes
tgttaaaagaaaacaa

SEQ ID NO: 279482 - DNA, 16 bp, P. troglodytes
tgttaaaagcaaaaat

SEQ ID NO: 279483 - DNA, 16 bp, P. troglodytes
tgttaaaataaatgtt

SEQ ID NO: 279484 - DNA, 16 bp, P. troglodytes
tgttaaaatatgttaa

SEQ ID NO: 279485 - DNA, 16 bp, P. troglodytes
tgttaaaatgctgatt

SEQ ID NO: 279486 - DNA, 16 bp, P. troglodytes
tgttaaaatgtccaca

SEQ ID NO: 279487 - DNA, 16 bp, P. troglodytes
tgttaaaatgtgtttt

SEQ ID NO: 279488 - DNA, 16 bp, P. troglodytes
tgttaaactctcccac

SEQ ID NO: 279489 - DNA, 16 bp, P. troglodytes
tgttaaatatatttct

SEQ ID NO: 279490 - DNA, 16 bp, P. troglodytes
tgttaaatcaaccttg

SEQ ID NO: 279491 - DNA, 16 bp, P. troglodytes
tgttaaatgaatgagt

SEQ ID NO: 279492 - DNA, 16 bp, P. troglodytes
tgttaaatgttaaatg

SEQ ID NO: 279493 - DNA, 16 bp, P. troglodytes
tgttaaatttattcct

SEQ ID NO: 279494 - DNA, 16 bp, P. troglodytes
tgttaaattttgcttt

SEQ ID NO: 279495 - DNA, 16 bp, P. troglodytes
tgttaacaatatgttt

SEQ ID NO: 279496 - DNA, 16 bp, P. troglodytes
tgttaacataaatatt

SEQ ID NO: 279497 - DNA, 18 bp, P. troglodytes
tgttaaccaggatggtct

SEQ ID NO: 279498 - DNA, 16 bp, P. troglodytes
tgttaaccctagagga

SEQ ID NO: 279499 - DNA, 16 bp, P. troglodytes
tgttaaccttgatcac

SEQ ID NO: 279500 - DNA, 16 bp, P. troglodytes
tgttaactctgatgat

SEQ ID NO: 279501 - DNA, 16 bp, P. troglodytes
tgttaactttgtcaaa

SEQ ID NO: 279502 - DNA, 16 bp, P. troglodytes
tgttaagaaaacaaaa

SEQ ID NO: 279503 - DNA, 16 bp, P. troglodytes
tgttaagaaggaaatt

SEQ ID NO: 279504 - DNA, 16 bp, P. troglodytes
tgttaagagggaagtt

SEQ ID NO: 279505 - DNA, 16 bp, P. troglodytes
tgttaagcctgtgggt

SEQ ID NO: 279506 - DNA, 16 bp, P. troglodytes
tgttaagtatatttac

SEQ ID NO: 279507 - DNA, 16 bp, P. troglodytes
tgttaagtccattaaa

SEQ ID NO: 279508 - DNA, 16 bp, P. troglodytes
tgttaagtgacacatg

SEQ ID NO: 279509 - DNA, 16 bp, P. troglodytes
tgttaatatttgtgat

SEQ ID NO: 279510 - DNA, 16 bp, P. troglodytes
tgttaatattttatca

SEQ ID NO: 279511 - DNA, 16 bp, P. troglodytes
tgttaatctttaaaaa

SEQ ID NO: 279512 - DNA, 16 bp, P. troglodytes
tgttaatggatacaca

SEQ ID NO: 279513 - DNA, 16 bp, P. troglodytes
tgttaatgttgacatt

SEQ ID NO: 279514 - DNA, 16 bp, P. troglodytes
tgttaattagcttgat

SEQ ID NO: 279515 - DNA, 16 bp, P. troglodytes
tgttaatttgctcaag

SEQ ID NO: 279516 - DNA, 16 bp, P. troglodytes
tgttacaaatgaggaa

SEQ ID NO: 279517 - DNA, 16 bp, P. troglodytes
tgttacaattcttcaa

SEQ ID NO: 279518 - DNA, 16 bp, P. troglodytes
tgttacagatgaggaa

SEQ ID NO: 279519 - DNA, 16 bp, P. troglodytes
tgttacagcagcctga

SEQ ID NO: 279520 - DNA, 16 bp, P. troglodytes
tgttacagtgcactct

SEQ ID NO: 279521 - DNA, 16 bp, P. troglodytes
tgttacatacatttta

SEQ ID NO: 279522 - DNA, 16 bp, P. troglodytes
tgttacatatatattt

SEQ ID NO: 279523 - DNA, 16 bp, P. troglodytes
tgttacatatgtataa

SEQ ID NO: 279524 - DNA, 16 bp, P. troglodytes
tgttacatatgtatat

SEQ ID NO: 279525 - DNA, 16 bp, P. troglodytes
tgttacatgaaataag

SEQ ID NO: 279526 - DNA, 16 bp, P. troglodytes
tgttacattttcattt

SEQ ID NO: 279527 - DNA, 16 bp, P. troglodytes
tgttacattttttaaa

SEQ ID NO: 279528 - DNA, 16 bp, P. troglodytes
tgttaccactggggaa

SEQ ID NO: 279529 - DNA, 16 bp, P. troglodytes
tgttaccagaaaggag

SEQ ID NO: 279530 - DNA, 16 bp, P. troglodytes
tgttaccatggcaaaa

SEQ ID NO: 279531 - DNA, 16 bp, P. troglodytes
tgttacccagcatgct

SEQ ID NO: 279532 - DNA, 16 bp, P. troglodytes
tgttacccaggttgga

SEQ ID NO: 279533 - DNA, 16 bp, P. troglodytes
tgttactataaaggaa

SEQ ID NO: 279534 - DNA, 16 bp, P. troglodytes
tgttactattgcaatt

SEQ ID NO: 279535 - DNA, 16 bp, P. troglodytes
tgttactgatttctag

SEQ ID NO: 279536 - DNA, 16 bp, P. troglodytes
tgttactgtattgaat

SEQ ID NO: 279537 - DNA, 16 bp, P. troglodytes
tgttacttgttttcta

SEQ ID NO: 279538 - DNA, 16 bp, P. troglodytes
tgttagaaaagcaaat

SEQ ID NO: 279539 - DNA, 16 bp, P. troglodytes
tgttagaaagagcctg

SEQ ID NO: 279540 - DNA, 16 bp, P. troglodytes
tgttagaaatggaaat

SEQ ID NO: 279541 - DNA, 16 bp, P. troglodytes
tgttagaaggaaaacc

SEQ ID NO: 279542 - DNA, 16 bp, P. troglodytes
tgttagaagtcaggat

SEQ ID NO: 279543 - DNA, 16 bp, P. troglodytes
tgttagactggataaa

SEQ ID NO: 279544 - DNA, 17 bp, P. troglodytes
tgttagatatgagttct

SEQ ID NO: 279545 - DNA, 16 bp, P. troglodytes
tgttagcatatagaaa

SEQ ID NO: 279546 - DNA, 18 bp, P. troglodytes
tgttagccaagatggtct

SEQ ID NO: 279547 - DNA, 18 bp, P. troglodytes
tgttagccacgatggtct

SEQ ID NO: 279548 - DNA, 18 bp, P. troglodytes
tgttagccagaatggtct

SEQ ID NO: 279549 - DNA, 16 bp, P. troglodytes
tgttagccaggagggt

SEQ ID NO: 279550 - DNA, 18 bp, P. troglodytes
tgttagccaggatgatct

SEQ ID NO: 279551 - DNA, 18 bp, P. troglodytes
tgttagccaggatgctct

SEQ ID NO: 279552 - DNA, 16 bp, P. troglodytes
tgttagccaggatgga

SEQ ID NO: 279553 - DNA, 18 bp, P. troglodytes
tgttagccaggatggtcc

SEQ ID NO: 279554 - DNA, 18 bp, P. troglodytes
tgttagccaggatggtct

SEQ ID NO: 279555 - DNA, 17 bp, P. troglodytes
tgttagccaggatggtt

SEQ ID NO: 279556 - DNA, 18 bp, P. troglodytes
tgttagccaggatgttct

SEQ ID NO: 279557 - DNA, 17 bp, P. troglodytes
tgttagccaggctggtt

SEQ ID NO: 279558 - DNA, 18 bp, P. troglodytes
tgttagccagggtggtct

SEQ ID NO: 279559 - DNA, 16 bp, P. troglodytes
tgttagcccaggctgg

SEQ ID NO: 279560 - DNA, 18 bp, P. troglodytes
tgttagccgggatggtct

SEQ ID NO: 279561 - DNA, 18 bp, P. troglodytes
tgttagctaggatggtct

SEQ ID NO: 279562 - DNA, 16 bp, P. troglodytes
tgttagctttttaaaa

SEQ ID NO: 279563 - DNA, 16 bp, P. troglodytes
tgttaggaacctggcc

SEQ ID NO: 279564 - DNA, 16 bp, P. troglodytes
tgttaggaactgggtc

SEQ ID NO: 279565 - DNA, 16 bp, P. troglodytes
tgttaggatggctatt

SEQ ID NO: 279566 - DNA, 16 bp, P. troglodytes
tgttaggccacaaaaa

SEQ ID NO: 279567 - DNA, 18 bp, P. troglodytes
tgttagtcaggatggtct

SEQ ID NO: 279568 - DNA, 16 bp, P. troglodytes
tgttataaataaagtt

SEQ ID NO: 279569 - DNA, 16 bp, P. troglodytes
tgttatagcagcacaa

SEQ ID NO: 279570 - DNA, 16 bp, P. troglodytes
tgttatatatggcttt

SEQ ID NO: 279571 - DNA, 16 bp, P. troglodytes
tgttatattttacatt

SEQ ID NO: 279572 - DNA, 16 bp, P. troglodytes
tgttatcaacttaaaa

SEQ ID NO: 279573 - DNA, 16 bp, P. troglodytes
tgttatcaatgacaat

SEQ ID NO: 279574 - DNA, 16 bp, P. troglodytes
tgttatccaggctgga

SEQ ID NO: 279575 - DNA, 16 bp, P. troglodytes
tgttatctctgtttta

SEQ ID NO: 279576 - DNA, 16 bp, P. troglodytes
tgttatctcttgtctt

SEQ ID NO: 279577 - DNA, 16 bp, P. troglodytes
tgttatgaaatctttg

SEQ ID NO: 279578 - DNA, 16 bp, P. troglodytes
tgttatgaggattaaa

SEQ ID NO: 279579 - DNA, 16 bp, P. troglodytes
tgttatgcagcaatat

SEQ ID NO: 279580 - DNA, 16 bp, P. troglodytes
tgttatgtaaataaag

SEQ ID NO: 279581 - DNA, 16 bp, P. troglodytes
tgttatgtaaatagtt

SEQ ID NO: 279582 - DNA, 16 bp, P. troglodytes
tgttatgtgaatttta

SEQ ID NO: 279583 - DNA, 16 bp, P. troglodytes
tgttattaaaaagtta

SEQ ID NO: 279584 - DNA, 16 bp, P. troglodytes
tgttattaatgttaaa

SEQ ID NO: 279585 - DNA, 16 bp, P. troglodytes
tgttattatcattatt

SEQ ID NO: 279586 - DNA, 16 bp, P. troglodytes
tgttattattcctatt

SEQ ID NO: 279587 - DNA, 16 bp, P. troglodytes
tgttattctttactcc

SEQ ID NO: 279588 - DNA, 16 bp, P. troglodytes
tgttattgatgtataa

SEQ ID NO: 279589 - DNA, 18 bp, P. troglodytes
tgttattggtctattcag

SEQ ID NO: 279590 - DNA, 16 bp, P. troglodytes
tgttatttaaacattt

SEQ ID NO: 279591 - DNA, 16 bp, P. troglodytes
tgttatttatctgaaa

SEQ ID NO: 279592 - DNA, 16 bp, P. troglodytes
tgttatttcttacaac

SEQ ID NO: 279593 - DNA, 16 bp, P. troglodytes
tgttatttcttgactt

SEQ ID NO: 279594 - DNA, 16 bp, P. troglodytes
tgttatttgctttctg

SEQ ID NO: 279595 - DNA, 16 bp, P. troglodytes
tgttattttagaatgt

SEQ ID NO: 279596 - DNA, 16 bp, P. troglodytes
tgttatttttctggat

SEQ ID NO: 279597 - DNA, 16 bp, P. troglodytes
tgttcaaaatatattt

SEQ ID NO: 279598 - DNA, 16 bp, P. troglodytes
tgttcaaacacacata

SEQ ID NO: 279599 - DNA, 16 bp, P. troglodytes
tgttcaaatattttgc

SEQ ID NO: 279600 - DNA, 16 bp, P. troglodytes
tgttcaacatcactga

SEQ ID NO: 279601 - DNA, 16 bp, P. troglodytes
tgttcaacattcttaa

SEQ ID NO: 279602 - DNA, 16 bp, P. troglodytes
tgttcaagaaataaaa

SEQ ID NO: 279603 - DNA, 16 bp, P. troglodytes
tgttcaagagtcaact

SEQ ID NO: 279604 - DNA, 16 bp, P. troglodytes
tgttcaagcgattctt

SEQ ID NO: 279605 - DNA, 16 bp, P. troglodytes
tgttcaagggcaagaa

SEQ ID NO: 279606 - DNA, 16 bp, P. troglodytes
tgttcaagggtcaact

SEQ ID NO: 279607 - DNA, 16 bp, P. troglodytes
tgttcaagtcccactt

SEQ ID NO: 279608 - DNA, 16 bp, P. troglodytes
tgttcaattctttgtt

SEQ ID NO: 279609 - DNA, 16 bp, P. troglodytes
tgttcacattgttcag

SEQ ID NO: 279610 - DNA, 16 bp, P. troglodytes
tgttcaccaaccagga

SEQ ID NO: 279611 - DNA, 16 bp, P. troglodytes
tgttcactctgatgat

SEQ ID NO: 279612 - DNA, 16 bp, P. troglodytes
tgttcactgcaacctc

SEQ ID NO: 279613 - DNA, 16 bp, P. troglodytes
tgttcactgcagtgct

SEQ ID NO: 279614 - DNA, 16 bp, P. troglodytes
tgttcactgtggcatt

SEQ ID NO: 279615 - DNA, 16 bp, P. troglodytes
tgttcacttaaaaaaa

SEQ ID NO: 279616 - DNA, 16 bp, P. troglodytes
tgttcactttgatgat

SEQ ID NO: 279617 - DNA, 16 bp, P. troglodytes
tgttcagagattctat

SEQ ID NO: 279618 - DNA, 16 bp, P. troglodytes
tgttcaggggtcaact

SEQ ID NO: 279619 - DNA, 16 bp, P. troglodytes
tgttcaggttttgaat

SEQ ID NO: 279620 - DNA, 16 bp, P. troglodytes
tgttcataattgccaa

SEQ ID NO: 279621 - DNA, 16 bp, P. troglodytes
tgttcatacaaagact

SEQ ID NO: 279622 - DNA, 16 bp, P. troglodytes
tgttcatacaatggaa

SEQ ID NO: 279623 - DNA, 16 bp, P. troglodytes
tgttcatagcaccatt

SEQ ID NO: 279624 - DNA, 16 bp, P. troglodytes
tgttcatatcctttgt

SEQ ID NO: 279625 - DNA, 16 bp, P. troglodytes
tgttcatattttctta

SEQ ID NO: 279626 - DNA, 16 bp, P. troglodytes
tgttcatcaacaaatg

SEQ ID NO: 279627 - DNA, 16 bp, P. troglodytes
tgttcatgaataggaa

SEQ ID NO: 279628 - DNA, 16 bp, P. troglodytes
tgttcattacagaaaa

SEQ ID NO: 279629 - DNA, 16 bp, P. troglodytes
tgttcattcatttctt

SEQ ID NO: 279630 - DNA, 16 bp, P. troglodytes
tgttcattccttttca

SEQ ID NO: 279631 - DNA, 16 bp, P. troglodytes
tgttcattgaagcatt

SEQ ID NO: 279632 - DNA, 16 bp, P. troglodytes
tgttcattgcagcact

SEQ ID NO: 279633 - DNA, 16 bp, P. troglodytes
tgttcattgtggcact

SEQ ID NO: 279634 - DNA, 16 bp, P. troglodytes
tgttcatttattcaat

SEQ ID NO: 279635 - DNA, 16 bp, P. troglodytes
tgttcatttcttttca

SEQ ID NO: 279636 - DNA, 16 bp, P. troglodytes
tgttcatttgaagttt

SEQ ID NO: 279637 - DNA, 16 bp, P. troglodytes
tgttcatttttgagaa

SEQ ID NO: 279638 - DNA, 16 bp, P. troglodytes
tgttccaacctctgtc

SEQ ID NO: 279639 - DNA, 16 bp, P. troglodytes
tgttccacatcctcac

SEQ ID NO: 279640 - DNA, 16 bp, P. troglodytes
tgttccacccggctca

SEQ ID NO: 279641 - DNA, 16 bp, P. troglodytes
tgttccacttcctgtg

SEQ ID NO: 279642 - DNA, 16 bp, P. troglodytes
tgttccagaccagcct

SEQ ID NO: 279643 - DNA, 16 bp, P. troglodytes
tgttccagctgctcca

SEQ ID NO: 279644 - DNA, 16 bp, P. troglodytes
tgttccatcaatacct

SEQ ID NO: 279645 - DNA, 16 bp, P. troglodytes
tgttccattattggaa

SEQ ID NO: 279646 - DNA, 16 bp, P. troglodytes
tgttccattttgcatt

SEQ ID NO: 279647 - DNA, 16 bp, P. troglodytes
tgttcccaccttttgg

SEQ ID NO: 279648 - DNA, 16 bp, P. troglodytes
tgttccccactctgtg

SEQ ID NO: 279649 - DNA, 16 bp, P. troglodytes
tgttccccaggctgga

SEQ ID NO: 279650 - DNA, 16 bp, P. troglodytes
tgttcccctctctgtg

SEQ ID NO: 279651 - DNA, 16 bp, P. troglodytes
tgttcccctttctcca

SEQ ID NO: 279652 - DNA, 16 bp, P. troglodytes
tgttccctccaaatct

SEQ ID NO: 279653 - DNA, 16 bp, P. troglodytes
tgttccgctccctgtg

SEQ ID NO: 279654 - DNA, 16 bp, P. troglodytes
tgttcctgaaacagca

SEQ ID NO: 279655 - DNA, 16 bp, P. troglodytes
tgttcctgaggaagaa

SEQ ID NO: 279656 - DNA, 17 bp, P. troglodytes
tgttcctgggtgtgtct

SEQ ID NO: 279657 - DNA, 16 bp, P. troglodytes
tgttcctgtttgcaga

SEQ ID NO: 279658 - DNA, 16 bp, P. troglodytes
tgttcctttttcacca

SEQ ID NO: 279659 - DNA, 16 bp, P. troglodytes
tgttcgagggcaggaa

SEQ ID NO: 279660 - DNA, 16 bp, P. troglodytes
tgttcggagtttcttc

SEQ ID NO: 279661 - DNA, 26 bp, P. troglodytes
tgttcgttaagagtcatcaccactcc

SEQ ID NO: 279662 - DNA, 16 bp, P. troglodytes
tgttctaaagcctttt

SEQ ID NO: 279663 - DNA, 16 bp, P. troglodytes
tgttctaaatgcttta

SEQ ID NO: 279664 - DNA, 16 bp, P. troglodytes
tgttctaggcactggg

SEQ ID NO: 279665 - DNA, 16 bp, P. troglodytes
tgttctatagttttca

SEQ ID NO: 279666 - DNA, 16 bp, P. troglodytes
tgttctattaaaaaaa

SEQ ID NO: 279667 - DNA, 16 bp, P. troglodytes
tgttctcaaagtgtgg

SEQ ID NO: 279668 - DNA, 16 bp, P. troglodytes
tgttctcaccacaaaa

SEQ ID NO: 279669 - DNA, 16 bp, P. troglodytes
tgttctcaccacaaag

SEQ ID NO: 279670 - DNA, 16 bp, P. troglodytes
tgttctcatgacagta

SEQ ID NO: 279671 - DNA, 17 bp, P. troglodytes
tgttctcatgataatga

SEQ ID NO: 279672 - DNA, 17 bp, P. troglodytes
tgttctcatgatagtga

SEQ ID NO: 279673 - DNA, 16 bp, P. troglodytes
tgttctcattgatttc

SEQ ID NO: 279674 - DNA, 16 bp, P. troglodytes
tgttctctggctcctt

SEQ ID NO: 279675 - DNA, 16 bp, P. troglodytes
tgttctcttcccttat

SEQ ID NO: 279676 - DNA, 16 bp, P. troglodytes
tgttctcttgatagtg

SEQ ID NO: 279677 - DNA, 16 bp, P. troglodytes
tgttctgcagcctcca

SEQ ID NO: 279678 - DNA, 16 bp, P. troglodytes
tgttctgcctggctca

SEQ ID NO: 279679 - DNA, 16 bp, P. troglodytes
tgttctgcctttctgg

SEQ ID NO: 279680 - DNA, 16 bp, P. troglodytes
tgttctggaggctggg

SEQ ID NO: 279681 - DNA, 16 bp, P. troglodytes
tgttctggaggtcaca

SEQ ID NO: 279682 - DNA, 16 bp, P. troglodytes
tgttctgggatgcagt

SEQ ID NO: 279683 - DNA, 16 bp, P. troglodytes
tgttctgtaaatacct

SEQ ID NO: 279684 - DNA, 16 bp, P. troglodytes
tgttctgtaaatgtct

SEQ ID NO: 279685 - DNA, 16 bp, P. troglodytes
tgttctgtaattttct

SEQ ID NO: 279686 - DNA, 16 bp, P. troglodytes
tgttctgtcatccagg

SEQ ID NO: 279687 - DNA, 16 bp, P. troglodytes
tgttcttaatttttaa

SEQ ID NO: 279688 - DNA, 16 bp, P. troglodytes
tgttcttacttacaag

SEQ ID NO: 279689 - DNA, 16 bp, P. troglodytes
tgttcttataagaaga

SEQ ID NO: 279690 - DNA, 16 bp, P. troglodytes
tgttcttattggccat

SEQ ID NO: 279691 - DNA, 16 bp, P. troglodytes
tgttcttcattctgtt

SEQ ID NO: 279692 - DNA, 16 bp, P. troglodytes
tgttcttcttgctcaa

SEQ ID NO: 279693 - DNA, 16 bp, P. troglodytes
tgttcttctttttaaa

SEQ ID NO: 279694 - DNA, 16 bp, P. troglodytes
tgttcttgaacttctg

SEQ ID NO: 279695 - DNA, 16 bp, P. troglodytes
tgttcttgctgtctca

SEQ ID NO: 279696 - DNA, 16 bp, P. troglodytes
tgttcttggcacattt

SEQ ID NO: 279697 - DNA, 16 bp, P. troglodytes
tgttctttataaatta

SEQ ID NO: 279698 - DNA, 16 bp, P. troglodytes
tgttctttgaaagaat

SEQ ID NO: 279699 - DNA, 16 bp, P. troglodytes
tgttctttgtccactt

SEQ ID NO: 279700 - DNA, 16 bp, P. troglodytes
tgttcttttaaaattt

SEQ ID NO: 279701 - DNA, 16 bp, P. troglodytes
tgttgaaaacaaaatt

SEQ ID NO: 279702 - DNA, 16 bp, P. troglodytes
tgttgaaaagactatt

SEQ ID NO: 279703 - DNA, 16 bp, P. troglodytes
tgttgaaaatcaattt

SEQ ID NO: 279704 - DNA, 16 bp, P. troglodytes
tgttgaaaatcagatg

SEQ ID NO: 279705 - DNA, 16 bp, P. troglodytes
tgttgaaaatcagttt

SEQ ID NO: 279706 - DNA, 16 bp, P. troglodytes
tgttgaaaattaaaat

SEQ ID NO: 279707 - DNA, 16 bp, P. troglodytes
tgttgaaatgtaatcc

SEQ ID NO: 279708 - DNA, 16 bp, P. troglodytes
tgttgaaatgtgatcc

SEQ ID NO: 279709 - DNA, 16 bp, P. troglodytes
tgttgaaatttaatcc

SEQ ID NO: 279710 - DNA, 16 bp, P. troglodytes
tgttgaacagaagtag

SEQ ID NO: 279711 - DNA, 16 bp, P. troglodytes
tgttgaacagaagtgg

SEQ ID NO: 279712 - DNA, 16 bp, P. troglodytes
tgttgaacctttcttt

SEQ ID NO: 279713 - DNA, 16 bp, P. troglodytes
tgttgaactttttaaa

SEQ ID NO: 279714 - DNA, 16 bp, P. troglodytes
tgttgaagatcagatg

SEQ ID NO: 279715 - DNA, 16 bp, P. troglodytes
tgttgaagatgctata

SEQ ID NO: 279716 - DNA, 16 bp, P. troglodytes
tgttgaagatttttgc

SEQ ID NO: 279717 - DNA, 16 bp, P. troglodytes
tgttgaagctctcaat

SEQ ID NO: 279718 - DNA, 16 bp, P. troglodytes
tgttgaagtctcccac

SEQ ID NO: 279719 - DNA, 16 bp, P. troglodytes
tgttgaagtcttaact

SEQ ID NO: 279720 - DNA, 16 bp, P. troglodytes
tgttgaagttgtttat

SEQ ID NO: 279721 - DNA, 16 bp, P. troglodytes
tgttgaataaatgtat

SEQ ID NO: 279722 - DNA, 29 bp, P. troglodytes
tgttgaatattggcccccactctcttctg

SEQ ID NO: 279723 - DNA, 16 bp, P. troglodytes
tgttgaatgaaggaat

SEQ ID NO: 279724 - DNA, 16 bp, P. troglodytes
tgttgaatgaataaaa

SEQ ID NO: 279725 - DNA, 16 bp, P. troglodytes
tgttgaatgaatgaat

SEQ ID NO: 279726 - DNA, 16 bp, P. troglodytes
tgttgaattaataaat

SEQ ID NO: 279727 - DNA, 16 bp, P. troglodytes
tgttgaattccagtgt

SEQ ID NO: 279728 - DNA, 16 bp, P. troglodytes
tgttgaattgtttaaa

SEQ ID NO: 279729 - DNA, 16 bp, P. troglodytes
tgttgaatttgaggtg

SEQ ID NO: 279730 - DNA, 16 bp, P. troglodytes
tgttgaattttaacaa

SEQ ID NO: 279731 - DNA, 17 bp, P. troglodytes
tgttgaattttattgaa

SEQ ID NO: 279732 - DNA, 17 bp, P. troglodytes
tgttgaattttgtcaaa

SEQ ID NO: 279733 - DNA, 16 bp, P. troglodytes
tgttgaccaaaacatc

SEQ ID NO: 279734 - DNA, 16 bp, P. troglodytes
tgttgaccagcctggt

SEQ ID NO: 279735 - DNA, 16 bp, P. troglodytes
tgttgactctgatgat

SEQ ID NO: 279736 - DNA, 16 bp, P. troglodytes
tgttgactggaagtct

SEQ ID NO: 279737 - DNA, 16 bp, P. troglodytes
tgttgactgtttcctt

SEQ ID NO: 279738 - DNA, 16 bp, P. troglodytes
tgttgagatggagtct

SEQ ID NO: 279739 - DNA, 16 bp, P. troglodytes
tgttgagctttttttc

SEQ ID NO: 279740 - DNA, 16 bp, P. troglodytes
tgttgaggaacctcca

SEQ ID NO: 279741 - DNA, 16 bp, P. troglodytes
tgttgaggggaaaaaa

SEQ ID NO: 279742 - DNA, 16 bp, P. troglodytes
tgttgagtaaaagaag

SEQ ID NO: 279743 - DNA, 16 bp, P. troglodytes
tgttgataattgttga

SEQ ID NO: 279744 - DNA, 16 bp, P. troglodytes
tgttgatgatgatgat

SEQ ID NO: 279745 - DNA, 16 bp, P. troglodytes
tgttgatgctgctggt

SEQ ID NO: 279746 - DNA, 16 bp, P. troglodytes
tgttgatgctgctgtt

SEQ ID NO: 279747 - DNA, 16 bp, P. troglodytes
tgttgatgggcacttg

SEQ ID NO: 279748 - DNA, 17 bp, P. troglodytes
tgttgattgctaaatgt

SEQ ID NO: 279749 - DNA, 16 bp, P. troglodytes
tgttgattgctttctt

SEQ ID NO: 279750 - DNA, 16 bp, P. troglodytes
tgttgatttaaagaaa

SEQ ID NO: 279751 - DNA, 16 bp, P. troglodytes
tgttgatttctaattt

SEQ ID NO: 279752 - DNA, 16 bp, P. troglodytes
tgttgattttatgtct

SEQ ID NO: 279753 - DNA, 16 bp, P. troglodytes
tgttgattttcaacct

SEQ ID NO: 279754 - DNA, 16 bp, P. troglodytes
tgttgcaagtgacagg

SEQ ID NO: 279755 - DNA, 16 bp, P. troglodytes
tgttgcaattgccttt

SEQ ID NO: 279756 - DNA, 16 bp, P. troglodytes
tgttgcacagactggt

SEQ ID NO: 279757 - DNA, 16 bp, P. troglodytes
tgttgcacaggctggt

SEQ ID NO: 279758 - DNA, 16 bp, P. troglodytes
tgttgcacaggttggt

SEQ ID NO: 279759 - DNA, 16 bp, P. troglodytes
tgttgcagaagaaaat

SEQ ID NO: 279760 - DNA, 16 bp, P. troglodytes
tgttgcagcaaaggac

SEQ ID NO: 279761 - DNA, 16 bp, P. troglodytes
tgttgcagttgttttt

SEQ ID NO: 279762 - DNA, 16 bp, P. troglodytes
tgttgcatttactttt

SEQ ID NO: 279763 - DNA, 16 bp, P. troglodytes
tgttgccaaagaagat

SEQ ID NO: 279764 - DNA, 16 bp, P. troglodytes
tgttgccaggggctgg

SEQ ID NO: 279765 - DNA, 16 bp, P. troglodytes
tgttgccattgatttt

SEQ ID NO: 279766 - DNA, 17 bp, P. troglodytes
tgttgccattgcttttc

SEQ ID NO: 279767 - DNA, 16 bp, P. troglodytes
tgttgcccaagcagga

SEQ ID NO: 279768 - DNA, 16 bp, P. troglodytes
tgttgcccaaggtgga

SEQ ID NO: 279769 - DNA, 16 bp, P. troglodytes
tgttgcccacgctgat

SEQ ID NO: 279770 - DNA, 16 bp, P. troglodytes
tgttgcccacgctgga

SEQ ID NO: 279771 - DNA, 16 bp, P. troglodytes
tgttgcccagactggt

SEQ ID NO: 279772 - DNA, 16 bp, P. troglodytes
tgttgcccagcctggg

SEQ ID NO: 279773 - DNA, 16 bp, P. troglodytes
tgttgcccaggctaga

SEQ ID NO: 279774 - DNA, 16 bp, P. troglodytes
tgttgcccaggctgct

SEQ ID NO: 279775 - DNA, 17 bp, P. troglodytes
tgttgcccaggctggac

SEQ ID NO: 279776 - DNA, 16 bp, P. troglodytes
tgttgcccaggctggc

SEQ ID NO: 279777 - DNA, 17 bp, P. troglodytes
tgttgcccaggctggta

SEQ ID NO: 279778 - DNA, 17 bp, P. troglodytes
tgttgcccaggctggtt

SEQ ID NO: 279779 - DNA, 16 bp, P. troglodytes
tgttgcccaggctgtc

SEQ ID NO: 279780 - DNA, 17 bp, P. troglodytes
tgttgcccaggctgtta

SEQ ID NO: 279781 - DNA, 16 bp, P. troglodytes
tgttgcccagggtgga

SEQ ID NO: 279782 - DNA, 16 bp, P. troglodytes
tgttgcccaggtctca

SEQ ID NO: 279783 - DNA, 16 bp, P. troglodytes
tgttgcccagtctggt

SEQ ID NO: 279784 - DNA, 16 bp, P. troglodytes
tgttgcctacaaaaaa

SEQ ID NO: 279785 - DNA, 16 bp, P. troglodytes
tgttgcctacaagaaa

SEQ ID NO: 279786 - DNA, 16 bp, P. troglodytes
tgttgcctggctggag

SEQ ID NO: 279787 - DNA, 16 bp, P. troglodytes
tgttgcctgggctggg

SEQ ID NO: 279788 - DNA, 16 bp, P. troglodytes
tgttgccttgtgaaga

SEQ ID NO: 279789 - DNA, 16 bp, P. troglodytes
tgttgctgaatttggt

SEQ ID NO: 279790 - DNA, 16 bp, P. troglodytes
tgttgctgcaaagaac

SEQ ID NO: 279791 - DNA, 16 bp, P. troglodytes
tgttgctgctgctgtt

SEQ ID NO: 279792 - DNA, 16 bp, P. troglodytes
tgttgctgctgctttt

SEQ ID NO: 279793 - DNA, 16 bp, P. troglodytes
tgttgctgtgttgccc

SEQ ID NO: 279794 - DNA, 16 bp, P. troglodytes
tgttgctgtttccagt

SEQ ID NO: 279795 - DNA, 16 bp, P. troglodytes
tgttgcttacaagaaa

SEQ ID NO: 279796 - DNA, 16 bp, P. troglodytes
tgttggaaaaatgaca

SEQ ID NO: 279797 - DNA, 16 bp, P. troglodytes
tgttggaaaggcatga

SEQ ID NO: 279798 - DNA, 16 bp, P. troglodytes
tgttggaaatgtaaat

SEQ ID NO: 279799 - DNA, 16 bp, P. troglodytes
tgttggaaattctggc

SEQ ID NO: 279800 - DNA, 16 bp, P. troglodytes
tgttggaacacagcca

SEQ ID NO: 279801 - DNA, 16 bp, P. troglodytes
tgttggaattacagac

SEQ ID NO: 279802 - DNA, 16 bp, P. troglodytes
tgttggaggaagggcc

SEQ ID NO: 279803 - DNA, 16 bp, P. troglodytes
tgttggaggtggggcc

SEQ ID NO: 279804 - DNA, 16 bp, P. troglodytes
tgttggatgcatagtt

SEQ ID NO: 279805 - DNA, 16 bp, P. troglodytes
tgttggcaaggatgtg

SEQ ID NO: 279806 - DNA, 16 bp, P. troglodytes
tgttggccaagatgtt

SEQ ID NO: 279807 - DNA, 18 bp, P. troglodytes
tgttggccacactggtct

SEQ ID NO: 279808 - DNA, 16 bp, P. troglodytes
tgttggccaggaaggt

SEQ ID NO: 279809 - DNA, 16 bp, P. troglodytes
tgttggccaggccgat

SEQ ID NO: 279810 - DNA, 16 bp, P. troglodytes
tgttggccaggctgga

SEQ ID NO: 279811 - DNA, 16 bp, P. troglodytes
tgttggccaggctggg

SEQ ID NO: 279812 - DNA, 16 bp, P. troglodytes
tgttggctaggttggt

SEQ ID NO: 279813 - DNA, 16 bp, P. troglodytes
tgttggctcacacctg

SEQ ID NO: 279814 - DNA, 16 bp, P. troglodytes
tgttggctcacgcctg

SEQ ID NO: 279815 - DNA, 16 bp, P. troglodytes
tgttggctgggcacgg

SEQ ID NO: 279816 - DNA, 16 bp, P. troglodytes
tgttgggaaaactgac

SEQ ID NO: 279817 - DNA, 16 bp, P. troglodytes
tgttgggaacaagccc

SEQ ID NO: 279818 - DNA, 17 bp, P. troglodytes
tgttgggaacaggcccc

SEQ ID NO: 279819 - DNA, 16 bp, P. troglodytes
tgttgggaacattcaa

SEQ ID NO: 279820 - DNA, 16 bp, P. troglodytes
tgttgggaactggaac

SEQ ID NO: 279821 - DNA, 16 bp, P. troglodytes
tgttggggaaatataa

SEQ ID NO: 279822 - DNA, 16 bp, P. troglodytes
tgttggggaagggacc

SEQ ID NO: 279823 - DNA, 16 bp, P. troglodytes
tgttgggtttacaggc

SEQ ID NO: 279824 - DNA, 16 bp, P. troglodytes
tgttgggttttggact

SEQ ID NO: 279825 - DNA, 16 bp, P. troglodytes
tgttggtaattttaaa

SEQ ID NO: 279826 - DNA, 17 bp, P. troglodytes
tgttggtcaggctggtt

SEQ ID NO: 279827 - DNA, 18 bp, P. troglodytes
tgttggtcagtctggtct

SEQ ID NO: 279828 - DNA, 16 bp, P. troglodytes
tgttggtgaagctggt

SEQ ID NO: 279829 - DNA, 16 bp, P. troglodytes
tgttggtgaggagctg

SEQ ID NO: 279830 - DNA, 16 bp, P. troglodytes
tgttggtgaggctgat

SEQ ID NO: 279831 - DNA, 16 bp, P. troglodytes
tgttggtgatgatgtg

SEQ ID NO: 279832 - DNA, 16 bp, P. troglodytes
tgttggtgggaatata

SEQ ID NO: 279833 - DNA, 16 bp, P. troglodytes
tgttggttccttctga

SEQ ID NO: 279834 - DNA, 16 bp, P. troglodytes
tgttgtaaggattaaa

SEQ ID NO: 279835 - DNA, 16 bp, P. troglodytes
tgttgtaagggttaaa

SEQ ID NO: 279836 - DNA, 16 bp, P. troglodytes
tgttgtatgtattata

SEQ ID NO: 279837 - DNA, 16 bp, P. troglodytes
tgttgtattttcagta

SEQ ID NO: 279838 - DNA, 16 bp, P. troglodytes
tgttgtcatctcaaca

SEQ ID NO: 279839 - DNA, 16 bp, P. troglodytes
tgttgtccaggatgga

SEQ ID NO: 279840 - DNA, 16 bp, P. troglodytes
tgttgtccaggcagga

SEQ ID NO: 279841 - DNA, 16 bp, P. troglodytes
tgttgtctacaagaga

SEQ ID NO: 279842 - DNA, 16 bp, P. troglodytes
tgttgtctgtcttctg

SEQ ID NO: 279843 - DNA, 16 bp, P. troglodytes
tgttgtcttttaaaaa

SEQ ID NO: 279844 - DNA, 16 bp, P. troglodytes
tgttgtgaaaatgacc

SEQ ID NO: 279845 - DNA, 16 bp, P. troglodytes
tgttgtgaagaataaa

SEQ ID NO: 279846 - DNA, 16 bp, P. troglodytes
tgttgtgaagattaat

SEQ ID NO: 279847 - DNA, 16 bp, P. troglodytes
tgttgtgaaggtattt

SEQ ID NO: 279848 - DNA, 16 bp, P. troglodytes
tgttgtgaaggttaaa

SEQ ID NO: 279849 - DNA, 16 bp, P. troglodytes
tgttgtgatcttggct

SEQ ID NO: 279850 - DNA, 16 bp, P. troglodytes
tgttgtgggaaggacc

SEQ ID NO: 279851 - DNA, 16 bp, P. troglodytes
tgttgtgggaggaacc

SEQ ID NO: 279852 - DNA, 16 bp, P. troglodytes
tgttgtgggagggacc

SEQ ID NO: 279853 - DNA, 16 bp, P. troglodytes
tgttgtgtctcaggaa

SEQ ID NO: 279854 - DNA, 16 bp, P. troglodytes
tgttgttactgttatt

SEQ ID NO: 279855 - DNA, 16 bp, P. troglodytes
tgttgttcatctctta

SEQ ID NO: 279856 - DNA, 16 bp, P. troglodytes
tgttgttgctgctatt

SEQ ID NO: 279857 - DNA, 16 bp, P. troglodytes
tgttgttgttactgtt

SEQ ID NO: 279858 - DNA, 16 bp, P. troglodytes
tgttgttgttattgct

SEQ ID NO: 279859 - DNA, 16 bp, P. troglodytes
tgttgttgttatttca

SEQ ID NO: 279860 - DNA, 16 bp, P. troglodytes
tgttgttgttgtttca

SEQ ID NO: 279861 - DNA, 16 bp, P. troglodytes
tgttgtttaagccatg

SEQ ID NO: 279862 - DNA, 16 bp, P. troglodytes
tgttgtttaatttcca

SEQ ID NO: 279863 - DNA, 16 bp, P. troglodytes
tgttgtttataaatga

SEQ ID NO: 279864 - DNA, 16 bp, P. troglodytes
tgttgttttcttgtaa

SEQ ID NO: 279865 - DNA, 16 bp, P. troglodytes
tgtttaaaaaaagaga

SEQ ID NO: 279866 - DNA, 16 bp, P. troglodytes
tgtttaaaaaacaaaa

SEQ ID NO: 279867 - DNA, 16 bp, P. troglodytes
tgtttaaaaaatacat

SEQ ID NO: 279868 - DNA, 16 bp, P. troglodytes
tgtttaaaaatggaaa

SEQ ID NO: 279869 - DNA, 16 bp, P. troglodytes
tgtttaaaatacaaat

SEQ ID NO: 279870 - DNA, 16 bp, P. troglodytes
tgtttaaaatgcagat

SEQ ID NO: 279871 - DNA, 16 bp, P. troglodytes
tgtttaaaatgtcttt

SEQ ID NO: 279872 - DNA, 16 bp, P. troglodytes
tgtttaaacattttat

SEQ ID NO: 279873 - DNA, 16 bp, P. troglodytes
tgtttaaaccacccag

SEQ ID NO: 279874 - DNA, 16 bp, P. troglodytes
tgtttaaagaagaaaa

SEQ ID NO: 279875 - DNA, 16 bp, P. troglodytes
tgtttaaaggaaaaat

SEQ ID NO: 279876 - DNA, 16 bp, P. troglodytes
tgtttaaagttttaaa

SEQ ID NO: 279877 - DNA, 16 bp, P. troglodytes
tgtttaaatttttgag

SEQ ID NO: 279878 - DNA, 16 bp, P. troglodytes
tgtttaacaaatattt

SEQ ID NO: 279879 - DNA, 16 bp, P. troglodytes
tgtttaacaaccagct

SEQ ID NO: 279880 - DNA, 16 bp, P. troglodytes
tgtttaacaactgact

SEQ ID NO: 279881 - DNA, 16 bp, P. troglodytes
tgtttaaggaggctga

SEQ ID NO: 279882 - DNA, 16 bp, P. troglodytes
tgtttaatcatttgag

SEQ ID NO: 279883 - DNA, 16 bp, P. troglodytes
tgtttaatgttttgag

SEQ ID NO: 279884 - DNA, 16 bp, P. troglodytes
tgtttaatttacatgt

SEQ ID NO: 279885 - DNA, 16 bp, P. troglodytes
tgtttaatttccaaat

SEQ ID NO: 279886 - DNA, 16 bp, P. troglodytes
tgtttacatagcattt

SEQ ID NO: 279887 - DNA, 16 bp, P. troglodytes
tgtttacatttaatgt

SEQ ID NO: 279888 - DNA, 16 bp, P. troglodytes
tgtttacattttctat

SEQ ID NO: 279889 - DNA, 16 bp, P. troglodytes
tgtttaccaagaattt

SEQ ID NO: 279890 - DNA, 16 bp, P. troglodytes
tgtttactgagcatct

SEQ ID NO: 279891 - DNA, 16 bp, P. troglodytes
tgtttactgaggcact

SEQ ID NO: 279892 - DNA, 16 bp, P. troglodytes
tgtttactgcagcact

SEQ ID NO: 279893 - DNA, 16 bp, P. troglodytes
tgtttactgcagcagt

SEQ ID NO: 279894 - DNA, 16 bp, P. troglodytes
tgtttacttaaaattt

SEQ ID NO: 279895 - DNA, 16 bp, P. troglodytes
tgtttacttgaaattt

SEQ ID NO: 279896 - DNA, 16 bp, P. troglodytes
tgtttactttgctgat

SEQ ID NO: 279897 - DNA, 16 bp, P. troglodytes
tgtttacttttttaaa

SEQ ID NO: 279898 - DNA, 16 bp, P. troglodytes
tgtttagacttgggtc

SEQ ID NO: 279899 - DNA, 16 bp, P. troglodytes
tgtttagagatggggt

SEQ ID NO: 279900 - DNA, 16 bp, P. troglodytes
tgtttagatacacaaa

SEQ ID NO: 279901 - DNA, 16 bp, P. troglodytes
tgtttagctccaactt

SEQ ID NO: 279902 - DNA, 16 bp, P. troglodytes
tgtttaggagaaagta

SEQ ID NO: 279903 - DNA, 16 bp, P. troglodytes
tgtttagggaataata

SEQ ID NO: 279904 - DNA, 16 bp, P. troglodytes
tgtttaggtcatgaag

SEQ ID NO: 279905 - DNA, 16 bp, P. troglodytes
tgtttagtagaattta

SEQ ID NO: 279906 - DNA, 16 bp, P. troglodytes
tgtttagtagagacag

SEQ ID NO: 279907 - DNA, 16 bp, P. troglodytes
tgtttagtagagatgg

SEQ ID NO: 279908 - DNA, 16 bp, P. troglodytes
tgtttagtgcagccac

SEQ ID NO: 279909 - DNA, 16 bp, P. troglodytes
tgtttataaaagtaaa

SEQ ID NO: 279910 - DNA, 16 bp, P. troglodytes
tgtttataataacaaa

SEQ ID NO: 279911 - DNA, 16 bp, P. troglodytes
tgtttatagagacagg

SEQ ID NO: 279912 - DNA, 16 bp, P. troglodytes
tgtttatatcagcttt

SEQ ID NO: 279913 - DNA, 16 bp, P. troglodytes
tgtttatccatgcatc

SEQ ID NO: 279914 - DNA, 16 bp, P. troglodytes
tgtttatctcccactt

SEQ ID NO: 279915 - DNA, 16 bp, P. troglodytes
tgtttatctgaaaaag

SEQ ID NO: 279916 - DNA, 16 bp, P. troglodytes
tgtttatctgaaattc

SEQ ID NO: 279917 - DNA, 16 bp, P. troglodytes
tgtttatctggagaac

SEQ ID NO: 279918 - DNA, 16 bp, P. troglodytes
tgtttatctgttcatt

SEQ ID NO: 279919 - DNA, 16 bp, P. troglodytes
tgtttatggataggaa

SEQ ID NO: 279920 - DNA, 16 bp, P. troglodytes
tgtttatggccagtct

SEQ ID NO: 279921 - DNA, 16 bp, P. troglodytes
tgtttatggtattctc

SEQ ID NO: 279922 - DNA, 16 bp, P. troglodytes
tgtttatggtttcagg

SEQ ID NO: 279923 - DNA, 16 bp, P. troglodytes
tgtttatgtagaaaat

SEQ ID NO: 279924 - DNA, 16 bp, P. troglodytes
tgtttatgtatatgta

SEQ ID NO: 279925 - DNA, 16 bp, P. troglodytes
tgtttatgtgatggat

SEQ ID NO: 279926 - DNA, 16 bp, P. troglodytes
tgtttattagttccag

SEQ ID NO: 279927 - DNA, 16 bp, P. troglodytes
tgtttattatcttgat

SEQ ID NO: 279928 - DNA, 16 bp, P. troglodytes
tgtttattcagatttt

SEQ ID NO: 279929 - DNA, 16 bp, P. troglodytes
tgtttattgaatgaat

SEQ ID NO: 279930 - DNA, 16 bp, P. troglodytes
tgtttattgcagcact

SEQ ID NO: 279931 - DNA, 16 bp, P. troglodytes
tgtttattgctgcatt

SEQ ID NO: 279932 - DNA, 16 bp, P. troglodytes
tgtttattggctgttt

SEQ ID NO: 279933 - DNA, 16 bp, P. troglodytes
tgtttattgtagaaaa

SEQ ID NO: 279934 - DNA, 16 bp, P. troglodytes
tgtttattgtctgtct

SEQ ID NO: 279935 - DNA, 16 bp, P. troglodytes
tgtttatttattcact

SEQ ID NO: 279936 - DNA, 16 bp, P. troglodytes
tgtttattttcaaata

SEQ ID NO: 279937 - DNA, 16 bp, P. troglodytes
tgtttattttccatct

SEQ ID NO: 279938 - DNA, 16 bp, P. troglodytes
tgtttcaaaaaaaaaa

SEQ ID NO: 279939 - DNA, 16 bp, P. troglodytes
tgtttcaaaaaggaaa

SEQ ID NO: 279940 - DNA, 16 bp, P. troglodytes
tgtttcaaaagaagaa

SEQ ID NO: 279941 - DNA, 16 bp, P. troglodytes
tgtttcaaaatatttt

SEQ ID NO: 279942 - DNA, 16 bp, P. troglodytes
tgtttcaaatatttta

SEQ ID NO: 279943 - DNA, 16 bp, P. troglodytes
tgtttcaagaaatttt

SEQ ID NO: 279944 - DNA, 16 bp, P. troglodytes
tgtttcagaaaaaaaa

SEQ ID NO: 279945 - DNA, 16 bp, P. troglodytes
tgtttcagaaacaaaa

SEQ ID NO: 279946 - DNA, 16 bp, P. troglodytes
tgtttcagaaataaaa

SEQ ID NO: 279947 - DNA, 16 bp, P. troglodytes
tgtttcagtttttgaa

SEQ ID NO: 279948 - DNA, 16 bp, P. troglodytes
tgtttcatcttctgtt

SEQ ID NO: 279949 - DNA, 16 bp, P. troglodytes
tgtttcatgtgtattt

SEQ ID NO: 279950 - DNA, 16 bp, P. troglodytes
tgtttcattaatcttt

SEQ ID NO: 279951 - DNA, 16 bp, P. troglodytes
tgtttcatttataaaa

SEQ ID NO: 279952 - DNA, 16 bp, P. troglodytes
tgtttcatttatctct

SEQ ID NO: 279953 - DNA, 16 bp, P. troglodytes
tgtttcatttcatctg

SEQ ID NO: 279954 - DNA, 16 bp, P. troglodytes
tgtttcatttctaatt

SEQ ID NO: 279955 - DNA, 16 bp, P. troglodytes
tgtttcatttgccttc

SEQ ID NO: 279956 - DNA, 16 bp, P. troglodytes
tgtttcattttaatta

SEQ ID NO: 279957 - DNA, 16 bp, P. troglodytes
tgtttcatttttaaaa

SEQ ID NO: 279958 - DNA, 16 bp, P. troglodytes
tgtttcatttttaata

SEQ ID NO: 279959 - DNA, 16 bp, P. troglodytes
tgtttcattttttaaa

SEQ ID NO: 279960 - DNA, 16 bp, P. troglodytes
tgtttccaaaataaaa

SEQ ID NO: 279961 - DNA, 16 bp, P. troglodytes
tgtttccaaatacagt

SEQ ID NO: 279962 - DNA, 16 bp, P. troglodytes
tgtttccacatcttgg

SEQ ID NO: 279963 - DNA, 16 bp, P. troglodytes
tgtttccaggaattta

SEQ ID NO: 279964 - DNA, 16 bp, P. troglodytes
tgtttccatctttgtg

SEQ ID NO: 279965 - DNA, 16 bp, P. troglodytes
tgtttccatggaaaca

SEQ ID NO: 279966 - DNA, 16 bp, P. troglodytes
tgtttccattctcccc

SEQ ID NO: 279967 - DNA, 16 bp, P. troglodytes
tgtttccatttttaaa

SEQ ID NO: 279968 - DNA, 16 bp, P. troglodytes
tgtttcccaaacttca

SEQ ID NO: 279969 - DNA, 16 bp, P. troglodytes
tgtttcccacagtggc

SEQ ID NO: 279970 - DNA, 16 bp, P. troglodytes
tgtttcccagcctggt

SEQ ID NO: 279971 - DNA, 16 bp, P. troglodytes
tgtttccctccatgtg

SEQ ID NO: 279972 - DNA, 16 bp, P. troglodytes
tgtttcctaattaaaa

SEQ ID NO: 279973 - DNA, 16 bp, P. troglodytes
tgtttcctcaactgta

SEQ ID NO: 279974 - DNA, 16 bp, P. troglodytes
tgtttcctcatctgta

SEQ ID NO: 279975 - DNA, 16 bp, P. troglodytes
tgtttcctccaaatct

SEQ ID NO: 279976 - DNA, 16 bp, P. troglodytes
tgtttcctgaaatttt

SEQ ID NO: 279977 - DNA, 16 bp, P. troglodytes
tgtttcctgaatttga

SEQ ID NO: 279978 - DNA, 16 bp, P. troglodytes
tgtttcctttgctgta

SEQ ID NO: 279979 - DNA, 16 bp, P. troglodytes
tgtttctaattcattt

SEQ ID NO: 279980 - DNA, 16 bp, P. troglodytes
tgtttctacaaaaatt

SEQ ID NO: 279981 - DNA, 16 bp, P. troglodytes
tgtttctacaaataat

SEQ ID NO: 279982 - DNA, 16 bp, P. troglodytes
tgtttctagaaaaaaa

SEQ ID NO: 279983 - DNA, 16 bp, P. troglodytes
tgtttctagaaattta

SEQ ID NO: 279984 - DNA, 16 bp, P. troglodytes
tgtttctaggaattta

SEQ ID NO: 279985 - DNA, 16 bp, P. troglodytes
tgtttctagtttttga

SEQ ID NO: 279986 - DNA, 16 bp, P. troglodytes
tgtttctataaataaa

SEQ ID NO: 279987 - DNA, 16 bp, P. troglodytes
tgtttctcaaataaat

SEQ ID NO: 279988 - DNA, 16 bp, P. troglodytes
tgtttctcattttaaa

SEQ ID NO: 279989 - DNA, 16 bp, P. troglodytes
tgtttctccccctgcc

SEQ ID NO: 279990 - DNA, 16 bp, P. troglodytes
tgtttctctagagaat

SEQ ID NO: 279991 - DNA, 18 bp, P. troglodytes
tgtttctctccacccaaa

SEQ ID NO: 279992 - DNA, 16 bp, P. troglodytes
tgtttctctgaaaaat

SEQ ID NO: 279993 - DNA, 16 bp, P. troglodytes
tgtttctctggaaaat

SEQ ID NO: 279994 - DNA, 16 bp, P. troglodytes
tgtttctctttttaaa

SEQ ID NO: 279995 - DNA, 16 bp, P. troglodytes
tgtttctgacttattt

SEQ ID NO: 279996 - DNA, 16 bp, P. troglodytes
tgtttctgatgagaag

SEQ ID NO: 279997 - DNA, 16 bp, P. troglodytes
tgtttctgcagtggct

SEQ ID NO: 279998 - DNA, 16 bp, P. troglodytes
tgtttctgctgagaaa

SEQ ID NO: 279999 - DNA, 16 bp, P. troglodytes
tgtttctggattctct

SEQ ID NO: 280000 - DNA, 16 bp, P. troglodytes
tgtttctgggtgttgc

SEQ ID NO: 280001 - DNA, 16 bp, P. troglodytes
tgtttctgtatcttgg

SEQ ID NO: 280002 - DNA, 16 bp, P. troglodytes
tgtttctgtttgaaga

SEQ ID NO: 280003 - DNA, 16 bp, P. troglodytes
tgtttctgttttaaat

SEQ ID NO: 280004 - DNA, 16 bp, P. troglodytes
tgtttcttcagtttct

SEQ ID NO: 280005 - DNA, 16 bp, P. troglodytes
tgtttcttctgcttga

SEQ ID NO: 280006 - DNA, 16 bp, P. troglodytes
tgtttctttaaaacag

SEQ ID NO: 280007 - DNA, 16 bp, P. troglodytes
tgtttctttatctgta

SEQ ID NO: 280008 - DNA, 16 bp, P. troglodytes
tgtttctttgataatt

SEQ ID NO: 280009 - DNA, 16 bp, P. troglodytes
tgtttctttgccatat

SEQ ID NO: 280010 - DNA, 16 bp, P. troglodytes
tgtttcttttaaataa

SEQ ID NO: 280011 - DNA, 16 bp, P. troglodytes
tgtttctttttctcca

SEQ ID NO: 280012 - DNA, 16 bp, P. troglodytes
tgtttctttttgaaaa

SEQ ID NO: 280013 - DNA, 16 bp, P. troglodytes
tgtttgaaaataaaat

SEQ ID NO: 280014 - DNA, 16 bp, P. troglodytes
tgtttgaaagaattca

SEQ ID NO: 280015 - DNA, 16 bp, P. troglodytes
tgtttgacttcattgt

SEQ ID NO: 280016 - DNA, 16 bp, P. troglodytes
tgtttgagaaaagcag

SEQ ID NO: 280017 - DNA, 16 bp, P. troglodytes
tgtttgagatgatgga

SEQ ID NO: 280018 - DNA, 16 bp, P. troglodytes
tgtttgagatggagtt

SEQ ID NO: 280019 - DNA, 16 bp, P. troglodytes
tgtttgaggtgacaga

SEQ ID NO: 280020 - DNA, 16 bp, P. troglodytes
tgtttgagtttttaaa

SEQ ID NO: 280021 - DNA, 16 bp, P. troglodytes
tgtttgatgatggtga

SEQ ID NO: 280022 - DNA, 16 bp, P. troglodytes
tgtttgatttttgaga

SEQ ID NO: 280023 - DNA, 16 bp, P. troglodytes
tgtttgcaaaaaaaaa

SEQ ID NO: 280024 - DNA, 16 bp, P. troglodytes
tgtttgcagatgatat

SEQ ID NO: 280025 - DNA, 16 bp, P. troglodytes
tgtttgcatgtgtgtg

SEQ ID NO: 280026 - DNA, 16 bp, P. troglodytes
tgtttgcattttttaa

SEQ ID NO: 280027 - DNA, 16 bp, P. troglodytes
tgtttgccaggctgtt

SEQ ID NO: 280028 - DNA, 16 bp, P. troglodytes
tgtttgccaggtttct

SEQ ID NO: 280029 - DNA, 17 bp, P. troglodytes
tgtttgcctggctatca

SEQ ID NO: 280030 - DNA, 16 bp, P. troglodytes
tgtttgcctgtgtgtg

SEQ ID NO: 280031 - DNA, 16 bp, P. troglodytes
tgtttgctgagaatga

SEQ ID NO: 280032 - DNA, 16 bp, P. troglodytes
tgtttgctgattattt

SEQ ID NO: 280033 - DNA, 16 bp, P. troglodytes
tgtttgctgcacccat

SEQ ID NO: 280034 - DNA, 16 bp, P. troglodytes
tgtttgctggctgctt

SEQ ID NO: 280035 - DNA, 16 bp, P. troglodytes
tgtttgctgttgcttc

SEQ ID NO: 280036 - DNA, 16 bp, P. troglodytes
tgtttgctttgtggaa

SEQ ID NO: 280037 - DNA, 16 bp, P. troglodytes
tgtttgcttttgagga

SEQ ID NO: 280038 - DNA, 16 bp, P. troglodytes
tgtttgctttttaaaa

SEQ ID NO: 280039 - DNA, 16 bp, P. troglodytes
tgtttggaaatatttt

SEQ ID NO: 280040 - DNA, 16 bp, P. troglodytes
tgtttggaacagtttc

SEQ ID NO: 280041 - DNA, 16 bp, P. troglodytes
tgtttggctttccatt

SEQ ID NO: 280042 - DNA, 16 bp, P. troglodytes
tgtttgggatgatgaa

SEQ ID NO: 280043 - DNA, 16 bp, P. troglodytes
tgtttggtattttgtc

SEQ ID NO: 280044 - DNA, 16 bp, P. troglodytes
tgtttggttgcatgga

SEQ ID NO: 280045 - DNA, 16 bp, P. troglodytes
tgtttggtttcccatt

SEQ ID NO: 280046 - DNA, 16 bp, P. troglodytes
tgtttggtttcctgtc

SEQ ID NO: 280047 - DNA, 16 bp, P. troglodytes
tgtttggttttccact

SEQ ID NO: 280048 - DNA, 16 bp, P. troglodytes
tgtttggtttttaaaa

SEQ ID NO: 280049 - DNA, 16 bp, P. troglodytes
tgtttgtaaaaataaa

SEQ ID NO: 280050 - DNA, 16 bp, P. troglodytes
tgtttgtaaaatgaga

SEQ ID NO: 280051 - DNA, 16 bp, P. troglodytes
tgtttgtaaagcactt

SEQ ID NO: 280052 - DNA, 16 bp, P. troglodytes
tgtttgtaatattctc

SEQ ID NO: 280053 - DNA, 21 bp, P. troglodytes
tgtttgtacctctggtagaat

SEQ ID NO: 280054 - DNA, 16 bp, P. troglodytes
tgtttgtagtagagac

SEQ ID NO: 280055 - DNA, 16 bp, P. troglodytes
tgtttgtagtgatgct

SEQ ID NO: 280056 - DNA, 16 bp, P. troglodytes
tgtttgtatttctgtg

SEQ ID NO: 280057 - DNA, 16 bp, P. troglodytes
tgtttgtctgagaaaa

SEQ ID NO: 280058 - DNA, 16 bp, P. troglodytes
tgtttgtcttttaaaa

SEQ ID NO: 280059 - DNA, 16 bp, P. troglodytes
tgtttgtgcatgtata

SEQ ID NO: 280060 - DNA, 16 bp, P. troglodytes
tgtttgtgtcctccca

SEQ ID NO: 280061 - DNA, 16 bp, P. troglodytes
tgtttgtgtgcacatg

SEQ ID NO: 280062 - DNA, 16 bp, P. troglodytes
tgtttgtgtgcatatg

SEQ ID NO: 280063 - DNA, 16 bp, P. troglodytes
tgtttgtgtgtacata

SEQ ID NO: 280064 - DNA, 16 bp, P. troglodytes
tgtttgtgtgtatata

SEQ ID NO: 280065 - DNA, 16 bp, P. troglodytes
tgtttgttgaatgaat

SEQ ID NO: 280066 - DNA, 16 bp, P. troglodytes
tgtttgttgagtgaat

SEQ ID NO: 280067 - DNA, 16 bp, P. troglodytes
tgtttgttggctattt

SEQ ID NO: 280068 - DNA, 16 bp, P. troglodytes
tgtttgtttaaaataa

SEQ ID NO: 280069 - DNA, 16 bp, P. troglodytes
tgtttgtttattgcag

SEQ ID NO: 280070 - DNA, 16 bp, P. troglodytes
tgtttgtttcatatat

SEQ ID NO: 280071 - DNA, 16 bp, P. troglodytes
tgtttgtttctttaaa

SEQ ID NO: 280072 - DNA, 16 bp, P. troglodytes
tgtttgtttgagatag

SEQ ID NO: 280073 - DNA, 16 bp, P. troglodytes
tgtttgttttaaaaaa

SEQ ID NO: 280074 - DNA, 16 bp, P. troglodytes
tgtttgttttaagaca

SEQ ID NO: 280075 - DNA, 16 bp, P. troglodytes
tgtttgttttcattca

SEQ ID NO: 280076 - DNA, 16 bp, P. troglodytes
tgtttgttttcctgta

SEQ ID NO: 280077 - DNA, 17 bp, P. troglodytes
tgtttgttttgagacaa

SEQ ID NO: 280078 - DNA, 16 bp, P. troglodytes
tgtttgttttgcaaat

SEQ ID NO: 280079 - DNA, 16 bp, P. troglodytes
tgtttgtttttaaagc

SEQ ID NO: 280080 - DNA, 16 bp, P. troglodytes
tgtttgtttttcaaga

SEQ ID NO: 280081 - DNA, 16 bp, P. troglodytes
tgtttgtttttgaact

SEQ ID NO: 280082 - DNA, 16 bp, P. troglodytes
tgtttgttttttcaga

SEQ ID NO: 280083 - DNA, 16 bp, P. troglodytes
tgtttgttttttcagg

SEQ ID NO: 280084 - DNA, 16 bp, P. troglodytes
tgttttaaaaatgatt

SEQ ID NO: 280085 - DNA, 16 bp, P. troglodytes
tgttttaaaaatgtaa

SEQ ID NO: 280086 - DNA, 16 bp, P. troglodytes
tgttttaaaacatatt

SEQ ID NO: 280087 - DNA, 16 bp, P. troglodytes
tgttttaaaactttaa

SEQ ID NO: 280088 - DNA, 16 bp, P. troglodytes
tgttttaaaactttca

SEQ ID NO: 280089 - DNA, 16 bp, P. troglodytes
tgttttaaaagatatt

SEQ ID NO: 280090 - DNA, 16 bp, P. troglodytes
tgttttaaaagtgtgt

SEQ ID NO: 280091 - DNA, 16 bp, P. troglodytes
tgttttaaaatatgta

SEQ ID NO: 280092 - DNA, 16 bp, P. troglodytes
tgttttaaacatttat

SEQ ID NO: 280093 - DNA, 16 bp, P. troglodytes
tgttttaaacattttt

SEQ ID NO: 280094 - DNA, 16 bp, P. troglodytes
tgttttaaagaaaaat

SEQ ID NO: 280095 - DNA, 16 bp, P. troglodytes
tgttttaaagaaagaa

SEQ ID NO: 280096 - DNA, 16 bp, P. troglodytes
tgttttaaagggagaa

SEQ ID NO: 280097 - DNA, 16 bp, P. troglodytes
tgttttaaagtctatt

SEQ ID NO: 280098 - DNA, 16 bp, P. troglodytes
tgttttaaataaaaac

SEQ ID NO: 280099 - DNA, 16 bp, P. troglodytes
tgttttaaataaaaag

SEQ ID NO: 280100 - DNA, 16 bp, P. troglodytes
tgttttaaataagaaa

SEQ ID NO: 280101 - DNA, 16 bp, P. troglodytes
tgttttaaattctgtt

SEQ ID NO: 280102 - DNA, 16 bp, P. troglodytes
tgttttaactttttaa

SEQ ID NO: 280103 - DNA, 16 bp, P. troglodytes
tgttttaagaaaatta

SEQ ID NO: 280104 - DNA, 16 bp, P. troglodytes
tgttttaagaaataaa

SEQ ID NO: 280105 - DNA, 16 bp, P. troglodytes
tgttttaagaaattgc

SEQ ID NO: 280106 - DNA, 16 bp, P. troglodytes
tgttttaagccacaga

SEQ ID NO: 280107 - DNA, 16 bp, P. troglodytes
tgttttaagccaccaa

SEQ ID NO: 280108 - DNA, 16 bp, P. troglodytes
tgttttaagttaaaat

SEQ ID NO: 280109 - DNA, 16 bp, P. troglodytes
tgttttaagttctttg

SEQ ID NO: 280110 - DNA, 16 bp, P. troglodytes
tgttttaattacattt

SEQ ID NO: 280111 - DNA, 16 bp, P. troglodytes
tgttttacaattaact

SEQ ID NO: 280112 - DNA, 16 bp, P. troglodytes
tgttttacagatgaag

SEQ ID NO: 280113 - DNA, 16 bp, P. troglodytes
tgttttacagttttca

SEQ ID NO: 280114 - DNA, 16 bp, P. troglodytes
tgttttacatatttaa

SEQ ID NO: 280115 - DNA, 16 bp, P. troglodytes
tgttttacattttcat

SEQ ID NO: 280116 - DNA, 16 bp, P. troglodytes
tgttttacttctaatt

SEQ ID NO: 280117 - DNA, 16 bp, P. troglodytes
tgttttactttcaatt

SEQ ID NO: 280118 - DNA, 16 bp, P. troglodytes
tgttttagaaaaaata

SEQ ID NO: 280119 - DNA, 16 bp, P. troglodytes
tgttttagaaaatata

SEQ ID NO: 280120 - DNA, 16 bp, P. troglodytes
tgttttagtccatttg

SEQ ID NO: 280121 - DNA, 16 bp, P. troglodytes
tgttttataaatgtgg

SEQ ID NO: 280122 - DNA, 16 bp, P. troglodytes
tgttttatagatgagg

SEQ ID NO: 280123 - DNA, 16 bp, P. troglodytes
tgttttatgcacaaaa

SEQ ID NO: 280124 - DNA, 16 bp, P. troglodytes
tgttttattcactgct

SEQ ID NO: 280125 - DNA, 16 bp, P. troglodytes
tgttttattcatctct

SEQ ID NO: 280126 - DNA, 16 bp, P. troglodytes
tgttttattgtggtaa

SEQ ID NO: 280127 - DNA, 16 bp, P. troglodytes
tgttttatttaaactt

SEQ ID NO: 280128 - DNA, 16 bp, P. troglodytes
tgttttatttcttcaa

SEQ ID NO: 280129 - DNA, 16 bp, P. troglodytes
tgttttattttcaaat

SEQ ID NO: 280130 - DNA, 16 bp, P. troglodytes
tgttttattttcctca

SEQ ID NO: 280131 - DNA, 16 bp, P. troglodytes
tgttttcaaaaaatca

SEQ ID NO: 280132 - DNA, 16 bp, P. troglodytes
tgttttcaaaatgaaa

SEQ ID NO: 280133 - DNA, 16 bp, P. troglodytes
tgttttcaaacttggt

SEQ ID NO: 280134 - DNA, 16 bp, P. troglodytes
tgttttcaaatttaaa

SEQ ID NO: 280135 - DNA, 16 bp, P. troglodytes
tgttttcaaggttcat

SEQ ID NO: 280136 - DNA, 16 bp, P. troglodytes
tgttttcaaggtttat

SEQ ID NO: 280137 - DNA, 16 bp, P. troglodytes
tgttttcaattctctt

SEQ ID NO: 280138 - DNA, 16 bp, P. troglodytes
tgttttcaattctttg

SEQ ID NO: 280139 - DNA, 16 bp, P. troglodytes
tgttttcaattttaaa

SEQ ID NO: 280140 - DNA, 16 bp, P. troglodytes
tgttttcacattttta

SEQ ID NO: 280141 - DNA, 16 bp, P. troglodytes
tgttttcagaaaaaaa

SEQ ID NO: 280142 - DNA, 16 bp, P. troglodytes
tgttttcagatatttt

SEQ ID NO: 280143 - DNA, 16 bp, P. troglodytes
tgttttcagatgatat

SEQ ID NO: 280144 - DNA, 16 bp, P. troglodytes
tgttttcagttctctt

SEQ ID NO: 280145 - DNA, 16 bp, P. troglodytes
tgttttcagttctttg

SEQ ID NO: 280146 - DNA, 16 bp, P. troglodytes
tgttttcagttttcat

SEQ ID NO: 280147 - DNA, 16 bp, P. troglodytes
tgttttcagtttttca

SEQ ID NO: 280148 - DNA, 16 bp, P. troglodytes
tgttttcataattttc

SEQ ID NO: 280149 - DNA, 16 bp, P. troglodytes
tgttttcatcatttaa

SEQ ID NO: 280150 - DNA, 16 bp, P. troglodytes
tgttttcatctgtaaa

SEQ ID NO: 280151 - DNA, 16 bp, P. troglodytes
tgttttcatcttttgg

SEQ ID NO: 280152 - DNA, 16 bp, P. troglodytes
tgttttcatgctgctt

SEQ ID NO: 280153 - DNA, 16 bp, P. troglodytes
tgttttcattatcatt

SEQ ID NO: 280154 - DNA, 16 bp, P. troglodytes
tgttttcattgcattt

SEQ ID NO: 280155 - DNA, 16 bp, P. troglodytes
tgttttcattggtttc

SEQ ID NO: 280156 - DNA, 16 bp, P. troglodytes
tgttttcatttcagaa

SEQ ID NO: 280157 - DNA, 16 bp, P. troglodytes
tgttttcatttgaaaa

SEQ ID NO: 280158 - DNA, 16 bp, P. troglodytes
tgttttccaaaatgat

SEQ ID NO: 280159 - DNA, 16 bp, P. troglodytes
tgttttccaaagtggt

SEQ ID NO: 280160 - DNA, 24 bp, P. troglodytes
tgttttccaacttggttccattct

SEQ ID NO: 280161 - DNA, 16 bp, P. troglodytes
tgttttccaataaaat

SEQ ID NO: 280162 - DNA, 16 bp, P. troglodytes
tgttttccaccttggt

SEQ ID NO: 280163 - DNA, 16 bp, P. troglodytes
tgttttccattggctt

SEQ ID NO: 280164 - DNA, 16 bp, P. troglodytes
tgttttccatttgtat

SEQ ID NO: 280165 - DNA, 16 bp, P. troglodytes
tgttttccatttttaa

SEQ ID NO: 280166 - DNA, 16 bp, P. troglodytes
tgttttcccacttgaa

SEQ ID NO: 280167 - DNA, 16 bp, P. troglodytes
tgttttcccagctact

SEQ ID NO: 280168 - DNA, 16 bp, P. troglodytes
tgttttcctcatttca

SEQ ID NO: 280169 - DNA, 16 bp, P. troglodytes
tgttttcctgatttta

SEQ ID NO: 280170 - DNA, 16 bp, P. troglodytes
tgttttccttttaaat

SEQ ID NO: 280171 - DNA, 16 bp, P. troglodytes
tgttttccttttgaaa

SEQ ID NO: 280172 - DNA, 16 bp, P. troglodytes
tgttttctaaaataat

SEQ ID NO: 280173 - DNA, 16 bp, P. troglodytes
tgttttctaaatattt

SEQ ID NO: 280174 - DNA, 16 bp, P. troglodytes
tgttttctacatattt

SEQ ID NO: 280175 - DNA, 16 bp, P. troglodytes
tgttttctatcttaaa

SEQ ID NO: 280176 - DNA, 16 bp, P. troglodytes
tgttttctcatttcat

SEQ ID NO: 280177 - DNA, 16 bp, P. troglodytes
tgttttctctaaaata

SEQ ID NO: 280178 - DNA, 16 bp, P. troglodytes
tgttttctctgttagc

SEQ ID NO: 280179 - DNA, 16 bp, P. troglodytes
tgttttctcttcctta

SEQ ID NO: 280180 - DNA, 16 bp, P. troglodytes
tgttttctgttttaaa

SEQ ID NO: 280181 - DNA, 16 bp, P. troglodytes
tgttttctgttttcaa

SEQ ID NO: 280182 - DNA, 16 bp, P. troglodytes
tgttttcttaaagaaa

SEQ ID NO: 280183 - DNA, 16 bp, P. troglodytes
tgttttcttcatatat

SEQ ID NO: 280184 - DNA, 16 bp, P. troglodytes
tgttttcttcatctgt

SEQ ID NO: 280185 - DNA, 16 bp, P. troglodytes
tgttttcttctaagtg

SEQ ID NO: 280186 - DNA, 16 bp, P. troglodytes
tgttttcttctggtag

SEQ ID NO: 280187 - DNA, 16 bp, P. troglodytes
tgttttctttaaaata

SEQ ID NO: 280188 - DNA, 16 bp, P. troglodytes
tgttttctttatccat

SEQ ID NO: 280189 - DNA, 16 bp, P. troglodytes
tgttttctttcagaaa

SEQ ID NO: 280190 - DNA, 16 bp, P. troglodytes
tgttttctttgaaaaa

SEQ ID NO: 280191 - DNA, 16 bp, P. troglodytes
tgttttctttgaaaat

SEQ ID NO: 280192 - DNA, 16 bp, P. troglodytes
tgttttctttgagaca

SEQ ID NO: 280193 - DNA, 16 bp, P. troglodytes
tgttttctttgtaaat

SEQ ID NO: 280194 - DNA, 16 bp, P. troglodytes
tgttttctttgttgaa

SEQ ID NO: 280195 - DNA, 16 bp, P. troglodytes
tgttttcttttctaaa

SEQ ID NO: 280196 - DNA, 16 bp, P. troglodytes
tgttttctttttaaaa

SEQ ID NO: 280197 - DNA, 16 bp, P. troglodytes
tgttttgaaaaataca

SEQ ID NO: 280198 - DNA, 16 bp, P. troglodytes
tgttttgaaaaatgaa

SEQ ID NO: 280199 - DNA, 16 bp, P. troglodytes
tgttttgaaaaatgta

SEQ ID NO: 280200 - DNA, 16 bp, P. troglodytes
tgttttgaaataaaat

SEQ ID NO: 280201 - DNA, 16 bp, P. troglodytes
tgttttgaaatctatt

SEQ ID NO: 280202 - DNA, 16 bp, P. troglodytes
tgttttgaaatgtaag

SEQ ID NO: 280203 - DNA, 16 bp, P. troglodytes
tgttttgaaatgtata

SEQ ID NO: 280204 - DNA, 16 bp, P. troglodytes
tgttttgaaatgtgag

SEQ ID NO: 280205 - DNA, 22 bp, P. troglodytes
tgttttgagacggagtcttgct

SEQ ID NO: 280206 - DNA, 16 bp, P. troglodytes
tgttttgagagagtct

SEQ ID NO: 280207 - DNA, 16 bp, P. troglodytes
tgttttgagatgcagt

SEQ ID NO: 280208 - DNA, 16 bp, P. troglodytes
tgttttgagatggagt

SEQ ID NO: 280209 - DNA, 16 bp, P. troglodytes
tgttttgaggattaaa

SEQ ID NO: 280210 - DNA, 16 bp, P. troglodytes
tgttttgatacaggca

SEQ ID NO: 280211 - DNA, 16 bp, P. troglodytes
tgttttgatacagtca

SEQ ID NO: 280212 - DNA, 16 bp, P. troglodytes
tgttttgatatacatt

SEQ ID NO: 280213 - DNA, 16 bp, P. troglodytes
tgttttgcaaatattt

SEQ ID NO: 280214 - DNA, 16 bp, P. troglodytes
tgttttgcaaatgttt

SEQ ID NO: 280215 - DNA, 16 bp, P. troglodytes
tgttttgccatgttgc

SEQ ID NO: 280216 - DNA, 16 bp, P. troglodytes
tgttttggaaatattt

SEQ ID NO: 280217 - DNA, 16 bp, P. troglodytes
tgttttgggaaaaaaa

SEQ ID NO: 280218 - DNA, 16 bp, P. troglodytes
tgttttggtttctata

SEQ ID NO: 280219 - DNA, 16 bp, P. troglodytes
tgttttgtaaataaag

SEQ ID NO: 280220 - DNA, 16 bp, P. troglodytes
tgttttgtaattttca

SEQ ID NO: 280221 - DNA, 16 bp, P. troglodytes
tgttttgtacttttca

SEQ ID NO: 280222 - DNA, 16 bp, P. troglodytes
tgttttgtagattctt

SEQ ID NO: 280223 - DNA, 16 bp, P. troglodytes
tgttttgtatatatct

SEQ ID NO: 280224 - DNA, 16 bp, P. troglodytes
tgttttgtgaaacttt

SEQ ID NO: 280225 - DNA, 16 bp, P. troglodytes
tgttttgttcaccatt

SEQ ID NO: 280226 - DNA, 16 bp, P. troglodytes
tgttttgttgatctgt

SEQ ID NO: 280227 - DNA, 16 bp, P. troglodytes
tgttttgtttactgta

SEQ ID NO: 280228 - DNA, 16 bp, P. troglodytes
tgttttgtttagaaat

SEQ ID NO: 280229 - DNA, 16 bp, P. troglodytes
tgttttgtttgaaaca

SEQ ID NO: 280230 - DNA, 16 bp, P. troglodytes
tgttttgttttaaaag

SEQ ID NO: 280231 - DNA, 16 bp, P. troglodytes
tgttttgttttaagag

SEQ ID NO: 280232 - DNA, 16 bp, P. troglodytes
tgttttgttttataca

SEQ ID NO: 280233 - DNA, 17 bp, P. troglodytes
tgttttgttttgagaca

SEQ ID NO: 280234 - DNA, 16 bp, P. troglodytes
tgtttttaaaaaaaca

SEQ ID NO: 280235 - DNA, 16 bp, P. troglodytes
tgtttttaaaaatctt

SEQ ID NO: 280236 - DNA, 16 bp, P. troglodytes
tgtttttaaaaatgaa

SEQ ID NO: 280237 - DNA, 16 bp, P. troglodytes
tgtttttaaaaatgta

SEQ ID NO: 280238 - DNA, 16 bp, P. troglodytes
tgtttttaaaactttt

SEQ ID NO: 280239 - DNA, 16 bp, P. troglodytes
tgtttttaaaatacat

SEQ ID NO: 280240 - DNA, 16 bp, P. troglodytes
tgtttttaaagaaaag

SEQ ID NO: 280241 - DNA, 16 bp, P. troglodytes
tgtttttaaagttcat

SEQ ID NO: 280242 - DNA, 16 bp, P. troglodytes
tgtttttaaataactt

SEQ ID NO: 280243 - DNA, 16 bp, P. troglodytes
tgtttttaaatgaatg

SEQ ID NO: 280244 - DNA, 16 bp, P. troglodytes
tgtttttaaatgtctt

SEQ ID NO: 280245 - DNA, 16 bp, P. troglodytes
tgtttttaacaaaaga

SEQ ID NO: 280246 - DNA, 16 bp, P. troglodytes
tgtttttaagccaccc

SEQ ID NO: 280247 - DNA, 16 bp, P. troglodytes
tgtttttaataaatga

SEQ ID NO: 280248 - DNA, 16 bp, P. troglodytes
tgtttttaatggcatc

SEQ ID NO: 280249 - DNA, 16 bp, P. troglodytes
tgtttttagaaaatat

SEQ ID NO: 280250 - DNA, 16 bp, P. troglodytes
tgtttttagaaataaa

SEQ ID NO: 280251 - DNA, 16 bp, P. troglodytes
tgtttttagagatggg

SEQ ID NO: 280252 - DNA, 16 bp, P. troglodytes
tgtttttagcagagac

SEQ ID NO: 280253 - DNA, 17 bp, P. troglodytes
tgtttttagtagagacg

SEQ ID NO: 280254 - DNA, 16 bp, P. troglodytes
tgtttttatgaagaat

SEQ ID NO: 280255 - DNA, 16 bp, P. troglodytes
tgtttttatgccatta

SEQ ID NO: 280256 - DNA, 16 bp, P. troglodytes
tgtttttattaaacca

SEQ ID NO: 280257 - DNA, 16 bp, P. troglodytes
tgtttttattacaaaa

SEQ ID NO: 280258 - DNA, 16 bp, P. troglodytes
tgtttttcaaaacttt

SEQ ID NO: 280259 - DNA, 16 bp, P. troglodytes
tgtttttcaaatattt

SEQ ID NO: 280260 - DNA, 16 bp, P. troglodytes
tgtttttcagactttt

SEQ ID NO: 280261 - DNA, 16 bp, P. troglodytes
tgtttttcagatgagg

SEQ ID NO: 280262 - DNA, 16 bp, P. troglodytes
tgtttttcagattctt

SEQ ID NO: 280263 - DNA, 16 bp, P. troglodytes
tgtttttcagcttcat

SEQ ID NO: 280264 - DNA, 16 bp, P. troglodytes
tgtttttcagtttcct

SEQ ID NO: 280265 - DNA, 16 bp, P. troglodytes
tgtttttcattttaaa

SEQ ID NO: 280266 - DNA, 16 bp, P. troglodytes
tgtttttcctacctct

SEQ ID NO: 280267 - DNA, 16 bp, P. troglodytes
tgtttttcctcaaaat

SEQ ID NO: 280268 - DNA, 16 bp, P. troglodytes
tgtttttccttcagca

SEQ ID NO: 280269 - DNA, 16 bp, P. troglodytes
tgtttttcctttaaaa

SEQ ID NO: 280270 - DNA, 16 bp, P. troglodytes
tgtttttctaaaaaaa

SEQ ID NO: 280271 - DNA, 16 bp, P. troglodytes
tgtttttctaaataaa

SEQ ID NO: 280272 - DNA, 16 bp, P. troglodytes
tgtttttctcatgata

SEQ ID NO: 280273 - DNA, 16 bp, P. troglodytes
tgtttttctcattaaa

SEQ ID NO: 280274 - DNA, 16 bp, P. troglodytes
tgtttttctgtacctg

SEQ ID NO: 280275 - DNA, 16 bp, P. troglodytes
tgtttttcttcaaaaa

SEQ ID NO: 280276 - DNA, 16 bp, P. troglodytes
tgtttttcttctgtga

SEQ ID NO: 280277 - DNA, 16 bp, P. troglodytes
tgtttttcttttaaaa

SEQ ID NO: 280278 - DNA, 16 bp, P. troglodytes
tgtttttgaagaatct

SEQ ID NO: 280279 - DNA, 16 bp, P. troglodytes
tgtttttgagacagtg

SEQ ID NO: 280280 - DNA, 16 bp, P. troglodytes
tgtttttgatatggag

SEQ ID NO: 280281 - DNA, 16 bp, P. troglodytes
tgtttttgattttaca

SEQ ID NO: 280282 - DNA, 16 bp, P. troglodytes
tgtttttgcaaataaa

SEQ ID NO: 280283 - DNA, 16 bp, P. troglodytes
tgtttttgcaattgtg

SEQ ID NO: 280284 - DNA, 16 bp, P. troglodytes
tgtttttgcttttcaa

SEQ ID NO: 280285 - DNA, 16 bp, P. troglodytes
tgtttttggatgaaat

SEQ ID NO: 280286 - DNA, 16 bp, P. troglodytes
tgtttttggccaggca

SEQ ID NO: 280287 - DNA, 16 bp, P. troglodytes
tgtttttgtctttgaa

SEQ ID NO: 280288 - DNA, 16 bp, P. troglodytes
tgtttttgtggtagca

SEQ ID NO: 280289 - DNA, 16 bp, P. troglodytes
tgtttttgtggtggca

SEQ ID NO: 280290 - DNA, 16 bp, P. troglodytes
tgttttttaaaaaagc

SEQ ID NO: 280291 - DNA, 16 bp, P. troglodytes
tgttttttaaaaacag

SEQ ID NO: 280292 - DNA, 16 bp, P. troglodytes
tgttttttaaaaagaa

SEQ ID NO: 280293 - DNA, 16 bp, P. troglodytes
tgttttttaaataact

SEQ ID NO: 280294 - DNA, 16 bp, P. troglodytes
tgttttttagtagaga

SEQ ID NO: 280295 - DNA, 16 bp, P. troglodytes
tgttttttcagacagg

SEQ ID NO: 280296 - DNA, 16 bp, P. troglodytes
tgttttttcttaaaat

SEQ ID NO: 280297 - DNA, 16 bp, P. troglodytes
tgttttttgagagagt

SEQ ID NO: 280298 - DNA, 16 bp, P. troglodytes
tgttttttggataaaa

SEQ ID NO: 280299 - DNA, 16 bp, P. troglodytes
tgttttttggctacat

SEQ ID NO: 280300 - DNA, 16 bp, P. troglodytes
tgtttttttaaaaaca

SEQ ID NO: 280301 - DNA, 16 bp, P. troglodytes
tgtttttttaatgaga

SEQ ID NO: 280302 - DNA, 16 bp, P. troglodytes
tgtttttttcagtaga

SEQ ID NO: 280303 - DNA, 16 bp, P. troglodytes
tgtttttttctaaaaa

SEQ ID NO: 280304 - DNA, 16 bp, P. troglodytes
tgtttttttctggaga

SEQ ID NO: 280305 - DNA, 16 bp, P. troglodytes
tgtttttttgaaaaca

SEQ ID NO: 280306 - DNA, 17 bp, P. troglodytes
tgtttttttgagacagg

SEQ ID NO: 280307 - DNA, 16 bp, P. troglodytes
tgtttttttgcttagg

SEQ ID NO: 280308 - DNA, 16 bp, P. troglodytes
tgttttttttccccca

SEQ ID NO: 280309 - DNA, 16 bp, P. troglodytes
tgttttttttctggag

SEQ ID NO: 280310 - DNA, 16 bp, P. troglodytes
ttaaaaaaaaaatctg

SEQ ID NO: 280311 - DNA, 16 bp, P. troglodytes
ttaaaaaaaaagtctg

SEQ ID NO: 280312 - DNA, 16 bp, P. troglodytes
ttaaaaaaaaatcagt

SEQ ID NO: 280313 - DNA, 16 bp, P. troglodytes
ttaaaaaaaaatctgt

SEQ ID NO: 280314 - DNA, 16 bp, P. troglodytes
ttaaaaaaaaatgctg

SEQ ID NO: 280315 - DNA, 16 bp, P. troglodytes
ttaaaaaaaactttgt

SEQ ID NO: 280316 - DNA, 16 bp, P. troglodytes
ttaaaaaaaagtcttt

SEQ ID NO: 280317 - DNA, 16 bp, P. troglodytes
ttaaaaaaataacagt

SEQ ID NO: 280318 - DNA, 16 bp, P. troglodytes
ttaaaaaaatagcttt

SEQ ID NO: 280319 - DNA, 16 bp, P. troglodytes
ttaaaaaaatcagtga

SEQ ID NO: 280320 - DNA, 16 bp, P. troglodytes
ttaaaaaaatccttct

SEQ ID NO: 280321 - DNA, 16 bp, P. troglodytes
ttaaaaaaatctattc

SEQ ID NO: 280322 - DNA, 16 bp, P. troglodytes
ttaaaaaaatctgtaa

SEQ ID NO: 280323 - DNA, 16 bp, P. troglodytes
ttaaaaaaatctgttt

SEQ ID NO: 280324 - DNA, 16 bp, P. troglodytes
ttaaaaaaatggttta

SEQ ID NO: 280325 - DNA, 16 bp, P. troglodytes
ttaaaaaaattctctg

SEQ ID NO: 280326 - DNA, 16 bp, P. troglodytes
ttaaaaaaattctgct

SEQ ID NO: 280327 - DNA, 16 bp, P. troglodytes
ttaaaaaacaatgaat

SEQ ID NO: 280328 - DNA, 16 bp, P. troglodytes
ttaaaaaacagcttta

SEQ ID NO: 280329 - DNA, 16 bp, P. troglodytes
ttaaaaaacattttca

SEQ ID NO: 280330 - DNA, 16 bp, P. troglodytes
ttaaaaaactagagaa

SEQ ID NO: 280331 - DNA, 16 bp, P. troglodytes
ttaaaaaactttttct

SEQ ID NO: 280332 - DNA, 16 bp, P. troglodytes
ttaaaaaagaaaatct

SEQ ID NO: 280333 - DNA, 16 bp, P. troglodytes
ttaaaaaagaaatctg

SEQ ID NO: 280334 - DNA, 16 bp, P. troglodytes
ttaaaaaagtttttgt

SEQ ID NO: 280335 - DNA, 16 bp, P. troglodytes
ttaaaaaataagcaat

SEQ ID NO: 280336 - DNA, 16 bp, P. troglodytes
ttaaaaaataatacag

SEQ ID NO: 280337 - DNA, 16 bp, P. troglodytes
ttaaaaaatagacatt

SEQ ID NO: 280338 - DNA, 16 bp, P. troglodytes
ttaaaaaatagagttt

SEQ ID NO: 280339 - DNA, 16 bp, P. troglodytes
ttaaaaaatatacctt

SEQ ID NO: 280340 - DNA, 16 bp, P. troglodytes
ttaaaaaatatcttca

SEQ ID NO: 280341 - DNA, 16 bp, P. troglodytes
ttaaaaaatatgtgta

SEQ ID NO: 280342 - DNA, 16 bp, P. troglodytes
ttaaaaaatcaaattg

SEQ ID NO: 280343 - DNA, 16 bp, P. troglodytes
ttaaaaaatcagaata

SEQ ID NO: 280344 - DNA, 16 bp, P. troglodytes
ttaaaaaatcagcttt

SEQ ID NO: 280345 - DNA, 16 bp, P. troglodytes
ttaaaaaatcagtttg

SEQ ID NO: 280346 - DNA, 16 bp, P. troglodytes
ttaaaaaatcttttga

SEQ ID NO: 280347 - DNA, 16 bp, P. troglodytes
ttaaaaaatgaaacat

SEQ ID NO: 280348 - DNA, 16 bp, P. troglodytes
ttaaaaaatgctttat

SEQ ID NO: 280349 - DNA, 16 bp, P. troglodytes
ttaaaaaatgtacaat

SEQ ID NO: 280350 - DNA, 16 bp, P. troglodytes
ttaaaaaatgttaact

SEQ ID NO: 280351 - DNA, 16 bp, P. troglodytes
ttaaaaaatgttactt

SEQ ID NO: 280352 - DNA, 16 bp, P. troglodytes
ttaaaaaattacaaga

SEQ ID NO: 280353 - DNA, 16 bp, P. troglodytes
ttaaaaaattacttca

SEQ ID NO: 280354 - DNA, 16 bp, P. troglodytes
ttaaaaaattatgtca

SEQ ID NO: 280355 - DNA, 16 bp, P. troglodytes
ttaaaaaattcctctt

SEQ ID NO: 280356 - DNA, 16 bp, P. troglodytes
ttaaaaaattgttaag

SEQ ID NO: 280357 - DNA, 16 bp, P. troglodytes
ttaaaaacaaattttc

SEQ ID NO: 280358 - DNA, 16 bp, P. troglodytes
ttaaaaacaacatttt

SEQ ID NO: 280359 - DNA, 16 bp, P. troglodytes
ttaaaaacaaggaaat

SEQ ID NO: 280360 - DNA, 16 bp, P. troglodytes
ttaaaaacacagattt

SEQ ID NO: 280361 - DNA, 16 bp, P. troglodytes
ttaaaaacaggagttt

SEQ ID NO: 280362 - DNA, 16 bp, P. troglodytes
ttaaaaacatactttt

SEQ ID NO: 280363 - DNA, 16 bp, P. troglodytes
ttaaaaacatgtttat

SEQ ID NO: 280364 - DNA, 16 bp, P. troglodytes
ttaaaaacattcattt

SEQ ID NO: 280365 - DNA, 16 bp, P. troglodytes
ttaaaaacatttcttt

SEQ ID NO: 280366 - DNA, 16 bp, P. troglodytes
ttaaaaactaacattt

SEQ ID NO: 280367 - DNA, 16 bp, P. troglodytes
ttaaaaactcatttaa

SEQ ID NO: 280368 - DNA, 16 bp, P. troglodytes
ttaaaaactgaaaaat

SEQ ID NO: 280369 - DNA, 16 bp, P. troglodytes
ttaaaaactgaaaaca

SEQ ID NO: 280370 - DNA, 16 bp, P. troglodytes
ttaaaaacttctgtgc

SEQ ID NO: 280371 - DNA, 16 bp, P. troglodytes
ttaaaaagaaaaactt

SEQ ID NO: 280372 - DNA, 16 bp, P. troglodytes
ttaaaaagaaaacatt

SEQ ID NO: 280373 - DNA, 16 bp, P. troglodytes
ttaaaaagaaaagtct

SEQ ID NO: 280374 - DNA, 16 bp, P. troglodytes
ttaaaaagaaaattct

SEQ ID NO: 280375 - DNA, 16 bp, P. troglodytes
ttaaaaagaaattctg

SEQ ID NO: 280376 - DNA, 16 bp, P. troglodytes
ttaaaaagaacattta

SEQ ID NO: 280377 - DNA, 16 bp, P. troglodytes
ttaaaaagacataaat

SEQ ID NO: 280378 - DNA, 16 bp, P. troglodytes
ttaaaaagcaacaaca

SEQ ID NO: 280379 - DNA, 16 bp, P. troglodytes
ttaaaaagcaagagaa

SEQ ID NO: 280380 - DNA, 16 bp, P. troglodytes
ttaaaaagcattatta

SEQ ID NO: 280381 - DNA, 16 bp, P. troglodytes
ttaaaaaggaaaatca

SEQ ID NO: 280382 - DNA, 16 bp, P. troglodytes
ttaaaaaggaaacaga

SEQ ID NO: 280383 - DNA, 16 bp, P. troglodytes
ttaaaaaggaaattga

SEQ ID NO: 280384 - DNA, 16 bp, P. troglodytes
ttaaaaaggaagcaga

SEQ ID NO: 280385 - DNA, 16 bp, P. troglodytes
ttaaaaaggaatttta

SEQ ID NO: 280386 - DNA, 16 bp, P. troglodytes
ttaaaaaggttatttt

SEQ ID NO: 280387 - DNA, 16 bp, P. troglodytes
ttaaaaagtaaaactt

SEQ ID NO: 280388 - DNA, 16 bp, P. troglodytes
ttaaaaagtcaaattc

SEQ ID NO: 280389 - DNA, 16 bp, P. troglodytes
ttaaaaagtcaacatt

SEQ ID NO: 280390 - DNA, 16 bp, P. troglodytes
ttaaaaagtcttattt

SEQ ID NO: 280391 - DNA, 16 bp, P. troglodytes
ttaaaaagttaaacac

SEQ ID NO: 280392 - DNA, 16 bp, P. troglodytes
ttaaaaagttaggaaa

SEQ ID NO: 280393 - DNA, 16 bp, P. troglodytes
ttaaaaagttggaaaa

SEQ ID NO: 280394 - DNA, 16 bp, P. troglodytes
ttaaaaagtttacaaa

SEQ ID NO: 280395 - DNA, 16 bp, P. troglodytes
ttaaaaagtttttttc

SEQ ID NO: 280396 - DNA, 16 bp, P. troglodytes
ttaaaaataaggtatt

SEQ ID NO: 280397 - DNA, 16 bp, P. troglodytes
ttaaaaataatgcaaa

SEQ ID NO: 280398 - DNA, 16 bp, P. troglodytes
ttaaaaataattcact

SEQ ID NO: 280399 - DNA, 16 bp, P. troglodytes
ttaaaaataattccat

SEQ ID NO: 280400 - DNA, 16 bp, P. troglodytes
ttaaaaataattctct

SEQ ID NO: 280401 - DNA, 16 bp, P. troglodytes
ttaaaaataattcttg

SEQ ID NO: 280402 - DNA, 16 bp, P. troglodytes
ttaaaaataattttgg

SEQ ID NO: 280403 - DNA, 16 bp, P. troglodytes
ttaaaaatacaaatgt

SEQ ID NO: 280404 - DNA, 16 bp, P. troglodytes
ttaaaaatacaatttc

SEQ ID NO: 280405 - DNA, 16 bp, P. troglodytes
ttaaaaatacagaaat

SEQ ID NO: 280406 - DNA, 16 bp, P. troglodytes
ttaaaaatacagattc

SEQ ID NO: 280407 - DNA, 16 bp, P. troglodytes
ttaaaaatacatatct

SEQ ID NO: 280408 - DNA, 16 bp, P. troglodytes
ttaaaaatacattgtt

SEQ ID NO: 280409 - DNA, 16 bp, P. troglodytes
ttaaaaatactttgta

SEQ ID NO: 280410 - DNA, 16 bp, P. troglodytes
ttaaaaatagatttct

SEQ ID NO: 280411 - DNA, 16 bp, P. troglodytes
ttaaaaatatacctat

SEQ ID NO: 280412 - DNA, 16 bp, P. troglodytes
ttaaaaatattgcttt

SEQ ID NO: 280413 - DNA, 16 bp, P. troglodytes
ttaaaaatatttactg

SEQ ID NO: 280414 - DNA, 16 bp, P. troglodytes
ttaaaaatattttctg

SEQ ID NO: 280415 - DNA, 16 bp, P. troglodytes
ttaaaaatcaaaatgt

SEQ ID NO: 280416 - DNA, 16 bp, P. troglodytes
ttaaaaatcaaaggaa

SEQ ID NO: 280417 - DNA, 16 bp, P. troglodytes
ttaaaaatcaagaaat

SEQ ID NO: 280418 - DNA, 16 bp, P. troglodytes
ttaaaaatcaatagaa

SEQ ID NO: 280419 - DNA, 16 bp, P. troglodytes
ttaaaaatcaatgtaa

SEQ ID NO: 280420 - DNA, 16 bp, P. troglodytes
ttaaaaatcacatttt

SEQ ID NO: 280421 - DNA, 16 bp, P. troglodytes
ttaaaaatcagctttt

SEQ ID NO: 280422 - DNA, 16 bp, P. troglodytes
ttaaaaatccttattt

SEQ ID NO: 280423 - DNA, 16 bp, P. troglodytes
ttaaaaatctagaaaa

SEQ ID NO: 280424 - DNA, 16 bp, P. troglodytes
ttaaaaatctgtaaat

SEQ ID NO: 280425 - DNA, 16 bp, P. troglodytes
ttaaaaatctttgtct

SEQ ID NO: 280426 - DNA, 16 bp, P. troglodytes
ttaaaaatcttttcct

SEQ ID NO: 280427 - DNA, 16 bp, P. troglodytes
ttaaaaatcttttgaa

SEQ ID NO: 280428 - DNA, 16 bp, P. troglodytes
ttaaaaatctttttgt

SEQ ID NO: 280429 - DNA, 16 bp, P. troglodytes
ttaaaaatgaaaacta

SEQ ID NO: 280430 - DNA, 16 bp, P. troglodytes
ttaaaaatgaaagcaa

SEQ ID NO: 280431 - DNA, 16 bp, P. troglodytes
ttaaaaatgaaagcat

SEQ ID NO: 280432 - DNA, 16 bp, P. troglodytes
ttaaaaatgaaattgt

SEQ ID NO: 280433 - DNA, 16 bp, P. troglodytes
ttaaaaatgaacattt

SEQ ID NO: 280434 - DNA, 16 bp, P. troglodytes
ttaaaaatgaagattt

SEQ ID NO: 280435 - DNA, 16 bp, P. troglodytes
ttaaaaatgaaggaga

SEQ ID NO: 280436 - DNA, 16 bp, P. troglodytes
ttaaaaatgacacaaa

SEQ ID NO: 280437 - DNA, 16 bp, P. troglodytes
ttaaaaatgaggaaac

SEQ ID NO: 280438 - DNA, 16 bp, P. troglodytes
ttaaaaatgcagattt

SEQ ID NO: 280439 - DNA, 16 bp, P. troglodytes
ttaaaaatgcattaaa

SEQ ID NO: 280440 - DNA, 16 bp, P. troglodytes
ttaaaaatgcattctt

SEQ ID NO: 280441 - DNA, 16 bp, P. troglodytes
ttaaaaatgcatttaa

SEQ ID NO: 280442 - DNA, 16 bp, P. troglodytes
ttaaaaatgctttatt

SEQ ID NO: 280443 - DNA, 16 bp, P. troglodytes
ttaaaaatggttagga

SEQ ID NO: 280444 - DNA, 16 bp, P. troglodytes
ttaaaaatggttttct

SEQ ID NO: 280445 - DNA, 16 bp, P. troglodytes
ttaaaaatgtaaatgt

SEQ ID NO: 280446 - DNA, 16 bp, P. troglodytes
ttaaaaatgtattgag

SEQ ID NO: 280447 - DNA, 16 bp, P. troglodytes
ttaaaaatgtctttag

SEQ ID NO: 280448 - DNA, 16 bp, P. troglodytes
ttaaaaatgtcttttt

SEQ ID NO: 280449 - DNA, 16 bp, P. troglodytes
ttaaaaatgtgaaaca

SEQ ID NO: 280450 - DNA, 16 bp, P. troglodytes
ttaaaaatgtgcattt

SEQ ID NO: 280451 - DNA, 16 bp, P. troglodytes
ttaaaaatgttaaaac

SEQ ID NO: 280452 - DNA, 16 bp, P. troglodytes
ttaaaaatgttctttc

SEQ ID NO: 280453 - DNA, 16 bp, P. troglodytes
ttaaaaatgtttaaga

SEQ ID NO: 280454 - DNA, 16 bp, P. troglodytes
ttaaaaatgtttcatt

SEQ ID NO: 280455 - DNA, 16 bp, P. troglodytes
ttaaaaatgtttctaa

SEQ ID NO: 280456 - DNA, 16 bp, P. troglodytes
ttaaaaatgtttgaag

SEQ ID NO: 280457 - DNA, 16 bp, P. troglodytes
ttaaaaatgtttttct

SEQ ID NO: 280458 - DNA, 16 bp, P. troglodytes
ttaaaaattagccaaa

SEQ ID NO: 280459 - DNA, 16 bp, P. troglodytes
ttaaaaattcagtaaa

SEQ ID NO: 280460 - DNA, 16 bp, P. troglodytes
ttaaaaattcagtttc

SEQ ID NO: 280461 - DNA, 16 bp, P. troglodytes
ttaaaaattccttaaa

SEQ ID NO: 280462 - DNA, 16 bp, P. troglodytes
ttaaaaattggctttg

SEQ ID NO: 280463 - DNA, 16 bp, P. troglodytes
ttaaaaattgttatgt

SEQ ID NO: 280464 - DNA, 16 bp, P. troglodytes
ttaaaaatttcaactt

SEQ ID NO: 280465 - DNA, 16 bp, P. troglodytes
ttaaaaattttctgta

SEQ ID NO: 280466 - DNA, 16 bp, P. troglodytes
ttaaaaattttgtgca

SEQ ID NO: 280467 - DNA, 16 bp, P. troglodytes
ttaaaacaaaaattag

SEQ ID NO: 280468 - DNA, 16 bp, P. troglodytes
ttaaaacaaatgagaa

SEQ ID NO: 280469 - DNA, 16 bp, P. troglodytes
ttaaaacaacagagat

SEQ ID NO: 280470 - DNA, 16 bp, P. troglodytes
ttaaaacaatgtaaat

SEQ ID NO: 280471 - DNA, 16 bp, P. troglodytes
ttaaaacaatgttgaa

SEQ ID NO: 280472 - DNA, 16 bp, P. troglodytes
ttaaaacaatttttag

SEQ ID NO: 280473 - DNA, 16 bp, P. troglodytes
ttaaaacacatttttt

SEQ ID NO: 280474 - DNA, 16 bp, P. troglodytes
ttaaaacagcatgttg

SEQ ID NO: 280475 - DNA, 16 bp, P. troglodytes
ttaaaacagctgtttt

SEQ ID NO: 280476 - DNA, 16 bp, P. troglodytes
ttaaaacagtttttaa

SEQ ID NO: 280477 - DNA, 16 bp, P. troglodytes
ttaaaacataattttc

SEQ ID NO: 280478 - DNA, 16 bp, P. troglodytes
ttaaaacattttactt

SEQ ID NO: 280479 - DNA, 16 bp, P. troglodytes
ttaaaacatttttcat

SEQ ID NO: 280480 - DNA, 16 bp, P. troglodytes
ttaaaaccaaaatgag

SEQ ID NO: 280481 - DNA, 16 bp, P. troglodytes
ttaaaacctaaatgac

SEQ ID NO: 280482 - DNA, 16 bp, P. troglodytes
ttaaaactgaagaaaa

SEQ ID NO: 280483 - DNA, 16 bp, P. troglodytes
ttaaaactgctatttt

SEQ ID NO: 280484 - DNA, 16 bp, P. troglodytes
ttaaaactgtttaaaa

SEQ ID NO: 280485 - DNA, 16 bp, P. troglodytes
ttaaaactgtttttaa

SEQ ID NO: 280486 - DNA, 16 bp, P. troglodytes
ttaaaacttccatttt

SEQ ID NO: 280487 - DNA, 16 bp, P. troglodytes
ttaaaacttgttttgt

SEQ ID NO: 280488 - DNA, 16 bp, P. troglodytes
ttaaaacttttcttct

SEQ ID NO: 280489 - DNA, 16 bp, P. troglodytes
ttaaaactttttgtta

SEQ ID NO: 280490 - DNA, 16 bp, P. troglodytes
ttaaaagaaaaactct

SEQ ID NO: 280491 - DNA, 16 bp, P. troglodytes
ttaaaagaaaacttaa

SEQ ID NO: 280492 - DNA, 16 bp, P. troglodytes
ttaaaagaaaatgttc

SEQ ID NO: 280493 - DNA, 16 bp, P. troglodytes
ttaaaagaaactttaa

SEQ ID NO: 280494 - DNA, 16 bp, P. troglodytes
ttaaaagaaccagaaa

SEQ ID NO: 280495 - DNA, 16 bp, P. troglodytes
ttaaaagaatcaaaat

SEQ ID NO: 280496 - DNA, 16 bp, P. troglodytes
ttaaaagacagatttt

SEQ ID NO: 280497 - DNA, 16 bp, P. troglodytes
ttaaaagacattttct

SEQ ID NO: 280498 - DNA, 16 bp, P. troglodytes
ttaaaagactgctttt

SEQ ID NO: 280499 - DNA, 16 bp, P. troglodytes
ttaaaagagctagaaa

SEQ ID NO: 280500 - DNA, 16 bp, P. troglodytes
ttaaaagatacaaata

SEQ ID NO: 280501 - DNA, 16 bp, P. troglodytes
ttaaaagcaacagaaa

SEQ ID NO: 280502 - DNA, 16 bp, P. troglodytes
ttaaaagcagaaaaca

SEQ ID NO: 280503 - DNA, 16 bp, P. troglodytes
ttaaaagcagaagaaa

SEQ ID NO: 280504 - DNA, 16 bp, P. troglodytes
ttaaaagcttctgctc

SEQ ID NO: 280505 - DNA, 16 bp, P. troglodytes
ttaaaagcttttaaaa

SEQ ID NO: 280506 - DNA, 16 bp, P. troglodytes
ttaaaaggaaagcaga

SEQ ID NO: 280507 - DNA, 16 bp, P. troglodytes
ttaaaaggaagaaatt

SEQ ID NO: 280508 - DNA, 16 bp, P. troglodytes
ttaaaagggaaattaa

SEQ ID NO: 280509 - DNA, 16 bp, P. troglodytes
ttaaaaggtattttta

SEQ ID NO: 280510 - DNA, 16 bp, P. troglodytes
ttaaaagtagattttt

SEQ ID NO: 280511 - DNA, 16 bp, P. troglodytes
ttaaaagtatgttgtt

SEQ ID NO: 280512 - DNA, 16 bp, P. troglodytes
ttaaaagtgtgtagta

SEQ ID NO: 280513 - DNA, 16 bp, P. troglodytes
ttaaaagtgtttttaa

SEQ ID NO: 280514 - DNA, 16 bp, P. troglodytes
ttaaaagttcaaaaaa

SEQ ID NO: 280515 - DNA, 16 bp, P. troglodytes
ttaaaagttcatttta

SEQ ID NO: 280516 - DNA, 16 bp, P. troglodytes
ttaaaataaaaaactg

SEQ ID NO: 280517 - DNA, 16 bp, P. troglodytes
ttaaaataaaagcttt

SEQ ID NO: 280518 - DNA, 16 bp, P. troglodytes
ttaaaataaacatctt

SEQ ID NO: 280519 - DNA, 16 bp, P. troglodytes
ttaaaataacatttct

SEQ ID NO: 280520 - DNA, 16 bp, P. troglodytes
ttaaaataatatcaag

SEQ ID NO: 280521 - DNA, 16 bp, P. troglodytes
ttaaaatacacacaca

SEQ ID NO: 280522 - DNA, 16 bp, P. troglodytes
ttaaaatacagaatta

SEQ ID NO: 280523 - DNA, 16 bp, P. troglodytes
ttaaaatacagattgc

SEQ ID NO: 280524 - DNA, 16 bp, P. troglodytes
ttaaaatacagtttta

SEQ ID NO: 280525 - DNA, 16 bp, P. troglodytes
ttaaaatacatgtaaa

SEQ ID NO: 280526 - DNA, 16 bp, P. troglodytes
ttaaaatactgaaaaa

SEQ ID NO: 280527 - DNA, 16 bp, P. troglodytes
ttaaaatacttgtttt

SEQ ID NO: 280528 - DNA, 16 bp, P. troglodytes
ttaaaatagccacaaa

SEQ ID NO: 280529 - DNA, 16 bp, P. troglodytes
ttaaaatagcttaaaa

SEQ ID NO: 280530 - DNA, 16 bp, P. troglodytes
ttaaaatagcttatat

SEQ ID NO: 280531 - DNA, 16 bp, P. troglodytes
ttaaaatagctttatt

SEQ ID NO: 280532 - DNA, 16 bp, P. troglodytes
ttaaaatatagaaaac

SEQ ID NO: 280533 - DNA, 16 bp, P. troglodytes
ttaaaatatattcagt

SEQ ID NO: 280534 - DNA, 16 bp, P. troglodytes
ttaaaatatctcttta

SEQ ID NO: 280535 - DNA, 16 bp, P. troglodytes
ttaaaatattaatgca

SEQ ID NO: 280536 - DNA, 16 bp, P. troglodytes
ttaaaatattcagaaa

SEQ ID NO: 280537 - DNA, 16 bp, P. troglodytes
ttaaaatattcagtaa

SEQ ID NO: 280538 - DNA, 16 bp, P. troglodytes
ttaaaatattctactt

SEQ ID NO: 280539 - DNA, 16 bp, P. troglodytes
ttaaaatattctgaaa

SEQ ID NO: 280540 - DNA, 16 bp, P. troglodytes
ttaaaatatttcccat

SEQ ID NO: 280541 - DNA, 16 bp, P. troglodytes
ttaaaatcaaaagcaa

SEQ ID NO: 280542 - DNA, 16 bp, P. troglodytes
ttaaaatcacattttt

SEQ ID NO: 280543 - DNA, 16 bp, P. troglodytes
ttaaaatcagaaaaca

SEQ ID NO: 280544 - DNA, 16 bp, P. troglodytes
ttaaaatcatggtgga

SEQ ID NO: 280545 - DNA, 16 bp, P. troglodytes
ttaaaatccattggtc

SEQ ID NO: 280546 - DNA, 16 bp, P. troglodytes
ttaaaatctattctct

SEQ ID NO: 280547 - DNA, 16 bp, P. troglodytes
ttaaaatctgatttta

SEQ ID NO: 280548 - DNA, 16 bp, P. troglodytes
ttaaaatgaaaaatca

SEQ ID NO: 280549 - DNA, 16 bp, P. troglodytes
ttaaaatgaaatgcaa

SEQ ID NO: 280550 - DNA, 16 bp, P. troglodytes
ttaaaatgacagtaaa

SEQ ID NO: 280551 - DNA, 16 bp, P. troglodytes
ttaaaatgacatttta

SEQ ID NO: 280552 - DNA, 16 bp, P. troglodytes
ttaaaatgacttttat

SEQ ID NO: 280553 - DNA, 16 bp, P. troglodytes
ttaaaatgcacattcc

SEQ ID NO: 280554 - DNA, 16 bp, P. troglodytes
ttaaaatgcagaaatt

SEQ ID NO: 280555 - DNA, 16 bp, P. troglodytes
ttaaaatgcatttcaa

SEQ ID NO: 280556 - DNA, 16 bp, P. troglodytes
ttaaaatgctgattct

SEQ ID NO: 280557 - DNA, 16 bp, P. troglodytes
ttaaaatgcttttaaa

SEQ ID NO: 280558 - DNA, 16 bp, P. troglodytes
ttaaaatggcaaattt

SEQ ID NO: 280559 - DNA, 16 bp, P. troglodytes
ttaaaatgggaagaaa

SEQ ID NO: 280560 - DNA, 16 bp, P. troglodytes
ttaaaatggtaaattt

SEQ ID NO: 280561 - DNA, 16 bp, P. troglodytes
ttaaaatggtaagttt

SEQ ID NO: 280562 - DNA, 16 bp, P. troglodytes
ttaaaatgtaattcat

SEQ ID NO: 280563 - DNA, 16 bp, P. troglodytes
ttaaaatgtacaataa

SEQ ID NO: 280564 - DNA, 16 bp, P. troglodytes
ttaaaatgtacacttt

SEQ ID NO: 280565 - DNA, 16 bp, P. troglodytes
ttaaaatgtattatgt

SEQ ID NO: 280566 - DNA, 16 bp, P. troglodytes
ttaaaatgtatttaca

SEQ ID NO: 280567 - DNA, 16 bp, P. troglodytes
ttaaaatgtatttctt

SEQ ID NO: 280568 - DNA, 16 bp, P. troglodytes
ttaaaatgtcaggaaa

SEQ ID NO: 280569 - DNA, 16 bp, P. troglodytes
ttaaaatgtcattatt

SEQ ID NO: 280570 - DNA, 16 bp, P. troglodytes
ttaaaatgtgaaagaa

SEQ ID NO: 280571 - DNA, 16 bp, P. troglodytes
ttaaaatgtgaagaaa

SEQ ID NO: 280572 - DNA, 16 bp, P. troglodytes
ttaaaatgtgcttttt

SEQ ID NO: 280573 - DNA, 16 bp, P. troglodytes
ttaaaatgtgtaaaat

SEQ ID NO: 280574 - DNA, 16 bp, P. troglodytes
ttaaaatgttcataaa

SEQ ID NO: 280575 - DNA, 16 bp, P. troglodytes
ttaaaatgttgaattt

SEQ ID NO: 280576 - DNA, 16 bp, P. troglodytes
ttaaaatgttgtaaaa

SEQ ID NO: 280577 - DNA, 16 bp, P. troglodytes
ttaaaatgtttaaatg

SEQ ID NO: 280578 - DNA, 16 bp, P. troglodytes
ttaaaatgtttaagtg

SEQ ID NO: 280579 - DNA, 16 bp, P. troglodytes
ttaaaatgtttatgta

SEQ ID NO: 280580 - DNA, 16 bp, P. troglodytes
ttaaaatgtttcattt

SEQ ID NO: 280581 - DNA, 16 bp, P. troglodytes
ttaaaatgttttatga

SEQ ID NO: 280582 - DNA, 16 bp, P. troglodytes
ttaaaattaaaaccac

SEQ ID NO: 280583 - DNA, 16 bp, P. troglodytes
ttaaaattacattttc

SEQ ID NO: 280584 - DNA, 16 bp, P. troglodytes
ttaaaattcttctttg

SEQ ID NO: 280585 - DNA, 16 bp, P. troglodytes
ttaaaattctttctct

SEQ ID NO: 280586 - DNA, 16 bp, P. troglodytes
ttaaaattgctaaaat

SEQ ID NO: 280587 - DNA, 16 bp, P. troglodytes
ttaaaattgctttctt

SEQ ID NO: 280588 - DNA, 16 bp, P. troglodytes
ttaaaattgtattctt

SEQ ID NO: 280589 - DNA, 16 bp, P. troglodytes
ttaaaatttcaaaatg

SEQ ID NO: 280590 - DNA, 16 bp, P. troglodytes
ttaaaatttctgttct

SEQ ID NO: 280591 - DNA, 16 bp, P. troglodytes
ttaaaatttctttgtt

SEQ ID NO: 280592 - DNA, 16 bp, P. troglodytes
ttaaaatttgatgaaa

SEQ ID NO: 280593 - DNA, 16 bp, P. troglodytes
ttaaaatttggtgttc

SEQ ID NO: 280594 - DNA, 16 bp, P. troglodytes
ttaaaatttgttgaaa

SEQ ID NO: 280595 - DNA, 16 bp, P. troglodytes
ttaaaattttctgtga

SEQ ID NO: 280596 - DNA, 16 bp, P. troglodytes
ttaaaattttcttctg

SEQ ID NO: 280597 - DNA, 16 bp, P. troglodytes
ttaaacaaactgtgat

SEQ ID NO: 280598 - DNA, 16 bp, P. troglodytes
ttaaacaaatttacga

SEQ ID NO: 280599 - DNA, 16 bp, P. troglodytes
ttaaacaaccagctgt

SEQ ID NO: 280600 - DNA, 16 bp, P. troglodytes
ttaaacaactttacaa

SEQ ID NO: 280601 - DNA, 16 bp, P. troglodytes
ttaaacaatcagatct

SEQ ID NO: 280602 - DNA, 16 bp, P. troglodytes
ttaaacacatacacac

SEQ ID NO: 280603 - DNA, 16 bp, P. troglodytes
ttaaacacatttattt

SEQ ID NO: 280604 - DNA, 16 bp, P. troglodytes
ttaaacagaaacacat

SEQ ID NO: 280605 - DNA, 16 bp, P. troglodytes
ttaaacagatatttgt

SEQ ID NO: 280606 - DNA, 16 bp, P. troglodytes
ttaaacataaatttac

SEQ ID NO: 280607 - DNA, 16 bp, P. troglodytes
ttaaacataagaaaat

SEQ ID NO: 280608 - DNA, 16 bp, P. troglodytes
ttaaacatatttgtaa

SEQ ID NO: 280609 - DNA, 16 bp, P. troglodytes
ttaaacatgattaaaa

SEQ ID NO: 280610 - DNA, 16 bp, P. troglodytes
ttaaacattatttctg

SEQ ID NO: 280611 - DNA, 16 bp, P. troglodytes
ttaaacatttaaatgt

SEQ ID NO: 280612 - DNA, 16 bp, P. troglodytes
ttaaacatttatttca

SEQ ID NO: 280613 - DNA, 16 bp, P. troglodytes
ttaaacatttctaaaa

SEQ ID NO: 280614 - DNA, 16 bp, P. troglodytes
ttaaacatttctcttt

SEQ ID NO: 280615 - DNA, 16 bp, P. troglodytes
ttaaacatttctttct

SEQ ID NO: 280616 - DNA, 16 bp, P. troglodytes
ttaaacattttcaaaa

SEQ ID NO: 280617 - DNA, 16 bp, P. troglodytes
ttaaaccaccaaagat

SEQ ID NO: 280618 - DNA, 16 bp, P. troglodytes
ttaaaccccttttctt

SEQ ID NO: 280619 - DNA, 16 bp, P. troglodytes
ttaaacctctttattt

SEQ ID NO: 280620 - DNA, 16 bp, P. troglodytes
ttaaactagattctga

SEQ ID NO: 280621 - DNA, 16 bp, P. troglodytes
ttaaactgttttcttt

SEQ ID NO: 280622 - DNA, 16 bp, P. troglodytes
ttaaacttacagaaaa

SEQ ID NO: 280623 - DNA, 16 bp, P. troglodytes
ttaaacttttagaaaa

SEQ ID NO: 280624 - DNA, 16 bp, P. troglodytes
ttaaacttttccaaaa

SEQ ID NO: 280625 - DNA, 16 bp, P. troglodytes
ttaaagaaaaagtttg

SEQ ID NO: 280626 - DNA, 16 bp, P. troglodytes
ttaaagaaaaatatct

SEQ ID NO: 280627 - DNA, 16 bp, P. troglodytes
ttaaagaaaactgaaa

SEQ ID NO: 280628 - DNA, 16 bp, P. troglodytes
ttaaagaaaagcaaat

SEQ ID NO: 280629 - DNA, 16 bp, P. troglodytes
ttaaagaaaagttgca

SEQ ID NO: 280630 - DNA, 16 bp, P. troglodytes
ttaaagaaaatctttt

SEQ ID NO: 280631 - DNA, 16 bp, P. troglodytes
ttaaagaaatgcaaat

SEQ ID NO: 280632 - DNA, 16 bp, P. troglodytes
ttaaagaactaaaaat

SEQ ID NO: 280633 - DNA, 16 bp, P. troglodytes
ttaaagaagaaataac

SEQ ID NO: 280634 - DNA, 16 bp, P. troglodytes
ttaaagaagaaatttt

SEQ ID NO: 280635 - DNA, 16 bp, P. troglodytes
ttaaagaagacacaga

SEQ ID NO: 280636 - DNA, 16 bp, P. troglodytes
ttaaagaagtattttt

SEQ ID NO: 280637 - DNA, 16 bp, P. troglodytes
ttaaagacagggtttc

SEQ ID NO: 280638 - DNA, 16 bp, P. troglodytes
ttaaagagatttgcaa

SEQ ID NO: 280639 - DNA, 16 bp, P. troglodytes
ttaaagagcaggttag

SEQ ID NO: 280640 - DNA, 16 bp, P. troglodytes
ttaaagagttaaatat

SEQ ID NO: 280641 - DNA, 16 bp, P. troglodytes
ttaaagagtttttggg

SEQ ID NO: 280642 - DNA, 16 bp, P. troglodytes
ttaaagataattttga

SEQ ID NO: 280643 - DNA, 16 bp, P. troglodytes
ttaaagatataaatgt

SEQ ID NO: 280644 - DNA, 16 bp, P. troglodytes
ttaaagatatttttct

SEQ ID NO: 280645 - DNA, 16 bp, P. troglodytes
ttaaagatgaaaaaca

SEQ ID NO: 280646 - DNA, 16 bp, P. troglodytes
ttaaagatgagatttg

SEQ ID NO: 280647 - DNA, 16 bp, P. troglodytes
ttaaagatgaggaaat

SEQ ID NO: 280648 - DNA, 16 bp, P. troglodytes
ttaaagatggaggaag

SEQ ID NO: 280649 - DNA, 16 bp, P. troglodytes
ttaaagatgttgctcc

SEQ ID NO: 280650 - DNA, 16 bp, P. troglodytes
ttaaagatttaaatga

SEQ ID NO: 280651 - DNA, 16 bp, P. troglodytes
ttaaagattttttttc

SEQ ID NO: 280652 - DNA, 16 bp, P. troglodytes
ttaaagcaaaaataat

SEQ ID NO: 280653 - DNA, 16 bp, P. troglodytes
ttaaagcaacacaaat

SEQ ID NO: 280654 - DNA, 16 bp, P. troglodytes
ttaaagcaattaaaaa

SEQ ID NO: 280655 - DNA, 16 bp, P. troglodytes
ttaaagcagtggcagc

SEQ ID NO: 280656 - DNA, 16 bp, P. troglodytes
ttaaagcagtgtgtag

SEQ ID NO: 280657 - DNA, 16 bp, P. troglodytes
ttaaagcatattttat

SEQ ID NO: 280658 - DNA, 16 bp, P. troglodytes
ttaaagcattttttaa

SEQ ID NO: 280659 - DNA, 16 bp, P. troglodytes
ttaaagcatttttttc

SEQ ID NO: 280660 - DNA, 16 bp, P. troglodytes
ttaaagctccaaaatt

SEQ ID NO: 280661 - DNA, 16 bp, P. troglodytes
ttaaagctttttaaaa

SEQ ID NO: 280662 - DNA, 16 bp, P. troglodytes
ttaaaggaaaagcttt

SEQ ID NO: 280663 - DNA, 16 bp, P. troglodytes
ttaaaggaaaatattt

SEQ ID NO: 280664 - DNA, 16 bp, P. troglodytes
ttaaaggaaatgaaag

SEQ ID NO: 280665 - DNA, 16 bp, P. troglodytes
ttaaaggaaattaaag

SEQ ID NO: 280666 - DNA, 16 bp, P. troglodytes
ttaaaggaattttaaa

SEQ ID NO: 280667 - DNA, 16 bp, P. troglodytes
ttaaaggagtgagcca

SEQ ID NO: 280668 - DNA, 16 bp, P. troglodytes
ttaaagggaaatttat

SEQ ID NO: 280669 - DNA, 16 bp, P. troglodytes
ttaaaggtggcatgga

SEQ ID NO: 280670 - DNA, 16 bp, P. troglodytes
ttaaagtacttttttc

SEQ ID NO: 280671 - DNA, 16 bp, P. troglodytes
ttaaagtacttttttt

SEQ ID NO: 280672 - DNA, 16 bp, P. troglodytes
ttaaagtagatttttc

SEQ ID NO: 280673 - DNA, 16 bp, P. troglodytes
ttaaagtatacaataa

SEQ ID NO: 280674 - DNA, 16 bp, P. troglodytes
ttaaagtatacaggag

SEQ ID NO: 280675 - DNA, 16 bp, P. troglodytes
ttaaagtatgttttgt

SEQ ID NO: 280676 - DNA, 16 bp, P. troglodytes
ttaaagtcatccatga

SEQ ID NO: 280677 - DNA, 16 bp, P. troglodytes
ttaaagtctattttct

SEQ ID NO: 280678 - DNA, 16 bp, P. troglodytes
ttaaagtctcagtttc

SEQ ID NO: 280679 - DNA, 19 bp, P. troglodytes
ttaaagtctcccactatta

SEQ ID NO: 280680 - DNA, 16 bp, P. troglodytes
ttaaagtctgtttatc

SEQ ID NO: 280681 - DNA, 22 bp, P. troglodytes
ttaaagtctgttttatcagaga

SEQ ID NO: 280682 - DNA, 16 bp, P. troglodytes
ttaaagtctgttttta

SEQ ID NO: 280683 - DNA, 16 bp, P. troglodytes
ttaaagtgtaataata

SEQ ID NO: 280684 - DNA, 16 bp, P. troglodytes
ttaaagtgtagaattt

SEQ ID NO: 280685 - DNA, 16 bp, P. troglodytes
ttaaagttacattttt

SEQ ID NO: 280686 - DNA, 16 bp, P. troglodytes
ttaaagtttatttttc

SEQ ID NO: 280687 - DNA, 16 bp, P. troglodytes
ttaaataaaaatctga

SEQ ID NO: 280688 - DNA, 16 bp, P. troglodytes
ttaaataaaagcaaat

SEQ ID NO: 280689 - DNA, 16 bp, P. troglodytes
ttaaataaaccttttt

SEQ ID NO: 280690 - DNA, 16 bp, P. troglodytes
ttaaataaatgcaaat

SEQ ID NO: 280691 - DNA, 16 bp, P. troglodytes
ttaaataaattatgca

SEQ ID NO: 280692 - DNA, 16 bp, P. troglodytes
ttaaataaattgaatc

SEQ ID NO: 280693 - DNA, 16 bp, P. troglodytes
ttaaataactgaaatt

SEQ ID NO: 280694 - DNA, 16 bp, P. troglodytes
ttaaatacagaaaata

SEQ ID NO: 280695 - DNA, 16 bp, P. troglodytes
ttaaatacctagaaat

SEQ ID NO: 280696 - DNA, 26 bp, P. troglodytes
ttaaatagggaatcctttccccattt

SEQ ID NO: 280697 - DNA, 16 bp, P. troglodytes
ttaaatagtttttttc

SEQ ID NO: 280698 - DNA, 16 bp, P. troglodytes
ttaaatataaaatggt

SEQ ID NO: 280699 - DNA, 16 bp, P. troglodytes
ttaaatataatttcca

SEQ ID NO: 280700 - DNA, 16 bp, P. troglodytes
ttaaatatatacaact

SEQ ID NO: 280701 - DNA, 16 bp, P. troglodytes
ttaaatatatgctttt

SEQ ID NO: 280702 - DNA, 16 bp, P. troglodytes
ttaaatatattcctag

SEQ ID NO: 280703 - DNA, 16 bp, P. troglodytes
ttaaatatcttttcaa

SEQ ID NO: 280704 - DNA, 16 bp, P. troglodytes
ttaaatatgcatattt

SEQ ID NO: 280705 - DNA, 16 bp, P. troglodytes
ttaaatatgtgcagtt

SEQ ID NO: 280706 - DNA, 16 bp, P. troglodytes
ttaaatatgttttcca

SEQ ID NO: 280707 - DNA, 16 bp, P. troglodytes
ttaaatattcaggaat

SEQ ID NO: 280708 - DNA, 16 bp, P. troglodytes
ttaaatatttcagtat

SEQ ID NO: 280709 - DNA, 16 bp, P. troglodytes
ttaaatatttcagtgt

SEQ ID NO: 280710 - DNA, 16 bp, P. troglodytes
ttaaatattttggaaa

SEQ ID NO: 280711 - DNA, 16 bp, P. troglodytes
ttaaatcacttgccca

SEQ ID NO: 280712 - DNA, 16 bp, P. troglodytes
ttaaatcagaaatgaa

SEQ ID NO: 280713 - DNA, 16 bp, P. troglodytes
ttaaatcattaatttg

SEQ ID NO: 280714 - DNA, 16 bp, P. troglodytes
ttaaatcatttcagca

SEQ ID NO: 280715 - DNA, 16 bp, P. troglodytes
ttaaatccattgtttc

SEQ ID NO: 280716 - DNA, 16 bp, P. troglodytes
ttaaatgaaatgtttt

SEQ ID NO: 280717 - DNA, 16 bp, P. troglodytes
ttaaatgaacatttta

SEQ ID NO: 280718 - DNA, 16 bp, P. troglodytes
ttaaatgagataatgc

SEQ ID NO: 280719 - DNA, 16 bp, P. troglodytes
ttaaatgagattatat

SEQ ID NO: 280720 - DNA, 16 bp, P. troglodytes
ttaaatgatttgctca

SEQ ID NO: 280721 - DNA, 16 bp, P. troglodytes
ttaaatgcaaatataa

SEQ ID NO: 280722 - DNA, 16 bp, P. troglodytes
ttaaatgcaaattaaa

SEQ ID NO: 280723 - DNA, 16 bp, P. troglodytes
ttaaatgcaatagttt

SEQ ID NO: 280724 - DNA, 16 bp, P. troglodytes
ttaaatgcattttaat

SEQ ID NO: 280725 - DNA, 16 bp, P. troglodytes
ttaaatgcattttttt

SEQ ID NO: 280726 - DNA, 16 bp, P. troglodytes
ttaaatgccttgaggt

SEQ ID NO: 280727 - DNA, 16 bp, P. troglodytes
ttaaatgctccaatta

SEQ ID NO: 280728 - DNA, 16 bp, P. troglodytes
ttaaatgcttatatta

SEQ ID NO: 280729 - DNA, 16 bp, P. troglodytes
ttaaatggaaaaagca

SEQ ID NO: 280730 - DNA, 16 bp, P. troglodytes
ttaaatggaaaacaaa

SEQ ID NO: 280731 - DNA, 16 bp, P. troglodytes
ttaaatggatttttaa

SEQ ID NO: 280732 - DNA, 16 bp, P. troglodytes
ttaaatgggcaaaata

SEQ ID NO: 280733 - DNA, 16 bp, P. troglodytes
ttaaatggtaaatttt

SEQ ID NO: 280734 - DNA, 21 bp, P. troglodytes
ttaaatgtaaatgggctaaat

SEQ ID NO: 280735 - DNA, 16 bp, P. troglodytes
ttaaatgtatacatta

SEQ ID NO: 280736 - DNA, 16 bp, P. troglodytes
ttaaatgtatcccaga

SEQ ID NO: 280737 - DNA, 16 bp, P. troglodytes
ttaaatgtccagtttt

SEQ ID NO: 280738 - DNA, 16 bp, P. troglodytes
ttaaatgtcttaaatt

SEQ ID NO: 280739 - DNA, 16 bp, P. troglodytes
ttaaatgtgaaaccca

SEQ ID NO: 280740 - DNA, 16 bp, P. troglodytes
ttaaatgtgaatttca

SEQ ID NO: 280741 - DNA, 16 bp, P. troglodytes
ttaaatgtgataatgt

SEQ ID NO: 280742 - DNA, 16 bp, P. troglodytes
ttaaatgtgtatataa

SEQ ID NO: 280743 - DNA, 16 bp, P. troglodytes
ttaaatgtgtcctaga

SEQ ID NO: 280744 - DNA, 16 bp, P. troglodytes
ttaaatgttaaaaatg

SEQ ID NO: 280745 - DNA, 16 bp, P. troglodytes
ttaaatgttgctttaa

SEQ ID NO: 280746 - DNA, 16 bp, P. troglodytes
ttaaatgtttctttct

SEQ ID NO: 280747 - DNA, 16 bp, P. troglodytes
ttaaatgtttggaaga

SEQ ID NO: 280748 - DNA, 16 bp, P. troglodytes
ttaaattacaaaagta

SEQ ID NO: 280749 - DNA, 16 bp, P. troglodytes
ttaaattacaaattca

SEQ ID NO: 280750 - DNA, 16 bp, P. troglodytes
ttaaattactatttca

SEQ ID NO: 280751 - DNA, 16 bp, P. troglodytes
ttaaattatactacaa

SEQ ID NO: 280752 - DNA, 16 bp, P. troglodytes
ttaaattatgcatttt

SEQ ID NO: 280753 - DNA, 16 bp, P. troglodytes
ttaaattcctttaaat

SEQ ID NO: 280754 - DNA, 16 bp, P. troglodytes
ttaaattctctctgtt

SEQ ID NO: 280755 - DNA, 16 bp, P. troglodytes
ttaaattctttaaaga

SEQ ID NO: 280756 - DNA, 16 bp, P. troglodytes
ttaaattgagacagag

SEQ ID NO: 280757 - DNA, 16 bp, P. troglodytes
ttaaattgtgtgctgt

SEQ ID NO: 280758 - DNA, 16 bp, P. troglodytes
ttaaatttattgaggt

SEQ ID NO: 280759 - DNA, 16 bp, P. troglodytes
ttaaatttcatcaaat

SEQ ID NO: 280760 - DNA, 16 bp, P. troglodytes
ttaaatttctttcaaa

SEQ ID NO: 280761 - DNA, 16 bp, P. troglodytes
ttaaatttgaattcca

SEQ ID NO: 280762 - DNA, 16 bp, P. troglodytes
ttaaatttgtatttca

SEQ ID NO: 280763 - DNA, 16 bp, P. troglodytes
ttaaatttgtgtgtgt

SEQ ID NO: 280764 - DNA, 16 bp, P. troglodytes
ttaaattttaatgaag

SEQ ID NO: 280765 - DNA, 16 bp, P. troglodytes
ttaaattttatttctg

SEQ ID NO: 280766 - DNA, 16 bp, P. troglodytes
ttaaattttctaatag

SEQ ID NO: 280767 - DNA, 16 bp, P. troglodytes
ttaaattttctttaag

SEQ ID NO: 280768 - DNA, 16 bp, P. troglodytes
ttaaattttttgagaa

SEQ ID NO: 280769 - DNA, 16 bp, P. troglodytes
ttaacaaaatccaaca

SEQ ID NO: 280770 - DNA, 16 bp, P. troglodytes
ttaacaaaattgaaat

SEQ ID NO: 280771 - DNA, 16 bp, P. troglodytes
ttaacaaagaaacatt

SEQ ID NO: 280772 - DNA, 16 bp, P. troglodytes
ttaacaaagagactgg

SEQ ID NO: 280773 - DNA, 16 bp, P. troglodytes
ttaacaaattttaaag

SEQ ID NO: 280774 - DNA, 16 bp, P. troglodytes
ttaacaaccagctctc

SEQ ID NO: 280775 - DNA, 16 bp, P. troglodytes
ttaacaagcaaaaaat

SEQ ID NO: 280776 - DNA, 16 bp, P. troglodytes
ttaacaagccctgcag

SEQ ID NO: 280777 - DNA, 16 bp, P. troglodytes
ttaacaagttcccagg

SEQ ID NO: 280778 - DNA, 16 bp, P. troglodytes
ttaacaataatctatt

SEQ ID NO: 280779 - DNA, 16 bp, P. troglodytes
ttaacaatactgtatt

SEQ ID NO: 280780 - DNA, 16 bp, P. troglodytes
ttaacaattctgaaat

SEQ ID NO: 280781 - DNA, 16 bp, P. troglodytes
ttaacaattttaaaag

SEQ ID NO: 280782 - DNA, 16 bp, P. troglodytes
ttaacacaaatttatt

SEQ ID NO: 280783 - DNA, 16 bp, P. troglodytes
ttaacacatccatcat

SEQ ID NO: 280784 - DNA, 16 bp, P. troglodytes
ttaacacattttgtat

SEQ ID NO: 280785 - DNA, 16 bp, P. troglodytes
ttaacacctgtaatcc

SEQ ID NO: 280786 - DNA, 16 bp, P. troglodytes
ttaacactacatggaa

SEQ ID NO: 280787 - DNA, 16 bp, P. troglodytes
ttaacagaaatagaaa

SEQ ID NO: 280788 - DNA, 16 bp, P. troglodytes
ttaacagaagaggaaa

SEQ ID NO: 280789 - DNA, 16 bp, P. troglodytes
ttaacagataaagaaa

SEQ ID NO: 280790 - DNA, 16 bp, P. troglodytes
ttaacagatgaatgga

SEQ ID NO: 280791 - DNA, 16 bp, P. troglodytes
ttaacagatgaggaag

SEQ ID NO: 280792 - DNA, 17 bp, P. troglodytes
ttaacagcaaaccagtc

SEQ ID NO: 280793 - DNA, 16 bp, P. troglodytes
ttaacagcagaattga

SEQ ID NO: 280794 - DNA, 16 bp, P. troglodytes
ttaacataatgccctc

SEQ ID NO: 280795 - DNA, 17 bp, P. troglodytes
ttaacatatgcaagtca

SEQ ID NO: 280796 - DNA, 16 bp, P. troglodytes
ttaacatcaacacaga

SEQ ID NO: 280797 - DNA, 16 bp, P. troglodytes
ttaacatcaacagtga

SEQ ID NO: 280798 - DNA, 16 bp, P. troglodytes
ttaacatcaggtatat

SEQ ID NO: 280799 - DNA, 16 bp, P. troglodytes
ttaacatctttattga

SEQ ID NO: 280800 - DNA, 16 bp, P. troglodytes
ttaacatgaaggaatg

SEQ ID NO: 280801 - DNA, 16 bp, P. troglodytes
ttaacatggtgaaacc

SEQ ID NO: 280802 - DNA, 16 bp, P. troglodytes
ttaacatgtttttatt

SEQ ID NO: 280803 - DNA, 16 bp, P. troglodytes
ttaacattagaaaata

SEQ ID NO: 280804 - DNA, 16 bp, P. troglodytes
ttaacattttaaatgt

SEQ ID NO: 280805 - DNA, 16 bp, P. troglodytes
ttaacattttcagaaa

SEQ ID NO: 280806 - DNA, 16 bp, P. troglodytes
ttaacattttgttaaa

SEQ ID NO: 280807 - DNA, 16 bp, P. troglodytes
ttaacatttttagaaa

SEQ ID NO: 280808 - DNA, 16 bp, P. troglodytes
ttaacatttttattga

SEQ ID NO: 280809 - DNA, 16 bp, P. troglodytes
ttaaccaacagaaatt

SEQ ID NO: 280810 - DNA, 17 bp, P. troglodytes
ttaaccaagtggtgact

SEQ ID NO: 280811 - DNA, 16 bp, P. troglodytes
ttaaccagtcatggtg

SEQ ID NO: 280812 - DNA, 16 bp, P. troglodytes
ttaaccatcacaagtt

SEQ ID NO: 280813 - DNA, 16 bp, P. troglodytes
ttaaccatcacactca

SEQ ID NO: 280814 - DNA, 16 bp, P. troglodytes
ttaaccattcacccac

SEQ ID NO: 280815 - DNA, 16 bp, P. troglodytes
ttaaccatttaaaaat

SEQ ID NO: 280816 - DNA, 16 bp, P. troglodytes
ttaaccatttaaaagt

SEQ ID NO: 280817 - DNA, 16 bp, P. troglodytes
ttaaccattttaaagt

SEQ ID NO: 280818 - DNA, 16 bp, P. troglodytes
ttaaccatttttaaat

SEQ ID NO: 280819 - DNA, 16 bp, P. troglodytes
ttaacccatttatgcc

SEQ ID NO: 280820 - DNA, 16 bp, P. troglodytes
ttaacccctctgagcc

SEQ ID NO: 280821 - DNA, 16 bp, P. troglodytes
ttaacctctctaagcc

SEQ ID NO: 280822 - DNA, 16 bp, P. troglodytes
ttaacctctttgagcc

SEQ ID NO: 280823 - DNA, 16 bp, P. troglodytes
ttaacctgggaggcag

SEQ ID NO: 280824 - DNA, 16 bp, P. troglodytes
ttaaccttaaatgcaa

SEQ ID NO: 280825 - DNA, 16 bp, P. troglodytes
ttaactcaaaatattt

SEQ ID NO: 280826 - DNA, 16 bp, P. troglodytes
ttaactcattccagca

SEQ ID NO: 280827 - DNA, 16 bp, P. troglodytes
ttaactcatttcagta

SEQ ID NO: 280828 - DNA, 17 bp, P. troglodytes
ttaactcattttagcat

SEQ ID NO: 280829 - DNA, 16 bp, P. troglodytes
ttaactgaaaatattt

SEQ ID NO: 280830 - DNA, 16 bp, P. troglodytes
ttaactgaaattttgt

SEQ ID NO: 280831 - DNA, 16 bp, P. troglodytes
ttaactgaagaaaaat

SEQ ID NO: 280832 - DNA, 16 bp, P. troglodytes
ttaactgggcatcctg

SEQ ID NO: 280833 - DNA, 16 bp, P. troglodytes
ttaactgtttatgtta

SEQ ID NO: 280834 - DNA, 16 bp, P. troglodytes
ttaacttattccagca

SEQ ID NO: 280835 - DNA, 16 bp, P. troglodytes
ttaacttgaaaaaaat

SEQ ID NO: 280836 - DNA, 16 bp, P. troglodytes
ttaactttgaaataaa

SEQ ID NO: 280837 - DNA, 16 bp, P. troglodytes
ttaactttgattttaa

SEQ ID NO: 280838 - DNA, 16 bp, P. troglodytes
ttaactttgtatcctg

SEQ ID NO: 280839 - DNA, 16 bp, P. troglodytes
ttaacttttaaaaagt

SEQ ID NO: 280840 - DNA, 16 bp, P. troglodytes
ttaacttttcccagtt

SEQ ID NO: 280841 - DNA, 16 bp, P. troglodytes
ttaagaaaaaaacttt

SEQ ID NO: 280842 - DNA, 16 bp, P. troglodytes
ttaagaaaactgaaat

SEQ ID NO: 280843 - DNA, 16 bp, P. troglodytes
ttaagaaaatgttttt

SEQ ID NO: 280844 - DNA, 16 bp, P. troglodytes
ttaagaaaccagaaaa

SEQ ID NO: 280845 - DNA, 16 bp, P. troglodytes
ttaagaaactggaaaa

SEQ ID NO: 280846 - DNA, 16 bp, P. troglodytes
ttaagaaacttgaaaa

SEQ ID NO: 280847 - DNA, 16 bp, P. troglodytes
ttaagaaagttttctt

SEQ ID NO: 280848 - DNA, 16 bp, P. troglodytes
ttaagaaatctccaaa

SEQ ID NO: 280849 - DNA, 16 bp, P. troglodytes
ttaagaaatgaaaaca

SEQ ID NO: 280850 - DNA, 16 bp, P. troglodytes
ttaagaaattgctaca

SEQ ID NO: 280851 - DNA, 16 bp, P. troglodytes
ttaagaacacttgtga

SEQ ID NO: 280852 - DNA, 16 bp, P. troglodytes
ttaagaacttgtttta

SEQ ID NO: 280853 - DNA, 16 bp, P. troglodytes
ttaagaagttagaaaa

SEQ ID NO: 280854 - DNA, 16 bp, P. troglodytes
ttaagaatttggggga

SEQ ID NO: 280855 - DNA, 16 bp, P. troglodytes
ttaagacagttatttt

SEQ ID NO: 280856 - DNA, 16 bp, P. troglodytes
ttaagacatttaaaaa

SEQ ID NO: 280857 - DNA, 16 bp, P. troglodytes
ttaagacctgaaacca

SEQ ID NO: 280858 - DNA, 16 bp, P. troglodytes
ttaagactttaaaaat

SEQ ID NO: 280859 - DNA, 16 bp, P. troglodytes
ttaagagaaaaaagca

SEQ ID NO: 280860 - DNA, 16 bp, P. troglodytes
ttaagagaaaagactg

SEQ ID NO: 280861 - DNA, 16 bp, P. troglodytes
ttaagagaagaaggct

SEQ ID NO: 280862 - DNA, 16 bp, P. troglodytes
ttaagagacagaatct

SEQ ID NO: 280863 - DNA, 16 bp, P. troglodytes
ttaagagacaggatct

SEQ ID NO: 280864 - DNA, 16 bp, P. troglodytes
ttaagagaccaggtct

SEQ ID NO: 280865 - DNA, 16 bp, P. troglodytes
ttaagagcagcctggg

SEQ ID NO: 280866 - DNA, 16 bp, P. troglodytes
ttaagagcatgggctt

SEQ ID NO: 280867 - DNA, 16 bp, P. troglodytes
ttaagaggctgaagtg

SEQ ID NO: 280868 - DNA, 16 bp, P. troglodytes
ttaagaggtgattggg

SEQ ID NO: 280869 - DNA, 47 bp, P. troglodytes; identical to SEQ ID NO: 158694

SEQ ID NO: 280870 - DNA, 16 bp, P. troglodytes
ttaagagttatttata

SEQ ID NO: 280871 - DNA, 16 bp, P. troglodytes
ttaagagttatttgta

SEQ ID NO: 280872 - DNA, 16 bp, P. troglodytes
ttaagataaagattgt

SEQ ID NO: 280873 - DNA, 16 bp, P. troglodytes
ttaagatacatatttt

SEQ ID NO: 280874 - DNA, 16 bp, P. troglodytes
ttaagatattttacat

SEQ ID NO: 280875 - DNA, 16 bp, P. troglodytes
ttaagatgataaattt

SEQ ID NO: 280876 - DNA, 16 bp, P. troglodytes
ttaagatgtatcatta

SEQ ID NO: 280877 - DNA, 16 bp, P. troglodytes
ttaagatgtttatcaa

SEQ ID NO: 280878 - DNA, 16 bp, P. troglodytes
ttaagcaaatttttaa

SEQ ID NO: 280879 - DNA, 16 bp, P. troglodytes
ttaagcaacatggaaa

SEQ ID NO: 280880 - DNA, 16 bp, P. troglodytes
ttaagcaagagaaaga

SEQ ID NO: 280881 - DNA, 16 bp, P. troglodytes
ttaagcataaaataaa

SEQ ID NO: 280882 - DNA, 16 bp, P. troglodytes
ttaagcatattttcat

SEQ ID NO: 280883 - DNA, 16 bp, P. troglodytes
ttaagcattttaaaaa

SEQ ID NO: 280884 - DNA, 16 bp, P. troglodytes
ttaagcatttttcata

SEQ ID NO: 280885 - DNA, 16 bp, P. troglodytes
ttaagcattttttaaa

SEQ ID NO: 280886 - DNA, 16 bp, P. troglodytes
ttaagcatttttttaa

SEQ ID NO: 280887 - DNA, 16 bp, P. troglodytes
ttaagccagtggttct

SEQ ID NO: 280888 - DNA, 16 bp, P. troglodytes
ttaagccattaaattt

SEQ ID NO: 280889 - DNA, 16 bp, P. troglodytes
ttaagcccaggagttg

SEQ ID NO: 280890 - DNA, 16 bp, P. troglodytes
ttaagctctgaaattc

SEQ ID NO: 280891 - DNA, 18 bp, P. troglodytes
ttaagctgctgaccctga

SEQ ID NO: 280892 - DNA, 16 bp, P. troglodytes
ttaagctgttcttgca

SEQ ID NO: 280893 - DNA, 16 bp, P. troglodytes
ttaaggaaaatatttt

SEQ ID NO: 280894 - DNA, 16 bp, P. troglodytes
ttaaggaaattaaaag

SEQ ID NO: 280895 - DNA, 16 bp, P. troglodytes
ttaaggaagaaattaa

SEQ ID NO: 280896 - DNA, 16 bp, P. troglodytes
ttaaggaatcaaattt

SEQ ID NO: 280897 - DNA, 16 bp, P. troglodytes
ttaaggacattatgct

SEQ ID NO: 280898 - DNA, 16 bp, P. troglodytes
ttaaggacctttgtga

SEQ ID NO: 280899 - DNA, 16 bp, P. troglodytes
ttaaggactttgagat

SEQ ID NO: 280900 - DNA, 16 bp, P. troglodytes
ttaaggatgaggaaac

SEQ ID NO: 280901 - DNA, 16 bp, P. troglodytes
ttaaggattttgagat

SEQ ID NO: 280902 - DNA, 16 bp, P. troglodytes
ttaaggcagaagtcaa

SEQ ID NO: 280903 - DNA, 17 bp, P. troglodytes
ttaaggcaggaactggc

SEQ ID NO: 280904 - DNA, 16 bp, P. troglodytes
ttaaggcagtggttct

SEQ ID NO: 280905 - DNA, 16 bp, P. troglodytes
ttaaggccaggaattc

SEQ ID NO: 280906 - DNA, 16 bp, P. troglodytes
ttaaggtaatggatat

SEQ ID NO: 280907 - DNA, 16 bp, P. troglodytes
ttaaggtattttgtta

SEQ ID NO: 280908 - DNA, 16 bp, P. troglodytes
ttaaggtttatattgt

SEQ ID NO: 280909 - DNA, 16 bp, P. troglodytes
ttaaggttttaaaaat

SEQ ID NO: 280910 - DNA, 16 bp, P. troglodytes
ttaagtaacctgccca

SEQ ID NO: 280911 - DNA, 16 bp, P. troglodytes
ttaagtaacttatcca

SEQ ID NO: 280912 - DNA, 16 bp, P. troglodytes
ttaagtaacttgccca

SEQ ID NO: 280913 - DNA, 16 bp, P. troglodytes
ttaagtaacttgctca

SEQ ID NO: 280914 - DNA, 16 bp, P. troglodytes
ttaagtaatttcttat

SEQ ID NO: 280915 - DNA, 16 bp, P. troglodytes
ttaagtacaatgagtt

SEQ ID NO: 280916 - DNA, 16 bp, P. troglodytes
ttaagtccaggagttc

SEQ ID NO: 280917 - DNA, 17 bp, P. troglodytes
ttaagtctgctgaagct

SEQ ID NO: 280918 - DNA, 16 bp, P. troglodytes
ttaagtctttaacttc

SEQ ID NO: 280919 - DNA, 16 bp, P. troglodytes
ttaagtgaaaaaagca

SEQ ID NO: 280920 - DNA, 16 bp, P. troglodytes
ttaagtgaaaaggtga

SEQ ID NO: 280921 - DNA, 16 bp, P. troglodytes
ttaagtgaacaaatat

SEQ ID NO: 280922 - DNA, 16 bp, P. troglodytes
ttaagtgaagtaactc

SEQ ID NO: 280923 - DNA, 16 bp, P. troglodytes
ttaagtgatcttcctg

SEQ ID NO: 280924 - DNA, 16 bp, P. troglodytes
ttaagtgattctccca

SEQ ID NO: 280925 - DNA, 16 bp, P. troglodytes
ttaagtgctgggatta

SEQ ID NO: 280926 - DNA, 16 bp, P. troglodytes
ttaagtggaagccaat

SEQ ID NO: 280927 - DNA, 16 bp, P. troglodytes
ttaagtgggtccctga

SEQ ID NO: 280928 - DNA, 16 bp, P. troglodytes
ttaagtgtacagtttg

SEQ ID NO: 280929 - DNA, 16 bp, P. troglodytes
ttaagtgtgtatatat

SEQ ID NO: 280930 - DNA, 16 bp, P. troglodytes
ttaagttaaaaacaaa

SEQ ID NO: 280931 - DNA, 16 bp, P. troglodytes
ttaagttattgatttg

SEQ ID NO: 280932 - DNA, 16 bp, P. troglodytes
ttaagttcatttgttc

SEQ ID NO: 280933 - DNA, 16 bp, P. troglodytes
ttaagttctgggatgc

SEQ ID NO: 280934 - DNA, 16 bp, P. troglodytes
ttaagttctttttaaa

SEQ ID NO: 280935 - DNA, 16 bp, P. troglodytes
ttaagttgaagccaat

SEQ ID NO: 280936 - DNA, 16 bp, P. troglodytes
ttaagtttcctgaggc

SEQ ID NO: 280937 - DNA, 16 bp, P. troglodytes
ttaagttttaaaagaa

SEQ ID NO: 280938 - DNA, 16 bp, P. troglodytes
ttaagttttaagaaaa

SEQ ID NO: 280939 - DNA, 16 bp, P. troglodytes
ttaagttttgggggaa

SEQ ID NO: 280940 - DNA, 16 bp, P. troglodytes
ttaataaaaatgggga

SEQ ID NO: 280941 - DNA, 16 bp, P. troglodytes
ttaataaaagccattt

SEQ ID NO: 280942 - DNA, 16 bp, P. troglodytes
ttaataaaatgtggca

SEQ ID NO: 280943 - DNA, 16 bp, P. troglodytes
ttaataaaattgacaa

SEQ ID NO: 280944 - DNA, 16 bp, P. troglodytes
ttaataaacatttgtt

SEQ ID NO: 280945 - DNA, 16 bp, P. troglodytes
ttaataaacttacttt

SEQ ID NO: 280946 - DNA, 16 bp, P. troglodytes
ttaataaagatgtgtt

SEQ ID NO: 280947 - DNA, 16 bp, P. troglodytes
ttaataaagctggaaa

SEQ ID NO: 280948 - DNA, 16 bp, P. troglodytes
ttaataaagttgattt

SEQ ID NO: 280949 - DNA, 16 bp, P. troglodytes
ttaataaatacagaaa

SEQ ID NO: 280950 - DNA, 16 bp, P. troglodytes
ttaataaatcacttgc

SEQ ID NO: 280951 - DNA, 16 bp, P. troglodytes
ttaataaatgaacaaa

SEQ ID NO: 280952 - DNA, 16 bp, P. troglodytes
ttaataaatgaattca

SEQ ID NO: 280953 - DNA, 16 bp, P. troglodytes
ttaataaatgctgttg

SEQ ID NO: 280954 - DNA, 16 bp, P. troglodytes
ttaataaatgcttgtt

SEQ ID NO: 280955 - DNA, 16 bp, P. troglodytes
ttaataaatggtgcta

SEQ ID NO: 280956 - DNA, 16 bp, P. troglodytes
ttaataaatggttttg

SEQ ID NO: 280957 - DNA, 16 bp, P. troglodytes
ttaataaattactcag

SEQ ID NO: 280958 - DNA, 16 bp, P. troglodytes
ttaataacaatgcatt

SEQ ID NO: 280959 - DNA, 16 bp, P. troglodytes
ttaataacaatgtatt

SEQ ID NO: 280960 - DNA, 16 bp, P. troglodytes
ttaataacagtaataa

SEQ ID NO: 280961 - DNA, 16 bp, P. troglodytes
ttaataataaatgctg

SEQ ID NO: 280962 - DNA, 16 bp, P. troglodytes
ttaataatcacattaa

SEQ ID NO: 280963 - DNA, 16 bp, P. troglodytes
ttaataatgtattgta

SEQ ID NO: 280964 - DNA, 16 bp, P. troglodytes
ttaataattgtacata

SEQ ID NO: 280965 - DNA, 16 bp, P. troglodytes
ttaatacaatgtaaat

SEQ ID NO: 280966 - DNA, 16 bp, P. troglodytes
ttaatacataggtgat

SEQ ID NO: 280967 - DNA, 16 bp, P. troglodytes
ttaatacatttgtttt

SEQ ID NO: 280968 - DNA, 17 bp, P. troglodytes
ttaatacctaggtgatg

SEQ ID NO: 280969 - DNA, 16 bp, P. troglodytes
ttaataccttggtgat

SEQ ID NO: 280970 - DNA, 16 bp, P. troglodytes
ttaatagatgaggaaa

SEQ ID NO: 280971 - DNA, 16 bp, P. troglodytes
ttaataggctttattt

SEQ ID NO: 280972 - DNA, 16 bp, P. troglodytes
ttaatatcattaagat

SEQ ID NO: 280973 - DNA, 16 bp, P. troglodytes
ttaatatggtgaatta

SEQ ID NO: 280974 - DNA, 16 bp, P. troglodytes
ttaatatgtgtatata

SEQ ID NO: 280975 - DNA, 16 bp, P. troglodytes
ttaatattaaaaagtc

SEQ ID NO: 280976 - DNA, 16 bp, P. troglodytes
ttaatattaatattcc

SEQ ID NO: 280977 - DNA, 16 bp, P. troglodytes
ttaatatttgcatttt

SEQ ID NO: 280978 - DNA, 16 bp, P. troglodytes
ttaatattttcaagta

SEQ ID NO: 280979 - DNA, 16 bp, P. troglodytes
ttaatattttgaggaa

SEQ ID NO: 280980 - DNA, 16 bp, P. troglodytes
ttaatcaatcatgcct

SEQ ID NO: 280981 - DNA, 16 bp, P. troglodytes
ttaatcaggcatggtg

SEQ ID NO: 280982 - DNA, 16 bp, P. troglodytes
ttaatcataaattctt

SEQ ID NO: 280983 - DNA, 16 bp, P. troglodytes
ttaatcatatctgcaa

SEQ ID NO: 280984 - DNA, 16 bp, P. troglodytes
ttaatccatcttgagc

SEQ ID NO: 280985 - DNA, 16 bp, P. troglodytes
ttaatcctcaaaacaa

SEQ ID NO: 280986 - DNA, 16 bp, P. troglodytes
ttaatccttaaaacaa

SEQ ID NO: 280987 - DNA, 16 bp, P. troglodytes
ttaatctattttctgt

SEQ ID NO: 280988 - DNA, 28 bp, P. troglodytes
ttaatctcaagtacccagggacacaaac

SEQ ID NO: 280989 - DNA, 16 bp, P. troglodytes
ttaatctcattcatga

SEQ ID NO: 280990 - DNA, 16 bp, P. troglodytes
ttaatctctctctctc

SEQ ID NO: 280991 - DNA, 16 bp, P. troglodytes
ttaatctctctgagct

SEQ ID NO: 280992 - DNA, 16 bp, P. troglodytes
ttaatctgttttgtgt

SEQ ID NO: 280993 - DNA, 16 bp, P. troglodytes
ttaatcttcacagcaa

SEQ ID NO: 280994 - DNA, 16 bp, P. troglodytes
ttaatctttaatccat

SEQ ID NO: 280995 - DNA, 16 bp, P. troglodytes
ttaatctttgcaacaa

SEQ ID NO: 280996 - DNA, 16 bp, P. troglodytes
ttaatcttttcaaaat

SEQ ID NO: 280997 - DNA, 16 bp, P. troglodytes
ttaatgaaaaaggatt

SEQ ID NO: 280998 - DNA, 16 bp, P. troglodytes
ttaatgaaaatgtatt

SEQ ID NO: 280999 - DNA, 16 bp, P. troglodytes
ttaatgaaagaaattg

SEQ ID NO: 281000 - DNA, 16 bp, P. troglodytes
ttaatgaaataaaaca

SEQ ID NO: 281001 - DNA, 16 bp, P. troglodytes
ttaatgaaatattttc

SEQ ID NO: 281002 - DNA, 16 bp, P. troglodytes
ttaatgaaatgaaatg

SEQ ID NO: 281003 - DNA, 16 bp, P. troglodytes
ttaatgacttattttt

SEQ ID NO: 281004 - DNA, 16 bp, P. troglodytes
ttaatgacttcatttt

SEQ ID NO: 281005 - DNA, 16 bp, P. troglodytes
ttaatgacttttaaaa

SEQ ID NO: 281006 - DNA, 16 bp, P. troglodytes
ttaatgagatatttta

SEQ ID NO: 281007 - DNA, 16 bp, P. troglodytes
ttaatgcaattattga

SEQ ID NO: 281008 - DNA, 16 bp, P. troglodytes
ttaatgcattttttaa

SEQ ID NO: 281009 - DNA, 16 bp, P. troglodytes
ttaatgccaatgaatt

SEQ ID NO: 281010 - DNA, 16 bp, P. troglodytes
ttaatgccaccaaact

SEQ ID NO: 281011 - DNA, 16 bp, P. troglodytes
ttaatgcctcaatttc

SEQ ID NO: 281012 - DNA, 16 bp, P. troglodytes
ttaatgctgaaatgac

SEQ ID NO: 281013 - DNA, 16 bp, P. troglodytes
ttaatggcaaaaaatg

SEQ ID NO: 281014 - DNA, 16 bp, P. troglodytes
ttaatgtaaaatgttt

SEQ ID NO: 281015 - DNA, 16 bp, P. troglodytes
ttaatgtaatacacca

SEQ ID NO: 281016 - DNA, 16 bp, P. troglodytes
ttaatgtcttattttg

SEQ ID NO: 281017 - DNA, 16 bp, P. troglodytes
ttaatgtgaaatattt

SEQ ID NO: 281018 - DNA, 16 bp, P. troglodytes
ttaatgtgattattga

SEQ ID NO: 281019 - DNA, 16 bp, P. troglodytes
ttaatgtgcatgccca

SEQ ID NO: 281020 - DNA, 16 bp, P. troglodytes
ttaatgtgtacaaaaa

SEQ ID NO: 281021 - DNA, 16 bp, P. troglodytes
ttaatgttaaaataga

SEQ ID NO: 281022 - DNA, 16 bp, P. troglodytes
ttaatgttaactatag

SEQ ID NO: 281023 - DNA, 16 bp, P. troglodytes
ttaatgttcatatttt

SEQ ID NO: 281024 - DNA, 16 bp, P. troglodytes
ttaatgttcattttct

SEQ ID NO: 281025 - DNA, 16 bp, P. troglodytes
ttaatgtttgtgggta

SEQ ID NO: 281026 - DNA, 16 bp, P. troglodytes
ttaatgttttgagaaa

SEQ ID NO: 281027 - DNA, 16 bp, P. troglodytes
ttaatgtttttccatt

SEQ ID NO: 281028 - DNA, 16 bp, P. troglodytes
ttaattaaaaatggat

SEQ ID NO: 281029 - DNA, 16 bp, P. troglodytes
ttaattaaactgaaga

SEQ ID NO: 281030 - DNA, 16 bp, P. troglodytes
ttaattaattgattga

SEQ ID NO: 281031 - DNA, 16 bp, P. troglodytes
ttaattacattcacaa

SEQ ID NO: 281032 - DNA, 16 bp, P. troglodytes
ttaattactgtatttt

SEQ ID NO: 281033 - DNA, 16 bp, P. troglodytes
ttaattaggccccact

SEQ ID NO: 281034 - DNA, 16 bp, P. troglodytes
ttaattatagccaact

SEQ ID NO: 281035 - DNA, 16 bp, P. troglodytes
ttaattatatttgcaa

SEQ ID NO: 281036 - DNA, 16 bp, P. troglodytes
ttaattattttccaaa

SEQ ID NO: 281037 - DNA, 16 bp, P. troglodytes
ttaattcatctttaaa

SEQ ID NO: 281038 - DNA, 16 bp, P. troglodytes
ttaattcattcattca

SEQ ID NO: 281039 - DNA, 16 bp, P. troglodytes
ttaattccaaatattt

SEQ ID NO: 281040 - DNA, 16 bp, P. troglodytes
ttaattctcacaacca

SEQ ID NO: 281041 - DNA, 16 bp, P. troglodytes
ttaattctcaccacaa

SEQ ID NO: 281042 - DNA, 16 bp, P. troglodytes
ttaattctggaaaatt

SEQ ID NO: 281043 - DNA, 16 bp, P. troglodytes
ttaattctgtttctct

SEQ ID NO: 281044 - DNA, 17 bp, P. troglodytes
ttaattgactcacagtt

SEQ ID NO: 281045 - DNA, 16 bp, P. troglodytes
ttaattgccatttaaa

SEQ ID NO: 281046 - DNA, 16 bp, P. troglodytes
ttaattgggctatttg

SEQ ID NO: 281047 - DNA, 16 bp, P. troglodytes
ttaattgggtcatttg

SEQ ID NO: 281048 - DNA, 16 bp, P. troglodytes
ttaattgtattcattt

SEQ ID NO: 281049 - DNA, 16 bp, P. troglodytes
ttaatttaaaaatcca

SEQ ID NO: 281050 - DNA, 16 bp, P. troglodytes
ttaatttacaaattag

SEQ ID NO: 281051 - DNA, 16 bp, P. troglodytes
ttaatttatgaagaaa

SEQ ID NO: 281052 - DNA, 16 bp, P. troglodytes
ttaatttatggcaata

SEQ ID NO: 281053 - DNA, 16 bp, P. troglodytes
ttaatttatttgttca

SEQ ID NO: 281054 - DNA, 16 bp, P. troglodytes
ttaatttcagaaaaat

SEQ ID NO: 281055 - DNA, 16 bp, P. troglodytes
ttaatttcagccattc

SEQ ID NO: 281056 - DNA, 16 bp, P. troglodytes
ttaatttcatgtgtca

SEQ ID NO: 281057 - DNA, 16 bp, P. troglodytes
ttaatttccttcaata

SEQ ID NO: 281058 - DNA, 16 bp, P. troglodytes
ttaatttctacaaaaa

SEQ ID NO: 281059 - DNA, 16 bp, P. troglodytes
ttaatttctgatatta

SEQ ID NO: 281060 - DNA, 16 bp, P. troglodytes
ttaatttctttaatag

SEQ ID NO: 281061 - DNA, 16 bp, P. troglodytes
ttaatttgagaacttt

SEQ ID NO: 281062 - DNA, 16 bp, P. troglodytes
ttaatttgcatatatt

SEQ ID NO: 281063 - DNA, 16 bp, P. troglodytes
ttaatttgcttaagat

SEQ ID NO: 281064 - DNA, 16 bp, P. troglodytes
ttaatttgcttttccc

SEQ ID NO: 281065 - DNA, 16 bp, P. troglodytes
ttaatttggctggata

SEQ ID NO: 281066 - DNA, 16 bp, P. troglodytes
ttaatttgggaaaaaa

SEQ ID NO: 281067 - DNA, 16 bp, P. troglodytes
ttaattttaaaactca

SEQ ID NO: 281068 - DNA, 16 bp, P. troglodytes
ttaattttagaataag

SEQ ID NO: 281069 - DNA, 16 bp, P. troglodytes
ttaattttatcaaaag

SEQ ID NO: 281070 - DNA, 16 bp, P. troglodytes
ttaattttatgtttca

SEQ ID NO: 281071 - DNA, 16 bp, P. troglodytes
ttaattttcatttgct

SEQ ID NO: 281072 - DNA, 16 bp, P. troglodytes
ttaattttctaaatgt

SEQ ID NO: 281073 - DNA, 16 bp, P. troglodytes
ttaattttctgtttca

SEQ ID NO: 281074 - DNA, 16 bp, P. troglodytes
ttaattttcttcaaaa

SEQ ID NO: 281075 - DNA, 16 bp, P. troglodytes
ttaattttcttcattg

SEQ ID NO: 281076 - DNA, 16 bp, P. troglodytes
ttaattttgagaaata

SEQ ID NO: 281077 - DNA, 16 bp, P. troglodytes
ttaattttgatgaaga

SEQ ID NO: 281078 - DNA, 16 bp, P. troglodytes
ttaattttggaagaaa

SEQ ID NO: 281079 - DNA, 16 bp, P. troglodytes
ttaattttgtgaaaaa

SEQ ID NO: 281080 - DNA, 16 bp, P. troglodytes
ttaatttttaagagat

SEQ ID NO: 281081 - DNA, 16 bp, P. troglodytes
ttaatttttccataaa

SEQ ID NO: 281082 - DNA, 16 bp, P. troglodytes
ttaatttttctcagca

SEQ ID NO: 281083 - DNA, 16 bp, P. troglodytes
ttaatttttgaaaact

SEQ ID NO: 281084 - DNA, 16 bp, P. troglodytes
ttaatttttgaaaatg

SEQ ID NO: 281085 - DNA, 16 bp, P. troglodytes
ttaatttttgaaatca

SEQ ID NO: 281086 - DNA, 16 bp, P. troglodytes
ttaatttttgagaaat

SEQ ID NO: 281087 - DNA, 16 bp, P. troglodytes
ttaattttttgaaagg

SEQ ID NO: 281088 - DNA, 16 bp, P. troglodytes
ttaattttttgagcaa

SEQ ID NO: 281089 - DNA, 16 bp, P. troglodytes
ttaatttttttcagca

SEQ ID NO: 281090 - DNA, 16 bp, P. troglodytes
ttaatttttttccagt

SEQ ID NO: 281091 - DNA, 16 bp, P. troglodytes
ttaattttttttcaga

SEQ ID NO: 281092 - DNA, 16 bp, P. troglodytes
ttacaaaaacagatgg

SEQ ID NO: 281093 - DNA, 16 bp, P. troglodytes
ttacaaaaagtatttt

SEQ ID NO: 281094 - DNA, 16 bp, P. troglodytes
ttacaaaagaaaacag

SEQ ID NO: 281095 - DNA, 16 bp, P. troglodytes
ttacaaaagaaaacat

SEQ ID NO: 281096 - DNA, 16 bp, P. troglodytes
ttacaaaagaaagaga

SEQ ID NO: 281097 - DNA, 16 bp, P. troglodytes
ttacaaaatcagaaaa

SEQ ID NO: 281098 - DNA, 16 bp, P. troglodytes
ttacaaaatgtatttt

SEQ ID NO: 281099 - DNA, 16 bp, P. troglodytes
ttacaaacaacagaaa

SEQ ID NO: 281100 - DNA, 16 bp, P. troglodytes
ttacaaacaatccaat

SEQ ID NO: 281101 - DNA, 17 bp, P. troglodytes
ttacaaaccactgctca

SEQ ID NO: 281102 - DNA, 16 bp, P. troglodytes
ttacaaagaaaaattt

SEQ ID NO: 281103 - DNA, 16 bp, P. troglodytes
ttacaaagaaaagaga

SEQ ID NO: 281104 - DNA, 16 bp, P. troglodytes
ttacaaagaaaataca

SEQ ID NO: 281105 - DNA, 16 bp, P. troglodytes
ttacaaagaaacttct

SEQ ID NO: 281106 - DNA, 16 bp, P. troglodytes
ttacaaagaatatttt

SEQ ID NO: 281107 - DNA, 16 bp, P. troglodytes
ttacaaaggaaaccaa

SEQ ID NO: 281108 - DNA, 16 bp, P. troglodytes
ttacaaaggaagaaaa

SEQ ID NO: 281109 - DNA, 16 bp, P. troglodytes
ttacaaaggagaaaac

SEQ ID NO: 281110 - DNA, 16 bp, P. troglodytes
ttacaaagtcaggaaa

SEQ ID NO: 281111 - DNA, 16 bp, P. troglodytes
ttacaaatatttcctc

SEQ ID NO: 281112 - DNA, 16 bp, P. troglodytes
ttacaaatatttttca

SEQ ID NO: 281113 - DNA, 16 bp, P. troglodytes
ttacaaatgaaaacag

SEQ ID NO: 281114 - DNA, 16 bp, P. troglodytes
ttacaaatgaagaatc

SEQ ID NO: 281115 - DNA, 16 bp, P. troglodytes
ttacaaatgagaaaat

SEQ ID NO: 281116 - DNA, 16 bp, P. troglodytes
ttacaaatgcaaattt

SEQ ID NO: 281117 - DNA, 18 bp, P. troglodytes
ttacaaatgccatggcaa

SEQ ID NO: 281118 - DNA, 16 bp, P. troglodytes
ttacaaatgttatttt

SEQ ID NO: 281119 - DNA, 16 bp, P. troglodytes
ttacaaatgttcttaa

SEQ ID NO: 281120 - DNA, 16 bp, P. troglodytes
ttacaacagccaagat

SEQ ID NO: 281121 - DNA, 16 bp, P. troglodytes
ttacaacccctgcctt

SEQ ID NO: 281122 - DNA, 16 bp, P. troglodytes
ttacaactgatgaact

SEQ ID NO: 281123 - DNA, 16 bp, P. troglodytes
ttacaagaaaaaaacc

SEQ ID NO: 281124 - DNA, 16 bp, P. troglodytes
ttacaagaagaaaaca

SEQ ID NO: 281125 - DNA, 16 bp, P. troglodytes
ttacaagagaaaagca

SEQ ID NO: 281126 - DNA, 17 bp, P. troglodytes
ttacaagccagaagaga

SEQ ID NO: 281127 - DNA, 17 bp, P. troglodytes
ttacaagcgtgagccac

SEQ ID NO: 281128 - DNA, 16 bp, P. troglodytes
ttacaagggaagtgaa

SEQ ID NO: 281129 - DNA, 16 bp, P. troglodytes
ttacaagttaaaaaaa

SEQ ID NO: 281130 - DNA, 16 bp, P. troglodytes
ttacaatttgaaatga

SEQ ID NO: 281131 - DNA, 16 bp, P. troglodytes
ttacaattttatgttt

SEQ ID NO: 281132 - DNA, 16 bp, P. troglodytes
ttacacaaacctagat

SEQ ID NO: 281133 - DNA, 16 bp, P. troglodytes
ttacacaaatatttaa

SEQ ID NO: 281134 - DNA, 16 bp, P. troglodytes
ttacacaatgtataca

SEQ ID NO: 281135 - DNA, 16 bp, P. troglodytes
ttacacaatgtatata

SEQ ID NO: 281136 - DNA, 16 bp, P. troglodytes
ttacacagaaatagat

SEQ ID NO: 281137 - DNA, 16 bp, P. troglodytes
ttacacagcaaaagct

SEQ ID NO: 281138 - DNA, 16 bp, P. troglodytes
ttacacagcaatagct

SEQ ID NO: 281139 - DNA, 18 bp, P. troglodytes
ttacaccagaagaatatg

SEQ ID NO: 281140 - DNA, 16 bp, P. troglodytes
ttacaccagtggtttt

SEQ ID NO: 281141 - DNA, 16 bp, P. troglodytes
ttacacctctaatccc

SEQ ID NO: 281142 - DNA, 16 bp, P. troglodytes
ttacactatggaaatt

SEQ ID NO: 281143 - DNA, 16 bp, P. troglodytes
ttacagaaaaagcttg

SEQ ID NO: 281144 - DNA, 16 bp, P. troglodytes
ttacagaaaaagtaaa

SEQ ID NO: 281145 - DNA, 16 bp, P. troglodytes
ttacagaaaaagtttg

SEQ ID NO: 281146 - DNA, 16 bp, P. troglodytes
ttacagaaaaggaaaa

SEQ ID NO: 281147 - DNA, 16 bp, P. troglodytes
ttacagaaaatataaa

SEQ ID NO: 281148 - DNA, 16 bp, P. troglodytes
ttacagaaaatttgca

SEQ ID NO: 281149 - DNA, 16 bp, P. troglodytes
ttacagaaagaaagaa

SEQ ID NO: 281150 - DNA, 16 bp, P. troglodytes
ttacagaaatagaaaa

SEQ ID NO: 281151 - DNA, 16 bp, P. troglodytes
ttacagaaatgagcca

SEQ ID NO: 281152 - DNA, 16 bp, P. troglodytes
ttacagaaatggaaaa

SEQ ID NO: 281153 - DNA, 16 bp, P. troglodytes
ttacagaagagaaaaa

SEQ ID NO: 281154 - DNA, 16 bp, P. troglodytes
ttacagaatgggaaaa

SEQ ID NO: 281155 - DNA, 16 bp, P. troglodytes
ttacagacaagaaaac

SEQ ID NO: 281156 - DNA, 16 bp, P. troglodytes
ttacagacacacccag

SEQ ID NO: 281157 - DNA, 16 bp, P. troglodytes
ttacagactttttttt

SEQ ID NO: 281158 - DNA, 16 bp, P. troglodytes
ttacagagaaaaataa

SEQ ID NO: 281159 - DNA, 18 bp, P. troglodytes
ttacagagagctgattgg

SEQ ID NO: 281160 - DNA, 16 bp, P. troglodytes
ttacagagtttggttt

SEQ ID NO: 281161 - DNA, 16 bp, P. troglodytes
ttacagatcaggaaat

SEQ ID NO: 281162 - DNA, 16 bp, P. troglodytes
ttacagatgaagaaat

SEQ ID NO: 281163 - DNA, 16 bp, P. troglodytes
ttacagatgaagacac

SEQ ID NO: 281164 - DNA, 16 bp, P. troglodytes
ttacagatgaagcaat

SEQ ID NO: 281165 - DNA, 16 bp, P. troglodytes
ttacagatgaggaaaa

SEQ ID NO: 281166 - DNA, 16 bp, P. troglodytes
ttacagatgaggaaag

SEQ ID NO: 281167 - DNA, 16 bp, P. troglodytes
ttacagatgaggaaat

SEQ ID NO: 281168 - DNA, 16 bp, P. troglodytes
ttacagatgaggacac

SEQ ID NO: 281169 - DNA, 16 bp, P. troglodytes
ttacagatggggaaac

SEQ ID NO: 281170 - DNA, 16 bp, P. troglodytes
ttacagatgtgagcta

SEQ ID NO: 281171 - DNA, 16 bp, P. troglodytes
ttacagattaaaagaa

SEQ ID NO: 281172 - DNA, 16 bp, P. troglodytes
ttacagattttatttt

SEQ ID NO: 281173 - DNA, 16 bp, P. troglodytes
ttacagcagaggaaac

SEQ ID NO: 281174 - DNA, 16 bp, P. troglodytes
ttacagcagcccaagc

SEQ ID NO: 281175 - DNA, 16 bp, P. troglodytes
ttacagcaggggtccc

SEQ ID NO: 281176 - DNA, 16 bp, P. troglodytes
ttacagcattatttat

SEQ ID NO: 281177 - DNA, 16 bp, P. troglodytes
ttacagctaaagaagt

SEQ ID NO: 281178 - DNA, 16 bp, P. troglodytes
ttacagctgaagaaat

SEQ ID NO: 281179 - DNA, 16 bp, P. troglodytes
ttacagcttttatttt

SEQ ID NO: 281180 - DNA, 16 bp, P. troglodytes
ttacaggaattgctaa

SEQ ID NO: 281181 - DNA, 16 bp, P. troglodytes
ttacaggagaggaaac

SEQ ID NO: 281182 - DNA, 16 bp, P. troglodytes
ttacaggagtgagcaa

SEQ ID NO: 281183 - DNA, 16 bp, P. troglodytes
ttacaggcaccatgcc

SEQ ID NO: 281184 - DNA, 16 bp, P. troglodytes
ttacaggcgcgtgcca

SEQ ID NO: 281185 - DNA, 16 bp, P. troglodytes
ttacaggcgtgagccc

SEQ ID NO: 281186 - DNA, 16 bp, P. troglodytes
ttacaggctcctgcca

SEQ ID NO: 281187 - DNA, 16 bp, P. troglodytes
ttacaggggtgcgcca

SEQ ID NO: 281188 - DNA, 16 bp, P. troglodytes
ttacaggtgaaagcca

SEQ ID NO: 281189 - DNA, 16 bp, P. troglodytes
ttacaggtgtgagcac

SEQ ID NO: 281190 - DNA, 19 bp, P. troglodytes
ttacaggtgtgagccacct

SEQ ID NO: 281191 - DNA, 16 bp, P. troglodytes
ttacaggtttgggata

SEQ ID NO: 281192 - DNA, 16 bp, P. troglodytes
ttacagtctgttttat

SEQ ID NO: 281193 - DNA, 16 bp, P. troglodytes
ttacagtgattttttt

SEQ ID NO: 281194 - DNA, 16 bp, P. troglodytes
ttacagtggtgtgaaa

SEQ ID NO: 281195 - DNA, 16 bp, P. troglodytes
ttacagtgtaataata

SEQ ID NO: 281196 - DNA, 16 bp, P. troglodytes
ttacagttagaaacac

SEQ ID NO: 281197 - DNA, 16 bp, P. troglodytes
ttacagttatttcttg

SEQ ID NO: 281198 - DNA, 16 bp, P. troglodytes
ttacagttctggaggc

SEQ ID NO: 281199 - DNA, 16 bp, P. troglodytes
ttacagttgagaaaac

SEQ ID NO: 281200 - DNA, 16 bp, P. troglodytes
ttacagttgtctacag

SEQ ID NO: 281201 - DNA, 16 bp, P. troglodytes
ttacagtttttgactt

SEQ ID NO: 281202 - DNA, 16 bp, P. troglodytes
ttacataaaatagaaa

SEQ ID NO: 281203 - DNA, 16 bp, P. troglodytes
ttacatacatatatat

SEQ ID NO: 281204 - DNA, 16 bp, P. troglodytes
ttacatagataaactt

SEQ ID NO: 281205 - DNA, 16 bp, P. troglodytes
ttacataggtaaatat

SEQ ID NO: 281206 - DNA, 16 bp, P. troglodytes
ttacatatatacatat

SEQ ID NO: 281207 - DNA, 16 bp, P. troglodytes
ttacatatatattaca

SEQ ID NO: 281208 - DNA, 16 bp, P. troglodytes
ttacatatatgtatgt

SEQ ID NO: 281209 - DNA, 16 bp, P. troglodytes
ttacatatctgggtgc

SEQ ID NO: 281210 - DNA, 16 bp, P. troglodytes
ttacatatgaaaatat

SEQ ID NO: 281211 - DNA, 16 bp, P. troglodytes
ttacatattatatgta

SEQ ID NO: 281212 - DNA, 16 bp, P. troglodytes
ttacatattgaaatat

SEQ ID NO: 281213 - DNA, 16 bp, P. troglodytes
ttacatattgtatgca

SEQ ID NO: 281214 - DNA, 16 bp, P. troglodytes
ttacatccaggtcatg

SEQ ID NO: 281215 - DNA, 16 bp, P. troglodytes
ttacatgaaaaaaatt

SEQ ID NO: 281216 - DNA, 16 bp, P. troglodytes
ttacatgagaaagaaa

SEQ ID NO: 281217 - DNA, 16 bp, P. troglodytes
ttacatgattttttaa

SEQ ID NO: 281218 - DNA, 16 bp, P. troglodytes
ttacatgcagattttt

SEQ ID NO: 281219 - DNA, 16 bp, P. troglodytes
ttacatgccataaaat

SEQ ID NO: 281220 - DNA, 16 bp, P. troglodytes
ttacatggcagaaggg

SEQ ID NO: 281221 - DNA, 16 bp, P. troglodytes
ttacatggcagcagaa

SEQ ID NO: 281222 - DNA, 16 bp, P. troglodytes
ttacatggtgaaaccc

SEQ ID NO: 281223 - DNA, 16 bp, P. troglodytes
ttacatgtaaatcttt

SEQ ID NO: 281224 - DNA, 16 bp, P. troglodytes
ttacatgtaatatatt

SEQ ID NO: 281225 - DNA, 16 bp, P. troglodytes
ttacatgtaatatttt

SEQ ID NO: 281226 - DNA, 16 bp, P. troglodytes
ttacatgtattgattt

SEQ ID NO: 281227 - DNA, 16 bp, P. troglodytes
ttacatgtatttttct

SEQ ID NO: 281228 - DNA, 16 bp, P. troglodytes
ttacatgttctcattt

SEQ ID NO: 281229 - DNA, 16 bp, P. troglodytes
ttacatgttttaaaaa

SEQ ID NO: 281230 - DNA, 16 bp, P. troglodytes
ttacattaaagttaaa

SEQ ID NO: 281231 - DNA, 16 bp, P. troglodytes
ttacattaaatacatt

SEQ ID NO: 281232 - DNA, 16 bp, P. troglodytes
ttacattaaatgtaaa

SEQ ID NO: 281233 - DNA, 16 bp, P. troglodytes
ttacattaaatgttat

SEQ ID NO: 281234 - DNA, 16 bp, P. troglodytes
ttacattagaaaagag

SEQ ID NO: 281235 - DNA, 16 bp, P. troglodytes
ttacattgattttgta

SEQ ID NO: 281236 - DNA, 16 bp, P. troglodytes
ttacattgtaaaatat

SEQ ID NO: 281237 - DNA, 16 bp, P. troglodytes
ttacattgtattagat

SEQ ID NO: 281238 - DNA, 16 bp, P. troglodytes
ttacattgtatttatt

SEQ ID NO: 281239 - DNA, 16 bp, P. troglodytes
ttacatttaaaatgta

SEQ ID NO: 281240 - DNA, 16 bp, P. troglodytes
ttacatttaaaatgtt

SEQ ID NO: 281241 - DNA, 16 bp, P. troglodytes
ttacatttaaaccttt

SEQ ID NO: 281242 - DNA, 16 bp, P. troglodytes
ttacatttaccagttt

SEQ ID NO: 281243 - DNA, 16 bp, P. troglodytes
ttacatttagatctat

SEQ ID NO: 281244 - DNA, 16 bp, P. troglodytes
ttacatttatgtctat

SEQ ID NO: 281245 - DNA, 16 bp, P. troglodytes
ttacatttcagtcttt

SEQ ID NO: 281246 - DNA, 16 bp, P. troglodytes
ttacatttctggaggt

SEQ ID NO: 281247 - DNA, 16 bp, P. troglodytes
ttacatttctttgatt

SEQ ID NO: 281248 - DNA, 16 bp, P. troglodytes
ttacatttgaaataaa

SEQ ID NO: 281249 - DNA, 16 bp, P. troglodytes
ttacattttaaatgtt

SEQ ID NO: 281250 - DNA, 16 bp, P. troglodytes
ttacattttaatttgt

SEQ ID NO: 281251 - DNA, 16 bp, P. troglodytes
ttacattttagtcttt

SEQ ID NO: 281252 - DNA, 16 bp, P. troglodytes
ttacattttatagaaa

SEQ ID NO: 281253 - DNA, 16 bp, P. troglodytes
ttacattttcaaaatg

SEQ ID NO: 281254 - DNA, 16 bp, P. troglodytes
ttacattttcaggaat

SEQ ID NO: 281255 - DNA, 16 bp, P. troglodytes
ttacattttcctgttt

SEQ ID NO: 281256 - DNA, 16 bp, P. troglodytes
ttacatttttgtgtgt

SEQ ID NO: 281257 - DNA, 16 bp, P. troglodytes
ttacattttttaaagt

SEQ ID NO: 281258 - DNA, 16 bp, P. troglodytes
ttacattttttaagtt

SEQ ID NO: 281259 - DNA, 16 bp, P. troglodytes
ttacattttttacaaa

SEQ ID NO: 281260 - DNA, 16 bp, P. troglodytes
ttacattttttagaaa

SEQ ID NO: 281261 - DNA, 16 bp, P. troglodytes
ttaccaaaaagtaaaa

SEQ ID NO: 281262 - DNA, 16 bp, P. troglodytes
ttaccaaagaagacat

SEQ ID NO: 281263 - DNA, 18 bp, P. troglodytes
ttaccaaccaaaaagagt

SEQ ID NO: 281264 - DNA, 16 bp, P. troglodytes
ttaccacaacctgttt

SEQ ID NO: 281265 - DNA, 16 bp, P. troglodytes
ttaccacattattaga

SEQ ID NO: 281266 - DNA, 16 bp, P. troglodytes
ttaccagaaagaccaa

SEQ ID NO: 281267 - DNA, 16 bp, P. troglodytes
ttaccagaagcagatg

SEQ ID NO: 281268 - DNA, 16 bp, P. troglodytes
ttaccagaattacttt

SEQ ID NO: 281269 - DNA, 16 bp, P. troglodytes
ttaccagaggcttgga

SEQ ID NO: 281270 - DNA, 16 bp, P. troglodytes
ttaccagctgtgtgac

SEQ ID NO: 281271 - DNA, 16 bp, P. troglodytes
ttaccagggaaatgca

SEQ ID NO: 281272 - DNA, 16 bp, P. troglodytes
ttaccagtattttatt

SEQ ID NO: 281273 - DNA, 16 bp, P. troglodytes
ttaccatattaacaga

SEQ ID NO: 281274 - DNA, 16 bp, P. troglodytes
ttaccatctggccctt

SEQ ID NO: 281275 - DNA, 16 bp, P. troglodytes
ttaccatgaggcttgt

SEQ ID NO: 281276 - DNA, 16 bp, P. troglodytes
ttaccattatataatg

SEQ ID NO: 281277 - DNA, 16 bp, P. troglodytes
ttaccattatgtgatg

SEQ ID NO: 281278 - DNA, 22 bp, P. troglodytes
ttaccattccttctgaaactat

SEQ ID NO: 281279 - DNA, 16 bp, P. troglodytes
ttaccattctgaaaat

SEQ ID NO: 281280 - DNA, 16 bp, P. troglodytes
ttaccattgtgttaca

SEQ ID NO: 281281 - DNA, 16 bp, P. troglodytes
ttaccattgttcctgg

SEQ ID NO: 281282 - DNA, 16 bp, P. troglodytes
ttaccatttcaacatg

SEQ ID NO: 281283 - DNA, 16 bp, P. troglodytes
ttaccattttaaccat

SEQ ID NO: 281284 - DNA, 16 bp, P. troglodytes
ttacccaacctcaggt

SEQ ID NO: 281285 - DNA, 16 bp, P. troglodytes
ttacccaatttcaggt

SEQ ID NO: 281286 - DNA, 19 bp, P. troglodytes
ttacccacaaagggaagct

SEQ ID NO: 281287 - DNA, 16 bp, P. troglodytes
ttacccaccacgatca

SEQ ID NO: 281288 - DNA, 16 bp, P. troglodytes
ttacccactttctgaa

SEQ ID NO: 281289 - DNA, 16 bp, P. troglodytes
ttacccagcctcagat

SEQ ID NO: 281290 - DNA, 16 bp, P. troglodytes
ttacccagcctggtct

SEQ ID NO: 281291 - DNA, 16 bp, P. troglodytes
ttacccaggctggtct

SEQ ID NO: 281292 - DNA, 16 bp, P. troglodytes
ttacccagttccaaac

SEQ ID NO: 281293 - DNA, 16 bp, P. troglodytes
ttacccagttccaaag

SEQ ID NO: 281294 - DNA, 16 bp, P. troglodytes
ttacccagttccaaat

SEQ ID NO: 281295 - DNA, 16 bp, P. troglodytes
ttacccagtttcaagt

SEQ ID NO: 281296 - DNA, 16 bp, P. troglodytes
ttacccatttttaaat

SEQ ID NO: 281297 - DNA, 16 bp, P. troglodytes
ttaccccaaaatcttt

SEQ ID NO: 281298 - DNA, 16 bp, P. troglodytes
ttaccccatgctgttc

SEQ ID NO: 281299 - DNA, 16 bp, P. troglodytes
ttaccctatgacccag

SEQ ID NO: 281300 - DNA, 16 bp, P. troglodytes
ttacctaatctctctg

SEQ ID NO: 281301 - DNA, 16 bp, P. troglodytes
ttacctatgaaacaaa

SEQ ID NO: 281302 - DNA, 16 bp, P. troglodytes
ttacctattaaaaata

SEQ ID NO: 281303 - DNA, 16 bp, P. troglodytes
ttacctatttttaaaa

SEQ ID NO: 281304 - DNA, 16 bp, P. troglodytes
ttacctccacctggtc

SEQ ID NO: 281305 - DNA, 16 bp, P. troglodytes
ttacctcccaaaggcc

SEQ ID NO: 281306 - DNA, 16 bp, P. troglodytes
ttacctcccaaaggct

SEQ ID NO: 281307 - DNA, 16 bp, P. troglodytes
ttacctcccagcaggt

SEQ ID NO: 281308 - DNA, 16 bp, P. troglodytes
ttacctctctgagcct

SEQ ID NO: 281309 - DNA, 16 bp, P. troglodytes
ttacctgggcctggtg

SEQ ID NO: 281310 - DNA, 16 bp, P. troglodytes
ttacctttgtgtgtgt

SEQ ID NO: 281311 - DNA, 16 bp, P. troglodytes
ttaccttttaaaaaat

SEQ ID NO: 281312 - DNA, 21 bp, P. troglodytes
ttacgcctgtaatcccagcag

SEQ ID NO: 281313 - DNA, 16 bp, P. troglodytes
ttactaaaatgtaaat

SEQ ID NO: 281314 - DNA, 16 bp, P. troglodytes
ttactaaagagaaaaa

SEQ ID NO: 281315 - DNA, 16 bp, P. troglodytes
ttactaaagtcatgtg

SEQ ID NO: 281316 - DNA, 16 bp, P. troglodytes
ttactaaatgaaagaa

SEQ ID NO: 281317 - DNA, 16 bp, P. troglodytes
ttactaagaagtcaaa

SEQ ID NO: 281318 - DNA, 16 bp, P. troglodytes
ttactataactttgta

SEQ ID NO: 281319 - DNA, 16 bp, P. troglodytes
ttactatatttgcttt

SEQ ID NO: 281320 - DNA, 16 bp, P. troglodytes
ttactatctgtgtgac

SEQ ID NO: 281321 - DNA, 16 bp, P. troglodytes
ttactatgctttagca

SEQ ID NO: 281322 - DNA, 16 bp, P. troglodytes
ttactatggctttgta

SEQ ID NO: 281323 - DNA, 16 bp, P. troglodytes
ttactattattgttgt

SEQ ID NO: 281324 - DNA, 16 bp, P. troglodytes
ttactattattttaga

SEQ ID NO: 281325 - DNA, 16 bp, P. troglodytes
ttactattttgaaaat

SEQ ID NO: 281326 - DNA, 16 bp, P. troglodytes
ttactcaacctctctg

SEQ ID NO: 281327 - DNA, 16 bp, P. troglodytes
ttactcaatgcctgta

SEQ ID NO: 281328 - DNA, 16 bp, P. troglodytes
ttactcacagttctgc

SEQ ID NO: 281329 - DNA, 16 bp, P. troglodytes
ttactcactgtcatga

SEQ ID NO: 281330 - DNA, 19 bp, P. troglodytes
ttactcaggaggctgaggt

SEQ ID NO: 281331 - DNA, 16 bp, P. troglodytes
ttactcaggctggagt

SEQ ID NO: 281332 - DNA, 16 bp, P. troglodytes
ttactcaggctggtct

SEQ ID NO: 281333 - DNA, 16 bp, P. troglodytes
ttactcagtctactga

SEQ ID NO: 281334 - DNA, 16 bp, P. troglodytes
ttactcataaattctt

SEQ ID NO: 281335 - DNA, 16 bp, P. troglodytes
ttactcatctttatat

SEQ ID NO: 281336 - DNA, 16 bp, P. troglodytes
ttactcatgtgtttgt

SEQ ID NO: 281337 - DNA, 16 bp, P. troglodytes
ttactctgctttattt

SEQ ID NO: 281338 - DNA, 16 bp, P. troglodytes
ttactctgtgccaggc

SEQ ID NO: 281339 - DNA, 16 bp, P. troglodytes
ttactctttttgccca

SEQ ID NO: 281340 - DNA, 16 bp, P. troglodytes
ttactgaaaaaaatta

SEQ ID NO: 281341 - DNA, 16 bp, P. troglodytes
ttactgaaatgccagg

SEQ ID NO: 281342 - DNA, 16 bp, P. troglodytes
ttactgaagttattta

SEQ ID NO: 281343 - DNA, 16 bp, P. troglodytes
ttactgaatttaaaaa

SEQ ID NO: 281344 - DNA, 16 bp, P. troglodytes
ttactgagaataatga

SEQ ID NO: 281345 - DNA, 16 bp, P. troglodytes
ttactgagatataatt

SEQ ID NO: 281346 - DNA, 16 bp, P. troglodytes
ttactgagcacctgct

SEQ ID NO: 281347 - DNA, 16 bp, P. troglodytes
ttactgagcatcttct

SEQ ID NO: 281348 - DNA, 16 bp, P. troglodytes
ttactgagtgctcact

SEQ ID NO: 281349 - DNA, 16 bp, P. troglodytes
ttactgagtgcttatt

SEQ ID NO: 281350 - DNA, 16 bp, P. troglodytes
ttactgatttaatttc

SEQ ID NO: 281351 - DNA, 16 bp, P. troglodytes
ttactgcagcactgtt

SEQ ID NO: 281352 - DNA, 16 bp, P. troglodytes
ttactgccactgaact

SEQ ID NO: 281353 - DNA, 16 bp, P. troglodytes
ttactgcccctttcca

SEQ ID NO: 281354 - DNA, 16 bp, P. troglodytes
ttactgctgatatgga

SEQ ID NO: 281355 - DNA, 16 bp, P. troglodytes
ttactgctgctgctgc

SEQ ID NO: 281356 - DNA, 16 bp, P. troglodytes
ttactggctgtgtgac

SEQ ID NO: 281357 - DNA, 16 bp, P. troglodytes
ttactggtgtatagga

SEQ ID NO: 281358 - DNA, 16 bp, P. troglodytes
ttactgtacctttata

SEQ ID NO: 281359 - DNA, 36 bp, P. troglodytes
ttactgtagccttgtagtatagtttgaagtcaggta

SEQ ID NO: 281360 - DNA, 16 bp, P. troglodytes
ttactgtagctctgta

SEQ ID NO: 281361 - DNA, 16 bp, P. troglodytes
ttactgtattgaatac

SEQ ID NO: 281362 - DNA, 16 bp, P. troglodytes
ttactgtttttaaaaa

SEQ ID NO: 281363 - DNA, 16 bp, P. troglodytes
ttacttaacctctctg

SEQ ID NO: 281364 - DNA, 16 bp, P. troglodytes
ttacttatttctgcct

SEQ ID NO: 281365 - DNA, 16 bp, P. troglodytes
ttacttatttttaagt

SEQ ID NO: 281366 - DNA, 16 bp, P. troglodytes
ttacttcatttaatct

SEQ ID NO: 281367 - DNA, 16 bp, P. troglodytes
ttacttcttgccttct

SEQ ID NO: 281368 - DNA, 16 bp, P. troglodytes
ttacttgagcccaggg

SEQ ID NO: 281369 - DNA, 16 bp, P. troglodytes
ttactttaaaaaactt

SEQ ID NO: 281370 - DNA, 16 bp, P. troglodytes
ttactttaaagaaaaa

SEQ ID NO: 281371 - DNA, 16 bp, P. troglodytes
ttactttacctctctg

SEQ ID NO: 281372 - DNA, 16 bp, P. troglodytes
ttactttagaaaataa

SEQ ID NO: 281373 - DNA, 16 bp, P. troglodytes
ttactttctgtctctg

SEQ ID NO: 281374 - DNA, 16 bp, P. troglodytes
ttactttgaaaataaa

SEQ ID NO: 281375 - DNA, 16 bp, P. troglodytes
ttactttgaatgtaaa

SEQ ID NO: 281376 - DNA, 16 bp, P. troglodytes
ttactttgttgcctag

SEQ ID NO: 281377 - DNA, 16 bp, P. troglodytes
ttacttttaaaactgg

SEQ ID NO: 281378 - DNA, 16 bp, P. troglodytes
ttacttttaaaagtaa

SEQ ID NO: 281379 - DNA, 16 bp, P. troglodytes
ttacttttaattgaca

SEQ ID NO: 281380 - DNA, 16 bp, P. troglodytes
ttacttttgaagaaaa

SEQ ID NO: 281381 - DNA, 16 bp, P. troglodytes
ttacttttggctacca

SEQ ID NO: 281382 - DNA, 16 bp, P. troglodytes
ttacttttgtgtgtgt

SEQ ID NO: 281383 - DNA, 16 bp, P. troglodytes
ttacttttgttgcaat

SEQ ID NO: 281384 - DNA, 16 bp, P. troglodytes
ttactttttaaaatgt

SEQ ID NO: 281385 - DNA, 16 bp, P. troglodytes
ttactttttaaagatt

SEQ ID NO: 281386 - DNA, 16 bp, P. troglodytes
ttactttttaataatg

SEQ ID NO: 281387 - DNA, 16 bp, P. troglodytes
ttactttttgtagaga

SEQ ID NO: 281388 - DNA, 16 bp, P. troglodytes
ttactttttttgtaga

SEQ ID NO: 281389 - DNA, 16 bp, P. troglodytes
ttacttttttttgaga

SEQ ID NO: 281390 - DNA, 16 bp, P. troglodytes
ttagaaaaatctcaaa

SEQ ID NO: 281391 - DNA, 16 bp, P. troglodytes
ttagaaaacaaaactg

SEQ ID NO: 281392 - DNA, 16 bp, P. troglodytes
ttagaaaacataaaat

SEQ ID NO: 281393 - DNA, 16 bp, P. troglodytes
ttagaaaaccccatca

SEQ ID NO: 281394 - DNA, 16 bp, P. troglodytes
ttagaaaaccccatcg

SEQ ID NO: 281395 - DNA, 16 bp, P. troglodytes
ttagaaaaccccatct

SEQ ID NO: 281396 - DNA, 16 bp, P. troglodytes
ttagaaaacctcattg

SEQ ID NO: 281397 - DNA, 16 bp, P. troglodytes
ttagaaaataacattt

SEQ ID NO: 281398 - DNA, 16 bp, P. troglodytes
ttagaaaatactattt

SEQ ID NO: 281399 - DNA, 16 bp, P. troglodytes
ttagaaaatactttaa

SEQ ID NO: 281400 - DNA, 16 bp, P. troglodytes
ttagaaaatactttta

SEQ ID NO: 281401 - DNA, 16 bp, P. troglodytes
ttagaaaatgaatttt

SEQ ID NO: 281402 - DNA, 16 bp, P. troglodytes
ttagaaaatgcaaact

SEQ ID NO: 281403 - DNA, 16 bp, P. troglodytes
ttagaaaatgtttaaa

SEQ ID NO: 281404 - DNA, 16 bp, P. troglodytes
ttagaaaatgtttctt

SEQ ID NO: 281405 - DNA, 16 bp, P. troglodytes
ttagaaaatttgcagc

SEQ ID NO: 281406 - DNA, 16 bp, P. troglodytes
ttagaaacaaaacagg

SEQ ID NO: 281407 - DNA, 16 bp, P. troglodytes
ttagaaacactgtttt

SEQ ID NO: 281408 - DNA, 16 bp, P. troglodytes
ttagaaaccaagatct

SEQ ID NO: 281409 - DNA, 16 bp, P. troglodytes
ttagaaagtcaaaaaa

SEQ ID NO: 281410 - DNA, 16 bp, P. troglodytes
ttagaaagttgatttt

SEQ ID NO: 281411 - DNA, 16 bp, P. troglodytes
ttagaaatatttgaaa

SEQ ID NO: 281412 - DNA, 16 bp, P. troglodytes
ttagaaatctcctcag

SEQ ID NO: 281413 - DNA, 16 bp, P. troglodytes
ttagaaatgcagaatc

SEQ ID NO: 281414 - DNA, 16 bp, P. troglodytes
ttagaaatggaaagaa

SEQ ID NO: 281415 - DNA, 16 bp, P. troglodytes
ttagaacagtgcctgg

SEQ ID NO: 281416 - DNA, 16 bp, P. troglodytes
ttagaacattttaatt

SEQ ID NO: 281417 - DNA, 16 bp, P. troglodytes
ttagaacattttttaa

SEQ ID NO: 281418 - DNA, 16 bp, P. troglodytes
ttagaagaaaacaaga

SEQ ID NO: 281419 - DNA, 16 bp, P. troglodytes
ttagaagaaaacctag

SEQ ID NO: 281420 - DNA, 16 bp, P. troglodytes
ttagaagaaaatgagt

SEQ ID NO: 281421 - DNA, 16 bp, P. troglodytes
ttagaagaaatggaca

SEQ ID NO: 281422 - DNA, 16 bp, P. troglodytes
ttagaagaatatttaa

SEQ ID NO: 281423 - DNA, 16 bp, P. troglodytes
ttagaagacacagact

SEQ ID NO: 281424 - DNA, 16 bp, P. troglodytes
ttagaagcagccaggt

SEQ ID NO: 281425 - DNA, 16 bp, P. troglodytes
ttagaagcagctgtgg

SEQ ID NO: 281426 - DNA, 16 bp, P. troglodytes
ttagaaggaaaagtaa

SEQ ID NO: 281427 - DNA, 16 bp, P. troglodytes
ttagaagtaattttaa

SEQ ID NO: 281428 - DNA, 16 bp, P. troglodytes
ttagaagtttgatgat

SEQ ID NO: 281429 - DNA, 16 bp, P. troglodytes
ttagaatagtttcaga

SEQ ID NO: 281430 - DNA, 16 bp, P. troglodytes
ttagaatgaaaatttt

SEQ ID NO: 281431 - DNA, 16 bp, P. troglodytes
ttagaatgagaaaata

SEQ ID NO: 281432 - DNA, 16 bp, P. troglodytes
ttagaattagcagaca

SEQ ID NO: 281433 - DNA, 16 bp, P. troglodytes
ttagaattatttttct

SEQ ID NO: 281434 - DNA, 16 bp, P. troglodytes
ttagaattctttcctt

SEQ ID NO: 281435 - DNA, 16 bp, P. troglodytes
ttagaatttcttttta

SEQ ID NO: 281436 - DNA, 16 bp, P. troglodytes
ttagacacagtcttgc

SEQ ID NO: 281437 - DNA, 17 bp, P. troglodytes
ttagacagatcaaggag

SEQ ID NO: 281438 - DNA, 16 bp, P. troglodytes
ttagacagtgagtgca

SEQ ID NO: 281439 - DNA, 16 bp, P. troglodytes
ttagactgtaagctcc

SEQ ID NO: 281440 - DNA, 16 bp, P. troglodytes
ttagagaaataatttt

SEQ ID NO: 281441 - DNA, 16 bp, P. troglodytes
ttagagaagcttcatt

SEQ ID NO: 281442 - DNA, 16 bp, P. troglodytes
ttagagacagggtttc

SEQ ID NO: 281443 - DNA, 17 bp, P. troglodytes
ttagagacagggtttca

SEQ ID NO: 281444 - DNA, 16 bp, P. troglodytes
ttagagagagagagag

SEQ ID NO: 281445 - DNA, 16 bp, P. troglodytes
ttagagatattaaaat

SEQ ID NO: 281446 - DNA, 16 bp, P. troglodytes
ttagagattcaatgcc

SEQ ID NO: 281447 - DNA, 16 bp, P. troglodytes
ttagagcaggagtaaa

SEQ ID NO: 281448 - DNA, 16 bp, P. troglodytes
ttagagctggaaggaa

SEQ ID NO: 281449 - DNA, 16 bp, P. troglodytes
ttagaggaaaaacttt

SEQ ID NO: 281450 - DNA, 16 bp, P. troglodytes
ttagaggtggggtctt

SEQ ID NO: 281451 - DNA, 16 bp, P. troglodytes
ttagagtgtgtgtgtg

SEQ ID NO: 281452 - DNA, 16 bp, P. troglodytes
ttagagtttttaaaaa

SEQ ID NO: 281453 - DNA, 16 bp, P. troglodytes
ttagatatacaaatac

SEQ ID NO: 281454 - DNA, 16 bp, P. troglodytes
ttagatatccaagtgg

SEQ ID NO: 281455 - DNA, 17 bp, P. troglodytes
ttagatatttctcctaa

SEQ ID NO: 281456 - DNA, 18 bp, P. troglodytes
ttagatatttctcctaat

SEQ ID NO: 281457 - DNA, 16 bp, P. troglodytes
ttagatccatttgtca

SEQ ID NO: 281458 - DNA, 16 bp, P. troglodytes
ttagatgaggtcatga

SEQ ID NO: 281459 - DNA, 16 bp, P. troglodytes
ttagatgtacatattt

SEQ ID NO: 281460 - DNA, 16 bp, P. troglodytes
ttagatgtgtggtgtt

SEQ ID NO: 281461 - DNA, 19 bp, P. troglodytes
ttagattctcataaggagc

SEQ ID NO: 281462 - DNA, 16 bp, P. troglodytes
ttagatttcataaaat

SEQ ID NO: 281463 - DNA, 16 bp, P. troglodytes
ttagatttgccccttt

SEQ ID NO: 281464 - DNA, 16 bp, P. troglodytes
ttagattttacatttt

SEQ ID NO: 281465 - DNA, 16 bp, P. troglodytes
ttagattttcatttta

SEQ ID NO: 281466 - DNA, 16 bp, P. troglodytes
ttagattttctttaat

SEQ ID NO: 281467 - DNA, 16 bp, P. troglodytes
ttagattttcttttaa

SEQ ID NO: 281468 - DNA, 16 bp, P. troglodytes
ttagcaaactaatgca

SEQ ID NO: 281469 - DNA, 16 bp, P. troglodytes
ttagcaaagaggttgg

SEQ ID NO: 281470 - DNA, 16 bp, P. troglodytes
ttagcaaagcagttgc

SEQ ID NO: 281471 - DNA, 16 bp, P. troglodytes
ttagcaaatatttttt

SEQ ID NO: 281472 - DNA, 16 bp, P. troglodytes
ttagcaaggagactgg

SEQ ID NO: 281473 - DNA, 16 bp, P. troglodytes
ttagcaattttcaaat

SEQ ID NO: 281474 - DNA, 16 bp, P. troglodytes
ttagcacagtatctgg

SEQ ID NO: 281475 - DNA, 16 bp, P. troglodytes
ttagcacagtgcctgg

SEQ ID NO: 281476 - DNA, 16 bp, P. troglodytes
ttagcacttcaacata

SEQ ID NO: 281477 - DNA, 16 bp, P. troglodytes
ttagcactttgggagg

SEQ ID NO: 281478 - DNA, 16 bp, P. troglodytes
ttagcagaagaaagga

SEQ ID NO: 281479 - DNA, 16 bp, P. troglodytes
ttagcagactgggaaa

SEQ ID NO: 281480 - DNA, 16 bp, P. troglodytes
ttagcagagcttgagc

SEQ ID NO: 281481 - DNA, 16 bp, P. troglodytes
ttagcagcttaaaaca

SEQ ID NO: 281482 - DNA, 16 bp, P. troglodytes
ttagcagcttaaaata

SEQ ID NO: 281483 - DNA, 16 bp, P. troglodytes
ttagcaggaaaaaaaa

SEQ ID NO: 281484 - DNA, 16 bp, P. troglodytes
ttagcagtatccctgg

SEQ ID NO: 281485 - DNA, 16 bp, P. troglodytes
ttagcagtcatttccc

SEQ ID NO: 281486 - DNA, 16 bp, P. troglodytes
ttagcagtgtaagaac

SEQ ID NO: 281487 - DNA, 16 bp, P. troglodytes
ttagcatatccatcat

SEQ ID NO: 281488 - DNA, 16 bp, P. troglodytes
ttagcatgaaggctgt

SEQ ID NO: 281489 - DNA, 16 bp, P. troglodytes
ttagcattttaaaaat

SEQ ID NO: 281490 - DNA, 16 bp, P. troglodytes
ttagcattttctttga

SEQ ID NO: 281491 - DNA, 16 bp, P. troglodytes
ttagccaagatcatgc

SEQ ID NO: 281492 - DNA, 22 bp, P. troglodytes
ttagccagatgtggtggtgcat

SEQ ID NO: 281493 - DNA, 16 bp, P. troglodytes
ttagccaggatagtct

SEQ ID NO: 281494 - DNA, 16 bp, P. troglodytes
ttagccaggatggcct

SEQ ID NO: 281495 - DNA, 18 bp, P. troglodytes
ttagccaggcatggtgac

SEQ ID NO: 281496 - DNA, 16 bp, P. troglodytes
ttagccaggcattggt

SEQ ID NO: 281497 - DNA, 20 bp, P. troglodytes
ttagccaggcgtggtggtga

SEQ ID NO: 281498 - DNA, 16 bp, P. troglodytes
ttagccaggctggact

SEQ ID NO: 281499 - DNA, 16 bp, P. troglodytes
ttagccaggctggtct

SEQ ID NO: 281500 - DNA, 16 bp, P. troglodytes
ttagccaggcttagtg

SEQ ID NO: 281501 - DNA, 16 bp, P. troglodytes
ttagccaggtgtgggg

SEQ ID NO: 281502 - DNA, 16 bp, P. troglodytes
ttagccatgtgtggtg

SEQ ID NO: 281503 - DNA, 16 bp, P. troglodytes
ttagcccaatgttttc

SEQ ID NO: 281504 - DNA, 16 bp, P. troglodytes
ttagcccagctaattt

SEQ ID NO: 281505 - DNA, 16 bp, P. troglodytes
ttagccgggcatggtc

SEQ ID NO: 281506 - DNA, 16 bp, P. troglodytes
ttagccgggcgcagtg

SEQ ID NO: 281507 - DNA, 19 bp, P. troglodytes
ttagccgggcgtggtggta

SEQ ID NO: 281508 - DNA, 16 bp, P. troglodytes
ttagcctcccaaagtg

SEQ ID NO: 281509 - DNA, 16 bp, P. troglodytes
ttagcctcttgagtag

SEQ ID NO: 281510 - DNA, 16 bp, P. troglodytes
ttagcctgcctcagcc

SEQ ID NO: 281511 - DNA, 16 bp, P. troglodytes
ttagcctggatggtct

SEQ ID NO: 281512 - DNA, 16 bp, P. troglodytes
ttagcctggccaacat

SEQ ID NO: 281513 - DNA, 16 bp, P. troglodytes
ttagcctgggtgacag

SEQ ID NO: 281514 - DNA, 16 bp, P. troglodytes
ttagccttttttaaaa

SEQ ID NO: 281515 - DNA, 16 bp, P. troglodytes
ttagctagacataaag

SEQ ID NO: 281516 - DNA, 16 bp, P. troglodytes
ttagctagatcttctg

SEQ ID NO: 281517 - DNA, 16 bp, P. troglodytes
ttagctattgttatta

SEQ ID NO: 281518 - DNA, 16 bp, P. troglodytes
ttagctattttaaaat

SEQ ID NO: 281519 - DNA, 16 bp, P. troglodytes
ttagctcaccgcaacc

SEQ ID NO: 281520 - DNA, 16 bp, P. troglodytes
ttagctctaacaatat

SEQ ID NO: 281521 - DNA, 16 bp, P. troglodytes
ttagctgaatgtggtg

SEQ ID NO: 281522 - DNA, 16 bp, P. troglodytes
ttagctgatcatggtg

SEQ ID NO: 281523 - DNA, 16 bp, P. troglodytes
ttagctgggactacag

SEQ ID NO: 281524 - DNA, 16 bp, P. troglodytes
ttagctgggattacag

SEQ ID NO: 281525 - DNA, 16 bp, P. troglodytes
ttagctgggcacagtg

SEQ ID NO: 281526 - DNA, 16 bp, P. troglodytes
ttagctgggcatggta

SEQ ID NO: 281527 - DNA, 16 bp, P. troglodytes
ttagctgggcatggtg

SEQ ID NO: 281528 - DNA, 16 bp, P. troglodytes
ttagctggtcttggtg

SEQ ID NO: 281529 - DNA, 16 bp, P. troglodytes
ttagctgtatgacctt

SEQ ID NO: 281530 - DNA, 16 bp, P. troglodytes
ttagcttggcctggtg

SEQ ID NO: 281531 - DNA, 16 bp, P. troglodytes
ttagctttgaaacaaa

SEQ ID NO: 281532 - DNA, 16 bp, P. troglodytes
ttagcttttgaatttg

SEQ ID NO: 281533 - DNA, 16 bp, P. troglodytes
ttagctttttaaaaag

SEQ ID NO: 281534 - DNA, 16 bp, P. troglodytes
ttaggaaaactggcta

SEQ ID NO: 281535 - DNA, 16 bp, P. troglodytes
ttaggaaaagaggaat

SEQ ID NO: 281536 - DNA, 16 bp, P. troglodytes
ttaggaaaatgaaaat

SEQ ID NO: 281537 - DNA, 16 bp, P. troglodytes
ttaggaaatacacact

SEQ ID NO: 281538 - DNA, 16 bp, P. troglodytes
ttaggaaatacatttt

SEQ ID NO: 281539 - DNA, 16 bp, P. troglodytes
ttaggaaatatttaaa

SEQ ID NO: 281540 - DNA, 16 bp, P. troglodytes
ttaggaaccctgtaca

SEQ ID NO: 281541 - DNA, 16 bp, P. troglodytes
ttaggaataaaaggaa

SEQ ID NO: 281542 - DNA, 16 bp, P. troglodytes
ttaggaataaatctga

SEQ ID NO: 281543 - DNA, 16 bp, P. troglodytes
ttaggaataaatgtaa

SEQ ID NO: 281544 - DNA, 16 bp, P. troglodytes
ttaggaataaattcaa

SEQ ID NO: 281545 - DNA, 16 bp, P. troglodytes
ttaggaatttctccta

SEQ ID NO: 281546 - DNA, 16 bp, P. troglodytes
ttaggagaaaagcatt

SEQ ID NO: 281547 - DNA, 16 bp, P. troglodytes
ttaggaggctgaggag

SEQ ID NO: 281548 - DNA, 16 bp, P. troglodytes
ttaggagtcatgcagc

SEQ ID NO: 281549 - DNA, 16 bp, P. troglodytes
ttaggataatgctggc

SEQ ID NO: 281550 - DNA, 16 bp, P. troglodytes
ttaggattacaagcgt

SEQ ID NO: 281551 - DNA, 16 bp, P. troglodytes
ttaggattgccttggc

SEQ ID NO: 281552 - DNA, 16 bp, P. troglodytes
ttaggattgtttttct

SEQ ID NO: 281553 - DNA, 16 bp, P. troglodytes
ttaggatttcaaaata

SEQ ID NO: 281554 - DNA, 16 bp, P. troglodytes
ttaggcaagtcactta

SEQ ID NO: 281555 - DNA, 16 bp, P. troglodytes
ttaggccattcttgca

SEQ ID NO: 281556 - DNA, 16 bp, P. troglodytes
ttaggctatttacatt

SEQ ID NO: 281557 - DNA, 16 bp, P. troglodytes
ttaggctttcttccct

SEQ ID NO: 281558 - DNA, 16 bp, P. troglodytes
ttagggaaatgcaaat

SEQ ID NO: 281559 - DNA, 16 bp, P. troglodytes
ttagggaataatgaca

SEQ ID NO: 281560 - DNA, 16 bp, P. troglodytes
ttagggatatttatgg

SEQ ID NO: 281561 - DNA, 16 bp, P. troglodytes
ttagggcccaccctaa

SEQ ID NO: 281562 - DNA, 16 bp, P. troglodytes
ttagggcccaccctca

SEQ ID NO: 281563 - DNA, 16 bp, P. troglodytes
ttagggtgggccctaa

SEQ ID NO: 281564 - DNA, 16 bp, P. troglodytes
ttagggttctccagag

SEQ ID NO: 281565 - DNA, 16 bp, P. troglodytes
ttagggtttcaacata

SEQ ID NO: 281566 - DNA, 16 bp, P. troglodytes
ttaggtattgatggga

SEQ ID NO: 281567 - DNA, 18 bp, P. troglodytes
ttaggtatttgtcctaat

SEQ ID NO: 281568 - DNA, 16 bp, P. troglodytes
ttaggtcagaagttca

SEQ ID NO: 281569 - DNA, 16 bp, P. troglodytes
ttaggtctgcttggtt

SEQ ID NO: 281570 - DNA, 16 bp, P. troglodytes
ttaggtctttaaggaa

SEQ ID NO: 281571 - DNA, 16 bp, P. troglodytes
ttaggtctttaatcca

SEQ ID NO: 281572 - DNA, 16 bp, P. troglodytes
ttaggtgctcaataaa

SEQ ID NO: 281573 - DNA, 16 bp, P. troglodytes
ttaggtgggaacacag

SEQ ID NO: 281574 - DNA, 16 bp, P. troglodytes
ttaggttgaaccatat

SEQ ID NO: 281575 - DNA, 16 bp, P. troglodytes
ttaggttgttaatttg

SEQ ID NO: 281576 - DNA, 16 bp, P. troglodytes
ttaggttttcttctag

SEQ ID NO: 281577 - DNA, 16 bp, P. troglodytes
ttaggttttctttaat

SEQ ID NO: 281578 - DNA, 16 bp, P. troglodytes
ttagtaaaagaggaag

SEQ ID NO: 281579 - DNA, 16 bp, P. troglodytes
ttagtaaagatggtgt

SEQ ID NO: 281580 - DNA, 16 bp, P. troglodytes
ttagtacaaatggggt

SEQ ID NO: 281581 - DNA, 18 bp, P. troglodytes
ttagtagaaacgaggttt

SEQ ID NO: 281582 - DNA, 16 bp, P. troglodytes
ttagtagagacggggg

SEQ ID NO: 281583 - DNA, 18 bp, P. troglodytes
ttagtagagatcgggttt

SEQ ID NO: 281584 - DNA, 16 bp, P. troglodytes
ttagtagctgggatta

SEQ ID NO: 281585 - DNA, 16 bp, P. troglodytes
ttagtattagtattag

SEQ ID NO: 281586 - DNA, 16 bp, P. troglodytes
ttagtcaggctgatct

SEQ ID NO: 281587 - DNA, 16 bp, P. troglodytes
ttagtcaggctggtct

SEQ ID NO: 281588 - DNA, 16 bp, P. troglodytes
ttagtcattagaaaaa

SEQ ID NO: 281589 - DNA, 16 bp, P. troglodytes
ttagtcattcaacaaa

SEQ ID NO: 281590 - DNA, 16 bp, P. troglodytes
ttagtcattttaattt

SEQ ID NO: 281591 - DNA, 16 bp, P. troglodytes
ttagtccagcagccca

SEQ ID NO: 281592 - DNA, 16 bp, P. troglodytes
ttagtccatttacatt

SEQ ID NO: 281593 - DNA, 16 bp, P. troglodytes
ttagtcttttttaaaa

SEQ ID NO: 281594 - DNA, 16 bp, P. troglodytes
ttagtgagtttggggt

SEQ ID NO: 281595 - DNA, 16 bp, P. troglodytes
ttagtgatgatgaaca

SEQ ID NO: 281596 - DNA, 16 bp, P. troglodytes
ttagtgattttcaaaa

SEQ ID NO: 281597 - DNA, 16 bp, P. troglodytes
ttagtgcccttgtaag

SEQ ID NO: 281598 - DNA, 16 bp, P. troglodytes
ttagtgcctcaaacta

SEQ ID NO: 281599 - DNA, 22 bp, P. troglodytes
ttagtgctataaatttccctct

SEQ ID NO: 281600 - DNA, 16 bp, P. troglodytes
ttagtgcttccttcag

SEQ ID NO: 281601 - DNA, 16 bp, P. troglodytes
ttagtgctttttgtgt

SEQ ID NO: 281602 - DNA, 16 bp, P. troglodytes
ttagtggagacagcgt

SEQ ID NO: 281603 - DNA, 16 bp, P. troglodytes
ttagtggcttcaaaca

SEQ ID NO: 281604 - DNA, 16 bp, P. troglodytes
ttagtggttgcttagg

SEQ ID NO: 281605 - DNA, 16 bp, P. troglodytes
ttagttaagttaaaat

SEQ ID NO: 281606 - DNA, 16 bp, P. troglodytes
ttagttatctattact

SEQ ID NO: 281607 - DNA, 16 bp, P. troglodytes
ttagttatttcaaaat

SEQ ID NO: 281608 - DNA, 16 bp, P. troglodytes
ttagttcatttgatga

SEQ ID NO: 281609 - DNA, 16 bp, P. troglodytes
ttagttctctctctct

SEQ ID NO: 281610 - DNA, 16 bp, P. troglodytes
ttagttctgtttagaa

SEQ ID NO: 281611 - DNA, 16 bp, P. troglodytes
ttagttctttaaatat

SEQ ID NO: 281612 - DNA, 16 bp, P. troglodytes
ttagttctttcagaaa

SEQ ID NO: 281613 - DNA, 16 bp, P. troglodytes
ttagttcttttttaaa

SEQ ID NO: 281614 - DNA, 16 bp, P. troglodytes
ttagttgataaagcag

SEQ ID NO: 281615 - DNA, 16 bp, P. troglodytes
ttagttgggattacag

SEQ ID NO: 281616 - DNA, 16 bp, P. troglodytes
ttagtttaaaaaacaa

SEQ ID NO: 281617 - DNA, 16 bp, P. troglodytes
ttagtttagccattgt

SEQ ID NO: 281618 - DNA, 16 bp, P. troglodytes
ttagtttccttacctg

SEQ ID NO: 281619 - DNA, 16 bp, P. troglodytes
ttagtttctgttctgt

SEQ ID NO: 281620 - DNA, 16 bp, P. troglodytes
ttagtttgtagtttaa

SEQ ID NO: 281621 - DNA, 16 bp, P. troglodytes
ttagtttgttaatatg

SEQ ID NO: 281622 - DNA, 16 bp, P. troglodytes
ttagttttaaaacaaa

SEQ ID NO: 281623 - DNA, 16 bp, P. troglodytes
ttagttttcaaaaaaa

SEQ ID NO: 281624 - DNA, 16 bp, P. troglodytes
ttagttttccttctga

SEQ ID NO: 281625 - DNA, 16 bp, P. troglodytes
ttagttttctattgct

SEQ ID NO: 281626 - DNA, 16 bp, P. troglodytes
ttagttttggggaagg

SEQ ID NO: 281627 - DNA, 16 bp, P. troglodytes
ttagttttgtaggaaa

SEQ ID NO: 281628 - DNA, 16 bp, P. troglodytes
ttagtttttaaagaaa

SEQ ID NO: 281629 - DNA, 16 bp, P. troglodytes
ttagtttttctactta

SEQ ID NO: 281630 - DNA, 16 bp, P. troglodytes
ttataaaaacactttt

SEQ ID NO: 281631 - DNA, 16 bp, P. troglodytes
ttataaaaatgttttc

SEQ ID NO: 281632 - DNA, 16 bp, P. troglodytes
ttataaaacagtattt

SEQ ID NO: 281633 - DNA, 16 bp, P. troglodytes
ttataaaacatttcat

SEQ ID NO: 281634 - DNA, 16 bp, P. troglodytes
ttataaaaccaccttc

SEQ ID NO: 281635 - DNA, 16 bp, P. troglodytes
ttataaaactggaaaa

SEQ ID NO: 281636 - DNA, 16 bp, P. troglodytes
ttataaaagcattaat

SEQ ID NO: 281637 - DNA, 16 bp, P. troglodytes
ttataaaagggaaaat

SEQ ID NO: 281638 - DNA, 16 bp, P. troglodytes
ttataaaataaatgca

SEQ ID NO: 281639 - DNA, 16 bp, P. troglodytes
ttataaaataagaaca

SEQ ID NO: 281640 - DNA, 16 bp, P. troglodytes
ttataaaatcagaaaa

SEQ ID NO: 281641 - DNA, 16 bp, P. troglodytes
ttataaaatgtccttt

SEQ ID NO: 281642 - DNA, 16 bp, P. troglodytes
ttataaacacacacac

SEQ ID NO: 281643 - DNA, 16 bp, P. troglodytes
ttataaaccaataaca

SEQ ID NO: 281644 - DNA, 16 bp, P. troglodytes
ttataaagaacataaa

SEQ ID NO: 281645 - DNA, 16 bp, P. troglodytes
ttataaagcaagttct

SEQ ID NO: 281646 - DNA, 16 bp, P. troglodytes
ttataaaggaaagggg

SEQ ID NO: 281647 - DNA, 16 bp, P. troglodytes
ttataaagttacagta

SEQ ID NO: 281648 - DNA, 16 bp, P. troglodytes
ttataaataaagctgt

SEQ ID NO: 281649 - DNA, 16 bp, P. troglodytes
ttataaatatgcatat

SEQ ID NO: 281650 - DNA, 16 bp, P. troglodytes
ttataaatgaggaaat

SEQ ID NO: 281651 - DNA, 16 bp, P. troglodytes
ttataaatggaacaac

SEQ ID NO: 281652 - DNA, 16 bp, P. troglodytes
ttataaatggcatttt

SEQ ID NO: 281653 - DNA, 16 bp, P. troglodytes
ttataaatgggattac

SEQ ID NO: 281654 - DNA, 16 bp, P. troglodytes
ttataaattacccggt

SEQ ID NO: 281655 - DNA, 16 bp, P. troglodytes
ttataaattcaacttt

SEQ ID NO: 281656 - DNA, 16 bp, P. troglodytes
ttataactgcatagta

SEQ ID NO: 281657 - DNA, 16 bp, P. troglodytes
ttataagaagagaaga

SEQ ID NO: 281658 - DNA, 16 bp, P. troglodytes
ttataagaagaggaaa

SEQ ID NO: 281659 - DNA, 16 bp, P. troglodytes
ttataagaagaggaga

SEQ ID NO: 281660 - DNA, 16 bp, P. troglodytes
ttataagcaaaggaga

SEQ ID NO: 281661 - DNA, 16 bp, P. troglodytes
ttataagccacccaat

SEQ ID NO: 281662 - DNA, 16 bp, P. troglodytes
ttataaggacaccagt

SEQ ID NO: 281663 - DNA, 16 bp, P. troglodytes
ttataaggacatttgt

SEQ ID NO: 281664 - DNA, 16 bp, P. troglodytes
ttataagtgggtgcta

SEQ ID NO: 281665 - DNA, 16 bp, P. troglodytes
ttataagtgtttggca

SEQ ID NO: 281666 - DNA, 16 bp, P. troglodytes
ttataataaacagaaa

SEQ ID NO: 281667 - DNA, 16 bp, P. troglodytes
ttataatagcattatt

SEQ ID NO: 281668 - DNA, 16 bp, P. troglodytes
ttataatcccaccact

SEQ ID NO: 281669 - DNA, 16 bp, P. troglodytes
ttataatcttatgaga

SEQ ID NO: 281670 - DNA, 16 bp, P. troglodytes
ttataatcttatggga

SEQ ID NO: 281671 - DNA, 16 bp, P. troglodytes
ttataattctgtgaaa

SEQ ID NO: 281672 - DNA, 20 bp, P. troglodytes
ttataatttcctatgcctgt

SEQ ID NO: 281673 - DNA, 16 bp, P. troglodytes
ttatacacagattttc

SEQ ID NO: 281674 - DNA, 16 bp, P. troglodytes
ttatacagattatttc

SEQ ID NO: 281675 - DNA, 16 bp, P. troglodytes
ttatacagcaatagat

SEQ ID NO: 281676 - DNA, 16 bp, P. troglodytes
ttatacataatgtata

SEQ ID NO: 281677 - DNA, 16 bp, P. troglodytes
ttatacatatgtgtat

SEQ ID NO: 281678 - DNA, 16 bp, P. troglodytes
ttatacatatttatgg

SEQ ID NO: 281679 - DNA, 16 bp, P. troglodytes
ttatacattttacata

SEQ ID NO: 281680 - DNA, 16 bp, P. troglodytes
ttatacattttagaaa

SEQ ID NO: 281681 - DNA, 16 bp, P. troglodytes
ttatactaatttacat

SEQ ID NO: 281682 - DNA, 17 bp, P. troglodytes
ttatactagatctagat

SEQ ID NO: 281683 - DNA, 16 bp, P. troglodytes
ttatactgaaacagtt

SEQ ID NO: 281684 - DNA, 16 bp, P. troglodytes
ttatacttgaagtttt

SEQ ID NO: 281685 - DNA, 16 bp, P. troglodytes
ttatagaaaatttgga

SEQ ID NO: 281686 - DNA, 16 bp, P. troglodytes
ttatagaagagaaaat

SEQ ID NO: 281687 - DNA, 16 bp, P. troglodytes
ttatagaggaagaaat

SEQ ID NO: 281688 - DNA, 16 bp, P. troglodytes
ttatagagtgtactta

SEQ ID NO: 281689 - DNA, 16 bp, P. troglodytes
ttatagcaacagaaaa

SEQ ID NO: 281690 - DNA, 16 bp, P. troglodytes
ttatagcagcagaaaa

SEQ ID NO: 281691 - DNA, 16 bp, P. troglodytes
ttatagcagccagaat

SEQ ID NO: 281692 - DNA, 16 bp, P. troglodytes
ttatagcagctcaaat

SEQ ID NO: 281693 - DNA, 16 bp, P. troglodytes
ttatagctcactgcaa

SEQ ID NO: 281694 - DNA, 18 bp, P. troglodytes
ttataggcatgagccacg

SEQ ID NO: 281695 - DNA, 16 bp, P. troglodytes
ttatagtttcatgttt

SEQ ID NO: 281696 - DNA, 16 bp, P. troglodytes
ttatagttttaggtat

SEQ ID NO: 281697 - DNA, 16 bp, P. troglodytes
ttatagttttataacc

SEQ ID NO: 281698 - DNA, 16 bp, P. troglodytes
ttatagttttcattgt

SEQ ID NO: 281699 - DNA, 16 bp, P. troglodytes
ttatagttttctgtat

SEQ ID NO: 281700 - DNA, 16 bp, P. troglodytes
ttatataagggatttg

SEQ ID NO: 281701 - DNA, 16 bp, P. troglodytes
ttatatacaaatatgt

SEQ ID NO: 281702 - DNA, 16 bp, P. troglodytes
ttatatacatatacaa

SEQ ID NO: 281703 - DNA, 16 bp, P. troglodytes
ttatatagcattttca

SEQ ID NO: 281704 - DNA, 16 bp, P. troglodytes
ttatatatacaaatgt

SEQ ID NO: 281705 - DNA, 16 bp, P. troglodytes
ttatatatatgtgtgt

SEQ ID NO: 281706 - DNA, 16 bp, P. troglodytes
ttatatatgaggaaat

SEQ ID NO: 281707 - DNA, 16 bp, P. troglodytes
ttatatatgcatacat

SEQ ID NO: 281708 - DNA, 16 bp, P. troglodytes
ttatatatgtatacat

SEQ ID NO: 281709 - DNA, 16 bp, P. troglodytes
ttatatatgtatatac

SEQ ID NO: 281710 - DNA, 16 bp, P. troglodytes
ttatatattctagata

SEQ ID NO: 281711 - DNA, 16 bp, P. troglodytes
ttatatattctagtta

SEQ ID NO: 281712 - DNA, 16 bp, P. troglodytes
ttatatattctggtta

SEQ ID NO: 281713 - DNA, 16 bp, P. troglodytes
ttatatattttccaaa

SEQ ID NO: 281714 - DNA, 16 bp, P. troglodytes
ttatatattttttcag

SEQ ID NO: 281715 - DNA, 16 bp, P. troglodytes
ttatatcactctgtat

SEQ ID NO: 281716 - DNA, 16 bp, P. troglodytes
ttatatcttgtcttct

SEQ ID NO: 281717 - DNA, 16 bp, P. troglodytes
ttatatgaagtttaaa

SEQ ID NO: 281718 - DNA, 16 bp, P. troglodytes
ttatatgaatttcacc

SEQ ID NO: 281719 - DNA, 16 bp, P. troglodytes
ttatatgcactgggaa

SEQ ID NO: 281720 - DNA, 16 bp, P. troglodytes
ttatatgcatgagcca

SEQ ID NO: 281721 - DNA, 16 bp, P. troglodytes
ttatatgcattatctc

SEQ ID NO: 281722 - DNA, 16 bp, P. troglodytes
ttatatgctatattct

SEQ ID NO: 281723 - DNA, 16 bp, P. troglodytes
ttatatgctgttggtg

SEQ ID NO: 281724 - DNA, 16 bp, P. troglodytes
ttatatggaaacacaa

SEQ ID NO: 281725 - DNA, 16 bp, P. troglodytes
ttatatgggtctattt

SEQ ID NO: 281726 - DNA, 16 bp, P. troglodytes
ttatatgtatgtatac

SEQ ID NO: 281727 - DNA, 16 bp, P. troglodytes
ttatatgtggaatctt

SEQ ID NO: 281728 - DNA, 16 bp, P. troglodytes
ttatatgtgtatgtat

SEQ ID NO: 281729 - DNA, 16 bp, P. troglodytes
ttatatgtgtgtgcat

SEQ ID NO: 281730 - DNA, 16 bp, P. troglodytes
ttatatgttatttgct

SEQ ID NO: 281731 - DNA, 16 bp, P. troglodytes
ttatattaaatggaaa

SEQ ID NO: 281732 - DNA, 16 bp, P. troglodytes
ttatattagttttcta

SEQ ID NO: 281733 - DNA, 16 bp, P. troglodytes
ttatattcagaaaaaa

SEQ ID NO: 281734 - DNA, 16 bp, P. troglodytes
ttatattctgaatatt

SEQ ID NO: 281735 - DNA, 16 bp, P. troglodytes
ttatattcttttgggt

SEQ ID NO: 281736 - DNA, 16 bp, P. troglodytes
ttatattgaggtatgt

SEQ ID NO: 281737 - DNA, 16 bp, P. troglodytes
ttatattgtccaggct

SEQ ID NO: 281738 - DNA, 16 bp, P. troglodytes
ttatatttcagaaata

SEQ ID NO: 281739 - DNA, 16 bp, P. troglodytes
ttatatttccttaaaa

SEQ ID NO: 281740 - DNA, 16 bp, P. troglodytes
ttatatttggaaaaat

SEQ ID NO: 281741 - DNA, 16 bp, P. troglodytes
ttatattttaagttca

SEQ ID NO: 281742 - DNA, 16 bp, P. troglodytes
ttatattttaccacaa

SEQ ID NO: 281743 - DNA, 16 bp, P. troglodytes
ttatattttcagaaat

SEQ ID NO: 281744 - DNA, 16 bp, P. troglodytes
ttatattttcagtaaa

SEQ ID NO: 281745 - DNA, 16 bp, P. troglodytes
ttatattttctaaaac

SEQ ID NO: 281746 - DNA, 16 bp, P. troglodytes
ttatattttgagtaga

SEQ ID NO: 281747 - DNA, 16 bp, P. troglodytes
ttatatttttctagaa

SEQ ID NO: 281748 - DNA, 16 bp, P. troglodytes
ttatcaaaagcttttt

SEQ ID NO: 281749 - DNA, 16 bp, P. troglodytes
ttatcaaaatcaggaa

SEQ ID NO: 281750 - DNA, 16 bp, P. troglodytes
ttatcaaatctaggag

SEQ ID NO: 281751 - DNA, 16 bp, P. troglodytes
ttatcaaatgaataaa

SEQ ID NO: 281752 - DNA, 16 bp, P. troglodytes
ttatcaaatgcatttt

SEQ ID NO: 281753 - DNA, 16 bp, P. troglodytes
ttatcaagctttttca

SEQ ID NO: 281754 - DNA, 16 bp, P. troglodytes
ttatcaagttgaggaa

SEQ ID NO: 281755 - DNA, 16 bp, P. troglodytes
ttatcaatcagtcagc

SEQ ID NO: 281756 - DNA, 16 bp, P. troglodytes
ttatcacagcattatt

SEQ ID NO: 281757 - DNA, 19 bp, P. troglodytes
ttatcacttccccaatcaa

SEQ ID NO: 281758 - DNA, 16 bp, P. troglodytes
ttatcagaaactcaaa

SEQ ID NO: 281759 - DNA, 16 bp, P. troglodytes
ttatcagaattttttt

SEQ ID NO: 281760 - DNA, 16 bp, P. troglodytes
ttatcagcagcaagaa

SEQ ID NO: 281761 - DNA, 16 bp, P. troglodytes
ttatcagctcaaggag

SEQ ID NO: 281762 - DNA, 16 bp, P. troglodytes
ttatcagcttaagaag

SEQ ID NO: 281763 - DNA, 16 bp, P. troglodytes
ttatcaggaaaaaaga

SEQ ID NO: 281764 - DNA, 16 bp, P. troglodytes
ttatcaggagcccact

SEQ ID NO: 281765 - DNA, 16 bp, P. troglodytes
ttatcaggagtttttg

SEQ ID NO: 281766 - DNA, 16 bp, P. troglodytes
ttatcagtctgggtgg

SEQ ID NO: 281767 - DNA, 16 bp, P. troglodytes
ttatcagttccaggag

SEQ ID NO: 281768 - DNA, 16 bp, P. troglodytes
ttatcagttctaaaag

SEQ ID NO: 281769 - DNA, 16 bp, P. troglodytes
ttatcatccccattta

SEQ ID NO: 281770 - DNA, 16 bp, P. troglodytes
ttatcatctgcctctg

SEQ ID NO: 281771 - DNA, 16 bp, P. troglodytes
ttatcatgggagtggg

SEQ ID NO: 281772 - DNA, 16 bp, P. troglodytes
ttatcatgggatattc

SEQ ID NO: 281773 - DNA, 16 bp, P. troglodytes
ttatcatgtattttat

SEQ ID NO: 281774 - DNA, 16 bp, P. troglodytes
ttatcattatatgatg

SEQ ID NO: 281775 - DNA, 16 bp, P. troglodytes
ttatcattatgtaatg

SEQ ID NO: 281776 - DNA, 16 bp, P. troglodytes
ttatcattcatatgtt

SEQ ID NO: 281777 - DNA, 16 bp, P. troglodytes
ttatcattcatgtatt

SEQ ID NO: 281778 - DNA, 16 bp, P. troglodytes
ttatcattcctgtgtt

SEQ ID NO: 281779 - DNA, 16 bp, P. troglodytes
ttatccaatcatctgt

SEQ ID NO: 281780 - DNA, 16 bp, P. troglodytes
ttatccacaggggata

SEQ ID NO: 281781 - DNA, 16 bp, P. troglodytes
ttatccactcattggt

SEQ ID NO: 281782 - DNA, 16 bp, P. troglodytes
ttatccagaaaaaaaa

SEQ ID NO: 281783 - DNA, 16 bp, P. troglodytes
ttatccaggctggtct

SEQ ID NO: 281784 - DNA, 16 bp, P. troglodytes
ttatccataaaatggg

SEQ ID NO: 281785 - DNA, 16 bp, P. troglodytes
ttatccattcattcat

SEQ ID NO: 281786 - DNA, 16 bp, P. troglodytes
ttatccatttaaaaaa

SEQ ID NO: 281787 - DNA, 16 bp, P. troglodytes
ttatccatttcttcaa

SEQ ID NO: 281788 - DNA, 16 bp, P. troglodytes
ttatccatttcttctg

SEQ ID NO: 281789 - DNA, 16 bp, P. troglodytes
ttatccatttgttgat

SEQ ID NO: 281790 - DNA, 16 bp, P. troglodytes
ttatccatttttctgt

SEQ ID NO: 281791 - DNA, 16 bp, P. troglodytes
ttatcccaagaatgca

SEQ ID NO: 281792 - DNA, 16 bp, P. troglodytes
ttatccccattttaca

SEQ ID NO: 281793 - DNA, 16 bp, P. troglodytes
ttatccccattttaga

SEQ ID NO: 281794 - DNA, 16 bp, P. troglodytes
ttatccctaaatattt

SEQ ID NO: 281795 - DNA, 16 bp, P. troglodytes
ttatcctagcactttg

SEQ ID NO: 281796 - DNA, 16 bp, P. troglodytes
ttatcctcattttaca

SEQ ID NO: 281797 - DNA, 16 bp, P. troglodytes
ttatcctgaattatcc

SEQ ID NO: 281798 - DNA, 16 bp, P. troglodytes
ttatccttatccttat

SEQ ID NO: 281799 - DNA, 16 bp, P. troglodytes
ttatccttgacctttg

SEQ ID NO: 281800 - DNA, 16 bp, P. troglodytes
ttatccttgggatgca

SEQ ID NO: 281801 - DNA, 16 bp, P. troglodytes
ttatcctttaaaatta

SEQ ID NO: 281802 - DNA, 16 bp, P. troglodytes
ttatcctttcatctgt

SEQ ID NO: 281803 - DNA, 16 bp, P. troglodytes
ttatctaatttaaaac

SEQ ID NO: 281804 - DNA, 16 bp, P. troglodytes
ttatctatcatctgtc

SEQ ID NO: 281805 - DNA, 16 bp, P. troglodytes
ttatctatctatctat

SEQ ID NO: 281806 - DNA, 16 bp, P. troglodytes
ttatctcaaattgtaa

SEQ ID NO: 281807 - DNA, 16 bp, P. troglodytes
ttatctcaaattttaa

SEQ ID NO: 281808 - DNA, 16 bp, P. troglodytes
ttatctcatttaagcc

SEQ ID NO: 281809 - DNA, 16 bp, P. troglodytes
ttatctccattttatg

SEQ ID NO: 281810 - DNA, 16 bp, P. troglodytes
ttatctgaaaaatgga

SEQ ID NO: 281811 - DNA, 16 bp, P. troglodytes
ttatctgaaatgcttg

SEQ ID NO: 281812 - DNA, 16 bp, P. troglodytes
ttatctgaaattcaaa

SEQ ID NO: 281813 - DNA, 16 bp, P. troglodytes
ttatctgggtgggctc

SEQ ID NO: 281814 - DNA, 16 bp, P. troglodytes
ttatctgtaaaatggg

SEQ ID NO: 281815 - DNA, 16 bp, P. troglodytes
ttatctgtacaaattg

SEQ ID NO: 281816 - DNA, 16 bp, P. troglodytes
ttatctgtattttaaa

SEQ ID NO: 281817 - DNA, 16 bp, P. troglodytes
ttatctgtggtttcac

SEQ ID NO: 281818 - DNA, 16 bp, P. troglodytes
ttatcttatttggaaa

SEQ ID NO: 281819 - DNA, 16 bp, P. troglodytes
ttatcttcctttgggt

SEQ ID NO: 281820 - DNA, 16 bp, P. troglodytes
ttatcttctttgatgc

SEQ ID NO: 281821 - DNA, 16 bp, P. troglodytes
ttatctttgaacttgt

SEQ ID NO: 281822 - DNA, 16 bp, P. troglodytes
ttatctttgttcctct

SEQ ID NO: 281823 - DNA, 16 bp, P. troglodytes
ttatcttttccaaaaa

SEQ ID NO: 281824 - DNA, 16 bp, P. troglodytes
ttatctttttaaaaac

SEQ ID NO: 281825 - DNA, 16 bp, P. troglodytes
ttatcttttttgagat

SEQ ID NO: 281826 - DNA, 16 bp, P. troglodytes
ttatgaaaaaaagctc

SEQ ID NO: 281827 - DNA, 16 bp, P. troglodytes
ttatgaaaaactgtat

SEQ ID NO: 281828 - DNA, 16 bp, P. troglodytes
ttatgaaaaagaaaac

SEQ ID NO: 281829 - DNA, 16 bp, P. troglodytes
ttatgaaaactgcaat

SEQ ID NO: 281830 - DNA, 16 bp, P. troglodytes
ttatgaaaactggaga

SEQ ID NO: 281831 - DNA, 16 bp, P. troglodytes
ttatgaaaagtttatg

SEQ ID NO: 281832 - DNA, 16 bp, P. troglodytes
ttatgaaaataactat

SEQ ID NO: 281833 - DNA, 16 bp, P. troglodytes
ttatgaaaatactttt

SEQ ID NO: 281834 - DNA, 16 bp, P. troglodytes
ttatgaaaatatttca

SEQ ID NO: 281835 - DNA, 16 bp, P. troglodytes
ttatgaaaatcatttt

SEQ ID NO: 281836 - DNA, 16 bp, P. troglodytes
ttatgaaaatgtatta

SEQ ID NO: 281837 - DNA, 16 bp, P. troglodytes
ttatgaaagaaaatgt

SEQ ID NO: 281838 - DNA, 16 bp, P. troglodytes
ttatgaagaaaagaag

SEQ ID NO: 281839 - DNA, 32 bp, P. troglodytes
ttatgaagcttagtttggctggatatgaaatt

SEQ ID NO: 281840 - DNA, 16 bp, P. troglodytes
ttatgaataaagatgc

SEQ ID NO: 281841 - DNA, 16 bp, P. troglodytes
ttatgaataaagctgc

SEQ ID NO: 281842 - DNA, 16 bp, P. troglodytes
ttatgaattacccagc

SEQ ID NO: 281843 - DNA, 16 bp, P. troglodytes
ttatgacaaccaaaaa

SEQ ID NO: 281844 - DNA, 25 bp, P. troglodytes
ttatgacatagattctattgctcac

SEQ ID NO: 281845 - DNA, 16 bp, P. troglodytes
ttatgacattttattt

SEQ ID NO: 281846 - DNA, 16 bp, P. troglodytes
ttatgagacagggtct

SEQ ID NO: 281847 - DNA, 16 bp, P. troglodytes
ttatgagggcactaat

SEQ ID NO: 281848 - DNA, 19 bp, P. troglodytes
ttatgagtgagaacatgcg

SEQ ID NO: 281849 - DNA, 16 bp, P. troglodytes
ttatgatagcatcaaa

SEQ ID NO: 281850 - DNA, 16 bp, P. troglodytes
ttatgattttcattct

SEQ ID NO: 281851 - DNA, 16 bp, P. troglodytes
ttatgattttcttaat

SEQ ID NO: 281852 - DNA, 16 bp, P. troglodytes
ttatgattttgcctgt

SEQ ID NO: 281853 - DNA, 16 bp, P. troglodytes
ttatgcagatgtagat

SEQ ID NO: 281854 - DNA, 17 bp, P. troglodytes
ttatgcagccaaaaaac

SEQ ID NO: 281855 - DNA, 16 bp, P. troglodytes
ttatgcagccaaaaag

SEQ ID NO: 281856 - DNA, 25 bp, P. troglodytes
ttatgcagccaaaagacacatgaaa

SEQ ID NO: 281857 - DNA, 16 bp, P. troglodytes
ttatgccagttagaat

SEQ ID NO: 281858 - DNA, 16 bp, P. troglodytes
ttatgcccatttcaca

SEQ ID NO: 281859 - DNA, 16 bp, P. troglodytes
ttatgcccattttaca

SEQ ID NO: 281860 - DNA, 16 bp, P. troglodytes
ttatgccttttaaaat

SEQ ID NO: 281861 - DNA, 16 bp, P. troglodytes
ttatgctgagcaaaag

SEQ ID NO: 281862 - DNA, 16 bp, P. troglodytes
ttatggaaaaggcaaa

SEQ ID NO: 281863 - DNA, 16 bp, P. troglodytes
ttatggcagaagatga

SEQ ID NO: 281864 - DNA, 16 bp, P. troglodytes
ttatggcagccccagc

SEQ ID NO: 281865 - DNA, 16 bp, P. troglodytes
ttatggccaaatagta

SEQ ID NO: 281866 - DNA, 16 bp, P. troglodytes
ttatggctcaaaccaa

SEQ ID NO: 281867 - DNA, 16 bp, P. troglodytes
ttatggctgaatagta

SEQ ID NO: 281868 - DNA, 16 bp, P. troglodytes
ttatggctgagtaata

SEQ ID NO: 281869 - DNA, 16 bp, P. troglodytes
ttatggctgcagagta

SEQ ID NO: 281870 - DNA, 16 bp, P. troglodytes
ttatgggctgaattgt

SEQ ID NO: 281871 - DNA, 16 bp, P. troglodytes
ttatgggttttgggga

SEQ ID NO: 281872 - DNA, 16 bp, P. troglodytes
ttatggtttttaaaaa

SEQ ID NO: 281873 - DNA, 16 bp, P. troglodytes
ttatgtaaaatgcaga

SEQ ID NO: 281874 - DNA, 16 bp, P. troglodytes
ttatgtaaaattatgt

SEQ ID NO: 281875 - DNA, 16 bp, P. troglodytes
ttatgtactgtatata

SEQ ID NO: 281876 - DNA, 16 bp, P. troglodytes
ttatgtagctggtcct

SEQ ID NO: 281877 - DNA, 16 bp, P. troglodytes
ttatgtataaaacaaa

SEQ ID NO: 281878 - DNA, 16 bp, P. troglodytes
ttatgtatatatacat

SEQ ID NO: 281879 - DNA, 16 bp, P. troglodytes
ttatgtatattttaca

SEQ ID NO: 281880 - DNA, 16 bp, P. troglodytes
ttatgtatattttatc

SEQ ID NO: 281881 - DNA, 16 bp, P. troglodytes
ttatgtatgtgtatgt

SEQ ID NO: 281882 - DNA, 16 bp, P. troglodytes
ttatgtcttggggttg

SEQ ID NO: 281883 - DNA, 16 bp, P. troglodytes
ttatgtgaaattcaaa

SEQ ID NO: 281884 - DNA, 16 bp, P. troglodytes
ttatgtgaagatactt

SEQ ID NO: 281885 - DNA, 16 bp, P. troglodytes
ttatgtgaattttgcc

SEQ ID NO: 281886 - DNA, 16 bp, P. troglodytes
ttatgtgatcagtttt

SEQ ID NO: 281887 - DNA, 16 bp, P. troglodytes
ttatgtgctgctggat

SEQ ID NO: 281888 - DNA, 16 bp, P. troglodytes
ttatgtggaaccaaaa

SEQ ID NO: 281889 - DNA, 16 bp, P. troglodytes
ttatgtgtcagacact

SEQ ID NO: 281890 - DNA, 16 bp, P. troglodytes
ttatgtgtcagtttga

SEQ ID NO: 281891 - DNA, 25 bp, P. troglodytes
ttatgtgtgaatttgatcctgtcat

SEQ ID NO: 281892 - DNA, 16 bp, P. troglodytes
ttatgtgtggcccaaa

SEQ ID NO: 281893 - DNA, 16 bp, P. troglodytes
ttatgttaaacatttt

SEQ ID NO: 281894 - DNA, 16 bp, P. troglodytes
ttatgttaagggaaat

SEQ ID NO: 281895 - DNA, 16 bp, P. troglodytes
ttatgttatttttcaa

SEQ ID NO: 281896 - DNA, 16 bp, P. troglodytes
ttatgttcacagcaaa

SEQ ID NO: 281897 - DNA, 16 bp, P. troglodytes
ttatgttctataaagt

SEQ ID NO: 281898 - DNA, 16 bp, P. troglodytes
ttatgttctgggatac

SEQ ID NO: 281899 - DNA, 17 bp, P. troglodytes
ttatgttgcccaggctg

SEQ ID NO: 281900 - DNA, 16 bp, P. troglodytes
ttatgtttaaaaaaca

SEQ ID NO: 281901 - DNA, 16 bp, P. troglodytes
ttatgtttatgagatt

SEQ ID NO: 281902 - DNA, 16 bp, P. troglodytes
ttatgtttgaatttga

SEQ ID NO: 281903 - DNA, 16 bp, P. troglodytes
ttatgtttttaaaaag

SEQ ID NO: 281904 - DNA, 16 bp, P. troglodytes
ttatgtttttcaaaaa

SEQ ID NO: 281905 - DNA, 16 bp, P. troglodytes
ttattaaaaaatcaga

SEQ ID NO: 281906 - DNA, 16 bp, P. troglodytes
ttattaaaaattcaga

SEQ ID NO: 281907 - DNA, 16 bp, P. troglodytes
ttattaaaatcatgtt

SEQ ID NO: 281908 - DNA, 16 bp, P. troglodytes
ttattaaaatcttcct

SEQ ID NO: 281909 - DNA, 16 bp, P. troglodytes
ttattaaaatggaaat

SEQ ID NO: 281910 - DNA, 16 bp, P. troglodytes
ttattaaacctctttt

SEQ ID NO: 281911 - DNA, 16 bp, P. troglodytes
ttattaaaggaaaatt

SEQ ID NO: 281912 - DNA, 16 bp, P. troglodytes
ttattaaatgctttga

SEQ ID NO: 281913 - DNA, 16 bp, P. troglodytes
ttattaaatgttttct

SEQ ID NO: 281914 - DNA, 16 bp, P. troglodytes
ttattaaccatagtca

SEQ ID NO: 281915 - DNA, 16 bp, P. troglodytes
ttattaactgaagaaa

SEQ ID NO: 281916 - DNA, 16 bp, P. troglodytes
ttattaactgtagtca

SEQ ID NO: 281917 - DNA, 16 bp, P. troglodytes
ttattaagaaaaacaa

SEQ ID NO: 281918 - DNA, 16 bp, P. troglodytes
ttattaagaaaaatca

SEQ ID NO: 281919 - DNA, 16 bp, P. troglodytes
ttattaaggagaattg

SEQ ID NO: 281920 - DNA, 16 bp, P. troglodytes
ttattaatagagatgg

SEQ ID NO: 281921 - DNA, 16 bp, P. troglodytes
ttattacaaaaatgtt

SEQ ID NO: 281922 - DNA, 16 bp, P. troglodytes
ttattacagaaaaaaa

SEQ ID NO: 281923 - DNA, 16 bp, P. troglodytes
ttattacatgtaatgt

SEQ ID NO: 281924 - DNA, 16 bp, P. troglodytes
ttattactattattgt

SEQ ID NO: 281925 - DNA, 16 bp, P. troglodytes
ttattactgattcaat

SEQ ID NO: 281926 - DNA, 16 bp, P. troglodytes
ttattacttaaatcag

SEQ ID NO: 281927 - DNA, 16 bp, P. troglodytes
ttattagaaacaaaaa

SEQ ID NO: 281928 - DNA, 16 bp, P. troglodytes
ttattagaactgataa

SEQ ID NO: 281929 - DNA, 16 bp, P. troglodytes
ttattagctctgtgac

SEQ ID NO: 281930 - DNA, 16 bp, P. troglodytes
ttattagtagtagtag

SEQ ID NO: 281931 - DNA, 17 bp, P. troglodytes
ttattagttccccaaat

SEQ ID NO: 281932 - DNA, 17 bp, P. troglodytes
ttattatacttcaagtt

SEQ ID NO: 281933 - DNA, 17 bp, P. troglodytes
ttattatactttaagtt

SEQ ID NO: 281934 - DNA, 16 bp, P. troglodytes
ttattatcactgtttt

SEQ ID NO: 281935 - DNA, 16 bp, P. troglodytes
ttattatcatccccat

SEQ ID NO: 281936 - DNA, 16 bp, P. troglodytes
ttattatccccatttt

SEQ ID NO: 281937 - DNA, 16 bp, P. troglodytes
ttattatgactattat

SEQ ID NO: 281938 - DNA, 16 bp, P. troglodytes
ttattatgagaattaa

SEQ ID NO: 281939 - DNA, 16 bp, P. troglodytes
ttattatgcaaataat

SEQ ID NO: 281940 - DNA, 16 bp, P. troglodytes
ttattattaaaccaat

SEQ ID NO: 281941 - DNA, 16 bp, P. troglodytes
ttattattaactaaag

SEQ ID NO: 281942 - DNA, 16 bp, P. troglodytes
ttattattatttctgg

SEQ ID NO: 281943 - DNA, 16 bp, P. troglodytes
ttattattctttaagt

SEQ ID NO: 281944 - DNA, 16 bp, P. troglodytes
ttattattgtacttta

SEQ ID NO: 281945 - DNA, 16 bp, P. troglodytes
ttattattgtcattgt

SEQ ID NO: 281946 - DNA, 16 bp, P. troglodytes
ttattatttcagaaat

SEQ ID NO: 281947 - DNA, 16 bp, P. troglodytes
ttattattttctgtag

SEQ ID NO: 281948 - DNA, 16 bp, P. troglodytes
ttattattttgagaga

SEQ ID NO: 281949 - DNA, 16 bp, P. troglodytes
ttattcaagaaatctt

SEQ ID NO: 281950 - DNA, 16 bp, P. troglodytes
ttattcaataagtatt

SEQ ID NO: 281951 - DNA, 16 bp, P. troglodytes
ttattcacaataggaa

SEQ ID NO: 281952 - DNA, 16 bp, P. troglodytes
ttattcactatcatga

SEQ ID NO: 281953 - DNA, 16 bp, P. troglodytes
ttattcactgtcacaa

SEQ ID NO: 281954 - DNA, 16 bp, P. troglodytes
ttattcatctttgtat

SEQ ID NO: 281955 - DNA, 16 bp, P. troglodytes
ttattcatgcattcaa

SEQ ID NO: 281956 - DNA, 16 bp, P. troglodytes
ttattcattcaagaaa

SEQ ID NO: 281957 - DNA, 16 bp, P. troglodytes
ttattcattcatcaaa

SEQ ID NO: 281958 - DNA, 16 bp, P. troglodytes
ttattcattcatttca

SEQ ID NO: 281959 - DNA, 16 bp, P. troglodytes
ttattcatttaaccaa

SEQ ID NO: 281960 - DNA, 16 bp, P. troglodytes
ttattcatttgtttaa

SEQ ID NO: 281961 - DNA, 16 bp, P. troglodytes
ttattcattttatgga

SEQ ID NO: 281962 - DNA, 16 bp, P. troglodytes
ttattcatttttactg

SEQ ID NO: 281963 - DNA, 16 bp, P. troglodytes
ttattccatttagttt

SEQ ID NO: 281964 - DNA, 16 bp, P. troglodytes
ttattcctagaatgca

SEQ ID NO: 281965 - DNA, 16 bp, P. troglodytes
ttattcctgagatgca

SEQ ID NO: 281966 - DNA, 16 bp, P. troglodytes
ttattcctgtgaacca

SEQ ID NO: 281967 - DNA, 16 bp, P. troglodytes
ttattccttccatcta

SEQ ID NO: 281968 - DNA, 16 bp, P. troglodytes
ttattctaaaatgtac

SEQ ID NO: 281969 - DNA, 16 bp, P. troglodytes
ttattctaaaatgtat

SEQ ID NO: 281970 - DNA, 16 bp, P. troglodytes
ttattctaagagaagt

SEQ ID NO: 281971 - DNA, 16 bp, P. troglodytes
ttattctaagccaaat

SEQ ID NO: 281972 - DNA, 16 bp, P. troglodytes
ttattctattaatgtg

SEQ ID NO: 281973 - DNA, 16 bp, P. troglodytes
ttattctcagcaccac

SEQ ID NO: 281974 - DNA, 16 bp, P. troglodytes
ttattctctttgaaag

SEQ ID NO: 281975 - DNA, 16 bp, P. troglodytes
ttattctgccattttt

SEQ ID NO: 281976 - DNA, 16 bp, P. troglodytes
ttattctgtaagtttt

SEQ ID NO: 281977 - DNA, 16 bp, P. troglodytes
ttattctgttaatgta

SEQ ID NO: 281978 - DNA, 16 bp, P. troglodytes
ttattcttgaagtcag

SEQ ID NO: 281979 - DNA, 16 bp, P. troglodytes
ttattctttttgaaat

SEQ ID NO: 281980 - DNA, 16 bp, P. troglodytes
ttattgaaaacaaaat

SEQ ID NO: 281981 - DNA, 16 bp, P. troglodytes
ttattgaacacctgct

SEQ ID NO: 281982 - DNA, 16 bp, P. troglodytes
ttattgaagaaagaaa

SEQ ID NO: 281983 - DNA, 16 bp, P. troglodytes
ttattgaatatctatt

SEQ ID NO: 281984 - DNA, 16 bp, P. troglodytes
ttattgaatggttttg

SEQ ID NO: 281985 - DNA, 16 bp, P. troglodytes
ttattgacattttaaa

SEQ ID NO: 281986 - DNA, 16 bp, P. troglodytes
ttattgacttctgtgc

SEQ ID NO: 281987 - DNA, 16 bp, P. troglodytes
ttattgagatataatt

SEQ ID NO: 281988 - DNA, 16 bp, P. troglodytes
ttattgagatatagtt

SEQ ID NO: 281989 - DNA, 16 bp, P. troglodytes
ttattgagcacttact

SEQ ID NO: 281990 - DNA, 16 bp, P. troglodytes
ttattgagtgcttatt

SEQ ID NO: 281991 - DNA, 16 bp, P. troglodytes
ttattgagtgtttact

SEQ ID NO: 281992 - DNA, 16 bp, P. troglodytes
ttattgatattttcta

SEQ ID NO: 281993 - DNA, 16 bp, P. troglodytes
ttattgatcatttttg

SEQ ID NO: 281994 - DNA, 16 bp, P. troglodytes
ttattgatctattcag

SEQ ID NO: 281995 - DNA, 16 bp, P. troglodytes
ttattgatctgtgtat

SEQ ID NO: 281996 - DNA, 16 bp, P. troglodytes
ttattgattagagctg

SEQ ID NO: 281997 - DNA, 16 bp, P. troglodytes
ttattgcactggctag

SEQ ID NO: 281998 - DNA, 16 bp, P. troglodytes
ttattgcatctctttg

SEQ ID NO: 281999 - DNA, 16 bp, P. troglodytes
ttattgccattatttt

SEQ ID NO: 282000 - DNA, 16 bp, P. troglodytes
ttattgctgtgtaaca

SEQ ID NO: 282001 - DNA, 16 bp, P. troglodytes
ttattgctgttgttgt

SEQ ID NO: 282002 - DNA, 16 bp, P. troglodytes
ttattggaaaacagcc

SEQ ID NO: 282003 - DNA, 16 bp, P. troglodytes
ttattggaattttaaa

SEQ ID NO: 282004 - DNA, 16 bp, P. troglodytes
ttattggacatttgta

SEQ ID NO: 282005 - DNA, 16 bp, P. troglodytes
ttattggatatgtttg

SEQ ID NO: 282006 - DNA, 16 bp, P. troglodytes
ttattggtctattcaa

SEQ ID NO: 282007 - DNA, 16 bp, P. troglodytes
ttattgtaaatacaaa

SEQ ID NO: 282008 - DNA, 16 bp, P. troglodytes
ttattgtaatatttgc

SEQ ID NO: 282009 - DNA, 16 bp, P. troglodytes
ttattgtacacatttt

SEQ ID NO: 282010 - DNA, 16 bp, P. troglodytes
ttattgtcatgcattt

SEQ ID NO: 282011 - DNA, 16 bp, P. troglodytes
ttattgtctaaaagtt

SEQ ID NO: 282012 - DNA, 16 bp, P. troglodytes
ttattgtgaagagcga

SEQ ID NO: 282013 - DNA, 16 bp, P. troglodytes
ttattgtgagaattaa

SEQ ID NO: 282014 - DNA, 16 bp, P. troglodytes
ttattgtgataaaata

SEQ ID NO: 282015 - DNA, 16 bp, P. troglodytes
ttattgtgcatttaaa

SEQ ID NO: 282016 - DNA, 16 bp, P. troglodytes
ttattgtgggagtggg

SEQ ID NO: 282017 - DNA, 16 bp, P. troglodytes
ttattgtgtgcttact

SEQ ID NO: 282018 - DNA, 16 bp, P. troglodytes
ttattgttattatact

SEQ ID NO: 282019 - DNA, 16 bp, P. troglodytes
ttattgttgctattgt

SEQ ID NO: 282020 - DNA, 16 bp, P. troglodytes
ttattgttttaaacca

SEQ ID NO: 282021 - DNA, 16 bp, P. troglodytes
ttattgttttcctgat

SEQ ID NO: 282022 - DNA, 16 bp, P. troglodytes
ttattgtttttgagac

SEQ ID NO: 282023 - DNA, 16 bp, P. troglodytes
ttatttaaaaagtcag

SEQ ID NO: 282024 - DNA, 16 bp, P. troglodytes
ttatttaaaaggaaat

SEQ ID NO: 282025 - DNA, 16 bp, P. troglodytes
ttatttaaaatgtaca

SEQ ID NO: 282026 - DNA, 16 bp, P. troglodytes
ttatttaaaatgtttc

SEQ ID NO: 282027 - DNA, 16 bp, P. troglodytes
ttatttaaacaaaaag

SEQ ID NO: 282028 - DNA, 16 bp, P. troglodytes
ttatttaaccataaaa

SEQ ID NO: 282029 - DNA, 16 bp, P. troglodytes
ttatttaacttaacat

SEQ ID NO: 282030 - DNA, 16 bp, P. troglodytes
ttatttaacttagcat

SEQ ID NO: 282031 - DNA, 16 bp, P. troglodytes
ttatttaagaaaaaca

SEQ ID NO: 282032 - DNA, 16 bp, P. troglodytes
ttatttaatcttctca

SEQ ID NO: 282033 - DNA, 16 bp, P. troglodytes
ttatttaatctttctg

SEQ ID NO: 282034 - DNA, 16 bp, P. troglodytes
ttatttaatgcccttc

SEQ ID NO: 282035 - DNA, 20 bp, P. troglodytes
ttatttactcagtagtcatt

SEQ ID NO: 282036 - DNA, 16 bp, P. troglodytes
ttatttagaaaataca

SEQ ID NO: 282037 - DNA, 16 bp, P. troglodytes
ttatttagcattttta

SEQ ID NO: 282038 - DNA, 16 bp, P. troglodytes
ttatttaggaaataaa

SEQ ID NO: 282039 - DNA, 16 bp, P. troglodytes
ttatttaggtcttatt

SEQ ID NO: 282040 - DNA, 16 bp, P. troglodytes
ttatttataatagcaa

SEQ ID NO: 282041 - DNA, 16 bp, P. troglodytes
ttatttatacattttg

SEQ ID NO: 282042 - DNA, 22 bp, P. troglodytes
ttatttatatcctactgctcaa

SEQ ID NO: 282043 - DNA, 16 bp, P. troglodytes
ttatttatcagaaaat

SEQ ID NO: 282044 - DNA, 16 bp, P. troglodytes
ttatttatctctgctc

SEQ ID NO: 282045 - DNA, 16 bp, P. troglodytes
ttatttatgcatttgt

SEQ ID NO: 282046 - DNA, 16 bp, P. troglodytes
ttatttatgtatctat

SEQ ID NO: 282047 - DNA, 16 bp, P. troglodytes
ttatttattcattcac

SEQ ID NO: 282048 - DNA, 16 bp, P. troglodytes
ttatttattgtaaaga

SEQ ID NO: 282049 - DNA, 16 bp, P. troglodytes
ttatttattgtagaaa

SEQ ID NO: 282050 - DNA, 16 bp, P. troglodytes
ttatttatttcaagaa

SEQ ID NO: 282051 - DNA, 16 bp, P. troglodytes
ttatttatttcaatgt

SEQ ID NO: 282052 - DNA, 16 bp, P. troglodytes
ttatttatttcacaaa

SEQ ID NO: 282053 - DNA, 16 bp, P. troglodytes
ttatttatttctagaa

SEQ ID NO: 282054 - DNA, 16 bp, P. troglodytes
ttatttatttctgaaa

SEQ ID NO: 282055 - DNA, 16 bp, P. troglodytes
ttatttatttgaatct

SEQ ID NO: 282056 - DNA, 16 bp, P. troglodytes
ttatttattttcaaga

SEQ ID NO: 282057 - DNA, 16 bp, P. troglodytes
ttatttattttcccaa

SEQ ID NO: 282058 - DNA, 16 bp, P. troglodytes
ttatttattttgggac

SEQ ID NO: 282059 - DNA, 16 bp, P. troglodytes
ttatttcaaaaactgt

SEQ ID NO: 282060 - DNA, 16 bp, P. troglodytes
ttatttcaaaaatgtt

SEQ ID NO: 282061 - DNA, 16 bp, P. troglodytes
ttatttcaaatatttg

SEQ ID NO: 282062 - DNA, 16 bp, P. troglodytes
ttatttcaatagcttt

SEQ ID NO: 282063 - DNA, 16 bp, P. troglodytes
ttatttcacttaacat

SEQ ID NO: 282064 - DNA, 16 bp, P. troglodytes
ttatttcagaaaaaaa

SEQ ID NO: 282065 - DNA, 16 bp, P. troglodytes
ttatttcagaagaaaa

SEQ ID NO: 282066 - DNA, 16 bp, P. troglodytes
ttatttcagaattttt

SEQ ID NO: 282067 - DNA, 16 bp, P. troglodytes
ttatttcatcaccctg

SEQ ID NO: 282068 - DNA, 16 bp, P. troglodytes
ttatttcatctgcaaa

SEQ ID NO: 282069 - DNA, 16 bp, P. troglodytes
ttatttcatgacccag

SEQ ID NO: 282070 - DNA, 16 bp, P. troglodytes
ttatttcattgtgtat

SEQ ID NO: 282071 - DNA, 16 bp, P. troglodytes
ttatttcatttaaaga

SEQ ID NO: 282072 - DNA, 16 bp, P. troglodytes
ttatttcatttagcat

SEQ ID NO: 282073 - DNA, 16 bp, P. troglodytes
ttatttccaaataaaa

SEQ ID NO: 282074 - DNA, 16 bp, P. troglodytes
ttatttccagaatttt

SEQ ID NO: 282075 - DNA, 16 bp, P. troglodytes
ttatttccattttatg

SEQ ID NO: 282076 - DNA, 16 bp, P. troglodytes
ttatttccattttcca

SEQ ID NO: 282077 - DNA, 16 bp, P. troglodytes
ttatttcccaaagatt

SEQ ID NO: 282078 - DNA, 16 bp, P. troglodytes
ttatttccttgagcat

SEQ ID NO: 282079 - DNA, 16 bp, P. troglodytes
ttatttcctttggaaa

SEQ ID NO: 282080 - DNA, 16 bp, P. troglodytes
ttatttctaagtattt

SEQ ID NO: 282081 - DNA, 16 bp, P. troglodytes
ttatttctagatattt

SEQ ID NO: 282082 - DNA, 16 bp, P. troglodytes
ttatttctcacagttt

SEQ ID NO: 282083 - DNA, 16 bp, P. troglodytes
ttatttctcctttgtg

SEQ ID NO: 282084 - DNA, 16 bp, P. troglodytes
ttatttctcttctgga

SEQ ID NO: 282085 - DNA, 16 bp, P. troglodytes
ttatttctgaaaatgt

SEQ ID NO: 282086 - DNA, 16 bp, P. troglodytes
ttatttctgaaatttt

SEQ ID NO: 282087 - DNA, 16 bp, P. troglodytes
ttatttctggaatttt

SEQ ID NO: 282088 - DNA, 16 bp, P. troglodytes
ttatttctggactctc

SEQ ID NO: 282089 - DNA, 16 bp, P. troglodytes
ttatttctggattctc

SEQ ID NO: 282090 - DNA, 16 bp, P. troglodytes
ttatttctgggtgtgt

SEQ ID NO: 282091 - DNA, 16 bp, P. troglodytes
ttatttctgtctcttg

SEQ ID NO: 282092 - DNA, 16 bp, P. troglodytes
ttatttctgtggtcta

SEQ ID NO: 282093 - DNA, 16 bp, P. troglodytes
ttatttctgttttcca

SEQ ID NO: 282094 - DNA, 16 bp, P. troglodytes
ttatttcttaaagatt

SEQ ID NO: 282095 - DNA, 16 bp, P. troglodytes
ttatttcttaaatgtt

SEQ ID NO: 282096 - DNA, 16 bp, P. troglodytes
ttatttcttcatgtat

SEQ ID NO: 282097 - DNA, 16 bp, P. troglodytes
ttatttctttatatag

SEQ ID NO: 282098 - DNA, 16 bp, P. troglodytes
ttatttctttctctgg

SEQ ID NO: 282099 - DNA, 16 bp, P. troglodytes
ttatttctttgtaaat

SEQ ID NO: 282100 - DNA, 16 bp, P. troglodytes
ttatttctttttaaga

SEQ ID NO: 282101 - DNA, 16 bp, P. troglodytes
ttatttgaaaagagaa

SEQ ID NO: 282102 - DNA, 16 bp, P. troglodytes
ttatttgaaaagtaaa

SEQ ID NO: 282103 - DNA, 16 bp, P. troglodytes
ttatttgaaaatttga

SEQ ID NO: 282104 - DNA, 16 bp, P. troglodytes
ttatttgaaatctttt

SEQ ID NO: 282105 - DNA, 16 bp, P. troglodytes
ttatttgaaatgaaaa

SEQ ID NO: 282106 - DNA, 16 bp, P. troglodytes
ttatttgaaattttca

SEQ ID NO: 282107 - DNA, 16 bp, P. troglodytes
ttatttgaacacagtt

SEQ ID NO: 282108 - DNA, 16 bp, P. troglodytes
ttatttgaaggaataa

SEQ ID NO: 282109 - DNA, 16 bp, P. troglodytes
ttatttgaaggtagac

SEQ ID NO: 282110 - DNA, 16 bp, P. troglodytes
ttatttgaagttttct

SEQ ID NO: 282111 - DNA, 16 bp, P. troglodytes
ttatttgacaatgctt

SEQ ID NO: 282112 - DNA, 16 bp, P. troglodytes
ttatttgacaatgttt

SEQ ID NO: 282113 - DNA, 16 bp, P. troglodytes
ttatttgaccacagaa

SEQ ID NO: 282114 - DNA, 16 bp, P. troglodytes
ttatttgagacagaat

SEQ ID NO: 282115 - DNA, 16 bp, P. troglodytes
ttatttgaggaaaaaa

SEQ ID NO: 282116 - DNA, 16 bp, P. troglodytes
ttatttgcatagaaat

SEQ ID NO: 282117 - DNA, 16 bp, P. troglodytes
ttatttgctaaatctg

SEQ ID NO: 282118 - DNA, 16 bp, P. troglodytes
ttatttgctttttaaa

SEQ ID NO: 282119 - DNA, 16 bp, P. troglodytes
ttatttggaaaaacaa

SEQ ID NO: 282120 - DNA, 16 bp, P. troglodytes
ttatttggaaaaatgt

SEQ ID NO: 282121 - DNA, 16 bp, P. troglodytes
ttatttggaaaatgtt

SEQ ID NO: 282122 - DNA, 16 bp, P. troglodytes
ttatttggaaacagtt

SEQ ID NO: 282123 - DNA, 16 bp, P. troglodytes
ttatttggaaataaga

SEQ ID NO: 282124 - DNA, 16 bp, P. troglodytes
ttatttggaattcttt

SEQ ID NO: 282125 - DNA, 16 bp, P. troglodytes
ttatttgggaaaaaaa

SEQ ID NO: 282126 - DNA, 16 bp, P. troglodytes
ttatttgtaaaacaaa

SEQ ID NO: 282127 - DNA, 16 bp, P. troglodytes
ttatttgtaaaatgag

SEQ ID NO: 282128 - DNA, 16 bp, P. troglodytes
ttatttgtatacagtg

SEQ ID NO: 282129 - DNA, 16 bp, P. troglodytes
ttatttgtcaaataaa

SEQ ID NO: 282130 - DNA, 16 bp, P. troglodytes
ttatttgtcaattaaa

SEQ ID NO: 282131 - DNA, 16 bp, P. troglodytes
ttatttgtgcaggagg

SEQ ID NO: 282132 - DNA, 16 bp, P. troglodytes
ttatttgtgtatagga

SEQ ID NO: 282133 - DNA, 16 bp, P. troglodytes
ttatttgtttcaaatt

SEQ ID NO: 282134 - DNA, 16 bp, P. troglodytes
ttattttaaaaagcag

SEQ ID NO: 282135 - DNA, 16 bp, P. troglodytes
ttattttaaaaagtgt

SEQ ID NO: 282136 - DNA, 16 bp, P. troglodytes
ttattttaaaactgaa

SEQ ID NO: 282137 - DNA, 16 bp, P. troglodytes
ttattttaaaagctaa

SEQ ID NO: 282138 - DNA, 16 bp, P. troglodytes
ttattttaaaaggata

SEQ ID NO: 282139 - DNA, 16 bp, P. troglodytes
ttattttaaaatgcaa

SEQ ID NO: 282140 - DNA, 16 bp, P. troglodytes
ttattttaaaatggaa

SEQ ID NO: 282141 - DNA, 16 bp, P. troglodytes
ttattttaaagaaagg

SEQ ID NO: 282142 - DNA, 16 bp, P. troglodytes
ttattttaaagatgaa

SEQ ID NO: 282143 - DNA, 16 bp, P. troglodytes
ttattttaaagcaatt

SEQ ID NO: 282144 - DNA, 16 bp, P. troglodytes
ttattttaaagcatat

SEQ ID NO: 282145 - DNA, 16 bp, P. troglodytes
ttattttaaatgctat

SEQ ID NO: 282146 - DNA, 16 bp, P. troglodytes
ttattttaaatgtgct

SEQ ID NO: 282147 - DNA, 16 bp, P. troglodytes
ttattttaagaaattg

SEQ ID NO: 282148 - DNA, 16 bp, P. troglodytes
ttattttaagaataca

SEQ ID NO: 282149 - DNA, 16 bp, P. troglodytes
ttattttaagtgaaaa

SEQ ID NO: 282150 - DNA, 16 bp, P. troglodytes
ttattttaatttgcat

SEQ ID NO: 282151 - DNA, 16 bp, P. troglodytes
ttattttacaaatgca

SEQ ID NO: 282152 - DNA, 16 bp, P. troglodytes
ttattttagaaaacaa

SEQ ID NO: 282153 - DNA, 16 bp, P. troglodytes
ttattttagaacaaaa

SEQ ID NO: 282154 - DNA, 16 bp, P. troglodytes
ttattttagagacagg

SEQ ID NO: 282155 - DNA, 16 bp, P. troglodytes
ttattttagattcaag

SEQ ID NO: 282156 - DNA, 16 bp, P. troglodytes
ttattttataaacaga

SEQ ID NO: 282157 - DNA, 16 bp, P. troglodytes
ttattttatcacagtt

SEQ ID NO: 282158 - DNA, 16 bp, P. troglodytes
ttattttatgcatttc

SEQ ID NO: 282159 - DNA, 16 bp, P. troglodytes
ttattttatggaaaaa

SEQ ID NO: 282160 - DNA, 16 bp, P. troglodytes
ttattttattgaaaca

SEQ ID NO: 282161 - DNA, 16 bp, P. troglodytes
ttattttcaaaaatgt

SEQ ID NO: 282162 - DNA, 16 bp, P. troglodytes
ttattttcaacaaatg

SEQ ID NO: 282163 - DNA, 16 bp, P. troglodytes
ttattttcaataaatg

SEQ ID NO: 282164 - DNA, 16 bp, P. troglodytes
ttattttcagttaatt

SEQ ID NO: 282165 - DNA, 16 bp, P. troglodytes
ttattttcataaagtt

SEQ ID NO: 282166 - DNA, 16 bp, P. troglodytes
ttattttcatcagttt

SEQ ID NO: 282167 - DNA, 16 bp, P. troglodytes
ttattttcattcagtt

SEQ ID NO: 282168 - DNA, 16 bp, P. troglodytes
ttattttcattgtaat

SEQ ID NO: 282169 - DNA, 16 bp, P. troglodytes
ttattttccaaatttc

SEQ ID NO: 282170 - DNA, 16 bp, P. troglodytes
ttattttccagatttt

SEQ ID NO: 282171 - DNA, 16 bp, P. troglodytes
ttattttccattaaaa

SEQ ID NO: 282172 - DNA, 16 bp, P. troglodytes
ttattttccatttgaa

SEQ ID NO: 282173 - DNA, 16 bp, P. troglodytes
ttattttccctgatcc

SEQ ID NO: 282174 - DNA, 16 bp, P. troglodytes
ttattttcgagacgga

SEQ ID NO: 282175 - DNA, 16 bp, P. troglodytes
ttattttctcacagtc

SEQ ID NO: 282176 - DNA, 16 bp, P. troglodytes
ttattttctcacagtt

SEQ ID NO: 282177 - DNA, 16 bp, P. troglodytes
ttattttctctgaaaa

SEQ ID NO: 282178 - DNA, 16 bp, P. troglodytes
ttattttctgaaatgt

SEQ ID NO: 282179 - DNA, 16 bp, P. troglodytes
ttattttctgaataat

SEQ ID NO: 282180 - DNA, 16 bp, P. troglodytes
ttattttcttcctaaa

SEQ ID NO: 282181 - DNA, 16 bp, P. troglodytes
ttattttcttctgctg

SEQ ID NO: 282182 - DNA, 16 bp, P. troglodytes
ttattttctttgaaaa

SEQ ID NO: 282183 - DNA, 16 bp, P. troglodytes
ttattttctttgaaag

SEQ ID NO: 282184 - DNA, 16 bp, P. troglodytes
ttattttctttgaaat

SEQ ID NO: 282185 - DNA, 16 bp, P. troglodytes
ttattttgaaaaacaa

SEQ ID NO: 282186 - DNA, 16 bp, P. troglodytes
ttattttgaaacattt

SEQ ID NO: 282187 - DNA, 16 bp, P. troglodytes
ttattttgaaatatgc

SEQ ID NO: 282188 - DNA, 16 bp, P. troglodytes
ttattttgaaatgaat

SEQ ID NO: 282189 - DNA, 16 bp, P. troglodytes
ttattttgaagaaaaa

SEQ ID NO: 282190 - DNA, 16 bp, P. troglodytes
ttattttgaagaaaat

SEQ ID NO: 282191 - DNA, 16 bp, P. troglodytes
ttattttgaagacaaa

SEQ ID NO: 282192 - DNA, 16 bp, P. troglodytes
ttattttgaagcaaat

SEQ ID NO: 282193 - DNA, 16 bp, P. troglodytes
ttattttgaagtatgt

SEQ ID NO: 282194 - DNA, 16 bp, P. troglodytes
ttattttgagacaagg

SEQ ID NO: 282195 - DNA, 16 bp, P. troglodytes
ttattttgcagaaata

SEQ ID NO: 282196 - DNA, 16 bp, P. troglodytes
ttattttgcagatgaa

SEQ ID NO: 282197 - DNA, 16 bp, P. troglodytes
ttattttgccaaggtt

SEQ ID NO: 282198 - DNA, 16 bp, P. troglodytes
ttattttgcttaatgt

SEQ ID NO: 282199 - DNA, 16 bp, P. troglodytes
ttattttggaaaaaat

SEQ ID NO: 282200 - DNA, 16 bp, P. troglodytes
ttattttggaaagaaa

SEQ ID NO: 282201 - DNA, 16 bp, P. troglodytes
ttattttggaaagttt

SEQ ID NO: 282202 - DNA, 16 bp, P. troglodytes
ttattttgggttcagg

SEQ ID NO: 282203 - DNA, 16 bp, P. troglodytes
ttattttggtaaaaat

SEQ ID NO: 282204 - DNA, 16 bp, P. troglodytes
ttattttgtaaaaaca

SEQ ID NO: 282205 - DNA, 16 bp, P. troglodytes
ttattttgtcacccaa

SEQ ID NO: 282206 - DNA, 16 bp, P. troglodytes
ttatttttaaacagaa

SEQ ID NO: 282207 - DNA, 16 bp, P. troglodytes
ttatttttaaaggaag

SEQ ID NO: 282208 - DNA, 16 bp, P. troglodytes
ttatttttaaatgcta

SEQ ID NO: 282209 - DNA, 16 bp, P. troglodytes
ttatttttaatgcagt

SEQ ID NO: 282210 - DNA, 16 bp, P. troglodytes
ttatttttaattactg

SEQ ID NO: 282211 - DNA, 16 bp, P. troglodytes
ttatttttagagacag

SEQ ID NO: 282212 - DNA, 16 bp, P. troglodytes
ttatttttagcaaaat

SEQ ID NO: 282213 - DNA, 16 bp, P. troglodytes
ttatttttagtagaga

SEQ ID NO: 282214 - DNA, 16 bp, P. troglodytes
ttatttttatatacag

SEQ ID NO: 282215 - DNA, 16 bp, P. troglodytes
ttatttttatatgcat

SEQ ID NO: 282216 - DNA, 16 bp, P. troglodytes
ttatttttatgacaat

SEQ ID NO: 282217 - DNA, 16 bp, P. troglodytes
ttatttttatgccatt

SEQ ID NO: 282218 - DNA, 16 bp, P. troglodytes
ttatttttatggcaat

SEQ ID NO: 282219 - DNA, 16 bp, P. troglodytes
ttatttttatggctga

SEQ ID NO: 282220 - DNA, 16 bp, P. troglodytes
ttatttttcaaaaaga

SEQ ID NO: 282221 - DNA, 16 bp, P. troglodytes
ttatttttcaaagaaa

SEQ ID NO: 282222 - DNA, 16 bp, P. troglodytes
ttatttttcaaatgaa

SEQ ID NO: 282223 - DNA, 16 bp, P. troglodytes
ttatttttcacaattc

SEQ ID NO: 282224 - DNA, 16 bp, P. troglodytes
ttatttttcagatatt

SEQ ID NO: 282225 - DNA, 16 bp, P. troglodytes
ttatttttcagatgga

SEQ ID NO: 282226 - DNA, 16 bp, P. troglodytes
ttatttttcagattat

SEQ ID NO: 282227 - DNA, 16 bp, P. troglodytes
ttatttttcatataga

SEQ ID NO: 282228 - DNA, 16 bp, P. troglodytes
ttatttttcatgaaaa

SEQ ID NO: 282229 - DNA, 16 bp, P. troglodytes
ttatttttctctgtag

SEQ ID NO: 282230 - DNA, 16 bp, P. troglodytes
ttatttttctgaaaaa

SEQ ID NO: 282231 - DNA, 16 bp, P. troglodytes
ttatttttctgtaaaa

SEQ ID NO: 282232 - DNA, 16 bp, P. troglodytes
ttatttttctgtaaat

SEQ ID NO: 282233 - DNA, 16 bp, P. troglodytes
ttatttttcttccaaa

SEQ ID NO: 282234 - DNA, 16 bp, P. troglodytes
ttatttttgaaaatct

SEQ ID NO: 282235 - DNA, 16 bp, P. troglodytes
ttatttttgagatggg

SEQ ID NO: 282236 - DNA, 16 bp, P. troglodytes
ttatttttgagatgta

SEQ ID NO: 282237 - DNA, 16 bp, P. troglodytes
ttatttttgcatttca

SEQ ID NO: 282238 - DNA, 16 bp, P. troglodytes
ttatttttgccaattt

SEQ ID NO: 282239 - DNA, 16 bp, P. troglodytes
ttatttttggtagaga

SEQ ID NO: 282240 - DNA, 16 bp, P. troglodytes
ttatttttgtacagat

SEQ ID NO: 282241 - DNA, 16 bp, P. troglodytes
ttatttttgtgagaca

SEQ ID NO: 282242 - DNA, 16 bp, P. troglodytes
ttattttttaaaggaa

SEQ ID NO: 282243 - DNA, 16 bp, P. troglodytes
ttattttttaagagaa

SEQ ID NO: 282244 - DNA, 16 bp, P. troglodytes
ttattttttctaaaga

SEQ ID NO: 282245 - DNA, 16 bp, P. troglodytes
ttattttttgagacaa

SEQ ID NO: 282246 - DNA, 16 bp, P. troglodytes
ttattttttgagacgg

SEQ ID NO: 282247 - DNA, 16 bp, P. troglodytes
ttatttttttcccaag

SEQ ID NO: 282248 - DNA, 16 bp, P. troglodytes
ttcaaaaaaactgaaa

SEQ ID NO: 282249 - DNA, 16 bp, P. troglodytes
ttcaaaaaaatcaatg

SEQ ID NO: 282250 - DNA, 16 bp, P. troglodytes
ttcaaaaaaattgaaa

SEQ ID NO: 282251 - DNA, 16 bp, P. troglodytes
ttcaaaaaacagaaat

SEQ ID NO: 282252 - DNA, 16 bp, P. troglodytes
ttcaaaaaagaaagga

SEQ ID NO: 282253 - DNA, 16 bp, P. troglodytes
ttcaaaaaagaaatta

SEQ ID NO: 282254 - DNA, 16 bp, P. troglodytes
ttcaaaaaagacaaag

SEQ ID NO: 282255 - DNA, 16 bp, P. troglodytes
ttcaaaaaataaatga

SEQ ID NO: 282256 - DNA, 16 bp, P. troglodytes
ttcaaaaaatgtttat

SEQ ID NO: 282257 - DNA, 16 bp, P. troglodytes
ttcaaaaaatgttttt

SEQ ID NO: 282258 - DNA, 16 bp, P. troglodytes
ttcaaaaacaggaaaa

SEQ ID NO: 282259 - DNA, 16 bp, P. troglodytes
ttcaaaaactattttt

SEQ ID NO: 282260 - DNA, 16 bp, P. troglodytes
ttcaaaaagaaaagga

SEQ ID NO: 282261 - DNA, 16 bp, P. troglodytes
ttcaaaaagaggaaaa

SEQ ID NO: 282262 - DNA, 16 bp, P. troglodytes
ttcaaaaataaagaag

SEQ ID NO: 282263 - DNA, 16 bp, P. troglodytes
ttcaaaaataaggaaa

SEQ ID NO: 282264 - DNA, 16 bp, P. troglodytes
ttcaaaaatatattca

SEQ ID NO: 282265 - DNA, 16 bp, P. troglodytes
ttcaaaaatatttact

SEQ ID NO: 282266 - DNA, 16 bp, P. troglodytes
ttcaaaaatatttttg

SEQ ID NO: 282267 - DNA, 16 bp, P. troglodytes
ttcaaaaatgaaatat

SEQ ID NO: 282268 - DNA, 16 bp, P. troglodytes
ttcaaaaatgaagaca

SEQ ID NO: 282269 - DNA, 16 bp, P. troglodytes
ttcaaaaatgttttca

SEQ ID NO: 282270 - DNA, 16 bp, P. troglodytes
ttcaaaacaattttat

SEQ ID NO: 282271 - DNA, 16 bp, P. troglodytes
ttcaaaacaccaagaa

SEQ ID NO: 282272 - DNA, 16 bp, P. troglodytes
ttcaaaaccaagcaaa

SEQ ID NO: 282273 - DNA, 16 bp, P. troglodytes
ttcaaaacttactgca

SEQ ID NO: 282274 - DNA, 16 bp, P. troglodytes
ttcaaaacttactgta

SEQ ID NO: 282275 - DNA, 16 bp, P. troglodytes
ttcaaaactttttaaa

SEQ ID NO: 282276 - DNA, 16 bp, P. troglodytes
ttcaaaagaaaaatga

SEQ ID NO: 282277 - DNA, 16 bp, P. troglodytes
ttcaaaagaaaacatt

SEQ ID NO: 282278 - DNA, 16 bp, P. troglodytes
ttcaaaagaaaatatt

SEQ ID NO: 282279 - DNA, 16 bp, P. troglodytes
ttcaaaagatcaatga

SEQ ID NO: 282280 - DNA, 16 bp, P. troglodytes
ttcaaaagcaaaatta

SEQ ID NO: 282281 - DNA, 16 bp, P. troglodytes
ttcaaaagcaattcaa

SEQ ID NO: 282282 - DNA, 16 bp, P. troglodytes
ttcaaaaggaaaacaa

SEQ ID NO: 282283 - DNA, 16 bp, P. troglodytes
ttcaaaaggaaggaaa

SEQ ID NO: 282284 - DNA, 16 bp, P. troglodytes
ttcaaaagttgaacga

SEQ ID NO: 282285 - DNA, 16 bp, P. troglodytes
ttcaaaataaaaagtt

SEQ ID NO: 282286 - DNA, 16 bp, P. troglodytes
ttcaaaataaaagtaa

SEQ ID NO: 282287 - DNA, 16 bp, P. troglodytes
ttcaaaataaaagttt

SEQ ID NO: 282288 - DNA, 16 bp, P. troglodytes
ttcaaaatacattttt

SEQ ID NO: 282289 - DNA, 16 bp, P. troglodytes
ttcaaaatataaaatg

SEQ ID NO: 282290 - DNA, 16 bp, P. troglodytes
ttcaaaatatgttttt

SEQ ID NO: 282291 - DNA, 16 bp, P. troglodytes
ttcaaaatattatttc

SEQ ID NO: 282292 - DNA, 16 bp, P. troglodytes
ttcaaaatatttccaa

SEQ ID NO: 282293 - DNA, 16 bp, P. troglodytes
ttcaaaatcaatcatg

SEQ ID NO: 282294 - DNA, 16 bp, P. troglodytes
ttcaaaatctgaaact

SEQ ID NO: 282295 - DNA, 16 bp, P. troglodytes
ttcaaaatgaaaatag

SEQ ID NO: 282296 - DNA, 16 bp, P. troglodytes
ttcaaaatgaaataat

SEQ ID NO: 282297 - DNA, 16 bp, P. troglodytes
ttcaaaatgagagaaa

SEQ ID NO: 282298 - DNA, 16 bp, P. troglodytes
ttcaaaatgcagattc

SEQ ID NO: 282299 - DNA, 16 bp, P. troglodytes
ttcaaaatgtataaaa

SEQ ID NO: 282300 - DNA, 16 bp, P. troglodytes
ttcaaaatgtattaat

SEQ ID NO: 282301 - DNA, 16 bp, P. troglodytes
ttcaaaatgtattata

SEQ ID NO: 282302 - DNA, 16 bp, P. troglodytes
ttcaaaatgtttattt

SEQ ID NO: 282303 - DNA, 16 bp, P. troglodytes
ttcaaaatgttttctt

SEQ ID NO: 282304 - DNA, 16 bp, P. troglodytes
ttcaaaatgttttttt

SEQ ID NO: 282305 - DNA, 16 bp, P. troglodytes
ttcaaaattaaagaaa

SEQ ID NO: 282306 - DNA, 16 bp, P. troglodytes
ttcaaaattaaagtca

SEQ ID NO: 282307 - DNA, 16 bp, P. troglodytes
ttcaaaattaatgaaa

SEQ ID NO: 282308 - DNA, 16 bp, P. troglodytes
ttcaaaattatctcct

SEQ ID NO: 282309 - DNA, 16 bp, P. troglodytes
ttcaaaattcaaaagg

SEQ ID NO: 282310 - DNA, 16 bp, P. troglodytes
ttcaaaattgttttaa

SEQ ID NO: 282311 - DNA, 16 bp, P. troglodytes
ttcaaaatttaaagaa

SEQ ID NO: 282312 - DNA, 16 bp, P. troglodytes
ttcaaaatttcaattt

SEQ ID NO: 282313 - DNA, 16 bp, P. troglodytes
ttcaaaatttgaagta

SEQ ID NO: 282314 - DNA, 16 bp, P. troglodytes
ttcaaacaattctctg

SEQ ID NO: 282315 - DNA, 16 bp, P. troglodytes
ttcaaacagaaagaaa

SEQ ID NO: 282316 - DNA, 16 bp, P. troglodytes
ttcaaacatacagaaa

SEQ ID NO: 282317 - DNA, 16 bp, P. troglodytes
ttcaaacccaggcaat

SEQ ID NO: 282318 - DNA, 16 bp, P. troglodytes
ttcaaacctgtgttgt

SEQ ID NO: 282319 - DNA, 16 bp, P. troglodytes
ttcaaacgattctcct

SEQ ID NO: 282320 - DNA, 16 bp, P. troglodytes
ttcaaactatactaaa

SEQ ID NO: 282321 - DNA, 16 bp, P. troglodytes
ttcaaactcctggcct

SEQ ID NO: 282322 - DNA, 16 bp, P. troglodytes
ttcaaactggtgtgag

SEQ ID NO: 282323 - DNA, 16 bp, P. troglodytes
ttcaaactgttacaaa

SEQ ID NO: 282324 - DNA, 16 bp, P. troglodytes
ttcaaactttccttct

SEQ ID NO: 282325 - DNA, 16 bp, P. troglodytes
ttcaaagaaaaatgtt

SEQ ID NO: 282326 - DNA, 16 bp, P. troglodytes
ttcaaagaaaacagaa

SEQ ID NO: 282327 - DNA, 16 bp, P. troglodytes
ttcaaagaacaggctg

SEQ ID NO: 282328 - DNA, 16 bp, P. troglodytes
ttcaaagaacatattt

SEQ ID NO: 282329 - DNA, 16 bp, P. troglodytes
ttcaaagaaccaattt

SEQ ID NO: 282330 - DNA, 16 bp, P. troglodytes
ttcaaagaacttcttt

SEQ ID NO: 282331 - DNA, 16 bp, P. troglodytes
ttcaaagaattctcct

SEQ ID NO: 282332 - DNA, 16 bp, P. troglodytes
ttcaaagaggttaaat

SEQ ID NO: 282333 - DNA, 16 bp, P. troglodytes
ttcaaagatacaaata

SEQ ID NO: 282334 - DNA, 16 bp, P. troglodytes
ttcaaagcaaaaataa

SEQ ID NO: 282335 - DNA, 16 bp, P. troglodytes
ttcaaagcagtgtgtg

SEQ ID NO: 282336 - DNA, 16 bp, P. troglodytes
ttcaaagccaaattct

SEQ ID NO: 282337 - DNA, 16 bp, P. troglodytes
ttcaaagccatcctga

SEQ ID NO: 282338 - DNA, 16 bp, P. troglodytes
ttcaaaggaaaaaaga

SEQ ID NO: 282339 - DNA, 16 bp, P. troglodytes
ttcaaaggaaaacaaa

SEQ ID NO: 282340 - DNA, 16 bp, P. troglodytes
ttcaaaggacatgaac

SEQ ID NO: 282341 - DNA, 16 bp, P. troglodytes
ttcaaagttgcagtga

SEQ ID NO: 282342 - DNA, 16 bp, P. troglodytes
ttcaaagtttaaaata

SEQ ID NO: 282343 - DNA, 16 bp, P. troglodytes
ttcaaataaaaaatga

SEQ ID NO: 282344 - DNA, 16 bp, P. troglodytes
ttcaaataaggaagag

SEQ ID NO: 282345 - DNA, 16 bp, P. troglodytes
ttcaaatacaggaaat

SEQ ID NO: 282346 - DNA, 16 bp, P. troglodytes
ttcaaatatacaaaga

SEQ ID NO: 282347 - DNA, 16 bp, P. troglodytes
ttcaaatatgtaattt

SEQ ID NO: 282348 - DNA, 16 bp, P. troglodytes
ttcaaatattctttca

SEQ ID NO: 282349 - DNA, 16 bp, P. troglodytes
ttcaaatatttcaaaa

SEQ ID NO: 282350 - DNA, 16 bp, P. troglodytes
ttcaaatccaggaaat

SEQ ID NO: 282351 - DNA, 16 bp, P. troglodytes
ttcaaatcccagctct

SEQ ID NO: 282352 - DNA, 16 bp, P. troglodytes
ttcaaatcctagctct

SEQ ID NO: 282353 - DNA, 16 bp, P. troglodytes
ttcaaatcctggctct

SEQ ID NO: 282354 - DNA, 16 bp, P. troglodytes
ttcaaatcttgcctct

SEQ ID NO: 282355 - DNA, 16 bp, P. troglodytes
ttcaaatgaaaagaaa

SEQ ID NO: 282356 - DNA, 16 bp, P. troglodytes
ttcaaatgaaaggaag

SEQ ID NO: 282357 - DNA, 16 bp, P. troglodytes
ttcaaatgcaaaaaaa

SEQ ID NO: 282358 - DNA, 16 bp, P. troglodytes
ttcaaatgtaaatttt

SEQ ID NO: 282359 - DNA, 16 bp, P. troglodytes
ttcaaatgtttcttct

SEQ ID NO: 282360 - DNA, 16 bp, P. troglodytes
ttcaaattaaagaaaa

SEQ ID NO: 282361 - DNA, 16 bp, P. troglodytes
ttcaaattagaaaaaa

SEQ ID NO: 282362 - DNA, 16 bp, P. troglodytes
ttcaaattatatgaca

SEQ ID NO: 282363 - DNA, 16 bp, P. troglodytes
ttcaaattcaggaaaa

SEQ ID NO: 282364 - DNA, 16 bp, P. troglodytes
ttcaaattccacctct

SEQ ID NO: 282365 - DNA, 16 bp, P. troglodytes
ttcaaattctgatttt

SEQ ID NO: 282366 - DNA, 16 bp, P. troglodytes
ttcaaattctggagaa

SEQ ID NO: 282367 - DNA, 16 bp, P. troglodytes
ttcaaattctggttct

SEQ ID NO: 282368 - DNA, 16 bp, P. troglodytes
ttcaaatttaactgag

SEQ ID NO: 282369 - DNA, 16 bp, P. troglodytes
ttcaaatttgatgaaa

SEQ ID NO: 282370 - DNA, 16 bp, P. troglodytes
ttcaaattttagtgtc

SEQ ID NO: 282371 - DNA, 16 bp, P. troglodytes
ttcaaattttatcatg

SEQ ID NO: 282372 - DNA, 16 bp, P. troglodytes
ttcaaatttttttctg

SEQ ID NO: 282373 - DNA, 16 bp, P. troglodytes
ttcaacaaaaagagct

SEQ ID NO: 282374 - DNA, 16 bp, P. troglodytes
ttcaacaaaaatttac

SEQ ID NO: 282375 - DNA, 16 bp, P. troglodytes
ttcaacaaacggtgct

SEQ ID NO: 282376 - DNA, 16 bp, P. troglodytes
ttcaacaaagaagata

SEQ ID NO: 282377 - DNA, 16 bp, P. troglodytes
ttcaacaaagatttat

SEQ ID NO: 282378 - DNA, 16 bp, P. troglodytes
ttcaacaaagtctcag

SEQ ID NO: 282379 - DNA, 16 bp, P. troglodytes
ttcaacaaataatgct

SEQ ID NO: 282380 - DNA, 16 bp, P. troglodytes
ttcaacaaatagtatt

SEQ ID NO: 282381 - DNA, 16 bp, P. troglodytes
ttcaacaaatattgtt

SEQ ID NO: 282382 - DNA, 16 bp, P. troglodytes
ttcaacaaatgatgct

SEQ ID NO: 282383 - DNA, 16 bp, P. troglodytes
ttcaacaaatgatgtt

SEQ ID NO: 282384 - DNA, 16 bp, P. troglodytes
ttcaacaaccagctct

SEQ ID NO: 282385 - DNA, 16 bp, P. troglodytes
ttcaacaatatttatt

SEQ ID NO: 282386 - DNA, 16 bp, P. troglodytes
ttcaacaattatttct

SEQ ID NO: 282387 - DNA, 16 bp, P. troglodytes
ttcaacacttcattat

SEQ ID NO: 282388 - DNA, 16 bp, P. troglodytes
ttcaacagctttattg

SEQ ID NO: 282389 - DNA, 16 bp, P. troglodytes
ttcaacagtgttttgt

SEQ ID NO: 282390 - DNA, 16 bp, P. troglodytes
ttcaacataaaatttg

SEQ ID NO: 282391 - DNA, 16 bp, P. troglodytes
ttcaacatacaaattt

SEQ ID NO: 282392 - DNA, 16 bp, P. troglodytes
ttcaacatagttttgg

SEQ ID NO: 282393 - DNA, 16 bp, P. troglodytes
ttcaacatatgaattt

SEQ ID NO: 282394 - DNA, 16 bp, P. troglodytes
ttcaacatgaatttta

SEQ ID NO: 282395 - DNA, 16 bp, P. troglodytes
ttcaacatgagatttg

SEQ ID NO: 282396 - DNA, 16 bp, P. troglodytes
ttcaacatgtaaccaa

SEQ ID NO: 282397 - DNA, 16 bp, P. troglodytes
ttcaacatgtgaattt

SEQ ID NO: 282398 - DNA, 16 bp, P. troglodytes
ttcaacattttaaaaa

SEQ ID NO: 282399 - DNA, 16 bp, P. troglodytes
ttcaacatttttaaag

SEQ ID NO: 282400 - DNA, 16 bp, P. troglodytes
ttcaaccaactgtgga

SEQ ID NO: 282401 - DNA, 16 bp, P. troglodytes
ttcaaccacagactga

SEQ ID NO: 282402 - DNA, 18 bp, P. troglodytes
ttcaaccattgtggaaga

SEQ ID NO: 282403 - DNA, 16 bp, P. troglodytes
ttcaacctctctgagc

SEQ ID NO: 282404 - DNA, 16 bp, P. troglodytes
ttcaacctcttcctgg

SEQ ID NO: 282405 - DNA, 16 bp, P. troglodytes
ttcaacgtatgaattt

SEQ ID NO: 282406 - DNA, 16 bp, P. troglodytes
ttcaactatgtggtca

SEQ ID NO: 282407 - DNA, 16 bp, P. troglodytes
ttcaactcacagagtt

SEQ ID NO: 282408 - DNA, 16 bp, P. troglodytes
ttcaactcctggcttc

SEQ ID NO: 282409 - DNA, 16 bp, P. troglodytes
ttcaactgggctctct

SEQ ID NO: 282410 - DNA, 16 bp, P. troglodytes
ttcaacttctttgcct

SEQ ID NO: 282411 - DNA, 16 bp, P. troglodytes
ttcaactttggagaat

SEQ ID NO: 282412 - DNA, 16 bp, P. troglodytes
ttcaacttttaaaaac

SEQ ID NO: 282413 - DNA, 16 bp, P. troglodytes
ttcaactttttaaaaa

SEQ ID NO: 282414 - DNA, 16 bp, P. troglodytes
ttcaactttttattgt

SEQ ID NO: 282415 - DNA, 16 bp, P. troglodytes
ttcaagaaaacacaga

SEQ ID NO: 282416 - DNA, 16 bp, P. troglodytes
ttcaagaaaagaattt

SEQ ID NO: 282417 - DNA, 16 bp, P. troglodytes
ttcaagaaaatgtctg

SEQ ID NO: 282418 - DNA, 16 bp, P. troglodytes
ttcaagaaaattaaat

SEQ ID NO: 282419 - DNA, 16 bp, P. troglodytes
ttcaagaaaatttaaa

SEQ ID NO: 282420 - DNA, 16 bp, P. troglodytes
ttcaagaaagaaataa

SEQ ID NO: 282421 - DNA, 16 bp, P. troglodytes
ttcaagaaatgcagag

SEQ ID NO: 282422 - DNA, 16 bp, P. troglodytes
ttcaagaaatggtgtt

SEQ ID NO: 282423 - DNA, 16 bp, P. troglodytes
ttcaagaaatgttttt

SEQ ID NO: 282424 - DNA, 16 bp, P. troglodytes
ttcaagaacaacctgg

SEQ ID NO: 282425 - DNA, 16 bp, P. troglodytes
ttcaagaacaggcaaa

SEQ ID NO: 282426 - DNA, 16 bp, P. troglodytes
ttcaagaacatcctgg

SEQ ID NO: 282427 - DNA, 16 bp, P. troglodytes
ttcaagaactagaaaa

SEQ ID NO: 282428 - DNA, 16 bp, P. troglodytes
ttcaagaagaaaaata

SEQ ID NO: 282429 - DNA, 16 bp, P. troglodytes
ttcaagaagaaagaaa

SEQ ID NO: 282430 - DNA, 16 bp, P. troglodytes
ttcaagaatgaagctg

SEQ ID NO: 282431 - DNA, 16 bp, P. troglodytes
ttcaagacaaaaacca

SEQ ID NO: 282432 - DNA, 16 bp, P. troglodytes
ttcaagacagtgacag

SEQ ID NO: 282433 - DNA, 16 bp, P. troglodytes
ttcaagaccaccatgg

SEQ ID NO: 282434 - DNA, 16 bp, P. troglodytes
ttcaagaccagccagc

SEQ ID NO: 282435 - DNA, 16 bp, P. troglodytes
ttcaagaccagcctgt

SEQ ID NO: 282436 - DNA, 16 bp, P. troglodytes
ttcaagaccatcctgg

SEQ ID NO: 282437 - DNA, 16 bp, P. troglodytes
ttcaagacccgcctgg

SEQ ID NO: 282438 - DNA, 16 bp, P. troglodytes
ttcaagactagcctgg

SEQ ID NO: 282439 - DNA, 16 bp, P. troglodytes
ttcaagagactcactt

SEQ ID NO: 282440 - DNA, 16 bp, P. troglodytes
ttcaagagcaacctgg

SEQ ID NO: 282441 - DNA, 16 bp, P. troglodytes
ttcaagaggccaaaga

SEQ ID NO: 282442 - DNA, 16 bp, P. troglodytes
ttcaagatatattttt

SEQ ID NO: 282443 - DNA, 16 bp, P. troglodytes
ttcaagatgagagttg

SEQ ID NO: 282444 - DNA, 16 bp, P. troglodytes
ttcaagatgagatttg

SEQ ID NO: 282445 - DNA, 16 bp, P. troglodytes
ttcaagatgagcctgg

SEQ ID NO: 282446 - DNA, 16 bp, P. troglodytes
ttcaagatgtgacttg

SEQ ID NO: 282447 - DNA, 16 bp, P. troglodytes
ttcaagattagcctgg

SEQ ID NO: 282448 - DNA, 16 bp, P. troglodytes
ttcaagattttctttt

SEQ ID NO: 282449 - DNA, 16 bp, P. troglodytes
ttcaagatttttcttt

SEQ ID NO: 282450 - DNA, 16 bp, P. troglodytes
ttcaagcaaatctcct

SEQ ID NO: 282451 - DNA, 16 bp, P. troglodytes
ttcaagcaatcctccc

SEQ ID NO: 282452 - DNA, 18 bp, P. troglodytes
ttcaagcaatcctcctgt

SEQ ID NO: 282453 - DNA, 16 bp, P. troglodytes
ttcaagcagaaggaag

SEQ ID NO: 282454 - DNA, 16 bp, P. troglodytes
ttcaagccagctgcaa

SEQ ID NO: 282455 - DNA, 16 bp, P. troglodytes
ttcaagcgattctgcc

SEQ ID NO: 282456 - DNA, 16 bp, P. troglodytes
ttcaagctccacctcc

SEQ ID NO: 282457 - DNA, 16 bp, P. troglodytes
ttcaagctctgctaag

SEQ ID NO: 282458 - DNA, 16 bp, P. troglodytes
ttcaagctgaaagaaa

SEQ ID NO: 282459 - DNA, 16 bp, P. troglodytes
ttcaaggaaaacaact

SEQ ID NO: 282460 - DNA, 16 bp, P. troglodytes
ttcaaggaaaagaaaa

SEQ ID NO: 282461 - DNA, 16 bp, P. troglodytes
ttcaaggccagccagg

SEQ ID NO: 282462 - DNA, 16 bp, P. troglodytes
ttcaaggctgtggtga

SEQ ID NO: 282463 - DNA, 16 bp, P. troglodytes
ttcaagggaaaaaaaa

SEQ ID NO: 282464 - DNA, 16 bp, P. troglodytes
ttcaaggtggcagtga

SEQ ID NO: 282465 - DNA, 16 bp, P. troglodytes
ttcaaggttcctccat

SEQ ID NO: 282466 - DNA, 16 bp, P. troglodytes
ttcaaggttcttccat

SEQ ID NO: 282467 - DNA, 16 bp, P. troglodytes
ttcaaggttgcagtga

SEQ ID NO: 282468 - DNA, 16 bp, P. troglodytes
ttcaagtaaaaatgat

SEQ ID NO: 282469 - DNA, 16 bp, P. troglodytes
ttcaagtattccatta

SEQ ID NO: 282470 - DNA, 16 bp, P. troglodytes
ttcaagtatttttaaa

SEQ ID NO: 282471 - DNA, 16 bp, P. troglodytes
ttcaagtattttttct

SEQ ID NO: 282472 - DNA, 16 bp, P. troglodytes
ttcaagtctctgcttt

SEQ ID NO: 282473 - DNA, 16 bp, P. troglodytes
ttcaagtcttattatt

SEQ ID NO: 282474 - DNA, 16 bp, P. troglodytes
ttcaagtgatccgccc

SEQ ID NO: 282475 - DNA, 16 bp, P. troglodytes
ttcaagtgtttcttct

SEQ ID NO: 282476 - DNA, 16 bp, P. troglodytes
ttcaagttattcttct

SEQ ID NO: 282477 - DNA, 16 bp, P. troglodytes
ttcaagtttaaaaaat

SEQ ID NO: 282478 - DNA, 16 bp, P. troglodytes
ttcaataaaagttgct

SEQ ID NO: 282479 - DNA, 16 bp, P. troglodytes
ttcaataaaattgttt

SEQ ID NO: 282480 - DNA, 16 bp, P. troglodytes
ttcaataaacatatgt

SEQ ID NO: 282481 - DNA, 16 bp, P. troglodytes
ttcaataaacctcttt

SEQ ID NO: 282482 - DNA, 16 bp, P. troglodytes
ttcaataaagttgatt

SEQ ID NO: 282483 - DNA, 16 bp, P. troglodytes
ttcaataaatattgat

SEQ ID NO: 282484 - DNA, 16 bp, P. troglodytes
ttcaataagtggtgtt

SEQ ID NO: 282485 - DNA, 16 bp, P. troglodytes
ttcaatacagtattca

SEQ ID NO: 282486 - DNA, 16 bp, P. troglodytes
ttcaatattatgttgg

SEQ ID NO: 282487 - DNA, 16 bp, P. troglodytes
ttcaatgaaaagaaaa

SEQ ID NO: 282488 - DNA, 16 bp, P. troglodytes
ttcaatgaaataaaag

SEQ ID NO: 282489 - DNA, 16 bp, P. troglodytes
ttcaatgaagaaagaa

SEQ ID NO: 282490 - DNA, 16 bp, P. troglodytes
ttcaatgaagaaagga

SEQ ID NO: 282491 - DNA, 16 bp, P. troglodytes
ttcaatgaagaatgga

SEQ ID NO: 282492 - DNA, 16 bp, P. troglodytes
ttcaatgagctgagat

SEQ ID NO: 282493 - DNA, 16 bp, P. troglodytes
ttcaatgccatcccaa

SEQ ID NO: 282494 - DNA, 16 bp, P. troglodytes
ttcaatgccatgccca

SEQ ID NO: 282495 - DNA, 16 bp, P. troglodytes
ttcaatgctgcagtga

SEQ ID NO: 282496 - DNA, 16 bp, P. troglodytes
ttcaatggaatattat

SEQ ID NO: 282497 - DNA, 16 bp, P. troglodytes
ttcaatggcttcccat

SEQ ID NO: 282498 - DNA, 16 bp, P. troglodytes
ttcaatggggaaagga

SEQ ID NO: 282499 - DNA, 16 bp, P. troglodytes
ttcaatgtagataaaa

SEQ ID NO: 282500 - DNA, 16 bp, P. troglodytes
ttcaatgtatcttttt

SEQ ID NO: 282501 - DNA, 16 bp, P. troglodytes
ttcaatgtatttttta

SEQ ID NO: 282502 - DNA, 16 bp, P. troglodytes
ttcaatgtcatcccca

SEQ ID NO: 282503 - DNA, 16 bp, P. troglodytes
ttcaatgtttctttgt

SEQ ID NO: 282504 - DNA, 16 bp, P. troglodytes
ttcaattaatgctgaa

SEQ ID NO: 282505 - DNA, 16 bp, P. troglodytes
ttcaattaggaaaaca

SEQ ID NO: 282506 - DNA, 16 bp, P. troglodytes
ttcaattctagaattt

SEQ ID NO: 282507 - DNA, 16 bp, P. troglodytes
ttcaatttgcattttc

SEQ ID NO: 282508 - DNA, 16 bp, P. troglodytes
ttcaatttggaaaaaa

SEQ ID NO: 282509 - DNA, 16 bp, P. troglodytes
ttcaatttgtaaaata

SEQ ID NO: 282510 - DNA, 16 bp, P. troglodytes
ttcaatttgtaagaaa

SEQ ID NO: 282511 - DNA, 16 bp, P. troglodytes
ttcaattttgctgtga

SEQ ID NO: 282512 - DNA, 16 bp, P. troglodytes
ttcaatttttttgaaa

SEQ ID NO: 282513 - DNA, 16 bp, P. troglodytes
ttcaattttttttgaa

SEQ ID NO: 282514 - DNA, 16 bp, P. troglodytes
ttcacaaaaaggaaga

SEQ ID NO: 282515 - DNA, 16 bp, P. troglodytes
ttcacaaaagaggaaa

SEQ ID NO: 282516 - DNA, 16 bp, P. troglodytes
ttcacaaaatattttt

SEQ ID NO: 282517 - DNA, 16 bp, P. troglodytes
ttcacaaagcctaaaa

SEQ ID NO: 282518 - DNA, 16 bp, P. troglodytes
ttcacaaatgctacaa

SEQ ID NO: 282519 - DNA, 16 bp, P. troglodytes
ttcacaaggaggcagg

SEQ ID NO: 282520 - DNA, 16 bp, P. troglodytes
ttcacaaggtcaggag

SEQ ID NO: 282521 - DNA, 16 bp, P. troglodytes
ttcacaataaatattt

SEQ ID NO: 282522 - DNA, 16 bp, P. troglodytes
ttcacaatagcaaaga

SEQ ID NO: 282523 - DNA, 16 bp, P. troglodytes
ttcacaatattcattc

SEQ ID NO: 282524 - DNA, 16 bp, P. troglodytes
ttcacaatattttaaa

SEQ ID NO: 282525 - DNA, 17 bp, P. troglodytes
ttcacaatgttgattct

SEQ ID NO: 282526 - DNA, 16 bp, P. troglodytes
ttcacaattgctacaa

SEQ ID NO: 282527 - DNA, 16 bp, P. troglodytes
ttcacacatatataca

SEQ ID NO: 282528 - DNA, 16 bp, P. troglodytes
ttcacacctgtaatcc

SEQ ID NO: 282529 - DNA, 16 bp, P. troglodytes
ttcacacctgtagtcc

SEQ ID NO: 282530 - DNA, 16 bp, P. troglodytes
ttcacaccttatttca

SEQ ID NO: 282531 - DNA, 16 bp, P. troglodytes
ttcacagaaaaagttt

SEQ ID NO: 282532 - DNA, 16 bp, P. troglodytes
ttcacagaaaataaaa

SEQ ID NO: 282533 - DNA, 16 bp, P. troglodytes
ttcacagaagaagaaa

SEQ ID NO: 282534 - DNA, 17 bp, P. troglodytes
ttcacagaattagaaaa

SEQ ID NO: 282535 - DNA, 16 bp, P. troglodytes
ttcacagacaaggaaa

SEQ ID NO: 282536 - DNA, 16 bp, P. troglodytes
ttcacagaggaagaaa

SEQ ID NO: 282537 - DNA, 16 bp, P. troglodytes
ttcacagaggaagaga

SEQ ID NO: 282538 - DNA, 16 bp, P. troglodytes
ttcacagatgaagaaa

SEQ ID NO: 282539 - DNA, 16 bp, P. troglodytes
ttcacagatgaggaaa

SEQ ID NO: 282540 - DNA, 16 bp, P. troglodytes
ttcacagatttggaaa

SEQ ID NO: 282541 - DNA, 16 bp, P. troglodytes
ttcacagatttttttt

SEQ ID NO: 282542 - DNA, 16 bp, P. troglodytes
ttcacagcaaagaaaa

SEQ ID NO: 282543 - DNA, 16 bp, P. troglodytes
ttcacagcaacaccta

SEQ ID NO: 282544 - DNA, 16 bp, P. troglodytes
ttcacagcatttatca

SEQ ID NO: 282545 - DNA, 16 bp, P. troglodytes
ttcacagggacatgga

SEQ ID NO: 282546 - DNA, 16 bp, P. troglodytes
ttcacagggcggcagg

SEQ ID NO: 282547 - DNA, 16 bp, P. troglodytes
ttcacaggttccagga

SEQ ID NO: 282548 - DNA, 16 bp, P. troglodytes
ttcacatatatattca

SEQ ID NO: 282549 - DNA, 16 bp, P. troglodytes
ttcacatgaaaaaaaa

SEQ ID NO: 282550 - DNA, 16 bp, P. troglodytes
ttcacatgttttcact

SEQ ID NO: 282551 - DNA, 16 bp, P. troglodytes
ttcacattgttgtgca

SEQ ID NO: 282552 - DNA, 16 bp, P. troglodytes
ttcacatttctctgat

SEQ ID NO: 282553 - DNA, 16 bp, P. troglodytes
ttcacattttttaaaa

SEQ ID NO: 282554 - DNA, 16 bp, P. troglodytes
ttcaccaaaaaagata

SEQ ID NO: 282555 - DNA, 16 bp, P. troglodytes
ttcaccaaaagtaaaa

SEQ ID NO: 282556 - DNA, 16 bp, P. troglodytes
ttcaccacactggcca

SEQ ID NO: 282557 - DNA, 16 bp, P. troglodytes
ttcaccacatcctcac

SEQ ID NO: 282558 - DNA, 16 bp, P. troglodytes
ttcaccaccagcctgg

SEQ ID NO: 282559 - DNA, 16 bp, P. troglodytes
ttcaccaccttggcca

SEQ ID NO: 282560 - DNA, 18 bp, P. troglodytes
ttcaccacgctggccagg

SEQ ID NO: 282561 - DNA, 16 bp, P. troglodytes
ttcaccaggagtaaat

SEQ ID NO: 282562 - DNA, 16 bp, P. troglodytes
ttcaccaggctggtct

SEQ ID NO: 282563 - DNA, 16 bp, P. troglodytes
ttcaccagtaaagcca

SEQ ID NO: 282564 - DNA, 16 bp, P. troglodytes
ttcaccagtttttcta

SEQ ID NO: 282565 - DNA, 20 bp, P. troglodytes
ttcaccatgttagccagaat

SEQ ID NO: 282566 - DNA, 25 bp, P. troglodytes
ttcaccatgttggccaggatggtcc

SEQ ID NO: 282567 - DNA, 16 bp, P. troglodytes
ttcaccattttagcca

SEQ ID NO: 282568 - DNA, 16 bp, P. troglodytes
ttcacccaggatggag

SEQ ID NO: 282569 - DNA, 16 bp, P. troglodytes
ttcacccatttaaagt

SEQ ID NO: 282570 - DNA, 16 bp, P. troglodytes
ttcaccccattctcct

SEQ ID NO: 282571 - DNA, 17 bp, P. troglodytes
ttcacctcccaggttca

SEQ ID NO: 282572 - DNA, 16 bp, P. troglodytes
ttcacctccttggtta

SEQ ID NO: 282573 - DNA, 16 bp, P. troglodytes
ttcacctctctgaact

SEQ ID NO: 282574 - DNA, 16 bp, P. troglodytes
ttcacctgccttggtc

SEQ ID NO: 282575 - DNA, 16 bp, P. troglodytes
ttcacctgcttcagcc

SEQ ID NO: 282576 - DNA, 16 bp, P. troglodytes
ttcacctgcttcggcc

SEQ ID NO: 282577 - DNA, 16 bp, P. troglodytes
ttcacctgcttctttt

SEQ ID NO: 282578 - DNA, 16 bp, P. troglodytes
ttcacctgtttccttt

SEQ ID NO: 282579 - DNA, 17 bp, P. troglodytes
ttcaccttccaccatga

SEQ ID NO: 282580 - DNA, 16 bp, P. troglodytes
ttcaccttctaccatg

SEQ ID NO: 282581 - DNA, 16 bp, P. troglodytes
ttcaccttctgtcatg

SEQ ID NO: 282582 - DNA, 16 bp, P. troglodytes
ttcaccttcttggcca

SEQ ID NO: 282583 - DNA, 16 bp, P. troglodytes
ttcaccttgctcaccc

SEQ ID NO: 282584 - DNA, 16 bp, P. troglodytes
ttcacctttttaaaaa

SEQ ID NO: 282585 - DNA, 16 bp, P. troglodytes
ttcactaattttctct

SEQ ID NO: 282586 - DNA, 16 bp, P. troglodytes
ttcactatcatgagaa

SEQ ID NO: 282587 - DNA, 16 bp, P. troglodytes
ttcactatgtacagag

SEQ ID NO: 282588 - DNA, 20 bp, P. troglodytes
ttcactatgttggccaggct

SEQ ID NO: 282589 - DNA, 16 bp, P. troglodytes
ttcactcactcactca

SEQ ID NO: 282590 - DNA, 16 bp, P. troglodytes
ttcactcactcattca

SEQ ID NO: 282591 - DNA, 16 bp, P. troglodytes
ttcactcatcatttgg

SEQ ID NO: 282592 - DNA, 16 bp, P. troglodytes
ttcactccagcctggg

SEQ ID NO: 282593 - DNA, 21 bp, P. troglodytes
ttcactctgatggtagtttct

SEQ ID NO: 282594 - DNA, 16 bp, P. troglodytes
ttcactctgtcgccca

SEQ ID NO: 282595 - DNA, 16 bp, P. troglodytes
ttcactcttgctgccc

SEQ ID NO: 282596 - DNA, 16 bp, P. troglodytes
ttcactgaaaaaaaat

SEQ ID NO: 282597 - DNA, 16 bp, P. troglodytes
ttcactgaaacctccg

SEQ ID NO: 282598 - DNA, 16 bp, P. troglodytes
ttcactgaagaaaaat

SEQ ID NO: 282599 - DNA, 16 bp, P. troglodytes
ttcactgacttttttt

SEQ ID NO: 282600 - DNA, 16 bp, P. troglodytes
ttcactgagcacttac

SEQ ID NO: 282601 - DNA, 16 bp, P. troglodytes
ttcactgatttttaaa

SEQ ID NO: 282602 - DNA, 16 bp, P. troglodytes
ttcactgcagcctcaa

SEQ ID NO: 282603 - DNA, 16 bp, P. troglodytes
ttcactgccacctctg

SEQ ID NO: 282604 - DNA, 16 bp, P. troglodytes
ttcactgccctgaaaa

SEQ ID NO: 282605 - DNA, 16 bp, P. troglodytes
ttcactgctgtgtccc

SEQ ID NO: 282606 - DNA, 17 bp, P. troglodytes
ttcactgggcactcatt

SEQ ID NO: 282607 - DNA, 16 bp, P. troglodytes
ttcactgtcataattt

SEQ ID NO: 282608 - DNA, 16 bp, P. troglodytes
ttcactgtctcctgtg

SEQ ID NO: 282609 - DNA, 16 bp, P. troglodytes
ttcactgtcttatatg

SEQ ID NO: 282610 - DNA, 16 bp, P. troglodytes
ttcacttatgatgctt

SEQ ID NO: 282611 - DNA, 16 bp, P. troglodytes
ttcacttattctttca

SEQ ID NO: 282612 - DNA, 16 bp, P. troglodytes
ttcacttatttattca

SEQ ID NO: 282613 - DNA, 16 bp, P. troglodytes
ttcacttctttttaaa

SEQ ID NO: 282614 - DNA, 16 bp, P. troglodytes
ttcacttggctctcat

SEQ ID NO: 282615 - DNA, 16 bp, P. troglodytes
ttcactttaaaaataa

SEQ ID NO: 282616 - DNA, 16 bp, P. troglodytes
ttcactttaaatataa

SEQ ID NO: 282617 - DNA, 16 bp, P. troglodytes
ttcactttgcagatga

SEQ ID NO: 282618 - DNA, 16 bp, P. troglodytes
ttcactttgtgggtaa

SEQ ID NO: 282619 - DNA, 16 bp, P. troglodytes
ttcacttttaaaacaa

SEQ ID NO: 282620 - DNA, 16 bp, P. troglodytes
ttcactttttaaaatg

SEQ ID NO: 282621 - DNA, 16 bp, P. troglodytes
ttcacttttttaaaaa

SEQ ID NO: 282622 - DNA, 16 bp, P. troglodytes
ttcagaaaaaaattaa

SEQ ID NO: 282623 - DNA, 16 bp, P. troglodytes
ttcagaaaaagcaaat

SEQ ID NO: 282624 - DNA, 16 bp, P. troglodytes
ttcagaaaaataaaag

SEQ ID NO: 282625 - DNA, 16 bp, P. troglodytes
ttcagaaaaatcagat

SEQ ID NO: 282626 - DNA, 16 bp, P. troglodytes
ttcagaaaaattaact

SEQ ID NO: 282627 - DNA, 16 bp, P. troglodytes
ttcagaaaacaaagaa

SEQ ID NO: 282628 - DNA, 16 bp, P. troglodytes
ttcagaaaacagaaga

SEQ ID NO: 282629 - DNA, 16 bp, P. troglodytes
ttcagaaaactgaaac

SEQ ID NO: 282630 - DNA, 16 bp, P. troglodytes
ttcagaaaaggcaaat

SEQ ID NO: 282631 - DNA, 16 bp, P. troglodytes
ttcagaaaagttgaaa

SEQ ID NO: 282632 - DNA, 16 bp, P. troglodytes
ttcagaaaataaaaga

SEQ ID NO: 282633 - DNA, 16 bp, P. troglodytes
ttcagaaaataaattt

SEQ ID NO: 282634 - DNA, 16 bp, P. troglodytes
ttcagaaaatatatat

SEQ ID NO: 282635 - DNA, 16 bp, P. troglodytes
ttcagaaaatatttat

SEQ ID NO: 282636 - DNA, 16 bp, P. troglodytes
ttcagaaaatatttgt

SEQ ID NO: 282637 - DNA, 16 bp, P. troglodytes
ttcagaaaatattttc

SEQ ID NO: 282638 - DNA, 16 bp, P. troglodytes
ttcagaaaattttcag

SEQ ID NO: 282639 - DNA, 16 bp, P. troglodytes
ttcagaaacatttttt

SEQ ID NO: 282640 - DNA, 16 bp, P. troglodytes
ttcagaaagaaaatat

SEQ ID NO: 282641 - DNA, 16 bp, P. troglodytes
ttcagaaagggaaaag

SEQ ID NO: 282642 - DNA, 16 bp, P. troglodytes
ttcagaaataaattta

SEQ ID NO: 282643 - DNA, 16 bp, P. troglodytes
ttcagaaatgttaaaa

SEQ ID NO: 282644 - DNA, 16 bp, P. troglodytes
ttcagaaattcaactt

SEQ ID NO: 282645 - DNA, 16 bp, P. troglodytes
ttcagaacaaataaaa

SEQ ID NO: 282646 - DNA, 16 bp, P. troglodytes
ttcagaacttgttact

SEQ ID NO: 282647 - DNA, 16 bp, P. troglodytes
ttcagaactttttcat

SEQ ID NO: 282648 - DNA, 16 bp, P. troglodytes
ttcagaagaaaataaa

SEQ ID NO: 282649 - DNA, 16 bp, P. troglodytes
ttcagaagctttttag

SEQ ID NO: 282650 - DNA, 19 bp, P. troglodytes
ttcagaaggtgggtaataa

SEQ ID NO: 282651 - DNA, 16 bp, P. troglodytes
ttcagaataaaaataa

SEQ ID NO: 282652 - DNA, 16 bp, P. troglodytes
ttcagaataggaaaat

SEQ ID NO: 282653 - DNA, 16 bp, P. troglodytes
ttcagaatatttattt

SEQ ID NO: 282654 - DNA, 16 bp, P. troglodytes
ttcagaatattttaaa

SEQ ID NO: 282655 - DNA, 16 bp, P. troglodytes
ttcagaattcagaatt

SEQ ID NO: 282656 - DNA, 16 bp, P. troglodytes
ttcagaattgttttgg

SEQ ID NO: 282657 - DNA, 16 bp, P. troglodytes
ttcagaatttaaaaat

SEQ ID NO: 282658 - DNA, 16 bp, P. troglodytes
ttcagaatttccattt

SEQ ID NO: 282659 - DNA, 16 bp, P. troglodytes
ttcagaatttgttatt

SEQ ID NO: 282660 - DNA, 16 bp, P. troglodytes
ttcagaatttgttttt

SEQ ID NO: 282661 - DNA, 16 bp, P. troglodytes
ttcagaattttatttt

SEQ ID NO: 282662 - DNA, 16 bp, P. troglodytes
ttcagacaagaaaatg

SEQ ID NO: 282663 - DNA, 16 bp, P. troglodytes
ttcagacagatgattc

SEQ ID NO: 282664 - DNA, 16 bp, P. troglodytes
ttcagacatgttataa

SEQ ID NO: 282665 - DNA, 16 bp, P. troglodytes
ttcagaccacagtgga

SEQ ID NO: 282666 - DNA, 16 bp, P. troglodytes
ttcagactgctgtgct

SEQ ID NO: 282667 - DNA, 16 bp, P. troglodytes
ttcagagaaaaagaaa

SEQ ID NO: 282668 - DNA, 16 bp, P. troglodytes
ttcagagaaaataaac

SEQ ID NO: 282669 - DNA, 16 bp, P. troglodytes
ttcagagaaacagaaa

SEQ ID NO: 282670 - DNA, 16 bp, P. troglodytes
ttcagagaaatggaaa

SEQ ID NO: 282671 - DNA, 16 bp, P. troglodytes
ttcagagaaattaaaa

SEQ ID NO: 282672 - DNA, 16 bp, P. troglodytes
ttcagagaaccagctt

SEQ ID NO: 282673 - DNA, 16 bp, P. troglodytes
ttcagagaaccagtct

SEQ ID NO: 282674 - DNA, 16 bp, P. troglodytes
ttcagagaaggaaaaa

SEQ ID NO: 282675 - DNA, 16 bp, P. troglodytes
ttcagagaattcaaaa

SEQ ID NO: 282676 - DNA, 16 bp, P. troglodytes
ttcagagaattgaaga

SEQ ID NO: 282677 - DNA, 16 bp, P. troglodytes
ttcagagagaaaaata

SEQ ID NO: 282678 - DNA, 16 bp, P. troglodytes
ttcagagatgttaaat

SEQ ID NO: 282679 - DNA, 16 bp, P. troglodytes
ttcagagattccactt

SEQ ID NO: 282680 - DNA, 16 bp, P. troglodytes
ttcagagattttctga

SEQ ID NO: 282681 - DNA, 16 bp, P. troglodytes
ttcagagcttgaagac

SEQ ID NO: 282682 - DNA, 16 bp, P. troglodytes
ttcagaggaaaaaaat

SEQ ID NO: 282683 - DNA, 16 bp, P. troglodytes
ttcagagggaaattta

SEQ ID NO: 282684 - DNA, 16 bp, P. troglodytes
ttcagagggtggaagc

SEQ ID NO: 282685 - DNA, 16 bp, P. troglodytes
ttcagagtcaaggaaa

SEQ ID NO: 282686 - DNA, 16 bp, P. troglodytes
ttcagagtttttattt

SEQ ID NO: 282687 - DNA, 16 bp, P. troglodytes
ttcagataaacaaaaa

SEQ ID NO: 282688 - DNA, 16 bp, P. troglodytes
ttcagataaacaatga

SEQ ID NO: 282689 - DNA, 16 bp, P. troglodytes
ttcagatatttgaaaa

SEQ ID NO: 282690 - DNA, 16 bp, P. troglodytes
ttcagatcctgaatat

SEQ ID NO: 282691 - DNA, 16 bp, P. troglodytes
ttcagatcctttgctc

SEQ ID NO: 282692 - DNA, 16 bp, P. troglodytes
ttcagatgaggaaatg

SEQ ID NO: 282693 - DNA, 16 bp, P. troglodytes
ttcagatggaaccaaa

SEQ ID NO: 282694 - DNA, 16 bp, P. troglodytes
ttcagattcaggaaac

SEQ ID NO: 282695 - DNA, 16 bp, P. troglodytes
ttcagatttcttcttt

SEQ ID NO: 282696 - DNA, 16 bp, P. troglodytes
ttcagattttagattt

SEQ ID NO: 282697 - DNA, 16 bp, P. troglodytes
ttcagattttggactt

SEQ ID NO: 282698 - DNA, 16 bp, P. troglodytes
ttcagatttttaaaaa

SEQ ID NO: 282699 - DNA, 16 bp, P. troglodytes
ttcagatttttcatgg

SEQ ID NO: 282700 - DNA, 16 bp, P. troglodytes
ttcagcaaagtttcag

SEQ ID NO: 282701 - DNA, 16 bp, P. troglodytes
ttcagcaacccttcat

SEQ ID NO: 282702 - DNA, 16 bp, P. troglodytes
ttcagcaagcacctca

SEQ ID NO: 282703 - DNA, 16 bp, P. troglodytes
ttcagcaaggtcacag

SEQ ID NO: 282704 - DNA, 16 bp, P. troglodytes
ttcagcaaggttgaaa

SEQ ID NO: 282705 - DNA, 28 bp, P. troglodytes
ttcagcaatgtctcaggatacaaaatca

SEQ ID NO: 282706 - DNA, 16 bp, P. troglodytes
ttcagcaccagcctgg

SEQ ID NO: 282707 - DNA, 16 bp, P. troglodytes
ttcagcacttgtaaga

SEQ ID NO: 282708 - DNA, 16 bp, P. troglodytes
ttcagcactttgaaaa

SEQ ID NO: 282709 - DNA, 16 bp, P. troglodytes
ttcagcactttgggag

SEQ ID NO: 282710 - DNA, 16 bp, P. troglodytes
ttcagcagcagctctc

SEQ ID NO: 282711 - DNA, 16 bp, P. troglodytes
ttcagcagtgaagaca

SEQ ID NO: 282712 - DNA, 16 bp, P. troglodytes
ttcagcagtgaagctg

SEQ ID NO: 282713 - DNA, 16 bp, P. troglodytes
ttcagcagtttcagga

SEQ ID NO: 282714 - DNA, 16 bp, P. troglodytes
ttcagcatggctgtgg

SEQ ID NO: 282715 - DNA, 16 bp, P. troglodytes
ttcagcatgttgacca

SEQ ID NO: 282716 - DNA, 16 bp, P. troglodytes
ttcagcatgttggtca

SEQ ID NO: 282717 - DNA, 16 bp, P. troglodytes
ttcagccaggcgtggt

SEQ ID NO: 282718 - DNA, 16 bp, P. troglodytes
ttcagcccaggaagtc

SEQ ID NO: 282719 - DNA, 16 bp, P. troglodytes
ttcagccccctttcca

SEQ ID NO: 282720 - DNA, 16 bp, P. troglodytes
ttcagccgggcatggt

SEQ ID NO: 282721 - DNA, 16 bp, P. troglodytes
ttcagcctccaaaact

SEQ ID NO: 282722 - DNA, 16 bp, P. troglodytes
ttcagcctcccaaagt

SEQ ID NO: 282723 - DNA, 16 bp, P. troglodytes
ttcagcctcccaagca

SEQ ID NO: 282724 - DNA, 20 bp, P. troglodytes
ttcagcctcccaagtagctg

SEQ ID NO: 282725 - DNA, 16 bp, P. troglodytes
ttcagcctcctgaaca

SEQ ID NO: 282726 - DNA, 16 bp, P. troglodytes
ttcagcctctgagtag

SEQ ID NO: 282727 - DNA, 16 bp, P. troglodytes
ttcagcctgagtgaca

SEQ ID NO: 282728 - DNA, 16 bp, P. troglodytes
ttcagcctgctgctgc

SEQ ID NO: 282729 - DNA, 16 bp, P. troglodytes
ttcagcctgtcttggc

SEQ ID NO: 282730 - DNA, 16 bp, P. troglodytes
ttcagccttaaaaata

SEQ ID NO: 282731 - DNA, 16 bp, P. troglodytes
ttcagccttattttac

SEQ ID NO: 282732 - DNA, 16 bp, P. troglodytes
ttcagctattccttta

SEQ ID NO: 282733 - DNA, 16 bp, P. troglodytes
ttcagctattttgaaa

SEQ ID NO: 282734 - DNA, 18 bp, P. troglodytes
ttcagctcactgcaacct

SEQ ID NO: 282735 - DNA, 16 bp, P. troglodytes
ttcagctccagaattt

SEQ ID NO: 282736 - DNA, 16 bp, P. troglodytes
ttcagctccatccaag

SEQ ID NO: 282737 - DNA, 16 bp, P. troglodytes
ttcagctcccactttt

SEQ ID NO: 282738 - DNA, 16 bp, P. troglodytes
ttcagctctgatttgg

SEQ ID NO: 282739 - DNA, 16 bp, P. troglodytes
ttcagctgaagttttt

SEQ ID NO: 282740 - DNA, 17 bp, P. troglodytes
ttcagctggcaaggcca

SEQ ID NO: 282741 - DNA, 16 bp, P. troglodytes
ttcagcttcattataa

SEQ ID NO: 282742 - DNA, 16 bp, P. troglodytes
ttcagcttcccaaagt

SEQ ID NO: 282743 - DNA, 16 bp, P. troglodytes
ttcagcttcttcatct

SEQ ID NO: 282744 - DNA, 16 bp, P. troglodytes
ttcagcttcttcattt

SEQ ID NO: 282745 - DNA, 17 bp, P. troglodytes
ttcagcttcttcctggt

SEQ ID NO: 282746 - DNA, 16 bp, P. troglodytes
ttcagcttctttattt

SEQ ID NO: 282747 - DNA, 16 bp, P. troglodytes
ttcagcttgcaactca

SEQ ID NO: 282748 - DNA, 16 bp, P. troglodytes
ttcagcttgggcaaca

SEQ ID NO: 282749 - DNA, 16 bp, P. troglodytes
ttcagctttagtagat

SEQ ID NO: 282750 - DNA, 16 bp, P. troglodytes
ttcagctttctactta

SEQ ID NO: 282751 - DNA, 16 bp, P. troglodytes
ttcaggaaaataaata

SEQ ID NO: 282752 - DNA, 16 bp, P. troglodytes
ttcaggaaagcagaaa

SEQ ID NO: 282753 - DNA, 16 bp, P. troglodytes
ttcaggaaataaagga

SEQ ID NO: 282754 - DNA, 16 bp, P. troglodytes
ttcaggaaatacagat

SEQ ID NO: 282755 - DNA, 16 bp, P. troglodytes
ttcaggaacttttcct

SEQ ID NO: 282756 - DNA, 16 bp, P. troglodytes
ttcaggacaaaccaga

SEQ ID NO: 282757 - DNA, 16 bp, P. troglodytes
ttcaggacttgaactt

SEQ ID NO: 282758 - DNA, 16 bp, P. troglodytes
ttcaggagaaaaaaaa

SEQ ID NO: 282759 - DNA, 16 bp, P. troglodytes
ttcaggagcagcctgg

SEQ ID NO: 282760 - DNA, 16 bp, P. troglodytes
ttcaggaggatgtgca

SEQ ID NO: 282761 - DNA, 16 bp, P. troglodytes
ttcaggaggctgagat

SEQ ID NO: 282762 - DNA, 17 bp, P. troglodytes
ttcaggaggctgaggcg

SEQ ID NO: 282763 - DNA, 22 bp, P. troglodytes
ttcaggatattatccaggagaa

SEQ ID NO: 282764 - DNA, 16 bp, P. troglodytes
ttcaggatctgaaaaa

SEQ ID NO: 282765 - DNA, 16 bp, P. troglodytes
ttcaggatgaaactgt

SEQ ID NO: 282766 - DNA, 16 bp, P. troglodytes
ttcaggatttcttgct

SEQ ID NO: 282767 - DNA, 16 bp, P. troglodytes
ttcaggcaaaaggaaa

SEQ ID NO: 282768 - DNA, 16 bp, P. troglodytes
ttcaggcacaactgac

SEQ ID NO: 282769 - DNA, 16 bp, P. troglodytes
ttcaggcataagccac

SEQ ID NO: 282770 - DNA, 16 bp, P. troglodytes
ttcaggcatagctgga

SEQ ID NO: 282771 - DNA, 16 bp, P. troglodytes
ttcaggccttaaggga

SEQ ID NO: 282772 - DNA, 16 bp, P. troglodytes
ttcagggaaaaaaaaa

SEQ ID NO: 282773 - DNA, 16 bp, P. troglodytes
ttcagggagcttccag

SEQ ID NO: 282774 - DNA, 16 bp, P. troglodytes
ttcagggatacaagtg

SEQ ID NO: 282775 - DNA, 16 bp, P. troglodytes
ttcaggggaaaaaaaa

SEQ ID NO: 282776 - DNA, 17 bp, P. troglodytes
ttcaggggaagtttgtc

SEQ ID NO: 282777 - DNA, 16 bp, P. troglodytes
ttcaggggtacttgtg

SEQ ID NO: 282778 - DNA, 16 bp, P. troglodytes
ttcagggtcttttgtg

SEQ ID NO: 282779 - DNA, 16 bp, P. troglodytes
ttcagggtttgttttt

SEQ ID NO: 282780 - DNA, 16 bp, P. troglodytes
ttcaggtatttatttt

SEQ ID NO: 282781 - DNA, 16 bp, P. troglodytes
ttcaggtattttctat

SEQ ID NO: 282782 - DNA, 16 bp, P. troglodytes
ttcaggtcctgcatac

SEQ ID NO: 282783 - DNA, 18 bp, P. troglodytes
ttcaggtgatccacccac

SEQ ID NO: 282784 - DNA, 20 bp, P. troglodytes
ttcaggtgatccacctgcct

SEQ ID NO: 282785 - DNA, 16 bp, P. troglodytes
ttcaggttggagtgca

SEQ ID NO: 282786 - DNA, 16 bp, P. troglodytes
ttcaggtttctctggg

SEQ ID NO: 282787 - DNA, 16 bp, P. troglodytes
ttcaggtttctgctca

SEQ ID NO: 282788 - DNA, 16 bp, P. troglodytes
ttcaggttttggattt

SEQ ID NO: 282789 - DNA, 16 bp, P. troglodytes
ttcaggtttttaaaaa

SEQ ID NO: 282790 - DNA, 16 bp, P. troglodytes
ttcagtaaaataattt

SEQ ID NO: 282791 - DNA, 16 bp, P. troglodytes
ttcagtaaaattaaat

SEQ ID NO: 282792 - DNA, 16 bp, P. troglodytes
ttcagtaaatattatt

SEQ ID NO: 282793 - DNA, 16 bp, P. troglodytes
ttcagtaacttgccca

SEQ ID NO: 282794 - DNA, 16 bp, P. troglodytes
ttcagtaagccatgct

SEQ ID NO: 282795 - DNA, 16 bp, P. troglodytes
ttcagtaagtggtgct

SEQ ID NO: 282796 - DNA, 16 bp, P. troglodytes
ttcagtaatttgccca

SEQ ID NO: 282797 - DNA, 16 bp, P. troglodytes
ttcagtagatgcagaa

SEQ ID NO: 282798 - DNA, 16 bp, P. troglodytes
ttcagtatgatatggg

SEQ ID NO: 282799 - DNA, 16 bp, P. troglodytes
ttcagtatgatgttga

SEQ ID NO: 282800 - DNA, 16 bp, P. troglodytes
ttcagtatgatgttgg

SEQ ID NO: 282801 - DNA, 16 bp, P. troglodytes
ttcagtattcactaat

SEQ ID NO: 282802 - DNA, 16 bp, P. troglodytes
ttcagtattgtgttgg

SEQ ID NO: 282803 - DNA, 16 bp, P. troglodytes
ttcagtatttcaccat

SEQ ID NO: 282804 - DNA, 16 bp, P. troglodytes
ttcagtcacactagcc

SEQ ID NO: 282805 - DNA, 16 bp, P. troglodytes
ttcagtcacctcccac

SEQ ID NO: 282806 - DNA, 16 bp, P. troglodytes
ttcagtcactcattca

SEQ ID NO: 282807 - DNA, 16 bp, P. troglodytes
ttcagtcattgtggaa

SEQ ID NO: 282808 - DNA, 16 bp, P. troglodytes
ttcagtctctttctct

SEQ ID NO: 282809 - DNA, 16 bp, P. troglodytes
ttcagtcttaaaaaaa

SEQ ID NO: 282810 - DNA, 16 bp, P. troglodytes
ttcagtctttcatcat

SEQ ID NO: 282811 - DNA, 16 bp, P. troglodytes
ttcagtgaactgagat

SEQ ID NO: 282812 - DNA, 16 bp, P. troglodytes
ttcagtgagctgagat

SEQ ID NO: 282813 - DNA, 16 bp, P. troglodytes
ttcagtgagtcaagat

SEQ ID NO: 282814 - DNA, 16 bp, P. troglodytes
ttcagtgatttttagt

SEQ ID NO: 282815 - DNA, 16 bp, P. troglodytes
ttcagtggaggaaaga

SEQ ID NO: 282816 - DNA, 16 bp, P. troglodytes
ttcagtggcacaatct

SEQ ID NO: 282817 - DNA, 16 bp, P. troglodytes
ttcagtggcattaagt

SEQ ID NO: 282818 - DNA, 16 bp, P. troglodytes
ttcagtggctttccat

SEQ ID NO: 282819 - DNA, 16 bp, P. troglodytes
ttcagtggtattaaat

SEQ ID NO: 282820 - DNA, 16 bp, P. troglodytes
ttcagtggtctggata

SEQ ID NO: 282821 - DNA, 16 bp, P. troglodytes
ttcagtggtgttaagt

SEQ ID NO: 282822 - DNA, 16 bp, P. troglodytes
ttcagtgtcttcatct

SEQ ID NO: 282823 - DNA, 16 bp, P. troglodytes
ttcagtgtgtatttcc

SEQ ID NO: 282824 - DNA, 16 bp, P. troglodytes
ttcagtgtttggtttt

SEQ ID NO: 282825 - DNA, 16 bp, P. troglodytes
ttcagttagaaggaat

SEQ ID NO: 282826 - DNA, 16 bp, P. troglodytes
ttcagttcaaagtatt

SEQ ID NO: 282827 - DNA, 16 bp, P. troglodytes
ttcagttccaggattt

SEQ ID NO: 282828 - DNA, 16 bp, P. troglodytes
ttcagttccatatgaa

SEQ ID NO: 282829 - DNA, 16 bp, P. troglodytes
ttcagttccgctctga

SEQ ID NO: 282830 - DNA, 16 bp, P. troglodytes
ttcagttcctcagtca

SEQ ID NO: 282831 - DNA, 16 bp, P. troglodytes
ttcagttctcagctca

SEQ ID NO: 282832 - DNA, 16 bp, P. troglodytes
ttcagttctttcattt

SEQ ID NO: 282833 - DNA, 16 bp, P. troglodytes
ttcagttgtgtgtgtg

SEQ ID NO: 282834 - DNA, 16 bp, P. troglodytes
ttcagtttcaaaaaaa

SEQ ID NO: 282835 - DNA, 16 bp, P. troglodytes
ttcagtttcacaagat

SEQ ID NO: 282836 - DNA, 16 bp, P. troglodytes
ttcagtttccatgcag

SEQ ID NO: 282837 - DNA, 16 bp, P. troglodytes
ttcagtttccccatct

SEQ ID NO: 282838 - DNA, 16 bp, P. troglodytes
ttcagtttcctcatct

SEQ ID NO: 282839 - DNA, 16 bp, P. troglodytes
ttcagtttcctccttt

SEQ ID NO: 282840 - DNA, 16 bp, P. troglodytes
ttcagtttccttattt

SEQ ID NO: 282841 - DNA, 16 bp, P. troglodytes
ttcagtttctatttct

SEQ ID NO: 282842 - DNA, 16 bp, P. troglodytes
ttcagtttctcagttg

SEQ ID NO: 282843 - DNA, 16 bp, P. troglodytes
ttcagtttcttcatct

SEQ ID NO: 282844 - DNA, 16 bp, P. troglodytes
ttcagttttacattta

SEQ ID NO: 282845 - DNA, 16 bp, P. troglodytes
ttcagttttataaagg

SEQ ID NO: 282846 - DNA, 16 bp, P. troglodytes
ttcagttttataattt

SEQ ID NO: 282847 - DNA, 16 bp, P. troglodytes
ttcagttttatattta

SEQ ID NO: 282848 - DNA, 16 bp, P. troglodytes
ttcagttttctgctta

SEQ ID NO: 282849 - DNA, 16 bp, P. troglodytes
ttcagttttgcaagag

SEQ ID NO: 282850 - DNA, 16 bp, P. troglodytes
ttcagtttttcaaaat

SEQ ID NO: 282851 - DNA, 16 bp, P. troglodytes
ttcagtttttccacat

SEQ ID NO: 282852 - DNA, 16 bp, P. troglodytes
ttcagtttttcccatt

SEQ ID NO: 282853 - DNA, 16 bp, P. troglodytes
ttcagtttttctgtaa

SEQ ID NO: 282854 - DNA, 16 bp, P. troglodytes
ttcagtttttgaattt

SEQ ID NO: 282855 - DNA, 16 bp, P. troglodytes
ttcataaaaatgcaaa

SEQ ID NO: 282856 - DNA, 16 bp, P. troglodytes
ttcataaaaccatcag

SEQ ID NO: 282857 - DNA, 16 bp, P. troglodytes
ttcataaaaggaagag

SEQ ID NO: 282858 - DNA, 16 bp, P. troglodytes
ttcataaaatgaattg

SEQ ID NO: 282859 - DNA, 16 bp, P. troglodytes
ttcataaaatgttaat

SEQ ID NO: 282860 - DNA, 16 bp, P. troglodytes
ttcataaagttttatt

SEQ ID NO: 282861 - DNA, 16 bp, P. troglodytes
ttcataaatgtattta

SEQ ID NO: 282862 - DNA, 16 bp, P. troglodytes
ttcataataacaaaga

SEQ ID NO: 282863 - DNA, 16 bp, P. troglodytes
ttcataatagttaaaa

SEQ ID NO: 282864 - DNA, 16 bp, P. troglodytes
ttcataatattctctg

SEQ ID NO: 282865 - DNA, 16 bp, P. troglodytes
ttcatactggagaaaa

SEQ ID NO: 282866 - DNA, 16 bp, P. troglodytes
ttcatagaaaaagaaa

SEQ ID NO: 282867 - DNA, 16 bp, P. troglodytes
ttcatagaagaggaaa

SEQ ID NO: 282868 - DNA, 16 bp, P. troglodytes
ttcatagagatgggat

SEQ ID NO: 282869 - DNA, 16 bp, P. troglodytes
ttcatagattggaaga

SEQ ID NO: 282870 - DNA, 16 bp, P. troglodytes
ttcatagcacttgtca

SEQ ID NO: 282871 - DNA, 16 bp, P. troglodytes
ttcatagcagcactgt

SEQ ID NO: 282872 - DNA, 16 bp, P. troglodytes
ttcatagcatttttca

SEQ ID NO: 282873 - DNA, 16 bp, P. troglodytes
ttcatataaaaattca

SEQ ID NO: 282874 - DNA, 16 bp, P. troglodytes
ttcatataatgactta

SEQ ID NO: 282875 - DNA, 16 bp, P. troglodytes
ttcatatacttgtttg

SEQ ID NO: 282876 - DNA, 16 bp, P. troglodytes
ttcatatatatgaata

SEQ ID NO: 282877 - DNA, 16 bp, P. troglodytes
ttcatatatctatata

SEQ ID NO: 282878 - DNA, 16 bp, P. troglodytes
ttcatatatggctttt

SEQ ID NO: 282879 - DNA, 16 bp, P. troglodytes
ttcatatattcattca

SEQ ID NO: 282880 - DNA, 16 bp, P. troglodytes
ttcatatcccttgccc

SEQ ID NO: 282881 - DNA, 16 bp, P. troglodytes
ttcatatccttcatcc

SEQ ID NO: 282882 - DNA, 20 bp, P. troglodytes
ttcatatccttcgcccactt

SEQ ID NO: 282883 - DNA, 17 bp, P. troglodytes
ttcatatggaaccaaaa

SEQ ID NO: 282884 - DNA, 17 bp, P. troglodytes
ttcatatggaaccaaag

SEQ ID NO: 282885 - DNA, 16 bp, P. troglodytes
ttcatatggaatgaaa

SEQ ID NO: 282886 - DNA, 16 bp, P. troglodytes
ttcatatgttttttgg

SEQ ID NO: 282887 - DNA, 16 bp, P. troglodytes
ttcatatttcaaaata

SEQ ID NO: 282888 - DNA, 16 bp, P. troglodytes
ttcatatttcatattc

SEQ ID NO: 282889 - DNA, 16 bp, P. troglodytes
ttcatatttgatgaaa

SEQ ID NO: 282890 - DNA, 16 bp, P. troglodytes
ttcatattttccatct

SEQ ID NO: 282891 - DNA, 16 bp, P. troglodytes
ttcatcaaactgtaca

SEQ ID NO: 282892 - DNA, 16 bp, P. troglodytes
ttcatcaagattaaaa

SEQ ID NO: 282893 - DNA, 16 bp, P. troglodytes
ttcatcaattataaca

SEQ ID NO: 282894 - DNA, 16 bp, P. troglodytes
ttcatcaattgtaata

SEQ ID NO: 282895 - DNA, 16 bp, P. troglodytes
ttcatcaccccaaaag

SEQ ID NO: 282896 - DNA, 16 bp, P. troglodytes
ttcatcactccaaaaa

SEQ ID NO: 282897 - DNA, 16 bp, P. troglodytes
ttcatcagaaatactt

SEQ ID NO: 282898 - DNA, 16 bp, P. troglodytes
ttcatcagggatattg

SEQ ID NO: 282899 - DNA, 16 bp, P. troglodytes
ttcatcagtgttttat

SEQ ID NO: 282900 - DNA, 16 bp, P. troglodytes
ttcatcatcaccatca

SEQ ID NO: 282901 - DNA, 16 bp, P. troglodytes
ttcatcatcatcatca

SEQ ID NO: 282902 - DNA, 16 bp, P. troglodytes
ttcatcatggattttt

SEQ ID NO: 282903 - DNA, 16 bp, P. troglodytes
ttcatcatgttggcaa

SEQ ID NO: 282904 - DNA, 16 bp, P. troglodytes
ttcatcatgttggcca

SEQ ID NO: 282905 - DNA, 16 bp, P. troglodytes
ttcatcattttaaata

SEQ ID NO: 282906 - DNA, 16 bp, P. troglodytes
ttcatcattttttatg

SEQ ID NO: 282907 - DNA, 16 bp, P. troglodytes
ttcatccatattcctg

SEQ ID NO: 282908 - DNA, 16 bp, P. troglodytes
ttcatccatccattca

SEQ ID NO: 282909 - DNA, 16 bp, P. troglodytes
ttcatccatgctgttg

SEQ ID NO: 282910 - DNA, 35 bp, P. troglodytes
ttcatccatgtccctacaaaggacatgaactcatc

SEQ ID NO: 282911 - DNA, 16 bp, P. troglodytes
ttcatccatgttgtag

SEQ ID NO: 282912 - DNA, 16 bp, P. troglodytes
ttcatccatttgttca

SEQ ID NO: 282913 - DNA, 16 bp, P. troglodytes
ttcatcccagaggagc

SEQ ID NO: 282914 - DNA, 16 bp, P. troglodytes
ttcatccgtgtccctg

SEQ ID NO: 282915 - DNA, 16 bp, P. troglodytes
ttcatcctcatcatct

SEQ ID NO: 282916 - DNA, 16 bp, P. troglodytes
ttcatcctgaggcaaa

SEQ ID NO: 282917 - DNA, 16 bp, P. troglodytes
ttcatcctgggtgaca

SEQ ID NO: 282918 - DNA, 16 bp, P. troglodytes
ttcatcctttaaaaaa

SEQ ID NO: 282919 - DNA, 16 bp, P. troglodytes
ttcatctaaagacata

SEQ ID NO: 282920 - DNA, 16 bp, P. troglodytes
ttcatctctacagaaa

SEQ ID NO: 282921 - DNA, 16 bp, P. troglodytes
ttcatctgaaaaaaaa

SEQ ID NO: 282922 - DNA, 16 bp, P. troglodytes
ttcatctgcactgcca

SEQ ID NO: 282923 - DNA, 16 bp, P. troglodytes
ttcatctggctgttca

SEQ ID NO: 282924 - DNA, 16 bp, P. troglodytes
ttcatctgtaaaatgg

SEQ ID NO: 282925 - DNA, 16 bp, P. troglodytes
ttcatctgtaaatatt

SEQ ID NO: 282926 - DNA, 16 bp, P. troglodytes
ttcatctgtatccttt

SEQ ID NO: 282927 - DNA, 16 bp, P. troglodytes
ttcatctgtatctttt

SEQ ID NO: 282928 - DNA, 16 bp, P. troglodytes
ttcatcttcacaacaa

SEQ ID NO: 282929 - DNA, 16 bp, P. troglodytes
ttcatcttcttcctgg

SEQ ID NO: 282930 - DNA, 16 bp, P. troglodytes
ttcatcttgaattgta

SEQ ID NO: 282931 - DNA, 16 bp, P. troglodytes
ttcatctttctcctgt

SEQ ID NO: 282932 - DNA, 16 bp, P. troglodytes
ttcatctttgcatccc

SEQ ID NO: 282933 - DNA, 16 bp, P. troglodytes
ttcatctttgtcttct

SEQ ID NO: 282934 - DNA, 16 bp, P. troglodytes
ttcatgaaaaaataaa

SEQ ID NO: 282935 - DNA, 16 bp, P. troglodytes
ttcatgaaagattttt

SEQ ID NO: 282936 - DNA, 16 bp, P. troglodytes
ttcatgaaataaataa

SEQ ID NO: 282937 - DNA, 16 bp, P. troglodytes
ttcatgaataaatatt

SEQ ID NO: 282938 - DNA, 16 bp, P. troglodytes
ttcatgaatcattcat

SEQ ID NO: 282939 - DNA, 16 bp, P. troglodytes
ttcatgaatgggaaga

SEQ ID NO: 282940 - DNA, 16 bp, P. troglodytes
ttcatgaatggtttag

SEQ ID NO: 282941 - DNA, 16 bp, P. troglodytes
ttcatgaattagaaga

SEQ ID NO: 282942 - DNA, 16 bp, P. troglodytes
ttcatgaattattttt

SEQ ID NO: 282943 - DNA, 16 bp, P. troglodytes
ttcatgaccaagaacc

SEQ ID NO: 282944 - DNA, 21 bp, P. troglodytes
ttcatgactaaaacaccaaaa

SEQ ID NO: 282945 - DNA, 16 bp, P. troglodytes
ttcatgcaaatggaaa

SEQ ID NO: 282946 - DNA, 16 bp, P. troglodytes
ttcatgcagagccagc

SEQ ID NO: 282947 - DNA, 16 bp, P. troglodytes
ttcatgcatgcattca

SEQ ID NO: 282948 - DNA, 16 bp, P. troglodytes
ttcatgcattaattca

SEQ ID NO: 282949 - DNA, 16 bp, P. troglodytes
ttcatgcatttttaaa

SEQ ID NO: 282950 - DNA, 16 bp, P. troglodytes
ttcatgcatttttttc

SEQ ID NO: 282951 - DNA, 22 bp, P. troglodytes
ttcatgcctgtaatcccaacac

SEQ ID NO: 282952 - DNA, 16 bp, P. troglodytes
ttcatgcctgtaattc

SEQ ID NO: 282953 - DNA, 16 bp, P. troglodytes
ttcatgctgttttcca

SEQ ID NO: 282954 - DNA, 16 bp, P. troglodytes
ttcatgcttttaaaaa

SEQ ID NO: 282955 - DNA, 16 bp, P. troglodytes
ttcatggaggaggtga

SEQ ID NO: 282956 - DNA, 16 bp, P. troglodytes
ttcatggctggggagg

SEQ ID NO: 282957 - DNA, 16 bp, P. troglodytes
ttcatgggctggcact

SEQ ID NO: 282958 - DNA, 16 bp, P. troglodytes
ttcatggggtacatga

SEQ ID NO: 282959 - DNA, 16 bp, P. troglodytes
ttcatgggttggaaga

SEQ ID NO: 282960 - DNA, 16 bp, P. troglodytes
ttcatggtctcactgg

SEQ ID NO: 282961 - DNA, 16 bp, P. troglodytes
ttcatggtttcagtta

SEQ ID NO: 282962 - DNA, 16 bp, P. troglodytes
ttcatgtaaatagaat

SEQ ID NO: 282963 - DNA, 16 bp, P. troglodytes
ttcatgtaaatgaaat

SEQ ID NO: 282964 - DNA, 16 bp, P. troglodytes
ttcatgtaacaaaaca

SEQ ID NO: 282965 - DNA, 16 bp, P. troglodytes
ttcatgtacctgtttg

SEQ ID NO: 282966 - DNA, 16 bp, P. troglodytes
ttcatgtatttatata

SEQ ID NO: 282967 - DNA, 16 bp, P. troglodytes
ttcatgtatttcttta

SEQ ID NO: 282968 - DNA, 16 bp, P. troglodytes
ttcatgtattttaaat

SEQ ID NO: 282969 - DNA, 16 bp, P. troglodytes
ttcatgtcctctgccc

SEQ ID NO: 282970 - DNA, 16 bp, P. troglodytes
ttcatgtcctttgtcc

SEQ ID NO: 282971 - DNA, 16 bp, P. troglodytes
ttcatgtcttccaccc

SEQ ID NO: 282972 - DNA, 16 bp, P. troglodytes
ttcatgtcttcttttg

SEQ ID NO: 282973 - DNA, 16 bp, P. troglodytes
ttcatgtcttttgctc

SEQ ID NO: 282974 - DNA, 16 bp, P. troglodytes
ttcatgtcttttgtag

SEQ ID NO: 282975 - DNA, 17 bp, P. troglodytes
ttcatgtggaaccaaaa

SEQ ID NO: 282976 - DNA, 16 bp, P. troglodytes
ttcatgtggtgttgag

SEQ ID NO: 282977 - DNA, 16 bp, P. troglodytes
ttcatgtgtaaaataa

SEQ ID NO: 282978 - DNA, 16 bp, P. troglodytes
ttcatgtgtttgctgg

SEQ ID NO: 282979 - DNA, 16 bp, P. troglodytes
ttcatgttaaaaacct

SEQ ID NO: 282980 - DNA, 18 bp, P. troglodytes
ttcatgttccatcctgta

SEQ ID NO: 282981 - DNA, 16 bp, P. troglodytes
ttcatgttgatatttt

SEQ ID NO: 282982 - DNA, 16 bp, P. troglodytes
ttcatgtttataaaat

SEQ ID NO: 282983 - DNA, 16 bp, P. troglodytes
ttcatgttttttggct

SEQ ID NO: 282984 - DNA, 16 bp, P. troglodytes
ttcattaagttggact

SEQ ID NO: 282985 - DNA, 16 bp, P. troglodytes
ttcattaattcactca

SEQ ID NO: 282986 - DNA, 16 bp, P. troglodytes
ttcattaccccaaaaa

SEQ ID NO: 282987 - DNA, 16 bp, P. troglodytes
ttcattataccattct

SEQ ID NO: 282988 - DNA, 16 bp, P. troglodytes
ttcattatgaaaatat

SEQ ID NO: 282989 - DNA, 16 bp, P. troglodytes
ttcattattttgattg

SEQ ID NO: 282990 - DNA, 16 bp, P. troglodytes
ttcattcaacaaacat

SEQ ID NO: 282991 - DNA, 16 bp, P. troglodytes
ttcattcaacaaataa

SEQ ID NO: 282992 - DNA, 16 bp, P. troglodytes
ttcattcaacaaatat

SEQ ID NO: 282993 - DNA, 16 bp, P. troglodytes
ttcattcaacagatat

SEQ ID NO: 282994 - DNA, 16 bp, P. troglodytes
ttcattcaataaatat

SEQ ID NO: 282995 - DNA, 16 bp, P. troglodytes
ttcattcactcaccca

SEQ ID NO: 282996 - DNA, 16 bp, P. troglodytes
ttcattcactcattca

SEQ ID NO: 282997 - DNA, 16 bp, P. troglodytes
ttcattcactcatttg

SEQ ID NO: 282998 - DNA, 16 bp, P. troglodytes
ttcattcacttaacaa

SEQ ID NO: 282999 - DNA, 16 bp, P. troglodytes
ttcattcagcaagtat

SEQ ID NO: 283000 - DNA, 16 bp, P. troglodytes
ttcattcagtaaatat

SEQ ID NO: 283001 - DNA, 16 bp, P. troglodytes
ttcattcagttaaaaa

SEQ ID NO: 283002 - DNA, 16 bp, P. troglodytes
ttcattcagttattca

SEQ ID NO: 283003 - DNA, 16 bp, P. troglodytes
ttcattcagttctgct

SEQ ID NO: 283004 - DNA, 16 bp, P. troglodytes
ttcattcatcaattca

SEQ ID NO: 283005 - DNA, 16 bp, P. troglodytes
ttcattcatccatcca

SEQ ID NO: 283006 - DNA, 16 bp, P. troglodytes
ttcattcatgttattg

SEQ ID NO: 283007 - DNA, 16 bp, P. troglodytes
ttcattcattatttca

SEQ ID NO: 283008 - DNA, 16 bp, P. troglodytes
ttcattcattcaacga

SEQ ID NO: 283009 - DNA, 16 bp, P. troglodytes
ttcattcattcaagat

SEQ ID NO: 283010 - DNA, 16 bp, P. troglodytes
ttcattcattcaagca

SEQ ID NO: 283011 - DNA, 16 bp, P. troglodytes
ttcattcattcattca

SEQ ID NO: 283012 - DNA, 16 bp, P. troglodytes
ttcattcattcattcc

SEQ ID NO: 283013 - DNA, 16 bp, P. troglodytes
ttcattcattcattcg

SEQ ID NO: 283014 - DNA, 16 bp, P. troglodytes
ttcattcattcattct

SEQ ID NO: 283015 - DNA, 16 bp, P. troglodytes
ttcattcattcattta

SEQ ID NO: 283016 - DNA, 16 bp, P. troglodytes
ttcattcattcctcca

SEQ ID NO: 283017 - DNA, 16 bp, P. troglodytes
ttcattcattgaacaa

SEQ ID NO: 283018 - DNA, 16 bp, P. troglodytes
ttcattcatttaaaaa

SEQ ID NO: 283019 - DNA, 16 bp, P. troglodytes
ttcattcatttactca

SEQ ID NO: 283020 - DNA, 16 bp, P. troglodytes
ttcattcatttattca

SEQ ID NO: 283021 - DNA, 16 bp, P. troglodytes
ttcattcatttctgtt

SEQ ID NO: 283022 - DNA, 16 bp, P. troglodytes
ttcattcatttgttca

SEQ ID NO: 283023 - DNA, 16 bp, P. troglodytes
ttcattcatttgttta

SEQ ID NO: 283024 - DNA, 16 bp, P. troglodytes
ttcattcattttaaca

SEQ ID NO: 283025 - DNA, 16 bp, P. troglodytes
ttcattcattttgaaa

SEQ ID NO: 283026 - DNA, 16 bp, P. troglodytes
ttcattccagcctggg

SEQ ID NO: 283027 - DNA, 16 bp, P. troglodytes
ttcattcctcccagtg

SEQ ID NO: 283028 - DNA, 16 bp, P. troglodytes
ttcattcctgatttta

SEQ ID NO: 283029 - DNA, 16 bp, P. troglodytes
ttcattccttcaacaa

SEQ ID NO: 283030 - DNA, 16 bp, P. troglodytes
ttcattccttcattca

SEQ ID NO: 283031 - DNA, 16 bp, P. troglodytes
ttcattcctttgttca

SEQ ID NO: 283032 - DNA, 16 bp, P. troglodytes
ttcattccttttattg

SEQ ID NO: 283033 - DNA, 16 bp, P. troglodytes
ttcattctctcttgcc

SEQ ID NO: 283034 - DNA, 16 bp, P. troglodytes
ttcattctgtttcatt

SEQ ID NO: 283035 - DNA, 16 bp, P. troglodytes
ttcattcttctttaaa

SEQ ID NO: 283036 - DNA, 16 bp, P. troglodytes
ttcattctttcattca

SEQ ID NO: 283037 - DNA, 16 bp, P. troglodytes
ttcattgaaaagaaaa

SEQ ID NO: 283038 - DNA, 16 bp, P. troglodytes
ttcattgaaattaaaa

SEQ ID NO: 283039 - DNA, 16 bp, P. troglodytes
ttcattgaatatttat

SEQ ID NO: 283040 - DNA, 16 bp, P. troglodytes
ttcattgagacagagt

SEQ ID NO: 283041 - DNA, 16 bp, P. troglodytes
ttcattgatcttttct

SEQ ID NO: 283042 - DNA, 16 bp, P. troglodytes
ttcattgcctgatgtc

SEQ ID NO: 283043 - DNA, 16 bp, P. troglodytes
ttcattgctgaattct

SEQ ID NO: 283044 - DNA, 16 bp, P. troglodytes
ttcattgtagattttg

SEQ ID NO: 283045 - DNA, 16 bp, P. troglodytes
ttcattgtatatatgt

SEQ ID NO: 283046 - DNA, 16 bp, P. troglodytes
ttcattgtatggatat

SEQ ID NO: 283047 - DNA, 16 bp, P. troglodytes
ttcattgtgctctttg

SEQ ID NO: 283048 - DNA, 16 bp, P. troglodytes
ttcattgtggttttaa

SEQ ID NO: 283049 - DNA, 16 bp, P. troglodytes
ttcatttaaaaaaaga

SEQ ID NO: 283050 - DNA, 16 bp, P. troglodytes
ttcatttaaaaagaaa

SEQ ID NO: 283051 - DNA, 16 bp, P. troglodytes
ttcatttaaaaagtat

SEQ ID NO: 283052 - DNA, 16 bp, P. troglodytes
ttcatttaaaagaaaa

SEQ ID NO: 283053 - DNA, 16 bp, P. troglodytes
ttcatttaaaaggaaa

SEQ ID NO: 283054 - DNA, 16 bp, P. troglodytes
ttcatttaaaataaca

SEQ ID NO: 283055 - DNA, 16 bp, P. troglodytes
ttcatttatatgaagt

SEQ ID NO: 283056 - DNA, 16 bp, P. troglodytes
ttcatttatcattcat

SEQ ID NO: 283057 - DNA, 16 bp, P. troglodytes
ttcatttatccattca

SEQ ID NO: 283058 - DNA, 16 bp, P. troglodytes
ttcatttatctattca

SEQ ID NO: 283059 - DNA, 16 bp, P. troglodytes
ttcatttattatttga

SEQ ID NO: 283060 - DNA, 16 bp, P. troglodytes
ttcatttattcagcaa

SEQ ID NO: 283061 - DNA, 16 bp, P. troglodytes
ttcatttattcagtca

SEQ ID NO: 283062 - DNA, 16 bp, P. troglodytes
ttcatttattcattca

SEQ ID NO: 283063 - DNA, 16 bp, P. troglodytes
ttcatttattcattga

SEQ ID NO: 283064 - DNA, 16 bp, P. troglodytes
ttcatttattccacaa

SEQ ID NO: 283065 - DNA, 16 bp, P. troglodytes
ttcatttattgaggaa

SEQ ID NO: 283066 - DNA, 16 bp, P. troglodytes
ttcatttatttactga

SEQ ID NO: 283067 - DNA, 16 bp, P. troglodytes
ttcatttatttattgg

SEQ ID NO: 283068 - DNA, 16 bp, P. troglodytes
ttcatttatttcaaac

SEQ ID NO: 283069 - DNA, 16 bp, P. troglodytes
ttcatttatttctgct

SEQ ID NO: 283070 - DNA, 16 bp, P. troglodytes
ttcatttatttgttca

SEQ ID NO: 283071 - DNA, 16 bp, P. troglodytes
ttcatttcagatattg

SEQ ID NO: 283072 - DNA, 16 bp, P. troglodytes
ttcatttcagttattt

SEQ ID NO: 283073 - DNA, 16 bp, P. troglodytes
ttcatttcatttagtt

SEQ ID NO: 283074 - DNA, 16 bp, P. troglodytes
ttcatttcatttcacc

SEQ ID NO: 283075 - DNA, 16 bp, P. troglodytes
ttcatttcattttatg

SEQ ID NO: 283076 - DNA, 16 bp, P. troglodytes
ttcatttccaaatttt

SEQ ID NO: 283077 - DNA, 16 bp, P. troglodytes
ttcatttccattttaa

SEQ ID NO: 283078 - DNA, 16 bp, P. troglodytes
ttcatttcctttgaaa

SEQ ID NO: 283079 - DNA, 16 bp, P. troglodytes
ttcatttctagaattt

SEQ ID NO: 283080 - DNA, 16 bp, P. troglodytes
ttcatttctcttaaaa

SEQ ID NO: 283081 - DNA, 16 bp, P. troglodytes
ttcatttctgaaggct

SEQ ID NO: 283082 - DNA, 16 bp, P. troglodytes
ttcatttctgatattg

SEQ ID NO: 283083 - DNA, 16 bp, P. troglodytes
ttcatttcttttaatg

SEQ ID NO: 283084 - DNA, 16 bp, P. troglodytes
ttcatttgaaaaaaaa

SEQ ID NO: 283085 - DNA, 16 bp, P. troglodytes
ttcatttgaaattttt

SEQ ID NO: 283086 - DNA, 16 bp, P. troglodytes
ttcatttgaattttta

SEQ ID NO: 283087 - DNA, 16 bp, P. troglodytes
ttcatttgagatcttt

SEQ ID NO: 283088 - DNA, 16 bp, P. troglodytes
ttcatttgatgtattt

SEQ ID NO: 283089 - DNA, 16 bp, P. troglodytes
ttcatttgcatgaaat

SEQ ID NO: 283090 - DNA, 16 bp, P. troglodytes
ttcatttggaaaaaaa

SEQ ID NO: 283091 - DNA, 16 bp, P. troglodytes
ttcatttggggaaaaa

SEQ ID NO: 283092 - DNA, 16 bp, P. troglodytes
ttcatttgtctgttgg

SEQ ID NO: 283093 - DNA, 16 bp, P. troglodytes
ttcatttgttaaaaat

SEQ ID NO: 283094 - DNA, 16 bp, P. troglodytes
ttcatttgttaattta

SEQ ID NO: 283095 - DNA, 16 bp, P. troglodytes
ttcatttgttcatcca

SEQ ID NO: 283096 - DNA, 16 bp, P. troglodytes
ttcatttgtttcaatt

SEQ ID NO: 283097 - DNA, 16 bp, P. troglodytes
ttcattttaaaagaaa

SEQ ID NO: 283098 - DNA, 16 bp, P. troglodytes
ttcattttaaaatatg

SEQ ID NO: 283099 - DNA, 16 bp, P. troglodytes
ttcattttaaaatgtt

SEQ ID NO: 283100 - DNA, 16 bp, P. troglodytes
ttcattttaacaaaat

SEQ ID NO: 283101 - DNA, 16 bp, P. troglodytes
ttcattttaagaaatt

SEQ ID NO: 283102 - DNA, 16 bp, P. troglodytes
ttcattttaatgaaaa

SEQ ID NO: 283103 - DNA, 16 bp, P. troglodytes
ttcattttacatatga

SEQ ID NO: 283104 - DNA, 16 bp, P. troglodytes
ttcattttaggttcag

SEQ ID NO: 283105 - DNA, 16 bp, P. troglodytes
ttcattttattgcatt

SEQ ID NO: 283106 - DNA, 16 bp, P. troglodytes
ttcattttcaaaatta

SEQ ID NO: 283107 - DNA, 16 bp, P. troglodytes
ttcattttcatcttca

SEQ ID NO: 283108 - DNA, 16 bp, P. troglodytes
ttcattttcatttgtc

SEQ ID NO: 283109 - DNA, 16 bp, P. troglodytes
ttcattttcctctttg

SEQ ID NO: 283110 - DNA, 16 bp, P. troglodytes
ttcattttcctttaaa

SEQ ID NO: 283111 - DNA, 16 bp, P. troglodytes
ttcattttctcattaa

SEQ ID NO: 283112 - DNA, 16 bp, P. troglodytes
ttcattttctctgaaa

SEQ ID NO: 283113 - DNA, 16 bp, P. troglodytes
ttcattttctcttctg

SEQ ID NO: 283114 - DNA, 16 bp, P. troglodytes
ttcattttctttcaaa

SEQ ID NO: 283115 - DNA, 16 bp, P. troglodytes
ttcattttctttggaa

SEQ ID NO: 283116 - DNA, 16 bp, P. troglodytes
ttcattttctttgggt

SEQ ID NO: 283117 - DNA, 16 bp, P. troglodytes
ttcattttgaaaaatt

SEQ ID NO: 283118 - DNA, 16 bp, P. troglodytes
ttcattttgaaaatat

SEQ ID NO: 283119 - DNA, 16 bp, P. troglodytes
ttcattttgaagaaaa

SEQ ID NO: 283120 - DNA, 16 bp, P. troglodytes
ttcattttggaagaaa

SEQ ID NO: 283121 - DNA, 16 bp, P. troglodytes
ttcattttgtaaaaat

SEQ ID NO: 283122 - DNA, 16 bp, P. troglodytes
ttcatttttaaaaaac

SEQ ID NO: 283123 - DNA, 16 bp, P. troglodytes
ttcatttttaaatgtt

SEQ ID NO: 283124 - DNA, 16 bp, P. troglodytes
ttcatttttaatgaaa

SEQ ID NO: 283125 - DNA, 16 bp, P. troglodytes
ttcatttttagaattt

SEQ ID NO: 283126 - DNA, 16 bp, P. troglodytes
ttcatttttatcaaaa

SEQ ID NO: 283127 - DNA, 16 bp, P. troglodytes
ttcatttttatgaatg

SEQ ID NO: 283128 - DNA, 16 bp, P. troglodytes
ttcatttttatggcta

SEQ ID NO: 283129 - DNA, 16 bp, P. troglodytes
ttcatttttctaaaaa

SEQ ID NO: 283130 - DNA, 16 bp, P. troglodytes
ttcatttttcttgcat

SEQ ID NO: 283131 - DNA, 16 bp, P. troglodytes
ttcatttttgaaagat

SEQ ID NO: 283132 - DNA, 16 bp, P. troglodytes
ttcatttttgaagtca

SEQ ID NO: 283133 - DNA, 16 bp, P. troglodytes
ttcatttttgagaaaa

SEQ ID NO: 283134 - DNA, 16 bp, P. troglodytes
ttcatttttgtaaata

SEQ ID NO: 283135 - DNA, 16 bp, P. troglodytes
ttcatttttgtttcaa

SEQ ID NO: 283136 - DNA, 16 bp, P. troglodytes
ttccaaaaagaaagaa

SEQ ID NO: 283137 - DNA, 16 bp, P. troglodytes
ttccaaaacatttcca

SEQ ID NO: 283138 - DNA, 16 bp, P. troglodytes
ttccaaaactgaagaa

SEQ ID NO: 283139 - DNA, 16 bp, P. troglodytes
ttccaaaagaagaaaa

SEQ ID NO: 283140 - DNA, 16 bp, P. troglodytes
ttccaaaagggaaaaa

SEQ ID NO: 283141 - DNA, 16 bp, P. troglodytes
ttccaaaagttttata

SEQ ID NO: 283142 - DNA, 16 bp, P. troglodytes
ttccaaaatactggga

SEQ ID NO: 283143 - DNA, 16 bp, P. troglodytes
ttccaaaatatgaaaa

SEQ ID NO: 283144 - DNA, 16 bp, P. troglodytes
ttccaaaatcaaatta

SEQ ID NO: 283145 - DNA, 19 bp, P. troglodytes
ttccaaaattgaccacata

SEQ ID NO: 283146 - DNA, 16 bp, P. troglodytes
ttccaaacaacagaaa

SEQ ID NO: 283147 - DNA, 16 bp, P. troglodytes
ttccaaaccatatatt

SEQ ID NO: 283148 - DNA, 16 bp, P. troglodytes
ttccaaactgctggga

SEQ ID NO: 283149 - DNA, 16 bp, P. troglodytes
ttccaaactttcagat

SEQ ID NO: 283150 - DNA, 16 bp, P. troglodytes
ttccaaagaaaaagaa

SEQ ID NO: 283151 - DNA, 16 bp, P. troglodytes
ttccaaagacagcaga

SEQ ID NO: 283152 - DNA, 16 bp, P. troglodytes
ttccaaagcattttca

SEQ ID NO: 283153 - DNA, 16 bp, P. troglodytes
ttccaaagtcatttcc

SEQ ID NO: 283154 - DNA, 16 bp, P. troglodytes
ttccaaagtgccagga

SEQ ID NO: 283155 - DNA, 16 bp, P. troglodytes
ttccaaagtggctgta

SEQ ID NO: 283156 - DNA, 16 bp, P. troglodytes
ttccaaagttaaaaaa

SEQ ID NO: 283157 - DNA, 16 bp, P. troglodytes
ttccaaataaaatgtt

SEQ ID NO: 283158 - DNA, 16 bp, P. troglodytes
ttccaaataaatttta

SEQ ID NO: 283159 - DNA, 16 bp, P. troglodytes
ttccaaataattttta

SEQ ID NO: 283160 - DNA, 16 bp, P. troglodytes
ttccaaataggagaaa

SEQ ID NO: 283161 - DNA, 16 bp, P. troglodytes
ttccaaatttcatttt

SEQ ID NO: 283162 - DNA, 16 bp, P. troglodytes
ttccaaatttggtgaa

SEQ ID NO: 283163 - DNA, 16 bp, P. troglodytes
ttccaacacatgaact

SEQ ID NO: 283164 - DNA, 16 bp, P. troglodytes
ttccaacaccatgttg

SEQ ID NO: 283165 - DNA, 16 bp, P. troglodytes
ttccaaccactgggat

SEQ ID NO: 283166 - DNA, 16 bp, P. troglodytes
ttccaacttctgcctg

SEQ ID NO: 283167 - DNA, 16 bp, P. troglodytes
ttccaagaacctatca

SEQ ID NO: 283168 - DNA, 16 bp, P. troglodytes
ttccaagacccccagt

SEQ ID NO: 283169 - DNA, 16 bp, P. troglodytes
ttccaagagttttagg

SEQ ID NO: 283170 - DNA, 16 bp, P. troglodytes
ttccaagcagaaggaa

SEQ ID NO: 283171 - DNA, 16 bp, P. troglodytes
ttccaagctcattcag

SEQ ID NO: 283172 - DNA, 16 bp, P. troglodytes
ttccaaggctgtttgc

SEQ ID NO: 283173 - DNA, 16 bp, P. troglodytes
ttccaagtaactggga

SEQ ID NO: 283174 - DNA, 16 bp, P. troglodytes
ttccaagtgattctga

SEQ ID NO: 283175 - DNA, 16 bp, P. troglodytes
ttccaagttgtttgct

SEQ ID NO: 283176 - DNA, 16 bp, P. troglodytes
ttccaataatggaaca

SEQ ID NO: 283177 - DNA, 18 bp, P. troglodytes
ttccaatactatgttgaa

SEQ ID NO: 283178 - DNA, 16 bp, P. troglodytes
ttccaatactgtgttg

SEQ ID NO: 283179 - DNA, 16 bp, P. troglodytes
ttccaatccatgaaca

SEQ ID NO: 283180 - DNA, 16 bp, P. troglodytes
ttccaatctctctctc

SEQ ID NO: 283181 - DNA, 16 bp, P. troglodytes
ttccaatctgctgaat

SEQ ID NO: 283182 - DNA, 16 bp, P. troglodytes
ttccaatgtgcagcca

SEQ ID NO: 283183 - DNA, 16 bp, P. troglodytes
ttccaatgtggatgcc

SEQ ID NO: 283184 - DNA, 16 bp, P. troglodytes
ttccaattatgtggtc

SEQ ID NO: 283185 - DNA, 16 bp, P. troglodytes
ttccaattctgtgaat

SEQ ID NO: 283186 - DNA, 16 bp, P. troglodytes
ttccaattgtgtgaag

SEQ ID NO: 283187 - DNA, 16 bp, P. troglodytes
ttccacaaaaaataca

SEQ ID NO: 283188 - DNA, 16 bp, P. troglodytes
ttccacaaaacactag

SEQ ID NO: 283189 - DNA, 16 bp, P. troglodytes
ttccacaaatatttat

SEQ ID NO: 283190 - DNA, 16 bp, P. troglodytes
ttccacaaggaatctc

SEQ ID NO: 283191 - DNA, 16 bp, P. troglodytes
ttccacaatgcataca

SEQ ID NO: 283192 - DNA, 19 bp, P. troglodytes
ttccacaatggttgaacta

SEQ ID NO: 283193 - DNA, 16 bp, P. troglodytes
ttccacagattttttt

SEQ ID NO: 283194 - DNA, 16 bp, P. troglodytes
ttccacaggcaggtca

SEQ ID NO: 283195 - DNA, 16 bp, P. troglodytes
ttccacagggctggag

SEQ ID NO: 283196 - DNA, 16 bp, P. troglodytes
ttccacagtgactgaa

SEQ ID NO: 283197 - DNA, 16 bp, P. troglodytes
ttccacagtggctaca

SEQ ID NO: 283198 - DNA, 16 bp, P. troglodytes
ttccacagtttcacct

SEQ ID NO: 283199 - DNA, 16 bp, P. troglodytes
ttccacatatcagtga

SEQ ID NO: 283200 - DNA, 16 bp, P. troglodytes
ttccacatcagcctcc

SEQ ID NO: 283201 - DNA, 16 bp, P. troglodytes
ttccacatgcaaaaga

SEQ ID NO: 283202 - DNA, 16 bp, P. troglodytes
ttccacatgcatttta

SEQ ID NO: 283203 - DNA, 16 bp, P. troglodytes
ttccacatggtgttgg

SEQ ID NO: 283204 - DNA, 16 bp, P. troglodytes
ttccacatgtaagtga

SEQ ID NO: 283205 - DNA, 16 bp, P. troglodytes
ttccacattgattttg

SEQ ID NO: 283206 - DNA, 16 bp, P. troglodytes
ttccacattttcaggt

SEQ ID NO: 283207 - DNA, 16 bp, P. troglodytes
ttccacatttttacaa

SEQ ID NO: 283208 - DNA, 16 bp, P. troglodytes
ttccaccatatgagga

SEQ ID NO: 283209 - DNA, 16 bp, P. troglodytes
ttccaccatgactgtg

SEQ ID NO: 283210 - DNA, 16 bp, P. troglodytes
ttccaccatgtgagga

SEQ ID NO: 283211 - DNA, 16 bp, P. troglodytes
ttccaccccagcccct

SEQ ID NO: 283212 - DNA, 16 bp, P. troglodytes
ttccacccgccttggc

SEQ ID NO: 283213 - DNA, 18 bp, P. troglodytes
ttccaccgtgattgtgag

SEQ ID NO: 283214 - DNA, 16 bp, P. troglodytes
ttccacctcagcctca

SEQ ID NO: 283215 - DNA, 16 bp, P. troglodytes
ttccacctcccagatt

SEQ ID NO: 283216 - DNA, 16 bp, P. troglodytes
ttccacctctgccacc

SEQ ID NO: 283217 - DNA, 16 bp, P. troglodytes
ttccacctgctcctcc

SEQ ID NO: 283218 - DNA, 16 bp, P. troglodytes
ttccaccttcttctgc

SEQ ID NO: 283219 - DNA, 16 bp, P. troglodytes
ttccaccttggcttcc

SEQ ID NO: 283220 - DNA, 16 bp, P. troglodytes
ttccaccttttggcta

SEQ ID NO: 283221 - DNA, 16 bp, P. troglodytes
ttccactatggtctga

SEQ ID NO: 283222 - DNA, 16 bp, P. troglodytes
ttccactgcaggcacc

SEQ ID NO: 283223 - DNA, 16 bp, P. troglodytes
ttccactgtgtgtgtg

SEQ ID NO: 283224 - DNA, 16 bp, P. troglodytes
ttccactgttgtctga

SEQ ID NO: 283225 - DNA, 16 bp, P. troglodytes
ttccacttaaatgagg

SEQ ID NO: 283226 - DNA, 16 bp, P. troglodytes
ttccacttatatgaaa

SEQ ID NO: 283227 - DNA, 16 bp, P. troglodytes
ttccacttcctgtgtc

SEQ ID NO: 283228 - DNA, 16 bp, P. troglodytes
ttccactttttgccca

SEQ ID NO: 283229 - DNA, 16 bp, P. troglodytes
ttccagaaaaaaaatt

SEQ ID NO: 283230 - DNA, 16 bp, P. troglodytes
ttccagaaaaagaaga

SEQ ID NO: 283231 - DNA, 16 bp, P. troglodytes
ttccagaaaatataaa

SEQ ID NO: 283232 - DNA, 16 bp, P. troglodytes
ttccagaaaggattta

SEQ ID NO: 283233 - DNA, 16 bp, P. troglodytes
ttccagaaataaaaat

SEQ ID NO: 283234 - DNA, 16 bp, P. troglodytes
ttccagaacatttcat

SEQ ID NO: 283235 - DNA, 16 bp, P. troglodytes
ttccagaagaaaacag

SEQ ID NO: 283236 - DNA, 16 bp, P. troglodytes
ttccagaagaaaacat

SEQ ID NO: 283237 - DNA, 16 bp, P. troglodytes
ttccagaagattttca

SEQ ID NO: 283238 - DNA, 16 bp, P. troglodytes
ttccagaaggagaaga

SEQ ID NO: 283239 - DNA, 16 bp, P. troglodytes
ttccagaaggagagaa

SEQ ID NO: 283240 - DNA, 16 bp, P. troglodytes
ttccagaatgctggga

SEQ ID NO: 283241 - DNA, 16 bp, P. troglodytes
ttccagaatgtcatgt

SEQ ID NO: 283242 - DNA, 16 bp, P. troglodytes
ttccagaattttccat

SEQ ID NO: 283243 - DNA, 16 bp, P. troglodytes
ttccagacagaaaatc

SEQ ID NO: 283244 - DNA, 16 bp, P. troglodytes
ttccagaccttgccct

SEQ ID NO: 283245 - DNA, 16 bp, P. troglodytes
ttccagacggagtctc

SEQ ID NO: 283246 - DNA, 16 bp, P. troglodytes
ttccagactcccagaa

SEQ ID NO: 283247 - DNA, 16 bp, P. troglodytes
ttccagagaacagaaa

SEQ ID NO: 283248 - DNA, 16 bp, P. troglodytes
ttccagagaagagaaa

SEQ ID NO: 283249 - DNA, 16 bp, P. troglodytes
ttccagagattttggt

SEQ ID NO: 283250 - DNA, 16 bp, P. troglodytes
ttccagagcttatata

SEQ ID NO: 283251 - DNA, 16 bp, P. troglodytes
ttccagaggaagaagc

SEQ ID NO: 283252 - DNA, 16 bp, P. troglodytes
ttccagaggagattgg

SEQ ID NO: 283253 - DNA, 16 bp, P. troglodytes
ttccagaggctgggaa

SEQ ID NO: 283254 - DNA, 16 bp, P. troglodytes
ttccagatgaggaaaa

SEQ ID NO: 283255 - DNA, 16 bp, P. troglodytes
ttccagatttttttct

SEQ ID NO: 283256 - DNA, 16 bp, P. troglodytes
ttccagcaaactccaa

SEQ ID NO: 283257 - DNA, 16 bp, P. troglodytes
ttccagcaacatttat

SEQ ID NO: 283258 - DNA, 16 bp, P. troglodytes
ttccagcacttcagga

SEQ ID NO: 283259 - DNA, 16 bp, P. troglodytes
ttccagcacttttgga

SEQ ID NO: 283260 - DNA, 16 bp, P. troglodytes
ttccagcatttgggga

SEQ ID NO: 283261 - DNA, 16 bp, P. troglodytes
ttccagcccagatact

SEQ ID NO: 283262 - DNA, 16 bp, P. troglodytes
ttccagcccccagaac

SEQ ID NO: 283263 - DNA, 16 bp, P. troglodytes
ttccagcctccagaac

SEQ ID NO: 283264 - DNA, 16 bp, P. troglodytes
ttccagcctccagaag

SEQ ID NO: 283265 - DNA, 16 bp, P. troglodytes
ttccagcctccagaat

SEQ ID NO: 283266 - DNA, 16 bp, P. troglodytes
ttccagcctccaggac

SEQ ID NO: 283267 - DNA, 16 bp, P. troglodytes
ttccagcctccctttc

SEQ ID NO: 283268 - DNA, 16 bp, P. troglodytes
ttccagcctgagcaac

SEQ ID NO: 283269 - DNA, 17 bp, P. troglodytes
ttccagcctgagcgaca

SEQ ID NO: 283270 - DNA, 16 bp, P. troglodytes
ttccagcctgcagaac

SEQ ID NO: 283271 - DNA, 16 bp, P. troglodytes
ttccagcctgggcaat

SEQ ID NO: 283272 - DNA, 16 bp, P. troglodytes
ttccagctactcagca

SEQ ID NO: 283273 - DNA, 16 bp, P. troglodytes
ttccagctccccatcc

SEQ ID NO: 283274 - DNA, 16 bp, P. troglodytes
ttccagctctgaaatt

SEQ ID NO: 283275 - DNA, 16 bp, P. troglodytes
ttccagctctgccact

SEQ ID NO: 283276 - DNA, 16 bp, P. troglodytes
ttccagctgctccagc

SEQ ID NO: 283277 - DNA, 16 bp, P. troglodytes
ttccagctgtgcctgc

SEQ ID NO: 283278 - DNA, 16 bp, P. troglodytes
ttccagcttccagaac

SEQ ID NO: 283279 - DNA, 16 bp, P. troglodytes
ttccagcttctagagg

SEQ ID NO: 283280 - DNA, 17 bp, P. troglodytes
ttccagcttgggcaaca

SEQ ID NO: 283281 - DNA, 16 bp, P. troglodytes
ttccagcttttcttct

SEQ ID NO: 283282 - DNA, 16 bp, P. troglodytes
ttccaggaagagggaa

SEQ ID NO: 283283 - DNA, 16 bp, P. troglodytes
ttccaggaatcttcat

SEQ ID NO: 283284 - DNA, 16 bp, P. troglodytes
ttccaggaatgcaaag

SEQ ID NO: 283285 - DNA, 16 bp, P. troglodytes
ttccaggaattttttt

SEQ ID NO: 283286 - DNA, 16 bp, P. troglodytes
ttccaggaccttcacc

SEQ ID NO: 283287 - DNA, 16 bp, P. troglodytes
ttccaggattctacag

SEQ ID NO: 283288 - DNA, 16 bp, P. troglodytes
ttccaggcaaaaggaa

SEQ ID NO: 283289 - DNA, 16 bp, P. troglodytes
ttccaggcaaagggaa

SEQ ID NO: 283290 - DNA, 16 bp, P. troglodytes
ttccaggcagagaaaa

SEQ ID NO: 283291 - DNA, 16 bp, P. troglodytes
ttccaggcagagggaa

SEQ ID NO: 283292 - DNA, 16 bp, P. troglodytes
ttccaggcagtgggtg

SEQ ID NO: 283293 - DNA, 16 bp, P. troglodytes
ttccaggccctaaaga

SEQ ID NO: 283294 - DNA, 16 bp, P. troglodytes
ttccaggctctagctc

SEQ ID NO: 283295 - DNA, 16 bp, P. troglodytes
ttccaggctgagggaa

SEQ ID NO: 283296 - DNA, 16 bp, P. troglodytes
ttccagggattagaat

SEQ ID NO: 283297 - DNA, 16 bp, P. troglodytes
ttccaggggctaatct

SEQ ID NO: 283298 - DNA, 16 bp, P. troglodytes
ttccaggggctctggg

SEQ ID NO: 283299 - DNA, 16 bp, P. troglodytes
ttccaggtggagggaa

SEQ ID NO: 283300 - DNA, 16 bp, P. troglodytes
ttccaggtgggcatgg

SEQ ID NO: 283301 - DNA, 16 bp, P. troglodytes
ttccaggtgggtgtgg

SEQ ID NO: 283302 - DNA, 16 bp, P. troglodytes
ttccagtaatggaaca

SEQ ID NO: 283303 - DNA, 16 bp, P. troglodytes
ttccagtacctggagg

SEQ ID NO: 283304 - DNA, 16 bp, P. troglodytes
ttccagtagcagcagt

SEQ ID NO: 283305 - DNA, 16 bp, P. troglodytes
ttccagtcctggctct

SEQ ID NO: 283306 - DNA, 16 bp, P. troglodytes
ttccagtgggataaga

SEQ ID NO: 283307 - DNA, 16 bp, P. troglodytes
ttccagtgtcatccat

SEQ ID NO: 283308 - DNA, 16 bp, P. troglodytes
ttccagttatacagat

SEQ ID NO: 283309 - DNA, 16 bp, P. troglodytes
ttccagttccagaatt

SEQ ID NO: 283310 - DNA, 16 bp, P. troglodytes
ttccagttcctgtagc

SEQ ID NO: 283311 - DNA, 16 bp, P. troglodytes
ttccagttctcagaga

SEQ ID NO: 283312 - DNA, 16 bp, P. troglodytes
ttccagttgattgcat

SEQ ID NO: 283313 - DNA, 16 bp, P. troglodytes
ttccagtttctctaca

SEQ ID NO: 283314 - DNA, 16 bp, P. troglodytes
ttccagtttctctgca

SEQ ID NO: 283315 - DNA, 16 bp, P. troglodytes
ttccagtttggggcta

SEQ ID NO: 283316 - DNA, 16 bp, P. troglodytes
ttccagtttgtggctt

SEQ ID NO: 283317 - DNA, 16 bp, P. troglodytes
ttccagttttattctt

SEQ ID NO: 283318 - DNA, 16 bp, P. troglodytes
ttccagttttgttttg

SEQ ID NO: 283319 - DNA, 16 bp, P. troglodytes
ttccagtttttctgtt

SEQ ID NO: 283320 - DNA, 16 bp, P. troglodytes
ttccagtttttggcaa

SEQ ID NO: 283321 - DNA, 16 bp, P. troglodytes
ttccatacatatttta

SEQ ID NO: 283322 - DNA, 16 bp, P. troglodytes
ttccatagatgtctat

SEQ ID NO: 283323 - DNA, 16 bp, P. troglodytes
ttccatataaatatta

SEQ ID NO: 283324 - DNA, 16 bp, P. troglodytes
ttccatataaatttta

SEQ ID NO: 283325 - DNA, 17 bp, P. troglodytes
ttccatatatatatata

SEQ ID NO: 283326 - DNA, 16 bp, P. troglodytes
ttccatatggctggga

SEQ ID NO: 283327 - DNA, 16 bp, P. troglodytes
ttccatatttttaaaa

SEQ ID NO: 283328 - DNA, 16 bp, P. troglodytes
ttccatatttttacaa

SEQ ID NO: 283329 - DNA, 16 bp, P. troglodytes
ttccatcatatgaata

SEQ ID NO: 283330 - DNA, 16 bp, P. troglodytes
ttccatcatgactgta

SEQ ID NO: 283331 - DNA, 16 bp, P. troglodytes
ttccatccaacagcag

SEQ ID NO: 283332 - DNA, 16 bp, P. troglodytes
ttccatccctggcccc

SEQ ID NO: 283333 - DNA, 17 bp, P. troglodytes
ttccatctcaaaaaaat

SEQ ID NO: 283334 - DNA, 16 bp, P. troglodytes
ttccatctcccaggtt

SEQ ID NO: 283335 - DNA, 16 bp, P. troglodytes
ttccatctcttcactt

SEQ ID NO: 283336 - DNA, 16 bp, P. troglodytes
ttccatctcttctgcc

SEQ ID NO: 283337 - DNA, 16 bp, P. troglodytes
ttccatctgagacctc

SEQ ID NO: 283338 - DNA, 16 bp, P. troglodytes
ttccatctgggtcctt

SEQ ID NO: 283339 - DNA, 16 bp, P. troglodytes
ttccatgccctccctg

SEQ ID NO: 283340 - DNA, 16 bp, P. troglodytes
ttccatggtttcagtt

SEQ ID NO: 283341 - DNA, 16 bp, P. troglodytes
ttccatgtaatatttt

SEQ ID NO: 283342 - DNA, 16 bp, P. troglodytes
ttccatgtcagtacat

SEQ ID NO: 283343 - DNA, 16 bp, P. troglodytes
ttccatgtctttgtta

SEQ ID NO: 283344 - DNA, 16 bp, P. troglodytes
ttccatgtgaacttta

SEQ ID NO: 283345 - DNA, 16 bp, P. troglodytes
ttccatgtgctgttga

SEQ ID NO: 283346 - DNA, 16 bp, P. troglodytes
ttccatgtggtgttaa

SEQ ID NO: 283347 - DNA, 16 bp, P. troglodytes
ttccatgtgtatatgt

SEQ ID NO: 283348 - DNA, 16 bp, P. troglodytes
ttccattcaaaatatt

SEQ ID NO: 283349 - DNA, 16 bp, P. troglodytes
ttccattcatctgttg

SEQ ID NO: 283350 - DNA, 16 bp, P. troglodytes
ttccattccatttcat

SEQ ID NO: 283351 - DNA, 16 bp, P. troglodytes
ttccattctcatggat

SEQ ID NO: 283352 - DNA, 16 bp, P. troglodytes
ttccattgaatatttt

SEQ ID NO: 283353 - DNA, 16 bp, P. troglodytes
ttccattgaccttaat

SEQ ID NO: 283354 - DNA, 16 bp, P. troglodytes
ttccattgagaagtct

SEQ ID NO: 283355 - DNA, 16 bp, P. troglodytes
ttccattgatctatgt

SEQ ID NO: 283356 - DNA, 18 bp, P. troglodytes
ttccattgctggtgagga

SEQ ID NO: 283357 - DNA, 16 bp, P. troglodytes
ttccattgtatgaata

SEQ ID NO: 283358 - DNA, 16 bp, P. troglodytes
ttccattgtatttata

SEQ ID NO: 283359 - DNA, 16 bp, P. troglodytes
ttccattgtgtggatg

SEQ ID NO: 283360 - DNA, 16 bp, P. troglodytes
ttccattgttttatat

SEQ ID NO: 283361 - DNA, 16 bp, P. troglodytes
ttccatttatttgtct

SEQ ID NO: 283362 - DNA, 16 bp, P. troglodytes
ttccatttattttcca

SEQ ID NO: 283363 - DNA, 16 bp, P. troglodytes
ttccatttctacaaaa

SEQ ID NO: 283364 - DNA, 16 bp, P. troglodytes
ttccatttctataaaa

SEQ ID NO: 283365 - DNA, 16 bp, P. troglodytes
ttccatttctctggag

SEQ ID NO: 283366 - DNA, 16 bp, P. troglodytes
ttccatttctgcaaaa

SEQ ID NO: 283367 - DNA, 16 bp, P. troglodytes
ttccatttctgccttt

SEQ ID NO: 283368 - DNA, 16 bp, P. troglodytes
ttccatttgaaaatat

SEQ ID NO: 283369 - DNA, 16 bp, P. troglodytes
ttccatttgcttgtgt

SEQ ID NO: 283370 - DNA, 16 bp, P. troglodytes
ttccatttgttgtgtc

SEQ ID NO: 283371 - DNA, 16 bp, P. troglodytes
ttccatttgtttatgt

SEQ ID NO: 283372 - DNA, 16 bp, P. troglodytes
ttccatttgttttcaa

SEQ ID NO: 283373 - DNA, 16 bp, P. troglodytes
ttccattttcaaaatt

SEQ ID NO: 283374 - DNA, 16 bp, P. troglodytes
ttccattttgtgtata

SEQ ID NO: 283375 - DNA, 16 bp, P. troglodytes
ttccatttttaaaacc

SEQ ID NO: 283376 - DNA, 16 bp, P. troglodytes
ttccatttttactaaa

SEQ ID NO: 283377 - DNA, 16 bp, P. troglodytes
ttccatttttttgcta

SEQ ID NO: 283378 - DNA, 16 bp, P. troglodytes
ttcccaaaagaagaca

SEQ ID NO: 283379 - DNA, 16 bp, P. troglodytes
ttcccaaaattctggg

SEQ ID NO: 283380 - DNA, 16 bp, P. troglodytes
ttcccaaacctagcaa

SEQ ID NO: 283381 - DNA, 16 bp, P. troglodytes
ttcccaaacctggctg

SEQ ID NO: 283382 - DNA, 22 bp, P. troglodytes
ttcccaaagtgctggaattaca

SEQ ID NO: 283383 - DNA, 16 bp, P. troglodytes
ttcccaacaaattcct

SEQ ID NO: 283384 - DNA, 16 bp, P. troglodytes
ttcccaacacaaagat

SEQ ID NO: 283385 - DNA, 16 bp, P. troglodytes
ttcccaactcattcta

SEQ ID NO: 283386 - DNA, 16 bp, P. troglodytes
ttcccaactctgtgtt

SEQ ID NO: 283387 - DNA, 16 bp, P. troglodytes
ttcccaatttttaaat

SEQ ID NO: 283388 - DNA, 16 bp, P. troglodytes
ttcccacaaaagacat

SEQ ID NO: 283389 - DNA, 16 bp, P. troglodytes
ttcccacagttctgga

SEQ ID NO: 283390 - DNA, 16 bp, P. troglodytes
ttcccacattttcttg

SEQ ID NO: 283391 - DNA, 16 bp, P. troglodytes
ttcccaccagcctgat

SEQ ID NO: 283392 - DNA, 16 bp, P. troglodytes
ttcccacctaggagtg

SEQ ID NO: 283393 - DNA, 20 bp, P. troglodytes
ttcccacctatgagtgagaa

SEQ ID NO: 283394 - DNA, 16 bp, P. troglodytes
ttcccacctcagcccc

SEQ ID NO: 283395 - DNA, 16 bp, P. troglodytes
ttcccacctcagcctc

SEQ ID NO: 283396 - DNA, 16 bp, P. troglodytes
ttcccacctcagcctt

SEQ ID NO: 283397 - DNA, 16 bp, P. troglodytes
ttcccacctcaggctc

SEQ ID NO: 283398 - DNA, 16 bp, P. troglodytes
ttcccacctgtaaaat

SEQ ID NO: 283399 - DNA, 16 bp, P. troglodytes
ttcccacctgtgaaat

SEQ ID NO: 283400 - DNA, 16 bp, P. troglodytes
ttcccacttcacacct

SEQ ID NO: 283401 - DNA, 16 bp, P. troglodytes
ttcccagaagccccca

SEQ ID NO: 283402 - DNA, 16 bp, P. troglodytes
ttcccagactcccttg

SEQ ID NO: 283403 - DNA, 16 bp, P. troglodytes
ttcccagactggagtg

SEQ ID NO: 283404 - DNA, 16 bp, P. troglodytes
ttcccagagaagcaaa

SEQ ID NO: 283405 - DNA, 16 bp, P. troglodytes
ttcccagagtgtgatg

SEQ ID NO: 283406 - DNA, 17 bp, P. troglodytes
ttcccagcactttggga

SEQ ID NO: 283407 - DNA, 16 bp, P. troglodytes
ttcccagcctacagaa

SEQ ID NO: 283408 - DNA, 16 bp, P. troglodytes
ttcccagcctccagaa

SEQ ID NO: 283409 - DNA, 16 bp, P. troglodytes
ttcccagcctctagaa

SEQ ID NO: 283410 - DNA, 16 bp, P. troglodytes
ttcccagctatggtgg

SEQ ID NO: 283411 - DNA, 16 bp, P. troglodytes
ttcccagctgctcagg

SEQ ID NO: 283412 - DNA, 16 bp, P. troglodytes
ttcccagcttcctccc

SEQ ID NO: 283413 - DNA, 20 bp, P. troglodytes
ttcccaggcattgtgaagac

SEQ ID NO: 283414 - DNA, 16 bp, P. troglodytes
ttcccaggctccagtg

SEQ ID NO: 283415 - DNA, 16 bp, P. troglodytes
ttcccaggctggtctg

SEQ ID NO: 283416 - DNA, 17 bp, P. troglodytes
ttcccaggtagctggga

SEQ ID NO: 283417 - DNA, 16 bp, P. troglodytes
ttcccaggtgttcttt

SEQ ID NO: 283418 - DNA, 16 bp, P. troglodytes
ttcccagtccccagaa

SEQ ID NO: 283419 - DNA, 16 bp, P. troglodytes
ttcccagtgcccagga

SEQ ID NO: 283420 - DNA, 16 bp, P. troglodytes
ttcccagttactcagg

SEQ ID NO: 283421 - DNA, 16 bp, P. troglodytes
ttcccagttctaaggc

SEQ ID NO: 283422 - DNA, 16 bp, P. troglodytes
ttcccataaagaaaac

SEQ ID NO: 283423 - DNA, 16 bp, P. troglodytes
ttcccatctcagcttc

SEQ ID NO: 283424 - DNA, 16 bp, P. troglodytes
ttcccatctgtaaaat

SEQ ID NO: 283425 - DNA, 16 bp, P. troglodytes
ttcccatcttacagat

SEQ ID NO: 283426 - DNA, 16 bp, P. troglodytes
ttcccatgctgttctc

SEQ ID NO: 283427 - DNA, 16 bp, P. troglodytes
ttcccattaaaaaaaa

SEQ ID NO: 283428 - DNA, 16 bp, P. troglodytes
ttcccattttacaaaa

SEQ ID NO: 283429 - DNA, 16 bp, P. troglodytes
ttcccattttacagat

SEQ ID NO: 283430 - DNA, 16 bp, P. troglodytes
ttccccaaaaacctat

SEQ ID NO: 283431 - DNA, 16 bp, P. troglodytes
ttccccaaaactcaac

SEQ ID NO: 283432 - DNA, 16 bp, P. troglodytes
ttccccaaagtcttaa

SEQ ID NO: 283433 - DNA, 16 bp, P. troglodytes
ttccccaaatatgttt

SEQ ID NO: 283434 - DNA, 19 bp, P. troglodytes
ttccccaaattaatacttt

SEQ ID NO: 283435 - DNA, 16 bp, P. troglodytes
ttccccacagccttgc

SEQ ID NO: 283436 - DNA, 16 bp, P. troglodytes
ttccccagaagcagaa

SEQ ID NO: 283437 - DNA, 16 bp, P. troglodytes
ttccccagcctagcaa

SEQ ID NO: 283438 - DNA, 16 bp, P. troglodytes
ttccccaggctggact

SEQ ID NO: 283439 - DNA, 16 bp, P. troglodytes
ttccccaggctggagt

SEQ ID NO: 283440 - DNA, 16 bp, P. troglodytes
ttccccaggctggcct

SEQ ID NO: 283441 - DNA, 16 bp, P. troglodytes
ttccccaggctggtct

SEQ ID NO: 283442 - DNA, 16 bp, P. troglodytes
ttccccagtagctgag

SEQ ID NO: 283443 - DNA, 16 bp, P. troglodytes
ttccccagtgccagcc

SEQ ID NO: 283444 - DNA, 16 bp, P. troglodytes
ttccccataaatttat

SEQ ID NO: 283445 - DNA, 16 bp, P. troglodytes
ttccccatccccagta

SEQ ID NO: 283446 - DNA, 16 bp, P. troglodytes
ttccccatctccatct

SEQ ID NO: 283447 - DNA, 16 bp, P. troglodytes
ttccccatctttaaaa

SEQ ID NO: 283448 - DNA, 16 bp, P. troglodytes
ttccccatggtcttgg

SEQ ID NO: 283449 - DNA, 16 bp, P. troglodytes
ttccccatgtggccct

SEQ ID NO: 283450 - DNA, 16 bp, P. troglodytes
ttccccattcagtgtg

SEQ ID NO: 283451 - DNA, 16 bp, P. troglodytes
ttccccatttctgttt

SEQ ID NO: 283452 - DNA, 16 bp, P. troglodytes
ttcccccaaatcccca

SEQ ID NO: 283453 - DNA, 17 bp, P. troglodytes
ttcccccatactgttct

SEQ ID NO: 283454 - DNA, 17 bp, P. troglodytes
ttcccccatgctgttct

SEQ ID NO: 283455 - DNA, 16 bp, P. troglodytes
ttccccccacctcagc

SEQ ID NO: 283456 - DNA, 16 bp, P. troglodytes
ttccccctcctcccag

SEQ ID NO: 283457 - DNA, 16 bp, P. troglodytes
ttccccgagtccccaa

SEQ ID NO: 283458 - DNA, 16 bp, P. troglodytes
ttcccctcactgtgtc

SEQ ID NO: 283459 - DNA, 16 bp, P. troglodytes
ttcccctccagcccac

SEQ ID NO: 283460 - DNA, 16 bp, P. troglodytes
ttcccctctggcccag

SEQ ID NO: 283461 - DNA, 16 bp, P. troglodytes
ttcccctctgtgtcca

SEQ ID NO: 283462 - DNA, 16 bp, P. troglodytes
ttcccctctttgtgcc

SEQ ID NO: 283463 - DNA, 16 bp, P. troglodytes
ttcccctgaagcaggt

SEQ ID NO: 283464 - DNA, 16 bp, P. troglodytes
ttcccctgagtcccca

SEQ ID NO: 283465 - DNA, 16 bp, P. troglodytes
ttcccctgcacatgct

SEQ ID NO: 283466 - DNA, 16 bp, P. troglodytes
ttcccctgccccattt

SEQ ID NO: 283467 - DNA, 16 bp, P. troglodytes
ttcccctgcctcaggc

SEQ ID NO: 283468 - DNA, 16 bp, P. troglodytes
ttcccctgcttcagcc

SEQ ID NO: 283469 - DNA, 18 bp, P. troglodytes
ttccccttcctgtgtcca

SEQ ID NO: 283470 - DNA, 16 bp, P. troglodytes
ttccccttctgccatg

SEQ ID NO: 283471 - DNA, 16 bp, P. troglodytes
ttcccctttcacttgg

SEQ ID NO: 283472 - DNA, 16 bp, P. troglodytes
ttcccgggttcaagcg

SEQ ID NO: 283473 - DNA, 16 bp, P. troglodytes
ttccctaaacaataca

SEQ ID NO: 283474 - DNA, 16 bp, P. troglodytes
ttccctaagtgctggg

SEQ ID NO: 283475 - DNA, 16 bp, P. troglodytes
ttccctatgaattcat

SEQ ID NO: 283476 - DNA, 16 bp, P. troglodytes
ttccctatgttgccca

SEQ ID NO: 283477 - DNA, 16 bp, P. troglodytes
ttccctcagcttttgt

SEQ ID NO: 283478 - DNA, 16 bp, P. troglodytes
ttccctcagtttttat

SEQ ID NO: 283479 - DNA, 16 bp, P. troglodytes
ttccctccacctggaa

SEQ ID NO: 283480 - DNA, 16 bp, P. troglodytes
ttccctccctgtgtcc

SEQ ID NO: 283481 - DNA, 16 bp, P. troglodytes
ttccctcctcagcctc

SEQ ID NO: 283482 - DNA, 16 bp, P. troglodytes
ttccctcctgtgcctg

SEQ ID NO: 283483 - DNA, 16 bp, P. troglodytes
ttccctctccctggaa

SEQ ID NO: 283484 - DNA, 16 bp, P. troglodytes
ttccctctgtacatgt

SEQ ID NO: 283485 - DNA, 16 bp, P. troglodytes
ttccctctgtgggtaa

SEQ ID NO: 283486 - DNA, 16 bp, P. troglodytes
ttccctcttaggcctc

SEQ ID NO: 283487 - DNA, 16 bp, P. troglodytes
ttccctgcccaaatct

SEQ ID NO: 283488 - DNA, 16 bp, P. troglodytes
ttccctgccccagccc

SEQ ID NO: 283489 - DNA, 17 bp, P. troglodytes
ttccctgcctcagcctc

SEQ ID NO: 283490 - DNA, 16 bp, P. troglodytes
ttccctgcctccagac

SEQ ID NO: 283491 - DNA, 16 bp, P. troglodytes
ttccctggaaagcaga

SEQ ID NO: 283492 - DNA, 16 bp, P. troglodytes
ttccctgggcctcagt

SEQ ID NO: 283493 - DNA, 16 bp, P. troglodytes
ttccctgggctggtct

SEQ ID NO: 283494 - DNA, 16 bp, P. troglodytes
ttccctggttctgagg

SEQ ID NO: 283495 - DNA, 16 bp, P. troglodytes
ttccctgtgtcccagc

SEQ ID NO: 283496 - DNA, 16 bp, P. troglodytes
ttcccttctattcctg

SEQ ID NO: 283497 - DNA, 16 bp, P. troglodytes
ttccctttatatatat

SEQ ID NO: 283498 - DNA, 16 bp, P. troglodytes
ttccctttgaaaactt

SEQ ID NO: 283499 - DNA, 16 bp, P. troglodytes
ttccctttgaaaattg

SEQ ID NO: 283500 - DNA, 16 bp, P. troglodytes
ttccctttgctttcag

SEQ ID NO: 283501 - DNA, 16 bp, P. troglodytes
ttccctttgggtagat

SEQ ID NO: 283502 - DNA, 16 bp, P. troglodytes
ttccctttgtgtgtgt

SEQ ID NO: 283503 - DNA, 16 bp, P. troglodytes
ttcccttttaaaattg

SEQ ID NO: 283504 - DNA, 16 bp, P. troglodytes
ttcccttttccccaca

SEQ ID NO: 283505 - DNA, 16 bp, P. troglodytes
ttcccttttctccaca

SEQ ID NO: 283506 - DNA, 16 bp, P. troglodytes
ttcccttttctctgta

SEQ ID NO: 283507 - DNA, 16 bp, P. troglodytes
ttcccttttgatttct

SEQ ID NO: 283508 - DNA, 16 bp, P. troglodytes
ttccctttttccacat

SEQ ID NO: 283509 - DNA, 16 bp, P. troglodytes
ttccgcctcagcctcc

SEQ ID NO: 283510 - DNA, 17 bp, P. troglodytes
ttccgccttctgggttc

SEQ ID NO: 283511 - DNA, 16 bp, P. troglodytes
ttccggccgggcgcgg

SEQ ID NO: 283512 - DNA, 16 bp, P. troglodytes
ttccgggttcaagtga

SEQ ID NO: 283513 - DNA, 16 bp, P. troglodytes
ttccggtacaccaagg

SEQ ID NO: 283514 - DNA, 16 bp, P. troglodytes
ttcctaaagtgctgag

SEQ ID NO: 283515 - DNA, 16 bp, P. troglodytes
ttcctaaatatttaat

SEQ ID NO: 283516 - DNA, 16 bp, P. troglodytes
ttcctaacaggccaca

SEQ ID NO: 283517 - DNA, 16 bp, P. troglodytes
ttcctaacaggtcatg

SEQ ID NO: 283518 - DNA, 16 bp, P. troglodytes
ttcctaagcagcaaag

SEQ ID NO: 283519 - DNA, 16 bp, P. troglodytes
ttcctaagcctcagtt

SEQ ID NO: 283520 - DNA, 16 bp, P. troglodytes
ttcctaatattttgtt

SEQ ID NO: 283521 - DNA, 16 bp, P. troglodytes
ttcctaatctataaaa

SEQ ID NO: 283522 - DNA, 16 bp, P. troglodytes
ttcctaattattttac

SEQ ID NO: 283523 - DNA, 16 bp, P. troglodytes
ttcctagaggaggtga

SEQ ID NO: 283524 - DNA, 17 bp, P. troglodytes
ttcctagcactttggga

SEQ ID NO: 283525 - DNA, 16 bp, P. troglodytes
ttcctagccaaggaaa

SEQ ID NO: 283526 - DNA, 16 bp, P. troglodytes
ttcctagcctccaaaa

SEQ ID NO: 283527 - DNA, 16 bp, P. troglodytes
ttcctagctgtgtgac

SEQ ID NO: 283528 - DNA, 16 bp, P. troglodytes
ttcctaggtgatgctg

SEQ ID NO: 283529 - DNA, 16 bp, P. troglodytes
ttcctatcaaaatctc

SEQ ID NO: 283530 - DNA, 16 bp, P. troglodytes
ttcctatgtcctgaat

SEQ ID NO: 283531 - DNA, 18 bp, P. troglodytes
ttcctattcggccatctt

SEQ ID NO: 283532 - DNA, 16 bp, P. troglodytes
ttcctattgctactgt

SEQ ID NO: 283533 - DNA, 16 bp, P. troglodytes
ttcctatttggatgcc

SEQ ID NO: 283534 - DNA, 16 bp, P. troglodytes
ttcctattttgattaa

SEQ ID NO: 283535 - DNA, 16 bp, P. troglodytes
ttcctcaaacaaaaca

SEQ ID NO: 283536 - DNA, 16 bp, P. troglodytes
ttcctcaaagagctaa

SEQ ID NO: 283537 - DNA, 16 bp, P. troglodytes
ttcctcaagaagagca

SEQ ID NO: 283538 - DNA, 16 bp, P. troglodytes
ttcctcaccagcaaca

SEQ ID NO: 283539 - DNA, 16 bp, P. troglodytes
ttcctcacctgtgaaa

SEQ ID NO: 283540 - DNA, 16 bp, P. troglodytes
ttcctcagcaaggcca

SEQ ID NO: 283541 - DNA, 16 bp, P. troglodytes
ttcctcagcagaaacc

SEQ ID NO: 283542 - DNA, 16 bp, P. troglodytes
ttcctcagcctccgct

SEQ ID NO: 283543 - DNA, 16 bp, P. troglodytes
ttcctcagctgtaaaa

SEQ ID NO: 283544 - DNA, 16 bp, P. troglodytes
ttcctcagctgtgtcc

SEQ ID NO: 283545 - DNA, 16 bp, P. troglodytes
ttcctcagggaaacct

SEQ ID NO: 283546 - DNA, 16 bp, P. troglodytes
ttcctcagttgcacta

SEQ ID NO: 283547 - DNA, 16 bp, P. troglodytes
ttcctcagtttcctca

SEQ ID NO: 283548 - DNA, 21 bp, P. troglodytes
ttcctcataaagcaacctttt

SEQ ID NO: 283549 - DNA, 16 bp, P. troglodytes
ttcctcatagttgttt

SEQ ID NO: 283550 - DNA, 16 bp, P. troglodytes
ttcctcatccatgaaa

SEQ ID NO: 283551 - DNA, 16 bp, P. troglodytes
ttcctcatctgtaaaa

SEQ ID NO: 283552 - DNA, 16 bp, P. troglodytes
ttcctcatcttcatct

SEQ ID NO: 283553 - DNA, 16 bp, P. troglodytes
ttcctcatcttcctgg

SEQ ID NO: 283554 - DNA, 16 bp, P. troglodytes
ttcctcatcttcctgt

SEQ ID NO: 283555 - DNA, 16 bp, P. troglodytes
ttcctcatgtgcaaaa

SEQ ID NO: 283556 - DNA, 16 bp, P. troglodytes
ttcctcatttccacct

SEQ ID NO: 283557 - DNA, 16 bp, P. troglodytes
ttcctcatttgtgaaa

SEQ ID NO: 283558 - DNA, 16 bp, P. troglodytes
ttcctccacacataca

SEQ ID NO: 283559 - DNA, 16 bp, P. troglodytes
ttcctccaccagggag

SEQ ID NO: 283560 - DNA, 16 bp, P. troglodytes
ttcctccatgattgtg

SEQ ID NO: 283561 - DNA, 16 bp, P. troglodytes
ttcctccatgtctttt

SEQ ID NO: 283562 - DNA, 16 bp, P. troglodytes
ttcctccatgttttct

SEQ ID NO: 283563 - DNA, 16 bp, P. troglodytes
ttcctcccagaggggc

SEQ ID NO: 283564 - DNA, 16 bp, P. troglodytes
ttcctcccctccagag

SEQ ID NO: 283565 - DNA, 16 bp, P. troglodytes
ttcctcctcagcctcc

SEQ ID NO: 283566 - DNA, 16 bp, P. troglodytes
ttcctcctcatcatca

SEQ ID NO: 283567 - DNA, 16 bp, P. troglodytes
ttcctcctccaaagga

SEQ ID NO: 283568 - DNA, 16 bp, P. troglodytes
ttcctcctcccccagc

SEQ ID NO: 283569 - DNA, 16 bp, P. troglodytes
ttcctcctcctcatca

SEQ ID NO: 283570 - DNA, 16 bp, P. troglodytes
ttcctcctcctccagc

SEQ ID NO: 283571 - DNA, 16 bp, P. troglodytes
ttcctcctctataaaa

SEQ ID NO: 283572 - DNA, 16 bp, P. troglodytes
ttcctcctctgtaaaa

SEQ ID NO: 283573 - DNA, 16 bp, P. troglodytes
ttcctcctgcctcagc

SEQ ID NO: 283574 - DNA, 16 bp, P. troglodytes
ttcctcctgggcctcc

SEQ ID NO: 283575 - DNA, 16 bp, P. troglodytes
ttcctcggcctcccaa

SEQ ID NO: 283576 - DNA, 16 bp, P. troglodytes
ttcctctaaacttctc

SEQ ID NO: 283577 - DNA, 16 bp, P. troglodytes
ttcctctatgtctttt

SEQ ID NO: 283578 - DNA, 16 bp, P. troglodytes
ttcctctctgagcctc

SEQ ID NO: 283579 - DNA, 16 bp, P. troglodytes
ttcctctctttttaaa

SEQ ID NO: 283580 - DNA, 16 bp, P. troglodytes
ttcctctgatagatct

SEQ ID NO: 283581 - DNA, 16 bp, P. troglodytes
ttcctctgcacaataa

SEQ ID NO: 283582 - DNA, 16 bp, P. troglodytes
ttcctctgcacatgct

SEQ ID NO: 283583 - DNA, 16 bp, P. troglodytes
ttcctctgccatggct

SEQ ID NO: 283584 - DNA, 16 bp, P. troglodytes
ttcctctgctgcctct

SEQ ID NO: 283585 - DNA, 32 bp, P. troglodytes
ttcctctggaagttttgtctcagaggagtacc

SEQ ID NO: 283586 - DNA, 16 bp, P. troglodytes
ttcctctggagcctca

SEQ ID NO: 283587 - DNA, 16 bp, P. troglodytes
ttcctctgttgcccag

SEQ ID NO: 283588 - DNA, 16 bp, P. troglodytes
ttcctcttcaaaggtt

SEQ ID NO: 283589 - DNA, 16 bp, P. troglodytes
ttcctcttcagttttt

SEQ ID NO: 283590 - DNA, 16 bp, P. troglodytes
ttcctcttctgtcaaa

SEQ ID NO: 283591 - DNA, 16 bp, P. troglodytes
ttcctcttgctgctgt

SEQ ID NO: 283592 - DNA, 16 bp, P. troglodytes
ttcctcttttactaat

SEQ ID NO: 283593 - DNA, 16 bp, P. troglodytes
ttcctcttttccagtt

SEQ ID NO: 283594 - DNA, 16 bp, P. troglodytes
ttcctgaaccaatcac

SEQ ID NO: 283595 - DNA, 16 bp, P. troglodytes
ttcctgaagttgtgat

SEQ ID NO: 283596 - DNA, 16 bp, P. troglodytes
ttcctgaatatagcac

SEQ ID NO: 283597 - DNA, 16 bp, P. troglodytes
ttcctgaattaaaaaa

SEQ ID NO: 283598 - DNA, 16 bp, P. troglodytes
ttcctgaattatttca

SEQ ID NO: 283599 - DNA, 16 bp, P. troglodytes
ttcctgacattgccat

SEQ ID NO: 283600 - DNA, 16 bp, P. troglodytes
ttcctgacccacagaa

SEQ ID NO: 283601 - DNA, 17 bp, P. troglodytes
ttcctgacctcgtgatc

SEQ ID NO: 283602 - DNA, 16 bp, P. troglodytes
ttcctgagcagctggg

SEQ ID NO: 283603 - DNA, 16 bp, P. troglodytes
ttcctgagccttgggg

SEQ ID NO: 283604 - DNA, 16 bp, P. troglodytes
ttcctgagctcaggtg

SEQ ID NO: 283605 - DNA, 16 bp, P. troglodytes
ttcctgaggaagaaaa

SEQ ID NO: 283606 - DNA, 16 bp, P. troglodytes
ttcctgaggaagaaga

SEQ ID NO: 283607 - DNA, 16 bp, P. troglodytes
ttcctgaggcctcagc

SEQ ID NO: 283608 - DNA, 16 bp, P. troglodytes
ttcctgaggcctcgcc

SEQ ID NO: 283609 - DNA, 16 bp, P. troglodytes
ttcctgaggctctcac

SEQ ID NO: 283610 - DNA, 17 bp, P. troglodytes
ttcctgaggcttcccca

SEQ ID NO: 283611 - DNA, 16 bp, P. troglodytes
ttcctgaggcttccct

SEQ ID NO: 283612 - DNA, 16 bp, P. troglodytes
ttcctgagggctctgt

SEQ ID NO: 283613 - DNA, 16 bp, P. troglodytes
ttcctgagtccccaaa

SEQ ID NO: 283614 - DNA, 16 bp, P. troglodytes
ttcctgagtgtgtctg

SEQ ID NO: 283615 - DNA, 16 bp, P. troglodytes
ttcctgagtttcttca

SEQ ID NO: 283616 - DNA, 16 bp, P. troglodytes
ttcctgatccaggaga

SEQ ID NO: 283617 - DNA, 16 bp, P. troglodytes
ttcctgatctcatgat

SEQ ID NO: 283618 - DNA, 16 bp, P. troglodytes
ttcctgatgctcttcc

SEQ ID NO: 283619 - DNA, 16 bp, P. troglodytes
ttcctgatgtttgata

SEQ ID NO: 283620 - DNA, 16 bp, P. troglodytes
ttcctgatttcaaact

SEQ ID NO: 283621 - DNA, 16 bp, P. troglodytes
ttcctgatttggctct

SEQ ID NO: 283622 - DNA, 16 bp, P. troglodytes
ttcctgatttttaaaa

SEQ ID NO: 283623 - DNA, 16 bp, P. troglodytes
ttcctgccccagacct

SEQ ID NO: 283624 - DNA, 16 bp, P. troglodytes
ttcctgccccagccct

SEQ ID NO: 283625 - DNA, 16 bp, P. troglodytes
ttcctgccccagcctc

SEQ ID NO: 283626 - DNA, 16 bp, P. troglodytes
ttcctgccctcagcct

SEQ ID NO: 283627 - DNA, 16 bp, P. troglodytes
ttcctgcctcagcatc

SEQ ID NO: 283628 - DNA, 16 bp, P. troglodytes
ttcctgcctcagcctc

SEQ ID NO: 283629 - DNA, 16 bp, P. troglodytes
ttcctgcctgccggct

SEQ ID NO: 283630 - DNA, 16 bp, P. troglodytes
ttcctgcctgccttct

SEQ ID NO: 283631 - DNA, 16 bp, P. troglodytes
ttcctgccttagcctc

SEQ ID NO: 283632 - DNA, 16 bp, P. troglodytes
ttcctgccttcaagga

SEQ ID NO: 283633 - DNA, 16 bp, P. troglodytes
ttcctgccttcagact

SEQ ID NO: 283634 - DNA, 16 bp, P. troglodytes
ttcctgccttggcctc

SEQ ID NO: 283635 - DNA, 16 bp, P. troglodytes
ttcctgcgttaattca

SEQ ID NO: 283636 - DNA, 16 bp, P. troglodytes
ttcctgctaaaaactc

SEQ ID NO: 283637 - DNA, 16 bp, P. troglodytes
ttcctgctgaccttct

SEQ ID NO: 283638 - DNA, 16 bp, P. troglodytes
ttcctgctgctgtaac

SEQ ID NO: 283639 - DNA, 16 bp, P. troglodytes
ttcctgctttagtctt

SEQ ID NO: 283640 - DNA, 16 bp, P. troglodytes
ttcctggaaaaacaca

SEQ ID NO: 283641 - DNA, 16 bp, P. troglodytes
ttcctggaaataaaaa

SEQ ID NO: 283642 - DNA, 16 bp, P. troglodytes
ttcctggaatgcaagg

SEQ ID NO: 283643 - DNA, 16 bp, P. troglodytes
ttcctggacacagaca

SEQ ID NO: 283644 - DNA, 16 bp, P. troglodytes
ttcctggacacctaca

SEQ ID NO: 283645 - DNA, 16 bp, P. troglodytes
ttcctggacctgtgaa

SEQ ID NO: 283646 - DNA, 16 bp, P. troglodytes
ttcctggagcagcttg

SEQ ID NO: 283647 - DNA, 16 bp, P. troglodytes
ttcctggagcctctgg

SEQ ID NO: 283648 - DNA, 16 bp, P. troglodytes
ttcctggaggaagaga

SEQ ID NO: 283649 - DNA, 16 bp, P. troglodytes
ttcctggaggagatga

SEQ ID NO: 283650 - DNA, 16 bp, P. troglodytes
ttcctggaggaggagg

SEQ ID NO: 283651 - DNA, 16 bp, P. troglodytes
ttcctggaggctttgt

SEQ ID NO: 283652 - DNA, 16 bp, P. troglodytes
ttcctggatgccagac

SEQ ID NO: 283653 - DNA, 16 bp, P. troglodytes
ttcctggatgtgggac

SEQ ID NO: 283654 - DNA, 16 bp, P. troglodytes
ttcctggattttcttt

SEQ ID NO: 283655 - DNA, 16 bp, P. troglodytes
ttcctggcacacagct

SEQ ID NO: 283656 - DNA, 16 bp, P. troglodytes
ttcctggcacagagct

SEQ ID NO: 283657 - DNA, 16 bp, P. troglodytes
ttcctggcagagagaa

SEQ ID NO: 283658 - DNA, 16 bp, P. troglodytes
ttcctggcagccaaag

SEQ ID NO: 283659 - DNA, 16 bp, P. troglodytes
ttcctggcctcttcca

SEQ ID NO: 283660 - DNA, 16 bp, P. troglodytes
ttcctggctcagcctc

SEQ ID NO: 283661 - DNA, 16 bp, P. troglodytes
ttcctggctcctcagc

SEQ ID NO: 283662 - DNA, 16 bp, P. troglodytes
ttcctggggcaggggc

SEQ ID NO: 283663 - DNA, 16 bp, P. troglodytes
ttcctggggctgctgt

SEQ ID NO: 283664 - DNA, 16 bp, P. troglodytes
ttcctgggtcaagtgg

SEQ ID NO: 283665 - DNA, 16 bp, P. troglodytes
ttcctgggtgagggcc

SEQ ID NO: 283666 - DNA, 16 bp, P. troglodytes
ttcctgggtggggacc

SEQ ID NO: 283667 - DNA, 16 bp, P. troglodytes
ttcctgggttcaagcc

SEQ ID NO: 283668 - DNA, 16 bp, P. troglodytes
ttcctggtgtctccaa

SEQ ID NO: 283669 - DNA, 16 bp, P. troglodytes
ttcctggttcaatttt

SEQ ID NO: 283670 - DNA, 16 bp, P. troglodytes
ttcctggttctccagc

SEQ ID NO: 283671 - DNA, 16 bp, P. troglodytes
ttcctggtttgcaggt

SEQ ID NO: 283672 - DNA, 16 bp, P. troglodytes
ttcctgtacaacctgt

SEQ ID NO: 283673 - DNA, 16 bp, P. troglodytes
ttcctgtacagtctgc

SEQ ID NO: 283674 - DNA, 16 bp, P. troglodytes
ttcctgtcacttttct

SEQ ID NO: 283675 - DNA, 16 bp, P. troglodytes
ttcctgtcatttattt

SEQ ID NO: 283676 - DNA, 16 bp, P. troglodytes
ttcctgtcctttgccc

SEQ ID NO: 283677 - DNA, 16 bp, P. troglodytes
ttcctgtctcagcctc

SEQ ID NO: 283678 - DNA, 16 bp, P. troglodytes
ttcctgtcttcctcta

SEQ ID NO: 283679 - DNA, 16 bp, P. troglodytes
ttcctgtgagatctgg

SEQ ID NO: 283680 - DNA, 16 bp, P. troglodytes
ttcctgtgcctcagcc

SEQ ID NO: 283681 - DNA, 16 bp, P. troglodytes
ttcctgtgtccatctg

SEQ ID NO: 283682 - DNA, 16 bp, P. troglodytes
ttcctgtgtccctttg

SEQ ID NO: 283683 - DNA, 16 bp, P. troglodytes
ttcctgtgttagcttg

SEQ ID NO: 283684 - DNA, 16 bp, P. troglodytes
ttcctgtgttagttca

SEQ ID NO: 283685 - DNA, 16 bp, P. troglodytes
ttcctgttaacaggcc

SEQ ID NO: 283686 - DNA, 16 bp, P. troglodytes
ttcctgttcaataaat

SEQ ID NO: 283687 - DNA, 16 bp, P. troglodytes
ttcctgttcactctga

SEQ ID NO: 283688 - DNA, 16 bp, P. troglodytes
ttcctgttgctgctgt

SEQ ID NO: 283689 - DNA, 16 bp, P. troglodytes
ttcctgtttctctgca

SEQ ID NO: 283690 - DNA, 16 bp, P. troglodytes
ttcctgtttcttcaca

SEQ ID NO: 283691 - DNA, 16 bp, P. troglodytes
ttccttaaaaaaatca

SEQ ID NO: 283692 - DNA, 16 bp, P. troglodytes
ttccttaaaaaagaaa

SEQ ID NO: 283693 - DNA, 16 bp, P. troglodytes
ttccttaaaaactaaa

SEQ ID NO: 283694 - DNA, 16 bp, P. troglodytes
ttccttaacctctctg

SEQ ID NO: 283695 - DNA, 16 bp, P. troglodytes
ttccttaagcctcatg

SEQ ID NO: 283696 - DNA, 16 bp, P. troglodytes
ttccttacaggaaaca

SEQ ID NO: 283697 - DNA, 16 bp, P. troglodytes
ttccttagaatttggg

SEQ ID NO: 283698 - DNA, 16 bp, P. troglodytes
ttccttagcttgtggc

SEQ ID NO: 283699 - DNA, 16 bp, P. troglodytes
ttccttataagaatct

SEQ ID NO: 283700 - DNA, 16 bp, P. troglodytes
ttccttatatataaaa

SEQ ID NO: 283701 - DNA, 16 bp, P. troglodytes
ttccttatctggaaaa

SEQ ID NO: 283702 - DNA, 16 bp, P. troglodytes
ttccttatctgtgaaa

SEQ ID NO: 283703 - DNA, 16 bp, P. troglodytes
ttccttatttgaaaaa

SEQ ID NO: 283704 - DNA, 16 bp, P. troglodytes
ttccttcaagaatttt

SEQ ID NO: 283705 - DNA, 16 bp, P. troglodytes
ttccttcaatacctag

SEQ ID NO: 283706 - DNA, 16 bp, P. troglodytes
ttccttcacagattct

SEQ ID NO: 283707 - DNA, 16 bp, P. troglodytes
ttccttcagatattca

SEQ ID NO: 283708 - DNA, 16 bp, P. troglodytes
ttccttcagatgttca

SEQ ID NO: 283709 - DNA, 16 bp, P. troglodytes
ttccttcaggaggaag

SEQ ID NO: 283710 - DNA, 16 bp, P. troglodytes
ttccttcaggatggag

SEQ ID NO: 283711 - DNA, 16 bp, P. troglodytes
ttccttcagggcctgc

SEQ ID NO: 283712 - DNA, 16 bp, P. troglodytes
ttccttcatcttctgc

SEQ ID NO: 283713 - DNA, 16 bp, P. troglodytes
ttccttcatgttgact

SEQ ID NO: 283714 - DNA, 16 bp, P. troglodytes
ttccttccaaaatatt

SEQ ID NO: 283715 - DNA, 16 bp, P. troglodytes
ttccttccagtctttt

SEQ ID NO: 283716 - DNA, 16 bp, P. troglodytes
ttccttccagtgggtt

SEQ ID NO: 283717 - DNA, 16 bp, P. troglodytes
ttccttccctgtgtta

SEQ ID NO: 283718 - DNA, 16 bp, P. troglodytes
ttccttcctaggcctc

SEQ ID NO: 283719 - DNA, 16 bp, P. troglodytes
ttccttcctctttaag

SEQ ID NO: 283720 - DNA, 16 bp, P. troglodytes
ttccttccttccatac

SEQ ID NO: 283721 - DNA, 16 bp, P. troglodytes
ttccttccttccttag

SEQ ID NO: 283722 - DNA, 16 bp, P. troglodytes
ttccttccttctgggt

SEQ ID NO: 283723 - DNA, 16 bp, P. troglodytes
ttccttctaactgtat

SEQ ID NO: 283724 - DNA, 16 bp, P. troglodytes
ttccttctagaatttt

SEQ ID NO: 283725 - DNA, 16 bp, P. troglodytes
ttccttctctgtaaaa

SEQ ID NO: 283726 - DNA, 16 bp, P. troglodytes
ttccttctgaaaatat

SEQ ID NO: 283727 - DNA, 16 bp, P. troglodytes
ttccttctgaaactgt

SEQ ID NO: 283728 - DNA, 18 bp, P. troglodytes
ttccttctgatgttcgga

SEQ ID NO: 283729 - DNA, 16 bp, P. troglodytes
ttccttctgggtgggg

SEQ ID NO: 283730 - DNA, 16 bp, P. troglodytes
ttccttctggtgggtt

SEQ ID NO: 283731 - DNA, 16 bp, P. troglodytes
ttccttcttaaggctg

SEQ ID NO: 283732 - DNA, 16 bp, P. troglodytes
ttccttcttcctggaa

SEQ ID NO: 283733 - DNA, 16 bp, P. troglodytes
ttccttctttctaaag

SEQ ID NO: 283734 - DNA, 16 bp, P. troglodytes
ttccttctttcttaaa

SEQ ID NO: 283735 - DNA, 16 bp, P. troglodytes
ttccttctttttaaaa

SEQ ID NO: 283736 - DNA, 16 bp, P. troglodytes
ttccttgagttctgct

SEQ ID NO: 283737 - DNA, 16 bp, P. troglodytes
ttccttgcctcagcct

SEQ ID NO: 283738 - DNA, 16 bp, P. troglodytes
ttccttgctttttcca

SEQ ID NO: 283739 - DNA, 16 bp, P. troglodytes
ttccttggaattttct

SEQ ID NO: 283740 - DNA, 16 bp, P. troglodytes
ttccttggcttggaga

SEQ ID NO: 283741 - DNA, 16 bp, P. troglodytes
ttccttgtaaatttaa

SEQ ID NO: 283742 - DNA, 16 bp, P. troglodytes
ttccttgtatattttg

SEQ ID NO: 283743 - DNA, 16 bp, P. troglodytes
ttccttgttggaagca

SEQ ID NO: 283744 - DNA, 16 bp, P. troglodytes
ttccttgtttttgtca

SEQ ID NO: 283745 - DNA, 16 bp, P. troglodytes
ttcctttaaaaaataa

SEQ ID NO: 283746 - DNA, 16 bp, P. troglodytes
ttcctttaaaaataat

SEQ ID NO: 283747 - DNA, 16 bp, P. troglodytes
ttcctttaaaggaaaa

SEQ ID NO: 283748 - DNA, 16 bp, P. troglodytes
ttcctttaagtgaaaa

SEQ ID NO: 283749 - DNA, 16 bp, P. troglodytes
ttcctttaggaaaaaa

SEQ ID NO: 283750 - DNA, 16 bp, P. troglodytes
ttcctttagttctttg

SEQ ID NO: 283751 - DNA, 16 bp, P. troglodytes
ttcctttatagatgta

SEQ ID NO: 283752 - DNA, 16 bp, P. troglodytes
ttcctttatttctgct

SEQ ID NO: 283753 - DNA, 16 bp, P. troglodytes
ttcctttcagttttct

SEQ ID NO: 283754 - DNA, 16 bp, P. troglodytes
ttcctttccaacttgg

SEQ ID NO: 283755 - DNA, 16 bp, P. troglodytes
ttcctttccatcctgg

SEQ ID NO: 283756 - DNA, 17 bp, P. troglodytes
ttcctttccatgtttag

SEQ ID NO: 283757 - DNA, 16 bp, P. troglodytes
ttcctttccatttgtt

SEQ ID NO: 283758 - DNA, 16 bp, P. troglodytes
ttcctttccctcaaaa

SEQ ID NO: 283759 - DNA, 16 bp, P. troglodytes
ttcctttcctctgggt

SEQ ID NO: 283760 - DNA, 16 bp, P. troglodytes
ttcctttcctttgaat

SEQ ID NO: 283761 - DNA, 16 bp, P. troglodytes
ttcctttctctgaact

SEQ ID NO: 283762 - DNA, 16 bp, P. troglodytes
ttcctttctgtttcta

SEQ ID NO: 283763 - DNA, 16 bp, P. troglodytes
ttcctttgaaaaccag

SEQ ID NO: 283764 - DNA, 16 bp, P. troglodytes
ttcctttgaatatttt

SEQ ID NO: 283765 - DNA, 16 bp, P. troglodytes
ttcctttgagaattgt

SEQ ID NO: 283766 - DNA, 16 bp, P. troglodytes
ttcctttgagatggag

SEQ ID NO: 283767 - DNA, 20 bp, P. troglodytes
ttcctttggaggaggagagg

SEQ ID NO: 283768 - DNA, 16 bp, P. troglodytes
ttcctttggatataaa

SEQ ID NO: 283769 - DNA, 16 bp, P. troglodytes
ttcctttgggtattta

SEQ ID NO: 283770 - DNA, 16 bp, P. troglodytes
ttcctttgtcacccag

SEQ ID NO: 283771 - DNA, 16 bp, P. troglodytes
ttcctttgtcatttct

SEQ ID NO: 283772 - DNA, 16 bp, P. troglodytes
ttccttttaaaaaaaa

SEQ ID NO: 283773 - DNA, 16 bp, P. troglodytes
ttccttttaaaatact

SEQ ID NO: 283774 - DNA, 16 bp, P. troglodytes
ttccttttcaaaataa

SEQ ID NO: 283775 - DNA, 16 bp, P. troglodytes
ttccttttcctgcctg

SEQ ID NO: 283776 - DNA, 16 bp, P. troglodytes
ttccttttctgtgaaa

SEQ ID NO: 283777 - DNA, 16 bp, P. troglodytes
ttccttttctttcagt

SEQ ID NO: 283778 - DNA, 16 bp, P. troglodytes
ttccttttctttgaga

SEQ ID NO: 283779 - DNA, 16 bp, P. troglodytes
ttccttttgcatatga

SEQ ID NO: 283780 - DNA, 16 bp, P. troglodytes
ttccttttgcttagaa

SEQ ID NO: 283781 - DNA, 16 bp, P. troglodytes
ttccttttgcttggta

SEQ ID NO: 283782 - DNA, 16 bp, P. troglodytes
ttccttttggaattga

SEQ ID NO: 283783 - DNA, 16 bp, P. troglodytes
ttccttttggagttga

SEQ ID NO: 283784 - DNA, 16 bp, P. troglodytes
ttccttttgttattga

SEQ ID NO: 283785 - DNA, 16 bp, P. troglodytes
ttccttttgttcttaa

SEQ ID NO: 283786 - DNA, 16 bp, P. troglodytes
ttcctttttaaaaaaa

SEQ ID NO: 283787 - DNA, 16 bp, P. troglodytes
ttcctttttaaggctg

SEQ ID NO: 283788 - DNA, 16 bp, P. troglodytes
ttcctttttactgctg

SEQ ID NO: 283789 - DNA, 16 bp, P. troglodytes
ttcctttttatggctg

SEQ ID NO: 283790 - DNA, 16 bp, P. troglodytes
ttcctttttatgggtg

SEQ ID NO: 283791 - DNA, 16 bp, P. troglodytes
ttcctttttctccaca

SEQ ID NO: 283792 - DNA, 16 bp, P. troglodytes
ttcctttttgaaaaaa

SEQ ID NO: 283793 - DNA, 16 bp, P. troglodytes
ttcctttttgttgatg

SEQ ID NO: 283794 - DNA, 16 bp, P. troglodytes
ttccttttttaaaaga

SEQ ID NO: 283795 - DNA, 16 bp, P. troglodytes
ttccttttttgaaaca

SEQ ID NO: 283796 - DNA, 16 bp, P. troglodytes
ttcctttttttccaaa

SEQ ID NO: 283797 - DNA, 17 bp, P. troglodytes
ttcgacaaaattcaaca

SEQ ID NO: 283798 - DNA, 16 bp, P. troglodytes
ttcgagacaagcctgg

SEQ ID NO: 283799 - DNA, 16 bp, P. troglodytes
ttcgagaccaaccttg

SEQ ID NO: 283800 - DNA, 16 bp, P. troglodytes
ttcgagaccagcctaa

SEQ ID NO: 283801 - DNA, 18 bp, P. troglodytes
ttcgagaccagcctggga

SEQ ID NO: 283802 - DNA, 16 bp, P. troglodytes
ttcgagatcagcctgg

SEQ ID NO: 283803 - DNA, 16 bp, P. troglodytes
ttcgaggccaccctgg

SEQ ID NO: 283804 - DNA, 16 bp, P. troglodytes
ttcgaggctgcactga

SEQ ID NO: 283805 - DNA, 16 bp, P. troglodytes
ttcgagtccagcctga

SEQ ID NO: 283806 - DNA, 18 bp, P. troglodytes
ttcgatccaatcaagttg

SEQ ID NO: 283807 - DNA, 16 bp, P. troglodytes
ttcgccatgctggcca

SEQ ID NO: 283808 - DNA, 16 bp, P. troglodytes
ttcgccatggtggcca

SEQ ID NO: 283809 - DNA, 16 bp, P. troglodytes
ttcggaggccaaggtg

SEQ ID NO: 283810 - DNA, 16 bp, P. troglodytes
ttcggccaggtgtggt

SEQ ID NO: 283811 - DNA, 18 bp, P. troglodytes
ttcggcctcccaaagtgt

SEQ ID NO: 283812 - DNA, 16 bp, P. troglodytes
ttcgggaccagcctga

SEQ ID NO: 283813 - DNA, 16 bp, P. troglodytes
ttcgggaggcagaggt

SEQ ID NO: 283814 - DNA, 17 bp, P. troglodytes
ttcggtggctcacgcct

SEQ ID NO: 283815 - DNA, 16 bp, P. troglodytes
ttcgtcaggctggtct

SEQ ID NO: 283816 - DNA, 16 bp, P. troglodytes
ttcgtctaaatttttt

SEQ ID NO: 283817 - DNA, 16 bp, P. troglodytes
ttcgtgatccacctgc

SEQ ID NO: 283818 - DNA, 17 bp, P. troglodytes
ttcgttcttgaagtcag

SEQ ID NO: 283819 - DNA, 16 bp, P. troglodytes
ttctaaaaaatgaaaa

SEQ ID NO: 283820 - DNA, 16 bp, P. troglodytes
ttctaaaaagtcaaaa

SEQ ID NO: 283821 - DNA, 16 bp, P. troglodytes
ttctaaaaataaaatg

SEQ ID NO: 283822 - DNA, 16 bp, P. troglodytes
ttctaaaaatatttct

SEQ ID NO: 283823 - DNA, 16 bp, P. troglodytes
ttctaaaacaggcaaa

SEQ ID NO: 283824 - DNA, 16 bp, P. troglodytes
ttctaaaacttttaaa

SEQ ID NO: 283825 - DNA, 16 bp, P. troglodytes
ttctaaaagtaaaaaa

SEQ ID NO: 283826 - DNA, 16 bp, P. troglodytes
ttctaaaatgtatata

SEQ ID NO: 283827 - DNA, 16 bp, P. troglodytes
ttctaaaatgttttta

SEQ ID NO: 283828 - DNA, 16 bp, P. troglodytes
ttctaaaattaatttg

SEQ ID NO: 283829 - DNA, 16 bp, P. troglodytes
ttctaaaattatttca

SEQ ID NO: 283830 - DNA, 16 bp, P. troglodytes
ttctaaaattattttg

SEQ ID NO: 283831 - DNA, 16 bp, P. troglodytes
ttctaaaattcatgtg

SEQ ID NO: 283832 - DNA, 16 bp, P. troglodytes
ttctaaaggtagatca

SEQ ID NO: 283833 - DNA, 16 bp, P. troglodytes
ttctaaagtaaatatt

SEQ ID NO: 283834 - DNA, 16 bp, P. troglodytes
ttctaaataaaacatt

SEQ ID NO: 283835 - DNA, 16 bp, P. troglodytes
ttctaaataaatgttt

SEQ ID NO: 283836 - DNA, 16 bp, P. troglodytes
ttctaaatctcatttt

SEQ ID NO: 283837 - DNA, 16 bp, P. troglodytes
ttctaaatctgtgaag

SEQ ID NO: 283838 - DNA, 16 bp, P. troglodytes
ttctaaatgttttaca

SEQ ID NO: 283839 - DNA, 16 bp, P. troglodytes
ttctaaattatatttg

SEQ ID NO: 283840 - DNA, 16 bp, P. troglodytes
ttctaaatttctaaaa

SEQ ID NO: 283841 - DNA, 16 bp, P. troglodytes
ttctaaatttcttcct

SEQ ID NO: 283842 - DNA, 16 bp, P. troglodytes
ttctaaatttgaattt

SEQ ID NO: 283843 - DNA, 16 bp, P. troglodytes
ttctaaatttgataaa

SEQ ID NO: 283844 - DNA, 16 bp, P. troglodytes
ttctaaattttgaaat

SEQ ID NO: 283845 - DNA, 16 bp, P. troglodytes
ttctaacagtcaggcc

SEQ ID NO: 283846 - DNA, 16 bp, P. troglodytes
ttctaacatgttccca

SEQ ID NO: 283847 - DNA, 18 bp, P. troglodytes
ttctaactggcatgagat

SEQ ID NO: 283848 - DNA, 16 bp, P. troglodytes
ttctaacttttgattt

SEQ ID NO: 283849 - DNA, 16 bp, P. troglodytes
ttctaagatacaatgg

SEQ ID NO: 283850 - DNA, 16 bp, P. troglodytes
ttctaagcctcagttt

SEQ ID NO: 283851 - DNA, 16 bp, P. troglodytes
ttctaagtgagaacat

SEQ ID NO: 283852 - DNA, 16 bp, P. troglodytes
ttctaagtgcttcaca

SEQ ID NO: 283853 - DNA, 16 bp, P. troglodytes
ttctaataatttctaa

SEQ ID NO: 283854 - DNA, 16 bp, P. troglodytes
ttctaatagtttttca

SEQ ID NO: 283855 - DNA, 16 bp, P. troglodytes
ttctaatgtatgcatt

SEQ ID NO: 283856 - DNA, 16 bp, P. troglodytes
ttctaattatgtttat

SEQ ID NO: 283857 - DNA, 16 bp, P. troglodytes
ttctaattctatgaaa

SEQ ID NO: 283858 - DNA, 16 bp, P. troglodytes
ttctaattggattatt

SEQ ID NO: 283859 - DNA, 16 bp, P. troglodytes
ttctaattgtgatgtt

SEQ ID NO: 283860 - DNA, 16 bp, P. troglodytes
ttctaatttaattaca

SEQ ID NO: 283861 - DNA, 16 bp, P. troglodytes
ttctaattttaaaatg

SEQ ID NO: 283862 - DNA, 16 bp, P. troglodytes
ttctaattttaaagaa

SEQ ID NO: 283863 - DNA, 16 bp, P. troglodytes
ttctacaagaggtaca

SEQ ID NO: 283864 - DNA, 16 bp, P. troglodytes
ttctacaatagtgatg

SEQ ID NO: 283865 - DNA, 30 bp, P. troglodytes
ttctacacagacacagtaacaatctgatct

SEQ ID NO: 283866 - DNA, 16 bp, P. troglodytes
ttctacacatggctag

SEQ ID NO: 283867 - DNA, 16 bp, P. troglodytes
ttctacagaaataaaa

SEQ ID NO: 283868 - DNA, 16 bp, P. troglodytes
ttctacagaagtaaaa

SEQ ID NO: 283869 - DNA, 16 bp, P. troglodytes
ttctacagatgaagaa

SEQ ID NO: 283870 - DNA, 16 bp, P. troglodytes
ttctacagcctctgct

SEQ ID NO: 283871 - DNA, 16 bp, P. troglodytes
ttctacattgattttg

SEQ ID NO: 283872 - DNA, 16 bp, P. troglodytes
ttctacatttttgggt

SEQ ID NO: 283873 - DNA, 16 bp, P. troglodytes
ttctaccaaaaataca

SEQ ID NO: 283874 - DNA, 16 bp, P. troglodytes
ttctaccacatggcca

SEQ ID NO: 283875 - DNA, 16 bp, P. troglodytes
ttctacccctggcccc

SEQ ID NO: 283876 - DNA, 16 bp, P. troglodytes
ttctacgataaagaca

SEQ ID NO: 283877 - DNA, 16 bp, P. troglodytes
ttctactaaaaatgca

SEQ ID NO: 283878 - DNA, 19 bp, P. troglodytes
ttctactaaaagtacaaaa

SEQ ID NO: 283879 - DNA, 16 bp, P. troglodytes
ttctactataaagatg

SEQ ID NO: 283880 - DNA, 16 bp, P. troglodytes
ttctactccagcctgg

SEQ ID NO: 283881 - DNA, 16 bp, P. troglodytes
ttctactctgcttcta

SEQ ID NO: 283882 - DNA, 16 bp, P. troglodytes
ttctactgttttaaaa

SEQ ID NO: 283883 - DNA, 16 bp, P. troglodytes
ttctactttctgcttc

SEQ ID NO: 283884 - DNA, 16 bp, P. troglodytes
ttctactttgtgtttc

SEQ ID NO: 283885 - DNA, 16 bp, P. troglodytes
ttctacttttaaactt

SEQ ID NO: 283886 - DNA, 16 bp, P. troglodytes
ttctacttttcaaaaa

SEQ ID NO: 283887 - DNA, 16 bp, P. troglodytes
ttctacttttcctgaa

SEQ ID NO: 283888 - DNA, 16 bp, P. troglodytes
ttctacttttctgtat

SEQ ID NO: 283889 - DNA, 16 bp, P. troglodytes
ttctagaaaaaagaaa

SEQ ID NO: 283890 - DNA, 16 bp, P. troglodytes
ttctagaaaaatatat

SEQ ID NO: 283891 - DNA, 16 bp, P. troglodytes
ttctagaaataaaatt

SEQ ID NO: 283892 - DNA, 16 bp, P. troglodytes
ttctagaaatagaatt

SEQ ID NO: 283893 - DNA, 16 bp, P. troglodytes
ttctagaagaaaacat

SEQ ID NO: 283894 - DNA, 16 bp, P. troglodytes
ttctagaagaaaatat

SEQ ID NO: 283895 - DNA, 16 bp, P. troglodytes
ttctagaattctagaa

SEQ ID NO: 283896 - DNA, 16 bp, P. troglodytes
ttctagaattttcttt

SEQ ID NO: 283897 - DNA, 16 bp, P. troglodytes
ttctagaattttgtat

SEQ ID NO: 283898 - DNA, 16 bp, P. troglodytes
ttctagaattttttaa

SEQ ID NO: 283899 - DNA, 16 bp, P. troglodytes
ttctagaggccacctg

SEQ ID NO: 283900 - DNA, 16 bp, P. troglodytes
ttctagagttgaaaaa

SEQ ID NO: 283901 - DNA, 16 bp, P. troglodytes
ttctagatacaagtcc

SEQ ID NO: 283902 - DNA, 16 bp, P. troglodytes
ttctagatattctagt

SEQ ID NO: 283903 - DNA, 16 bp, P. troglodytes
ttctagatattttata

SEQ ID NO: 283904 - DNA, 19 bp, P. troglodytes
ttctagatccttgaggaat

SEQ ID NO: 283905 - DNA, 16 bp, P. troglodytes
ttctaggaatgtatcc

SEQ ID NO: 283906 - DNA, 18 bp, P. troglodytes
ttctaggatttgacattt

SEQ ID NO: 283907 - DNA, 16 bp, P. troglodytes
ttctaggcactgggga

SEQ ID NO: 283908 - DNA, 16 bp, P. troglodytes
ttctaggcagaggaaa

SEQ ID NO: 283909 - DNA, 16 bp, P. troglodytes
ttctagggttttttat

SEQ ID NO: 283910 - DNA, 16 bp, P. troglodytes
ttctaggtgctggaga

SEQ ID NO: 283911 - DNA, 16 bp, P. troglodytes
ttctaggtgctgggga

SEQ ID NO: 283912 - DNA, 16 bp, P. troglodytes
ttctaggttcaagtga

SEQ ID NO: 283913 - DNA, 16 bp, P. troglodytes
ttctagtattttaata

SEQ ID NO: 283914 - DNA, 16 bp, P. troglodytes
ttctagtgtttttatg

SEQ ID NO: 283915 - DNA, 16 bp, P. troglodytes
ttctagttatcttgct

SEQ ID NO: 283916 - DNA, 16 bp, P. troglodytes
ttctagttcctctagg

SEQ ID NO: 283917 - DNA, 16 bp, P. troglodytes
ttctagttgttttaat

SEQ ID NO: 283918 - DNA, 16 bp, P. troglodytes
ttctagtttgttgagt

SEQ ID NO: 283919 - DNA, 16 bp, P. troglodytes
ttctagttttaaattt

SEQ ID NO: 283920 - DNA, 16 bp, P. troglodytes
ttctataagttttata

SEQ ID NO: 283921 - DNA, 16 bp, P. troglodytes
ttctataattagaaaa

SEQ ID NO: 283922 - DNA, 16 bp, P. troglodytes
ttctatagaaataaaa

SEQ ID NO: 283923 - DNA, 16 bp, P. troglodytes
ttctatagaaatttta

SEQ ID NO: 283924 - DNA, 16 bp, P. troglodytes
ttctatagagatgggg

SEQ ID NO: 283925 - DNA, 16 bp, P. troglodytes
ttctatcaaaaagata

SEQ ID NO: 283926 - DNA, 16 bp, P. troglodytes
ttctatcaaatactag

SEQ ID NO: 283927 - DNA, 16 bp, P. troglodytes
ttctatcaattactga

SEQ ID NO: 283928 - DNA, 16 bp, P. troglodytes
ttctatcagaaaaaaa

SEQ ID NO: 283929 - DNA, 16 bp, P. troglodytes
ttctatctaactgtgt

SEQ ID NO: 283930 - DNA, 16 bp, P. troglodytes
ttctatctgtgaaatt

SEQ ID NO: 283931 - DNA, 16 bp, P. troglodytes
ttctatgaaaaataaa

SEQ ID NO: 283932 - DNA, 16 bp, P. troglodytes
ttctatgaaaacagtg

SEQ ID NO: 283933 - DNA, 16 bp, P. troglodytes
ttctatgatgatggaa

SEQ ID NO: 283934 - DNA, 16 bp, P. troglodytes
ttctatggctgaataa

SEQ ID NO: 283935 - DNA, 16 bp, P. troglodytes
ttctatgggttttgat

SEQ ID NO: 283936 - DNA, 16 bp, P. troglodytes
ttctatgtatgtatgt

SEQ ID NO: 283937 - DNA, 16 bp, P. troglodytes
ttctatgtatttatta

SEQ ID NO: 283938 - DNA, 16 bp, P. troglodytes
ttctatgtcttctttg

SEQ ID NO: 283939 - DNA, 16 bp, P. troglodytes
ttctatgtgtatatat

SEQ ID NO: 283940 - DNA, 16 bp, P. troglodytes
ttctattcaacatagt

SEQ ID NO: 283941 - DNA, 26 bp, P. troglodytes
ttctattccacaaaaccgccattgtc

SEQ ID NO: 283942 - DNA, 16 bp, P. troglodytes
ttctattctgttcctt

SEQ ID NO: 283943 - DNA, 16 bp, P. troglodytes
ttctatttctagaaat

SEQ ID NO: 283944 - DNA, 16 bp, P. troglodytes
ttctatttctgagaaa

SEQ ID NO: 283945 - DNA, 16 bp, P. troglodytes
ttctatttcttcaaaa

SEQ ID NO: 283946 - DNA, 16 bp, P. troglodytes
ttctattttaaagaca

SEQ ID NO: 283947 - DNA, 16 bp, P. troglodytes
ttctattttgaaaaaa

SEQ ID NO: 283948 - DNA, 16 bp, P. troglodytes
ttctattttgtaaata

SEQ ID NO: 283949 - DNA, 16 bp, P. troglodytes
ttctatttttagtagc

SEQ ID NO: 283950 - DNA, 16 bp, P. troglodytes
ttctatttttgtaaag

SEQ ID NO: 283951 - DNA, 16 bp, P. troglodytes
ttctatttttttgaga

SEQ ID NO: 283952 - DNA, 16 bp, P. troglodytes
ttctcaaaaaaagaca

SEQ ID NO: 283953 - DNA, 16 bp, P. troglodytes
ttctcaaaaaatatat

SEQ ID NO: 283954 - DNA, 16 bp, P. troglodytes
ttctcaaaaagaaaaa

SEQ ID NO: 283955 - DNA, 17 bp, P. troglodytes
ttctcaaaagaagacat

SEQ ID NO: 283956 - DNA, 16 bp, P. troglodytes
ttctcaaaagaataca

SEQ ID NO: 283957 - DNA, 16 bp, P. troglodytes
ttctcaaaagcaattg

SEQ ID NO: 283958 - DNA, 16 bp, P. troglodytes
ttctcaaaataatcct

SEQ ID NO: 283959 - DNA, 16 bp, P. troglodytes
ttctcaaactcaactt

SEQ ID NO: 283960 - DNA, 16 bp, P. troglodytes
ttctcaaactttagca

SEQ ID NO: 283961 - DNA, 16 bp, P. troglodytes
ttctcaaactttagtg

SEQ ID NO: 283962 - DNA, 16 bp, P. troglodytes
ttctcaaactttttgg

SEQ ID NO: 283963 - DNA, 16 bp, P. troglodytes
ttctcaaagaattaaa

SEQ ID NO: 283964 - DNA, 16 bp, P. troglodytes
ttctcaaagatagacc

SEQ ID NO: 283965 - DNA, 16 bp, P. troglodytes
ttctcaaagtgtggtc

SEQ ID NO: 283966 - DNA, 16 bp, P. troglodytes
ttctcaaagtgtgttc

SEQ ID NO: 283967 - DNA, 16 bp, P. troglodytes
ttctcaaattttagca

SEQ ID NO: 283968 - DNA, 16 bp, P. troglodytes
ttctcaaccctggctg

SEQ ID NO: 283969 - DNA, 16 bp, P. troglodytes
ttctcaactactcata

SEQ ID NO: 283970 - DNA, 16 bp, P. troglodytes
ttctcaagaaagaaaa

SEQ ID NO: 283971 - DNA, 16 bp, P. troglodytes
ttctcaagcagaagaa

SEQ ID NO: 283972 - DNA, 16 bp, P. troglodytes
ttctcaatcaaaagaa

SEQ ID NO: 283973 - DNA, 16 bp, P. troglodytes
ttctcacaacaaccct

SEQ ID NO: 283974 - DNA, 17 bp, P. troglodytes
ttctcacactgctgtaa

SEQ ID NO: 283975 - DNA, 17 bp, P. troglodytes
ttctcacagctccacta

SEQ ID NO: 283976 - DNA, 16 bp, P. troglodytes
ttctcacagtttggga

SEQ ID NO: 283977 - DNA, 16 bp, P. troglodytes
ttctcacatggcagaa

SEQ ID NO: 283978 - DNA, 16 bp, P. troglodytes
ttctcacattgctgta

SEQ ID NO: 283979 - DNA, 16 bp, P. troglodytes
ttctcactatgtcccc

SEQ ID NO: 283980 - DNA, 16 bp, P. troglodytes
ttctcactatgttgcc

SEQ ID NO: 283981 - DNA, 16 bp, P. troglodytes
ttctcactcataagtg

SEQ ID NO: 283982 - DNA, 20 bp, P. troglodytes
ttctcactcataggtgggaa

SEQ ID NO: 283983 - DNA, 30 bp, P. troglodytes; identical to SEQ ID NO: 163576

SEQ ID NO: 283984 - DNA, 16 bp, P. troglodytes
ttctcactctgttgcc

SEQ ID NO: 283985 - DNA, 16 bp, P. troglodytes
ttctcactgtgtcttc

SEQ ID NO: 283986 - DNA, 16 bp, P. troglodytes
ttctcacttataagtg

SEQ ID NO: 283987 - DNA, 16 bp, P. troglodytes
ttctcacttatttgtg

SEQ ID NO: 283988 - DNA, 16 bp, P. troglodytes
ttctcagaaaacttct

SEQ ID NO: 283989 - DNA, 16 bp, P. troglodytes
ttctcagaacctttaa

SEQ ID NO: 283990 - DNA, 16 bp, P. troglodytes
ttctcagaagaaaaca

SEQ ID NO: 283991 - DNA, 16 bp, P. troglodytes
ttctcagaagaagaaa

SEQ ID NO: 283992 - DNA, 18 bp, P. troglodytes
ttctcagaagtcagacct

SEQ ID NO: 283993 - DNA, 16 bp, P. troglodytes
ttctcagaatgattct

SEQ ID NO: 283994 - DNA, 16 bp, P. troglodytes
ttctcagaatgtattt

SEQ ID NO: 283995 - DNA, 16 bp, P. troglodytes
ttctcagaatgtgtct

SEQ ID NO: 283996 - DNA, 17 bp, P. troglodytes
ttctcagatctcaagct

SEQ ID NO: 283997 - DNA, 16 bp, P. troglodytes
ttctcagatctctagc

SEQ ID NO: 283998 - DNA, 16 bp, P. troglodytes
ttctcagattcaccaa

SEQ ID NO: 283999 - DNA, 16 bp, P. troglodytes
ttctcagattttcttt

SEQ ID NO: 284000 - DNA, 17 bp, P. troglodytes
ttctcagcactttggga

SEQ ID NO: 284001 - DNA, 16 bp, P. troglodytes
ttctcagccctccaaa

SEQ ID NO: 284002 - DNA, 16 bp, P. troglodytes
ttctcagcctcagcac

SEQ ID NO: 284003 - DNA, 16 bp, P. troglodytes
ttctcagcctcagcct

SEQ ID NO: 284004 - DNA, 16 bp, P. troglodytes
ttctcagccttggcac

SEQ ID NO: 284005 - DNA, 16 bp, P. troglodytes
ttctcagctacttggg

SEQ ID NO: 284006 - DNA, 16 bp, P. troglodytes
ttctcagctgcaaaat

SEQ ID NO: 284007 - DNA, 16 bp, P. troglodytes
ttctcagctttatttt

SEQ ID NO: 284008 - DNA, 16 bp, P. troglodytes
ttctcaggacctcctg

SEQ ID NO: 284009 - DNA, 16 bp, P. troglodytes
ttctcagttttaattt

SEQ ID NO: 284010 - DNA, 16 bp, P. troglodytes
ttctcataattttaaa

SEQ ID NO: 284011 - DNA, 16 bp, P. troglodytes
ttctcatcatttggct

SEQ ID NO: 284012 - DNA, 16 bp, P. troglodytes
ttctcatccacaaaat

SEQ ID NO: 284013 - DNA, 16 bp, P. troglodytes
ttctcatctatgaaat

SEQ ID NO: 284014 - DNA, 16 bp, P. troglodytes
ttctcatctgcaaaat

SEQ ID NO: 284015 - DNA, 16 bp, P. troglodytes
ttctcatctgtgaaac

SEQ ID NO: 284016 - DNA, 16 bp, P. troglodytes
ttctcatgataatgaa

SEQ ID NO: 284017 - DNA, 16 bp, P. troglodytes
ttctcatgcctctgcc

SEQ ID NO: 284018 - DNA, 16 bp, P. troglodytes
ttctcatgctgctgat

SEQ ID NO: 284019 - DNA, 16 bp, P. troglodytes
ttctcatgcttcaaat

SEQ ID NO: 284020 - DNA, 16 bp, P. troglodytes
ttctcatggctcagcc

SEQ ID NO: 284021 - DNA, 16 bp, P. troglodytes
ttctcattattcacag

SEQ ID NO: 284022 - DNA, 16 bp, P. troglodytes
ttctcattattttcaa

SEQ ID NO: 284023 - DNA, 16 bp, P. troglodytes
ttctcattctgtcttc

SEQ ID NO: 284024 - DNA, 16 bp, P. troglodytes
ttctcattgtaaagat

SEQ ID NO: 284025 - DNA, 16 bp, P. troglodytes
ttctcatttaaaaaga

SEQ ID NO: 284026 - DNA, 16 bp, P. troglodytes
ttctcattttaaaaac

SEQ ID NO: 284027 - DNA, 16 bp, P. troglodytes
ttctcattttaaaaat

SEQ ID NO: 284028 - DNA, 16 bp, P. troglodytes
ttctccaaagaagaaa

SEQ ID NO: 284029 - DNA, 16 bp, P. troglodytes
ttctccaaagaagaca

SEQ ID NO: 284030 - DNA, 16 bp, P. troglodytes
ttctccaaagaaggta

SEQ ID NO: 284031 - DNA, 16 bp, P. troglodytes
ttctccaactctctgg

SEQ ID NO: 284032 - DNA, 16 bp, P. troglodytes
ttctccaagcccacat

SEQ ID NO: 284033 - DNA, 16 bp, P. troglodytes
ttctccaagtccccac

SEQ ID NO: 284034 - DNA, 17 bp, P. troglodytes
ttctccaagttggccag

SEQ ID NO: 284035 - DNA, 16 bp, P. troglodytes
ttctccacagaaaatg

SEQ ID NO: 284036 - DNA, 16 bp, P. troglodytes
ttctccacatcctctg

SEQ ID NO: 284037 - DNA, 16 bp, P. troglodytes
ttctccaccacaacaa

SEQ ID NO: 284038 - DNA, 16 bp, P. troglodytes
ttctccaggctcagcc

SEQ ID NO: 284039 - DNA, 16 bp, P. troglodytes
ttctccatattctctc

SEQ ID NO: 284040 - DNA, 16 bp, P. troglodytes
ttctccatcatcctga

SEQ ID NO: 284041 - DNA, 16 bp, P. troglodytes
ttctccatcctgcttt

SEQ ID NO: 284042 - DNA, 16 bp, P. troglodytes
ttctccatgttgggca

SEQ ID NO: 284043 - DNA, 16 bp, P. troglodytes
ttctccattctccatg

SEQ ID NO: 284044 - DNA, 16 bp, P. troglodytes
ttctccatttctttaa

SEQ ID NO: 284045 - DNA, 16 bp, P. troglodytes
ttctccattttacaga

SEQ ID NO: 284046 - DNA, 16 bp, P. troglodytes
ttctcccaatctgtgg

SEQ ID NO: 284047 - DNA, 17 bp, P. troglodytes
ttctcccacctcagcct

SEQ ID NO: 284048 - DNA, 16 bp, P. troglodytes
ttctcccagaggtaca

SEQ ID NO: 284049 - DNA, 17 bp, P. troglodytes
ttctcccagcaccattt

SEQ ID NO: 284050 - DNA, 16 bp, P. troglodytes
ttctcccagtaccatt

SEQ ID NO: 284051 - DNA, 16 bp, P. troglodytes
ttctcccattatgtag

SEQ ID NO: 284052 - DNA, 16 bp, P. troglodytes
ttctcccattttacag

SEQ ID NO: 284053 - DNA, 16 bp, P. troglodytes
ttctcccattttgtat

SEQ ID NO: 284054 - DNA, 16 bp, P. troglodytes
ttctccccaaactgat

SEQ ID NO: 284055 - DNA, 16 bp, P. troglodytes
ttctccccagaaagtg

SEQ ID NO: 284056 - DNA, 16 bp, P. troglodytes
ttctccccagagcctc

SEQ ID NO: 284057 - DNA, 16 bp, P. troglodytes
ttctcccccttcagcc

SEQ ID NO: 284058 - DNA, 16 bp, P. troglodytes
ttctcccctcagcctc

SEQ ID NO: 284059 - DNA, 16 bp, P. troglodytes
ttctcccgttctgtag

SEQ ID NO: 284060 - DNA, 16 bp, P. troglodytes
ttctccctcagagcct

SEQ ID NO: 284061 - DNA, 16 bp, P. troglodytes
ttctccctcttcagcc

SEQ ID NO: 284062 - DNA, 16 bp, P. troglodytes
ttctccctggagcctc

SEQ ID NO: 284063 - DNA, 16 bp, P. troglodytes
ttctccctgttggcca

SEQ ID NO: 284064 - DNA, 16 bp, P. troglodytes
ttctccctttagttct

SEQ ID NO: 284065 - DNA, 16 bp, P. troglodytes
ttctcctaactgaaat

SEQ ID NO: 284066 - DNA, 16 bp, P. troglodytes
ttctcctacctcagca

SEQ ID NO: 284067 - DNA, 16 bp, P. troglodytes
ttctcctacctcagct

SEQ ID NO: 284068 - DNA, 16 bp, P. troglodytes
ttctcctatgttttct

SEQ ID NO: 284069 - DNA, 16 bp, P. troglodytes
ttctcctattctgtaa

SEQ ID NO: 284070 - DNA, 16 bp, P. troglodytes
ttctcctcccaggttc

SEQ ID NO: 284071 - DNA, 18 bp, P. troglodytes
ttctcctccctcagcctc

SEQ ID NO: 284072 - DNA, 16 bp, P. troglodytes
ttctcctgaagcctct

SEQ ID NO: 284073 - DNA, 16 bp, P. troglodytes
ttctcctgacccagcc

SEQ ID NO: 284074 - DNA, 16 bp, P. troglodytes
ttctcctgactcaggc

SEQ ID NO: 284075 - DNA, 16 bp, P. troglodytes
ttctcctgagggcagg

SEQ ID NO: 284076 - DNA, 16 bp, P. troglodytes
ttctcctgccccagca

SEQ ID NO: 284077 - DNA, 16 bp, P. troglodytes
ttctcctgccccagcc

SEQ ID NO: 284078 - DNA, 16 bp, P. troglodytes
ttctcctgccctcagc

SEQ ID NO: 284079 - DNA, 16 bp, P. troglodytes
ttctcctgcctccacc

SEQ ID NO: 284080 - DNA, 16 bp, P. troglodytes
ttctcctgcctccatc

SEQ ID NO: 284081 - DNA, 16 bp, P. troglodytes
ttctcctgcctctgct

SEQ ID NO: 284082 - DNA, 16 bp, P. troglodytes
ttctcctgcctctgtc

SEQ ID NO: 284083 - DNA, 16 bp, P. troglodytes
ttctcctgcttgagcc

SEQ ID NO: 284084 - DNA, 16 bp, P. troglodytes
ttctcctgtctcagca

SEQ ID NO: 284085 - DNA, 16 bp, P. troglodytes
ttctcctgtctctgcc

SEQ ID NO: 284086 - DNA, 16 bp, P. troglodytes
ttctccttcactgatt

SEQ ID NO: 284087 - DNA, 16 bp, P. troglodytes
ttctccttcatgtttg

SEQ ID NO: 284088 - DNA, 16 bp, P. troglodytes
ttctccttcctcaacc

SEQ ID NO: 284089 - DNA, 16 bp, P. troglodytes
ttctccttcctgctac

SEQ ID NO: 284090 - DNA, 16 bp, P. troglodytes
ttctccttcctgctgc

SEQ ID NO: 284091 - DNA, 16 bp, P. troglodytes
ttctccttcctgggtg

SEQ ID NO: 284092 - DNA, 16 bp, P. troglodytes
ttctccttctgttatt

SEQ ID NO: 284093 - DNA, 16 bp, P. troglodytes
ttctccttgcatttct

SEQ ID NO: 284094 - DNA, 16 bp, P. troglodytes
ttctccttggctgcag

SEQ ID NO: 284095 - DNA, 16 bp, P. troglodytes
ttctccttggtttcaa

SEQ ID NO: 284096 - DNA, 16 bp, P. troglodytes
ttctcctttaaaaata

SEQ ID NO: 284097 - DNA, 16 bp, P. troglodytes
ttctcctttctgccac

SEQ ID NO: 284098 - DNA, 16 bp, P. troglodytes
ttctcctttgtaaaat

SEQ ID NO: 284099 - DNA, 16 bp, P. troglodytes
ttctcgaactcctgag

SEQ ID NO: 284100 - DNA, 16 bp, P. troglodytes
ttctcgccctgtggtg

SEQ ID NO: 284101 - DNA, 19 bp, P. troglodytes
ttctcggccttttggctaa

SEQ ID NO: 284102 - DNA, 16 bp, P. troglodytes
ttctcgtgctgtggtt

SEQ ID NO: 284103 - DNA, 16 bp, P. troglodytes
ttctctaaaaatgttt

SEQ ID NO: 284104 - DNA, 16 bp, P. troglodytes
ttctctaaaagcattt

SEQ ID NO: 284105 - DNA, 16 bp, P. troglodytes
ttctctaatcttgtct

SEQ ID NO: 284106 - DNA, 16 bp, P. troglodytes
ttctctaattctttca

SEQ ID NO: 284107 - DNA, 16 bp, P. troglodytes
ttctctacctccatga

SEQ ID NO: 284108 - DNA, 16 bp, P. troglodytes
ttctctacttttgagg

SEQ ID NO: 284109 - DNA, 16 bp, P. troglodytes
ttctctagagaaacaa

SEQ ID NO: 284110 - DNA, 16 bp, P. troglodytes
ttctctagcttgcttt

SEQ ID NO: 284111 - DNA, 16 bp, P. troglodytes
ttctctaggttttcta

SEQ ID NO: 284112 - DNA, 16 bp, P. troglodytes
ttctctcatttgtaaa

SEQ ID NO: 284113 - DNA, 16 bp, P. troglodytes
ttctctcccatgcctg

SEQ ID NO: 284114 - DNA, 16 bp, P. troglodytes
ttctctccctcagcct

SEQ ID NO: 284115 - DNA, 16 bp, P. troglodytes
ttctctcctgttgccc

SEQ ID NO: 284116 - DNA, 16 bp, P. troglodytes
ttctctctcacacaca

SEQ ID NO: 284117 - DNA, 16 bp, P. troglodytes
ttctctctcaccatgt

SEQ ID NO: 284118 - DNA, 16 bp, P. troglodytes
ttctctctccagttcc

SEQ ID NO: 284119 - DNA, 16 bp, P. troglodytes
ttctctctctggctct

SEQ ID NO: 284120 - DNA, 16 bp, P. troglodytes
ttctctctgcctgccc

SEQ ID NO: 284121 - DNA, 16 bp, P. troglodytes
ttctctcttttggaat

SEQ ID NO: 284122 - DNA, 16 bp, P. troglodytes
ttctctctttttaaaa

SEQ ID NO: 284123 - DNA, 16 bp, P. troglodytes
ttctctgaatgcttct

SEQ ID NO: 284124 - DNA, 16 bp, P. troglodytes
ttctctgaatttattt

SEQ ID NO: 284125 - DNA, 16 bp, P. troglodytes
ttctctgagcctctat

SEQ ID NO: 284126 - DNA, 16 bp, P. troglodytes
ttctctgagttctgtg

SEQ ID NO: 284127 - DNA, 16 bp, P. troglodytes
ttctctgatatttatt

SEQ ID NO: 284128 - DNA, 16 bp, P. troglodytes
ttctctgatgattact

SEQ ID NO: 284129 - DNA, 16 bp, P. troglodytes
ttctctgcagaaccct

SEQ ID NO: 284130 - DNA, 16 bp, P. troglodytes
ttctctgcattttctg

SEQ ID NO: 284131 - DNA, 16 bp, P. troglodytes
ttctctgccacccagg

SEQ ID NO: 284132 - DNA, 16 bp, P. troglodytes
ttctctgcctcagcct

SEQ ID NO: 284133 - DNA, 16 bp, P. troglodytes
ttctctgcctcatcct

SEQ ID NO: 284134 - DNA, 16 bp, P. troglodytes
ttctctgcctctttga

SEQ ID NO: 284135 - DNA, 16 bp, P. troglodytes
ttctctgcttttaaaa

SEQ ID NO: 284136 - DNA, 16 bp, P. troglodytes
ttctctggaggaccct

SEQ ID NO: 284137 - DNA, 16 bp, P. troglodytes
ttctctggaggctgag

SEQ ID NO: 284138 - DNA, 16 bp, P. troglodytes
ttctctggctgctttc

SEQ ID NO: 284139 - DNA, 16 bp, P. troglodytes
ttctctgggcctcagt

SEQ ID NO: 284140 - DNA, 16 bp, P. troglodytes
ttctctggggtccctt

SEQ ID NO: 284141 - DNA, 16 bp, P. troglodytes
ttctctgtactatctt

SEQ ID NO: 284142 - DNA, 16 bp, P. troglodytes
ttctctgtatctattg

SEQ ID NO: 284143 - DNA, 19 bp, P. troglodytes
ttctctgtatttcctgaat

SEQ ID NO: 284144 - DNA, 16 bp, P. troglodytes
ttctctgtctgtaaaa

SEQ ID NO: 284145 - DNA, 16 bp, P. troglodytes
ttctctgtctgtctgt

SEQ ID NO: 284146 - DNA, 16 bp, P. troglodytes
ttctctgtgaaatggg

SEQ ID NO: 284147 - DNA, 16 bp, P. troglodytes
ttctctgtgccaagca

SEQ ID NO: 284148 - DNA, 16 bp, P. troglodytes
ttctctgtggcccagg

SEQ ID NO: 284149 - DNA, 16 bp, P. troglodytes
ttctctgtgtgaacat

SEQ ID NO: 284150 - DNA, 16 bp, P. troglodytes
ttctctgtgtgtctct

SEQ ID NO: 284151 - DNA, 16 bp, P. troglodytes
ttctctgtgttctcat

SEQ ID NO: 284152 - DNA, 16 bp, P. troglodytes
ttctctgtgtttcctg

SEQ ID NO: 284153 - DNA, 16 bp, P. troglodytes
ttctctgtttaataaa

SEQ ID NO: 284154 - DNA, 16 bp, P. troglodytes
ttctctgtttttaaaa

SEQ ID NO: 284155 - DNA, 16 bp, P. troglodytes
ttctcttacagttctg

SEQ ID NO: 284156 - DNA, 16 bp, P. troglodytes
ttctcttagtaatttt

SEQ ID NO: 284157 - DNA, 16 bp, P. troglodytes
ttctcttatctctttg

SEQ ID NO: 284158 - DNA, 16 bp, P. troglodytes
ttctcttcaaataatc

SEQ ID NO: 284159 - DNA, 16 bp, P. troglodytes
ttctcttcagaaacca

SEQ ID NO: 284160 - DNA, 16 bp, P. troglodytes
ttctcttccattctgt

SEQ ID NO: 284161 - DNA, 16 bp, P. troglodytes
ttctcttcctctgggt

SEQ ID NO: 284162 - DNA, 16 bp, P. troglodytes
ttctcttcttcctcag

SEQ ID NO: 284163 - DNA, 16 bp, P. troglodytes
ttctcttctttaaaat

SEQ ID NO: 284164 - DNA, 16 bp, P. troglodytes
ttctcttctttataaa

SEQ ID NO: 284165 - DNA, 16 bp, P. troglodytes
ttctcttgactgcaaa

SEQ ID NO: 284166 - DNA, 16 bp, P. troglodytes
ttctcttgcccaggct

SEQ ID NO: 284167 - DNA, 16 bp, P. troglodytes
ttctcttgggtatata

SEQ ID NO: 284168 - DNA, 16 bp, P. troglodytes
ttctctttagttctgt

SEQ ID NO: 284169 - DNA, 16 bp, P. troglodytes
ttctctttatttcctg

SEQ ID NO: 284170 - DNA, 16 bp, P. troglodytes
ttctctttcaaaataa

SEQ ID NO: 284171 - DNA, 16 bp, P. troglodytes
ttctctttgaaaacca

SEQ ID NO: 284172 - DNA, 16 bp, P. troglodytes
ttctctttgttcttca

SEQ ID NO: 284173 - DNA, 16 bp, P. troglodytes
ttctcttttaaaaaag

SEQ ID NO: 284174 - DNA, 16 bp, P. troglodytes
ttctcttttctctgaa

SEQ ID NO: 284175 - DNA, 16 bp, P. troglodytes
ttctcttttctctgca

SEQ ID NO: 284176 - DNA, 16 bp, P. troglodytes
ttctcttttctctgta

SEQ ID NO: 284177 - DNA, 16 bp, P. troglodytes
ttctctttttaaaaaa

SEQ ID NO: 284178 - DNA, 16 bp, P. troglodytes
ttctctttttcaaaaa

SEQ ID NO: 284179 - DNA, 16 bp, P. troglodytes
ttctcttttttcctga

SEQ ID NO: 284180 - DNA, 16 bp, P. troglodytes
ttctgaaaaaagaaaa

SEQ ID NO: 284181 - DNA, 16 bp, P. troglodytes
ttctgaaaactgaaaa

SEQ ID NO: 284182 - DNA, 16 bp, P. troglodytes
ttctgaaaatatctat

SEQ ID NO: 284183 - DNA, 16 bp, P. troglodytes
ttctgaaaattaaaga

SEQ ID NO: 284184 - DNA, 16 bp, P. troglodytes
ttctgaaacagggtct

SEQ ID NO: 284185 - DNA, 16 bp, P. troglodytes
ttctgaaactatttta

SEQ ID NO: 284186 - DNA, 16 bp, P. troglodytes
ttctgaaagttaaaaa

SEQ ID NO: 284187 - DNA, 16 bp, P. troglodytes
ttctgaaagttttttt

SEQ ID NO: 284188 - DNA, 16 bp, P. troglodytes
ttctgaaataaaatta

SEQ ID NO: 284189 - DNA, 16 bp, P. troglodytes
ttctgaaataaattat

SEQ ID NO: 284190 - DNA, 16 bp, P. troglodytes
ttctgaaatattttca

SEQ ID NO: 284191 - DNA, 16 bp, P. troglodytes
ttctgaaatatttttt

SEQ ID NO: 284192 - DNA, 16 bp, P. troglodytes
ttctgaaattatttca

SEQ ID NO: 284193 - DNA, 16 bp, P. troglodytes
ttctgaaattcttttt

SEQ ID NO: 284194 - DNA, 16 bp, P. troglodytes
ttctgaaattgaggca

SEQ ID NO: 284195 - DNA, 16 bp, P. troglodytes
ttctgaaatttcaaaa

SEQ ID NO: 284196 - DNA, 16 bp, P. troglodytes
ttctgaaatttcagaa

SEQ ID NO: 284197 - DNA, 16 bp, P. troglodytes
ttctgaacatttcata

SEQ ID NO: 284198 - DNA, 16 bp, P. troglodytes
ttctgaagaaaaagaa

SEQ ID NO: 284199 - DNA, 16 bp, P. troglodytes
ttctgaagaaaacaaa

SEQ ID NO: 284200 - DNA, 16 bp, P. troglodytes
ttctgaagaaaagaaa

SEQ ID NO: 284201 - DNA, 16 bp, P. troglodytes
ttctgaagaaagaaaa

SEQ ID NO: 284202 - DNA, 16 bp, P. troglodytes
ttctgaagcctctgct

SEQ ID NO: 284203 - DNA, 16 bp, P. troglodytes
ttctgaagtctacttt

SEQ ID NO: 284204 - DNA, 16 bp, P. troglodytes
ttctgaagtttaagtt

SEQ ID NO: 284205 - DNA, 16 bp, P. troglodytes
ttctgaataatttctt

SEQ ID NO: 284206 - DNA, 16 bp, P. troglodytes
ttctgaatatattttg

SEQ ID NO: 284207 - DNA, 16 bp, P. troglodytes
ttctgaatatttattt

SEQ ID NO: 284208 - DNA, 16 bp, P. troglodytes
ttctgaattctgaaat

SEQ ID NO: 284209 - DNA, 16 bp, P. troglodytes
ttctgaatttaaatgt

SEQ ID NO: 284210 - DNA, 16 bp, P. troglodytes
ttctgaattttaaaaa

SEQ ID NO: 284211 - DNA, 16 bp, P. troglodytes
ttctgacaaaacagat

SEQ ID NO: 284212 - DNA, 19 bp, P. troglodytes
ttctgacaaagggctaata

SEQ ID NO: 284213 - DNA, 16 bp, P. troglodytes
ttctgactcagtaggt

SEQ ID NO: 284214 - DNA, 16 bp, P. troglodytes
ttctgactcatccttg

SEQ ID NO: 284215 - DNA, 16 bp, P. troglodytes
ttctgactggtataag

SEQ ID NO: 284216 - DNA, 16 bp, P. troglodytes
ttctgactttgtgatc

SEQ ID NO: 284217 - DNA, 16 bp, P. troglodytes
ttctgagaaaactgga

SEQ ID NO: 284218 - DNA, 16 bp, P. troglodytes
ttctgagaaatgcatc

SEQ ID NO: 284219 - DNA, 16 bp, P. troglodytes
ttctgagaaatgtatt

SEQ ID NO: 284220 - DNA, 16 bp, P. troglodytes
ttctgagaaatgtcta

SEQ ID NO: 284221 - DNA, 16 bp, P. troglodytes
ttctgagaaatgtgtc

SEQ ID NO: 284222 - DNA, 16 bp, P. troglodytes
ttctgagaacatgtgc

SEQ ID NO: 284223 - DNA, 16 bp, P. troglodytes
ttctgagaattaaatg

SEQ ID NO: 284224 - DNA, 16 bp, P. troglodytes
ttctgagacacagtct

SEQ ID NO: 284225 - DNA, 16 bp, P. troglodytes
ttctgagacagtgtct

SEQ ID NO: 284226 - DNA, 16 bp, P. troglodytes
ttctgagagagaaaaa

SEQ ID NO: 284227 - DNA, 16 bp, P. troglodytes
ttctgagatggagtct

SEQ ID NO: 284228 - DNA, 16 bp, P. troglodytes
ttctgagcaaactatt

SEQ ID NO: 284229 - DNA, 16 bp, P. troglodytes
ttctgagcactttaca

SEQ ID NO: 284230 - DNA, 16 bp, P. troglodytes
ttctgagcagaggagg

SEQ ID NO: 284231 - DNA, 16 bp, P. troglodytes
ttctgagccaggagaa

SEQ ID NO: 284232 - DNA, 16 bp, P. troglodytes
ttctgagcccataaaa

SEQ ID NO: 284233 - DNA, 16 bp, P. troglodytes
ttctgagcctatgtgt

SEQ ID NO: 284234 - DNA, 16 bp, P. troglodytes
ttctgaggaagaagag

SEQ ID NO: 284235 - DNA, 16 bp, P. troglodytes
ttctgaggaatccagg

SEQ ID NO: 284236 - DNA, 16 bp, P. troglodytes
ttctgaggagacaaga

SEQ ID NO: 284237 - DNA, 16 bp, P. troglodytes
ttctgaggaggtgaca

SEQ ID NO: 284238 - DNA, 16 bp, P. troglodytes
ttctgaggcactgggg

SEQ ID NO: 284239 - DNA, 16 bp, P. troglodytes
ttctgagggaacagga

SEQ ID NO: 284240 - DNA, 16 bp, P. troglodytes
ttctgagtagctagga

SEQ ID NO: 284241 - DNA, 16 bp, P. troglodytes
ttctgagtctcagttt

SEQ ID NO: 284242 - DNA, 16 bp, P. troglodytes
ttctgataaaatattt

SEQ ID NO: 284243 - DNA, 16 bp, P. troglodytes
ttctgataactttgga

SEQ ID NO: 284244 - DNA, 16 bp, P. troglodytes
ttctgatagatgtgta

SEQ ID NO: 284245 - DNA, 16 bp, P. troglodytes
ttctgatatattttat

SEQ ID NO: 284246 - DNA, 16 bp, P. troglodytes
ttctgatgccctgggc

SEQ ID NO: 284247 - DNA, 16 bp, P. troglodytes
ttctgatgcctcagcc

SEQ ID NO: 284248 - DNA, 16 bp, P. troglodytes
ttctgattatgtttat

SEQ ID NO: 284249 - DNA, 16 bp, P. troglodytes
ttctgattcagaaagt

SEQ ID NO: 284250 - DNA, 16 bp, P. troglodytes
ttctgattcagtaggt

SEQ ID NO: 284251 - DNA, 16 bp, P. troglodytes
ttctgattgtgtttgt

SEQ ID NO: 284252 - DNA, 16 bp, P. troglodytes
ttctgatttaattgat

SEQ ID NO: 284253 - DNA, 16 bp, P. troglodytes
ttctgatttcaaaata

SEQ ID NO: 284254 - DNA, 16 bp, P. troglodytes
ttctgatttttgcaca

SEQ ID NO: 284255 - DNA, 16 bp, P. troglodytes
ttctgcaaggctgggg

SEQ ID NO: 284256 - DNA, 16 bp, P. troglodytes
ttctgcaatgatggaa

SEQ ID NO: 284257 - DNA, 16 bp, P. troglodytes
ttctgcacatgtatcc

SEQ ID NO: 284258 - DNA, 16 bp, P. troglodytes
ttctgcacatgtatct

SEQ ID NO: 284259 - DNA, 16 bp, P. troglodytes
ttctgcacggcaaaag

SEQ ID NO: 284260 - DNA, 16 bp, P. troglodytes
ttctgcagactgtaca

SEQ ID NO: 284261 - DNA, 17 bp, P. troglodytes
ttctgcagcctctgctg

SEQ ID NO: 284262 - DNA, 16 bp, P. troglodytes
ttctgcagctgcaggc

SEQ ID NO: 284263 - DNA, 16 bp, P. troglodytes
ttctgcaggctgtaca

SEQ ID NO: 284264 - DNA, 16 bp, P. troglodytes
ttctgcatataaatat

SEQ ID NO: 284265 - DNA, 16 bp, P. troglodytes
ttctgcatatggctag

SEQ ID NO: 284266 - DNA, 16 bp, P. troglodytes
ttctgcatcagcctcc

SEQ ID NO: 284267 - DNA, 16 bp, P. troglodytes
ttctgcatgtggatgt

SEQ ID NO: 284268 - DNA, 16 bp, P. troglodytes
ttctgcattatttaaa

SEQ ID NO: 284269 - DNA, 16 bp, P. troglodytes
ttctgcatttctgaca

SEQ ID NO: 284270 - DNA, 16 bp, P. troglodytes
ttctgcatttcttaca

SEQ ID NO: 284271 - DNA, 16 bp, P. troglodytes
ttctgcatttgatttt

SEQ ID NO: 284272 - DNA, 16 bp, P. troglodytes
ttctgcatttttaaaa

SEQ ID NO: 284273 - DNA, 16 bp, P. troglodytes
ttctgccaacagcctg

SEQ ID NO: 284274 - DNA, 16 bp, P. troglodytes
ttctgccacctcagcc

SEQ ID NO: 284275 - DNA, 16 bp, P. troglodytes
ttctgccatgaatgtg

SEQ ID NO: 284276 - DNA, 18 bp, P. troglodytes
ttctgccatggcttcagc

SEQ ID NO: 284277 - DNA, 16 bp, P. troglodytes
ttctgccatgtaagga

SEQ ID NO: 284278 - DNA, 16 bp, P. troglodytes
ttctgcccagcaaaag

SEQ ID NO: 284279 - DNA, 16 bp, P. troglodytes
ttctgcccattcagta

SEQ ID NO: 284280 - DNA, 16 bp, P. troglodytes
ttctgccccattctct

SEQ ID NO: 284281 - DNA, 16 bp, P. troglodytes
ttctgccctgtgttgc

SEQ ID NO: 284282 - DNA, 16 bp, P. troglodytes
ttctgcctaccacaaa

SEQ ID NO: 284283 - DNA, 16 bp, P. troglodytes
ttctgcctcagactcc

SEQ ID NO: 284284 - DNA, 16 bp, P. troglodytes
ttctgcctcagccctc

SEQ ID NO: 284285 - DNA, 16 bp, P. troglodytes
ttctgcctcagcctcc

SEQ ID NO: 284286 - DNA, 16 bp, P. troglodytes
ttctgcctcagccttc

SEQ ID NO: 284287 - DNA, 16 bp, P. troglodytes
ttctgcctcaggctcc

SEQ ID NO: 284288 - DNA, 16 bp, P. troglodytes
ttctgcctcagtctcc

SEQ ID NO: 284289 - DNA, 18 bp, P. troglodytes
ttctgcctcctgggttca

SEQ ID NO: 284290 - DNA, 16 bp, P. troglodytes
ttctgcctcggcctct

SEQ ID NO: 284291 - DNA, 16 bp, P. troglodytes
ttctgcctgagcctcc

SEQ ID NO: 284292 - DNA, 16 bp, P. troglodytes
ttctgcctgcctcggc

SEQ ID NO: 284293 - DNA, 16 bp, P. troglodytes
ttctgcctgggcatct

SEQ ID NO: 284294 - DNA, 16 bp, P. troglodytes
ttctgcctgggtgaca

SEQ ID NO: 284295 - DNA, 16 bp, P. troglodytes
ttctgccttccataaa

SEQ ID NO: 284296 - DNA, 16 bp, P. troglodytes
ttctgccttccgggtt

SEQ ID NO: 284297 - DNA, 16 bp, P. troglodytes
ttctgccttttaaaat

SEQ ID NO: 284298 - DNA, 16 bp, P. troglodytes
ttctgctatttaaaaa

SEQ ID NO: 284299 - DNA, 16 bp, P. troglodytes
ttctgctcactgcaac

SEQ ID NO: 284300 - DNA, 16 bp, P. troglodytes
ttctgctcagcaaaat

SEQ ID NO: 284301 - DNA, 16 bp, P. troglodytes
ttctgctccatcaggt

SEQ ID NO: 284302 - DNA, 16 bp, P. troglodytes
ttctgctccattggtc

SEQ ID NO: 284303 - DNA, 16 bp, P. troglodytes
ttctgctgaaaagtct

SEQ ID NO: 284304 - DNA, 16 bp, P. troglodytes
ttctgctgccctgtga

SEQ ID NO: 284305 - DNA, 16 bp, P. troglodytes
ttctgctgccttttgt

SEQ ID NO: 284306 - DNA, 16 bp, P. troglodytes
ttctgctgctccagga

SEQ ID NO: 284307 - DNA, 16 bp, P. troglodytes
ttctgctgggcacagt

SEQ ID NO: 284308 - DNA, 19 bp, P. troglodytes
ttctgctgtctcagcctcc

SEQ ID NO: 284309 - DNA, 16 bp, P. troglodytes
ttctgctgtctctcct

SEQ ID NO: 284310 - DNA, 16 bp, P. troglodytes
ttctgcttatttttaa

SEQ ID NO: 284311 - DNA, 16 bp, P. troglodytes
ttctgcttcagcctcc

SEQ ID NO: 284312 - DNA, 16 bp, P. troglodytes
ttctgcttcagcttcc

SEQ ID NO: 284313 - DNA, 16 bp, P. troglodytes
ttctgcttcagtaggt

SEQ ID NO: 284314 - DNA, 16 bp, P. troglodytes
ttctgcttcattttct

SEQ ID NO: 284315 - DNA, 16 bp, P. troglodytes
ttctgcttcattttta

SEQ ID NO: 284316 - DNA, 16 bp, P. troglodytes
ttctgcttccattttt

SEQ ID NO: 284317 - DNA, 16 bp, P. troglodytes
ttctgcttctgctgct

SEQ ID NO: 284318 - DNA, 16 bp, P. troglodytes
ttctgcttgaggagag

SEQ ID NO: 284319 - DNA, 16 bp, P. troglodytes
ttctgcttggtctagt

SEQ ID NO: 284320 - DNA, 16 bp, P. troglodytes
ttctgcttggtgttct

SEQ ID NO: 284321 - DNA, 16 bp, P. troglodytes
ttctgctttagcctcc

SEQ ID NO: 284322 - DNA, 22 bp, P. troglodytes
ttctgctttgagatgctgttaa

SEQ ID NO: 284323 - DNA, 16 bp, P. troglodytes
ttctgcttttacttct

SEQ ID NO: 284324 - DNA, 16 bp, P. troglodytes
ttctggaaaaagtaaa

SEQ ID NO: 284325 - DNA, 16 bp, P. troglodytes
ttctggaaaagagaaa

SEQ ID NO: 284326 - DNA, 16 bp, P. troglodytes
ttctggaaaaggcaaa

SEQ ID NO: 284327 - DNA, 16 bp, P. troglodytes
ttctggaaaaggtaaa

SEQ ID NO: 284328 - DNA, 16 bp, P. troglodytes
ttctggaaacacacaa

SEQ ID NO: 284329 - DNA, 16 bp, P. troglodytes
ttctggaaaccatggg

SEQ ID NO: 284330 - DNA, 16 bp, P. troglodytes
ttctggaaaggcaaaa

SEQ ID NO: 284331 - DNA, 16 bp, P. troglodytes
ttctggaaagtctcag

SEQ ID NO: 284332 - DNA, 16 bp, P. troglodytes
ttctggaaagttttct

SEQ ID NO: 284333 - DNA, 16 bp, P. troglodytes
ttctggaaatgaaaaa

SEQ ID NO: 284334 - DNA, 16 bp, P. troglodytes
ttctggaaatgaagga

SEQ ID NO: 284335 - DNA, 16 bp, P. troglodytes
ttctggaaatggatag

SEQ ID NO: 284336 - DNA, 16 bp, P. troglodytes
ttctggaactcctatt

SEQ ID NO: 284337 - DNA, 16 bp, P. troglodytes
ttctggaagacagtgt

SEQ ID NO: 284338 - DNA, 16 bp, P. troglodytes
ttctggaagagactgt

SEQ ID NO: 284339 - DNA, 16 bp, P. troglodytes
ttctggaagctggaaa

SEQ ID NO: 284340 - DNA, 16 bp, P. troglodytes
ttctggaagtcagaaa

SEQ ID NO: 284341 - DNA, 16 bp, P. troglodytes
ttctggaagttagaag

SEQ ID NO: 284342 - DNA, 16 bp, P. troglodytes
ttctggaatgagggtc

SEQ ID NO: 284343 - DNA, 16 bp, P. troglodytes
ttctggacatttcaca

SEQ ID NO: 284344 - DNA, 16 bp, P. troglodytes
ttctggacattttata

SEQ ID NO: 284345 - DNA, 16 bp, P. troglodytes
ttctggagactgagaa

SEQ ID NO: 284346 - DNA, 16 bp, P. troglodytes
ttctggagagaaattc

SEQ ID NO: 284347 - DNA, 16 bp, P. troglodytes
ttctggagatgaaaaa

SEQ ID NO: 284348 - DNA, 16 bp, P. troglodytes
ttctggagatggatgg

SEQ ID NO: 284349 - DNA, 16 bp, P. troglodytes
ttctggagatgggtgg

SEQ ID NO: 284350 - DNA, 16 bp, P. troglodytes
ttctggagcctggaag

SEQ ID NO: 284351 - DNA, 16 bp, P. troglodytes
ttctggagctgaagaa

SEQ ID NO: 284352 - DNA, 16 bp, P. troglodytes
ttctggaggacagaag

SEQ ID NO: 284353 - DNA, 16 bp, P. troglodytes
ttctggaggatgggaa

SEQ ID NO: 284354 - DNA, 16 bp, P. troglodytes
ttctggaggctggaca

SEQ ID NO: 284355 - DNA, 16 bp, P. troglodytes
ttctggagggcaattt

SEQ ID NO: 284356 - DNA, 16 bp, P. troglodytes
ttctggagtctggaag

SEQ ID NO: 284357 - DNA, 16 bp, P. troglodytes
ttctggatatattttt

SEQ ID NO: 284358 - DNA, 16 bp, P. troglodytes
ttctggatattagtca

SEQ ID NO: 284359 - DNA, 16 bp, P. troglodytes
ttctggatgctggaag

SEQ ID NO: 284360 - DNA, 16 bp, P. troglodytes
ttctggatgctgggaa

SEQ ID NO: 284361 - DNA, 16 bp, P. troglodytes
ttctggattctggatt

SEQ ID NO: 284362 - DNA, 16 bp, P. troglodytes
ttctggcaatatgaca

SEQ ID NO: 284363 - DNA, 16 bp, P. troglodytes
ttctggcactggggaa

SEQ ID NO: 284364 - DNA, 16 bp, P. troglodytes
ttctggccacactggc

SEQ ID NO: 284365 - DNA, 16 bp, P. troglodytes
ttctggccatgctggc

SEQ ID NO: 284366 - DNA, 16 bp, P. troglodytes
ttctggccctgtgtct

SEQ ID NO: 284367 - DNA, 16 bp, P. troglodytes
ttctggcctcagcctc

SEQ ID NO: 284368 - DNA, 16 bp, P. troglodytes
ttctggcctccagaac

SEQ ID NO: 284369 - DNA, 16 bp, P. troglodytes
ttctggcctccagacc

SEQ ID NO: 284370 - DNA, 16 bp, P. troglodytes
ttctggctccccatcc

SEQ ID NO: 284371 - DNA, 16 bp, P. troglodytes
ttctggcttctcttga

SEQ ID NO: 284372 - DNA, 16 bp, P. troglodytes
ttctggcttttggaat

SEQ ID NO: 284373 - DNA, 16 bp, P. troglodytes
ttctgggaaaggggca

SEQ ID NO: 284374 - DNA, 16 bp, P. troglodytes
ttctgggaagaaagtc

SEQ ID NO: 284375 - DNA, 16 bp, P. troglodytes
ttctgggaagatggca

SEQ ID NO: 284376 - DNA, 16 bp, P. troglodytes
ttctgggatatatgtg

SEQ ID NO: 284377 - DNA, 16 bp, P. troglodytes
ttctgggatgggagag

SEQ ID NO: 284378 - DNA, 16 bp, P. troglodytes
ttctgggcactgggga

SEQ ID NO: 284379 - DNA, 16 bp, P. troglodytes
ttctgggccaggtgca

SEQ ID NO: 284380 - DNA, 16 bp, P. troglodytes
ttctgggctcaaggga

SEQ ID NO: 284381 - DNA, 16 bp, P. troglodytes
ttctgggctgggtgtg

SEQ ID NO: 284382 - DNA, 16 bp, P. troglodytes
ttctggggaggaattc

SEQ ID NO: 284383 - DNA, 16 bp, P. troglodytes
ttctgggggctgggaa

SEQ ID NO: 284384 - DNA, 16 bp, P. troglodytes
ttctgggtatttatcc

SEQ ID NO: 284385 - DNA, 16 bp, P. troglodytes
ttctgggtcataaaac

SEQ ID NO: 284386 - DNA, 16 bp, P. troglodytes
ttctgggtctataaac

SEQ ID NO: 284387 - DNA, 16 bp, P. troglodytes
ttctgggttcaagtga

SEQ ID NO: 284388 - DNA, 17 bp, P. troglodytes
ttctggtacaccaatca

SEQ ID NO: 284389 - DNA, 16 bp, P. troglodytes
ttctggtcaatagtag

SEQ ID NO: 284390 - DNA, 16 bp, P. troglodytes
ttctggtctctctatt

SEQ ID NO: 284391 - DNA, 16 bp, P. troglodytes
ttctggtgagggccct

SEQ ID NO: 284392 - DNA, 16 bp, P. troglodytes
ttctggttgttttgca

SEQ ID NO: 284393 - DNA, 16 bp, P. troglodytes
ttctggtttaaaaaaa

SEQ ID NO: 284394 - DNA, 16 bp, P. troglodytes
ttctgtaaacttaaaa

SEQ ID NO: 284395 - DNA, 16 bp, P. troglodytes
ttctgtaaaggaccag

SEQ ID NO: 284396 - DNA, 16 bp, P. troglodytes
ttctgtaaatatatat

SEQ ID NO: 284397 - DNA, 16 bp, P. troglodytes
ttctgtaaatatctgt

SEQ ID NO: 284398 - DNA, 16 bp, P. troglodytes
ttctgtaagtttgact

SEQ ID NO: 284399 - DNA, 16 bp, P. troglodytes
ttctgtacagcctgtg

SEQ ID NO: 284400 - DNA, 16 bp, P. troglodytes
ttctgtacatgtatcc

SEQ ID NO: 284401 - DNA, 16 bp, P. troglodytes
ttctgtagtttgaaaa

SEQ ID NO: 284402 - DNA, 16 bp, P. troglodytes
ttctgtagtttgcctg

SEQ ID NO: 284403 - DNA, 16 bp, P. troglodytes
ttctgtataaattact

SEQ ID NO: 284404 - DNA, 16 bp, P. troglodytes
ttctgtatatttgaaa

SEQ ID NO: 284405 - DNA, 16 bp, P. troglodytes
ttctgtatctttgctg

SEQ ID NO: 284406 - DNA, 16 bp, P. troglodytes
ttctgtatgaacttta

SEQ ID NO: 284407 - DNA, 16 bp, P. troglodytes
ttctgtatggttctgt

SEQ ID NO: 284408 - DNA, 16 bp, P. troglodytes
ttctgtatgtatttta

SEQ ID NO: 284409 - DNA, 16 bp, P. troglodytes
ttctgtattatttaaa

SEQ ID NO: 284410 - DNA, 16 bp, P. troglodytes
ttctgtattctgtatt

SEQ ID NO: 284411 - DNA, 16 bp, P. troglodytes
ttctgtattcttagta

SEQ ID NO: 284412 - DNA, 16 bp, P. troglodytes
ttctgtcaacttgtca

SEQ ID NO: 284413 - DNA, 16 bp, P. troglodytes
ttctgtcacccaggtt

SEQ ID NO: 284414 - DNA, 16 bp, P. troglodytes
ttctgtcactcaggct

SEQ ID NO: 284415 - DNA, 16 bp, P. troglodytes
ttctgtcatgagttgc

SEQ ID NO: 284416 - DNA, 16 bp, P. troglodytes
ttctgtcatgattgta

SEQ ID NO: 284417 - DNA, 16 bp, P. troglodytes
ttctgtcattggttct

SEQ ID NO: 284418 - DNA, 16 bp, P. troglodytes
ttctgtcatttaaaat

SEQ ID NO: 284419 - DNA, 16 bp, P. troglodytes
ttctgtccaaaaaaaa

SEQ ID NO: 284420 - DNA, 16 bp, P. troglodytes
ttctgtcccccaggct

SEQ ID NO: 284421 - DNA, 16 bp, P. troglodytes
ttctgtctcaacaaaa

SEQ ID NO: 284422 - DNA, 16 bp, P. troglodytes
ttctgtctcactggtg

SEQ ID NO: 284423 - DNA, 16 bp, P. troglodytes
ttctgtctcagcctcc

SEQ ID NO: 284424 - DNA, 16 bp, P. troglodytes
ttctgtctcagcctct

SEQ ID NO: 284425 - DNA, 24 bp, P. troglodytes
ttctgtctcattgatctgtctaat

SEQ ID NO: 284426 - DNA, 16 bp, P. troglodytes
ttctgtctctggattt

SEQ ID NO: 284427 - DNA, 16 bp, P. troglodytes
ttctgtcttcattttg

SEQ ID NO: 284428 - DNA, 16 bp, P. troglodytes
ttctgtcttgctggtg

SEQ ID NO: 284429 - DNA, 16 bp, P. troglodytes
ttctgtcttgtagagt

SEQ ID NO: 284430 - DNA, 24 bp, P. troglodytes
ttctgtcttgttgatctgtctaat

SEQ ID NO: 284431 - DNA, 16 bp, P. troglodytes
ttctgtctttatgaat

SEQ ID NO: 284432 - DNA, 16 bp, P. troglodytes
ttctgtctttcaccat

SEQ ID NO: 284433 - DNA, 16 bp, P. troglodytes
ttctgtctttgacttt

SEQ ID NO: 284434 - DNA, 16 bp, P. troglodytes
ttctgtgaaaaaagtc

SEQ ID NO: 284435 - DNA, 16 bp, P. troglodytes
ttctgtgaacatttgt

SEQ ID NO: 284436 - DNA, 16 bp, P. troglodytes
ttctgtgaaggaagtc

SEQ ID NO: 284437 - DNA, 16 bp, P. troglodytes
ttctgtgaccttgagc

SEQ ID NO: 284438 - DNA, 16 bp, P. troglodytes
ttctgtgagatcagtg

SEQ ID NO: 284439 - DNA, 16 bp, P. troglodytes
ttctgtgagtccttct

SEQ ID NO: 284440 - DNA, 16 bp, P. troglodytes
ttctgtgcctaactta

SEQ ID NO: 284441 - DNA, 16 bp, P. troglodytes
ttctgtgcctcagtct

SEQ ID NO: 284442 - DNA, 16 bp, P. troglodytes
ttctgtgcctgcctta

SEQ ID NO: 284443 - DNA, 16 bp, P. troglodytes
ttctgtggaaaaagca

SEQ ID NO: 284444 - DNA, 16 bp, P. troglodytes
ttctgtggaattggtg

SEQ ID NO: 284445 - DNA, 16 bp, P. troglodytes
ttctgtggacaccact

SEQ ID NO: 284446 - DNA, 16 bp, P. troglodytes
ttctgtggatggatgg

SEQ ID NO: 284447 - DNA, 16 bp, P. troglodytes
ttctgtggctccaccc

SEQ ID NO: 284448 - DNA, 16 bp, P. troglodytes
ttctgtgggatcgttg

SEQ ID NO: 284449 - DNA, 16 bp, P. troglodytes
ttctgtgggccaggcc

SEQ ID NO: 284450 - DNA, 16 bp, P. troglodytes
ttctgtggggccagtg

SEQ ID NO: 284451 - DNA, 16 bp, P. troglodytes
ttctgtggtattcctg

SEQ ID NO: 284452 - DNA, 16 bp, P. troglodytes
ttctgtggtctggagg

SEQ ID NO: 284453 - DNA, 16 bp, P. troglodytes
ttctgtggttgttgga

SEQ ID NO: 284454 - DNA, 16 bp, P. troglodytes
ttctgtggtttcagtt

SEQ ID NO: 284455 - DNA, 16 bp, P. troglodytes
ttctgtgtatatgtgt

SEQ ID NO: 284456 - DNA, 16 bp, P. troglodytes
ttctgtgtatgtgatg

SEQ ID NO: 284457 - DNA, 16 bp, P. troglodytes
ttctgtgtcaaaaaaa

SEQ ID NO: 284458 - DNA, 16 bp, P. troglodytes
ttctgtgtctctctgt

SEQ ID NO: 284459 - DNA, 16 bp, P. troglodytes
ttctgtgtcttcacat

SEQ ID NO: 284460 - DNA, 16 bp, P. troglodytes
ttctgtgtgtaaacat

SEQ ID NO: 284461 - DNA, 16 bp, P. troglodytes
ttctgtgttgctcaca

SEQ ID NO: 284462 - DNA, 16 bp, P. troglodytes
ttctgttaatgtagtg

SEQ ID NO: 284463 - DNA, 16 bp, P. troglodytes
ttctgttatagtaaca

SEQ ID NO: 284464 - DNA, 16 bp, P. troglodytes
ttctgttatttaagcc

SEQ ID NO: 284465 - DNA, 17 bp, P. troglodytes
ttctgttccattggtct

SEQ ID NO: 284466 - DNA, 16 bp, P. troglodytes
ttctgttcctgtgtta

SEQ ID NO: 284467 - DNA, 16 bp, P. troglodytes
ttctgttctgttgatc

SEQ ID NO: 284468 - DNA, 16 bp, P. troglodytes
ttctgttcttctgtta

SEQ ID NO: 284469 - DNA, 16 bp, P. troglodytes
ttctgttgaatttcac

SEQ ID NO: 284470 - DNA, 16 bp, P. troglodytes
ttctgttgccctggct

SEQ ID NO: 284471 - DNA, 16 bp, P. troglodytes
ttctgttgttctaagc

SEQ ID NO: 284472 - DNA, 16 bp, P. troglodytes
ttctgttgtttaaaaa

SEQ ID NO: 284473 - DNA, 16 bp, P. troglodytes
ttctgttgtttgtaag

SEQ ID NO: 284474 - DNA, 16 bp, P. troglodytes
ttctgtttaaataaaa

SEQ ID NO: 284475 - DNA, 16 bp, P. troglodytes
ttctgtttatgtgatg

SEQ ID NO: 284476 - DNA, 16 bp, P. troglodytes
ttctgtttattaaaat

SEQ ID NO: 284477 - DNA, 16 bp, P. troglodytes
ttctgtttcattggtc

SEQ ID NO: 284478 - DNA, 16 bp, P. troglodytes
ttctgtttcctgaggc

SEQ ID NO: 284479 - DNA, 16 bp, P. troglodytes
ttctgtttctcagttt

SEQ ID NO: 284480 - DNA, 16 bp, P. troglodytes
ttctgtttctctctga

SEQ ID NO: 284481 - DNA, 16 bp, P. troglodytes
ttctgtttctctgaat

SEQ ID NO: 284482 - DNA, 16 bp, P. troglodytes
ttctgtttctgagttg

SEQ ID NO: 284483 - DNA, 16 bp, P. troglodytes
ttctgtttctgtccta

SEQ ID NO: 284484 - DNA, 16 bp, P. troglodytes
ttctgtttctttaaaa

SEQ ID NO: 284485 - DNA, 16 bp, P. troglodytes
ttctgtttctttctca

SEQ ID NO: 284486 - DNA, 16 bp, P. troglodytes
ttctgtttgtgtgatg

SEQ ID NO: 284487 - DNA, 16 bp, P. troglodytes
ttctgtttgttttaaa

SEQ ID NO: 284488 - DNA, 16 bp, P. troglodytes
ttctgttttaaaatta

SEQ ID NO: 284489 - DNA, 16 bp, P. troglodytes
ttctgttttatcagag

SEQ ID NO: 284490 - DNA, 16 bp, P. troglodytes
ttctgttttcaaattt

SEQ ID NO: 284491 - DNA, 16 bp, P. troglodytes
ttctgttttgcaagat

SEQ ID NO: 284492 - DNA, 16 bp, P. troglodytes
ttctgttttggaaaat

SEQ ID NO: 284493 - DNA, 16 bp, P. troglodytes
ttctgttttgtaaatt

SEQ ID NO: 284494 - DNA, 16 bp, P. troglodytes
ttctgtttttaaaata

SEQ ID NO: 284495 - DNA, 16 bp, P. troglodytes
ttctgtttttaggtct

SEQ ID NO: 284496 - DNA, 16 bp, P. troglodytes
ttctgtttttcagaat

SEQ ID NO: 284497 - DNA, 16 bp, P. troglodytes
ttctgtttttctccat

SEQ ID NO: 284498 - DNA, 16 bp, P. troglodytes
ttctgtttttgaaaat

SEQ ID NO: 284499 - DNA, 16 bp, P. troglodytes
ttctgttttttaaaaa

SEQ ID NO: 284500 - DNA, 16 bp, P. troglodytes
ttctgttttttataaa

SEQ ID NO: 284501 - DNA, 16 bp, P. troglodytes
ttcttaaaaaaaggaa

SEQ ID NO: 284502 - DNA, 16 bp, P. troglodytes
ttcttaaaaacacaaa

SEQ ID NO: 284503 - DNA, 16 bp, P. troglodytes
ttcttaaaaagaaaga

SEQ ID NO: 284504 - DNA, 16 bp, P. troglodytes
ttcttaaaaataaaga

SEQ ID NO: 284505 - DNA, 16 bp, P. troglodytes
ttcttaaaaataagtt

SEQ ID NO: 284506 - DNA, 16 bp, P. troglodytes
ttcttaaaaatgcaga

SEQ ID NO: 284507 - DNA, 16 bp, P. troglodytes
ttcttaaaaggacact

SEQ ID NO: 284508 - DNA, 16 bp, P. troglodytes
ttcttaaaatgaatta

SEQ ID NO: 284509 - DNA, 16 bp, P. troglodytes
ttcttaaaatgtattt

SEQ ID NO: 284510 - DNA, 16 bp, P. troglodytes
ttcttaaagaactgaa

SEQ ID NO: 284511 - DNA, 16 bp, P. troglodytes
ttcttaaagagaaaaa

SEQ ID NO: 284512 - DNA, 16 bp, P. troglodytes
ttcttaaagattattt

SEQ ID NO: 284513 - DNA, 16 bp, P. troglodytes
ttcttaaaggtcccac

SEQ ID NO: 284514 - DNA, 16 bp, P. troglodytes
ttcttaaataaaagaa

SEQ ID NO: 284515 - DNA, 16 bp, P. troglodytes
ttcttaaatattttgt

SEQ ID NO: 284516 - DNA, 16 bp, P. troglodytes
ttcttaaatgtatgta

SEQ ID NO: 284517 - DNA, 16 bp, P. troglodytes
ttcttaaccaggctga

SEQ ID NO: 284518 - DNA, 19 bp, P. troglodytes
ttcttaagggtgggggaga

SEQ ID NO: 284519 - DNA, 19 bp, P. troglodytes
ttcttaatcctgagttcta

SEQ ID NO: 284520 - DNA, 16 bp, P. troglodytes
ttcttaatgacatttt

SEQ ID NO: 284521 - DNA, 16 bp, P. troglodytes
ttcttaattctgagtt

SEQ ID NO: 284522 - DNA, 16 bp, P. troglodytes
ttcttaattttgataa

SEQ ID NO: 284523 - DNA, 16 bp, P. troglodytes
ttcttacaaaaagaaa

SEQ ID NO: 284524 - DNA, 16 bp, P. troglodytes
ttcttacttataaaat

SEQ ID NO: 284525 - DNA, 16 bp, P. troglodytes
ttcttagaaaaaaatt

SEQ ID NO: 284526 - DNA, 16 bp, P. troglodytes
ttcttagaagtaaaat

SEQ ID NO: 284527 - DNA, 16 bp, P. troglodytes
ttcttagactttcctt

SEQ ID NO: 284528 - DNA, 16 bp, P. troglodytes
ttcttagagaagaaaa

SEQ ID NO: 284529 - DNA, 16 bp, P. troglodytes
ttcttagatatggcac

SEQ ID NO: 284530 - DNA, 16 bp, P. troglodytes
ttcttagtattgattt

SEQ ID NO: 284531 - DNA, 16 bp, P. troglodytes
ttcttatctggaaaat

SEQ ID NO: 284532 - DNA, 16 bp, P. troglodytes
ttcttatgaaagtgct

SEQ ID NO: 284533 - DNA, 16 bp, P. troglodytes
ttcttatgaagatgct

SEQ ID NO: 284534 - DNA, 16 bp, P. troglodytes
ttcttatgaatggttt

SEQ ID NO: 284535 - DNA, 16 bp, P. troglodytes
ttcttatgaggacact

SEQ ID NO: 284536 - DNA, 16 bp, P. troglodytes
ttcttattggtctgtt

SEQ ID NO: 284537 - DNA, 16 bp, P. troglodytes
ttcttattgttcagtt

SEQ ID NO: 284538 - DNA, 16 bp, P. troglodytes
ttcttatttaaatgtt

SEQ ID NO: 284539 - DNA, 16 bp, P. troglodytes
ttcttattttatggca

SEQ ID NO: 284540 - DNA, 16 bp, P. troglodytes
ttcttattttcaaatg

SEQ ID NO: 284541 - DNA, 16 bp, P. troglodytes
ttcttattttccaaat

SEQ ID NO: 284542 - DNA, 16 bp, P. troglodytes
ttcttatttttagaaa

SEQ ID NO: 284543 - DNA, 16 bp, P. troglodytes
ttcttcaagaaaagaa

SEQ ID NO: 284544 - DNA, 16 bp, P. troglodytes
ttcttcaaggttgaaa

SEQ ID NO: 284545 - DNA, 16 bp, P. troglodytes
ttcttcaataataaat

SEQ ID NO: 284546 - DNA, 16 bp, P. troglodytes
ttcttcacaaaattag

SEQ ID NO: 284547 - DNA, 16 bp, P. troglodytes
ttcttcacagaattta

SEQ ID NO: 284548 - DNA, 16 bp, P. troglodytes
ttcttcagagagaagg

SEQ ID NO: 284549 - DNA, 16 bp, P. troglodytes
ttcttcagatattttt

SEQ ID NO: 284550 - DNA, 16 bp, P. troglodytes
ttcttcagcaacttct

SEQ ID NO: 284551 - DNA, 16 bp, P. troglodytes
ttcttcaggatattat

SEQ ID NO: 284552 - DNA, 16 bp, P. troglodytes
ttcttcaggatgggcc

SEQ ID NO: 284553 - DNA, 17 bp, P. troglodytes
ttcttcagtggtgattt

SEQ ID NO: 284554 - DNA, 16 bp, P. troglodytes
ttcttcagttccagga

SEQ ID NO: 284555 - DNA, 16 bp, P. troglodytes
ttcttcatagattctg

SEQ ID NO: 284556 - DNA, 16 bp, P. troglodytes
ttcttcatccagcttt

SEQ ID NO: 284557 - DNA, 16 bp, P. troglodytes
ttcttcatctgaaaaa

SEQ ID NO: 284558 - DNA, 16 bp, P. troglodytes
ttcttcatctgaaaag

SEQ ID NO: 284559 - DNA, 16 bp, P. troglodytes
ttcttcatcttcaaaa

SEQ ID NO: 284560 - DNA, 16 bp, P. troglodytes
ttcttcatgatttagt

SEQ ID NO: 284561 - DNA, 16 bp, P. troglodytes
ttcttcattaaaaaaa

SEQ ID NO: 284562 - DNA, 16 bp, P. troglodytes
ttcttcattgtaaaat

SEQ ID NO: 284563 - DNA, 16 bp, P. troglodytes
ttcttcattttcaaga

SEQ ID NO: 284564 - DNA, 16 bp, P. troglodytes
ttcttcattttgaaaa

SEQ ID NO: 284565 - DNA, 16 bp, P. troglodytes
ttcttccaaacaaatg

SEQ ID NO: 284566 - DNA, 16 bp, P. troglodytes
ttcttccaaattttat

SEQ ID NO: 284567 - DNA, 16 bp, P. troglodytes
ttcttccacttctgcc

SEQ ID NO: 284568 - DNA, 16 bp, P. troglodytes
ttcttccagtctgtgg

SEQ ID NO: 284569 - DNA, 16 bp, P. troglodytes
ttcttccagttgatca

SEQ ID NO: 284570 - DNA, 16 bp, P. troglodytes
ttcttcccaaatattt

SEQ ID NO: 284571 - DNA, 17 bp, P. troglodytes
ttcttcccaatccaaag

SEQ ID NO: 284572 - DNA, 16 bp, P. troglodytes
ttcttcccatctttgt

SEQ ID NO: 284573 - DNA, 16 bp, P. troglodytes
ttcttcccattctgta

SEQ ID NO: 284574 - DNA, 16 bp, P. troglodytes
ttcttccccaagaaag

SEQ ID NO: 284575 - DNA, 16 bp, P. troglodytes
ttcttcctagtttaat

SEQ ID NO: 284576 - DNA, 16 bp, P. troglodytes
ttcttcctcatcatct

SEQ ID NO: 284577 - DNA, 16 bp, P. troglodytes
ttcttcctcattgtct

SEQ ID NO: 284578 - DNA, 16 bp, P. troglodytes
ttcttcctcctcagcc

SEQ ID NO: 284579 - DNA, 16 bp, P. troglodytes
ttcttcctcctgggtt

SEQ ID NO: 284580 - DNA, 16 bp, P. troglodytes
ttcttcctctgcaaaa

SEQ ID NO: 284581 - DNA, 23 bp, P. troglodytes
ttcttcctggtttagtcttggga

SEQ ID NO: 284582 - DNA, 16 bp, P. troglodytes
ttcttccttcccaatt

SEQ ID NO: 284583 - DNA, 16 bp, P. troglodytes
ttcttccttcctgatg

SEQ ID NO: 284584 - DNA, 16 bp, P. troglodytes
ttcttccttttcaata

SEQ ID NO: 284585 - DNA, 16 bp, P. troglodytes
ttcttctaaaagtttt

SEQ ID NO: 284586 - DNA, 16 bp, P. troglodytes
ttcttctaagattctt

SEQ ID NO: 284587 - DNA, 16 bp, P. troglodytes
ttcttctacagcttcc

SEQ ID NO: 284588 - DNA, 16 bp, P. troglodytes
ttcttctacttgttta

SEQ ID NO: 284589 - DNA, 16 bp, P. troglodytes
ttcttctaggttttcc

SEQ ID NO: 284590 - DNA, 17 bp, P. troglodytes
ttcttctcacagctcca

SEQ ID NO: 284591 - DNA, 16 bp, P. troglodytes
ttcttctctgtgtccc

SEQ ID NO: 284592 - DNA, 16 bp, P. troglodytes
ttcttctgaaagtttt

SEQ ID NO: 284593 - DNA, 16 bp, P. troglodytes
ttcttctgacttcttt

SEQ ID NO: 284594 - DNA, 16 bp, P. troglodytes
ttcttctgccacagcc

SEQ ID NO: 284595 - DNA, 16 bp, P. troglodytes
ttcttctgccagctca

SEQ ID NO: 284596 - DNA, 19 bp, P. troglodytes
ttcttctgccatggcttca

SEQ ID NO: 284597 - DNA, 16 bp, P. troglodytes
ttcttctgcctgctct

SEQ ID NO: 284598 - DNA, 16 bp, P. troglodytes
ttcttctgctgctgct

SEQ ID NO: 284599 - DNA, 16 bp, P. troglodytes
ttcttctgcttgttca

SEQ ID NO: 284600 - DNA, 16 bp, P. troglodytes
ttcttctggaagcttt

SEQ ID NO: 284601 - DNA, 16 bp, P. troglodytes
ttcttctggaatattt

SEQ ID NO: 284602 - DNA, 16 bp, P. troglodytes
ttcttctggatatata

SEQ ID NO: 284603 - DNA, 16 bp, P. troglodytes
ttcttctggtagtttt

SEQ ID NO: 284604 - DNA, 16 bp, P. troglodytes
ttcttcttagcaccac

SEQ ID NO: 284605 - DNA, 16 bp, P. troglodytes
ttcttcttcacatggt

SEQ ID NO: 284606 - DNA, 16 bp, P. troglodytes
ttcttcttcctcagcc

SEQ ID NO: 284607 - DNA, 16 bp, P. troglodytes
ttcttcttcctgctgc

SEQ ID NO: 284608 - DNA, 16 bp, P. troglodytes
ttcttcttctttaaaa

SEQ ID NO: 284609 - DNA, 16 bp, P. troglodytes
ttcttcttcttttgag

SEQ ID NO: 284610 - DNA, 16 bp, P. troglodytes
ttcttcttgaaaaaaa

SEQ ID NO: 284611 - DNA, 16 bp, P. troglodytes
ttcttcttgggaaggc

SEQ ID NO: 284612 - DNA, 16 bp, P. troglodytes
ttcttctttgacccat

SEQ ID NO: 284613 - DNA, 16 bp, P. troglodytes
ttcttctttggagaaa

SEQ ID NO: 284614 - DNA, 16 bp, P. troglodytes
ttcttcttttctagta

SEQ ID NO: 284615 - DNA, 16 bp, P. troglodytes
ttcttcttttttgaaa

SEQ ID NO: 284616 - DNA, 16 bp, P. troglodytes
ttcttgaaaaaaaaat

SEQ ID NO: 284617 - DNA, 16 bp, P. troglodytes
ttcttgaaaataaatt

SEQ ID NO: 284618 - DNA, 16 bp, P. troglodytes
ttcttgaaaatattaa

SEQ ID NO: 284619 - DNA, 16 bp, P. troglodytes
ttcttgaaaatatttt

SEQ ID NO: 284620 - DNA, 16 bp, P. troglodytes
ttcttgaagaggtcct

SEQ ID NO: 284621 - DNA, 16 bp, P. troglodytes
ttcttgaatgaatgaa

SEQ ID NO: 284622 - DNA, 17 bp, P. troglodytes
ttcttgacttctgtgca

SEQ ID NO: 284623 - DNA, 16 bp, P. troglodytes
ttcttgacttttaaaa

SEQ ID NO: 284624 - DNA, 16 bp, P. troglodytes
ttcttgactttttgat

SEQ ID NO: 284625 - DNA, 16 bp, P. troglodytes
ttcttgagtcagtttt

SEQ ID NO: 284626 - DNA, 16 bp, P. troglodytes
ttcttgagttttgttc

SEQ ID NO: 284627 - DNA, 16 bp, P. troglodytes
ttcttgatcttaaaga

SEQ ID NO: 284628 - DNA, 16 bp, P. troglodytes
ttcttgatttttaaaa

SEQ ID NO: 284629 - DNA, 18 bp, P. troglodytes
ttcttgcatgagatccaa

SEQ ID NO: 284630 - DNA, 16 bp, P. troglodytes
ttcttgcattaatttg

SEQ ID NO: 284631 - DNA, 16 bp, P. troglodytes
ttcttgcattgctgta

SEQ ID NO: 284632 - DNA, 16 bp, P. troglodytes
ttcttgccaaaaatgc

SEQ ID NO: 284633 - DNA, 16 bp, P. troglodytes
ttcttgcctcagcctc

SEQ ID NO: 284634 - DNA, 42 bp, P. troglodytes
ttcttgccttctgctagcttttgaatgtgtttgctcttgctt

SEQ ID NO: 284635 - DNA, 16 bp, P. troglodytes
ttcttgctctgtcacc

SEQ ID NO: 284636 - DNA, 16 bp, P. troglodytes
ttcttgctgaattgac

SEQ ID NO: 284637 - DNA, 16 bp, P. troglodytes
ttcttgcttcccaaat

SEQ ID NO: 284638 - DNA, 16 bp, P. troglodytes
ttcttggaaactatga

SEQ ID NO: 284639 - DNA, 17 bp, P. troglodytes
ttcttggaggttttgtt

SEQ ID NO: 284640 - DNA, 16 bp, P. troglodytes
ttcttggcacctttat

SEQ ID NO: 284641 - DNA, 16 bp, P. troglodytes
ttcttggcctcccaaa

SEQ ID NO: 284642 - DNA, 16 bp, P. troglodytes
ttcttgggattttcta

SEQ ID NO: 284643 - DNA, 16 bp, P. troglodytes
ttcttgggctgctttt

SEQ ID NO: 284644 - DNA, 16 bp, P. troglodytes
ttcttggggaagaaaa

SEQ ID NO: 284645 - DNA, 16 bp, P. troglodytes
ttcttgggggctttgt

SEQ ID NO: 284646 - DNA, 16 bp, P. troglodytes
ttcttggtagagatgg

SEQ ID NO: 284647 - DNA, 16 bp, P. troglodytes
ttcttggttaagttta

SEQ ID NO: 284648 - DNA, 16 bp, P. troglodytes
ttcttgtaatgtcctt

SEQ ID NO: 284649 - DNA, 16 bp, P. troglodytes
ttcttgtagaattttt

SEQ ID NO: 284650 - DNA, 16 bp, P. troglodytes
ttcttgtgacagtgag

SEQ ID NO: 284651 - DNA, 16 bp, P. troglodytes
ttcttgtgagaagtgt

SEQ ID NO: 284652 - DNA, 16 bp, P. troglodytes
ttcttgtgccagtttt

SEQ ID NO: 284653 - DNA, 16 bp, P. troglodytes
ttcttgtttctccagt

SEQ ID NO: 284654 - DNA, 16 bp, P. troglodytes
ttcttgtttttgagac

SEQ ID NO: 284655 - DNA, 16 bp, P. troglodytes
ttcttgttttttaaaa

SEQ ID NO: 284656 - DNA, 16 bp, P. troglodytes
ttctttaaaaaaaatc

SEQ ID NO: 284657 - DNA, 16 bp, P. troglodytes
ttctttaaaaaaatac

SEQ ID NO: 284658 - DNA, 16 bp, P. troglodytes
ttctttaaaaagataa

SEQ ID NO: 284659 - DNA, 16 bp, P. troglodytes
ttctttaaaaaggaaa

SEQ ID NO: 284660 - DNA, 16 bp, P. troglodytes
ttctttaaaaatgaat

SEQ ID NO: 284661 - DNA, 16 bp, P. troglodytes
ttctttaaaagtgtgt

SEQ ID NO: 284662 - DNA, 16 bp, P. troglodytes
ttctttaaaataaatc

SEQ ID NO: 284663 - DNA, 16 bp, P. troglodytes
ttctttaaaatgcttt

SEQ ID NO: 284664 - DNA, 16 bp, P. troglodytes
ttctttaaaattacaa

SEQ ID NO: 284665 - DNA, 16 bp, P. troglodytes
ttctttaaacaaaaat

SEQ ID NO: 284666 - DNA, 16 bp, P. troglodytes
ttctttaaagttttta

SEQ ID NO: 284667 - DNA, 16 bp, P. troglodytes
ttctttaaatatgctt

SEQ ID NO: 284668 - DNA, 16 bp, P. troglodytes
ttctttaaatattttg

SEQ ID NO: 284669 - DNA, 16 bp, P. troglodytes
ttctttaaatgtctga

SEQ ID NO: 284670 - DNA, 16 bp, P. troglodytes
ttctttaaatgttttc

SEQ ID NO: 284671 - DNA, 16 bp, P. troglodytes
ttctttaagcagtgtt

SEQ ID NO: 284672 - DNA, 16 bp, P. troglodytes
ttctttaatttcaaaa

SEQ ID NO: 284673 - DNA, 16 bp, P. troglodytes
ttctttacagcagtat

SEQ ID NO: 284674 - DNA, 16 bp, P. troglodytes
ttctttactttcctaa

SEQ ID NO: 284675 - DNA, 16 bp, P. troglodytes
ttctttagaaaaatgt

SEQ ID NO: 284676 - DNA, 16 bp, P. troglodytes
ttctttagccataaag

SEQ ID NO: 284677 - DNA, 16 bp, P. troglodytes
ttctttagctcagagg

SEQ ID NO: 284678 - DNA, 16 bp, P. troglodytes
ttctttagtggtaatt

SEQ ID NO: 284679 - DNA, 16 bp, P. troglodytes
ttctttatacattctg

SEQ ID NO: 284680 - DNA, 16 bp, P. troglodytes
ttctttatagaaatgt

SEQ ID NO: 284681 - DNA, 16 bp, P. troglodytes
ttctttatctgaaaaa

SEQ ID NO: 284682 - DNA, 16 bp, P. troglodytes
ttctttatgaatttta

SEQ ID NO: 284683 - DNA, 16 bp, P. troglodytes
ttctttattaattacc

SEQ ID NO: 284684 - DNA, 20 bp, P. troglodytes
ttctttattagtcttgctag

SEQ ID NO: 284685 - DNA, 16 bp, P. troglodytes
ttctttattcaataaa

SEQ ID NO: 284686 - DNA, 16 bp, P. troglodytes
ttctttattctacttg

SEQ ID NO: 284687 - DNA, 16 bp, P. troglodytes
ttctttatttctgcct

SEQ ID NO: 284688 - DNA, 16 bp, P. troglodytes
ttctttcaaaaaatgt

SEQ ID NO: 284689 - DNA, 16 bp, P. troglodytes
ttctttcaaaaacaaa

SEQ ID NO: 284690 - DNA, 16 bp, P. troglodytes
ttctttcaaaaatgtt

SEQ ID NO: 284691 - DNA, 16 bp, P. troglodytes
ttctttcaaaataaaa

SEQ ID NO: 284692 - DNA, 16 bp, P. troglodytes
ttctttcactcagcac

SEQ ID NO: 284693 - DNA, 16 bp, P. troglodytes
ttctttcacttagcat

SEQ ID NO: 284694 - DNA, 16 bp, P. troglodytes
ttctttcagacttttt

SEQ ID NO: 284695 - DNA, 17 bp, P. troglodytes
ttctttcagcagtgttt

SEQ ID NO: 284696 - DNA, 16 bp, P. troglodytes
ttctttcagtaatgtt

SEQ ID NO: 284697 - DNA, 16 bp, P. troglodytes
ttctttcagttctttg

SEQ ID NO: 284698 - DNA, 16 bp, P. troglodytes
ttctttcagttgtgaa

SEQ ID NO: 284699 - DNA, 16 bp, P. troglodytes
ttctttcataataaat

SEQ ID NO: 284700 - DNA, 16 bp, P. troglodytes
ttctttcatcagagtt

SEQ ID NO: 284701 - DNA, 16 bp, P. troglodytes
ttctttcattgctata

SEQ ID NO: 284702 - DNA, 16 bp, P. troglodytes
ttctttcatttcaatc

SEQ ID NO: 284703 - DNA, 16 bp, P. troglodytes
ttctttcccagtctgt

SEQ ID NO: 284704 - DNA, 16 bp, P. troglodytes
ttctttcccattctgt

SEQ ID NO: 284705 - DNA, 16 bp, P. troglodytes
ttctttccccactgaa

SEQ ID NO: 284706 - DNA, 16 bp, P. troglodytes
ttctttcctgactttt

SEQ ID NO: 284707 - DNA, 16 bp, P. troglodytes
ttctttccttctgcta

SEQ ID NO: 284708 - DNA, 16 bp, P. troglodytes
ttctttccttggctgt

SEQ ID NO: 284709 - DNA, 16 bp, P. troglodytes
ttctttctaaaaatat

SEQ ID NO: 284710 - DNA, 16 bp, P. troglodytes
ttctttctagttttca

SEQ ID NO: 284711 - DNA, 16 bp, P. troglodytes
ttctttctcatttggg

SEQ ID NO: 284712 - DNA, 16 bp, P. troglodytes
ttctttctccattgaa

SEQ ID NO: 284713 - DNA, 16 bp, P. troglodytes
ttctttctctctgtta

SEQ ID NO: 284714 - DNA, 16 bp, P. troglodytes
ttctttctctgaaaat

SEQ ID NO: 284715 - DNA, 16 bp, P. troglodytes
ttctttctctgtgcag

SEQ ID NO: 284716 - DNA, 16 bp, P. troglodytes
ttctttctgcttagaa

SEQ ID NO: 284717 - DNA, 16 bp, P. troglodytes
ttctttctggtttagt

SEQ ID NO: 284718 - DNA, 16 bp, P. troglodytes
ttctttcttgagacag

SEQ ID NO: 284719 - DNA, 16 bp, P. troglodytes
ttctttctttcataga

SEQ ID NO: 284720 - DNA, 16 bp, P. troglodytes
ttctttcttttccatg

SEQ ID NO: 284721 - DNA, 16 bp, P. troglodytes
ttctttgaaaaaaatt

SEQ ID NO: 284722 - DNA, 16 bp, P. troglodytes
ttctttgaaaacatca

SEQ ID NO: 284723 - DNA, 16 bp, P. troglodytes
ttctttgaaaataaat

SEQ ID NO: 284724 - DNA, 16 bp, P. troglodytes
ttctttgaaaccagcg

SEQ ID NO: 284725 - DNA, 16 bp, P. troglodytes
ttctttgaaatgataa

SEQ ID NO: 284726 - DNA, 16 bp, P. troglodytes
ttctttgaagaatttt

SEQ ID NO: 284727 - DNA, 16 bp, P. troglodytes
ttctttgaatatattt

SEQ ID NO: 284728 - DNA, 16 bp, P. troglodytes
ttctttgaatgtttta

SEQ ID NO: 284729 - DNA, 16 bp, P. troglodytes
ttctttgaattaaaaa

SEQ ID NO: 284730 - DNA, 16 bp, P. troglodytes
ttctttgacatatttt

SEQ ID NO: 284731 - DNA, 16 bp, P. troglodytes
ttctttgactcagaaa

SEQ ID NO: 284732 - DNA, 16 bp, P. troglodytes
ttctttgagaaaaaaa

SEQ ID NO: 284733 - DNA, 16 bp, P. troglodytes
ttctttgagaaaataa

SEQ ID NO: 284734 - DNA, 16 bp, P. troglodytes
ttctttgagaaatctt

SEQ ID NO: 284735 - DNA, 16 bp, P. troglodytes
ttctttgagacacagt

SEQ ID NO: 284736 - DNA, 16 bp, P. troglodytes
ttctttgaggaaaaaa

SEQ ID NO: 284737 - DNA, 16 bp, P. troglodytes
ttctttgagttctttg

SEQ ID NO: 284738 - DNA, 16 bp, P. troglodytes
ttctttgataatattt

SEQ ID NO: 284739 - DNA, 16 bp, P. troglodytes
ttctttgataattttc

SEQ ID NO: 284740 - DNA, 16 bp, P. troglodytes
ttctttgatgaagtgt

SEQ ID NO: 284741 - DNA, 16 bp, P. troglodytes
ttctttgcagaaatat

SEQ ID NO: 284742 - DNA, 16 bp, P. troglodytes
ttctttgctaaaactg

SEQ ID NO: 284743 - DNA, 16 bp, P. troglodytes
ttctttggaaattatt

SEQ ID NO: 284744 - DNA, 16 bp, P. troglodytes
ttctttggaattttat

SEQ ID NO: 284745 - DNA, 16 bp, P. troglodytes
ttctttggagaaccct

SEQ ID NO: 284746 - DNA, 16 bp, P. troglodytes
ttctttggcaacttct

SEQ ID NO: 284747 - DNA, 16 bp, P. troglodytes
ttctttggcttaggat

SEQ ID NO: 284748 - DNA, 16 bp, P. troglodytes
ttctttggttccatat

SEQ ID NO: 284749 - DNA, 16 bp, P. troglodytes
ttctttgtaaattgcc

SEQ ID NO: 284750 - DNA, 16 bp, P. troglodytes
ttctttgtagattatg

SEQ ID NO: 284751 - DNA, 16 bp, P. troglodytes
ttctttgtggaggagg

SEQ ID NO: 284752 - DNA, 16 bp, P. troglodytes
ttctttgttgactttc

SEQ ID NO: 284753 - DNA, 16 bp, P. troglodytes
ttctttgttggattac

SEQ ID NO: 284754 - DNA, 16 bp, P. troglodytes
ttctttgttgtgggaa

SEQ ID NO: 284755 - DNA, 16 bp, P. troglodytes
ttctttgttttggcca

SEQ ID NO: 284756 - DNA, 16 bp, P. troglodytes
ttcttttaagaaaatt

SEQ ID NO: 284757 - DNA, 16 bp, P. troglodytes
ttcttttaatctgtaa

SEQ ID NO: 284758 - DNA, 16 bp, P. troglodytes
ttcttttacttaacat

SEQ ID NO: 284759 - DNA, 16 bp, P. troglodytes
ttcttttagaaattat

SEQ ID NO: 284760 - DNA, 16 bp, P. troglodytes
ttcttttataagaaaa

SEQ ID NO: 284761 - DNA, 16 bp, P. troglodytes
ttcttttattttgaga

SEQ ID NO: 284762 - DNA, 16 bp, P. troglodytes
ttcttttcaaaaaatg

SEQ ID NO: 284763 - DNA, 16 bp, P. troglodytes
ttcttttcaaaataat

SEQ ID NO: 284764 - DNA, 16 bp, P. troglodytes
ttcttttcaaaatgta

SEQ ID NO: 284765 - DNA, 16 bp, P. troglodytes
ttcttttcaaaattgt

SEQ ID NO: 284766 - DNA, 16 bp, P. troglodytes
ttcttttcaaatacat

SEQ ID NO: 284767 - DNA, 16 bp, P. troglodytes
ttcttttcaataaatg

SEQ ID NO: 284768 - DNA, 16 bp, P. troglodytes
ttcttttcacaggtgt

SEQ ID NO: 284769 - DNA, 16 bp, P. troglodytes
ttcttttcctctggat

SEQ ID NO: 284770 - DNA, 16 bp, P. troglodytes
ttcttttccttataaa

SEQ ID NO: 284771 - DNA, 16 bp, P. troglodytes
ttcttttccttttgca

SEQ ID NO: 284772 - DNA, 16 bp, P. troglodytes
ttcttttctaatgtat

SEQ ID NO: 284773 - DNA, 16 bp, P. troglodytes
ttcttttctcagtctc

SEQ ID NO: 284774 - DNA, 16 bp, P. troglodytes
ttcttttctgaaattt

SEQ ID NO: 284775 - DNA, 16 bp, P. troglodytes
ttcttttctggaaaat

SEQ ID NO: 284776 - DNA, 16 bp, P. troglodytes
ttcttttctgtcacat

SEQ ID NO: 284777 - DNA, 16 bp, P. troglodytes
ttcttttctgttctaa

SEQ ID NO: 284778 - DNA, 16 bp, P. troglodytes
ttcttttcttaagaat

SEQ ID NO: 284779 - DNA, 16 bp, P. troglodytes
ttcttttcttcagcac

SEQ ID NO: 284780 - DNA, 16 bp, P. troglodytes
ttcttttctttgagaa

SEQ ID NO: 284781 - DNA, 16 bp, P. troglodytes
ttcttttgaaaaaaaa

SEQ ID NO: 284782 - DNA, 16 bp, P. troglodytes
ttcttttgaaaaatat

SEQ ID NO: 284783 - DNA, 16 bp, P. troglodytes
ttcttttgaaaataaa

SEQ ID NO: 284784 - DNA, 16 bp, P. troglodytes
ttcttttgaaagaaaa

SEQ ID NO: 284785 - DNA, 16 bp, P. troglodytes
ttcttttgaagtctta

SEQ ID NO: 284786 - DNA, 16 bp, P. troglodytes
ttcttttgaattaaaa

SEQ ID NO: 284787 - DNA, 16 bp, P. troglodytes
ttcttttgagaactgt

SEQ ID NO: 284788 - DNA, 16 bp, P. troglodytes
ttcttttgagaattgc

SEQ ID NO: 284789 - DNA, 16 bp, P. troglodytes
ttcttttgagtccttg

SEQ ID NO: 284790 - DNA, 16 bp, P. troglodytes
ttcttttgattcagca

SEQ ID NO: 284791 - DNA, 16 bp, P. troglodytes
ttcttttgcctctgcc

SEQ ID NO: 284792 - DNA, 16 bp, P. troglodytes
ttcttttgctgggcag

SEQ ID NO: 284793 - DNA, 16 bp, P. troglodytes
ttcttttgctgtatag

SEQ ID NO: 284794 - DNA, 16 bp, P. troglodytes
ttcttttgcttcagcc

SEQ ID NO: 284795 - DNA, 16 bp, P. troglodytes
ttcttttggaaaatgt

SEQ ID NO: 284796 - DNA, 16 bp, P. troglodytes
ttcttttgggaaatgt

SEQ ID NO: 284797 - DNA, 16 bp, P. troglodytes
ttcttttgtaaagtgt

SEQ ID NO: 284798 - DNA, 16 bp, P. troglodytes
ttcttttgtcttagga

SEQ ID NO: 284799 - DNA, 21 bp, P. troglodytes
ttcttttgtggatcttcagtt

SEQ ID NO: 284800 - DNA, 16 bp, P. troglodytes
ttcttttgttatgcag

SEQ ID NO: 284801 - DNA, 16 bp, P. troglodytes
ttcttttgtttccatg

SEQ ID NO: 284802 - DNA, 16 bp, P. troglodytes
ttctttttaaaaagta

SEQ ID NO: 284803 - DNA, 16 bp, P. troglodytes
ttctttttaaaaagtt

SEQ ID NO: 284804 - DNA, 16 bp, P. troglodytes
ttctttttaaaagttg

SEQ ID NO: 284805 - DNA, 16 bp, P. troglodytes
ttctttttaaaataca

SEQ ID NO: 284806 - DNA, 16 bp, P. troglodytes
ttctttttaaaatcaa

SEQ ID NO: 284807 - DNA, 16 bp, P. troglodytes
ttctttttaaaattgt

SEQ ID NO: 284808 - DNA, 16 bp, P. troglodytes
ttctttttaaacaaat

SEQ ID NO: 284809 - DNA, 16 bp, P. troglodytes
ttctttttaaagtgtt

SEQ ID NO: 284810 - DNA, 16 bp, P. troglodytes
ttctttttaaatgtgt

SEQ ID NO: 284811 - DNA, 16 bp, P. troglodytes
ttctttttaacaaata

SEQ ID NO: 284812 - DNA, 16 bp, P. troglodytes
ttctttttaagaattt

SEQ ID NO: 284813 - DNA, 16 bp, P. troglodytes
ttctttttaatttgaa

SEQ ID NO: 284814 - DNA, 16 bp, P. troglodytes
ttctttttatgtaaat

SEQ ID NO: 284815 - DNA, 16 bp, P. troglodytes
ttctttttccaaaaga

SEQ ID NO: 284816 - DNA, 16 bp, P. troglodytes
ttctttttctctgcag

SEQ ID NO: 284817 - DNA, 16 bp, P. troglodytes
ttctttttcttctcag

SEQ ID NO: 284818 - DNA, 16 bp, P. troglodytes
ttctttttctttaaag

SEQ ID NO: 284819 - DNA, 16 bp, P. troglodytes
ttctttttgcaaaaaa

SEQ ID NO: 284820 - DNA, 16 bp, P. troglodytes
ttctttttgtggagaa

SEQ ID NO: 284821 - DNA, 16 bp, P. troglodytes
ttctttttgtggctgc

SEQ ID NO: 284822 - DNA, 16 bp, P. troglodytes
ttctttttgttcagga

SEQ ID NO: 284823 - DNA, 16 bp, P. troglodytes
ttcttttttaaaaaac

SEQ ID NO: 284824 - DNA, 16 bp, P. troglodytes
ttcttttttaaggctg

SEQ ID NO: 284825 - DNA, 16 bp, P. troglodytes
ttcttttttatggctg

SEQ ID NO: 284826 - DNA, 16 bp, P. troglodytes
ttcttttttatggtgg

SEQ ID NO: 284827 - DNA, 16 bp, P. troglodytes
ttcttttttatgtaaa

SEQ ID NO: 284828 - DNA, 16 bp, P. troglodytes
ttcttttttcctgaga

SEQ ID NO: 284829 - DNA, 16 bp, P. troglodytes
ttcttttttcttgaga

SEQ ID NO: 284830 - DNA, 16 bp, P. troglodytes
ttcttttttgagatgg

SEQ ID NO: 284831 - DNA, 16 bp, P. troglodytes
ttcttttttgatatag

SEQ ID NO: 284832 - DNA, 16 bp, P. troglodytes
ttcttttttggaaaat

SEQ ID NO: 284833 - DNA, 16 bp, P. troglodytes
ttctttttttaaagaa

SEQ ID NO: 284834 - DNA, 16 bp, P. troglodytes
ttctttttttaagata

SEQ ID NO: 284835 - DNA, 16 bp, P. troglodytes
ttctttttttgaaatg

SEQ ID NO: 284836 - DNA, 16 bp, P. troglodytes
ttcttttttttaaaga

SEQ ID NO: 284837 - DNA, 16 bp, P. troglodytes
ttcttttttttggaga

SEQ ID NO: 284838 - DNA, 16 bp, P. troglodytes
ttgaaaaaaatgaatg

SEQ ID NO: 284839 - DNA, 16 bp, P. troglodytes
ttgaaaaaacaaattt

SEQ ID NO: 284840 - DNA, 16 bp, P. troglodytes
ttgaaaaaaccagctc

SEQ ID NO: 284841 - DNA, 17 bp, P. troglodytes
ttgaaaaaaggttagac

SEQ ID NO: 284842 - DNA, 16 bp, P. troglodytes
ttgaaaaaatcaaaag

SEQ ID NO: 284843 - DNA, 16 bp, P. troglodytes
ttgaaaaaatcatttt

SEQ ID NO: 284844 - DNA, 16 bp, P. troglodytes
ttgaaaaacaatagac

SEQ ID NO: 284845 - DNA, 16 bp, P. troglodytes
ttgaaaaacagcagat

SEQ ID NO: 284846 - DNA, 16 bp, P. troglodytes
ttgaaaaactctagcc

SEQ ID NO: 284847 - DNA, 16 bp, P. troglodytes
ttgaaaaactgaatat

SEQ ID NO: 284848 - DNA, 16 bp, P. troglodytes
ttgaaaaagaaatgta

SEQ ID NO: 284849 - DNA, 16 bp, P. troglodytes
ttgaaaaagaacagaa

SEQ ID NO: 284850 - DNA, 16 bp, P. troglodytes
ttgaaaaagaagagca

SEQ ID NO: 284851 - DNA, 16 bp, P. troglodytes
ttgaaaaaggaaatat

SEQ ID NO: 284852 - DNA, 16 bp, P. troglodytes
ttgaaaaatattttct

SEQ ID NO: 284853 - DNA, 16 bp, P. troglodytes
ttgaaaaatcattaaa

SEQ ID NO: 284854 - DNA, 16 bp, P. troglodytes
ttgaaaaatgcaaaga

SEQ ID NO: 284855 - DNA, 16 bp, P. troglodytes
ttgaaaaatgcagaaa

SEQ ID NO: 284856 - DNA, 16 bp, P. troglodytes
ttgaaaaattacctgt

SEQ ID NO: 284857 - DNA, 16 bp, P. troglodytes
ttgaaaaatttcaaaa

SEQ ID NO: 284858 - DNA, 16 bp, P. troglodytes
ttgaaaacaatgtttt

SEQ ID NO: 284859 - DNA, 16 bp, P. troglodytes
ttgaaaacagagaaaa

SEQ ID NO: 284860 - DNA, 16 bp, P. troglodytes
ttgaaaacagcaagag

SEQ ID NO: 284861 - DNA, 16 bp, P. troglodytes
ttgaaaacattacact

SEQ ID NO: 284862 - DNA, 16 bp, P. troglodytes
ttgaaaaccaaaacaa

SEQ ID NO: 284863 - DNA, 16 bp, P. troglodytes
ttgaaaaccactgatc

SEQ ID NO: 284864 - DNA, 16 bp, P. troglodytes
ttgaaaaccagcataa

SEQ ID NO: 284865 - DNA, 16 bp, P. troglodytes
ttgaaaactttttttc

SEQ ID NO: 284866 - DNA, 16 bp, P. troglodytes
ttgaaaagaatattct

SEQ ID NO: 284867 - DNA, 16 bp, P. troglodytes
ttgaaaagaatgtatt

SEQ ID NO: 284868 - DNA, 16 bp, P. troglodytes
ttgaaaagactattat

SEQ ID NO: 284869 - DNA, 16 bp, P. troglodytes
ttgaaaagatcagcaa

SEQ ID NO: 284870 - DNA, 16 bp, P. troglodytes
ttgaaaagatcattca

SEQ ID NO: 284871 - DNA, 16 bp, P. troglodytes
ttgaaaaggaaagttt

SEQ ID NO: 284872 - DNA, 16 bp, P. troglodytes
ttgaaaaggcctggtc

SEQ ID NO: 284873 - DNA, 16 bp, P. troglodytes
ttgaaaagtaagaaat

SEQ ID NO: 284874 - DNA, 16 bp, P. troglodytes
ttgaaaataaagtttt

SEQ ID NO: 284875 - DNA, 16 bp, P. troglodytes
ttgaaaataaatttga

SEQ ID NO: 284876 - DNA, 16 bp, P. troglodytes
ttgaaaataatgagaa

SEQ ID NO: 284877 - DNA, 16 bp, P. troglodytes
ttgaaaataatgtttt

SEQ ID NO: 284878 - DNA, 16 bp, P. troglodytes
ttgaaaataatttcaa

SEQ ID NO: 284879 - DNA, 16 bp, P. troglodytes
ttgaaaatacatatat

SEQ ID NO: 284880 - DNA, 16 bp, P. troglodytes
ttgaaaatatacagtc

SEQ ID NO: 284881 - DNA, 16 bp, P. troglodytes
ttgaaaatatgtattt

SEQ ID NO: 284882 - DNA, 16 bp, P. troglodytes
ttgaaaatatttcctc

SEQ ID NO: 284883 - DNA, 16 bp, P. troglodytes
ttgaaaatatttttct

SEQ ID NO: 284884 - DNA, 16 bp, P. troglodytes
ttgaaaatcaacttaa

SEQ ID NO: 284885 - DNA, 16 bp, P. troglodytes
ttgaaaatcagtcaga

SEQ ID NO: 284886 - DNA, 16 bp, P. troglodytes
ttgaaaatcattttta

SEQ ID NO: 284887 - DNA, 16 bp, P. troglodytes
ttgaaaatgacagaaa

SEQ ID NO: 284888 - DNA, 16 bp, P. troglodytes
ttgaaaatgcatttaa

SEQ ID NO: 284889 - DNA, 16 bp, P. troglodytes
ttgaaaatggaaaata

SEQ ID NO: 284890 - DNA, 16 bp, P. troglodytes
ttgaaaatgtaatttt

SEQ ID NO: 284891 - DNA, 16 bp, P. troglodytes
ttgaaaatgtgttgtt

SEQ ID NO: 284892 - DNA, 16 bp, P. troglodytes
ttgaaaattagaaatt

SEQ ID NO: 284893 - DNA, 16 bp, P. troglodytes
ttgaaaattcagaaaa

SEQ ID NO: 284894 - DNA, 16 bp, P. troglodytes
ttgaaaattgttcaat

SEQ ID NO: 284895 - DNA, 16 bp, P. troglodytes
ttgaaaatttcttttt

SEQ ID NO: 284896 - DNA, 16 bp, P. troglodytes
ttgaaaatttttttca

SEQ ID NO: 284897 - DNA, 16 bp, P. troglodytes
ttgaaacaaagatggt

SEQ ID NO: 284898 - DNA, 16 bp, P. troglodytes
ttgaaacaaattaaaa

SEQ ID NO: 284899 - DNA, 16 bp, P. troglodytes
ttgaaacacagccaca

SEQ ID NO: 284900 - DNA, 16 bp, P. troglodytes
ttgaaacagagccttg

SEQ ID NO: 284901 - DNA, 16 bp, P. troglodytes
ttgaaacatttaaaaa

SEQ ID NO: 284902 - DNA, 16 bp, P. troglodytes
ttgaaacatttgtttt

SEQ ID NO: 284903 - DNA, 16 bp, P. troglodytes
ttgaaacattttcaaa

SEQ ID NO: 284904 - DNA, 16 bp, P. troglodytes
ttgaaaccaaagagaa

SEQ ID NO: 284905 - DNA, 16 bp, P. troglodytes
ttgaaaccagcctgga

SEQ ID NO: 284906 - DNA, 17 bp, P. troglodytes
ttgaaaccccgtctcta

SEQ ID NO: 284907 - DNA, 16 bp, P. troglodytes
ttgaaacctggcacaa

SEQ ID NO: 284908 - DNA, 16 bp, P. troglodytes
ttgaaactaaaataaa

SEQ ID NO: 284909 - DNA, 16 bp, P. troglodytes
ttgaaactatgtaaat

SEQ ID NO: 284910 - DNA, 16 bp, P. troglodytes
ttgaaacttccttttg

SEQ ID NO: 284911 - DNA, 16 bp, P. troglodytes
ttgaaagaaaacattt

SEQ ID NO: 284912 - DNA, 16 bp, P. troglodytes
ttgaaagaaacaaact

SEQ ID NO: 284913 - DNA, 16 bp, P. troglodytes
ttgaaagaaataattt

SEQ ID NO: 284914 - DNA, 16 bp, P. troglodytes
ttgaaagaaatatatt

SEQ ID NO: 284915 - DNA, 16 bp, P. troglodytes
ttgaaagaagatgcca

SEQ ID NO: 284916 - DNA, 16 bp, P. troglodytes
ttgaaagataattttt

SEQ ID NO: 284917 - DNA, 16 bp, P. troglodytes
ttgaaagatatatttt

SEQ ID NO: 284918 - DNA, 16 bp, P. troglodytes
ttgaaagatttaatat

SEQ ID NO: 284919 - DNA, 16 bp, P. troglodytes
ttgaaagcaaagaaaa

SEQ ID NO: 284920 - DNA, 16 bp, P. troglodytes
ttgaaaggagaaatag

SEQ ID NO: 284921 - DNA, 16 bp, P. troglodytes
ttgaaagtattttaaa

SEQ ID NO: 284922 - DNA, 16 bp, P. troglodytes
ttgaaagtctgtttta

SEQ ID NO: 284923 - DNA, 16 bp, P. troglodytes
ttgaaagtgaaaagat

SEQ ID NO: 284924 - DNA, 16 bp, P. troglodytes
ttgaaagtgaggtatt

SEQ ID NO: 284925 - DNA, 16 bp, P. troglodytes
ttgaaagtgccatttt

SEQ ID NO: 284926 - DNA, 16 bp, P. troglodytes
ttgaaagtggacttgg

SEQ ID NO: 284927 - DNA, 16 bp, P. troglodytes
ttgaaagtgtttgctc

SEQ ID NO: 284928 - DNA, 16 bp, P. troglodytes
ttgaaagttttaaaaa

SEQ ID NO: 284929 - DNA, 16 bp, P. troglodytes
ttgaaataaatgtgaa

SEQ ID NO: 284930 - DNA, 16 bp, P. troglodytes
ttgaaataactgaaaa

SEQ ID NO: 284931 - DNA, 16 bp, P. troglodytes
ttgaaataatattttg

SEQ ID NO: 284932 - DNA, 16 bp, P. troglodytes
ttgaaataatttcatt

SEQ ID NO: 284933 - DNA, 16 bp, P. troglodytes
ttgaaatagaaaacaa

SEQ ID NO: 284934 - DNA, 16 bp, P. troglodytes
ttgaaatattttcatt

SEQ ID NO: 284935 - DNA, 16 bp, P. troglodytes
ttgaaatattttgaaa

SEQ ID NO: 284936 - DNA, 16 bp, P. troglodytes
ttgaaatcaatgagaa

SEQ ID NO: 284937 - DNA, 16 bp, P. troglodytes
ttgaaatcctaacttc

SEQ ID NO: 284938 - DNA, 16 bp, P. troglodytes
ttgaaatgaaaacaaa

SEQ ID NO: 284939 - DNA, 16 bp, P. troglodytes
ttgaaatgaaaatatt

SEQ ID NO: 284940 - DNA, 16 bp, P. troglodytes
ttgaaatgaaatgaaa

SEQ ID NO: 284941 - DNA, 16 bp, P. troglodytes
ttgaaatgaatgaaaa

SEQ ID NO: 284942 - DNA, 16 bp, P. troglodytes
ttgaaatgacaacaaa

SEQ ID NO: 284943 - DNA, 16 bp, P. troglodytes
ttgaaatgataacaaa

SEQ ID NO: 284944 - DNA, 16 bp, P. troglodytes
ttgaaatgatcatata

SEQ ID NO: 284945 - DNA, 16 bp, P. troglodytes
ttgaaatgatcatttt

SEQ ID NO: 284946 - DNA, 16 bp, P. troglodytes
ttgaaatggcaacaaa

SEQ ID NO: 284947 - DNA, 16 bp, P. troglodytes
ttgaaatgggaaaagt

SEQ ID NO: 284948 - DNA, 16 bp, P. troglodytes
ttgaaatggtcctgca

SEQ ID NO: 284949 - DNA, 16 bp, P. troglodytes
ttgaaattaaaaactt

SEQ ID NO: 284950 - DNA, 16 bp, P. troglodytes
ttgaaattatgtaaat

SEQ ID NO: 284951 - DNA, 16 bp, P. troglodytes
ttgaaattcttaatga

SEQ ID NO: 284952 - DNA, 16 bp, P. troglodytes
ttgaaattcttatttt

SEQ ID NO: 284953 - DNA, 16 bp, P. troglodytes
ttgaaattgtatcaag

SEQ ID NO: 284954 - DNA, 16 bp, P. troglodytes
ttgaaatttgtcaaat

SEQ ID NO: 284955 - DNA, 16 bp, P. troglodytes
ttgaaattttaaatgt

SEQ ID NO: 284956 - DNA, 16 bp, P. troglodytes
ttgaaattttccagaa

SEQ ID NO: 284957 - DNA, 16 bp, P. troglodytes
ttgaaattttccataa

SEQ ID NO: 284958 - DNA, 16 bp, P. troglodytes
ttgaaattttctaaaa

SEQ ID NO: 284959 - DNA, 16 bp, P. troglodytes
ttgaaatttttaaaga

SEQ ID NO: 284960 - DNA, 16 bp, P. troglodytes
ttgaaatttttcttct

SEQ ID NO: 284961 - DNA, 16 bp, P. troglodytes
ttgaaattttttcaaa

SEQ ID NO: 284962 - DNA, 16 bp, P. troglodytes
ttgaacaaagaattgg

SEQ ID NO: 284963 - DNA, 16 bp, P. troglodytes
ttgaacaaatgaaaat

SEQ ID NO: 284964 - DNA, 16 bp, P. troglodytes
ttgaacaatgacaaca

SEQ ID NO: 284965 - DNA, 16 bp, P. troglodytes
ttgaacagttttgaaa

SEQ ID NO: 284966 - DNA, 16 bp, P. troglodytes
ttgaacatattttaaa

SEQ ID NO: 284967 - DNA, 16 bp, P. troglodytes
ttgaacatgggaggca

SEQ ID NO: 284968 - DNA, 16 bp, P. troglodytes
ttgaacattttatcat

SEQ ID NO: 284969 - DNA, 16 bp, P. troglodytes
ttgaaccaagaagaaa

SEQ ID NO: 284970 - DNA, 16 bp, P. troglodytes
ttgaaccagcctggca

SEQ ID NO: 284971 - DNA, 31 bp, P. troglodytes; identical to SEQ ID NO: 165170

SEQ ID NO: 284972 - DNA, 21 bp, P. troglodytes
ttgaacccaggagacagaggt

SEQ ID NO: 284973 - DNA, 16 bp, P. troglodytes
ttgaacccaggtggtc

SEQ ID NO: 284974 - DNA, 16 bp, P. troglodytes
ttgaacccgggaagcg

SEQ ID NO: 284975 - DNA, 16 bp, P. troglodytes
ttgaactcagtgctgc

SEQ ID NO: 284976 - DNA, 16 bp, P. troglodytes
ttgaactccaagttct

SEQ ID NO: 284977 - DNA, 17 bp, P. troglodytes
ttgaactcctggcctca

SEQ ID NO: 284978 - DNA, 16 bp, P. troglodytes
ttgaactcctgggcta

SEQ ID NO: 284979 - DNA, 16 bp, P. troglodytes
ttgaactgaaagaaaa

SEQ ID NO: 284980 - DNA, 16 bp, P. troglodytes
ttgaacttatttacac

SEQ ID NO: 284981 - DNA, 16 bp, P. troglodytes
ttgaacttcccaacct

SEQ ID NO: 284982 - DNA, 16 bp, P. troglodytes
ttgaacttgagagaaa

SEQ ID NO: 284983 - DNA, 16 bp, P. troglodytes
ttgaacttgtgggctc

SEQ ID NO: 284984 - DNA, 16 bp, P. troglodytes
ttgaactttataaaaa

SEQ ID NO: 284985 - DNA, 16 bp, P. troglodytes
ttgaacttttaaaata

SEQ ID NO: 284986 - DNA, 16 bp, P. troglodytes
ttgaagaaaaaatgtt

SEQ ID NO: 284987 - DNA, 16 bp, P. troglodytes
ttgaagaaaatgaaga

SEQ ID NO: 284988 - DNA, 16 bp, P. troglodytes
ttgaagaaacaatggc

SEQ ID NO: 284989 - DNA, 16 bp, P. troglodytes
ttgaagaaatatttgt

SEQ ID NO: 284990 - DNA, 16 bp, P. troglodytes
ttgaagaaatgaatga

SEQ ID NO: 284991 - DNA, 16 bp, P. troglodytes
ttgaagaaatgcttca

SEQ ID NO: 284992 - DNA, 16 bp, P. troglodytes
ttgaagaaatggctga

SEQ ID NO: 284993 - DNA, 16 bp, P. troglodytes
ttgaagaaatttttaa

SEQ ID NO: 284994 - DNA, 16 bp, P. troglodytes
ttgaagaacaaaagtt

SEQ ID NO: 284995 - DNA, 16 bp, P. troglodytes
ttgaagaacagaagtt

SEQ ID NO: 284996 - DNA, 16 bp, P. troglodytes
ttgaagaacttttctg

SEQ ID NO: 284997 - DNA, 16 bp, P. troglodytes
ttgaagaaggaaaaat

SEQ ID NO: 284998 - DNA, 16 bp, P. troglodytes
ttgaagaattttttaa

SEQ ID NO: 284999 - DNA, 16 bp, P. troglodytes
ttgaagaccatcttgc

SEQ ID NO: 285000 - DNA, 16 bp, P. troglodytes
ttgaagagatggggtt

SEQ ID NO: 285001 - DNA, 16 bp, P. troglodytes
ttgaagagattatttt

SEQ ID NO: 285002 - DNA, 16 bp, P. troglodytes
ttgaagaggaaacttt

SEQ ID NO: 285003 - DNA, 16 bp, P. troglodytes
ttgaagaggtccttcc

SEQ ID NO: 285004 - DNA, 16 bp, P. troglodytes
ttgaagataaaattat

SEQ ID NO: 285005 - DNA, 16 bp, P. troglodytes
ttgaagatatttttct

SEQ ID NO: 285006 - DNA, 16 bp, P. troglodytes
ttgaagatgcagtgag

SEQ ID NO: 285007 - DNA, 16 bp, P. troglodytes
ttgaagatggagaaag

SEQ ID NO: 285008 - DNA, 16 bp, P. troglodytes
ttgaagatggggcctt

SEQ ID NO: 285009 - DNA, 16 bp, P. troglodytes
ttgaagatgtgattaa

SEQ ID NO: 285010 - DNA, 16 bp, P. troglodytes
ttgaagcaaaggcagg

SEQ ID NO: 285011 - DNA, 16 bp, P. troglodytes
ttgaagcaaatcctag

SEQ ID NO: 285012 - DNA, 16 bp, P. troglodytes
ttgaagccaggtagtg

SEQ ID NO: 285013 - DNA, 16 bp, P. troglodytes
ttgaagccatgagttc

SEQ ID NO: 285014 - DNA, 16 bp, P. troglodytes
ttgaagccctaatccc

SEQ ID NO: 285015 - DNA, 16 bp, P. troglodytes
ttgaagctgcagtgag

SEQ ID NO: 285016 - DNA, 16 bp, P. troglodytes
ttgaagcttgtgtatg

SEQ ID NO: 285017 - DNA, 16 bp, P. troglodytes
ttgaaggaaattgaaa

SEQ ID NO: 285018 - DNA, 16 bp, P. troglodytes
ttgaaggaagttaaaa

SEQ ID NO: 285019 - DNA, 16 bp, P. troglodytes
ttgaaggacatttttg

SEQ ID NO: 285020 - DNA, 16 bp, P. troglodytes
ttgaaggagaaaaaca

SEQ ID NO: 285021 - DNA, 16 bp, P. troglodytes
ttgaaggagctgcaga

SEQ ID NO: 285022 - DNA, 16 bp, P. troglodytes
ttgaagggtttttctt

SEQ ID NO: 285023 - DNA, 16 bp, P. troglodytes
ttgaagggttttttgg

SEQ ID NO: 285024 - DNA, 16 bp, P. troglodytes
ttgaaggtataaaacc

SEQ ID NO: 285025 - DNA, 16 bp, P. troglodytes
ttgaagtaaaaattat

SEQ ID NO: 285026 - DNA, 16 bp, P. troglodytes
ttgaagtacattcctt

SEQ ID NO: 285027 - DNA, 16 bp, P. troglodytes
ttgaagtcagacagac

SEQ ID NO: 285028 - DNA, 16 bp, P. troglodytes
ttgaagtcctaacttc

SEQ ID NO: 285029 - DNA, 16 bp, P. troglodytes
ttgaagtgagcagaga

SEQ ID NO: 285030 - DNA, 16 bp, P. troglodytes
ttgaagttgtttatca

SEQ ID NO: 285031 - DNA, 16 bp, P. troglodytes
ttgaagtttttcaaaa

SEQ ID NO: 285032 - DNA, 16 bp, P. troglodytes
ttgaataaatgtttct

SEQ ID NO: 285033 - DNA, 16 bp, P. troglodytes
ttgaataacaccatgg

SEQ ID NO: 285034 - DNA, 16 bp, P. troglodytes
ttgaataaggaatcct

SEQ ID NO: 285035 - DNA, 16 bp, P. troglodytes
ttgaataatatttcat

SEQ ID NO: 285036 - DNA, 16 bp, P. troglodytes
ttgaataatcttttgt

SEQ ID NO: 285037 - DNA, 16 bp, P. troglodytes
ttgaataatgaatgaa

SEQ ID NO: 285038 - DNA, 16 bp, P. troglodytes
ttgaatacacatttct

SEQ ID NO: 285039 - DNA, 16 bp, P. troglodytes
ttgaataggattggta

SEQ ID NO: 285040 - DNA, 16 bp, P. troglodytes
ttgaatatatagatca

SEQ ID NO: 285041 - DNA, 16 bp, P. troglodytes
ttgaatatatttttct

SEQ ID NO: 285042 - DNA, 16 bp, P. troglodytes
ttgaatatttactata

SEQ ID NO: 285043 - DNA, 16 bp, P. troglodytes
ttgaatatttgaaata

SEQ ID NO: 285044 - DNA, 16 bp, P. troglodytes
ttgaatcacctgaggt

SEQ ID NO: 285045 - DNA, 16 bp, P. troglodytes
ttgaatcagaaagaaa

SEQ ID NO: 285046 - DNA, 16 bp, P. troglodytes
ttgaatccaggaggta

SEQ ID NO: 285047 - DNA, 16 bp, P. troglodytes
ttgaatcctgacctca

SEQ ID NO: 285048 - DNA, 16 bp, P. troglodytes
ttgaatctgcagattg

SEQ ID NO: 285049 - DNA, 16 bp, P. troglodytes
ttgaatctgggagatg

SEQ ID NO: 285050 - DNA, 16 bp, P. troglodytes
ttgaatctttcttttg

SEQ ID NO: 285051 - DNA, 16 bp, P. troglodytes
ttgaatgaacaaatga

SEQ ID NO: 285052 - DNA, 16 bp, P. troglodytes
ttgaatgaatgaggag

SEQ ID NO: 285053 - DNA, 16 bp, P. troglodytes
ttgaatgaattaatga

SEQ ID NO: 285054 - DNA, 16 bp, P. troglodytes
ttgaatgaattaatta

SEQ ID NO: 285055 - DNA, 16 bp, P. troglodytes
ttgaatgattccattt

SEQ ID NO: 285056 - DNA, 16 bp, P. troglodytes
ttgaatgatttttcat

SEQ ID NO: 285057 - DNA, 16 bp, P. troglodytes
ttgaatgcagaagcag

SEQ ID NO: 285058 - DNA, 16 bp, P. troglodytes
ttgaatggatgaataa

SEQ ID NO: 285059 - DNA, 16 bp, P. troglodytes
ttgaatgtgtttgccc

SEQ ID NO: 285060 - DNA, 16 bp, P. troglodytes
ttgaatgttcccaata

SEQ ID NO: 285061 - DNA, 16 bp, P. troglodytes
ttgaattatgaagaaa

SEQ ID NO: 285062 - DNA, 16 bp, P. troglodytes
ttgaattatttgaaat

SEQ ID NO: 285063 - DNA, 16 bp, P. troglodytes
ttgaattcccacatgt

SEQ ID NO: 285064 - DNA, 16 bp, P. troglodytes
ttgaattctctctctg

SEQ ID NO: 285065 - DNA, 16 bp, P. troglodytes
ttgaattgtacacttc

SEQ ID NO: 285066 - DNA, 16 bp, P. troglodytes
ttgaattgtttgagct

SEQ ID NO: 285067 - DNA, 16 bp, P. troglodytes
ttgaattgtttgagtt

SEQ ID NO: 285068 - DNA, 16 bp, P. troglodytes
ttgaatttaatcagac

SEQ ID NO: 285069 - DNA, 16 bp, P. troglodytes
ttgaatttcattttct

SEQ ID NO: 285070 - DNA, 17 bp, P. troglodytes
ttgaatttctccccaga

SEQ ID NO: 285071 - DNA, 16 bp, P. troglodytes
ttgaatttctgtggga

SEQ ID NO: 285072 - DNA, 16 bp, P. troglodytes
ttgaatttgcatttcc

SEQ ID NO: 285073 - DNA, 16 bp, P. troglodytes
ttgaatttgggaggtg

SEQ ID NO: 285074 - DNA, 16 bp, P. troglodytes
ttgaatttgtatcctg

SEQ ID NO: 285075 - DNA, 16 bp, P. troglodytes
ttgaatttgttgagac

SEQ ID NO: 285076 - DNA, 16 bp, P. troglodytes
ttgaattttaaaacaa

SEQ ID NO: 285077 - DNA, 16 bp, P. troglodytes
ttgaattttactttaa

SEQ ID NO: 285078 - DNA, 16 bp, P. troglodytes
ttgaattttatcatat

SEQ ID NO: 285079 - DNA, 16 bp, P. troglodytes
ttgaatttttaaaaag

SEQ ID NO: 285080 - DNA, 16 bp, P. troglodytes
ttgaatttttttcaga

SEQ ID NO: 285081 - DNA, 16 bp, P. troglodytes
ttgacaaaaatgctaa

SEQ ID NO: 285082 - DNA, 16 bp, P. troglodytes
ttgacaaaaattcaac

SEQ ID NO: 285083 - DNA, 16 bp, P. troglodytes
ttgacaaaactttagc

SEQ ID NO: 285084 - DNA, 16 bp, P. troglodytes
ttgacaaaataaactt

SEQ ID NO: 285085 - DNA, 16 bp, P. troglodytes
ttgacaaacctgagga

SEQ ID NO: 285086 - DNA, 16 bp, P. troglodytes
ttgacaaagaaaaatg

SEQ ID NO: 285087 - DNA, 16 bp, P. troglodytes
ttgacaaagaaataga

SEQ ID NO: 285088 - DNA, 25 bp, P. troglodytes
ttgacaaagggctaatatccagaat

SEQ ID NO: 285089 - DNA, 16 bp, P. troglodytes
ttgacaaaggtgtcaa

SEQ ID NO: 285090 - DNA, 16 bp, P. troglodytes
ttgacaaattgctgga

SEQ ID NO: 285091 - DNA, 16 bp, P. troglodytes
ttgacaattataaata

SEQ ID NO: 285092 - DNA, 16 bp, P. troglodytes
ttgacaatttaaaatt

SEQ ID NO: 285093 - DNA, 16 bp, P. troglodytes
ttgacacagagtcttg

SEQ ID NO: 285094 - DNA, 21 bp, P. troglodytes
ttgacacagcacatgtttcag

SEQ ID NO: 285095 - DNA, 16 bp, P. troglodytes
ttgacaccacagaaat

SEQ ID NO: 285096 - DNA, 16 bp, P. troglodytes
ttgacaccagcctgac

SEQ ID NO: 285097 - DNA, 16 bp, P. troglodytes
ttgacacgtggggatt

SEQ ID NO: 285098 - DNA, 16 bp, P. troglodytes
ttgacagaggaagaga

SEQ ID NO: 285099 - DNA, 16 bp, P. troglodytes
ttgacagtattttatt

SEQ ID NO: 285100 - DNA, 16 bp, P. troglodytes
ttgacagtggagtgtt

SEQ ID NO: 285101 - DNA, 16 bp, P. troglodytes
ttgacatacaaaaagc

SEQ ID NO: 285102 - DNA, 16 bp, P. troglodytes
ttgacattaaaaaaaa

SEQ ID NO: 285103 - DNA, 16 bp, P. troglodytes
ttgacatttcattttt

SEQ ID NO: 285104 - DNA, 16 bp, P. troglodytes
ttgacattttgggctg

SEQ ID NO: 285105 - DNA, 16 bp, P. troglodytes
ttgacatttttagatt

SEQ ID NO: 285106 - DNA, 16 bp, P. troglodytes
ttgaccaacatggtga

SEQ ID NO: 285107 - DNA, 16 bp, P. troglodytes
ttgaccaggctagtct

SEQ ID NO: 285108 - DNA, 16 bp, P. troglodytes
ttgaccaggctgctct

SEQ ID NO: 285109 - DNA, 16 bp, P. troglodytes
ttgaccaggctggagt

SEQ ID NO: 285110 - DNA, 16 bp, P. troglodytes
ttgaccaggctggtct

SEQ ID NO: 285111 - DNA, 16 bp, P. troglodytes
ttgaccattttttaat

SEQ ID NO: 285112 - DNA, 16 bp, P. troglodytes
ttgacctaattgacat

SEQ ID NO: 285113 - DNA, 16 bp, P. troglodytes
ttgacctcaagtgatc

SEQ ID NO: 285114 - DNA, 18 bp, P. troglodytes
ttgacctcaagtgatctg

SEQ ID NO: 285115 - DNA, 16 bp, P. troglodytes
ttgacctccagggctc

SEQ ID NO: 285116 - DNA, 17 bp, P. troglodytes
ttgacctcccaggccca

SEQ ID NO: 285117 - DNA, 16 bp, P. troglodytes
ttgacctcctaaagtg

SEQ ID NO: 285118 - DNA, 16 bp, P. troglodytes
ttgacctctctgagcc

SEQ ID NO: 285119 - DNA, 16 bp, P. troglodytes
ttgacctcttgacctc

SEQ ID NO: 285120 - DNA, 16 bp, P. troglodytes
ttgacctgggaggtgg

SEQ ID NO: 285121 - DNA, 16 bp, P. troglodytes
ttgactcagcaattcc

SEQ ID NO: 285122 - DNA, 17 bp, P. troglodytes
ttgactccaattttgaa

SEQ ID NO: 285123 - DNA, 16 bp, P. troglodytes
ttgactggaagcctta

SEQ ID NO: 285124 - DNA, 16 bp, P. troglodytes
ttgactgtggtgatgg

SEQ ID NO: 285125 - DNA, 16 bp, P. troglodytes
ttgactgttttagatt

SEQ ID NO: 285126 - DNA, 16 bp, P. troglodytes
ttgacttaatttttgt

SEQ ID NO: 285127 - DNA, 16 bp, P. troglodytes
ttgacttacagttctg

SEQ ID NO: 285128 - DNA, 16 bp, P. troglodytes
ttgacttccctggctc

SEQ ID NO: 285129 - DNA, 16 bp, P. troglodytes
ttgacttctgtgaacc

SEQ ID NO: 285130 - DNA, 16 bp, P. troglodytes
ttgacttgtctcagat

SEQ ID NO: 285131 - DNA, 16 bp, P. troglodytes
ttgactttaaattttt

SEQ ID NO: 285132 - DNA, 16 bp, P. troglodytes
ttgactttctatttct

SEQ ID NO: 285133 - DNA, 16 bp, P. troglodytes
ttgactttctctttct

SEQ ID NO: 285134 - DNA, 16 bp, P. troglodytes
ttgactttctgtcttg

SEQ ID NO: 285135 - DNA, 16 bp, P. troglodytes
ttgactttgggcaagt

SEQ ID NO: 285136 - DNA, 16 bp, P. troglodytes
ttgacttttgaatatt

SEQ ID NO: 285137 - DNA, 16 bp, P. troglodytes
ttgactttttaaaagt

SEQ ID NO: 285138 - DNA, 16 bp, P. troglodytes
ttgactttttcataat

SEQ ID NO: 285139 - DNA, 16 bp, P. troglodytes
ttgactttttttcccc

SEQ ID NO: 285140 - DNA, 16 bp, P. troglodytes
ttgagaaaaggagagg

SEQ ID NO: 285141 - DNA, 16 bp, P. troglodytes
ttgagaaagaacaaaa

SEQ ID NO: 285142 - DNA, 16 bp, P. troglodytes
ttgagaaataaagttt

SEQ ID NO: 285143 - DNA, 16 bp, P. troglodytes
ttgagaaataaatttc

SEQ ID NO: 285144 - DNA, 16 bp, P. troglodytes
ttgagaaatcaccaaa

SEQ ID NO: 285145 - DNA, 16 bp, P. troglodytes
ttgagaaatcttcata

SEQ ID NO: 285146 - DNA, 16 bp, P. troglodytes
ttgagaagaactgaca

SEQ ID NO: 285147 - DNA, 16 bp, P. troglodytes
ttgagaagatgaaaaa

SEQ ID NO: 285148 - DNA, 16 bp, P. troglodytes
ttgagaagtgttttgt

SEQ ID NO: 285149 - DNA, 16 bp, P. troglodytes
ttgagaatatatattt

SEQ ID NO: 285150 - DNA, 16 bp, P. troglodytes
ttgagaatcactgatc

SEQ ID NO: 285151 - DNA, 16 bp, P. troglodytes
ttgagaattttctatt

SEQ ID NO: 285152 - DNA, 16 bp, P. troglodytes
ttgagacaagagtctt

SEQ ID NO: 285153 - DNA, 16 bp, P. troglodytes
ttgagacagagtcact

SEQ ID NO: 285154 - DNA, 18 bp, P. troglodytes
ttgagacagagtctcacc

SEQ ID NO: 285155 - DNA, 16 bp, P. troglodytes
ttgagacagagtctgt

SEQ ID NO: 285156 - DNA, 16 bp, P. troglodytes
ttgagacagggcttca

SEQ ID NO: 285157 - DNA, 16 bp, P. troglodytes
ttgagacagggtctct

SEQ ID NO: 285158 - DNA, 16 bp, P. troglodytes
ttgagacaggttctca

SEQ ID NO: 285159 - DNA, 17 bp, P. troglodytes
ttgagaccagcctgcca

SEQ ID NO: 285160 - DNA, 16 bp, P. troglodytes
ttgagaccagctgggc

SEQ ID NO: 285161 - DNA, 16 bp, P. troglodytes
ttgagaccaggagttt

SEQ ID NO: 285162 - DNA, 16 bp, P. troglodytes
ttgagaccagtctgga

SEQ ID NO: 285163 - DNA, 17 bp, P. troglodytes
ttgagacctactgctca

SEQ ID NO: 285164 - DNA, 16 bp, P. troglodytes
ttgagacctgcctgga

SEQ ID NO: 285165 - DNA, 16 bp, P. troglodytes
ttgagacgaagtctca

SEQ ID NO: 285166 - DNA, 16 bp, P. troglodytes
ttgagactcagtttcc

SEQ ID NO: 285167 - DNA, 16 bp, P. troglodytes
ttgagactgagttttg

SEQ ID NO: 285168 - DNA, 16 bp, P. troglodytes
ttgagagaaaatattt

SEQ ID NO: 285169 - DNA, 16 bp, P. troglodytes
ttgagagagaatctca

SEQ ID NO: 285170 - DNA, 17 bp, P. troglodytes
ttgagagcaatcatcga

SEQ ID NO: 285171 - DNA, 16 bp, P. troglodytes
ttgagagcctgaggca

SEQ ID NO: 285172 - DNA, 16 bp, P. troglodytes
ttgagaggccgaggca

SEQ ID NO: 285173 - DNA, 16 bp, P. troglodytes
ttgagagggagtctcg

SEQ ID NO: 285174 - DNA, 16 bp, P. troglodytes
ttgagagggagttttg

SEQ ID NO: 285175 - DNA, 16 bp, P. troglodytes
ttgagagttctttata

SEQ ID NO: 285176 - DNA, 16 bp, P. troglodytes
ttgagagttttattat

SEQ ID NO: 285177 - DNA, 16 bp, P. troglodytes
ttgagagttttcaaca

SEQ ID NO: 285178 - DNA, 16 bp, P. troglodytes
ttgagatacaattcac

SEQ ID NO: 285179 - DNA, 20 bp, P. troglodytes
ttgagatagagtctcactgt

SEQ ID NO: 285180 - DNA, 16 bp, P. troglodytes
ttgagatataattaat

SEQ ID NO: 285181 - DNA, 17 bp, P. troglodytes
ttgagatattttgcaga

SEQ ID NO: 285182 - DNA, 16 bp, P. troglodytes
ttgagatcaggagctc

SEQ ID NO: 285183 - DNA, 16 bp, P. troglodytes
ttgagatcgcaccact

SEQ ID NO: 285184 - DNA, 16 bp, P. troglodytes
ttgagatctttctttt

SEQ ID NO: 285185 - DNA, 16 bp, P. troglodytes
ttgagatggagctttg

SEQ ID NO: 285186 - DNA, 16 bp, P. troglodytes
ttgagatggaggctca

SEQ ID NO: 285187 - DNA, 16 bp, P. troglodytes
ttgagatggagtctgc

SEQ ID NO: 285188 - DNA, 16 bp, P. troglodytes
ttgagatggcatttca

SEQ ID NO: 285189 - DNA, 16 bp, P. troglodytes
ttgagatggggagatt

SEQ ID NO: 285190 - DNA, 16 bp, P. troglodytes
ttgagatgtctgtggt

SEQ ID NO: 285191 - DNA, 16 bp, P. troglodytes
ttgagattttctacat

SEQ ID NO: 285192 - DNA, 16 bp, P. troglodytes
ttgagcaaaatcatct

SEQ ID NO: 285193 - DNA, 16 bp, P. troglodytes
ttgagcaataaaataa

SEQ ID NO: 285194 - DNA, 16 bp, P. troglodytes
ttgagcacaggaggtc

SEQ ID NO: 285195 - DNA, 16 bp, P. troglodytes
ttgagcaccaacatga

SEQ ID NO: 285196 - DNA, 16 bp, P. troglodytes
ttgagcagaaacctga

SEQ ID NO: 285197 - DNA, 16 bp, P. troglodytes
ttgagcagcagtttgt

SEQ ID NO: 285198 - DNA, 22 bp, P. troglodytes
ttgagcagtaggatataaataa

SEQ ID NO: 285199 - DNA, 16 bp, P. troglodytes
ttgagcagtttgggaa

SEQ ID NO: 285200 - DNA, 16 bp, P. troglodytes
ttgagcatattttctt

SEQ ID NO: 285201 - DNA, 16 bp, P. troglodytes
ttgagcatctgcagat

SEQ ID NO: 285202 - DNA, 16 bp, P. troglodytes
ttgagcatcttttcac

SEQ ID NO: 285203 - DNA, 16 bp, P. troglodytes
ttgagcatcttttcag

SEQ ID NO: 285204 - DNA, 16 bp, P. troglodytes
ttgagcatcttttcat

SEQ ID NO: 285205 - DNA, 16 bp, P. troglodytes
ttgagcatctttttat

SEQ ID NO: 285206 - DNA, 16 bp, P. troglodytes
ttgagcattttttata

SEQ ID NO: 285207 - DNA, 17 bp, P. troglodytes
ttgagccaccgcgccca

SEQ ID NO: 285208 - DNA, 16 bp, P. troglodytes
ttgagccactgcacca

SEQ ID NO: 285209 - DNA, 21 bp, P. troglodytes
ttgagccactgcacctggcct

SEQ ID NO: 285210 - DNA, 16 bp, P. troglodytes
ttgagcccacaagttc

SEQ ID NO: 285211 - DNA, 16 bp, P. troglodytes
ttgagccctggaattc

SEQ ID NO: 285212 - DNA, 19 bp, P. troglodytes
ttgagccgagattgtgcca

SEQ ID NO: 285213 - DNA, 16 bp, P. troglodytes
ttgagcctagcagttt

SEQ ID NO: 285214 - DNA, 16 bp, P. troglodytes
ttgagcctaggagttc

SEQ ID NO: 285215 - DNA, 16 bp, P. troglodytes
ttgagcctatgagtgt

SEQ ID NO: 285216 - DNA, 16 bp, P. troglodytes
ttgagcctcggaggtc

SEQ ID NO: 285217 - DNA, 16 bp, P. troglodytes
ttgagcctgggaaatg

SEQ ID NO: 285218 - DNA, 16 bp, P. troglodytes
ttgagcctgggagatc

SEQ ID NO: 285219 - DNA, 16 bp, P. troglodytes
ttgagcctgggagttc

SEQ ID NO: 285220 - DNA, 16 bp, P. troglodytes
ttgagctccacctcct

SEQ ID NO: 285221 - DNA, 16 bp, P. troglodytes
ttgagctgagatcaca

SEQ ID NO: 285222 - DNA, 18 bp, P. troglodytes
ttgagctgagatcatgcc

SEQ ID NO: 285223 - DNA, 16 bp, P. troglodytes
ttgagctgctgtgggc

SEQ ID NO: 285224 - DNA, 16 bp, P. troglodytes
ttgagcttctttaaaa

SEQ ID NO: 285225 - DNA, 16 bp, P. troglodytes
ttgagctttgaaacaa

SEQ ID NO: 285226 - DNA, 16 bp, P. troglodytes
ttgagctttttaaaat

SEQ ID NO: 285227 - DNA, 16 bp, P. troglodytes
ttgaggaaactgaggc

SEQ ID NO: 285228 - DNA, 16 bp, P. troglodytes
ttgaggaacctccaca

SEQ ID NO: 285229 - DNA, 16 bp, P. troglodytes
ttgaggaaccttcaaa

SEQ ID NO: 285230 - DNA, 16 bp, P. troglodytes
ttgaggaatcatcaca

SEQ ID NO: 285231 - DNA, 16 bp, P. troglodytes
ttgaggacattatgct

SEQ ID NO: 285232 - DNA, 16 bp, P. troglodytes
ttgaggagcaaggaga

SEQ ID NO: 285233 - DNA, 16 bp, P. troglodytes
ttgaggagcatctgta

SEQ ID NO: 285234 - DNA, 18 bp, P. troglodytes
ttgaggagcccttcagcc

SEQ ID NO: 285235 - DNA, 16 bp, P. troglodytes
ttgaggagtctcactc

SEQ ID NO: 285236 - DNA, 16 bp, P. troglodytes
ttgaggataggagttc

SEQ ID NO: 285237 - DNA, 16 bp, P. troglodytes
ttgaggatatttgcat

SEQ ID NO: 285238 - DNA, 16 bp, P. troglodytes
ttgaggcagagtctca

SEQ ID NO: 285239 - DNA, 22 bp, P. troglodytes
ttgaggcaggagaattgcttga

SEQ ID NO: 285240 - DNA, 16 bp, P. troglodytes
ttgaggccaggaggtt

SEQ ID NO: 285241 - DNA, 16 bp, P. troglodytes
ttgaggccaggagtcc

SEQ ID NO: 285242 - DNA, 16 bp, P. troglodytes
ttgaggctacagggag

SEQ ID NO: 285243 - DNA, 16 bp, P. troglodytes
ttgaggctacagtgag

SEQ ID NO: 285244 - DNA, 16 bp, P. troglodytes
ttgaggctgcaagtga

SEQ ID NO: 285245 - DNA, 16 bp, P. troglodytes
ttgaggctgcaatgag

SEQ ID NO: 285246 - DNA, 16 bp, P. troglodytes
ttgaggctgcagtgag

SEQ ID NO: 285247 - DNA, 16 bp, P. troglodytes
ttgaggctgcagtggg

SEQ ID NO: 285248 - DNA, 16 bp, P. troglodytes
ttgaggctgctgacct

SEQ ID NO: 285249 - DNA, 16 bp, P. troglodytes
ttgaggctggtcttga

SEQ ID NO: 285250 - DNA, 16 bp, P. troglodytes
ttgaggcttgttttgt

SEQ ID NO: 285251 - DNA, 16 bp, P. troglodytes
ttgagggagggatctg

SEQ ID NO: 285252 - DNA, 16 bp, P. troglodytes
ttgagggcaggagttc

SEQ ID NO: 285253 - DNA, 16 bp, P. troglodytes
ttgaggggatggataa

SEQ ID NO: 285254 - DNA, 16 bp, P. troglodytes
ttgagggtttttgtca

SEQ ID NO: 285255 - DNA, 16 bp, P. troglodytes
ttgaggtcagagtttg

SEQ ID NO: 285256 - DNA, 16 bp, P. troglodytes
ttgaggtgaggagttc

SEQ ID NO: 285257 - DNA, 16 bp, P. troglodytes
ttgaggtgatggatat

SEQ ID NO: 285258 - DNA, 16 bp, P. troglodytes
ttgaggtgctgctgga

SEQ ID NO: 285259 - DNA, 16 bp, P. troglodytes
ttgaggtggggcctgg

SEQ ID NO: 285260 - DNA, 16 bp, P. troglodytes
ttgaggttacagaaag

SEQ ID NO: 285261 - DNA, 16 bp, P. troglodytes
ttgaggttatctactg

SEQ ID NO: 285262 - DNA, 17 bp, P. troglodytes
ttgaggttgggagttcg

SEQ ID NO: 285263 - DNA, 16 bp, P. troglodytes
ttgaggtttacaacat

SEQ ID NO: 285264 - DNA, 16 bp, P. troglodytes
ttgaggttttgtttca

SEQ ID NO: 285265 - DNA, 16 bp, P. troglodytes
ttgagtaattgtgaca

SEQ ID NO: 285266 - DNA, 16 bp, P. troglodytes
ttgagtaatttgccca

SEQ ID NO: 285267 - DNA, 16 bp, P. troglodytes
ttgagtatcccttatc

SEQ ID NO: 285268 - DNA, 16 bp, P. troglodytes
ttgagtatcccttatt

SEQ ID NO: 285269 - DNA, 16 bp, P. troglodytes
ttgagtatcttttcag

SEQ ID NO: 285270 - DNA, 16 bp, P. troglodytes
ttgagtcaggagttcg

SEQ ID NO: 285271 - DNA, 16 bp, P. troglodytes
ttgagtcccagagttc

SEQ ID NO: 285272 - DNA, 16 bp, P. troglodytes
ttgagtgcagtggcgc

SEQ ID NO: 285273 - DNA, 16 bp, P. troglodytes
ttgagtggctgaggca

SEQ ID NO: 285274 - DNA, 16 bp, P. troglodytes
ttgagtgtcctcacaa

SEQ ID NO: 285275 - DNA, 16 bp, P. troglodytes
ttgagtgtctgtggct

SEQ ID NO: 285276 - DNA, 16 bp, P. troglodytes
ttgagtgtttcatttg

SEQ ID NO: 285277 - DNA, 16 bp, P. troglodytes
ttgagttaatgtttgt

SEQ ID NO: 285278 - DNA, 16 bp, P. troglodytes
ttgagttgttcatttt

SEQ ID NO: 285279 - DNA, 16 bp, P. troglodytes
ttgagttgtttgaatt

SEQ ID NO: 285280 - DNA, 16 bp, P. troglodytes
ttgagttgtttgagtc

SEQ ID NO: 285281 - DNA, 16 bp, P. troglodytes
ttgagtttctgatgag

SEQ ID NO: 285282 - DNA, 16 bp, P. troglodytes
ttgagttttaagattt

SEQ ID NO: 285283 - DNA, 16 bp, P. troglodytes
ttgagtttttaaaaga

SEQ ID NO: 285284 - DNA, 16 bp, P. troglodytes
ttgataaaaatgcaaa

SEQ ID NO: 285285 - DNA, 16 bp, P. troglodytes
ttgataaaatacaaca

SEQ ID NO: 285286 - DNA, 16 bp, P. troglodytes
ttgataaaattaaaca

SEQ ID NO: 285287 - DNA, 16 bp, P. troglodytes
ttgataaatatttgct

SEQ ID NO: 285288 - DNA, 16 bp, P. troglodytes
ttgataaggattgcat

SEQ ID NO: 285289 - DNA, 16 bp, P. troglodytes
ttgataatattcaaca

SEQ ID NO: 285290 - DNA, 16 bp, P. troglodytes
ttgataatgatgatga

SEQ ID NO: 285291 - DNA, 16 bp, P. troglodytes
ttgataattgttgaag

SEQ ID NO: 285292 - DNA, 16 bp, P. troglodytes
ttgatacagaaaaaaa

SEQ ID NO: 285293 - DNA, 16 bp, P. troglodytes
ttgatacagagtctca

SEQ ID NO: 285294 - DNA, 16 bp, P. troglodytes
ttgatacatttttaaa

SEQ ID NO: 285295 - DNA, 16 bp, P. troglodytes
ttgatagaatttacca

SEQ ID NO: 285296 - DNA, 16 bp, P. troglodytes
ttgatatcttaacaat

SEQ ID NO: 285297 - DNA, 16 bp, P. troglodytes
ttgatatgctgctgaa

SEQ ID NO: 285298 - DNA, 16 bp, P. troglodytes
ttgatattcatgaaca

SEQ ID NO: 285299 - DNA, 16 bp, P. troglodytes
ttgatatttatagaat

SEQ ID NO: 285300 - DNA, 16 bp, P. troglodytes
ttgatcaacatctccc

SEQ ID NO: 285301 - DNA, 16 bp, P. troglodytes
ttgatcaggctggtct

SEQ ID NO: 285302 - DNA, 16 bp, P. troglodytes
ttgatcagttgatgaa

SEQ ID NO: 285303 - DNA, 16 bp, P. troglodytes
ttgatcatgatgaatg

SEQ ID NO: 285304 - DNA, 16 bp, P. troglodytes
ttgatcatttttaaaa

SEQ ID NO: 285305 - DNA, 16 bp, P. troglodytes
ttgatccgcctgcctt

SEQ ID NO: 285306 - DNA, 16 bp, P. troglodytes
ttgatcctgtcattct

SEQ ID NO: 285307 - DNA, 16 bp, P. troglodytes
ttgatccttttcaaaa

SEQ ID NO: 285308 - DNA, 16 bp, P. troglodytes
ttgatctcagatttct

SEQ ID NO: 285309 - DNA, 16 bp, P. troglodytes
ttgatctcttcacctc

SEQ ID NO: 285310 - DNA, 16 bp, P. troglodytes
ttgatctgataaacaa

SEQ ID NO: 285311 - DNA, 16 bp, P. troglodytes
ttgatcttaaaaaaaa

SEQ ID NO: 285312 - DNA, 16 bp, P. troglodytes
ttgatcttagccaaaa

SEQ ID NO: 285313 - DNA, 16 bp, P. troglodytes
ttgatcttctatctag

SEQ ID NO: 285314 - DNA, 16 bp, P. troglodytes
ttgatctttctaatat

SEQ ID NO: 285315 - DNA, 16 bp, P. troglodytes
ttgatcttttaaaaaa

SEQ ID NO: 285316 - DNA, 16 bp, P. troglodytes
ttgatcttttcaaaga

SEQ ID NO: 285317 - DNA, 16 bp, P. troglodytes
ttgatctttttatcat

SEQ ID NO: 285318 - DNA, 16 bp, P. troglodytes
ttgatctttttgaaaa

SEQ ID NO: 285319 - DNA, 16 bp, P. troglodytes
ttgatgaaatgtatct

SEQ ID NO: 285320 - DNA, 18 bp, P. troglodytes
ttgatgaacattgatgca

SEQ ID NO: 285321 - DNA, 16 bp, P. troglodytes
ttgatgaacatttgaa

SEQ ID NO: 285322 - DNA, 16 bp, P. troglodytes
ttgatgaacatttgga

SEQ ID NO: 285323 - DNA, 16 bp, P. troglodytes
ttgatgaagaaattga

SEQ ID NO: 285324 - DNA, 16 bp, P. troglodytes
ttgatgaatgaataaa

SEQ ID NO: 285325 - DNA, 16 bp, P. troglodytes
ttgatgaattttcata

SEQ ID NO: 285326 - DNA, 16 bp, P. troglodytes
ttgatgagagaacctg

SEQ ID NO: 285327 - DNA, 16 bp, P. troglodytes
ttgatgaggaaactga

SEQ ID NO: 285328 - DNA, 16 bp, P. troglodytes
ttgatgagtttggaca

SEQ ID NO: 285329 - DNA, 16 bp, P. troglodytes
ttgatgatcctgacct

SEQ ID NO: 285330 - DNA, 16 bp, P. troglodytes
ttgatgatgatggtga

SEQ ID NO: 285331 - DNA, 16 bp, P. troglodytes
ttgatgattatttctt

SEQ ID NO: 285332 - DNA, 16 bp, P. troglodytes
ttgatgcacagaagtt

SEQ ID NO: 285333 - DNA, 16 bp, P. troglodytes
ttgatgcagaaatcct

SEQ ID NO: 285334 - DNA, 16 bp, P. troglodytes
ttgatgcagttttttc

SEQ ID NO: 285335 - DNA, 16 bp, P. troglodytes
ttgatggaaatgtaaa

SEQ ID NO: 285336 - DNA, 16 bp, P. troglodytes
ttgatggaagactttt

SEQ ID NO: 285337 - DNA, 16 bp, P. troglodytes
ttgatggctactgact

SEQ ID NO: 285338 - DNA, 16 bp, P. troglodytes
ttgatgggatgtattt

SEQ ID NO: 285339 - DNA, 16 bp, P. troglodytes
ttgatgggcacctagg

SEQ ID NO: 285340 - DNA, 16 bp, P. troglodytes
ttgatgggcgcagcaa

SEQ ID NO: 285341 - DNA, 16 bp, P. troglodytes
ttgatgtaggtattta

SEQ ID NO: 285342 - DNA, 16 bp, P. troglodytes
ttgatgtctcatgcct

SEQ ID NO: 285343 - DNA, 17 bp, P. troglodytes
ttgatgtgaacagcttt

SEQ ID NO: 285344 - DNA, 16 bp, P. troglodytes
ttgatgtgggtattta

SEQ ID NO: 285345 - DNA, 16 bp, P. troglodytes
ttgatgttattgtaaa

SEQ ID NO: 285346 - DNA, 16 bp, P. troglodytes
ttgattaaaaaacaaa

SEQ ID NO: 285347 - DNA, 16 bp, P. troglodytes
ttgattagcaatgtct

SEQ ID NO: 285348 - DNA, 16 bp, P. troglodytes
ttgattaggaaaagag

SEQ ID NO: 285349 - DNA, 16 bp, P. troglodytes
ttgattatttaaaaga

SEQ ID NO: 285350 - DNA, 16 bp, P. troglodytes
ttgattattttgagct

SEQ ID NO: 285351 - DNA, 16 bp, P. troglodytes
ttgattcaatacagca

SEQ ID NO: 285352 - DNA, 16 bp, P. troglodytes
ttgattccatacaaca

SEQ ID NO: 285353 - DNA, 16 bp, P. troglodytes
ttgattccatgtattt

SEQ ID NO: 285354 - DNA, 16 bp, P. troglodytes
ttgattccatttcatt

SEQ ID NO: 285355 - DNA, 16 bp, P. troglodytes
ttgattccctgtcttt

SEQ ID NO: 285356 - DNA, 16 bp, P. troglodytes
ttgattcttagcttgg

SEQ ID NO: 285357 - DNA, 16 bp, P. troglodytes
ttgattcttctctttc

SEQ ID NO: 285358 - DNA, 16 bp, P. troglodytes
ttgattcttctgtctt

SEQ ID NO: 285359 - DNA, 16 bp, P. troglodytes
ttgattctttcccttt

SEQ ID NO: 285360 - DNA, 16 bp, P. troglodytes
ttgattctttcttctg

SEQ ID NO: 285361 - DNA, 16 bp, P. troglodytes
ttgattcttttttaaa

SEQ ID NO: 285362 - DNA, 16 bp, P. troglodytes
ttgattgaaagagtta

SEQ ID NO: 285363 - DNA, 16 bp, P. troglodytes
ttgattgactgatttt

SEQ ID NO: 285364 - DNA, 16 bp, P. troglodytes
ttgattgatgtctcat

SEQ ID NO: 285365 - DNA, 16 bp, P. troglodytes
ttgattgattgactga

SEQ ID NO: 285366 - DNA, 16 bp, P. troglodytes
ttgattgattgattga

SEQ ID NO: 285367 - DNA, 16 bp, P. troglodytes
ttgattgcaccactgc

SEQ ID NO: 285368 - DNA, 16 bp, P. troglodytes
ttgattgcattgtggt

SEQ ID NO: 285369 - DNA, 16 bp, P. troglodytes
ttgattgctttttgct

SEQ ID NO: 285370 - DNA, 16 bp, P. troglodytes
ttgattggaataattt

SEQ ID NO: 285371 - DNA, 16 bp, P. troglodytes
ttgattgtgtcctttg

SEQ ID NO: 285372 - DNA, 16 bp, P. troglodytes
ttgatttaaaaaaact

SEQ ID NO: 285373 - DNA, 16 bp, P. troglodytes
ttgatttacatatttt

SEQ ID NO: 285374 - DNA, 16 bp, P. troglodytes
ttgatttattcaacaa

SEQ ID NO: 285375 - DNA, 16 bp, P. troglodytes
ttgatttcttcctggt

SEQ ID NO: 285376 - DNA, 16 bp, P. troglodytes
ttgatttctttttaaa

SEQ ID NO: 285377 - DNA, 16 bp, P. troglodytes
ttgatttgattttcag

SEQ ID NO: 285378 - DNA, 16 bp, P. troglodytes
ttgatttgcgtatatt

SEQ ID NO: 285379 - DNA, 16 bp, P. troglodytes
ttgattttaaaaatgt

SEQ ID NO: 285380 - DNA, 16 bp, P. troglodytes
ttgattttacagactc

SEQ ID NO: 285381 - DNA, 16 bp, P. troglodytes
ttgattttcaaatgtt

SEQ ID NO: 285382 - DNA, 16 bp, P. troglodytes
ttgattttcagcagtt

SEQ ID NO: 285383 - DNA, 16 bp, P. troglodytes
ttgattttcagtttta

SEQ ID NO: 285384 - DNA, 16 bp, P. troglodytes
ttgattttcatgtgtt

SEQ ID NO: 285385 - DNA, 16 bp, P. troglodytes
ttgattttctctattg

SEQ ID NO: 285386 - DNA, 16 bp, P. troglodytes
ttgattttgtctcctg

SEQ ID NO: 285387 - DNA, 16 bp, P. troglodytes
ttgatttttgaatact

SEQ ID NO: 285388 - DNA, 16 bp, P. troglodytes
ttgattttttaaaaga

SEQ ID NO: 285389 - DNA, 16 bp, P. troglodytes
ttgattttttcaaaaa

SEQ ID NO: 285390 - DNA, 16 bp, P. troglodytes
ttgattttttgaaagg

SEQ ID NO: 285391 - DNA, 16 bp, P. troglodytes
ttgattttttgaagag

SEQ ID NO: 285392 - DNA, 16 bp, P. troglodytes
ttgatttttttcaaaa

SEQ ID NO: 285393 - DNA, 16 bp, P. troglodytes
ttgatttttttctccc

SEQ ID NO: 285394 - DNA, 16 bp, P. troglodytes
ttgattttttttcaaa

SEQ ID NO: 285395 - DNA, 16 bp, P. troglodytes
ttgcaaaaataataca

SEQ ID NO: 285396 - DNA, 16 bp, P. troglodytes
ttgcaaaaattctctc

SEQ ID NO: 285397 - DNA, 16 bp, P. troglodytes
ttgcaaaacttcttga

SEQ ID NO: 285398 - DNA, 16 bp, P. troglodytes
ttgcaaaagaaagagg

SEQ ID NO: 285399 - DNA, 16 bp, P. troglodytes
ttgcaaaattcctgaa

SEQ ID NO: 285400 - DNA, 16 bp, P. troglodytes
ttgcaaagatatgaaa

SEQ ID NO: 285401 - DNA, 16 bp, P. troglodytes
ttgcaaagatttttct

SEQ ID NO: 285402 - DNA, 16 bp, P. troglodytes
ttgcaaataagaaaat

SEQ ID NO: 285403 - DNA, 16 bp, P. troglodytes
ttgcaaatatttcccc

SEQ ID NO: 285404 - DNA, 16 bp, P. troglodytes
ttgcaaatatttttct

SEQ ID NO: 285405 - DNA, 16 bp, P. troglodytes
ttgcaaattttctgta

SEQ ID NO: 285406 - DNA, 16 bp, P. troglodytes
ttgcaaattttttttc

SEQ ID NO: 285407 - DNA, 16 bp, P. troglodytes
ttgcaacagagactat

SEQ ID NO: 285408 - DNA, 16 bp, P. troglodytes
ttgcaacagaggctac

SEQ ID NO: 285409 - DNA, 16 bp, P. troglodytes
ttgcaacctcagcctc

SEQ ID NO: 285410 - DNA, 16 bp, P. troglodytes
ttgcaacttcctatga

SEQ ID NO: 285411 - DNA, 16 bp, P. troglodytes
ttgcaacttttctgta

SEQ ID NO: 285412 - DNA, 16 bp, P. troglodytes
ttgcaagaaacagaaa

SEQ ID NO: 285413 - DNA, 16 bp, P. troglodytes
ttgcaagatctggtca

SEQ ID NO: 285414 - DNA, 16 bp, P. troglodytes
ttgcaaggacagaaaa

SEQ ID NO: 285415 - DNA, 16 bp, P. troglodytes
ttgcaagtattttttc

SEQ ID NO: 285416 - DNA, 21 bp, P. troglodytes
ttgcaatcctagtctctgata

SEQ ID NO: 285417 - DNA, 34 bp, P. troglodytes
ttgcaatcctagtctctgataaaacagactttaa

SEQ ID NO: 285418 - DNA, 16 bp, P. troglodytes
ttgcaattgttttggg

SEQ ID NO: 285419 - DNA, 16 bp, P. troglodytes
ttgcaatttcttttgg

SEQ ID NO: 285420 - DNA, 16 bp, P. troglodytes
ttgcacaggctggcct

SEQ ID NO: 285421 - DNA, 16 bp, P. troglodytes
ttgcacatattttgtt

SEQ ID NO: 285422 - DNA, 16 bp, P. troglodytes
ttgcacatgctattcc

SEQ ID NO: 285423 - DNA, 16 bp, P. troglodytes
ttgcacatttttttct

SEQ ID NO: 285424 - DNA, 16 bp, P. troglodytes
ttgcaccactgcactg

SEQ ID NO: 285425 - DNA, 16 bp, P. troglodytes
ttgcaccactgccctc

SEQ ID NO: 285426 - DNA, 16 bp, P. troglodytes
ttgcaccatggcactc

SEQ ID NO: 285427 - DNA, 16 bp, P. troglodytes
ttgcaccattttacat

SEQ ID NO: 285428 - DNA, 16 bp, P. troglodytes
ttgcactaatttacat

SEQ ID NO: 285429 - DNA, 16 bp, P. troglodytes
ttgcactccagcgtgg

SEQ ID NO: 285430 - DNA, 16 bp, P. troglodytes
ttgcactgaatctata

SEQ ID NO: 285431 - DNA, 16 bp, P. troglodytes
ttgcagaaatgtaaaa

SEQ ID NO: 285432 - DNA, 16 bp, P. troglodytes
ttgcagaactggttga

SEQ ID NO: 285433 - DNA, 16 bp, P. troglodytes
ttgcagacagcagatt

SEQ ID NO: 285434 - DNA, 16 bp, P. troglodytes
ttgcagacattcccca

SEQ ID NO: 285435 - DNA, 16 bp, P. troglodytes
ttgcagactctgcact

SEQ ID NO: 285436 - DNA, 16 bp, P. troglodytes
ttgcagactgacaatg

SEQ ID NO: 285437 - DNA, 16 bp, P. troglodytes
ttgcagatactgtgtt

SEQ ID NO: 285438 - DNA, 16 bp, P. troglodytes
ttgcagatggaatcaa

SEQ ID NO: 285439 - DNA, 16 bp, P. troglodytes
ttgcagcaagcagaga

SEQ ID NO: 285440 - DNA, 16 bp, P. troglodytes
ttgcagcccagggctg

SEQ ID NO: 285441 - DNA, 16 bp, P. troglodytes
ttgcagcctcaacctc

SEQ ID NO: 285442 - DNA, 16 bp, P. troglodytes
ttgcagcttttgccat

SEQ ID NO: 285443 - DNA, 16 bp, P. troglodytes
ttgcaggaaaacaagt

SEQ ID NO: 285444 - DNA, 20 bp, P. troglodytes
ttgcaggatattatccagga

SEQ ID NO: 285445 - DNA, 16 bp, P. troglodytes
ttgcaggatttttttt

SEQ ID NO: 285446 - DNA, 16 bp, P. troglodytes
ttgcagggagtggaga

SEQ ID NO: 285447 - DNA, 16 bp, P. troglodytes
ttgcagggatgcctct

SEQ ID NO: 285448 - DNA, 16 bp, P. troglodytes
ttgcagtaagcggaga

SEQ ID NO: 285449 - DNA, 16 bp, P. troglodytes
ttgcagtccttgtgtc

SEQ ID NO: 285450 - DNA, 16 bp, P. troglodytes
ttgcagtgagccatgg

SEQ ID NO: 285451 - DNA, 16 bp, P. troglodytes
ttgcagtgagctaata

SEQ ID NO: 285452 - DNA, 16 bp, P. troglodytes
ttgcagtgagctatga

SEQ ID NO: 285453 - DNA, 16 bp, P. troglodytes
ttgcagtgagctgagt

SEQ ID NO: 285454 - DNA, 16 bp, P. troglodytes
ttgcagtgagctgatc

SEQ ID NO: 285455 - DNA, 16 bp, P. troglodytes
ttgcagtgagttatga

SEQ ID NO: 285456 - DNA, 16 bp, P. troglodytes
ttgcagtgagttgtga

SEQ ID NO: 285457 - DNA, 17 bp, P. troglodytes
ttgcagtggcacgatca

SEQ ID NO: 285458 - DNA, 16 bp, P. troglodytes
ttgcagtgtgctgaga

SEQ ID NO: 285459 - DNA, 16 bp, P. troglodytes
ttgcagtgttgcccag

SEQ ID NO: 285460 - DNA, 35 bp, P. troglodytes
ttgcagttgagatagaggaaggccactgtctcctg

SEQ ID NO: 285461 - DNA, 16 bp, P. troglodytes
ttgcagtttagacaca

SEQ ID NO: 285462 - DNA, 16 bp, P. troglodytes
ttgcagtttttgccac

SEQ ID NO: 285463 - DNA, 16 bp, P. troglodytes
ttgcagtttttgtaga

SEQ ID NO: 285464 - DNA, 16 bp, P. troglodytes
ttgcataatgataaaa

SEQ ID NO: 285465 - DNA, 16 bp, P. troglodytes
ttgcatataatctatg

SEQ ID NO: 285466 - DNA, 16 bp, P. troglodytes
ttgcatattctggaca

SEQ ID NO: 285467 - DNA, 16 bp, P. troglodytes
ttgcatcctgaaactt

SEQ ID NO: 285468 - DNA, 16 bp, P. troglodytes
ttgcatcctggctctg

SEQ ID NO: 285469 - DNA, 16 bp, P. troglodytes
ttgcatccttcaatct

SEQ ID NO: 285470 - DNA, 16 bp, P. troglodytes
ttgcatgagccaattt

SEQ ID NO: 285471 - DNA, 16 bp, P. troglodytes
ttgcatgattgccctg

SEQ ID NO: 285472 - DNA, 16 bp, P. troglodytes
ttgcatgcctgcaggt

SEQ ID NO: 285473 - DNA, 16 bp, P. troglodytes
ttgcatgctgttctga

SEQ ID NO: 285474 - DNA, 16 bp, P. troglodytes
ttgcatgtgtgtgtgt

SEQ ID NO: 285475 - DNA, 16 bp, P. troglodytes
ttgcatgtttattttg

SEQ ID NO: 285476 - DNA, 16 bp, P. troglodytes
ttgcattcaatctgta

SEQ ID NO: 285477 - DNA, 16 bp, P. troglodytes
ttgcattcctttgagt

SEQ ID NO: 285478 - DNA, 16 bp, P. troglodytes
ttgcatttaaaaaaat

SEQ ID NO: 285479 - DNA, 16 bp, P. troglodytes
ttgcatttatatgaaa

SEQ ID NO: 285480 - DNA, 16 bp, P. troglodytes
ttgcatttcagataaa

SEQ ID NO: 285481 - DNA, 16 bp, P. troglodytes
ttgcatttccatgatg

SEQ ID NO: 285482 - DNA, 16 bp, P. troglodytes
ttgcatttccttgata

SEQ ID NO: 285483 - DNA, 16 bp, P. troglodytes
ttgcatttctcatttt

SEQ ID NO: 285484 - DNA, 16 bp, P. troglodytes
ttgcatttctctgaat

SEQ ID NO: 285485 - DNA, 16 bp, P. troglodytes
ttgcatttcttcattt

SEQ ID NO: 285486 - DNA, 16 bp, P. troglodytes
ttgcatttctttgctt

SEQ ID NO: 285487 - DNA, 16 bp, P. troglodytes
ttgcatttcttttcct

SEQ ID NO: 285488 - DNA, 16 bp, P. troglodytes
ttgcatttgctgagta

SEQ ID NO: 285489 - DNA, 16 bp, P. troglodytes
ttgcattttccttatg

SEQ ID NO: 285490 - DNA, 16 bp, P. troglodytes
ttgcatttttatataa

SEQ ID NO: 285491 - DNA, 16 bp, P. troglodytes
ttgcatttttattaaa

SEQ ID NO: 285492 - DNA, 16 bp, P. troglodytes
ttgcatttttcaactc

SEQ ID NO: 285493 - DNA, 16 bp, P. troglodytes
ttgcatttttcttcat

SEQ ID NO: 285494 - DNA, 16 bp, P. troglodytes
ttgccaaaatttggaa

SEQ ID NO: 285495 - DNA, 16 bp, P. troglodytes
ttgccaacaaaaaaaa

SEQ ID NO: 285496 - DNA, 16 bp, P. troglodytes
ttgccaaggatgtgga

SEQ ID NO: 285497 - DNA, 16 bp, P. troglodytes
ttgccaaggccagtgt

SEQ ID NO: 285498 - DNA, 16 bp, P. troglodytes
ttgccaatgaaagtgg

SEQ ID NO: 285499 - DNA, 16 bp, P. troglodytes
ttgccacaaaccttca

SEQ ID NO: 285500 - DNA, 16 bp, P. troglodytes
ttgccacaaatcttca

SEQ ID NO: 285501 - DNA, 16 bp, P. troglodytes
ttgccaccatcttgga

SEQ ID NO: 285502 - DNA, 16 bp, P. troglodytes
ttgccactgctggctt

SEQ ID NO: 285503 - DNA, 16 bp, P. troglodytes
ttgccactttttaatg

SEQ ID NO: 285504 - DNA, 16 bp, P. troglodytes
ttgccagaggctgggg

SEQ ID NO: 285505 - DNA, 16 bp, P. troglodytes
ttgccaggagctggag

SEQ ID NO: 285506 - DNA, 16 bp, P. troglodytes
ttgccaggcacatgtg

SEQ ID NO: 285507 - DNA, 16 bp, P. troglodytes
ttgccaggctggtctc

SEQ ID NO: 285508 - DNA, 16 bp, P. troglodytes
ttgccagggaagaagg

SEQ ID NO: 285509 - DNA, 16 bp, P. troglodytes
ttgccagggacctgcc

SEQ ID NO: 285510 - DNA, 16 bp, P. troglodytes
ttgccaggttgcccag

SEQ ID NO: 285511 - DNA, 16 bp, P. troglodytes
ttgccagtattttatt

SEQ ID NO: 285512 - DNA, 16 bp, P. troglodytes
ttgccagtttttaagt

SEQ ID NO: 285513 - DNA, 16 bp, P. troglodytes
ttgccataacagaata

SEQ ID NO: 285514 - DNA, 16 bp, P. troglodytes
ttgccatcttggacaa

SEQ ID NO: 285515 - DNA, 16 bp, P. troglodytes
ttgccatgagcagaga

SEQ ID NO: 285516 - DNA, 18 bp, P. troglodytes
ttgccatggcatttgtaa

SEQ ID NO: 285517 - DNA, 16 bp, P. troglodytes
ttgccatgttgcccag

SEQ ID NO: 285518 - DNA, 17 bp, P. troglodytes
ttgccatgttgcccaga

SEQ ID NO: 285519 - DNA, 16 bp, P. troglodytes
ttgccattatttttaa

SEQ ID NO: 285520 - DNA, 16 bp, P. troglodytes
ttgccattctaattgg

SEQ ID NO: 285521 - DNA, 16 bp, P. troglodytes
ttgcccaaagttgcac

SEQ ID NO: 285522 - DNA, 16 bp, P. troglodytes
ttgcccaagctggtct

SEQ ID NO: 285523 - DNA, 16 bp, P. troglodytes
ttgcccacactggtct

SEQ ID NO: 285524 - DNA, 16 bp, P. troglodytes
ttgcccacttttaaat

SEQ ID NO: 285525 - DNA, 16 bp, P. troglodytes
ttgcccagactagagt

SEQ ID NO: 285526 - DNA, 16 bp, P. troglodytes
ttgcccagactggtct

SEQ ID NO: 285527 - DNA, 16 bp, P. troglodytes
ttgcccagagctggag

SEQ ID NO: 285528 - DNA, 16 bp, P. troglodytes
ttgcccagattggagt

SEQ ID NO: 285529 - DNA, 16 bp, P. troglodytes
ttgcccagcctggact

SEQ ID NO: 285530 - DNA, 16 bp, P. troglodytes
ttgcccagcctggagc

SEQ ID NO: 285531 - DNA, 16 bp, P. troglodytes
ttgcccaggatggtct

SEQ ID NO: 285532 - DNA, 16 bp, P. troglodytes
ttgcccaggccagtct

SEQ ID NO: 285533 - DNA, 16 bp, P. troglodytes
ttgcccaggctagagg

SEQ ID NO: 285534 - DNA, 16 bp, P. troglodytes
ttgcccaggctagtct

SEQ ID NO: 285535 - DNA, 16 bp, P. troglodytes
ttgcccaggctcgtct

SEQ ID NO: 285536 - DNA, 16 bp, P. troglodytes
ttgcccaggctgatct

SEQ ID NO: 285537 - DNA, 17 bp, P. troglodytes
ttgcccaggctggcctt

SEQ ID NO: 285538 - DNA, 16 bp, P. troglodytes
ttgcccaggctggtcc

SEQ ID NO: 285539 - DNA, 16 bp, P. troglodytes
ttgcccaggctggtcg

SEQ ID NO: 285540 - DNA, 16 bp, P. troglodytes
ttgcccaggctggtct

SEQ ID NO: 285541 - DNA, 16 bp, P. troglodytes
ttgcccaggctggtgt

SEQ ID NO: 285542 - DNA, 16 bp, P. troglodytes
ttgcccaggctgtggc

SEQ ID NO: 285543 - DNA, 16 bp, P. troglodytes
ttgcccaggctgttcc

SEQ ID NO: 285544 - DNA, 17 bp, P. troglodytes
ttgcccaggctgttctc

SEQ ID NO: 285545 - DNA, 16 bp, P. troglodytes
ttgcccagggtggtct

SEQ ID NO: 285546 - DNA, 16 bp, P. troglodytes
ttgcccaggtgcagtg

SEQ ID NO: 285547 - DNA, 16 bp, P. troglodytes
ttgcccaggtgtggtg

SEQ ID NO: 285548 - DNA, 16 bp, P. troglodytes
ttgcccaggttgctct

SEQ ID NO: 285549 - DNA, 16 bp, P. troglodytes
ttgcccaggttggtct

SEQ ID NO: 285550 - DNA, 16 bp, P. troglodytes
ttgcccagttcatgga

SEQ ID NO: 285551 - DNA, 16 bp, P. troglodytes
ttgcccataccaatgt

SEQ ID NO: 285552 - DNA, 27 bp, P. troglodytes
ttgcccatgcctatgtcctgaatggta

SEQ ID NO: 285553 - DNA, 16 bp, P. troglodytes
ttgcccatgctggtct

SEQ ID NO: 285554 - DNA, 16 bp, P. troglodytes
ttgccccaggaaatca

SEQ ID NO: 285555 - DNA, 16 bp, P. troglodytes
ttgccccagtcctgtg

SEQ ID NO: 285556 - DNA, 16 bp, P. troglodytes
ttgcccccaggctgga

SEQ ID NO: 285557 - DNA, 16 bp, P. troglodytes
ttgcccgggctgaagt

SEQ ID NO: 285558 - DNA, 16 bp, P. troglodytes
ttgcccgggctggcct

SEQ ID NO: 285559 - DNA, 16 bp, P. troglodytes
ttgcccgggctggtct

SEQ ID NO: 285560 - DNA, 16 bp, P. troglodytes
ttgccctgaagggtga

SEQ ID NO: 285561 - DNA, 16 bp, P. troglodytes
ttgccctgctgacact

SEQ ID NO: 285562 - DNA, 16 bp, P. troglodytes
ttgccctggctggcct

SEQ ID NO: 285563 - DNA, 16 bp, P. troglodytes
ttgccctggctggggt

SEQ ID NO: 285564 - DNA, 17 bp, P. troglodytes
ttgccctttgaagcatg

SEQ ID NO: 285565 - DNA, 16 bp, P. troglodytes
ttgccgaggctggtct

SEQ ID NO: 285566 - DNA, 16 bp, P. troglodytes
ttgccgccatcttgga

SEQ ID NO: 285567 - DNA, 16 bp, P. troglodytes
ttgcctaagctggtct

SEQ ID NO: 285568 - DNA, 16 bp, P. troglodytes
ttgcctaaggtcacat

SEQ ID NO: 285569 - DNA, 16 bp, P. troglodytes
ttgcctaatccaaggt

SEQ ID NO: 285570 - DNA, 16 bp, P. troglodytes
ttgcctacagaataaa

SEQ ID NO: 285571 - DNA, 16 bp, P. troglodytes
ttgcctacctgtcaaa

SEQ ID NO: 285572 - DNA, 16 bp, P. troglodytes
ttgcctaggctagtct

SEQ ID NO: 285573 - DNA, 16 bp, P. troglodytes
ttgcctaggctggagg

SEQ ID NO: 285574 - DNA, 16 bp, P. troglodytes
ttgcctaggctggagt

SEQ ID NO: 285575 - DNA, 16 bp, P. troglodytes
ttgcctaggctggtct

SEQ ID NO: 285576 - DNA, 16 bp, P. troglodytes
ttgcctattttttaaa

SEQ ID NO: 285577 - DNA, 16 bp, P. troglodytes
ttgcctcaaaaaagaa

SEQ ID NO: 285578 - DNA, 16 bp, P. troglodytes
ttgcctcagcttcccg

SEQ ID NO: 285579 - DNA, 16 bp, P. troglodytes
ttgcctcagcttcctg

SEQ ID NO: 285580 - DNA, 16 bp, P. troglodytes
ttgcctcagggccttt

SEQ ID NO: 285581 - DNA, 16 bp, P. troglodytes
ttgcctccagaactgt

SEQ ID NO: 285582 - DNA, 16 bp, P. troglodytes
ttgcctcctcagagga

SEQ ID NO: 285583 - DNA, 17 bp, P. troglodytes
ttgcctcggcttcccaa

SEQ ID NO: 285584 - DNA, 16 bp, P. troglodytes
ttgcctctaccaaaaa

SEQ ID NO: 285585 - DNA, 16 bp, P. troglodytes
ttgcctctcccagctt

SEQ ID NO: 285586 - DNA, 16 bp, P. troglodytes
ttgcctctctgtttgt

SEQ ID NO: 285587 - DNA, 16 bp, P. troglodytes
ttgcctctgcctggaa

SEQ ID NO: 285588 - DNA, 16 bp, P. troglodytes
ttgcctcttctggaca

SEQ ID NO: 285589 - DNA, 16 bp, P. troglodytes
ttgcctgaaaaaaaaa

SEQ ID NO: 285590 - DNA, 16 bp, P. troglodytes
ttgcctgagagcacag

SEQ ID NO: 285591 - DNA, 16 bp, P. troglodytes
ttgcctgaggtcacag

SEQ ID NO: 285592 - DNA, 16 bp, P. troglodytes
ttgcctgccgccatgt

SEQ ID NO: 285593 - DNA, 16 bp, P. troglodytes
ttgcctgcctcagcct

SEQ ID NO: 285594 - DNA, 17 bp, P. troglodytes
ttgcctgcctcggcctc

SEQ ID NO: 285595 - DNA, 16 bp, P. troglodytes
ttgcctgcctctgcct

SEQ ID NO: 285596 - DNA, 16 bp, P. troglodytes
ttgcctgcctgcctgc

SEQ ID NO: 285597 - DNA, 16 bp, P. troglodytes
ttgcctgccttggcct

SEQ ID NO: 285598 - DNA, 16 bp, P. troglodytes
ttgcctgcttcagcct

SEQ ID NO: 285599 - DNA, 16 bp, P. troglodytes
ttgcctgggcccagga

SEQ ID NO: 285600 - DNA, 16 bp, P. troglodytes
ttgcctggggaccagt

SEQ ID NO: 285601 - DNA, 16 bp, P. troglodytes
ttgcctggtgtggtgg

SEQ ID NO: 285602 - DNA, 16 bp, P. troglodytes
ttgcctgtttattctg

SEQ ID NO: 285603 - DNA, 18 bp, P. troglodytes
ttgccttccaggttcaag

SEQ ID NO: 285604 - DNA, 16 bp, P. troglodytes
ttgccttctaccatga

SEQ ID NO: 285605 - DNA, 16 bp, P. troglodytes
ttgccttctcctagct

SEQ ID NO: 285606 - DNA, 16 bp, P. troglodytes
ttgccttctgccagga

SEQ ID NO: 285607 - DNA, 16 bp, P. troglodytes
ttgccttctttaaaaa

SEQ ID NO: 285608 - DNA, 17 bp, P. troglodytes
ttgccttgctgagaatt

SEQ ID NO: 285609 - DNA, 16 bp, P. troglodytes
ttgccttggggattaa

SEQ ID NO: 285610 - DNA, 17 bp, P. troglodytes
ttgccttgtcgcccagg

SEQ ID NO: 285611 - DNA, 16 bp, P. troglodytes
ttgccttgtctcaggt

SEQ ID NO: 285612 - DNA, 16 bp, P. troglodytes
ttgccttgtgatcttt

SEQ ID NO: 285613 - DNA, 16 bp, P. troglodytes
ttgcctttaaattttt

SEQ ID NO: 285614 - DNA, 16 bp, P. troglodytes
ttgcctttctgtgcct

SEQ ID NO: 285615 - DNA, 16 bp, P. troglodytes
ttgccttttaaaattt

SEQ ID NO: 285616 - DNA, 16 bp, P. troglodytes
ttgccttttccagctt

SEQ ID NO: 285617 - DNA, 16 bp, P. troglodytes
ttgccttttccaggat

SEQ ID NO: 285618 - DNA, 16 bp, P. troglodytes
ttgccttttccagttt

SEQ ID NO: 285619 - DNA, 16 bp, P. troglodytes
ttgcctttttaataat

SEQ ID NO: 285620 - DNA, 16 bp, P. troglodytes
ttgcgatagtttgctc

SEQ ID NO: 285621 - DNA, 16 bp, P. troglodytes
ttgcgccactgcgctc

SEQ ID NO: 285622 - DNA, 19 bp, P. troglodytes
ttgcggtgagccgagatcg

SEQ ID NO: 285623 - DNA, 16 bp, P. troglodytes
ttgcggtttttgcaat

SEQ ID NO: 285624 - DNA, 16 bp, P. troglodytes
ttgctaaatctggtaa

SEQ ID NO: 285625 - DNA, 16 bp, P. troglodytes
ttgctaaatgaaagaa

SEQ ID NO: 285626 - DNA, 16 bp, P. troglodytes
ttgctaacattttatt

SEQ ID NO: 285627 - DNA, 16 bp, P. troglodytes
ttgctaagagagcaga

SEQ ID NO: 285628 - DNA, 16 bp, P. troglodytes
ttgctaataaagacat

SEQ ID NO: 285629 - DNA, 16 bp, P. troglodytes
ttgctaatattttgat

SEQ ID NO: 285630 - DNA, 16 bp, P. troglodytes
ttgctaattaaaaaaa

SEQ ID NO: 285631 - DNA, 16 bp, P. troglodytes
ttgctaatttatttat

SEQ ID NO: 285632 - DNA, 16 bp, P. troglodytes
ttgctacaaaaaataa

SEQ ID NO: 285633 - DNA, 16 bp, P. troglodytes
ttgctacaaagaacat

SEQ ID NO: 285634 - DNA, 16 bp, P. troglodytes
ttgctaccaagagaat

SEQ ID NO: 285635 - DNA, 16 bp, P. troglodytes
ttgctagaaggactca

SEQ ID NO: 285636 - DNA, 16 bp, P. troglodytes
ttgctagtctgtgtct

SEQ ID NO: 285637 - DNA, 16 bp, P. troglodytes
ttgctataaaggaaca

SEQ ID NO: 285638 - DNA, 16 bp, P. troglodytes
ttgctatgcaaaagct

SEQ ID NO: 285639 - DNA, 16 bp, P. troglodytes
ttgctatgcagaagtt

SEQ ID NO: 285640 - DNA, 16 bp, P. troglodytes
ttgctatggtctgaat

SEQ ID NO: 285641 - DNA, 16 bp, P. troglodytes
ttgctatgttgctcag

SEQ ID NO: 285642 - DNA, 16 bp, P. troglodytes
ttgctattattttgaa

SEQ ID NO: 285643 - DNA, 16 bp, P. troglodytes
ttgctattttgcctag

SEQ ID NO: 285644 - DNA, 16 bp, P. troglodytes
ttgctcaaatcaatca

SEQ ID NO: 285645 - DNA, 16 bp, P. troglodytes
ttgctcaactttaatt

SEQ ID NO: 285646 - DNA, 16 bp, P. troglodytes
ttgctcaataaacatt

SEQ ID NO: 285647 - DNA, 16 bp, P. troglodytes
ttgctcaccactgtat

SEQ ID NO: 285648 - DNA, 16 bp, P. troglodytes
ttgctcacctcctgct

SEQ ID NO: 285649 - DNA, 16 bp, P. troglodytes
ttgctcactgcaacct

SEQ ID NO: 285650 - DNA, 16 bp, P. troglodytes
ttgctcagcctggagt

SEQ ID NO: 285651 - DNA, 16 bp, P. troglodytes
ttgctcaggctagtct

SEQ ID NO: 285652 - DNA, 16 bp, P. troglodytes
ttgctcaggctggagt

SEQ ID NO: 285653 - DNA, 16 bp, P. troglodytes
ttgctcaggctggtct

SEQ ID NO: 285654 - DNA, 16 bp, P. troglodytes
ttgctcatgctggagt

SEQ ID NO: 285655 - DNA, 16 bp, P. troglodytes
ttgctcatgttgccca

SEQ ID NO: 285656 - DNA, 16 bp, P. troglodytes
ttgctcattaacatcc

SEQ ID NO: 285657 - DNA, 16 bp, P. troglodytes
ttgctcatttaaaaaa

SEQ ID NO: 285658 - DNA, 16 bp, P. troglodytes
ttgctcatttatttct

SEQ ID NO: 285659 - DNA, 16 bp, P. troglodytes
ttgctccacccatcaa

SEQ ID NO: 285660 - DNA, 17 bp, P. troglodytes
ttgctcctccttgcctt

SEQ ID NO: 285661 - DNA, 16 bp, P. troglodytes
ttgctcctgctcctgc

SEQ ID NO: 285662 - DNA, 16 bp, P. troglodytes
ttgctcctgctcttgc

SEQ ID NO: 285663 - DNA, 16 bp, P. troglodytes
ttgctccttagaaatt

SEQ ID NO: 285664 - DNA, 16 bp, P. troglodytes
ttgctctgccagctga

SEQ ID NO: 285665 - DNA, 16 bp, P. troglodytes
ttgctctggatgagtc

SEQ ID NO: 285666 - DNA, 16 bp, P. troglodytes
ttgctctggattgggc

SEQ ID NO: 285667 - DNA, 16 bp, P. troglodytes
ttgctctgtcacctat

SEQ ID NO: 285668 - DNA, 16 bp, P. troglodytes
ttgctctgtggccagg

SEQ ID NO: 285669 - DNA, 16 bp, P. troglodytes
ttgctcttactgccca

SEQ ID NO: 285670 - DNA, 16 bp, P. troglodytes
ttgctcttctccagga

SEQ ID NO: 285671 - DNA, 17 bp, P. troglodytes
ttgctcttgtcgcccag

SEQ ID NO: 285672 - DNA, 16 bp, P. troglodytes
ttgctgaaaatcaact

SEQ ID NO: 285673 - DNA, 16 bp, P. troglodytes
ttgctgaaagcaaagg

SEQ ID NO: 285674 - DNA, 16 bp, P. troglodytes
ttgctgaagacaggcc

SEQ ID NO: 285675 - DNA, 16 bp, P. troglodytes
ttgctgaagataatgg

SEQ ID NO: 285676 - DNA, 16 bp, P. troglodytes
ttgctgaaggttgggt

SEQ ID NO: 285677 - DNA, 16 bp, P. troglodytes
ttgctgaagttgtttg

SEQ ID NO: 285678 - DNA, 16 bp, P. troglodytes
ttgctgaatattttta

SEQ ID NO: 285679 - DNA, 16 bp, P. troglodytes
ttgctgaatgaataca

SEQ ID NO: 285680 - DNA, 16 bp, P. troglodytes
ttgctgagaaaagaat

SEQ ID NO: 285681 - DNA, 24 bp, P. troglodytes
ttgctgagatgttgttaatttgta

SEQ ID NO: 285682 - DNA, 16 bp, P. troglodytes
ttgctgagcagtattc

SEQ ID NO: 285683 - DNA, 16 bp, P. troglodytes
ttgctgagcatggtgg

SEQ ID NO: 285684 - DNA, 16 bp, P. troglodytes
ttgctgaggaaaatgg

SEQ ID NO: 285685 - DNA, 16 bp, P. troglodytes
ttgctgaggatgatgg

SEQ ID NO: 285686 - DNA, 16 bp, P. troglodytes
ttgctgagggccctgg

SEQ ID NO: 285687 - DNA, 16 bp, P. troglodytes
ttgctgagtgaataaa

SEQ ID NO: 285688 - DNA, 16 bp, P. troglodytes
ttgctgatgatattat

SEQ ID NO: 285689 - DNA, 16 bp, P. troglodytes
ttgctgatggctgtgg

SEQ ID NO: 285690 - DNA, 16 bp, P. troglodytes
ttgctgatgggaatgc

SEQ ID NO: 285691 - DNA, 16 bp, P. troglodytes
ttgctgatgggaatgt

SEQ ID NO: 285692 - DNA, 16 bp, P. troglodytes
ttgctgcaggagcagg

SEQ ID NO: 285693 - DNA, 16 bp, P. troglodytes
ttgctgcctgcttctt

SEQ ID NO: 285694 - DNA, 16 bp, P. troglodytes
ttgctgctacagattg

SEQ ID NO: 285695 - DNA, 16 bp, P. troglodytes
ttgctgctgcaggctc

SEQ ID NO: 285696 - DNA, 16 bp, P. troglodytes
ttgctgctgccatgtg

SEQ ID NO: 285697 - DNA, 16 bp, P. troglodytes
ttgctgctgctgctgt

SEQ ID NO: 285698 - DNA, 16 bp, P. troglodytes
ttgctgctgctgcttc

SEQ ID NO: 285699 - DNA, 16 bp, P. troglodytes
ttgctgctgctggctt

SEQ ID NO: 285700 - DNA, 16 bp, P. troglodytes
ttgctgctgcttctgc

SEQ ID NO: 285701 - DNA, 16 bp, P. troglodytes
ttgctgctgtaataaa

SEQ ID NO: 285702 - DNA, 16 bp, P. troglodytes
ttgctgctttgaaatt

SEQ ID NO: 285703 - DNA, 16 bp, P. troglodytes
ttgctgcttttaagat

SEQ ID NO: 285704 - DNA, 16 bp, P. troglodytes
ttgctggaaaggacat

SEQ ID NO: 285705 - DNA, 16 bp, P. troglodytes
ttgctggagtggctca

SEQ ID NO: 285706 - DNA, 16 bp, P. troglodytes
ttgctggatcatatga

SEQ ID NO: 285707 - DNA, 16 bp, P. troglodytes
ttgctggcaatccttg

SEQ ID NO: 285708 - DNA, 16 bp, P. troglodytes
ttgctggctctgaaga

SEQ ID NO: 285709 - DNA, 16 bp, P. troglodytes
ttgctggctgcataaa

SEQ ID NO: 285710 - DNA, 16 bp, P. troglodytes
ttgctggctttgaagg

SEQ ID NO: 285711 - DNA, 16 bp, P. troglodytes
ttgctgggactacagg

SEQ ID NO: 285712 - DNA, 16 bp, P. troglodytes
ttgctgggagaattaa

SEQ ID NO: 285713 - DNA, 16 bp, P. troglodytes
ttgctgggattacagg

SEQ ID NO: 285714 - DNA, 20 bp, P. troglodytes
ttgctgggattacaggcatg

SEQ ID NO: 285715 - DNA, 16 bp, P. troglodytes
ttgctgggccccaccc

SEQ ID NO: 285716 - DNA, 16 bp, P. troglodytes
ttgctgggctctgtgg

SEQ ID NO: 285717 - DNA, 16 bp, P. troglodytes
ttgctggggttacagg

SEQ ID NO: 285718 - DNA, 16 bp, P. troglodytes
ttgctgggttatatgg

SEQ ID NO: 285719 - DNA, 16 bp, P. troglodytes
ttgctggttttgaaga

SEQ ID NO: 285720 - DNA, 16 bp, P. troglodytes
ttgctgtatgaccttg

SEQ ID NO: 285721 - DNA, 16 bp, P. troglodytes
ttgctgtgaacctaaa

SEQ ID NO: 285722 - DNA, 16 bp, P. troglodytes
ttgctgtgagaattaa

SEQ ID NO: 285723 - DNA, 16 bp, P. troglodytes
ttgctgtgagccaaga

SEQ ID NO: 285724 - DNA, 16 bp, P. troglodytes
ttgctgtgtaacaaac

SEQ ID NO: 285725 - DNA, 16 bp, P. troglodytes
ttgctgtgtaaccttg

SEQ ID NO: 285726 - DNA, 16 bp, P. troglodytes
ttgctgtgtcaaatgg

SEQ ID NO: 285727 - DNA, 16 bp, P. troglodytes
ttgctgtgtcccagag

SEQ ID NO: 285728 - DNA, 16 bp, P. troglodytes
ttgctgtgtgctcaca

SEQ ID NO: 285729 - DNA, 16 bp, P. troglodytes
ttgctgttaataaata

SEQ ID NO: 285730 - DNA, 16 bp, P. troglodytes
ttgctgttgctgctgc

SEQ ID NO: 285731 - DNA, 16 bp, P. troglodytes
ttgcttaaacctggaa

SEQ ID NO: 285732 - DNA, 16 bp, P. troglodytes
ttgcttaatccagtct

SEQ ID NO: 285733 - DNA, 16 bp, P. troglodytes
ttgcttaatttttaaa

SEQ ID NO: 285734 - DNA, 16 bp, P. troglodytes
ttgcttagaattgctt

SEQ ID NO: 285735 - DNA, 16 bp, P. troglodytes
ttgcttaggctggtct

SEQ ID NO: 285736 - DNA, 16 bp, P. troglodytes
ttgcttaggttgtctt

SEQ ID NO: 285737 - DNA, 16 bp, P. troglodytes
ttgcttatttccttct

SEQ ID NO: 285738 - DNA, 16 bp, P. troglodytes
ttgcttcagaaggtgc

SEQ ID NO: 285739 - DNA, 16 bp, P. troglodytes
ttgcttcatgcatttt

SEQ ID NO: 285740 - DNA, 16 bp, P. troglodytes
ttgcttccaaatttta

SEQ ID NO: 285741 - DNA, 16 bp, P. troglodytes
ttgcttccaatttttg

SEQ ID NO: 285742 - DNA, 16 bp, P. troglodytes
ttgcttccacattttc

SEQ ID NO: 285743 - DNA, 16 bp, P. troglodytes
ttgcttccagtttggg

SEQ ID NO: 285744 - DNA, 16 bp, P. troglodytes
ttgcttccagtttttg

SEQ ID NO: 285745 - DNA, 16 bp, P. troglodytes
ttgcttctgtttcagt

SEQ ID NO: 285746 - DNA, 16 bp, P. troglodytes
ttgcttgaaaccggga

SEQ ID NO: 285747 - DNA, 16 bp, P. troglodytes
ttgcttgaacccggag

SEQ ID NO: 285748 - DNA, 16 bp, P. troglodytes
ttgcttgaacctggaa

SEQ ID NO: 285749 - DNA, 16 bp, P. troglodytes
ttgcttgaagctggga

SEQ ID NO: 285750 - DNA, 16 bp, P. troglodytes
ttgcttgagaaaagca

SEQ ID NO: 285751 - DNA, 16 bp, P. troglodytes
ttgcttgagcccagat

SEQ ID NO: 285752 - DNA, 16 bp, P. troglodytes
ttgcttgagcctgaga

SEQ ID NO: 285753 - DNA, 16 bp, P. troglodytes
ttgcttgaggccagag

SEQ ID NO: 285754 - DNA, 16 bp, P. troglodytes
ttgcttgattttgtca

SEQ ID NO: 285755 - DNA, 16 bp, P. troglodytes
ttgcttgcttgcttgt

SEQ ID NO: 285756 - DNA, 16 bp, P. troglodytes
ttgcttgcttttgtca

SEQ ID NO: 285757 - DNA, 16 bp, P. troglodytes
ttgcttgtacttttgg

SEQ ID NO: 285758 - DNA, 16 bp, P. troglodytes
ttgcttgtgcttttga

SEQ ID NO: 285759 - DNA, 16 bp, P. troglodytes
ttgcttgttttttaaa

SEQ ID NO: 285760 - DNA, 16 bp, P. troglodytes
ttgctttaaaaaattt

SEQ ID NO: 285761 - DNA, 16 bp, P. troglodytes
ttgctttaaaataatt

SEQ ID NO: 285762 - DNA, 16 bp, P. troglodytes
ttgctttaaaatactt

SEQ ID NO: 285763 - DNA, 16 bp, P. troglodytes
ttgctttaaaatatat

SEQ ID NO: 285764 - DNA, 16 bp, P. troglodytes
ttgctttaaaattttt

SEQ ID NO: 285765 - DNA, 16 bp, P. troglodytes
ttgctttaaagaaaaa

SEQ ID NO: 285766 - DNA, 16 bp, P. troglodytes
ttgctttaaagaaata

SEQ ID NO: 285767 - DNA, 16 bp, P. troglodytes
ttgctttaagagtact

SEQ ID NO: 285768 - DNA, 16 bp, P. troglodytes
ttgctttaataaaaat

SEQ ID NO: 285769 - DNA, 16 bp, P. troglodytes
ttgctttacataatcc

SEQ ID NO: 285770 - DNA, 16 bp, P. troglodytes
ttgctttcaattcttt

SEQ ID NO: 285771 - DNA, 16 bp, P. troglodytes
ttgctttctgatggtt

SEQ ID NO: 285772 - DNA, 16 bp, P. troglodytes
ttgctttcttgatttc

SEQ ID NO: 285773 - DNA, 24 bp, P. troglodytes
ttgctttgctgagatgttgttaat

SEQ ID NO: 285774 - DNA, 16 bp, P. troglodytes
ttgctttgctttttaa

SEQ ID NO: 285775 - DNA, 16 bp, P. troglodytes
ttgctttgggcagtat

SEQ ID NO: 285776 - DNA, 16 bp, P. troglodytes
ttgctttggggaaaaa

SEQ ID NO: 285777 - DNA, 16 bp, P. troglodytes
ttgctttggttacctg

SEQ ID NO: 285778 - DNA, 16 bp, P. troglodytes
ttgctttgttacccag

SEQ ID NO: 285779 - DNA, 16 bp, P. troglodytes
ttgcttttaaaaataa

SEQ ID NO: 285780 - DNA, 16 bp, P. troglodytes
ttgcttttaaaaattt

SEQ ID NO: 285781 - DNA, 16 bp, P. troglodytes
ttgcttttaaaatttt

SEQ ID NO: 285782 - DNA, 16 bp, P. troglodytes
ttgcttttaagatttt

SEQ ID NO: 285783 - DNA, 16 bp, P. troglodytes
ttgcttttcacattta

SEQ ID NO: 285784 - DNA, 16 bp, P. troglodytes
ttgcttttctatgtct

SEQ ID NO: 285785 - DNA, 16 bp, P. troglodytes
ttgcttttctccattc

SEQ ID NO: 285786 - DNA, 16 bp, P. troglodytes
ttgcttttgacatctt

SEQ ID NO: 285787 - DNA, 16 bp, P. troglodytes
ttgcttttgcaccttt

SEQ ID NO: 285788 - DNA, 16 bp, P. troglodytes
ttgcttttgtaaataa

SEQ ID NO: 285789 - DNA, 16 bp, P. troglodytes
ttgcttttgttgaatt

SEQ ID NO: 285790 - DNA, 16 bp, P. troglodytes
ttgctttttaaaatgt

SEQ ID NO: 285791 - DNA, 16 bp, P. troglodytes
ttgctttttaaatcag

SEQ ID NO: 285792 - DNA, 16 bp, P. troglodytes
ttgctttttccagaat

SEQ ID NO: 285793 - DNA, 16 bp, P. troglodytes
ttgcttttttgactta

SEQ ID NO: 285794 - DNA, 16 bp, P. troglodytes
ttgctttttttgagac

SEQ ID NO: 285795 - DNA, 16 bp, P. troglodytes
ttggaaaaaaaatact

SEQ ID NO: 285796 - DNA, 16 bp, P. troglodytes
ttggaaaaaaatgtat

SEQ ID NO: 285797 - DNA, 16 bp, P. troglodytes
ttggaaaaaacaactt

SEQ ID NO: 285798 - DNA, 16 bp, P. troglodytes
ttggaaaaaatatttg

SEQ ID NO: 285799 - DNA, 16 bp, P. troglodytes
ttggaaaaactacttt

SEQ ID NO: 285800 - DNA, 16 bp, P. troglodytes
ttggaaaaagaaaatg

SEQ ID NO: 285801 - DNA, 16 bp, P. troglodytes
ttggaaaaagatgcca

SEQ ID NO: 285802 - DNA, 16 bp, P. troglodytes
ttggaaaacaatattt

SEQ ID NO: 285803 - DNA, 16 bp, P. troglodytes
ttggaaaacactgcag

SEQ ID NO: 285804 - DNA, 16 bp, P. troglodytes
ttggaaaacagtgtgg

SEQ ID NO: 285805 - DNA, 16 bp, P. troglodytes
ttggaaaacatatttg

SEQ ID NO: 285806 - DNA, 16 bp, P. troglodytes
ttggaaaacattttga

SEQ ID NO: 285807 - DNA, 16 bp, P. troglodytes
ttggaaaactgaggca

SEQ ID NO: 285808 - DNA, 16 bp, P. troglodytes
ttggaaaagaacaaaa

SEQ ID NO: 285809 - DNA, 16 bp, P. troglodytes
ttggaaaagaatttat

SEQ ID NO: 285810 - DNA, 16 bp, P. troglodytes
ttggaaaagagaaagt

SEQ ID NO: 285811 - DNA, 16 bp, P. troglodytes
ttggaaaataaaattt

SEQ ID NO: 285812 - DNA, 16 bp, P. troglodytes
ttggaaaatagtttga

SEQ ID NO: 285813 - DNA, 16 bp, P. troglodytes
ttggaaaatggaaaaa

SEQ ID NO: 285814 - DNA, 16 bp, P. troglodytes
ttggaaaatgtgcagc

SEQ ID NO: 285815 - DNA, 16 bp, P. troglodytes
ttggaaaatttaatat

SEQ ID NO: 285816 - DNA, 16 bp, P. troglodytes
ttggaaacatttcaaa

SEQ ID NO: 285817 - DNA, 16 bp, P. troglodytes
ttggaaacctccacct

SEQ ID NO: 285818 - DNA, 16 bp, P. troglodytes
ttggaaactatgcaaa

SEQ ID NO: 285819 - DNA, 16 bp, P. troglodytes
ttggaaactctctttt

SEQ ID NO: 285820 - DNA, 16 bp, P. troglodytes
ttggaaagaaaatgaa

SEQ ID NO: 285821 - DNA, 16 bp, P. troglodytes
ttggaaagatgaaaaa

SEQ ID NO: 285822 - DNA, 16 bp, P. troglodytes
ttggaaagctaaggca

SEQ ID NO: 285823 - DNA, 16 bp, P. troglodytes
ttggaaataaatttaa

SEQ ID NO: 285824 - DNA, 16 bp, P. troglodytes
ttggaaatactttttt

SEQ ID NO: 285825 - DNA, 16 bp, P. troglodytes
ttggaaatattttctc

SEQ ID NO: 285826 - DNA, 16 bp, P. troglodytes
ttggaaatatttttaa

SEQ ID NO: 285827 - DNA, 16 bp, P. troglodytes
ttggaaatcctagcca

SEQ ID NO: 285828 - DNA, 16 bp, P. troglodytes
ttggaaatggaaaaaa

SEQ ID NO: 285829 - DNA, 16 bp, P. troglodytes
ttggaaatggagaaat

SEQ ID NO: 285830 - DNA, 16 bp, P. troglodytes
ttggaaattatttaaa

SEQ ID NO: 285831 - DNA, 16 bp, P. troglodytes
ttggaacacagccaca

SEQ ID NO: 285832 - DNA, 16 bp, P. troglodytes
ttggaactcagtgctg

SEQ ID NO: 285833 - DNA, 16 bp, P. troglodytes
ttggaactgggtaaca

SEQ ID NO: 285834 - DNA, 16 bp, P. troglodytes
ttggaagaaataatat

SEQ ID NO: 285835 - DNA, 16 bp, P. troglodytes
ttggaagaatttatat

SEQ ID NO: 285836 - DNA, 16 bp, P. troglodytes
ttggaagaccaaggca

SEQ ID NO: 285837 - DNA, 16 bp, P. troglodytes
ttggaagactcagaag

SEQ ID NO: 285838 - DNA, 16 bp, P. troglodytes
ttggaagccaaggcag

SEQ ID NO: 285839 - DNA, 16 bp, P. troglodytes
ttggaagcccattgag

SEQ ID NO: 285840 - DNA, 16 bp, P. troglodytes
ttggaaggctgaggtg

SEQ ID NO: 285841 - DNA, 16 bp, P. troglodytes
ttggaagggacaaaca

SEQ ID NO: 285842 - DNA, 16 bp, P. troglodytes
ttggaagtaaaacact

SEQ ID NO: 285843 - DNA, 19 bp, P. troglodytes
ttggaagtaaagctctcct

SEQ ID NO: 285844 - DNA, 16 bp, P. troglodytes
ttggaagtcctagcca

SEQ ID NO: 285845 - DNA, 23 bp, P. troglodytes
ttggaagtgctggccagggcaat

SEQ ID NO: 285846 - DNA, 16 bp, P. troglodytes
ttggaagttccagcca

SEQ ID NO: 285847 - DNA, 20 bp, P. troglodytes
ttggaagttctggccaggga

SEQ ID NO: 285848 - DNA, 23 bp, P. troglodytes
ttggaagttctggccagggcaac

SEQ ID NO: 285849 - DNA, 23 bp, P. troglodytes
ttggaagttctggccagggcaat

SEQ ID NO: 285850 - DNA, 16 bp, P. troglodytes
ttggaataataatttt

SEQ ID NO: 285851 - DNA, 29 bp, P. troglodytes
ttggaatagtttcagaaggaatggtacca

SEQ ID NO: 285852 - DNA, 16 bp, P. troglodytes
ttggaatcatacagta

SEQ ID NO: 285853 - DNA, 16 bp, P. troglodytes
ttggaatggaaacatt

SEQ ID NO: 285854 - DNA, 16 bp, P. troglodytes
ttggaatggctaaaat

SEQ ID NO: 285855 - DNA, 16 bp, P. troglodytes
ttggaattatcagact

SEQ ID NO: 285856 - DNA, 16 bp, P. troglodytes
ttggaatttgaaatta

SEQ ID NO: 285857 - DNA, 16 bp, P. troglodytes
ttggaattttcagact

SEQ ID NO: 285858 - DNA, 16 bp, P. troglodytes
ttggaattttgataaa

SEQ ID NO: 285859 - DNA, 16 bp, P. troglodytes
ttggacaaaaaggcta

SEQ ID NO: 285860 - DNA, 16 bp, P. troglodytes
ttggacaaatttataa

SEQ ID NO: 285861 - DNA, 16 bp, P. troglodytes
ttggacacagaaaggg

SEQ ID NO: 285862 - DNA, 16 bp, P. troglodytes
ttggacaggatggtct

SEQ ID NO: 285863 - DNA, 16 bp, P. troglodytes
ttggacaggctgatct

SEQ ID NO: 285864 - DNA, 18 bp, P. troglodytes
ttggacaggctggtctca

SEQ ID NO: 285865 - DNA, 16 bp, P. troglodytes
ttggaccatgaatttt

SEQ ID NO: 285866 - DNA, 16 bp, P. troglodytes
ttggacccaggaggtg

SEQ ID NO: 285867 - DNA, 16 bp, P. troglodytes
ttggacttcccaacct

SEQ ID NO: 285868 - DNA, 16 bp, P. troglodytes
ttggactttggggact

SEQ ID NO: 285869 - DNA, 16 bp, P. troglodytes
ttggacttttaaaaaa

SEQ ID NO: 285870 - DNA, 16 bp, P. troglodytes
ttggagaaaaggcata

SEQ ID NO: 285871 - DNA, 16 bp, P. troglodytes
ttggagaaatgcctat

SEQ ID NO: 285872 - DNA, 16 bp, P. troglodytes
ttggagaaatggttga

SEQ ID NO: 285873 - DNA, 16 bp, P. troglodytes
ttggagaacattatgc

SEQ ID NO: 285874 - DNA, 16 bp, P. troglodytes
ttggagaactcacact

SEQ ID NO: 285875 - DNA, 16 bp, P. troglodytes
ttggagaatgtttcat

SEQ ID NO: 285876 - DNA, 16 bp, P. troglodytes
ttggagacaagcctgg

SEQ ID NO: 285877 - DNA, 16 bp, P. troglodytes
ttggagacagggtctt

SEQ ID NO: 285878 - DNA, 16 bp, P. troglodytes
ttggagaccagcatgg

SEQ ID NO: 285879 - DNA, 16 bp, P. troglodytes
ttggagaccagcctga

SEQ ID NO: 285880 - DNA, 16 bp, P. troglodytes
ttggagaccagcctgg

SEQ ID NO: 285881 - DNA, 16 bp, P. troglodytes
ttggagacctacaaag

SEQ ID NO: 285882 - DNA, 16 bp, P. troglodytes
ttggagagcagcctga

SEQ ID NO: 285883 - DNA, 16 bp, P. troglodytes
ttggagatggggcctt

SEQ ID NO: 285884 - DNA, 16 bp, P. troglodytes
ttggagcaaatcaatt

SEQ ID NO: 285885 - DNA, 16 bp, P. troglodytes
ttggagcattttggat

SEQ ID NO: 285886 - DNA, 16 bp, P. troglodytes
ttggagctcccacaca

SEQ ID NO: 285887 - DNA, 16 bp, P. troglodytes
ttggagctggaggcca

SEQ ID NO: 285888 - DNA, 16 bp, P. troglodytes
ttggaggaaaaacaaa

SEQ ID NO: 285889 - DNA, 16 bp, P. troglodytes
ttggaggaaacaaaca

SEQ ID NO: 285890 - DNA, 16 bp, P. troglodytes
ttggaggacacccagc

SEQ ID NO: 285891 - DNA, 16 bp, P. troglodytes
ttggaggagaagaagc

SEQ ID NO: 285892 - DNA, 16 bp, P. troglodytes
ttggaggaggagagac

SEQ ID NO: 285893 - DNA, 16 bp, P. troglodytes
ttggaggaggggcctg

SEQ ID NO: 285894 - DNA, 16 bp, P. troglodytes
ttggaggatgaggcag

SEQ ID NO: 285895 - DNA, 16 bp, P. troglodytes
ttggaggcagaggctg

SEQ ID NO: 285896 - DNA, 16 bp, P. troglodytes
ttggaggccaaggagg

SEQ ID NO: 285897 - DNA, 16 bp, P. troglodytes
ttggaggccaaggcgg

SEQ ID NO: 285898 - DNA, 16 bp, P. troglodytes
ttggaggccaaggtgg

SEQ ID NO: 285899 - DNA, 16 bp, P. troglodytes
ttggaggccaggagtt

SEQ ID NO: 285900 - DNA, 16 bp, P. troglodytes
ttggaggccattatct

SEQ ID NO: 285901 - DNA, 16 bp, P. troglodytes
ttggaggcctaggagg

SEQ ID NO: 285902 - DNA, 16 bp, P. troglodytes
ttggaggctgaggaag

SEQ ID NO: 285903 - DNA, 16 bp, P. troglodytes
ttggaggctgaggcgg

SEQ ID NO: 285904 - DNA, 16 bp, P. troglodytes
ttggaggcttcagtga

SEQ ID NO: 285905 - DNA, 16 bp, P. troglodytes
ttggaggctttcttca

SEQ ID NO: 285906 - DNA, 16 bp, P. troglodytes
ttggaggggccagggg

SEQ ID NO: 285907 - DNA, 16 bp, P. troglodytes
ttggagggggagaggc

SEQ ID NO: 285908 - DNA, 16 bp, P. troglodytes
ttggaggtcagaagca

SEQ ID NO: 285909 - DNA, 16 bp, P. troglodytes
ttggaggtggggtctg

SEQ ID NO: 285910 - DNA, 16 bp, P. troglodytes
ttggaggttaggactt

SEQ ID NO: 285911 - DNA, 16 bp, P. troglodytes
ttggaggttagggctt

SEQ ID NO: 285912 - DNA, 16 bp, P. troglodytes
ttggagtacagtggtg

SEQ ID NO: 285913 - DNA, 16 bp, P. troglodytes
ttggagtgcagaggca

SEQ ID NO: 285914 - DNA, 16 bp, P. troglodytes
ttggagtgcaggggca

SEQ ID NO: 285915 - DNA, 17 bp, P. troglodytes
ttggagtgcagtggcat

SEQ ID NO: 285916 - DNA, 17 bp, P. troglodytes
ttggagtgcagtggcgc

SEQ ID NO: 285917 - DNA, 17 bp, P. troglodytes
ttggagtgcagtggtgc

SEQ ID NO: 285918 - DNA, 16 bp, P. troglodytes
ttggagtttaggcaca

SEQ ID NO: 285919 - DNA, 16 bp, P. troglodytes
ttggagtttcaccatg

SEQ ID NO: 285920 - DNA, 16 bp, P. troglodytes
ttggataaatacctag

SEQ ID NO: 285921 - DNA, 16 bp, P. troglodytes
ttggatacctggtttt

SEQ ID NO: 285922 - DNA, 16 bp, P. troglodytes
ttggatatttagctga

SEQ ID NO: 285923 - DNA, 16 bp, P. troglodytes
ttggatatttgtcctc

SEQ ID NO: 285924 - DNA, 16 bp, P. troglodytes
ttggatcaagagtcaa

SEQ ID NO: 285925 - DNA, 16 bp, P. troglodytes
ttggatccattgttgg

SEQ ID NO: 285926 - DNA, 16 bp, P. troglodytes
ttggatcctgaaacag

SEQ ID NO: 285927 - DNA, 16 bp, P. troglodytes
ttggatctttcctgct

SEQ ID NO: 285928 - DNA, 16 bp, P. troglodytes
ttggatgttctggcca

SEQ ID NO: 285929 - DNA, 16 bp, P. troglodytes
ttggattatttccact

SEQ ID NO: 285930 - DNA, 16 bp, P. troglodytes
ttggattggatcctgg

SEQ ID NO: 285931 - DNA, 16 bp, P. troglodytes
ttggattgggaagaag

SEQ ID NO: 285932 - DNA, 16 bp, P. troglodytes
ttggatttctctaatg

SEQ ID NO: 285933 - DNA, 16 bp, P. troglodytes
ttggatttctctgatg

SEQ ID NO: 285934 - DNA, 16 bp, P. troglodytes
ttggatttggggccca

SEQ ID NO: 285935 - DNA, 16 bp, P. troglodytes
ttggattttatcctgt

SEQ ID NO: 285936 - DNA, 16 bp, P. troglodytes
ttggattttcaaatta

SEQ ID NO: 285937 - DNA, 16 bp, P. troglodytes
ttggattttggccatt

SEQ ID NO: 285938 - DNA, 16 bp, P. troglodytes
ttggatttttagtaga

SEQ ID NO: 285939 - DNA, 16 bp, P. troglodytes
ttggcaaaaacaaaaa

SEQ ID NO: 285940 - DNA, 16 bp, P. troglodytes
ttggcaaaaatgtgtt

SEQ ID NO: 285941 - DNA, 16 bp, P. troglodytes
ttggcaaaagaacaga

SEQ ID NO: 285942 - DNA, 16 bp, P. troglodytes
ttggcaaaataaactt

SEQ ID NO: 285943 - DNA, 16 bp, P. troglodytes
ttggcaaactgtggcc

SEQ ID NO: 285944 - DNA, 16 bp, P. troglodytes
ttggcaaatgaaaaat

SEQ ID NO: 285945 - DNA, 16 bp, P. troglodytes
ttggcaatgttttctt

SEQ ID NO: 285946 - DNA, 16 bp, P. troglodytes
ttggcaattggttgaa

SEQ ID NO: 285947 - DNA, 16 bp, P. troglodytes
ttggcaatttttaaat

SEQ ID NO: 285948 - DNA, 16 bp, P. troglodytes
ttggcaccagggacag

SEQ ID NO: 285949 - DNA, 16 bp, P. troglodytes
ttggcacgtgcctgta

SEQ ID NO: 285950 - DNA, 16 bp, P. troglodytes
ttggcactttgggagg

SEQ ID NO: 285951 - DNA, 16 bp, P. troglodytes
ttggcacttttgttga

SEQ ID NO: 285952 - DNA, 16 bp, P. troglodytes
ttggcagaatttattt

SEQ ID NO: 285953 - DNA, 16 bp, P. troglodytes
ttggcagggcacagtg

SEQ ID NO: 285954 - DNA, 16 bp, P. troglodytes
ttggcagttcctcaaa

SEQ ID NO: 285955 - DNA, 16 bp, P. troglodytes
ttggcatctatgttca

SEQ ID NO: 285956 - DNA, 16 bp, P. troglodytes
ttggcatgagccactg

SEQ ID NO: 285957 - DNA, 16 bp, P. troglodytes
ttggcattccttgact

SEQ ID NO: 285958 - DNA, 16 bp, P. troglodytes
ttggcattgaagagtt

SEQ ID NO: 285959 - DNA, 16 bp, P. troglodytes
ttggcattttcatcat

SEQ ID NO: 285960 - DNA, 16 bp, P. troglodytes
ttggcatttttaaaat

SEQ ID NO: 285961 - DNA, 16 bp, P. troglodytes
ttggccaaaacaagtc

SEQ ID NO: 285962 - DNA, 19 bp, P. troglodytes
ttggccaacatggtgaaat

SEQ ID NO: 285963 - DNA, 18 bp, P. troglodytes
ttggccaagatggtgaaa

SEQ ID NO: 285964 - DNA, 16 bp, P. troglodytes
ttggccaagctgctct

SEQ ID NO: 285965 - DNA, 16 bp, P. troglodytes
ttggccaagctggtct

SEQ ID NO: 285966 - DNA, 16 bp, P. troglodytes
ttggccaaggagaccc

SEQ ID NO: 285967 - DNA, 16 bp, P. troglodytes
ttggccagactggtct

SEQ ID NO: 285968 - DNA, 16 bp, P. troglodytes
ttggccagcctggtct

SEQ ID NO: 285969 - DNA, 16 bp, P. troglodytes
ttggccaggacggtct

SEQ ID NO: 285970 - DNA, 16 bp, P. troglodytes
ttggccaggatagtct

SEQ ID NO: 285971 - DNA, 16 bp, P. troglodytes
ttggccaggatgatct

SEQ ID NO: 285972 - DNA, 16 bp, P. troglodytes
ttggccaggatggtct

SEQ ID NO: 285973 - DNA, 16 bp, P. troglodytes
ttggccaggatggttt

SEQ ID NO: 285974 - DNA, 16 bp, P. troglodytes
ttggccaggcaggtct

SEQ ID NO: 285975 - DNA, 16 bp, P. troglodytes
ttggccaggcgggtct

SEQ ID NO: 285976 - DNA, 16 bp, P. troglodytes
ttggccaggctagtca

SEQ ID NO: 285977 - DNA, 16 bp, P. troglodytes
ttggccaggctagtct

SEQ ID NO: 285978 - DNA, 16 bp, P. troglodytes
ttggccaggctagttt

SEQ ID NO: 285979 - DNA, 16 bp, P. troglodytes
ttggccaggctgatct

SEQ ID NO: 285980 - DNA, 16 bp, P. troglodytes
ttggccaggctgattt

SEQ ID NO: 285981 - DNA, 16 bp, P. troglodytes
ttggccaggctgctct

SEQ ID NO: 285982 - DNA, 16 bp, P. troglodytes
ttggccaggctggact

SEQ ID NO: 285983 - DNA, 16 bp, P. troglodytes
ttggccaggctggcct

SEQ ID NO: 285984 - DNA, 16 bp, P. troglodytes
ttggccaggctggtca

SEQ ID NO: 285985 - DNA, 16 bp, P. troglodytes
ttggccaggctggtcc

SEQ ID NO: 285986 - DNA, 16 bp, P. troglodytes
ttggccaggctggtcg

SEQ ID NO: 285987 - DNA, 16 bp, P. troglodytes
ttggccaggctggtct

SEQ ID NO: 285988 - DNA, 16 bp, P. troglodytes
ttggccaggctggtgt

SEQ ID NO: 285989 - DNA, 16 bp, P. troglodytes
ttggccaggctggttt

SEQ ID NO: 285990 - DNA, 16 bp, P. troglodytes
ttggccaggctgttct

SEQ ID NO: 285991 - DNA, 16 bp, P. troglodytes
ttggccaggcttgtct

SEQ ID NO: 285992 - DNA, 16 bp, P. troglodytes
ttggccaggcttttct

SEQ ID NO: 285993 - DNA, 16 bp, P. troglodytes
ttggccagggtggtct

SEQ ID NO: 285994 - DNA, 16 bp, P. troglodytes
ttggccaggtgtggtg

SEQ ID NO: 285995 - DNA, 16 bp, P. troglodytes
ttggccaggttggtct

SEQ ID NO: 285996 - DNA, 17 bp, P. troglodytes
ttggccaggttggtctc

SEQ ID NO: 285997 - DNA, 16 bp, P. troglodytes
ttggccagtctggcct

SEQ ID NO: 285998 - DNA, 16 bp, P. troglodytes
ttggccagtctggtct

SEQ ID NO: 285999 - DNA, 16 bp, P. troglodytes
ttggccatgctggtct

SEQ ID NO: 286000 - DNA, 16 bp, P. troglodytes
ttggccatttgtgtat

SEQ ID NO: 286001 - DNA, 16 bp, P. troglodytes
ttggcccaggagtttg

SEQ ID NO: 286002 - DNA, 16 bp, P. troglodytes
ttggccgggcacagtg

SEQ ID NO: 286003 - DNA, 16 bp, P. troglodytes
ttggccgggcgcagtg

SEQ ID NO: 286004 - DNA, 16 bp, P. troglodytes
ttggccgggctggtct

SEQ ID NO: 286005 - DNA, 16 bp, P. troglodytes
ttggccgggctggttt

SEQ ID NO: 286006 - DNA, 19 bp, P. troglodytes
ttggccgggtgcagtggct

SEQ ID NO: 286007 - DNA, 16 bp, P. troglodytes
ttggccgtgtccccac

SEQ ID NO: 286008 - DNA, 16 bp, P. troglodytes
ttggcctccaaaactg

SEQ ID NO: 286009 - DNA, 16 bp, P. troglodytes
ttggcctccagctcca

SEQ ID NO: 286010 - DNA, 17 bp, P. troglodytes
ttggcctcccaaagtgt

SEQ ID NO: 286011 - DNA, 16 bp, P. troglodytes
ttggcctcccaaagtt

SEQ ID NO: 286012 - DNA, 16 bp, P. troglodytes
ttggcctcccagaatg

SEQ ID NO: 286013 - DNA, 16 bp, P. troglodytes
ttggcctcccagagtg

SEQ ID NO: 286014 - DNA, 16 bp, P. troglodytes
ttggcctcctaaagtg

SEQ ID NO: 286015 - DNA, 16 bp, P. troglodytes
ttggcctcctaaagtt

SEQ ID NO: 286016 - DNA, 16 bp, P. troglodytes
ttggcctctcaaagtg

SEQ ID NO: 286017 - DNA, 16 bp, P. troglodytes
ttggcctctctagcta

SEQ ID NO: 286018 - DNA, 17 bp, P. troglodytes
ttggcctgccttgctag

SEQ ID NO: 286019 - DNA, 16 bp, P. troglodytes
ttggcctggcatggtg

SEQ ID NO: 286020 - DNA, 16 bp, P. troglodytes
ttggcctggctgatct

SEQ ID NO: 286021 - DNA, 16 bp, P. troglodytes
ttggcctggctggtct

SEQ ID NO: 286022 - DNA, 16 bp, P. troglodytes
ttggccttccaaactg

SEQ ID NO: 286023 - DNA, 16 bp, P. troglodytes
ttggccttcccaagtg

SEQ ID NO: 286024 - DNA, 16 bp, P. troglodytes
ttggccttgtcaaaga

SEQ ID NO: 286025 - DNA, 16 bp, P. troglodytes
ttggccttttaaaaaa

SEQ ID NO: 286026 - DNA, 16 bp, P. troglodytes
ttggccttttggctaa

SEQ ID NO: 286027 - DNA, 16 bp, P. troglodytes
ttggcgtgatcttggc

SEQ ID NO: 286028 - DNA, 16 bp, P. troglodytes
ttggctaaataaatga

SEQ ID NO: 286029 - DNA, 16 bp, P. troglodytes
ttggctaggcgtggtg

SEQ ID NO: 286030 - DNA, 16 bp, P. troglodytes
ttggctaggctggtct

SEQ ID NO: 286031 - DNA, 16 bp, P. troglodytes
ttggctattgtgaata

SEQ ID NO: 286032 - DNA, 16 bp, P. troglodytes
ttggctcacagttctg

SEQ ID NO: 286033 - DNA, 16 bp, P. troglodytes
ttggctcactgcacct

SEQ ID NO: 286034 - DNA, 16 bp, P. troglodytes
ttggctcactgtagct

SEQ ID NO: 286035 - DNA, 16 bp, P. troglodytes
ttggctcatttttaaa

SEQ ID NO: 286036 - DNA, 16 bp, P. troglodytes
ttggctctgcatcccc

SEQ ID NO: 286037 - DNA, 16 bp, P. troglodytes
ttggctctgtgggctc

SEQ ID NO: 286038 - DNA, 16 bp, P. troglodytes
ttggctgagaggaggg

SEQ ID NO: 286039 - DNA, 16 bp, P. troglodytes
ttggctgcagcaccca

SEQ ID NO: 286040 - DNA, 16 bp, P. troglodytes
ttggctgcgtccccac

SEQ ID NO: 286041 - DNA, 16 bp, P. troglodytes
ttggctggacatgaaa

SEQ ID NO: 286042 - DNA, 16 bp, P. troglodytes
ttggctggcatctggg

SEQ ID NO: 286043 - DNA, 16 bp, P. troglodytes
ttggctggccatggtg

SEQ ID NO: 286044 - DNA, 16 bp, P. troglodytes
ttggctgggcacagtg

SEQ ID NO: 286045 - DNA, 16 bp, P. troglodytes
ttggctgggctggtct

SEQ ID NO: 286046 - DNA, 16 bp, P. troglodytes
ttggctgggtccccac

SEQ ID NO: 286047 - DNA, 16 bp, P. troglodytes
ttggctgggtgaggtg

SEQ ID NO: 286048 - DNA, 16 bp, P. troglodytes
ttggctggttgcagtg

SEQ ID NO: 286049 - DNA, 16 bp, P. troglodytes
ttggctgtgtccccag

SEQ ID NO: 286050 - DNA, 16 bp, P. troglodytes
ttggctgtgtgcagtg

SEQ ID NO: 286051 - DNA, 16 bp, P. troglodytes
ttggctgttaagtatt

SEQ ID NO: 286052 - DNA, 16 bp, P. troglodytes
ttggcttctctgggcc

SEQ ID NO: 286053 - DNA, 16 bp, P. troglodytes
ttggcttgtaaatggc

SEQ ID NO: 286054 - DNA, 16 bp, P. troglodytes
ttggcttttattgcca

SEQ ID NO: 286055 - DNA, 16 bp, P. troglodytes
ttggcttttggaaatt

SEQ ID NO: 286056 - DNA, 16 bp, P. troglodytes
ttggctttttaaaaat

SEQ ID NO: 286057 - DNA, 16 bp, P. troglodytes
ttgggaaaactggcca

SEQ ID NO: 286058 - DNA, 16 bp, P. troglodytes
ttgggaaaagctgagt

SEQ ID NO: 286059 - DNA, 16 bp, P. troglodytes
ttgggaaaataaaaat

SEQ ID NO: 286060 - DNA, 16 bp, P. troglodytes
ttgggaaaattttctc

SEQ ID NO: 286061 - DNA, 16 bp, P. troglodytes
ttgggaaactgaggca

SEQ ID NO: 286062 - DNA, 16 bp, P. troglodytes
ttgggaaagaataaaa

SEQ ID NO: 286063 - DNA, 16 bp, P. troglodytes
ttgggaaataaaataa

SEQ ID NO: 286064 - DNA, 16 bp, P. troglodytes
ttgggaaataatttat

SEQ ID NO: 286065 - DNA, 16 bp, P. troglodytes
ttgggaagccaaagca

SEQ ID NO: 286066 - DNA, 16 bp, P. troglodytes
ttgggaagccatgatt

SEQ ID NO: 286067 - DNA, 16 bp, P. troglodytes
ttgggaagctgaggta

SEQ ID NO: 286068 - DNA, 16 bp, P. troglodytes
ttgggacccctttccg

SEQ ID NO: 286069 - DNA, 16 bp, P. troglodytes
ttgggactacaggtgt

SEQ ID NO: 286070 - DNA, 16 bp, P. troglodytes
ttgggagaaaaggaaa

SEQ ID NO: 286071 - DNA, 16 bp, P. troglodytes
ttgggagaaacaaagt

SEQ ID NO: 286072 - DNA, 16 bp, P. troglodytes
ttgggagactgagaca

SEQ ID NO: 286073 - DNA, 16 bp, P. troglodytes
ttgggaggatgaagtg

SEQ ID NO: 286074 - DNA, 16 bp, P. troglodytes
ttgggaggcacaggtg

SEQ ID NO: 286075 - DNA, 16 bp, P. troglodytes
ttgggaggccaagaaa

SEQ ID NO: 286076 - DNA, 16 bp, P. troglodytes
ttgggaggccgaaggg

SEQ ID NO: 286077 - DNA, 16 bp, P. troglodytes
ttgggaggccgaggcc

SEQ ID NO: 286078 - DNA, 16 bp, P. troglodytes
ttgggaggcgggtgga

SEQ ID NO: 286079 - DNA, 16 bp, P. troglodytes
ttgggaggctcagatg

SEQ ID NO: 286080 - DNA, 16 bp, P. troglodytes
ttgggaggctgaactg

SEQ ID NO: 286081 - DNA, 20 bp, P. troglodytes
ttgggaggctgagacgggcg

SEQ ID NO: 286082 - DNA, 16 bp, P. troglodytes
ttgggaggctggagtg

SEQ ID NO: 286083 - DNA, 16 bp, P. troglodytes
ttgggaggctgtggag

SEQ ID NO: 286084 - DNA, 16 bp, P. troglodytes
ttgggagggccgaggc

SEQ ID NO: 286085 - DNA, 16 bp, P. troglodytes
ttgggagggtgagaca

SEQ ID NO: 286086 - DNA, 16 bp, P. troglodytes
ttgggaggtcaaggcc

SEQ ID NO: 286087 - DNA, 20 bp, P. troglodytes
ttgggaggtcgaggcaggcg

SEQ ID NO: 286088 - DNA, 16 bp, P. troglodytes
ttgggaggtggggcct

SEQ ID NO: 286089 - DNA, 16 bp, P. troglodytes
ttgggaggttgaagtg

SEQ ID NO: 286090 - DNA, 16 bp, P. troglodytes
ttgggagtgcattgag

SEQ ID NO: 286091 - DNA, 16 bp, P. troglodytes
ttgggagtttgagacc

SEQ ID NO: 286092 - DNA, 16 bp, P. troglodytes
ttgggatacatcagtg

SEQ ID NO: 286093 - DNA, 16 bp, P. troglodytes
ttgggattacaagtgt

SEQ ID NO: 286094 - DNA, 16 bp, P. troglodytes
ttgggattacaggagt

SEQ ID NO: 286095 - DNA, 16 bp, P. troglodytes
ttgggattacaggcgc

SEQ ID NO: 286096 - DNA, 16 bp, P. troglodytes
ttgggcaaaatcatct

SEQ ID NO: 286097 - DNA, 16 bp, P. troglodytes
ttgggcaacatggtga

SEQ ID NO: 286098 - DNA, 19 bp, P. troglodytes
ttgggcaagtcacttaact

SEQ ID NO: 286099 - DNA, 16 bp, P. troglodytes
ttgggcaagtttctta

SEQ ID NO: 286100 - DNA, 16 bp, P. troglodytes
ttgggcagcctggtct

SEQ ID NO: 286101 - DNA, 16 bp, P. troglodytes
ttgggcagctctgctc

SEQ ID NO: 286102 - DNA, 16 bp, P. troglodytes
ttgggcagctgcagct

SEQ ID NO: 286103 - DNA, 16 bp, P. troglodytes
ttgggcaggctagtct

SEQ ID NO: 286104 - DNA, 16 bp, P. troglodytes
ttgggcaggctgctct

SEQ ID NO: 286105 - DNA, 16 bp, P. troglodytes
ttgggcaggctggtct

SEQ ID NO: 286106 - DNA, 17 bp, P. troglodytes
ttgggcaggctggtctc

SEQ ID NO: 286107 - DNA, 20 bp, P. troglodytes
ttgggcagtatggccatttt

SEQ ID NO: 286108 - DNA, 16 bp, P. troglodytes
ttgggcatatatccag

SEQ ID NO: 286109 - DNA, 16 bp, P. troglodytes
ttgggcatggtggcag

SEQ ID NO: 286110 - DNA, 16 bp, P. troglodytes
ttgggccacacgtaaa

SEQ ID NO: 286111 - DNA, 16 bp, P. troglodytes
ttgggccactgcactt

SEQ ID NO: 286112 - DNA, 16 bp, P. troglodytes
ttgggccaggtgtggt

SEQ ID NO: 286113 - DNA, 16 bp, P. troglodytes
ttgggcccaggagttc

SEQ ID NO: 286114 - DNA, 16 bp, P. troglodytes
ttgggcctcagtttcc

SEQ ID NO: 286115 - DNA, 16 bp, P. troglodytes
ttgggctcaagcaatc

SEQ ID NO: 286116 - DNA, 16 bp, P. troglodytes
ttgggctcccaaagca

SEQ ID NO: 286117 - DNA, 16 bp, P. troglodytes
ttgggctctgtgtccc

SEQ ID NO: 286118 - DNA, 16 bp, P. troglodytes
ttgggctgaggtggga

SEQ ID NO: 286119 - DNA, 16 bp, P. troglodytes
ttgggctgcattcaaa

SEQ ID NO: 286120 - DNA, 16 bp, P. troglodytes
ttgggctgggctgggc

SEQ ID NO: 286121 - DNA, 16 bp, P. troglodytes
ttggggaaaaaaataa

SEQ ID NO: 286122 - DNA, 16 bp, P. troglodytes
ttggggaaactgaggc

SEQ ID NO: 286123 - DNA, 16 bp, P. troglodytes
ttggggaacaagtggt

SEQ ID NO: 286124 - DNA, 16 bp, P. troglodytes
ttggggaagccaaggc

SEQ ID NO: 286125 - DNA, 16 bp, P. troglodytes
ttggggacacagatcc

SEQ ID NO: 286126 - DNA, 16 bp, P. troglodytes
ttggggacagagtgag

SEQ ID NO: 286127 - DNA, 16 bp, P. troglodytes
ttggggaccactgccc

SEQ ID NO: 286128 - DNA, 16 bp, P. troglodytes
ttggggagcaggtggt

SEQ ID NO: 286129 - DNA, 16 bp, P. troglodytes
ttggggaggctgaggc

SEQ ID NO: 286130 - DNA, 16 bp, P. troglodytes
ttggggaggctgattt

SEQ ID NO: 286131 - DNA, 16 bp, P. troglodytes
ttggggattaaaattt

SEQ ID NO: 286132 - DNA, 16 bp, P. troglodytes
ttggggattataattt

SEQ ID NO: 286133 - DNA, 16 bp, P. troglodytes
ttggggcactgcctag

SEQ ID NO: 286134 - DNA, 18 bp, P. troglodytes
ttggggccaggcacggtg

SEQ ID NO: 286135 - DNA, 16 bp, P. troglodytes
ttggggcccaccctaa

SEQ ID NO: 286136 - DNA, 16 bp, P. troglodytes
ttgggggaacccaccc

SEQ ID NO: 286137 - DNA, 16 bp, P. troglodytes
ttgggggactattggg

SEQ ID NO: 286138 - DNA, 16 bp, P. troglodytes
ttgggggagaaaaaaa

SEQ ID NO: 286139 - DNA, 16 bp, P. troglodytes
ttgggggatgatggaa

SEQ ID NO: 286140 - DNA, 16 bp, P. troglodytes
ttgggggcagggagga

SEQ ID NO: 286141 - DNA, 16 bp, P. troglodytes
ttgggggcagtggctc

SEQ ID NO: 286142 - DNA, 16 bp, P. troglodytes
ttggggggcagaggtg

SEQ ID NO: 286143 - DNA, 16 bp, P. troglodytes
ttggggtccccaattc

SEQ ID NO: 286144 - DNA, 22 bp, P. troglodytes
ttggggtgatcagacccaacac

SEQ ID NO: 286145 - DNA, 16 bp, P. troglodytes
ttggggtgtcaatttt

SEQ ID NO: 286146 - DNA, 16 bp, P. troglodytes
ttgggtaagtcattta

SEQ ID NO: 286147 - DNA, 16 bp, P. troglodytes
ttgggtaagttctcct

SEQ ID NO: 286148 - DNA, 16 bp, P. troglodytes
ttgggtaataaaatgt

SEQ ID NO: 286149 - DNA, 16 bp, P. troglodytes
ttgggtatagaattct

SEQ ID NO: 286150 - DNA, 16 bp, P. troglodytes
ttgggtatatacccaa

SEQ ID NO: 286151 - DNA, 16 bp, P. troglodytes
ttgggtcttgactctt

SEQ ID NO: 286152 - DNA, 20 bp, P. troglodytes
ttgggtgacagagtgagacc

SEQ ID NO: 286153 - DNA, 16 bp, P. troglodytes
ttgggtgagacccagt

SEQ ID NO: 286154 - DNA, 16 bp, P. troglodytes
ttgggtggagatacag

SEQ ID NO: 286155 - DNA, 16 bp, P. troglodytes
ttgggtggatcacctg

SEQ ID NO: 286156 - DNA, 16 bp, P. troglodytes
ttgggtgggagcacag

SEQ ID NO: 286157 - DNA, 16 bp, P. troglodytes
ttgggtggggtcacag

SEQ ID NO: 286158 - DNA, 16 bp, P. troglodytes
ttgggtgtgtatatat

SEQ ID NO: 286159 - DNA, 16 bp, P. troglodytes
ttgggttagaatatgc

SEQ ID NO: 286160 - DNA, 16 bp, P. troglodytes
ttgggttgtttccaag

SEQ ID NO: 286161 - DNA, 16 bp, P. troglodytes
ttgggtttatcctgtt

SEQ ID NO: 286162 - DNA, 16 bp, P. troglodytes
ttgggtttgaattctg

SEQ ID NO: 286163 - DNA, 16 bp, P. troglodytes
ttgggttttacattga

SEQ ID NO: 286164 - DNA, 16 bp, P. troglodytes
ttggtaaatttttaaa

SEQ ID NO: 286165 - DNA, 16 bp, P. troglodytes
ttggtaagactagtct

SEQ ID NO: 286166 - DNA, 16 bp, P. troglodytes
ttggtagtttgatagg

SEQ ID NO: 286167 - DNA, 16 bp, P. troglodytes
ttggtatattcacaga

SEQ ID NO: 286168 - DNA, 16 bp, P. troglodytes
ttggtattaattcttt

SEQ ID NO: 286169 - DNA, 16 bp, P. troglodytes
ttggtatttttaaaaa

SEQ ID NO: 286170 - DNA, 16 bp, P. troglodytes
ttggtatttttagaag

SEQ ID NO: 286171 - DNA, 16 bp, P. troglodytes
ttggtatttttagtaa

SEQ ID NO: 286172 - DNA, 17 bp, P. troglodytes
ttggtatttttagtaga

SEQ ID NO: 286173 - DNA, 16 bp, P. troglodytes
ttggtcaagctggtct

SEQ ID NO: 286174 - DNA, 16 bp, P. troglodytes
ttggtcagactggtct

SEQ ID NO: 286175 - DNA, 16 bp, P. troglodytes
ttggtcagcctggtct

SEQ ID NO: 286176 - DNA, 16 bp, P. troglodytes
ttggtcaggctagtct

SEQ ID NO: 286177 - DNA, 16 bp, P. troglodytes
ttggtcaggctgacct

SEQ ID NO: 286178 - DNA, 16 bp, P. troglodytes
ttggtcaggctgatct

SEQ ID NO: 286179 - DNA, 16 bp, P. troglodytes
ttggtcaggctgctct

SEQ ID NO: 286180 - DNA, 16 bp, P. troglodytes
ttggtcaggctggtcc

SEQ ID NO: 286181 - DNA, 16 bp, P. troglodytes
ttggtcaggctggtct

SEQ ID NO: 286182 - DNA, 16 bp, P. troglodytes
ttggtcaggctggtgt

SEQ ID NO: 286183 - DNA, 16 bp, P. troglodytes
ttggtcagggtggtct

SEQ ID NO: 286184 - DNA, 16 bp, P. troglodytes
ttggtcatgctggtct

SEQ ID NO: 286185 - DNA, 16 bp, P. troglodytes
ttggtctaaaattttc

SEQ ID NO: 286186 - DNA, 16 bp, P. troglodytes
ttggtctcaaactcct

SEQ ID NO: 286187 - DNA, 18 bp, P. troglodytes
ttggtctcaaactcctgg

SEQ ID NO: 286188 - DNA, 16 bp, P. troglodytes
ttggtctgggcaagga

SEQ ID NO: 286189 - DNA, 16 bp, P. troglodytes
ttggtcttgaactcct

SEQ ID NO: 286190 - DNA, 16 bp, P. troglodytes
ttggtctttatttaga

SEQ ID NO: 286191 - DNA, 16 bp, P. troglodytes
ttggtctttctggtga

SEQ ID NO: 286192 - DNA, 16 bp, P. troglodytes
ttggtctttctgtgcc

SEQ ID NO: 286193 - DNA, 17 bp, P. troglodytes
ttggtgaaaccccatct

SEQ ID NO: 286194 - DNA, 16 bp, P. troglodytes
ttggtgaagtgtctgt

SEQ ID NO: 286195 - DNA, 21 bp, P. troglodytes
ttggtgaatctgacaattatg

SEQ ID NO: 286196 - DNA, 16 bp, P. troglodytes
ttggtgactatggcct

SEQ ID NO: 286197 - DNA, 16 bp, P. troglodytes
ttggtgagaatgtaag

SEQ ID NO: 286198 - DNA, 16 bp, P. troglodytes
ttggtgaggatttgga

SEQ ID NO: 286199 - DNA, 16 bp, P. troglodytes
ttggtgagggcagatc

SEQ ID NO: 286200 - DNA, 16 bp, P. troglodytes
ttggtgatctcatcca

SEQ ID NO: 286201 - DNA, 16 bp, P. troglodytes
ttggtgatgaccttga

SEQ ID NO: 286202 - DNA, 16 bp, P. troglodytes
ttggtgcaaaagcaat

SEQ ID NO: 286203 - DNA, 16 bp, P. troglodytes
ttggtgcaaaagtaat

SEQ ID NO: 286204 - DNA, 16 bp, P. troglodytes
ttggtgcaattacttt

SEQ ID NO: 286205 - DNA, 16 bp, P. troglodytes
ttggtgcagtttcttc

SEQ ID NO: 286206 - DNA, 16 bp, P. troglodytes
ttggtgccactgcctt

SEQ ID NO: 286207 - DNA, 16 bp, P. troglodytes
ttggtgctcaataaat

SEQ ID NO: 286208 - DNA, 18 bp, P. troglodytes
ttggtggaaaaattgatg

SEQ ID NO: 286209 - DNA, 16 bp, P. troglodytes
ttggtggaatctttag

SEQ ID NO: 286210 - DNA, 16 bp, P. troglodytes
ttggtggagaaggtgg

SEQ ID NO: 286211 - DNA, 16 bp, P. troglodytes
ttggtggcactgtaaa

SEQ ID NO: 286212 - DNA, 17 bp, P. troglodytes
ttggtggcgcatgccta

SEQ ID NO: 286213 - DNA, 16 bp, P. troglodytes
ttggtggctcacgcct

SEQ ID NO: 286214 - DNA, 17 bp, P. troglodytes
ttggtggctcatgcctg

SEQ ID NO: 286215 - DNA, 16 bp, P. troglodytes
ttggtggctgagcttg

SEQ ID NO: 286216 - DNA, 16 bp, P. troglodytes
ttggtgggaatgtaaa

SEQ ID NO: 286217 - DNA, 16 bp, P. troglodytes
ttggtgggatggtaaa

SEQ ID NO: 286218 - DNA, 16 bp, P. troglodytes
ttggtggggacacaga

SEQ ID NO: 286219 - DNA, 18 bp, P. troglodytes
ttggtggtagtggtcccc

SEQ ID NO: 286220 - DNA, 16 bp, P. troglodytes
ttggtggtgcatgcct

SEQ ID NO: 286221 - DNA, 16 bp, P. troglodytes
ttggtggtgtcatatt

SEQ ID NO: 286222 - DNA, 16 bp, P. troglodytes
ttggtgtacaggaatg

SEQ ID NO: 286223 - DNA, 16 bp, P. troglodytes
ttggtgtataagaaat

SEQ ID NO: 286224 - DNA, 16 bp, P. troglodytes
ttggtgtatagaaatg

SEQ ID NO: 286225 - DNA, 16 bp, P. troglodytes
ttggtgtcatattcaa

SEQ ID NO: 286226 - DNA, 16 bp, P. troglodytes
ttggtgtctggtgagg

SEQ ID NO: 286227 - DNA, 16 bp, P. troglodytes
ttggtgttttggacat

SEQ ID NO: 286228 - DNA, 16 bp, P. troglodytes
ttggttaaaatgaaaa

SEQ ID NO: 286229 - DNA, 16 bp, P. troglodytes
ttggttaaatgaatga

SEQ ID NO: 286230 - DNA, 16 bp, P. troglodytes
ttggttaaatgtattt

SEQ ID NO: 286231 - DNA, 16 bp, P. troglodytes
ttggttaggctggtct

SEQ ID NO: 286232 - DNA, 16 bp, P. troglodytes
ttggttatattaccaa

SEQ ID NO: 286233 - DNA, 16 bp, P. troglodytes
ttggttatcagatcaa

SEQ ID NO: 286234 - DNA, 16 bp, P. troglodytes
ttggttattatgaata

SEQ ID NO: 286235 - DNA, 16 bp, P. troglodytes
ttggttatttctagtt

SEQ ID NO: 286236 - DNA, 16 bp, P. troglodytes
ttggttccacaatttt

SEQ ID NO: 286237 - DNA, 16 bp, P. troglodytes
ttggttcctggtgagg

SEQ ID NO: 286238 - DNA, 16 bp, P. troglodytes
ttggttctttctgagg

SEQ ID NO: 286239 - DNA, 16 bp, P. troglodytes
ttggttgaataaatga

SEQ ID NO: 286240 - DNA, 16 bp, P. troglodytes
ttggttgaatccatgg

SEQ ID NO: 286241 - DNA, 16 bp, P. troglodytes
ttggttgccagtgaag

SEQ ID NO: 286242 - DNA, 19 bp, P. troglodytes
ttggttgccattgcttttg

SEQ ID NO: 286243 - DNA, 16 bp, P. troglodytes
ttggttgcctgtgcct

SEQ ID NO: 286244 - DNA, 16 bp, P. troglodytes
ttggttggaccaggtg

SEQ ID NO: 286245 - DNA, 16 bp, P. troglodytes
ttggttggccaggatg

SEQ ID NO: 286246 - DNA, 16 bp, P. troglodytes
ttggttgtcacaactg

SEQ ID NO: 286247 - DNA, 16 bp, P. troglodytes
ttggtttatttcactt

SEQ ID NO: 286248 - DNA, 16 bp, P. troglodytes
ttggtttcaaagaaaa

SEQ ID NO: 286249 - DNA, 16 bp, P. troglodytes
ttggtttcctttgtaa

SEQ ID NO: 286250 - DNA, 16 bp, P. troglodytes
ttggtttctggggagg

SEQ ID NO: 286251 - DNA, 16 bp, P. troglodytes
ttggtttgcattttcc

SEQ ID NO: 286252 - DNA, 16 bp, P. troglodytes
ttggttttatttctgg

SEQ ID NO: 286253 - DNA, 16 bp, P. troglodytes
ttggttttccattcca

SEQ ID NO: 286254 - DNA, 16 bp, P. troglodytes
ttggttttccattctt

SEQ ID NO: 286255 - DNA, 16 bp, P. troglodytes
ttggttttctactcct

SEQ ID NO: 286256 - DNA, 16 bp, P. troglodytes
ttggttttgaaatata

SEQ ID NO: 286257 - DNA, 16 bp, P. troglodytes
ttggtttttatttgca

SEQ ID NO: 286258 - DNA, 16 bp, P. troglodytes
ttggttttttgaaagg

SEQ ID NO: 286259 - DNA, 16 bp, P. troglodytes
ttgtaaaaagcatgca

SEQ ID NO: 286260 - DNA, 16 bp, P. troglodytes
ttgtaaaaatgaagaa

SEQ ID NO: 286261 - DNA, 16 bp, P. troglodytes
ttgtaaaaattgacaa

SEQ ID NO: 286262 - DNA, 16 bp, P. troglodytes
ttgtaaaataaaacat

SEQ ID NO: 286263 - DNA, 16 bp, P. troglodytes
ttgtaaaatgaatgaa

SEQ ID NO: 286264 - DNA, 16 bp, P. troglodytes
ttgtaaaatgaatttg

SEQ ID NO: 286265 - DNA, 16 bp, P. troglodytes
ttgtaaaatttgcaaa

SEQ ID NO: 286266 - DNA, 16 bp, P. troglodytes
ttgtaaacattttatt

SEQ ID NO: 286267 - DNA, 16 bp, P. troglodytes
ttgtaaagctaatgaa

SEQ ID NO: 286268 - DNA, 16 bp, P. troglodytes
ttgtaaataaactttt

SEQ ID NO: 286269 - DNA, 16 bp, P. troglodytes
ttgtaaataaagattt

SEQ ID NO: 286270 - DNA, 16 bp, P. troglodytes
ttgtaaataacatttt

SEQ ID NO: 286271 - DNA, 16 bp, P. troglodytes
ttgtaaatacagatga

SEQ ID NO: 286272 - DNA, 16 bp, P. troglodytes
ttgtaaatatattttc

SEQ ID NO: 286273 - DNA, 16 bp, P. troglodytes
ttgtaaatatttcttt

SEQ ID NO: 286274 - DNA, 16 bp, P. troglodytes
ttgtaaatgcaccaat

SEQ ID NO: 286275 - DNA, 16 bp, P. troglodytes
ttgtaaatttctttga

SEQ ID NO: 286276 - DNA, 16 bp, P. troglodytes
ttgtaaatttgttgga

SEQ ID NO: 286277 - DNA, 16 bp, P. troglodytes
ttgtaacaaagtacca

SEQ ID NO: 286278 - DNA, 16 bp, P. troglodytes
ttgtaacaaatgtacc

SEQ ID NO: 286279 - DNA, 16 bp, P. troglodytes
ttgtaacatattttga

SEQ ID NO: 286280 - DNA, 16 bp, P. troglodytes
ttgtaaccatatgatt

SEQ ID NO: 286281 - DNA, 16 bp, P. troglodytes
ttgtaacttttaaaat

SEQ ID NO: 286282 - DNA, 16 bp, P. troglodytes
ttgtaagaagaggaaa

SEQ ID NO: 286283 - DNA, 16 bp, P. troglodytes
ttgtaagagttattta

SEQ ID NO: 286284 - DNA, 16 bp, P. troglodytes
ttgtaaggcaggtctg

SEQ ID NO: 286285 - DNA, 16 bp, P. troglodytes
ttgtaagtgtaaaata

SEQ ID NO: 286286 - DNA, 16 bp, P. troglodytes
ttgtaagttacctgag

SEQ ID NO: 286287 - DNA, 16 bp, P. troglodytes
ttgtaatattctctga

SEQ ID NO: 286288 - DNA, 17 bp, P. troglodytes
ttgtaatcccagcactt

SEQ ID NO: 286289 - DNA, 17 bp, P. troglodytes
ttgtaatcccagctact

SEQ ID NO: 286290 - DNA, 17 bp, P. troglodytes
ttgtaatcctagcactt

SEQ ID NO: 286291 - DNA, 16 bp, P. troglodytes
ttgtaatctcaacact

SEQ ID NO: 286292 - DNA, 16 bp, P. troglodytes
ttgtaatgtattttga

SEQ ID NO: 286293 - DNA, 16 bp, P. troglodytes
ttgtaattttaaagaa

SEQ ID NO: 286294 - DNA, 16 bp, P. troglodytes
ttgtacaaatttatgg

SEQ ID NO: 286295 - DNA, 16 bp, P. troglodytes
ttgtacaacaagaagg

SEQ ID NO: 286296 - DNA, 16 bp, P. troglodytes
ttgtacaacactgtga

SEQ ID NO: 286297 - DNA, 16 bp, P. troglodytes
ttgtacataaatcttt

SEQ ID NO: 286298 - DNA, 16 bp, P. troglodytes
ttgtacatattatttt

SEQ ID NO: 286299 - DNA, 16 bp, P. troglodytes
ttgtacatatttgtgg

SEQ ID NO: 286300 - DNA, 16 bp, P. troglodytes
ttgtacatattttaaa

SEQ ID NO: 286301 - DNA, 16 bp, P. troglodytes
ttgtacatatttttgg

SEQ ID NO: 286302 - DNA, 16 bp, P. troglodytes
ttgtacatttttaaat

SEQ ID NO: 286303 - DNA, 16 bp, P. troglodytes
ttgtacatttttatgg

SEQ ID NO: 286304 - DNA, 16 bp, P. troglodytes
ttgtacattttttaaa

SEQ ID NO: 286305 - DNA, 16 bp, P. troglodytes
ttgtaccactgcacta

SEQ ID NO: 286306 - DNA, 16 bp, P. troglodytes
ttgtaccactgcattc

SEQ ID NO: 286307 - DNA, 19 bp, P. troglodytes
ttgtacctctggtagaatt

SEQ ID NO: 286308 - DNA, 16 bp, P. troglodytes
ttgtactaatttacac

SEQ ID NO: 286309 - DNA, 17 bp, P. troglodytes
ttgtactccagcctgga

SEQ ID NO: 286310 - DNA, 16 bp, P. troglodytes
ttgtactgcagcctgg

SEQ ID NO: 286311 - DNA, 16 bp, P. troglodytes
ttgtactggtacaaaa

SEQ ID NO: 286312 - DNA, 18 bp, P. troglodytes
ttgtacttttagtagaga

SEQ ID NO: 286313 - DNA, 16 bp, P. troglodytes
ttgtacttttcagctc

SEQ ID NO: 286314 - DNA, 16 bp, P. troglodytes
ttgtacttttttgtag

SEQ ID NO: 286315 - DNA, 16 bp, P. troglodytes
ttgtagaaattaacaa

SEQ ID NO: 286316 - DNA, 16 bp, P. troglodytes
ttgtagaatattttaa

SEQ ID NO: 286317 - DNA, 16 bp, P. troglodytes
ttgtagaatgaatgaa

SEQ ID NO: 286318 - DNA, 16 bp, P. troglodytes
ttgtagaatttgcaag

SEQ ID NO: 286319 - DNA, 16 bp, P. troglodytes
ttgtagagacaggtct

SEQ ID NO: 286320 - DNA, 16 bp, P. troglodytes
ttgtagagacagtttc

SEQ ID NO: 286321 - DNA, 16 bp, P. troglodytes
ttgtagagatgggggg

SEQ ID NO: 286322 - DNA, 16 bp, P. troglodytes
ttgtagagcacaggca

SEQ ID NO: 286323 - DNA, 16 bp, P. troglodytes
ttgtagatatatatat

SEQ ID NO: 286324 - DNA, 16 bp, P. troglodytes
ttgtagatgaagaaac

SEQ ID NO: 286325 - DNA, 16 bp, P. troglodytes
ttgtagctaatttgtt

SEQ ID NO: 286326 - DNA, 16 bp, P. troglodytes
ttgtagctcccataat

SEQ ID NO: 286327 - DNA, 16 bp, P. troglodytes
ttgtagctgtaattga

SEQ ID NO: 286328 - DNA, 16 bp, P. troglodytes
ttgtaggtctctaaga

SEQ ID NO: 286329 - DNA, 17 bp, P. troglodytes
ttgtagtcccagctact

SEQ ID NO: 286330 - DNA, 17 bp, P. troglodytes
ttgtagtgagcggagat

SEQ ID NO: 286331 - DNA, 16 bp, P. troglodytes
ttgtagtgcaaaagca

SEQ ID NO: 286332 - DNA, 16 bp, P. troglodytes
ttgtagtgggttgaat

SEQ ID NO: 286333 - DNA, 16 bp, P. troglodytes
ttgtagttcccataat

SEQ ID NO: 286334 - DNA, 16 bp, P. troglodytes
ttgtagttttacattt

SEQ ID NO: 286335 - DNA, 16 bp, P. troglodytes
ttgtagttttagtagg

SEQ ID NO: 286336 - DNA, 16 bp, P. troglodytes
ttgtagttttcattat

SEQ ID NO: 286337 - DNA, 16 bp, P. troglodytes
ttgtagttttctgcat

SEQ ID NO: 286338 - DNA, 16 bp, P. troglodytes
ttgtataaatgtgtta

SEQ ID NO: 286339 - DNA, 16 bp, P. troglodytes
ttgtatacaaatgttt

SEQ ID NO: 286340 - DNA, 16 bp, P. troglodytes
ttgtatactttaaata

SEQ ID NO: 286341 - DNA, 16 bp, P. troglodytes
ttgtatagatatacca

SEQ ID NO: 286342 - DNA, 16 bp, P. troglodytes
ttgtatagttttcaaa

SEQ ID NO: 286343 - DNA, 16 bp, P. troglodytes
ttgtatagttttgaga

SEQ ID NO: 286344 - DNA, 16 bp, P. troglodytes
ttgtatatgtatgtat

SEQ ID NO: 286345 - DNA, 16 bp, P. troglodytes
ttgtatattctcactt

SEQ ID NO: 286346 - DNA, 16 bp, P. troglodytes
ttgtatattctgtata

SEQ ID NO: 286347 - DNA, 16 bp, P. troglodytes
ttgtatatttagagaa

SEQ ID NO: 286348 - DNA, 16 bp, P. troglodytes
ttgtatatttccattt

SEQ ID NO: 286349 - DNA, 16 bp, P. troglodytes
ttgtatatttgaaata

SEQ ID NO: 286350 - DNA, 16 bp, P. troglodytes
ttgtatcaaaaagaca

SEQ ID NO: 286351 - DNA, 16 bp, P. troglodytes
ttgtatcatgggggtt

SEQ ID NO: 286352 - DNA, 16 bp, P. troglodytes
ttgtatcctgcaactt

SEQ ID NO: 286353 - DNA, 16 bp, P. troglodytes
ttgtatctggaatata

SEQ ID NO: 286354 - DNA, 16 bp, P. troglodytes
ttgtatctggcttatt

SEQ ID NO: 286355 - DNA, 16 bp, P. troglodytes
ttgtatcttcagatga

SEQ ID NO: 286356 - DNA, 16 bp, P. troglodytes
ttgtatctttccagga

SEQ ID NO: 286357 - DNA, 16 bp, P. troglodytes
ttgtatgcattaaata

SEQ ID NO: 286358 - DNA, 16 bp, P. troglodytes
ttgtatggatatacca

SEQ ID NO: 286359 - DNA, 16 bp, P. troglodytes
ttgtatggtttttcac

SEQ ID NO: 286360 - DNA, 16 bp, P. troglodytes
ttgtatgtatgtgtat

SEQ ID NO: 286361 - DNA, 16 bp, P. troglodytes
ttgtatgtcttctatt

SEQ ID NO: 286362 - DNA, 18 bp, P. troglodytes
ttgtatgtttagtagaga

SEQ ID NO: 286363 - DNA, 16 bp, P. troglodytes
ttgtatgttttaaaaa

SEQ ID NO: 286364 - DNA, 16 bp, P. troglodytes
ttgtatgttttgtaaa

SEQ ID NO: 286365 - DNA, 16 bp, P. troglodytes
ttgtattaaaaataca

SEQ ID NO: 286366 - DNA, 16 bp, P. troglodytes
ttgtattaatccattt

SEQ ID NO: 286367 - DNA, 16 bp, P. troglodytes
ttgtattcagaatata

SEQ ID NO: 286368 - DNA, 16 bp, P. troglodytes
ttgtattcagtattat

SEQ ID NO: 286369 - DNA, 16 bp, P. troglodytes
ttgtattcattaacca

SEQ ID NO: 286370 - DNA, 16 bp, P. troglodytes
ttgtattcctttgggt

SEQ ID NO: 286371 - DNA, 18 bp, P. troglodytes
ttgtattcttagtagaga

SEQ ID NO: 286372 - DNA, 16 bp, P. troglodytes
ttgtattcttgaaaat

SEQ ID NO: 286373 - DNA, 16 bp, P. troglodytes
ttgtatttagtagaga

SEQ ID NO: 286374 - DNA, 16 bp, P. troglodytes
ttgtatttctccttca

SEQ ID NO: 286375 - DNA, 16 bp, P. troglodytes
ttgtatttctgtggaa

SEQ ID NO: 286376 - DNA, 16 bp, P. troglodytes
ttgtatttggaaaaac

SEQ ID NO: 286377 - DNA, 18 bp, P. troglodytes
ttgtatttgtagtagaga

SEQ ID NO: 286378 - DNA, 17 bp, P. troglodytes
ttgtattttagtagaga

SEQ ID NO: 286379 - DNA, 16 bp, P. troglodytes
ttgtattttcagaaga

SEQ ID NO: 286380 - DNA, 16 bp, P. troglodytes
ttgtattttcagtgga

SEQ ID NO: 286381 - DNA, 16 bp, P. troglodytes
ttgtattttcttctaa

SEQ ID NO: 286382 - DNA, 16 bp, P. troglodytes
ttgtattttgaaattc

SEQ ID NO: 286383 - DNA, 16 bp, P. troglodytes
ttgtattttgagtaga

SEQ ID NO: 286384 - DNA, 16 bp, P. troglodytes
ttgtattttgttgaag

SEQ ID NO: 286385 - DNA, 16 bp, P. troglodytes
ttgtatttttaaaaag

SEQ ID NO: 286386 - DNA, 16 bp, P. troglodytes
ttgtatttttaaaaga

SEQ ID NO: 286387 - DNA, 16 bp, P. troglodytes
ttgtatttttactgga

SEQ ID NO: 286388 - DNA, 16 bp, P. troglodytes
ttgtatttttaggaga

SEQ ID NO: 286389 - DNA, 17 bp, P. troglodytes
ttgtatttttagtagaa

SEQ ID NO: 286390 - DNA, 18 bp, P. troglodytes
ttgtatttttagtagaga

SEQ ID NO: 286391 - DNA, 16 bp, P. troglodytes
ttgtatttttagtcaa

SEQ ID NO: 286392 - DNA, 16 bp, P. troglodytes
ttgtatttttcgtaga

SEQ ID NO: 286393 - DNA, 16 bp, P. troglodytes
ttgtatttttctagta

SEQ ID NO: 286394 - DNA, 16 bp, P. troglodytes
ttgtatttttggtaga

SEQ ID NO: 286395 - DNA, 16 bp, P. troglodytes
ttgtatttttgtagaa

SEQ ID NO: 286396 - DNA, 16 bp, P. troglodytes
ttgtattttttacaga

SEQ ID NO: 286397 - DNA, 16 bp, P. troglodytes
ttgtcaaaaatcaaat

SEQ ID NO: 286398 - DNA, 16 bp, P. troglodytes
ttgtcaaaattttaaa

SEQ ID NO: 286399 - DNA, 16 bp, P. troglodytes
ttgtcaaagatcattt

SEQ ID NO: 286400 - DNA, 16 bp, P. troglodytes
ttgtcaaataaatgaa

SEQ ID NO: 286401 - DNA, 16 bp, P. troglodytes
ttgtcaacacttatta

SEQ ID NO: 286402 - DNA, 16 bp, P. troglodytes
ttgtcaattaaaaaaa

SEQ ID NO: 286403 - DNA, 16 bp, P. troglodytes
ttgtcaattaaatatt

SEQ ID NO: 286404 - DNA, 16 bp, P. troglodytes
ttgtcaatttctcctt

SEQ ID NO: 286405 - DNA, 16 bp, P. troglodytes
ttgtcaccacaaagaa

SEQ ID NO: 286406 - DNA, 16 bp, P. troglodytes
ttgtcacccaggctgt

SEQ ID NO: 286407 - DNA, 16 bp, P. troglodytes
ttgtcacctctcaata

SEQ ID NO: 286408 - DNA, 17 bp, P. troglodytes
ttgtcactggttctgtt

SEQ ID NO: 286409 - DNA, 16 bp, P. troglodytes
ttgtcagaaactagaa

SEQ ID NO: 286410 - DNA, 16 bp, P. troglodytes
ttgtcagaaatcaatt

SEQ ID NO: 286411 - DNA, 16 bp, P. troglodytes
ttgtcagtatttttta

SEQ ID NO: 286412 - DNA, 16 bp, P. troglodytes
ttgtcagttttgttca

SEQ ID NO: 286413 - DNA, 16 bp, P. troglodytes
ttgtcatactgtattg

SEQ ID NO: 286414 - DNA, 16 bp, P. troglodytes
ttgtcatcttcatcat

SEQ ID NO: 286415 - DNA, 16 bp, P. troglodytes
ttgtcatgctttaagg

SEQ ID NO: 286416 - DNA, 16 bp, P. troglodytes
ttgtcatgtctcctta

SEQ ID NO: 286417 - DNA, 16 bp, P. troglodytes
ttgtcattcttcagtt

SEQ ID NO: 286418 - DNA, 16 bp, P. troglodytes
ttgtcattgctgttgt

SEQ ID NO: 286419 - DNA, 16 bp, P. troglodytes
ttgtcatttaaaaata

SEQ ID NO: 286420 - DNA, 16 bp, P. troglodytes
ttgtcatttatttgtg

SEQ ID NO: 286421 - DNA, 16 bp, P. troglodytes
ttgtcatttctttgtg

SEQ ID NO: 286422 - DNA, 16 bp, P. troglodytes
ttgtcatttgtatatc

SEQ ID NO: 286423 - DNA, 16 bp, P. troglodytes
ttgtcatttgtttcaa

SEQ ID NO: 286424 - DNA, 16 bp, P. troglodytes
ttgtcattttccattt

SEQ ID NO: 286425 - DNA, 16 bp, P. troglodytes
ttgtccaagctggtct

SEQ ID NO: 286426 - DNA, 16 bp, P. troglodytes
ttgtccaaggccacat

SEQ ID NO: 286427 - DNA, 16 bp, P. troglodytes
ttgtccagactggtct

SEQ ID NO: 286428 - DNA, 16 bp, P. troglodytes
ttgtccaggctagagt

SEQ ID NO: 286429 - DNA, 16 bp, P. troglodytes
ttgtccaggctagtct

SEQ ID NO: 286430 - DNA, 16 bp, P. troglodytes
ttgtccaggctggtct

SEQ ID NO: 286431 - DNA, 16 bp, P. troglodytes
ttgtccaggttggttt

SEQ ID NO: 286432 - DNA, 16 bp, P. troglodytes
ttgtccatatcaccat

SEQ ID NO: 286433 - DNA, 16 bp, P. troglodytes
ttgtccatggttcctg

SEQ ID NO: 286434 - DNA, 16 bp, P. troglodytes
ttgtcccaataatgtc

SEQ ID NO: 286435 - DNA, 16 bp, P. troglodytes
ttgtcccagatttggc

SEQ ID NO: 286436 - DNA, 16 bp, P. troglodytes
ttgtccctgccctaga

SEQ ID NO: 286437 - DNA, 16 bp, P. troglodytes
ttgtcctgaaataaat

SEQ ID NO: 286438 - DNA, 16 bp, P. troglodytes
ttgtccttcctcagcc

SEQ ID NO: 286439 - DNA, 16 bp, P. troglodytes
ttgtccttttttactg

SEQ ID NO: 286440 - DNA, 16 bp, P. troglodytes
ttgtcgttttgatttg

SEQ ID NO: 286441 - DNA, 16 bp, P. troglodytes
ttgtctactttttcca

SEQ ID NO: 286442 - DNA, 16 bp, P. troglodytes
ttgtctaggttttctt

SEQ ID NO: 286443 - DNA, 16 bp, P. troglodytes
ttgtctatttctcctt

SEQ ID NO: 286444 - DNA, 16 bp, P. troglodytes
ttgtctcaaaaataaa

SEQ ID NO: 286445 - DNA, 16 bp, P. troglodytes
ttgtctcactctgtca

SEQ ID NO: 286446 - DNA, 16 bp, P. troglodytes
ttgtctcagccccaaa

SEQ ID NO: 286447 - DNA, 16 bp, P. troglodytes
ttgtctcccaggctga

SEQ ID NO: 286448 - DNA, 16 bp, P. troglodytes
ttgtctctaccaaaat

SEQ ID NO: 286449 - DNA, 16 bp, P. troglodytes
ttgtctctgcagatga

SEQ ID NO: 286450 - DNA, 16 bp, P. troglodytes
ttgtctctggtttcag

SEQ ID NO: 286451 - DNA, 16 bp, P. troglodytes
ttgtctcttttgatat

SEQ ID NO: 286452 - DNA, 16 bp, P. troglodytes
ttgtctgaaaaatatt

SEQ ID NO: 286453 - DNA, 16 bp, P. troglodytes
ttgtctgacaggcatt

SEQ ID NO: 286454 - DNA, 16 bp, P. troglodytes
ttgtctgagatggagt

SEQ ID NO: 286455 - DNA, 16 bp, P. troglodytes
ttgtctgagttcattg

SEQ ID NO: 286456 - DNA, 16 bp, P. troglodytes
ttgtctgatgtttctt

SEQ ID NO: 286457 - DNA, 16 bp, P. troglodytes
ttgtctggaaaagact

SEQ ID NO: 286458 - DNA, 16 bp, P. troglodytes
ttgtctgtaaaatggg

SEQ ID NO: 286459 - DNA, 16 bp, P. troglodytes
ttgtctgtgaatgaca

SEQ ID NO: 286460 - DNA, 16 bp, P. troglodytes
ttgtcttaaaaagaaa

SEQ ID NO: 286461 - DNA, 16 bp, P. troglodytes
ttgtcttaagccacta

SEQ ID NO: 286462 - DNA, 16 bp, P. troglodytes
ttgtcttatttcactt

SEQ ID NO: 286463 - DNA, 16 bp, P. troglodytes
ttgtcttgaactcctg

SEQ ID NO: 286464 - DNA, 16 bp, P. troglodytes
ttgtcttgctctgtca

SEQ ID NO: 286465 - DNA, 16 bp, P. troglodytes
ttgtctttataaaaat

SEQ ID NO: 286466 - DNA, 16 bp, P. troglodytes
ttgtctttctgcacct

SEQ ID NO: 286467 - DNA, 16 bp, P. troglodytes
ttgtctttctgcatct

SEQ ID NO: 286468 - DNA, 16 bp, P. troglodytes
ttgtctttctgtgcct

SEQ ID NO: 286469 - DNA, 16 bp, P. troglodytes
ttgtctttctgtggct

SEQ ID NO: 286470 - DNA, 16 bp, P. troglodytes
ttgtctttctttacct

SEQ ID NO: 286471 - DNA, 16 bp, P. troglodytes
ttgtctttgagctctg

SEQ ID NO: 286472 - DNA, 16 bp, P. troglodytes
ttgtctttggctacca

SEQ ID NO: 286473 - DNA, 16 bp, P. troglodytes
ttgtctttgtctttga

SEQ ID NO: 286474 - DNA, 16 bp, P. troglodytes
ttgtcttttctagctt

SEQ ID NO: 286475 - DNA, 16 bp, P. troglodytes
ttgtcttttttaactg

SEQ ID NO: 286476 - DNA, 16 bp, P. troglodytes
ttgtctttttttgaga

SEQ ID NO: 286477 - DNA, 16 bp, P. troglodytes
ttgtgaaaaacaaaaa

SEQ ID NO: 286478 - DNA, 16 bp, P. troglodytes
ttgtgaaaaatcagtt

SEQ ID NO: 286479 - DNA, 16 bp, P. troglodytes
ttgtgaaaaatgtttt

SEQ ID NO: 286480 - DNA, 16 bp, P. troglodytes
ttgtgaaaaccaaaaa

SEQ ID NO: 286481 - DNA, 16 bp, P. troglodytes
ttgtgaaaataaccat

SEQ ID NO: 286482 - DNA, 16 bp, P. troglodytes
ttgtgaaaatcaaatg

SEQ ID NO: 286483 - DNA, 16 bp, P. troglodytes
ttgtgaaaatggccat

SEQ ID NO: 286484 - DNA, 16 bp, P. troglodytes
ttgtgaaaattcatca

SEQ ID NO: 286485 - DNA, 16 bp, P. troglodytes
ttgtgaaataaatgaa

SEQ ID NO: 286486 - DNA, 16 bp, P. troglodytes
ttgtgaaatgtctgtt

SEQ ID NO: 286487 - DNA, 16 bp, P. troglodytes
ttgtgaacactgctgc

SEQ ID NO: 286488 - DNA, 16 bp, P. troglodytes
ttgtgaagaaggtgac

SEQ ID NO: 286489 - DNA, 16 bp, P. troglodytes
ttgtgaagataaaatg

SEQ ID NO: 286490 - DNA, 16 bp, P. troglodytes
ttgtgaagatgaaata

SEQ ID NO: 286491 - DNA, 16 bp, P. troglodytes
ttgtgaatagagctgc

SEQ ID NO: 286492 - DNA, 16 bp, P. troglodytes
ttgtgaatgggagatc

SEQ ID NO: 286493 - DNA, 16 bp, P. troglodytes
ttgtgaattgtgcatg

SEQ ID NO: 286494 - DNA, 16 bp, P. troglodytes
ttgtgaattgtgctgc

SEQ ID NO: 286495 - DNA, 16 bp, P. troglodytes
ttgtgacaaccaaaaa

SEQ ID NO: 286496 - DNA, 16 bp, P. troglodytes
ttgtgacaatatggat

SEQ ID NO: 286497 - DNA, 16 bp, P. troglodytes
ttgtgacaatgaaaaa

SEQ ID NO: 286498 - DNA, 16 bp, P. troglodytes
ttgtgacatatttctg

SEQ ID NO: 286499 - DNA, 16 bp, P. troglodytes
ttgtgacattctctgt

SEQ ID NO: 286500 - DNA, 16 bp, P. troglodytes
ttgtgaccttgagcaa

SEQ ID NO: 286501 - DNA, 16 bp, P. troglodytes
ttgtgactaagaatgc

SEQ ID NO: 286502 - DNA, 16 bp, P. troglodytes
ttgtgacttacacaga

SEQ ID NO: 286503 - DNA, 16 bp, P. troglodytes
ttgtgagaaaatattt

SEQ ID NO: 286504 - DNA, 16 bp, P. troglodytes
ttgtgagagttaaatg

SEQ ID NO: 286505 - DNA, 16 bp, P. troglodytes
ttgtgagatggagtct

SEQ ID NO: 286506 - DNA, 16 bp, P. troglodytes
ttgtgagattcatcca

SEQ ID NO: 286507 - DNA, 16 bp, P. troglodytes
ttgtgaggatgaaatg

SEQ ID NO: 286508 - DNA, 16 bp, P. troglodytes
ttgtgaggattaatga

SEQ ID NO: 286509 - DNA, 16 bp, P. troglodytes
ttgtgaggatttaatg

SEQ ID NO: 286510 - DNA, 16 bp, P. troglodytes
ttgtgaggccaaggtg

SEQ ID NO: 286511 - DNA, 16 bp, P. troglodytes
ttgtgaggccacccca

SEQ ID NO: 286512 - DNA, 16 bp, P. troglodytes
ttgtgagtttgtcata

SEQ ID NO: 286513 - DNA, 16 bp, P. troglodytes
ttgtgatatattcata

SEQ ID NO: 286514 - DNA, 16 bp, P. troglodytes
ttgtgatatggtttgg

SEQ ID NO: 286515 - DNA, 16 bp, P. troglodytes
ttgtgatggtgctttt

SEQ ID NO: 286516 - DNA, 16 bp, P. troglodytes
ttgtgatttataataa

SEQ ID NO: 286517 - DNA, 16 bp, P. troglodytes
ttgtgatttttgcata

SEQ ID NO: 286518 - DNA, 16 bp, P. troglodytes
ttgtgatttttttcaa

SEQ ID NO: 286519 - DNA, 16 bp, P. troglodytes
ttgtgcaaccactacc

SEQ ID NO: 286520 - DNA, 16 bp, P. troglodytes
ttgtgcaccattctga

SEQ ID NO: 286521 - DNA, 16 bp, P. troglodytes
ttgtgcacccatcacc

SEQ ID NO: 286522 - DNA, 16 bp, P. troglodytes
ttgtgcagcaggcagg

SEQ ID NO: 286523 - DNA, 16 bp, P. troglodytes
ttgtgcaggctggtct

SEQ ID NO: 286524 - DNA, 16 bp, P. troglodytes
ttgtgcaggctgtaca

SEQ ID NO: 286525 - DNA, 16 bp, P. troglodytes
ttgtgcatcaaagaac

SEQ ID NO: 286526 - DNA, 16 bp, P. troglodytes
ttgtgccactgcacct

SEQ ID NO: 286527 - DNA, 16 bp, P. troglodytes
ttgtgccactgtactg

SEQ ID NO: 286528 - DNA, 16 bp, P. troglodytes
ttgtgccagtattcaa

SEQ ID NO: 286529 - DNA, 16 bp, P. troglodytes
ttgtgccctgccccca

SEQ ID NO: 286530 - DNA, 16 bp, P. troglodytes
ttgtgcctcagccttt

SEQ ID NO: 286531 - DNA, 16 bp, P. troglodytes
ttgtgccttggttttc

SEQ ID NO: 286532 - DNA, 16 bp, P. troglodytes
ttgtgctattattgtt

SEQ ID NO: 286533 - DNA, 16 bp, P. troglodytes
ttgtgctggtttttaa

SEQ ID NO: 286534 - DNA, 16 bp, P. troglodytes
ttgtgcttccctggtg

SEQ ID NO: 286535 - DNA, 16 bp, P. troglodytes
ttgtgcttttgatttg

SEQ ID NO: 286536 - DNA, 16 bp, P. troglodytes
ttgtgcttttggtatt

SEQ ID NO: 286537 - DNA, 16 bp, P. troglodytes
ttgtggaaaatttcaa

SEQ ID NO: 286538 - DNA, 16 bp, P. troglodytes
ttgtggaactttaaac

SEQ ID NO: 286539 - DNA, 16 bp, P. troglodytes
ttgtggaagaaaattt

SEQ ID NO: 286540 - DNA, 16 bp, P. troglodytes
ttgtggaagacagttt

SEQ ID NO: 286541 - DNA, 16 bp, P. troglodytes
ttgtggaagggaaaag

SEQ ID NO: 286542 - DNA, 16 bp, P. troglodytes
ttgtggaagggacctg

SEQ ID NO: 286543 - DNA, 16 bp, P. troglodytes
ttgtggaatagtgtca

SEQ ID NO: 286544 - DNA, 16 bp, P. troglodytes
ttgtggagaaaaataa

SEQ ID NO: 286545 - DNA, 16 bp, P. troglodytes
ttgtggcaatcatttc

SEQ ID NO: 286546 - DNA, 16 bp, P. troglodytes
ttgtggcagaaggtga

SEQ ID NO: 286547 - DNA, 16 bp, P. troglodytes
ttgtggcatgtgcctg

SEQ ID NO: 286548 - DNA, 16 bp, P. troglodytes
ttgtggcctctggctg

SEQ ID NO: 286549 - DNA, 16 bp, P. troglodytes
ttgtggctcatgcctg

SEQ ID NO: 286550 - DNA, 16 bp, P. troglodytes
ttgtggctttgatttg

SEQ ID NO: 286551 - DNA, 16 bp, P. troglodytes
ttgtgggccagctgga

SEQ ID NO: 286552 - DNA, 16 bp, P. troglodytes
ttgtgggtaaccagac

SEQ ID NO: 286553 - DNA, 16 bp, P. troglodytes
ttgtggtctgaaaaga

SEQ ID NO: 286554 - DNA, 16 bp, P. troglodytes
ttgtggtcttgctgac

SEQ ID NO: 286555 - DNA, 16 bp, P. troglodytes
ttgtggtgaatgcttc

SEQ ID NO: 286556 - DNA, 18 bp, P. troglodytes
ttgtggtgagccaagatt

SEQ ID NO: 286557 - DNA, 16 bp, P. troglodytes
ttgtggttcccataat

SEQ ID NO: 286558 - DNA, 16 bp, P. troglodytes
ttgtggttgcattgtg

SEQ ID NO: 286559 - DNA, 16 bp, P. troglodytes
ttgtggtttgagtgcc

SEQ ID NO: 286560 - DNA, 16 bp, P. troglodytes
ttgtgtacaagttttt

SEQ ID NO: 286561 - DNA, 16 bp, P. troglodytes
ttgtgtactttaaaat

SEQ ID NO: 286562 - DNA, 16 bp, P. troglodytes
ttgtgtatatatgtgt

SEQ ID NO: 286563 - DNA, 16 bp, P. troglodytes
ttgtgtatgtatatat

SEQ ID NO: 286564 - DNA, 16 bp, P. troglodytes
ttgtgtattctccttc

SEQ ID NO: 286565 - DNA, 16 bp, P. troglodytes
ttgtgtatttagaaaa

SEQ ID NO: 286566 - DNA, 16 bp, P. troglodytes
ttgtgtattttcagta

SEQ ID NO: 286567 - DNA, 16 bp, P. troglodytes
ttgtgtcatctatgat

SEQ ID NO: 286568 - DNA, 16 bp, P. troglodytes
ttgtgtcatctgattt

SEQ ID NO: 286569 - DNA, 16 bp, P. troglodytes
ttgtgtcctttgacca

SEQ ID NO: 286570 - DNA, 16 bp, P. troglodytes
ttgtgtccttttcaat

SEQ ID NO: 286571 - DNA, 16 bp, P. troglodytes
ttgtgtctctttgatt

SEQ ID NO: 286572 - DNA, 16 bp, P. troglodytes
ttgtgtctgttggctg

SEQ ID NO: 286573 - DNA, 16 bp, P. troglodytes
ttgtgtctttaatttc

SEQ ID NO: 286574 - DNA, 16 bp, P. troglodytes
ttgtgtgaacataaat

SEQ ID NO: 286575 - DNA, 16 bp, P. troglodytes
ttgtgtgaatgtatgt

SEQ ID NO: 286576 - DNA, 16 bp, P. troglodytes
ttgtgtgatctcagct

SEQ ID NO: 286577 - DNA, 16 bp, P. troglodytes
ttgtgtgtacatatgt

SEQ ID NO: 286578 - DNA, 16 bp, P. troglodytes
ttgtgtgtgcatgcat

SEQ ID NO: 286579 - DNA, 16 bp, P. troglodytes
ttgtgtgtgtgcctgc

SEQ ID NO: 286580 - DNA, 16 bp, P. troglodytes
ttgtgtgtgtgcgtgc

SEQ ID NO: 286581 - DNA, 16 bp, P. troglodytes
ttgtgttgcccaggct

SEQ ID NO: 286582 - DNA, 16 bp, P. troglodytes
ttgtgttgctataaag

SEQ ID NO: 286583 - DNA, 16 bp, P. troglodytes
ttgtgttggaaacatt

SEQ ID NO: 286584 - DNA, 16 bp, P. troglodytes
ttgtgtttctagtaga

SEQ ID NO: 286585 - DNA, 16 bp, P. troglodytes
ttgtgtttctgccagg

SEQ ID NO: 286586 - DNA, 16 bp, P. troglodytes
ttgtgtttgattttca

SEQ ID NO: 286587 - DNA, 16 bp, P. troglodytes
ttgtgttttaaaaata

SEQ ID NO: 286588 - DNA, 16 bp, P. troglodytes
ttgtgttttaaaatgt

SEQ ID NO: 286589 - DNA, 16 bp, P. troglodytes
ttgtgttttatcttaa

SEQ ID NO: 286590 - DNA, 16 bp, P. troglodytes
ttgtgttttcattctc

SEQ ID NO: 286591 - DNA, 16 bp, P. troglodytes
ttgtgtttttaatgga

SEQ ID NO: 286592 - DNA, 16 bp, P. troglodytes
ttgttaaaaacatgtt

SEQ ID NO: 286593 - DNA, 16 bp, P. troglodytes
ttgttaaaaatgcaca

SEQ ID NO: 286594 - DNA, 16 bp, P. troglodytes
ttgttaaaaatgcaga

SEQ ID NO: 286595 - DNA, 16 bp, P. troglodytes
ttgttaaaaatgtcca

SEQ ID NO: 286596 - DNA, 16 bp, P. troglodytes
ttgttaaaacattaaa

SEQ ID NO: 286597 - DNA, 16 bp, P. troglodytes
ttgttaaaacttgttt

SEQ ID NO: 286598 - DNA, 16 bp, P. troglodytes
ttgttaaaatgcaaat

SEQ ID NO: 286599 - DNA, 16 bp, P. troglodytes
ttgttaaaatgcagat

SEQ ID NO: 286600 - DNA, 16 bp, P. troglodytes
ttgttaaacaaatgaa

SEQ ID NO: 286601 - DNA, 16 bp, P. troglodytes
ttgttaaaccacagat

SEQ ID NO: 286602 - DNA, 16 bp, P. troglodytes
ttgttaaaggcctttt

SEQ ID NO: 286603 - DNA, 16 bp, P. troglodytes
ttgttaaatttcattt

SEQ ID NO: 286604 - DNA, 16 bp, P. troglodytes
ttgttaactatagtca

SEQ ID NO: 286605 - DNA, 16 bp, P. troglodytes
ttgttaatattttgcc

SEQ ID NO: 286606 - DNA, 16 bp, P. troglodytes
ttgttaattttctgac

SEQ ID NO: 286607 - DNA, 16 bp, P. troglodytes
ttgttacactgtattg

SEQ ID NO: 286608 - DNA, 16 bp, P. troglodytes
ttgttacagaaaaaaa

SEQ ID NO: 286609 - DNA, 16 bp, P. troglodytes
ttgttacatagttaaa

SEQ ID NO: 286610 - DNA, 16 bp, P. troglodytes
ttgttacatatgttta

SEQ ID NO: 286611 - DNA, 16 bp, P. troglodytes
ttgttacatggacata

SEQ ID NO: 286612 - DNA, 16 bp, P. troglodytes
ttgttacatgggtaaa

SEQ ID NO: 286613 - DNA, 16 bp, P. troglodytes
ttgttactgattcaat

SEQ ID NO: 286614 - DNA, 16 bp, P. troglodytes
ttgttactttctatga

SEQ ID NO: 286615 - DNA, 16 bp, P. troglodytes
ttgttagaaaagaaaa

SEQ ID NO: 286616 - DNA, 16 bp, P. troglodytes
ttgttagaaatacaga

SEQ ID NO: 286617 - DNA, 16 bp, P. troglodytes
ttgttagaaatgtaaa

SEQ ID NO: 286618 - DNA, 16 bp, P. troglodytes
ttgttagcacacagaa

SEQ ID NO: 286619 - DNA, 17 bp, P. troglodytes
ttgttagggagagacat

SEQ ID NO: 286620 - DNA, 16 bp, P. troglodytes
ttgttagtagagatgg

SEQ ID NO: 286621 - DNA, 16 bp, P. troglodytes
ttgttataattgatga

SEQ ID NO: 286622 - DNA, 17 bp, P. troglodytes
ttgttataatttctgtt

SEQ ID NO: 286623 - DNA, 16 bp, P. troglodytes
ttgttatataggtaaa

SEQ ID NO: 286624 - DNA, 16 bp, P. troglodytes
ttgttatgcagcaata

SEQ ID NO: 286625 - DNA, 16 bp, P. troglodytes
ttgttattaagaaaaa

SEQ ID NO: 286626 - DNA, 16 bp, P. troglodytes
ttgttattgagttgta

SEQ ID NO: 286627 - DNA, 16 bp, P. troglodytes
ttgttattttaagcca

SEQ ID NO: 286628 - DNA, 16 bp, P. troglodytes
ttgttattttagtaga

SEQ ID NO: 286629 - DNA, 16 bp, P. troglodytes
ttgttatttttagaga

SEQ ID NO: 286630 - DNA, 16 bp, P. troglodytes
ttgttatttttgcaca

SEQ ID NO: 286631 - DNA, 16 bp, P. troglodytes
ttgttcaaaatgccaa

SEQ ID NO: 286632 - DNA, 16 bp, P. troglodytes
ttgttcaacctcagct

SEQ ID NO: 286633 - DNA, 17 bp, P. troglodytes
ttgttcaagaccagcct

SEQ ID NO: 286634 - DNA, 19 bp, P. troglodytes
ttgttcaattcccacctaa

SEQ ID NO: 286635 - DNA, 16 bp, P. troglodytes
ttgttcactgttgtat

SEQ ID NO: 286636 - DNA, 16 bp, P. troglodytes
ttgttcaggctggagt

SEQ ID NO: 286637 - DNA, 16 bp, P. troglodytes
ttgttcaggctggtct

SEQ ID NO: 286638 - DNA, 16 bp, P. troglodytes
ttgttcaggctgttct

SEQ ID NO: 286639 - DNA, 16 bp, P. troglodytes
ttgttcagtttctatg

SEQ ID NO: 286640 - DNA, 16 bp, P. troglodytes
ttgttcagttttcatg

SEQ ID NO: 286641 - DNA, 16 bp, P. troglodytes
ttgttcagtttttaaa

SEQ ID NO: 286642 - DNA, 16 bp, P. troglodytes
ttgttcatcattgtat

SEQ ID NO: 286643 - DNA, 16 bp, P. troglodytes
ttgttcatctgaaatt

SEQ ID NO: 286644 - DNA, 16 bp, P. troglodytes
ttgttccatttgcttt

SEQ ID NO: 286645 - DNA, 16 bp, P. troglodytes
ttgttcccagtcttag

SEQ ID NO: 286646 - DNA, 16 bp, P. troglodytes
ttgttcccttccctgt

SEQ ID NO: 286647 - DNA, 16 bp, P. troglodytes
ttgttcccttctttat

SEQ ID NO: 286648 - DNA, 16 bp, P. troglodytes
ttgttcccttgctgga

SEQ ID NO: 286649 - DNA, 16 bp, P. troglodytes
ttgttcctttccacat

SEQ ID NO: 286650 - DNA, 16 bp, P. troglodytes
ttgttctattataaag

SEQ ID NO: 286651 - DNA, 16 bp, P. troglodytes
ttgttctctctgcctg

SEQ ID NO: 286652 - DNA, 16 bp, P. troglodytes
ttgttctctggcccct

SEQ ID NO: 286653 - DNA, 16 bp, P. troglodytes
ttgttctgaatattca

SEQ ID NO: 286654 - DNA, 16 bp, P. troglodytes
ttgttctgtttatgtg

SEQ ID NO: 286655 - DNA, 16 bp, P. troglodytes
ttgttctgtttcccag

SEQ ID NO: 286656 - DNA, 16 bp, P. troglodytes
ttgttcttctctttca

SEQ ID NO: 286657 - DNA, 16 bp, P. troglodytes
ttgttctttctgatgt

SEQ ID NO: 286658 - DNA, 16 bp, P. troglodytes
ttgttcttttccatgt

SEQ ID NO: 286659 - DNA, 16 bp, P. troglodytes
ttgttcttttcttaaa

SEQ ID NO: 286660 - DNA, 16 bp, P. troglodytes
ttgttcttttttaaga

SEQ ID NO: 286661 - DNA, 16 bp, P. troglodytes
ttgttgaaaatgagtt

SEQ ID NO: 286662 - DNA, 16 bp, P. troglodytes
ttgttgaaactttcca

SEQ ID NO: 286663 - DNA, 16 bp, P. troglodytes
ttgttgaataaataaa

SEQ ID NO: 286664 - DNA, 16 bp, P. troglodytes
ttgttgaataagtaaa

SEQ ID NO: 286665 - DNA, 16 bp, P. troglodytes
ttgttgaatgaatgat

SEQ ID NO: 286666 - DNA, 16 bp, P. troglodytes
ttgttgaatggctttg

SEQ ID NO: 286667 - DNA, 16 bp, P. troglodytes
ttgttgagttttgaaa

SEQ ID NO: 286668 - DNA, 16 bp, P. troglodytes
ttgttgatgatatgat

SEQ ID NO: 286669 - DNA, 16 bp, P. troglodytes
ttgttgcagagctgag

SEQ ID NO: 286670 - DNA, 16 bp, P. troglodytes
ttgttgcccaaactgg

SEQ ID NO: 286671 - DNA, 16 bp, P. troglodytes
ttgttgcccaggctgg

SEQ ID NO: 286672 - DNA, 16 bp, P. troglodytes
ttgttggaaactggag

SEQ ID NO: 286673 - DNA, 16 bp, P. troglodytes
ttgttggcagcataaa

SEQ ID NO: 286674 - DNA, 16 bp, P. troglodytes
ttgttgggaactgaag

SEQ ID NO: 286675 - DNA, 16 bp, P. troglodytes
ttgttggtggcattaa

SEQ ID NO: 286676 - DNA, 22 bp, P. troglodytes
ttgttggtttaaagtctgtttt

SEQ ID NO: 286677 - DNA, 16 bp, P. troglodytes
ttgttgtacctgaaag

SEQ ID NO: 286678 - DNA, 16 bp, P. troglodytes
ttgttgtagagatggg

SEQ ID NO: 286679 - DNA, 16 bp, P. troglodytes
ttgttgtatactgtta

SEQ ID NO: 286680 - DNA, 16 bp, P. troglodytes
ttgttgtgaggattaa

SEQ ID NO: 286681 - DNA, 16 bp, P. troglodytes
ttgttgtgtctcagag

SEQ ID NO: 286682 - DNA, 16 bp, P. troglodytes
ttgttgtgtctgtgcc

SEQ ID NO: 286683 - DNA, 16 bp, P. troglodytes
ttgttgttgatgatga

SEQ ID NO: 286684 - DNA, 16 bp, P. troglodytes
ttgttgttgttgaaag

SEQ ID NO: 286685 - DNA, 16 bp, P. troglodytes
ttgttgttgttgcaga

SEQ ID NO: 286686 - DNA, 18 bp, P. troglodytes
ttgttgtttcctgacttt

SEQ ID NO: 286687 - DNA, 16 bp, P. troglodytes
ttgttgtttttaaaga

SEQ ID NO: 286688 - DNA, 16 bp, P. troglodytes
ttgttgtttttaacaa

SEQ ID NO: 286689 - DNA, 16 bp, P. troglodytes
ttgttgttttttaaca

SEQ ID NO: 286690 - DNA, 16 bp, P. troglodytes
ttgtttaaaaaaagag

SEQ ID NO: 286691 - DNA, 16 bp, P. troglodytes
ttgtttaaaaacaaaa

SEQ ID NO: 286692 - DNA, 16 bp, P. troglodytes
ttgtttaaaaagagcc

SEQ ID NO: 286693 - DNA, 16 bp, P. troglodytes
ttgtttaaaagaaaat

SEQ ID NO: 286694 - DNA, 16 bp, P. troglodytes
ttgtttaaataaactt

SEQ ID NO: 286695 - DNA, 16 bp, P. troglodytes
ttgtttaacctctctg

SEQ ID NO: 286696 - DNA, 16 bp, P. troglodytes
ttgtttaagccatcca

SEQ ID NO: 286697 - DNA, 16 bp, P. troglodytes
ttgtttaagctaccta

SEQ ID NO: 286698 - DNA, 16 bp, P. troglodytes
ttgtttacaccagcat

SEQ ID NO: 286699 - DNA, 16 bp, P. troglodytes
ttgtttacattttaaa

SEQ ID NO: 286700 - DNA, 16 bp, P. troglodytes
ttgtttacccattcat

SEQ ID NO: 286701 - DNA, 16 bp, P. troglodytes
ttgtttactcatttat

SEQ ID NO: 286702 - DNA, 16 bp, P. troglodytes
ttgtttataatagcaa

SEQ ID NO: 286703 - DNA, 16 bp, P. troglodytes
ttgtttatatgctgga

SEQ ID NO: 286704 - DNA, 16 bp, P. troglodytes
ttgtttatattttcaa

SEQ ID NO: 286705 - DNA, 16 bp, P. troglodytes
ttgtttatcagttcaa

SEQ ID NO: 286706 - DNA, 16 bp, P. troglodytes
ttgtttatcccttcat

SEQ ID NO: 286707 - DNA, 16 bp, P. troglodytes
ttgtttatctgaaatt

SEQ ID NO: 286708 - DNA, 16 bp, P. troglodytes
ttgtttatcttttgaa

SEQ ID NO: 286709 - DNA, 16 bp, P. troglodytes
ttgtttatggtgtgag

SEQ ID NO: 286710 - DNA, 16 bp, P. troglodytes
ttgtttattcattcag

SEQ ID NO: 286711 - DNA, 16 bp, P. troglodytes
ttgtttatttctgaaa

SEQ ID NO: 286712 - DNA, 16 bp, P. troglodytes
ttgtttcaaaaacaaa

SEQ ID NO: 286713 - DNA, 16 bp, P. troglodytes
ttgtttcaaaaatttt

SEQ ID NO: 286714 - DNA, 16 bp, P. troglodytes
ttgtttcaaaatgttt

SEQ ID NO: 286715 - DNA, 16 bp, P. troglodytes
ttgtttccaatttttc

SEQ ID NO: 286716 - DNA, 16 bp, P. troglodytes
ttgtttccatcttttg

SEQ ID NO: 286717 - DNA, 16 bp, P. troglodytes
ttgtttcctcatctgt

SEQ ID NO: 286718 - DNA, 16 bp, P. troglodytes
ttgtttctagtttggg

SEQ ID NO: 286719 - DNA, 16 bp, P. troglodytes
ttgtttctgatgaaaa

SEQ ID NO: 286720 - DNA, 16 bp, P. troglodytes
ttgtttctgcaattta

SEQ ID NO: 286721 - DNA, 16 bp, P. troglodytes
ttgtttctgccccacc

SEQ ID NO: 286722 - DNA, 16 bp, P. troglodytes
ttgtttgaaaagaaaa

SEQ ID NO: 286723 - DNA, 16 bp, P. troglodytes
ttgtttgaacctgaga

SEQ ID NO: 286724 - DNA, 16 bp, P. troglodytes
ttgtttgagacagtct

SEQ ID NO: 286725 - DNA, 16 bp, P. troglodytes
ttgtttgagcctagga

SEQ ID NO: 286726 - DNA, 16 bp, P. troglodytes
ttgtttgtaaaatgag

SEQ ID NO: 286727 - DNA, 16 bp, P. troglodytes
ttgtttgtagattctg

SEQ ID NO: 286728 - DNA, 16 bp, P. troglodytes
ttgtttgtttgggaaa

SEQ ID NO: 286729 - DNA, 16 bp, P. troglodytes
ttgtttgttttaacca

SEQ ID NO: 286730 - DNA, 16 bp, P. troglodytes
ttgtttgttttacata

SEQ ID NO: 286731 - DNA, 16 bp, P. troglodytes
ttgtttgttttcccaa

SEQ ID NO: 286732 - DNA, 16 bp, P. troglodytes
ttgtttgtttttcaaa

SEQ ID NO: 286733 - DNA, 16 bp, P. troglodytes
ttgttttaaaaaaatg

SEQ ID NO: 286734 - DNA, 16 bp, P. troglodytes
ttgttttaaaaaatgt

SEQ ID NO: 286735 - DNA, 16 bp, P. troglodytes
ttgttttaaaacaaaa

SEQ ID NO: 286736 - DNA, 16 bp, P. troglodytes
ttgttttaaaacaata

SEQ ID NO: 286737 - DNA, 16 bp, P. troglodytes
ttgttttaaaactaaa

SEQ ID NO: 286738 - DNA, 16 bp, P. troglodytes
ttgttttaaaagaaaa

SEQ ID NO: 286739 - DNA, 16 bp, P. troglodytes
ttgttttaaagatgag

SEQ ID NO: 286740 - DNA, 16 bp, P. troglodytes
ttgttttaatgtaaaa

SEQ ID NO: 286741 - DNA, 16 bp, P. troglodytes
ttgttttaatttccat

SEQ ID NO: 286742 - DNA, 16 bp, P. troglodytes
ttgttttacaaatttg

SEQ ID NO: 286743 - DNA, 16 bp, P. troglodytes
ttgttttacagatggg

SEQ ID NO: 286744 - DNA, 16 bp, P. troglodytes
ttgttttagccatttt

SEQ ID NO: 286745 - DNA, 16 bp, P. troglodytes
ttgttttatgtccaat

SEQ ID NO: 286746 - DNA, 16 bp, P. troglodytes
ttgttttattctaaaa

SEQ ID NO: 286747 - DNA, 16 bp, P. troglodytes
ttgttttcaaatttta

SEQ ID NO: 286748 - DNA, 16 bp, P. troglodytes
ttgttttcctcatttc

SEQ ID NO: 286749 - DNA, 16 bp, P. troglodytes
ttgttttcctgcagct

SEQ ID NO: 286750 - DNA, 16 bp, P. troglodytes
ttgttttccttttaaa

SEQ ID NO: 286751 - DNA, 16 bp, P. troglodytes
ttgttttctaaagaaa

SEQ ID NO: 286752 - DNA, 16 bp, P. troglodytes
ttgttttctaataaaa

SEQ ID NO: 286753 - DNA, 16 bp, P. troglodytes
ttgttttcttaaactt

SEQ ID NO: 286754 - DNA, 16 bp, P. troglodytes
ttgttttcttcactta

SEQ ID NO: 286755 - DNA, 16 bp, P. troglodytes
ttgttttcttcctaaa

SEQ ID NO: 286756 - DNA, 16 bp, P. troglodytes
ttgttttcttctaaga

SEQ ID NO: 286757 - DNA, 16 bp, P. troglodytes
ttgttttctttaaaat

SEQ ID NO: 286758 - DNA, 16 bp, P. troglodytes
ttgttttctttcctca

SEQ ID NO: 286759 - DNA, 16 bp, P. troglodytes
ttgttttgaaaaaaat

SEQ ID NO: 286760 - DNA, 16 bp, P. troglodytes
ttgttttgaagattaa

SEQ ID NO: 286761 - DNA, 16 bp, P. troglodytes
ttgttttgagacagaa

SEQ ID NO: 286762 - DNA, 16 bp, P. troglodytes
ttgttttgcatttgct

SEQ ID NO: 286763 - DNA, 16 bp, P. troglodytes
ttgttttgccagtatt

SEQ ID NO: 286764 - DNA, 16 bp, P. troglodytes
ttgttttgcttttgga

SEQ ID NO: 286765 - DNA, 16 bp, P. troglodytes
ttgttttgggacacca

SEQ ID NO: 286766 - DNA, 16 bp, P. troglodytes
ttgttttgtaaataaa

SEQ ID NO: 286767 - DNA, 16 bp, P. troglodytes
ttgttttgtagagatg

SEQ ID NO: 286768 - DNA, 16 bp, P. troglodytes
ttgtttttaaaactta

SEQ ID NO: 286769 - DNA, 16 bp, P. troglodytes
ttgtttttaaagtaaa

SEQ ID NO: 286770 - DNA, 16 bp, P. troglodytes
ttgtttttaagaaaaa

SEQ ID NO: 286771 - DNA, 16 bp, P. troglodytes
ttgtttttaagaaata

SEQ ID NO: 286772 - DNA, 16 bp, P. troglodytes
ttgtttttaagacaga

SEQ ID NO: 286773 - DNA, 16 bp, P. troglodytes
ttgtttttaagagatg

SEQ ID NO: 286774 - DNA, 16 bp, P. troglodytes
ttgtttttaagggaaa

SEQ ID NO: 286775 - DNA, 16 bp, P. troglodytes
ttgtttttaatacatt

SEQ ID NO: 286776 - DNA, 16 bp, P. troglodytes
ttgtttttaatagaaa

SEQ ID NO: 286777 - DNA, 16 bp, P. troglodytes
ttgtttttatagaaaa

SEQ ID NO: 286778 - DNA, 16 bp, P. troglodytes
ttgtttttcaaaaaat

SEQ ID NO: 286779 - DNA, 16 bp, P. troglodytes
ttgtttttcaaaaata

SEQ ID NO: 286780 - DNA, 16 bp, P. troglodytes
ttgtttttcaaataaa

SEQ ID NO: 286781 - DNA, 16 bp, P. troglodytes
ttgtttttcaagattg

SEQ ID NO: 286782 - DNA, 16 bp, P. troglodytes
ttgtttttctgaaaat

SEQ ID NO: 286783 - DNA, 16 bp, P. troglodytes
ttgttttttaaaaagg

SEQ ID NO: 286784 - DNA, 16 bp, P. troglodytes
ttgttttttaaacaaa

SEQ ID NO: 286785 - DNA, 16 bp, P. troglodytes
ttgttttttaaataca

SEQ ID NO: 286786 - DNA, 16 bp, P. troglodytes
ttgttttttaaatcca

SEQ ID NO: 286787 - DNA, 17 bp, P. troglodytes
ttgttttttgagacaga

SEQ ID NO: 286788 - DNA, 16 bp, P. troglodytes
ttgttttttgagacat

SEQ ID NO: 286789 - DNA, 16 bp, P. troglodytes
ttgtttttttcaaaat

SEQ ID NO: 286790 - DNA, 16 bp, P. troglodytes
ttgtttttttccccat

SEQ ID NO: 286791 - DNA, 16 bp, P. troglodytes
ttgtttttttgagacg

SEQ ID NO: 286792 - DNA, 16 bp, P. troglodytes
tttaaaaaaaaatctg

SEQ ID NO: 286793 - DNA, 16 bp, P. troglodytes
tttaaaaaaaagtctt

SEQ ID NO: 286794 - DNA, 16 bp, P. troglodytes
tttaaaaaaaatcctt

SEQ ID NO: 286795 - DNA, 16 bp, P. troglodytes
tttaaaaaaacagtaa

SEQ ID NO: 286796 - DNA, 16 bp, P. troglodytes
tttaaaaaaacagttt

SEQ ID NO: 286797 - DNA, 16 bp, P. troglodytes
tttaaaaaaactactt

SEQ ID NO: 286798 - DNA, 16 bp, P. troglodytes
tttaaaaaaatacatg

SEQ ID NO: 286799 - DNA, 16 bp, P. troglodytes
tttaaaaaaatgacaa

SEQ ID NO: 286800 - DNA, 16 bp, P. troglodytes
tttaaaaaaatgcaaa

SEQ ID NO: 286801 - DNA, 16 bp, P. troglodytes
tttaaaaaaatgcaca

SEQ ID NO: 286802 - DNA, 16 bp, P. troglodytes
tttaaaaaaatgtttc

SEQ ID NO: 286803 - DNA, 16 bp, P. troglodytes
tttaaaaaaattccac

SEQ ID NO: 286804 - DNA, 16 bp, P. troglodytes
tttaaaaaaattctgt

SEQ ID NO: 286805 - DNA, 16 bp, P. troglodytes
tttaaaaaaattgcaa

SEQ ID NO: 286806 - DNA, 16 bp, P. troglodytes
tttaaaaaaattgtgg

SEQ ID NO: 286807 - DNA, 16 bp, P. troglodytes
tttaaaaaaatttcct

SEQ ID NO: 286808 - DNA, 16 bp, P. troglodytes
tttaaaaaacaaatgt

SEQ ID NO: 286809 - DNA, 16 bp, P. troglodytes
tttaaaaaacaacttt

SEQ ID NO: 286810 - DNA, 16 bp, P. troglodytes
tttaaaaaacaagttt

SEQ ID NO: 286811 - DNA, 16 bp, P. troglodytes
tttaaaaaacagataa

SEQ ID NO: 286812 - DNA, 16 bp, P. troglodytes
tttaaaaaacagtctt

SEQ ID NO: 286813 - DNA, 16 bp, P. troglodytes
tttaaaaaacagtgaa

SEQ ID NO: 286814 - DNA, 16 bp, P. troglodytes
tttaaaaaacatcttt

SEQ ID NO: 286815 - DNA, 16 bp, P. troglodytes
tttaaaaaaccaactt

SEQ ID NO: 286816 - DNA, 16 bp, P. troglodytes
tttaaaaaaccttttt

SEQ ID NO: 286817 - DNA, 16 bp, P. troglodytes
tttaaaaaactacatt

SEQ ID NO: 286818 - DNA, 16 bp, P. troglodytes
tttaaaaaactatttc

SEQ ID NO: 286819 - DNA, 16 bp, P. troglodytes
tttaaaaaactgataa

SEQ ID NO: 286820 - DNA, 16 bp, P. troglodytes
tttaaaaaactgatta

SEQ ID NO: 286821 - DNA, 16 bp, P. troglodytes
tttaaaaaactgtata

SEQ ID NO: 286822 - DNA, 16 bp, P. troglodytes
tttaaaaaagaatgtt

SEQ ID NO: 286823 - DNA, 16 bp, P. troglodytes
tttaaaaaagactgaa

SEQ ID NO: 286824 - DNA, 16 bp, P. troglodytes
tttaaaaaagactttc

SEQ ID NO: 286825 - DNA, 16 bp, P. troglodytes
tttaaaaaagcaaaat

SEQ ID NO: 286826 - DNA, 16 bp, P. troglodytes
tttaaaaaaggaaaca

SEQ ID NO: 286827 - DNA, 16 bp, P. troglodytes
tttaaaaaaggcaaaa

SEQ ID NO: 286828 - DNA, 16 bp, P. troglodytes
tttaaaaaaggctttt

SEQ ID NO: 286829 - DNA, 16 bp, P. troglodytes
tttaaaaaagtgaatt

SEQ ID NO: 286830 - DNA, 16 bp, P. troglodytes
tttaaaaaagtttcta

SEQ ID NO: 286831 - DNA, 16 bp, P. troglodytes
tttaaaaaagttttct

SEQ ID NO: 286832 - DNA, 16 bp, P. troglodytes
tttaaaaaataatgtg

SEQ ID NO: 286833 - DNA, 16 bp, P. troglodytes
tttaaaaaatacacac

SEQ ID NO: 286834 - DNA, 16 bp, P. troglodytes
tttaaaaaataccttc

SEQ ID NO: 286835 - DNA, 16 bp, P. troglodytes
tttaaaaaatacttca

SEQ ID NO: 286836 - DNA, 16 bp, P. troglodytes
tttaaaaaatattctg

SEQ ID NO: 286837 - DNA, 16 bp, P. troglodytes
tttaaaaaatcaacct

SEQ ID NO: 286838 - DNA, 16 bp, P. troglodytes
tttaaaaaatcattgt

SEQ ID NO: 286839 - DNA, 16 bp, P. troglodytes
tttaaaaaatgaaatc

SEQ ID NO: 286840 - DNA, 16 bp, P. troglodytes
tttaaaaaatgaagag

SEQ ID NO: 286841 - DNA, 16 bp, P. troglodytes
tttaaaaaatgcataa

SEQ ID NO: 286842 - DNA, 16 bp, P. troglodytes
tttaaaaaatgtacag

SEQ ID NO: 286843 - DNA, 16 bp, P. troglodytes
tttaaaaaatgtactc

SEQ ID NO: 286844 - DNA, 16 bp, P. troglodytes
tttaaaaaatgtcttc

SEQ ID NO: 286845 - DNA, 16 bp, P. troglodytes
tttaaaaaattaaggt

SEQ ID NO: 286846 - DNA, 16 bp, P. troglodytes
tttaaaaaattacaag

SEQ ID NO: 286847 - DNA, 16 bp, P. troglodytes
tttaaaaaattagcca

SEQ ID NO: 286848 - DNA, 16 bp, P. troglodytes
tttaaaaaattcacta

SEQ ID NO: 286849 - DNA, 16 bp, P. troglodytes
tttaaaaaattcagtt

SEQ ID NO: 286850 - DNA, 16 bp, P. troglodytes
tttaaaaaattctgaa

SEQ ID NO: 286851 - DNA, 16 bp, P. troglodytes
tttaaaaaattgatac

SEQ ID NO: 286852 - DNA, 16 bp, P. troglodytes
tttaaaaaattggatt

SEQ ID NO: 286853 - DNA, 16 bp, P. troglodytes
tttaaaaaattgtgtt

SEQ ID NO: 286854 - DNA, 16 bp, P. troglodytes
tttaaaaaattgttct

SEQ ID NO: 286855 - DNA, 16 bp, P. troglodytes
tttaaaaaattgttga

SEQ ID NO: 286856 - DNA, 16 bp, P. troglodytes
tttaaaaaattgttgt

SEQ ID NO: 286857 - DNA, 16 bp, P. troglodytes
tttaaaaaatttctct

SEQ ID NO: 286858 - DNA, 16 bp, P. troglodytes
tttaaaaacaaagaga

SEQ ID NO: 286859 - DNA, 16 bp, P. troglodytes
tttaaaaacaacttta

SEQ ID NO: 286860 - DNA, 16 bp, P. troglodytes
tttaaaaacaagaaca

SEQ ID NO: 286861 - DNA, 16 bp, P. troglodytes
tttaaaaacaagtaaa

SEQ ID NO: 286862 - DNA, 16 bp, P. troglodytes
tttaaaaacagaaaca

SEQ ID NO: 286863 - DNA, 16 bp, P. troglodytes
tttaaaaacagaagaa

SEQ ID NO: 286864 - DNA, 16 bp, P. troglodytes
tttaaaaacagaagtt

SEQ ID NO: 286865 - DNA, 16 bp, P. troglodytes
tttaaaaacaggaaaa

SEQ ID NO: 286866 - DNA, 16 bp, P. troglodytes
tttaaaaacatgttat

SEQ ID NO: 286867 - DNA, 16 bp, P. troglodytes
tttaaaaacatttaca

SEQ ID NO: 286868 - DNA, 16 bp, P. troglodytes
tttaaaaacatttctg

SEQ ID NO: 286869 - DNA, 16 bp, P. troglodytes
tttaaaaaccattctt

SEQ ID NO: 286870 - DNA, 16 bp, P. troglodytes
tttaaaaaccatttat

SEQ ID NO: 286871 - DNA, 16 bp, P. troglodytes
tttaaaaaccattttt

SEQ ID NO: 286872 - DNA, 16 bp, P. troglodytes
tttaaaaacgtatttt

SEQ ID NO: 286873 - DNA, 16 bp, P. troglodytes
tttaaaaactgaataa

SEQ ID NO: 286874 - DNA, 16 bp, P. troglodytes
tttaaaaactgcttta

SEQ ID NO: 286875 - DNA, 16 bp, P. troglodytes
tttaaaaactgtaata

SEQ ID NO: 286876 - DNA, 16 bp, P. troglodytes
tttaaaaactgtaatt

SEQ ID NO: 286877 - DNA, 16 bp, P. troglodytes
tttaaaaacttcttaa

SEQ ID NO: 286878 - DNA, 16 bp, P. troglodytes
tttaaaaactttcaaa

SEQ ID NO: 286879 - DNA, 16 bp, P. troglodytes
tttaaaaagaaaagtg

SEQ ID NO: 286880 - DNA, 16 bp, P. troglodytes
tttaaaaagaaaatca

SEQ ID NO: 286881 - DNA, 16 bp, P. troglodytes
tttaaaaagaaatcta

SEQ ID NO: 286882 - DNA, 16 bp, P. troglodytes
tttaaaaagaatcaca

SEQ ID NO: 286883 - DNA, 16 bp, P. troglodytes
tttaaaaagacaattt

SEQ ID NO: 286884 - DNA, 16 bp, P. troglodytes
tttaaaaagacacaaa

SEQ ID NO: 286885 - DNA, 16 bp, P. troglodytes
tttaaaaagacattaa

SEQ ID NO: 286886 - DNA, 16 bp, P. troglodytes
tttaaaaagacatttt

SEQ ID NO: 286887 - DNA, 16 bp, P. troglodytes
tttaaaaagagaacat

SEQ ID NO: 286888 - DNA, 16 bp, P. troglodytes
tttaaaaagagagaga

SEQ ID NO: 286889 - DNA, 16 bp, P. troglodytes
tttaaaaagagtgaaa

SEQ ID NO: 286890 - DNA, 16 bp, P. troglodytes
tttaaaaagatgttta

SEQ ID NO: 286891 - DNA, 16 bp, P. troglodytes
tttaaaaagatgtttt

SEQ ID NO: 286892 - DNA, 16 bp, P. troglodytes
tttaaaaagcaaaatg

SEQ ID NO: 286893 - DNA, 16 bp, P. troglodytes
tttaaaaagcaaatat

SEQ ID NO: 286894 - DNA, 16 bp, P. troglodytes
tttaaaaagcaaattt

SEQ ID NO: 286895 - DNA, 16 bp, P. troglodytes
tttaaaaagcaagatg

SEQ ID NO: 286896 - DNA, 16 bp, P. troglodytes
tttaaaaagcaagtta

SEQ ID NO: 286897 - DNA, 16 bp, P. troglodytes
tttaaaaagcaataaa

SEQ ID NO: 286898 - DNA, 16 bp, P. troglodytes
tttaaaaagcagaaaa

SEQ ID NO: 286899 - DNA, 16 bp, P. troglodytes
tttaaaaagcagattt

SEQ ID NO: 286900 - DNA, 16 bp, P. troglodytes
tttaaaaagcaggaaa

SEQ ID NO: 286901 - DNA, 16 bp, P. troglodytes
tttaaaaagcagttta

SEQ ID NO: 286902 - DNA, 16 bp, P. troglodytes
tttaaaaagcatataa

SEQ ID NO: 286903 - DNA, 16 bp, P. troglodytes
tttaaaaagcattaat

SEQ ID NO: 286904 - DNA, 16 bp, P. troglodytes
tttaaaaagcattatt

SEQ ID NO: 286905 - DNA, 16 bp, P. troglodytes
tttaaaaagccaacat

SEQ ID NO: 286906 - DNA, 16 bp, P. troglodytes
tttaaaaagctgaaaa

SEQ ID NO: 286907 - DNA, 16 bp, P. troglodytes
tttaaaaaggaaaagg

SEQ ID NO: 286908 - DNA, 16 bp, P. troglodytes
tttaaaaaggaaagca

SEQ ID NO: 286909 - DNA, 16 bp, P. troglodytes
tttaaaaaggaatttg

SEQ ID NO: 286910 - DNA, 16 bp, P. troglodytes
tttaaaaaggacaaaa

SEQ ID NO: 286911 - DNA, 16 bp, P. troglodytes
tttaaaaaggagaaga

SEQ ID NO: 286912 - DNA, 16 bp, P. troglodytes
tttaaaaaggattttt

SEQ ID NO: 286913 - DNA, 16 bp, P. troglodytes
tttaaaaagggaaaac

SEQ ID NO: 286914 - DNA, 16 bp, P. troglodytes
tttaaaaagggcaaaa

SEQ ID NO: 286915 - DNA, 16 bp, P. troglodytes
tttaaaaagtaaaaac

SEQ ID NO: 286916 - DNA, 16 bp, P. troglodytes
tttaaaaagtaattca

SEQ ID NO: 286917 - DNA, 16 bp, P. troglodytes
tttaaaaagtactttt

SEQ ID NO: 286918 - DNA, 16 bp, P. troglodytes
tttaaaaagtagatta

SEQ ID NO: 286919 - DNA, 16 bp, P. troglodytes
tttaaaaagtattcta

SEQ ID NO: 286920 - DNA, 16 bp, P. troglodytes
tttaaaaagtcaagaa

SEQ ID NO: 286921 - DNA, 16 bp, P. troglodytes
tttaaaaagtcaggtt

SEQ ID NO: 286922 - DNA, 16 bp, P. troglodytes
tttaaaaagtcatatt

SEQ ID NO: 286923 - DNA, 16 bp, P. troglodytes
tttaaaaagtcatttg

SEQ ID NO: 286924 - DNA, 16 bp, P. troglodytes
tttaaaaagtccattt

SEQ ID NO: 286925 - DNA, 16 bp, P. troglodytes
tttaaaaagtgaaatt

SEQ ID NO: 286926 - DNA, 16 bp, P. troglodytes
tttaaaaagtgaacag

SEQ ID NO: 286927 - DNA, 16 bp, P. troglodytes
tttaaaaagtgatata

SEQ ID NO: 286928 - DNA, 16 bp, P. troglodytes
tttaaaaagtgtcttt

SEQ ID NO: 286929 - DNA, 16 bp, P. troglodytes
tttaaaaagtgtttca

SEQ ID NO: 286930 - DNA, 16 bp, P. troglodytes
tttaaaaagttatctt

SEQ ID NO: 286931 - DNA, 16 bp, P. troglodytes
tttaaaaataaacatg

SEQ ID NO: 286932 - DNA, 16 bp, P. troglodytes
tttaaaaataaagcaa

SEQ ID NO: 286933 - DNA, 16 bp, P. troglodytes
tttaaaaataagaaca

SEQ ID NO: 286934 - DNA, 16 bp, P. troglodytes
tttaaaaataagacaa

SEQ ID NO: 286935 - DNA, 16 bp, P. troglodytes
tttaaaaataagatca

SEQ ID NO: 286936 - DNA, 16 bp, P. troglodytes
tttaaaaataagctaa

SEQ ID NO: 286937 - DNA, 16 bp, P. troglodytes
tttaaaaataatagac

SEQ ID NO: 286938 - DNA, 16 bp, P. troglodytes
tttaaaaataattcct

SEQ ID NO: 286939 - DNA, 16 bp, P. troglodytes
tttaaaaatacacaga

SEQ ID NO: 286940 - DNA, 16 bp, P. troglodytes
tttaaaaatacacatg

SEQ ID NO: 286941 - DNA, 16 bp, P. troglodytes
tttaaaaatacagaaa

SEQ ID NO: 286942 - DNA, 16 bp, P. troglodytes
tttaaaaatacagaga

SEQ ID NO: 286943 - DNA, 16 bp, P. troglodytes
tttaaaaatacatagt

SEQ ID NO: 286944 - DNA, 16 bp, P. troglodytes
tttaaaaatacatgtt

SEQ ID NO: 286945 - DNA, 16 bp, P. troglodytes
tttaaaaatacattag

SEQ ID NO: 286946 - DNA, 16 bp, P. troglodytes
tttaaaaatacttgat

SEQ ID NO: 286947 - DNA, 16 bp, P. troglodytes
tttaaaaatagaatca

SEQ ID NO: 286948 - DNA, 16 bp, P. troglodytes
tttaaaaatagacttt

SEQ ID NO: 286949 - DNA, 16 bp, P. troglodytes
tttaaaaatagtcttt

SEQ ID NO: 286950 - DNA, 16 bp, P. troglodytes
tttaaaaatatccttt

SEQ ID NO: 286951 - DNA, 16 bp, P. troglodytes
tttaaaaatatctaca

SEQ ID NO: 286952 - DNA, 16 bp, P. troglodytes
tttaaaaatatgcaat

SEQ ID NO: 286953 - DNA, 16 bp, P. troglodytes
tttaaaaatattgtct

SEQ ID NO: 286954 - DNA, 16 bp, P. troglodytes
tttaaaaatcaaagta

SEQ ID NO: 286955 - DNA, 16 bp, P. troglodytes
tttaaaaatcaacttt

SEQ ID NO: 286956 - DNA, 16 bp, P. troglodytes
tttaaaaatcaagtaa

SEQ ID NO: 286957 - DNA, 16 bp, P. troglodytes
tttaaaaatcaatgta

SEQ ID NO: 286958 - DNA, 16 bp, P. troglodytes
tttaaaaatcacattt

SEQ ID NO: 286959 - DNA, 16 bp, P. troglodytes
tttaaaaatcactgta

SEQ ID NO: 286960 - DNA, 16 bp, P. troglodytes
tttaaaaatcactttt

SEQ ID NO: 286961 - DNA, 16 bp, P. troglodytes
tttaaaaatcagaaag

SEQ ID NO: 286962 - DNA, 16 bp, P. troglodytes
tttaaaaatcagaatg

SEQ ID NO: 286963 - DNA, 16 bp, P. troglodytes
tttaaaaatcagagtg

SEQ ID NO: 286964 - DNA, 16 bp, P. troglodytes
tttaaaaatcagatta

SEQ ID NO: 286965 - DNA, 16 bp, P. troglodytes
tttaaaaatcagtttg

SEQ ID NO: 286966 - DNA, 16 bp, P. troglodytes
tttaaaaatcagtttt

SEQ ID NO: 286967 - DNA, 16 bp, P. troglodytes
tttaaaaatcataatc

SEQ ID NO: 286968 - DNA, 16 bp, P. troglodytes
tttaaaaatcatcttt

SEQ ID NO: 286969 - DNA, 16 bp, P. troglodytes
tttaaaaatcattgta

SEQ ID NO: 286970 - DNA, 16 bp, P. troglodytes
tttaaaaatccataat

SEQ ID NO: 286971 - DNA, 16 bp, P. troglodytes
tttaaaaatcctttat

SEQ ID NO: 286972 - DNA, 16 bp, P. troglodytes
tttaaaaatctattca

SEQ ID NO: 286973 - DNA, 16 bp, P. troglodytes
tttaaaaatctcttct

SEQ ID NO: 286974 - DNA, 16 bp, P. troglodytes
tttaaaaatctgaatt

SEQ ID NO: 286975 - DNA, 16 bp, P. troglodytes
tttaaaaatctggaaa

SEQ ID NO: 286976 - DNA, 16 bp, P. troglodytes
tttaaaaatctgtatg

SEQ ID NO: 286977 - DNA, 16 bp, P. troglodytes
tttaaaaatctgtgat

SEQ ID NO: 286978 - DNA, 16 bp, P. troglodytes
tttaaaaatctgttta

SEQ ID NO: 286979 - DNA, 16 bp, P. troglodytes
tttaaaaatcttccca

SEQ ID NO: 286980 - DNA, 16 bp, P. troglodytes
tttaaaaatgaaaact

SEQ ID NO: 286981 - DNA, 16 bp, P. troglodytes
tttaaaaatgaacaaa

SEQ ID NO: 286982 - DNA, 16 bp, P. troglodytes
tttaaaaatgaagatg

SEQ ID NO: 286983 - DNA, 16 bp, P. troglodytes
tttaaaaatgagaaca

SEQ ID NO: 286984 - DNA, 16 bp, P. troglodytes
tttaaaaatgattctt

SEQ ID NO: 286985 - DNA, 16 bp, P. troglodytes
tttaaaaatgcaaatc

SEQ ID NO: 286986 - DNA, 16 bp, P. troglodytes
tttaaaaatgcaaatt

SEQ ID NO: 286987 - DNA, 16 bp, P. troglodytes
tttaaaaatgcaattt

SEQ ID NO: 286988 - DNA, 16 bp, P. troglodytes
tttaaaaatgcacaca

SEQ ID NO: 286989 - DNA, 16 bp, P. troglodytes
tttaaaaatgcatatg

SEQ ID NO: 286990 - DNA, 16 bp, P. troglodytes
tttaaaaatgcatgaa

SEQ ID NO: 286991 - DNA, 16 bp, P. troglodytes
tttaaaaatgccaaaa

SEQ ID NO: 286992 - DNA, 16 bp, P. troglodytes
tttaaaaatgcttaat

SEQ ID NO: 286993 - DNA, 16 bp, P. troglodytes
tttaaaaatggatttg

SEQ ID NO: 286994 - DNA, 16 bp, P. troglodytes
tttaaaaatgggaaaa

SEQ ID NO: 286995 - DNA, 16 bp, P. troglodytes
tttaaaaatgtataca

SEQ ID NO: 286996 - DNA, 16 bp, P. troglodytes
tttaaaaatgtatact

SEQ ID NO: 286997 - DNA, 16 bp, P. troglodytes
tttaaaaatgtcaaga

SEQ ID NO: 286998 - DNA, 16 bp, P. troglodytes
tttaaaaatgtcattt

SEQ ID NO: 286999 - DNA, 16 bp, P. troglodytes
tttaaaaatgtgaatt

SEQ ID NO: 287000 - DNA, 16 bp, P. troglodytes
tttaaaaatgtggaaa

SEQ ID NO: 287001 - DNA, 16 bp, P. troglodytes
tttaaaaatgtggttt

SEQ ID NO: 287002 - DNA, 16 bp, P. troglodytes
tttaaaaatgtgtaaa

SEQ ID NO: 287003 - DNA, 16 bp, P. troglodytes
tttaaaaatgtgttta

SEQ ID NO: 287004 - DNA, 16 bp, P. troglodytes
tttaaaaatgttatct

SEQ ID NO: 287005 - DNA, 16 bp, P. troglodytes
tttaaaaatgtttctt

SEQ ID NO: 287006 - DNA, 16 bp, P. troglodytes
tttaaaaattaagctt

SEQ ID NO: 287007 - DNA, 16 bp, P. troglodytes
tttaaaaattacagtt

SEQ ID NO: 287008 - DNA, 16 bp, P. troglodytes
tttaaaaattactgat

SEQ ID NO: 287009 - DNA, 16 bp, P. troglodytes
tttaaaaattactgtt

SEQ ID NO: 287010 - DNA, 16 bp, P. troglodytes
tttaaaaattagcctg

SEQ ID NO: 287011 - DNA, 16 bp, P. troglodytes
tttaaaaattagtaag

SEQ ID NO: 287012 - DNA, 16 bp, P. troglodytes
tttaaaaattatccag

SEQ ID NO: 287013 - DNA, 16 bp, P. troglodytes
tttaaaaattatcttc

SEQ ID NO: 287014 - DNA, 16 bp, P. troglodytes
tttaaaaattatcttg

SEQ ID NO: 287015 - DNA, 16 bp, P. troglodytes
tttaaaaattcctctt

SEQ ID NO: 287016 - DNA, 16 bp, P. troglodytes
tttaaaaattctaaac

SEQ ID NO: 287017 - DNA, 16 bp, P. troglodytes
tttaaaaattctcaaa

SEQ ID NO: 287018 - DNA, 16 bp, P. troglodytes
tttaaaaattctgtta

SEQ ID NO: 287019 - DNA, 16 bp, P. troglodytes
tttaaaaattcttact

SEQ ID NO: 287020 - DNA, 16 bp, P. troglodytes
tttaaaaattctttcc

SEQ ID NO: 287021 - DNA, 16 bp, P. troglodytes
tttaaaaattgatgaa

SEQ ID NO: 287022 - DNA, 16 bp, P. troglodytes
tttaaaaattgatgta

SEQ ID NO: 287023 - DNA, 16 bp, P. troglodytes
tttaaaaatttcattg

SEQ ID NO: 287024 - DNA, 16 bp, P. troglodytes
tttaaaaattttgaga

SEQ ID NO: 287025 - DNA, 16 bp, P. troglodytes
tttaaaacaaaagcaa

SEQ ID NO: 287026 - DNA, 16 bp, P. troglodytes
tttaaaacaaaatgaa

SEQ ID NO: 287027 - DNA, 16 bp, P. troglodytes
tttaaaacaaattatg

SEQ ID NO: 287028 - DNA, 16 bp, P. troglodytes
tttaaaacaaatttct

SEQ ID NO: 287029 - DNA, 16 bp, P. troglodytes
tttaaaacaactgttt

SEQ ID NO: 287030 - DNA, 16 bp, P. troglodytes
tttaaaacacaaatga

SEQ ID NO: 287031 - DNA, 16 bp, P. troglodytes
tttaaaacacacacac

SEQ ID NO: 287032 - DNA, 16 bp, P. troglodytes
tttaaaacagaaagaa

SEQ ID NO: 287033 - DNA, 16 bp, P. troglodytes
tttaaaacagagtctt

SEQ ID NO: 287034 - DNA, 16 bp, P. troglodytes
tttaaaacagcaaaat

SEQ ID NO: 287035 - DNA, 16 bp, P. troglodytes
tttaaaacagctttat

SEQ ID NO: 287036 - DNA, 16 bp, P. troglodytes
tttaaaacatcaattt

SEQ ID NO: 287037 - DNA, 16 bp, P. troglodytes
tttaaaacatgtaaaa

SEQ ID NO: 287038 - DNA, 16 bp, P. troglodytes
tttaaaacattcttta

SEQ ID NO: 287039 - DNA, 16 bp, P. troglodytes
tttaaaacatttccat

SEQ ID NO: 287040 - DNA, 16 bp, P. troglodytes
tttaaaacatttctta

SEQ ID NO: 287041 - DNA, 16 bp, P. troglodytes
tttaaaaccaaagaaa

SEQ ID NO: 287042 - DNA, 16 bp, P. troglodytes
tttaaaaccatttaaa

SEQ ID NO: 287043 - DNA, 16 bp, P. troglodytes
tttaaaactaatgaaa

SEQ ID NO: 287044 - DNA, 16 bp, P. troglodytes
tttaaaactagaaaaa

SEQ ID NO: 287045 - DNA, 16 bp, P. troglodytes
tttaaaactatattct

SEQ ID NO: 287046 - DNA, 16 bp, P. troglodytes
tttaaaactgtaattt

SEQ ID NO: 287047 - DNA, 16 bp, P. troglodytes
tttaaaactgtgtagc

SEQ ID NO: 287048 - DNA, 16 bp, P. troglodytes
tttaaaactgttattt

SEQ ID NO: 287049 - DNA, 16 bp, P. troglodytes
tttaaaactttctaca

SEQ ID NO: 287050 - DNA, 16 bp, P. troglodytes
tttaaaactttgaaat

SEQ ID NO: 287051 - DNA, 16 bp, P. troglodytes
tttaaaactttgtttt

SEQ ID NO: 287052 - DNA, 16 bp, P. troglodytes
tttaaaacttttctaa

SEQ ID NO: 287053 - DNA, 16 bp, P. troglodytes
tttaaaacttttgttt

SEQ ID NO: 287054 - DNA, 16 bp, P. troglodytes
tttaaaagaaaaatca

SEQ ID NO: 287055 - DNA, 16 bp, P. troglodytes
tttaaaagaaaacatt

SEQ ID NO: 287056 - DNA, 16 bp, P. troglodytes
tttaaaagaaaatcta

SEQ ID NO: 287057 - DNA, 16 bp, P. troglodytes
tttaaaagaaactatt

SEQ ID NO: 287058 - DNA, 16 bp, P. troglodytes
tttaaaagaaagtttt

SEQ ID NO: 287059 - DNA, 16 bp, P. troglodytes
tttaaaagaacatttt

SEQ ID NO: 287060 - DNA, 16 bp, P. troglodytes
tttaaaagaactaaaa

SEQ ID NO: 287061 - DNA, 16 bp, P. troglodytes
tttaaaagaagaggaa

SEQ ID NO: 287062 - DNA, 16 bp, P. troglodytes
tttaaaagaagatttt

SEQ ID NO: 287063 - DNA, 16 bp, P. troglodytes
tttaaaagaataaaca

SEQ ID NO: 287064 - DNA, 16 bp, P. troglodytes
tttaaaagactatttt

SEQ ID NO: 287065 - DNA, 16 bp, P. troglodytes
tttaaaagactgaaaa

SEQ ID NO: 287066 - DNA, 16 bp, P. troglodytes
tttaaaagacttaaaa

SEQ ID NO: 287067 - DNA, 16 bp, P. troglodytes
tttaaaagagaaaatc

SEQ ID NO: 287068 - DNA, 16 bp, P. troglodytes
tttaaaagagagagaa

SEQ ID NO: 287069 - DNA, 16 bp, P. troglodytes
tttaaaagagattttt

SEQ ID NO: 287070 - DNA, 16 bp, P. troglodytes
tttaaaagagttttct

SEQ ID NO: 287071 - DNA, 16 bp, P. troglodytes
tttaaaagataaaatc

SEQ ID NO: 287072 - DNA, 16 bp, P. troglodytes
tttaaaagatatttca

SEQ ID NO: 287073 - DNA, 16 bp, P. troglodytes
tttaaaagatattttg

SEQ ID NO: 287074 - DNA, 16 bp, P. troglodytes
tttaaaagatgaagaa

SEQ ID NO: 287075 - DNA, 16 bp, P. troglodytes
tttaaaagatgtttaa

SEQ ID NO: 287076 - DNA, 16 bp, P. troglodytes
tttaaaagatgtttat

SEQ ID NO: 287077 - DNA, 16 bp, P. troglodytes
tttaaaagatttattg

SEQ ID NO: 287078 - DNA, 16 bp, P. troglodytes
tttaaaagcaaaataa

SEQ ID NO: 287079 - DNA, 16 bp, P. troglodytes
tttaaaagcatttatt

SEQ ID NO: 287080 - DNA, 16 bp, P. troglodytes
tttaaaagctatttta

SEQ ID NO: 287081 - DNA, 16 bp, P. troglodytes
tttaaaagctgaaaat

SEQ ID NO: 287082 - DNA, 16 bp, P. troglodytes
tttaaaagcttctgca

SEQ ID NO: 287083 - DNA, 16 bp, P. troglodytes
tttaaaaggaaatgtt

SEQ ID NO: 287084 - DNA, 16 bp, P. troglodytes
tttaaaaggaaatttt

SEQ ID NO: 287085 - DNA, 16 bp, P. troglodytes
tttaaaaggactttat

SEQ ID NO: 287086 - DNA, 16 bp, P. troglodytes
tttaaaaggattttta

SEQ ID NO: 287087 - DNA, 16 bp, P. troglodytes
tttaaaagggaaacag

SEQ ID NO: 287088 - DNA, 16 bp, P. troglodytes
tttaaaagggaaagaa

SEQ ID NO: 287089 - DNA, 16 bp, P. troglodytes
tttaaaaggggaaaat

SEQ ID NO: 287090 - DNA, 16 bp, P. troglodytes
tttaaaaggtaatttt

SEQ ID NO: 287091 - DNA, 16 bp, P. troglodytes
tttaaaaggttaaata

SEQ ID NO: 287092 - DNA, 16 bp, P. troglodytes
tttaaaagtaactaaa

SEQ ID NO: 287093 - DNA, 16 bp, P. troglodytes
tttaaaagtaatttct

SEQ ID NO: 287094 - DNA, 16 bp, P. troglodytes
tttaaaagtatctgtt

SEQ ID NO: 287095 - DNA, 16 bp, P. troglodytes
tttaaaagtcaaaaaa

SEQ ID NO: 287096 - DNA, 16 bp, P. troglodytes
tttaaaagtctaattt

SEQ ID NO: 287097 - DNA, 16 bp, P. troglodytes
tttaaaagtgaatatt

SEQ ID NO: 287098 - DNA, 16 bp, P. troglodytes
tttaaaagtgaatttt

SEQ ID NO: 287099 - DNA, 16 bp, P. troglodytes
tttaaaagtgtgtagt

SEQ ID NO: 287100 - DNA, 16 bp, P. troglodytes
tttaaaagtgtgtggc

SEQ ID NO: 287101 - DNA, 16 bp, P. troglodytes
tttaaaagtgtgtgtc

SEQ ID NO: 287102 - DNA, 16 bp, P. troglodytes
tttaaaagttaaaaac

SEQ ID NO: 287103 - DNA, 16 bp, P. troglodytes
tttaaaagttctattt

SEQ ID NO: 287104 - DNA, 16 bp, P. troglodytes
tttaaaagttgaataa

SEQ ID NO: 287105 - DNA, 16 bp, P. troglodytes
tttaaaagtttaaaag

SEQ ID NO: 287106 - DNA, 16 bp, P. troglodytes
tttaaaagtttggaaa

SEQ ID NO: 287107 - DNA, 16 bp, P. troglodytes
tttaaaagttttaaag

SEQ ID NO: 287108 - DNA, 16 bp, P. troglodytes
tttaaaagttttgaat

SEQ ID NO: 287109 - DNA, 16 bp, P. troglodytes
tttaaaataaagatgt

SEQ ID NO: 287110 - DNA, 16 bp, P. troglodytes
tttaaaataaatagtg

SEQ ID NO: 287111 - DNA, 16 bp, P. troglodytes
tttaaaataaatggtt

SEQ ID NO: 287112 - DNA, 16 bp, P. troglodytes
tttaaaataaattcct

SEQ ID NO: 287113 - DNA, 16 bp, P. troglodytes
tttaaaataacagaat

SEQ ID NO: 287114 - DNA, 16 bp, P. troglodytes
tttaaaataacatgat

SEQ ID NO: 287115 - DNA, 16 bp, P. troglodytes
tttaaaataactagaa

SEQ ID NO: 287116 - DNA, 16 bp, P. troglodytes
tttaaaataagctttt

SEQ ID NO: 287117 - DNA, 16 bp, P. troglodytes
tttaaaataatcagaa

SEQ ID NO: 287118 - DNA, 16 bp, P. troglodytes
tttaaaatacagaaaa

SEQ ID NO: 287119 - DNA, 16 bp, P. troglodytes
tttaaaatacatttcc

SEQ ID NO: 287120 - DNA, 16 bp, P. troglodytes
tttaaaatacctattt

SEQ ID NO: 287121 - DNA, 16 bp, P. troglodytes
tttaaaatagccacaa

SEQ ID NO: 287122 - DNA, 16 bp, P. troglodytes
tttaaaataggatttt

SEQ ID NO: 287123 - DNA, 16 bp, P. troglodytes
tttaaaatagttttct

SEQ ID NO: 287124 - DNA, 16 bp, P. troglodytes
tttaaaatatactgaa

SEQ ID NO: 287125 - DNA, 16 bp, P. troglodytes
tttaaaatatatgctt

SEQ ID NO: 287126 - DNA, 16 bp, P. troglodytes
tttaaaatatatgtgt

SEQ ID NO: 287127 - DNA, 16 bp, P. troglodytes
tttaaaatatcagaat

SEQ ID NO: 287128 - DNA, 16 bp, P. troglodytes
tttaaaatatctgaaa

SEQ ID NO: 287129 - DNA, 16 bp, P. troglodytes
tttaaaatatcttcat

SEQ ID NO: 287130 - DNA, 16 bp, P. troglodytes
tttaaaatatgaagtt

SEQ ID NO: 287131 - DNA, 16 bp, P. troglodytes
tttaaaatatgcataa

SEQ ID NO: 287132 - DNA, 16 bp, P. troglodytes
tttaaaatatgtgcat

SEQ ID NO: 287133 - DNA, 16 bp, P. troglodytes
tttaaaatatgttcaa

SEQ ID NO: 287134 - DNA, 16 bp, P. troglodytes
tttaaaatattctaca

SEQ ID NO: 287135 - DNA, 16 bp, P. troglodytes
tttaaaatattgcata

SEQ ID NO: 287136 - DNA, 16 bp, P. troglodytes
tttaaaatcacatttt

SEQ ID NO: 287137 - DNA, 16 bp, P. troglodytes
tttaaaatcagattgt

SEQ ID NO: 287138 - DNA, 16 bp, P. troglodytes
tttaaaatcatcttta

SEQ ID NO: 287139 - DNA, 16 bp, P. troglodytes
tttaaaatcattttca

SEQ ID NO: 287140 - DNA, 16 bp, P. troglodytes
tttaaaatccattctt

SEQ ID NO: 287141 - DNA, 16 bp, P. troglodytes
tttaaaatccatttta

SEQ ID NO: 287142 - DNA, 16 bp, P. troglodytes
tttaaaatctattttg

SEQ ID NO: 287143 - DNA, 16 bp, P. troglodytes
tttaaaatctctttca

SEQ ID NO: 287144 - DNA, 16 bp, P. troglodytes
tttaaaatctgctttt

SEQ ID NO: 287145 - DNA, 16 bp, P. troglodytes
tttaaaatctgttttt

SEQ ID NO: 287146 - DNA, 16 bp, P. troglodytes
tttaaaatgaaagaca

SEQ ID NO: 287147 - DNA, 16 bp, P. troglodytes
tttaaaatgaatacaa

SEQ ID NO: 287148 - DNA, 16 bp, P. troglodytes
tttaaaatgaatttct

SEQ ID NO: 287149 - DNA, 16 bp, P. troglodytes
tttaaaatgacttttt

SEQ ID NO: 287150 - DNA, 16 bp, P. troglodytes
tttaaaatgatgtaaa

SEQ ID NO: 287151 - DNA, 16 bp, P. troglodytes
tttaaaatgatgttta

SEQ ID NO: 287152 - DNA, 16 bp, P. troglodytes
tttaaaatgcaaaata

SEQ ID NO: 287153 - DNA, 16 bp, P. troglodytes
tttaaaatgcacaaaa

SEQ ID NO: 287154 - DNA, 16 bp, P. troglodytes
tttaaaatgcaggttt

SEQ ID NO: 287155 - DNA, 16 bp, P. troglodytes
tttaaaatgcataatt

SEQ ID NO: 287156 - DNA, 16 bp, P. troglodytes
tttaaaatgcatatgt

SEQ ID NO: 287157 - DNA, 16 bp, P. troglodytes
tttaaaatgcattaaa

SEQ ID NO: 287158 - DNA, 16 bp, P. troglodytes
tttaaaatgcattttt

SEQ ID NO: 287159 - DNA, 16 bp, P. troglodytes
tttaaaatgctaatat

SEQ ID NO: 287160 - DNA, 16 bp, P. troglodytes
tttaaaatgcttaaaa

SEQ ID NO: 287161 - DNA, 16 bp, P. troglodytes
tttaaaatgcttattt

SEQ ID NO: 287162 - DNA, 16 bp, P. troglodytes
tttaaaatggaaacag

SEQ ID NO: 287163 - DNA, 16 bp, P. troglodytes
tttaaaatggaaagtt

SEQ ID NO: 287164 - DNA, 16 bp, P. troglodytes
tttaaaatggaatatt

SEQ ID NO: 287165 - DNA, 16 bp, P. troglodytes
tttaaaatggattaaa

SEQ ID NO: 287166 - DNA, 16 bp, P. troglodytes
tttaaaatggtgaatt

SEQ ID NO: 287167 - DNA, 16 bp, P. troglodytes
tttaaaatgtaagcat

SEQ ID NO: 287168 - DNA, 16 bp, P. troglodytes
tttaaaatgtaagtga

SEQ ID NO: 287169 - DNA, 16 bp, P. troglodytes
tttaaaatgtatcttt

SEQ ID NO: 287170 - DNA, 16 bp, P. troglodytes
tttaaaatgtatgtaa

SEQ ID NO: 287171 - DNA, 16 bp, P. troglodytes
tttaaaatgtatttga

SEQ ID NO: 287172 - DNA, 16 bp, P. troglodytes
tttaaaatgtcaacat

SEQ ID NO: 287173 - DNA, 16 bp, P. troglodytes
tttaaaatgtcagaaa

SEQ ID NO: 287174 - DNA, 16 bp, P. troglodytes
tttaaaatgtcatctt

SEQ ID NO: 287175 - DNA, 16 bp, P. troglodytes
tttaaaatgtcatttg

SEQ ID NO: 287176 - DNA, 16 bp, P. troglodytes
tttaaaatgtgaacat

SEQ ID NO: 287177 - DNA, 16 bp, P. troglodytes
tttaaaatgtgaattt

SEQ ID NO: 287178 - DNA, 16 bp, P. troglodytes
tttaaaatgtgtatat

SEQ ID NO: 287179 - DNA, 16 bp, P. troglodytes
tttaaaatgtgtttct

SEQ ID NO: 287180 - DNA, 16 bp, P. troglodytes
tttaaaatgttacata

SEQ ID NO: 287181 - DNA, 16 bp, P. troglodytes
tttaaaatgttacttt

SEQ ID NO: 287182 - DNA, 16 bp, P. troglodytes
tttaaaatgttcagtt

SEQ ID NO: 287183 - DNA, 16 bp, P. troglodytes
tttaaaatgttctttc

SEQ ID NO: 287184 - DNA, 16 bp, P. troglodytes
tttaaaatgtttagaa

SEQ ID NO: 287185 - DNA, 16 bp, P. troglodytes
tttaaaatgttttctt

SEQ ID NO: 287186 - DNA, 16 bp, P. troglodytes
tttaaaatgttttgaa

SEQ ID NO: 287187 - DNA, 16 bp, P. troglodytes
tttaaaattaaccttt

SEQ ID NO: 287188 - DNA, 16 bp, P. troglodytes
tttaaaattaagcttt

SEQ ID NO: 287189 - DNA, 16 bp, P. troglodytes
tttaaaattacatgtg

SEQ ID NO: 287190 - DNA, 16 bp, P. troglodytes
tttaaaattacattct

SEQ ID NO: 287191 - DNA, 16 bp, P. troglodytes
tttaaaattacatttg

SEQ ID NO: 287192 - DNA, 16 bp, P. troglodytes
tttaaaattattgcta

SEQ ID NO: 287193 - DNA, 16 bp, P. troglodytes
tttaaaattattggta

SEQ ID NO: 287194 - DNA, 16 bp, P. troglodytes
tttaaaattcaagtta

SEQ ID NO: 287195 - DNA, 16 bp, P. troglodytes
tttaaaattcagttca

SEQ ID NO: 287196 - DNA, 16 bp, P. troglodytes
tttaaaattcagtttt

SEQ ID NO: 287197 - DNA, 16 bp, P. troglodytes
tttaaaattcatgtgg

SEQ ID NO: 287198 - DNA, 16 bp, P. troglodytes
tttaaaattctctctt

SEQ ID NO: 287199 - DNA, 16 bp, P. troglodytes
tttaaaattggaattt

SEQ ID NO: 287200 - DNA, 16 bp, P. troglodytes
tttaaaattggattgt

SEQ ID NO: 287201 - DNA, 16 bp, P. troglodytes
tttaaaattgtcttta

SEQ ID NO: 287202 - DNA, 16 bp, P. troglodytes
tttaaaattgttttct

SEQ ID NO: 287203 - DNA, 16 bp, P. troglodytes
tttaaaatttattgag

SEQ ID NO: 287204 - DNA, 16 bp, P. troglodytes
tttaaaatttcacaaa

SEQ ID NO: 287205 - DNA, 16 bp, P. troglodytes
tttaaaatttcagttt

SEQ ID NO: 287206 - DNA, 16 bp, P. troglodytes
tttaaaatttgttcag

SEQ ID NO: 287207 - DNA, 16 bp, P. troglodytes
tttaaaattttctgaa

SEQ ID NO: 287208 - DNA, 16 bp, P. troglodytes
tttaaaattttgatga

SEQ ID NO: 287209 - DNA, 16 bp, P. troglodytes
tttaaaattttgcttt

SEQ ID NO: 287210 - DNA, 16 bp, P. troglodytes
tttaaaatttttgcca

SEQ ID NO: 287211 - DNA, 16 bp, P. troglodytes
tttaaaatttttgtct

SEQ ID NO: 287212 - DNA, 16 bp, P. troglodytes
tttaaacaaaagcaaa

SEQ ID NO: 287213 - DNA, 16 bp, P. troglodytes
tttaaacaaagacagt

SEQ ID NO: 287214 - DNA, 16 bp, P. troglodytes
tttaaacaattcaaca

SEQ ID NO: 287215 - DNA, 16 bp, P. troglodytes
tttaaacacattattt

SEQ ID NO: 287216 - DNA, 16 bp, P. troglodytes
tttaaacatctttaaa

SEQ ID NO: 287217 - DNA, 16 bp, P. troglodytes
tttaaacatgtttaaa

SEQ ID NO: 287218 - DNA, 16 bp, P. troglodytes
tttaaacattaaacat

SEQ ID NO: 287219 - DNA, 16 bp, P. troglodytes
tttaaacattgttttc

SEQ ID NO: 287220 - DNA, 16 bp, P. troglodytes
tttaaacatttagaaa

SEQ ID NO: 287221 - DNA, 16 bp, P. troglodytes
tttaaacatttttttg

SEQ ID NO: 287222 - DNA, 16 bp, P. troglodytes
tttaaaccaacaaaca

SEQ ID NO: 287223 - DNA, 16 bp, P. troglodytes
tttaaaccatttaaaa

SEQ ID NO: 287224 - DNA, 16 bp, P. troglodytes
tttaaacccaggaggc

SEQ ID NO: 287225 - DNA, 16 bp, P. troglodytes
tttaaacttttttgct

SEQ ID NO: 287226 - DNA, 16 bp, P. troglodytes
tttaaagaaaaacata

SEQ ID NO: 287227 - DNA, 16 bp, P. troglodytes
tttaaagaaaaactaa

SEQ ID NO: 287228 - DNA, 16 bp, P. troglodytes
tttaaagaaaaatgca

SEQ ID NO: 287229 - DNA, 16 bp, P. troglodytes
tttaaagaaaatcata

SEQ ID NO: 287230 - DNA, 16 bp, P. troglodytes
tttaaagaaacaaatg

SEQ ID NO: 287231 - DNA, 16 bp, P. troglodytes
tttaaagaaacagaaa

SEQ ID NO: 287232 - DNA, 16 bp, P. troglodytes
tttaaagaaacagcag

SEQ ID NO: 287233 - DNA, 16 bp, P. troglodytes
tttaaagaaactacca

SEQ ID NO: 287234 - DNA, 16 bp, P. troglodytes
tttaaagaaagtttat

SEQ ID NO: 287235 - DNA, 16 bp, P. troglodytes
tttaaagaaatatttg

SEQ ID NO: 287236 - DNA, 16 bp, P. troglodytes
tttaaagaaattttct

SEQ ID NO: 287237 - DNA, 16 bp, P. troglodytes
tttaaagaacaaattt

SEQ ID NO: 287238 - DNA, 16 bp, P. troglodytes
tttaaagaagaaatgt

SEQ ID NO: 287239 - DNA, 16 bp, P. troglodytes
tttaaagaagagaaat

SEQ ID NO: 287240 - DNA, 16 bp, P. troglodytes
tttaaagaattcagaa

SEQ ID NO: 287241 - DNA, 16 bp, P. troglodytes
tttaaagacaaaaata

SEQ ID NO: 287242 - DNA, 16 bp, P. troglodytes
tttaaagacaccttat

SEQ ID NO: 287243 - DNA, 16 bp, P. troglodytes
tttaaagacagagttt

SEQ ID NO: 287244 - DNA, 16 bp, P. troglodytes
tttaaagacagattct

SEQ ID NO: 287245 - DNA, 16 bp, P. troglodytes
tttaaagacattttat

SEQ ID NO: 287246 - DNA, 16 bp, P. troglodytes
tttaaagagaaatatt

SEQ ID NO: 287247 - DNA, 16 bp, P. troglodytes
tttaaagagatgacaa

SEQ ID NO: 287248 - DNA, 16 bp, P. troglodytes
tttaaagagatttaaa

SEQ ID NO: 287249 - DNA, 16 bp, P. troglodytes
tttaaagataactttt

SEQ ID NO: 287250 - DNA, 16 bp, P. troglodytes
tttaaagataaggaaa

SEQ ID NO: 287251 - DNA, 16 bp, P. troglodytes
tttaaagatgaaaaag

SEQ ID NO: 287252 - DNA, 16 bp, P. troglodytes
tttaaagatgaacaaa

SEQ ID NO: 287253 - DNA, 16 bp, P. troglodytes
tttaaagatgaagaaa

SEQ ID NO: 287254 - DNA, 16 bp, P. troglodytes
tttaaagatgagaaaa

SEQ ID NO: 287255 - DNA, 16 bp, P. troglodytes
tttaaagatgtgaaaa

SEQ ID NO: 287256 - DNA, 16 bp, P. troglodytes
tttaaagatgtggaaa

SEQ ID NO: 287257 - DNA, 16 bp, P. troglodytes
tttaaagatttatttc

SEQ ID NO: 287258 - DNA, 16 bp, P. troglodytes
tttaaagcaaatgaaa

SEQ ID NO: 287259 - DNA, 16 bp, P. troglodytes
tttaaagcaatgtgta

SEQ ID NO: 287260 - DNA, 16 bp, P. troglodytes
tttaaagcatatttta

SEQ ID NO: 287261 - DNA, 16 bp, P. troglodytes
tttaaagcattttttt

SEQ ID NO: 287262 - DNA, 16 bp, P. troglodytes
tttaaagccttttttt

SEQ ID NO: 287263 - DNA, 16 bp, P. troglodytes
tttaaagctgaaaaat

SEQ ID NO: 287264 - DNA, 16 bp, P. troglodytes
tttaaaggaaaaacaa

SEQ ID NO: 287265 - DNA, 16 bp, P. troglodytes
tttaaaggaaaatgtt

SEQ ID NO: 287266 - DNA, 16 bp, P. troglodytes
tttaaaggaaacaaaa

SEQ ID NO: 287267 - DNA, 16 bp, P. troglodytes
tttaaaggaaatttta

SEQ ID NO: 287268 - DNA, 16 bp, P. troglodytes
tttaaaggaagaaaag

SEQ ID NO: 287269 - DNA, 16 bp, P. troglodytes
tttaaaggaagaaaat

SEQ ID NO: 287270 - DNA, 16 bp, P. troglodytes
tttaaaggatgaaaaa

SEQ ID NO: 287271 - DNA, 16 bp, P. troglodytes
tttaaaggatttaaaa

SEQ ID NO: 287272 - DNA, 16 bp, P. troglodytes
tttaaaggccctatct

SEQ ID NO: 287273 - DNA, 16 bp, P. troglodytes
tttaaagggaaaaata

SEQ ID NO: 287274 - DNA, 16 bp, P. troglodytes
tttaaaggtgaggaaa

SEQ ID NO: 287275 - DNA, 16 bp, P. troglodytes
tttaaaggttaaataa

SEQ ID NO: 287276 - DNA, 16 bp, P. troglodytes
tttaaaggtttttaaa

SEQ ID NO: 287277 - DNA, 16 bp, P. troglodytes
tttaaagtacacaatt

SEQ ID NO: 287278 - DNA, 16 bp, P. troglodytes
tttaaagtagtgtttt

SEQ ID NO: 287279 - DNA, 16 bp, P. troglodytes
tttaaagtagtttctt

SEQ ID NO: 287280 - DNA, 16 bp, P. troglodytes
tttaaagtattttctt

SEQ ID NO: 287281 - DNA, 16 bp, P. troglodytes
tttaaagtatttttct

SEQ ID NO: 287282 - DNA, 16 bp, P. troglodytes
tttaaagtctttgttt

SEQ ID NO: 287283 - DNA, 16 bp, P. troglodytes
tttaaagtgagttttt

SEQ ID NO: 287284 - DNA, 16 bp, P. troglodytes
tttaaagtggatttct

SEQ ID NO: 287285 - DNA, 16 bp, P. troglodytes
tttaaagtggcagttt

SEQ ID NO: 287286 - DNA, 16 bp, P. troglodytes
tttaaagtgtaaaatt

SEQ ID NO: 287287 - DNA, 16 bp, P. troglodytes
tttaaagtgtacaatt

SEQ ID NO: 287288 - DNA, 16 bp, P. troglodytes
tttaaagtgtacattt

SEQ ID NO: 287289 - DNA, 16 bp, P. troglodytes
tttaaagtgtttttct

SEQ ID NO: 287290 - DNA, 16 bp, P. troglodytes
tttaaagttaatttct

SEQ ID NO: 287291 - DNA, 16 bp, P. troglodytes
tttaaagttttcttaa

SEQ ID NO: 287292 - DNA, 16 bp, P. troglodytes
tttaaagtttttcaaa

SEQ ID NO: 287293 - DNA, 16 bp, P. troglodytes
tttaaagtttttgaaa

SEQ ID NO: 287294 - DNA, 16 bp, P. troglodytes
tttaaagtttttttca

SEQ ID NO: 287295 - DNA, 16 bp, P. troglodytes
tttaaataaaagaaca

SEQ ID NO: 287296 - DNA, 16 bp, P. troglodytes
tttaaataaaatgaca

SEQ ID NO: 287297 - DNA, 16 bp, P. troglodytes
tttaaataaaatgtct

SEQ ID NO: 287298 - DNA, 16 bp, P. troglodytes
tttaaataaacaaatg

SEQ ID NO: 287299 - DNA, 16 bp, P. troglodytes
tttaaataaatgagta

SEQ ID NO: 287300 - DNA, 16 bp, P. troglodytes
tttaaataagcaaaaa

SEQ ID NO: 287301 - DNA, 16 bp, P. troglodytes
tttaaataatgcattt

SEQ ID NO: 287302 - DNA, 16 bp, P. troglodytes
tttaaataattgcttt

SEQ ID NO: 287303 - DNA, 16 bp, P. troglodytes
tttaaatacagtaaaa

SEQ ID NO: 287304 - DNA, 16 bp, P. troglodytes
tttaaataccatctat

SEQ ID NO: 287305 - DNA, 16 bp, P. troglodytes
tttaaatagttgaaaa

SEQ ID NO: 287306 - DNA, 16 bp, P. troglodytes
tttaaatatcagaaat

SEQ ID NO: 287307 - DNA, 16 bp, P. troglodytes
tttaaatatctggaaa

SEQ ID NO: 287308 - DNA, 16 bp, P. troglodytes
tttaaatatgcttatt

SEQ ID NO: 287309 - DNA, 16 bp, P. troglodytes
tttaaatatgctttat

SEQ ID NO: 287310 - DNA, 16 bp, P. troglodytes
tttaaatattgctttt

SEQ ID NO: 287311 - DNA, 16 bp, P. troglodytes
tttaaatatttgttct

SEQ ID NO: 287312 - DNA, 16 bp, P. troglodytes
tttaaatattttcagt

SEQ ID NO: 287313 - DNA, 16 bp, P. troglodytes
tttaaatattttgaga

SEQ ID NO: 287314 - DNA, 16 bp, P. troglodytes
tttaaatcagagaaaa

SEQ ID NO: 287315 - DNA, 16 bp, P. troglodytes
tttaaatcaggaagaa

SEQ ID NO: 287316 - DNA, 16 bp, P. troglodytes
tttaaatcaggaagtg

SEQ ID NO: 287317 - DNA, 16 bp, P. troglodytes
tttaaatcagtgtttt

SEQ ID NO: 287318 - DNA, 16 bp, P. troglodytes
tttaaatcatctctag

SEQ ID NO: 287319 - DNA, 16 bp, P. troglodytes
tttaaatccagaattt

SEQ ID NO: 287320 - DNA, 16 bp, P. troglodytes
tttaaatctgtaaaat

SEQ ID NO: 287321 - DNA, 16 bp, P. troglodytes
tttaaatcttttgccc

SEQ ID NO: 287322 - DNA, 16 bp, P. troglodytes
tttaaatgaagaaatt

SEQ ID NO: 287323 - DNA, 16 bp, P. troglodytes
tttaaatgaagatttt

SEQ ID NO: 287324 - DNA, 16 bp, P. troglodytes
tttaaatgacaaataa

SEQ ID NO: 287325 - DNA, 16 bp, P. troglodytes
tttaaatgactttatt

SEQ ID NO: 287326 - DNA, 16 bp, P. troglodytes
tttaaatgagtaaatt

SEQ ID NO: 287327 - DNA, 16 bp, P. troglodytes
tttaaatgcaaaatta

SEQ ID NO: 287328 - DNA, 16 bp, P. troglodytes
tttaaatgcttttaaa

SEQ ID NO: 287329 - DNA, 16 bp, P. troglodytes
tttaaatggaacattt

SEQ ID NO: 287330 - DNA, 16 bp, P. troglodytes
tttaaatggttgaaaa

SEQ ID NO: 287331 - DNA, 16 bp, P. troglodytes
tttaaatgtacagaaa

SEQ ID NO: 287332 - DNA, 16 bp, P. troglodytes
tttaaatgtactattt

SEQ ID NO: 287333 - DNA, 16 bp, P. troglodytes
tttaaatgtaggcatt

SEQ ID NO: 287334 - DNA, 16 bp, P. troglodytes
tttaaatgtcaatttt

SEQ ID NO: 287335 - DNA, 16 bp, P. troglodytes
tttaaatgtcattttt

SEQ ID NO: 287336 - DNA, 16 bp, P. troglodytes
tttaaatgtgaaattt

SEQ ID NO: 287337 - DNA, 16 bp, P. troglodytes
tttaaatgtgtatttc

SEQ ID NO: 287338 - DNA, 16 bp, P. troglodytes
tttaaatgtgtgaatt

SEQ ID NO: 287339 - DNA, 16 bp, P. troglodytes
tttaaatgtgtgtgtg

SEQ ID NO: 287340 - DNA, 16 bp, P. troglodytes
tttaaatgtgtttctt

SEQ ID NO: 287341 - DNA, 16 bp, P. troglodytes
tttaaatgttctgttt

SEQ ID NO: 287342 - DNA, 16 bp, P. troglodytes
tttaaatgttgaaaga

SEQ ID NO: 287343 - DNA, 16 bp, P. troglodytes
tttaaatgtttatcat

SEQ ID NO: 287344 - DNA, 16 bp, P. troglodytes
tttaaatgtttcaaaa

SEQ ID NO: 287345 - DNA, 16 bp, P. troglodytes
tttaaatgtttgcatg

SEQ ID NO: 287346 - DNA, 16 bp, P. troglodytes
tttaaatgttttctta

SEQ ID NO: 287347 - DNA, 16 bp, P. troglodytes
tttaaattaaatgtgt

SEQ ID NO: 287348 - DNA, 16 bp, P. troglodytes
tttaaattacatgaaa

SEQ ID NO: 287349 - DNA, 16 bp, P. troglodytes
tttaaattagttcagc

SEQ ID NO: 287350 - DNA, 16 bp, P. troglodytes
tttaaattcacattta

SEQ ID NO: 287351 - DNA, 16 bp, P. troglodytes
tttaaattcagaaaat

SEQ ID NO: 287352 - DNA, 16 bp, P. troglodytes
tttaaattcatgacca

SEQ ID NO: 287353 - DNA, 16 bp, P. troglodytes
tttaaattctctctct

SEQ ID NO: 287354 - DNA, 16 bp, P. troglodytes
tttaaattctctttca

SEQ ID NO: 287355 - DNA, 16 bp, P. troglodytes
tttaaattgacttttt

SEQ ID NO: 287356 - DNA, 16 bp, P. troglodytes
tttaaattgcttattt

SEQ ID NO: 287357 - DNA, 16 bp, P. troglodytes
tttaaattgtacaatt

SEQ ID NO: 287358 - DNA, 16 bp, P. troglodytes
tttaaattgtcaaaat

SEQ ID NO: 287359 - DNA, 16 bp, P. troglodytes
tttaaattgtttcatt

SEQ ID NO: 287360 - DNA, 16 bp, P. troglodytes
tttaaattgttttcaa

SEQ ID NO: 287361 - DNA, 16 bp, P. troglodytes
tttaaattgtttttca

SEQ ID NO: 287362 - DNA, 16 bp, P. troglodytes
tttaaatttacctata

SEQ ID NO: 287363 - DNA, 16 bp, P. troglodytes
tttaaatttcagcttt

SEQ ID NO: 287364 - DNA, 16 bp, P. troglodytes
tttaaatttctgcctt

SEQ ID NO: 287365 - DNA, 16 bp, P. troglodytes
tttaaatttcttgaga

SEQ ID NO: 287366 - DNA, 16 bp, P. troglodytes
tttaaatttgttgagg

SEQ ID NO: 287367 - DNA, 16 bp, P. troglodytes
tttaaattttcattga

SEQ ID NO: 287368 - DNA, 16 bp, P. troglodytes
tttaaattttctaaac

SEQ ID NO: 287369 - DNA, 16 bp, P. troglodytes
tttaaattttgccaat

SEQ ID NO: 287370 - DNA, 16 bp, P. troglodytes
tttaaattttggaata

SEQ ID NO: 287371 - DNA, 16 bp, P. troglodytes
tttaaattttgtgtag

SEQ ID NO: 287372 - DNA, 16 bp, P. troglodytes
tttaaatttttctgta

SEQ ID NO: 287373 - DNA, 16 bp, P. troglodytes
tttaaatttttgagga

SEQ ID NO: 287374 - DNA, 16 bp, P. troglodytes
tttaacaaaacatttt

SEQ ID NO: 287375 - DNA, 16 bp, P. troglodytes
tttaacaaagaaagaa

SEQ ID NO: 287376 - DNA, 16 bp, P. troglodytes
tttaacaagctcccag

SEQ ID NO: 287377 - DNA, 16 bp, P. troglodytes
tttaacagaagagaaa

SEQ ID NO: 287378 - DNA, 16 bp, P. troglodytes
tttaacagagagaaaa

SEQ ID NO: 287379 - DNA, 16 bp, P. troglodytes
tttaacagagagaatt

SEQ ID NO: 287380 - DNA, 17 bp, P. troglodytes
tttaacagcacccaagt

SEQ ID NO: 287381 - DNA, 16 bp, P. troglodytes
tttaacatgaaagaat

SEQ ID NO: 287382 - DNA, 16 bp, P. troglodytes
tttaacattgaaaaat

SEQ ID NO: 287383 - DNA, 16 bp, P. troglodytes
tttaaccaagaaggta

SEQ ID NO: 287384 - DNA, 16 bp, P. troglodytes
tttaaccaagagaaat

SEQ ID NO: 287385 - DNA, 16 bp, P. troglodytes
tttaaccaggaaaaag

SEQ ID NO: 287386 - DNA, 16 bp, P. troglodytes
tttaacccagaatttc

SEQ ID NO: 287387 - DNA, 16 bp, P. troglodytes
tttaactattgtgaat

SEQ ID NO: 287388 - DNA, 16 bp, P. troglodytes
tttaactcaggtgttt

SEQ ID NO: 287389 - DNA, 16 bp, P. troglodytes
tttaactgatttttaa

SEQ ID NO: 287390 - DNA, 16 bp, P. troglodytes
tttaactggtatatga

SEQ ID NO: 287391 - DNA, 16 bp, P. troglodytes
tttaactgtatttttg

SEQ ID NO: 287392 - DNA, 16 bp, P. troglodytes
tttaacttcttcctgg

SEQ ID NO: 287393 - DNA, 16 bp, P. troglodytes
tttaacttgaaatttt

SEQ ID NO: 287394 - DNA, 16 bp, P. troglodytes
tttaacttgttcctct

SEQ ID NO: 287395 - DNA, 16 bp, P. troglodytes
tttaactttgcttaaa

SEQ ID NO: 287396 - DNA, 16 bp, P. troglodytes
tttaactttgtaagaa

SEQ ID NO: 287397 - DNA, 16 bp, P. troglodytes
tttaactttgttttaa

SEQ ID NO: 287398 - DNA, 16 bp, P. troglodytes
tttaacttttaaaatg

SEQ ID NO: 287399 - DNA, 16 bp, P. troglodytes
tttaacttttaaagaa

SEQ ID NO: 287400 - DNA, 16 bp, P. troglodytes
tttaacttttcagaaa

SEQ ID NO: 287401 - DNA, 16 bp, P. troglodytes
tttaacttttctgtgc

SEQ ID NO: 287402 - DNA, 16 bp, P. troglodytes
tttaactttttgaaaa

SEQ ID NO: 287403 - DNA, 16 bp, P. troglodytes
tttaactttttgagga

SEQ ID NO: 287404 - DNA, 16 bp, P. troglodytes
tttaacttttttgcct

SEQ ID NO: 287405 - DNA, 16 bp, P. troglodytes
tttaagaaaaacaaac

SEQ ID NO: 287406 - DNA, 16 bp, P. troglodytes
tttaagaaaaagtttg

SEQ ID NO: 287407 - DNA, 16 bp, P. troglodytes
tttaagaaaaatatac

SEQ ID NO: 287408 - DNA, 16 bp, P. troglodytes
tttaagaaaacaatat

SEQ ID NO: 287409 - DNA, 16 bp, P. troglodytes
tttaagaaaacagaaa

SEQ ID NO: 287410 - DNA, 16 bp, P. troglodytes
tttaagaaaacatgaa

SEQ ID NO: 287411 - DNA, 16 bp, P. troglodytes
tttaagaaaagtattt

SEQ ID NO: 287412 - DNA, 16 bp, P. troglodytes
tttaagaaaataatca

SEQ ID NO: 287413 - DNA, 16 bp, P. troglodytes
tttaagaaaataatgg

SEQ ID NO: 287414 - DNA, 16 bp, P. troglodytes
tttaagaaaatcattt

SEQ ID NO: 287415 - DNA, 36 bp, P. troglodytes
tttaagaaaatgtggcacatatacaccatggaatac

SEQ ID NO: 287416 - DNA, 16 bp, P. troglodytes
tttaagaaaatttttg

SEQ ID NO: 287417 - DNA, 16 bp, P. troglodytes
tttaagaaacaaaaca

SEQ ID NO: 287418 - DNA, 16 bp, P. troglodytes
tttaagaaacatttaa

SEQ ID NO: 287419 - DNA, 16 bp, P. troglodytes
tttaagaaactgaaaa

SEQ ID NO: 287420 - DNA, 16 bp, P. troglodytes
tttaagaaactttttt

SEQ ID NO: 287421 - DNA, 16 bp, P. troglodytes
tttaagaaagtaaaag

SEQ ID NO: 287422 - DNA, 16 bp, P. troglodytes
tttaagaaagtttaca

SEQ ID NO: 287423 - DNA, 16 bp, P. troglodytes
tttaagaaatacaatt

SEQ ID NO: 287424 - DNA, 16 bp, P. troglodytes
tttaagaaatactttt

SEQ ID NO: 287425 - DNA, 16 bp, P. troglodytes
tttaagaaatagaatt

SEQ ID NO: 287426 - DNA, 16 bp, P. troglodytes
tttaagaaatatattg

SEQ ID NO: 287427 - DNA, 16 bp, P. troglodytes
tttaagaaatgaagaa

SEQ ID NO: 287428 - DNA, 16 bp, P. troglodytes
tttaagaaatgagaaa

SEQ ID NO: 287429 - DNA, 16 bp, P. troglodytes
tttaagaaatgttttc

SEQ ID NO: 287430 - DNA, 20 bp, P. troglodytes
tttaagaactgtaacactca

SEQ ID NO: 287431 - DNA, 16 bp, P. troglodytes
tttaagaatgctgaat

SEQ ID NO: 287432 - DNA, 16 bp, P. troglodytes
tttaagaatttgaaaa

SEQ ID NO: 287433 - DNA, 16 bp, P. troglodytes
tttaagaatttttctt

SEQ ID NO: 287434 - DNA, 16 bp, P. troglodytes
tttaagacaaatgaaa

SEQ ID NO: 287435 - DNA, 16 bp, P. troglodytes
tttaagacaattataa

SEQ ID NO: 287436 - DNA, 16 bp, P. troglodytes
tttaagacggagtctc

SEQ ID NO: 287437 - DNA, 16 bp, P. troglodytes
tttaagactttaaaaa

SEQ ID NO: 287438 - DNA, 17 bp, P. troglodytes
tttaagagactcctgta

SEQ ID NO: 287439 - DNA, 16 bp, P. troglodytes
tttaagaggagaaaaa

SEQ ID NO: 287440 - DNA, 16 bp, P. troglodytes
tttaagaggtggggtc

SEQ ID NO: 287441 - DNA, 16 bp, P. troglodytes
tttaagagtttctttt

SEQ ID NO: 287442 - DNA, 16 bp, P. troglodytes
tttaagatcagcctga

SEQ ID NO: 287443 - DNA, 16 bp, P. troglodytes
tttaagatttattttc

SEQ ID NO: 287444 - DNA, 16 bp, P. troglodytes
tttaagcagaggagtg

SEQ ID NO: 287445 - DNA, 16 bp, P. troglodytes
tttaagcatttaaaaa

SEQ ID NO: 287446 - DNA, 16 bp, P. troglodytes
tttaagcatttatttt

SEQ ID NO: 287447 - DNA, 16 bp, P. troglodytes
tttaagcatttcttgt

SEQ ID NO: 287448 - DNA, 16 bp, P. troglodytes
tttaagctgctaattt

SEQ ID NO: 287449 - DNA, 16 bp, P. troglodytes
tttaagcttttaaaaa

SEQ ID NO: 287450 - DNA, 16 bp, P. troglodytes
tttaaggaaaatatat

SEQ ID NO: 287451 - DNA, 16 bp, P. troglodytes
tttaaggaaacatttt

SEQ ID NO: 287452 - DNA, 16 bp, P. troglodytes
tttaaggaaagaaaat

SEQ ID NO: 287453 - DNA, 16 bp, P. troglodytes
tttaaggaaagaaacc

SEQ ID NO: 287454 - DNA, 16 bp, P. troglodytes
tttaaggaatggaaag

SEQ ID NO: 287455 - DNA, 16 bp, P. troglodytes
tttaagggactcacag

SEQ ID NO: 287456 - DNA, 16 bp, P. troglodytes
tttaaggtcttctctg

SEQ ID NO: 287457 - DNA, 16 bp, P. troglodytes
tttaaggtgatagata

SEQ ID NO: 287458 - DNA, 16 bp, P. troglodytes
tttaagtcattttaaa

SEQ ID NO: 287459 - DNA, 16 bp, P. troglodytes
tttaagtcatttttta

SEQ ID NO: 287460 - DNA, 16 bp, P. troglodytes
tttaagtctattgttt

SEQ ID NO: 287461 - DNA, 16 bp, P. troglodytes
tttaagtctgatgttt

SEQ ID NO: 287462 - DNA, 16 bp, P. troglodytes
tttaagtctgcagatg

SEQ ID NO: 287463 - DNA, 16 bp, P. troglodytes
tttaagtctttgattt

SEQ ID NO: 287464 - DNA, 16 bp, P. troglodytes
tttaagtgaagatatt

SEQ ID NO: 287465 - DNA, 16 bp, P. troglodytes
tttaagtggaatattt

SEQ ID NO: 287466 - DNA, 16 bp, P. troglodytes
tttaagtggttttcca

SEQ ID NO: 287467 - DNA, 16 bp, P. troglodytes
tttaagtgtacagtta

SEQ ID NO: 287468 - DNA, 18 bp, P. troglodytes
tttaagttctgggataca

SEQ ID NO: 287469 - DNA, 19 bp, P. troglodytes
tttaagttctggggtacat

SEQ ID NO: 287470 - DNA, 16 bp, P. troglodytes
tttaagttctttgcag

SEQ ID NO: 287471 - DNA, 16 bp, P. troglodytes
tttaagtttcctgagg

SEQ ID NO: 287472 - DNA, 16 bp, P. troglodytes
tttaagttttaatcca

SEQ ID NO: 287473 - DNA, 16 bp, P. troglodytes
tttaagtttttaaaag

SEQ ID NO: 287474 - DNA, 16 bp, P. troglodytes
tttaataaaaacagct

SEQ ID NO: 287475 - DNA, 16 bp, P. troglodytes
tttaataaaagctttt

SEQ ID NO: 287476 - DNA, 16 bp, P. troglodytes
tttaataaatagggaa

SEQ ID NO: 287477 - DNA, 16 bp, P. troglodytes
tttaataaattttcac

SEQ ID NO: 287478 - DNA, 16 bp, P. troglodytes
tttaataaggacacca

SEQ ID NO: 287479 - DNA, 16 bp, P. troglodytes
tttaatacagaaaaaa

SEQ ID NO: 287480 - DNA, 16 bp, P. troglodytes
tttaatagacttacag

SEQ ID NO: 287481 - DNA, 16 bp, P. troglodytes
tttaatagagagaggg

SEQ ID NO: 287482 - DNA, 16 bp, P. troglodytes
tttaatagagatggga

SEQ ID NO: 287483 - DNA, 16 bp, P. troglodytes
tttaatattttcatgt

SEQ ID NO: 287484 - DNA, 16 bp, P. troglodytes
tttaatcatgaagaaa

SEQ ID NO: 287485 - DNA, 16 bp, P. troglodytes
tttaatcatgaatgga

SEQ ID NO: 287486 - DNA, 16 bp, P. troglodytes
tttaatcccagctact

SEQ ID NO: 287487 - DNA, 16 bp, P. troglodytes
tttaatcccagttact

SEQ ID NO: 287488 - DNA, 16 bp, P. troglodytes
tttaatcctcataaga

SEQ ID NO: 287489 - DNA, 16 bp, P. troglodytes
tttaatccttcttgaa

SEQ ID NO: 287490 - DNA, 16 bp, P. troglodytes
tttaatctgtttacat

SEQ ID NO: 287491 - DNA, 16 bp, P. troglodytes
tttaatctgttttata

SEQ ID NO: 287492 - DNA, 16 bp, P. troglodytes
tttaatcttcaaatat

SEQ ID NO: 287493 - DNA, 16 bp, P. troglodytes
tttaatcttcacaata

SEQ ID NO: 287494 - DNA, 16 bp, P. troglodytes
tttaatctttttaaag

SEQ ID NO: 287495 - DNA, 16 bp, P. troglodytes
tttaatgaaaaaagtt

SEQ ID NO: 287496 - DNA, 16 bp, P. troglodytes
tttaatgaaaagcaac

SEQ ID NO: 287497 - DNA, 16 bp, P. troglodytes
tttaatgaaaagcagc

SEQ ID NO: 287498 - DNA, 16 bp, P. troglodytes
tttaatgaaaatgaat

SEQ ID NO: 287499 - DNA, 16 bp, P. troglodytes
tttaatgaaatcaaat

SEQ ID NO: 287500 - DNA, 16 bp, P. troglodytes
tttaatgaagagaaaa

SEQ ID NO: 287501 - DNA, 16 bp, P. troglodytes
tttaatgaatacattt

SEQ ID NO: 287502 - DNA, 16 bp, P. troglodytes
tttaatgactgcccag

SEQ ID NO: 287503 - DNA, 16 bp, P. troglodytes
tttaatgatcaccgtt

SEQ ID NO: 287504 - DNA, 16 bp, P. troglodytes
tttaatgatgagaaaa

SEQ ID NO: 287505 - DNA, 16 bp, P. troglodytes
tttaatgatttccatt

SEQ ID NO: 287506 - DNA, 16 bp, P. troglodytes
tttaatgcattttaaa

SEQ ID NO: 287507 - DNA, 16 bp, P. troglodytes
tttaatgcatttttaa

SEQ ID NO: 287508 - DNA, 16 bp, P. troglodytes
tttaatgccttttatt

SEQ ID NO: 287509 - DNA, 16 bp, P. troglodytes
tttaatgcttttaaaa

SEQ ID NO: 287510 - DNA, 16 bp, P. troglodytes
tttaatggaattgttg

SEQ ID NO: 287511 - DNA, 16 bp, P. troglodytes
tttaatggggttattt

SEQ ID NO: 287512 - DNA, 16 bp, P. troglodytes
tttaatgtaaatgaat

SEQ ID NO: 287513 - DNA, 16 bp, P. troglodytes
tttaatgtaatcattt

SEQ ID NO: 287514 - DNA, 16 bp, P. troglodytes
tttaatgtctttgtct

SEQ ID NO: 287515 - DNA, 16 bp, P. troglodytes
tttaatgtgaagtttt

SEQ ID NO: 287516 - DNA, 16 bp, P. troglodytes
tttaatgtgtacaatt

SEQ ID NO: 287517 - DNA, 16 bp, P. troglodytes
tttaatgttcatattt

SEQ ID NO: 287518 - DNA, 16 bp, P. troglodytes
tttaatgtttgaaaat

SEQ ID NO: 287519 - DNA, 16 bp, P. troglodytes
tttaatgttttagaaa

SEQ ID NO: 287520 - DNA, 16 bp, P. troglodytes
tttaattaaatcccac

SEQ ID NO: 287521 - DNA, 27 bp, P. troglodytes
tttaattagatcccatttgtcaatttt

SEQ ID NO: 287522 - DNA, 16 bp, P. troglodytes
tttaattaggtcccat

SEQ ID NO: 287523 - DNA, 16 bp, P. troglodytes
tttaattagtcaggca

SEQ ID NO: 287524 - DNA, 16 bp, P. troglodytes
tttaattctcataaca

SEQ ID NO: 287525 - DNA, 16 bp, P. troglodytes
tttaattctctcaaca

SEQ ID NO: 287526 - DNA, 16 bp, P. troglodytes
tttaattgacatttat

SEQ ID NO: 287527 - DNA, 16 bp, P. troglodytes
tttaattgcttaaaaa

SEQ ID NO: 287528 - DNA, 16 bp, P. troglodytes
tttaattgcttttaaa

SEQ ID NO: 287529 - DNA, 16 bp, P. troglodytes
tttaattggcaaataa

SEQ ID NO: 287530 - DNA, 16 bp, P. troglodytes
tttaattggcattttt

SEQ ID NO: 287531 - DNA, 16 bp, P. troglodytes
tttaattgtgacatta

SEQ ID NO: 287532 - DNA, 16 bp, P. troglodytes
tttaattgtggtaaaa

SEQ ID NO: 287533 - DNA, 16 bp, P. troglodytes
tttaatttactcacag

SEQ ID NO: 287534 - DNA, 16 bp, P. troglodytes
tttaatttatggaaaa

SEQ ID NO: 287535 - DNA, 16 bp, P. troglodytes
tttaatttcaaatgtt

SEQ ID NO: 287536 - DNA, 16 bp, P. troglodytes
tttaatttcagaaatg

SEQ ID NO: 287537 - DNA, 16 bp, P. troglodytes
tttaatttcagccatt

SEQ ID NO: 287538 - DNA, 16 bp, P. troglodytes
tttaatttcattgatt

SEQ ID NO: 287539 - DNA, 16 bp, P. troglodytes
tttaatttccaagtat

SEQ ID NO: 287540 - DNA, 16 bp, P. troglodytes
tttaatttccataaat

SEQ ID NO: 287541 - DNA, 16 bp, P. troglodytes
tttaatttctctgagc

SEQ ID NO: 287542 - DNA, 16 bp, P. troglodytes
tttaatttgcatatgt

SEQ ID NO: 287543 - DNA, 16 bp, P. troglodytes
tttaatttgtcaattt

SEQ ID NO: 287544 - DNA, 16 bp, P. troglodytes
tttaatttgttgtaga

SEQ ID NO: 287545 - DNA, 16 bp, P. troglodytes
tttaattttagagaaa

SEQ ID NO: 287546 - DNA, 16 bp, P. troglodytes
tttaattttagccatt

SEQ ID NO: 287547 - DNA, 16 bp, P. troglodytes
tttaattttcacaaaa

SEQ ID NO: 287548 - DNA, 16 bp, P. troglodytes
tttaattttcagctcc

SEQ ID NO: 287549 - DNA, 16 bp, P. troglodytes
tttaattttccatttg

SEQ ID NO: 287550 - DNA, 16 bp, P. troglodytes
tttaattttctaaaga

SEQ ID NO: 287551 - DNA, 16 bp, P. troglodytes
tttaattttgaaagat

SEQ ID NO: 287552 - DNA, 16 bp, P. troglodytes
tttaattttgatgaaa

SEQ ID NO: 287553 - DNA, 16 bp, P. troglodytes
tttaattttgtttgca

SEQ ID NO: 287554 - DNA, 16 bp, P. troglodytes
tttaatttttctaaag

SEQ ID NO: 287555 - DNA, 16 bp, P. troglodytes
tttaatttttctaatg

SEQ ID NO: 287556 - DNA, 16 bp, P. troglodytes
tttaatttttgaagaa

SEQ ID NO: 287557 - DNA, 16 bp, P. troglodytes
tttaatttttgccatt

SEQ ID NO: 287558 - DNA, 16 bp, P. troglodytes
tttaattttttctgga

SEQ ID NO: 287559 - DNA, 16 bp, P. troglodytes
tttacaaaaaatgcaa

SEQ ID NO: 287560 - DNA, 16 bp, P. troglodytes
tttacaaaaatgttta

SEQ ID NO: 287561 - DNA, 16 bp, P. troglodytes
tttacaaaagaaagaa

SEQ ID NO: 287562 - DNA, 16 bp, P. troglodytes
tttacaaaagaagaaa

SEQ ID NO: 287563 - DNA, 16 bp, P. troglodytes
tttacaaaaggagaaa

SEQ ID NO: 287564 - DNA, 16 bp, P. troglodytes
tttacaaaataaagaa

SEQ ID NO: 287565 - DNA, 16 bp, P. troglodytes
tttacaaaatatttcc

SEQ ID NO: 287566 - DNA, 16 bp, P. troglodytes
tttacaaaatggaaaa

SEQ ID NO: 287567 - DNA, 16 bp, P. troglodytes
tttacaaaatggagat

SEQ ID NO: 287568 - DNA, 16 bp, P. troglodytes
tttacaaaatgtaaaa

SEQ ID NO: 287569 - DNA, 16 bp, P. troglodytes
tttacaaacaaggaaa

SEQ ID NO: 287570 - DNA, 20 bp, P. troglodytes
tttacaaaccttgagctaga

SEQ ID NO: 287571 - DNA, 16 bp, P. troglodytes
tttacaaactgctgaa

SEQ ID NO: 287572 - DNA, 16 bp, P. troglodytes
tttacaaagaaagaaa

SEQ ID NO: 287573 - DNA, 16 bp, P. troglodytes
tttacaaagaaagaga

SEQ ID NO: 287574 - DNA, 16 bp, P. troglodytes
tttacaaagaaggaaa

SEQ ID NO: 287575 - DNA, 16 bp, P. troglodytes
tttacaaagcactttc

SEQ ID NO: 287576 - DNA, 16 bp, P. troglodytes
tttacaaagccctttc

SEQ ID NO: 287577 - DNA, 16 bp, P. troglodytes
tttacaaagtgctttc

SEQ ID NO: 287578 - DNA, 16 bp, P. troglodytes
tttacaaataaagaaa

SEQ ID NO: 287579 - DNA, 16 bp, P. troglodytes
tttacaaataaggaaa

SEQ ID NO: 287580 - DNA, 16 bp, P. troglodytes
tttacaaatagaaaat

SEQ ID NO: 287581 - DNA, 16 bp, P. troglodytes
tttacaaatgaagaga

SEQ ID NO: 287582 - DNA, 16 bp, P. troglodytes
tttacaaatgagaaaa

SEQ ID NO: 287583 - DNA, 16 bp, P. troglodytes
tttacaaatgagagaa

SEQ ID NO: 287584 - DNA, 16 bp, P. troglodytes
tttacaaatgaggaaa

SEQ ID NO: 287585 - DNA, 16 bp, P. troglodytes
tttacaaatgaggaga

SEQ ID NO: 287586 - DNA, 16 bp, P. troglodytes
tttacaaatgtggaaa

SEQ ID NO: 287587 - DNA, 16 bp, P. troglodytes
tttacaaattatccag

SEQ ID NO: 287588 - DNA, 16 bp, P. troglodytes
tttacaacaaatattt

SEQ ID NO: 287589 - DNA, 16 bp, P. troglodytes
tttacaacctgctctc

SEQ ID NO: 287590 - DNA, 16 bp, P. troglodytes
tttacaactgaagaaa

SEQ ID NO: 287591 - DNA, 16 bp, P. troglodytes
tttacaacttttaaaa

SEQ ID NO: 287592 - DNA, 16 bp, P. troglodytes
tttacaagaaaaaaca

SEQ ID NO: 287593 - DNA, 16 bp, P. troglodytes
tttacaagaaaaagac

SEQ ID NO: 287594 - DNA, 16 bp, P. troglodytes
tttacaagaaaataat

SEQ ID NO: 287595 - DNA, 16 bp, P. troglodytes
tttacaagaaactttt

SEQ ID NO: 287596 - DNA, 16 bp, P. troglodytes
tttacaagagctcctg

SEQ ID NO: 287597 - DNA, 16 bp, P. troglodytes
tttacaaggaactcaa

SEQ ID NO: 287598 - DNA, 16 bp, P. troglodytes
tttacaagtgaggaaa

SEQ ID NO: 287599 - DNA, 16 bp, P. troglodytes
tttacaataatttgta

SEQ ID NO: 287600 - DNA, 20 bp, P. troglodytes
tttacaatccctgagctaga

SEQ ID NO: 287601 - DNA, 16 bp, P. troglodytes
tttacaatgaagaaat

SEQ ID NO: 287602 - DNA, 16 bp, P. troglodytes
tttacaattaagaaaa

SEQ ID NO: 287603 - DNA, 16 bp, P. troglodytes
tttacaatttacaaag

SEQ ID NO: 287604 - DNA, 16 bp, P. troglodytes
tttacaatttttaatg

SEQ ID NO: 287605 - DNA, 16 bp, P. troglodytes
tttacacaagaagaaa

SEQ ID NO: 287606 - DNA, 16 bp, P. troglodytes
tttacacatattaact

SEQ ID NO: 287607 - DNA, 16 bp, P. troglodytes
tttacacatatttttg

SEQ ID NO: 287608 - DNA, 16 bp, P. troglodytes
tttacacatccagtta

SEQ ID NO: 287609 - DNA, 16 bp, P. troglodytes
tttacacatgaggaaa

SEQ ID NO: 287610 - DNA, 16 bp, P. troglodytes
tttacaccaaaataaa

SEQ ID NO: 287611 - DNA, 16 bp, P. troglodytes
tttacacctatgtttt

SEQ ID NO: 287612 - DNA, 16 bp, P. troglodytes
tttacactacaggaat

SEQ ID NO: 287613 - DNA, 16 bp, P. troglodytes
tttacactgccagttt

SEQ ID NO: 287614 - DNA, 16 bp, P. troglodytes
tttacactgttgggag

SEQ ID NO: 287615 - DNA, 16 bp, P. troglodytes
tttacacttaaaaatt

SEQ ID NO: 287616 - DNA, 16 bp, P. troglodytes
tttacactttaaaaaa

SEQ ID NO: 287617 - DNA, 16 bp, P. troglodytes
tttacagaaaaagttt

SEQ ID NO: 287618 - DNA, 16 bp, P. troglodytes
tttacagaaaaggaaa

SEQ ID NO: 287619 - DNA, 16 bp, P. troglodytes
tttacagaaaagtttg

SEQ ID NO: 287620 - DNA, 16 bp, P. troglodytes
tttacagaaacatttt

SEQ ID NO: 287621 - DNA, 16 bp, P. troglodytes
tttacagaagaggaaa

SEQ ID NO: 287622 - DNA, 16 bp, P. troglodytes
tttacagacaaggaaa

SEQ ID NO: 287623 - DNA, 16 bp, P. troglodytes
tttacagacagagaaa

SEQ ID NO: 287624 - DNA, 16 bp, P. troglodytes
tttacagagaagcaaa

SEQ ID NO: 287625 - DNA, 16 bp, P. troglodytes
tttacagataaagtaa

SEQ ID NO: 287626 - DNA, 16 bp, P. troglodytes
tttacagatatggaaa

SEQ ID NO: 287627 - DNA, 16 bp, P. troglodytes
tttacagatattttct

SEQ ID NO: 287628 - DNA, 16 bp, P. troglodytes
tttacagatcaagaaa

SEQ ID NO: 287629 - DNA, 16 bp, P. troglodytes
tttacagatgaaaata

SEQ ID NO: 287630 - DNA, 16 bp, P. troglodytes
tttacagatgaagaaa

SEQ ID NO: 287631 - DNA, 16 bp, P. troglodytes
tttacagatgaagaac

SEQ ID NO: 287632 - DNA, 16 bp, P. troglodytes
tttacagatgacataa

SEQ ID NO: 287633 - DNA, 16 bp, P. troglodytes
tttacagatgagaaaa

SEQ ID NO: 287634 - DNA, 16 bp, P. troglodytes
tttacagatgagaaca

SEQ ID NO: 287635 - DNA, 16 bp, P. troglodytes
tttacagatgaggaaa

SEQ ID NO: 287636 - DNA, 16 bp, P. troglodytes
tttacagatgaggaag

SEQ ID NO: 287637 - DNA, 16 bp, P. troglodytes
tttacagatgcggaaa

SEQ ID NO: 287638 - DNA, 16 bp, P. troglodytes
tttacagatgggcaaa

SEQ ID NO: 287639 - DNA, 16 bp, P. troglodytes
tttacagatggggaaa

SEQ ID NO: 287640 - DNA, 16 bp, P. troglodytes
tttacagattcattgc

SEQ ID NO: 287641 - DNA, 16 bp, P. troglodytes
tttacagattgagaaa

SEQ ID NO: 287642 - DNA, 16 bp, P. troglodytes
tttacagatttgtgtt

SEQ ID NO: 287643 - DNA, 16 bp, P. troglodytes
tttacaggaaaaaaaa

SEQ ID NO: 287644 - DNA, 16 bp, P. troglodytes
tttacaggaagaaaaa

SEQ ID NO: 287645 - DNA, 16 bp, P. troglodytes
tttacaggagaggaaa

SEQ ID NO: 287646 - DNA, 16 bp, P. troglodytes
tttacaggcaaggaaa

SEQ ID NO: 287647 - DNA, 16 bp, P. troglodytes
tttacaggggagaaaa

SEQ ID NO: 287648 - DNA, 16 bp, P. troglodytes
tttacaggtgaaaaaa

SEQ ID NO: 287649 - DNA, 16 bp, P. troglodytes
tttacaggtgagcaaa

SEQ ID NO: 287650 - DNA, 16 bp, P. troglodytes
tttacagtgagtttta

SEQ ID NO: 287651 - DNA, 16 bp, P. troglodytes
tttacagttaagaaaa

SEQ ID NO: 287652 - DNA, 16 bp, P. troglodytes
tttacagttaaggaaa

SEQ ID NO: 287653 - DNA, 16 bp, P. troglodytes
tttacagttgaagaaa

SEQ ID NO: 287654 - DNA, 16 bp, P. troglodytes
tttacagtttaaaaaa

SEQ ID NO: 287655 - DNA, 16 bp, P. troglodytes
tttacagttttcaaaa

SEQ ID NO: 287656 - DNA, 16 bp, P. troglodytes
tttacagttttgcatt

SEQ ID NO: 287657 - DNA, 16 bp, P. troglodytes
tttacataaatacata

SEQ ID NO: 287658 - DNA, 16 bp, P. troglodytes
tttacataaatggtat

SEQ ID NO: 287659 - DNA, 16 bp, P. troglodytes
tttacataagaagaaa

SEQ ID NO: 287660 - DNA, 16 bp, P. troglodytes
tttacatacacacaca

SEQ ID NO: 287661 - DNA, 16 bp, P. troglodytes
tttacatacagtgaaa

SEQ ID NO: 287662 - DNA, 16 bp, P. troglodytes
tttacatataaaatgt

SEQ ID NO: 287663 - DNA, 16 bp, P. troglodytes
tttacatatatttgta

SEQ ID NO: 287664 - DNA, 16 bp, P. troglodytes
tttacatcagggttca

SEQ ID NO: 287665 - DNA, 16 bp, P. troglodytes
tttacatccccaccag

SEQ ID NO: 287666 - DNA, 16 bp, P. troglodytes
tttacatcttacattt

SEQ ID NO: 287667 - DNA, 16 bp, P. troglodytes
tttacatgcattatct

SEQ ID NO: 287668 - DNA, 16 bp, P. troglodytes
tttacatgcattttta

SEQ ID NO: 287669 - DNA, 16 bp, P. troglodytes
tttacatgtacatttt

SEQ ID NO: 287670 - DNA, 16 bp, P. troglodytes
tttacatgtatatatt

SEQ ID NO: 287671 - DNA, 16 bp, P. troglodytes
tttacatgtattatct

SEQ ID NO: 287672 - DNA, 16 bp, P. troglodytes
tttacatgtattattt

SEQ ID NO: 287673 - DNA, 16 bp, P. troglodytes
tttacatgtcaacttg

SEQ ID NO: 287674 - DNA, 16 bp, P. troglodytes
tttacatgttgtctat

SEQ ID NO: 287675 - DNA, 16 bp, P. troglodytes
tttacattcaagttta

SEQ ID NO: 287676 - DNA, 16 bp, P. troglodytes
tttacattcccaccag

SEQ ID NO: 287677 - DNA, 16 bp, P. troglodytes
tttacattcccattaa

SEQ ID NO: 287678 - DNA, 16 bp, P. troglodytes
tttacattgatgttca

SEQ ID NO: 287679 - DNA, 16 bp, P. troglodytes
tttacatttaaggtta

SEQ ID NO: 287680 - DNA, 16 bp, P. troglodytes
tttacatttaagtttt

SEQ ID NO: 287681 - DNA, 16 bp, P. troglodytes
tttacatttaatatga

SEQ ID NO: 287682 - DNA, 16 bp, P. troglodytes
tttacatttaatgtaa

SEQ ID NO: 287683 - DNA, 16 bp, P. troglodytes
tttacatttatttaga

SEQ ID NO: 287684 - DNA, 16 bp, P. troglodytes
tttacatttccaacaa

SEQ ID NO: 287685 - DNA, 16 bp, P. troglodytes
tttacatttccctaat

SEQ ID NO: 287686 - DNA, 16 bp, P. troglodytes
tttacatttgtaattt

SEQ ID NO: 287687 - DNA, 16 bp, P. troglodytes
tttacattttatcaag

SEQ ID NO: 287688 - DNA, 16 bp, P. troglodytes
tttacattttcaaata

SEQ ID NO: 287689 - DNA, 16 bp, P. troglodytes
tttacattttcataaa

SEQ ID NO: 287690 - DNA, 16 bp, P. troglodytes
tttacattttgaagac

SEQ ID NO: 287691 - DNA, 16 bp, P. troglodytes
tttacattttgataaa

SEQ ID NO: 287692 - DNA, 16 bp, P. troglodytes
tttacattttggcatg

SEQ ID NO: 287693 - DNA, 16 bp, P. troglodytes
tttacattttgtaaaa

SEQ ID NO: 287694 - DNA, 16 bp, P. troglodytes
tttacatttttaaagt

SEQ ID NO: 287695 - DNA, 16 bp, P. troglodytes
tttacatttttaaatg

SEQ ID NO: 287696 - DNA, 16 bp, P. troglodytes
tttacatttttctgat

SEQ ID NO: 287697 - DNA, 16 bp, P. troglodytes
tttacatttttgtatg

SEQ ID NO: 287698 - DNA, 16 bp, P. troglodytes
tttacattttttaaag

SEQ ID NO: 287699 - DNA, 16 bp, P. troglodytes
tttacattttttgtag

SEQ ID NO: 287700 - DNA, 16 bp, P. troglodytes
tttaccaaagaagata

SEQ ID NO: 287701 - DNA, 16 bp, P. troglodytes
tttaccaaatatttta

SEQ ID NO: 287702 - DNA, 16 bp, P. troglodytes
tttaccaaatgcctgt

SEQ ID NO: 287703 - DNA, 16 bp, P. troglodytes
tttaccaagaaaatgg

SEQ ID NO: 287704 - DNA, 16 bp, P. troglodytes
tttaccaaggttttga

SEQ ID NO: 287705 - DNA, 16 bp, P. troglodytes
tttaccagtgaggaaa

SEQ ID NO: 287706 - DNA, 16 bp, P. troglodytes
tttaccatgatgtgat

SEQ ID NO: 287707 - DNA, 16 bp, P. troglodytes
tttaccatgttggcta

SEQ ID NO: 287708 - DNA, 16 bp, P. troglodytes
tttacccaaaagaaaa

SEQ ID NO: 287709 - DNA, 16 bp, P. troglodytes
tttacccagtattcat

SEQ ID NO: 287710 - DNA, 16 bp, P. troglodytes
tttacctaatgtcttt

SEQ ID NO: 287711 - DNA, 16 bp, P. troglodytes
tttacctcctcttctg

SEQ ID NO: 287712 - DNA, 16 bp, P. troglodytes
tttacctctgtggtct

SEQ ID NO: 287713 - DNA, 16 bp, P. troglodytes
tttacctgcattatct

SEQ ID NO: 287714 - DNA, 16 bp, P. troglodytes
tttacctgcctcagcc

SEQ ID NO: 287715 - DNA, 16 bp, P. troglodytes
tttaccttcaaaatat

SEQ ID NO: 287716 - DNA, 16 bp, P. troglodytes
tttaccttgttgggtg

SEQ ID NO: 287717 - DNA, 16 bp, P. troglodytes
tttacctttctgtgcc

SEQ ID NO: 287718 - DNA, 16 bp, P. troglodytes
tttaccttttctatgt

SEQ ID NO: 287719 - DNA, 16 bp, P. troglodytes
tttacgtgtgtgtgtg

SEQ ID NO: 287720 - DNA, 16 bp, P. troglodytes
tttactaaaaatcatt

SEQ ID NO: 287721 - DNA, 16 bp, P. troglodytes
tttactaaatatacaa

SEQ ID NO: 287722 - DNA, 16 bp, P. troglodytes
tttactattatgtaat

SEQ ID NO: 287723 - DNA, 16 bp, P. troglodytes
tttactatttggccct

SEQ ID NO: 287724 - DNA, 16 bp, P. troglodytes
tttactatttggcctt

SEQ ID NO: 287725 - DNA, 16 bp, P. troglodytes
tttactccacatcctt

SEQ ID NO: 287726 - DNA, 16 bp, P. troglodytes
tttactccatttacat

SEQ ID NO: 287727 - DNA, 16 bp, P. troglodytes
tttactctatggactt

SEQ ID NO: 287728 - DNA, 16 bp, P. troglodytes
tttactctgttgatag

SEQ ID NO: 287729 - DNA, 16 bp, P. troglodytes
tttactcttttcacat

SEQ ID NO: 287730 - DNA, 16 bp, P. troglodytes
tttactgaaacatttt

SEQ ID NO: 287731 - DNA, 16 bp, P. troglodytes
tttactgaaatatttt

SEQ ID NO: 287732 - DNA, 16 bp, P. troglodytes
tttactgaaattttat

SEQ ID NO: 287733 - DNA, 16 bp, P. troglodytes
tttactgaacatttta

SEQ ID NO: 287734 - DNA, 16 bp, P. troglodytes
tttactgaatacttac

SEQ ID NO: 287735 - DNA, 16 bp, P. troglodytes
tttactgaatatattt

SEQ ID NO: 287736 - DNA, 16 bp, P. troglodytes
tttactgaatttttat

SEQ ID NO: 287737 - DNA, 16 bp, P. troglodytes
tttactgacaatgatg

SEQ ID NO: 287738 - DNA, 16 bp, P. troglodytes
tttactgagaacctac

SEQ ID NO: 287739 - DNA, 16 bp, P. troglodytes
tttactgagcatgaga

SEQ ID NO: 287740 - DNA, 16 bp, P. troglodytes
tttactgaggtatgat

SEQ ID NO: 287741 - DNA, 16 bp, P. troglodytes
tttactgataagaaaa

SEQ ID NO: 287742 - DNA, 16 bp, P. troglodytes
tttactgatgaggaaa

SEQ ID NO: 287743 - DNA, 16 bp, P. troglodytes
tttactgattttcaaa

SEQ ID NO: 287744 - DNA, 16 bp, P. troglodytes
tttactgtaacttttc

SEQ ID NO: 287745 - DNA, 16 bp, P. troglodytes
tttactgtatttttaa

SEQ ID NO: 287746 - DNA, 16 bp, P. troglodytes
tttactgttgttttaa

SEQ ID NO: 287747 - DNA, 16 bp, P. troglodytes
tttactgtttaaaatg

SEQ ID NO: 287748 - DNA, 16 bp, P. troglodytes
tttacttaaaatatct

SEQ ID NO: 287749 - DNA, 16 bp, P. troglodytes
tttacttaaagtctat

SEQ ID NO: 287750 - DNA, 16 bp, P. troglodytes
tttacttcaaaatatt

SEQ ID NO: 287751 - DNA, 16 bp, P. troglodytes
tttacttcatcctctc

SEQ ID NO: 287752 - DNA, 16 bp, P. troglodytes
tttactttatccagtc

SEQ ID NO: 287753 - DNA, 16 bp, P. troglodytes
tttactttatgaactt

SEQ ID NO: 287754 - DNA, 16 bp, P. troglodytes
tttactttgttaataa

SEQ ID NO: 287755 - DNA, 16 bp, P. troglodytes
tttactttgttgatag

SEQ ID NO: 287756 - DNA, 16 bp, P. troglodytes
tttactttgttttaaa

SEQ ID NO: 287757 - DNA, 16 bp, P. troglodytes
tttacttttaacctat

SEQ ID NO: 287758 - DNA, 16 bp, P. troglodytes
tttacttttaagaaat

SEQ ID NO: 287759 - DNA, 16 bp, P. troglodytes
tttacttttcaaaata

SEQ ID NO: 287760 - DNA, 16 bp, P. troglodytes
tttactttttaaaaca

SEQ ID NO: 287761 - DNA, 16 bp, P. troglodytes
tttactttttaaaatg

SEQ ID NO: 287762 - DNA, 16 bp, P. troglodytes
tttactttttaaagta

SEQ ID NO: 287763 - DNA, 16 bp, P. troglodytes
tttactttttcaaaga

SEQ ID NO: 287764 - DNA, 16 bp, P. troglodytes
tttactttttctgtaa

SEQ ID NO: 287765 - DNA, 16 bp, P. troglodytes
tttagaaaaaaattgt

SEQ ID NO: 287766 - DNA, 16 bp, P. troglodytes
tttagaaaaacagttt

SEQ ID NO: 287767 - DNA, 16 bp, P. troglodytes
tttagaaaaagagaag

SEQ ID NO: 287768 - DNA, 16 bp, P. troglodytes
tttagaaaaatggaaa

SEQ ID NO: 287769 - DNA, 16 bp, P. troglodytes
tttagaaaacaatttt

SEQ ID NO: 287770 - DNA, 16 bp, P. troglodytes
tttagaaaactttaaa

SEQ ID NO: 287771 - DNA, 16 bp, P. troglodytes
tttagaaaagaaagga

SEQ ID NO: 287772 - DNA, 16 bp, P. troglodytes
tttagaaaagaacata

SEQ ID NO: 287773 - DNA, 16 bp, P. troglodytes
tttagaaaataaactt

SEQ ID NO: 287774 - DNA, 16 bp, P. troglodytes
tttagaaaataaagtt

SEQ ID NO: 287775 - DNA, 16 bp, P. troglodytes
tttagaaaatacattt

SEQ ID NO: 287776 - DNA, 16 bp, P. troglodytes
tttagaaaatgaagaa

SEQ ID NO: 287777 - DNA, 16 bp, P. troglodytes
tttagaaaatgtgttt

SEQ ID NO: 287778 - DNA, 16 bp, P. troglodytes
tttagaaaatgttaaa

SEQ ID NO: 287779 - DNA, 16 bp, P. troglodytes
tttagaaaattctaaa

SEQ ID NO: 287780 - DNA, 16 bp, P. troglodytes
tttagaaaattctttt

SEQ ID NO: 287781 - DNA, 16 bp, P. troglodytes
tttagaaaatttgcaa

SEQ ID NO: 287782 - DNA, 16 bp, P. troglodytes
tttagaaacacaaata

SEQ ID NO: 287783 - DNA, 16 bp, P. troglodytes
tttagaaacagggtct

SEQ ID NO: 287784 - DNA, 16 bp, P. troglodytes
tttagaaactgatttt

SEQ ID NO: 287785 - DNA, 16 bp, P. troglodytes
tttagaaactgtaaaa

SEQ ID NO: 287786 - DNA, 16 bp, P. troglodytes
tttagaaagaaggaaa

SEQ ID NO: 287787 - DNA, 16 bp, P. troglodytes
tttagaaagtttcttt

SEQ ID NO: 287788 - DNA, 16 bp, P. troglodytes
tttagaaatgaaagaa

SEQ ID NO: 287789 - DNA, 16 bp, P. troglodytes
tttagaaatgaagaaa

SEQ ID NO: 287790 - DNA, 16 bp, P. troglodytes
tttagaaatggaaaaa

SEQ ID NO: 287791 - DNA, 16 bp, P. troglodytes
tttagaaatgtgaaaa

SEQ ID NO: 287792 - DNA, 16 bp, P. troglodytes
tttagaaattctttct

SEQ ID NO: 287793 - DNA, 16 bp, P. troglodytes
tttagaacattttatt

SEQ ID NO: 287794 - DNA, 16 bp, P. troglodytes
tttagaacatttttat

SEQ ID NO: 287795 - DNA, 16 bp, P. troglodytes
tttagaagtgtgttat

SEQ ID NO: 287796 - DNA, 16 bp, P. troglodytes
tttagaagttttaaat

SEQ ID NO: 287797 - DNA, 16 bp, P. troglodytes
tttagaatattctaaa

SEQ ID NO: 287798 - DNA, 16 bp, P. troglodytes
tttagaatatttcata

SEQ ID NO: 287799 - DNA, 16 bp, P. troglodytes
tttagaatcagaaaaa

SEQ ID NO: 287800 - DNA, 16 bp, P. troglodytes
tttagaattaaaaaca

SEQ ID NO: 287801 - DNA, 16 bp, P. troglodytes
tttagaatttccttta

SEQ ID NO: 287802 - DNA, 16 bp, P. troglodytes
tttagaattttctaaa

SEQ ID NO: 287803 - DNA, 16 bp, P. troglodytes
tttagaatttttgcat

SEQ ID NO: 287804 - DNA, 16 bp, P. troglodytes
tttagacaaagcttaa

SEQ ID NO: 287805 - DNA, 32 bp, P. troglodytes
tttagacgaatgtataactagaataaccaata

SEQ ID NO: 287806 - DNA, 16 bp, P. troglodytes
tttagagaaaaacaaa

SEQ ID NO: 287807 - DNA, 16 bp, P. troglodytes
tttagagaaaattttt

SEQ ID NO: 287808 - DNA, 16 bp, P. troglodytes
tttagagaaacagaac

SEQ ID NO: 287809 - DNA, 16 bp, P. troglodytes
tttagagacaaggtct

SEQ ID NO: 287810 - DNA, 16 bp, P. troglodytes
tttagagacatggtct

SEQ ID NO: 287811 - DNA, 16 bp, P. troglodytes
tttagagagaaaaata

SEQ ID NO: 287812 - DNA, 16 bp, P. troglodytes
tttagagagaagaaaa

SEQ ID NO: 287813 - DNA, 16 bp, P. troglodytes
tttagagatagagtct

SEQ ID NO: 287814 - DNA, 16 bp, P. troglodytes
tttagagataggttct

SEQ ID NO: 287815 - DNA, 16 bp, P. troglodytes
tttagagatgaggaaa

SEQ ID NO: 287816 - DNA, 16 bp, P. troglodytes
tttagagatggagtcc

SEQ ID NO: 287817 - DNA, 16 bp, P. troglodytes
tttagagatggagtct

SEQ ID NO: 287818 - DNA, 16 bp, P. troglodytes
tttagagatgggatct

SEQ ID NO: 287819 - DNA, 16 bp, P. troglodytes
tttagagatggggtct

SEQ ID NO: 287820 - DNA, 16 bp, P. troglodytes
tttagagatggggttt

SEQ ID NO: 287821 - DNA, 16 bp, P. troglodytes
tttagaggaaaatata

SEQ ID NO: 287822 - DNA, 16 bp, P. troglodytes
tttagataaactcaac

SEQ ID NO: 287823 - DNA, 16 bp, P. troglodytes
tttagataataactct

SEQ ID NO: 287824 - DNA, 16 bp, P. troglodytes
tttagatacataaata

SEQ ID NO: 287825 - DNA, 16 bp, P. troglodytes
tttagatactttattt

SEQ ID NO: 287826 - DNA, 16 bp, P. troglodytes
tttagatatttcaaaa

SEQ ID NO: 287827 - DNA, 16 bp, P. troglodytes
tttagatctaataata

SEQ ID NO: 287828 - DNA, 16 bp, P. troglodytes
tttagatctattaata

SEQ ID NO: 287829 - DNA, 16 bp, P. troglodytes
tttagatcttctttta

SEQ ID NO: 287830 - DNA, 16 bp, P. troglodytes
tttagatctttcttct

SEQ ID NO: 287831 - DNA, 16 bp, P. troglodytes
tttagatgaaatgaac

SEQ ID NO: 287832 - DNA, 18 bp, P. troglodytes
tttagatggagttttgct

SEQ ID NO: 287833 - DNA, 16 bp, P. troglodytes
tttagatttaaagaca

SEQ ID NO: 287834 - DNA, 16 bp, P. troglodytes
tttagatttcacattt

SEQ ID NO: 287835 - DNA, 16 bp, P. troglodytes
tttagatttcatttta

SEQ ID NO: 287836 - DNA, 16 bp, P. troglodytes
tttagatttcttcatg

SEQ ID NO: 287837 - DNA, 16 bp, P. troglodytes
tttagattttgaaata

SEQ ID NO: 287838 - DNA, 16 bp, P. troglodytes
tttagcaaacatttat

SEQ ID NO: 287839 - DNA, 16 bp, P. troglodytes
tttagcaaataaaaac

SEQ ID NO: 287840 - DNA, 16 bp, P. troglodytes
tttagcaaatattaaa

SEQ ID NO: 287841 - DNA, 16 bp, P. troglodytes
tttagcaccatctccc

SEQ ID NO: 287842 - DNA, 16 bp, P. troglodytes
tttagcagagactggt

SEQ ID NO: 287843 - DNA, 16 bp, P. troglodytes
tttagcagagatggag

SEQ ID NO: 287844 - DNA, 16 bp, P. troglodytes
tttagcagtttggaaa

SEQ ID NO: 287845 - DNA, 16 bp, P. troglodytes
tttagcagttttgaaa

SEQ ID NO: 287846 - DNA, 16 bp, P. troglodytes
tttagcatataatcaa

SEQ ID NO: 287847 - DNA, 16 bp, P. troglodytes
tttagcatatcatcaa

SEQ ID NO: 287848 - DNA, 16 bp, P. troglodytes
tttagcatttatttat

SEQ ID NO: 287849 - DNA, 16 bp, P. troglodytes
tttagcattttctttg

SEQ ID NO: 287850 - DNA, 16 bp, P. troglodytes
tttagcattttttata

SEQ ID NO: 287851 - DNA, 17 bp, P. troglodytes
tttagccaggatggtct

SEQ ID NO: 287852 - DNA, 16 bp, P. troglodytes
tttagccaggcatggt

SEQ ID NO: 287853 - DNA, 16 bp, P. troglodytes
tttagccaggtgtggt

SEQ ID NO: 287854 - DNA, 16 bp, P. troglodytes
tttagccatcctggtg

SEQ ID NO: 287855 - DNA, 16 bp, P. troglodytes
tttagccatttttaaa

SEQ ID NO: 287856 - DNA, 16 bp, P. troglodytes
tttagcccactttttg

SEQ ID NO: 287857 - DNA, 16 bp, P. troglodytes
tttagcctgttaactt

SEQ ID NO: 287858 - DNA, 16 bp, P. troglodytes
tttagctcttacattt

SEQ ID NO: 287859 - DNA, 16 bp, P. troglodytes
tttagctgggcatggt

SEQ ID NO: 287860 - DNA, 16 bp, P. troglodytes
tttagctgtgtctcag

SEQ ID NO: 287861 - DNA, 16 bp, P. troglodytes
tttagctgttttcatt

SEQ ID NO: 287862 - DNA, 16 bp, P. troglodytes
tttagcttatttttaa

SEQ ID NO: 287863 - DNA, 16 bp, P. troglodytes
tttagcttcattataa

SEQ ID NO: 287864 - DNA, 16 bp, P. troglodytes
tttagcttccatatat

SEQ ID NO: 287865 - DNA, 16 bp, P. troglodytes
tttagcttctttccag

SEQ ID NO: 287866 - DNA, 16 bp, P. troglodytes
tttagctttttgagga

SEQ ID NO: 287867 - DNA, 16 bp, P. troglodytes
tttaggaaaacatttt

SEQ ID NO: 287868 - DNA, 16 bp, P. troglodytes
tttaggaaataaatat

SEQ ID NO: 287869 - DNA, 16 bp, P. troglodytes
tttaggacaagaattt

SEQ ID NO: 287870 - DNA, 16 bp, P. troglodytes
tttaggagaaagtaag

SEQ ID NO: 287871 - DNA, 16 bp, P. troglodytes
tttaggagatttattt

SEQ ID NO: 287872 - DNA, 16 bp, P. troglodytes
tttaggccaggagttc

SEQ ID NO: 287873 - DNA, 16 bp, P. troglodytes
tttaggctaaacttaa

SEQ ID NO: 287874 - DNA, 16 bp, P. troglodytes
tttaggctttgctggc

SEQ ID NO: 287875 - DNA, 16 bp, P. troglodytes
tttagggaacctaata

SEQ ID NO: 287876 - DNA, 16 bp, P. troglodytes
tttagggggaaaaaaa

SEQ ID NO: 287877 - DNA, 16 bp, P. troglodytes
tttaggtcctgaatat

SEQ ID NO: 287878 - DNA, 16 bp, P. troglodytes
tttaggtgatccaccc

SEQ ID NO: 287879 - DNA, 16 bp, P. troglodytes
tttaggttcacagcaa

SEQ ID NO: 287880 - DNA, 16 bp, P. troglodytes
tttaggtttttaaaaa

SEQ ID NO: 287881 - DNA, 17 bp, P. troglodytes
tttagtagaaatggagt

SEQ ID NO: 287882 - DNA, 19 bp, P. troglodytes
tttagtagagatgaggttt

SEQ ID NO: 287883 - DNA, 16 bp, P. troglodytes
tttagtagagatggtg

SEQ ID NO: 287884 - DNA, 16 bp, P. troglodytes
tttagtataagcatgt

SEQ ID NO: 287885 - DNA, 16 bp, P. troglodytes
tttagtataattagat

SEQ ID NO: 287886 - DNA, 16 bp, P. troglodytes
tttagtcatttaaaaa

SEQ ID NO: 287887 - DNA, 16 bp, P. troglodytes
tttagtcccagctacc

SEQ ID NO: 287888 - DNA, 16 bp, P. troglodytes
tttagtcccagctact

SEQ ID NO: 287889 - DNA, 16 bp, P. troglodytes
tttagtgaaggtaatt

SEQ ID NO: 287890 - DNA, 16 bp, P. troglodytes
tttagtgcctctttca

SEQ ID NO: 287891 - DNA, 16 bp, P. troglodytes
tttagtggagacaagg

SEQ ID NO: 287892 - DNA, 16 bp, P. troglodytes
tttagtggagatggga

SEQ ID NO: 287893 - DNA, 16 bp, P. troglodytes
tttagtggggacacag

SEQ ID NO: 287894 - DNA, 16 bp, P. troglodytes
tttagtggttatttct

SEQ ID NO: 287895 - DNA, 16 bp, P. troglodytes
tttagttaaaatgtct

SEQ ID NO: 287896 - DNA, 16 bp, P. troglodytes
tttagttaacaataat

SEQ ID NO: 287897 - DNA, 16 bp, P. troglodytes
tttagttcaattagat

SEQ ID NO: 287898 - DNA, 16 bp, P. troglodytes
tttagttccagctact

SEQ ID NO: 287899 - DNA, 16 bp, P. troglodytes
tttagttctataaatt

SEQ ID NO: 287900 - DNA, 16 bp, P. troglodytes
tttagttcttacattt

SEQ ID NO: 287901 - DNA, 16 bp, P. troglodytes
tttagttctttgaaaa

SEQ ID NO: 287902 - DNA, 16 bp, P. troglodytes
tttagttgaaaaagca

SEQ ID NO: 287903 - DNA, 16 bp, P. troglodytes
tttagttgactcacag

SEQ ID NO: 287904 - DNA, 16 bp, P. troglodytes
tttagtttctataggg

SEQ ID NO: 287905 - DNA, 16 bp, P. troglodytes
tttagtttgcattttc

SEQ ID NO: 287906 - DNA, 16 bp, P. troglodytes
tttagtttgctcttct

SEQ ID NO: 287907 - DNA, 16 bp, P. troglodytes
tttagttttgccatct

SEQ ID NO: 287908 - DNA, 16 bp, P. troglodytes
tttataaaaatgaagt

SEQ ID NO: 287909 - DNA, 16 bp, P. troglodytes
tttataaaaatggttt

SEQ ID NO: 287910 - DNA, 16 bp, P. troglodytes
tttataaaacatgttt

SEQ ID NO: 287911 - DNA, 16 bp, P. troglodytes
tttataaaagcaaaat

SEQ ID NO: 287912 - DNA, 16 bp, P. troglodytes
tttataaaatgactat

SEQ ID NO: 287913 - DNA, 16 bp, P. troglodytes
tttataaaatgggaat

SEQ ID NO: 287914 - DNA, 16 bp, P. troglodytes
tttataaacaaaatag

SEQ ID NO: 287915 - DNA, 16 bp, P. troglodytes
tttataaacacataca

SEQ ID NO: 287916 - DNA, 16 bp, P. troglodytes
tttataaacagaaatg

SEQ ID NO: 287917 - DNA, 16 bp, P. troglodytes
tttataaacatgaaaa

SEQ ID NO: 287918 - DNA, 16 bp, P. troglodytes
tttataaacatgtata

SEQ ID NO: 287919 - DNA, 16 bp, P. troglodytes
tttataaactgtaaag

SEQ ID NO: 287920 - DNA, 16 bp, P. troglodytes
tttataaagaaaagtg

SEQ ID NO: 287921 - DNA, 16 bp, P. troglodytes
tttataaagaaacaga

SEQ ID NO: 287922 - DNA, 16 bp, P. troglodytes
tttataaagaaaggtt

SEQ ID NO: 287923 - DNA, 16 bp, P. troglodytes
tttataaagagaaaga

SEQ ID NO: 287924 - DNA, 16 bp, P. troglodytes
tttataaagcaaaaaa

SEQ ID NO: 287925 - DNA, 16 bp, P. troglodytes
tttataaagcaataaa

SEQ ID NO: 287926 - DNA, 16 bp, P. troglodytes
tttataaagccatcag

SEQ ID NO: 287927 - DNA, 16 bp, P. troglodytes
tttataaaggaaaaga

SEQ ID NO: 287928 - DNA, 16 bp, P. troglodytes
tttataaaggaaggaa

SEQ ID NO: 287929 - DNA, 16 bp, P. troglodytes
tttataaaggagagag

SEQ ID NO: 287930 - DNA, 16 bp, P. troglodytes
tttataaaggaggaaa

SEQ ID NO: 287931 - DNA, 16 bp, P. troglodytes
tttataaatgatgaaa

SEQ ID NO: 287932 - DNA, 16 bp, P. troglodytes
tttataaatgggcaaa

SEQ ID NO: 287933 - DNA, 16 bp, P. troglodytes
tttataaattacccag

SEQ ID NO: 287934 - DNA, 16 bp, P. troglodytes
tttataaattcagaaa

SEQ ID NO: 287935 - DNA, 16 bp, P. troglodytes
tttataaattgctcag

SEQ ID NO: 287936 - DNA, 16 bp, P. troglodytes
tttataacaacacaaa

SEQ ID NO: 287937 - DNA, 16 bp, P. troglodytes
tttataagaaaaaaac

SEQ ID NO: 287938 - DNA, 16 bp, P. troglodytes
tttataagaaccaaaa

SEQ ID NO: 287939 - DNA, 16 bp, P. troglodytes
tttataagagcactaa

SEQ ID NO: 287940 - DNA, 16 bp, P. troglodytes
tttataagccacccag

SEQ ID NO: 287941 - DNA, 16 bp, P. troglodytes
tttataagctttttaa

SEQ ID NO: 287942 - DNA, 16 bp, P. troglodytes
tttataagggactttt

SEQ ID NO: 287943 - DNA, 16 bp, P. troglodytes
tttataagtaaagttt

SEQ ID NO: 287944 - DNA, 16 bp, P. troglodytes
tttataataaaactgt

SEQ ID NO: 287945 - DNA, 16 bp, P. troglodytes
tttataataaaccagt

SEQ ID NO: 287946 - DNA, 16 bp, P. troglodytes
tttataataaactgtt

SEQ ID NO: 287947 - DNA, 16 bp, P. troglodytes
tttataatactgtttt

SEQ ID NO: 287948 - DNA, 16 bp, P. troglodytes
tttataatagctattt

SEQ ID NO: 287949 - DNA, 16 bp, P. troglodytes
tttataatagcttttt

SEQ ID NO: 287950 - DNA, 16 bp, P. troglodytes
tttataatcaatttgt

SEQ ID NO: 287951 - DNA, 16 bp, P. troglodytes
tttataatcagaaaaa

SEQ ID NO: 287952 - DNA, 16 bp, P. troglodytes
tttataattctgaaaa

SEQ ID NO: 287953 - DNA, 16 bp, P. troglodytes
tttataatttcaacat

SEQ ID NO: 287954 - DNA, 16 bp, P. troglodytes
tttataattttcagca

SEQ ID NO: 287955 - DNA, 16 bp, P. troglodytes
tttataattttctcca

SEQ ID NO: 287956 - DNA, 16 bp, P. troglodytes
tttatacaatggaata

SEQ ID NO: 287957 - DNA, 16 bp, P. troglodytes
tttatacatatgtaaa

SEQ ID NO: 287958 - DNA, 16 bp, P. troglodytes
tttatacatgaagaaa

SEQ ID NO: 287959 - DNA, 16 bp, P. troglodytes
tttataccactaaatg

SEQ ID NO: 287960 - DNA, 16 bp, P. troglodytes
tttataccattgtggt

SEQ ID NO: 287961 - DNA, 16 bp, P. troglodytes
tttatacccaaaagaa

SEQ ID NO: 287962 - DNA, 16 bp, P. troglodytes
tttatactttctgcag

SEQ ID NO: 287963 - DNA, 16 bp, P. troglodytes
tttatagaaaatgttt

SEQ ID NO: 287964 - DNA, 16 bp, P. troglodytes
tttatagaaatacaaa

SEQ ID NO: 287965 - DNA, 16 bp, P. troglodytes
tttatagatggagaaa

SEQ ID NO: 287966 - DNA, 16 bp, P. troglodytes
tttatagatggggaaa

SEQ ID NO: 287967 - DNA, 16 bp, P. troglodytes
tttatagcaatacaaa

SEQ ID NO: 287968 - DNA, 17 bp, P. troglodytes
tttatagcagcacaatt

SEQ ID NO: 287969 - DNA, 16 bp, P. troglodytes
tttatagcagcatgtt

SEQ ID NO: 287970 - DNA, 16 bp, P. troglodytes
tttatagcatttatca

SEQ ID NO: 287971 - DNA, 16 bp, P. troglodytes
tttatagcattttgtt

SEQ ID NO: 287972 - DNA, 16 bp, P. troglodytes
tttatagctggggaaa

SEQ ID NO: 287973 - DNA, 16 bp, P. troglodytes
tttatagctttatatt

SEQ ID NO: 287974 - DNA, 16 bp, P. troglodytes
tttatagcttttgatt

SEQ ID NO: 287975 - DNA, 16 bp, P. troglodytes
tttatagtaataaaca

SEQ ID NO: 287976 - DNA, 16 bp, P. troglodytes
tttatagtagcaaaaa

SEQ ID NO: 287977 - DNA, 18 bp, P. troglodytes
tttatagtgttctctgat

SEQ ID NO: 287978 - DNA, 16 bp, P. troglodytes
tttatagttagaaaaa

SEQ ID NO: 287979 - DNA, 16 bp, P. troglodytes
tttatagtttacaaag

SEQ ID NO: 287980 - DNA, 16 bp, P. troglodytes
tttatagttttaactt

SEQ ID NO: 287981 - DNA, 16 bp, P. troglodytes
tttatagttttctata

SEQ ID NO: 287982 - DNA, 16 bp, P. troglodytes
tttatataaaatgaca

SEQ ID NO: 287983 - DNA, 16 bp, P. troglodytes
tttatataaaatgtgt

SEQ ID NO: 287984 - DNA, 16 bp, P. troglodytes
tttatataaatggaat

SEQ ID NO: 287985 - DNA, 16 bp, P. troglodytes
tttatatacatacata

SEQ ID NO: 287986 - DNA, 16 bp, P. troglodytes
tttatatatccattca

SEQ ID NO: 287987 - DNA, 16 bp, P. troglodytes
tttatatatgaagaaa

SEQ ID NO: 287988 - DNA, 16 bp, P. troglodytes
tttatatatgtgtgta

SEQ ID NO: 287989 - DNA, 16 bp, P. troglodytes
tttatatatgtgtgtg

SEQ ID NO: 287990 - DNA, 16 bp, P. troglodytes
tttatatcctgagact

SEQ ID NO: 287991 - DNA, 16 bp, P. troglodytes
tttatatctgtatata

SEQ ID NO: 287992 - DNA, 16 bp, P. troglodytes
tttatatgaaaatgca

SEQ ID NO: 287993 - DNA, 16 bp, P. troglodytes
tttatatgaaatcaca

SEQ ID NO: 287994 - DNA, 16 bp, P. troglodytes
tttatatgacattctt

SEQ ID NO: 287995 - DNA, 16 bp, P. troglodytes
tttatatgcattatct

SEQ ID NO: 287996 - DNA, 16 bp, P. troglodytes
tttatatgccacattt

SEQ ID NO: 287997 - DNA, 16 bp, P. troglodytes
tttatatgtgaaatct

SEQ ID NO: 287998 - DNA, 16 bp, P. troglodytes
tttatatgtgaatata

SEQ ID NO: 287999 - DNA, 16 bp, P. troglodytes
tttatattaagtcttg

SEQ ID NO: 288000 - DNA, 16 bp, P. troglodytes
tttatattcccaccag

SEQ ID NO: 288001 - DNA, 16 bp, P. troglodytes
tttatatttattcatg

SEQ ID NO: 288002 - DNA, 16 bp, P. troglodytes
tttatatttatttgca

SEQ ID NO: 288003 - DNA, 16 bp, P. troglodytes
tttatatttccagaaa

SEQ ID NO: 288004 - DNA, 16 bp, P. troglodytes
tttatatttgagaaaa

SEQ ID NO: 288005 - DNA, 16 bp, P. troglodytes
tttatatttgtagaaa

SEQ ID NO: 288006 - DNA, 16 bp, P. troglodytes
tttatatttgtcaatt

SEQ ID NO: 288007 - DNA, 16 bp, P. troglodytes
tttatattttcatgtg

SEQ ID NO: 288008 - DNA, 16 bp, P. troglodytes
tttatatttttgccat

SEQ ID NO: 288009 - DNA, 16 bp, P. troglodytes
tttatcaaatttgcca

SEQ ID NO: 288010 - DNA, 16 bp, P. troglodytes
tttatcaagtctagga

SEQ ID NO: 288011 - DNA, 16 bp, P. troglodytes
tttatcacattttgtt

SEQ ID NO: 288012 - DNA, 16 bp, P. troglodytes
tttatcactttaaaaa

SEQ ID NO: 288013 - DNA, 16 bp, P. troglodytes
tttatcagatatatgc

SEQ ID NO: 288014 - DNA, 16 bp, P. troglodytes
tttatcaggaaaaaag

SEQ ID NO: 288015 - DNA, 16 bp, P. troglodytes
tttatcagtaatttga

SEQ ID NO: 288016 - DNA, 16 bp, P. troglodytes
tttatcagtattttct

SEQ ID NO: 288017 - DNA, 16 bp, P. troglodytes
tttatcataaaggaat

SEQ ID NO: 288018 - DNA, 16 bp, P. troglodytes
tttatcattatgaaat

SEQ ID NO: 288019 - DNA, 16 bp, P. troglodytes
tttatcattctgaaaa

SEQ ID NO: 288020 - DNA, 16 bp, P. troglodytes
tttatcatttcaaaaa

SEQ ID NO: 288021 - DNA, 16 bp, P. troglodytes
tttatccaaaggaaaa

SEQ ID NO: 288022 - DNA, 16 bp, P. troglodytes
tttatccaagatcaca

SEQ ID NO: 288023 - DNA, 16 bp, P. troglodytes
tttatccaatccactg

SEQ ID NO: 288024 - DNA, 16 bp, P. troglodytes
tttatccacattgtag

SEQ ID NO: 288025 - DNA, 16 bp, P. troglodytes
tttatccactcattgg

SEQ ID NO: 288026 - DNA, 16 bp, P. troglodytes
tttatccagtcatcag

SEQ ID NO: 288027 - DNA, 16 bp, P. troglodytes
tttatccattcatctg

SEQ ID NO: 288028 - DNA, 16 bp, P. troglodytes
tttatccattcattga

SEQ ID NO: 288029 - DNA, 16 bp, P. troglodytes
tttatccatttgttca

SEQ ID NO: 288030 - DNA, 16 bp, P. troglodytes
tttatccctcaacccc

SEQ ID NO: 288031 - DNA, 16 bp, P. troglodytes
tttatcctacttggag

SEQ ID NO: 288032 - DNA, 16 bp, P. troglodytes
tttatcctttaaaaaa

SEQ ID NO: 288033 - DNA, 16 bp, P. troglodytes
tttatcctttcatcca

SEQ ID NO: 288034 - DNA, 16 bp, P. troglodytes
tttatctaatctatca

SEQ ID NO: 288035 - DNA, 16 bp, P. troglodytes
tttatctccaaataca

SEQ ID NO: 288036 - DNA, 16 bp, P. troglodytes
tttatctctaaaaaat

SEQ ID NO: 288037 - DNA, 16 bp, P. troglodytes
tttatctgaaattcca

SEQ ID NO: 288038 - DNA, 16 bp, P. troglodytes
tttatctgactccaaa

SEQ ID NO: 288039 - DNA, 16 bp, P. troglodytes
tttatctgtttatctg

SEQ ID NO: 288040 - DNA, 16 bp, P. troglodytes
tttatcttaaagaaat

SEQ ID NO: 288041 - DNA, 16 bp, P. troglodytes
tttatcttaacctgaa

SEQ ID NO: 288042 - DNA, 20 bp, P. troglodytes
tttatcttaacctgaacatt

SEQ ID NO: 288043 - DNA, 16 bp, P. troglodytes
tttatcttctcaaaga

SEQ ID NO: 288044 - DNA, 16 bp, P. troglodytes
tttatcttgagaacat

SEQ ID NO: 288045 - DNA, 16 bp, P. troglodytes
tttatcttgtggaata

SEQ ID NO: 288046 - DNA, 16 bp, P. troglodytes
tttatctttcaaaata

SEQ ID NO: 288047 - DNA, 16 bp, P. troglodytes
tttatctttctatgcc

SEQ ID NO: 288048 - DNA, 16 bp, P. troglodytes
tttatctttgaaaata

SEQ ID NO: 288049 - DNA, 16 bp, P. troglodytes
tttatcttttcaaaga

SEQ ID NO: 288050 - DNA, 16 bp, P. troglodytes
tttatcttttcagaaa

SEQ ID NO: 288051 - DNA, 16 bp, P. troglodytes
tttatcttttccaaaa

SEQ ID NO: 288052 - DNA, 16 bp, P. troglodytes
tttatgaaaatgttaa

SEQ ID NO: 288053 - DNA, 16 bp, P. troglodytes
tttatgaaacagaaaa

SEQ ID NO: 288054 - DNA, 16 bp, P. troglodytes
tttatgaaatactttt

SEQ ID NO: 288055 - DNA, 16 bp, P. troglodytes
tttatgaactgtaaca

SEQ ID NO: 288056 - DNA, 16 bp, P. troglodytes
tttatgaagaaaagag

SEQ ID NO: 288057 - DNA, 16 bp, P. troglodytes
tttatgaagaaaatga

SEQ ID NO: 288058 - DNA, 16 bp, P. troglodytes
tttatgaagttttaaa

SEQ ID NO: 288059 - DNA, 28 bp, P. troglodytes
tttatgaatctgggtgctcctgtattgg

SEQ ID NO: 288060 - DNA, 16 bp, P. troglodytes
tttatgaatgaggaaa

SEQ ID NO: 288061 - DNA, 16 bp, P. troglodytes
tttatgacctcattta

SEQ ID NO: 288062 - DNA, 16 bp, P. troglodytes
tttatgactaaatagt

SEQ ID NO: 288063 - DNA, 16 bp, P. troglodytes
tttatgactttttaaa

SEQ ID NO: 288064 - DNA, 16 bp, P. troglodytes
tttatgagaaatattt

SEQ ID NO: 288065 - DNA, 17 bp, P. troglodytes
tttatgagacggagtct

SEQ ID NO: 288066 - DNA, 16 bp, P. troglodytes
tttatgagatggagtc

SEQ ID NO: 288067 - DNA, 16 bp, P. troglodytes
tttatgatgatccact

SEQ ID NO: 288068 - DNA, 16 bp, P. troglodytes
tttatgatgcagagac

SEQ ID NO: 288069 - DNA, 16 bp, P. troglodytes
tttatgattatgaaat

SEQ ID NO: 288070 - DNA, 16 bp, P. troglodytes
tttatgattccactta

SEQ ID NO: 288071 - DNA, 16 bp, P. troglodytes
tttatgcaaaaataaa

SEQ ID NO: 288072 - DNA, 16 bp, P. troglodytes
tttatgcaaataatca

SEQ ID NO: 288073 - DNA, 16 bp, P. troglodytes
tttatgcagtgaatct

SEQ ID NO: 288074 - DNA, 16 bp, P. troglodytes
tttatgcatattattt

SEQ ID NO: 288075 - DNA, 16 bp, P. troglodytes
tttatgcattcatcca

SEQ ID NO: 288076 - DNA, 16 bp, P. troglodytes
tttatgcttaaaatat

SEQ ID NO: 288077 - DNA, 16 bp, P. troglodytes
tttatgcttttaaaaa

SEQ ID NO: 288078 - DNA, 16 bp, P. troglodytes
tttatgcttttggtgt

SEQ ID NO: 288079 - DNA, 16 bp, P. troglodytes
tttatgctttttaaaa

SEQ ID NO: 288080 - DNA, 16 bp, P. troglodytes
tttatggaaaaaatat

SEQ ID NO: 288081 - DNA, 16 bp, P. troglodytes
tttatggaaagaaaaa

SEQ ID NO: 288082 - DNA, 16 bp, P. troglodytes
tttatggaggattttt

SEQ ID NO: 288083 - DNA, 16 bp, P. troglodytes
tttatggagtgcttac

SEQ ID NO: 288084 - DNA, 16 bp, P. troglodytes
tttatggatgagcaaa

SEQ ID NO: 288085 - DNA, 16 bp, P. troglodytes
tttatggattgtgctt

SEQ ID NO: 288086 - DNA, 16 bp, P. troglodytes
tttatgggaagatatt

SEQ ID NO: 288087 - DNA, 16 bp, P. troglodytes
tttatggttttctagg

SEQ ID NO: 288088 - DNA, 16 bp, P. troglodytes
tttatgtaaaaatgaa

SEQ ID NO: 288089 - DNA, 16 bp, P. troglodytes
tttatgtaaaaatgta

SEQ ID NO: 288090 - DNA, 16 bp, P. troglodytes
tttatgtaaagatatt

SEQ ID NO: 288091 - DNA, 16 bp, P. troglodytes
tttatgtaaagtaaaa

SEQ ID NO: 288092 - DNA, 16 bp, P. troglodytes
tttatgtacacacaca

SEQ ID NO: 288093 - DNA, 16 bp, P. troglodytes
tttatgtatctataaa

SEQ ID NO: 288094 - DNA, 16 bp, P. troglodytes
tttatgtattcattca

SEQ ID NO: 288095 - DNA, 16 bp, P. troglodytes
tttatgtatttattca

SEQ ID NO: 288096 - DNA, 16 bp, P. troglodytes
tttatgtccatgagta

SEQ ID NO: 288097 - DNA, 16 bp, P. troglodytes
tttatgtctaaaacac

SEQ ID NO: 288098 - DNA, 16 bp, P. troglodytes
tttatgtctatgttca

SEQ ID NO: 288099 - DNA, 16 bp, P. troglodytes
tttatgtcttaaaaat

SEQ ID NO: 288100 - DNA, 16 bp, P. troglodytes
tttatgtctttaattc

SEQ ID NO: 288101 - DNA, 16 bp, P. troglodytes
tttatgtgaaatcttt

SEQ ID NO: 288102 - DNA, 16 bp, P. troglodytes
tttatgtgaacatata

SEQ ID NO: 288103 - DNA, 16 bp, P. troglodytes
tttatgtgtaaaataa

SEQ ID NO: 288104 - DNA, 16 bp, P. troglodytes
tttatgtgtccaggaa

SEQ ID NO: 288105 - DNA, 16 bp, P. troglodytes
tttatgtgtctgtgtg

SEQ ID NO: 288106 - DNA, 16 bp, P. troglodytes
tttatgtgtgcatgtg

SEQ ID NO: 288107 - DNA, 20 bp, P. troglodytes
tttatgtgtggcccaagaca

SEQ ID NO: 288108 - DNA, 16 bp, P. troglodytes
tttatgtttacaaaat

SEQ ID NO: 288109 - DNA, 16 bp, P. troglodytes
tttatgtttacattta

SEQ ID NO: 288110 - DNA, 16 bp, P. troglodytes
tttatgtttcaaatat

SEQ ID NO: 288111 - DNA, 16 bp, P. troglodytes
tttatgtttccaggaa

SEQ ID NO: 288112 - DNA, 16 bp, P. troglodytes
tttatgttttagaaaa

SEQ ID NO: 288113 - DNA, 16 bp, P. troglodytes
tttatgttttcaaaaa

SEQ ID NO: 288114 - DNA, 16 bp, P. troglodytes
tttattaaaaagcttt

SEQ ID NO: 288115 - DNA, 16 bp, P. troglodytes
tttattaaaagcattt

SEQ ID NO: 288116 - DNA, 16 bp, P. troglodytes
tttattaaagacaggg

SEQ ID NO: 288117 - DNA, 16 bp, P. troglodytes
tttattaaagacattt

SEQ ID NO: 288118 - DNA, 16 bp, P. troglodytes
tttattaaagagggaa

SEQ ID NO: 288119 - DNA, 16 bp, P. troglodytes
tttattaagattttct

SEQ ID NO: 288120 - DNA, 16 bp, P. troglodytes
tttattaagcacttat

SEQ ID NO: 288121 - DNA, 16 bp, P. troglodytes
tttattaatgaagaaa

SEQ ID NO: 288122 - DNA, 16 bp, P. troglodytes
tttattaatgattttc

SEQ ID NO: 288123 - DNA, 16 bp, P. troglodytes
tttattaatgttttca

SEQ ID NO: 288124 - DNA, 16 bp, P. troglodytes
tttattacagaaattt

SEQ ID NO: 288125 - DNA, 16 bp, P. troglodytes
tttattacagtataat

SEQ ID NO: 288126 - DNA, 16 bp, P. troglodytes
tttattacatttgaaa

SEQ ID NO: 288127 - DNA, 16 bp, P. troglodytes
tttattactaattcaa

SEQ ID NO: 288128 - DNA, 16 bp, P. troglodytes
tttattactcacagca

SEQ ID NO: 288129 - DNA, 16 bp, P. troglodytes
tttattactgaagaaa

SEQ ID NO: 288130 - DNA, 16 bp, P. troglodytes
tttattactgttatta

SEQ ID NO: 288131 - DNA, 16 bp, P. troglodytes
tttattacttacagat

SEQ ID NO: 288132 - DNA, 16 bp, P. troglodytes
tttattagcagcgtga

SEQ ID NO: 288133 - DNA, 16 bp, P. troglodytes
tttattataaaatagg

SEQ ID NO: 288134 - DNA, 16 bp, P. troglodytes
tttattatataggtaa

SEQ ID NO: 288135 - DNA, 16 bp, P. troglodytes
tttattatccccactt

SEQ ID NO: 288136 - DNA, 16 bp, P. troglodytes
tttattatgctttaag

SEQ ID NO: 288137 - DNA, 16 bp, P. troglodytes
tttattatggaaaatt

SEQ ID NO: 288138 - DNA, 16 bp, P. troglodytes
tttattattcattaag

SEQ ID NO: 288139 - DNA, 16 bp, P. troglodytes
tttattattttacagt

SEQ ID NO: 288140 - DNA, 16 bp, P. troglodytes
tttattcaaaagaaac

SEQ ID NO: 288141 - DNA, 16 bp, P. troglodytes
tttattcaaaattcaa

SEQ ID NO: 288142 - DNA, 16 bp, P. troglodytes
tttattcaaagaaaaa

SEQ ID NO: 288143 - DNA, 16 bp, P. troglodytes
tttattcaaatgaaat

SEQ ID NO: 288144 - DNA, 16 bp, P. troglodytes
tttattcaacaaaaat

SEQ ID NO: 288145 - DNA, 16 bp, P. troglodytes
tttattcaagaaaatt

SEQ ID NO: 288146 - DNA, 16 bp, P. troglodytes
tttattcaaggtcaca

SEQ ID NO: 288147 - DNA, 16 bp, P. troglodytes
tttattcagcagcagc

SEQ ID NO: 288148 - DNA, 16 bp, P. troglodytes
tttattcagtcatcca

SEQ ID NO: 288149 - DNA, 16 bp, P. troglodytes
tttattcataattgcc

SEQ ID NO: 288150 - DNA, 16 bp, P. troglodytes
tttattcatccattca

SEQ ID NO: 288151 - DNA, 16 bp, P. troglodytes
tttattcattcatcca

SEQ ID NO: 288152 - DNA, 16 bp, P. troglodytes
tttattcattcatgca

SEQ ID NO: 288153 - DNA, 16 bp, P. troglodytes
tttattcattcattca

SEQ ID NO: 288154 - DNA, 16 bp, P. troglodytes
tttattcatttgcata

SEQ ID NO: 288155 - DNA, 16 bp, P. troglodytes
tttattcatttgtgta

SEQ ID NO: 288156 - DNA, 16 bp, P. troglodytes
tttattcatttttgaa

SEQ ID NO: 288157 - DNA, 16 bp, P. troglodytes
tttattcctaaatact

SEQ ID NO: 288158 - DNA, 16 bp, P. troglodytes
tttattcctagtttat

SEQ ID NO: 288159 - DNA, 16 bp, P. troglodytes
tttattccttaaatgt

SEQ ID NO: 288160 - DNA, 16 bp, P. troglodytes
tttattccttttcaaa

SEQ ID NO: 288161 - DNA, 16 bp, P. troglodytes
tttattctagaaaata

SEQ ID NO: 288162 - DNA, 16 bp, P. troglodytes
tttattctcattggtt

SEQ ID NO: 288163 - DNA, 16 bp, P. troglodytes
tttattctgtttaaaa

SEQ ID NO: 288164 - DNA, 16 bp, P. troglodytes
tttattctttcaaaaa

SEQ ID NO: 288165 - DNA, 16 bp, P. troglodytes
tttattctttcaccaa

SEQ ID NO: 288166 - DNA, 16 bp, P. troglodytes
tttattctttgaccca

SEQ ID NO: 288167 - DNA, 16 bp, P. troglodytes
tttattcttttgaaaa

SEQ ID NO: 288168 - DNA, 16 bp, P. troglodytes
tttattgaaaaacatt

SEQ ID NO: 288169 - DNA, 16 bp, P. troglodytes
tttattgaaaatcaat

SEQ ID NO: 288170 - DNA, 16 bp, P. troglodytes
tttattgaacacctac

SEQ ID NO: 288171 - DNA, 16 bp, P. troglodytes
tttattgaagaaatta

SEQ ID NO: 288172 - DNA, 16 bp, P. troglodytes
tttattgaagacattt

SEQ ID NO: 288173 - DNA, 16 bp, P. troglodytes
tttattgaatatggag

SEQ ID NO: 288174 - DNA, 16 bp, P. troglodytes
tttattgacacataat

SEQ ID NO: 288175 - DNA, 16 bp, P. troglodytes
tttattgagaaactac

SEQ ID NO: 288176 - DNA, 16 bp, P. troglodytes
tttattgagcaaatat

SEQ ID NO: 288177 - DNA, 16 bp, P. troglodytes
tttattgagcacctgc

SEQ ID NO: 288178 - DNA, 16 bp, P. troglodytes
tttattgagcatccac

SEQ ID NO: 288179 - DNA, 16 bp, P. troglodytes
tttattgagcatttac

SEQ ID NO: 288180 - DNA, 16 bp, P. troglodytes
tttattgaggtaaaat

SEQ ID NO: 288181 - DNA, 16 bp, P. troglodytes
tttattgaggtgtaat

SEQ ID NO: 288182 - DNA, 16 bp, P. troglodytes
tttattgatgaagaaa

SEQ ID NO: 288183 - DNA, 16 bp, P. troglodytes
tttattgatgcataat

SEQ ID NO: 288184 - DNA, 16 bp, P. troglodytes
tttattgatggacatt

SEQ ID NO: 288185 - DNA, 16 bp, P. troglodytes
tttattgatgttgatg

SEQ ID NO: 288186 - DNA, 17 bp, P. troglodytes
tttattgatttgcatat

SEQ ID NO: 288187 - DNA, 16 bp, P. troglodytes
tttattgatttgtgaa

SEQ ID NO: 288188 - DNA, 16 bp, P. troglodytes
tttattgcactttgca

SEQ ID NO: 288189 - DNA, 16 bp, P. troglodytes
tttattgcagaattat

SEQ ID NO: 288190 - DNA, 16 bp, P. troglodytes
tttattgcagcatcat

SEQ ID NO: 288191 - DNA, 16 bp, P. troglodytes
tttattgctattatta

SEQ ID NO: 288192 - DNA, 16 bp, P. troglodytes
tttattgctgatgaaa

SEQ ID NO: 288193 - DNA, 16 bp, P. troglodytes
tttattgctttataaa

SEQ ID NO: 288194 - DNA, 16 bp, P. troglodytes
tttattgctttccatt

SEQ ID NO: 288195 - DNA, 16 bp, P. troglodytes
tttattggaaaaaata

SEQ ID NO: 288196 - DNA, 16 bp, P. troglodytes
tttattggatacaaag

SEQ ID NO: 288197 - DNA, 16 bp, P. troglodytes
tttattggcacacagt

SEQ ID NO: 288198 - DNA, 16 bp, P. troglodytes
tttattggctatttgt

SEQ ID NO: 288199 - DNA, 16 bp, P. troglodytes
tttattgggagacttt

SEQ ID NO: 288200 - DNA, 16 bp, P. troglodytes
tttattgtacatttta

SEQ ID NO: 288201 - DNA, 16 bp, P. troglodytes
tttattgtagaaaatt

SEQ ID NO: 288202 - DNA, 16 bp, P. troglodytes
tttattgtagtaaaat

SEQ ID NO: 288203 - DNA, 16 bp, P. troglodytes
tttattgtatacattt

SEQ ID NO: 288204 - DNA, 16 bp, P. troglodytes
tttattgtctatctcc

SEQ ID NO: 288205 - DNA, 16 bp, P. troglodytes
tttattgtggtaaaat

SEQ ID NO: 288206 - DNA, 16 bp, P. troglodytes
tttatttaaagcattt

SEQ ID NO: 288207 - DNA, 16 bp, P. troglodytes
tttatttaaatgaagt

SEQ ID NO: 288208 - DNA, 16 bp, P. troglodytes
tttatttaagagacag

SEQ ID NO: 288209 - DNA, 16 bp, P. troglodytes
tttatttacaaaagca

SEQ ID NO: 288210 - DNA, 16 bp, P. troglodytes
tttatttacaaaagta

SEQ ID NO: 288211 - DNA, 16 bp, P. troglodytes
tttatttacatgattt

SEQ ID NO: 288212 - DNA, 16 bp, P. troglodytes
tttatttacatttccc

SEQ ID NO: 288213 - DNA, 16 bp, P. troglodytes
tttatttactaaaaca

SEQ ID NO: 288214 - DNA, 16 bp, P. troglodytes
tttatttagaaaatgt

SEQ ID NO: 288215 - DNA, 16 bp, P. troglodytes
tttatttagaaagaaa

SEQ ID NO: 288216 - DNA, 16 bp, P. troglodytes
tttatttagaaatgga

SEQ ID NO: 288217 - DNA, 16 bp, P. troglodytes
tttatttagcataatg

SEQ ID NO: 288218 - DNA, 16 bp, P. troglodytes
tttatttagcatctac

SEQ ID NO: 288219 - DNA, 16 bp, P. troglodytes
tttatttagccattca

SEQ ID NO: 288220 - DNA, 16 bp, P. troglodytes
tttatttaggccttct

SEQ ID NO: 288221 - DNA, 16 bp, P. troglodytes
tttatttagtgcctat

SEQ ID NO: 288222 - DNA, 16 bp, P. troglodytes
tttatttatagaaaca

SEQ ID NO: 288223 - DNA, 16 bp, P. troglodytes
tttatttatccagttt

SEQ ID NO: 288224 - DNA, 16 bp, P. troglodytes
tttatttatgaaacag

SEQ ID NO: 288225 - DNA, 16 bp, P. troglodytes
tttatttatgagacag

SEQ ID NO: 288226 - DNA, 16 bp, P. troglodytes
tttatttatgcattta

SEQ ID NO: 288227 - DNA, 16 bp, P. troglodytes
tttatttattgaacaa

SEQ ID NO: 288228 - DNA, 16 bp, P. troglodytes
tttatttattgagaaa

SEQ ID NO: 288229 - DNA, 16 bp, P. troglodytes
tttatttatttgctca

SEQ ID NO: 288230 - DNA, 16 bp, P. troglodytes
tttatttatttgggtc

SEQ ID NO: 288231 - DNA, 16 bp, P. troglodytes
tttatttattttacag

SEQ ID NO: 288232 - DNA, 16 bp, P. troglodytes
tttatttcaaaaacaa

SEQ ID NO: 288233 - DNA, 16 bp, P. troglodytes
tttatttcaaagaaaa

SEQ ID NO: 288234 - DNA, 16 bp, P. troglodytes
tttatttcaaagaatt

SEQ ID NO: 288235 - DNA, 16 bp, P. troglodytes
tttatttcaaatatca

SEQ ID NO: 288236 - DNA, 16 bp, P. troglodytes
tttatttcaaattgtt

SEQ ID NO: 288237 - DNA, 16 bp, P. troglodytes
tttatttcaagaaaat

SEQ ID NO: 288238 - DNA, 16 bp, P. troglodytes
tttatttcagaaatgt

SEQ ID NO: 288239 - DNA, 16 bp, P. troglodytes
tttatttcagcagtgt

SEQ ID NO: 288240 - DNA, 16 bp, P. troglodytes
tttatttcagcattat

SEQ ID NO: 288241 - DNA, 16 bp, P. troglodytes
tttatttcaggaaaat

SEQ ID NO: 288242 - DNA, 16 bp, P. troglodytes
tttatttcatgcattt

SEQ ID NO: 288243 - DNA, 16 bp, P. troglodytes
tttatttccaagtttt

SEQ ID NO: 288244 - DNA, 16 bp, P. troglodytes
tttatttccataaaat

SEQ ID NO: 288245 - DNA, 16 bp, P. troglodytes
tttatttctaaatgtt

SEQ ID NO: 288246 - DNA, 16 bp, P. troglodytes
tttatttctcaaaaaa

SEQ ID NO: 288247 - DNA, 16 bp, P. troglodytes
tttatttctcaaagtt

SEQ ID NO: 288248 - DNA, 16 bp, P. troglodytes
tttatttctcagttct

SEQ ID NO: 288249 - DNA, 16 bp, P. troglodytes
tttatttctccagaaa

SEQ ID NO: 288250 - DNA, 16 bp, P. troglodytes
tttatttctgaatatt

SEQ ID NO: 288251 - DNA, 16 bp, P. troglodytes
tttatttctgagacag

SEQ ID NO: 288252 - DNA, 16 bp, P. troglodytes
tttatttctgctctca

SEQ ID NO: 288253 - DNA, 16 bp, P. troglodytes
tttatttctggaattt

SEQ ID NO: 288254 - DNA, 16 bp, P. troglodytes
tttatttctgtaaaaa

SEQ ID NO: 288255 - DNA, 16 bp, P. troglodytes
tttatttctgtagaat

SEQ ID NO: 288256 - DNA, 16 bp, P. troglodytes
tttatttcttaaaaca

SEQ ID NO: 288257 - DNA, 16 bp, P. troglodytes
tttatttcttacagtt

SEQ ID NO: 288258 - DNA, 16 bp, P. troglodytes
tttatttcttctcaaa

SEQ ID NO: 288259 - DNA, 16 bp, P. troglodytes
tttatttcttgaaaaa

SEQ ID NO: 288260 - DNA, 16 bp, P. troglodytes
tttatttctttatgaa

SEQ ID NO: 288261 - DNA, 16 bp, P. troglodytes
tttatttctttgtaaa

SEQ ID NO: 288262 - DNA, 16 bp, P. troglodytes
tttatttgaaaagtaa

SEQ ID NO: 288263 - DNA, 16 bp, P. troglodytes
tttatttgaaatcttt

SEQ ID NO: 288264 - DNA, 16 bp, P. troglodytes
tttatttgaaattcag

SEQ ID NO: 288265 - DNA, 16 bp, P. troglodytes
tttatttgaatcttct

SEQ ID NO: 288266 - DNA, 16 bp, P. troglodytes
tttatttgacatttta

SEQ ID NO: 288267 - DNA, 16 bp, P. troglodytes
tttatttgagcaaaca

SEQ ID NO: 288268 - DNA, 16 bp, P. troglodytes
tttatttgcagctatt

SEQ ID NO: 288269 - DNA, 16 bp, P. troglodytes
tttatttgcatagagg

SEQ ID NO: 288270 - DNA, 16 bp, P. troglodytes
tttatttgcatcttct

SEQ ID NO: 288271 - DNA, 16 bp, P. troglodytes
tttatttggagaaata

SEQ ID NO: 288272 - DNA, 16 bp, P. troglodytes
tttatttgggaagaaa

SEQ ID NO: 288273 - DNA, 16 bp, P. troglodytes
tttatttgtatcatct

SEQ ID NO: 288274 - DNA, 16 bp, P. troglodytes
tttatttgtggaaaaa

SEQ ID NO: 288275 - DNA, 16 bp, P. troglodytes
tttattttaaaagatg

SEQ ID NO: 288276 - DNA, 16 bp, P. troglodytes
tttattttaaatgcta

SEQ ID NO: 288277 - DNA, 16 bp, P. troglodytes
tttattttaaattctg

SEQ ID NO: 288278 - DNA, 16 bp, P. troglodytes
tttattttaaggaact

SEQ ID NO: 288279 - DNA, 16 bp, P. troglodytes
tttattttaagttgag

SEQ ID NO: 288280 - DNA, 16 bp, P. troglodytes
tttattttaattgaca

SEQ ID NO: 288281 - DNA, 16 bp, P. troglodytes
tttattttacagaaaa

SEQ ID NO: 288282 - DNA, 16 bp, P. troglodytes
tttattttacagaaga

SEQ ID NO: 288283 - DNA, 16 bp, P. troglodytes
tttattttacttgaaa

SEQ ID NO: 288284 - DNA, 16 bp, P. troglodytes
tttattttaggaaaaa

SEQ ID NO: 288285 - DNA, 16 bp, P. troglodytes
tttattttatgagaaa

SEQ ID NO: 288286 - DNA, 16 bp, P. troglodytes
tttattttcaggattt

SEQ ID NO: 288287 - DNA, 16 bp, P. troglodytes
tttattttcagtttca

SEQ ID NO: 288288 - DNA, 16 bp, P. troglodytes
tttattttcataaatg

SEQ ID NO: 288289 - DNA, 16 bp, P. troglodytes
tttattttccatctgt

SEQ ID NO: 288290 - DNA, 16 bp, P. troglodytes
tttattttcctaatga

SEQ ID NO: 288291 - DNA, 16 bp, P. troglodytes
tttattttcctacagt

SEQ ID NO: 288292 - DNA, 16 bp, P. troglodytes
tttattttctcccagt

SEQ ID NO: 288293 - DNA, 16 bp, P. troglodytes
tttattttctgtaaaa

SEQ ID NO: 288294 - DNA, 16 bp, P. troglodytes
tttattttctgtgaaa

SEQ ID NO: 288295 - DNA, 16 bp, P. troglodytes
tttattttctgtgtaa

SEQ ID NO: 288296 - DNA, 16 bp, P. troglodytes
tttattttcttaatgg

SEQ ID NO: 288297 - DNA, 16 bp, P. troglodytes
tttattttcttgaaaa

SEQ ID NO: 288298 - DNA, 16 bp, P. troglodytes
tttattttcttggaaa

SEQ ID NO: 288299 - DNA, 16 bp, P. troglodytes
tttattttctttagag

SEQ ID NO: 288300 - DNA, 16 bp, P. troglodytes
tttattttgaaaaatg

SEQ ID NO: 288301 - DNA, 16 bp, P. troglodytes
tttattttgaaatcag

SEQ ID NO: 288302 - DNA, 16 bp, P. troglodytes
tttattttgaagataa

SEQ ID NO: 288303 - DNA, 16 bp, P. troglodytes
tttattttgagatgta

SEQ ID NO: 288304 - DNA, 24 bp, P. troglodytes
tttattttgagcctatgtgtgtct

SEQ ID NO: 288305 - DNA, 16 bp, P. troglodytes
tttattttgagtctgt

SEQ ID NO: 288306 - DNA, 16 bp, P. troglodytes
tttattttgcagaaaa

SEQ ID NO: 288307 - DNA, 16 bp, P. troglodytes
tttattttgccaaaat

SEQ ID NO: 288308 - DNA, 16 bp, P. troglodytes
tttattttggaaaaaa

SEQ ID NO: 288309 - DNA, 16 bp, P. troglodytes
tttattttggctcaca

SEQ ID NO: 288310 - DNA, 16 bp, P. troglodytes
tttattttgggacaga

SEQ ID NO: 288311 - DNA, 16 bp, P. troglodytes
tttattttgtgatgga

SEQ ID NO: 288312 - DNA, 16 bp, P. troglodytes
tttatttttaaaacca

SEQ ID NO: 288313 - DNA, 16 bp, P. troglodytes
tttatttttaaaggca

SEQ ID NO: 288314 - DNA, 16 bp, P. troglodytes
tttatttttaaatgct

SEQ ID NO: 288315 - DNA, 16 bp, P. troglodytes
tttatttttaacaagt

SEQ ID NO: 288316 - DNA, 16 bp, P. troglodytes
tttatttttaagccat

SEQ ID NO: 288317 - DNA, 16 bp, P. troglodytes
tttatttttaagttca

SEQ ID NO: 288318 - DNA, 16 bp, P. troglodytes
tttatttttacagaaa

SEQ ID NO: 288319 - DNA, 16 bp, P. troglodytes
tttatttttagcagtt

SEQ ID NO: 288320 - DNA, 16 bp, P. troglodytes
tttatttttagccatt

SEQ ID NO: 288321 - DNA, 16 bp, P. troglodytes
tttatttttaggggaa

SEQ ID NO: 288322 - DNA, 16 bp, P. troglodytes
tttatttttcaaatgt

SEQ ID NO: 288323 - DNA, 16 bp, P. troglodytes
tttatttttcagaaat

SEQ ID NO: 288324 - DNA, 16 bp, P. troglodytes
tttatttttccagaaa

SEQ ID NO: 288325 - DNA, 16 bp, P. troglodytes
tttatttttctccaga

SEQ ID NO: 288326 - DNA, 16 bp, P. troglodytes
tttatttttctgaaaa

SEQ ID NO: 288327 - DNA, 16 bp, P. troglodytes
tttatttttgaaatgg

SEQ ID NO: 288328 - DNA, 16 bp, P. troglodytes
tttatttttgcatatg

SEQ ID NO: 288329 - DNA, 16 bp, P. troglodytes
tttatttttgccatta

SEQ ID NO: 288330 - DNA, 16 bp, P. troglodytes
tttatttttgctaata

SEQ ID NO: 288331 - DNA, 16 bp, P. troglodytes
tttatttttggaagaa

SEQ ID NO: 288332 - DNA, 16 bp, P. troglodytes
tttatttttggagact

SEQ ID NO: 288333 - DNA, 16 bp, P. troglodytes
tttatttttgtacaga

SEQ ID NO: 288334 - DNA, 16 bp, P. troglodytes
tttatttttgtgaaga

SEQ ID NO: 288335 - DNA, 16 bp, P. troglodytes
tttattttttcaaaga

SEQ ID NO: 288336 - DNA, 16 bp, P. troglodytes
tttattttttgaaaac

SEQ ID NO: 288337 - DNA, 16 bp, P. troglodytes
tttattttttgtagca

SEQ ID NO: 288338 - DNA, 16 bp, P. troglodytes
tttatttttttcagag

SEQ ID NO: 288339 - DNA, 16 bp, P. troglodytes
tttatttttttccaag

SEQ ID NO: 288340 - DNA, 16 bp, P. troglodytes
tttcaaaaaaatgaat

SEQ ID NO: 288341 - DNA, 24 bp, P. troglodytes
tttcaaaaaaccagctcctggatt

SEQ ID NO: 288342 - DNA, 16 bp, P. troglodytes
tttcaaaaaactattt

SEQ ID NO: 288343 - DNA, 16 bp, P. troglodytes
tttcaaaaaaggaaaa

SEQ ID NO: 288344 - DNA, 16 bp, P. troglodytes
tttcaaaaaagtattt

SEQ ID NO: 288345 - DNA, 16 bp, P. troglodytes
tttcaaaaaattaatg

SEQ ID NO: 288346 - DNA, 16 bp, P. troglodytes
tttcaaaaacaaagaa

SEQ ID NO: 288347 - DNA, 16 bp, P. troglodytes
tttcaaaaacaattat

SEQ ID NO: 288348 - DNA, 16 bp, P. troglodytes
tttcaaaaactatttt

SEQ ID NO: 288349 - DNA, 16 bp, P. troglodytes
tttcaaaaactgaaaa

SEQ ID NO: 288350 - DNA, 16 bp, P. troglodytes
tttcaaaaagaaattt

SEQ ID NO: 288351 - DNA, 16 bp, P. troglodytes
tttcaaaaagatattt

SEQ ID NO: 288352 - DNA, 16 bp, P. troglodytes
tttcaaaaaggaaaca

SEQ ID NO: 288353 - DNA, 16 bp, P. troglodytes
tttcaaaaagtaaata

SEQ ID NO: 288354 - DNA, 16 bp, P. troglodytes
tttcaaaaagtttaaa

SEQ ID NO: 288355 - DNA, 16 bp, P. troglodytes
tttcaaaaatatggaa

SEQ ID NO: 288356 - DNA, 16 bp, P. troglodytes
tttcaaaaatgagaaa

SEQ ID NO: 288357 - DNA, 16 bp, P. troglodytes
tttcaaaaatgcattt

SEQ ID NO: 288358 - DNA, 16 bp, P. troglodytes
tttcaaaaatgttaat

SEQ ID NO: 288359 - DNA, 16 bp, P. troglodytes
tttcaaaaatgttttt

SEQ ID NO: 288360 - DNA, 16 bp, P. troglodytes
tttcaaaaattctgaa

SEQ ID NO: 288361 - DNA, 16 bp, P. troglodytes
tttcaaaacaaaaaga

SEQ ID NO: 288362 - DNA, 16 bp, P. troglodytes
tttcaaaacaaaagca

SEQ ID NO: 288363 - DNA, 16 bp, P. troglodytes
tttcaaaacaaatgaa

SEQ ID NO: 288364 - DNA, 16 bp, P. troglodytes
tttcaaaacataattt

SEQ ID NO: 288365 - DNA, 16 bp, P. troglodytes
tttcaaaacattttta

SEQ ID NO: 288366 - DNA, 16 bp, P. troglodytes
tttcaaaacatttttg

SEQ ID NO: 288367 - DNA, 16 bp, P. troglodytes
tttcaaaactaaattt

SEQ ID NO: 288368 - DNA, 16 bp, P. troglodytes
tttcaaaactgctaaa

SEQ ID NO: 288369 - DNA, 16 bp, P. troglodytes
tttcaaaactgctcta

SEQ ID NO: 288370 - DNA, 16 bp, P. troglodytes
tttcaaaactggaaaa

SEQ ID NO: 288371 - DNA, 16 bp, P. troglodytes
tttcaaaagaaaaata

SEQ ID NO: 288372 - DNA, 16 bp, P. troglodytes
tttcaaaagaaaatat

SEQ ID NO: 288373 - DNA, 16 bp, P. troglodytes
tttcaaaagaaaatgt

SEQ ID NO: 288374 - DNA, 16 bp, P. troglodytes
tttcaaaagaaattta

SEQ ID NO: 288375 - DNA, 16 bp, P. troglodytes
tttcaaaagaagacat

SEQ ID NO: 288376 - DNA, 16 bp, P. troglodytes
tttcaaaagaagactt

SEQ ID NO: 288377 - DNA, 16 bp, P. troglodytes
tttcaaaagaaggcat

SEQ ID NO: 288378 - DNA, 16 bp, P. troglodytes
tttcaaaagacataca

SEQ ID NO: 288379 - DNA, 16 bp, P. troglodytes
tttcaaaagatgaaaa

SEQ ID NO: 288380 - DNA, 16 bp, P. troglodytes
tttcaaaagccaaaga

SEQ ID NO: 288381 - DNA, 16 bp, P. troglodytes
tttcaaaaggaaaaga

SEQ ID NO: 288382 - DNA, 16 bp, P. troglodytes
tttcaaaagggagaaa

SEQ ID NO: 288383 - DNA, 16 bp, P. troglodytes
tttcaaaaggggaggg

SEQ ID NO: 288384 - DNA, 16 bp, P. troglodytes
tttcaaaataaaaagt

SEQ ID NO: 288385 - DNA, 16 bp, P. troglodytes
tttcaaaataacaagt

SEQ ID NO: 288386 - DNA, 16 bp, P. troglodytes
tttcaaaataatcttt

SEQ ID NO: 288387 - DNA, 16 bp, P. troglodytes
tttcaaaataattttc

SEQ ID NO: 288388 - DNA, 16 bp, P. troglodytes
tttcaaaatatattac

SEQ ID NO: 288389 - DNA, 16 bp, P. troglodytes
tttcaaaatatgtgaa

SEQ ID NO: 288390 - DNA, 16 bp, P. troglodytes
tttcaaaatatgtgta

SEQ ID NO: 288391 - DNA, 16 bp, P. troglodytes
tttcaaaatatgtttt

SEQ ID NO: 288392 - DNA, 16 bp, P. troglodytes
tttcaaaatattaatg

SEQ ID NO: 288393 - DNA, 16 bp, P. troglodytes
tttcaaaatattactg

SEQ ID NO: 288394 - DNA, 16 bp, P. troglodytes
tttcaaaatatttctg

SEQ ID NO: 288395 - DNA, 16 bp, P. troglodytes
tttcaaaatcagtttt

SEQ ID NO: 288396 - DNA, 16 bp, P. troglodytes
tttcaaaatgaaaatt

SEQ ID NO: 288397 - DNA, 16 bp, P. troglodytes
tttcaaaatggaaaat

SEQ ID NO: 288398 - DNA, 16 bp, P. troglodytes
tttcaaaatgggaaaa

SEQ ID NO: 288399 - DNA, 16 bp, P. troglodytes
tttcaaaatgtcatgt

SEQ ID NO: 288400 - DNA, 16 bp, P. troglodytes
tttcaaaattaaaagt

SEQ ID NO: 288401 - DNA, 16 bp, P. troglodytes
tttcaaaattaatcat

SEQ ID NO: 288402 - DNA, 16 bp, P. troglodytes
tttcaaaattatcttg

SEQ ID NO: 288403 - DNA, 16 bp, P. troglodytes
tttcaaaattattttg

SEQ ID NO: 288404 - DNA, 16 bp, P. troglodytes
tttcaaaattctcatt

SEQ ID NO: 288405 - DNA, 16 bp, P. troglodytes
tttcaaaattgctaaa

SEQ ID NO: 288406 - DNA, 16 bp, P. troglodytes
tttcaaaattttcaaa

SEQ ID NO: 288407 - DNA, 16 bp, P. troglodytes
tttcaaacaaaacaga

SEQ ID NO: 288408 - DNA, 16 bp, P. troglodytes
tttcaaacactttttt

SEQ ID NO: 288409 - DNA, 16 bp, P. troglodytes
tttcaaacatacaaaa

SEQ ID NO: 288410 - DNA, 16 bp, P. troglodytes
tttcaaacatatataa

SEQ ID NO: 288411 - DNA, 16 bp, P. troglodytes
tttcaaacattatttc

SEQ ID NO: 288412 - DNA, 16 bp, P. troglodytes
tttcaaactattcatc

SEQ ID NO: 288413 - DNA, 16 bp, P. troglodytes
tttcaaacttagagaa

SEQ ID NO: 288414 - DNA, 16 bp, P. troglodytes
tttcaaactttaaaaa

SEQ ID NO: 288415 - DNA, 16 bp, P. troglodytes
tttcaaactttaaaat

SEQ ID NO: 288416 - DNA, 16 bp, P. troglodytes
tttcaaacttttccat

SEQ ID NO: 288417 - DNA, 16 bp, P. troglodytes
tttcaaactttttgat

SEQ ID NO: 288418 - DNA, 16 bp, P. troglodytes
tttcaaagaaaaataa

SEQ ID NO: 288419 - DNA, 16 bp, P. troglodytes
tttcaaagaaaaatta

SEQ ID NO: 288420 - DNA, 16 bp, P. troglodytes
tttcaaagaaaacaga

SEQ ID NO: 288421 - DNA, 16 bp, P. troglodytes
tttcaaagaaaataat

SEQ ID NO: 288422 - DNA, 16 bp, P. troglodytes
tttcaaagaaacatct

SEQ ID NO: 288423 - DNA, 16 bp, P. troglodytes
tttcaaagaaagtaaa

SEQ ID NO: 288424 - DNA, 16 bp, P. troglodytes
tttcaaagaaccaaat

SEQ ID NO: 288425 - DNA, 16 bp, P. troglodytes
tttcaaagaacttgtt

SEQ ID NO: 288426 - DNA, 16 bp, P. troglodytes
tttcaaagaacttttt

SEQ ID NO: 288427 - DNA, 16 bp, P. troglodytes
tttcaaagaatttctt

SEQ ID NO: 288428 - DNA, 16 bp, P. troglodytes
tttcaaagatttcttt

SEQ ID NO: 288429 - DNA, 21 bp, P. troglodytes
tttcaaagggaatgcttccag

SEQ ID NO: 288430 - DNA, 16 bp, P. troglodytes
tttcaaaggtagtttg

SEQ ID NO: 288431 - DNA, 16 bp, P. troglodytes
tttcaaagtgattttt

SEQ ID NO: 288432 - DNA, 16 bp, P. troglodytes
tttcaaagttactttc

SEQ ID NO: 288433 - DNA, 16 bp, P. troglodytes
tttcaaataaaattct

SEQ ID NO: 288434 - DNA, 16 bp, P. troglodytes
tttcaaataaatggaa

SEQ ID NO: 288435 - DNA, 16 bp, P. troglodytes
tttcaaataagaaata

SEQ ID NO: 288436 - DNA, 16 bp, P. troglodytes
tttcaaataatgactt

SEQ ID NO: 288437 - DNA, 16 bp, P. troglodytes
tttcaaatacatgaaa

SEQ ID NO: 288438 - DNA, 16 bp, P. troglodytes
tttcaaatacattttc

SEQ ID NO: 288439 - DNA, 16 bp, P. troglodytes
tttcaaatactttttg

SEQ ID NO: 288440 - DNA, 16 bp, P. troglodytes
tttcaaatatacagaa

SEQ ID NO: 288441 - DNA, 16 bp, P. troglodytes
tttcaaatatcttctc

SEQ ID NO: 288442 - DNA, 16 bp, P. troglodytes
tttcaaatattttgaa

SEQ ID NO: 288443 - DNA, 16 bp, P. troglodytes
tttcaaatatttttga

SEQ ID NO: 288444 - DNA, 16 bp, P. troglodytes
tttcaaatattttttg

SEQ ID NO: 288445 - DNA, 16 bp, P. troglodytes
tttcaaatctcttatt

SEQ ID NO: 288446 - DNA, 16 bp, P. troglodytes
tttcaaatctgtaatt

SEQ ID NO: 288447 - DNA, 16 bp, P. troglodytes
tttcaaatgaagaaaa

SEQ ID NO: 288448 - DNA, 16 bp, P. troglodytes
tttcaaatgaagaaac

SEQ ID NO: 288449 - DNA, 16 bp, P. troglodytes
tttcaaatgaataaaa

SEQ ID NO: 288450 - DNA, 16 bp, P. troglodytes
tttcaaatgcattttt

SEQ ID NO: 288451 - DNA, 16 bp, P. troglodytes
tttcaaatgctttttt

SEQ ID NO: 288452 - DNA, 16 bp, P. troglodytes
tttcaaatgtaataaa

SEQ ID NO: 288453 - DNA, 16 bp, P. troglodytes
tttcaaatgttttcaa

SEQ ID NO: 288454 - DNA, 16 bp, P. troglodytes
tttcaaatgtttttct

SEQ ID NO: 288455 - DNA, 16 bp, P. troglodytes
tttcaaattcctgacc

SEQ ID NO: 288456 - DNA, 16 bp, P. troglodytes
tttcaaatttcaaatt

SEQ ID NO: 288457 - DNA, 16 bp, P. troglodytes
tttcaaatttgaaatt

SEQ ID NO: 288458 - DNA, 16 bp, P. troglodytes
tttcaacaaaagcaaa

SEQ ID NO: 288459 - DNA, 16 bp, P. troglodytes
tttcaacaaaattgaa

SEQ ID NO: 288460 - DNA, 16 bp, P. troglodytes
tttcaacacaggaatt

SEQ ID NO: 288461 - DNA, 16 bp, P. troglodytes
tttcaacagcatgtgc

SEQ ID NO: 288462 - DNA, 16 bp, P. troglodytes
tttcaacatagaaatt

SEQ ID NO: 288463 - DNA, 16 bp, P. troglodytes
tttcaacatatgattt

SEQ ID NO: 288464 - DNA, 16 bp, P. troglodytes
tttcaacatgaatttt

SEQ ID NO: 288465 - DNA, 16 bp, P. troglodytes
tttcaacatttgaaaa

SEQ ID NO: 288466 - DNA, 16 bp, P. troglodytes
tttcaacattttaata

SEQ ID NO: 288467 - DNA, 16 bp, P. troglodytes
tttcaaccaattgcca

SEQ ID NO: 288468 - DNA, 16 bp, P. troglodytes
tttcaacccagatttt

SEQ ID NO: 288469 - DNA, 16 bp, P. troglodytes
tttcaacctctgccca

SEQ ID NO: 288470 - DNA, 16 bp, P. troglodytes
tttcaagaaatggtgc

SEQ ID NO: 288471 - DNA, 16 bp, P. troglodytes
tttcaagaaattttta

SEQ ID NO: 288472 - DNA, 16 bp, P. troglodytes
tttcaagaatgtcata

SEQ ID NO: 288473 - DNA, 16 bp, P. troglodytes
tttcaagaattatttt

SEQ ID NO: 288474 - DNA, 16 bp, P. troglodytes
tttcaagacaaaaacc

SEQ ID NO: 288475 - DNA, 16 bp, P. troglodytes
tttcaagaccagcctg

SEQ ID NO: 288476 - DNA, 16 bp, P. troglodytes
tttcaagagaagctgg

SEQ ID NO: 288477 - DNA, 16 bp, P. troglodytes
tttcaagattgttttt

SEQ ID NO: 288478 - DNA, 16 bp, P. troglodytes
tttcaagcaaaaatta

SEQ ID NO: 288479 - DNA, 16 bp, P. troglodytes
tttcaagcacaaaact

SEQ ID NO: 288480 - DNA, 16 bp, P. troglodytes
tttcaaggaaaaaaaa

SEQ ID NO: 288481 - DNA, 16 bp, P. troglodytes
tttcaaggaaaaacat

SEQ ID NO: 288482 - DNA, 16 bp, P. troglodytes
tttcaaggaatttttc

SEQ ID NO: 288483 - DNA, 16 bp, P. troglodytes
tttcaagtgctcatta

SEQ ID NO: 288484 - DNA, 16 bp, P. troglodytes
tttcaagtttaaaaaa

SEQ ID NO: 288485 - DNA, 16 bp, P. troglodytes
tttcaataaaatccaa

SEQ ID NO: 288486 - DNA, 16 bp, P. troglodytes
tttcaataaaattcaa

SEQ ID NO: 288487 - DNA, 16 bp, P. troglodytes
tttcaataaactttct

SEQ ID NO: 288488 - DNA, 16 bp, P. troglodytes
tttcaataaagctatt

SEQ ID NO: 288489 - DNA, 16 bp, P. troglodytes
tttcaataaattcctt

SEQ ID NO: 288490 - DNA, 16 bp, P. troglodytes
tttcaataacatttta

SEQ ID NO: 288491 - DNA, 16 bp, P. troglodytes
tttcaataatagccat

SEQ ID NO: 288492 - DNA, 16 bp, P. troglodytes
tttcaatagtttttga

SEQ ID NO: 288493 - DNA, 16 bp, P. troglodytes
tttcaatatgaatttt

SEQ ID NO: 288494 - DNA, 16 bp, P. troglodytes
tttcaatattgttttg

SEQ ID NO: 288495 - DNA, 16 bp, P. troglodytes
tttcaatatttgaaaa

SEQ ID NO: 288496 - DNA, 16 bp, P. troglodytes
tttcaatctcactgct

SEQ ID NO: 288497 - DNA, 16 bp, P. troglodytes
tttcaatctctttgtt

SEQ ID NO: 288498 - DNA, 16 bp, P. troglodytes
tttcaatgacattttt

SEQ ID NO: 288499 - DNA, 16 bp, P. troglodytes
tttcaatgatgttttg

SEQ ID NO: 288500 - DNA, 16 bp, P. troglodytes
tttcaatggaaatttt

SEQ ID NO: 288501 - DNA, 16 bp, P. troglodytes
tttcaattaggaaaag

SEQ ID NO: 288502 - DNA, 16 bp, P. troglodytes
tttcaattcatttaaa

SEQ ID NO: 288503 - DNA, 16 bp, P. troglodytes
tttcaattctgtcagt

SEQ ID NO: 288504 - DNA, 16 bp, P. troglodytes
tttcaatttatgaatt

SEQ ID NO: 288505 - DNA, 16 bp, P. troglodytes
tttcaatttctccata

SEQ ID NO: 288506 - DNA, 16 bp, P. troglodytes
tttcaatttctttgaa

SEQ ID NO: 288507 - DNA, 16 bp, P. troglodytes
tttcaattttcatttg

SEQ ID NO: 288508 - DNA, 16 bp, P. troglodytes
tttcaattttctacat

SEQ ID NO: 288509 - DNA, 16 bp, P. troglodytes
tttcaattttcttaag

SEQ ID NO: 288510 - DNA, 16 bp, P. troglodytes
tttcaattttgttgat

SEQ ID NO: 288511 - DNA, 16 bp, P. troglodytes
tttcacaaaaatgaaa

SEQ ID NO: 288512 - DNA, 16 bp, P. troglodytes
tttcacaaatcaccac

SEQ ID NO: 288513 - DNA, 16 bp, P. troglodytes
tttcacaaattttata

SEQ ID NO: 288514 - DNA, 16 bp, P. troglodytes
tttcacaacaacccta

SEQ ID NO: 288515 - DNA, 16 bp, P. troglodytes
tttcacaatattcatt

SEQ ID NO: 288516 - DNA, 16 bp, P. troglodytes
tttcacaatattgatt

SEQ ID NO: 288517 - DNA, 16 bp, P. troglodytes
tttcacaattttaaaa

SEQ ID NO: 288518 - DNA, 16 bp, P. troglodytes
tttcacacacaaaaaa

SEQ ID NO: 288519 - DNA, 16 bp, P. troglodytes
tttcacacacacacac

SEQ ID NO: 288520 - DNA, 16 bp, P. troglodytes
tttcacagaaaaaaaa

SEQ ID NO: 288521 - DNA, 16 bp, P. troglodytes
tttcacagaagaagaa

SEQ ID NO: 288522 - DNA, 16 bp, P. troglodytes
tttcacagaattagaa

SEQ ID NO: 288523 - DNA, 16 bp, P. troglodytes
tttcacagaggaggaa

SEQ ID NO: 288524 - DNA, 16 bp, P. troglodytes
tttcacagagttgaac

SEQ ID NO: 288525 - DNA, 16 bp, P. troglodytes
tttcacagatggagaa

SEQ ID NO: 288526 - DNA, 16 bp, P. troglodytes
tttcacagattttttt

SEQ ID NO: 288527 - DNA, 16 bp, P. troglodytes
tttcacagcaaaggaa

SEQ ID NO: 288528 - DNA, 16 bp, P. troglodytes
tttcacataagaaaat

SEQ ID NO: 288529 - DNA, 16 bp, P. troglodytes
tttcacataataaaat

SEQ ID NO: 288530 - DNA, 16 bp, P. troglodytes
tttcacatcaccaaga

SEQ ID NO: 288531 - DNA, 16 bp, P. troglodytes
tttcacatttagattt

SEQ ID NO: 288532 - DNA, 17 bp, P. troglodytes
tttcaccacgttagcca

SEQ ID NO: 288533 - DNA, 16 bp, P. troglodytes
tttcaccagatatact

SEQ ID NO: 288534 - DNA, 16 bp, P. troglodytes
tttcaccaggctggcc

SEQ ID NO: 288535 - DNA, 16 bp, P. troglodytes
tttcaccagtgtttta

SEQ ID NO: 288536 - DNA, 18 bp, P. troglodytes
tttcaccatattggtcat

SEQ ID NO: 288537 - DNA, 17 bp, P. troglodytes
tttcaccatcttgacca

SEQ ID NO: 288538 - DNA, 17 bp, P. troglodytes
tttcaccatgttaatca

SEQ ID NO: 288539 - DNA, 17 bp, P. troglodytes
tttcaccatgttaccca

SEQ ID NO: 288540 - DNA, 18 bp, P. troglodytes
tttcaccatgttgaccaa

SEQ ID NO: 288541 - DNA, 16 bp, P. troglodytes
tttcaccatgttgacg

SEQ ID NO: 288542 - DNA, 16 bp, P. troglodytes
tttcaccatgttgcca

SEQ ID NO: 288543 - DNA, 16 bp, P. troglodytes
tttcaccatgttgcct

SEQ ID NO: 288544 - DNA, 16 bp, P. troglodytes
tttcaccatgttgctc

SEQ ID NO: 288545 - DNA, 16 bp, P. troglodytes
tttcaccatgttgctt

SEQ ID NO: 288546 - DNA, 18 bp, P. troglodytes
tttcaccatgttggccaa

SEQ ID NO: 288547 - DNA, 19 bp, P. troglodytes
tttcaccatgttggccagc

SEQ ID NO: 288548 - DNA, 23 bp, P. troglodytes
tttcaccatgttggccaggctga

SEQ ID NO: 288549 - DNA, 17 bp, P. troglodytes
tttcaccatgttggtcg

SEQ ID NO: 288550 - DNA, 16 bp, P. troglodytes
tttcaccatgtttcct

SEQ ID NO: 288551 - DNA, 16 bp, P. troglodytes
tttcaccattgaatat

SEQ ID NO: 288552 - DNA, 17 bp, P. troglodytes
tttcaccattttgccca

SEQ ID NO: 288553 - DNA, 16 bp, P. troglodytes
tttcacccagcataat

SEQ ID NO: 288554 - DNA, 17 bp, P. troglodytes
tttcacccctggcccct

SEQ ID NO: 288555 - DNA, 19 bp, P. troglodytes
tttcaccctgttagccagg

SEQ ID NO: 288556 - DNA, 19 bp, P. troglodytes
tttcaccgtgttagccaga

SEQ ID NO: 288557 - DNA, 21 bp, P. troglodytes
tttcaccgtgttagccaggac

SEQ ID NO: 288558 - DNA, 16 bp, P. troglodytes
tttcaccgtgttgccc

SEQ ID NO: 288559 - DNA, 16 bp, P. troglodytes
tttcacctatcagatt

SEQ ID NO: 288560 - DNA, 16 bp, P. troglodytes
tttcaccttagcattt

SEQ ID NO: 288561 - DNA, 16 bp, P. troglodytes
tttcaccttcagccat

SEQ ID NO: 288562 - DNA, 16 bp, P. troglodytes
tttcaccttttaaaaa

SEQ ID NO: 288563 - DNA, 16 bp, P. troglodytes
tttcactaaaattaaa

SEQ ID NO: 288564 - DNA, 16 bp, P. troglodytes
tttcactaattttgct

SEQ ID NO: 288565 - DNA, 17 bp, P. troglodytes
tttcactatgttgacca

SEQ ID NO: 288566 - DNA, 16 bp, P. troglodytes
tttcactatgttgctc

SEQ ID NO: 288567 - DNA, 17 bp, P. troglodytes
tttcactatgttggccg

SEQ ID NO: 288568 - DNA, 16 bp, P. troglodytes
tttcactatgttggct

SEQ ID NO: 288569 - DNA, 16 bp, P. troglodytes
tttcactcagcatcat

SEQ ID NO: 288570 - DNA, 16 bp, P. troglodytes
tttcactgccctaaaa

SEQ ID NO: 288571 - DNA, 16 bp, P. troglodytes
tttcactgccttaaaa

SEQ ID NO: 288572 - DNA, 16 bp, P. troglodytes
tttcactgtatataaa

SEQ ID NO: 288573 - DNA, 16 bp, P. troglodytes
tttcactgtctcagtt

SEQ ID NO: 288574 - DNA, 16 bp, P. troglodytes
tttcactgttggtggg

SEQ ID NO: 288575 - DNA, 16 bp, P. troglodytes
tttcacttaaaattat

SEQ ID NO: 288576 - DNA, 16 bp, P. troglodytes
tttcacttaacattgt

SEQ ID NO: 288577 - DNA, 16 bp, P. troglodytes
tttcacttaataatat

SEQ ID NO: 288578 - DNA, 16 bp, P. troglodytes
tttcacttaatgtatt

SEQ ID NO: 288579 - DNA, 16 bp, P. troglodytes
tttcacttagtaatat

SEQ ID NO: 288580 - DNA, 16 bp, P. troglodytes
tttcacttctgatttt

SEQ ID NO: 288581 - DNA, 16 bp, P. troglodytes
tttcacttcttcagtt

SEQ ID NO: 288582 - DNA, 16 bp, P. troglodytes
tttcacttgaacactt

SEQ ID NO: 288583 - DNA, 16 bp, P. troglodytes
tttcacttggcataat

SEQ ID NO: 288584 - DNA, 16 bp, P. troglodytes
tttcactttaaaaaaa

SEQ ID NO: 288585 - DNA, 16 bp, P. troglodytes
tttcactttaaaatgt

SEQ ID NO: 288586 - DNA, 16 bp, P. troglodytes
tttcactttcaaatat

SEQ ID NO: 288587 - DNA, 16 bp, P. troglodytes
tttcacttttaaaatg

SEQ ID NO: 288588 - DNA, 16 bp, P. troglodytes
tttcactttttaaaaa

SEQ ID NO: 288589 - DNA, 16 bp, P. troglodytes
tttcactttttgaaaa

SEQ ID NO: 288590 - DNA, 16 bp, P. troglodytes
tttcagaaaaaagaaa

SEQ ID NO: 288591 - DNA, 16 bp, P. troglodytes
tttcagaaaaacaaat

SEQ ID NO: 288592 - DNA, 16 bp, P. troglodytes
tttcagaaaaaggaaa

SEQ ID NO: 288593 - DNA, 16 bp, P. troglodytes
tttcagaaaatgaaaa

SEQ ID NO: 288594 - DNA, 16 bp, P. troglodytes
tttcagaaaatgtatg

SEQ ID NO: 288595 - DNA, 16 bp, P. troglodytes
tttcagaaaatgtttt

SEQ ID NO: 288596 - DNA, 16 bp, P. troglodytes
tttcagaaagaaaaga

SEQ ID NO: 288597 - DNA, 16 bp, P. troglodytes
tttcagaaagaataaa

SEQ ID NO: 288598 - DNA, 16 bp, P. troglodytes
tttcagaaagagaaaa

SEQ ID NO: 288599 - DNA, 16 bp, P. troglodytes
tttcagaaaggaagga

SEQ ID NO: 288600 - DNA, 16 bp, P. troglodytes
tttcagaaaggagaaa

SEQ ID NO: 288601 - DNA, 16 bp, P. troglodytes
tttcagaaataaaaaa

SEQ ID NO: 288602 - DNA, 16 bp, P. troglodytes
tttcagaaataaaatt

SEQ ID NO: 288603 - DNA, 16 bp, P. troglodytes
tttcagaaatataaat

SEQ ID NO: 288604 - DNA, 16 bp, P. troglodytes
tttcagaaatatttct

SEQ ID NO: 288605 - DNA, 16 bp, P. troglodytes
tttcagaaattatttt

SEQ ID NO: 288606 - DNA, 16 bp, P. troglodytes
tttcagaactttttca

SEQ ID NO: 288607 - DNA, 16 bp, P. troglodytes
tttcagaagaaaaaat

SEQ ID NO: 288608 - DNA, 16 bp, P. troglodytes
tttcagaagaagaaat

SEQ ID NO: 288609 - DNA, 16 bp, P. troglodytes
tttcagaagagaaaaa

SEQ ID NO: 288610 - DNA, 27 bp, P. troglodytes
tttcagaaggaatggtaccagctcctt

SEQ ID NO: 288611 - DNA, 16 bp, P. troglodytes
tttcagaaggagtctc

SEQ ID NO: 288612 - DNA, 16 bp, P. troglodytes
tttcagaataaatatt

SEQ ID NO: 288613 - DNA, 16 bp, P. troglodytes
tttcagaatattttca

SEQ ID NO: 288614 - DNA, 16 bp, P. troglodytes
tttcagaatgtatttt

SEQ ID NO: 288615 - DNA, 16 bp, P. troglodytes
tttcagaattaaatga

SEQ ID NO: 288616 - DNA, 16 bp, P. troglodytes
tttcagaatttaaaaa

SEQ ID NO: 288617 - DNA, 16 bp, P. troglodytes
tttcagacaaaataga

SEQ ID NO: 288618 - DNA, 16 bp, P. troglodytes
tttcagacaaatgctg

SEQ ID NO: 288619 - DNA, 16 bp, P. troglodytes
tttcagactcagccca

SEQ ID NO: 288620 - DNA, 16 bp, P. troglodytes
tttcagactttggaat

SEQ ID NO: 288621 - DNA, 16 bp, P. troglodytes
tttcagactttttaat

SEQ ID NO: 288622 - DNA, 16 bp, P. troglodytes
tttcagagacaaggtc

SEQ ID NO: 288623 - DNA, 16 bp, P. troglodytes
tttcagagagagaatt

SEQ ID NO: 288624 - DNA, 16 bp, P. troglodytes
tttcagagagagagag

SEQ ID NO: 288625 - DNA, 16 bp, P. troglodytes
tttcagagatgaagaa

SEQ ID NO: 288626 - DNA, 16 bp, P. troglodytes
tttcagagatgccctg

SEQ ID NO: 288627 - DNA, 16 bp, P. troglodytes
tttcagagatgtcctg

SEQ ID NO: 288628 - DNA, 16 bp, P. troglodytes
tttcagagcagcctgg

SEQ ID NO: 288629 - DNA, 16 bp, P. troglodytes
tttcagaggaggaaac

SEQ ID NO: 288630 - DNA, 16 bp, P. troglodytes
tttcagagggaaaaaa

SEQ ID NO: 288631 - DNA, 16 bp, P. troglodytes
tttcagaggggaaaaa

SEQ ID NO: 288632 - DNA, 16 bp, P. troglodytes
tttcagatatttattt

SEQ ID NO: 288633 - DNA, 16 bp, P. troglodytes
tttcagatgaaagaaa

SEQ ID NO: 288634 - DNA, 16 bp, P. troglodytes
tttcagatgaggaaaa

SEQ ID NO: 288635 - DNA, 16 bp, P. troglodytes
tttcagattaaagaaa

SEQ ID NO: 288636 - DNA, 16 bp, P. troglodytes
tttcagatttcacatt

SEQ ID NO: 288637 - DNA, 16 bp, P. troglodytes
tttcagatttctcttc

SEQ ID NO: 288638 - DNA, 16 bp, P. troglodytes
tttcagatttcttctt

SEQ ID NO: 288639 - DNA, 16 bp, P. troglodytes
tttcagatttgatttt

SEQ ID NO: 288640 - DNA, 16 bp, P. troglodytes
tttcagatttggggat

SEQ ID NO: 288641 - DNA, 16 bp, P. troglodytes
tttcagattttaaaaa

SEQ ID NO: 288642 - DNA, 16 bp, P. troglodytes
tttcagattttctgct

SEQ ID NO: 288643 - DNA, 16 bp, P. troglodytes
tttcagatttttaaaa

SEQ ID NO: 288644 - DNA, 16 bp, P. troglodytes
tttcagatttttgaat

SEQ ID NO: 288645 - DNA, 16 bp, P. troglodytes
tttcagatttttttca

SEQ ID NO: 288646 - DNA, 16 bp, P. troglodytes
tttcagcaaaaaaaaa

SEQ ID NO: 288647 - DNA, 16 bp, P. troglodytes
tttcagcagtgttctg

SEQ ID NO: 288648 - DNA, 16 bp, P. troglodytes
tttcagcagtgtttca

SEQ ID NO: 288649 - DNA, 16 bp, P. troglodytes
tttcagcatttgcttg

SEQ ID NO: 288650 - DNA, 16 bp, P. troglodytes
tttcagccattctgat

SEQ ID NO: 288651 - DNA, 16 bp, P. troglodytes
tttcagcccaaaagct

SEQ ID NO: 288652 - DNA, 16 bp, P. troglodytes
tttcagccccaccctc

SEQ ID NO: 288653 - DNA, 16 bp, P. troglodytes
tttcagccccatcccc

SEQ ID NO: 288654 - DNA, 16 bp, P. troglodytes
tttcagcctccagaac

SEQ ID NO: 288655 - DNA, 16 bp, P. troglodytes
tttcagccttatttta

SEQ ID NO: 288656 - DNA, 16 bp, P. troglodytes
tttcagctatttcttt

SEQ ID NO: 288657 - DNA, 16 bp, P. troglodytes
tttcagctctatcaga

SEQ ID NO: 288658 - DNA, 16 bp, P. troglodytes
tttcagctggggaaga

SEQ ID NO: 288659 - DNA, 16 bp, P. troglodytes
tttcagcttctagtgg

SEQ ID NO: 288660 - DNA, 16 bp, P. troglodytes
tttcagcttctctgct

SEQ ID NO: 288661 - DNA, 16 bp, P. troglodytes
tttcagcttctggtgg

SEQ ID NO: 288662 - DNA, 16 bp, P. troglodytes
tttcagcttgaagaac

SEQ ID NO: 288663 - DNA, 16 bp, P. troglodytes
tttcagctttttaaaa

SEQ ID NO: 288664 - DNA, 16 bp, P. troglodytes
tttcaggaaaaaaaat

SEQ ID NO: 288665 - DNA, 16 bp, P. troglodytes
tttcaggaaaaacaaa

SEQ ID NO: 288666 - DNA, 16 bp, P. troglodytes
tttcaggatacaaaat

SEQ ID NO: 288667 - DNA, 16 bp, P. troglodytes
tttcaggcaaagggaa

SEQ ID NO: 288668 - DNA, 16 bp, P. troglodytes
tttcaggctttaaatt

SEQ ID NO: 288669 - DNA, 16 bp, P. troglodytes
tttcaggggaaaaaaa

SEQ ID NO: 288670 - DNA, 16 bp, P. troglodytes
tttcaggtatttttat

SEQ ID NO: 288671 - DNA, 16 bp, P. troglodytes
tttcaggtgcaccaat

SEQ ID NO: 288672 - DNA, 16 bp, P. troglodytes
tttcaggttttatatt

SEQ ID NO: 288673 - DNA, 16 bp, P. troglodytes
tttcagtaaatatttg

SEQ ID NO: 288674 - DNA, 16 bp, P. troglodytes
tttcagtaataataaa

SEQ ID NO: 288675 - DNA, 16 bp, P. troglodytes
tttcagtactgtgttg

SEQ ID NO: 288676 - DNA, 16 bp, P. troglodytes
tttcagtactttaaat

SEQ ID NO: 288677 - DNA, 16 bp, P. troglodytes
tttcagtactttgaaa

SEQ ID NO: 288678 - DNA, 22 bp, P. troglodytes
tttcagtagagacagggtttca

SEQ ID NO: 288679 - DNA, 21 bp, P. troglodytes
tttcagtagagacggggtttc

SEQ ID NO: 288680 - DNA, 16 bp, P. troglodytes
tttcagtatttaaaaa

SEQ ID NO: 288681 - DNA, 16 bp, P. troglodytes
tttcagtattttaaat

SEQ ID NO: 288682 - DNA, 16 bp, P. troglodytes
tttcagtcctgccatt

SEQ ID NO: 288683 - DNA, 16 bp, P. troglodytes
tttcagtctttttaaa

SEQ ID NO: 288684 - DNA, 16 bp, P. troglodytes
tttcagtgatttttaa

SEQ ID NO: 288685 - DNA, 16 bp, P. troglodytes
tttcagtgctaaaatt

SEQ ID NO: 288686 - DNA, 16 bp, P. troglodytes
tttcagtgctttggga

SEQ ID NO: 288687 - DNA, 16 bp, P. troglodytes
tttcagtggcttccca

SEQ ID NO: 288688 - DNA, 16 bp, P. troglodytes
tttcagtggggacaca

SEQ ID NO: 288689 - DNA, 16 bp, P. troglodytes
tttcagttagaggtta

SEQ ID NO: 288690 - DNA, 16 bp, P. troglodytes
tttcagttatttgaga

SEQ ID NO: 288691 - DNA, 16 bp, P. troglodytes
tttcagttatttttaa

SEQ ID NO: 288692 - DNA, 16 bp, P. troglodytes
tttcagttccttgaat

SEQ ID NO: 288693 - DNA, 16 bp, P. troglodytes
tttcagttctaaaatt

SEQ ID NO: 288694 - DNA, 16 bp, P. troglodytes
tttcagttcttttaaa

SEQ ID NO: 288695 - DNA, 16 bp, P. troglodytes
tttcagtttaaatttt

SEQ ID NO: 288696 - DNA, 16 bp, P. troglodytes
tttcagtttaatttta

SEQ ID NO: 288697 - DNA, 16 bp, P. troglodytes
tttcagtttccatttt

SEQ ID NO: 288698 - DNA, 16 bp, P. troglodytes
tttcagtttctttcat

SEQ ID NO: 288699 - DNA, 16 bp, P. troglodytes
tttcagttttaaaaca

SEQ ID NO: 288700 - DNA, 16 bp, P. troglodytes
tttcagttttagaaaa

SEQ ID NO: 288701 - DNA, 16 bp, P. troglodytes
tttcagttttattcca

SEQ ID NO: 288702 - DNA, 16 bp, P. troglodytes
tttcagttttcaaagt

SEQ ID NO: 288703 - DNA, 16 bp, P. troglodytes
tttcagttttcctttc

SEQ ID NO: 288704 - DNA, 16 bp, P. troglodytes
tttcagttttctgtat

SEQ ID NO: 288705 - DNA, 16 bp, P. troglodytes
tttcagttttgaaaaa

SEQ ID NO: 288706 - DNA, 16 bp, P. troglodytes
tttcagtttttacttc

SEQ ID NO: 288707 - DNA, 16 bp, P. troglodytes
tttcagtttttccaca

SEQ ID NO: 288708 - DNA, 16 bp, P. troglodytes
tttcagtttttcctca

SEQ ID NO: 288709 - DNA, 16 bp, P. troglodytes
tttcagtttttttaaa

SEQ ID NO: 288710 - DNA, 16 bp, P. troglodytes
tttcataaaagaaaga

SEQ ID NO: 288711 - DNA, 16 bp, P. troglodytes
tttcataaaagtaaaa

SEQ ID NO: 288712 - DNA, 16 bp, P. troglodytes
tttcataaaataaagt

SEQ ID NO: 288713 - DNA, 16 bp, P. troglodytes
tttcataaaatatttc

SEQ ID NO: 288714 - DNA, 16 bp, P. troglodytes
tttcataaaatgttat

SEQ ID NO: 288715 - DNA, 16 bp, P. troglodytes
tttcataaaattggaa

SEQ ID NO: 288716 - DNA, 16 bp, P. troglodytes
tttcataaaattttca

SEQ ID NO: 288717 - DNA, 16 bp, P. troglodytes
tttcataatttaaaag

SEQ ID NO: 288718 - DNA, 16 bp, P. troglodytes
tttcatacatttgtaa

SEQ ID NO: 288719 - DNA, 16 bp, P. troglodytes
tttcatagaaaatatt

SEQ ID NO: 288720 - DNA, 16 bp, P. troglodytes
tttcatagtttaaaaa

SEQ ID NO: 288721 - DNA, 16 bp, P. troglodytes
tttcatagtttcagat

SEQ ID NO: 288722 - DNA, 16 bp, P. troglodytes
tttcatagttttcatt

SEQ ID NO: 288723 - DNA, 16 bp, P. troglodytes
tttcatagtttttaaa

SEQ ID NO: 288724 - DNA, 16 bp, P. troglodytes
tttcatataaatagaa

SEQ ID NO: 288725 - DNA, 16 bp, P. troglodytes
tttcatatacatctta

SEQ ID NO: 288726 - DNA, 16 bp, P. troglodytes
tttcatatctataaaa

SEQ ID NO: 288727 - DNA, 16 bp, P. troglodytes
tttcatatgcaaacca

SEQ ID NO: 288728 - DNA, 16 bp, P. troglodytes
tttcatatgtaaattt

SEQ ID NO: 288729 - DNA, 16 bp, P. troglodytes
tttcatatgttcaaaa

SEQ ID NO: 288730 - DNA, 16 bp, P. troglodytes
tttcatatgttttcat

SEQ ID NO: 288731 - DNA, 16 bp, P. troglodytes
tttcatattcctgttt

SEQ ID NO: 288732 - DNA, 16 bp, P. troglodytes
tttcatatttgaaaaa

SEQ ID NO: 288733 - DNA, 16 bp, P. troglodytes
tttcatatttgacaat

SEQ ID NO: 288734 - DNA, 16 bp, P. troglodytes
tttcatatttttagaa

SEQ ID NO: 288735 - DNA, 16 bp, P. troglodytes
tttcatatttttagtg

SEQ ID NO: 288736 - DNA, 16 bp, P. troglodytes
tttcatcacatcatat

SEQ ID NO: 288737 - DNA, 16 bp, P. troglodytes
tttcatcaccccagaa

SEQ ID NO: 288738 - DNA, 16 bp, P. troglodytes
tttcatcacccccaaa

SEQ ID NO: 288739 - DNA, 16 bp, P. troglodytes
tttcatcactccaaaa

SEQ ID NO: 288740 - DNA, 16 bp, P. troglodytes
tttcatcactgttatt

SEQ ID NO: 288741 - DNA, 16 bp, P. troglodytes
tttcatcagattttca

SEQ ID NO: 288742 - DNA, 16 bp, P. troglodytes
tttcatcagtgttttg

SEQ ID NO: 288743 - DNA, 16 bp, P. troglodytes
tttcatcatcccaaat

SEQ ID NO: 288744 - DNA, 16 bp, P. troglodytes
tttcatcatgctgccc

SEQ ID NO: 288745 - DNA, 17 bp, P. troglodytes
tttcatcatgttgctca

SEQ ID NO: 288746 - DNA, 21 bp, P. troglodytes
tttcatcatgttggccaggat

SEQ ID NO: 288747 - DNA, 19 bp, P. troglodytes
tttcatcatgttggtcagg

SEQ ID NO: 288748 - DNA, 16 bp, P. troglodytes
tttcatcatttaaaaa

SEQ ID NO: 288749 - DNA, 16 bp, P. troglodytes
tttcatcatttctgtt

SEQ ID NO: 288750 - DNA, 16 bp, P. troglodytes
tttcatcattttaaaa

SEQ ID NO: 288751 - DNA, 16 bp, P. troglodytes
tttcatccaagagctg

SEQ ID NO: 288752 - DNA, 24 bp, P. troglodytes
tttcatccatgtccctacaaagga

SEQ ID NO: 288753 - DNA, 16 bp, P. troglodytes
tttcatctataaaatg

SEQ ID NO: 288754 - DNA, 16 bp, P. troglodytes
tttcatctctagaaat

SEQ ID NO: 288755 - DNA, 16 bp, P. troglodytes
tttcatcttcttggtt

SEQ ID NO: 288756 - DNA, 16 bp, P. troglodytes
tttcatctttcaaaat

SEQ ID NO: 288757 - DNA, 16 bp, P. troglodytes
tttcatgaaagaaaaa

SEQ ID NO: 288758 - DNA, 16 bp, P. troglodytes
tttcatgaaaggaaaa

SEQ ID NO: 288759 - DNA, 16 bp, P. troglodytes
tttcatgaaatctttg

SEQ ID NO: 288760 - DNA, 16 bp, P. troglodytes
tttcatgacaaaaaca

SEQ ID NO: 288761 - DNA, 16 bp, P. troglodytes
tttcatgcaaatattt

SEQ ID NO: 288762 - DNA, 16 bp, P. troglodytes
tttcatgcatttattt

SEQ ID NO: 288763 - DNA, 16 bp, P. troglodytes
tttcatgctacagtgg

SEQ ID NO: 288764 - DNA, 16 bp, P. troglodytes
tttcatggaacaccat

SEQ ID NO: 288765 - DNA, 16 bp, P. troglodytes
tttcatgtattaaaat

SEQ ID NO: 288766 - DNA, 16 bp, P. troglodytes
tttcatgtattttaat

SEQ ID NO: 288767 - DNA, 26 bp, P. troglodytes
tttcatgtgaaatctttagtgttgtg

SEQ ID NO: 288768 - DNA, 16 bp, P. troglodytes
tttcatgttaaaataa

SEQ ID NO: 288769 - DNA, 16 bp, P. troglodytes
tttcatgtttgttgcc

SEQ ID NO: 288770 - DNA, 16 bp, P. troglodytes
tttcatgttttaaaaa

SEQ ID NO: 288771 - DNA, 16 bp, P. troglodytes
tttcattaaatatgtt

SEQ ID NO: 288772 - DNA, 16 bp, P. troglodytes
tttcattataaaacat

SEQ ID NO: 288773 - DNA, 16 bp, P. troglodytes
tttcattatagttttg

SEQ ID NO: 288774 - DNA, 17 bp, P. troglodytes
tttcattatgttggcca

SEQ ID NO: 288775 - DNA, 16 bp, P. troglodytes
tttcattattctgcat

SEQ ID NO: 288776 - DNA, 16 bp, P. troglodytes
tttcattatttgggta

SEQ ID NO: 288777 - DNA, 16 bp, P. troglodytes
tttcattattttgaaa

SEQ ID NO: 288778 - DNA, 16 bp, P. troglodytes
tttcattcacttattc

SEQ ID NO: 288779 - DNA, 16 bp, P. troglodytes
tttcattcagcaaaca

SEQ ID NO: 288780 - DNA, 16 bp, P. troglodytes
tttcattcagcaaata

SEQ ID NO: 288781 - DNA, 16 bp, P. troglodytes
tttcattcatatgaaa

SEQ ID NO: 288782 - DNA, 16 bp, P. troglodytes
tttcattcattcactc

SEQ ID NO: 288783 - DNA, 16 bp, P. troglodytes
tttcattcattcattc

SEQ ID NO: 288784 - DNA, 16 bp, P. troglodytes
tttcattcccatcaac

SEQ ID NO: 288785 - DNA, 16 bp, P. troglodytes
tttcattctcagcttg

SEQ ID NO: 288786 - DNA, 16 bp, P. troglodytes
tttcattcttctcagt

SEQ ID NO: 288787 - DNA, 16 bp, P. troglodytes
tttcattgaaataatt

SEQ ID NO: 288788 - DNA, 16 bp, P. troglodytes
tttcattgatttctac

SEQ ID NO: 288789 - DNA, 16 bp, P. troglodytes
tttcattggacttaca

SEQ ID NO: 288790 - DNA, 16 bp, P. troglodytes
tttcattggagaattt

SEQ ID NO: 288791 - DNA, 16 bp, P. troglodytes
tttcattggagcattt

SEQ ID NO: 288792 - DNA, 16 bp, P. troglodytes
tttcattgtaatttta

SEQ ID NO: 288793 - DNA, 16 bp, P. troglodytes
tttcattgtggcttta

SEQ ID NO: 288794 - DNA, 16 bp, P. troglodytes
tttcattgtgtatgta

SEQ ID NO: 288795 - DNA, 16 bp, P. troglodytes
tttcattgttgtgcaa

SEQ ID NO: 288796 - DNA, 16 bp, P. troglodytes
tttcattgtttaaaat

SEQ ID NO: 288797 - DNA, 16 bp, P. troglodytes
tttcattgtttataaa

SEQ ID NO: 288798 - DNA, 16 bp, P. troglodytes
tttcatttaaaatgta

SEQ ID NO: 288799 - DNA, 16 bp, P. troglodytes
tttcatttaaagaaaa

SEQ ID NO: 288800 - DNA, 16 bp, P. troglodytes
tttcatttaagataat

SEQ ID NO: 288801 - DNA, 16 bp, P. troglodytes
tttcatttaattcaaa

SEQ ID NO: 288802 - DNA, 16 bp, P. troglodytes
tttcatttagcataat

SEQ ID NO: 288803 - DNA, 16 bp, P. troglodytes
tttcatttatatgaaa

SEQ ID NO: 288804 - DNA, 16 bp, P. troglodytes
tttcatttatatggaa

SEQ ID NO: 288805 - DNA, 16 bp, P. troglodytes
tttcatttattcatgt

SEQ ID NO: 288806 - DNA, 16 bp, P. troglodytes
tttcatttatttaatg

SEQ ID NO: 288807 - DNA, 16 bp, P. troglodytes
tttcatttcaaattca

SEQ ID NO: 288808 - DNA, 16 bp, P. troglodytes
tttcatttccaaaata

SEQ ID NO: 288809 - DNA, 16 bp, P. troglodytes
tttcatttcctctgga

SEQ ID NO: 288810 - DNA, 16 bp, P. troglodytes
tttcatttccttgatg

SEQ ID NO: 288811 - DNA, 16 bp, P. troglodytes
tttcatttctatgaaa

SEQ ID NO: 288812 - DNA, 16 bp, P. troglodytes
tttcatttctgattgt

SEQ ID NO: 288813 - DNA, 16 bp, P. troglodytes
tttcatttcttattga

SEQ ID NO: 288814 - DNA, 16 bp, P. troglodytes
tttcatttctttggat

SEQ ID NO: 288815 - DNA, 16 bp, P. troglodytes
tttcatttctttggga

SEQ ID NO: 288816 - DNA, 16 bp, P. troglodytes
tttcatttgcattttc

SEQ ID NO: 288817 - DNA, 16 bp, P. troglodytes
tttcatttgcttttcc

SEQ ID NO: 288818 - DNA, 16 bp, P. troglodytes
tttcatttgtaaattg

SEQ ID NO: 288819 - DNA, 16 bp, P. troglodytes
tttcatttgttaaaaa

SEQ ID NO: 288820 - DNA, 16 bp, P. troglodytes
tttcatttgtttctga

SEQ ID NO: 288821 - DNA, 16 bp, P. troglodytes
tttcattttaaagaat

SEQ ID NO: 288822 - DNA, 16 bp, P. troglodytes
tttcattttataagaa

SEQ ID NO: 288823 - DNA, 16 bp, P. troglodytes
tttcattttatagata

SEQ ID NO: 288824 - DNA, 16 bp, P. troglodytes
tttcattttatgaatg

SEQ ID NO: 288825 - DNA, 16 bp, P. troglodytes
tttcattttcaaaagt

SEQ ID NO: 288826 - DNA, 16 bp, P. troglodytes
tttcattttcaataaa

SEQ ID NO: 288827 - DNA, 16 bp, P. troglodytes
tttcattttcagaaaa

SEQ ID NO: 288828 - DNA, 16 bp, P. troglodytes
tttcattttctaaatg

SEQ ID NO: 288829 - DNA, 16 bp, P. troglodytes
tttcattttctccaca

SEQ ID NO: 288830 - DNA, 16 bp, P. troglodytes
tttcattttctgaaag

SEQ ID NO: 288831 - DNA, 16 bp, P. troglodytes
tttcattttgaagaaa

SEQ ID NO: 288832 - DNA, 16 bp, P. troglodytes
tttcattttgataatt

SEQ ID NO: 288833 - DNA, 16 bp, P. troglodytes
tttcattttgcataat

SEQ ID NO: 288834 - DNA, 16 bp, P. troglodytes
tttcatttttaaatga

SEQ ID NO: 288835 - DNA, 16 bp, P. troglodytes
tttcatttttaatgat

SEQ ID NO: 288836 - DNA, 16 bp, P. troglodytes
tttcatttttagaagt

SEQ ID NO: 288837 - DNA, 16 bp, P. troglodytes
tttcatttttctgcat

SEQ ID NO: 288838 - DNA, 16 bp, P. troglodytes
tttcatttttctgtaa

SEQ ID NO: 288839 - DNA, 16 bp, P. troglodytes
tttcatttttgaaaat

SEQ ID NO: 288840 - DNA, 16 bp, P. troglodytes
tttcatttttgtaaat

SEQ ID NO: 288841 - DNA, 16 bp, P. troglodytes
tttcattttttgagga

SEQ ID NO: 288842 - DNA, 16 bp, P. troglodytes
tttcatttttttaaga

SEQ ID NO: 288843 - DNA, 16 bp, P. troglodytes
tttccaaaacttttca

SEQ ID NO: 288844 - DNA, 16 bp, P. troglodytes
tttccaaaagaaaaaa

SEQ ID NO: 288845 - DNA, 16 bp, P. troglodytes
tttccaaaagaaattt

SEQ ID NO: 288846 - DNA, 16 bp, P. troglodytes
tttccaaaagatattt

SEQ ID NO: 288847 - DNA, 16 bp, P. troglodytes
tttccaaaatatgtaa

SEQ ID NO: 288848 - DNA, 16 bp, P. troglodytes
tttccaaaatattttc

SEQ ID NO: 288849 - DNA, 16 bp, P. troglodytes
tttccaaaattaaaat

SEQ ID NO: 288850 - DNA, 16 bp, P. troglodytes
tttccaaaatttttca

SEQ ID NO: 288851 - DNA, 16 bp, P. troglodytes
tttccaaactgctaaa

SEQ ID NO: 288852 - DNA, 16 bp, P. troglodytes
tttccaaactgctttt

SEQ ID NO: 288853 - DNA, 16 bp, P. troglodytes
tttccaaacttttatg

SEQ ID NO: 288854 - DNA, 16 bp, P. troglodytes
tttccaaagaaaaaga

SEQ ID NO: 288855 - DNA, 16 bp, P. troglodytes
tttccaaagaaaattt

SEQ ID NO: 288856 - DNA, 16 bp, P. troglodytes
tttccaaagaagaaaa

SEQ ID NO: 288857 - DNA, 16 bp, P. troglodytes
tttccaaagaagaaat

SEQ ID NO: 288858 - DNA, 16 bp, P. troglodytes
tttccaaagagaaaaa

SEQ ID NO: 288859 - DNA, 16 bp, P. troglodytes
tttccaaagcattttt

SEQ ID NO: 288860 - DNA, 16 bp, P. troglodytes
tttccaaaggaaaaaa

SEQ ID NO: 288861 - DNA, 16 bp, P. troglodytes
tttccaaaggagaaaa

SEQ ID NO: 288862 - DNA, 16 bp, P. troglodytes
tttccaaagtttctct

SEQ ID NO: 288863 - DNA, 16 bp, P. troglodytes
tttccaaagtttttct

SEQ ID NO: 288864 - DNA, 16 bp, P. troglodytes
tttccaaataaaattt

SEQ ID NO: 288865 - DNA, 16 bp, P. troglodytes
tttccaaataaggtca

SEQ ID NO: 288866 - DNA, 16 bp, P. troglodytes
tttccaaatatagtca

SEQ ID NO: 288867 - DNA, 16 bp, P. troglodytes
tttccaaatatattat

SEQ ID NO: 288868 - DNA, 16 bp, P. troglodytes
tttccaaatattaaaa

SEQ ID NO: 288869 - DNA, 16 bp, P. troglodytes
tttccaaatatttgaa

SEQ ID NO: 288870 - DNA, 16 bp, P. troglodytes
tttccaaattaaataa

SEQ ID NO: 288871 - DNA, 16 bp, P. troglodytes
tttccaaatttgtttt

SEQ ID NO: 288872 - DNA, 16 bp, P. troglodytes
tttccaagaaaaaaaa

SEQ ID NO: 288873 - DNA, 16 bp, P. troglodytes
tttccaagacaatcct

SEQ ID NO: 288874 - DNA, 16 bp, P. troglodytes
tttccaagtagctggg

SEQ ID NO: 288875 - DNA, 16 bp, P. troglodytes
tttccaataaaaatat

SEQ ID NO: 288876 - DNA, 16 bp, P. troglodytes
tttccaatgttgtctt

SEQ ID NO: 288877 - DNA, 16 bp, P. troglodytes
tttccacaaaagacat

SEQ ID NO: 288878 - DNA, 16 bp, P. troglodytes
tttccacaaagaaaaa

SEQ ID NO: 288879 - DNA, 16 bp, P. troglodytes
tttccacagtggatga

SEQ ID NO: 288880 - DNA, 16 bp, P. troglodytes
tttccacagtggctgc

SEQ ID NO: 288881 - DNA, 16 bp, P. troglodytes
tttccacatctgcaaa

SEQ ID NO: 288882 - DNA, 16 bp, P. troglodytes
tttccacatctgtaaa

SEQ ID NO: 288883 - DNA, 16 bp, P. troglodytes
tttccacatttttgtg

SEQ ID NO: 288884 - DNA, 16 bp, P. troglodytes
tttccaccctttggct

SEQ ID NO: 288885 - DNA, 16 bp, P. troglodytes
tttccacctcctgggt

SEQ ID NO: 288886 - DNA, 16 bp, P. troglodytes
tttccactggctggct

SEQ ID NO: 288887 - DNA, 16 bp, P. troglodytes
tttccagaaataaaaa

SEQ ID NO: 288888 - DNA, 16 bp, P. troglodytes
tttccagaaatggaaa

SEQ ID NO: 288889 - DNA, 16 bp, P. troglodytes
tttccagaaatttatc

SEQ ID NO: 288890 - DNA, 16 bp, P. troglodytes
tttccagaaatttttt

SEQ ID NO: 288891 - DNA, 16 bp, P. troglodytes
tttccagaagaaatta

SEQ ID NO: 288892 - DNA, 16 bp, P. troglodytes
tttccagaagagatga

SEQ ID NO: 288893 - DNA, 16 bp, P. troglodytes
tttccagaaggctttc

SEQ ID NO: 288894 - DNA, 16 bp, P. troglodytes
tttccagagaaataaa

SEQ ID NO: 288895 - DNA, 16 bp, P. troglodytes
tttccagcagtcccat

SEQ ID NO: 288896 - DNA, 16 bp, P. troglodytes
tttccagctcctagag

SEQ ID NO: 288897 - DNA, 16 bp, P. troglodytes
tttccagcttcataca

SEQ ID NO: 288898 - DNA, 16 bp, P. troglodytes
tttccagcttgcagat

SEQ ID NO: 288899 - DNA, 16 bp, P. troglodytes
tttccaggtattttat

SEQ ID NO: 288900 - DNA, 16 bp, P. troglodytes
tttccagttgttttgt

SEQ ID NO: 288901 - DNA, 16 bp, P. troglodytes
tttccagtttggagct

SEQ ID NO: 288902 - DNA, 16 bp, P. troglodytes
tttccagtttttctgt

SEQ ID NO: 288903 - DNA, 16 bp, P. troglodytes
tttccagtttttgact

SEQ ID NO: 288904 - DNA, 16 bp, P. troglodytes
tttccataacataaaa

SEQ ID NO: 288905 - DNA, 16 bp, P. troglodytes
tttccataataaaaag

SEQ ID NO: 288906 - DNA, 16 bp, P. troglodytes
tttccataataaaatg

SEQ ID NO: 288907 - DNA, 16 bp, P. troglodytes
tttccatacatccttt

SEQ ID NO: 288908 - DNA, 16 bp, P. troglodytes
tttccatagaggttgt

SEQ ID NO: 288909 - DNA, 16 bp, P. troglodytes
tttccatatctttgct

SEQ ID NO: 288910 - DNA, 16 bp, P. troglodytes
tttccatatgaatttt

SEQ ID NO: 288911 - DNA, 16 bp, P. troglodytes
tttccatatggatttt

SEQ ID NO: 288912 - DNA, 16 bp, P. troglodytes
tttccatatttatgtc

SEQ ID NO: 288913 - DNA, 16 bp, P. troglodytes
tttccatctcagcctc

SEQ ID NO: 288914 - DNA, 16 bp, P. troglodytes
tttccatctgttttct

SEQ ID NO: 288915 - DNA, 16 bp, P. troglodytes
tttccatgctgttctc

SEQ ID NO: 288916 - DNA, 16 bp, P. troglodytes
tttccatgtagctgtg

SEQ ID NO: 288917 - DNA, 16 bp, P. troglodytes
tttccatgtagttgtg

SEQ ID NO: 288918 - DNA, 16 bp, P. troglodytes
tttccatgtcaataaa

SEQ ID NO: 288919 - DNA, 16 bp, P. troglodytes
tttccatgtgaatttt

SEQ ID NO: 288920 - DNA, 16 bp, P. troglodytes
tttccatgtgtctttt

SEQ ID NO: 288921 - DNA, 16 bp, P. troglodytes
tttccatgtgtttgtg

SEQ ID NO: 288922 - DNA, 16 bp, P. troglodytes
tttccatgttgcccag

SEQ ID NO: 288923 - DNA, 16 bp, P. troglodytes
tttccatgtttataca

SEQ ID NO: 288924 - DNA, 16 bp, P. troglodytes
tttccattatcattta

SEQ ID NO: 288925 - DNA, 16 bp, P. troglodytes
tttccattccaaaagg

SEQ ID NO: 288926 - DNA, 17 bp, P. troglodytes
tttccattcctgagtta

SEQ ID NO: 288927 - DNA, 16 bp, P. troglodytes
tttccattcttttaaa

SEQ ID NO: 288928 - DNA, 16 bp, P. troglodytes
tttccattcttttgaa

SEQ ID NO: 288929 - DNA, 16 bp, P. troglodytes
tttccattgttttgca

SEQ ID NO: 288930 - DNA, 16 bp, P. troglodytes
tttccatttcaataaa

SEQ ID NO: 288931 - DNA, 16 bp, P. troglodytes
tttccatttctccaca

SEQ ID NO: 288932 - DNA, 17 bp, P. troglodytes
tttccatttgcttggta

SEQ ID NO: 288933 - DNA, 16 bp, P. troglodytes
tttccatttggccttt

SEQ ID NO: 288934 - DNA, 16 bp, P. troglodytes
tttccatttgtaaaat

SEQ ID NO: 288935 - DNA, 16 bp, P. troglodytes
tttccatttgtttgtg

SEQ ID NO: 288936 - DNA, 16 bp, P. troglodytes
tttccatttgttttaa

SEQ ID NO: 288937 - DNA, 16 bp, P. troglodytes
tttccattttagaaag

SEQ ID NO: 288938 - DNA, 16 bp, P. troglodytes
tttccattttatacat

SEQ ID NO: 288939 - DNA, 16 bp, P. troglodytes
tttccattttatagac

SEQ ID NO: 288940 - DNA, 16 bp, P. troglodytes
tttccattttcaaaat

SEQ ID NO: 288941 - DNA, 16 bp, P. troglodytes
tttccattttcattca

SEQ ID NO: 288942 - DNA, 16 bp, P. troglodytes
tttccattttcatttg

SEQ ID NO: 288943 - DNA, 16 bp, P. troglodytes
tttccattttcctgat

SEQ ID NO: 288944 - DNA, 16 bp, P. troglodytes
tttccattttctctgt

SEQ ID NO: 288945 - DNA, 16 bp, P. troglodytes
tttcccaaagaagaaa

SEQ ID NO: 288946 - DNA, 16 bp, P. troglodytes
tttcccaaagattact

SEQ ID NO: 288947 - DNA, 16 bp, P. troglodytes
tttcccaaatatattt

SEQ ID NO: 288948 - DNA, 16 bp, P. troglodytes
tttcccaatgtgtgtt

SEQ ID NO: 288949 - DNA, 16 bp, P. troglodytes
tttcccacattttcct

SEQ ID NO: 288950 - DNA, 16 bp, P. troglodytes
tttcccactttctgat

SEQ ID NO: 288951 - DNA, 16 bp, P. troglodytes
tttcccagatgttctt

SEQ ID NO: 288952 - DNA, 16 bp, P. troglodytes
tttcccagcaccagtt

SEQ ID NO: 288953 - DNA, 16 bp, P. troglodytes
tttcccagcatcactt

SEQ ID NO: 288954 - DNA, 16 bp, P. troglodytes
tttcccagcctccaaa

SEQ ID NO: 288955 - DNA, 16 bp, P. troglodytes
tttcccagcctttctt

SEQ ID NO: 288956 - DNA, 16 bp, P. troglodytes
tttcccagctccatgc

SEQ ID NO: 288957 - DNA, 16 bp, P. troglodytes
tttcccaggctggtct

SEQ ID NO: 288958 - DNA, 16 bp, P. troglodytes
tttcccagtactattt

SEQ ID NO: 288959 - DNA, 16 bp, P. troglodytes
tttcccatagttctgg

SEQ ID NO: 288960 - DNA, 16 bp, P. troglodytes
tttcccatctgaaaaa

SEQ ID NO: 288961 - DNA, 16 bp, P. troglodytes
tttcccatgctggagt

SEQ ID NO: 288962 - DNA, 16 bp, P. troglodytes
tttcccatgctggatg

SEQ ID NO: 288963 - DNA, 16 bp, P. troglodytes
tttcccatgctgttct

SEQ ID NO: 288964 - DNA, 16 bp, P. troglodytes
tttcccatggtgttct

SEQ ID NO: 288965 - DNA, 16 bp, P. troglodytes
tttcccatgttttctt

SEQ ID NO: 288966 - DNA, 16 bp, P. troglodytes
tttcccattgcttatt

SEQ ID NO: 288967 - DNA, 16 bp, P. troglodytes
tttcccattttaaaat

SEQ ID NO: 288968 - DNA, 16 bp, P. troglodytes
tttcccattttgtggg

SEQ ID NO: 288969 - DNA, 16 bp, P. troglodytes
tttccccaatggtaac

SEQ ID NO: 288970 - DNA, 16 bp, P. troglodytes
tttccccacttccctg

SEQ ID NO: 288971 - DNA, 16 bp, P. troglodytes
tttccccattcagcat

SEQ ID NO: 288972 - DNA, 16 bp, P. troglodytes
tttccccattgcatgt

SEQ ID NO: 288973 - DNA, 20 bp, P. troglodytes
tttccccattgcttgttttt

SEQ ID NO: 288974 - DNA, 16 bp, P. troglodytes
tttccccattgtatat

SEQ ID NO: 288975 - DNA, 16 bp, P. troglodytes
tttcccccatgctttt

SEQ ID NO: 288976 - DNA, 16 bp, P. troglodytes
tttccccccaaaaaag

SEQ ID NO: 288977 - DNA, 16 bp, P. troglodytes
tttcccccccccaaaa

SEQ ID NO: 288978 - DNA, 16 bp, P. troglodytes
tttcccccttactgtt

SEQ ID NO: 288979 - DNA, 16 bp, P. troglodytes
tttcccctccaaatct

SEQ ID NO: 288980 - DNA, 16 bp, P. troglodytes
tttcccctgctgttct

SEQ ID NO: 288981 - DNA, 16 bp, P. troglodytes
tttccctaaaatattt

SEQ ID NO: 288982 - DNA, 16 bp, P. troglodytes
tttccctacaaaggac

SEQ ID NO: 288983 - DNA, 16 bp, P. troglodytes
tttccctgaattctgt

SEQ ID NO: 288984 - DNA, 16 bp, P. troglodytes
tttccctgatcctctc

SEQ ID NO: 288985 - DNA, 16 bp, P. troglodytes
tttccctgattattag

SEQ ID NO: 288986 - DNA, 16 bp, P. troglodytes
tttccctgcccaatct

SEQ ID NO: 288987 - DNA, 16 bp, P. troglodytes
tttccctgggggagtt

SEQ ID NO: 288988 - DNA, 16 bp, P. troglodytes
tttccctggtgctggc

SEQ ID NO: 288989 - DNA, 16 bp, P. troglodytes
tttcccttctagtttt

SEQ ID NO: 288990 - DNA, 16 bp, P. troglodytes
tttcccttttctgaaa

SEQ ID NO: 288991 - DNA, 16 bp, P. troglodytes
tttccctttttaaaaa

SEQ ID NO: 288992 - DNA, 16 bp, P. troglodytes
tttcctaaaaatgaaa

SEQ ID NO: 288993 - DNA, 16 bp, P. troglodytes
tttcctaaaagtttta

SEQ ID NO: 288994 - DNA, 16 bp, P. troglodytes
tttcctaaatgtattt

SEQ ID NO: 288995 - DNA, 17 bp, P. troglodytes
tttcctaatcaaagaaa

SEQ ID NO: 288996 - DNA, 16 bp, P. troglodytes
tttcctaattataaaa

SEQ ID NO: 288997 - DNA, 16 bp, P. troglodytes
tttcctaattggtttt

SEQ ID NO: 288998 - DNA, 16 bp, P. troglodytes
tttcctaatttgcaaa

SEQ ID NO: 288999 - DNA, 16 bp, P. troglodytes
tttcctaattttaaaa

SEQ ID NO: 289000 - DNA, 16 bp, P. troglodytes
tttcctagctgtgtga

SEQ ID NO: 289001 - DNA, 16 bp, P. troglodytes
tttcctaggcagaggt

SEQ ID NO: 289002 - DNA, 16 bp, P. troglodytes
tttcctagttctgtga

SEQ ID NO: 289003 - DNA, 16 bp, P. troglodytes
tttcctagttgaatac

SEQ ID NO: 289004 - DNA, 16 bp, P. troglodytes
tttcctattctgtgaa

SEQ ID NO: 289005 - DNA, 16 bp, P. troglodytes
tttcctcacctgtaaa

SEQ ID NO: 289006 - DNA, 16 bp, P. troglodytes
tttcctcagaaaacta

SEQ ID NO: 289007 - DNA, 16 bp, P. troglodytes
tttcctcatattttaa

SEQ ID NO: 289008 - DNA, 16 bp, P. troglodytes
tttcctcatccttaaa

SEQ ID NO: 289009 - DNA, 16 bp, P. troglodytes
tttcctcatctaaaaa

SEQ ID NO: 289010 - DNA, 16 bp, P. troglodytes
tttcctcatctataaa

SEQ ID NO: 289011 - DNA, 16 bp, P. troglodytes
tttcctcatctatgaa

SEQ ID NO: 289012 - DNA, 16 bp, P. troglodytes
tttcctcatctccaaa

SEQ ID NO: 289013 - DNA, 16 bp, P. troglodytes
tttcctcatctgtaga

SEQ ID NO: 289014 - DNA, 16 bp, P. troglodytes
tttcctcatctgtgag

SEQ ID NO: 289015 - DNA, 16 bp, P. troglodytes
tttcctcatcttcatg

SEQ ID NO: 289016 - DNA, 16 bp, P. troglodytes
tttcctcatcttcctg

SEQ ID NO: 289017 - DNA, 16 bp, P. troglodytes
tttcctcatctttaaa

SEQ ID NO: 289018 - DNA, 16 bp, P. troglodytes
tttcctcatttaaaaa

SEQ ID NO: 289019 - DNA, 16 bp, P. troglodytes
tttcctccaaattcct

SEQ ID NO: 289020 - DNA, 16 bp, P. troglodytes
tttcctccagttccca

SEQ ID NO: 289021 - DNA, 16 bp, P. troglodytes
tttcctccattgaatt

SEQ ID NO: 289022 - DNA, 16 bp, P. troglodytes
tttcctcccattctgt

SEQ ID NO: 289023 - DNA, 16 bp, P. troglodytes
tttcctcctctgtgaa

SEQ ID NO: 289024 - DNA, 16 bp, P. troglodytes
tttcctctaaaaactg

SEQ ID NO: 289025 - DNA, 16 bp, P. troglodytes
tttcctctataaatta

SEQ ID NO: 289026 - DNA, 16 bp, P. troglodytes
tttcctctcctgtaaa

SEQ ID NO: 289027 - DNA, 16 bp, P. troglodytes
tttcctctgcctggaa

SEQ ID NO: 289028 - DNA, 16 bp, P. troglodytes
tttcctcttctgcaaa

SEQ ID NO: 289029 - DNA, 16 bp, P. troglodytes
tttcctcttctgtaaa

SEQ ID NO: 289030 - DNA, 16 bp, P. troglodytes
tttcctcttctgtgaa

SEQ ID NO: 289031 - DNA, 16 bp, P. troglodytes
tttcctctttgtaatt

SEQ ID NO: 289032 - DNA, 16 bp, P. troglodytes
tttcctgaaaaaggaa

SEQ ID NO: 289033 - DNA, 16 bp, P. troglodytes
tttcctgaaacatttt

SEQ ID NO: 289034 - DNA, 16 bp, P. troglodytes
tttcctgaaagaaaaa

SEQ ID NO: 289035 - DNA, 16 bp, P. troglodytes
tttcctgaaatatttt

SEQ ID NO: 289036 - DNA, 16 bp, P. troglodytes
tttcctgaacattaaa

SEQ ID NO: 289037 - DNA, 16 bp, P. troglodytes
tttcctgacttgttaa

SEQ ID NO: 289038 - DNA, 16 bp, P. troglodytes
tttcctgaggcttctc

SEQ ID NO: 289039 - DNA, 16 bp, P. troglodytes
tttcctgagtagctga

SEQ ID NO: 289040 - DNA, 16 bp, P. troglodytes
tttcctgatgttttaa

SEQ ID NO: 289041 - DNA, 16 bp, P. troglodytes
tttcctgattttaaaa

SEQ ID NO: 289042 - DNA, 16 bp, P. troglodytes
tttcctgatttttcta

SEQ ID NO: 289043 - DNA, 16 bp, P. troglodytes
tttcctgcctcagccc

SEQ ID NO: 289044 - DNA, 16 bp, P. troglodytes
tttcctgcctcagtcc

SEQ ID NO: 289045 - DNA, 16 bp, P. troglodytes
tttcctgccttctgct

SEQ ID NO: 289046 - DNA, 16 bp, P. troglodytes
tttcctgctggcctgg

SEQ ID NO: 289047 - DNA, 16 bp, P. troglodytes
tttcctgctttatctt

SEQ ID NO: 289048 - DNA, 16 bp, P. troglodytes
tttcctggccttgcta

SEQ ID NO: 289049 - DNA, 16 bp, P. troglodytes
tttcctggtctgtaaa

SEQ ID NO: 289050 - DNA, 16 bp, P. troglodytes
tttcctggttttccag

SEQ ID NO: 289051 - DNA, 16 bp, P. troglodytes
tttcctgtaaccattt

SEQ ID NO: 289052 - DNA, 16 bp, P. troglodytes
tttcctgtaagatcag

SEQ ID NO: 289053 - DNA, 16 bp, P. troglodytes
tttcctgtattttaaa

SEQ ID NO: 289054 - DNA, 16 bp, P. troglodytes
tttcctgtcatagctg

SEQ ID NO: 289055 - DNA, 16 bp, P. troglodytes
tttcctgtgctgttct

SEQ ID NO: 289056 - DNA, 16 bp, P. troglodytes
tttcctgtttcttcat

SEQ ID NO: 289057 - DNA, 16 bp, P. troglodytes
tttcctgttttcaatt

SEQ ID NO: 289058 - DNA, 16 bp, P. troglodytes
tttccttaaataaatt

SEQ ID NO: 289059 - DNA, 16 bp, P. troglodytes
tttccttaaatgtttt

SEQ ID NO: 289060 - DNA, 16 bp, P. troglodytes
tttccttaactgtaaa

SEQ ID NO: 289061 - DNA, 16 bp, P. troglodytes
tttccttagctgtaaa

SEQ ID NO: 289062 - DNA, 16 bp, P. troglodytes
tttccttagtttttac

SEQ ID NO: 289063 - DNA, 16 bp, P. troglodytes
tttccttatattaaaa

SEQ ID NO: 289064 - DNA, 16 bp, P. troglodytes
tttccttatctataaa

SEQ ID NO: 289065 - DNA, 16 bp, P. troglodytes
tttccttatctgtaaa

SEQ ID NO: 289066 - DNA, 16 bp, P. troglodytes
tttccttatttcaaaa

SEQ ID NO: 289067 - DNA, 16 bp, P. troglodytes
tttccttatttggaaa

SEQ ID NO: 289068 - DNA, 16 bp, P. troglodytes
tttccttatttgtaaa

SEQ ID NO: 289069 - DNA, 16 bp, P. troglodytes
tttccttattttgaaa

SEQ ID NO: 289070 - DNA, 16 bp, P. troglodytes
tttccttcagtctttt

SEQ ID NO: 289071 - DNA, 16 bp, P. troglodytes
tttccttcatagcatt

SEQ ID NO: 289072 - DNA, 16 bp, P. troglodytes
tttccttcatcttaac

SEQ ID NO: 289073 - DNA, 16 bp, P. troglodytes
tttccttcatttctga

SEQ ID NO: 289074 - DNA, 16 bp, P. troglodytes
tttccttccagacttt

SEQ ID NO: 289075 - DNA, 16 bp, P. troglodytes
tttccttccttttaag

SEQ ID NO: 289076 - DNA, 17 bp, P. troglodytes
tttccttctaacactca

SEQ ID NO: 289077 - DNA, 16 bp, P. troglodytes
tttccttctccagcct

SEQ ID NO: 289078 - DNA, 16 bp, P. troglodytes
tttccttctcctgcat

SEQ ID NO: 289079 - DNA, 16 bp, P. troglodytes
tttccttctgatttct

SEQ ID NO: 289080 - DNA, 16 bp, P. troglodytes
tttccttctgtgtctg

SEQ ID NO: 289081 - DNA, 16 bp, P. troglodytes
tttccttctttaaaat

SEQ ID NO: 289082 - DNA, 16 bp, P. troglodytes
tttccttgaatatttt

SEQ ID NO: 289083 - DNA, 16 bp, P. troglodytes
tttccttgctggctgt

SEQ ID NO: 289084 - DNA, 16 bp, P. troglodytes
tttccttgtagttgtg

SEQ ID NO: 289085 - DNA, 16 bp, P. troglodytes
tttccttgtcctgcct

SEQ ID NO: 289086 - DNA, 16 bp, P. troglodytes
tttccttgtctcagat

SEQ ID NO: 289087 - DNA, 16 bp, P. troglodytes
tttccttgtgtgtaaa

SEQ ID NO: 289088 - DNA, 16 bp, P. troglodytes
tttccttgttttgatg

SEQ ID NO: 289089 - DNA, 16 bp, P. troglodytes
tttcctttaagaaaaa

SEQ ID NO: 289090 - DNA, 16 bp, P. troglodytes
tttcctttataaatca

SEQ ID NO: 289091 - DNA, 16 bp, P. troglodytes
tttcctttatcatgtg

SEQ ID NO: 289092 - DNA, 16 bp, P. troglodytes
tttcctttatttgaaa

SEQ ID NO: 289093 - DNA, 16 bp, P. troglodytes
tttcctttcaaagaaa

SEQ ID NO: 289094 - DNA, 16 bp, P. troglodytes
tttcctttcagcattt

SEQ ID NO: 289095 - DNA, 16 bp, P. troglodytes
tttcctttcctttgta

SEQ ID NO: 289096 - DNA, 16 bp, P. troglodytes
tttcctttcttaaaaa

SEQ ID NO: 289097 - DNA, 16 bp, P. troglodytes
tttcctttcttataaa

SEQ ID NO: 289098 - DNA, 16 bp, P. troglodytes
tttcctttcttctgta

SEQ ID NO: 289099 - DNA, 16 bp, P. troglodytes
tttcctttgagcgtca

SEQ ID NO: 289100 - DNA, 16 bp, P. troglodytes
tttcctttgcccattt

SEQ ID NO: 289101 - DNA, 16 bp, P. troglodytes
tttcctttgctgattt

SEQ ID NO: 289102 - DNA, 16 bp, P. troglodytes
tttcctttgctgtgga

SEQ ID NO: 289103 - DNA, 16 bp, P. troglodytes
tttcctttgtaaaaat

SEQ ID NO: 289104 - DNA, 16 bp, P. troglodytes
tttcctttgtaatttc

SEQ ID NO: 289105 - DNA, 16 bp, P. troglodytes
tttcctttgtcatttc

SEQ ID NO: 289106 - DNA, 16 bp, P. troglodytes
tttccttttaaaataa

SEQ ID NO: 289107 - DNA, 16 bp, P. troglodytes
tttccttttccccaat

SEQ ID NO: 289108 - DNA, 16 bp, P. troglodytes
tttccttttctagaat

SEQ ID NO: 289109 - DNA, 16 bp, P. troglodytes
tttccttttctctaaa

SEQ ID NO: 289110 - DNA, 16 bp, P. troglodytes
tttccttttctctgca

SEQ ID NO: 289111 - DNA, 16 bp, P. troglodytes
tttccttttctgtaaa

SEQ ID NO: 289112 - DNA, 16 bp, P. troglodytes
tttccttttcttaaaa

SEQ ID NO: 289113 - DNA, 16 bp, P. troglodytes
tttccttttgaaaatt

SEQ ID NO: 289114 - DNA, 16 bp, P. troglodytes
tttccttttgatccag

SEQ ID NO: 289115 - DNA, 16 bp, P. troglodytes
tttccttttgcttaat

SEQ ID NO: 289116 - DNA, 16 bp, P. troglodytes
tttcctttttaaagaa

SEQ ID NO: 289117 - DNA, 16 bp, P. troglodytes
tttcctttttaaccat

SEQ ID NO: 289118 - DNA, 16 bp, P. troglodytes
tttcctttttcaaaat

SEQ ID NO: 289119 - DNA, 16 bp, P. troglodytes
tttcctttttctgaaa

SEQ ID NO: 289120 - DNA, 16 bp, P. troglodytes
tttccttttttaaaga

SEQ ID NO: 289121 - DNA, 16 bp, P. troglodytes
tttccttttttctgaa

SEQ ID NO: 289122 - DNA, 16 bp, P. troglodytes
tttcctttttttaaga

SEQ ID NO: 289123 - DNA, 16 bp, P. troglodytes
tttcgaattcctgacc

SEQ ID NO: 289124 - DNA, 16 bp, P. troglodytes
tttcgagacggagttt

SEQ ID NO: 289125 - DNA, 16 bp, P. troglodytes
tttcgccacattggcc

SEQ ID NO: 289126 - DNA, 17 bp, P. troglodytes
tttcgccatgttgccca

SEQ ID NO: 289127 - DNA, 16 bp, P. troglodytes
tttcgcccaggctgga

SEQ ID NO: 289128 - DNA, 19 bp, P. troglodytes
tttcgctcttgtcgcccag

SEQ ID NO: 289129 - DNA, 16 bp, P. troglodytes
tttcggaggccgaggc

SEQ ID NO: 289130 - DNA, 16 bp, P. troglodytes
tttcgggtggagagtt

SEQ ID NO: 289131 - DNA, 18 bp, P. troglodytes
tttcgttcttgttgccca

SEQ ID NO: 289132 - DNA, 16 bp, P. troglodytes
tttctaaaaagtaaaa

SEQ ID NO: 289133 - DNA, 16 bp, P. troglodytes
tttctaaaaatcaaat

SEQ ID NO: 289134 - DNA, 16 bp, P. troglodytes
tttctaaaaatgattt

SEQ ID NO: 289135 - DNA, 16 bp, P. troglodytes
tttctaaaaatgtatt

SEQ ID NO: 289136 - DNA, 16 bp, P. troglodytes
tttctaaaacacagat

SEQ ID NO: 289137 - DNA, 16 bp, P. troglodytes
tttctaaaagaaaaaa

SEQ ID NO: 289138 - DNA, 16 bp, P. troglodytes
tttctaaaagaaaaat

SEQ ID NO: 289139 - DNA, 16 bp, P. troglodytes
tttctaaaagaagaaa

SEQ ID NO: 289140 - DNA, 16 bp, P. troglodytes
tttctaaaataaaagt

SEQ ID NO: 289141 - DNA, 16 bp, P. troglodytes
tttctaaaataaacat

SEQ ID NO: 289142 - DNA, 16 bp, P. troglodytes
tttctaaaatatacat

SEQ ID NO: 289143 - DNA, 16 bp, P. troglodytes
tttctaaaatatgcat

SEQ ID NO: 289144 - DNA, 16 bp, P. troglodytes
tttctaaaatattcta

SEQ ID NO: 289145 - DNA, 16 bp, P. troglodytes
tttctaaaatgtaaat

SEQ ID NO: 289146 - DNA, 16 bp, P. troglodytes
tttctaaaatgtattt

SEQ ID NO: 289147 - DNA, 16 bp, P. troglodytes
tttctaaaatgttaaa

SEQ ID NO: 289148 - DNA, 16 bp, P. troglodytes
tttctaaaatttcaaa

SEQ ID NO: 289149 - DNA, 16 bp, P. troglodytes
tttctaaacagcaaag

SEQ ID NO: 289150 - DNA, 16 bp, P. troglodytes
tttctaaacataaaat

SEQ ID NO: 289151 - DNA, 16 bp, P. troglodytes
tttctaaacatacaat

SEQ ID NO: 289152 - DNA, 16 bp, P. troglodytes
tttctaaagaaaaaca

SEQ ID NO: 289153 - DNA, 16 bp, P. troglodytes
tttctaaagaagaaaa

SEQ ID NO: 289154 - DNA, 16 bp, P. troglodytes
tttctaaagaagaaat

SEQ ID NO: 289155 - DNA, 16 bp, P. troglodytes
tttctaaagaatattt

SEQ ID NO: 289156 - DNA, 16 bp, P. troglodytes
tttctaaagcattttc

SEQ ID NO: 289157 - DNA, 16 bp, P. troglodytes
tttctaaataaagaaa

SEQ ID NO: 289158 - DNA, 16 bp, P. troglodytes
tttctaaataaagttt

SEQ ID NO: 289159 - DNA, 16 bp, P. troglodytes
tttctaaatgtaaaaa

SEQ ID NO: 289160 - DNA, 16 bp, P. troglodytes
tttctaaatgtttatt

SEQ ID NO: 289161 - DNA, 16 bp, P. troglodytes
tttctaaatttgaaaa

SEQ ID NO: 289162 - DNA, 16 bp, P. troglodytes
tttctaacaaattccc

SEQ ID NO: 289163 - DNA, 16 bp, P. troglodytes
tttctaactggaaaaa

SEQ ID NO: 289164 - DNA, 16 bp, P. troglodytes
tttctaacttgtattt

SEQ ID NO: 289165 - DNA, 16 bp, P. troglodytes
tttctaagcaaagtgt

SEQ ID NO: 289166 - DNA, 16 bp, P. troglodytes
tttctaaggatagcag

SEQ ID NO: 289167 - DNA, 16 bp, P. troglodytes
tttctaataaaaatac

SEQ ID NO: 289168 - DNA, 19 bp, P. troglodytes
tttctaattatgcctgaaa

SEQ ID NO: 289169 - DNA, 16 bp, P. troglodytes
tttctaattctgtgaa

SEQ ID NO: 289170 - DNA, 16 bp, P. troglodytes
tttctaatttgcacaa

SEQ ID NO: 289171 - DNA, 16 bp, P. troglodytes
tttctacaaagaaaaa

SEQ ID NO: 289172 - DNA, 18 bp, P. troglodytes
tttctacatagacacagt

SEQ ID NO: 289173 - DNA, 16 bp, P. troglodytes
tttctacattttctaa

SEQ ID NO: 289174 - DNA, 16 bp, P. troglodytes
tttctactaaaaatac

SEQ ID NO: 289175 - DNA, 16 bp, P. troglodytes
tttctactaaaaatat

SEQ ID NO: 289176 - DNA, 16 bp, P. troglodytes
tttctactgaatgtgt

SEQ ID NO: 289177 - DNA, 16 bp, P. troglodytes
tttctacttaaaatat

SEQ ID NO: 289178 - DNA, 18 bp, P. troglodytes
tttctacttttagtagag

SEQ ID NO: 289179 - DNA, 16 bp, P. troglodytes
tttctagaaataaaat

SEQ ID NO: 289180 - DNA, 16 bp, P. troglodytes
tttctagaagaaaaca

SEQ ID NO: 289181 - DNA, 16 bp, P. troglodytes
tttctagaagttttat

SEQ ID NO: 289182 - DNA, 16 bp, P. troglodytes
tttctagaatgtcatg

SEQ ID NO: 289183 - DNA, 16 bp, P. troglodytes
tttctagaattatttt

SEQ ID NO: 289184 - DNA, 16 bp, P. troglodytes
tttctagacctgccct

SEQ ID NO: 289185 - DNA, 16 bp, P. troglodytes
tttctagatttaaaat

SEQ ID NO: 289186 - DNA, 16 bp, P. troglodytes
tttctagctgccttta

SEQ ID NO: 289187 - DNA, 16 bp, P. troglodytes
tttctagctgtgtgac

SEQ ID NO: 289188 - DNA, 16 bp, P. troglodytes
tttctagctgtgtgat

SEQ ID NO: 289189 - DNA, 16 bp, P. troglodytes
tttctagctttatttc

SEQ ID NO: 289190 - DNA, 16 bp, P. troglodytes
tttctaggctgggtgc

SEQ ID NO: 289191 - DNA, 16 bp, P. troglodytes
tttctaggtattttat

SEQ ID NO: 289192 - DNA, 16 bp, P. troglodytes
tttctaggttggggaa

SEQ ID NO: 289193 - DNA, 16 bp, P. troglodytes
tttctagtaaattttt

SEQ ID NO: 289194 - DNA, 16 bp, P. troglodytes
tttctagtaatttatt

SEQ ID NO: 289195 - DNA, 16 bp, P. troglodytes
tttctagtttatttga

SEQ ID NO: 289196 - DNA, 16 bp, P. troglodytes
tttctagtttcctaag

SEQ ID NO: 289197 - DNA, 16 bp, P. troglodytes
tttctagtttcttaaa

SEQ ID NO: 289198 - DNA, 16 bp, P. troglodytes
tttctagtttgtatgc

SEQ ID NO: 289199 - DNA, 16 bp, P. troglodytes
tttctagtttttggct

SEQ ID NO: 289200 - DNA, 16 bp, P. troglodytes
tttctataaaatggaa

SEQ ID NO: 289201 - DNA, 16 bp, P. troglodytes
tttctataataaatgt

SEQ ID NO: 289202 - DNA, 16 bp, P. troglodytes
tttctatacatatata

SEQ ID NO: 289203 - DNA, 18 bp, P. troglodytes
tttctatagattatagat

SEQ ID NO: 289204 - DNA, 16 bp, P. troglodytes
tttctatataccaaaa

SEQ ID NO: 289205 - DNA, 16 bp, P. troglodytes
tttctatattttggat

SEQ ID NO: 289206 - DNA, 16 bp, P. troglodytes
tttctatcaccacaga

SEQ ID NO: 289207 - DNA, 16 bp, P. troglodytes
tttctattgtaaatag

SEQ ID NO: 289208 - DNA, 16 bp, P. troglodytes
tttctattgtaaattt

SEQ ID NO: 289209 - DNA, 16 bp, P. troglodytes
tttctatttccttcag

SEQ ID NO: 289210 - DNA, 16 bp, P. troglodytes
tttctatttctgtcaa

SEQ ID NO: 289211 - DNA, 16 bp, P. troglodytes
tttctatttcttcaaa

SEQ ID NO: 289212 - DNA, 16 bp, P. troglodytes
tttctatttgcatttc

SEQ ID NO: 289213 - DNA, 16 bp, P. troglodytes
tttctattttaaaagt

SEQ ID NO: 289214 - DNA, 16 bp, P. troglodytes
tttctattttccctaa

SEQ ID NO: 289215 - DNA, 16 bp, P. troglodytes
tttctatttttaaaag

SEQ ID NO: 289216 - DNA, 16 bp, P. troglodytes
tttctatttttgaaat

SEQ ID NO: 289217 - DNA, 16 bp, P. troglodytes
tttctatttttgtaaa

SEQ ID NO: 289218 - DNA, 16 bp, P. troglodytes
tttctatttttgtaga

SEQ ID NO: 289219 - DNA, 16 bp, P. troglodytes
tttctattttttgaaa

SEQ ID NO: 289220 - DNA, 16 bp, P. troglodytes
tttctcaaaaatatat

SEQ ID NO: 289221 - DNA, 16 bp, P. troglodytes
tttctcaaaatgaaaa

SEQ ID NO: 289222 - DNA, 16 bp, P. troglodytes
tttctcaaactttcct

SEQ ID NO: 289223 - DNA, 16 bp, P. troglodytes
tttctcaaagaaataa

SEQ ID NO: 289224 - DNA, 16 bp, P. troglodytes
tttctcaaagaacata

SEQ ID NO: 289225 - DNA, 16 bp, P. troglodytes
tttctcaactgtaaaa

SEQ ID NO: 289226 - DNA, 16 bp, P. troglodytes
tttctcaattgtaaaa

SEQ ID NO: 289227 - DNA, 16 bp, P. troglodytes
tttctcaatttaaaaa

SEQ ID NO: 289228 - DNA, 16 bp, P. troglodytes
tttctcaatttcaaaa

SEQ ID NO: 289229 - DNA, 16 bp, P. troglodytes
tttctcacacttctgg

SEQ ID NO: 289230 - DNA, 16 bp, P. troglodytes
tttctcacagtttttg

SEQ ID NO: 289231 - DNA, 16 bp, P. troglodytes
tttctcaccattaaat

SEQ ID NO: 289232 - DNA, 16 bp, P. troglodytes
tttctcaccattctgg

SEQ ID NO: 289233 - DNA, 16 bp, P. troglodytes
tttctcacccataaaa

SEQ ID NO: 289234 - DNA, 16 bp, P. troglodytes
tttctcacttctgtaa

SEQ ID NO: 289235 - DNA, 16 bp, P. troglodytes
tttctcagaaaaaaaa

SEQ ID NO: 289236 - DNA, 16 bp, P. troglodytes
tttctcagaaaaaaat

SEQ ID NO: 289237 - DNA, 16 bp, P. troglodytes
tttctcagaaaaccaa

SEQ ID NO: 289238 - DNA, 16 bp, P. troglodytes
tttctcagaaaccttc

SEQ ID NO: 289239 - DNA, 16 bp, P. troglodytes
tttctcagaaagaaat

SEQ ID NO: 289240 - DNA, 16 bp, P. troglodytes
tttctcagaaatcttc

SEQ ID NO: 289241 - DNA, 16 bp, P. troglodytes
tttctcagaatttttc

SEQ ID NO: 289242 - DNA, 16 bp, P. troglodytes
tttctcagattttaaa

SEQ ID NO: 289243 - DNA, 16 bp, P. troglodytes
tttctcagcatttgct

SEQ ID NO: 289244 - DNA, 16 bp, P. troglodytes
tttctcagctgcaaaa

SEQ ID NO: 289245 - DNA, 16 bp, P. troglodytes
tttctcagctggctga

SEQ ID NO: 289246 - DNA, 16 bp, P. troglodytes
tttctcagctttcctt

SEQ ID NO: 289247 - DNA, 16 bp, P. troglodytes
tttctcaggcaggcac

SEQ ID NO: 289248 - DNA, 16 bp, P. troglodytes
tttctcagtcttttcc

SEQ ID NO: 289249 - DNA, 16 bp, P. troglodytes
tttctcagttttctct

SEQ ID NO: 289250 - DNA, 16 bp, P. troglodytes
tttctcatatgtaaaa

SEQ ID NO: 289251 - DNA, 16 bp, P. troglodytes
tttctcatatttgaaa

SEQ ID NO: 289252 - DNA, 16 bp, P. troglodytes
tttctcatcagaaata

SEQ ID NO: 289253 - DNA, 16 bp, P. troglodytes
tttctcatctgtcaaa

SEQ ID NO: 289254 - DNA, 16 bp, P. troglodytes
tttctcatgcttttct

SEQ ID NO: 289255 - DNA, 16 bp, P. troglodytes
tttctcattaaaatat

SEQ ID NO: 289256 - DNA, 16 bp, P. troglodytes
tttctcatttaaaaaa

SEQ ID NO: 289257 - DNA, 16 bp, P. troglodytes
tttctcatttgtaaat

SEQ ID NO: 289258 - DNA, 16 bp, P. troglodytes
tttctcatttttcaaa

SEQ ID NO: 289259 - DNA, 16 bp, P. troglodytes
tttctccaaaagattt

SEQ ID NO: 289260 - DNA, 16 bp, P. troglodytes
tttctccaaagaaaac

SEQ ID NO: 289261 - DNA, 16 bp, P. troglodytes
tttctccaaagataat

SEQ ID NO: 289262 - DNA, 16 bp, P. troglodytes
tttctccaaagatgat

SEQ ID NO: 289263 - DNA, 16 bp, P. troglodytes
tttctccaaggagcct

SEQ ID NO: 289264 - DNA, 16 bp, P. troglodytes
tttctccacaaccttg

SEQ ID NO: 289265 - DNA, 16 bp, P. troglodytes
tttctccacagcctca

SEQ ID NO: 289266 - DNA, 16 bp, P. troglodytes
tttctccacatcctca

SEQ ID NO: 289267 - DNA, 16 bp, P. troglodytes
tttctccacatcctcc

SEQ ID NO: 289268 - DNA, 16 bp, P. troglodytes
tttctccacatcttct

SEQ ID NO: 289269 - DNA, 16 bp, P. troglodytes
tttctccacatgctca

SEQ ID NO: 289270 - DNA, 16 bp, P. troglodytes
tttctccacttccttg

SEQ ID NO: 289271 - DNA, 16 bp, P. troglodytes
tttctccagggacccc

SEQ ID NO: 289272 - DNA, 16 bp, P. troglodytes
tttctccagtgctgga

SEQ ID NO: 289273 - DNA, 16 bp, P. troglodytes
tttctccatatcctct

SEQ ID NO: 289274 - DNA, 18 bp, P. troglodytes
tttctccatgttggttag

SEQ ID NO: 289275 - DNA, 16 bp, P. troglodytes
tttctccattcagtat

SEQ ID NO: 289276 - DNA, 16 bp, P. troglodytes
tttctccattgaatgg

SEQ ID NO: 289277 - DNA, 16 bp, P. troglodytes
tttctccattgtgtgt

SEQ ID NO: 289278 - DNA, 16 bp, P. troglodytes
tttctccatttattca

SEQ ID NO: 289279 - DNA, 16 bp, P. troglodytes
tttctccatttgtaaa

SEQ ID NO: 289280 - DNA, 16 bp, P. troglodytes
tttctccattttaaaa

SEQ ID NO: 289281 - DNA, 16 bp, P. troglodytes
tttctcccactctata

SEQ ID NO: 289282 - DNA, 16 bp, P. troglodytes
tttctcccagaggatg

SEQ ID NO: 289283 - DNA, 16 bp, P. troglodytes
tttctcccagtctttg

SEQ ID NO: 289284 - DNA, 16 bp, P. troglodytes
tttctccccatccttg

SEQ ID NO: 289285 - DNA, 16 bp, P. troglodytes
tttctccctctgtaaa

SEQ ID NO: 289286 - DNA, 16 bp, P. troglodytes
tttctcctaaaaatac

SEQ ID NO: 289287 - DNA, 16 bp, P. troglodytes
tttctcctagattttc

SEQ ID NO: 289288 - DNA, 16 bp, P. troglodytes
tttctcctattattaa

SEQ ID NO: 289289 - DNA, 16 bp, P. troglodytes
tttctcctcatcctca

SEQ ID NO: 289290 - DNA, 16 bp, P. troglodytes
tttctcctctataaaa

SEQ ID NO: 289291 - DNA, 16 bp, P. troglodytes
tttctcctgaggcctc

SEQ ID NO: 289292 - DNA, 16 bp, P. troglodytes
tttctcctgcccttgg

SEQ ID NO: 289293 - DNA, 18 bp, P. troglodytes
tttctcctgcctcagcct

SEQ ID NO: 289294 - DNA, 16 bp, P. troglodytes
tttctccttcctggga

SEQ ID NO: 289295 - DNA, 16 bp, P. troglodytes
tttctccttggaaaat

SEQ ID NO: 289296 - DNA, 16 bp, P. troglodytes
tttctcctttgcttat

SEQ ID NO: 289297 - DNA, 16 bp, P. troglodytes
tttctccttttcagtt

SEQ ID NO: 289298 - DNA, 16 bp, P. troglodytes
tttctcctttttacaa

SEQ ID NO: 289299 - DNA, 16 bp, P. troglodytes
tttctcctttttggaa

SEQ ID NO: 289300 - DNA, 16 bp, P. troglodytes
tttctctaaaaagaaa

SEQ ID NO: 289301 - DNA, 16 bp, P. troglodytes
tttctctaaagatcag

SEQ ID NO: 289302 - DNA, 16 bp, P. troglodytes
tttctctaaccttgtc

SEQ ID NO: 289303 - DNA, 16 bp, P. troglodytes
tttctctaataaaaaa

SEQ ID NO: 289304 - DNA, 16 bp, P. troglodytes
tttctctaataataaa

SEQ ID NO: 289305 - DNA, 16 bp, P. troglodytes
tttctctacaacctca

SEQ ID NO: 289306 - DNA, 16 bp, P. troglodytes
tttctctacctgccct

SEQ ID NO: 289307 - DNA, 16 bp, P. troglodytes
tttctctactgcaatg

SEQ ID NO: 289308 - DNA, 16 bp, P. troglodytes
tttctctagtttactt

SEQ ID NO: 289309 - DNA, 26 bp, P. troglodytes
tttctctatactttgtctctgtgtct

SEQ ID NO: 289310 - DNA, 16 bp, P. troglodytes
tttctctatttttgaa

SEQ ID NO: 289311 - DNA, 16 bp, P. troglodytes
tttctctcctgctgcc

SEQ ID NO: 289312 - DNA, 17 bp, P. troglodytes
tttctctctacctgatt

SEQ ID NO: 289313 - DNA, 16 bp, P. troglodytes
tttctctctcagactt

SEQ ID NO: 289314 - DNA, 16 bp, P. troglodytes
tttctctctctgccat

SEQ ID NO: 289315 - DNA, 21 bp, P. troglodytes
tttctctctgactgcccttaa

SEQ ID NO: 289316 - DNA, 16 bp, P. troglodytes
tttctctgaaaagaaa

SEQ ID NO: 289317 - DNA, 16 bp, P. troglodytes
tttctctgaaataaaa

SEQ ID NO: 289318 - DNA, 16 bp, P. troglodytes
tttctctgaagatatt

SEQ ID NO: 289319 - DNA, 16 bp, P. troglodytes
tttctctgaatatttt

SEQ ID NO: 289320 - DNA, 16 bp, P. troglodytes
tttctctgacttttct

SEQ ID NO: 289321 - DNA, 16 bp, P. troglodytes
tttctctgagacagag

SEQ ID NO: 289322 - DNA, 16 bp, P. troglodytes
tttctctgatgataag

SEQ ID NO: 289323 - DNA, 16 bp, P. troglodytes
tttctctgatttctct

SEQ ID NO: 289324 - DNA, 16 bp, P. troglodytes
tttctctgcatccttg

SEQ ID NO: 289325 - DNA, 16 bp, P. troglodytes
tttctctgcctctgcc

SEQ ID NO: 289326 - DNA, 16 bp, P. troglodytes
tttctctggaaaaaaa

SEQ ID NO: 289327 - DNA, 16 bp, P. troglodytes
tttctctggaagcttt

SEQ ID NO: 289328 - DNA, 16 bp, P. troglodytes
tttctctggggacccc

SEQ ID NO: 289329 - DNA, 16 bp, P. troglodytes
tttctctggggtcccc

SEQ ID NO: 289330 - DNA, 16 bp, P. troglodytes
tttctctgtacatagt

SEQ ID NO: 289331 - DNA, 16 bp, P. troglodytes
tttctctgtagcccag

SEQ ID NO: 289332 - DNA, 16 bp, P. troglodytes
tttctctgtatctatt

SEQ ID NO: 289333 - DNA, 16 bp, P. troglodytes
tttctctgtgtgtgta

SEQ ID NO: 289334 - DNA, 16 bp, P. troglodytes
tttctctgtttcctca

SEQ ID NO: 289335 - DNA, 16 bp, P. troglodytes
tttctctgtttttcaa

SEQ ID NO: 289336 - DNA, 16 bp, P. troglodytes
tttctcttaaaataat

SEQ ID NO: 289337 - DNA, 16 bp, P. troglodytes
tttctcttcacaggac

SEQ ID NO: 289338 - DNA, 16 bp, P. troglodytes
tttctcttcagaaaaa

SEQ ID NO: 289339 - DNA, 16 bp, P. troglodytes
tttctcttcagtatga

SEQ ID NO: 289340 - DNA, 16 bp, P. troglodytes
tttctcttctaaaata

SEQ ID NO: 289341 - DNA, 16 bp, P. troglodytes
tttctcttcttttgaa

SEQ ID NO: 289342 - DNA, 16 bp, P. troglodytes
tttctcttgctgccac

SEQ ID NO: 289343 - DNA, 16 bp, P. troglodytes
tttctcttgctgctgt

SEQ ID NO: 289344 - DNA, 16 bp, P. troglodytes
tttctcttgggtaaat

SEQ ID NO: 289345 - DNA, 16 bp, P. troglodytes
tttctcttgtgggtat

SEQ ID NO: 289346 - DNA, 16 bp, P. troglodytes
tttctctttaataaaa

SEQ ID NO: 289347 - DNA, 16 bp, P. troglodytes
tttctctttagaaaaa

SEQ ID NO: 289348 - DNA, 16 bp, P. troglodytes
tttctctttccccaaa

SEQ ID NO: 289349 - DNA, 16 bp, P. troglodytes
tttctctttcctgatt

SEQ ID NO: 289350 - DNA, 16 bp, P. troglodytes
tttctctttctgaaaa

SEQ ID NO: 289351 - DNA, 16 bp, P. troglodytes
tttctctttctgaaat

SEQ ID NO: 289352 - DNA, 16 bp, P. troglodytes
tttctctttgcatttc

SEQ ID NO: 289353 - DNA, 16 bp, P. troglodytes
tttctcttttccagaa

SEQ ID NO: 289354 - DNA, 16 bp, P. troglodytes
tttctcttttcttcag

SEQ ID NO: 289355 - DNA, 16 bp, P. troglodytes
tttctcttttgaaaaa

SEQ ID NO: 289356 - DNA, 16 bp, P. troglodytes
tttctcttttgaaaag

SEQ ID NO: 289357 - DNA, 16 bp, P. troglodytes
tttctcttttgaataa

SEQ ID NO: 289358 - DNA, 16 bp, P. troglodytes
tttctctttttaaagt

SEQ ID NO: 289359 - DNA, 16 bp, P. troglodytes
tttctgaaaaaaacaa

SEQ ID NO: 289360 - DNA, 16 bp, P. troglodytes
tttctgaaaaaagaaa

SEQ ID NO: 289361 - DNA, 16 bp, P. troglodytes
tttctgaaaaacaaat

SEQ ID NO: 289362 - DNA, 16 bp, P. troglodytes
tttctgaaaaatggaa

SEQ ID NO: 289363 - DNA, 16 bp, P. troglodytes
tttctgaaaagcaatt

SEQ ID NO: 289364 - DNA, 16 bp, P. troglodytes
tttctgaaaatcattt

SEQ ID NO: 289365 - DNA, 16 bp, P. troglodytes
tttctgaaaatgaaaa

SEQ ID NO: 289366 - DNA, 16 bp, P. troglodytes
tttctgaaaatgcaaa

SEQ ID NO: 289367 - DNA, 16 bp, P. troglodytes
tttctgaaaatgtttt

SEQ ID NO: 289368 - DNA, 16 bp, P. troglodytes
tttctgaaaattttca

SEQ ID NO: 289369 - DNA, 16 bp, P. troglodytes
tttctgaaacacaaat

SEQ ID NO: 289370 - DNA, 16 bp, P. troglodytes
tttctgaaatgttttt

SEQ ID NO: 289371 - DNA, 16 bp, P. troglodytes
tttctgaaattgtttt

SEQ ID NO: 289372 - DNA, 16 bp, P. troglodytes
tttctgaaccaaacca

SEQ ID NO: 289373 - DNA, 16 bp, P. troglodytes
tttctgaaggctcctg

SEQ ID NO: 289374 - DNA, 16 bp, P. troglodytes
tttctgaataaaattt

SEQ ID NO: 289375 - DNA, 16 bp, P. troglodytes
tttctgaatattttaa

SEQ ID NO: 289376 - DNA, 16 bp, P. troglodytes
tttctgaattatttta

SEQ ID NO: 289377 - DNA, 16 bp, P. troglodytes
tttctgaatttcattt

SEQ ID NO: 289378 - DNA, 16 bp, P. troglodytes
tttctgaatttgttta

SEQ ID NO: 289379 - DNA, 16 bp, P. troglodytes
tttctgaattttaaaa

SEQ ID NO: 289380 - DNA, 16 bp, P. troglodytes
tttctgaattttgaaa

SEQ ID NO: 289381 - DNA, 16 bp, P. troglodytes
tttctgaatttttcta

SEQ ID NO: 289382 - DNA, 16 bp, P. troglodytes
tttctgacctcatctc

SEQ ID NO: 289383 - DNA, 16 bp, P. troglodytes
tttctgacttctttca

SEQ ID NO: 289384 - DNA, 16 bp, P. troglodytes
tttctgagaaaaaaat

SEQ ID NO: 289385 - DNA, 16 bp, P. troglodytes
tttctgagaaactgct

SEQ ID NO: 289386 - DNA, 16 bp, P. troglodytes
tttctgagacagggtc

SEQ ID NO: 289387 - DNA, 16 bp, P. troglodytes
tttctgagactttggt

SEQ ID NO: 289388 - DNA, 16 bp, P. troglodytes
tttctgagcagcaaag

SEQ ID NO: 289389 - DNA, 16 bp, P. troglodytes
tttctgagcatatttt

SEQ ID NO: 289390 - DNA, 16 bp, P. troglodytes
tttctgagcttcctgg

SEQ ID NO: 289391 - DNA, 16 bp, P. troglodytes
tttctgagggtcagga

SEQ ID NO: 289392 - DNA, 16 bp, P. troglodytes
tttctgagtctcaatt

SEQ ID NO: 289393 - DNA, 16 bp, P. troglodytes
tttctgagtttcagtt

SEQ ID NO: 289394 - DNA, 16 bp, P. troglodytes
tttctgataattttgg

SEQ ID NO: 289395 - DNA, 16 bp, P. troglodytes
tttctgatatgctgtt

SEQ ID NO: 289396 - DNA, 16 bp, P. troglodytes
tttctgatcctgaaga

SEQ ID NO: 289397 - DNA, 16 bp, P. troglodytes
tttctgatggagtctt

SEQ ID NO: 289398 - DNA, 16 bp, P. troglodytes
tttctgatgtgctgct

SEQ ID NO: 289399 - DNA, 16 bp, P. troglodytes
tttctgattctagatc

SEQ ID NO: 289400 - DNA, 16 bp, P. troglodytes
tttctgattgtgtcta

SEQ ID NO: 289401 - DNA, 16 bp, P. troglodytes
tttctgattttagaaa

SEQ ID NO: 289402 - DNA, 16 bp, P. troglodytes
tttctgattttcaaat

SEQ ID NO: 289403 - DNA, 16 bp, P. troglodytes
tttctgcaaaagaaaa

SEQ ID NO: 289404 - DNA, 16 bp, P. troglodytes
tttctgcaatattttt

SEQ ID NO: 289405 - DNA, 16 bp, P. troglodytes
tttctgcaatctactc

SEQ ID NO: 289406 - DNA, 16 bp, P. troglodytes
tttctgcagcaggctt

SEQ ID NO: 289407 - DNA, 16 bp, P. troglodytes
tttctgcagccaactt

SEQ ID NO: 289408 - DNA, 16 bp, P. troglodytes
tttctgcagctggtca

SEQ ID NO: 289409 - DNA, 16 bp, P. troglodytes
tttctgcatatggata

SEQ ID NO: 289410 - DNA, 16 bp, P. troglodytes
tttctgcattttcaaa

SEQ ID NO: 289411 - DNA, 16 bp, P. troglodytes
tttctgccatgactgt

SEQ ID NO: 289412 - DNA, 16 bp, P. troglodytes
tttctgccttctttat

SEQ ID NO: 289413 - DNA, 16 bp, P. troglodytes
tttctgccttggcctc

SEQ ID NO: 289414 - DNA, 16 bp, P. troglodytes
tttctgccttttaatt

SEQ ID NO: 289415 - DNA, 16 bp, P. troglodytes
tttctgctgaaagatc

SEQ ID NO: 289416 - DNA, 16 bp, P. troglodytes
tttctgctgctgcttc

SEQ ID NO: 289417 - DNA, 16 bp, P. troglodytes
tttctgctttcagttt

SEQ ID NO: 289418 - DNA, 16 bp, P. troglodytes
tttctgctttcatttc

SEQ ID NO: 289419 - DNA, 16 bp, P. troglodytes
tttctgctttcctgaa

SEQ ID NO: 289420 - DNA, 16 bp, P. troglodytes
tttctggaaaatattt

SEQ ID NO: 289421 - DNA, 16 bp, P. troglodytes
tttctggaaacaaatg

SEQ ID NO: 289422 - DNA, 16 bp, P. troglodytes
tttctggaaagataaa

SEQ ID NO: 289423 - DNA, 16 bp, P. troglodytes
tttctggaaagcacca

SEQ ID NO: 289424 - DNA, 16 bp, P. troglodytes
tttctggaaaggattt

SEQ ID NO: 289425 - DNA, 16 bp, P. troglodytes
tttctggaagaaaaaa

SEQ ID NO: 289426 - DNA, 16 bp, P. troglodytes
tttctggaagaaattg

SEQ ID NO: 289427 - DNA, 16 bp, P. troglodytes
tttctggaagagactg

SEQ ID NO: 289428 - DNA, 16 bp, P. troglodytes
tttctggaagagattg

SEQ ID NO: 289429 - DNA, 16 bp, P. troglodytes
tttctggaagagattt

SEQ ID NO: 289430 - DNA, 16 bp, P. troglodytes
tttctggaagagtttt

SEQ ID NO: 289431 - DNA, 16 bp, P. troglodytes
tttctggaaggtaaga

SEQ ID NO: 289432 - DNA, 16 bp, P. troglodytes
tttctggaataatttt

SEQ ID NO: 289433 - DNA, 16 bp, P. troglodytes
tttctggacacacaca

SEQ ID NO: 289434 - DNA, 16 bp, P. troglodytes
tttctggactgaacca

SEQ ID NO: 289435 - DNA, 16 bp, P. troglodytes
tttctggactttttat

SEQ ID NO: 289436 - DNA, 16 bp, P. troglodytes
tttctggagagcaatt

SEQ ID NO: 289437 - DNA, 16 bp, P. troglodytes
tttctggaggctctga

SEQ ID NO: 289438 - DNA, 16 bp, P. troglodytes
tttctggcactgcttc

SEQ ID NO: 289439 - DNA, 16 bp, P. troglodytes
tttctggctacttcct

SEQ ID NO: 289440 - DNA, 16 bp, P. troglodytes
tttctggcttcatcca

SEQ ID NO: 289441 - DNA, 16 bp, P. troglodytes
tttctgggaagaaatt

SEQ ID NO: 289442 - DNA, 16 bp, P. troglodytes
tttctgggatgatgga

SEQ ID NO: 289443 - DNA, 16 bp, P. troglodytes
tttctgggcctcattt

SEQ ID NO: 289444 - DNA, 16 bp, P. troglodytes
tttctgggctctctgt

SEQ ID NO: 289445 - DNA, 16 bp, P. troglodytes
tttctgggctgtctat

SEQ ID NO: 289446 - DNA, 16 bp, P. troglodytes
tttctgggctttctat

SEQ ID NO: 289447 - DNA, 16 bp, P. troglodytes
tttctggggagaaatt

SEQ ID NO: 289448 - DNA, 16 bp, P. troglodytes
tttctggtgtctcttc

SEQ ID NO: 289449 - DNA, 16 bp, P. troglodytes
tttctggtttatttca

SEQ ID NO: 289450 - DNA, 16 bp, P. troglodytes
tttctggttttaaaat

SEQ ID NO: 289451 - DNA, 16 bp, P. troglodytes
tttctggttttggtat

SEQ ID NO: 289452 - DNA, 16 bp, P. troglodytes
tttctgtaaaaacaaa

SEQ ID NO: 289453 - DNA, 16 bp, P. troglodytes
tttctgtaaaatgggg

SEQ ID NO: 289454 - DNA, 16 bp, P. troglodytes
tttctgtaaacatttt

SEQ ID NO: 289455 - DNA, 16 bp, P. troglodytes
tttctgtaaagtattt

SEQ ID NO: 289456 - DNA, 16 bp, P. troglodytes
tttctgtaaatctgaa

SEQ ID NO: 289457 - DNA, 16 bp, P. troglodytes
tttctgtaaatgaaat

SEQ ID NO: 289458 - DNA, 16 bp, P. troglodytes
tttctgtaaatgtaaa

SEQ ID NO: 289459 - DNA, 16 bp, P. troglodytes
tttctgtaatgatgga

SEQ ID NO: 289460 - DNA, 16 bp, P. troglodytes
tttctgtacctcactt

SEQ ID NO: 289461 - DNA, 16 bp, P. troglodytes
tttctgtactttctgt

SEQ ID NO: 289462 - DNA, 16 bp, P. troglodytes
tttctgtatatatgta

SEQ ID NO: 289463 - DNA, 16 bp, P. troglodytes
tttctgtatgtttgaa

SEQ ID NO: 289464 - DNA, 16 bp, P. troglodytes
tttctgtatttaaaaa

SEQ ID NO: 289465 - DNA, 16 bp, P. troglodytes
tttctgtatttatata

SEQ ID NO: 289466 - DNA, 16 bp, P. troglodytes
tttctgtatttcctaa

SEQ ID NO: 289467 - DNA, 16 bp, P. troglodytes
tttctgtattttcagt

SEQ ID NO: 289468 - DNA, 16 bp, P. troglodytes
tttctgtcaccccaaa

SEQ ID NO: 289469 - DNA, 16 bp, P. troglodytes
tttctgtcacttgcaa

SEQ ID NO: 289470 - DNA, 16 bp, P. troglodytes
tttctgtcattgattt

SEQ ID NO: 289471 - DNA, 16 bp, P. troglodytes
tttctgtcatttgcaa

SEQ ID NO: 289472 - DNA, 16 bp, P. troglodytes
tttctgtcatttttaa

SEQ ID NO: 289473 - DNA, 16 bp, P. troglodytes
tttctgtccttttaaa

SEQ ID NO: 289474 - DNA, 16 bp, P. troglodytes
tttctgtccttttact

SEQ ID NO: 289475 - DNA, 16 bp, P. troglodytes
tttctgtctccataaa

SEQ ID NO: 289476 - DNA, 16 bp, P. troglodytes
tttctgtctctagtga

SEQ ID NO: 289477 - DNA, 16 bp, P. troglodytes
tttctgtctgtctgtc

SEQ ID NO: 289478 - DNA, 16 bp, P. troglodytes
tttctgtcttttaaaa

SEQ ID NO: 289479 - DNA, 16 bp, P. troglodytes
tttctgtgaaagaaaa

SEQ ID NO: 289480 - DNA, 16 bp, P. troglodytes
tttctgtgaagaacat

SEQ ID NO: 289481 - DNA, 16 bp, P. troglodytes
tttctgtgatgtaaat

SEQ ID NO: 289482 - DNA, 16 bp, P. troglodytes
tttctgtggaatcagt

SEQ ID NO: 289483 - DNA, 16 bp, P. troglodytes
tttctgtgggaaggaa

SEQ ID NO: 289484 - DNA, 16 bp, P. troglodytes
tttctgtgtatatata

SEQ ID NO: 289485 - DNA, 16 bp, P. troglodytes
tttctgtgtatttgta

SEQ ID NO: 289486 - DNA, 16 bp, P. troglodytes
tttctgtgtctatgga

SEQ ID NO: 289487 - DNA, 16 bp, P. troglodytes
tttctgtgtgtttgaa

SEQ ID NO: 289488 - DNA, 16 bp, P. troglodytes
tttctgtgtttattca

SEQ ID NO: 289489 - DNA, 16 bp, P. troglodytes
tttctgttaatattta

SEQ ID NO: 289490 - DNA, 16 bp, P. troglodytes
tttctgttagcatttt

SEQ ID NO: 289491 - DNA, 16 bp, P. troglodytes
tttctgttcatgtgtt

SEQ ID NO: 289492 - DNA, 16 bp, P. troglodytes
tttctgttcattcatt

SEQ ID NO: 289493 - DNA, 16 bp, P. troglodytes
tttctgttcattttca

SEQ ID NO: 289494 - DNA, 16 bp, P. troglodytes
tttctgttccaggatc

SEQ ID NO: 289495 - DNA, 16 bp, P. troglodytes
tttctgttctctggaa

SEQ ID NO: 289496 - DNA, 16 bp, P. troglodytes
tttctgttcttctaca

SEQ ID NO: 289497 - DNA, 16 bp, P. troglodytes
tttctgttctttgaaa

SEQ ID NO: 289498 - DNA, 16 bp, P. troglodytes
tttctgttgctataat

SEQ ID NO: 289499 - DNA, 16 bp, P. troglodytes
tttctgttgcttacaa

SEQ ID NO: 289500 - DNA, 16 bp, P. troglodytes
tttctgttgcttataa

SEQ ID NO: 289501 - DNA, 16 bp, P. troglodytes
tttctgttgcttttaa

SEQ ID NO: 289502 - DNA, 16 bp, P. troglodytes
tttctgttgtttgaag

SEQ ID NO: 289503 - DNA, 16 bp, P. troglodytes
tttctgtttaaaatta

SEQ ID NO: 289504 - DNA, 16 bp, P. troglodytes
tttctgtttaaagatg

SEQ ID NO: 289505 - DNA, 16 bp, P. troglodytes
tttctgtttctaaaat

SEQ ID NO: 289506 - DNA, 16 bp, P. troglodytes
tttctgtttctagatc

SEQ ID NO: 289507 - DNA, 16 bp, P. troglodytes
tttctgtttctgaaaa

SEQ ID NO: 289508 - DNA, 16 bp, P. troglodytes
tttctgtttctgtaaa

SEQ ID NO: 289509 - DNA, 16 bp, P. troglodytes
tttctgtttctgtgaa

SEQ ID NO: 289510 - DNA, 16 bp, P. troglodytes
tttctgtttcttaaaa

SEQ ID NO: 289511 - DNA, 16 bp, P. troglodytes
tttctgtttgggatga

SEQ ID NO: 289512 - DNA, 16 bp, P. troglodytes
tttctgttttccagtt

SEQ ID NO: 289513 - DNA, 16 bp, P. troglodytes
tttctgttttctgaaa

SEQ ID NO: 289514 - DNA, 16 bp, P. troglodytes
tttctgttttctgagc

SEQ ID NO: 289515 - DNA, 16 bp, P. troglodytes
tttctgtttttaagat

SEQ ID NO: 289516 - DNA, 16 bp, P. troglodytes
tttctgtttttcaaaa

SEQ ID NO: 289517 - DNA, 16 bp, P. troglodytes
tttcttaaaaaagaaa

SEQ ID NO: 289518 - DNA, 16 bp, P. troglodytes
tttcttaaaaagtgaa

SEQ ID NO: 289519 - DNA, 16 bp, P. troglodytes
tttcttaaaaatacaa

SEQ ID NO: 289520 - DNA, 16 bp, P. troglodytes
tttcttaaaaatatga

SEQ ID NO: 289521 - DNA, 16 bp, P. troglodytes
tttcttaaaacataaa

SEQ ID NO: 289522 - DNA, 18 bp, P. troglodytes
tttcttaaaacattatga

SEQ ID NO: 289523 - DNA, 16 bp, P. troglodytes
tttcttaaaagaaaga

SEQ ID NO: 289524 - DNA, 16 bp, P. troglodytes
tttcttaaaagaagat

SEQ ID NO: 289525 - DNA, 16 bp, P. troglodytes
tttcttaaaagacaaa

SEQ ID NO: 289526 - DNA, 16 bp, P. troglodytes
tttcttaaaatagaaa

SEQ ID NO: 289527 - DNA, 16 bp, P. troglodytes
tttcttaaaatccaaa

SEQ ID NO: 289528 - DNA, 16 bp, P. troglodytes
tttcttaaaatgaaga

SEQ ID NO: 289529 - DNA, 16 bp, P. troglodytes
tttcttaaaatgttaa

SEQ ID NO: 289530 - DNA, 16 bp, P. troglodytes
tttcttaaaatgttta

SEQ ID NO: 289531 - DNA, 16 bp, P. troglodytes
tttcttaaaatttcaa

SEQ ID NO: 289532 - DNA, 16 bp, P. troglodytes
tttcttaaacaaaaca

SEQ ID NO: 289533 - DNA, 16 bp, P. troglodytes
tttcttaaataagaaa

SEQ ID NO: 289534 - DNA, 16 bp, P. troglodytes
tttcttaaattataag

SEQ ID NO: 289535 - DNA, 16 bp, P. troglodytes
tttcttaataaacttc

SEQ ID NO: 289536 - DNA, 16 bp, P. troglodytes
tttcttaatccagttt

SEQ ID NO: 289537 - DNA, 16 bp, P. troglodytes
tttcttacaaaaataa

SEQ ID NO: 289538 - DNA, 16 bp, P. troglodytes
tttcttacaaaacaaa

SEQ ID NO: 289539 - DNA, 16 bp, P. troglodytes
tttcttacagttctgg

SEQ ID NO: 289540 - DNA, 16 bp, P. troglodytes
tttcttacataaaaat

SEQ ID NO: 289541 - DNA, 16 bp, P. troglodytes
tttcttacatattttg

SEQ ID NO: 289542 - DNA, 16 bp, P. troglodytes
tttcttacatgcatat

SEQ ID NO: 289543 - DNA, 16 bp, P. troglodytes
tttcttacctataaaa

SEQ ID NO: 289544 - DNA, 16 bp, P. troglodytes
tttcttagaatatatt

SEQ ID NO: 289545 - DNA, 16 bp, P. troglodytes
tttcttagaatttcca

SEQ ID NO: 289546 - DNA, 16 bp, P. troglodytes
tttcttagttaaaaaa

SEQ ID NO: 289547 - DNA, 16 bp, P. troglodytes
tttcttatcagtaaaa

SEQ ID NO: 289548 - DNA, 16 bp, P. troglodytes
tttcttatctctaaaa

SEQ ID NO: 289549 - DNA, 16 bp, P. troglodytes
tttcttatggttctgg

SEQ ID NO: 289550 - DNA, 16 bp, P. troglodytes
tttcttattttcagta

SEQ ID NO: 289551 - DNA, 16 bp, P. troglodytes
tttcttcaaaaaaatt

SEQ ID NO: 289552 - DNA, 16 bp, P. troglodytes
tttcttcaaaaaataa

SEQ ID NO: 289553 - DNA, 16 bp, P. troglodytes
tttcttcaaagaagac

SEQ ID NO: 289554 - DNA, 16 bp, P. troglodytes
tttcttcaaagaatat

SEQ ID NO: 289555 - DNA, 16 bp, P. troglodytes
tttcttcaaataaaat

SEQ ID NO: 289556 - DNA, 16 bp, P. troglodytes
tttcttcaagaaaaat

SEQ ID NO: 289557 - DNA, 16 bp, P. troglodytes
tttcttcaagaatttt

SEQ ID NO: 289558 - DNA, 16 bp, P. troglodytes
tttcttcaagtatttt

SEQ ID NO: 289559 - DNA, 16 bp, P. troglodytes
tttcttcacaaggcag

SEQ ID NO: 289560 - DNA, 16 bp, P. troglodytes
tttcttcacatcctca

SEQ ID NO: 289561 - DNA, 16 bp, P. troglodytes
tttcttcacctgaaaa

SEQ ID NO: 289562 - DNA, 16 bp, P. troglodytes
tttcttcagccttttc

SEQ ID NO: 289563 - DNA, 16 bp, P. troglodytes
tttcttcagctataaa

SEQ ID NO: 289564 - DNA, 16 bp, P. troglodytes
tttcttcagttataaa

SEQ ID NO: 289565 - DNA, 16 bp, P. troglodytes
tttcttcatatcagca

SEQ ID NO: 289566 - DNA, 16 bp, P. troglodytes
tttcttcatatttctg

SEQ ID NO: 289567 - DNA, 16 bp, P. troglodytes
tttcttcatctataaa

SEQ ID NO: 289568 - DNA, 16 bp, P. troglodytes
tttcttcatctataca

SEQ ID NO: 289569 - DNA, 16 bp, P. troglodytes
tttcttcatctctaaa

SEQ ID NO: 289570 - DNA, 16 bp, P. troglodytes
tttcttcatctgcaaa

SEQ ID NO: 289571 - DNA, 16 bp, P. troglodytes
tttcttcatctgtaaa

SEQ ID NO: 289572 - DNA, 16 bp, P. troglodytes
tttcttcatcttcaaa

SEQ ID NO: 289573 - DNA, 16 bp, P. troglodytes
tttcttcatggcattt

SEQ ID NO: 289574 - DNA, 16 bp, P. troglodytes
tttcttcatgtgtttg

SEQ ID NO: 289575 - DNA, 16 bp, P. troglodytes
tttcttcattaaaaaa

SEQ ID NO: 289576 - DNA, 16 bp, P. troglodytes
tttcttcattcattca

SEQ ID NO: 289577 - DNA, 16 bp, P. troglodytes
tttcttcatttcaact

SEQ ID NO: 289578 - DNA, 16 bp, P. troglodytes
tttcttcatttctctg

SEQ ID NO: 289579 - DNA, 16 bp, P. troglodytes
tttcttccaagagttt

SEQ ID NO: 289580 - DNA, 16 bp, P. troglodytes
tttcttccagaaattt

SEQ ID NO: 289581 - DNA, 16 bp, P. troglodytes
tttcttccataaatgt

SEQ ID NO: 289582 - DNA, 16 bp, P. troglodytes
tttcttccattaaaaa

SEQ ID NO: 289583 - DNA, 16 bp, P. troglodytes
tttcttccattgaatt

SEQ ID NO: 289584 - DNA, 16 bp, P. troglodytes
tttcttcccagtctct

SEQ ID NO: 289585 - DNA, 16 bp, P. troglodytes
tttcttcctctgtaaa

SEQ ID NO: 289586 - DNA, 16 bp, P. troglodytes
tttcttcctgattcag

SEQ ID NO: 289587 - DNA, 16 bp, P. troglodytes
tttcttcctggttcag

SEQ ID NO: 289588 - DNA, 16 bp, P. troglodytes
tttcttccttctggaa

SEQ ID NO: 289589 - DNA, 16 bp, P. troglodytes
tttcttcctttctgat

SEQ ID NO: 289590 - DNA, 16 bp, P. troglodytes
tttcttccttttcaaa

SEQ ID NO: 289591 - DNA, 16 bp, P. troglodytes
tttcttccttttgaaa

SEQ ID NO: 289592 - DNA, 16 bp, P. troglodytes
tttcttctaaaaaata

SEQ ID NO: 289593 - DNA, 16 bp, P. troglodytes
tttcttctaaaagttg

SEQ ID NO: 289594 - DNA, 16 bp, P. troglodytes
tttcttctagaaactt

SEQ ID NO: 289595 - DNA, 16 bp, P. troglodytes
tttcttctagaagctt

SEQ ID NO: 289596 - DNA, 16 bp, P. troglodytes
tttcttctagctattt

SEQ ID NO: 289597 - DNA, 16 bp, P. troglodytes
tttcttctattcctag

SEQ ID NO: 289598 - DNA, 16 bp, P. troglodytes
tttcttctcagaaaaa

SEQ ID NO: 289599 - DNA, 16 bp, P. troglodytes
tttcttctctaaaaat

SEQ ID NO: 289600 - DNA, 16 bp, P. troglodytes
tttcttctctgcaaaa

SEQ ID NO: 289601 - DNA, 16 bp, P. troglodytes
tttcttctctgcactt

SEQ ID NO: 289602 - DNA, 16 bp, P. troglodytes
tttcttctctttcaag

SEQ ID NO: 289603 - DNA, 16 bp, P. troglodytes
tttcttctgaaaaaaa

SEQ ID NO: 289604 - DNA, 16 bp, P. troglodytes
tttcttctgaagcctc

SEQ ID NO: 289605 - DNA, 16 bp, P. troglodytes
tttcttctgagaattt

SEQ ID NO: 289606 - DNA, 16 bp, P. troglodytes
tttcttctgaggcctc

SEQ ID NO: 289607 - DNA, 16 bp, P. troglodytes
tttcttctgccatctg

SEQ ID NO: 289608 - DNA, 16 bp, P. troglodytes
tttcttctggaatttt

SEQ ID NO: 289609 - DNA, 16 bp, P. troglodytes
tttcttctggtagctt

SEQ ID NO: 289610 - DNA, 16 bp, P. troglodytes
tttcttctgtggcttc

SEQ ID NO: 289611 - DNA, 16 bp, P. troglodytes
tttcttcttaaaaata

SEQ ID NO: 289612 - DNA, 16 bp, P. troglodytes
tttcttcttaaagttt

SEQ ID NO: 289613 - DNA, 16 bp, P. troglodytes
tttcttcttagaaaat

SEQ ID NO: 289614 - DNA, 16 bp, P. troglodytes
tttcttcttcagaaaa

SEQ ID NO: 289615 - DNA, 16 bp, P. troglodytes
tttcttcttcaggaaa

SEQ ID NO: 289616 - DNA, 16 bp, P. troglodytes
tttcttcttccccaaa

SEQ ID NO: 289617 - DNA, 16 bp, P. troglodytes
tttcttcttcctcagg

SEQ ID NO: 289618 - DNA, 16 bp, P. troglodytes
tttcttcttgagtcag

SEQ ID NO: 289619 - DNA, 16 bp, P. troglodytes
tttcttctttgagaaa

SEQ ID NO: 289620 - DNA, 16 bp, P. troglodytes
tttcttctttgatcta

SEQ ID NO: 289621 - DNA, 16 bp, P. troglodytes
tttcttcttttcagag

SEQ ID NO: 289622 - DNA, 16 bp, P. troglodytes
tttcttcttttgtaaa

SEQ ID NO: 289623 - DNA, 16 bp, P. troglodytes
tttcttgaaaaaaaaa

SEQ ID NO: 289624 - DNA, 16 bp, P. troglodytes
tttcttgaaaattttt

SEQ ID NO: 289625 - DNA, 16 bp, P. troglodytes
tttcttgaaataattt

SEQ ID NO: 289626 - DNA, 16 bp, P. troglodytes
tttcttgaaatatttt

SEQ ID NO: 289627 - DNA, 16 bp, P. troglodytes
tttcttgaaattcttt

SEQ ID NO: 289628 - DNA, 16 bp, P. troglodytes
tttcttgaatttttaa

SEQ ID NO: 289629 - DNA, 16 bp, P. troglodytes
tttcttgagatggaat

SEQ ID NO: 289630 - DNA, 16 bp, P. troglodytes
tttcttgagcacctac

SEQ ID NO: 289631 - DNA, 16 bp, P. troglodytes
tttcttgattgtttcc

SEQ ID NO: 289632 - DNA, 16 bp, P. troglodytes
tttcttgcttgtagtt

SEQ ID NO: 289633 - DNA, 16 bp, P. troglodytes
tttcttggaaaaatat

SEQ ID NO: 289634 - DNA, 16 bp, P. troglodytes
tttcttggagcctttg

SEQ ID NO: 289635 - DNA, 16 bp, P. troglodytes
tttcttggaggctttt

SEQ ID NO: 289636 - DNA, 16 bp, P. troglodytes
tttcttgggattttct

SEQ ID NO: 289637 - DNA, 16 bp, P. troglodytes
tttcttggggaaaaaa

SEQ ID NO: 289638 - DNA, 16 bp, P. troglodytes
tttcttggtgaatttt

SEQ ID NO: 289639 - DNA, 16 bp, P. troglodytes
tttcttgtaaatatgt

SEQ ID NO: 289640 - DNA, 16 bp, P. troglodytes
tttcttgtaaatttat

SEQ ID NO: 289641 - DNA, 16 bp, P. troglodytes
tttcttgtgtatcctt

SEQ ID NO: 289642 - DNA, 16 bp, P. troglodytes
tttctttaaaaaaaag

SEQ ID NO: 289643 - DNA, 16 bp, P. troglodytes
tttctttaaaaagaaa

SEQ ID NO: 289644 - DNA, 16 bp, P. troglodytes
tttctttaaaaagaga

SEQ ID NO: 289645 - DNA, 16 bp, P. troglodytes
tttctttaaaaagtaa

SEQ ID NO: 289646 - DNA, 16 bp, P. troglodytes
tttctttaaaacaaaa

SEQ ID NO: 289647 - DNA, 16 bp, P. troglodytes
tttctttaaaagacaa

SEQ ID NO: 289648 - DNA, 16 bp, P. troglodytes
tttctttaaaatgtaa

SEQ ID NO: 289649 - DNA, 16 bp, P. troglodytes
tttctttaaaatgttt

SEQ ID NO: 289650 - DNA, 16 bp, P. troglodytes
tttctttaaagaaaaa

SEQ ID NO: 289651 - DNA, 16 bp, P. troglodytes
tttctttaaagttctt

SEQ ID NO: 289652 - DNA, 16 bp, P. troglodytes
tttctttaaataaaag

SEQ ID NO: 289653 - DNA, 16 bp, P. troglodytes
tttctttaaatttctg

SEQ ID NO: 289654 - DNA, 16 bp, P. troglodytes
tttctttaaggatgct

SEQ ID NO: 289655 - DNA, 16 bp, P. troglodytes
tttctttaatagatat

SEQ ID NO: 289656 - DNA, 16 bp, P. troglodytes
tttctttacaaaataa

SEQ ID NO: 289657 - DNA, 16 bp, P. troglodytes
tttctttacagaaaaa

SEQ ID NO: 289658 - DNA, 16 bp, P. troglodytes
tttctttacccattta

SEQ ID NO: 289659 - DNA, 16 bp, P. troglodytes
tttctttacctgaaaa

SEQ ID NO: 289660 - DNA, 16 bp, P. troglodytes
tttctttacttgtaaa

SEQ ID NO: 289661 - DNA, 16 bp, P. troglodytes
tttctttagaaattat

SEQ ID NO: 289662 - DNA, 16 bp, P. troglodytes
tttctttagaatttct

SEQ ID NO: 289663 - DNA, 16 bp, P. troglodytes
tttctttataaactgc

SEQ ID NO: 289664 - DNA, 16 bp, P. troglodytes
tttctttataaatgat

SEQ ID NO: 289665 - DNA, 16 bp, P. troglodytes
tttctttataaattgt

SEQ ID NO: 289666 - DNA, 16 bp, P. troglodytes
tttctttataagaaaa

SEQ ID NO: 289667 - DNA, 16 bp, P. troglodytes
tttctttatctgtaaa

SEQ ID NO: 289668 - DNA, 16 bp, P. troglodytes
tttctttatggcttct

SEQ ID NO: 289669 - DNA, 16 bp, P. troglodytes
tttctttatgtaaata

SEQ ID NO: 289670 - DNA, 16 bp, P. troglodytes
tttctttattacagct

SEQ ID NO: 289671 - DNA, 16 bp, P. troglodytes
tttctttattcagtat

SEQ ID NO: 289672 - DNA, 16 bp, P. troglodytes
tttctttattttgaag

SEQ ID NO: 289673 - DNA, 16 bp, P. troglodytes
tttctttcaaatgttt

SEQ ID NO: 289674 - DNA, 16 bp, P. troglodytes
tttctttcagaatgtt

SEQ ID NO: 289675 - DNA, 16 bp, P. troglodytes
tttctttcagctcttg

SEQ ID NO: 289676 - DNA, 16 bp, P. troglodytes
tttctttcagtgcttt

SEQ ID NO: 289677 - DNA, 16 bp, P. troglodytes
tttctttcataaaaga

SEQ ID NO: 289678 - DNA, 16 bp, P. troglodytes
tttctttcattctgta

SEQ ID NO: 289679 - DNA, 16 bp, P. troglodytes
tttctttctaagaaaa

SEQ ID NO: 289680 - DNA, 16 bp, P. troglodytes
tttctttctcctaaaa

SEQ ID NO: 289681 - DNA, 16 bp, P. troglodytes
tttctttctctggaaa

SEQ ID NO: 289682 - DNA, 16 bp, P. troglodytes
tttctttctgattcag

SEQ ID NO: 289683 - DNA, 16 bp, P. troglodytes
tttctttctgctctaa

SEQ ID NO: 289684 - DNA, 16 bp, P. troglodytes
tttctttctgtataaa

SEQ ID NO: 289685 - DNA, 16 bp, P. troglodytes
tttctttcttaaaaaa

SEQ ID NO: 289686 - DNA, 16 bp, P. troglodytes
tttctttcttctgcat

SEQ ID NO: 289687 - DNA, 16 bp, P. troglodytes
tttctttcttgaaaaa

SEQ ID NO: 289688 - DNA, 16 bp, P. troglodytes
tttctttctttgaaat

SEQ ID NO: 289689 - DNA, 16 bp, P. troglodytes
tttctttctttggagg

SEQ ID NO: 289690 - DNA, 16 bp, P. troglodytes
tttctttgaaaagaaa

SEQ ID NO: 289691 - DNA, 16 bp, P. troglodytes
tttctttgaaaatatt

SEQ ID NO: 289692 - DNA, 16 bp, P. troglodytes
tttctttgaacacttt

SEQ ID NO: 289693 - DNA, 16 bp, P. troglodytes
tttctttgaataaaat

SEQ ID NO: 289694 - DNA, 16 bp, P. troglodytes
tttctttgactagaaa

SEQ ID NO: 289695 - DNA, 16 bp, P. troglodytes
tttctttgagacagtt

SEQ ID NO: 289696 - DNA, 17 bp, P. troglodytes
tttctttgagcagtgtt

SEQ ID NO: 289697 - DNA, 16 bp, P. troglodytes
tttctttgagcagttt

SEQ ID NO: 289698 - DNA, 16 bp, P. troglodytes
tttctttgagcctcag

SEQ ID NO: 289699 - DNA, 16 bp, P. troglodytes
tttctttgcagaaatt

SEQ ID NO: 289700 - DNA, 16 bp, P. troglodytes
tttctttgcctggctt

SEQ ID NO: 289701 - DNA, 16 bp, P. troglodytes
tttctttggaaaatta

SEQ ID NO: 289702 - DNA, 16 bp, P. troglodytes
tttctttggaaataaa

SEQ ID NO: 289703 - DNA, 16 bp, P. troglodytes
tttctttgggggaaaa

SEQ ID NO: 289704 - DNA, 16 bp, P. troglodytes
tttctttgtaaattac

SEQ ID NO: 289705 - DNA, 16 bp, P. troglodytes
tttctttgtacatctg

SEQ ID NO: 289706 - DNA, 16 bp, P. troglodytes
tttctttgtgaaaaat

SEQ ID NO: 289707 - DNA, 16 bp, P. troglodytes
tttctttgttttaaaa

SEQ ID NO: 289708 - DNA, 16 bp, P. troglodytes
tttctttgttttggga

SEQ ID NO: 289709 - DNA, 16 bp, P. troglodytes
tttcttttaaaaagta

SEQ ID NO: 289710 - DNA, 16 bp, P. troglodytes
tttcttttaaaacaca

SEQ ID NO: 289711 - DNA, 16 bp, P. troglodytes
tttcttttaaaagaag

SEQ ID NO: 289712 - DNA, 16 bp, P. troglodytes
tttcttttaaaatatg

SEQ ID NO: 289713 - DNA, 16 bp, P. troglodytes
tttcttttaaacataa

SEQ ID NO: 289714 - DNA, 16 bp, P. troglodytes
tttcttttaaatatgt

SEQ ID NO: 289715 - DNA, 16 bp, P. troglodytes
tttcttttaaattctg

SEQ ID NO: 289716 - DNA, 16 bp, P. troglodytes
tttcttttaagaaatt

SEQ ID NO: 289717 - DNA, 16 bp, P. troglodytes
tttcttttaagaattt

SEQ ID NO: 289718 - DNA, 16 bp, P. troglodytes
tttcttttaagagaca

SEQ ID NO: 289719 - DNA, 16 bp, P. troglodytes
tttcttttaagatgga

SEQ ID NO: 289720 - DNA, 16 bp, P. troglodytes
tttcttttacaaaaga

SEQ ID NO: 289721 - DNA, 16 bp, P. troglodytes
tttcttttagaaatgt

SEQ ID NO: 289722 - DNA, 16 bp, P. troglodytes
tttcttttaggtatat

SEQ ID NO: 289723 - DNA, 16 bp, P. troglodytes
tttcttttataaaatg

SEQ ID NO: 289724 - DNA, 16 bp, P. troglodytes
tttcttttatcaatgt

SEQ ID NO: 289725 - DNA, 16 bp, P. troglodytes
tttcttttatgattca

SEQ ID NO: 289726 - DNA, 16 bp, P. troglodytes
tttcttttcaaagaaa

SEQ ID NO: 289727 - DNA, 16 bp, P. troglodytes
tttcttttcagattgt

SEQ ID NO: 289728 - DNA, 16 bp, P. troglodytes
tttcttttcagtaaat

SEQ ID NO: 289729 - DNA, 16 bp, P. troglodytes
tttcttttccaaaatt

SEQ ID NO: 289730 - DNA, 16 bp, P. troglodytes
tttcttttccagaaat

SEQ ID NO: 289731 - DNA, 16 bp, P. troglodytes
tttcttttccagattg

SEQ ID NO: 289732 - DNA, 16 bp, P. troglodytes
tttcttttcctcagaa

SEQ ID NO: 289733 - DNA, 16 bp, P. troglodytes
tttcttttcctgaaat

SEQ ID NO: 289734 - DNA, 16 bp, P. troglodytes
tttcttttctaaaaaa

SEQ ID NO: 289735 - DNA, 16 bp, P. troglodytes
tttcttttctaaaatg

SEQ ID NO: 289736 - DNA, 16 bp, P. troglodytes
tttcttttctaacaaa

SEQ ID NO: 289737 - DNA, 16 bp, P. troglodytes
tttcttttctaacata

SEQ ID NO: 289738 - DNA, 16 bp, P. troglodytes
tttcttttctactgca

SEQ ID NO: 289739 - DNA, 16 bp, P. troglodytes
tttcttttctctagct

SEQ ID NO: 289740 - DNA, 16 bp, P. troglodytes
tttcttttctctgcat

SEQ ID NO: 289741 - DNA, 16 bp, P. troglodytes
tttcttttctgagatg

SEQ ID NO: 289742 - DNA, 16 bp, P. troglodytes
tttcttttctgtagct

SEQ ID NO: 289743 - DNA, 16 bp, P. troglodytes
tttcttttgaaaaaga

SEQ ID NO: 289744 - DNA, 16 bp, P. troglodytes
tttcttttgaaaagaa

SEQ ID NO: 289745 - DNA, 16 bp, P. troglodytes
tttcttttgaaacaaa

SEQ ID NO: 289746 - DNA, 16 bp, P. troglodytes
tttcttttgaatatat

SEQ ID NO: 289747 - DNA, 16 bp, P. troglodytes
tttcttttgagcatca

SEQ ID NO: 289748 - DNA, 16 bp, P. troglodytes
tttcttttgatgaaaa

SEQ ID NO: 289749 - DNA, 16 bp, P. troglodytes
tttcttttgctctgca

SEQ ID NO: 289750 - DNA, 16 bp, P. troglodytes
tttcttttggaaaata

SEQ ID NO: 289751 - DNA, 16 bp, P. troglodytes
tttcttttggaggtga

SEQ ID NO: 289752 - DNA, 16 bp, P. troglodytes
tttcttttgggaaaaa

SEQ ID NO: 289753 - DNA, 16 bp, P. troglodytes
tttcttttggtaaaat

SEQ ID NO: 289754 - DNA, 16 bp, P. troglodytes
tttcttttgttaaaaa

SEQ ID NO: 289755 - DNA, 16 bp, P. troglodytes
tttctttttaaagaag

SEQ ID NO: 289756 - DNA, 16 bp, P. troglodytes
tttctttttaaatctg

SEQ ID NO: 289757 - DNA, 16 bp, P. troglodytes
tttctttttaaattga

SEQ ID NO: 289758 - DNA, 16 bp, P. troglodytes
tttctttttaagaaat

SEQ ID NO: 289759 - DNA, 16 bp, P. troglodytes
tttctttttaagtaat

SEQ ID NO: 289760 - DNA, 16 bp, P. troglodytes
tttctttttagagaca

SEQ ID NO: 289761 - DNA, 16 bp, P. troglodytes
tttctttttagagata

SEQ ID NO: 289762 - DNA, 16 bp, P. troglodytes
tttctttttatagaaa

SEQ ID NO: 289763 - DNA, 16 bp, P. troglodytes
tttctttttatgaaaa

SEQ ID NO: 289764 - DNA, 16 bp, P. troglodytes
tttctttttcagactg

SEQ ID NO: 289765 - DNA, 16 bp, P. troglodytes
tttctttttcatggct

SEQ ID NO: 289766 - DNA, 16 bp, P. troglodytes
tttctttttccagaat

SEQ ID NO: 289767 - DNA, 16 bp, P. troglodytes
tttctttttcctgaaa

SEQ ID NO: 289768 - DNA, 16 bp, P. troglodytes
tttctttttctgtcca

SEQ ID NO: 289769 - DNA, 16 bp, P. troglodytes
tttctttttgaaaata

SEQ ID NO: 289770 - DNA, 16 bp, P. troglodytes
tttctttttgaaaatg

SEQ ID NO: 289771 - DNA, 16 bp, P. troglodytes
tttctttttgacagag

SEQ ID NO: 289772 - DNA, 16 bp, P. troglodytes
tttctttttgagaagg

SEQ ID NO: 289773 - DNA, 16 bp, P. troglodytes
tttctttttgagacag

SEQ ID NO: 289774 - DNA, 16 bp, P. troglodytes
tttctttttgaggtgg

SEQ ID NO: 289775 - DNA, 16 bp, P. troglodytes
tttctttttggagaca

SEQ ID NO: 289776 - DNA, 16 bp, P. troglodytes
tttcttttttaaacag

SEQ ID NO: 289777 - DNA, 16 bp, P. troglodytes
tttcttttttaaagaa

SEQ ID NO: 289778 - DNA, 16 bp, P. troglodytes
tttcttttttaacaca

SEQ ID NO: 289779 - DNA, 16 bp, P. troglodytes
tttcttttttaagaca

SEQ ID NO: 289780 - DNA, 16 bp, P. troglodytes
tttcttttttgaaaat

SEQ ID NO: 289781 - DNA, 16 bp, P. troglodytes
tttcttttttgagaca

SEQ ID NO: 289782 - DNA, 16 bp, P. troglodytes
tttcttttttgtcaaa

SEQ ID NO: 289783 - DNA, 16 bp, P. troglodytes
tttctttttttaagag

SEQ ID NO: 289784 - DNA, 16 bp, P. troglodytes
tttctttttttcaaga

SEQ ID NO: 289785 - DNA, 16 bp, P. troglodytes
tttctttttttcagag

SEQ ID NO: 289786 - DNA, 16 bp, P. troglodytes
tttctttttttcccag

SEQ ID NO: 289787 - DNA, 16 bp, P. troglodytes
tttctttttttggaag

SEQ ID NO: 289788 - DNA, 16 bp, P. troglodytes
tttgaaaaaaaaatct

SEQ ID NO: 289789 - DNA, 16 bp, P. troglodytes
tttgaaaaaaaatctc

SEQ ID NO: 289790 - DNA, 16 bp, P. troglodytes
tttgaaaaaaactttt

SEQ ID NO: 289791 - DNA, 16 bp, P. troglodytes
tttgaaaaaaataaca

SEQ ID NO: 289792 - DNA, 16 bp, P. troglodytes
tttgaaaaaactttct

SEQ ID NO: 289793 - DNA, 16 bp, P. troglodytes
tttgaaaaaataaaca

SEQ ID NO: 289794 - DNA, 16 bp, P. troglodytes
tttgaaaaaataagca

SEQ ID NO: 289795 - DNA, 16 bp, P. troglodytes
tttgaaaaaatgtttt

SEQ ID NO: 289796 - DNA, 16 bp, P. troglodytes
tttgaaaaacaaataa

SEQ ID NO: 289797 - DNA, 16 bp, P. troglodytes
tttgaaaaacaaatta

SEQ ID NO: 289798 - DNA, 16 bp, P. troglodytes
tttgaaaaacactgat

SEQ ID NO: 289799 - DNA, 16 bp, P. troglodytes
tttgaaaaacactttt

SEQ ID NO: 289800 - DNA, 16 bp, P. troglodytes
tttgaaaaacagtttg

SEQ ID NO: 289801 - DNA, 16 bp, P. troglodytes
tttgaaaaacatgaaa

SEQ ID NO: 289802 - DNA, 16 bp, P. troglodytes
tttgaaaaacatttta

SEQ ID NO: 289803 - DNA, 16 bp, P. troglodytes
tttgaaaaacattttc

SEQ ID NO: 289804 - DNA, 16 bp, P. troglodytes
tttgaaaaacttaaaa

SEQ ID NO: 289805 - DNA, 16 bp, P. troglodytes
tttgaaaaagaagaac

SEQ ID NO: 289806 - DNA, 16 bp, P. troglodytes
tttgaaaaagatattt

SEQ ID NO: 289807 - DNA, 16 bp, P. troglodytes
tttgaaaaaggaaaat

SEQ ID NO: 289808 - DNA, 16 bp, P. troglodytes
tttgaaaaagtgaaaa

SEQ ID NO: 289809 - DNA, 16 bp, P. troglodytes
tttgaaaaataaacat

SEQ ID NO: 289810 - DNA, 16 bp, P. troglodytes
tttgaaaaataaagtt

SEQ ID NO: 289811 - DNA, 16 bp, P. troglodytes
tttgaaaaataacaaa

SEQ ID NO: 289812 - DNA, 16 bp, P. troglodytes
tttgaaaaatatctat

SEQ ID NO: 289813 - DNA, 16 bp, P. troglodytes
tttgaaaaatatttct

SEQ ID NO: 289814 - DNA, 16 bp, P. troglodytes
tttgaaaaatctcatt

SEQ ID NO: 289815 - DNA, 16 bp, P. troglodytes
tttgaaaaatcttcaa

SEQ ID NO: 289816 - DNA, 16 bp, P. troglodytes
tttgaaaaatgcataa

SEQ ID NO: 289817 - DNA, 16 bp, P. troglodytes
tttgaaaaatgctttt

SEQ ID NO: 289818 - DNA, 16 bp, P. troglodytes
tttgaaaaatgtaatt

SEQ ID NO: 289819 - DNA, 16 bp, P. troglodytes
tttgaaaaatgtctgt

SEQ ID NO: 289820 - DNA, 16 bp, P. troglodytes
tttgaaaaatgtttct

SEQ ID NO: 289821 - DNA, 16 bp, P. troglodytes
tttgaaaaatgttttc

SEQ ID NO: 289822 - DNA, 16 bp, P. troglodytes
tttgaaaaattgcttt

SEQ ID NO: 289823 - DNA, 16 bp, P. troglodytes
tttgaaaaatttcaaa

SEQ ID NO: 289824 - DNA, 16 bp, P. troglodytes
tttgaaaaattttgaa

SEQ ID NO: 289825 - DNA, 16 bp, P. troglodytes
tttgaaaacaaaaatt

SEQ ID NO: 289826 - DNA, 16 bp, P. troglodytes
tttgaaaacaattttt

SEQ ID NO: 289827 - DNA, 16 bp, P. troglodytes
tttgaaaacataattt

SEQ ID NO: 289828 - DNA, 16 bp, P. troglodytes
tttgaaaacattttgt

SEQ ID NO: 289829 - DNA, 16 bp, P. troglodytes
tttgaaaaccactggt

SEQ ID NO: 289830 - DNA, 16 bp, P. troglodytes
tttgaaaactttaaaa

SEQ ID NO: 289831 - DNA, 16 bp, P. troglodytes
tttgaaaagaagaaag

SEQ ID NO: 289832 - DNA, 16 bp, P. troglodytes
tttgaaaagacatttt

SEQ ID NO: 289833 - DNA, 16 bp, P. troglodytes
tttgaaaagataagta

SEQ ID NO: 289834 - DNA, 16 bp, P. troglodytes
tttgaaaagattttaa

SEQ ID NO: 289835 - DNA, 16 bp, P. troglodytes
tttgaaaagcaaataa

SEQ ID NO: 289836 - DNA, 16 bp, P. troglodytes
tttgaaaaggaaaatg

SEQ ID NO: 289837 - DNA, 16 bp, P. troglodytes
tttgaaaaggagaaaa

SEQ ID NO: 289838 - DNA, 16 bp, P. troglodytes
tttgaaaaggatcaaa

SEQ ID NO: 289839 - DNA, 16 bp, P. troglodytes
tttgaaaaggattaaa

SEQ ID NO: 289840 - DNA, 16 bp, P. troglodytes
tttgaaaagggagaaa

SEQ ID NO: 289841 - DNA, 16 bp, P. troglodytes
tttgaaaagttgtttt

SEQ ID NO: 289842 - DNA, 16 bp, P. troglodytes
tttgaaaagtttaaaa

SEQ ID NO: 289843 - DNA, 16 bp, P. troglodytes
tttgaaaataacaaaa

SEQ ID NO: 289844 - DNA, 16 bp, P. troglodytes
tttgaaaataactttt

SEQ ID NO: 289845 - DNA, 16 bp, P. troglodytes
tttgaaaataatgaga

SEQ ID NO: 289846 - DNA, 16 bp, P. troglodytes
tttgaaaataattatg

SEQ ID NO: 289847 - DNA, 16 bp, P. troglodytes
tttgaaaatacagaaa

SEQ ID NO: 289848 - DNA, 16 bp, P. troglodytes
tttgaaaatactattt

SEQ ID NO: 289849 - DNA, 16 bp, P. troglodytes
tttgaaaatactttct

SEQ ID NO: 289850 - DNA, 16 bp, P. troglodytes
tttgaaaatatagaat

SEQ ID NO: 289851 - DNA, 16 bp, P. troglodytes
tttgaaaatatgtatt

SEQ ID NO: 289852 - DNA, 16 bp, P. troglodytes
tttgaaaatattactg

SEQ ID NO: 289853 - DNA, 16 bp, P. troglodytes
tttgaaaatcaattaa

SEQ ID NO: 289854 - DNA, 16 bp, P. troglodytes
tttgaaaatctttttt

SEQ ID NO: 289855 - DNA, 16 bp, P. troglodytes
tttgaaaatgaaagga

SEQ ID NO: 289856 - DNA, 16 bp, P. troglodytes
tttgaaaatgaaagta

SEQ ID NO: 289857 - DNA, 16 bp, P. troglodytes
tttgaaaatgaaggaa

SEQ ID NO: 289858 - DNA, 16 bp, P. troglodytes
tttgaaaatgatttaa

SEQ ID NO: 289859 - DNA, 16 bp, P. troglodytes
tttgaaaatgctttct

SEQ ID NO: 289860 - DNA, 16 bp, P. troglodytes
tttgaaaatggagaaa

SEQ ID NO: 289861 - DNA, 16 bp, P. troglodytes
tttgaaaatgtgattt

SEQ ID NO: 289862 - DNA, 16 bp, P. troglodytes
tttgaaaatgttaaat

SEQ ID NO: 289863 - DNA, 16 bp, P. troglodytes
tttgaaaatgtttcaa

SEQ ID NO: 289864 - DNA, 16 bp, P. troglodytes
tttgaaaattacatga

SEQ ID NO: 289865 - DNA, 16 bp, P. troglodytes
tttgaaaattcatttt

SEQ ID NO: 289866 - DNA, 16 bp, P. troglodytes
tttgaaaattcttttc

SEQ ID NO: 289867 - DNA, 16 bp, P. troglodytes
tttgaaaatttaaaca

SEQ ID NO: 289868 - DNA, 16 bp, P. troglodytes
tttgaaaatttgaatt

SEQ ID NO: 289869 - DNA, 16 bp, P. troglodytes
tttgaaaattttactt

SEQ ID NO: 289870 - DNA, 16 bp, P. troglodytes
tttgaaacaaagatgg

SEQ ID NO: 289871 - DNA, 16 bp, P. troglodytes
tttgaaacacagtctt

SEQ ID NO: 289872 - DNA, 16 bp, P. troglodytes
tttgaaacactatttt

SEQ ID NO: 289873 - DNA, 16 bp, P. troglodytes
tttgaaacagaaaaat

SEQ ID NO: 289874 - DNA, 16 bp, P. troglodytes
tttgaaacagagtctc

SEQ ID NO: 289875 - DNA, 16 bp, P. troglodytes
tttgaaacattttcag

SEQ ID NO: 289876 - DNA, 21 bp, P. troglodytes
tttgaaaccaatgagaacaaa

SEQ ID NO: 289877 - DNA, 16 bp, P. troglodytes
tttgaaaccatcctgg

SEQ ID NO: 289878 - DNA, 17 bp, P. troglodytes
tttgaaaccgatgagaa

SEQ ID NO: 289879 - DNA, 16 bp, P. troglodytes
tttgaaactattccaa

SEQ ID NO: 289880 - DNA, 16 bp, P. troglodytes
tttgaaactcagtttt

SEQ ID NO: 289881 - DNA, 16 bp, P. troglodytes
tttgaaactgctttgt

SEQ ID NO: 289882 - DNA, 16 bp, P. troglodytes
tttgaaagaaaatttt

SEQ ID NO: 289883 - DNA, 16 bp, P. troglodytes
tttgaaagaattcaac

SEQ ID NO: 289884 - DNA, 16 bp, P. troglodytes
tttgaaagcattttta

SEQ ID NO: 289885 - DNA, 16 bp, P. troglodytes
tttgaaaggaaaaaca

SEQ ID NO: 289886 - DNA, 16 bp, P. troglodytes
tttgaaaggaagaaaa

SEQ ID NO: 289887 - DNA, 16 bp, P. troglodytes
tttgaaagtaaaatat

SEQ ID NO: 289888 - DNA, 16 bp, P. troglodytes
tttgaaagtaaatttt

SEQ ID NO: 289889 - DNA, 16 bp, P. troglodytes
tttgaaataaaaattg

SEQ ID NO: 289890 - DNA, 16 bp, P. troglodytes
tttgaaatacaaaaaa

SEQ ID NO: 289891 - DNA, 17 bp, P. troglodytes
tttgaaatacatcccat

SEQ ID NO: 289892 - DNA, 16 bp, P. troglodytes
tttgaaataccagata

SEQ ID NO: 289893 - DNA, 16 bp, P. troglodytes
tttgaaatatgaaaat

SEQ ID NO: 289894 - DNA, 16 bp, P. troglodytes
tttgaaatatgagaaa

SEQ ID NO: 289895 - DNA, 16 bp, P. troglodytes
tttgaaatatgattta

SEQ ID NO: 289896 - DNA, 16 bp, P. troglodytes
tttgaaatatttacat

SEQ ID NO: 289897 - DNA, 16 bp, P. troglodytes
tttgaaatatttctta

SEQ ID NO: 289898 - DNA, 16 bp, P. troglodytes
tttgaaatattttctt

SEQ ID NO: 289899 - DNA, 16 bp, P. troglodytes
tttgaaatcagaaaat

SEQ ID NO: 289900 - DNA, 16 bp, P. troglodytes
tttgaaatcagaaagt

SEQ ID NO: 289901 - DNA, 16 bp, P. troglodytes
tttgaaatctgatttt

SEQ ID NO: 289902 - DNA, 16 bp, P. troglodytes
tttgaaatctttcttt

SEQ ID NO: 289903 - DNA, 16 bp, P. troglodytes
tttgaaatgaaatttt

SEQ ID NO: 289904 - DNA, 16 bp, P. troglodytes
tttgaaatgaatcttt

SEQ ID NO: 289905 - DNA, 16 bp, P. troglodytes
tttgaaatgcagtttt

SEQ ID NO: 289906 - DNA, 16 bp, P. troglodytes
tttgaaatgcatattt

SEQ ID NO: 289907 - DNA, 16 bp, P. troglodytes
tttgaaatgcttttta

SEQ ID NO: 289908 - DNA, 16 bp, P. troglodytes
tttgaaatggaaaata

SEQ ID NO: 289909 - DNA, 16 bp, P. troglodytes
tttgaaatgtgaagac

SEQ ID NO: 289910 - DNA, 16 bp, P. troglodytes
tttgaaatgtgtttct

SEQ ID NO: 289911 - DNA, 16 bp, P. troglodytes
tttgaaatgttaataa

SEQ ID NO: 289912 - DNA, 16 bp, P. troglodytes
tttgaaatgtttaata

SEQ ID NO: 289913 - DNA, 16 bp, P. troglodytes
tttgaaatgttttcta

SEQ ID NO: 289914 - DNA, 16 bp, P. troglodytes
tttgaaattaatgaga

SEQ ID NO: 289915 - DNA, 16 bp, P. troglodytes
tttgaaattatatgaa

SEQ ID NO: 289916 - DNA, 16 bp, P. troglodytes
tttgaaattatttcaa

SEQ ID NO: 289917 - DNA, 16 bp, P. troglodytes
tttgaaattcatccat

SEQ ID NO: 289918 - DNA, 16 bp, P. troglodytes
tttgaaatttactttt

SEQ ID NO: 289919 - DNA, 16 bp, P. troglodytes
tttgaaattttacatt

SEQ ID NO: 289920 - DNA, 16 bp, P. troglodytes
tttgaaattttccaaa

SEQ ID NO: 289921 - DNA, 16 bp, P. troglodytes
tttgaacaagttgtgg

SEQ ID NO: 289922 - DNA, 16 bp, P. troglodytes
tttgaacactcagcag

SEQ ID NO: 289923 - DNA, 16 bp, P. troglodytes
tttgaacagttggctg

SEQ ID NO: 289924 - DNA, 16 bp, P. troglodytes
tttgaaccatgtgaat

SEQ ID NO: 289925 - DNA, 16 bp, P. troglodytes
tttgaacccaagaggc

SEQ ID NO: 289926 - DNA, 16 bp, P. troglodytes
tttgaacccagcctgg

SEQ ID NO: 289927 - DNA, 16 bp, P. troglodytes
tttgaacccaggaggc

SEQ ID NO: 289928 - DNA, 16 bp, P. troglodytes
tttgaacccaggaggt

SEQ ID NO: 289929 - DNA, 16 bp, P. troglodytes
tttgaacccaggagtt

SEQ ID NO: 289930 - DNA, 16 bp, P. troglodytes
tttgaacccgggaggc

SEQ ID NO: 289931 - DNA, 16 bp, P. troglodytes
tttgaacccgggaggt

SEQ ID NO: 289932 - DNA, 16 bp, P. troglodytes
tttgaaccctggaggc

SEQ ID NO: 289933 - DNA, 16 bp, P. troglodytes
tttgaacctgggaagc

SEQ ID NO: 289934 - DNA, 16 bp, P. troglodytes
tttgaacctgggaggc

SEQ ID NO: 289935 - DNA, 16 bp, P. troglodytes
tttgaacctgggaggt

SEQ ID NO: 289936 - DNA, 16 bp, P. troglodytes
tttgaactcaggaggc

SEQ ID NO: 289937 - DNA, 16 bp, P. troglodytes
tttgaactccttatat

SEQ ID NO: 289938 - DNA, 16 bp, P. troglodytes
tttgaactcttgagct

SEQ ID NO: 289939 - DNA, 16 bp, P. troglodytes
tttgaactgttttata

SEQ ID NO: 289940 - DNA, 18 bp, P. troglodytes
tttgaacttgagagagat

SEQ ID NO: 289941 - DNA, 16 bp, P. troglodytes
tttgaagaaataattt

SEQ ID NO: 289942 - DNA, 16 bp, P. troglodytes
tttgaagaagaaaatg

SEQ ID NO: 289943 - DNA, 16 bp, P. troglodytes
tttgaagaatatttaa

SEQ ID NO: 289944 - DNA, 16 bp, P. troglodytes
tttgaagagaaacctc

SEQ ID NO: 289945 - DNA, 16 bp, P. troglodytes
tttgaagagaaattta

SEQ ID NO: 289946 - DNA, 16 bp, P. troglodytes
tttgaagagtttgaga

SEQ ID NO: 289947 - DNA, 16 bp, P. troglodytes
tttgaagatgaagaaa

SEQ ID NO: 289948 - DNA, 16 bp, P. troglodytes
tttgaagatggaaaaa

SEQ ID NO: 289949 - DNA, 16 bp, P. troglodytes
tttgaagatggaagag

SEQ ID NO: 289950 - DNA, 16 bp, P. troglodytes
tttgaagatggagaaa

SEQ ID NO: 289951 - DNA, 16 bp, P. troglodytes
tttgaagattatatat

SEQ ID NO: 289952 - DNA, 16 bp, P. troglodytes
tttgaagattctacaa

SEQ ID NO: 289953 - DNA, 16 bp, P. troglodytes
tttgaagcaaatctca

SEQ ID NO: 289954 - DNA, 16 bp, P. troglodytes
tttgaagccaagcatt

SEQ ID NO: 289955 - DNA, 16 bp, P. troglodytes
tttgaagccattgtga

SEQ ID NO: 289956 - DNA, 16 bp, P. troglodytes
tttgaagctaacagag

SEQ ID NO: 289957 - DNA, 16 bp, P. troglodytes
tttgaagctttgaaac

SEQ ID NO: 289958 - DNA, 16 bp, P. troglodytes
tttgaaggaaaaaata

SEQ ID NO: 289959 - DNA, 16 bp, P. troglodytes
tttgaaggaaataaaa

SEQ ID NO: 289960 - DNA, 16 bp, P. troglodytes
tttgaaggaagaaaaa

SEQ ID NO: 289961 - DNA, 16 bp, P. troglodytes
tttgaaggatattttg

SEQ ID NO: 289962 - DNA, 16 bp, P. troglodytes
tttgaagggaaaaaaa

SEQ ID NO: 289963 - DNA, 16 bp, P. troglodytes
tttgaaggtataaaac

SEQ ID NO: 289964 - DNA, 16 bp, P. troglodytes
tttgaagtaaatgaaa

SEQ ID NO: 289965 - DNA, 16 bp, P. troglodytes
tttgaagtaaatttta

SEQ ID NO: 289966 - DNA, 16 bp, P. troglodytes
tttgaagtaattgtga

SEQ ID NO: 289967 - DNA, 16 bp, P. troglodytes
tttgaagtcaaacaga

SEQ ID NO: 289968 - DNA, 16 bp, P. troglodytes
tttgaagtggagtctc

SEQ ID NO: 289969 - DNA, 16 bp, P. troglodytes
tttgaagtgtgtgtgt

SEQ ID NO: 289970 - DNA, 16 bp, P. troglodytes
tttgaagttttaaaaa

SEQ ID NO: 289971 - DNA, 16 bp, P. troglodytes
tttgaataaaatttct

SEQ ID NO: 289972 - DNA, 16 bp, P. troglodytes
tttgaataaataatgg

SEQ ID NO: 289973 - DNA, 16 bp, P. troglodytes
tttgaatatgttttct

SEQ ID NO: 289974 - DNA, 16 bp, P. troglodytes
tttgaatattttaaga

SEQ ID NO: 289975 - DNA, 16 bp, P. troglodytes
tttgaatatttttcaa

SEQ ID NO: 289976 - DNA, 16 bp, P. troglodytes
tttgaatcccagctgt

SEQ ID NO: 289977 - DNA, 16 bp, P. troglodytes
tttgaatctcaatttt

SEQ ID NO: 289978 - DNA, 16 bp, P. troglodytes
tttgaatctctctttt

SEQ ID NO: 289979 - DNA, 16 bp, P. troglodytes
tttgaatcttagctct

SEQ ID NO: 289980 - DNA, 16 bp, P. troglodytes
tttgaatcttggctct

SEQ ID NO: 289981 - DNA, 16 bp, P. troglodytes
tttgaatcttggttct

SEQ ID NO: 289982 - DNA, 16 bp, P. troglodytes
tttgaatctttaaaaa

SEQ ID NO: 289983 - DNA, 16 bp, P. troglodytes
tttgaatgaaaaattt

SEQ ID NO: 289984 - DNA, 16 bp, P. troglodytes
tttgaatgttctcatc

SEQ ID NO: 289985 - DNA, 16 bp, P. troglodytes
tttgaatgtttgatag

SEQ ID NO: 289986 - DNA, 16 bp, P. troglodytes
tttgaattaaaatgtt

SEQ ID NO: 289987 - DNA, 16 bp, P. troglodytes
tttgaattaatttttc

SEQ ID NO: 289988 - DNA, 16 bp, P. troglodytes
tttgaattccagctct

SEQ ID NO: 289989 - DNA, 16 bp, P. troglodytes
tttgaattccttgtat

SEQ ID NO: 289990 - DNA, 16 bp, P. troglodytes
tttgaattctttttcc

SEQ ID NO: 289991 - DNA, 16 bp, P. troglodytes
tttgaattggaaatat

SEQ ID NO: 289992 - DNA, 16 bp, P. troglodytes
tttgaatttcagataa

SEQ ID NO: 289993 - DNA, 16 bp, P. troglodytes
tttgaatttctgtaat

SEQ ID NO: 289994 - DNA, 16 bp, P. troglodytes
tttgaatttctttgct

SEQ ID NO: 289995 - DNA, 16 bp, P. troglodytes
tttgaatttgaaaaat

SEQ ID NO: 289996 - DNA, 16 bp, P. troglodytes
tttgaatttgtatttc

SEQ ID NO: 289997 - DNA, 16 bp, P. troglodytes
tttgaattttaaaaga

SEQ ID NO: 289998 - DNA, 16 bp, P. troglodytes
tttgaattttaaaatg

SEQ ID NO: 289999 - DNA, 16 bp, P. troglodytes
tttgaattttagaaaa

SEQ ID NO: 290000 - DNA, 16 bp, P. troglodytes
tttgaattttctttca

SEQ ID NO: 290001 - DNA, 16 bp, P. troglodytes
tttgaattttgaacca

SEQ ID NO: 290002 - DNA, 16 bp, P. troglodytes
tttgaattttgatgaa

SEQ ID NO: 290003 - DNA, 16 bp, P. troglodytes
tttgaattttggaata

SEQ ID NO: 290004 - DNA, 16 bp, P. troglodytes
tttgacaaaaatactg

SEQ ID NO: 290005 - DNA, 16 bp, P. troglodytes
tttgacaaaaatgctg

SEQ ID NO: 290006 - DNA, 16 bp, P. troglodytes
tttgacaaaacaaaca

SEQ ID NO: 290007 - DNA, 16 bp, P. troglodytes
tttgacaaaatccaac

SEQ ID NO: 290008 - DNA, 17 bp, P. troglodytes
tttgacaaaatccagca

SEQ ID NO: 290009 - DNA, 17 bp, P. troglodytes
tttgacaaaattcaaca

SEQ ID NO: 290010 - DNA, 16 bp, P. troglodytes
tttgacaaacatctcc

SEQ ID NO: 290011 - DNA, 16 bp, P. troglodytes
tttgacaaatacataa

SEQ ID NO: 290012 - DNA, 16 bp, P. troglodytes
tttgacaaatatttat

SEQ ID NO: 290013 - DNA, 16 bp, P. troglodytes
tttgacaaatgaagaa

SEQ ID NO: 290014 - DNA, 16 bp, P. troglodytes
tttgacaaatggtgct

SEQ ID NO: 290015 - DNA, 16 bp, P. troglodytes
tttgacaaatgtaaaa

SEQ ID NO: 290016 - DNA, 16 bp, P. troglodytes
tttgacaatatttttt

SEQ ID NO: 290017 - DNA, 16 bp, P. troglodytes
tttgacacactgattt

SEQ ID NO: 290018 - DNA, 16 bp, P. troglodytes
tttgacagatgaaaaa

SEQ ID NO: 290019 - DNA, 16 bp, P. troglodytes
tttgacagcacaacag

SEQ ID NO: 290020 - DNA, 16 bp, P. troglodytes
tttgacagggtgctga

SEQ ID NO: 290021 - DNA, 16 bp, P. troglodytes
tttgacatttatttta

SEQ ID NO: 290022 - DNA, 16 bp, P. troglodytes
tttgacattttcaaaa

SEQ ID NO: 290023 - DNA, 16 bp, P. troglodytes
tttgacattttcagca

SEQ ID NO: 290024 - DNA, 16 bp, P. troglodytes
tttgacatttttgtca

SEQ ID NO: 290025 - DNA, 16 bp, P. troglodytes
tttgaccttctcccat

SEQ ID NO: 290026 - DNA, 16 bp, P. troglodytes
tttgaccttgggcaag

SEQ ID NO: 290027 - DNA, 16 bp, P. troglodytes
tttgacgagctgacag

SEQ ID NO: 290028 - DNA, 16 bp, P. troglodytes
tttgactatggctgcc

SEQ ID NO: 290029 - DNA, 16 bp, P. troglodytes
tttgactattttaaat

SEQ ID NO: 290030 - DNA, 16 bp, P. troglodytes
tttgactgcattttga

SEQ ID NO: 290031 - DNA, 16 bp, P. troglodytes
tttgactgtgaatcca

SEQ ID NO: 290032 - DNA, 16 bp, P. troglodytes
tttgacttagaataat

SEQ ID NO: 290033 - DNA, 16 bp, P. troglodytes
tttgacttatttcact

SEQ ID NO: 290034 - DNA, 16 bp, P. troglodytes
tttgacttcctctcct

SEQ ID NO: 290035 - DNA, 16 bp, P. troglodytes
tttgacttcctctctt

SEQ ID NO: 290036 - DNA, 17 bp, P. troglodytes
tttgacttcctcttttc

SEQ ID NO: 290037 - DNA, 16 bp, P. troglodytes
tttgacttcctgggct

SEQ ID NO: 290038 - DNA, 16 bp, P. troglodytes
tttgactttctccttt

SEQ ID NO: 290039 - DNA, 16 bp, P. troglodytes
tttgactttctgtctt

SEQ ID NO: 290040 - DNA, 16 bp, P. troglodytes
tttgactttgcttatg

SEQ ID NO: 290041 - DNA, 16 bp, P. troglodytes
tttgactttgtttctg

SEQ ID NO: 290042 - DNA, 16 bp, P. troglodytes
tttgacttttaaaaaa

SEQ ID NO: 290043 - DNA, 16 bp, P. troglodytes
tttgacttttaaaaat

SEQ ID NO: 290044 - DNA, 16 bp, P. troglodytes
tttgacttttaaataa

SEQ ID NO: 290045 - DNA, 16 bp, P. troglodytes
tttgacttttaaatat

SEQ ID NO: 290046 - DNA, 16 bp, P. troglodytes
tttgacttttacattt

SEQ ID NO: 290047 - DNA, 16 bp, P. troglodytes
tttgacttttctctct

SEQ ID NO: 290048 - DNA, 16 bp, P. troglodytes
tttgacttttgacaat

SEQ ID NO: 290049 - DNA, 16 bp, P. troglodytes
tttgactttttaaaaa

SEQ ID NO: 290050 - DNA, 16 bp, P. troglodytes
tttgactttttgaaaa

SEQ ID NO: 290051 - DNA, 16 bp, P. troglodytes
tttgactttttttaaa

SEQ ID NO: 290052 - DNA, 16 bp, P. troglodytes
tttgagaaaaataaac

SEQ ID NO: 290053 - DNA, 16 bp, P. troglodytes
tttgagaaaaatattt

SEQ ID NO: 290054 - DNA, 16 bp, P. troglodytes
tttgagaaaataaatt

SEQ ID NO: 290055 - DNA, 16 bp, P. troglodytes
tttgagaaaatatctg

SEQ ID NO: 290056 - DNA, 16 bp, P. troglodytes
tttgagaaaatatttt

SEQ ID NO: 290057 - DNA, 16 bp, P. troglodytes
tttgagaaaattaatt

SEQ ID NO: 290058 - DNA, 16 bp, P. troglodytes
tttgagaaacactgcc

SEQ ID NO: 290059 - DNA, 16 bp, P. troglodytes
tttgagaaacagaaag

SEQ ID NO: 290060 - DNA, 16 bp, P. troglodytes
tttgagaaactgccag

SEQ ID NO: 290061 - DNA, 16 bp, P. troglodytes
tttgagaaagaaataa

SEQ ID NO: 290062 - DNA, 16 bp, P. troglodytes
tttgagaaataatttt

SEQ ID NO: 290063 - DNA, 16 bp, P. troglodytes
tttgagaaatgaatga

SEQ ID NO: 290064 - DNA, 16 bp, P. troglodytes
tttgagaaatgcaaat

SEQ ID NO: 290065 - DNA, 16 bp, P. troglodytes
tttgagaaatgtcatt

SEQ ID NO: 290066 - DNA, 16 bp, P. troglodytes
tttgagaaatgtctat

SEQ ID NO: 290067 - DNA, 16 bp, P. troglodytes
tttgagaaatttctat

SEQ ID NO: 290068 - DNA, 16 bp, P. troglodytes
tttgagaaattttctt

SEQ ID NO: 290069 - DNA, 16 bp, P. troglodytes
tttgagaacagcctga

SEQ ID NO: 290070 - DNA, 16 bp, P. troglodytes
tttgagaacagcttgg

SEQ ID NO: 290071 - DNA, 16 bp, P. troglodytes
tttgagaacaggctgg

SEQ ID NO: 290072 - DNA, 16 bp, P. troglodytes
tttgagaaccactggc

SEQ ID NO: 290073 - DNA, 16 bp, P. troglodytes
tttgagaaccagtgct

SEQ ID NO: 290074 - DNA, 16 bp, P. troglodytes
tttgagaaccattgtt

SEQ ID NO: 290075 - DNA, 16 bp, P. troglodytes
tttgagaagagtctgt

SEQ ID NO: 290076 - DNA, 16 bp, P. troglodytes
tttgagaagcactgaa

SEQ ID NO: 290077 - DNA, 16 bp, P. troglodytes
tttgagaaggagtctc

SEQ ID NO: 290078 - DNA, 17 bp, P. troglodytes
tttgagaagtgtctgtt

SEQ ID NO: 290079 - DNA, 16 bp, P. troglodytes
tttgagaagtgtcttt

SEQ ID NO: 290080 - DNA, 16 bp, P. troglodytes
tttgagaatctgatga

SEQ ID NO: 290081 - DNA, 16 bp, P. troglodytes
tttgagaatgagtctc

SEQ ID NO: 290082 - DNA, 16 bp, P. troglodytes
tttgagacagagtcgc

SEQ ID NO: 290083 - DNA, 16 bp, P. troglodytes
tttgagacagagtctc

SEQ ID NO: 290084 - DNA, 17 bp, P. troglodytes
tttgagacagagtctcc

SEQ ID NO: 290085 - DNA, 17 bp, P. troglodytes
tttgagacagagtctct

SEQ ID NO: 290086 - DNA, 16 bp, P. troglodytes
tttgagacagagtctt

SEQ ID NO: 290087 - DNA, 16 bp, P. troglodytes
tttgagacaggcctgg

SEQ ID NO: 290088 - DNA, 16 bp, P. troglodytes
tttgagacagggtctg

SEQ ID NO: 290089 - DNA, 17 bp, P. troglodytes
tttgagacagtctcgct

SEQ ID NO: 290090 - DNA, 16 bp, P. troglodytes
tttgagacagtttctt

SEQ ID NO: 290091 - DNA, 16 bp, P. troglodytes
tttgagacatagtctc

SEQ ID NO: 290092 - DNA, 16 bp, P. troglodytes
tttgagacatggtctc

SEQ ID NO: 290093 - DNA, 16 bp, P. troglodytes
tttgagaccaacatgg

SEQ ID NO: 290094 - DNA, 16 bp, P. troglodytes
tttgagaccaagtttc

SEQ ID NO: 290095 - DNA, 16 bp, P. troglodytes
tttgagaccgacctgg

SEQ ID NO: 290096 - DNA, 16 bp, P. troglodytes
tttgagaccgagcctc

SEQ ID NO: 290097 - DNA, 16 bp, P. troglodytes
tttgagacgagtctca

SEQ ID NO: 290098 - DNA, 17 bp, P. troglodytes
tttgagacggagtctcc

SEQ ID NO: 290099 - DNA, 17 bp, P. troglodytes
tttgagacggagttttt

SEQ ID NO: 290100 - DNA, 16 bp, P. troglodytes
tttgagacggggtctc

SEQ ID NO: 290101 - DNA, 16 bp, P. troglodytes
tttgagactgaatttc

SEQ ID NO: 290102 - DNA, 16 bp, P. troglodytes
tttgagactgatctcc

SEQ ID NO: 290103 - DNA, 16 bp, P. troglodytes
tttgagagaattgact

SEQ ID NO: 290104 - DNA, 16 bp, P. troglodytes
tttgagagagaaaaaa

SEQ ID NO: 290105 - DNA, 17 bp, P. troglodytes
tttgagagagcagggta

SEQ ID NO: 290106 - DNA, 16 bp, P. troglodytes
tttgagagcatcctgg

SEQ ID NO: 290107 - DNA, 16 bp, P. troglodytes
tttgagaggccaaagc

SEQ ID NO: 290108 - DNA, 16 bp, P. troglodytes
tttgagaggccaaagt

SEQ ID NO: 290109 - DNA, 21 bp, P. troglodytes
tttgagaggccaaggtgggcg

SEQ ID NO: 290110 - DNA, 16 bp, P. troglodytes
tttgagaggcctaggc

SEQ ID NO: 290111 - DNA, 17 bp, P. troglodytes
tttgagaggctgaggca

SEQ ID NO: 290112 - DNA, 17 bp, P. troglodytes
tttgagatacgttccat

SEQ ID NO: 290113 - DNA, 16 bp, P. troglodytes
tttgagatcagcccag

SEQ ID NO: 290114 - DNA, 16 bp, P. troglodytes
tttgagatcaggagtt

SEQ ID NO: 290115 - DNA, 16 bp, P. troglodytes
tttgagatctttctga

SEQ ID NO: 290116 - DNA, 16 bp, P. troglodytes
tttgagatgatggaaa

SEQ ID NO: 290117 - DNA, 16 bp, P. troglodytes
tttgagatggaatctt

SEQ ID NO: 290118 - DNA, 16 bp, P. troglodytes
tttgagatggaatttc

SEQ ID NO: 290119 - DNA, 16 bp, P. troglodytes
tttgagatggagtctc

SEQ ID NO: 290120 - DNA, 16 bp, P. troglodytes
tttgagattcatccat

SEQ ID NO: 290121 - DNA, 16 bp, P. troglodytes
tttgagcatcatgttg

SEQ ID NO: 290122 - DNA, 16 bp, P. troglodytes
tttgagccatggctgg

SEQ ID NO: 290123 - DNA, 16 bp, P. troglodytes
tttgagcccaggagtt

SEQ ID NO: 290124 - DNA, 16 bp, P. troglodytes
tttgagcccaggggtt

SEQ ID NO: 290125 - DNA, 16 bp, P. troglodytes
tttgagctcagcctgg

SEQ ID NO: 290126 - DNA, 17 bp, P. troglodytes
tttgagctcaggagttt

SEQ ID NO: 290127 - DNA, 16 bp, P. troglodytes
tttgagcttcccagcc

SEQ ID NO: 290128 - DNA, 16 bp, P. troglodytes
tttgaggaaaaaaatg

SEQ ID NO: 290129 - DNA, 16 bp, P. troglodytes
tttgaggaaaaggaaa

SEQ ID NO: 290130 - DNA, 16 bp, P. troglodytes
tttgaggaaatatttt

SEQ ID NO: 290131 - DNA, 16 bp, P. troglodytes
tttgaggaaccaccaa

SEQ ID NO: 290132 - DNA, 16 bp, P. troglodytes
tttgaggaagaaaaaa

SEQ ID NO: 290133 - DNA, 16 bp, P. troglodytes
tttgaggacctgctgt

SEQ ID NO: 290134 - DNA, 16 bp, P. troglodytes
tttgaggacttggtca

SEQ ID NO: 290135 - DNA, 16 bp, P. troglodytes
tttgaggagcccttca

SEQ ID NO: 290136 - DNA, 16 bp, P. troglodytes
tttgaggagctgccag

SEQ ID NO: 290137 - DNA, 16 bp, P. troglodytes
tttgaggaggcagtgt

SEQ ID NO: 290138 - DNA, 16 bp, P. troglodytes
tttgaggagtactggt

SEQ ID NO: 290139 - DNA, 16 bp, P. troglodytes
tttgaggcagagtctg

SEQ ID NO: 290140 - DNA, 16 bp, P. troglodytes
tttgaggccaggagtt

SEQ ID NO: 290141 - DNA, 16 bp, P. troglodytes
tttgaggccgggagtt

SEQ ID NO: 290142 - DNA, 16 bp, P. troglodytes
tttgaggcctgtggtg

SEQ ID NO: 290143 - DNA, 16 bp, P. troglodytes
tttgagggcctctaaa

SEQ ID NO: 290144 - DNA, 16 bp, P. troglodytes
tttgaggtcaagagtt

SEQ ID NO: 290145 - DNA, 16 bp, P. troglodytes
tttgaggtcaggagtt

SEQ ID NO: 290146 - DNA, 16 bp, P. troglodytes
tttgaggtcaggattt

SEQ ID NO: 290147 - DNA, 16 bp, P. troglodytes
tttgagtagaattggt

SEQ ID NO: 290148 - DNA, 20 bp, P. troglodytes
tttgagtagagacggggttt

SEQ ID NO: 290149 - DNA, 16 bp, P. troglodytes
tttgagtagagatggg

SEQ ID NO: 290150 - DNA, 16 bp, P. troglodytes
tttgagtatcttttca

SEQ ID NO: 290151 - DNA, 16 bp, P. troglodytes
tttgagtcttcatttt

SEQ ID NO: 290152 - DNA, 16 bp, P. troglodytes
tttgagtcttctctct

SEQ ID NO: 290153 - DNA, 16 bp, P. troglodytes
tttgagttcaggagtt

SEQ ID NO: 290154 - DNA, 16 bp, P. troglodytes
tttgagttggtgctgg

SEQ ID NO: 290155 - DNA, 16 bp, P. troglodytes
tttgagttgtttccag

SEQ ID NO: 290156 - DNA, 16 bp, P. troglodytes
tttgagtttaatttgc

SEQ ID NO: 290157 - DNA, 16 bp, P. troglodytes
tttgagtttcattgta

SEQ ID NO: 290158 - DNA, 16 bp, P. troglodytes
tttgagtttctcacca

SEQ ID NO: 290159 - DNA, 16 bp, P. troglodytes
tttgagttttacattt

SEQ ID NO: 290160 - DNA, 16 bp, P. troglodytes
tttgagtttttaaaaa

SEQ ID NO: 290161 - DNA, 16 bp, P. troglodytes
tttgataaggaaaagt

SEQ ID NO: 290162 - DNA, 16 bp, P. troglodytes
tttgataattcactag

SEQ ID NO: 290163 - DNA, 17 bp, P. troglodytes
tttgatacagacatgca

SEQ ID NO: 290164 - DNA, 16 bp, P. troglodytes
tttgatacatgtatat

SEQ ID NO: 290165 - DNA, 16 bp, P. troglodytes
tttgatacattcatat

SEQ ID NO: 290166 - DNA, 16 bp, P. troglodytes
tttgatacatttaaaa

SEQ ID NO: 290167 - DNA, 16 bp, P. troglodytes
tttgatagaacagttt

SEQ ID NO: 290168 - DNA, 16 bp, P. troglodytes
tttgatagcagagtag

SEQ ID NO: 290169 - DNA, 16 bp, P. troglodytes
tttgatatcagaatga

SEQ ID NO: 290170 - DNA, 16 bp, P. troglodytes
tttgatatgcatttct

SEQ ID NO: 290171 - DNA, 16 bp, P. troglodytes
tttgatattcatgaac

SEQ ID NO: 290172 - DNA, 16 bp, P. troglodytes
tttgatatttgacaaa

SEQ ID NO: 290173 - DNA, 16 bp, P. troglodytes
tttgatattttattca

SEQ ID NO: 290174 - DNA, 16 bp, P. troglodytes
tttgatccagtgctga

SEQ ID NO: 290175 - DNA, 16 bp, P. troglodytes
tttgatccattttcag

SEQ ID NO: 290176 - DNA, 16 bp, P. troglodytes
tttgatcctttcatta

SEQ ID NO: 290177 - DNA, 16 bp, P. troglodytes
tttgatctctttctct

SEQ ID NO: 290178 - DNA, 16 bp, P. troglodytes
tttgatcttcaacaaa

SEQ ID NO: 290179 - DNA, 16 bp, P. troglodytes
tttgatcttggacttt

SEQ ID NO: 290180 - DNA, 16 bp, P. troglodytes
tttgatgaaaaagagc

SEQ ID NO: 290181 - DNA, 16 bp, P. troglodytes
tttgatgaaaaatatt

SEQ ID NO: 290182 - DNA, 16 bp, P. troglodytes
tttgatgaacagaaat

SEQ ID NO: 290183 - DNA, 16 bp, P. troglodytes
tttgatgaagtccaat

SEQ ID NO: 290184 - DNA, 16 bp, P. troglodytes
tttgatgagctgctgg

SEQ ID NO: 290185 - DNA, 17 bp, P. troglodytes
tttgatgatgatgatga

SEQ ID NO: 290186 - DNA, 18 bp, P. troglodytes
tttgatgatggtgatgta

SEQ ID NO: 290187 - DNA, 16 bp, P. troglodytes
tttgatgcattttgag

SEQ ID NO: 290188 - DNA, 16 bp, P. troglodytes
tttgatgcctgtgctg

SEQ ID NO: 290189 - DNA, 16 bp, P. troglodytes
tttgatgctatcataa

SEQ ID NO: 290190 - DNA, 17 bp, P. troglodytes
tttgatgggcttccctt

SEQ ID NO: 290191 - DNA, 16 bp, P. troglodytes
tttgatggtctttaca

SEQ ID NO: 290192 - DNA, 16 bp, P. troglodytes
tttgatgtgctgccag

SEQ ID NO: 290193 - DNA, 16 bp, P. troglodytes
tttgatgtgtcaactt

SEQ ID NO: 290194 - DNA, 16 bp, P. troglodytes
tttgattaataaagat

SEQ ID NO: 290195 - DNA, 16 bp, P. troglodytes
tttgattagcatttcc

SEQ ID NO: 290196 - DNA, 16 bp, P. troglodytes
tttgattcagcaggtt

SEQ ID NO: 290197 - DNA, 16 bp, P. troglodytes
tttgattcatctctct

SEQ ID NO: 290198 - DNA, 16 bp, P. troglodytes
tttgattctccatttt

SEQ ID NO: 290199 - DNA, 16 bp, P. troglodytes
tttgattcttctctcc

SEQ ID NO: 290200 - DNA, 16 bp, P. troglodytes
tttgattgctctgtgg

SEQ ID NO: 290201 - DNA, 16 bp, P. troglodytes
tttgatttatttctgc

SEQ ID NO: 290202 - DNA, 16 bp, P. troglodytes
tttgatttcaaaatat

SEQ ID NO: 290203 - DNA, 16 bp, P. troglodytes
tttgatttcacaggct

SEQ ID NO: 290204 - DNA, 16 bp, P. troglodytes
tttgatttccatttta

SEQ ID NO: 290205 - DNA, 16 bp, P. troglodytes
tttgatttctatttcc

SEQ ID NO: 290206 - DNA, 16 bp, P. troglodytes
tttgatttctctctct

SEQ ID NO: 290207 - DNA, 16 bp, P. troglodytes
tttgatttcttcctgg

SEQ ID NO: 290208 - DNA, 16 bp, P. troglodytes
tttgatttctttgtag

SEQ ID NO: 290209 - DNA, 27 bp, P. troglodytes
tttgatttgcatttctctgatggccag

SEQ ID NO: 290210 - DNA, 16 bp, P. troglodytes
tttgattttaaaaaca

SEQ ID NO: 290211 - DNA, 16 bp, P. troglodytes
tttgattttaaaaagt

SEQ ID NO: 290212 - DNA, 16 bp, P. troglodytes
tttgattttaaagaaa

SEQ ID NO: 290213 - DNA, 16 bp, P. troglodytes
tttgattttagaaaaa

SEQ ID NO: 290214 - DNA, 16 bp, P. troglodytes
tttgattttcttaata

SEQ ID NO: 290215 - DNA, 16 bp, P. troglodytes
tttgatttttaaaggc

SEQ ID NO: 290216 - DNA, 16 bp, P. troglodytes
tttgatttttacaaat

SEQ ID NO: 290217 - DNA, 16 bp, P. troglodytes
tttgatttttctaaaa

SEQ ID NO: 290218 - DNA, 16 bp, P. troglodytes
tttgatttttttcccc

SEQ ID NO: 290219 - DNA, 16 bp, P. troglodytes
tttgcaaaaataaatg

SEQ ID NO: 290220 - DNA, 16 bp, P. troglodytes
tttgcaaaaatatttt

SEQ ID NO: 290221 - DNA, 16 bp, P. troglodytes
tttgcaaaacaaaaca

SEQ ID NO: 290222 - DNA, 16 bp, P. troglodytes
tttgcaaaagagaaaa

SEQ ID NO: 290223 - DNA, 16 bp, P. troglodytes
tttgcaaaagcagttt

SEQ ID NO: 290224 - DNA, 16 bp, P. troglodytes
tttgcaaaataaattt

SEQ ID NO: 290225 - DNA, 16 bp, P. troglodytes
tttgcaaaataagttt

SEQ ID NO: 290226 - DNA, 16 bp, P. troglodytes
tttgcaaaatgagaat

SEQ ID NO: 290227 - DNA, 16 bp, P. troglodytes
tttgcaaaattatgac

SEQ ID NO: 290228 - DNA, 16 bp, P. troglodytes
tttgcaaaattgtttt

SEQ ID NO: 290229 - DNA, 16 bp, P. troglodytes
tttgcaaaatttttct

SEQ ID NO: 290230 - DNA, 16 bp, P. troglodytes
tttgcaaacaaatcag

SEQ ID NO: 290231 - DNA, 16 bp, P. troglodytes
tttgcaaaccatatat

SEQ ID NO: 290232 - DNA, 16 bp, P. troglodytes
tttgcaaactctgcat

SEQ ID NO: 290233 - DNA, 16 bp, P. troglodytes
tttgcaaactgtgtat

SEQ ID NO: 290234 - DNA, 16 bp, P. troglodytes
tttgcaaagaagaaaa

SEQ ID NO: 290235 - DNA, 16 bp, P. troglodytes
tttgcaaagcaaaaat

SEQ ID NO: 290236 - DNA, 16 bp, P. troglodytes
tttgcaaagtattcat

SEQ ID NO: 290237 - DNA, 16 bp, P. troglodytes
tttgcaaataaaattt

SEQ ID NO: 290238 - DNA, 16 bp, P. troglodytes
tttgcaaatacagaat

SEQ ID NO: 290239 - DNA, 16 bp, P. troglodytes
tttgcaaatatgttct

SEQ ID NO: 290240 - DNA, 16 bp, P. troglodytes
tttgcaaatatttctc

SEQ ID NO: 290241 - DNA, 16 bp, P. troglodytes
tttgcaaatattttct

SEQ ID NO: 290242 - DNA, 16 bp, P. troglodytes
tttgcaaatgaaaaaa

SEQ ID NO: 290243 - DNA, 16 bp, P. troglodytes
tttgcaaattatattt

SEQ ID NO: 290244 - DNA, 16 bp, P. troglodytes
tttgcaaattatttat

SEQ ID NO: 290245 - DNA, 16 bp, P. troglodytes
tttgcaaattcttttt

SEQ ID NO: 290246 - DNA, 16 bp, P. troglodytes
tttgcaaattgaattt

SEQ ID NO: 290247 - DNA, 16 bp, P. troglodytes
tttgcaaccagcctgg

SEQ ID NO: 290248 - DNA, 16 bp, P. troglodytes
tttgcaacttcctgtg

SEQ ID NO: 290249 - DNA, 16 bp, P. troglodytes
tttgcaatatttttat

SEQ ID NO: 290250 - DNA, 20 bp, P. troglodytes
tttgcaatctatccatctga

SEQ ID NO: 290251 - DNA, 16 bp, P. troglodytes
tttgcaatgaatttcc

SEQ ID NO: 290252 - DNA, 16 bp, P. troglodytes
tttgcaattttttaaa

SEQ ID NO: 290253 - DNA, 16 bp, P. troglodytes
tttgcaatttttttaa

SEQ ID NO: 290254 - DNA, 16 bp, P. troglodytes
tttgcacaatgatttt

SEQ ID NO: 290255 - DNA, 16 bp, P. troglodytes
tttgcacatgctgttt

SEQ ID NO: 290256 - DNA, 16 bp, P. troglodytes
tttgcacatggatttt

SEQ ID NO: 290257 - DNA, 18 bp, P. troglodytes
tttgcaccaacctaatat

SEQ ID NO: 290258 - DNA, 16 bp, P. troglodytes
tttgcactgatggtgc

SEQ ID NO: 290259 - DNA, 16 bp, P. troglodytes
tttgcacttgcttctc

SEQ ID NO: 290260 - DNA, 16 bp, P. troglodytes
tttgcactttttaaaa

SEQ ID NO: 290261 - DNA, 16 bp, P. troglodytes
tttgcagaaaaaaaaa

SEQ ID NO: 290262 - DNA, 16 bp, P. troglodytes
tttgcagaaaaaaatg

SEQ ID NO: 290263 - DNA, 16 bp, P. troglodytes
tttgcagaaaagaaaa

SEQ ID NO: 290264 - DNA, 16 bp, P. troglodytes
tttgcagaaataaaaa

SEQ ID NO: 290265 - DNA, 16 bp, P. troglodytes
tttgcagaaatggaaa

SEQ ID NO: 290266 - DNA, 16 bp, P. troglodytes
tttgcagaaatgtaaa

SEQ ID NO: 290267 - DNA, 16 bp, P. troglodytes
tttgcagaaattttct

SEQ ID NO: 290268 - DNA, 16 bp, P. troglodytes
tttgcagaccctgtac

SEQ ID NO: 290269 - DNA, 16 bp, P. troglodytes
tttgcagatcacatga

SEQ ID NO: 290270 - DNA, 16 bp, P. troglodytes
tttgcagatgaaatga

SEQ ID NO: 290271 - DNA, 16 bp, P. troglodytes
tttgcagatgacaaaa

SEQ ID NO: 290272 - DNA, 16 bp, P. troglodytes
tttgcagatgacatgt

SEQ ID NO: 290273 - DNA, 16 bp, P. troglodytes
tttgcagatgagaaga

SEQ ID NO: 290274 - DNA, 16 bp, P. troglodytes
tttgcagatgaggaaa

SEQ ID NO: 290275 - DNA, 16 bp, P. troglodytes
tttgcagatgatgaaa

SEQ ID NO: 290276 - DNA, 16 bp, P. troglodytes
tttgcagatggagaaa

SEQ ID NO: 290277 - DNA, 16 bp, P. troglodytes
tttgcagatggaggaa

SEQ ID NO: 290278 - DNA, 16 bp, P. troglodytes
tttgcagatgtaatga

SEQ ID NO: 290279 - DNA, 16 bp, P. troglodytes
tttgcagatgtaatta

SEQ ID NO: 290280 - DNA, 16 bp, P. troglodytes
tttgcagatgtgatta

SEQ ID NO: 290281 - DNA, 16 bp, P. troglodytes
tttgcagcatccctgg

SEQ ID NO: 290282 - DNA, 16 bp, P. troglodytes
tttgcagcccatggat

SEQ ID NO: 290283 - DNA, 16 bp, P. troglodytes
tttgcagcctgatgat

SEQ ID NO: 290284 - DNA, 16 bp, P. troglodytes
tttgcagctattataa

SEQ ID NO: 290285 - DNA, 16 bp, P. troglodytes
tttgcagctgaggaaa

SEQ ID NO: 290286 - DNA, 16 bp, P. troglodytes
tttgcaggaaaaaaaa

SEQ ID NO: 290287 - DNA, 16 bp, P. troglodytes
tttgcaggaaaagttt

SEQ ID NO: 290288 - DNA, 16 bp, P. troglodytes
tttgcaggaaaatgga

SEQ ID NO: 290289 - DNA, 16 bp, P. troglodytes
tttgcagggaaaaaaa

SEQ ID NO: 290290 - DNA, 19 bp, P. troglodytes
tttgcagggacatggatgg

SEQ ID NO: 290291 - DNA, 16 bp, P. troglodytes
tttgcaggtgaggaaa

SEQ ID NO: 290292 - DNA, 16 bp, P. troglodytes
tttgcagtatacattt

SEQ ID NO: 290293 - DNA, 16 bp, P. troglodytes
tttgcagtctgacaat

SEQ ID NO: 290294 - DNA, 18 bp, P. troglodytes
tttgcagtgagccaagat

SEQ ID NO: 290295 - DNA, 19 bp, P. troglodytes
tttgcagtgagccgagatt

SEQ ID NO: 290296 - DNA, 16 bp, P. troglodytes
tttgcatataattaaa

SEQ ID NO: 290297 - DNA, 16 bp, P. troglodytes
tttgcatatattttct

SEQ ID NO: 290298 - DNA, 16 bp, P. troglodytes
tttgcatatgtaatga

SEQ ID NO: 290299 - DNA, 16 bp, P. troglodytes
tttgcatatgttattt

SEQ ID NO: 290300 - DNA, 16 bp, P. troglodytes
tttgcatattttatct

SEQ ID NO: 290301 - DNA, 16 bp, P. troglodytes
tttgcatatttttaaa

SEQ ID NO: 290302 - DNA, 16 bp, P. troglodytes
tttgcatccttcaatg

SEQ ID NO: 290303 - DNA, 16 bp, P. troglodytes
tttgcatcctttgacc

SEQ ID NO: 290304 - DNA, 16 bp, P. troglodytes
tttgcatctccctgat

SEQ ID NO: 290305 - DNA, 16 bp, P. troglodytes
tttgcatgcatgcaaa

SEQ ID NO: 290306 - DNA, 16 bp, P. troglodytes
tttgcatgcattatct

SEQ ID NO: 290307 - DNA, 16 bp, P. troglodytes
tttgcattatttcatt

SEQ ID NO: 290308 - DNA, 16 bp, P. troglodytes
tttgcattcacaactt

SEQ ID NO: 290309 - DNA, 16 bp, P. troglodytes
tttgcattcccaccag

SEQ ID NO: 290310 - DNA, 16 bp, P. troglodytes
tttgcattcctgggat

SEQ ID NO: 290311 - DNA, 16 bp, P. troglodytes
tttgcattgtgaaggg

SEQ ID NO: 290312 - DNA, 16 bp, P. troglodytes
tttgcatttaatgtaa

SEQ ID NO: 290313 - DNA, 16 bp, P. troglodytes
tttgcatttacattta

SEQ ID NO: 290314 - DNA, 16 bp, P. troglodytes
tttgcatttattcatt

SEQ ID NO: 290315 - DNA, 16 bp, P. troglodytes
tttgcatttattgaga

SEQ ID NO: 290316 - DNA, 16 bp, P. troglodytes
tttgcatttcagaaag

SEQ ID NO: 290317 - DNA, 16 bp, P. troglodytes
tttgcatttcctagaa

SEQ ID NO: 290318 - DNA, 16 bp, P. troglodytes
tttgcatttctagcaa

SEQ ID NO: 290319 - DNA, 16 bp, P. troglodytes
tttgcatttctgacaa

SEQ ID NO: 290320 - DNA, 16 bp, P. troglodytes
tttgcatttctgatga

SEQ ID NO: 290321 - DNA, 16 bp, P. troglodytes
tttgcatttctgtaaa

SEQ ID NO: 290322 - DNA, 16 bp, P. troglodytes
tttgcatttgcatttc

SEQ ID NO: 290323 - DNA, 16 bp, P. troglodytes
tttgcatttgctcttt

SEQ ID NO: 290324 - DNA, 16 bp, P. troglodytes
tttgcattttaaaata

SEQ ID NO: 290325 - DNA, 16 bp, P. troglodytes
tttgcattttacattt

SEQ ID NO: 290326 - DNA, 16 bp, P. troglodytes
tttgcattttccttat

SEQ ID NO: 290327 - DNA, 16 bp, P. troglodytes
tttgcattttctgatt

SEQ ID NO: 290328 - DNA, 16 bp, P. troglodytes
tttgcattttcttaat

SEQ ID NO: 290329 - DNA, 16 bp, P. troglodytes
tttgcattttcttgat

SEQ ID NO: 290330 - DNA, 16 bp, P. troglodytes
tttgcatttttagtaa

SEQ ID NO: 290331 - DNA, 17 bp, P. troglodytes
tttgcatttttagtaga

SEQ ID NO: 290332 - DNA, 16 bp, P. troglodytes
tttgcatttttataat

SEQ ID NO: 290333 - DNA, 16 bp, P. troglodytes
tttgcattttttaaat

SEQ ID NO: 290334 - DNA, 16 bp, P. troglodytes
tttgccaaaattaaaa

SEQ ID NO: 290335 - DNA, 16 bp, P. troglodytes
tttgccaaatactttt

SEQ ID NO: 290336 - DNA, 16 bp, P. troglodytes
tttgccaacacttggt

SEQ ID NO: 290337 - DNA, 19 bp, P. troglodytes
tttgccaaggttaaggatg

SEQ ID NO: 290338 - DNA, 16 bp, P. troglodytes
tttgccaatttccatg

SEQ ID NO: 290339 - DNA, 16 bp, P. troglodytes
tttgccaccaccaggc

SEQ ID NO: 290340 - DNA, 16 bp, P. troglodytes
tttgccaccagcctgg

SEQ ID NO: 290341 - DNA, 16 bp, P. troglodytes
tttgccaggctggagt

SEQ ID NO: 290342 - DNA, 16 bp, P. troglodytes
tttgccagtctgtttc

SEQ ID NO: 290343 - DNA, 16 bp, P. troglodytes
tttgccagtttctttt

SEQ ID NO: 290344 - DNA, 16 bp, P. troglodytes
tttgccatatttgctt

SEQ ID NO: 290345 - DNA, 16 bp, P. troglodytes
tttgccatattttatt

SEQ ID NO: 290346 - DNA, 16 bp, P. troglodytes
tttgccatctgcatat

SEQ ID NO: 290347 - DNA, 16 bp, P. troglodytes
tttgccatggtaacac

SEQ ID NO: 290348 - DNA, 16 bp, P. troglodytes
tttgccatttatttat

SEQ ID NO: 290349 - DNA, 16 bp, P. troglodytes
tttgccatttttctat

SEQ ID NO: 290350 - DNA, 16 bp, P. troglodytes
tttgccatttttttcc

SEQ ID NO: 290351 - DNA, 16 bp, P. troglodytes
tttgcccagatccatc

SEQ ID NO: 290352 - DNA, 16 bp, P. troglodytes
tttgcccagcctggag

SEQ ID NO: 290353 - DNA, 16 bp, P. troglodytes
tttgcccaggcctttc

SEQ ID NO: 290354 - DNA, 16 bp, P. troglodytes
tttgcccagtttttaa

SEQ ID NO: 290355 - DNA, 16 bp, P. troglodytes
tttgcccattaaaaaa

SEQ ID NO: 290356 - DNA, 16 bp, P. troglodytes
tttgcccattttctat

SEQ ID NO: 290357 - DNA, 16 bp, P. troglodytes
tttgcccattttgaaa

SEQ ID NO: 290358 - DNA, 16 bp, P. troglodytes
tttgcccattttgaat

SEQ ID NO: 290359 - DNA, 17 bp, P. troglodytes
tttgcccctgccctaga

SEQ ID NO: 290360 - DNA, 16 bp, P. troglodytes
tttgcccttccaccat

SEQ ID NO: 290361 - DNA, 16 bp, P. troglodytes
tttgcctaaggtcaca

SEQ ID NO: 290362 - DNA, 16 bp, P. troglodytes
tttgcctacattttag

SEQ ID NO: 290363 - DNA, 16 bp, P. troglodytes
tttgcctcagcctccc

SEQ ID NO: 290364 - DNA, 17 bp, P. troglodytes
tttgcctcagcctcccg

SEQ ID NO: 290365 - DNA, 16 bp, P. troglodytes
tttgcctcatatattt

SEQ ID NO: 290366 - DNA, 16 bp, P. troglodytes
tttgcctgctgccatc

SEQ ID NO: 290367 - DNA, 16 bp, P. troglodytes
tttgcctgttctagaa

SEQ ID NO: 290368 - DNA, 16 bp, P. troglodytes
tttgcctgtttttgaa

SEQ ID NO: 290369 - DNA, 16 bp, P. troglodytes
tttgccttaattttgt

SEQ ID NO: 290370 - DNA, 16 bp, P. troglodytes
tttgccttccaaagtg

SEQ ID NO: 290371 - DNA, 16 bp, P. troglodytes
tttgccttccatcatg

SEQ ID NO: 290372 - DNA, 16 bp, P. troglodytes
tttgccttctgccagg

SEQ ID NO: 290373 - DNA, 17 bp, P. troglodytes
tttgccttctgccatga

SEQ ID NO: 290374 - DNA, 16 bp, P. troglodytes
tttgccttctgctgtg

SEQ ID NO: 290375 - DNA, 16 bp, P. troglodytes
tttgcctttcacattt

SEQ ID NO: 290376 - DNA, 16 bp, P. troglodytes
tttgcctttctaacaa

SEQ ID NO: 290377 - DNA, 16 bp, P. troglodytes
tttgccttttaaagaa

SEQ ID NO: 290378 - DNA, 16 bp, P. troglodytes
tttgccttttcagaat

SEQ ID NO: 290379 - DNA, 16 bp, P. troglodytes
tttgccttttccagaa

SEQ ID NO: 290380 - DNA, 16 bp, P. troglodytes
tttgccttttctagaa

SEQ ID NO: 290381 - DNA, 16 bp, P. troglodytes
tttgcctttttaaaaa

SEQ ID NO: 290382 - DNA, 16 bp, P. troglodytes
tttgcctttttcactg

SEQ ID NO: 290383 - DNA, 16 bp, P. troglodytes
tttgcgacggagtctc

SEQ ID NO: 290384 - DNA, 16 bp, P. troglodytes
tttgctaaggataata

SEQ ID NO: 290385 - DNA, 16 bp, P. troglodytes
tttgctaattttaaaa

SEQ ID NO: 290386 - DNA, 16 bp, P. troglodytes
tttgctaatttttaaa

SEQ ID NO: 290387 - DNA, 16 bp, P. troglodytes
tttgctaggattttgt

SEQ ID NO: 290388 - DNA, 16 bp, P. troglodytes
tttgctatctctagga

SEQ ID NO: 290389 - DNA, 16 bp, P. troglodytes
tttgctattgcaaaca

SEQ ID NO: 290390 - DNA, 16 bp, P. troglodytes
tttgctattgtgaaaa

SEQ ID NO: 290391 - DNA, 16 bp, P. troglodytes
tttgctattgttaata

SEQ ID NO: 290392 - DNA, 16 bp, P. troglodytes
tttgctatttaaaaaa

SEQ ID NO: 290393 - DNA, 16 bp, P. troglodytes
tttgctcaaagtcaca

SEQ ID NO: 290394 - DNA, 16 bp, P. troglodytes
tttgctcaaatgtcac

SEQ ID NO: 290395 - DNA, 16 bp, P. troglodytes
tttgctcagcttctgg

SEQ ID NO: 290396 - DNA, 16 bp, P. troglodytes
tttgctcattttctaa

SEQ ID NO: 290397 - DNA, 16 bp, P. troglodytes
tttgctcctgcatctg

SEQ ID NO: 290398 - DNA, 16 bp, P. troglodytes
tttgctccttttcatt

SEQ ID NO: 290399 - DNA, 16 bp, P. troglodytes
tttgctcggcacttct

SEQ ID NO: 290400 - DNA, 16 bp, P. troglodytes
tttgctctgttgccca

SEQ ID NO: 290401 - DNA, 16 bp, P. troglodytes
tttgctcttgttcccc

SEQ ID NO: 290402 - DNA, 16 bp, P. troglodytes
tttgctgaaaataatg

SEQ ID NO: 290403 - DNA, 16 bp, P. troglodytes
tttgctgaaaatgatg

SEQ ID NO: 290404 - DNA, 16 bp, P. troglodytes
tttgctgaagttcctt

SEQ ID NO: 290405 - DNA, 16 bp, P. troglodytes
tttgctgaatgaagaa

SEQ ID NO: 290406 - DNA, 16 bp, P. troglodytes
tttgctgaattaatga

SEQ ID NO: 290407 - DNA, 16 bp, P. troglodytes
tttgctgaattccttt

SEQ ID NO: 290408 - DNA, 16 bp, P. troglodytes
tttgctgaattctttt

SEQ ID NO: 290409 - DNA, 16 bp, P. troglodytes
tttgctgagaaggatg

SEQ ID NO: 290410 - DNA, 16 bp, P. troglodytes
tttgctgagagctttc

SEQ ID NO: 290411 - DNA, 16 bp, P. troglodytes
tttgctgagaggtttt

SEQ ID NO: 290412 - DNA, 16 bp, P. troglodytes
tttgctgagagtgatg

SEQ ID NO: 290413 - DNA, 16 bp, P. troglodytes
tttgctgagattgatg

SEQ ID NO: 290414 - DNA, 16 bp, P. troglodytes
tttgctgaggataacg

SEQ ID NO: 290415 - DNA, 16 bp, P. troglodytes
tttgctgatattttgt

SEQ ID NO: 290416 - DNA, 16 bp, P. troglodytes
tttgctgatgaagaaa

SEQ ID NO: 290417 - DNA, 16 bp, P. troglodytes
tttgctgatgacatga

SEQ ID NO: 290418 - DNA, 16 bp, P. troglodytes
tttgctgattttctct

SEQ ID NO: 290419 - DNA, 16 bp, P. troglodytes
tttgctgcacccctca

SEQ ID NO: 290420 - DNA, 16 bp, P. troglodytes
tttgctgctgctgctg

SEQ ID NO: 290421 - DNA, 16 bp, P. troglodytes
tttgctgggcatgatg

SEQ ID NO: 290422 - DNA, 16 bp, P. troglodytes
tttgctgtcttctgta

SEQ ID NO: 290423 - DNA, 17 bp, P. troglodytes
tttgctgtgcagaagct

SEQ ID NO: 290424 - DNA, 16 bp, P. troglodytes
tttgctgtgcagcttt

SEQ ID NO: 290425 - DNA, 16 bp, P. troglodytes
tttgctgtgttgccca

SEQ ID NO: 290426 - DNA, 16 bp, P. troglodytes
tttgctgtgttggcca

SEQ ID NO: 290427 - DNA, 16 bp, P. troglodytes
tttgctgttataaata

SEQ ID NO: 290428 - DNA, 16 bp, P. troglodytes
tttgctgttcttgtga

SEQ ID NO: 290429 - DNA, 16 bp, P. troglodytes
tttgctgttgttattg

SEQ ID NO: 290430 - DNA, 16 bp, P. troglodytes
tttgctgttgttggat

SEQ ID NO: 290431 - DNA, 16 bp, P. troglodytes
tttgctgtttcctctg

SEQ ID NO: 290432 - DNA, 16 bp, P. troglodytes
tttgctgttttctcaa

SEQ ID NO: 290433 - DNA, 16 bp, P. troglodytes
tttgcttaaaacattt

SEQ ID NO: 290434 - DNA, 16 bp, P. troglodytes
tttgcttaaatatttt

SEQ ID NO: 290435 - DNA, 16 bp, P. troglodytes
tttgcttatgttttaa

SEQ ID NO: 290436 - DNA, 16 bp, P. troglodytes
tttgcttcagctgcag

SEQ ID NO: 290437 - DNA, 16 bp, P. troglodytes
tttgcttcatatattt

SEQ ID NO: 290438 - DNA, 16 bp, P. troglodytes
tttgcttcccctttgc

SEQ ID NO: 290439 - DNA, 16 bp, P. troglodytes
tttgcttgcttgttta

SEQ ID NO: 290440 - DNA, 16 bp, P. troglodytes
tttgcttgctttttaa

SEQ ID NO: 290441 - DNA, 16 bp, P. troglodytes
tttgcttgggataatg

SEQ ID NO: 290442 - DNA, 16 bp, P. troglodytes
tttgcttgtctggaaa

SEQ ID NO: 290443 - DNA, 16 bp, P. troglodytes
tttgcttgtttgggaa

SEQ ID NO: 290444 - DNA, 16 bp, P. troglodytes
tttgcttgttttaaaa

SEQ ID NO: 290445 - DNA, 16 bp, P. troglodytes
tttgctttaaaaatat

SEQ ID NO: 290446 - DNA, 16 bp, P. troglodytes
tttgctttaagaaaaa

SEQ ID NO: 290447 - DNA, 16 bp, P. troglodytes
tttgctttatccattt

SEQ ID NO: 290448 - DNA, 16 bp, P. troglodytes
tttgctttattaaaaa

SEQ ID NO: 290449 - DNA, 16 bp, P. troglodytes
tttgctttatttcact

SEQ ID NO: 290450 - DNA, 16 bp, P. troglodytes
tttgctttccatttcc

SEQ ID NO: 290451 - DNA, 16 bp, P. troglodytes
tttgctttctctgtgc

SEQ ID NO: 290452 - DNA, 16 bp, P. troglodytes
tttgctttgtagattt

SEQ ID NO: 290453 - DNA, 16 bp, P. troglodytes
tttgcttttaaaaaaa

SEQ ID NO: 290454 - DNA, 16 bp, P. troglodytes
tttgcttttaaagaaa

SEQ ID NO: 290455 - DNA, 16 bp, P. troglodytes
tttgcttttctaaaaa

SEQ ID NO: 290456 - DNA, 16 bp, P. troglodytes
tttgcttttctatata

SEQ ID NO: 290457 - DNA, 16 bp, P. troglodytes
tttgcttttctggaaa

SEQ ID NO: 290458 - DNA, 16 bp, P. troglodytes
tttgcttttcttaaaa

SEQ ID NO: 290459 - DNA, 16 bp, P. troglodytes
tttgcttttgtcacct

SEQ ID NO: 290460 - DNA, 16 bp, P. troglodytes
tttgcttttgtggcct

SEQ ID NO: 290461 - DNA, 16 bp, P. troglodytes
tttgcttttgttccaa

SEQ ID NO: 290462 - DNA, 16 bp, P. troglodytes
tttgctttttaataat

SEQ ID NO: 290463 - DNA, 16 bp, P. troglodytes
tttgctttttctggaa

SEQ ID NO: 290464 - DNA, 16 bp, P. troglodytes
tttgctttttgagatg

SEQ ID NO: 290465 - DNA, 16 bp, P. troglodytes
tttggaaaaaaataga

SEQ ID NO: 290466 - DNA, 16 bp, P. troglodytes
tttggaaaaaatgttt

SEQ ID NO: 290467 - DNA, 16 bp, P. troglodytes
tttggaaaaacagttt

SEQ ID NO: 290468 - DNA, 16 bp, P. troglodytes
tttggaaaaacttaaa

SEQ ID NO: 290469 - DNA, 16 bp, P. troglodytes
tttggaaaaagaaaga

SEQ ID NO: 290470 - DNA, 16 bp, P. troglodytes
tttggaaaaatataat

SEQ ID NO: 290471 - DNA, 16 bp, P. troglodytes
tttggaaaaatatttg

SEQ ID NO: 290472 - DNA, 16 bp, P. troglodytes
tttggaaaaatgtctt

SEQ ID NO: 290473 - DNA, 16 bp, P. troglodytes
tttggaaaaatgttta

SEQ ID NO: 290474 - DNA, 16 bp, P. troglodytes
tttggaaaacataaaa

SEQ ID NO: 290475 - DNA, 16 bp, P. troglodytes
tttggaaaacttgtat

SEQ ID NO: 290476 - DNA, 16 bp, P. troglodytes
tttggaaaagaaaaat

SEQ ID NO: 290477 - DNA, 16 bp, P. troglodytes
tttggaaaagaaataa

SEQ ID NO: 290478 - DNA, 16 bp, P. troglodytes
tttggaaaagaacaaa

SEQ ID NO: 290479 - DNA, 16 bp, P. troglodytes
tttggaaaagacaaaa

SEQ ID NO: 290480 - DNA, 16 bp, P. troglodytes
tttggaaaagaggaag

SEQ ID NO: 290481 - DNA, 16 bp, P. troglodytes
tttggaaaataaacat

SEQ ID NO: 290482 - DNA, 16 bp, P. troglodytes
tttggaaaataatctg

SEQ ID NO: 290483 - DNA, 16 bp, P. troglodytes
tttggaaaataatttg

SEQ ID NO: 290484 - DNA, 16 bp, P. troglodytes
tttggaaaatagtttg

SEQ ID NO: 290485 - DNA, 16 bp, P. troglodytes
tttggaaaatatagtt

SEQ ID NO: 290486 - DNA, 16 bp, P. troglodytes
tttggaaaatgaaaaa

SEQ ID NO: 290487 - DNA, 16 bp, P. troglodytes
tttggaaaatgtattt

SEQ ID NO: 290488 - DNA, 16 bp, P. troglodytes
tttggaaaatgtttat

SEQ ID NO: 290489 - DNA, 16 bp, P. troglodytes
tttggaaaatgttttg

SEQ ID NO: 290490 - DNA, 16 bp, P. troglodytes
tttggaaaatttccag

SEQ ID NO: 290491 - DNA, 16 bp, P. troglodytes
tttggaaaattttaaa

SEQ ID NO: 290492 - DNA, 16 bp, P. troglodytes
tttggaaacacacaca

SEQ ID NO: 290493 - DNA, 16 bp, P. troglodytes
tttggaaacagtattt

SEQ ID NO: 290494 - DNA, 16 bp, P. troglodytes
tttggaaacatttttg

SEQ ID NO: 290495 - DNA, 16 bp, P. troglodytes
tttggaaagaataaaa

SEQ ID NO: 290496 - DNA, 16 bp, P. troglodytes
tttggaaagagaaaaa

SEQ ID NO: 290497 - DNA, 16 bp, P. troglodytes
tttggaaagcattttg

SEQ ID NO: 290498 - DNA, 16 bp, P. troglodytes
tttggaaaggagaaaa

SEQ ID NO: 290499 - DNA, 16 bp, P. troglodytes
tttggaaaggctcatc

SEQ ID NO: 290500 - DNA, 16 bp, P. troglodytes
tttggaaagtttttag

SEQ ID NO: 290501 - DNA, 16 bp, P. troglodytes
tttggaaataaagaaa

SEQ ID NO: 290502 - DNA, 16 bp, P. troglodytes
tttggaaatattttct

SEQ ID NO: 290503 - DNA, 16 bp, P. troglodytes
tttggaaatgaaaaat

SEQ ID NO: 290504 - DNA, 16 bp, P. troglodytes
tttggaaatgaaaata

SEQ ID NO: 290505 - DNA, 16 bp, P. troglodytes
tttggaaatgcagaaa

SEQ ID NO: 290506 - DNA, 16 bp, P. troglodytes
tttggaaatgggtaac

SEQ ID NO: 290507 - DNA, 16 bp, P. troglodytes
tttggaaattatgaat

SEQ ID NO: 290508 - DNA, 16 bp, P. troglodytes
tttggaacagtttcag

SEQ ID NO: 290509 - DNA, 16 bp, P. troglodytes
tttggaacctcctaga

SEQ ID NO: 290510 - DNA, 16 bp, P. troglodytes
tttggaactcctgggc

SEQ ID NO: 290511 - DNA, 16 bp, P. troglodytes
tttggaacttcctaga

SEQ ID NO: 290512 - DNA, 16 bp, P. troglodytes
tttggaagaaaaataa

SEQ ID NO: 290513 - DNA, 16 bp, P. troglodytes
tttggaagaaaataaa

SEQ ID NO: 290514 - DNA, 16 bp, P. troglodytes
tttggaagaaaatata

SEQ ID NO: 290515 - DNA, 16 bp, P. troglodytes
tttggaagaaaatatt

SEQ ID NO: 290516 - DNA, 16 bp, P. troglodytes
tttggaagaagaaaaa

SEQ ID NO: 290517 - DNA, 16 bp, P. troglodytes
tttggaagaagatgcc

SEQ ID NO: 290518 - DNA, 16 bp, P. troglodytes
tttggaagaagctgat

SEQ ID NO: 290519 - DNA, 16 bp, P. troglodytes
tttggaagaagttgat

SEQ ID NO: 290520 - DNA, 16 bp, P. troglodytes
tttggaagacagcttg

SEQ ID NO: 290521 - DNA, 16 bp, P. troglodytes
tttggaagagaaaaat

SEQ ID NO: 290522 - DNA, 16 bp, P. troglodytes
tttggaagagtttaag

SEQ ID NO: 290523 - DNA, 16 bp, P. troglodytes
tttggaagccgaggca

SEQ ID NO: 290524 - DNA, 16 bp, P. troglodytes
tttggaagctggaagt

SEQ ID NO: 290525 - DNA, 16 bp, P. troglodytes
tttggaaggcaaaggc

SEQ ID NO: 290526 - DNA, 16 bp, P. troglodytes
tttggaaggccaaggc

SEQ ID NO: 290527 - DNA, 16 bp, P. troglodytes
tttggaaggccgaggt

SEQ ID NO: 290528 - DNA, 16 bp, P. troglodytes
tttggaaggctcagaa

SEQ ID NO: 290529 - DNA, 16 bp, P. troglodytes
tttggaaggtgattag

SEQ ID NO: 290530 - DNA, 16 bp, P. troglodytes
tttggaagtgttccct

SEQ ID NO: 290531 - DNA, 16 bp, P. troglodytes
tttggaagttttcttt

SEQ ID NO: 290532 - DNA, 16 bp, P. troglodytes
tttggaataattttaa

SEQ ID NO: 290533 - DNA, 16 bp, P. troglodytes
tttggaataattttag

SEQ ID NO: 290534 - DNA, 16 bp, P. troglodytes
tttggaatatatatat

SEQ ID NO: 290535 - DNA, 16 bp, P. troglodytes
tttggaatatattttg

SEQ ID NO: 290536 - DNA, 16 bp, P. troglodytes
tttggaatatttgaat

SEQ ID NO: 290537 - DNA, 16 bp, P. troglodytes
tttggaatcaaacaga

SEQ ID NO: 290538 - DNA, 16 bp, P. troglodytes
tttggaatcactgttt

SEQ ID NO: 290539 - DNA, 17 bp, P. troglodytes
tttggaatggctgtatt

SEQ ID NO: 290540 - DNA, 16 bp, P. troglodytes
tttggaatgggtatat

SEQ ID NO: 290541 - DNA, 16 bp, P. troglodytes
tttggaattcagaatt

SEQ ID NO: 290542 - DNA, 16 bp, P. troglodytes
tttggaattcattttt

SEQ ID NO: 290543 - DNA, 16 bp, P. troglodytes
tttggaattttagaaa

SEQ ID NO: 290544 - DNA, 16 bp, P. troglodytes
tttggaattttccatt

SEQ ID NO: 290545 - DNA, 16 bp, P. troglodytes
tttggacaaaaaggct

SEQ ID NO: 290546 - DNA, 16 bp, P. troglodytes
tttggacaagttattt

SEQ ID NO: 290547 - DNA, 16 bp, P. troglodytes
tttggaccatggttga

SEQ ID NO: 290548 - DNA, 17 bp, P. troglodytes
tttggactctgggactt

SEQ ID NO: 290549 - DNA, 16 bp, P. troglodytes
tttggactgtgaactt

SEQ ID NO: 290550 - DNA, 16 bp, P. troglodytes
tttggacttctcagcc

SEQ ID NO: 290551 - DNA, 16 bp, P. troglodytes
tttggacttctgacct

SEQ ID NO: 290552 - DNA, 16 bp, P. troglodytes
tttggacttgaacttt

SEQ ID NO: 290553 - DNA, 16 bp, P. troglodytes
tttggactttagactt

SEQ ID NO: 290554 - DNA, 16 bp, P. troglodytes
tttggagaaacagaaa

SEQ ID NO: 290555 - DNA, 16 bp, P. troglodytes
tttggagaaataccta

SEQ ID NO: 290556 - DNA, 16 bp, P. troglodytes
tttggagaagaggaaa

SEQ ID NO: 290557 - DNA, 16 bp, P. troglodytes
tttggagaatatattt

SEQ ID NO: 290558 - DNA, 16 bp, P. troglodytes
tttggagaatctgatg

SEQ ID NO: 290559 - DNA, 16 bp, P. troglodytes
tttggagacacagtct

SEQ ID NO: 290560 - DNA, 16 bp, P. troglodytes
tttggagacagaatct

SEQ ID NO: 290561 - DNA, 16 bp, P. troglodytes
tttggagacagcatct

SEQ ID NO: 290562 - DNA, 16 bp, P. troglodytes
tttggagacagggcct

SEQ ID NO: 290563 - DNA, 16 bp, P. troglodytes
tttggagacagggtct

SEQ ID NO: 290564 - DNA, 16 bp, P. troglodytes
tttggagagagggtct

SEQ ID NO: 290565 - DNA, 16 bp, P. troglodytes
tttggagagatggggg

SEQ ID NO: 290566 - DNA, 16 bp, P. troglodytes
tttggagagatggggt

SEQ ID NO: 290567 - DNA, 16 bp, P. troglodytes
tttggagagcttccag

SEQ ID NO: 290568 - DNA, 16 bp, P. troglodytes
tttggagataaggtct

SEQ ID NO: 290569 - DNA, 16 bp, P. troglodytes
tttggagatgaagaaa

SEQ ID NO: 290570 - DNA, 16 bp, P. troglodytes
tttggagatgaggaaa

SEQ ID NO: 290571 - DNA, 16 bp, P. troglodytes
tttggagctctttgag

SEQ ID NO: 290572 - DNA, 16 bp, P. troglodytes
tttggaggaaaaaaga

SEQ ID NO: 290573 - DNA, 16 bp, P. troglodytes
tttggaggcagagttt

SEQ ID NO: 290574 - DNA, 16 bp, P. troglodytes
tttggaggccaaagtg

SEQ ID NO: 290575 - DNA, 16 bp, P. troglodytes
tttggaggccgaggca

SEQ ID NO: 290576 - DNA, 16 bp, P. troglodytes
tttggaggggaagagg

SEQ ID NO: 290577 - DNA, 16 bp, P. troglodytes
tttggagtacaaatga

SEQ ID NO: 290578 - DNA, 16 bp, P. troglodytes
tttggagtcagacaga

SEQ ID NO: 290579 - DNA, 16 bp, P. troglodytes
tttggagtcagggtct

SEQ ID NO: 290580 - DNA, 16 bp, P. troglodytes
tttggagtccccagtg

SEQ ID NO: 290581 - DNA, 16 bp, P. troglodytes
tttggagttttttcct

SEQ ID NO: 290582 - DNA, 16 bp, P. troglodytes
tttggataaaaagaaa

SEQ ID NO: 290583 - DNA, 16 bp, P. troglodytes
tttggatatataccca

SEQ ID NO: 290584 - DNA, 16 bp, P. troglodytes
tttggatatgacctca

SEQ ID NO: 290585 - DNA, 16 bp, P. troglodytes
tttggatatttgtccc

SEQ ID NO: 290586 - DNA, 16 bp, P. troglodytes
tttggatccattgttg

SEQ ID NO: 290587 - DNA, 16 bp, P. troglodytes
tttggatcctgattca

SEQ ID NO: 290588 - DNA, 16 bp, P. troglodytes
tttggatctgtgtccc

SEQ ID NO: 290589 - DNA, 16 bp, P. troglodytes
tttggatgaaagccat

SEQ ID NO: 290590 - DNA, 16 bp, P. troglodytes
tttggatgataaatta

SEQ ID NO: 290591 - DNA, 16 bp, P. troglodytes
tttggattcagcaggt

SEQ ID NO: 290592 - DNA, 16 bp, P. troglodytes
tttggattcattgctg

SEQ ID NO: 290593 - DNA, 16 bp, P. troglodytes
tttggatttcaaattt

SEQ ID NO: 290594 - DNA, 16 bp, P. troglodytes
tttggatttctcttct

SEQ ID NO: 290595 - DNA, 16 bp, P. troglodytes
tttggatttgtctgat

SEQ ID NO: 290596 - DNA, 16 bp, P. troglodytes
tttggattttattcca

SEQ ID NO: 290597 - DNA, 16 bp, P. troglodytes
tttggattttgtcaaa

SEQ ID NO: 290598 - DNA, 16 bp, P. troglodytes
tttggatttttgtcct

SEQ ID NO: 290599 - DNA, 16 bp, P. troglodytes
tttggcaaaaaaaaaa

SEQ ID NO: 290600 - DNA, 16 bp, P. troglodytes
tttggcaacaccatca

SEQ ID NO: 290601 - DNA, 16 bp, P. troglodytes
tttggcaatgtctggg

SEQ ID NO: 290602 - DNA, 16 bp, P. troglodytes
tttggcacaagggacc

SEQ ID NO: 290603 - DNA, 16 bp, P. troglodytes
tttggcagaagaaatt

SEQ ID NO: 290604 - DNA, 16 bp, P. troglodytes
tttggcagcaccctca

SEQ ID NO: 290605 - DNA, 16 bp, P. troglodytes
tttggcagttcctcct

SEQ ID NO: 290606 - DNA, 16 bp, P. troglodytes
tttggcagtttctttt

SEQ ID NO: 290607 - DNA, 16 bp, P. troglodytes
tttggcatttgaagca

SEQ ID NO: 290608 - DNA, 16 bp, P. troglodytes
tttggccaatgaaatg

SEQ ID NO: 290609 - DNA, 16 bp, P. troglodytes
tttggccatttgtatg

SEQ ID NO: 290610 - DNA, 22 bp, P. troglodytes
tttggccgggcacagtggctca

SEQ ID NO: 290611 - DNA, 16 bp, P. troglodytes
tttggcctaaagctgc

SEQ ID NO: 290612 - DNA, 21 bp, P. troglodytes
tttggcctcccaaagtgctgg

SEQ ID NO: 290613 - DNA, 16 bp, P. troglodytes
tttggcctccctctcc

SEQ ID NO: 290614 - DNA, 16 bp, P. troglodytes
tttggcctgcaggctg

SEQ ID NO: 290615 - DNA, 16 bp, P. troglodytes
tttggctaatttttaa

SEQ ID NO: 290616 - DNA, 16 bp, P. troglodytes
tttggctattatttct

SEQ ID NO: 290617 - DNA, 16 bp, P. troglodytes
tttggctattgagaat

SEQ ID NO: 290618 - DNA, 16 bp, P. troglodytes
tttggctctccatttg

SEQ ID NO: 290619 - DNA, 16 bp, P. troglodytes
tttggctctctatttg

SEQ ID NO: 290620 - DNA, 16 bp, P. troglodytes
tttggctctctgcttg

SEQ ID NO: 290621 - DNA, 16 bp, P. troglodytes
tttggctcttggcttg

SEQ ID NO: 290622 - DNA, 17 bp, P. troglodytes
tttggctgggcacggtg

SEQ ID NO: 290623 - DNA, 16 bp, P. troglodytes
tttggctgggcatggt

SEQ ID NO: 290624 - DNA, 16 bp, P. troglodytes
tttggctgtttcccca

SEQ ID NO: 290625 - DNA, 16 bp, P. troglodytes
tttggcttaggactga

SEQ ID NO: 290626 - DNA, 16 bp, P. troglodytes
tttggcttccctgagc

SEQ ID NO: 290627 - DNA, 16 bp, P. troglodytes
tttggcttccctggcc

SEQ ID NO: 290628 - DNA, 16 bp, P. troglodytes
tttggcttccctgggc

SEQ ID NO: 290629 - DNA, 16 bp, P. troglodytes
tttggctttatttcta

SEQ ID NO: 290630 - DNA, 16 bp, P. troglodytes
tttggctttccattcc

SEQ ID NO: 290631 - DNA, 16 bp, P. troglodytes
tttggctttctctggt

SEQ ID NO: 290632 - DNA, 16 bp, P. troglodytes
tttggctttgtgggcc

SEQ ID NO: 290633 - DNA, 16 bp, P. troglodytes
tttggcttttaaaaat

SEQ ID NO: 290634 - DNA, 16 bp, P. troglodytes
tttggcttttattgcc

SEQ ID NO: 290635 - DNA, 16 bp, P. troglodytes
tttggctttttgataa

SEQ ID NO: 290636 - DNA, 16 bp, P. troglodytes
tttgggaaaaaacaaa

SEQ ID NO: 290637 - DNA, 16 bp, P. troglodytes
tttgggaaaaaattat

SEQ ID NO: 290638 - DNA, 16 bp, P. troglodytes
tttgggaaaaatagaa

SEQ ID NO: 290639 - DNA, 16 bp, P. troglodytes
tttgggaaaagagaaa

SEQ ID NO: 290640 - DNA, 16 bp, P. troglodytes
tttgggaaaataattt

SEQ ID NO: 290641 - DNA, 16 bp, P. troglodytes
tttgggaaacactgaa

SEQ ID NO: 290642 - DNA, 16 bp, P. troglodytes
tttgggaaacagtttg

SEQ ID NO: 290643 - DNA, 16 bp, P. troglodytes
tttgggaaagtttgga

SEQ ID NO: 290644 - DNA, 16 bp, P. troglodytes
tttgggaaatacagag

SEQ ID NO: 290645 - DNA, 16 bp, P. troglodytes
tttgggaaatattttg

SEQ ID NO: 290646 - DNA, 16 bp, P. troglodytes
tttgggaaatctccat

SEQ ID NO: 290647 - DNA, 16 bp, P. troglodytes
tttgggaaattctcag

SEQ ID NO: 290648 - DNA, 16 bp, P. troglodytes
tttgggaaccactgct

SEQ ID NO: 290649 - DNA, 16 bp, P. troglodytes
tttgggaagataaaaa

SEQ ID NO: 290650 - DNA, 16 bp, P. troglodytes
tttgggaagatgagaa

SEQ ID NO: 290651 - DNA, 16 bp, P. troglodytes
tttgggaagatgaggt

SEQ ID NO: 290652 - DNA, 16 bp, P. troglodytes
tttgggaagccaagga

SEQ ID NO: 290653 - DNA, 20 bp, P. troglodytes
tttgggaagccaaggcaggt

SEQ ID NO: 290654 - DNA, 17 bp, P. troglodytes
tttgggaagccaaggcg

SEQ ID NO: 290655 - DNA, 16 bp, P. troglodytes
tttgggaagccagggc

SEQ ID NO: 290656 - DNA, 16 bp, P. troglodytes
tttgggaatatttgca

SEQ ID NO: 290657 - DNA, 16 bp, P. troglodytes
tttgggagaaaaaaat

SEQ ID NO: 290658 - DNA, 16 bp, P. troglodytes
tttgggaggacaaggt

SEQ ID NO: 290659 - DNA, 16 bp, P. troglodytes
tttgggaggaggaggc

SEQ ID NO: 290660 - DNA, 16 bp, P. troglodytes
tttgggaggcaaaggt

SEQ ID NO: 290661 - DNA, 16 bp, P. troglodytes
tttgggaggcaattag

SEQ ID NO: 290662 - DNA, 17 bp, P. troglodytes
tttgggaggccaaggca

SEQ ID NO: 290663 - DNA, 16 bp, P. troglodytes
tttgggaggccaaggg

SEQ ID NO: 290664 - DNA, 16 bp, P. troglodytes
tttgggaggccaaggt

SEQ ID NO: 290665 - DNA, 20 bp, P. troglodytes
tttgggaggccaaggtgggt

SEQ ID NO: 290666 - DNA, 18 bp, P. troglodytes
tttgggaggccgaggtgg

SEQ ID NO: 290667 - DNA, 16 bp, P. troglodytes
tttgggaggcctgagg

SEQ ID NO: 290668 - DNA, 16 bp, P. troglodytes
tttgggaggctcaggc

SEQ ID NO: 290669 - DNA, 20 bp, P. troglodytes
tttgggaggctgaagcgggc

SEQ ID NO: 290670 - DNA, 16 bp, P. troglodytes
tttgggaggctgagtc

SEQ ID NO: 290671 - DNA, 16 bp, P. troglodytes
tttgggaggtgattag

SEQ ID NO: 290672 - DNA, 16 bp, P. troglodytes
tttgggagtccaaggc

SEQ ID NO: 290673 - DNA, 16 bp, P. troglodytes
tttgggatgaggataa

SEQ ID NO: 290674 - DNA, 16 bp, P. troglodytes
tttgggatgcagctaa

SEQ ID NO: 290675 - DNA, 16 bp, P. troglodytes
tttgggatgcccaggc

SEQ ID NO: 290676 - DNA, 16 bp, P. troglodytes
tttgggatgtgtgcat

SEQ ID NO: 290677 - DNA, 16 bp, P. troglodytes
tttgggatttttaaaa

SEQ ID NO: 290678 - DNA, 16 bp, P. troglodytes
tttgggcaaagtcatt

SEQ ID NO: 290679 - DNA, 16 bp, P. troglodytes
tttgggcaaatttctt

SEQ ID NO: 290680 - DNA, 16 bp, P. troglodytes
tttgggcaagtttctt

SEQ ID NO: 290681 - DNA, 16 bp, P. troglodytes
tttgggcactgatgag

SEQ ID NO: 290682 - DNA, 16 bp, P. troglodytes
tttgggcagacaccaa

SEQ ID NO: 290683 - DNA, 16 bp, P. troglodytes
tttgggcatgaaaaca

SEQ ID NO: 290684 - DNA, 16 bp, P. troglodytes
tttgggccaggtgtgg

SEQ ID NO: 290685 - DNA, 16 bp, P. troglodytes
tttgggctcaagtgat

SEQ ID NO: 290686 - DNA, 18 bp, P. troglodytes
tttgggctgagacagtgg

SEQ ID NO: 290687 - DNA, 16 bp, P. troglodytes
tttggggaaaaaagaa

SEQ ID NO: 290688 - DNA, 16 bp, P. troglodytes
tttggggaaaaacaaa

SEQ ID NO: 290689 - DNA, 16 bp, P. troglodytes
tttggggaaataaaaa

SEQ ID NO: 290690 - DNA, 16 bp, P. troglodytes
tttggggaagaggtgg

SEQ ID NO: 290691 - DNA, 16 bp, P. troglodytes
tttggggactcaggaa

SEQ ID NO: 290692 - DNA, 16 bp, P. troglodytes
tttggggacttagcca

SEQ ID NO: 290693 - DNA, 16 bp, P. troglodytes
tttggggagcaggagg

SEQ ID NO: 290694 - DNA, 16 bp, P. troglodytes
tttggggagcaggtgg

SEQ ID NO: 290695 - DNA, 16 bp, P. troglodytes
tttggggatgatgaaa

SEQ ID NO: 290696 - DNA, 16 bp, P. troglodytes
tttggggctgagatga

SEQ ID NO: 290697 - DNA, 16 bp, P. troglodytes
tttgggggacacaatt

SEQ ID NO: 290698 - DNA, 16 bp, P. troglodytes
tttgggggagaagagg

SEQ ID NO: 290699 - DNA, 16 bp, P. troglodytes
tttgggggctgaggca

SEQ ID NO: 290700 - DNA, 16 bp, P. troglodytes
tttggggggaaaaaaa

SEQ ID NO: 290701 - DNA, 16 bp, P. troglodytes
tttggggggaacacaa

SEQ ID NO: 290702 - DNA, 16 bp, P. troglodytes
tttggggggaacaggt

SEQ ID NO: 290703 - DNA, 16 bp, P. troglodytes
tttgggggggaaaaaa

SEQ ID NO: 290704 - DNA, 16 bp, P. troglodytes
tttgggggtgcatgtg

SEQ ID NO: 290705 - DNA, 16 bp, P. troglodytes
tttggggtcctgagat

SEQ ID NO: 290706 - DNA, 16 bp, P. troglodytes
tttggggtgatgaaaa

SEQ ID NO: 290707 - DNA, 16 bp, P. troglodytes
tttggggtggtgaaaa

SEQ ID NO: 290708 - DNA, 26 bp, P. troglodytes
tttgggtatatacccagtaatgggat

SEQ ID NO: 290709 - DNA, 16 bp, P. troglodytes
tttgggtcatgggggc

SEQ ID NO: 290710 - DNA, 16 bp, P. troglodytes
tttgggtctcaatttt

SEQ ID NO: 290711 - DNA, 16 bp, P. troglodytes
tttgggtcttcatttt

SEQ ID NO: 290712 - DNA, 16 bp, P. troglodytes
tttgggtgacagagca

SEQ ID NO: 290713 - DNA, 16 bp, P. troglodytes
tttgggtggccaaggt

SEQ ID NO: 290714 - DNA, 16 bp, P. troglodytes
tttgggtgtataccta

SEQ ID NO: 290715 - DNA, 16 bp, P. troglodytes
tttgggtttgtctgat

SEQ ID NO: 290716 - DNA, 16 bp, P. troglodytes
tttggtataaggatga

SEQ ID NO: 290717 - DNA, 18 bp, P. troglodytes
tttggtatcaggacgatg

SEQ ID NO: 290718 - DNA, 16 bp, P. troglodytes
tttggtatcagggtaa

SEQ ID NO: 290719 - DNA, 16 bp, P. troglodytes
tttggtatctgtggga

SEQ ID NO: 290720 - DNA, 16 bp, P. troglodytes
tttggtcatttaaaaa

SEQ ID NO: 290721 - DNA, 16 bp, P. troglodytes
tttggtctaaattatg

SEQ ID NO: 290722 - DNA, 21 bp, P. troglodytes
tttggtctttgatgatggtga

SEQ ID NO: 290723 - DNA, 16 bp, P. troglodytes
tttggtgagatcatgt

SEQ ID NO: 290724 - DNA, 16 bp, P. troglodytes
tttggtgatttctcaa

SEQ ID NO: 290725 - DNA, 16 bp, P. troglodytes
tttggtgccacaaaag

SEQ ID NO: 290726 - DNA, 16 bp, P. troglodytes
tttggtggaagaaatt

SEQ ID NO: 290727 - DNA, 16 bp, P. troglodytes
tttggtggcttccatg

SEQ ID NO: 290728 - DNA, 16 bp, P. troglodytes
tttggtgggcagcagc

SEQ ID NO: 290729 - DNA, 16 bp, P. troglodytes
tttggtggggacacag

SEQ ID NO: 290730 - DNA, 16 bp, P. troglodytes
tttggtggtctgctgc

SEQ ID NO: 290731 - DNA, 16 bp, P. troglodytes
tttggtgtcatagcta

SEQ ID NO: 290732 - DNA, 16 bp, P. troglodytes
tttggtgtcatgtcta

SEQ ID NO: 290733 - DNA, 16 bp, P. troglodytes
tttggtgtgcccatca

SEQ ID NO: 290734 - DNA, 16 bp, P. troglodytes
tttggtgtgctttcct

SEQ ID NO: 290735 - DNA, 16 bp, P. troglodytes
tttggtgttccttggc

SEQ ID NO: 290736 - DNA, 16 bp, P. troglodytes
tttggtgttttcttca

SEQ ID NO: 290737 - DNA, 16 bp, P. troglodytes
tttggttaaattcatt

SEQ ID NO: 290738 - DNA, 16 bp, P. troglodytes
tttggttactggagcc

SEQ ID NO: 290739 - DNA, 16 bp, P. troglodytes
tttggttgtcaaaact

SEQ ID NO: 290740 - DNA, 16 bp, P. troglodytes
tttggtttaaaaaaaa

SEQ ID NO: 290741 - DNA, 16 bp, P. troglodytes
tttggtttaaaaaaat

SEQ ID NO: 290742 - DNA, 16 bp, P. troglodytes
tttggtttaaaaatta

SEQ ID NO: 290743 - DNA, 16 bp, P. troglodytes
tttggtttgctattat

SEQ ID NO: 290744 - DNA, 16 bp, P. troglodytes
tttggtttgtttccag

SEQ ID NO: 290745 - DNA, 16 bp, P. troglodytes
tttggttttatacatt

SEQ ID NO: 290746 - DNA, 16 bp, P. troglodytes
tttggttttatgcatt

SEQ ID NO: 290747 - DNA, 16 bp, P. troglodytes
tttggttttcttccca

SEQ ID NO: 290748 - DNA, 16 bp, P. troglodytes
tttggttttgatatca

SEQ ID NO: 290749 - DNA, 16 bp, P. troglodytes
tttgtaaaaacatttt

SEQ ID NO: 290750 - DNA, 16 bp, P. troglodytes
tttgtaaaaagttaaa

SEQ ID NO: 290751 - DNA, 16 bp, P. troglodytes
tttgtaaaaataaaca

SEQ ID NO: 290752 - DNA, 16 bp, P. troglodytes
tttgtaaaagccaaaa

SEQ ID NO: 290753 - DNA, 16 bp, P. troglodytes
tttgtaaaaggaaaaa

SEQ ID NO: 290754 - DNA, 16 bp, P. troglodytes
tttgtaaaatacaata

SEQ ID NO: 290755 - DNA, 16 bp, P. troglodytes
tttgtaaaatctgtga

SEQ ID NO: 290756 - DNA, 16 bp, P. troglodytes
tttgtaaaatgaagag

SEQ ID NO: 290757 - DNA, 16 bp, P. troglodytes
tttgtaaaatgaagat

SEQ ID NO: 290758 - DNA, 16 bp, P. troglodytes
tttgtaaactgtaaag

SEQ ID NO: 290759 - DNA, 16 bp, P. troglodytes
tttgtaaagatggagt

SEQ ID NO: 290760 - DNA, 16 bp, P. troglodytes
tttgtaaataacaaaa

SEQ ID NO: 290761 - DNA, 16 bp, P. troglodytes
tttgtaaatatcttct

SEQ ID NO: 290762 - DNA, 16 bp, P. troglodytes
tttgtaaatatctttt

SEQ ID NO: 290763 - DNA, 16 bp, P. troglodytes
tttgtaaatatttcaa

SEQ ID NO: 290764 - DNA, 16 bp, P. troglodytes
tttgtaaatatttccc

SEQ ID NO: 290765 - DNA, 16 bp, P. troglodytes
tttgtaaatattttct

SEQ ID NO: 290766 - DNA, 16 bp, P. troglodytes
tttgtaaatgagaaaa

SEQ ID NO: 290767 - DNA, 16 bp, P. troglodytes
tttgtaaatgttaaaa

SEQ ID NO: 290768 - DNA, 16 bp, P. troglodytes
tttgtaaattatgcat

SEQ ID NO: 290769 - DNA, 19 bp, P. troglodytes
tttgtaaattgcccagtct

SEQ ID NO: 290770 - DNA, 16 bp, P. troglodytes
tttgtaacatttattt

SEQ ID NO: 290771 - DNA, 16 bp, P. troglodytes
tttgtaacccccaaat

SEQ ID NO: 290772 - DNA, 16 bp, P. troglodytes
tttgtaactttacttc

SEQ ID NO: 290773 - DNA, 16 bp, P. troglodytes
tttgtaactttttaaa

SEQ ID NO: 290774 - DNA, 16 bp, P. troglodytes
tttgtaagaaaagaaa

SEQ ID NO: 290775 - DNA, 16 bp, P. troglodytes
tttgtaagaagctgcc

SEQ ID NO: 290776 - DNA, 16 bp, P. troglodytes
tttgtaagtgaaggag

SEQ ID NO: 290777 - DNA, 16 bp, P. troglodytes
tttgtaataatgaaaa

SEQ ID NO: 290778 - DNA, 16 bp, P. troglodytes
tttgtaatagccaaaa

SEQ ID NO: 290779 - DNA, 16 bp, P. troglodytes
tttgtaatagtcaaaa

SEQ ID NO: 290780 - DNA, 16 bp, P. troglodytes
tttgtaatatacattt

SEQ ID NO: 290781 - DNA, 16 bp, P. troglodytes
tttgtaatatagtttg

SEQ ID NO: 290782 - DNA, 16 bp, P. troglodytes
tttgtaattacaaaat

SEQ ID NO: 290783 - DNA, 16 bp, P. troglodytes
tttgtaattctgttta

SEQ ID NO: 290784 - DNA, 16 bp, P. troglodytes
tttgtaattttgatag

SEQ ID NO: 290785 - DNA, 16 bp, P. troglodytes
tttgtacatatatttt

SEQ ID NO: 290786 - DNA, 16 bp, P. troglodytes
tttgtacattgctttt

SEQ ID NO: 290787 - DNA, 16 bp, P. troglodytes
tttgtacattttaatt

SEQ ID NO: 290788 - DNA, 16 bp, P. troglodytes
tttgtacattttaggg

SEQ ID NO: 290789 - DNA, 16 bp, P. troglodytes
tttgtacattttggat

SEQ ID NO: 290790 - DNA, 16 bp, P. troglodytes
tttgtacccattaacc

SEQ ID NO: 290791 - DNA, 16 bp, P. troglodytes
tttgtacttccctcag

SEQ ID NO: 290792 - DNA, 16 bp, P. troglodytes
tttgtacttctctgat

SEQ ID NO: 290793 - DNA, 16 bp, P. troglodytes
tttgtactttaaaaaa

SEQ ID NO: 290794 - DNA, 16 bp, P. troglodytes
tttgtacttttagtaa

SEQ ID NO: 290795 - DNA, 16 bp, P. troglodytes
tttgtactttttaata

SEQ ID NO: 290796 - DNA, 17 bp, P. troglodytes
tttgtactttttgtaga

SEQ ID NO: 290797 - DNA, 16 bp, P. troglodytes
tttgtagaaatgggat

SEQ ID NO: 290798 - DNA, 16 bp, P. troglodytes
tttgtagaatatgtga

SEQ ID NO: 290799 - DNA, 16 bp, P. troglodytes
tttgtagaatgagttt

SEQ ID NO: 290800 - DNA, 16 bp, P. troglodytes
tttgtagaatgtttct

SEQ ID NO: 290801 - DNA, 16 bp, P. troglodytes
tttgtagagacaaaat

SEQ ID NO: 290802 - DNA, 16 bp, P. troglodytes
tttgtagagacaggtt

SEQ ID NO: 290803 - DNA, 16 bp, P. troglodytes
tttgtagagatgaagg

SEQ ID NO: 290804 - DNA, 17 bp, P. troglodytes
tttgtagagatgggatc

SEQ ID NO: 290805 - DNA, 16 bp, P. troglodytes
tttgtagagatgggtt

SEQ ID NO: 290806 - DNA, 16 bp, P. troglodytes
tttgtagatacttttt

SEQ ID NO: 290807 - DNA, 16 bp, P. troglodytes
tttgtagatattgaca

SEQ ID NO: 290808 - DNA, 16 bp, P. troglodytes
tttgtagcctaggagc

SEQ ID NO: 290809 - DNA, 16 bp, P. troglodytes
tttgtagcttttaaaa

SEQ ID NO: 290810 - DNA, 16 bp, P. troglodytes
tttgtagtcctccttg

SEQ ID NO: 290811 - DNA, 22 bp, P. troglodytes
tttgtagttctccttgaagaga

SEQ ID NO: 290812 - DNA, 16 bp, P. troglodytes
tttgtagttctcttta

SEQ ID NO: 290813 - DNA, 16 bp, P. troglodytes
tttgtagttgtccttg

SEQ ID NO: 290814 - DNA, 17 bp, P. troglodytes
tttgtagttttagtaga

SEQ ID NO: 290815 - DNA, 16 bp, P. troglodytes
tttgtataaatagaat

SEQ ID NO: 290816 - DNA, 16 bp, P. troglodytes
tttgtataatgctatt

SEQ ID NO: 290817 - DNA, 16 bp, P. troglodytes
tttgtatacaaatata

SEQ ID NO: 290818 - DNA, 16 bp, P. troglodytes
tttgtatacccatgtt

SEQ ID NO: 290819 - DNA, 16 bp, P. troglodytes
tttgtatagcttttta

SEQ ID NO: 290820 - DNA, 16 bp, P. troglodytes
tttgtatatacacata

SEQ ID NO: 290821 - DNA, 16 bp, P. troglodytes
tttgtatatgtgtata

SEQ ID NO: 290822 - DNA, 19 bp, P. troglodytes
tttgtatatttagtagaga

SEQ ID NO: 290823 - DNA, 16 bp, P. troglodytes
tttgtatccttcaatc

SEQ ID NO: 290824 - DNA, 16 bp, P. troglodytes
tttgtatctctgtgtc

SEQ ID NO: 290825 - DNA, 16 bp, P. troglodytes
tttgtatctttggtag

SEQ ID NO: 290826 - DNA, 16 bp, P. troglodytes
tttgtatcttttgtag

SEQ ID NO: 290827 - DNA, 16 bp, P. troglodytes
tttgtatgacttgaat

SEQ ID NO: 290828 - DNA, 16 bp, P. troglodytes
tttgtatgatactata

SEQ ID NO: 290829 - DNA, 16 bp, P. troglodytes
tttgtatggtttttca

SEQ ID NO: 290830 - DNA, 16 bp, P. troglodytes
tttgtatgtcatcttt

SEQ ID NO: 290831 - DNA, 16 bp, P. troglodytes
tttgtatgtctgtggg

SEQ ID NO: 290832 - DNA, 19 bp, P. troglodytes
tttgtattattagtagaga

SEQ ID NO: 290833 - DNA, 16 bp, P. troglodytes
tttgtattcttataaa

SEQ ID NO: 290834 - DNA, 16 bp, P. troglodytes
tttgtattctttgacc

SEQ ID NO: 290835 - DNA, 16 bp, P. troglodytes
tttgtatttgtagtaa

SEQ ID NO: 290836 - DNA, 17 bp, P. troglodytes
tttgtattttcaataga

SEQ ID NO: 290837 - DNA, 16 bp, P. troglodytes
tttgtattttcagtaa

SEQ ID NO: 290838 - DNA, 17 bp, P. troglodytes
tttgtattttcagtaga

SEQ ID NO: 290839 - DNA, 19 bp, P. troglodytes
tttgtattttcagtagaga

SEQ ID NO: 290840 - DNA, 16 bp, P. troglodytes
tttgtattttcttaaa

SEQ ID NO: 290841 - DNA, 16 bp, P. troglodytes
tttgtatttttacaaa

SEQ ID NO: 290842 - DNA, 16 bp, P. troglodytes
tttgtatttttcagta

SEQ ID NO: 290843 - DNA, 16 bp, P. troglodytes
tttgtatttttctaga

SEQ ID NO: 290844 - DNA, 16 bp, P. troglodytes
tttgtatttttgtaca

SEQ ID NO: 290845 - DNA, 16 bp, P. troglodytes
tttgtattttttacag

SEQ ID NO: 290846 - DNA, 16 bp, P. troglodytes
tttgtcaaaaagaaaa

SEQ ID NO: 290847 - DNA, 16 bp, P. troglodytes
tttgtcaaaactcata

SEQ ID NO: 290848 - DNA, 16 bp, P. troglodytes
tttgtcaaaagtgagt

SEQ ID NO: 290849 - DNA, 16 bp, P. troglodytes
tttgtcaaaatatttt

SEQ ID NO: 290850 - DNA, 16 bp, P. troglodytes
tttgtcaaaatcagat

SEQ ID NO: 290851 - DNA, 17 bp, P. troglodytes
tttgtcaaagatcagat

SEQ ID NO: 290852 - DNA, 16 bp, P. troglodytes
tttgtcaagatcagat

SEQ ID NO: 290853 - DNA, 16 bp, P. troglodytes
tttgtcaataaagttt

SEQ ID NO: 290854 - DNA, 16 bp, P. troglodytes
tttgtcaatattggct

SEQ ID NO: 290855 - DNA, 16 bp, P. troglodytes
tttgtcaatattttct

SEQ ID NO: 290856 - DNA, 16 bp, P. troglodytes
tttgtcaatgtttgct

SEQ ID NO: 290857 - DNA, 16 bp, P. troglodytes
tttgtcaattaaaaaa

SEQ ID NO: 290858 - DNA, 16 bp, P. troglodytes
tttgtcaattatacct

SEQ ID NO: 290859 - DNA, 16 bp, P. troglodytes
tttgtcaattatatct

SEQ ID NO: 290860 - DNA, 16 bp, P. troglodytes
tttgtcaatttaaaat

SEQ ID NO: 290861 - DNA, 16 bp, P. troglodytes
tttgtcacagttctgg

SEQ ID NO: 290862 - DNA, 16 bp, P. troglodytes
tttgtcacctttgtca

SEQ ID NO: 290863 - DNA, 16 bp, P. troglodytes
tttgtcagaaaaataa

SEQ ID NO: 290864 - DNA, 16 bp, P. troglodytes
tttgtcataaatatct

SEQ ID NO: 290865 - DNA, 16 bp, P. troglodytes
tttgtcatatttgctt

SEQ ID NO: 290866 - DNA, 16 bp, P. troglodytes
tttgtcatctttaaaa

SEQ ID NO: 290867 - DNA, 16 bp, P. troglodytes
tttgtcattgttgttg

SEQ ID NO: 290868 - DNA, 16 bp, P. troglodytes
tttgtccagtgctttt

SEQ ID NO: 290869 - DNA, 16 bp, P. troglodytes
tttgtccatccatcca

SEQ ID NO: 290870 - DNA, 16 bp, P. troglodytes
tttgtccatctcttct

SEQ ID NO: 290871 - DNA, 16 bp, P. troglodytes
tttgtccatttaaaaa

SEQ ID NO: 290872 - DNA, 16 bp, P. troglodytes
tttgtccattttaaaa

SEQ ID NO: 290873 - DNA, 16 bp, P. troglodytes
tttgtcctttaaaaaa

SEQ ID NO: 290874 - DNA, 16 bp, P. troglodytes
tttgtcgcccaggctg

SEQ ID NO: 290875 - DNA, 16 bp, P. troglodytes
tttgtctaattcagaa

SEQ ID NO: 290876 - DNA, 16 bp, P. troglodytes
tttgtctcaataaata

SEQ ID NO: 290877 - DNA, 16 bp, P. troglodytes
tttgtctcattttata

SEQ ID NO: 290878 - DNA, 16 bp, P. troglodytes
tttgtctcccaggctg

SEQ ID NO: 290879 - DNA, 16 bp, P. troglodytes
tttgtctctctgtgct

SEQ ID NO: 290880 - DNA, 16 bp, P. troglodytes
tttgtctcttaatgca

SEQ ID NO: 290881 - DNA, 16 bp, P. troglodytes
tttgtctcttccagaa

SEQ ID NO: 290882 - DNA, 16 bp, P. troglodytes
tttgtctgaaaaagat

SEQ ID NO: 290883 - DNA, 16 bp, P. troglodytes
tttgtctgaagttttt

SEQ ID NO: 290884 - DNA, 16 bp, P. troglodytes
tttgtcttcaaatatt

SEQ ID NO: 290885 - DNA, 16 bp, P. troglodytes
tttgtcttcagtttct

SEQ ID NO: 290886 - DNA, 16 bp, P. troglodytes
tttgtcttgcaaaact

SEQ ID NO: 290887 - DNA, 16 bp, P. troglodytes
tttgtcttgcagcttg

SEQ ID NO: 290888 - DNA, 16 bp, P. troglodytes
tttgtcttgtatccaa

SEQ ID NO: 290889 - DNA, 16 bp, P. troglodytes
tttgtctttcaaaagt

SEQ ID NO: 290890 - DNA, 16 bp, P. troglodytes
tttgtctttctgtgcc

SEQ ID NO: 290891 - DNA, 16 bp, P. troglodytes
tttgtcttttaaaaat

SEQ ID NO: 290892 - DNA, 16 bp, P. troglodytes
tttgtcttttaaaatg

SEQ ID NO: 290893 - DNA, 16 bp, P. troglodytes
tttgtcttttaaaatt

SEQ ID NO: 290894 - DNA, 16 bp, P. troglodytes
tttgtctttttaaaat

SEQ ID NO: 290895 - DNA, 16 bp, P. troglodytes
tttgtctttttaaact

SEQ ID NO: 290896 - DNA, 16 bp, P. troglodytes
tttgtctttttgatag

SEQ ID NO: 290897 - DNA, 16 bp, P. troglodytes
tttgtgaaaattcact

SEQ ID NO: 290898 - DNA, 16 bp, P. troglodytes
tttgtgaaactgcttt

SEQ ID NO: 290899 - DNA, 16 bp, P. troglodytes
tttgtgaaataataaa

SEQ ID NO: 290900 - DNA, 16 bp, P. troglodytes
tttgtgaaatgaaaat

SEQ ID NO: 290901 - DNA, 16 bp, P. troglodytes
tttgtgaaatgtcttt

SEQ ID NO: 290902 - DNA, 16 bp, P. troglodytes
tttgtgaacatatttt

SEQ ID NO: 290903 - DNA, 16 bp, P. troglodytes
tttgtgaagatatttc

SEQ ID NO: 290904 - DNA, 16 bp, P. troglodytes
tttgtgaataaaattt

SEQ ID NO: 290905 - DNA, 16 bp, P. troglodytes
tttgtgaatatataaa

SEQ ID NO: 290906 - DNA, 16 bp, P. troglodytes
tttgtgaatattgaca

SEQ ID NO: 290907 - DNA, 16 bp, P. troglodytes
tttgtgaattaaaaat

SEQ ID NO: 290908 - DNA, 16 bp, P. troglodytes
tttgtgaattgtgctg

SEQ ID NO: 290909 - DNA, 16 bp, P. troglodytes
tttgtgacctgtatct

SEQ ID NO: 290910 - DNA, 16 bp, P. troglodytes
tttgtgactttttaaa

SEQ ID NO: 290911 - DNA, 16 bp, P. troglodytes
tttgtgagcactttga

SEQ ID NO: 290912 - DNA, 16 bp, P. troglodytes
tttgtgaggaaaaaaa

SEQ ID NO: 290913 - DNA, 16 bp, P. troglodytes
tttgtgaggaaaaaat

SEQ ID NO: 290914 - DNA, 16 bp, P. troglodytes
tttgtgagtttttaaa

SEQ ID NO: 290915 - DNA, 16 bp, P. troglodytes
tttgtgatcagcctgg

SEQ ID NO: 290916 - DNA, 16 bp, P. troglodytes
tttgtgcacacacaca

SEQ ID NO: 290917 - DNA, 16 bp, P. troglodytes
tttgtgcatatatata

SEQ ID NO: 290918 - DNA, 16 bp, P. troglodytes
tttgtgcatcttcttt

SEQ ID NO: 290919 - DNA, 16 bp, P. troglodytes
tttgtgcatgtgtgtg

SEQ ID NO: 290920 - DNA, 16 bp, P. troglodytes
tttgtgccatctatga

SEQ ID NO: 290921 - DNA, 16 bp, P. troglodytes
tttgtgcctcaatttc

SEQ ID NO: 290922 - DNA, 16 bp, P. troglodytes
tttgtgctatgaattt

SEQ ID NO: 290923 - DNA, 16 bp, P. troglodytes
tttgtgctgggaacat

SEQ ID NO: 290924 - DNA, 16 bp, P. troglodytes
tttgtgcttccaaatc

SEQ ID NO: 290925 - DNA, 16 bp, P. troglodytes
tttgtgcttttaaaaa

SEQ ID NO: 290926 - DNA, 16 bp, P. troglodytes
tttgtggaaaggtttt

SEQ ID NO: 290927 - DNA, 16 bp, P. troglodytes
tttgtggaagaaaatt

SEQ ID NO: 290928 - DNA, 16 bp, P. troglodytes
tttgtggaagattttt

SEQ ID NO: 290929 - DNA, 16 bp, P. troglodytes
tttgtggaatctttag

SEQ ID NO: 290930 - DNA, 16 bp, P. troglodytes
tttgtggacatgtttt

SEQ ID NO: 290931 - DNA, 16 bp, P. troglodytes
tttgtggatgaggaaa

SEQ ID NO: 290932 - DNA, 16 bp, P. troglodytes
tttgtggctattataa

SEQ ID NO: 290933 - DNA, 16 bp, P. troglodytes
tttgtgggaaggtttt

SEQ ID NO: 290934 - DNA, 16 bp, P. troglodytes
tttgtgggactgttgg

SEQ ID NO: 290935 - DNA, 16 bp, P. troglodytes
tttgtggggaaaaaaa

SEQ ID NO: 290936 - DNA, 16 bp, P. troglodytes
tttgtggtagcaggtg

SEQ ID NO: 290937 - DNA, 16 bp, P. troglodytes
tttgtggtgatggaaa

SEQ ID NO: 290938 - DNA, 16 bp, P. troglodytes
tttgtggtgcagaagc

SEQ ID NO: 290939 - DNA, 16 bp, P. troglodytes
tttgtggtttaagaat

SEQ ID NO: 290940 - DNA, 16 bp, P. troglodytes
tttgtggtttcatatg

SEQ ID NO: 290941 - DNA, 16 bp, P. troglodytes
tttgtggttttcagtg

SEQ ID NO: 290942 - DNA, 16 bp, P. troglodytes
tttgtgtaaatatgtt

SEQ ID NO: 290943 - DNA, 16 bp, P. troglodytes
tttgtgtacattttat

SEQ ID NO: 290944 - DNA, 16 bp, P. troglodytes
tttgtgtacgtgtgtg

SEQ ID NO: 290945 - DNA, 16 bp, P. troglodytes
tttgtgtatagaaatg

SEQ ID NO: 290946 - DNA, 16 bp, P. troglodytes
tttgtgtatccattca

SEQ ID NO: 290947 - DNA, 16 bp, P. troglodytes
tttgtgtatctaaaca

SEQ ID NO: 290948 - DNA, 16 bp, P. troglodytes
tttgtgtatcttttca

SEQ ID NO: 290949 - DNA, 16 bp, P. troglodytes
tttgtgtatgtgtctg

SEQ ID NO: 290950 - DNA, 16 bp, P. troglodytes
tttgtgtatgtttaaa

SEQ ID NO: 290951 - DNA, 16 bp, P. troglodytes
tttgtgtcataatctt

SEQ ID NO: 290952 - DNA, 16 bp, P. troglodytes
tttgtgtccatactct

SEQ ID NO: 290953 - DNA, 47 bp, P. troglodytes; identical to SEQ ID NO: 174387

SEQ ID NO: 290954 - DNA, 16 bp, P. troglodytes
tttgtgtcctttctta

SEQ ID NO: 290955 - DNA, 16 bp, P. troglodytes
tttgtgtctctgtctc

SEQ ID NO: 290956 - DNA, 16 bp, P. troglodytes
tttgtgtctctgtgtc

SEQ ID NO: 290957 - DNA, 16 bp, P. troglodytes
tttgtgtctggcatct

SEQ ID NO: 290958 - DNA, 16 bp, P. troglodytes
tttgtgtctgtgtgta

SEQ ID NO: 290959 - DNA, 16 bp, P. troglodytes
tttgtgtctgtgttca

SEQ ID NO: 290960 - DNA, 16 bp, P. troglodytes
tttgtgtcttctctca

SEQ ID NO: 290961 - DNA, 16 bp, P. troglodytes
tttgtgtcttggagtt

SEQ ID NO: 290962 - DNA, 16 bp, P. troglodytes
tttgtgtcttttaaat

SEQ ID NO: 290963 - DNA, 16 bp, P. troglodytes
tttgtgtctttttaaa

SEQ ID NO: 290964 - DNA, 16 bp, P. troglodytes
tttgtgtgcatgtatg

SEQ ID NO: 290965 - DNA, 16 bp, P. troglodytes
tttgtgtgtctaaaca

SEQ ID NO: 290966 - DNA, 16 bp, P. troglodytes
tttgtgtgtgtagagg

SEQ ID NO: 290967 - DNA, 16 bp, P. troglodytes
tttgtgtgtgtgcatg

SEQ ID NO: 290968 - DNA, 16 bp, P. troglodytes
tttgtgtgtgtggaaa

SEQ ID NO: 290969 - DNA, 16 bp, P. troglodytes
tttgtgtgtgttttca

SEQ ID NO: 290970 - DNA, 16 bp, P. troglodytes
tttgtgttatctgtga

SEQ ID NO: 290971 - DNA, 16 bp, P. troglodytes
tttgtgttcctccaaa

SEQ ID NO: 290972 - DNA, 16 bp, P. troglodytes
tttgtgttgagaacat

SEQ ID NO: 290973 - DNA, 16 bp, P. troglodytes
tttgtgttgctataaa

SEQ ID NO: 290974 - DNA, 16 bp, P. troglodytes
tttgtgttgggcctca

SEQ ID NO: 290975 - DNA, 16 bp, P. troglodytes
tttgtgttgtttccac

SEQ ID NO: 290976 - DNA, 16 bp, P. troglodytes
tttgtgtttgagacag

SEQ ID NO: 290977 - DNA, 16 bp, P. troglodytes
tttgtgttttaaaaaa

SEQ ID NO: 290978 - DNA, 16 bp, P. troglodytes
tttgttaaaaggaaaa

SEQ ID NO: 290979 - DNA, 16 bp, P. troglodytes
tttgttaaacaaatga

SEQ ID NO: 290980 - DNA, 16 bp, P. troglodytes
tttgttaaataaaatg

SEQ ID NO: 290981 - DNA, 16 bp, P. troglodytes
tttgttacacagcagt

SEQ ID NO: 290982 - DNA, 16 bp, P. troglodytes
tttgttacaggaaagg

SEQ ID NO: 290983 - DNA, 16 bp, P. troglodytes
tttgttacagtagcca

SEQ ID NO: 290984 - DNA, 19 bp, P. troglodytes
tttgttacataggtaaaca

SEQ ID NO: 290985 - DNA, 16 bp, P. troglodytes
tttgttacatggatat

SEQ ID NO: 290986 - DNA, 16 bp, P. troglodytes
tttgttacatgtatag

SEQ ID NO: 290987 - DNA, 16 bp, P. troglodytes
tttgttacctctgtgg

SEQ ID NO: 290988 - DNA, 16 bp, P. troglodytes
tttgttactgcagcat

SEQ ID NO: 290989 - DNA, 16 bp, P. troglodytes
tttgttatagcagctt

SEQ ID NO: 290990 - DNA, 16 bp, P. troglodytes
tttgttattagaaaaa

SEQ ID NO: 290991 - DNA, 16 bp, P. troglodytes
tttgttattatttcag

SEQ ID NO: 290992 - DNA, 16 bp, P. troglodytes
tttgttcactcattta

SEQ ID NO: 290993 - DNA, 16 bp, P. troglodytes
tttgttcactttttaa

SEQ ID NO: 290994 - DNA, 16 bp, P. troglodytes
tttgttcaggctggtc

SEQ ID NO: 290995 - DNA, 16 bp, P. troglodytes
tttgttcagggctcag

SEQ ID NO: 290996 - DNA, 16 bp, P. troglodytes
tttgttcattcactca

SEQ ID NO: 290997 - DNA, 16 bp, P. troglodytes
tttgttcattttcaaa

SEQ ID NO: 290998 - DNA, 16 bp, P. troglodytes
tttgttcatttttaaa

SEQ ID NO: 290999 - DNA, 16 bp, P. troglodytes
tttgttccactgctgg

SEQ ID NO: 291000 - DNA, 16 bp, P. troglodytes
tttgttcccagtttca

SEQ ID NO: 291001 - DNA, 16 bp, P. troglodytes
tttgttccttcagatg

SEQ ID NO: 291002 - DNA, 16 bp, P. troglodytes
tttgttcctttaaaaa

SEQ ID NO: 291003 - DNA, 16 bp, P. troglodytes
tttgttctacttgggt

SEQ ID NO: 291004 - DNA, 16 bp, P. troglodytes
tttgttctattaaggc

SEQ ID NO: 291005 - DNA, 16 bp, P. troglodytes
tttgttctcattactt

SEQ ID NO: 291006 - DNA, 16 bp, P. troglodytes
tttgttctctcacagt

SEQ ID NO: 291007 - DNA, 16 bp, P. troglodytes
tttgttctctttgaag

SEQ ID NO: 291008 - DNA, 16 bp, P. troglodytes
tttgttctgttaatgt

SEQ ID NO: 291009 - DNA, 16 bp, P. troglodytes
tttgttcttaaaaata

SEQ ID NO: 291010 - DNA, 16 bp, P. troglodytes
tttgttctttaaaaaa

SEQ ID NO: 291011 - DNA, 16 bp, P. troglodytes
tttgttgaaaaaaatt

SEQ ID NO: 291012 - DNA, 16 bp, P. troglodytes
tttgttgaaaaaatga

SEQ ID NO: 291013 - DNA, 16 bp, P. troglodytes
tttgttgaaaacaaaa

SEQ ID NO: 291014 - DNA, 16 bp, P. troglodytes
tttgttgaaagaaaaa

SEQ ID NO: 291015 - DNA, 16 bp, P. troglodytes
tttgttgaaattctca

SEQ ID NO: 291016 - DNA, 16 bp, P. troglodytes
tttgttgaaattgctt

SEQ ID NO: 291017 - DNA, 16 bp, P. troglodytes
tttgttgaagaaaaaa

SEQ ID NO: 291018 - DNA, 16 bp, P. troglodytes
tttgttgaagaaacca

SEQ ID NO: 291019 - DNA, 16 bp, P. troglodytes
tttgttgaagatcaat

SEQ ID NO: 291020 - DNA, 16 bp, P. troglodytes
tttgttgaagttgctt

SEQ ID NO: 291021 - DNA, 16 bp, P. troglodytes
tttgttgaatgaaaaa

SEQ ID NO: 291022 - DNA, 16 bp, P. troglodytes
tttgttgaatgaataa

SEQ ID NO: 291023 - DNA, 16 bp, P. troglodytes
tttgttgaatgaatgc

SEQ ID NO: 291024 - DNA, 16 bp, P. troglodytes
tttgttgaatgactga

SEQ ID NO: 291025 - DNA, 16 bp, P. troglodytes
tttgttgagaattgtt

SEQ ID NO: 291026 - DNA, 16 bp, P. troglodytes
tttgttgcaattgttt

SEQ ID NO: 291027 - DNA, 16 bp, P. troglodytes
tttgttgcagttgttt

SEQ ID NO: 291028 - DNA, 16 bp, P. troglodytes
tttgttgccagtgctt

SEQ ID NO: 291029 - DNA, 16 bp, P. troglodytes
tttgttgcccaagctg

SEQ ID NO: 291030 - DNA, 16 bp, P. troglodytes
tttgttgcccaggctg

SEQ ID NO: 291031 - DNA, 16 bp, P. troglodytes
tttgttgcctgtattt

SEQ ID NO: 291032 - DNA, 16 bp, P. troglodytes
tttgttgctattgtta

SEQ ID NO: 291033 - DNA, 16 bp, P. troglodytes
tttgttgctgctgctg

SEQ ID NO: 291034 - DNA, 16 bp, P. troglodytes
tttgttgcttagaaat

SEQ ID NO: 291035 - DNA, 16 bp, P. troglodytes
tttgttggcatacagt

SEQ ID NO: 291036 - DNA, 16 bp, P. troglodytes
tttgttggctacttgt

SEQ ID NO: 291037 - DNA, 16 bp, P. troglodytes
tttgttgtatatggct

SEQ ID NO: 291038 - DNA, 16 bp, P. troglodytes
tttgttgtccaggctg

SEQ ID NO: 291039 - DNA, 22 bp, P. troglodytes
tttgttgtcccctgcttgagga

SEQ ID NO: 291040 - DNA, 16 bp, P. troglodytes
tttgttgttaaaaaaa

SEQ ID NO: 291041 - DNA, 16 bp, P. troglodytes
tttgtttaaaaaaaac

SEQ ID NO: 291042 - DNA, 16 bp, P. troglodytes
tttgtttaaaaagtaa

SEQ ID NO: 291043 - DNA, 16 bp, P. troglodytes
tttgtttaaaaatgaa

SEQ ID NO: 291044 - DNA, 16 bp, P. troglodytes
tttgtttaaaacaaaa

SEQ ID NO: 291045 - DNA, 16 bp, P. troglodytes
tttgtttaactttaaa

SEQ ID NO: 291046 - DNA, 16 bp, P. troglodytes
tttgtttaagttcttg

SEQ ID NO: 291047 - DNA, 16 bp, P. troglodytes
tttgtttaatgaatga

SEQ ID NO: 291048 - DNA, 16 bp, P. troglodytes
tttgtttacacatttt

SEQ ID NO: 291049 - DNA, 16 bp, P. troglodytes
tttgtttacactgtga

SEQ ID NO: 291050 - DNA, 16 bp, P. troglodytes
tttgtttacatgttta

SEQ ID NO: 291051 - DNA, 16 bp, P. troglodytes
tttgtttacattaaaa

SEQ ID NO: 291052 - DNA, 16 bp, P. troglodytes
tttgtttatccattca

SEQ ID NO: 291053 - DNA, 16 bp, P. troglodytes
tttgtttattcaacaa

SEQ ID NO: 291054 - DNA, 16 bp, P. troglodytes
tttgtttattcattca

SEQ ID NO: 291055 - DNA, 16 bp, P. troglodytes
tttgtttattgattca

SEQ ID NO: 291056 - DNA, 16 bp, P. troglodytes
tttgtttatttaaaca

SEQ ID NO: 291057 - DNA, 16 bp, P. troglodytes
tttgtttatttctaaa

SEQ ID NO: 291058 - DNA, 16 bp, P. troglodytes
tttgtttcaaaagaaa

SEQ ID NO: 291059 - DNA, 16 bp, P. troglodytes
tttgtttcaaagaatt

SEQ ID NO: 291060 - DNA, 16 bp, P. troglodytes
tttgtttcaaataaaa

SEQ ID NO: 291061 - DNA, 16 bp, P. troglodytes
tttgtttcaagatatt

SEQ ID NO: 291062 - DNA, 16 bp, P. troglodytes
tttgtttcagagacag

SEQ ID NO: 291063 - DNA, 16 bp, P. troglodytes
tttgtttcattaaaaa

SEQ ID NO: 291064 - DNA, 16 bp, P. troglodytes
tttgtttcattgatct

SEQ ID NO: 291065 - DNA, 16 bp, P. troglodytes
tttgtttccagaaatt

SEQ ID NO: 291066 - DNA, 16 bp, P. troglodytes
tttgtttccaggaatt

SEQ ID NO: 291067 - DNA, 16 bp, P. troglodytes
tttgtttcccatctct

SEQ ID NO: 291068 - DNA, 16 bp, P. troglodytes
tttgtttcctctgact

SEQ ID NO: 291069 - DNA, 16 bp, P. troglodytes
tttgtttcctttggat

SEQ ID NO: 291070 - DNA, 16 bp, P. troglodytes
tttgtttctatttcaa

SEQ ID NO: 291071 - DNA, 16 bp, P. troglodytes
tttgtttctcagttct

SEQ ID NO: 291072 - DNA, 16 bp, P. troglodytes
tttgtttctccattta

SEQ ID NO: 291073 - DNA, 16 bp, P. troglodytes
tttgtttctccccctg

SEQ ID NO: 291074 - DNA, 16 bp, P. troglodytes
tttgtttctctttgaa

SEQ ID NO: 291075 - DNA, 16 bp, P. troglodytes
tttgtttctgaaattt

SEQ ID NO: 291076 - DNA, 16 bp, P. troglodytes
tttgtttctggaattt

SEQ ID NO: 291077 - DNA, 16 bp, P. troglodytes
tttgtttcttgtaaat

SEQ ID NO: 291078 - DNA, 16 bp, P. troglodytes
tttgtttctttaaaat

SEQ ID NO: 291079 - DNA, 16 bp, P. troglodytes
tttgtttctttgaaat

SEQ ID NO: 291080 - DNA, 16 bp, P. troglodytes
tttgtttgaaaatgtt

SEQ ID NO: 291081 - DNA, 16 bp, P. troglodytes
tttgtttgaatacctg

SEQ ID NO: 291082 - DNA, 16 bp, P. troglodytes
tttgtttgtccattca

SEQ ID NO: 291083 - DNA, 16 bp, P. troglodytes
tttgtttgtgccatct

SEQ ID NO: 291084 - DNA, 16 bp, P. troglodytes
tttgtttgttggagac

SEQ ID NO: 291085 - DNA, 16 bp, P. troglodytes
tttgttttaaaaagca

SEQ ID NO: 291086 - DNA, 16 bp, P. troglodytes
tttgttttaaaatcat

SEQ ID NO: 291087 - DNA, 16 bp, P. troglodytes
tttgttttaaagcaaa

SEQ ID NO: 291088 - DNA, 16 bp, P. troglodytes
tttgttttaaaggaaa

SEQ ID NO: 291089 - DNA, 16 bp, P. troglodytes
tttgttttaaatgtgg

SEQ ID NO: 291090 - DNA, 16 bp, P. troglodytes
tttgttttaaattctg

SEQ ID NO: 291091 - DNA, 16 bp, P. troglodytes
tttgttttaattgaca

SEQ ID NO: 291092 - DNA, 16 bp, P. troglodytes
tttgttttcaaaatat

SEQ ID NO: 291093 - DNA, 16 bp, P. troglodytes
tttgttttcagtctat

SEQ ID NO: 291094 - DNA, 16 bp, P. troglodytes
tttgttttcattaaat

SEQ ID NO: 291095 - DNA, 16 bp, P. troglodytes
tttgttttcattcagt

SEQ ID NO: 291096 - DNA, 16 bp, P. troglodytes
tttgttttccatttac

SEQ ID NO: 291097 - DNA, 16 bp, P. troglodytes
tttgttttccccaaaa

SEQ ID NO: 291098 - DNA, 16 bp, P. troglodytes
tttgttttccttaaat

SEQ ID NO: 291099 - DNA, 16 bp, P. troglodytes
tttgttttccttcata

SEQ ID NO: 291100 - DNA, 16 bp, P. troglodytes
tttgttttcctttgaa

SEQ ID NO: 291101 - DNA, 16 bp, P. troglodytes
tttgttttctaaaata

SEQ ID NO: 291102 - DNA, 16 bp, P. troglodytes
tttgttttctaaattg

SEQ ID NO: 291103 - DNA, 16 bp, P. troglodytes
tttgttttctcatctg

SEQ ID NO: 291104 - DNA, 16 bp, P. troglodytes
tttgttttctcattaa

SEQ ID NO: 291105 - DNA, 16 bp, P. troglodytes
tttgttttcttaaaat

SEQ ID NO: 291106 - DNA, 16 bp, P. troglodytes
tttgttttcttacaaa

SEQ ID NO: 291107 - DNA, 16 bp, P. troglodytes
tttgttttcttctcaa

SEQ ID NO: 291108 - DNA, 16 bp, P. troglodytes
tttgttttcttgaaaa

SEQ ID NO: 291109 - DNA, 16 bp, P. troglodytes
tttgttttggccaaat

SEQ ID NO: 291110 - DNA, 16 bp, P. troglodytes
tttgttttgtgagaca

SEQ ID NO: 291111 - DNA, 16 bp, P. troglodytes
tttgttttgttgctca

SEQ ID NO: 291112 - DNA, 16 bp, P. troglodytes
tttgttttgtttcaag

SEQ ID NO: 291113 - DNA, 16 bp, P. troglodytes
tttgtttttaaaaatc

SEQ ID NO: 291114 - DNA, 16 bp, P. troglodytes
tttgtttttaaaacag

SEQ ID NO: 291115 - DNA, 16 bp, P. troglodytes
tttgtttttaaaactc

SEQ ID NO: 291116 - DNA, 16 bp, P. troglodytes
tttgtttttaaacaaa

SEQ ID NO: 291117 - DNA, 16 bp, P. troglodytes
tttgtttttaaacaag

SEQ ID NO: 291118 - DNA, 16 bp, P. troglodytes
tttgtttttaaactgt

SEQ ID NO: 291119 - DNA, 16 bp, P. troglodytes
tttgtttttaaagaaa

SEQ ID NO: 291120 - DNA, 16 bp, P. troglodytes
tttgtttttaaagact

SEQ ID NO: 291121 - DNA, 16 bp, P. troglodytes
tttgtttttaaagtga

SEQ ID NO: 291122 - DNA, 16 bp, P. troglodytes
tttgtttttaaatctg

SEQ ID NO: 291123 - DNA, 16 bp, P. troglodytes
tttgtttttaacaaaa

SEQ ID NO: 291124 - DNA, 16 bp, P. troglodytes
tttgtttttaaccaaa

SEQ ID NO: 291125 - DNA, 16 bp, P. troglodytes
tttgtttttaagaaaa

SEQ ID NO: 291126 - DNA, 16 bp, P. troglodytes
tttgtttttaagacag

SEQ ID NO: 291127 - DNA, 16 bp, P. troglodytes
tttgtttttacaaaat

SEQ ID NO: 291128 - DNA, 16 bp, P. troglodytes
tttgtttttatggctg

SEQ ID NO: 291129 - DNA, 16 bp, P. troglodytes
tttgtttttatgtcag

SEQ ID NO: 291130 - DNA, 16 bp, P. troglodytes
tttgtttttattcaaa

SEQ ID NO: 291131 - DNA, 16 bp, P. troglodytes
tttgtttttcaaaatt

SEQ ID NO: 291132 - DNA, 16 bp, P. troglodytes
tttgtttttcagaaat

SEQ ID NO: 291133 - DNA, 16 bp, P. troglodytes
tttgtttttcagagcc

SEQ ID NO: 291134 - DNA, 16 bp, P. troglodytes
tttgtttttccaaaaa

SEQ ID NO: 291135 - DNA, 16 bp, P. troglodytes
tttgtttttccccaaa

SEQ ID NO: 291136 - DNA, 16 bp, P. troglodytes
tttgtttttcctgaag

SEQ ID NO: 291137 - DNA, 16 bp, P. troglodytes
tttgtttttctaaaat

SEQ ID NO: 291138 - DNA, 16 bp, P. troglodytes
tttgtttttctgagac

SEQ ID NO: 291139 - DNA, 16 bp, P. troglodytes
tttgtttttctgagag

SEQ ID NO: 291140 - DNA, 16 bp, P. troglodytes
tttgtttttctggaaa

SEQ ID NO: 291141 - DNA, 16 bp, P. troglodytes
tttgtttttcttaaac

SEQ ID NO: 291142 - DNA, 16 bp, P. troglodytes
tttgtttttgaaaaag

SEQ ID NO: 291143 - DNA, 16 bp, P. troglodytes
tttgtttttgaaacag

SEQ ID NO: 291144 - DNA, 16 bp, P. troglodytes
tttgtttttgacacag

SEQ ID NO: 291145 - DNA, 17 bp, P. troglodytes
tttgtttttgagacaag

SEQ ID NO: 291146 - DNA, 16 bp, P. troglodytes
tttgtttttgagacag

SEQ ID NO: 291147 - DNA, 16 bp, P. troglodytes
tttgtttttgagatag

SEQ ID NO: 291148 - DNA, 16 bp, P. troglodytes
tttgtttttgtggcaa

SEQ ID NO: 291149 - DNA, 16 bp, P. troglodytes
tttgttttttaacagt

SEQ ID NO: 291150 - DNA, 16 bp, P. troglodytes
tttgttttttaatcaa

SEQ ID NO: 291151 - DNA, 16 bp, P. troglodytes
tttgttttttagagac

SEQ ID NO: 291152 - DNA, 16 bp, P. troglodytes
tttgttttttcacagt

SEQ ID NO: 291153 - DNA, 16 bp, P. troglodytes
tttgttttttcagatg

SEQ ID NO: 291154 - DNA, 16 bp, P. troglodytes
tttgttttttccaaga

SEQ ID NO: 291155 - DNA, 16 bp, P. troglodytes
tttgttttttgaaatc

SEQ ID NO: 291156 - DNA, 16 bp, P. troglodytes
tttgtttttttaaaca

SEQ ID NO: 291157 - DNA, 16 bp, P. troglodytes
tttgtttttttaacaa

SEQ ID NO: 291158 - DNA, 16 bp, P. troglodytes
ttttaaaaaaaagttg

SEQ ID NO: 291159 - DNA, 16 bp, P. troglodytes
ttttaaaaaaacctat

SEQ ID NO: 291160 - DNA, 16 bp, P. troglodytes
ttttaaaaaaactttg

SEQ ID NO: 291161 - DNA, 16 bp, P. troglodytes
ttttaaaaaaagatcc

SEQ ID NO: 291162 - DNA, 16 bp, P. troglodytes
ttttaaaaaaagcaac

SEQ ID NO: 291163 - DNA, 16 bp, P. troglodytes
ttttaaaaaaagtact

SEQ ID NO: 291164 - DNA, 16 bp, P. troglodytes
ttttaaaaaaatacag

SEQ ID NO: 291165 - DNA, 16 bp, P. troglodytes
ttttaaaaaaatcaga

SEQ ID NO: 291166 - DNA, 16 bp, P. troglodytes
ttttaaaaaaatctca

SEQ ID NO: 291167 - DNA, 16 bp, P. troglodytes
ttttaaaaaaatgaca

SEQ ID NO: 291168 - DNA, 16 bp, P. troglodytes
ttttaaaaaaatgttg

SEQ ID NO: 291169 - DNA, 16 bp, P. troglodytes
ttttaaaaaacacatt

SEQ ID NO: 291170 - DNA, 16 bp, P. troglodytes
ttttaaaaaacacttt

SEQ ID NO: 291171 - DNA, 16 bp, P. troglodytes
ttttaaaaaacagata

SEQ ID NO: 291172 - DNA, 16 bp, P. troglodytes
ttttaaaaaacagctg

SEQ ID NO: 291173 - DNA, 16 bp, P. troglodytes
ttttaaaaaaccaaga

SEQ ID NO: 291174 - DNA, 16 bp, P. troglodytes
ttttaaaaaaccattt

SEQ ID NO: 291175 - DNA, 16 bp, P. troglodytes
ttttaaaaaactagaa

SEQ ID NO: 291176 - DNA, 16 bp, P. troglodytes
ttttaaaaaactgtca

SEQ ID NO: 291177 - DNA, 16 bp, P. troglodytes
ttttaaaaaagaaaca

SEQ ID NO: 291178 - DNA, 16 bp, P. troglodytes
ttttaaaaaagacaag

SEQ ID NO: 291179 - DNA, 16 bp, P. troglodytes
ttttaaaaaagacttt

SEQ ID NO: 291180 - DNA, 16 bp, P. troglodytes
ttttaaaaaagatcat

SEQ ID NO: 291181 - DNA, 16 bp, P. troglodytes
ttttaaaaaagcaatt

SEQ ID NO: 291182 - DNA, 16 bp, P. troglodytes
ttttaaaaaagcactg

SEQ ID NO: 291183 - DNA, 16 bp, P. troglodytes
ttttaaaaaagcattt

SEQ ID NO: 291184 - DNA, 16 bp, P. troglodytes
ttttaaaaaagcttat

SEQ ID NO: 291185 - DNA, 16 bp, P. troglodytes
ttttaaaaaaggaatt

SEQ ID NO: 291186 - DNA, 16 bp, P. troglodytes
ttttaaaaaaggattt

SEQ ID NO: 291187 - DNA, 16 bp, P. troglodytes
ttttaaaaaaggcaaa

SEQ ID NO: 291188 - DNA, 16 bp, P. troglodytes
ttttaaaaaagtgtat

SEQ ID NO: 291189 - DNA, 16 bp, P. troglodytes
ttttaaaaaataccca

SEQ ID NO: 291190 - DNA, 16 bp, P. troglodytes
ttttaaaaaatcacct

SEQ ID NO: 291191 - DNA, 16 bp, P. troglodytes
ttttaaaaaatcatca

SEQ ID NO: 291192 - DNA, 16 bp, P. troglodytes
ttttaaaaaatcatga

SEQ ID NO: 291193 - DNA, 16 bp, P. troglodytes
ttttaaaaaatctcaa

SEQ ID NO: 291194 - DNA, 16 bp, P. troglodytes
ttttaaaaaatgaaac

SEQ ID NO: 291195 - DNA, 16 bp, P. troglodytes
ttttaaaaaatgaact

SEQ ID NO: 291196 - DNA, 16 bp, P. troglodytes
ttttaaaaaatgacag

SEQ ID NO: 291197 - DNA, 16 bp, P. troglodytes
ttttaaaaaatgactt

SEQ ID NO: 291198 - DNA, 16 bp, P. troglodytes
ttttaaaaaatgagat

SEQ ID NO: 291199 - DNA, 16 bp, P. troglodytes
ttttaaaaaatgatca

SEQ ID NO: 291200 - DNA, 16 bp, P. troglodytes
ttttaaaaaatgtatc

SEQ ID NO: 291201 - DNA, 16 bp, P. troglodytes
ttttaaaaaatgtgta

SEQ ID NO: 291202 - DNA, 16 bp, P. troglodytes
ttttaaaaaatgtgtg

SEQ ID NO: 291203 - DNA, 16 bp, P. troglodytes
ttttaaaaaatgttca

SEQ ID NO: 291204 - DNA, 16 bp, P. troglodytes
ttttaaaaaatgtttg

SEQ ID NO: 291205 - DNA, 16 bp, P. troglodytes
ttttaaaaaattctct

SEQ ID NO: 291206 - DNA, 16 bp, P. troglodytes
ttttaaaaaattctgg

SEQ ID NO: 291207 - DNA, 16 bp, P. troglodytes
ttttaaaaaatttgct

SEQ ID NO: 291208 - DNA, 16 bp, P. troglodytes
ttttaaaaacaaatct

SEQ ID NO: 291209 - DNA, 16 bp, P. troglodytes
ttttaaaaacaaatga

SEQ ID NO: 291210 - DNA, 16 bp, P. troglodytes
ttttaaaaacaatgtt

SEQ ID NO: 291211 - DNA, 16 bp, P. troglodytes
ttttaaaaacagtatt

SEQ ID NO: 291212 - DNA, 16 bp, P. troglodytes
ttttaaaaacagtgaa

SEQ ID NO: 291213 - DNA, 16 bp, P. troglodytes
ttttaaaaacagttat

SEQ ID NO: 291214 - DNA, 16 bp, P. troglodytes
ttttaaaaacatggat

SEQ ID NO: 291215 - DNA, 16 bp, P. troglodytes
ttttaaaaaccatttc

SEQ ID NO: 291216 - DNA, 16 bp, P. troglodytes
ttttaaaaacctgaaa

SEQ ID NO: 291217 - DNA, 16 bp, P. troglodytes
ttttaaaaacctttat

SEQ ID NO: 291218 - DNA, 16 bp, P. troglodytes
ttttaaaaacctttca

SEQ ID NO: 291219 - DNA, 16 bp, P. troglodytes
ttttaaaaactgaatt

SEQ ID NO: 291220 - DNA, 16 bp, P. troglodytes
ttttaaaaactgattt

SEQ ID NO: 291221 - DNA, 16 bp, P. troglodytes
ttttaaaaactgcttt

SEQ ID NO: 291222 - DNA, 16 bp, P. troglodytes
ttttaaaaactggaaa

SEQ ID NO: 291223 - DNA, 16 bp, P. troglodytes
ttttaaaaactgtttt

SEQ ID NO: 291224 - DNA, 16 bp, P. troglodytes
ttttaaaaacttgttt

SEQ ID NO: 291225 - DNA, 16 bp, P. troglodytes
ttttaaaaactttcat

SEQ ID NO: 291226 - DNA, 16 bp, P. troglodytes
ttttaaaaactttgta

SEQ ID NO: 291227 - DNA, 16 bp, P. troglodytes
ttttaaaaagaaaaca

SEQ ID NO: 291228 - DNA, 16 bp, P. troglodytes
ttttaaaaagaaacaa

SEQ ID NO: 291229 - DNA, 16 bp, P. troglodytes
ttttaaaaagaactta

SEQ ID NO: 291230 - DNA, 16 bp, P. troglodytes
ttttaaaaagaagatg

SEQ ID NO: 291231 - DNA, 16 bp, P. troglodytes
ttttaaaaagaagcca

SEQ ID NO: 291232 - DNA, 16 bp, P. troglodytes
ttttaaaaagacaagg

SEQ ID NO: 291233 - DNA, 16 bp, P. troglodytes
ttttaaaaagactttt

SEQ ID NO: 291234 - DNA, 16 bp, P. troglodytes
ttttaaaaagagaagt

SEQ ID NO: 291235 - DNA, 16 bp, P. troglodytes
ttttaaaaagcaaagt

SEQ ID NO: 291236 - DNA, 16 bp, P. troglodytes
ttttaaaaagcaaata

SEQ ID NO: 291237 - DNA, 16 bp, P. troglodytes
ttttaaaaagcaagag

SEQ ID NO: 291238 - DNA, 16 bp, P. troglodytes
ttttaaaaagcaagtt

SEQ ID NO: 291239 - DNA, 16 bp, P. troglodytes
ttttaaaaagcaatca

SEQ ID NO: 291240 - DNA, 16 bp, P. troglodytes
ttttaaaaagcaggca

SEQ ID NO: 291241 - DNA, 16 bp, P. troglodytes
ttttaaaaagcatcat

SEQ ID NO: 291242 - DNA, 16 bp, P. troglodytes
ttttaaaaagccaaag

SEQ ID NO: 291243 - DNA, 16 bp, P. troglodytes
ttttaaaaagctcatt

SEQ ID NO: 291244 - DNA, 16 bp, P. troglodytes
ttttaaaaagctttgt

SEQ ID NO: 291245 - DNA, 16 bp, P. troglodytes
ttttaaaaaggaatgt

SEQ ID NO: 291246 - DNA, 16 bp, P. troglodytes
ttttaaaaaggcaaaa

SEQ ID NO: 291247 - DNA, 16 bp, P. troglodytes
ttttaaaaagggaaag

SEQ ID NO: 291248 - DNA, 16 bp, P. troglodytes
ttttaaaaaggtgaaa

SEQ ID NO: 291249 - DNA, 16 bp, P. troglodytes
ttttaaaaagtacatt

SEQ ID NO: 291250 - DNA, 16 bp, P. troglodytes
ttttaaaaagtgataa

SEQ ID NO: 291251 - DNA, 16 bp, P. troglodytes
ttttaaaaagtgattt

SEQ ID NO: 291252 - DNA, 16 bp, P. troglodytes
ttttaaaaagtgtaat

SEQ ID NO: 291253 - DNA, 16 bp, P. troglodytes
ttttaaaaagtgttta

SEQ ID NO: 291254 - DNA, 16 bp, P. troglodytes
ttttaaaaagttatcc

SEQ ID NO: 291255 - DNA, 16 bp, P. troglodytes
ttttaaaaagttcttg

SEQ ID NO: 291256 - DNA, 16 bp, P. troglodytes
ttttaaaaataactca

SEQ ID NO: 291257 - DNA, 16 bp, P. troglodytes
ttttaaaaataactgc

SEQ ID NO: 291258 - DNA, 16 bp, P. troglodytes
ttttaaaaataacttc

SEQ ID NO: 291259 - DNA, 16 bp, P. troglodytes
ttttaaaaataacttg

SEQ ID NO: 291260 - DNA, 16 bp, P. troglodytes
ttttaaaaataagctt

SEQ ID NO: 291261 - DNA, 16 bp, P. troglodytes
ttttaaaaataattgg

SEQ ID NO: 291262 - DNA, 16 bp, P. troglodytes
ttttaaaaatacagaa

SEQ ID NO: 291263 - DNA, 16 bp, P. troglodytes
ttttaaaaatacagta

SEQ ID NO: 291264 - DNA, 16 bp, P. troglodytes
ttttaaaaatactctt

SEQ ID NO: 291265 - DNA, 16 bp, P. troglodytes
ttttaaaaatagagta

SEQ ID NO: 291266 - DNA, 16 bp, P. troglodytes
ttttaaaaatagcttt

SEQ ID NO: 291267 - DNA, 16 bp, P. troglodytes
ttttaaaaatagtatg

SEQ ID NO: 291268 - DNA, 16 bp, P. troglodytes
ttttaaaaatatctgt

SEQ ID NO: 291269 - DNA, 16 bp, P. troglodytes
ttttaaaaatcaacta

SEQ ID NO: 291270 - DNA, 16 bp, P. troglodytes
ttttaaaaatcaagaa

SEQ ID NO: 291271 - DNA, 16 bp, P. troglodytes
ttttaaaaatcaggat

SEQ ID NO: 291272 - DNA, 16 bp, P. troglodytes
ttttaaaaatcagttt

SEQ ID NO: 291273 - DNA, 16 bp, P. troglodytes
ttttaaaaatccaggt

SEQ ID NO: 291274 - DNA, 16 bp, P. troglodytes
ttttaaaaatccattc

SEQ ID NO: 291275 - DNA, 16 bp, P. troglodytes
ttttaaaaatcccctt

SEQ ID NO: 291276 - DNA, 16 bp, P. troglodytes
ttttaaaaatctagtt

SEQ ID NO: 291277 - DNA, 16 bp, P. troglodytes
ttttaaaaatctcatt

SEQ ID NO: 291278 - DNA, 16 bp, P. troglodytes
ttttaaaaatctgaga

SEQ ID NO: 291279 - DNA, 16 bp, P. troglodytes
ttttaaaaatcttgtt

SEQ ID NO: 291280 - DNA, 16 bp, P. troglodytes
ttttaaaaatgaactt

SEQ ID NO: 291281 - DNA, 16 bp, P. troglodytes
ttttaaaaatgcaaaa

SEQ ID NO: 291282 - DNA, 16 bp, P. troglodytes
ttttaaaaatgcatat

SEQ ID NO: 291283 - DNA, 16 bp, P. troglodytes
ttttaaaaatgccaaa

SEQ ID NO: 291284 - DNA, 16 bp, P. troglodytes
ttttaaaaatgccttt

SEQ ID NO: 291285 - DNA, 16 bp, P. troglodytes
ttttaaaaatgcttat

SEQ ID NO: 291286 - DNA, 16 bp, P. troglodytes
ttttaaaaatggtctt

SEQ ID NO: 291287 - DNA, 16 bp, P. troglodytes
ttttaaaaatgtaact

SEQ ID NO: 291288 - DNA, 16 bp, P. troglodytes
ttttaaaaatgtcata

SEQ ID NO: 291289 - DNA, 16 bp, P. troglodytes
ttttaaaaatgtcatt

SEQ ID NO: 291290 - DNA, 16 bp, P. troglodytes
ttttaaaaatgttcac

SEQ ID NO: 291291 - DNA, 16 bp, P. troglodytes
ttttaaaaatgttctc

SEQ ID NO: 291292 - DNA, 16 bp, P. troglodytes
ttttaaaaatgttttc

SEQ ID NO: 291293 - DNA, 16 bp, P. troglodytes
ttttaaaaattaaagg

SEQ ID NO: 291294 - DNA, 16 bp, P. troglodytes
ttttaaaaattacctt

SEQ ID NO: 291295 - DNA, 16 bp, P. troglodytes
ttttaaaaattagcat

SEQ ID NO: 291296 - DNA, 16 bp, P. troglodytes
ttttaaaaattagctg

SEQ ID NO: 291297 - DNA, 16 bp, P. troglodytes
ttttaaaaattatgca

SEQ ID NO: 291298 - DNA, 16 bp, P. troglodytes
ttttaaaaattcaaca

SEQ ID NO: 291299 - DNA, 16 bp, P. troglodytes
ttttaaaaattcacaa

SEQ ID NO: 291300 - DNA, 16 bp, P. troglodytes
ttttaaaaattcctaa

SEQ ID NO: 291301 - DNA, 16 bp, P. troglodytes
ttttaaaaattgagtt

SEQ ID NO: 291302 - DNA, 16 bp, P. troglodytes
ttttaaaaattggaaa

SEQ ID NO: 291303 - DNA, 16 bp, P. troglodytes
ttttaaaaattgtggt

SEQ ID NO: 291304 - DNA, 16 bp, P. troglodytes
ttttaaaaatttaacc

SEQ ID NO: 291305 - DNA, 16 bp, P. troglodytes
ttttaaaaatttaagg

SEQ ID NO: 291306 - DNA, 16 bp, P. troglodytes
ttttaaaaatttagca

SEQ ID NO: 291307 - DNA, 16 bp, P. troglodytes
ttttaaaacaaagaaa

SEQ ID NO: 291308 - DNA, 16 bp, P. troglodytes
ttttaaaacaaatgat

SEQ ID NO: 291309 - DNA, 16 bp, P. troglodytes
ttttaaaacaactttt

SEQ ID NO: 291310 - DNA, 16 bp, P. troglodytes
ttttaaaacaaggaaa

SEQ ID NO: 291311 - DNA, 16 bp, P. troglodytes
ttttaaaacactgaaa

SEQ ID NO: 291312 - DNA, 16 bp, P. troglodytes
ttttaaaacagaaatt

SEQ ID NO: 291313 - DNA, 16 bp, P. troglodytes
ttttaaaacagctatt

SEQ ID NO: 291314 - DNA, 16 bp, P. troglodytes
ttttaaaacagcttta

SEQ ID NO: 291315 - DNA, 16 bp, P. troglodytes
ttttaaaacatcatct

SEQ ID NO: 291316 - DNA, 16 bp, P. troglodytes
ttttaaaacatcattt

SEQ ID NO: 291317 - DNA, 16 bp, P. troglodytes
ttttaaaacatgagaa

SEQ ID NO: 291318 - DNA, 16 bp, P. troglodytes
ttttaaaacatttttg

SEQ ID NO: 291319 - DNA, 16 bp, P. troglodytes
ttttaaaaccaatttt

SEQ ID NO: 291320 - DNA, 16 bp, P. troglodytes
ttttaaaaccttgaaa

SEQ ID NO: 291321 - DNA, 16 bp, P. troglodytes
ttttaaaactattttg

SEQ ID NO: 291322 - DNA, 16 bp, P. troglodytes
ttttaaaactctttct

SEQ ID NO: 291323 - DNA, 16 bp, P. troglodytes
ttttaaaactgaaaag

SEQ ID NO: 291324 - DNA, 16 bp, P. troglodytes
ttttaaaactgaattt

SEQ ID NO: 291325 - DNA, 16 bp, P. troglodytes
ttttaaaactggcaaa

SEQ ID NO: 291326 - DNA, 16 bp, P. troglodytes
ttttaaaactgtaaat

SEQ ID NO: 291327 - DNA, 16 bp, P. troglodytes
ttttaaaactgtaatt

SEQ ID NO: 291328 - DNA, 16 bp, P. troglodytes
ttttaaaactgtattt

SEQ ID NO: 291329 - DNA, 16 bp, P. troglodytes
ttttaaaacttcatta

SEQ ID NO: 291330 - DNA, 16 bp, P. troglodytes
ttttaaaacttgaaaa

SEQ ID NO: 291331 - DNA, 16 bp, P. troglodytes
ttttaaaactttgttt

SEQ ID NO: 291332 - DNA, 16 bp, P. troglodytes
ttttaaaagaaacttt

SEQ ID NO: 291333 - DNA, 16 bp, P. troglodytes
ttttaaaagaaagaca

SEQ ID NO: 291334 - DNA, 16 bp, P. troglodytes
ttttaaaagaaagatt

SEQ ID NO: 291335 - DNA, 16 bp, P. troglodytes
ttttaaaagaaagtca

SEQ ID NO: 291336 - DNA, 16 bp, P. troglodytes
ttttaaaagaaagtta

SEQ ID NO: 291337 - DNA, 16 bp, P. troglodytes
ttttaaaagaaatgtt

SEQ ID NO: 291338 - DNA, 16 bp, P. troglodytes
ttttaaaagaaattca

SEQ ID NO: 291339 - DNA, 16 bp, P. troglodytes
ttttaaaagaacaatt

SEQ ID NO: 291340 - DNA, 16 bp, P. troglodytes
ttttaaaagaaccaaa

SEQ ID NO: 291341 - DNA, 16 bp, P. troglodytes
ttttaaaagaagagaa

SEQ ID NO: 291342 - DNA, 16 bp, P. troglodytes
ttttaaaagaagcatt

SEQ ID NO: 291343 - DNA, 16 bp, P. troglodytes
ttttaaaagaatgttg

SEQ ID NO: 291344 - DNA, 16 bp, P. troglodytes
ttttaaaagaatgttt

SEQ ID NO: 291345 - DNA, 16 bp, P. troglodytes
ttttaaaagacataat

SEQ ID NO: 291346 - DNA, 16 bp, P. troglodytes
ttttaaaagacatttt

SEQ ID NO: 291347 - DNA, 16 bp, P. troglodytes
ttttaaaagacctttt

SEQ ID NO: 291348 - DNA, 16 bp, P. troglodytes
ttttaaaagactattt

SEQ ID NO: 291349 - DNA, 16 bp, P. troglodytes
ttttaaaagacttgaa

SEQ ID NO: 291350 - DNA, 16 bp, P. troglodytes
ttttaaaagactttta

SEQ ID NO: 291351 - DNA, 16 bp, P. troglodytes
ttttaaaagagaagca

SEQ ID NO: 291352 - DNA, 16 bp, P. troglodytes
ttttaaaagagagaaa

SEQ ID NO: 291353 - DNA, 16 bp, P. troglodytes
ttttaaaagagtgaaa

SEQ ID NO: 291354 - DNA, 16 bp, P. troglodytes
ttttaaaagatgaata

SEQ ID NO: 291355 - DNA, 16 bp, P. troglodytes
ttttaaaagatgactt

SEQ ID NO: 291356 - DNA, 16 bp, P. troglodytes
ttttaaaagcaaaaat

SEQ ID NO: 291357 - DNA, 16 bp, P. troglodytes
ttttaaaagcaaaatg

SEQ ID NO: 291358 - DNA, 16 bp, P. troglodytes
ttttaaaagcaaattt

SEQ ID NO: 291359 - DNA, 16 bp, P. troglodytes
ttttaaaagcacttta

SEQ ID NO: 291360 - DNA, 16 bp, P. troglodytes
ttttaaaagcatgtat

SEQ ID NO: 291361 - DNA, 16 bp, P. troglodytes
ttttaaaagctatttt

SEQ ID NO: 291362 - DNA, 16 bp, P. troglodytes
ttttaaaagcttttaa

SEQ ID NO: 291363 - DNA, 16 bp, P. troglodytes
ttttaaaaggaaaaca

SEQ ID NO: 291364 - DNA, 16 bp, P. troglodytes
ttttaaaaggaaagaa

SEQ ID NO: 291365 - DNA, 16 bp, P. troglodytes
ttttaaaaggatattt

SEQ ID NO: 291366 - DNA, 16 bp, P. troglodytes
ttttaaaaggcaaaaa

SEQ ID NO: 291367 - DNA, 16 bp, P. troglodytes
ttttaaaaggctgttt

SEQ ID NO: 291368 - DNA, 16 bp, P. troglodytes
ttttaaaagggagaaa

SEQ ID NO: 291369 - DNA, 16 bp, P. troglodytes
ttttaaaaggtaaatg

SEQ ID NO: 291370 - DNA, 16 bp, P. troglodytes
ttttaaaaggtaataa

SEQ ID NO: 291371 - DNA, 16 bp, P. troglodytes
ttttaaaagtaggaaa

SEQ ID NO: 291372 - DNA, 16 bp, P. troglodytes
ttttaaaagtatatgt

SEQ ID NO: 291373 - DNA, 16 bp, P. troglodytes
ttttaaaagtcaaaat

SEQ ID NO: 291374 - DNA, 16 bp, P. troglodytes
ttttaaaagtcaaatt

SEQ ID NO: 291375 - DNA, 16 bp, P. troglodytes
ttttaaaagtcaattt

SEQ ID NO: 291376 - DNA, 16 bp, P. troglodytes
ttttaaaagtcacttt

SEQ ID NO: 291377 - DNA, 16 bp, P. troglodytes
ttttaaaagtcataaa

SEQ ID NO: 291378 - DNA, 16 bp, P. troglodytes
ttttaaaagtcatttt

SEQ ID NO: 291379 - DNA, 16 bp, P. troglodytes
ttttaaaagtctcaaa

SEQ ID NO: 291380 - DNA, 16 bp, P. troglodytes
ttttaaaagtctgtat

SEQ ID NO: 291381 - DNA, 16 bp, P. troglodytes
ttttaaaagtgaaaag

SEQ ID NO: 291382 - DNA, 16 bp, P. troglodytes
ttttaaaagtgaattt

SEQ ID NO: 291383 - DNA, 16 bp, P. troglodytes
ttttaaaagtggaaaa

SEQ ID NO: 291384 - DNA, 16 bp, P. troglodytes
ttttaaaagtgtgtgg

SEQ ID NO: 291385 - DNA, 16 bp, P. troglodytes
ttttaaaagttcaaat

SEQ ID NO: 291386 - DNA, 16 bp, P. troglodytes
ttttaaaagttcttta

SEQ ID NO: 291387 - DNA, 16 bp, P. troglodytes
ttttaaaagttttaga

SEQ ID NO: 291388 - DNA, 16 bp, P. troglodytes
ttttaaaataaaagtg

SEQ ID NO: 291389 - DNA, 16 bp, P. troglodytes
ttttaaaataaagcaa

SEQ ID NO: 291390 - DNA, 16 bp, P. troglodytes
ttttaaaataactgaa

SEQ ID NO: 291391 - DNA, 16 bp, P. troglodytes
ttttaaaataagacaa

SEQ ID NO: 291392 - DNA, 16 bp, P. troglodytes
ttttaaaataagcttt

SEQ ID NO: 291393 - DNA, 16 bp, P. troglodytes
ttttaaaataatgcaa

SEQ ID NO: 291394 - DNA, 16 bp, P. troglodytes
ttttaaaatacagaga

SEQ ID NO: 291395 - DNA, 16 bp, P. troglodytes
ttttaaaatacagttt

SEQ ID NO: 291396 - DNA, 16 bp, P. troglodytes
ttttaaaataccattt

SEQ ID NO: 291397 - DNA, 16 bp, P. troglodytes
ttttaaaatagacttt

SEQ ID NO: 291398 - DNA, 16 bp, P. troglodytes
ttttaaaatagagata

SEQ ID NO: 291399 - DNA, 16 bp, P. troglodytes
ttttaaaatagctaaa

SEQ ID NO: 291400 - DNA, 16 bp, P. troglodytes
ttttaaaatataccaa

SEQ ID NO: 291401 - DNA, 16 bp, P. troglodytes
ttttaaaatatatacc

SEQ ID NO: 291402 - DNA, 16 bp, P. troglodytes
ttttaaaatatatcca

SEQ ID NO: 291403 - DNA, 16 bp, P. troglodytes
ttttaaaatatgggaa

SEQ ID NO: 291404 - DNA, 16 bp, P. troglodytes
ttttaaaatattactg

SEQ ID NO: 291405 - DNA, 16 bp, P. troglodytes
ttttaaaatattgact

SEQ ID NO: 291406 - DNA, 16 bp, P. troglodytes
ttttaaaatcacattt

SEQ ID NO: 291407 - DNA, 16 bp, P. troglodytes
ttttaaaatcatgttt

SEQ ID NO: 291408 - DNA, 16 bp, P. troglodytes
ttttaaaatccacttt

SEQ ID NO: 291409 - DNA, 16 bp, P. troglodytes
ttttaaaatccagaaa

SEQ ID NO: 291410 - DNA, 16 bp, P. troglodytes
ttttaaaatcctgatt

SEQ ID NO: 291411 - DNA, 16 bp, P. troglodytes
ttttaaaatcctttct

SEQ ID NO: 291412 - DNA, 16 bp, P. troglodytes
ttttaaaatctaaagt

SEQ ID NO: 291413 - DNA, 16 bp, P. troglodytes
ttttaaaatctctgcc

SEQ ID NO: 291414 - DNA, 16 bp, P. troglodytes
ttttaaaatctgaaaa

SEQ ID NO: 291415 - DNA, 16 bp, P. troglodytes
ttttaaaatgaatgta

SEQ ID NO: 291416 - DNA, 16 bp, P. troglodytes
ttttaaaatgagtaaa

SEQ ID NO: 291417 - DNA, 16 bp, P. troglodytes
ttttaaaatgagttaa

SEQ ID NO: 291418 - DNA, 16 bp, P. troglodytes
ttttaaaatgataatg

SEQ ID NO: 291419 - DNA, 16 bp, P. troglodytes
ttttaaaatgatttct

SEQ ID NO: 291420 - DNA, 16 bp, P. troglodytes
ttttaaaatgcaaaat

SEQ ID NO: 291421 - DNA, 16 bp, P. troglodytes
ttttaaaatgcaaatt

SEQ ID NO: 291422 - DNA, 16 bp, P. troglodytes
ttttaaaatgcacaaa

SEQ ID NO: 291423 - DNA, 16 bp, P. troglodytes
ttttaaaatgcagatt

SEQ ID NO: 291424 - DNA, 16 bp, P. troglodytes
ttttaaaatgcataaa

SEQ ID NO: 291425 - DNA, 16 bp, P. troglodytes
ttttaaaatgcatttt

SEQ ID NO: 291426 - DNA, 16 bp, P. troglodytes
ttttaaaatgctttgt

SEQ ID NO: 291427 - DNA, 16 bp, P. troglodytes
ttttaaaatgggaaat

SEQ ID NO: 291428 - DNA, 16 bp, P. troglodytes
ttttaaaatggtaata

SEQ ID NO: 291429 - DNA, 16 bp, P. troglodytes
ttttaaaatgtaaact

SEQ ID NO: 291430 - DNA, 16 bp, P. troglodytes
ttttaaaatgtaacat

SEQ ID NO: 291431 - DNA, 16 bp, P. troglodytes
ttttaaaatgtacatt

SEQ ID NO: 291432 - DNA, 16 bp, P. troglodytes
ttttaaaatgtagaaa

SEQ ID NO: 291433 - DNA, 16 bp, P. troglodytes
ttttaaaatgtcattt

SEQ ID NO: 291434 - DNA, 16 bp, P. troglodytes
ttttaaaatgtgcatg

SEQ ID NO: 291435 - DNA, 16 bp, P. troglodytes
ttttaaaatgtgtaat

SEQ ID NO: 291436 - DNA, 16 bp, P. troglodytes
ttttaaaatgtgtaca

SEQ ID NO: 291437 - DNA, 16 bp, P. troglodytes
ttttaaaatgtgtgtt

SEQ ID NO: 291438 - DNA, 16 bp, P. troglodytes
ttttaaaatgttagca

SEQ ID NO: 291439 - DNA, 16 bp, P. troglodytes
ttttaaaatgtttcat

SEQ ID NO: 291440 - DNA, 16 bp, P. troglodytes
ttttaaaattaacaca

SEQ ID NO: 291441 - DNA, 16 bp, P. troglodytes
ttttaaaattacactt

SEQ ID NO: 291442 - DNA, 16 bp, P. troglodytes
ttttaaaattagctag

SEQ ID NO: 291443 - DNA, 16 bp, P. troglodytes
ttttaaaattatgact

SEQ ID NO: 291444 - DNA, 16 bp, P. troglodytes
ttttaaaattatgtga

SEQ ID NO: 291445 - DNA, 16 bp, P. troglodytes
ttttaaaattcacctt

SEQ ID NO: 291446 - DNA, 16 bp, P. troglodytes
ttttaaaattccttct

SEQ ID NO: 291447 - DNA, 16 bp, P. troglodytes
ttttaaaattctgctt

SEQ ID NO: 291448 - DNA, 16 bp, P. troglodytes
ttttaaaattctgttt

SEQ ID NO: 291449 - DNA, 16 bp, P. troglodytes
ttttaaaattcttcct

SEQ ID NO: 291450 - DNA, 16 bp, P. troglodytes
ttttaaaattgaggta

SEQ ID NO: 291451 - DNA, 16 bp, P. troglodytes
ttttaaaattgcaaat

SEQ ID NO: 291452 - DNA, 16 bp, P. troglodytes
ttttaaaattgcaatt

SEQ ID NO: 291453 - DNA, 16 bp, P. troglodytes
ttttaaaattgctttt

SEQ ID NO: 291454 - DNA, 16 bp, P. troglodytes
ttttaaaattggcttt

SEQ ID NO: 291455 - DNA, 16 bp, P. troglodytes
ttttaaaattgtacat

SEQ ID NO: 291456 - DNA, 16 bp, P. troglodytes
ttttaaaattgtcatt

SEQ ID NO: 291457 - DNA, 16 bp, P. troglodytes
ttttaaaatttactga

SEQ ID NO: 291458 - DNA, 16 bp, P. troglodytes
ttttaaaatttcaact

SEQ ID NO: 291459 - DNA, 16 bp, P. troglodytes
ttttaaaatttcagat

SEQ ID NO: 291460 - DNA, 16 bp, P. troglodytes
ttttaaaatttgaatg

SEQ ID NO: 291461 - DNA, 16 bp, P. troglodytes
ttttaaaatttgtaga

SEQ ID NO: 291462 - DNA, 16 bp, P. troglodytes
ttttaaaatttgtctt

SEQ ID NO: 291463 - DNA, 16 bp, P. troglodytes
ttttaaaatttttgct

SEQ ID NO: 291464 - DNA, 16 bp, P. troglodytes
ttttaaacaaaatcat

SEQ ID NO: 291465 - DNA, 16 bp, P. troglodytes
ttttaaacaaaatgaa

SEQ ID NO: 291466 - DNA, 16 bp, P. troglodytes
ttttaaacaaaatttc

SEQ ID NO: 291467 - DNA, 16 bp, P. troglodytes
ttttaaacaaagaatt

SEQ ID NO: 291468 - DNA, 16 bp, P. troglodytes
ttttaaacaaatgatg

SEQ ID NO: 291469 - DNA, 16 bp, P. troglodytes
ttttaaacaaatgtat

SEQ ID NO: 291470 - DNA, 16 bp, P. troglodytes
ttttaaacaaccaaat

SEQ ID NO: 291471 - DNA, 16 bp, P. troglodytes
ttttaaacaaccagat

SEQ ID NO: 291472 - DNA, 16 bp, P. troglodytes
ttttaaacacagaaat

SEQ ID NO: 291473 - DNA, 16 bp, P. troglodytes
ttttaaacagaatttt

SEQ ID NO: 291474 - DNA, 16 bp, P. troglodytes
ttttaaacagagaaat

SEQ ID NO: 291475 - DNA, 16 bp, P. troglodytes
ttttaaacaggaaaaa

SEQ ID NO: 291476 - DNA, 16 bp, P. troglodytes
ttttaaacaggaaaat

SEQ ID NO: 291477 - DNA, 16 bp, P. troglodytes
ttttaaacataaaaag

SEQ ID NO: 291478 - DNA, 16 bp, P. troglodytes
ttttaaacatacattt

SEQ ID NO: 291479 - DNA, 16 bp, P. troglodytes
ttttaaacatgtaaaa

SEQ ID NO: 291480 - DNA, 16 bp, P. troglodytes
ttttaaacattgaaaa

SEQ ID NO: 291481 - DNA, 16 bp, P. troglodytes
ttttaaacattgtttt

SEQ ID NO: 291482 - DNA, 16 bp, P. troglodytes
ttttaaaccaccagat

SEQ ID NO: 291483 - DNA, 16 bp, P. troglodytes
ttttaaacccactgtt

SEQ ID NO: 291484 - DNA, 16 bp, P. troglodytes
ttttaaactagttttt

SEQ ID NO: 291485 - DNA, 16 bp, P. troglodytes
ttttaaactatgaatt

SEQ ID NO: 291486 - DNA, 16 bp, P. troglodytes
ttttaaacttattttg

SEQ ID NO: 291487 - DNA, 16 bp, P. troglodytes
ttttaaactttctaaa

SEQ ID NO: 291488 - DNA, 16 bp, P. troglodytes
ttttaaactttgttct

SEQ ID NO: 291489 - DNA, 16 bp, P. troglodytes
ttttaaacttttaagt

SEQ ID NO: 291490 - DNA, 16 bp, P. troglodytes
ttttaaacttttagtt

SEQ ID NO: 291491 - DNA, 16 bp, P. troglodytes
ttttaaacttttgaaa

SEQ ID NO: 291492 - DNA, 16 bp, P. troglodytes
ttttaaagaaaaaaac

SEQ ID NO: 291493 - DNA, 16 bp, P. troglodytes
ttttaaagaaaaagca

SEQ ID NO: 291494 - DNA, 16 bp, P. troglodytes
ttttaaagaaaaatgt

SEQ ID NO: 291495 - DNA, 16 bp, P. troglodytes
ttttaaagaaaatcag

SEQ ID NO: 291496 - DNA, 16 bp, P. troglodytes
ttttaaagaaacaaaa

SEQ ID NO: 291497 - DNA, 16 bp, P. troglodytes
ttttaaagaaacatat

SEQ ID NO: 291498 - DNA, 16 bp, P. troglodytes
ttttaaagaaactaaa

SEQ ID NO: 291499 - DNA, 16 bp, P. troglodytes
ttttaaagaaagattt

SEQ ID NO: 291500 - DNA, 16 bp, P. troglodytes
ttttaaagaaatagtt

SEQ ID NO: 291501 - DNA, 16 bp, P. troglodytes
ttttaaagaaatatga

SEQ ID NO: 291502 - DNA, 16 bp, P. troglodytes
ttttaaagaaatgttt

SEQ ID NO: 291503 - DNA, 16 bp, P. troglodytes
ttttaaagaacatctt

SEQ ID NO: 291504 - DNA, 16 bp, P. troglodytes
ttttaaagaagttatt

SEQ ID NO: 291505 - DNA, 16 bp, P. troglodytes
ttttaaagaatgaaat

SEQ ID NO: 291506 - DNA, 16 bp, P. troglodytes
ttttaaagaatgttga

SEQ ID NO: 291507 - DNA, 16 bp, P. troglodytes
ttttaaagaatttctt

SEQ ID NO: 291508 - DNA, 16 bp, P. troglodytes
ttttaaagacaaaatt

SEQ ID NO: 291509 - DNA, 16 bp, P. troglodytes
ttttaaagacaatgaa

SEQ ID NO: 291510 - DNA, 16 bp, P. troglodytes
ttttaaagacagtttt

SEQ ID NO: 291511 - DNA, 16 bp, P. troglodytes
ttttaaagagaaaatg

SEQ ID NO: 291512 - DNA, 16 bp, P. troglodytes
ttttaaagagaagttt

SEQ ID NO: 291513 - DNA, 16 bp, P. troglodytes
ttttaaagagacagtg

SEQ ID NO: 291514 - DNA, 16 bp, P. troglodytes
ttttaaagagaggaaa

SEQ ID NO: 291515 - DNA, 16 bp, P. troglodytes
ttttaaagagcattta

SEQ ID NO: 291516 - DNA, 16 bp, P. troglodytes
ttttaaagagttaatt

SEQ ID NO: 291517 - DNA, 16 bp, P. troglodytes
ttttaaagatacatta

SEQ ID NO: 291518 - DNA, 16 bp, P. troglodytes
ttttaaagatgaaatt

SEQ ID NO: 291519 - DNA, 16 bp, P. troglodytes
ttttaaagatgatgaa

SEQ ID NO: 291520 - DNA, 16 bp, P. troglodytes
ttttaaagatggagtt

SEQ ID NO: 291521 - DNA, 16 bp, P. troglodytes
ttttaaagatgtaaaa

SEQ ID NO: 291522 - DNA, 16 bp, P. troglodytes
ttttaaagcaagtttt

SEQ ID NO: 291523 - DNA, 16 bp, P. troglodytes
ttttaaagcattcttt

SEQ ID NO: 291524 - DNA, 16 bp, P. troglodytes
ttttaaagctataaat

SEQ ID NO: 291525 - DNA, 16 bp, P. troglodytes
ttttaaagcttcaaaa

SEQ ID NO: 291526 - DNA, 16 bp, P. troglodytes
ttttaaagctttcttt

SEQ ID NO: 291527 - DNA, 16 bp, P. troglodytes
ttttaaaggaaaaatg

SEQ ID NO: 291528 - DNA, 16 bp, P. troglodytes
ttttaaaggaaaaatt

SEQ ID NO: 291529 - DNA, 16 bp, P. troglodytes
ttttaaaggaaagagg

SEQ ID NO: 291530 - DNA, 16 bp, P. troglodytes
ttttaaaggaaattaa

SEQ ID NO: 291531 - DNA, 16 bp, P. troglodytes
ttttaaaggaagaaaa

SEQ ID NO: 291532 - DNA, 16 bp, P. troglodytes
ttttaaaggaagaaag

SEQ ID NO: 291533 - DNA, 16 bp, P. troglodytes
ttttaaaggaatattt

SEQ ID NO: 291534 - DNA, 16 bp, P. troglodytes
ttttaaaggaatcttt

SEQ ID NO: 291535 - DNA, 16 bp, P. troglodytes
ttttaaaggacaattt

SEQ ID NO: 291536 - DNA, 16 bp, P. troglodytes
ttttaaaggctatttt

SEQ ID NO: 291537 - DNA, 16 bp, P. troglodytes
ttttaaaggctgaata

SEQ ID NO: 291538 - DNA, 16 bp, P. troglodytes
ttttaaagggaaaaaa

SEQ ID NO: 291539 - DNA, 16 bp, P. troglodytes
ttttaaaggttaaaaa

SEQ ID NO: 291540 - DNA, 16 bp, P. troglodytes
ttttaaagtaaaaaca

SEQ ID NO: 291541 - DNA, 16 bp, P. troglodytes
ttttaaagtaaatgtt

SEQ ID NO: 291542 - DNA, 16 bp, P. troglodytes
ttttaaagtacattat

SEQ ID NO: 291543 - DNA, 16 bp, P. troglodytes
ttttaaagtacatttt

SEQ ID NO: 291544 - DNA, 16 bp, P. troglodytes
ttttaaagtagaaaag

SEQ ID NO: 291545 - DNA, 16 bp, P. troglodytes
ttttaaagtagctttt

SEQ ID NO: 291546 - DNA, 16 bp, P. troglodytes
ttttaaagtatacaat

SEQ ID NO: 291547 - DNA, 16 bp, P. troglodytes
ttttaaagtatatgta

SEQ ID NO: 291548 - DNA, 16 bp, P. troglodytes
ttttaaagtatatttc

SEQ ID NO: 291549 - DNA, 16 bp, P. troglodytes
ttttaaagtattcatt

SEQ ID NO: 291550 - DNA, 16 bp, P. troglodytes
ttttaaagtattttct

SEQ ID NO: 291551 - DNA, 16 bp, P. troglodytes
ttttaaagtcacattt

SEQ ID NO: 291552 - DNA, 16 bp, P. troglodytes
ttttaaagtcagattt

SEQ ID NO: 291553 - DNA, 16 bp, P. troglodytes
ttttaaagtcatttta

SEQ ID NO: 291554 - DNA, 16 bp, P. troglodytes
ttttaaagtcattttg

SEQ ID NO: 291555 - DNA, 16 bp, P. troglodytes
ttttaaagtgactttt

SEQ ID NO: 291556 - DNA, 16 bp, P. troglodytes
ttttaaagtgattaaa

SEQ ID NO: 291557 - DNA, 16 bp, P. troglodytes
ttttaaagtgtataaa

SEQ ID NO: 291558 - DNA, 16 bp, P. troglodytes
ttttaaagttacattt

SEQ ID NO: 291559 - DNA, 16 bp, P. troglodytes
ttttaaagttcttatt

SEQ ID NO: 291560 - DNA, 16 bp, P. troglodytes
ttttaaagtttaactt

SEQ ID NO: 291561 - DNA, 16 bp, P. troglodytes
ttttaaagtttacttt

SEQ ID NO: 291562 - DNA, 16 bp, P. troglodytes
ttttaaagtttcttca

SEQ ID NO: 291563 - DNA, 16 bp, P. troglodytes
ttttaaagtttttctg

SEQ ID NO: 291564 - DNA, 16 bp, P. troglodytes
ttttaaataaagatgg

SEQ ID NO: 291565 - DNA, 16 bp, P. troglodytes
ttttaaataaagcaaa

SEQ ID NO: 291566 - DNA, 16 bp, P. troglodytes
ttttaaataaaggttt

SEQ ID NO: 291567 - DNA, 16 bp, P. troglodytes
ttttaaataaagtgtt

SEQ ID NO: 291568 - DNA, 16 bp, P. troglodytes
ttttaaataacactat

SEQ ID NO: 291569 - DNA, 16 bp, P. troglodytes
ttttaaataactgaaa

SEQ ID NO: 291570 - DNA, 16 bp, P. troglodytes
ttttaaataagctttt

SEQ ID NO: 291571 - DNA, 16 bp, P. troglodytes
ttttaaataaggaaag

SEQ ID NO: 291572 - DNA, 16 bp, P. troglodytes
ttttaaataaggaaat

SEQ ID NO: 291573 - DNA, 16 bp, P. troglodytes
ttttaaatacaacttt

SEQ ID NO: 291574 - DNA, 16 bp, P. troglodytes
ttttaaatacacattt

SEQ ID NO: 291575 - DNA, 16 bp, P. troglodytes
ttttaaatacagaaaa

SEQ ID NO: 291576 - DNA, 16 bp, P. troglodytes
ttttaaatacatggaa

SEQ ID NO: 291577 - DNA, 16 bp, P. troglodytes
ttttaaatacatgttt

SEQ ID NO: 291578 - DNA, 16 bp, P. troglodytes
ttttaaatacttttgt

SEQ ID NO: 291579 - DNA, 16 bp, P. troglodytes
ttttaaatagcatttt

SEQ ID NO: 291580 - DNA, 16 bp, P. troglodytes
ttttaaatagtttttc

SEQ ID NO: 291581 - DNA, 16 bp, P. troglodytes
ttttaaatatacttca

SEQ ID NO: 291582 - DNA, 16 bp, P. troglodytes
ttttaaatatgtcttt

SEQ ID NO: 291583 - DNA, 16 bp, P. troglodytes
ttttaaatattgcaaa

SEQ ID NO: 291584 - DNA, 16 bp, P. troglodytes
ttttaaatcacagaaa

SEQ ID NO: 291585 - DNA, 16 bp, P. troglodytes
ttttaaatcagaaatt

SEQ ID NO: 291586 - DNA, 16 bp, P. troglodytes
ttttaaatcaggtaag

SEQ ID NO: 291587 - DNA, 16 bp, P. troglodytes
ttttaaatcccttgtt

SEQ ID NO: 291588 - DNA, 16 bp, P. troglodytes
ttttaaatctatatgt

SEQ ID NO: 291589 - DNA, 16 bp, P. troglodytes
ttttaaatgaacaaat

SEQ ID NO: 291590 - DNA, 16 bp, P. troglodytes
ttttaaatgacaaaat

SEQ ID NO: 291591 - DNA, 16 bp, P. troglodytes
ttttaaatgacaatat

SEQ ID NO: 291592 - DNA, 16 bp, P. troglodytes
ttttaaatgaccagat

SEQ ID NO: 291593 - DNA, 16 bp, P. troglodytes
ttttaaatgacttttt

SEQ ID NO: 291594 - DNA, 16 bp, P. troglodytes
ttttaaatgatcaaaa

SEQ ID NO: 291595 - DNA, 16 bp, P. troglodytes
ttttaaatgatcaatt

SEQ ID NO: 291596 - DNA, 16 bp, P. troglodytes
ttttaaatgattggaa

SEQ ID NO: 291597 - DNA, 16 bp, P. troglodytes
ttttaaatgcaaaata

SEQ ID NO: 291598 - DNA, 16 bp, P. troglodytes
ttttaaatgcaaattt

SEQ ID NO: 291599 - DNA, 16 bp, P. troglodytes
ttttaaatgctgaaaa

SEQ ID NO: 291600 - DNA, 16 bp, P. troglodytes
ttttaaatggaaaata

SEQ ID NO: 291601 - DNA, 16 bp, P. troglodytes
ttttaaatggcaaaat

SEQ ID NO: 291602 - DNA, 16 bp, P. troglodytes
ttttaaatgggagaaa

SEQ ID NO: 291603 - DNA, 16 bp, P. troglodytes
ttttaaatgggattat

SEQ ID NO: 291604 - DNA, 16 bp, P. troglodytes
ttttaaatgtaaagat

SEQ ID NO: 291605 - DNA, 16 bp, P. troglodytes
ttttaaatgtaaatga

SEQ ID NO: 291606 - DNA, 16 bp, P. troglodytes
ttttaaatgtaacatt

SEQ ID NO: 291607 - DNA, 16 bp, P. troglodytes
ttttaaatgtaagaat

SEQ ID NO: 291608 - DNA, 16 bp, P. troglodytes
ttttaaatgtacagtt

SEQ ID NO: 291609 - DNA, 16 bp, P. troglodytes
ttttaaatgtattgag

SEQ ID NO: 291610 - DNA, 16 bp, P. troglodytes
ttttaaatgtctataa

SEQ ID NO: 291611 - DNA, 16 bp, P. troglodytes
ttttaaatgtctcttt

SEQ ID NO: 291612 - DNA, 16 bp, P. troglodytes
ttttaaatgtgtccca

SEQ ID NO: 291613 - DNA, 16 bp, P. troglodytes
ttttaaatgtgtcttt

SEQ ID NO: 291614 - DNA, 16 bp, P. troglodytes
ttttaaatgtgtgtgt

SEQ ID NO: 291615 - DNA, 16 bp, P. troglodytes
ttttaaatgttcattt

SEQ ID NO: 291616 - DNA, 16 bp, P. troglodytes
ttttaaatgttctcag

SEQ ID NO: 291617 - DNA, 16 bp, P. troglodytes
ttttaaatgttcttca

SEQ ID NO: 291618 - DNA, 16 bp, P. troglodytes
ttttaaatgtttcttc

SEQ ID NO: 291619 - DNA, 16 bp, P. troglodytes
ttttaaatgttttaca

SEQ ID NO: 291620 - DNA, 16 bp, P. troglodytes
ttttaaatgttttcac

SEQ ID NO: 291621 - DNA, 16 bp, P. troglodytes
ttttaaattaaaagtg

SEQ ID NO: 291622 - DNA, 16 bp, P. troglodytes
ttttaaattaagaagt

SEQ ID NO: 291623 - DNA, 16 bp, P. troglodytes
ttttaaattagaaaag

SEQ ID NO: 291624 - DNA, 16 bp, P. troglodytes
ttttaaattagcattt

SEQ ID NO: 291625 - DNA, 16 bp, P. troglodytes
ttttaaattatgaagt

SEQ ID NO: 291626 - DNA, 16 bp, P. troglodytes
ttttaaattcagaaat

SEQ ID NO: 291627 - DNA, 16 bp, P. troglodytes
ttttaaattcatgttt

SEQ ID NO: 291628 - DNA, 16 bp, P. troglodytes
ttttaaattccagttt

SEQ ID NO: 291629 - DNA, 16 bp, P. troglodytes
ttttaaattctgaata

SEQ ID NO: 291630 - DNA, 16 bp, P. troglodytes
ttttaaattctgtaat

SEQ ID NO: 291631 - DNA, 16 bp, P. troglodytes
ttttaaattgatacat

SEQ ID NO: 291632 - DNA, 16 bp, P. troglodytes
ttttaaattgctaaaa

SEQ ID NO: 291633 - DNA, 16 bp, P. troglodytes
ttttaaattgtacttt

SEQ ID NO: 291634 - DNA, 16 bp, P. troglodytes
ttttaaattgttttca

SEQ ID NO: 291635 - DNA, 16 bp, P. troglodytes
ttttaaattttctagt

SEQ ID NO: 291636 - DNA, 16 bp, P. troglodytes
ttttaacaaaaggagg

SEQ ID NO: 291637 - DNA, 16 bp, P. troglodytes
ttttaacaaaggaaaa

SEQ ID NO: 291638 - DNA, 16 bp, P. troglodytes
ttttaacaagccctcc

SEQ ID NO: 291639 - DNA, 16 bp, P. troglodytes
ttttaacaagtttttt

SEQ ID NO: 291640 - DNA, 16 bp, P. troglodytes
ttttaacagaaataaa

SEQ ID NO: 291641 - DNA, 16 bp, P. troglodytes
ttttaacagctttatt

SEQ ID NO: 291642 - DNA, 16 bp, P. troglodytes
ttttaacataaaatgt

SEQ ID NO: 291643 - DNA, 16 bp, P. troglodytes
ttttaacataaagaaa

SEQ ID NO: 291644 - DNA, 16 bp, P. troglodytes
ttttaacatctttgaa

SEQ ID NO: 291645 - DNA, 16 bp, P. troglodytes
ttttaacatgttttat

SEQ ID NO: 291646 - DNA, 16 bp, P. troglodytes
ttttaacattcaaaat

SEQ ID NO: 291647 - DNA, 16 bp, P. troglodytes
ttttaacatttctgaa

SEQ ID NO: 291648 - DNA, 16 bp, P. troglodytes
ttttaaccattttaag

SEQ ID NO: 291649 - DNA, 16 bp, P. troglodytes
ttttaacctctctgtg

SEQ ID NO: 291650 - DNA, 16 bp, P. troglodytes
ttttaactctagaatt

SEQ ID NO: 291651 - DNA, 16 bp, P. troglodytes
ttttaacttaatgtaa

SEQ ID NO: 291652 - DNA, 16 bp, P. troglodytes
ttttaacttgtaaaat

SEQ ID NO: 291653 - DNA, 16 bp, P. troglodytes
ttttaacttttcaaag

SEQ ID NO: 291654 - DNA, 16 bp, P. troglodytes
ttttaacttttgaaat

SEQ ID NO: 291655 - DNA, 16 bp, P. troglodytes
ttttaactttttaagt

SEQ ID NO: 291656 - DNA, 16 bp, P. troglodytes
ttttaactttttgaga

SEQ ID NO: 291657 - DNA, 16 bp, P. troglodytes
ttttaagaaaaaagca

SEQ ID NO: 291658 - DNA, 16 bp, P. troglodytes
ttttaagaaaaacaaa

SEQ ID NO: 291659 - DNA, 16 bp, P. troglodytes
ttttaagaaaacattt

SEQ ID NO: 291660 - DNA, 16 bp, P. troglodytes
ttttaagaaaaccaaa

SEQ ID NO: 291661 - DNA, 16 bp, P. troglodytes
ttttaagaaaatagtt

SEQ ID NO: 291662 - DNA, 16 bp, P. troglodytes
ttttaagaaagaacaa

SEQ ID NO: 291663 - DNA, 16 bp, P. troglodytes
ttttaagaaagaatca

SEQ ID NO: 291664 - DNA, 16 bp, P. troglodytes
ttttaagaaatggggt

SEQ ID NO: 291665 - DNA, 16 bp, P. troglodytes
ttttaagaacaaaaat

SEQ ID NO: 291666 - DNA, 16 bp, P. troglodytes
ttttaagaacataaaa

SEQ ID NO: 291667 - DNA, 16 bp, P. troglodytes
ttttaagaagaaaaca

SEQ ID NO: 291668 - DNA, 16 bp, P. troglodytes
ttttaagaagcatttt

SEQ ID NO: 291669 - DNA, 16 bp, P. troglodytes
ttttaagaaggaaaaa

SEQ ID NO: 291670 - DNA, 16 bp, P. troglodytes
ttttaagaagggacaa

SEQ ID NO: 291671 - DNA, 16 bp, P. troglodytes
ttttaagaagtatctg

SEQ ID NO: 291672 - DNA, 16 bp, P. troglodytes
ttttaagaatgaaaat

SEQ ID NO: 291673 - DNA, 16 bp, P. troglodytes
ttttaagaatgaagaa

SEQ ID NO: 291674 - DNA, 16 bp, P. troglodytes
ttttaagaattcttta

SEQ ID NO: 291675 - DNA, 16 bp, P. troglodytes
ttttaagacagaatct

SEQ ID NO: 291676 - DNA, 16 bp, P. troglodytes
ttttaagacagagtcc

SEQ ID NO: 291677 - DNA, 16 bp, P. troglodytes
ttttaagacagggtct

SEQ ID NO: 291678 - DNA, 16 bp, P. troglodytes
ttttaagacattttaa

SEQ ID NO: 291679 - DNA, 16 bp, P. troglodytes
ttttaagagaaatgaa

SEQ ID NO: 291680 - DNA, 16 bp, P. troglodytes
ttttaagagatggagt

SEQ ID NO: 291681 - DNA, 16 bp, P. troglodytes
ttttaagagctttatt

SEQ ID NO: 291682 - DNA, 16 bp, P. troglodytes
ttttaagataacattt

SEQ ID NO: 291683 - DNA, 16 bp, P. troglodytes
ttttaagatgggatct

SEQ ID NO: 291684 - DNA, 16 bp, P. troglodytes
ttttaagatttactat

SEQ ID NO: 291685 - DNA, 16 bp, P. troglodytes
ttttaagatttccttt

SEQ ID NO: 291686 - DNA, 16 bp, P. troglodytes
ttttaagattttctct

SEQ ID NO: 291687 - DNA, 16 bp, P. troglodytes
ttttaagatttttctc

SEQ ID NO: 291688 - DNA, 16 bp, P. troglodytes
ttttaagcaggaaagt

SEQ ID NO: 291689 - DNA, 16 bp, P. troglodytes
ttttaagcattaaaaa

SEQ ID NO: 291690 - DNA, 16 bp, P. troglodytes
ttttaagcattatttt

SEQ ID NO: 291691 - DNA, 16 bp, P. troglodytes
ttttaagcatttttat

SEQ ID NO: 291692 - DNA, 21 bp, P. troglodytes
ttttaagccccacatgcatta

SEQ ID NO: 291693 - DNA, 16 bp, P. troglodytes
ttttaagctttttaaa

SEQ ID NO: 291694 - DNA, 16 bp, P. troglodytes
ttttaaggaaaaaagt

SEQ ID NO: 291695 - DNA, 16 bp, P. troglodytes
ttttaaggaaaaatat

SEQ ID NO: 291696 - DNA, 16 bp, P. troglodytes
ttttaaggaaaataat

SEQ ID NO: 291697 - DNA, 16 bp, P. troglodytes
ttttaaggaaacaaat

SEQ ID NO: 291698 - DNA, 16 bp, P. troglodytes
ttttaaggaaagaaaa

SEQ ID NO: 291699 - DNA, 16 bp, P. troglodytes
ttttaaggaaatgaaa

SEQ ID NO: 291700 - DNA, 16 bp, P. troglodytes
ttttaaggaagaaaat

SEQ ID NO: 291701 - DNA, 16 bp, P. troglodytes
ttttaaggaagagaaa

SEQ ID NO: 291702 - DNA, 16 bp, P. troglodytes
ttttaagggaaatttt

SEQ ID NO: 291703 - DNA, 16 bp, P. troglodytes
ttttaagggtacagtt

SEQ ID NO: 291704 - DNA, 16 bp, P. troglodytes
ttttaaggttaaaaaa

SEQ ID NO: 291705 - DNA, 16 bp, P. troglodytes
ttttaagtaaacaaaa

SEQ ID NO: 291706 - DNA, 16 bp, P. troglodytes
ttttaagtaacttttt

SEQ ID NO: 291707 - DNA, 16 bp, P. troglodytes
ttttaagtatttggct

SEQ ID NO: 291708 - DNA, 16 bp, P. troglodytes
ttttaagtcatttaaa

SEQ ID NO: 291709 - DNA, 16 bp, P. troglodytes
ttttaagtctctattt

SEQ ID NO: 291710 - DNA, 16 bp, P. troglodytes
ttttaagtcttaaaaa

SEQ ID NO: 291711 - DNA, 16 bp, P. troglodytes
ttttaagtgcacagtt

SEQ ID NO: 291712 - DNA, 16 bp, P. troglodytes
ttttaagtggaaaaaa

SEQ ID NO: 291713 - DNA, 16 bp, P. troglodytes
ttttaagtggttaaaa

SEQ ID NO: 291714 - DNA, 16 bp, P. troglodytes
ttttaagtggttgaaa

SEQ ID NO: 291715 - DNA, 16 bp, P. troglodytes
ttttaagtgtacagtt

SEQ ID NO: 291716 - DNA, 16 bp, P. troglodytes
ttttaagtgtttaaaa

SEQ ID NO: 291717 - DNA, 16 bp, P. troglodytes
ttttaagttccttgag

SEQ ID NO: 291718 - DNA, 16 bp, P. troglodytes
ttttaagttctgggat

SEQ ID NO: 291719 - DNA, 16 bp, P. troglodytes
ttttaagtttgcattt

SEQ ID NO: 291720 - DNA, 16 bp, P. troglodytes
ttttaagttttctagt

SEQ ID NO: 291721 - DNA, 16 bp, P. troglodytes
ttttaataaaaatggg

SEQ ID NO: 291722 - DNA, 16 bp, P. troglodytes
ttttaataaaactgtt

SEQ ID NO: 291723 - DNA, 16 bp, P. troglodytes
ttttaataaaatgtga

SEQ ID NO: 291724 - DNA, 16 bp, P. troglodytes
ttttaataaatgagaa

SEQ ID NO: 291725 - DNA, 16 bp, P. troglodytes
ttttaataaatgcttt

SEQ ID NO: 291726 - DNA, 16 bp, P. troglodytes
ttttaataaatgtcat

SEQ ID NO: 291727 - DNA, 16 bp, P. troglodytes
ttttaataagccctcc

SEQ ID NO: 291728 - DNA, 19 bp, P. troglodytes
ttttaataatcaccattct

SEQ ID NO: 291729 - DNA, 16 bp, P. troglodytes
ttttaataattatgct

SEQ ID NO: 291730 - DNA, 16 bp, P. troglodytes
ttttaatacagttttt

SEQ ID NO: 291731 - DNA, 16 bp, P. troglodytes
ttttaatacattttga

SEQ ID NO: 291732 - DNA, 17 bp, P. troglodytes
ttttaatactttaagtt

SEQ ID NO: 291733 - DNA, 16 bp, P. troglodytes
ttttaatagacacggg

SEQ ID NO: 291734 - DNA, 16 bp, P. troglodytes
ttttaatagacttttt

SEQ ID NO: 291735 - DNA, 16 bp, P. troglodytes
ttttaatagatgaaaa

SEQ ID NO: 291736 - DNA, 16 bp, P. troglodytes
ttttaatagccttttc

SEQ ID NO: 291737 - DNA, 16 bp, P. troglodytes
ttttaataggcatttc

SEQ ID NO: 291738 - DNA, 16 bp, P. troglodytes
ttttaatagtagccat

SEQ ID NO: 291739 - DNA, 16 bp, P. troglodytes
ttttaatatagacatt

SEQ ID NO: 291740 - DNA, 16 bp, P. troglodytes
ttttaatattagccat

SEQ ID NO: 291741 - DNA, 16 bp, P. troglodytes
ttttaatattctgtgt

SEQ ID NO: 291742 - DNA, 16 bp, P. troglodytes
ttttaatcaaatgttt

SEQ ID NO: 291743 - DNA, 16 bp, P. troglodytes
ttttaatcaccatttt

SEQ ID NO: 291744 - DNA, 16 bp, P. troglodytes
ttttaatcattgccat

SEQ ID NO: 291745 - DNA, 16 bp, P. troglodytes
ttttaatccatatttc

SEQ ID NO: 291746 - DNA, 16 bp, P. troglodytes
ttttaatctctaaaat

SEQ ID NO: 291747 - DNA, 16 bp, P. troglodytes
ttttaatctctttgaa

SEQ ID NO: 291748 - DNA, 16 bp, P. troglodytes
ttttaatctgaaaaaa

SEQ ID NO: 291749 - DNA, 16 bp, P. troglodytes
ttttaatctgtatttc

SEQ ID NO: 291750 - DNA, 16 bp, P. troglodytes
ttttaatgaaaacttt

SEQ ID NO: 291751 - DNA, 16 bp, P. troglodytes
ttttaatgaaatgaaa

SEQ ID NO: 291752 - DNA, 16 bp, P. troglodytes
ttttaatgaagttgtt

SEQ ID NO: 291753 - DNA, 16 bp, P. troglodytes
ttttaatgaatttcaa

SEQ ID NO: 291754 - DNA, 16 bp, P. troglodytes
ttttaatgaggaaaat

SEQ ID NO: 291755 - DNA, 16 bp, P. troglodytes
ttttaatgaggatttt

SEQ ID NO: 291756 - DNA, 16 bp, P. troglodytes
ttttaatgattaccat

SEQ ID NO: 291757 - DNA, 16 bp, P. troglodytes
ttttaatgcattaaaa

SEQ ID NO: 291758 - DNA, 16 bp, P. troglodytes
ttttaatgctttaaat

SEQ ID NO: 291759 - DNA, 16 bp, P. troglodytes
ttttaatggaaaataa

SEQ ID NO: 291760 - DNA, 16 bp, P. troglodytes
ttttaatggaaaatat

SEQ ID NO: 291761 - DNA, 16 bp, P. troglodytes
ttttaatggaaaattt

SEQ ID NO: 291762 - DNA, 16 bp, P. troglodytes
ttttaatggagaaaaa

SEQ ID NO: 291763 - DNA, 16 bp, P. troglodytes
ttttaatggagttgtt

SEQ ID NO: 291764 - DNA, 16 bp, P. troglodytes
ttttaatggcaaaaat

SEQ ID NO: 291765 - DNA, 16 bp, P. troglodytes
ttttaatggtgaaaac

SEQ ID NO: 291766 - DNA, 16 bp, P. troglodytes
ttttaatgtaaacaaa

SEQ ID NO: 291767 - DNA, 16 bp, P. troglodytes
ttttaatgtatctatt

SEQ ID NO: 291768 - DNA, 16 bp, P. troglodytes
ttttaatgtctcattt

SEQ ID NO: 291769 - DNA, 16 bp, P. troglodytes
ttttaattagagaaaa

SEQ ID NO: 291770 - DNA, 16 bp, P. troglodytes
ttttaattatggtaaa

SEQ ID NO: 291771 - DNA, 16 bp, P. troglodytes
ttttaattatgtgaaa

SEQ ID NO: 291772 - DNA, 16 bp, P. troglodytes
ttttaattcaagaaat

SEQ ID NO: 291773 - DNA, 16 bp, P. troglodytes
ttttaattcacatttc

SEQ ID NO: 291774 - DNA, 16 bp, P. troglodytes
ttttaattcagcaaat

SEQ ID NO: 291775 - DNA, 16 bp, P. troglodytes
ttttaattcatcttga

SEQ ID NO: 291776 - DNA, 16 bp, P. troglodytes
ttttaattcatttgaa

SEQ ID NO: 291777 - DNA, 16 bp, P. troglodytes
ttttaattctgttgat

SEQ ID NO: 291778 - DNA, 16 bp, P. troglodytes
ttttaattgaagaaaa

SEQ ID NO: 291779 - DNA, 16 bp, P. troglodytes
ttttaattgacaagta

SEQ ID NO: 291780 - DNA, 16 bp, P. troglodytes
ttttaattgagcattt

SEQ ID NO: 291781 - DNA, 16 bp, P. troglodytes
ttttaattgaggtata

SEQ ID NO: 291782 - DNA, 16 bp, P. troglodytes
ttttaattgcatttcc

SEQ ID NO: 291783 - DNA, 16 bp, P. troglodytes
ttttaattgggatatt

SEQ ID NO: 291784 - DNA, 16 bp, P. troglodytes
ttttaattgggctgtt

SEQ ID NO: 291785 - DNA, 16 bp, P. troglodytes
ttttaattgtgatgtc

SEQ ID NO: 291786 - DNA, 16 bp, P. troglodytes
ttttaatttaacagaa

SEQ ID NO: 291787 - DNA, 16 bp, P. troglodytes
ttttaatttcagaaaa

SEQ ID NO: 291788 - DNA, 16 bp, P. troglodytes
ttttaatttcaggaaa

SEQ ID NO: 291789 - DNA, 16 bp, P. troglodytes
ttttaatttctcaaaa

SEQ ID NO: 291790 - DNA, 16 bp, P. troglodytes
ttttaatttctgaatt

SEQ ID NO: 291791 - DNA, 16 bp, P. troglodytes
ttttaatttctttaga

SEQ ID NO: 291792 - DNA, 16 bp, P. troglodytes
ttttaatttgaaaaca

SEQ ID NO: 291793 - DNA, 16 bp, P. troglodytes
ttttaatttgcagttt

SEQ ID NO: 291794 - DNA, 16 bp, P. troglodytes
ttttaatttggatttc

SEQ ID NO: 291795 - DNA, 16 bp, P. troglodytes
ttttaattttcagttc

SEQ ID NO: 291796 - DNA, 16 bp, P. troglodytes
ttttaattttcatgta

SEQ ID NO: 291797 - DNA, 16 bp, P. troglodytes
ttttaattttgcaata

SEQ ID NO: 291798 - DNA, 16 bp, P. troglodytes
ttttaattttgggaaa

SEQ ID NO: 291799 - DNA, 16 bp, P. troglodytes
ttttaatttttgtcag

SEQ ID NO: 291800 - DNA, 16 bp, P. troglodytes
ttttacaaaaagaaaa

SEQ ID NO: 291801 - DNA, 16 bp, P. troglodytes
ttttacaaaaagaaat

SEQ ID NO: 291802 - DNA, 16 bp, P. troglodytes
ttttacaaaaaggaaa

SEQ ID NO: 291803 - DNA, 16 bp, P. troglodytes
ttttacaaaagagaaa

SEQ ID NO: 291804 - DNA, 16 bp, P. troglodytes
ttttacaaaagggaaa

SEQ ID NO: 291805 - DNA, 16 bp, P. troglodytes
ttttacaaaatgtttt

SEQ ID NO: 291806 - DNA, 16 bp, P. troglodytes
ttttacaaacaagaaa

SEQ ID NO: 291807 - DNA, 16 bp, P. troglodytes
ttttacaaagattttt

SEQ ID NO: 291808 - DNA, 16 bp, P. troglodytes
ttttacaaaggaaaaa

SEQ ID NO: 291809 - DNA, 16 bp, P. troglodytes
ttttacaaaggtgcca

SEQ ID NO: 291810 - DNA, 16 bp, P. troglodytes
ttttacaaataaatgt

SEQ ID NO: 291811 - DNA, 16 bp, P. troglodytes
ttttacaaataaggaa

SEQ ID NO: 291812 - DNA, 16 bp, P. troglodytes
ttttacaaatgaaaaa

SEQ ID NO: 291813 - DNA, 16 bp, P. troglodytes
ttttacaaatgcagaa

SEQ ID NO: 291814 - DNA, 16 bp, P. troglodytes
ttttacaacagtgatg

SEQ ID NO: 291815 - DNA, 16 bp, P. troglodytes
ttttacaagttttaaa

SEQ ID NO: 291816 - DNA, 16 bp, P. troglodytes
ttttacacaaatggta

SEQ ID NO: 291817 - DNA, 16 bp, P. troglodytes
ttttacagaaaaaaaa

SEQ ID NO: 291818 - DNA, 16 bp, P. troglodytes
ttttacagaaataaaa

SEQ ID NO: 291819 - DNA, 16 bp, P. troglodytes
ttttacagaagaaaaa

SEQ ID NO: 291820 - DNA, 16 bp, P. troglodytes
ttttacagaagacaaa

SEQ ID NO: 291821 - DNA, 16 bp, P. troglodytes
ttttacagaagcagaa

SEQ ID NO: 291822 - DNA, 16 bp, P. troglodytes
ttttacagaaggaaaa

SEQ ID NO: 291823 - DNA, 16 bp, P. troglodytes
ttttacagagagaaaa

SEQ ID NO: 291824 - DNA, 16 bp, P. troglodytes
ttttacagaggagaag

SEQ ID NO: 291825 - DNA, 16 bp, P. troglodytes
ttttacagaggaggag

SEQ ID NO: 291826 - DNA, 16 bp, P. troglodytes
ttttacagataaagga

SEQ ID NO: 291827 - DNA, 16 bp, P. troglodytes
ttttacagatgaagga

SEQ ID NO: 291828 - DNA, 16 bp, P. troglodytes
ttttacagatgaggaa

SEQ ID NO: 291829 - DNA, 16 bp, P. troglodytes
ttttacagatgctgaa

SEQ ID NO: 291830 - DNA, 16 bp, P. troglodytes
ttttacagatgtgaaa

SEQ ID NO: 291831 - DNA, 16 bp, P. troglodytes
ttttacagcagaggaa

SEQ ID NO: 291832 - DNA, 16 bp, P. troglodytes
ttttacagcagtgtga

SEQ ID NO: 291833 - DNA, 16 bp, P. troglodytes
ttttacaggttcatag

SEQ ID NO: 291834 - DNA, 16 bp, P. troglodytes
ttttacagttaaggaa

SEQ ID NO: 291835 - DNA, 16 bp, P. troglodytes
ttttacagttgaagaa

SEQ ID NO: 291836 - DNA, 16 bp, P. troglodytes
ttttacagttgagaaa

SEQ ID NO: 291837 - DNA, 16 bp, P. troglodytes
ttttacagttttcagt

SEQ ID NO: 291838 - DNA, 16 bp, P. troglodytes
ttttacataaacattt

SEQ ID NO: 291839 - DNA, 16 bp, P. troglodytes
ttttacataaatagaa

SEQ ID NO: 291840 - DNA, 16 bp, P. troglodytes
ttttacatatgtaaaa

SEQ ID NO: 291841 - DNA, 16 bp, P. troglodytes
ttttacatatgtaaat

SEQ ID NO: 291842 - DNA, 16 bp, P. troglodytes
ttttacatatgtattt

SEQ ID NO: 291843 - DNA, 16 bp, P. troglodytes
ttttacatgaaaaaaa

SEQ ID NO: 291844 - DNA, 16 bp, P. troglodytes
ttttacatgagagaaa

SEQ ID NO: 291845 - DNA, 16 bp, P. troglodytes
ttttacatgtgaatat

SEQ ID NO: 291846 - DNA, 16 bp, P. troglodytes
ttttacatgtggccca

SEQ ID NO: 291847 - DNA, 16 bp, P. troglodytes
ttttacattgattttg

SEQ ID NO: 291848 - DNA, 16 bp, P. troglodytes
ttttacattgttgatg

SEQ ID NO: 291849 - DNA, 16 bp, P. troglodytes
ttttacatttaagtct

SEQ ID NO: 291850 - DNA, 16 bp, P. troglodytes
ttttacatttctgaat

SEQ ID NO: 291851 - DNA, 16 bp, P. troglodytes
ttttacatttgagaaa

SEQ ID NO: 291852 - DNA, 16 bp, P. troglodytes
ttttacattttgaaaa

SEQ ID NO: 291853 - DNA, 16 bp, P. troglodytes
ttttacatttttgaat

SEQ ID NO: 291854 - DNA, 16 bp, P. troglodytes
ttttacatttttgata

SEQ ID NO: 291855 - DNA, 16 bp, P. troglodytes
ttttaccacaataaaa

SEQ ID NO: 291856 - DNA, 16 bp, P. troglodytes
ttttaccactgttatt

SEQ ID NO: 291857 - DNA, 16 bp, P. troglodytes
ttttacccattttaaa

SEQ ID NO: 291858 - DNA, 16 bp, P. troglodytes
ttttaccccaaaatat

SEQ ID NO: 291859 - DNA, 16 bp, P. troglodytes
ttttaccttttcaaaa

SEQ ID NO: 291860 - DNA, 16 bp, P. troglodytes
ttttactagaaatggg

SEQ ID NO: 291861 - DNA, 20 bp, P. troglodytes
ttttactagagatggggttt

SEQ ID NO: 291862 - DNA, 16 bp, P. troglodytes
ttttactataaagaca

SEQ ID NO: 291863 - DNA, 16 bp, P. troglodytes
ttttactgagatataa

SEQ ID NO: 291864 - DNA, 16 bp, P. troglodytes
ttttactgtatataaa

SEQ ID NO: 291865 - DNA, 16 bp, P. troglodytes
ttttactgtttgtaaa

SEQ ID NO: 291866 - DNA, 16 bp, P. troglodytes
ttttacttaaaaacaa

SEQ ID NO: 291867 - DNA, 16 bp, P. troglodytes
ttttacttactgattt

SEQ ID NO: 291868 - DNA, 16 bp, P. troglodytes
ttttacttagtgtaat

SEQ ID NO: 291869 - DNA, 16 bp, P. troglodytes
ttttacttctgggtat

SEQ ID NO: 291870 - DNA, 16 bp, P. troglodytes
ttttactttcttgata

SEQ ID NO: 291871 - DNA, 16 bp, P. troglodytes
ttttactttgaaataa

SEQ ID NO: 291872 - DNA, 16 bp, P. troglodytes
ttttactttgaatatt

SEQ ID NO: 291873 - DNA, 16 bp, P. troglodytes
ttttactttgcatttc

SEQ ID NO: 291874 - DNA, 16 bp, P. troglodytes
ttttactttgtaaaat

SEQ ID NO: 291875 - DNA, 16 bp, P. troglodytes
ttttacttttaaagaa

SEQ ID NO: 291876 - DNA, 16 bp, P. troglodytes
ttttacttttcaaatg

SEQ ID NO: 291877 - DNA, 16 bp, P. troglodytes
ttttacttttctgaaa

SEQ ID NO: 291878 - DNA, 16 bp, P. troglodytes
ttttacttttgtaaaa

SEQ ID NO: 291879 - DNA, 16 bp, P. troglodytes
ttttagaaaaaaaatc

SEQ ID NO: 291880 - DNA, 16 bp, P. troglodytes
ttttagaaaaaaactt

SEQ ID NO: 291881 - DNA, 16 bp, P. troglodytes
ttttagaaaacaaata

SEQ ID NO: 291882 - DNA, 16 bp, P. troglodytes
ttttagaaaacaattt

SEQ ID NO: 291883 - DNA, 16 bp, P. troglodytes
ttttagaaaacagaaa

SEQ ID NO: 291884 - DNA, 16 bp, P. troglodytes
ttttagaaaactgttt

SEQ ID NO: 291885 - DNA, 16 bp, P. troglodytes
ttttagaaaaggaaaa

SEQ ID NO: 291886 - DNA, 16 bp, P. troglodytes
ttttagaaaataacat

SEQ ID NO: 291887 - DNA, 16 bp, P. troglodytes
ttttagaaaatagttt

SEQ ID NO: 291888 - DNA, 16 bp, P. troglodytes
ttttagaaagaaaaag

SEQ ID NO: 291889 - DNA, 16 bp, P. troglodytes
ttttagaaagaaaaca

SEQ ID NO: 291890 - DNA, 16 bp, P. troglodytes
ttttagaaagataatt

SEQ ID NO: 291891 - DNA, 16 bp, P. troglodytes
ttttagaaagattatt

SEQ ID NO: 291892 - DNA, 16 bp, P. troglodytes
ttttagaaagcatttt

SEQ ID NO: 291893 - DNA, 16 bp, P. troglodytes
ttttagaaatgtaaat

SEQ ID NO: 291894 - DNA, 16 bp, P. troglodytes
ttttagaaatgtgaaa

SEQ ID NO: 291895 - DNA, 16 bp, P. troglodytes
ttttagaaattaagaa

SEQ ID NO: 291896 - DNA, 16 bp, P. troglodytes
ttttagaagaaaatga

SEQ ID NO: 291897 - DNA, 16 bp, P. troglodytes
ttttagaagaaacagg

SEQ ID NO: 291898 - DNA, 16 bp, P. troglodytes
ttttagaagaaatgaa

SEQ ID NO: 291899 - DNA, 16 bp, P. troglodytes
ttttagaagaagaaaa

SEQ ID NO: 291900 - DNA, 16 bp, P. troglodytes
ttttagaagagatggg

SEQ ID NO: 291901 - DNA, 16 bp, P. troglodytes
ttttagaaggaaaact

SEQ ID NO: 291902 - DNA, 16 bp, P. troglodytes
ttttagaagtagaatt

SEQ ID NO: 291903 - DNA, 16 bp, P. troglodytes
ttttagaattaaatga

SEQ ID NO: 291904 - DNA, 16 bp, P. troglodytes
ttttagaattttcagc

SEQ ID NO: 291905 - DNA, 16 bp, P. troglodytes
ttttagacagagtctc

SEQ ID NO: 291906 - DNA, 16 bp, P. troglodytes
ttttagacttacagaa

SEQ ID NO: 291907 - DNA, 16 bp, P. troglodytes
ttttagagaaggaaaa

SEQ ID NO: 291908 - DNA, 16 bp, P. troglodytes
ttttagagacagtctt

SEQ ID NO: 291909 - DNA, 16 bp, P. troglodytes
ttttagagagacaggg

SEQ ID NO: 291910 - DNA, 16 bp, P. troglodytes
ttttagagatgaagaa

SEQ ID NO: 291911 - DNA, 16 bp, P. troglodytes
ttttagagatgaggat

SEQ ID NO: 291912 - DNA, 16 bp, P. troglodytes
ttttagagatgggaaa

SEQ ID NO: 291913 - DNA, 16 bp, P. troglodytes
ttttagagatttaaaa

SEQ ID NO: 291914 - DNA, 16 bp, P. troglodytes
ttttagagcagaagtg

SEQ ID NO: 291915 - DNA, 16 bp, P. troglodytes
ttttagagcagtttta

SEQ ID NO: 291916 - DNA, 16 bp, P. troglodytes
ttttagagcagttttg

SEQ ID NO: 291917 - DNA, 16 bp, P. troglodytes
ttttagaggtagggtc

SEQ ID NO: 291918 - DNA, 16 bp, P. troglodytes
ttttagatattaacct

SEQ ID NO: 291919 - DNA, 16 bp, P. troglodytes
ttttagatggcgtctc

SEQ ID NO: 291920 - DNA, 16 bp, P. troglodytes
ttttagattcaggaag

SEQ ID NO: 291921 - DNA, 16 bp, P. troglodytes
ttttagattccacata

SEQ ID NO: 291922 - DNA, 16 bp, P. troglodytes
ttttagatttctaaaa

SEQ ID NO: 291923 - DNA, 16 bp, P. troglodytes
ttttagattttggaat

SEQ ID NO: 291924 - DNA, 16 bp, P. troglodytes
ttttagcaaaaaaaaa

SEQ ID NO: 291925 - DNA, 16 bp, P. troglodytes
ttttagcactgaaagt

SEQ ID NO: 291926 - DNA, 16 bp, P. troglodytes
ttttagcattttttaa

SEQ ID NO: 291927 - DNA, 16 bp, P. troglodytes
ttttagcccagtgaga

SEQ ID NO: 291928 - DNA, 16 bp, P. troglodytes
ttttagccttttaaaa

SEQ ID NO: 291929 - DNA, 16 bp, P. troglodytes
ttttagctattatttc

SEQ ID NO: 291930 - DNA, 16 bp, P. troglodytes
ttttagctattttagt

SEQ ID NO: 291931 - DNA, 16 bp, P. troglodytes
ttttagctctaataat

SEQ ID NO: 291932 - DNA, 16 bp, P. troglodytes
ttttagcttctttgtg

SEQ ID NO: 291933 - DNA, 16 bp, P. troglodytes
ttttagctttaaaata

SEQ ID NO: 291934 - DNA, 16 bp, P. troglodytes
ttttaggaaagaaaaa

SEQ ID NO: 291935 - DNA, 16 bp, P. troglodytes
ttttaggaagacatga

SEQ ID NO: 291936 - DNA, 18 bp, P. troglodytes
ttttaggacaggtaaaat

SEQ ID NO: 291937 - DNA, 16 bp, P. troglodytes
ttttaggagaaaaaca

SEQ ID NO: 291938 - DNA, 16 bp, P. troglodytes
ttttaggagatggggt

SEQ ID NO: 291939 - DNA, 16 bp, P. troglodytes
ttttagggaaaagaaa

SEQ ID NO: 291940 - DNA, 16 bp, P. troglodytes
ttttagggcagtgaaa

SEQ ID NO: 291941 - DNA, 16 bp, P. troglodytes
ttttagggtacctgtg

SEQ ID NO: 291942 - DNA, 16 bp, P. troglodytes
ttttaggttcaggggt

SEQ ID NO: 291943 - DNA, 16 bp, P. troglodytes
ttttaggtttaaaaaa

SEQ ID NO: 291944 - DNA, 16 bp, P. troglodytes
ttttaggtttacagaa

SEQ ID NO: 291945 - DNA, 16 bp, P. troglodytes
ttttagtaaagaccag

SEQ ID NO: 291946 - DNA, 16 bp, P. troglodytes
ttttagtaaaggcagg

SEQ ID NO: 291947 - DNA, 16 bp, P. troglodytes
ttttagtaaattcaca

SEQ ID NO: 291948 - DNA, 16 bp, P. troglodytes
ttttagtaaatttgca

SEQ ID NO: 291949 - DNA, 16 bp, P. troglodytes
ttttagtacagatgag

SEQ ID NO: 291950 - DNA, 20 bp, P. troglodytes
ttttagtagaaatggggttt

SEQ ID NO: 291951 - DNA, 16 bp, P. troglodytes
ttttagtagaatcagg

SEQ ID NO: 291952 - DNA, 16 bp, P. troglodytes
ttttagtagagaagag

SEQ ID NO: 291953 - DNA, 17 bp, P. troglodytes
ttttagtagagacaaga

SEQ ID NO: 291954 - DNA, 25 bp, P. troglodytes
ttttagtagagacagggtttcaccg

SEQ ID NO: 291955 - DNA, 16 bp, P. troglodytes
ttttagtagagacatg

SEQ ID NO: 291956 - DNA, 16 bp, P. troglodytes
ttttagtagagacgga

SEQ ID NO: 291957 - DNA, 23 bp, P. troglodytes
ttttagtagagacgggatttcat

SEQ ID NO: 291958 - DNA, 17 bp, P. troglodytes
ttttagtagagacgggc

SEQ ID NO: 291959 - DNA, 27 bp, P. troglodytes
ttttagtagagacggggtttctccatg

SEQ ID NO: 291960 - DNA, 24 bp, P. troglodytes
ttttagtagagacggggttttacc

SEQ ID NO: 291961 - DNA, 22 bp, P. troglodytes
ttttagtagagatagggtttct

SEQ ID NO: 291962 - DNA, 22 bp, P. troglodytes
ttttagtagagatgggttttca

SEQ ID NO: 291963 - DNA, 20 bp, P. troglodytes
ttttagtagagctggggttt

SEQ ID NO: 291964 - DNA, 20 bp, P. troglodytes
ttttagtagaggcagggttt

SEQ ID NO: 291965 - DNA, 20 bp, P. troglodytes
ttttagtagaggtggggttt

SEQ ID NO: 291966 - DNA, 16 bp, P. troglodytes
ttttagtagataaggg

SEQ ID NO: 291967 - DNA, 20 bp, P. troglodytes
ttttagtagggacggggttt

SEQ ID NO: 291968 - DNA, 20 bp, P. troglodytes
ttttagtagggatggggttt

SEQ ID NO: 291969 - DNA, 20 bp, P. troglodytes
ttttagtagtgacggggttt

SEQ ID NO: 291970 - DNA, 16 bp, P. troglodytes
ttttagtatatgtgct

SEQ ID NO: 291971 - DNA, 16 bp, P. troglodytes
ttttagtatattttca

SEQ ID NO: 291972 - DNA, 16 bp, P. troglodytes
ttttagtcattctagt

SEQ ID NO: 291973 - DNA, 16 bp, P. troglodytes
ttttagtccattttgt

SEQ ID NO: 291974 - DNA, 16 bp, P. troglodytes
ttttagtgctaaataa

SEQ ID NO: 291975 - DNA, 16 bp, P. troglodytes
ttttagtggagaaggg

SEQ ID NO: 291976 - DNA, 16 bp, P. troglodytes
ttttagtggagaatgg

SEQ ID NO: 291977 - DNA, 27 bp, P. troglodytes
ttttagtggagacggggtttcaccgtg

SEQ ID NO: 291978 - DNA, 16 bp, P. troglodytes
ttttagtggagatagg

SEQ ID NO: 291979 - DNA, 16 bp, P. troglodytes
ttttagtggcttaaaa

SEQ ID NO: 291980 - DNA, 16 bp, P. troglodytes
ttttagttattctagt

SEQ ID NO: 291981 - DNA, 16 bp, P. troglodytes
ttttagtttcagaaaa

SEQ ID NO: 291982 - DNA, 16 bp, P. troglodytes
ttttagttttaacatt

SEQ ID NO: 291983 - DNA, 16 bp, P. troglodytes
ttttagttttagaaaa

SEQ ID NO: 291984 - DNA, 16 bp, P. troglodytes
ttttagttttgctgtc

SEQ ID NO: 291985 - DNA, 16 bp, P. troglodytes
ttttagtttttgagga

SEQ ID NO: 291986 - DNA, 16 bp, P. troglodytes
ttttagtttttggaga

SEQ ID NO: 291987 - DNA, 16 bp, P. troglodytes
ttttataaaagtgaaa

SEQ ID NO: 291988 - DNA, 16 bp, P. troglodytes
ttttataaactggttt

SEQ ID NO: 291989 - DNA, 16 bp, P. troglodytes
ttttataaagctcaaa

SEQ ID NO: 291990 - DNA, 16 bp, P. troglodytes
ttttataaagcttttt

SEQ ID NO: 291991 - DNA, 16 bp, P. troglodytes
ttttataaaggaagaa

SEQ ID NO: 291992 - DNA, 16 bp, P. troglodytes
ttttataaatggcagt

SEQ ID NO: 291993 - DNA, 16 bp, P. troglodytes
ttttataaatgtagaa

SEQ ID NO: 291994 - DNA, 16 bp, P. troglodytes
ttttataaattaccca

SEQ ID NO: 291995 - DNA, 16 bp, P. troglodytes
ttttataatctgattt

SEQ ID NO: 291996 - DNA, 16 bp, P. troglodytes
ttttataatgcatttt

SEQ ID NO: 291997 - DNA, 16 bp, P. troglodytes
ttttataatgttcttc

SEQ ID NO: 291998 - DNA, 16 bp, P. troglodytes
ttttataatttgaggt

SEQ ID NO: 291999 - DNA, 16 bp, P. troglodytes
ttttatacaatgtttt

SEQ ID NO: 292000 - DNA, 16 bp, P. troglodytes
ttttatacatttcaaa

SEQ ID NO: 292001 - DNA, 16 bp, P. troglodytes
ttttatacattttagg

SEQ ID NO: 292002 - DNA, 16 bp, P. troglodytes
ttttataccagtatca

SEQ ID NO: 292003 - DNA, 16 bp, P. troglodytes
ttttataccttcagat

SEQ ID NO: 292004 - DNA, 16 bp, P. troglodytes
ttttatacttggaaaa

SEQ ID NO: 292005 - DNA, 16 bp, P. troglodytes
ttttatagaaaaggaa

SEQ ID NO: 292006 - DNA, 16 bp, P. troglodytes
ttttatagaaaagttt

SEQ ID NO: 292007 - DNA, 16 bp, P. troglodytes
ttttatagaagaggaa

SEQ ID NO: 292008 - DNA, 16 bp, P. troglodytes
ttttatagaatctgca

SEQ ID NO: 292009 - DNA, 16 bp, P. troglodytes
ttttatagacagagaa

SEQ ID NO: 292010 - DNA, 16 bp, P. troglodytes
ttttatagagaaaggg

SEQ ID NO: 292011 - DNA, 16 bp, P. troglodytes
ttttatagagaaggaa

SEQ ID NO: 292012 - DNA, 16 bp, P. troglodytes
ttttatagagtgctga

SEQ ID NO: 292013 - DNA, 16 bp, P. troglodytes
ttttatagataaggaa

SEQ ID NO: 292014 - DNA, 16 bp, P. troglodytes
ttttatagatgagaaa

SEQ ID NO: 292015 - DNA, 16 bp, P. troglodytes
ttttatagattctgga

SEQ ID NO: 292016 - DNA, 16 bp, P. troglodytes
ttttataggaaagaaa

SEQ ID NO: 292017 - DNA, 16 bp, P. troglodytes
ttttatagttgaagaa

SEQ ID NO: 292018 - DNA, 16 bp, P. troglodytes
ttttatagtttcagat

SEQ ID NO: 292019 - DNA, 16 bp, P. troglodytes
ttttatagtttccagt

SEQ ID NO: 292020 - DNA, 16 bp, P. troglodytes
ttttatatgaagaaat

SEQ ID NO: 292021 - DNA, 16 bp, P. troglodytes
ttttatatgcatatat

SEQ ID NO: 292022 - DNA, 16 bp, P. troglodytes
ttttatatgcatattt

SEQ ID NO: 292023 - DNA, 16 bp, P. troglodytes
ttttatatgcattggg

SEQ ID NO: 292024 - DNA, 16 bp, P. troglodytes
ttttatatgcttttaa

SEQ ID NO: 292025 - DNA, 16 bp, P. troglodytes
ttttatatggaaccaa

SEQ ID NO: 292026 - DNA, 16 bp, P. troglodytes
ttttatatttacagaa

SEQ ID NO: 292027 - DNA, 16 bp, P. troglodytes
ttttatatttagatct

SEQ ID NO: 292028 - DNA, 16 bp, P. troglodytes
ttttatatttcacaaa

SEQ ID NO: 292029 - DNA, 16 bp, P. troglodytes
ttttatatttcagaaa

SEQ ID NO: 292030 - DNA, 16 bp, P. troglodytes
ttttatatttccaaaa

SEQ ID NO: 292031 - DNA, 16 bp, P. troglodytes
ttttatatttgcatat

SEQ ID NO: 292032 - DNA, 16 bp, P. troglodytes
ttttatatttggaaaa

SEQ ID NO: 292033 - DNA, 16 bp, P. troglodytes
ttttatatttttggca

SEQ ID NO: 292034 - DNA, 16 bp, P. troglodytes
ttttatcaaaagactt

SEQ ID NO: 292035 - DNA, 16 bp, P. troglodytes
ttttatcaaaatgaaa

SEQ ID NO: 292036 - DNA, 16 bp, P. troglodytes
ttttatcaatgtttta

SEQ ID NO: 292037 - DNA, 16 bp, P. troglodytes
ttttatcactgattca

SEQ ID NO: 292038 - DNA, 16 bp, P. troglodytes
ttttatcatcccaaaa

SEQ ID NO: 292039 - DNA, 16 bp, P. troglodytes
ttttatcatctataaa

SEQ ID NO: 292040 - DNA, 16 bp, P. troglodytes
ttttatcatgaaaagg

SEQ ID NO: 292041 - DNA, 16 bp, P. troglodytes
ttttatcatgaaagca

SEQ ID NO: 292042 - DNA, 16 bp, P. troglodytes
ttttatcatgaaggga

SEQ ID NO: 292043 - DNA, 16 bp, P. troglodytes
ttttatcattatgtaa

SEQ ID NO: 292044 - DNA, 16 bp, P. troglodytes
ttttatcattttgaaa

SEQ ID NO: 292045 - DNA, 16 bp, P. troglodytes
ttttatccattattga

SEQ ID NO: 292046 - DNA, 16 bp, P. troglodytes
ttttatccctcacacc

SEQ ID NO: 292047 - DNA, 16 bp, P. troglodytes
ttttatccctcaccct

SEQ ID NO: 292048 - DNA, 16 bp, P. troglodytes
ttttatctaaagtaaa

SEQ ID NO: 292049 - DNA, 16 bp, P. troglodytes
ttttatctacttttga

SEQ ID NO: 292050 - DNA, 18 bp, P. troglodytes
ttttatctataagcccct

SEQ ID NO: 292051 - DNA, 16 bp, P. troglodytes
ttttatctgatattaa

SEQ ID NO: 292052 - DNA, 16 bp, P. troglodytes
ttttatctgcatttta

SEQ ID NO: 292053 - DNA, 16 bp, P. troglodytes
ttttatctggggatgt

SEQ ID NO: 292054 - DNA, 16 bp, P. troglodytes
ttttatctgtaaaatg

SEQ ID NO: 292055 - DNA, 16 bp, P. troglodytes
ttttatctttaaaaag

SEQ ID NO: 292056 - DNA, 16 bp, P. troglodytes
ttttatctttaaaatg

SEQ ID NO: 292057 - DNA, 16 bp, P. troglodytes
ttttatctttagtaga

SEQ ID NO: 292058 - DNA, 16 bp, P. troglodytes
ttttatgaaaaataac

SEQ ID NO: 292059 - DNA, 16 bp, P. troglodytes
ttttatgaaaatgaaa

SEQ ID NO: 292060 - DNA, 16 bp, P. troglodytes
ttttatgaaacattta

SEQ ID NO: 292061 - DNA, 16 bp, P. troglodytes
ttttatgaatgaaaaa

SEQ ID NO: 292062 - DNA, 16 bp, P. troglodytes
ttttatgatgaaaaca

SEQ ID NO: 292063 - DNA, 16 bp, P. troglodytes
ttttatgatgaaaatg

SEQ ID NO: 292064 - DNA, 16 bp, P. troglodytes
ttttatgatgctttga

SEQ ID NO: 292065 - DNA, 16 bp, P. troglodytes
ttttatgcatattttc

SEQ ID NO: 292066 - DNA, 16 bp, P. troglodytes
ttttatgccattttaa

SEQ ID NO: 292067 - DNA, 16 bp, P. troglodytes
ttttatggaaccacaa

SEQ ID NO: 292068 - DNA, 16 bp, P. troglodytes
ttttatggaagcttca

SEQ ID NO: 292069 - DNA, 16 bp, P. troglodytes
ttttatggaggaggaa

SEQ ID NO: 292070 - DNA, 16 bp, P. troglodytes
ttttatggatgagtag

SEQ ID NO: 292071 - DNA, 16 bp, P. troglodytes
ttttatggctctgtag

SEQ ID NO: 292072 - DNA, 16 bp, P. troglodytes
ttttatggtagcaaat

SEQ ID NO: 292073 - DNA, 16 bp, P. troglodytes
ttttatggtttcatgt

SEQ ID NO: 292074 - DNA, 16 bp, P. troglodytes
ttttatgtacctttgg

SEQ ID NO: 292075 - DNA, 16 bp, P. troglodytes
ttttatgtagagatgg

SEQ ID NO: 292076 - DNA, 16 bp, P. troglodytes
ttttatgtatttcaaa

SEQ ID NO: 292077 - DNA, 16 bp, P. troglodytes
ttttatgtattttcca

SEQ ID NO: 292078 - DNA, 16 bp, P. troglodytes
ttttatgtcaattaaa

SEQ ID NO: 292079 - DNA, 16 bp, P. troglodytes
ttttatgtctaaaaat

SEQ ID NO: 292080 - DNA, 16 bp, P. troglodytes
ttttatgtgaaagaaa

SEQ ID NO: 292081 - DNA, 16 bp, P. troglodytes
ttttatgtgaaattag

SEQ ID NO: 292082 - DNA, 16 bp, P. troglodytes
ttttatgtgaaatttc

SEQ ID NO: 292083 - DNA, 16 bp, P. troglodytes
ttttatgtgtacatat

SEQ ID NO: 292084 - DNA, 16 bp, P. troglodytes
ttttatgttatagaga

SEQ ID NO: 292085 - DNA, 16 bp, P. troglodytes
ttttatgttttcagta

SEQ ID NO: 292086 - DNA, 16 bp, P. troglodytes
ttttatgtttttcaaa

SEQ ID NO: 292087 - DNA, 16 bp, P. troglodytes
ttttatgtttttcaga

SEQ ID NO: 292088 - DNA, 16 bp, P. troglodytes
ttttattaaaacacag

SEQ ID NO: 292089 - DNA, 16 bp, P. troglodytes
ttttattaaaagcttt

SEQ ID NO: 292090 - DNA, 16 bp, P. troglodytes
ttttattaaaaggaaa

SEQ ID NO: 292091 - DNA, 16 bp, P. troglodytes
ttttattaaaggaaaa

SEQ ID NO: 292092 - DNA, 16 bp, P. troglodytes
ttttattaagagaaaa

SEQ ID NO: 292093 - DNA, 16 bp, P. troglodytes
ttttattaatgagaaa

SEQ ID NO: 292094 - DNA, 16 bp, P. troglodytes
ttttattacagaaaat

SEQ ID NO: 292095 - DNA, 16 bp, P. troglodytes
ttttattacagtattt

SEQ ID NO: 292096 - DNA, 16 bp, P. troglodytes
ttttattagaaagaaa

SEQ ID NO: 292097 - DNA, 16 bp, P. troglodytes
ttttattaggaaaaaa

SEQ ID NO: 292098 - DNA, 16 bp, P. troglodytes
ttttattatggcaaaa

SEQ ID NO: 292099 - DNA, 16 bp, P. troglodytes
ttttattatggcagcc

SEQ ID NO: 292100 - DNA, 16 bp, P. troglodytes
ttttattatggtaaaa

SEQ ID NO: 292101 - DNA, 16 bp, P. troglodytes
ttttattcacttaaca

SEQ ID NO: 292102 - DNA, 16 bp, P. troglodytes
ttttattcagaatttt

SEQ ID NO: 292103 - DNA, 16 bp, P. troglodytes
ttttattcatttgcat

SEQ ID NO: 292104 - DNA, 16 bp, P. troglodytes
ttttattccaaataaa

SEQ ID NO: 292105 - DNA, 16 bp, P. troglodytes
ttttattccattctgt

SEQ ID NO: 292106 - DNA, 16 bp, P. troglodytes
ttttattctttgagaa

SEQ ID NO: 292107 - DNA, 16 bp, P. troglodytes
ttttattcttttgaga

SEQ ID NO: 292108 - DNA, 16 bp, P. troglodytes
ttttattgaacatttt

SEQ ID NO: 292109 - DNA, 16 bp, P. troglodytes
ttttattgaagaataa

SEQ ID NO: 292110 - DNA, 16 bp, P. troglodytes
ttttattgagatggag

SEQ ID NO: 292111 - DNA, 16 bp, P. troglodytes
ttttattgagcagttt

SEQ ID NO: 292112 - DNA, 16 bp, P. troglodytes
ttttattgaggaattt

SEQ ID NO: 292113 - DNA, 16 bp, P. troglodytes
ttttattgcatgtatt

SEQ ID NO: 292114 - DNA, 16 bp, P. troglodytes
ttttattgcatttgct

SEQ ID NO: 292115 - DNA, 16 bp, P. troglodytes
ttttattgcctctatt

SEQ ID NO: 292116 - DNA, 16 bp, P. troglodytes
ttttattgctaaataa

SEQ ID NO: 292117 - DNA, 16 bp, P. troglodytes
ttttattgctaagtaa

SEQ ID NO: 292118 - DNA, 16 bp, P. troglodytes
ttttattgctgagtag

SEQ ID NO: 292119 - DNA, 16 bp, P. troglodytes
ttttattggaatatag

SEQ ID NO: 292120 - DNA, 16 bp, P. troglodytes
ttttattggacttaca

SEQ ID NO: 292121 - DNA, 16 bp, P. troglodytes
ttttattgtactttaa

SEQ ID NO: 292122 - DNA, 16 bp, P. troglodytes
ttttattgtgctttgc

SEQ ID NO: 292123 - DNA, 16 bp, P. troglodytes
ttttatttaaaggaaa

SEQ ID NO: 292124 - DNA, 16 bp, P. troglodytes
ttttatttaacattgt

SEQ ID NO: 292125 - DNA, 16 bp, P. troglodytes
ttttatttaaccctat

SEQ ID NO: 292126 - DNA, 16 bp, P. troglodytes
ttttatttcaaaaaga

SEQ ID NO: 292127 - DNA, 16 bp, P. troglodytes
ttttatttcaaccatt

SEQ ID NO: 292128 - DNA, 16 bp, P. troglodytes
ttttatttcagatatt

SEQ ID NO: 292129 - DNA, 16 bp, P. troglodytes
ttttatttcagtactt

SEQ ID NO: 292130 - DNA, 16 bp, P. troglodytes
ttttatttcatgtaaa

SEQ ID NO: 292131 - DNA, 16 bp, P. troglodytes
ttttatttcattgaat

SEQ ID NO: 292132 - DNA, 16 bp, P. troglodytes
ttttatttctaaaatg

SEQ ID NO: 292133 - DNA, 16 bp, P. troglodytes
ttttatttctagcatt

SEQ ID NO: 292134 - DNA, 16 bp, P. troglodytes
ttttatttctatgaaa

SEQ ID NO: 292135 - DNA, 16 bp, P. troglodytes
ttttatttctcaaaga

SEQ ID NO: 292136 - DNA, 16 bp, P. troglodytes
ttttatttctccatca

SEQ ID NO: 292137 - DNA, 16 bp, P. troglodytes
ttttatttctcttgag

SEQ ID NO: 292138 - DNA, 16 bp, P. troglodytes
ttttatttctgaaaat

SEQ ID NO: 292139 - DNA, 16 bp, P. troglodytes
ttttatttctgaggca

SEQ ID NO: 292140 - DNA, 16 bp, P. troglodytes
ttttatttctgtaaaa

SEQ ID NO: 292141 - DNA, 16 bp, P. troglodytes
ttttatttctgtggct

SEQ ID NO: 292142 - DNA, 16 bp, P. troglodytes
ttttatttctttaagg

SEQ ID NO: 292143 - DNA, 16 bp, P. troglodytes
ttttatttgaaaaaca

SEQ ID NO: 292144 - DNA, 16 bp, P. troglodytes
ttttatttgaaacaga

SEQ ID NO: 292145 - DNA, 16 bp, P. troglodytes
ttttatttgagatgga

SEQ ID NO: 292146 - DNA, 16 bp, P. troglodytes
ttttatttggaaaata

SEQ ID NO: 292147 - DNA, 16 bp, P. troglodytes
ttttatttggaaataa

SEQ ID NO: 292148 - DNA, 16 bp, P. troglodytes
ttttatttgtacaaat

SEQ ID NO: 292149 - DNA, 16 bp, P. troglodytes
ttttatttgtcaatta

SEQ ID NO: 292150 - DNA, 16 bp, P. troglodytes
ttttattttaaagact

SEQ ID NO: 292151 - DNA, 16 bp, P. troglodytes
ttttattttaagaaga

SEQ ID NO: 292152 - DNA, 16 bp, P. troglodytes
ttttattttagaatca

SEQ ID NO: 292153 - DNA, 16 bp, P. troglodytes
ttttattttcaagaat

SEQ ID NO: 292154 - DNA, 16 bp, P. troglodytes
ttttattttcagaagt

SEQ ID NO: 292155 - DNA, 16 bp, P. troglodytes
ttttattttcagattg

SEQ ID NO: 292156 - DNA, 16 bp, P. troglodytes
ttttattttcagtaaa

SEQ ID NO: 292157 - DNA, 16 bp, P. troglodytes
ttttattttcatgaaa

SEQ ID NO: 292158 - DNA, 16 bp, P. troglodytes
ttttattttcatgaag

SEQ ID NO: 292159 - DNA, 16 bp, P. troglodytes
ttttattttcccaaat

SEQ ID NO: 292160 - DNA, 16 bp, P. troglodytes
ttttattttctctcag

SEQ ID NO: 292161 - DNA, 16 bp, P. troglodytes
ttttattttctgaata

SEQ ID NO: 292162 - DNA, 16 bp, P. troglodytes
ttttattttgaaacaa

SEQ ID NO: 292163 - DNA, 16 bp, P. troglodytes
ttttattttgaggtaa

SEQ ID NO: 292164 - DNA, 16 bp, P. troglodytes
ttttattttgcaaaga

SEQ ID NO: 292165 - DNA, 16 bp, P. troglodytes
ttttattttgccaagg

SEQ ID NO: 292166 - DNA, 16 bp, P. troglodytes
ttttattttgctaaat

SEQ ID NO: 292167 - DNA, 16 bp, P. troglodytes
ttttattttgggaaaa

SEQ ID NO: 292168 - DNA, 16 bp, P. troglodytes
ttttattttgtaatca

SEQ ID NO: 292169 - DNA, 16 bp, P. troglodytes
ttttatttttaactga

SEQ ID NO: 292170 - DNA, 16 bp, P. troglodytes
ttttatttttctgaca

SEQ ID NO: 292171 - DNA, 16 bp, P. troglodytes
ttttatttttgaagga

SEQ ID NO: 292172 - DNA, 16 bp, P. troglodytes
ttttatttttgagaca

SEQ ID NO: 292173 - DNA, 16 bp, P. troglodytes
ttttatttttgaggca

SEQ ID NO: 292174 - DNA, 16 bp, P. troglodytes
ttttatttttggaaac

SEQ ID NO: 292175 - DNA, 16 bp, P. troglodytes
ttttattttttgcaaa

SEQ ID NO: 292176 - DNA, 16 bp, P. troglodytes
ttttattttttggcag

SEQ ID NO: 292177 - DNA, 16 bp, P. troglodytes
ttttcaaaaaatcagc

SEQ ID NO: 292178 - DNA, 16 bp, P. troglodytes
ttttcaaaaacaattt

SEQ ID NO: 292179 - DNA, 16 bp, P. troglodytes
ttttcaaaaacatatt

SEQ ID NO: 292180 - DNA, 16 bp, P. troglodytes
ttttcaaaaacattaa

SEQ ID NO: 292181 - DNA, 16 bp, P. troglodytes
ttttcaaaaagatttt

SEQ ID NO: 292182 - DNA, 16 bp, P. troglodytes
ttttcaaaaagcaaat

SEQ ID NO: 292183 - DNA, 16 bp, P. troglodytes
ttttcaaaaagtaaaa

SEQ ID NO: 292184 - DNA, 16 bp, P. troglodytes
ttttcaaaaataatga

SEQ ID NO: 292185 - DNA, 16 bp, P. troglodytes
ttttcaaaaatacttt

SEQ ID NO: 292186 - DNA, 16 bp, P. troglodytes
ttttcaaaaatataca

SEQ ID NO: 292187 - DNA, 16 bp, P. troglodytes
ttttcaaaaatcattt

SEQ ID NO: 292188 - DNA, 16 bp, P. troglodytes
ttttcaaaaatctatt

SEQ ID NO: 292189 - DNA, 16 bp, P. troglodytes
ttttcaaaaatgtatt

SEQ ID NO: 292190 - DNA, 16 bp, P. troglodytes
ttttcaaaacactttt

SEQ ID NO: 292191 - DNA, 16 bp, P. troglodytes
ttttcaaaacagaaat

SEQ ID NO: 292192 - DNA, 16 bp, P. troglodytes
ttttcaaaacataaat

SEQ ID NO: 292193 - DNA, 16 bp, P. troglodytes
ttttcaaaacatttaa

SEQ ID NO: 292194 - DNA, 16 bp, P. troglodytes
ttttcaaaactgctca

SEQ ID NO: 292195 - DNA, 16 bp, P. troglodytes
ttttcaaaactgtatt

SEQ ID NO: 292196 - DNA, 16 bp, P. troglodytes
ttttcaaaactgtttt

SEQ ID NO: 292197 - DNA, 16 bp, P. troglodytes
ttttcaaaagaaataa

SEQ ID NO: 292198 - DNA, 16 bp, P. troglodytes
ttttcaaaagaagaaa

SEQ ID NO: 292199 - DNA, 16 bp, P. troglodytes
ttttcaaaagataatt

SEQ ID NO: 292200 - DNA, 16 bp, P. troglodytes
ttttcaaaagcaaaat

SEQ ID NO: 292201 - DNA, 16 bp, P. troglodytes
ttttcaaaataaaaga

SEQ ID NO: 292202 - DNA, 16 bp, P. troglodytes
ttttcaaaatattact

SEQ ID NO: 292203 - DNA, 16 bp, P. troglodytes
ttttcaaaatattgat

SEQ ID NO: 292204 - DNA, 16 bp, P. troglodytes
ttttcaaaatgaaaat

SEQ ID NO: 292205 - DNA, 16 bp, P. troglodytes
ttttcaaaatgtaaat

SEQ ID NO: 292206 - DNA, 16 bp, P. troglodytes
ttttcaaaatgtattt

SEQ ID NO: 292207 - DNA, 16 bp, P. troglodytes
ttttcaaaatgtttat

SEQ ID NO: 292208 - DNA, 16 bp, P. troglodytes
ttttcaaaattgtttt

SEQ ID NO: 292209 - DNA, 16 bp, P. troglodytes
ttttcaaacaagaaaa

SEQ ID NO: 292210 - DNA, 16 bp, P. troglodytes
ttttcaaacttaaaaa

SEQ ID NO: 292211 - DNA, 16 bp, P. troglodytes
ttttcaaacttttaaa

SEQ ID NO: 292212 - DNA, 16 bp, P. troglodytes
ttttcaaacttttaga

SEQ ID NO: 292213 - DNA, 16 bp, P. troglodytes
ttttcaaagaaataaa

SEQ ID NO: 292214 - DNA, 16 bp, P. troglodytes
ttttcaaagacatttt

SEQ ID NO: 292215 - DNA, 16 bp, P. troglodytes
ttttcaaagagatttt

SEQ ID NO: 292216 - DNA, 16 bp, P. troglodytes
ttttcaaagcagtttt

SEQ ID NO: 292217 - DNA, 16 bp, P. troglodytes
ttttcaaaggaaaaat

SEQ ID NO: 292218 - DNA, 16 bp, P. troglodytes
ttttcaaaggcaatgc

SEQ ID NO: 292219 - DNA, 16 bp, P. troglodytes
ttttcaaagtaatttt

SEQ ID NO: 292220 - DNA, 16 bp, P. troglodytes
ttttcaaagtttaaaa

SEQ ID NO: 292221 - DNA, 16 bp, P. troglodytes
ttttcaaagttttctt

SEQ ID NO: 292222 - DNA, 16 bp, P. troglodytes
ttttcaaataaaagaa

SEQ ID NO: 292223 - DNA, 16 bp, P. troglodytes
ttttcaaataaaatct

SEQ ID NO: 292224 - DNA, 16 bp, P. troglodytes
ttttcaaataaatatg

SEQ ID NO: 292225 - DNA, 16 bp, P. troglodytes
ttttcaaataagaaaa

SEQ ID NO: 292226 - DNA, 16 bp, P. troglodytes
ttttcaaataatttgt

SEQ ID NO: 292227 - DNA, 16 bp, P. troglodytes
ttttcaaatatacaat

SEQ ID NO: 292228 - DNA, 16 bp, P. troglodytes
ttttcaaatcaggaaa

SEQ ID NO: 292229 - DNA, 16 bp, P. troglodytes
ttttcaaatctgtttt

SEQ ID NO: 292230 - DNA, 16 bp, P. troglodytes
ttttcaaatgaagaca

SEQ ID NO: 292231 - DNA, 16 bp, P. troglodytes
ttttcaaatgtatttt

SEQ ID NO: 292232 - DNA, 16 bp, P. troglodytes
ttttcaaatgtgtgaa

SEQ ID NO: 292233 - DNA, 16 bp, P. troglodytes
ttttcaaatgttattt

SEQ ID NO: 292234 - DNA, 16 bp, P. troglodytes
ttttcaaatgtttatt

SEQ ID NO: 292235 - DNA, 16 bp, P. troglodytes
ttttcaaatgtttttg

SEQ ID NO: 292236 - DNA, 16 bp, P. troglodytes
ttttcaaattctgaaa

SEQ ID NO: 292237 - DNA, 16 bp, P. troglodytes
ttttcaaattgctttt

SEQ ID NO: 292238 - DNA, 16 bp, P. troglodytes
ttttcaaatttgggat

SEQ ID NO: 292239 - DNA, 16 bp, P. troglodytes
ttttcaacaatggtgc

SEQ ID NO: 292240 - DNA, 16 bp, P. troglodytes
ttttcaacaatttaaa

SEQ ID NO: 292241 - DNA, 16 bp, P. troglodytes
ttttcaacattgtatt

SEQ ID NO: 292242 - DNA, 16 bp, P. troglodytes
ttttcaacattgtttt

SEQ ID NO: 292243 - DNA, 16 bp, P. troglodytes
ttttcaactttatgat

SEQ ID NO: 292244 - DNA, 16 bp, P. troglodytes
ttttcaacttttagat

SEQ ID NO: 292245 - DNA, 16 bp, P. troglodytes
ttttcaagaaaatttt

SEQ ID NO: 292246 - DNA, 16 bp, P. troglodytes
ttttcaagaaacaaaa

SEQ ID NO: 292247 - DNA, 16 bp, P. troglodytes
ttttcaagaagaaaaa

SEQ ID NO: 292248 - DNA, 16 bp, P. troglodytes
ttttcaagaaggaaaa

SEQ ID NO: 292249 - DNA, 16 bp, P. troglodytes
ttttcaagaatacaat

SEQ ID NO: 292250 - DNA, 16 bp, P. troglodytes
ttttcaagaatgcaat

SEQ ID NO: 292251 - DNA, 16 bp, P. troglodytes
ttttcaagaatttttt

SEQ ID NO: 292252 - DNA, 16 bp, P. troglodytes
ttttcaagatattttt

SEQ ID NO: 292253 - DNA, 16 bp, P. troglodytes
ttttcaagattaaaaa

SEQ ID NO: 292254 - DNA, 16 bp, P. troglodytes
ttttcaagattcatcc

SEQ ID NO: 292255 - DNA, 16 bp, P. troglodytes
ttttcaaggaagaaaa

SEQ ID NO: 292256 - DNA, 16 bp, P. troglodytes
ttttcaaggatagttt

SEQ ID NO: 292257 - DNA, 16 bp, P. troglodytes
ttttcaaggtcacaca

SEQ ID NO: 292258 - DNA, 16 bp, P. troglodytes
ttttcaagtctctgct

SEQ ID NO: 292259 - DNA, 16 bp, P. troglodytes
ttttcaatagagatga

SEQ ID NO: 292260 - DNA, 16 bp, P. troglodytes
ttttcaatctatccat

SEQ ID NO: 292261 - DNA, 16 bp, P. troglodytes
ttttcaatgaaaaaaa

SEQ ID NO: 292262 - DNA, 16 bp, P. troglodytes
ttttcaatgaatatat

SEQ ID NO: 292263 - DNA, 16 bp, P. troglodytes
ttttcaatgaatattg

SEQ ID NO: 292264 - DNA, 16 bp, P. troglodytes
ttttcaatgcagaatt

SEQ ID NO: 292265 - DNA, 16 bp, P. troglodytes
ttttcaatgtaaaaat

SEQ ID NO: 292266 - DNA, 16 bp, P. troglodytes
ttttcaatgtacagat

SEQ ID NO: 292267 - DNA, 16 bp, P. troglodytes
ttttcaatgtgatttt

SEQ ID NO: 292268 - DNA, 16 bp, P. troglodytes
ttttcaatgtttttaa

SEQ ID NO: 292269 - DNA, 16 bp, P. troglodytes
ttttcaattaaagaaa

SEQ ID NO: 292270 - DNA, 16 bp, P. troglodytes
ttttcaattttgaaaa

SEQ ID NO: 292271 - DNA, 16 bp, P. troglodytes
ttttcaatttttggaa

SEQ ID NO: 292272 - DNA, 16 bp, P. troglodytes
ttttcacaaatgtttt

SEQ ID NO: 292273 - DNA, 16 bp, P. troglodytes
ttttcacaattataaa

SEQ ID NO: 292274 - DNA, 16 bp, P. troglodytes
ttttcacagaactgga

SEQ ID NO: 292275 - DNA, 16 bp, P. troglodytes
ttttcacagatgaaga

SEQ ID NO: 292276 - DNA, 16 bp, P. troglodytes
ttttcacaggtgttga

SEQ ID NO: 292277 - DNA, 16 bp, P. troglodytes
ttttcacatgcttatt

SEQ ID NO: 292278 - DNA, 16 bp, P. troglodytes
ttttcacattgatatt

SEQ ID NO: 292279 - DNA, 16 bp, P. troglodytes
ttttcacatttgtaaa

SEQ ID NO: 292280 - DNA, 16 bp, P. troglodytes
ttttcacattttaaaa

SEQ ID NO: 292281 - DNA, 16 bp, P. troglodytes
ttttcacattttcctg

SEQ ID NO: 292282 - DNA, 16 bp, P. troglodytes
ttttcacccaataaac

SEQ ID NO: 292283 - DNA, 16 bp, P. troglodytes
ttttcactagagatgg

SEQ ID NO: 292284 - DNA, 16 bp, P. troglodytes
ttttcactgaatataa

SEQ ID NO: 292285 - DNA, 16 bp, P. troglodytes
ttttcactgtaaaatg

SEQ ID NO: 292286 - DNA, 16 bp, P. troglodytes
ttttcactgtattgat

SEQ ID NO: 292287 - DNA, 16 bp, P. troglodytes
ttttcactgtttttaa

SEQ ID NO: 292288 - DNA, 16 bp, P. troglodytes
ttttcacttccacaag

SEQ ID NO: 292289 - DNA, 16 bp, P. troglodytes
ttttcacttgcatttc

SEQ ID NO: 292290 - DNA, 16 bp, P. troglodytes
ttttcactttcattca

SEQ ID NO: 292291 - DNA, 16 bp, P. troglodytes
ttttcactttcttgat

SEQ ID NO: 292292 - DNA, 16 bp, P. troglodytes
ttttcagaaaaaaata

SEQ ID NO: 292293 - DNA, 16 bp, P. troglodytes
ttttcagaaaaataaa

SEQ ID NO: 292294 - DNA, 16 bp, P. troglodytes
ttttcagaaaactttt

SEQ ID NO: 292295 - DNA, 16 bp, P. troglodytes
ttttcagaaaatatta

SEQ ID NO: 292296 - DNA, 16 bp, P. troglodytes
ttttcagaaaatgaaa

SEQ ID NO: 292297 - DNA, 16 bp, P. troglodytes
ttttcagaaataaaaa

SEQ ID NO: 292298 - DNA, 16 bp, P. troglodytes
ttttcagaaataaaga

SEQ ID NO: 292299 - DNA, 16 bp, P. troglodytes
ttttcagaaatagaaa

SEQ ID NO: 292300 - DNA, 16 bp, P. troglodytes
ttttcagaagaaaaaa

SEQ ID NO: 292301 - DNA, 16 bp, P. troglodytes
ttttcagaagaaaatg

SEQ ID NO: 292302 - DNA, 16 bp, P. troglodytes
ttttcagaagaagaaa

SEQ ID NO: 292303 - DNA, 16 bp, P. troglodytes
ttttcagaagtgtctg

SEQ ID NO: 292304 - DNA, 16 bp, P. troglodytes
ttttcagaatattttg

SEQ ID NO: 292305 - DNA, 16 bp, P. troglodytes
ttttcagaatgttttt

SEQ ID NO: 292306 - DNA, 16 bp, P. troglodytes
ttttcagaattatttt

SEQ ID NO: 292307 - DNA, 16 bp, P. troglodytes
ttttcagaccacaatg

SEQ ID NO: 292308 - DNA, 16 bp, P. troglodytes
ttttcagactttaaaa

SEQ ID NO: 292309 - DNA, 16 bp, P. troglodytes
ttttcagacttttctt

SEQ ID NO: 292310 - DNA, 16 bp, P. troglodytes
ttttcagagaagaaaa

SEQ ID NO: 292311 - DNA, 16 bp, P. troglodytes
ttttcagaggaaaaaa

SEQ ID NO: 292312 - DNA, 16 bp, P. troglodytes
ttttcagagtcttgct

SEQ ID NO: 292313 - DNA, 16 bp, P. troglodytes
ttttcagatgaaaaaa

SEQ ID NO: 292314 - DNA, 16 bp, P. troglodytes
ttttcagatgagggaa

SEQ ID NO: 292315 - DNA, 16 bp, P. troglodytes
ttttcagatggagaaa

SEQ ID NO: 292316 - DNA, 16 bp, P. troglodytes
ttttcagatggggaaa

SEQ ID NO: 292317 - DNA, 16 bp, P. troglodytes
ttttcagattaggaat

SEQ ID NO: 292318 - DNA, 16 bp, P. troglodytes
ttttcagattccacat

SEQ ID NO: 292319 - DNA, 16 bp, P. troglodytes
ttttcagatttcattt

SEQ ID NO: 292320 - DNA, 16 bp, P. troglodytes
ttttcagattttacat

SEQ ID NO: 292321 - DNA, 16 bp, P. troglodytes
ttttcagattttctat

SEQ ID NO: 292322 - DNA, 16 bp, P. troglodytes
ttttcagatttttcat

SEQ ID NO: 292323 - DNA, 16 bp, P. troglodytes
ttttcagcagaaacct

SEQ ID NO: 292324 - DNA, 16 bp, P. troglodytes
ttttcagcatatagat

SEQ ID NO: 292325 - DNA, 16 bp, P. troglodytes
ttttcagcatcaattg

SEQ ID NO: 292326 - DNA, 16 bp, P. troglodytes
ttttcagccatttaaa

SEQ ID NO: 292327 - DNA, 16 bp, P. troglodytes
ttttcagctataaaat

SEQ ID NO: 292328 - DNA, 16 bp, P. troglodytes
ttttcagctccaggat

SEQ ID NO: 292329 - DNA, 16 bp, P. troglodytes
ttttcagctccatcag

SEQ ID NO: 292330 - DNA, 16 bp, P. troglodytes
ttttcagcttcagaat

SEQ ID NO: 292331 - DNA, 16 bp, P. troglodytes
ttttcagcttcattat

SEQ ID NO: 292332 - DNA, 16 bp, P. troglodytes
ttttcagctttctctc

SEQ ID NO: 292333 - DNA, 16 bp, P. troglodytes
ttttcagcttttctgt

SEQ ID NO: 292334 - DNA, 16 bp, P. troglodytes
ttttcagcttttgccc

SEQ ID NO: 292335 - DNA, 16 bp, P. troglodytes
ttttcaggaaaaactg

SEQ ID NO: 292336 - DNA, 16 bp, P. troglodytes
ttttcaggaatttttt

SEQ ID NO: 292337 - DNA, 16 bp, P. troglodytes
ttttcaggatttgttt

SEQ ID NO: 292338 - DNA, 16 bp, P. troglodytes
ttttcaggattttgat

SEQ ID NO: 292339 - DNA, 17 bp, P. troglodytes
ttttcagggacatggat

SEQ ID NO: 292340 - DNA, 16 bp, P. troglodytes
ttttcaggggaagaat

SEQ ID NO: 292341 - DNA, 16 bp, P. troglodytes
ttttcaggggtttttt

SEQ ID NO: 292342 - DNA, 16 bp, P. troglodytes
ttttcagggttatttt

SEQ ID NO: 292343 - DNA, 16 bp, P. troglodytes
ttttcagtaaagatgg

SEQ ID NO: 292344 - DNA, 16 bp, P. troglodytes
ttttcagtagacacgg

SEQ ID NO: 292345 - DNA, 18 bp, P. troglodytes
ttttcagtagagacgggt

SEQ ID NO: 292346 - DNA, 16 bp, P. troglodytes
ttttcagtagagatgg

SEQ ID NO: 292347 - DNA, 16 bp, P. troglodytes
ttttcagtataaaaat

SEQ ID NO: 292348 - DNA, 16 bp, P. troglodytes
ttttcagtattttata

SEQ ID NO: 292349 - DNA, 17 bp, P. troglodytes
ttttcagtgagccaaga

SEQ ID NO: 292350 - DNA, 16 bp, P. troglodytes
ttttcagtggacagag

SEQ ID NO: 292351 - DNA, 16 bp, P. troglodytes
ttttcagtgtacaagt

SEQ ID NO: 292352 - DNA, 16 bp, P. troglodytes
ttttcagttattttaa

SEQ ID NO: 292353 - DNA, 16 bp, P. troglodytes
ttttcagtttgttcag

SEQ ID NO: 292354 - DNA, 16 bp, P. troglodytes
ttttcagttttaatat

SEQ ID NO: 292355 - DNA, 16 bp, P. troglodytes
ttttcagtttttaaaa

SEQ ID NO: 292356 - DNA, 16 bp, P. troglodytes
ttttcataaaacattt

SEQ ID NO: 292357 - DNA, 16 bp, P. troglodytes
ttttcataaagctaaa

SEQ ID NO: 292358 - DNA, 16 bp, P. troglodytes
ttttcataatatacat

SEQ ID NO: 292359 - DNA, 16 bp, P. troglodytes
ttttcatagaaaataa

SEQ ID NO: 292360 - DNA, 16 bp, P. troglodytes
ttttcatagaaatatt

SEQ ID NO: 292361 - DNA, 16 bp, P. troglodytes
ttttcatagagatgga

SEQ ID NO: 292362 - DNA, 16 bp, P. troglodytes
ttttcatagagcagtt

SEQ ID NO: 292363 - DNA, 16 bp, P. troglodytes
ttttcatatatgtgtt

SEQ ID NO: 292364 - DNA, 16 bp, P. troglodytes
ttttcatatgcctctt

SEQ ID NO: 292365 - DNA, 16 bp, P. troglodytes
ttttcatatgcttgtt

SEQ ID NO: 292366 - DNA, 16 bp, P. troglodytes
ttttcatatgtaaaat

SEQ ID NO: 292367 - DNA, 16 bp, P. troglodytes
ttttcatatgttggtt

SEQ ID NO: 292368 - DNA, 16 bp, P. troglodytes
ttttcatcaactttgt

SEQ ID NO: 292369 - DNA, 16 bp, P. troglodytes
ttttcatcaccccaaa

SEQ ID NO: 292370 - DNA, 16 bp, P. troglodytes
ttttcatcacccccaa

SEQ ID NO: 292371 - DNA, 16 bp, P. troglodytes
ttttcatcattaaaaa

SEQ ID NO: 292372 - DNA, 16 bp, P. troglodytes
ttttcatctataaaat

SEQ ID NO: 292373 - DNA, 16 bp, P. troglodytes
ttttcatcttaaaaaa

SEQ ID NO: 292374 - DNA, 16 bp, P. troglodytes
ttttcatcttataaaa

SEQ ID NO: 292375 - DNA, 16 bp, P. troglodytes
ttttcatcttgtgaaa

SEQ ID NO: 292376 - DNA, 16 bp, P. troglodytes
ttttcatctttgtgtc

SEQ ID NO: 292377 - DNA, 16 bp, P. troglodytes
ttttcatgaaaagaaa

SEQ ID NO: 292378 - DNA, 16 bp, P. troglodytes
ttttcatgatgatttt

SEQ ID NO: 292379 - DNA, 16 bp, P. troglodytes
ttttcatgcctgctaa

SEQ ID NO: 292380 - DNA, 16 bp, P. troglodytes
ttttcatgctgatgat

SEQ ID NO: 292381 - DNA, 16 bp, P. troglodytes
ttttcatgctgcttat

SEQ ID NO: 292382 - DNA, 16 bp, P. troglodytes
ttttcatggttgcata

SEQ ID NO: 292383 - DNA, 16 bp, P. troglodytes
ttttcatgtattaaat

SEQ ID NO: 292384 - DNA, 16 bp, P. troglodytes
ttttcatgtctgattt

SEQ ID NO: 292385 - DNA, 16 bp, P. troglodytes
ttttcatgtgaatatt

SEQ ID NO: 292386 - DNA, 16 bp, P. troglodytes
ttttcatgtgcttctt

SEQ ID NO: 292387 - DNA, 16 bp, P. troglodytes
ttttcatgtggttatt

SEQ ID NO: 292388 - DNA, 16 bp, P. troglodytes
ttttcatgttaataat

SEQ ID NO: 292389 - DNA, 16 bp, P. troglodytes
ttttcatgtttaaaat

SEQ ID NO: 292390 - DNA, 16 bp, P. troglodytes
ttttcattaaaatgaa

SEQ ID NO: 292391 - DNA, 16 bp, P. troglodytes
ttttcattaaatgttt

SEQ ID NO: 292392 - DNA, 16 bp, P. troglodytes
ttttcattaatgaaaa

SEQ ID NO: 292393 - DNA, 16 bp, P. troglodytes
ttttcattctgtaatt

SEQ ID NO: 292394 - DNA, 16 bp, P. troglodytes
ttttcattgaaaaaca

SEQ ID NO: 292395 - DNA, 16 bp, P. troglodytes
ttttcattgaaatata

SEQ ID NO: 292396 - DNA, 16 bp, P. troglodytes
ttttcattgctgcata

SEQ ID NO: 292397 - DNA, 16 bp, P. troglodytes
ttttcattgtaaaata

SEQ ID NO: 292398 - DNA, 16 bp, P. troglodytes
ttttcattgttttaca

SEQ ID NO: 292399 - DNA, 16 bp, P. troglodytes
ttttcatttaaagtga

SEQ ID NO: 292400 - DNA, 16 bp, P. troglodytes
ttttcatttaaagttt

SEQ ID NO: 292401 - DNA, 16 bp, P. troglodytes
ttttcatttaaatgtt

SEQ ID NO: 292402 - DNA, 16 bp, P. troglodytes
ttttcatttagaaaat

SEQ ID NO: 292403 - DNA, 16 bp, P. troglodytes
ttttcatttccaaata

SEQ ID NO: 292404 - DNA, 16 bp, P. troglodytes
ttttcatttccctgaa

SEQ ID NO: 292405 - DNA, 16 bp, P. troglodytes
ttttcatttctaaaac

SEQ ID NO: 292406 - DNA, 16 bp, P. troglodytes
ttttcatttctaacaa

SEQ ID NO: 292407 - DNA, 16 bp, P. troglodytes
ttttcatttctctgga

SEQ ID NO: 292408 - DNA, 16 bp, P. troglodytes
ttttcatttctgttga

SEQ ID NO: 292409 - DNA, 16 bp, P. troglodytes
ttttcatttgtaaaat

SEQ ID NO: 292410 - DNA, 16 bp, P. troglodytes
ttttcatttgtgaaat

SEQ ID NO: 292411 - DNA, 16 bp, P. troglodytes
ttttcattttagacat

SEQ ID NO: 292412 - DNA, 16 bp, P. troglodytes
ttttcattttataatg

SEQ ID NO: 292413 - DNA, 16 bp, P. troglodytes
ttttcattttatagat

SEQ ID NO: 292414 - DNA, 16 bp, P. troglodytes
ttttcattttcaaatg

SEQ ID NO: 292415 - DNA, 16 bp, P. troglodytes
ttttcattttcctgat

SEQ ID NO: 292416 - DNA, 16 bp, P. troglodytes
ttttcattttgcactg

SEQ ID NO: 292417 - DNA, 16 bp, P. troglodytes
ttttcatttttcagtg

SEQ ID NO: 292418 - DNA, 16 bp, P. troglodytes
ttttccaaaaaggaaa

SEQ ID NO: 292419 - DNA, 16 bp, P. troglodytes
ttttccaaaacaaaaa

SEQ ID NO: 292420 - DNA, 16 bp, P. troglodytes
ttttccaaaacaaata

SEQ ID NO: 292421 - DNA, 16 bp, P. troglodytes
ttttccaaaagaaaaa

SEQ ID NO: 292422 - DNA, 16 bp, P. troglodytes
ttttccaaaagcaaaa

SEQ ID NO: 292423 - DNA, 16 bp, P. troglodytes
ttttccaaaaggaaaa

SEQ ID NO: 292424 - DNA, 16 bp, P. troglodytes
ttttccaaaataaata

SEQ ID NO: 292425 - DNA, 16 bp, P. troglodytes
ttttccaaaatacttt

SEQ ID NO: 292426 - DNA, 16 bp, P. troglodytes
ttttccaaaatcattt

SEQ ID NO: 292427 - DNA, 16 bp, P. troglodytes
ttttccaaaatgttat

SEQ ID NO: 292428 - DNA, 16 bp, P. troglodytes
ttttccaaacaaaaat

SEQ ID NO: 292429 - DNA, 16 bp, P. troglodytes
ttttccaaacatttaa

SEQ ID NO: 292430 - DNA, 16 bp, P. troglodytes
ttttccaaacattttt

SEQ ID NO: 292431 - DNA, 16 bp, P. troglodytes
ttttccaaacttttat

SEQ ID NO: 292432 - DNA, 16 bp, P. troglodytes
ttttccaaagaaaaca

SEQ ID NO: 292433 - DNA, 16 bp, P. troglodytes
ttttccaaagaagaca

SEQ ID NO: 292434 - DNA, 16 bp, P. troglodytes
ttttccaaagagaaaa

SEQ ID NO: 292435 - DNA, 16 bp, P. troglodytes
ttttccaaagatgaca

SEQ ID NO: 292436 - DNA, 16 bp, P. troglodytes
ttttccaaaggagaaa

SEQ ID NO: 292437 - DNA, 16 bp, P. troglodytes
ttttccaaagtggtgg

SEQ ID NO: 292438 - DNA, 16 bp, P. troglodytes
ttttccaaagttttat

SEQ ID NO: 292439 - DNA, 16 bp, P. troglodytes
ttttccaaagttttct

SEQ ID NO: 292440 - DNA, 16 bp, P. troglodytes
ttttccaaatataata

SEQ ID NO: 292441 - DNA, 16 bp, P. troglodytes
ttttccaaatgaaaaa

SEQ ID NO: 292442 - DNA, 16 bp, P. troglodytes
ttttccaaatgaattt

SEQ ID NO: 292443 - DNA, 16 bp, P. troglodytes
ttttccaaattaaaat

SEQ ID NO: 292444 - DNA, 16 bp, P. troglodytes
ttttccaaattcattt

SEQ ID NO: 292445 - DNA, 16 bp, P. troglodytes
ttttccaaattgattt

SEQ ID NO: 292446 - DNA, 16 bp, P. troglodytes
ttttccaaattggttc

SEQ ID NO: 292447 - DNA, 16 bp, P. troglodytes
ttttccacaaaagaaa

SEQ ID NO: 292448 - DNA, 16 bp, P. troglodytes
ttttccacacagcagc

SEQ ID NO: 292449 - DNA, 16 bp, P. troglodytes
ttttccacagaccagg

SEQ ID NO: 292450 - DNA, 16 bp, P. troglodytes
ttttccacagcagctg

SEQ ID NO: 292451 - DNA, 16 bp, P. troglodytes
ttttccagaaaataaa

SEQ ID NO: 292452 - DNA, 16 bp, P. troglodytes
ttttccagaaagaaaa

SEQ ID NO: 292453 - DNA, 16 bp, P. troglodytes
ttttccagaaagtttt

SEQ ID NO: 292454 - DNA, 16 bp, P. troglodytes
ttttccagaaatgaaa

SEQ ID NO: 292455 - DNA, 16 bp, P. troglodytes
ttttccagaagaaaat

SEQ ID NO: 292456 - DNA, 16 bp, P. troglodytes
ttttccagaataattt

SEQ ID NO: 292457 - DNA, 16 bp, P. troglodytes
ttttccagaatattat

SEQ ID NO: 292458 - DNA, 16 bp, P. troglodytes
ttttccagaattattt

SEQ ID NO: 292459 - DNA, 16 bp, P. troglodytes
ttttccagataaggaa

SEQ ID NO: 292460 - DNA, 16 bp, P. troglodytes
ttttccagcaccattt

SEQ ID NO: 292461 - DNA, 16 bp, P. troglodytes
ttttccagccttcctt

SEQ ID NO: 292462 - DNA, 16 bp, P. troglodytes
ttttccagctttactg

SEQ ID NO: 292463 - DNA, 16 bp, P. troglodytes
ttttccagctttcctt

SEQ ID NO: 292464 - DNA, 16 bp, P. troglodytes
ttttccaggatcatat

SEQ ID NO: 292465 - DNA, 16 bp, P. troglodytes
ttttccaggctggagt

SEQ ID NO: 292466 - DNA, 16 bp, P. troglodytes
ttttccaggctggtct

SEQ ID NO: 292467 - DNA, 16 bp, P. troglodytes
ttttccaggctggttt

SEQ ID NO: 292468 - DNA, 16 bp, P. troglodytes
ttttccagtcttcttt

SEQ ID NO: 292469 - DNA, 16 bp, P. troglodytes
ttttccagtgtagaaa

SEQ ID NO: 292470 - DNA, 16 bp, P. troglodytes
ttttccagttaaaaaa

SEQ ID NO: 292471 - DNA, 16 bp, P. troglodytes
ttttccagtttctctt

SEQ ID NO: 292472 - DNA, 16 bp, P. troglodytes
ttttccagtttcttaa

SEQ ID NO: 292473 - DNA, 16 bp, P. troglodytes
ttttccagttttactt

SEQ ID NO: 292474 - DNA, 16 bp, P. troglodytes
ttttccagtttttaaa

SEQ ID NO: 292475 - DNA, 16 bp, P. troglodytes
ttttccatagcagctg

SEQ ID NO: 292476 - DNA, 16 bp, P. troglodytes
ttttccatatcctcac

SEQ ID NO: 292477 - DNA, 16 bp, P. troglodytes
ttttccatatccttgc

SEQ ID NO: 292478 - DNA, 16 bp, P. troglodytes
ttttccatatggatat

SEQ ID NO: 292479 - DNA, 16 bp, P. troglodytes
ttttccatattaaaaa

SEQ ID NO: 292480 - DNA, 16 bp, P. troglodytes
ttttccatatttaaaa

SEQ ID NO: 292481 - DNA, 16 bp, P. troglodytes
ttttccatctataaaa

SEQ ID NO: 292482 - DNA, 16 bp, P. troglodytes
ttttccatggtttgga

SEQ ID NO: 292483 - DNA, 16 bp, P. troglodytes
ttttccatgtagacaa

SEQ ID NO: 292484 - DNA, 16 bp, P. troglodytes
ttttccatgtattttg

SEQ ID NO: 292485 - DNA, 16 bp, P. troglodytes
ttttccatgtggatat

SEQ ID NO: 292486 - DNA, 16 bp, P. troglodytes
ttttccattaaaatat

SEQ ID NO: 292487 - DNA, 16 bp, P. troglodytes
ttttccattataaaaa

SEQ ID NO: 292488 - DNA, 16 bp, P. troglodytes
ttttccatttctagaa

SEQ ID NO: 292489 - DNA, 16 bp, P. troglodytes
ttttccatttctgtga

SEQ ID NO: 292490 - DNA, 16 bp, P. troglodytes
ttttccatttgatatt

SEQ ID NO: 292491 - DNA, 16 bp, P. troglodytes
ttttccattttgatga

SEQ ID NO: 292492 - DNA, 16 bp, P. troglodytes
ttttccatttttgtca

SEQ ID NO: 292493 - DNA, 16 bp, P. troglodytes
ttttcccaaagaaaat

SEQ ID NO: 292494 - DNA, 16 bp, P. troglodytes
ttttcccaaataaaaa

SEQ ID NO: 292495 - DNA, 16 bp, P. troglodytes
ttttcccaacttttat

SEQ ID NO: 292496 - DNA, 16 bp, P. troglodytes
ttttcccacctcagcc

SEQ ID NO: 292497 - DNA, 16 bp, P. troglodytes
ttttcccagatatttt

SEQ ID NO: 292498 - DNA, 16 bp, P. troglodytes
ttttcccagctctgtg

SEQ ID NO: 292499 - DNA, 16 bp, P. troglodytes
ttttcccatttaaaaa

SEQ ID NO: 292500 - DNA, 16 bp, P. troglodytes
ttttcccatttctaaa

SEQ ID NO: 292501 - DNA, 16 bp, P. troglodytes
ttttccccaaagtttt

SEQ ID NO: 292502 - DNA, 16 bp, P. troglodytes
ttttccccagtgtttt

SEQ ID NO: 292503 - DNA, 16 bp, P. troglodytes
ttttccccattttaaa

SEQ ID NO: 292504 - DNA, 16 bp, P. troglodytes
ttttcccccaaataaa

SEQ ID NO: 292505 - DNA, 16 bp, P. troglodytes
ttttcccccattctgt

SEQ ID NO: 292506 - DNA, 16 bp, P. troglodytes
ttttcccccattttgt

SEQ ID NO: 292507 - DNA, 16 bp, P. troglodytes
ttttccctaataaaat

SEQ ID NO: 292508 - DNA, 17 bp, P. troglodytes
ttttccctcctaggcct

SEQ ID NO: 292509 - DNA, 16 bp, P. troglodytes
ttttcccttcagtttt

SEQ ID NO: 292510 - DNA, 16 bp, P. troglodytes
ttttccctttaaaatg

SEQ ID NO: 292511 - DNA, 16 bp, P. troglodytes
ttttccctttaaatat

SEQ ID NO: 292512 - DNA, 16 bp, P. troglodytes
ttttcctaaaatgaaa

SEQ ID NO: 292513 - DNA, 16 bp, P. troglodytes
ttttcctaaagaaata

SEQ ID NO: 292514 - DNA, 16 bp, P. troglodytes
ttttcctaaatgtatt

SEQ ID NO: 292515 - DNA, 16 bp, P. troglodytes
ttttcctaagaatttt

SEQ ID NO: 292516 - DNA, 16 bp, P. troglodytes
ttttcctaaggaaata

SEQ ID NO: 292517 - DNA, 16 bp, P. troglodytes
ttttcctaagtatttt

SEQ ID NO: 292518 - DNA, 27 bp, P. troglodytes
ttttcctaattgaataccctttatttc

SEQ ID NO: 292519 - DNA, 16 bp, P. troglodytes
ttttcctaatttgaaa

SEQ ID NO: 292520 - DNA, 18 bp, P. troglodytes
ttttcctaggttatgatt

SEQ ID NO: 292521 - DNA, 16 bp, P. troglodytes
ttttcctatggagttg

SEQ ID NO: 292522 - DNA, 16 bp, P. troglodytes
ttttcctattaaaata

SEQ ID NO: 292523 - DNA, 16 bp, P. troglodytes
ttttcctattctggac

SEQ ID NO: 292524 - DNA, 16 bp, P. troglodytes
ttttcctattgatttg

SEQ ID NO: 292525 - DNA, 16 bp, P. troglodytes
ttttcctcagttttct

SEQ ID NO: 292526 - DNA, 16 bp, P. troglodytes
ttttcctccctaaaag

SEQ ID NO: 292527 - DNA, 16 bp, P. troglodytes
ttttcctccctcagcc

SEQ ID NO: 292528 - DNA, 16 bp, P. troglodytes
ttttcctcctgatttt

SEQ ID NO: 292529 - DNA, 16 bp, P. troglodytes
ttttcctctagaattt

SEQ ID NO: 292530 - DNA, 16 bp, P. troglodytes
ttttcctctgaatttt

SEQ ID NO: 292531 - DNA, 16 bp, P. troglodytes
ttttcctctttgcatt

SEQ ID NO: 292532 - DNA, 16 bp, P. troglodytes
ttttcctgaaatattt

SEQ ID NO: 292533 - DNA, 16 bp, P. troglodytes
ttttcctgacattttt

SEQ ID NO: 292534 - DNA, 16 bp, P. troglodytes
ttttcctgatgagaaa

SEQ ID NO: 292535 - DNA, 16 bp, P. troglodytes
ttttcctgccaaacca

SEQ ID NO: 292536 - DNA, 16 bp, P. troglodytes
ttttcctgcctcagct

SEQ ID NO: 292537 - DNA, 16 bp, P. troglodytes
ttttcctgcttccatg

SEQ ID NO: 292538 - DNA, 16 bp, P. troglodytes
ttttcctggaatttct

SEQ ID NO: 292539 - DNA, 16 bp, P. troglodytes
ttttcctggcttattt

SEQ ID NO: 292540 - DNA, 16 bp, P. troglodytes
ttttcctggggaaaaa

SEQ ID NO: 292541 - DNA, 16 bp, P. troglodytes
ttttcctgtcttctga

SEQ ID NO: 292542 - DNA, 16 bp, P. troglodytes
ttttcctgtgatttct

SEQ ID NO: 292543 - DNA, 16 bp, P. troglodytes
ttttcctgttggacta

SEQ ID NO: 292544 - DNA, 16 bp, P. troglodytes
ttttcctgtttggatg

SEQ ID NO: 292545 - DNA, 16 bp, P. troglodytes
ttttccttaagaaata

SEQ ID NO: 292546 - DNA, 16 bp, P. troglodytes
ttttccttagaaaata

SEQ ID NO: 292547 - DNA, 16 bp, P. troglodytes
ttttccttagtccttc

SEQ ID NO: 292548 - DNA, 16 bp, P. troglodytes
ttttccttatccaatc

SEQ ID NO: 292549 - DNA, 16 bp, P. troglodytes
ttttccttcatctgaa

SEQ ID NO: 292550 - DNA, 16 bp, P. troglodytes
ttttccttcattctgt

SEQ ID NO: 292551 - DNA, 16 bp, P. troglodytes
ttttccttctgcattt

SEQ ID NO: 292552 - DNA, 16 bp, P. troglodytes
ttttccttgaaaaaaa

SEQ ID NO: 292553 - DNA, 16 bp, P. troglodytes
ttttccttgaaaatgt

SEQ ID NO: 292554 - DNA, 16 bp, P. troglodytes
ttttccttgaagaggt

SEQ ID NO: 292555 - DNA, 16 bp, P. troglodytes
ttttccttgctgctgc

SEQ ID NO: 292556 - DNA, 16 bp, P. troglodytes
ttttccttgtctgtaa

SEQ ID NO: 292557 - DNA, 16 bp, P. troglodytes
ttttcctttaaaaaat

SEQ ID NO: 292558 - DNA, 16 bp, P. troglodytes
ttttcctttaaaaata

SEQ ID NO: 292559 - DNA, 16 bp, P. troglodytes
ttttcctttaaataaa

SEQ ID NO: 292560 - DNA, 16 bp, P. troglodytes
ttttcctttaataaaa

SEQ ID NO: 292561 - DNA, 16 bp, P. troglodytes
ttttcctttagaattt

SEQ ID NO: 292562 - DNA, 16 bp, P. troglodytes
ttttcctttccatgtt

SEQ ID NO: 292563 - DNA, 16 bp, P. troglodytes
ttttcctttgcagaaa

SEQ ID NO: 292564 - DNA, 16 bp, P. troglodytes
ttttcctttggaaaaa

SEQ ID NO: 292565 - DNA, 16 bp, P. troglodytes
ttttcctttggaattt

SEQ ID NO: 292566 - DNA, 16 bp, P. troglodytes
ttttccttttaaaaaa

SEQ ID NO: 292567 - DNA, 16 bp, P. troglodytes
ttttccttttaacagt

SEQ ID NO: 292568 - DNA, 16 bp, P. troglodytes
ttttccttttagctta

SEQ ID NO: 292569 - DNA, 16 bp, P. troglodytes
ttttccttttgcctga

SEQ ID NO: 292570 - DNA, 16 bp, P. troglodytes
ttttccttttgttgca

SEQ ID NO: 292571 - DNA, 16 bp, P. troglodytes
ttttcgtgcctcagcc

SEQ ID NO: 292572 - DNA, 16 bp, P. troglodytes
ttttctaaaaaataca

SEQ ID NO: 292573 - DNA, 16 bp, P. troglodytes
ttttctaaaaatgcaa

SEQ ID NO: 292574 - DNA, 16 bp, P. troglodytes
ttttctaaaagtattt

SEQ ID NO: 292575 - DNA, 16 bp, P. troglodytes
ttttctaaacataaaa

SEQ ID NO: 292576 - DNA, 16 bp, P. troglodytes
ttttctaaagaagata

SEQ ID NO: 292577 - DNA, 16 bp, P. troglodytes
ttttctaaagtaaaaa

SEQ ID NO: 292578 - DNA, 16 bp, P. troglodytes
ttttctaaataaatgt

SEQ ID NO: 292579 - DNA, 16 bp, P. troglodytes
ttttctaaatggaaaa

SEQ ID NO: 292580 - DNA, 16 bp, P. troglodytes
ttttctaaatgtacaa

SEQ ID NO: 292581 - DNA, 16 bp, P. troglodytes
ttttctaaatgttatt

SEQ ID NO: 292582 - DNA, 16 bp, P. troglodytes
ttttctaaatgtttta

SEQ ID NO: 292583 - DNA, 16 bp, P. troglodytes
ttttctaaatttgaat

SEQ ID NO: 292584 - DNA, 16 bp, P. troglodytes
ttttctaaattttatg

SEQ ID NO: 292585 - DNA, 16 bp, P. troglodytes
ttttctaacaaaaagc

SEQ ID NO: 292586 - DNA, 16 bp, P. troglodytes
ttttctaacttaaaat

SEQ ID NO: 292587 - DNA, 16 bp, P. troglodytes
ttttctaagaaagaaa

SEQ ID NO: 292588 - DNA, 16 bp, P. troglodytes
ttttctaagaataatg

SEQ ID NO: 292589 - DNA, 16 bp, P. troglodytes
ttttctaatgaaaaaa

SEQ ID NO: 292590 - DNA, 16 bp, P. troglodytes
ttttctaatgaaaata

SEQ ID NO: 292591 - DNA, 16 bp, P. troglodytes
ttttctaatgttttaa

SEQ ID NO: 292592 - DNA, 16 bp, P. troglodytes
ttttctaatttgcaca

SEQ ID NO: 292593 - DNA, 16 bp, P. troglodytes
ttttctacatacaaaa

SEQ ID NO: 292594 - DNA, 16 bp, P. troglodytes
ttttctacatttaaaa

SEQ ID NO: 292595 - DNA, 16 bp, P. troglodytes
ttttctaccttttaaa

SEQ ID NO: 292596 - DNA, 16 bp, P. troglodytes
ttttctacttagaaaa

SEQ ID NO: 292597 - DNA, 16 bp, P. troglodytes
ttttctagaaatgttt

SEQ ID NO: 292598 - DNA, 16 bp, P. troglodytes
ttttctagaattttat

SEQ ID NO: 292599 - DNA, 16 bp, P. troglodytes
ttttctagaattttta

SEQ ID NO: 292600 - DNA, 16 bp, P. troglodytes
ttttctagattttcta

SEQ ID NO: 292601 - DNA, 16 bp, P. troglodytes
ttttctagctattttg

SEQ ID NO: 292602 - DNA, 16 bp, P. troglodytes
ttttctaggttaaaaa

SEQ ID NO: 292603 - DNA, 16 bp, P. troglodytes
ttttctagttaatttg

SEQ ID NO: 292604 - DNA, 17 bp, P. troglodytes
ttttctagttctgtgaa

SEQ ID NO: 292605 - DNA, 16 bp, P. troglodytes
ttttctagttcttgaa

SEQ ID NO: 292606 - DNA, 16 bp, P. troglodytes
ttttctagtttcttga

SEQ ID NO: 292607 - DNA, 16 bp, P. troglodytes
ttttctataaaatggg

SEQ ID NO: 292608 - DNA, 16 bp, P. troglodytes
ttttctatgaaaatga

SEQ ID NO: 292609 - DNA, 16 bp, P. troglodytes
ttttctatgtaaaaaa

SEQ ID NO: 292610 - DNA, 16 bp, P. troglodytes
ttttctatgtaaaaat

SEQ ID NO: 292611 - DNA, 16 bp, P. troglodytes
ttttctatgtaatatt

SEQ ID NO: 292612 - DNA, 16 bp, P. troglodytes
ttttctatgtttagat

SEQ ID NO: 292613 - DNA, 16 bp, P. troglodytes
ttttctattaaagaaa

SEQ ID NO: 292614 - DNA, 16 bp, P. troglodytes
ttttctattgattggg

SEQ ID NO: 292615 - DNA, 16 bp, P. troglodytes
ttttctatttgacaaa

SEQ ID NO: 292616 - DNA, 16 bp, P. troglodytes
ttttctatttggaaaa

SEQ ID NO: 292617 - DNA, 16 bp, P. troglodytes
ttttctatttgtaaaa

SEQ ID NO: 292618 - DNA, 16 bp, P. troglodytes
ttttctattttgtaaa

SEQ ID NO: 292619 - DNA, 16 bp, P. troglodytes
ttttctatttttgcca

SEQ ID NO: 292620 - DNA, 16 bp, P. troglodytes
ttttctcaaaaaaata

SEQ ID NO: 292621 - DNA, 16 bp, P. troglodytes
ttttctcaaaaaatat

SEQ ID NO: 292622 - DNA, 16 bp, P. troglodytes
ttttctcaaataatat

SEQ ID NO: 292623 - DNA, 16 bp, P. troglodytes
ttttctcaaatatttg

SEQ ID NO: 292624 - DNA, 16 bp, P. troglodytes
ttttctcaattgtaaa

SEQ ID NO: 292625 - DNA, 16 bp, P. troglodytes
ttttctcacactctgt

SEQ ID NO: 292626 - DNA, 16 bp, P. troglodytes
ttttctcacctaaaaa

SEQ ID NO: 292627 - DNA, 16 bp, P. troglodytes
ttttctcacctgtaaa

SEQ ID NO: 292628 - DNA, 16 bp, P. troglodytes
ttttctcacttttaaa

SEQ ID NO: 292629 - DNA, 16 bp, P. troglodytes
ttttctcagcatcatt

SEQ ID NO: 292630 - DNA, 16 bp, P. troglodytes
ttttctcagcatcttt

SEQ ID NO: 292631 - DNA, 16 bp, P. troglodytes
ttttctcataataaaa

SEQ ID NO: 292632 - DNA, 16 bp, P. troglodytes
ttttctcatatgtata

SEQ ID NO: 292633 - DNA, 16 bp, P. troglodytes
ttttctcatcagtaaa

SEQ ID NO: 292634 - DNA, 16 bp, P. troglodytes
ttttctcatctgcaaa

SEQ ID NO: 292635 - DNA, 16 bp, P. troglodytes
ttttctcatctgtaaa

SEQ ID NO: 292636 - DNA, 16 bp, P. troglodytes
ttttctcatctgtaat

SEQ ID NO: 292637 - DNA, 16 bp, P. troglodytes
ttttctcatctgtgca

SEQ ID NO: 292638 - DNA, 16 bp, P. troglodytes
ttttctcatcttaaaa

SEQ ID NO: 292639 - DNA, 16 bp, P. troglodytes
ttttctcatctttaaa

SEQ ID NO: 292640 - DNA, 16 bp, P. troglodytes
ttttctcatgtataaa

SEQ ID NO: 292641 - DNA, 16 bp, P. troglodytes
ttttctcattctgtgg

SEQ ID NO: 292642 - DNA, 16 bp, P. troglodytes
ttttctcattgtcttg

SEQ ID NO: 292643 - DNA, 16 bp, P. troglodytes
ttttctcatttccaaa

SEQ ID NO: 292644 - DNA, 16 bp, P. troglodytes
ttttctcatttgaaaa

SEQ ID NO: 292645 - DNA, 16 bp, P. troglodytes
ttttctcatttgtaaa

SEQ ID NO: 292646 - DNA, 16 bp, P. troglodytes
ttttctccaaatataa

SEQ ID NO: 292647 - DNA, 16 bp, P. troglodytes
ttttctccaaatttta

SEQ ID NO: 292648 - DNA, 16 bp, P. troglodytes
ttttctccactgattt

SEQ ID NO: 292649 - DNA, 16 bp, P. troglodytes
ttttctccagtgtttt

SEQ ID NO: 292650 - DNA, 16 bp, P. troglodytes
ttttctccagttctgt

SEQ ID NO: 292651 - DNA, 16 bp, P. troglodytes
ttttctccataggcct

SEQ ID NO: 292652 - DNA, 16 bp, P. troglodytes
ttttctccatccctgt

SEQ ID NO: 292653 - DNA, 16 bp, P. troglodytes
ttttctccatgtcctt

SEQ ID NO: 292654 - DNA, 16 bp, P. troglodytes
ttttctccattcctgt

SEQ ID NO: 292655 - DNA, 16 bp, P. troglodytes
ttttctcccattctgt

SEQ ID NO: 292656 - DNA, 16 bp, P. troglodytes
ttttctcctagtagtt

SEQ ID NO: 292657 - DNA, 16 bp, P. troglodytes
ttttctcctatctcag

SEQ ID NO: 292658 - DNA, 16 bp, P. troglodytes
ttttctcctgcccttg

SEQ ID NO: 292659 - DNA, 16 bp, P. troglodytes
ttttctcctgtgttat

SEQ ID NO: 292660 - DNA, 16 bp, P. troglodytes
ttttctcctgttaatc

SEQ ID NO: 292661 - DNA, 16 bp, P. troglodytes
ttttctccttgaattt

SEQ ID NO: 292662 - DNA, 16 bp, P. troglodytes
ttttctctaaatgttt

SEQ ID NO: 292663 - DNA, 16 bp, P. troglodytes
ttttctctactgattt

SEQ ID NO: 292664 - DNA, 16 bp, P. troglodytes
ttttctctagctgcct

SEQ ID NO: 292665 - DNA, 16 bp, P. troglodytes
ttttctctctcactgt

SEQ ID NO: 292666 - DNA, 16 bp, P. troglodytes
ttttctctctgaatct

SEQ ID NO: 292667 - DNA, 16 bp, P. troglodytes
ttttctctgacctttt

SEQ ID NO: 292668 - DNA, 16 bp, P. troglodytes
ttttctctgatattta

SEQ ID NO: 292669 - DNA, 16 bp, P. troglodytes
ttttctctgcatttct

SEQ ID NO: 292670 - DNA, 16 bp, P. troglodytes
ttttctctggagaaat

SEQ ID NO: 292671 - DNA, 16 bp, P. troglodytes
ttttctcttaaaataa

SEQ ID NO: 292672 - DNA, 16 bp, P. troglodytes
ttttctcttaaaatgt

SEQ ID NO: 292673 - DNA, 16 bp, P. troglodytes
ttttctcttaggaaaa

SEQ ID NO: 292674 - DNA, 16 bp, P. troglodytes
ttttctcttctgcaaa

SEQ ID NO: 292675 - DNA, 16 bp, P. troglodytes
ttttctcttgtaaagt

SEQ ID NO: 292676 - DNA, 16 bp, P. troglodytes
ttttctcttgtctgat

SEQ ID NO: 292677 - DNA, 16 bp, P. troglodytes
ttttctctttgaaatg

SEQ ID NO: 292678 - DNA, 16 bp, P. troglodytes
ttttctctttgccatt

SEQ ID NO: 292679 - DNA, 16 bp, P. troglodytes
ttttctcttttagaaa

SEQ ID NO: 292680 - DNA, 16 bp, P. troglodytes
ttttctcttttgcaaa

SEQ ID NO: 292681 - DNA, 16 bp, P. troglodytes
ttttctctttttgaga

SEQ ID NO: 292682 - DNA, 16 bp, P. troglodytes
ttttctgaaaaatttt

SEQ ID NO: 292683 - DNA, 16 bp, P. troglodytes
ttttctgaaaactttt

SEQ ID NO: 292684 - DNA, 16 bp, P. troglodytes
ttttctgaaaatgaga

SEQ ID NO: 292685 - DNA, 16 bp, P. troglodytes
ttttctgaaacttttt

SEQ ID NO: 292686 - DNA, 16 bp, P. troglodytes
ttttctgaaagagaaa

SEQ ID NO: 292687 - DNA, 16 bp, P. troglodytes
ttttctgaaagcattt

SEQ ID NO: 292688 - DNA, 16 bp, P. troglodytes
ttttctgaaagtaaaa

SEQ ID NO: 292689 - DNA, 16 bp, P. troglodytes
ttttctgaaatatttt

SEQ ID NO: 292690 - DNA, 16 bp, P. troglodytes
ttttctgaaatctttt

SEQ ID NO: 292691 - DNA, 16 bp, P. troglodytes
ttttctgaaatttaaa

SEQ ID NO: 292692 - DNA, 16 bp, P. troglodytes
ttttctgaaatttcat

SEQ ID NO: 292693 - DNA, 16 bp, P. troglodytes
ttttctgaacttttat

SEQ ID NO: 292694 - DNA, 16 bp, P. troglodytes
ttttctgaagtagaga

SEQ ID NO: 292695 - DNA, 16 bp, P. troglodytes
ttttctgaataaatta

SEQ ID NO: 292696 - DNA, 16 bp, P. troglodytes
ttttctgaatcatttg

SEQ ID NO: 292697 - DNA, 16 bp, P. troglodytes
ttttctgaatgtttta

SEQ ID NO: 292698 - DNA, 16 bp, P. troglodytes
ttttctgactttgaaa

SEQ ID NO: 292699 - DNA, 16 bp, P. troglodytes
ttttctgactttttaa

SEQ ID NO: 292700 - DNA, 16 bp, P. troglodytes
ttttctgagactgagt

SEQ ID NO: 292701 - DNA, 16 bp, P. troglodytes
ttttctgagatgaagt

SEQ ID NO: 292702 - DNA, 16 bp, P. troglodytes
ttttctgaggagaaat

SEQ ID NO: 292703 - DNA, 16 bp, P. troglodytes
ttttctgaggccttcc

SEQ ID NO: 292704 - DNA, 16 bp, P. troglodytes
ttttctgaggtggagt

SEQ ID NO: 292705 - DNA, 16 bp, P. troglodytes
ttttctgagtctcact

SEQ ID NO: 292706 - DNA, 16 bp, P. troglodytes
ttttctgatataaata

SEQ ID NO: 292707 - DNA, 16 bp, P. troglodytes
ttttctgatcctgcat

SEQ ID NO: 292708 - DNA, 16 bp, P. troglodytes
ttttctgattttcaaa

SEQ ID NO: 292709 - DNA, 16 bp, P. troglodytes
ttttctgatttttaaa

SEQ ID NO: 292710 - DNA, 16 bp, P. troglodytes
ttttctgcatctactg

SEQ ID NO: 292711 - DNA, 20 bp, P. troglodytes
ttttctgcatctattgagat

SEQ ID NO: 292712 - DNA, 16 bp, P. troglodytes
ttttctgcatgtattg

SEQ ID NO: 292713 - DNA, 16 bp, P. troglodytes
ttttctgcattttaaa

SEQ ID NO: 292714 - DNA, 16 bp, P. troglodytes
ttttctgcctgtttat

SEQ ID NO: 292715 - DNA, 16 bp, P. troglodytes
ttttctgccttgatga

SEQ ID NO: 292716 - DNA, 16 bp, P. troglodytes
ttttctgcctttaaaa

SEQ ID NO: 292717 - DNA, 16 bp, P. troglodytes
ttttctgctagctttg

SEQ ID NO: 292718 - DNA, 16 bp, P. troglodytes
ttttctgcttaaaaaa

SEQ ID NO: 292719 - DNA, 16 bp, P. troglodytes
ttttctgctttaaaaa

SEQ ID NO: 292720 - DNA, 16 bp, P. troglodytes
ttttctgcttttgaaa

SEQ ID NO: 292721 - DNA, 16 bp, P. troglodytes
ttttctggaaaaatat

SEQ ID NO: 292722 - DNA, 16 bp, P. troglodytes
ttttctggaaaagact

SEQ ID NO: 292723 - DNA, 16 bp, P. troglodytes
ttttctggaaaataat

SEQ ID NO: 292724 - DNA, 16 bp, P. troglodytes
ttttctggaaagaaaa

SEQ ID NO: 292725 - DNA, 16 bp, P. troglodytes
ttttctggaagaattt

SEQ ID NO: 292726 - DNA, 16 bp, P. troglodytes
ttttctggaatgttct

SEQ ID NO: 292727 - DNA, 16 bp, P. troglodytes
ttttctggaattttat

SEQ ID NO: 292728 - DNA, 16 bp, P. troglodytes
ttttctggagatgggg

SEQ ID NO: 292729 - DNA, 16 bp, P. troglodytes
ttttctggctgaataa

SEQ ID NO: 292730 - DNA, 16 bp, P. troglodytes
ttttctgggaaaataa

SEQ ID NO: 292731 - DNA, 16 bp, P. troglodytes
ttttctgggagaaatt

SEQ ID NO: 292732 - DNA, 16 bp, P. troglodytes
ttttctgggagagggg

SEQ ID NO: 292733 - DNA, 16 bp, P. troglodytes
ttttctgggataaatg

SEQ ID NO: 292734 - DNA, 16 bp, P. troglodytes
ttttctgggctggcca

SEQ ID NO: 292735 - DNA, 16 bp, P. troglodytes
ttttctggggaaaaat

SEQ ID NO: 292736 - DNA, 16 bp, P. troglodytes
ttttctggttgacagt

SEQ ID NO: 292737 - DNA, 16 bp, P. troglodytes
ttttctgtaaaatggg

SEQ ID NO: 292738 - DNA, 16 bp, P. troglodytes
ttttctgtaaactgaa

SEQ ID NO: 292739 - DNA, 16 bp, P. troglodytes
ttttctgtaaacttct

SEQ ID NO: 292740 - DNA, 16 bp, P. troglodytes
ttttctgtaaatattt

SEQ ID NO: 292741 - DNA, 16 bp, P. troglodytes
ttttctgtaaattatt

SEQ ID NO: 292742 - DNA, 16 bp, P. troglodytes
ttttctgtaatattta

SEQ ID NO: 292743 - DNA, 16 bp, P. troglodytes
ttttctgtaatgtctt

SEQ ID NO: 292744 - DNA, 16 bp, P. troglodytes
ttttctgtacataaaa

SEQ ID NO: 292745 - DNA, 16 bp, P. troglodytes
ttttctgtacatattt

SEQ ID NO: 292746 - DNA, 16 bp, P. troglodytes
ttttctgtagagacag

SEQ ID NO: 292747 - DNA, 16 bp, P. troglodytes
ttttctgtagctattg

SEQ ID NO: 292748 - DNA, 16 bp, P. troglodytes
ttttctgtagtttgaa

SEQ ID NO: 292749 - DNA, 16 bp, P. troglodytes
ttttctgtatatgtat

SEQ ID NO: 292750 - DNA, 16 bp, P. troglodytes
ttttctgtattttaaa

SEQ ID NO: 292751 - DNA, 16 bp, P. troglodytes
ttttctgtctcagcct

SEQ ID NO: 292752 - DNA, 16 bp, P. troglodytes
ttttctgtctggaaga

SEQ ID NO: 292753 - DNA, 16 bp, P. troglodytes
ttttctgtcttcttca

SEQ ID NO: 292754 - DNA, 16 bp, P. troglodytes
ttttctgtcttgttca

SEQ ID NO: 292755 - DNA, 16 bp, P. troglodytes
ttttctgtctttatga

SEQ ID NO: 292756 - DNA, 16 bp, P. troglodytes
ttttctgtggctgctt

SEQ ID NO: 292757 - DNA, 16 bp, P. troglodytes
ttttctgtgtctctat

SEQ ID NO: 292758 - DNA, 16 bp, P. troglodytes
ttttctgttaaaaact

SEQ ID NO: 292759 - DNA, 16 bp, P. troglodytes
ttttctgttactataa

SEQ ID NO: 292760 - DNA, 16 bp, P. troglodytes
ttttctgttataaaaa

SEQ ID NO: 292761 - DNA, 16 bp, P. troglodytes
ttttctgttgcattgt

SEQ ID NO: 292762 - DNA, 16 bp, P. troglodytes
ttttctgttgctgctg

SEQ ID NO: 292763 - DNA, 16 bp, P. troglodytes
ttttctgtttctgagt

SEQ ID NO: 292764 - DNA, 16 bp, P. troglodytes
ttttctgttttaaaaa

SEQ ID NO: 292765 - DNA, 16 bp, P. troglodytes
ttttctgttttcctaa

SEQ ID NO: 292766 - DNA, 16 bp, P. troglodytes
ttttctgttttggaaa

SEQ ID NO: 292767 - DNA, 16 bp, P. troglodytes
ttttctgttttgtgaa

SEQ ID NO: 292768 - DNA, 16 bp, P. troglodytes
ttttctgtttttcaag

SEQ ID NO: 292769 - DNA, 16 bp, P. troglodytes
ttttcttaaaaagtta

SEQ ID NO: 292770 - DNA, 16 bp, P. troglodytes
ttttcttaaaaatgaa

SEQ ID NO: 292771 - DNA, 16 bp, P. troglodytes
ttttcttaaaagataa

SEQ ID NO: 292772 - DNA, 16 bp, P. troglodytes
ttttcttaaaaggaaa

SEQ ID NO: 292773 - DNA, 16 bp, P. troglodytes
ttttcttaaagggcca

SEQ ID NO: 292774 - DNA, 16 bp, P. troglodytes
ttttcttaaatgaaaa

SEQ ID NO: 292775 - DNA, 16 bp, P. troglodytes
ttttcttaaatgcttt

SEQ ID NO: 292776 - DNA, 16 bp, P. troglodytes
ttttcttaactgtaaa

SEQ ID NO: 292777 - DNA, 16 bp, P. troglodytes
ttttcttaacttaaaa

SEQ ID NO: 292778 - DNA, 16 bp, P. troglodytes
ttttcttaagataatt

SEQ ID NO: 292779 - DNA, 16 bp, P. troglodytes
ttttcttaataacaaa

SEQ ID NO: 292780 - DNA, 16 bp, P. troglodytes
ttttcttaattacaaa

SEQ ID NO: 292781 - DNA, 16 bp, P. troglodytes
ttttcttaattgaaaa

SEQ ID NO: 292782 - DNA, 16 bp, P. troglodytes
ttttcttatcaatttg

SEQ ID NO: 292783 - DNA, 16 bp, P. troglodytes
ttttcttatctgtaaa

SEQ ID NO: 292784 - DNA, 16 bp, P. troglodytes
ttttcttatgaaaaaa

SEQ ID NO: 292785 - DNA, 16 bp, P. troglodytes
ttttcttatgaaaaat

SEQ ID NO: 292786 - DNA, 16 bp, P. troglodytes
ttttcttatgaaaata

SEQ ID NO: 292787 - DNA, 16 bp, P. troglodytes
ttttcttattgactta

SEQ ID NO: 292788 - DNA, 16 bp, P. troglodytes
ttttcttattgtaaaa

SEQ ID NO: 292789 - DNA, 16 bp, P. troglodytes
ttttcttatttaaatg

SEQ ID NO: 292790 - DNA, 16 bp, P. troglodytes
ttttcttcaaatattc

SEQ ID NO: 292791 - DNA, 16 bp, P. troglodytes
ttttcttcaagaactt

SEQ ID NO: 292792 - DNA, 16 bp, P. troglodytes
ttttcttcacagcact

SEQ ID NO: 292793 - DNA, 16 bp, P. troglodytes
ttttcttcagctttat

SEQ ID NO: 292794 - DNA, 16 bp, P. troglodytes
ttttcttcatccagtc

SEQ ID NO: 292795 - DNA, 16 bp, P. troglodytes
ttttcttcatctctgt

SEQ ID NO: 292796 - DNA, 16 bp, P. troglodytes
ttttcttcattctctg

SEQ ID NO: 292797 - DNA, 16 bp, P. troglodytes
ttttcttcattgcatt

SEQ ID NO: 292798 - DNA, 16 bp, P. troglodytes
ttttcttcatttgaaa

SEQ ID NO: 292799 - DNA, 16 bp, P. troglodytes
ttttcttcattttgaa

SEQ ID NO: 292800 - DNA, 16 bp, P. troglodytes
ttttcttccacaaaac

SEQ ID NO: 292801 - DNA, 16 bp, P. troglodytes
ttttcttccacttctg

SEQ ID NO: 292802 - DNA, 16 bp, P. troglodytes
ttttcttccagaagtt

SEQ ID NO: 292803 - DNA, 16 bp, P. troglodytes
ttttcttccattaaaa

SEQ ID NO: 292804 - DNA, 16 bp, P. troglodytes
ttttcttccccaagaa

SEQ ID NO: 292805 - DNA, 16 bp, P. troglodytes
ttttcttcctaggcct

SEQ ID NO: 292806 - DNA, 16 bp, P. troglodytes
ttttcttcctgtgtta

SEQ ID NO: 292807 - DNA, 16 bp, P. troglodytes
ttttcttcctttgaaa

SEQ ID NO: 292808 - DNA, 16 bp, P. troglodytes
ttttcttctaaaagtt

SEQ ID NO: 292809 - DNA, 16 bp, P. troglodytes
ttttcttctaaagaaa

SEQ ID NO: 292810 - DNA, 16 bp, P. troglodytes
ttttcttctaagattt

SEQ ID NO: 292811 - DNA, 16 bp, P. troglodytes
ttttcttctactctgt

SEQ ID NO: 292812 - DNA, 16 bp, P. troglodytes
ttttcttctagaaaat

SEQ ID NO: 292813 - DNA, 16 bp, P. troglodytes
ttttcttctaggattt

SEQ ID NO: 292814 - DNA, 16 bp, P. troglodytes
ttttcttctcaaagtt

SEQ ID NO: 292815 - DNA, 16 bp, P. troglodytes
ttttcttctccaaatt

SEQ ID NO: 292816 - DNA, 16 bp, P. troglodytes
ttttcttctctgattg

SEQ ID NO: 292817 - DNA, 16 bp, P. troglodytes
ttttcttctctgtgaa

SEQ ID NO: 292818 - DNA, 16 bp, P. troglodytes
ttttcttctgaaatgt

SEQ ID NO: 292819 - DNA, 16 bp, P. troglodytes
ttttcttctgaagttt

SEQ ID NO: 292820 - DNA, 16 bp, P. troglodytes
ttttcttctgagagtt

SEQ ID NO: 292821 - DNA, 16 bp, P. troglodytes
ttttcttctgaggttt

SEQ ID NO: 292822 - DNA, 16 bp, P. troglodytes
ttttcttctggaaaca

SEQ ID NO: 292823 - DNA, 16 bp, P. troglodytes
ttttcttctgggattc

SEQ ID NO: 292824 - DNA, 16 bp, P. troglodytes
ttttcttcttagcact

SEQ ID NO: 292825 - DNA, 16 bp, P. troglodytes
ttttcttcttgaaatt

SEQ ID NO: 292826 - DNA, 16 bp, P. troglodytes
ttttcttcttgctgat

SEQ ID NO: 292827 - DNA, 16 bp, P. troglodytes
ttttcttctttagaaa

SEQ ID NO: 292828 - DNA, 16 bp, P. troglodytes
ttttcttctttatgag

SEQ ID NO: 292829 - DNA, 16 bp, P. troglodytes
ttttcttgaaaaaatt

SEQ ID NO: 292830 - DNA, 16 bp, P. troglodytes
ttttcttgaactttta

SEQ ID NO: 292831 - DNA, 16 bp, P. troglodytes
ttttcttgagcatttt

SEQ ID NO: 292832 - DNA, 16 bp, P. troglodytes
ttttcttgcaaattta

SEQ ID NO: 292833 - DNA, 16 bp, P. troglodytes
ttttcttgcctatttc

SEQ ID NO: 292834 - DNA, 16 bp, P. troglodytes
ttttcttggagacagg

SEQ ID NO: 292835 - DNA, 16 bp, P. troglodytes
ttttcttgtacatttg

SEQ ID NO: 292836 - DNA, 16 bp, P. troglodytes
ttttcttgtttgaaaa

SEQ ID NO: 292837 - DNA, 16 bp, P. troglodytes
ttttcttgtttgtaaa

SEQ ID NO: 292838 - DNA, 16 bp, P. troglodytes
ttttcttgttttgaaa

SEQ ID NO: 292839 - DNA, 16 bp, P. troglodytes
ttttctttaaaaatgt

SEQ ID NO: 292840 - DNA, 16 bp, P. troglodytes
ttttctttaaaggaaa

SEQ ID NO: 292841 - DNA, 16 bp, P. troglodytes
ttttctttaaaggaat

SEQ ID NO: 292842 - DNA, 16 bp, P. troglodytes
ttttctttaaatgctt

SEQ ID NO: 292843 - DNA, 16 bp, P. troglodytes
ttttctttaaattgag

SEQ ID NO: 292844 - DNA, 16 bp, P. troglodytes
ttttctttaacaaaaa

SEQ ID NO: 292845 - DNA, 16 bp, P. troglodytes
ttttctttaataatgt

SEQ ID NO: 292846 - DNA, 16 bp, P. troglodytes
ttttctttagaaaaat

SEQ ID NO: 292847 - DNA, 16 bp, P. troglodytes
ttttctttagaaaata

SEQ ID NO: 292848 - DNA, 16 bp, P. troglodytes
ttttctttataagtta

SEQ ID NO: 292849 - DNA, 16 bp, P. troglodytes
ttttctttatagaatt

SEQ ID NO: 292850 - DNA, 16 bp, P. troglodytes
ttttctttatgaaaaa

SEQ ID NO: 292851 - DNA, 16 bp, P. troglodytes
ttttctttatgctaga

SEQ ID NO: 292852 - DNA, 16 bp, P. troglodytes
ttttctttatgtaaaa

SEQ ID NO: 292853 - DNA, 16 bp, P. troglodytes
ttttctttcagatatt

SEQ ID NO: 292854 - DNA, 16 bp, P. troglodytes
ttttctttccattaaa

SEQ ID NO: 292855 - DNA, 16 bp, P. troglodytes
ttttctttctatgcct

SEQ ID NO: 292856 - DNA, 16 bp, P. troglodytes
ttttctttctcagaat

SEQ ID NO: 292857 - DNA, 16 bp, P. troglodytes
ttttctttctcattga

SEQ ID NO: 292858 - DNA, 16 bp, P. troglodytes
ttttctttctccaaga

SEQ ID NO: 292859 - DNA, 16 bp, P. troglodytes
ttttctttctgaaaaa

SEQ ID NO: 292860 - DNA, 16 bp, P. troglodytes
ttttctttctgaaagt

SEQ ID NO: 292861 - DNA, 16 bp, P. troglodytes
ttttctttcttgaaat

SEQ ID NO: 292862 - DNA, 16 bp, P. troglodytes
ttttctttgaataaat

SEQ ID NO: 292863 - DNA, 16 bp, P. troglodytes
ttttctttgaatatat

SEQ ID NO: 292864 - DNA, 16 bp, P. troglodytes
ttttctttgagaattt

SEQ ID NO: 292865 - DNA, 16 bp, P. troglodytes
ttttctttgagttaaa

SEQ ID NO: 292866 - DNA, 16 bp, P. troglodytes
ttttctttgctctaaa

SEQ ID NO: 292867 - DNA, 16 bp, P. troglodytes
ttttctttgctctgaa

SEQ ID NO: 292868 - DNA, 16 bp, P. troglodytes
ttttctttggagaagt

SEQ ID NO: 292869 - DNA, 16 bp, P. troglodytes
ttttctttgtggagtt

SEQ ID NO: 292870 - DNA, 16 bp, P. troglodytes
ttttctttgtgggaaa

SEQ ID NO: 292871 - DNA, 16 bp, P. troglodytes
ttttctttgtgggtag

SEQ ID NO: 292872 - DNA, 16 bp, P. troglodytes
ttttctttgttggaaa

SEQ ID NO: 292873 - DNA, 16 bp, P. troglodytes
ttttcttttaaagaca

SEQ ID NO: 292874 - DNA, 16 bp, P. troglodytes
ttttcttttaaatatg

SEQ ID NO: 292875 - DNA, 16 bp, P. troglodytes
ttttcttttaaatgaa

SEQ ID NO: 292876 - DNA, 16 bp, P. troglodytes
ttttcttttaacacta

SEQ ID NO: 292877 - DNA, 16 bp, P. troglodytes
ttttcttttaagaaaa

SEQ ID NO: 292878 - DNA, 16 bp, P. troglodytes
ttttcttttaatgaaa

SEQ ID NO: 292879 - DNA, 16 bp, P. troglodytes
ttttcttttcagcaaa

SEQ ID NO: 292880 - DNA, 16 bp, P. troglodytes
ttttcttttgaaaaat

SEQ ID NO: 292881 - DNA, 16 bp, P. troglodytes
ttttcttttgagctat

SEQ ID NO: 292882 - DNA, 16 bp, P. troglodytes
ttttcttttgataaaa

SEQ ID NO: 292883 - DNA, 16 bp, P. troglodytes
ttttcttttgcaacag

SEQ ID NO: 292884 - DNA, 16 bp, P. troglodytes
ttttcttttggaaatt

SEQ ID NO: 292885 - DNA, 16 bp, P. troglodytes
ttttcttttggaatat

SEQ ID NO: 292886 - DNA, 16 bp, P. troglodytes
ttttcttttgtaacag

SEQ ID NO: 292887 - DNA, 16 bp, P. troglodytes
ttttctttttaaaaag

SEQ ID NO: 292888 - DNA, 16 bp, P. troglodytes
ttttctttttaaagta

SEQ ID NO: 292889 - DNA, 16 bp, P. troglodytes
ttttctttttaaggaa

SEQ ID NO: 292890 - DNA, 16 bp, P. troglodytes
ttttctttttaatgaa

SEQ ID NO: 292891 - DNA, 16 bp, P. troglodytes
ttttctttttagaaaa

SEQ ID NO: 292892 - DNA, 16 bp, P. troglodytes
ttttctttttagaaat

SEQ ID NO: 292893 - DNA, 16 bp, P. troglodytes
ttttctttttccaaaa

SEQ ID NO: 292894 - DNA, 16 bp, P. troglodytes
ttttctttttctccag

SEQ ID NO: 292895 - DNA, 16 bp, P. troglodytes
ttttctttttctgaaa

SEQ ID NO: 292896 - DNA, 16 bp, P. troglodytes
ttttctttttgaaaat

SEQ ID NO: 292897 - DNA, 16 bp, P. troglodytes
ttttctttttgaaatg

SEQ ID NO: 292898 - DNA, 16 bp, P. troglodytes
ttttctttttgaggca

SEQ ID NO: 292899 - DNA, 16 bp, P. troglodytes
ttttcttttttaacag

SEQ ID NO: 292900 - DNA, 16 bp, P. troglodytes
ttttcttttttagaga

SEQ ID NO: 292901 - DNA, 16 bp, P. troglodytes
ttttgaaaaaaacatt

SEQ ID NO: 292902 - DNA, 16 bp, P. troglodytes
ttttgaaaaaatactt

SEQ ID NO: 292903 - DNA, 16 bp, P. troglodytes
ttttgaaaaacaatta

SEQ ID NO: 292904 - DNA, 16 bp, P. troglodytes
ttttgaaaaacagttt

SEQ ID NO: 292905 - DNA, 16 bp, P. troglodytes
ttttgaaaaacatctg

SEQ ID NO: 292906 - DNA, 16 bp, P. troglodytes
ttttgaaaaacttttt

SEQ ID NO: 292907 - DNA, 16 bp, P. troglodytes
ttttgaaaaagaattt

SEQ ID NO: 292908 - DNA, 16 bp, P. troglodytes
ttttgaaaaagacttg

SEQ ID NO: 292909 - DNA, 16 bp, P. troglodytes
ttttgaaaaagtaaag

SEQ ID NO: 292910 - DNA, 16 bp, P. troglodytes
ttttgaaaaataaagt

SEQ ID NO: 292911 - DNA, 16 bp, P. troglodytes
ttttgaaaaatagtaa

SEQ ID NO: 292912 - DNA, 16 bp, P. troglodytes
ttttgaaaaatatctg

SEQ ID NO: 292913 - DNA, 16 bp, P. troglodytes
ttttgaaaaatgaact

SEQ ID NO: 292914 - DNA, 16 bp, P. troglodytes
ttttgaaaaatggaaa

SEQ ID NO: 292915 - DNA, 16 bp, P. troglodytes
ttttgaaaaatgttta

SEQ ID NO: 292916 - DNA, 16 bp, P. troglodytes
ttttgaaaacaaataa

SEQ ID NO: 292917 - DNA, 16 bp, P. troglodytes
ttttgaaaacaaattt

SEQ ID NO: 292918 - DNA, 16 bp, P. troglodytes
ttttgaaaacatgaaa

SEQ ID NO: 292919 - DNA, 16 bp, P. troglodytes
ttttgaaaagaaactt

SEQ ID NO: 292920 - DNA, 16 bp, P. troglodytes
ttttgaaaagaagaaa

SEQ ID NO: 292921 - DNA, 16 bp, P. troglodytes
ttttgaaaagaatttt

SEQ ID NO: 292922 - DNA, 16 bp, P. troglodytes
ttttgaaaagacaaac

SEQ ID NO: 292923 - DNA, 16 bp, P. troglodytes
ttttgaaaagcatttt

SEQ ID NO: 292924 - DNA, 16 bp, P. troglodytes
ttttgaaaagcttttt

SEQ ID NO: 292925 - DNA, 16 bp, P. troglodytes
ttttgaaaaggaaaaa

SEQ ID NO: 292926 - DNA, 16 bp, P. troglodytes
ttttgaaaaggaattt

SEQ ID NO: 292927 - DNA, 16 bp, P. troglodytes
ttttgaaaaggataaa

SEQ ID NO: 292928 - DNA, 16 bp, P. troglodytes
ttttgaaaagtaaatt

SEQ ID NO: 292929 - DNA, 16 bp, P. troglodytes
ttttgaaaataaaaca

SEQ ID NO: 292930 - DNA, 16 bp, P. troglodytes
ttttgaaaataaagtt

SEQ ID NO: 292931 - DNA, 16 bp, P. troglodytes
ttttgaaaatatgaaa

SEQ ID NO: 292932 - DNA, 16 bp, P. troglodytes
ttttgaaaatatgtat

SEQ ID NO: 292933 - DNA, 16 bp, P. troglodytes
ttttgaaaatattact

SEQ ID NO: 292934 - DNA, 16 bp, P. troglodytes
ttttgaaaatcaaatg

SEQ ID NO: 292935 - DNA, 16 bp, P. troglodytes
ttttgaaaatcatttc

SEQ ID NO: 292936 - DNA, 16 bp, P. troglodytes
ttttgaaaatctctaa

SEQ ID NO: 292937 - DNA, 16 bp, P. troglodytes
ttttgaaaatgaagaa

SEQ ID NO: 292938 - DNA, 16 bp, P. troglodytes
ttttgaaaatgaattt

SEQ ID NO: 292939 - DNA, 16 bp, P. troglodytes
ttttgaaaatgatgaa

SEQ ID NO: 292940 - DNA, 16 bp, P. troglodytes
ttttgaaaatgattta

SEQ ID NO: 292941 - DNA, 16 bp, P. troglodytes
ttttgaaaatgctttt

SEQ ID NO: 292942 - DNA, 16 bp, P. troglodytes
ttttgaaaatgtaaat

SEQ ID NO: 292943 - DNA, 16 bp, P. troglodytes
ttttgaaaatgtcttt

SEQ ID NO: 292944 - DNA, 16 bp, P. troglodytes
ttttgaaaattacttt

SEQ ID NO: 292945 - DNA, 16 bp, P. troglodytes
ttttgaaaattgttca

SEQ ID NO: 292946 - DNA, 16 bp, P. troglodytes
ttttgaaaatttacat

SEQ ID NO: 292947 - DNA, 16 bp, P. troglodytes
ttttgaaacaaaataa

SEQ ID NO: 292948 - DNA, 16 bp, P. troglodytes
ttttgaaacaagatct

SEQ ID NO: 292949 - DNA, 16 bp, P. troglodytes
ttttgaaacacatttt

SEQ ID NO: 292950 - DNA, 16 bp, P. troglodytes
ttttgaaacactgctt

SEQ ID NO: 292951 - DNA, 16 bp, P. troglodytes
ttttgaaacacttttt

SEQ ID NO: 292952 - DNA, 16 bp, P. troglodytes
ttttgaaacagaattt

SEQ ID NO: 292953 - DNA, 16 bp, P. troglodytes
ttttgaaacagactct

SEQ ID NO: 292954 - DNA, 16 bp, P. troglodytes
ttttgaaacagagttt

SEQ ID NO: 292955 - DNA, 16 bp, P. troglodytes
ttttgaaacagggtct

SEQ ID NO: 292956 - DNA, 16 bp, P. troglodytes
ttttgaaacattttca

SEQ ID NO: 292957 - DNA, 16 bp, P. troglodytes
ttttgaaacgaagtct

SEQ ID NO: 292958 - DNA, 16 bp, P. troglodytes
ttttgaaactgaaatt

SEQ ID NO: 292959 - DNA, 16 bp, P. troglodytes
ttttgaaagaaaactt

SEQ ID NO: 292960 - DNA, 16 bp, P. troglodytes
ttttgaaagaagagaa

SEQ ID NO: 292961 - DNA, 16 bp, P. troglodytes
ttttgaaagctgtttt

SEQ ID NO: 292962 - DNA, 16 bp, P. troglodytes
ttttgaaaggaaaatt

SEQ ID NO: 292963 - DNA, 16 bp, P. troglodytes
ttttgaaaggataaaa

SEQ ID NO: 292964 - DNA, 16 bp, P. troglodytes
ttttgaaagggaaaaa

SEQ ID NO: 292965 - DNA, 16 bp, P. troglodytes
ttttgaaaggtaaaaa

SEQ ID NO: 292966 - DNA, 16 bp, P. troglodytes
ttttgaaagttccttt

SEQ ID NO: 292967 - DNA, 16 bp, P. troglodytes
ttttgaaataaaactt

SEQ ID NO: 292968 - DNA, 16 bp, P. troglodytes
ttttgaaataaagttt

SEQ ID NO: 292969 - DNA, 16 bp, P. troglodytes
ttttgaaataagtaaa

SEQ ID NO: 292970 - DNA, 16 bp, P. troglodytes
ttttgaaatacatata

SEQ ID NO: 292971 - DNA, 16 bp, P. troglodytes
ttttgaaatatataca

SEQ ID NO: 292972 - DNA, 16 bp, P. troglodytes
ttttgaaatatatagt

SEQ ID NO: 292973 - DNA, 16 bp, P. troglodytes
ttttgaaatctaaaaa

SEQ ID NO: 292974 - DNA, 16 bp, P. troglodytes
ttttgaaatgaaatgt

SEQ ID NO: 292975 - DNA, 16 bp, P. troglodytes
ttttgaaatgaagaaa

SEQ ID NO: 292976 - DNA, 16 bp, P. troglodytes
ttttgaaatggaaaat

SEQ ID NO: 292977 - DNA, 16 bp, P. troglodytes
ttttgaaatggagtct

SEQ ID NO: 292978 - DNA, 16 bp, P. troglodytes
ttttgaaatggagttt

SEQ ID NO: 292979 - DNA, 16 bp, P. troglodytes
ttttgaaatggccctg

SEQ ID NO: 292980 - DNA, 16 bp, P. troglodytes
ttttgaaatgtaaaaa

SEQ ID NO: 292981 - DNA, 16 bp, P. troglodytes
ttttgaaatgtaaaat

SEQ ID NO: 292982 - DNA, 16 bp, P. troglodytes
ttttgaaatgtaaaga

SEQ ID NO: 292983 - DNA, 16 bp, P. troglodytes
ttttgaaatgtctttg

SEQ ID NO: 292984 - DNA, 16 bp, P. troglodytes
ttttgaaatgtctttt

SEQ ID NO: 292985 - DNA, 16 bp, P. troglodytes
ttttgaaatgtgagga

SEQ ID NO: 292986 - DNA, 16 bp, P. troglodytes
ttttgaaatgtgcaat

SEQ ID NO: 292987 - DNA, 16 bp, P. troglodytes
ttttgaaatgtttctt

SEQ ID NO: 292988 - DNA, 16 bp, P. troglodytes
ttttgaaatgtttttc

SEQ ID NO: 292989 - DNA, 16 bp, P. troglodytes
ttttgaaattcaaatt

SEQ ID NO: 292990 - DNA, 16 bp, P. troglodytes
ttttgaaatttcttaa

SEQ ID NO: 292991 - DNA, 16 bp, P. troglodytes
ttttgaaatttgaaaa

SEQ ID NO: 292992 - DNA, 16 bp, P. troglodytes
ttttgaaattttctgt

SEQ ID NO: 292993 - DNA, 16 bp, P. troglodytes
ttttgaacagtttttt

SEQ ID NO: 292994 - DNA, 16 bp, P. troglodytes
ttttgaacatatttat

SEQ ID NO: 292995 - DNA, 16 bp, P. troglodytes
ttttgaactcctgaac

SEQ ID NO: 292996 - DNA, 16 bp, P. troglodytes
ttttgaactttatgta

SEQ ID NO: 292997 - DNA, 16 bp, P. troglodytes
ttttgaagaaaaaagt

SEQ ID NO: 292998 - DNA, 16 bp, P. troglodytes
ttttgaagaaaaacaa

SEQ ID NO: 292999 - DNA, 16 bp, P. troglodytes
ttttgaagaaaaattt

SEQ ID NO: 293000 - DNA, 16 bp, P. troglodytes
ttttgaagaaaacatt

SEQ ID NO: 293001 - DNA, 16 bp, P. troglodytes
ttttgaagaaagaaaa

SEQ ID NO: 293002 - DNA, 16 bp, P. troglodytes
ttttgaagaaataatt

SEQ ID NO: 293003 - DNA, 16 bp, P. troglodytes
ttttgaagaacttcca

SEQ ID NO: 293004 - DNA, 16 bp, P. troglodytes
ttttgaagaagaaaaa

SEQ ID NO: 293005 - DNA, 16 bp, P. troglodytes
ttttgaagaagaagaa

SEQ ID NO: 293006 - DNA, 16 bp, P. troglodytes
ttttgaagaagagaaa

SEQ ID NO: 293007 - DNA, 16 bp, P. troglodytes
ttttgaagaataaaag

SEQ ID NO: 293008 - DNA, 16 bp, P. troglodytes
ttttgaagaatatatt

SEQ ID NO: 293009 - DNA, 16 bp, P. troglodytes
ttttgaagacagagtt

SEQ ID NO: 293010 - DNA, 16 bp, P. troglodytes
ttttgaagataaaata

SEQ ID NO: 293011 - DNA, 16 bp, P. troglodytes
ttttgaagatgaggaa

SEQ ID NO: 293012 - DNA, 16 bp, P. troglodytes
ttttgaagatggagtc

SEQ ID NO: 293013 - DNA, 16 bp, P. troglodytes
ttttgaagattaaatg

SEQ ID NO: 293014 - DNA, 16 bp, P. troglodytes
ttttgaagattttctc

SEQ ID NO: 293015 - DNA, 16 bp, P. troglodytes
ttttgaaggacagttt

SEQ ID NO: 293016 - DNA, 16 bp, P. troglodytes
ttttgaaggacatttt

SEQ ID NO: 293017 - DNA, 16 bp, P. troglodytes
ttttgaaggataattt

SEQ ID NO: 293018 - DNA, 16 bp, P. troglodytes
ttttgaaggggacaca

SEQ ID NO: 293019 - DNA, 16 bp, P. troglodytes
ttttgaaggtttttaa

SEQ ID NO: 293020 - DNA, 16 bp, P. troglodytes
ttttgaagtattttct

SEQ ID NO: 293021 - DNA, 16 bp, P. troglodytes
ttttgaatgaacaaat

SEQ ID NO: 293022 - DNA, 16 bp, P. troglodytes
ttttgaatggtttttc

SEQ ID NO: 293023 - DNA, 16 bp, P. troglodytes
ttttgaattaaagaaa

SEQ ID NO: 293024 - DNA, 16 bp, P. troglodytes
ttttgaattacttatt

SEQ ID NO: 293025 - DNA, 16 bp, P. troglodytes
ttttgaatttcaaaaa

SEQ ID NO: 293026 - DNA, 16 bp, P. troglodytes
ttttgaatttcagttt

SEQ ID NO: 293027 - DNA, 16 bp, P. troglodytes
ttttgaattttgaaaa

SEQ ID NO: 293028 - DNA, 16 bp, P. troglodytes
ttttgaattttgatga

SEQ ID NO: 293029 - DNA, 16 bp, P. troglodytes
ttttgaattttggaat

SEQ ID NO: 293030 - DNA, 16 bp, P. troglodytes
ttttgacaaaaataaa

SEQ ID NO: 293031 - DNA, 16 bp, P. troglodytes
ttttgacaaatgtgta

SEQ ID NO: 293032 - DNA, 16 bp, P. troglodytes
ttttgacagatgtata

SEQ ID NO: 293033 - DNA, 16 bp, P. troglodytes
ttttgacagtgtcttg

SEQ ID NO: 293034 - DNA, 16 bp, P. troglodytes
ttttgacatatgtata

SEQ ID NO: 293035 - DNA, 16 bp, P. troglodytes
ttttgacttgacttgg

SEQ ID NO: 293036 - DNA, 16 bp, P. troglodytes
ttttgactttaaaaaa

SEQ ID NO: 293037 - DNA, 16 bp, P. troglodytes
ttttgacttttcagta

SEQ ID NO: 293038 - DNA, 16 bp, P. troglodytes
ttttgactttttagta

SEQ ID NO: 293039 - DNA, 16 bp, P. troglodytes
ttttgagaaaaaatat

SEQ ID NO: 293040 - DNA, 16 bp, P. troglodytes
ttttgagaaacagcag

SEQ ID NO: 293041 - DNA, 16 bp, P. troglodytes
ttttgagaaacttcca

SEQ ID NO: 293042 - DNA, 16 bp, P. troglodytes
ttttgagaaagaagaa

SEQ ID NO: 293043 - DNA, 16 bp, P. troglodytes
ttttgagaaaggaaaa

SEQ ID NO: 293044 - DNA, 16 bp, P. troglodytes
ttttgagaaataaaat

SEQ ID NO: 293045 - DNA, 16 bp, P. troglodytes
ttttgagaaatgtgtt

SEQ ID NO: 293046 - DNA, 16 bp, P. troglodytes
ttttgagaaggactct

SEQ ID NO: 293047 - DNA, 16 bp, P. troglodytes
ttttgagaaggagtct

SEQ ID NO: 293048 - DNA, 16 bp, P. troglodytes
ttttgagaaggagttt

SEQ ID NO: 293049 - DNA, 16 bp, P. troglodytes
ttttgagacaaggtct

SEQ ID NO: 293050 - DNA, 16 bp, P. troglodytes
ttttgagacaatgtct

SEQ ID NO: 293051 - DNA, 16 bp, P. troglodytes
ttttgagacacaatct

SEQ ID NO: 293052 - DNA, 16 bp, P. troglodytes
ttttgagacacagtct

SEQ ID NO: 293053 - DNA, 16 bp, P. troglodytes
ttttgagacagaagct

SEQ ID NO: 293054 - DNA, 16 bp, P. troglodytes
ttttgagacagaatct

SEQ ID NO: 293055 - DNA, 16 bp, P. troglodytes
ttttgagacagaattt

SEQ ID NO: 293056 - DNA, 16 bp, P. troglodytes
ttttgagacagacttt

SEQ ID NO: 293057 - DNA, 16 bp, P. troglodytes
ttttgagacagagcat

SEQ ID NO: 293058 - DNA, 16 bp, P. troglodytes
ttttgagacagagcct

SEQ ID NO: 293059 - DNA, 16 bp, P. troglodytes
ttttgagacagaggct

SEQ ID NO: 293060 - DNA, 16 bp, P. troglodytes
ttttgagacagagttt

SEQ ID NO: 293061 - DNA, 16 bp, P. troglodytes
ttttgagacaggatct

SEQ ID NO: 293062 - DNA, 16 bp, P. troglodytes
ttttgagacaggctct

SEQ ID NO: 293063 - DNA, 16 bp, P. troglodytes
ttttgagacagggtct

SEQ ID NO: 293064 - DNA, 16 bp, P. troglodytes
ttttgagacagggttt

SEQ ID NO: 293065 - DNA, 16 bp, P. troglodytes
ttttgagacagtctca

SEQ ID NO: 293066 - DNA, 16 bp, P. troglodytes
ttttgagacagtctcg

SEQ ID NO: 293067 - DNA, 16 bp, P. troglodytes
ttttgagacagtctta

SEQ ID NO: 293068 - DNA, 16 bp, P. troglodytes
ttttgagacagtgcct

SEQ ID NO: 293069 - DNA, 16 bp, P. troglodytes
ttttgagaccaagtct

SEQ ID NO: 293070 - DNA, 18 bp, P. troglodytes
ttttgagacggagtctca

SEQ ID NO: 293071 - DNA, 22 bp, P. troglodytes
ttttgagacggagtctcgctgt

SEQ ID NO: 293072 - DNA, 17 bp, P. troglodytes
ttttgagacggagtctg

SEQ ID NO: 293073 - DNA, 16 bp, P. troglodytes
ttttgagacggagttt

SEQ ID NO: 293074 - DNA, 16 bp, P. troglodytes
ttttgagactcagtct

SEQ ID NO: 293075 - DNA, 18 bp, P. troglodytes
ttttgagactgagtctcg

SEQ ID NO: 293076 - DNA, 16 bp, P. troglodytes
ttttgagagagaaaat

SEQ ID NO: 293077 - DNA, 16 bp, P. troglodytes
ttttgagagagagaga

SEQ ID NO: 293078 - DNA, 16 bp, P. troglodytes
ttttgagagagttttg

SEQ ID NO: 293079 - DNA, 16 bp, P. troglodytes
ttttgagataattgta

SEQ ID NO: 293080 - DNA, 16 bp, P. troglodytes
ttttgagatacagtct

SEQ ID NO: 293081 - DNA, 16 bp, P. troglodytes
ttttgagatagagtct

SEQ ID NO: 293082 - DNA, 21 bp, P. troglodytes
ttttgagatcaactggtctga

SEQ ID NO: 293083 - DNA, 16 bp, P. troglodytes
ttttgagatgaagtct

SEQ ID NO: 293084 - DNA, 16 bp, P. troglodytes
ttttgagatgaagttt

SEQ ID NO: 293085 - DNA, 16 bp, P. troglodytes
ttttgagatgaggaaa

SEQ ID NO: 293086 - DNA, 16 bp, P. troglodytes
ttttgagatgcagtct

SEQ ID NO: 293087 - DNA, 16 bp, P. troglodytes
ttttgagatggactct

SEQ ID NO: 293088 - DNA, 16 bp, P. troglodytes
ttttgagatggagtgt

SEQ ID NO: 293089 - DNA, 16 bp, P. troglodytes
ttttgagatggagttt

SEQ ID NO: 293090 - DNA, 16 bp, P. troglodytes
ttttgagatggggtct

SEQ ID NO: 293091 - DNA, 16 bp, P. troglodytes
ttttgagcaacctcca

SEQ ID NO: 293092 - DNA, 16 bp, P. troglodytes
ttttgagcaggagagt

SEQ ID NO: 293093 - DNA, 16 bp, P. troglodytes
ttttgagcagttttag

SEQ ID NO: 293094 - DNA, 16 bp, P. troglodytes
ttttgagccagagtct

SEQ ID NO: 293095 - DNA, 16 bp, P. troglodytes
ttttgagcctttgtgt

SEQ ID NO: 293096 - DNA, 16 bp, P. troglodytes
ttttgaggaaaggaaa

SEQ ID NO: 293097 - DNA, 16 bp, P. troglodytes
ttttgaggaaatattt

SEQ ID NO: 293098 - DNA, 16 bp, P. troglodytes
ttttgaggaaccccca

SEQ ID NO: 293099 - DNA, 16 bp, P. troglodytes
ttttgaggaatcacca

SEQ ID NO: 293100 - DNA, 16 bp, P. troglodytes
ttttgaggatgaaatg

SEQ ID NO: 293101 - DNA, 16 bp, P. troglodytes
ttttgaggattaaatt

SEQ ID NO: 293102 - DNA, 17 bp, P. troglodytes
ttttgaggcagagtctc

SEQ ID NO: 293103 - DNA, 16 bp, P. troglodytes
ttttgaggcagggtct

SEQ ID NO: 293104 - DNA, 16 bp, P. troglodytes
ttttgaggtgctgctg

SEQ ID NO: 293105 - DNA, 16 bp, P. troglodytes
ttttgaggttttggga

SEQ ID NO: 293106 - DNA, 16 bp, P. troglodytes
ttttgagtaaataatg

SEQ ID NO: 293107 - DNA, 16 bp, P. troglodytes
ttttgagtaattttct

SEQ ID NO: 293108 - DNA, 16 bp, P. troglodytes
ttttgagtctcaattt

SEQ ID NO: 293109 - DNA, 25 bp, P. troglodytes
ttttgagtgagtttcttaatcctga

SEQ ID NO: 293110 - DNA, 16 bp, P. troglodytes
ttttgagtgtgtttct

SEQ ID NO: 293111 - DNA, 16 bp, P. troglodytes
ttttgagttacatttt

SEQ ID NO: 293112 - DNA, 16 bp, P. troglodytes
ttttgagttctttgag

SEQ ID NO: 293113 - DNA, 16 bp, P. troglodytes
ttttgagttggaatct

SEQ ID NO: 293114 - DNA, 17 bp, P. troglodytes
ttttgagttggagtctc

SEQ ID NO: 293115 - DNA, 16 bp, P. troglodytes
ttttgataaaacaatt

SEQ ID NO: 293116 - DNA, 16 bp, P. troglodytes
ttttgataaacagaaa

SEQ ID NO: 293117 - DNA, 16 bp, P. troglodytes
ttttgatacagagtct

SEQ ID NO: 293118 - DNA, 16 bp, P. troglodytes
ttttgatacattttta

SEQ ID NO: 293119 - DNA, 16 bp, P. troglodytes
ttttgatactcaaatt

SEQ ID NO: 293120 - DNA, 16 bp, P. troglodytes
ttttgatactttaaaa

SEQ ID NO: 293121 - DNA, 16 bp, P. troglodytes
ttttgatagggattgt

SEQ ID NO: 293122 - DNA, 16 bp, P. troglodytes
ttttgatatgctgttt

SEQ ID NO: 293123 - DNA, 16 bp, P. troglodytes
ttttgatatgttgctg

SEQ ID NO: 293124 - DNA, 16 bp, P. troglodytes
ttttgatctttgttgg

SEQ ID NO: 293125 - DNA, 16 bp, P. troglodytes
ttttgatgaaaaaaat

SEQ ID NO: 293126 - DNA, 16 bp, P. troglodytes
ttttgatgaaagaaaa

SEQ ID NO: 293127 - DNA, 16 bp, P. troglodytes
ttttgatgggcttgtt

SEQ ID NO: 293128 - DNA, 16 bp, P. troglodytes
ttttgatgtaggtgct

SEQ ID NO: 293129 - DNA, 16 bp, P. troglodytes
ttttgatgtatttcaa

SEQ ID NO: 293130 - DNA, 16 bp, P. troglodytes
ttttgatgttgatgct

SEQ ID NO: 293131 - DNA, 16 bp, P. troglodytes
ttttgattaactcaaa

SEQ ID NO: 293132 - DNA, 16 bp, P. troglodytes
ttttgattatgaccat

SEQ ID NO: 293133 - DNA, 16 bp, P. troglodytes
ttttgattcatcaggt

SEQ ID NO: 293134 - DNA, 16 bp, P. troglodytes
ttttgattcttttaaa

SEQ ID NO: 293135 - DNA, 16 bp, P. troglodytes
ttttgattgaaagtga

SEQ ID NO: 293136 - DNA, 16 bp, P. troglodytes
ttttgattgatcagtt

SEQ ID NO: 293137 - DNA, 16 bp, P. troglodytes
ttttgattggagaatt

SEQ ID NO: 293138 - DNA, 16 bp, P. troglodytes
ttttgattggcatttt

SEQ ID NO: 293139 - DNA, 16 bp, P. troglodytes
ttttgatttccatttg

SEQ ID NO: 293140 - DNA, 16 bp, P. troglodytes
ttttgatttctgtagc

SEQ ID NO: 293141 - DNA, 16 bp, P. troglodytes
ttttgatttcttaaaa

SEQ ID NO: 293142 - DNA, 16 bp, P. troglodytes
ttttgatttgcatatc

SEQ ID NO: 293143 - DNA, 16 bp, P. troglodytes
ttttgatttgcatttc

SEQ ID NO: 293144 - DNA, 16 bp, P. troglodytes
ttttgattttacatgc

SEQ ID NO: 293145 - DNA, 16 bp, P. troglodytes
ttttgattttagccat

SEQ ID NO: 293146 - DNA, 16 bp, P. troglodytes
ttttgcaaaaacaaaa

SEQ ID NO: 293147 - DNA, 16 bp, P. troglodytes
ttttgcaaaagaagaa

SEQ ID NO: 293148 - DNA, 16 bp, P. troglodytes
ttttgcaaaatacctt

SEQ ID NO: 293149 - DNA, 16 bp, P. troglodytes
ttttgcaaaatgttac

SEQ ID NO: 293150 - DNA, 16 bp, P. troglodytes
ttttgcaaaatgtttt

SEQ ID NO: 293151 - DNA, 16 bp, P. troglodytes
ttttgcaaatgtaatt

SEQ ID NO: 293152 - DNA, 16 bp, P. troglodytes
ttttgcaacttcttgt

SEQ ID NO: 293153 - DNA, 16 bp, P. troglodytes
ttttgcaagacaaaaa

SEQ ID NO: 293154 - DNA, 16 bp, P. troglodytes
ttttgcaattaaaagt

SEQ ID NO: 293155 - DNA, 16 bp, P. troglodytes
ttttgcacagcaaagg

SEQ ID NO: 293156 - DNA, 16 bp, P. troglodytes
ttttgcacattgattt

SEQ ID NO: 293157 - DNA, 16 bp, P. troglodytes
ttttgcagaatctgca

SEQ ID NO: 293158 - DNA, 16 bp, P. troglodytes
ttttgcagacaaagaa

SEQ ID NO: 293159 - DNA, 16 bp, P. troglodytes
ttttgcagagatgggg

SEQ ID NO: 293160 - DNA, 16 bp, P. troglodytes
ttttgcagagcagaaa

SEQ ID NO: 293161 - DNA, 16 bp, P. troglodytes
ttttgcagaggagaaa

SEQ ID NO: 293162 - DNA, 16 bp, P. troglodytes
ttttgcagatgaggaa

SEQ ID NO: 293163 - DNA, 16 bp, P. troglodytes
ttttgcagggaaaatg

SEQ ID NO: 293164 - DNA, 16 bp, P. troglodytes
ttttgcagtgcagaag

SEQ ID NO: 293165 - DNA, 17 bp, P. troglodytes
ttttgcagtggctggta

SEQ ID NO: 293166 - DNA, 16 bp, P. troglodytes
ttttgcagttttagta

SEQ ID NO: 293167 - DNA, 16 bp, P. troglodytes
ttttgcataaaataaa

SEQ ID NO: 293168 - DNA, 16 bp, P. troglodytes
ttttgcatatatgttc

SEQ ID NO: 293169 - DNA, 16 bp, P. troglodytes
ttttgcatatgatgtt

SEQ ID NO: 293170 - DNA, 16 bp, P. troglodytes
ttttgcatattttaaa

SEQ ID NO: 293171 - DNA, 16 bp, P. troglodytes
ttttgcatcaacctaa

SEQ ID NO: 293172 - DNA, 16 bp, P. troglodytes
ttttgcatcactataa

SEQ ID NO: 293173 - DNA, 16 bp, P. troglodytes
ttttgcatctcaattt

SEQ ID NO: 293174 - DNA, 16 bp, P. troglodytes
ttttgcatgtatttat

SEQ ID NO: 293175 - DNA, 16 bp, P. troglodytes
ttttgcatgttttaaa

SEQ ID NO: 293176 - DNA, 16 bp, P. troglodytes
ttttgcattaaaaata

SEQ ID NO: 293177 - DNA, 16 bp, P. troglodytes
ttttgcattgcatttt

SEQ ID NO: 293178 - DNA, 16 bp, P. troglodytes
ttttgcatttaaattt

SEQ ID NO: 293179 - DNA, 16 bp, P. troglodytes
ttttgcatttctgact

SEQ ID NO: 293180 - DNA, 16 bp, P. troglodytes
ttttgcattttaaaga

SEQ ID NO: 293181 - DNA, 16 bp, P. troglodytes
ttttgcattttcatat

SEQ ID NO: 293182 - DNA, 18 bp, P. troglodytes
ttttgcatttttagtaga

SEQ ID NO: 293183 - DNA, 16 bp, P. troglodytes
ttttgcatttttggta

SEQ ID NO: 293184 - DNA, 16 bp, P. troglodytes
ttttgcatttttgtca

SEQ ID NO: 293185 - DNA, 16 bp, P. troglodytes
ttttgccaaaaataaa

SEQ ID NO: 293186 - DNA, 16 bp, P. troglodytes
ttttgccacattgccc

SEQ ID NO: 293187 - DNA, 16 bp, P. troglodytes
ttttgccagcatgcca

SEQ ID NO: 293188 - DNA, 16 bp, P. troglodytes
ttttgccatgtaaggt

SEQ ID NO: 293189 - DNA, 16 bp, P. troglodytes
ttttgccatgttttcc

SEQ ID NO: 293190 - DNA, 16 bp, P. troglodytes
ttttgccattaaaagt

SEQ ID NO: 293191 - DNA, 16 bp, P. troglodytes
ttttgccatttaaagt

SEQ ID NO: 293192 - DNA, 16 bp, P. troglodytes
ttttgcccaggctggg

SEQ ID NO: 293193 - DNA, 20 bp, P. troglodytes
ttttgcccattcagtatgat

SEQ ID NO: 293194 - DNA, 16 bp, P. troglodytes
ttttgcccatttttaa

SEQ ID NO: 293195 - DNA, 16 bp, P. troglodytes
ttttgcctaataaata

SEQ ID NO: 293196 - DNA, 16 bp, P. troglodytes
ttttgcctcatatttt

SEQ ID NO: 293197 - DNA, 16 bp, P. troglodytes
ttttgcctcctgccat

SEQ ID NO: 293198 - DNA, 16 bp, P. troglodytes
ttttgcctgttttgaa

SEQ ID NO: 293199 - DNA, 16 bp, P. troglodytes
ttttgcctttaaaaaa

SEQ ID NO: 293200 - DNA, 16 bp, P. troglodytes
ttttgcctttgttgcc

SEQ ID NO: 293201 - DNA, 16 bp, P. troglodytes
ttttgccttttctgga

SEQ ID NO: 293202 - DNA, 16 bp, P. troglodytes
ttttgccttttgaaaa

SEQ ID NO: 293203 - DNA, 16 bp, P. troglodytes
ttttgccttttggtaa

SEQ ID NO: 293204 - DNA, 16 bp, P. troglodytes
ttttgcctttttaata

SEQ ID NO: 293205 - DNA, 16 bp, P. troglodytes
ttttgctatgttgtcc

SEQ ID NO: 293206 - DNA, 16 bp, P. troglodytes
ttttgctattacaaaa

SEQ ID NO: 293207 - DNA, 16 bp, P. troglodytes
ttttgctattgtgaat

SEQ ID NO: 293208 - DNA, 16 bp, P. troglodytes
ttttgctcaacattgt

SEQ ID NO: 293209 - DNA, 16 bp, P. troglodytes
ttttgctcttgtcact

SEQ ID NO: 293210 - DNA, 16 bp, P. troglodytes
ttttgctctttttaaa

SEQ ID NO: 293211 - DNA, 16 bp, P. troglodytes
ttttgctgattaaaaa

SEQ ID NO: 293212 - DNA, 17 bp, P. troglodytes
ttttgctgcaattgctt

SEQ ID NO: 293213 - DNA, 16 bp, P. troglodytes
ttttgctgcagaaata

SEQ ID NO: 293214 - DNA, 16 bp, P. troglodytes
ttttgctgctgtaaca

SEQ ID NO: 293215 - DNA, 16 bp, P. troglodytes
ttttgctggatatact

SEQ ID NO: 293216 - DNA, 16 bp, P. troglodytes
ttttgctgttgttgcc

SEQ ID NO: 293217 - DNA, 16 bp, P. troglodytes
ttttgcttaaaataat

SEQ ID NO: 293218 - DNA, 16 bp, P. troglodytes
ttttgcttaaaatgtt

SEQ ID NO: 293219 - DNA, 16 bp, P. troglodytes
ttttgcttatccattt

SEQ ID NO: 293220 - DNA, 16 bp, P. troglodytes
ttttgcttatctgtat

SEQ ID NO: 293221 - DNA, 16 bp, P. troglodytes
ttttgcttccacaaga

SEQ ID NO: 293222 - DNA, 16 bp, P. troglodytes
ttttgcttctctctca

SEQ ID NO: 293223 - DNA, 16 bp, P. troglodytes
ttttgctttaaataaa

SEQ ID NO: 293224 - DNA, 16 bp, P. troglodytes
ttttgctttggaaaaa

SEQ ID NO: 293225 - DNA, 16 bp, P. troglodytes
ttttgcttttaaaaat

SEQ ID NO: 293226 - DNA, 16 bp, P. troglodytes
ttttgcttttcaaaaa

SEQ ID NO: 293227 - DNA, 16 bp, P. troglodytes
ttttgcttttcaaatt

SEQ ID NO: 293228 - DNA, 16 bp, P. troglodytes
ttttgcttttcagatt

SEQ ID NO: 293229 - DNA, 16 bp, P. troglodytes
ttttgctttttaaaaa

SEQ ID NO: 293230 - DNA, 16 bp, P. troglodytes
ttttgctttttaaaat

SEQ ID NO: 293231 - DNA, 16 bp, P. troglodytes
ttttgctttttcacat

SEQ ID NO: 293232 - DNA, 16 bp, P. troglodytes
ttttgctttttctaga

SEQ ID NO: 293233 - DNA, 16 bp, P. troglodytes
ttttggaaaaaaaatg

SEQ ID NO: 293234 - DNA, 16 bp, P. troglodytes
ttttggaaaaacaaat

SEQ ID NO: 293235 - DNA, 16 bp, P. troglodytes
ttttggaaaaatattt

SEQ ID NO: 293236 - DNA, 16 bp, P. troglodytes
ttttggaaaagaagaa

SEQ ID NO: 293237 - DNA, 16 bp, P. troglodytes
ttttggaaaagatttt

SEQ ID NO: 293238 - DNA, 16 bp, P. troglodytes
ttttggaaaaggaaat

SEQ ID NO: 293239 - DNA, 16 bp, P. troglodytes
ttttggaaaatacaaa

SEQ ID NO: 293240 - DNA, 16 bp, P. troglodytes
ttttggaaaatagaaa

SEQ ID NO: 293241 - DNA, 16 bp, P. troglodytes
ttttggaaaatataca

SEQ ID NO: 293242 - DNA, 16 bp, P. troglodytes
ttttggaaaattaaaa

SEQ ID NO: 293243 - DNA, 16 bp, P. troglodytes
ttttggaaaattctta

SEQ ID NO: 293244 - DNA, 16 bp, P. troglodytes
ttttggaaagaagaaa

SEQ ID NO: 293245 - DNA, 16 bp, P. troglodytes
ttttggaaagattttt

SEQ ID NO: 293246 - DNA, 16 bp, P. troglodytes
ttttggaaagtgatta

SEQ ID NO: 293247 - DNA, 16 bp, P. troglodytes
ttttggaaataaaata

SEQ ID NO: 293248 - DNA, 16 bp, P. troglodytes
ttttggaagaaaaaaa

SEQ ID NO: 293249 - DNA, 16 bp, P. troglodytes
ttttggaagagtttaa

SEQ ID NO: 293250 - DNA, 16 bp, P. troglodytes
ttttggaagagtttca

SEQ ID NO: 293251 - DNA, 16 bp, P. troglodytes
ttttggaagtttctat

SEQ ID NO: 293252 - DNA, 16 bp, P. troglodytes
ttttggaataagtgtg

SEQ ID NO: 293253 - DNA, 16 bp, P. troglodytes
ttttggaatacatgtg

SEQ ID NO: 293254 - DNA, 16 bp, P. troglodytes
ttttggaatagtttca

SEQ ID NO: 293255 - DNA, 16 bp, P. troglodytes
ttttggaatatttgca

SEQ ID NO: 293256 - DNA, 16 bp, P. troglodytes
ttttggaatattttga

SEQ ID NO: 293257 - DNA, 16 bp, P. troglodytes
ttttggaatgggaatg

SEQ ID NO: 293258 - DNA, 16 bp, P. troglodytes
ttttggaattttcatc

SEQ ID NO: 293259 - DNA, 16 bp, P. troglodytes
ttttggaccaatatcc

SEQ ID NO: 293260 - DNA, 18 bp, P. troglodytes
ttttggacctttaagatt

SEQ ID NO: 293261 - DNA, 16 bp, P. troglodytes
ttttggactcaagcaa

SEQ ID NO: 293262 - DNA, 16 bp, P. troglodytes
ttttggagaaaaaaag

SEQ ID NO: 293263 - DNA, 16 bp, P. troglodytes
ttttggagaaaaaaat

SEQ ID NO: 293264 - DNA, 16 bp, P. troglodytes
ttttggagaagaaaaa

SEQ ID NO: 293265 - DNA, 16 bp, P. troglodytes
ttttggagacaagatc

SEQ ID NO: 293266 - DNA, 16 bp, P. troglodytes
ttttggagagacagag

SEQ ID NO: 293267 - DNA, 16 bp, P. troglodytes
ttttggagcagaaagt

SEQ ID NO: 293268 - DNA, 16 bp, P. troglodytes
ttttggagcattttga

SEQ ID NO: 293269 - DNA, 16 bp, P. troglodytes
ttttggaggaagaaaa

SEQ ID NO: 293270 - DNA, 16 bp, P. troglodytes
ttttggaggacacaat

SEQ ID NO: 293271 - DNA, 16 bp, P. troglodytes
ttttggaggctgaaag

SEQ ID NO: 293272 - DNA, 16 bp, P. troglodytes
ttttggaggctggaag

SEQ ID NO: 293273 - DNA, 16 bp, P. troglodytes
ttttggaggctgggaa

SEQ ID NO: 293274 - DNA, 16 bp, P. troglodytes
ttttggagtcctcagt

SEQ ID NO: 293275 - DNA, 16 bp, P. troglodytes
ttttggataaaagcta

SEQ ID NO: 293276 - DNA, 16 bp, P. troglodytes
ttttggataaaatatt

SEQ ID NO: 293277 - DNA, 16 bp, P. troglodytes
ttttggatattaatct

SEQ ID NO: 293278 - DNA, 16 bp, P. troglodytes
ttttggatttcagatt

SEQ ID NO: 293279 - DNA, 16 bp, P. troglodytes
ttttggatttcttcct

SEQ ID NO: 293280 - DNA, 16 bp, P. troglodytes
ttttggattttagaaa

SEQ ID NO: 293281 - DNA, 16 bp, P. troglodytes
ttttggcaaatgtata

SEQ ID NO: 293282 - DNA, 16 bp, P. troglodytes
ttttggcaccagggac

SEQ ID NO: 293283 - DNA, 16 bp, P. troglodytes
ttttggccaatttctc

SEQ ID NO: 293284 - DNA, 16 bp, P. troglodytes
ttttggccagctcctt

SEQ ID NO: 293285 - DNA, 16 bp, P. troglodytes
ttttggccattttctc

SEQ ID NO: 293286 - DNA, 16 bp, P. troglodytes
ttttggctgctgtgaa

SEQ ID NO: 293287 - DNA, 16 bp, P. troglodytes
ttttggctgttgtgaa

SEQ ID NO: 293288 - DNA, 16 bp, P. troglodytes
ttttggcttccctggg

SEQ ID NO: 293289 - DNA, 16 bp, P. troglodytes
ttttggctttagttgc

SEQ ID NO: 293290 - DNA, 16 bp, P. troglodytes
ttttgggaagccaaga

SEQ ID NO: 293291 - DNA, 16 bp, P. troglodytes
ttttgggacagggtct

SEQ ID NO: 293292 - DNA, 16 bp, P. troglodytes
ttttgggaggaaaaaa

SEQ ID NO: 293293 - DNA, 16 bp, P. troglodytes
ttttgggaggccaaag

SEQ ID NO: 293294 - DNA, 18 bp, P. troglodytes
ttttgggaggccaaggca

SEQ ID NO: 293295 - DNA, 17 bp, P. troglodytes
ttttgggaggccgagga

SEQ ID NO: 293296 - DNA, 18 bp, P. troglodytes
ttttgggaggctgaggcg

SEQ ID NO: 293297 - DNA, 16 bp, P. troglodytes
ttttgggagggcgagg

SEQ ID NO: 293298 - DNA, 16 bp, P. troglodytes
ttttgggctgagatga

SEQ ID NO: 293299 - DNA, 16 bp, P. troglodytes
ttttggggaaaaaaat

SEQ ID NO: 293300 - DNA, 16 bp, P. troglodytes
ttttggggccagttta

SEQ ID NO: 293301 - DNA, 16 bp, P. troglodytes
ttttgggggcaggggg

SEQ ID NO: 293302 - DNA, 16 bp, P. troglodytes
ttttggggggaaaaaa

SEQ ID NO: 293303 - DNA, 16 bp, P. troglodytes
ttttggggtgataaaa

SEQ ID NO: 293304 - DNA, 16 bp, P. troglodytes
ttttgggttaaatctg

SEQ ID NO: 293305 - DNA, 16 bp, P. troglodytes
ttttgggttttcagtg

SEQ ID NO: 293306 - DNA, 16 bp, P. troglodytes
ttttggtagagaagga

SEQ ID NO: 293307 - DNA, 24 bp, P. troglodytes
ttttggtagagacagggttttgcc

SEQ ID NO: 293308 - DNA, 17 bp, P. troglodytes
ttttggtagagatggga

SEQ ID NO: 293309 - DNA, 17 bp, P. troglodytes
ttttggtagagatgggg

SEQ ID NO: 293310 - DNA, 21 bp, P. troglodytes
ttttggtagagatggggtttc

SEQ ID NO: 293311 - DNA, 16 bp, P. troglodytes
ttttggtatctgtggg

SEQ ID NO: 293312 - DNA, 16 bp, P. troglodytes
ttttggtatttaaaaa

SEQ ID NO: 293313 - DNA, 16 bp, P. troglodytes
ttttggtcaaagacat

SEQ ID NO: 293314 - DNA, 16 bp, P. troglodytes
ttttggtcattatttc

SEQ ID NO: 293315 - DNA, 16 bp, P. troglodytes
ttttggtggagtcttt

SEQ ID NO: 293316 - DNA, 17 bp, P. troglodytes
ttttggtgtggatgtcc

SEQ ID NO: 293317 - DNA, 16 bp, P. troglodytes
ttttggttattacaaa

SEQ ID NO: 293318 - DNA, 16 bp, P. troglodytes
ttttggttcagaaaat

SEQ ID NO: 293319 - DNA, 17 bp, P. troglodytes
ttttggttccatatgaa

SEQ ID NO: 293320 - DNA, 16 bp, P. troglodytes
ttttggttgtcacaac

SEQ ID NO: 293321 - DNA, 16 bp, P. troglodytes
ttttggtttcattgat

SEQ ID NO: 293322 - DNA, 16 bp, P. troglodytes
ttttgtaaaacaaaat

SEQ ID NO: 293323 - DNA, 16 bp, P. troglodytes
ttttgtaaaacatttt

SEQ ID NO: 293324 - DNA, 16 bp, P. troglodytes
ttttgtaaaaggaaaa

SEQ ID NO: 293325 - DNA, 16 bp, P. troglodytes
ttttgtaaaagtaaaa

SEQ ID NO: 293326 - DNA, 16 bp, P. troglodytes
ttttgtaaaatgcatt

SEQ ID NO: 293327 - DNA, 16 bp, P. troglodytes
ttttgtaaaatgcttt

SEQ ID NO: 293328 - DNA, 16 bp, P. troglodytes
ttttgtaaacattttt

SEQ ID NO: 293329 - DNA, 16 bp, P. troglodytes
ttttgtaaagcatcaa

SEQ ID NO: 293330 - DNA, 16 bp, P. troglodytes
ttttgtaaataaagat

SEQ ID NO: 293331 - DNA, 16 bp, P. troglodytes
ttttgtaaatatctat

SEQ ID NO: 293332 - DNA, 16 bp, P. troglodytes
ttttgtaaatattctt

SEQ ID NO: 293333 - DNA, 16 bp, P. troglodytes
ttttgtaaatctcttt

SEQ ID NO: 293334 - DNA, 16 bp, P. troglodytes
ttttgtaaatgaaaaa

SEQ ID NO: 293335 - DNA, 16 bp, P. troglodytes
ttttgtaaatgaagtc

SEQ ID NO: 293336 - DNA, 16 bp, P. troglodytes
ttttgtaaatgctttt

SEQ ID NO: 293337 - DNA, 16 bp, P. troglodytes
ttttgtaaatgttctt

SEQ ID NO: 293338 - DNA, 16 bp, P. troglodytes
ttttgtaagaaaccac

SEQ ID NO: 293339 - DNA, 16 bp, P. troglodytes
ttttgtaagagaaatt

SEQ ID NO: 293340 - DNA, 16 bp, P. troglodytes
ttttgtaataacattt

SEQ ID NO: 293341 - DNA, 16 bp, P. troglodytes
ttttgtaatagtttca

SEQ ID NO: 293342 - DNA, 16 bp, P. troglodytes
ttttgtaatcagaaaa

SEQ ID NO: 293343 - DNA, 16 bp, P. troglodytes
ttttgtaattatcatt

SEQ ID NO: 293344 - DNA, 16 bp, P. troglodytes
ttttgtacattttgta

SEQ ID NO: 293345 - DNA, 18 bp, P. troglodytes
ttttgtacttttagtaga

SEQ ID NO: 293346 - DNA, 16 bp, P. troglodytes
ttttgtagaaaaatat

SEQ ID NO: 293347 - DNA, 16 bp, P. troglodytes
ttttgtagaaaataaa

SEQ ID NO: 293348 - DNA, 16 bp, P. troglodytes
ttttgtagaaacagaa

SEQ ID NO: 293349 - DNA, 16 bp, P. troglodytes
ttttgtagaaggtgct

SEQ ID NO: 293350 - DNA, 16 bp, P. troglodytes
ttttgtagaatatgca

SEQ ID NO: 293351 - DNA, 16 bp, P. troglodytes
ttttgtagaatatgtg

SEQ ID NO: 293352 - DNA, 16 bp, P. troglodytes
ttttgtagaatctgca

SEQ ID NO: 293353 - DNA, 16 bp, P. troglodytes
ttttgtagagaagtgg

SEQ ID NO: 293354 - DNA, 19 bp, P. troglodytes
ttttgtagagacaaggttt

SEQ ID NO: 293355 - DNA, 16 bp, P. troglodytes
ttttgtagagacagag

SEQ ID NO: 293356 - DNA, 16 bp, P. troglodytes
ttttgtagagacagga

SEQ ID NO: 293357 - DNA, 16 bp, P. troglodytes
ttttgtagagacaggg

SEQ ID NO: 293358 - DNA, 19 bp, P. troglodytes
ttttgtagagacagggttt

SEQ ID NO: 293359 - DNA, 16 bp, P. troglodytes
ttttgtagagacagtg

SEQ ID NO: 293360 - DNA, 16 bp, P. troglodytes
ttttgtataagatgta

SEQ ID NO: 293361 - DNA, 16 bp, P. troglodytes
ttttgtatacatttta

SEQ ID NO: 293362 - DNA, 16 bp, P. troglodytes
ttttgtatactgattt

SEQ ID NO: 293363 - DNA, 16 bp, P. troglodytes
ttttgtatattaactt

SEQ ID NO: 293364 - DNA, 16 bp, P. troglodytes
ttttgtatatttcaaa

SEQ ID NO: 293365 - DNA, 16 bp, P. troglodytes
ttttgtatcatgagac

SEQ ID NO: 293366 - DNA, 18 bp, P. troglodytes
ttttgtatctttagtaga

SEQ ID NO: 293367 - DNA, 20 bp, P. troglodytes
ttttgtatctttagtagaga

SEQ ID NO: 293368 - DNA, 19 bp, P. troglodytes
ttttgtattagtagagatg

SEQ ID NO: 293369 - DNA, 16 bp, P. troglodytes
ttttgtatttagaaaa

SEQ ID NO: 293370 - DNA, 18 bp, P. troglodytes
ttttgtatttctagtaga

SEQ ID NO: 293371 - DNA, 17 bp, P. troglodytes
ttttgtattttagcaga

SEQ ID NO: 293372 - DNA, 16 bp, P. troglodytes
ttttgtattttcacta

SEQ ID NO: 293373 - DNA, 16 bp, P. troglodytes
ttttgtattttcgtag

SEQ ID NO: 293374 - DNA, 16 bp, P. troglodytes
ttttgtattttctaaa

SEQ ID NO: 293375 - DNA, 18 bp, P. troglodytes
ttttgtatttttagcaga

SEQ ID NO: 293376 - DNA, 16 bp, P. troglodytes
ttttgtcaaatatatt

SEQ ID NO: 293377 - DNA, 16 bp, P. troglodytes
ttttgtcaaatgtttt

SEQ ID NO: 293378 - DNA, 16 bp, P. troglodytes
ttttgtcaaatttgtt

SEQ ID NO: 293379 - DNA, 16 bp, P. troglodytes
ttttgtcacatttgct

SEQ ID NO: 293380 - DNA, 16 bp, P. troglodytes
ttttgtcagatttgtt

SEQ ID NO: 293381 - DNA, 16 bp, P. troglodytes
ttttgtcaggttttgt

SEQ ID NO: 293382 - DNA, 16 bp, P. troglodytes
ttttgtcatagcagca

SEQ ID NO: 293383 - DNA, 16 bp, P. troglodytes
ttttgtcatatgtttg

SEQ ID NO: 293384 - DNA, 16 bp, P. troglodytes
ttttgtcatctgtaaa

SEQ ID NO: 293385 - DNA, 16 bp, P. troglodytes
ttttgtcatttattca

SEQ ID NO: 293386 - DNA, 16 bp, P. troglodytes
ttttgtcattttaaaa

SEQ ID NO: 293387 - DNA, 16 bp, P. troglodytes
ttttgtccagttttct

SEQ ID NO: 293388 - DNA, 16 bp, P. troglodytes
ttttgtccttcattct

SEQ ID NO: 293389 - DNA, 16 bp, P. troglodytes
ttttgtccttttgata

SEQ ID NO: 293390 - DNA, 16 bp, P. troglodytes
ttttgtctcagaggag

SEQ ID NO: 293391 - DNA, 16 bp, P. troglodytes
ttttgtctccttttaa

SEQ ID NO: 293392 - DNA, 16 bp, P. troglodytes
ttttgtctgacataag

SEQ ID NO: 293393 - DNA, 16 bp, P. troglodytes
ttttgtcttaaaatat

SEQ ID NO: 293394 - DNA, 16 bp, P. troglodytes
ttttgtcttcaaattt

SEQ ID NO: 293395 - DNA, 16 bp, P. troglodytes
ttttgtctttaaatat

SEQ ID NO: 293396 - DNA, 16 bp, P. troglodytes
ttttgtctttccatat

SEQ ID NO: 293397 - DNA, 16 bp, P. troglodytes
ttttgtctttttcaaa

SEQ ID NO: 293398 - DNA, 16 bp, P. troglodytes
ttttgtgaaaaattaa

SEQ ID NO: 293399 - DNA, 16 bp, P. troglodytes
ttttgtgacagtgtct

SEQ ID NO: 293400 - DNA, 16 bp, P. troglodytes
ttttgtgatgagaaca

SEQ ID NO: 293401 - DNA, 16 bp, P. troglodytes
ttttgtgattccattt

SEQ ID NO: 293402 - DNA, 16 bp, P. troglodytes
ttttgtgctttaaaat

SEQ ID NO: 293403 - DNA, 16 bp, P. troglodytes
ttttgtgcttttaata

SEQ ID NO: 293404 - DNA, 16 bp, P. troglodytes
ttttgtgcttttagta

SEQ ID NO: 293405 - DNA, 16 bp, P. troglodytes
ttttgtggaagataat

SEQ ID NO: 293406 - DNA, 16 bp, P. troglodytes
ttttgtggaatttgca

SEQ ID NO: 293407 - DNA, 16 bp, P. troglodytes
ttttgtggagacaggt

SEQ ID NO: 293408 - DNA, 16 bp, P. troglodytes
ttttgtggagatggtg

SEQ ID NO: 293409 - DNA, 16 bp, P. troglodytes
ttttgtggcaccaaaa

SEQ ID NO: 293410 - DNA, 16 bp, P. troglodytes
ttttgtgggccaggcc

SEQ ID NO: 293411 - DNA, 16 bp, P. troglodytes
ttttgtggggaaaaaa

SEQ ID NO: 293412 - DNA, 16 bp, P. troglodytes
ttttgtggtagcaagt

SEQ ID NO: 293413 - DNA, 16 bp, P. troglodytes
ttttgtgtacatattt

SEQ ID NO: 293414 - DNA, 16 bp, P. troglodytes
ttttgtgtctggcttc

SEQ ID NO: 293415 - DNA, 16 bp, P. troglodytes
ttttgtgtgtggtaag

SEQ ID NO: 293416 - DNA, 16 bp, P. troglodytes
ttttgtgtgtgtaaaa

SEQ ID NO: 293417 - DNA, 16 bp, P. troglodytes
ttttgtgtttaaaaaa

SEQ ID NO: 293418 - DNA, 16 bp, P. troglodytes
ttttgttaaaaactaa

SEQ ID NO: 293419 - DNA, 16 bp, P. troglodytes
ttttgttaaaggcctt

SEQ ID NO: 293420 - DNA, 16 bp, P. troglodytes
ttttgttaaataaatg

SEQ ID NO: 293421 - DNA, 16 bp, P. troglodytes
ttttgttacttttaaa

SEQ ID NO: 293422 - DNA, 16 bp, P. troglodytes
ttttgttatctgtaaa

SEQ ID NO: 293423 - DNA, 16 bp, P. troglodytes
ttttgttatggaaaat

SEQ ID NO: 293424 - DNA, 16 bp, P. troglodytes
ttttgttattttcaaa

SEQ ID NO: 293425 - DNA, 16 bp, P. troglodytes
ttttgttcaacattgt

SEQ ID NO: 293426 - DNA, 16 bp, P. troglodytes
ttttgttcactgctgc

SEQ ID NO: 293427 - DNA, 16 bp, P. troglodytes
ttttgttcactgctgt

SEQ ID NO: 293428 - DNA, 16 bp, P. troglodytes
ttttgttcataaatta

SEQ ID NO: 293429 - DNA, 16 bp, P. troglodytes
ttttgttcattaaaaa

SEQ ID NO: 293430 - DNA, 16 bp, P. troglodytes
ttttgttcattttaaa

SEQ ID NO: 293431 - DNA, 16 bp, P. troglodytes
ttttgttcccagtttt

SEQ ID NO: 293432 - DNA, 16 bp, P. troglodytes
ttttgttctatatgaa

SEQ ID NO: 293433 - DNA, 16 bp, P. troglodytes
ttttgttctattcagg

SEQ ID NO: 293434 - DNA, 16 bp, P. troglodytes
ttttgttgaaagcaaa

SEQ ID NO: 293435 - DNA, 16 bp, P. troglodytes
ttttgttgagacagaa

SEQ ID NO: 293436 - DNA, 16 bp, P. troglodytes
ttttgttgatgctttc

SEQ ID NO: 293437 - DNA, 16 bp, P. troglodytes
ttttgttgcagttgct

SEQ ID NO: 293438 - DNA, 16 bp, P. troglodytes
ttttgttgcatgtgct

SEQ ID NO: 293439 - DNA, 16 bp, P. troglodytes
ttttgttgctcaagtt

SEQ ID NO: 293440 - DNA, 16 bp, P. troglodytes
ttttgttggcagtttt

SEQ ID NO: 293441 - DNA, 16 bp, P. troglodytes
ttttgttgtggtaaaa

SEQ ID NO: 293442 - DNA, 16 bp, P. troglodytes
ttttgtttaaaaaaag

SEQ ID NO: 293443 - DNA, 16 bp, P. troglodytes
ttttgtttaaaaagat

SEQ ID NO: 293444 - DNA, 16 bp, P. troglodytes
ttttgtttaaaacatt

SEQ ID NO: 293445 - DNA, 16 bp, P. troglodytes
ttttgtttaaacaaaa

SEQ ID NO: 293446 - DNA, 16 bp, P. troglodytes
ttttgtttcaaaattt

SEQ ID NO: 293447 - DNA, 16 bp, P. troglodytes
ttttgtttcagatatt

SEQ ID NO: 293448 - DNA, 16 bp, P. troglodytes
ttttgtttcatatgaa

SEQ ID NO: 293449 - DNA, 16 bp, P. troglodytes
ttttgtttccatttca

SEQ ID NO: 293450 - DNA, 16 bp, P. troglodytes
ttttgtttcttaaaag

SEQ ID NO: 293451 - DNA, 16 bp, P. troglodytes
ttttgtttcttctgag

SEQ ID NO: 293452 - DNA, 16 bp, P. troglodytes
ttttgtttctttaaaa

SEQ ID NO: 293453 - DNA, 16 bp, P. troglodytes
ttttgtttgctttgaa

SEQ ID NO: 293454 - DNA, 17 bp, P. troglodytes
ttttgtttggctatgcc

SEQ ID NO: 293455 - DNA, 16 bp, P. troglodytes
ttttgtttgtaaaatg

SEQ ID NO: 293456 - DNA, 16 bp, P. troglodytes
ttttgtttgtctgaaa

SEQ ID NO: 293457 - DNA, 16 bp, P. troglodytes
ttttgttttaaaacaa

SEQ ID NO: 293458 - DNA, 16 bp, P. troglodytes
ttttgttttaaacagt

SEQ ID NO: 293459 - DNA, 16 bp, P. troglodytes
ttttgttttaaataca

SEQ ID NO: 293460 - DNA, 16 bp, P. troglodytes
ttttgttttagatgga

SEQ ID NO: 293461 - DNA, 16 bp, P. troglodytes
ttttgttttcaaaagt

SEQ ID NO: 293462 - DNA, 16 bp, P. troglodytes
ttttgttttcaaataa

SEQ ID NO: 293463 - DNA, 16 bp, P. troglodytes
ttttgttttcaaatat

SEQ ID NO: 293464 - DNA, 16 bp, P. troglodytes
ttttgttttcatgaaa

SEQ ID NO: 293465 - DNA, 16 bp, P. troglodytes
ttttgttttctaaatg

SEQ ID NO: 293466 - DNA, 16 bp, P. troglodytes
ttttgttttctgagac

SEQ ID NO: 293467 - DNA, 16 bp, P. troglodytes
ttttgttttcttgaga

SEQ ID NO: 293468 - DNA, 16 bp, P. troglodytes
ttttgttttgaaaaca

SEQ ID NO: 293469 - DNA, 16 bp, P. troglodytes
ttttgttttgagacag

SEQ ID NO: 293470 - DNA, 16 bp, P. troglodytes
ttttgttttgagacgg

SEQ ID NO: 293471 - DNA, 16 bp, P. troglodytes
ttttgttttgaggcag

SEQ ID NO: 293472 - DNA, 16 bp, P. troglodytes
ttttgtttttaatgca

SEQ ID NO: 293473 - DNA, 16 bp, P. troglodytes
ttttgtttttagaaga

SEQ ID NO: 293474 - DNA, 16 bp, P. troglodytes
ttttgtttttcaaaaa

SEQ ID NO: 293475 - DNA, 16 bp, P. troglodytes
ttttgtttttcaaagt

SEQ ID NO: 293476 - DNA, 16 bp, P. troglodytes
ttttgtttttcacaaa

SEQ ID NO: 293477 - DNA, 16 bp, P. troglodytes
ttttgtttttcataga

SEQ ID NO: 293478 - DNA, 16 bp, P. troglodytes
ttttgtttttccagag

SEQ ID NO: 293479 - DNA, 16 bp, P. troglodytes
ttttgtttttctcaaa

SEQ ID NO: 293480 - DNA, 16 bp, P. troglodytes
ttttgtttttgagaga

SEQ ID NO: 293481 - DNA, 16 bp, P. troglodytes
ttttgtttttggagaa

SEQ ID NO: 293482 - DNA, 16 bp, P. troglodytes
ttttgtttttggagac

SEQ ID NO: 293483 - DNA, 16 bp, P. troglodytes
ttttgttttttaagac

SEQ ID NO: 293484 - DNA, 16 bp, P. troglodytes
ttttgttttttcaaga

SEQ ID NO: 293485 - DNA, 16 bp, P. troglodytes
tttttaaaaaaaacct

SEQ ID NO: 293486 - DNA, 16 bp, P. troglodytes
tttttaaaaaaaagca

SEQ ID NO: 293487 - DNA, 16 bp, P. troglodytes
tttttaaaaaaacaag

SEQ ID NO: 293488 - DNA, 16 bp, P. troglodytes
tttttaaaaaaactca

SEQ ID NO: 293489 - DNA, 16 bp, P. troglodytes
tttttaaaaaaactgt

SEQ ID NO: 293490 - DNA, 16 bp, P. troglodytes
tttttaaaaaaagagc

SEQ ID NO: 293491 - DNA, 16 bp, P. troglodytes
tttttaaaaaaagcat

SEQ ID NO: 293492 - DNA, 16 bp, P. troglodytes
tttttaaaaaaagctt

SEQ ID NO: 293493 - DNA, 16 bp, P. troglodytes
tttttaaaaaaaggca

SEQ ID NO: 293494 - DNA, 16 bp, P. troglodytes
tttttaaaaaacagct

SEQ ID NO: 293495 - DNA, 16 bp, P. troglodytes
tttttaaaaaacatga

SEQ ID NO: 293496 - DNA, 16 bp, P. troglodytes
tttttaaaaaactgct

SEQ ID NO: 293497 - DNA, 16 bp, P. troglodytes
tttttaaaaaactgtt

SEQ ID NO: 293498 - DNA, 16 bp, P. troglodytes
tttttaaaaaaggatc

SEQ ID NO: 293499 - DNA, 16 bp, P. troglodytes
tttttaaaaaaggtta

SEQ ID NO: 293500 - DNA, 16 bp, P. troglodytes
tttttaaaaaaggttt

SEQ ID NO: 293501 - DNA, 16 bp, P. troglodytes
tttttaaaaaatcctt

SEQ ID NO: 293502 - DNA, 16 bp, P. troglodytes
tttttaaaaaatctga

SEQ ID NO: 293503 - DNA, 16 bp, P. troglodytes
tttttaaaaaatgcat

SEQ ID NO: 293504 - DNA, 16 bp, P. troglodytes
tttttaaaaaatgctt

SEQ ID NO: 293505 - DNA, 16 bp, P. troglodytes
tttttaaaaaatggaa

SEQ ID NO: 293506 - DNA, 16 bp, P. troglodytes
tttttaaaaaatggca

SEQ ID NO: 293507 - DNA, 16 bp, P. troglodytes
tttttaaaaaatgtgt

SEQ ID NO: 293508 - DNA, 16 bp, P. troglodytes
tttttaaaaaattgct

SEQ ID NO: 293509 - DNA, 16 bp, P. troglodytes
tttttaaaaacacctt

SEQ ID NO: 293510 - DNA, 16 bp, P. troglodytes
tttttaaaaaccaaga

SEQ ID NO: 293511 - DNA, 16 bp, P. troglodytes
tttttaaaaaccatat

SEQ ID NO: 293512 - DNA, 16 bp, P. troglodytes
tttttaaaaactcaat

SEQ ID NO: 293513 - DNA, 16 bp, P. troglodytes
tttttaaaaactgaat

SEQ ID NO: 293514 - DNA, 16 bp, P. troglodytes
tttttaaaaagacaaa

SEQ ID NO: 293515 - DNA, 16 bp, P. troglodytes
tttttaaaaagacatt

SEQ ID NO: 293516 - DNA, 16 bp, P. troglodytes
tttttaaaaagagatg

SEQ ID NO: 293517 - DNA, 16 bp, P. troglodytes
tttttaaaaagcaaaa

SEQ ID NO: 293518 - DNA, 16 bp, P. troglodytes
tttttaaaaagcaaac

SEQ ID NO: 293519 - DNA, 16 bp, P. troglodytes
tttttaaaaagcaaat

SEQ ID NO: 293520 - DNA, 16 bp, P. troglodytes
tttttaaaaagcacat

SEQ ID NO: 293521 - DNA, 16 bp, P. troglodytes
tttttaaaaagcacct

SEQ ID NO: 293522 - DNA, 17 bp, P. troglodytes
tttttaaaaagcacttt

SEQ ID NO: 293523 - DNA, 16 bp, P. troglodytes
tttttaaaaagcatat

SEQ ID NO: 293524 - DNA, 16 bp, P. troglodytes
tttttaaaaagcattt

SEQ ID NO: 293525 - DNA, 16 bp, P. troglodytes
tttttaaaaagccaat

SEQ ID NO: 293526 - DNA, 16 bp, P. troglodytes
tttttaaaaagctttt

SEQ ID NO: 293527 - DNA, 16 bp, P. troglodytes
tttttaaaaaggaact

SEQ ID NO: 293528 - DNA, 16 bp, P. troglodytes
tttttaaaaaggcatt

SEQ ID NO: 293529 - DNA, 16 bp, P. troglodytes
tttttaaaaagggaga

SEQ ID NO: 293530 - DNA, 16 bp, P. troglodytes
tttttaaaaaggtgat

SEQ ID NO: 293531 - DNA, 16 bp, P. troglodytes
tttttaaaaaggttat

SEQ ID NO: 293532 - DNA, 16 bp, P. troglodytes
tttttaaaaagtaaag

SEQ ID NO: 293533 - DNA, 16 bp, P. troglodytes
tttttaaaaagtaact

SEQ ID NO: 293534 - DNA, 16 bp, P. troglodytes
tttttaaaaagtaaga

SEQ ID NO: 293535 - DNA, 16 bp, P. troglodytes
tttttaaaaagtagct

SEQ ID NO: 293536 - DNA, 16 bp, P. troglodytes
tttttaaaaagtatca

SEQ ID NO: 293537 - DNA, 16 bp, P. troglodytes
tttttaaaaagtcaaa

SEQ ID NO: 293538 - DNA, 16 bp, P. troglodytes
tttttaaaaagtgatt

SEQ ID NO: 293539 - DNA, 16 bp, P. troglodytes
tttttaaaaagtgctt

SEQ ID NO: 293540 - DNA, 16 bp, P. troglodytes
tttttaaaaagtgtat

SEQ ID NO: 293541 - DNA, 16 bp, P. troglodytes
tttttaaaaagttttc

SEQ ID NO: 293542 - DNA, 16 bp, P. troglodytes
tttttaaaaatatgtg

SEQ ID NO: 293543 - DNA, 16 bp, P. troglodytes
tttttaaaaatcaaag

SEQ ID NO: 293544 - DNA, 16 bp, P. troglodytes
tttttaaaaatcaact

SEQ ID NO: 293545 - DNA, 16 bp, P. troglodytes
tttttaaaaatcagac

SEQ ID NO: 293546 - DNA, 16 bp, P. troglodytes
tttttaaaaatcagag

SEQ ID NO: 293547 - DNA, 16 bp, P. troglodytes
tttttaaaaatccaaa

SEQ ID NO: 293548 - DNA, 16 bp, P. troglodytes
tttttaaaaatccaat

SEQ ID NO: 293549 - DNA, 16 bp, P. troglodytes
tttttaaaaatctcat

SEQ ID NO: 293550 - DNA, 16 bp, P. troglodytes
tttttaaaaatctgtt

SEQ ID NO: 293551 - DNA, 16 bp, P. troglodytes
tttttaaaaatgacat

SEQ ID NO: 293552 - DNA, 16 bp, P. troglodytes
tttttaaaaatgaggt

SEQ ID NO: 293553 - DNA, 16 bp, P. troglodytes
tttttaaaaatgcatt

SEQ ID NO: 293554 - DNA, 16 bp, P. troglodytes
tttttaaaaatgcttt

SEQ ID NO: 293555 - DNA, 16 bp, P. troglodytes
tttttaaaaatggaaa

SEQ ID NO: 293556 - DNA, 16 bp, P. troglodytes
tttttaaaaatggatt

SEQ ID NO: 293557 - DNA, 16 bp, P. troglodytes
tttttaaaaatgggaa

SEQ ID NO: 293558 - DNA, 16 bp, P. troglodytes
tttttaaaaatgtaca

SEQ ID NO: 293559 - DNA, 16 bp, P. troglodytes
tttttaaaaattaggt

SEQ ID NO: 293560 - DNA, 16 bp, P. troglodytes
tttttaaaaattctag

SEQ ID NO: 293561 - DNA, 16 bp, P. troglodytes
tttttaaaaattctca

SEQ ID NO: 293562 - DNA, 16 bp, P. troglodytes
tttttaaaaattgcca

SEQ ID NO: 293563 - DNA, 16 bp, P. troglodytes
tttttaaaaattgctt

SEQ ID NO: 293564 - DNA, 16 bp, P. troglodytes
tttttaaaaattgtga

SEQ ID NO: 293565 - DNA, 16 bp, P. troglodytes
tttttaaaacaaaggt

SEQ ID NO: 293566 - DNA, 16 bp, P. troglodytes
tttttaaaacaacttt

SEQ ID NO: 293567 - DNA, 16 bp, P. troglodytes
tttttaaaacaagaaa

SEQ ID NO: 293568 - DNA, 16 bp, P. troglodytes
tttttaaaacagatat

SEQ ID NO: 293569 - DNA, 16 bp, P. troglodytes
tttttaaaacatgttt

SEQ ID NO: 293570 - DNA, 16 bp, P. troglodytes
tttttaaaaccaaatt

SEQ ID NO: 293571 - DNA, 16 bp, P. troglodytes
tttttaaaacctgttt

SEQ ID NO: 293572 - DNA, 16 bp, P. troglodytes
tttttaaaacgttttt

SEQ ID NO: 293573 - DNA, 16 bp, P. troglodytes
tttttaaaactgaatg

SEQ ID NO: 293574 - DNA, 16 bp, P. troglodytes
tttttaaaactgtgaa

SEQ ID NO: 293575 - DNA, 16 bp, P. troglodytes
tttttaaaactgtttt

SEQ ID NO: 293576 - DNA, 16 bp, P. troglodytes
tttttaaaacttcagt

SEQ ID NO: 293577 - DNA, 16 bp, P. troglodytes
tttttaaaactttgaa

SEQ ID NO: 293578 - DNA, 16 bp, P. troglodytes
tttttaaaagaaaaca

SEQ ID NO: 293579 - DNA, 16 bp, P. troglodytes
tttttaaaagaagatg

SEQ ID NO: 293580 - DNA, 16 bp, P. troglodytes
tttttaaaagaagcaa

SEQ ID NO: 293581 - DNA, 16 bp, P. troglodytes
tttttaaaagaaggta

SEQ ID NO: 293582 - DNA, 16 bp, P. troglodytes
tttttaaaagaatcaa

SEQ ID NO: 293583 - DNA, 16 bp, P. troglodytes
tttttaaaagacattt

SEQ ID NO: 293584 - DNA, 16 bp, P. troglodytes
tttttaaaagacttaa

SEQ ID NO: 293585 - DNA, 16 bp, P. troglodytes
tttttaaaagagctat

SEQ ID NO: 293586 - DNA, 16 bp, P. troglodytes
tttttaaaagataaac

SEQ ID NO: 293587 - DNA, 16 bp, P. troglodytes
tttttaaaagataaag

SEQ ID NO: 293588 - DNA, 16 bp, P. troglodytes
tttttaaaagatagaa

SEQ ID NO: 293589 - DNA, 16 bp, P. troglodytes
tttttaaaagatgtca

SEQ ID NO: 293590 - DNA, 16 bp, P. troglodytes
tttttaaaagattact

SEQ ID NO: 293591 - DNA, 16 bp, P. troglodytes
tttttaaaagcaaaaa

SEQ ID NO: 293592 - DNA, 16 bp, P. troglodytes
tttttaaaagcagaag

SEQ ID NO: 293593 - DNA, 16 bp, P. troglodytes
tttttaaaagcatatg

SEQ ID NO: 293594 - DNA, 16 bp, P. troglodytes
tttttaaaagccttta

SEQ ID NO: 293595 - DNA, 16 bp, P. troglodytes
tttttaaaagggaatt

SEQ ID NO: 293596 - DNA, 16 bp, P. troglodytes
tttttaaaaggtgaaa

SEQ ID NO: 293597 - DNA, 16 bp, P. troglodytes
tttttaaaagtaagtt

SEQ ID NO: 293598 - DNA, 16 bp, P. troglodytes
tttttaaaagtacagt

SEQ ID NO: 293599 - DNA, 16 bp, P. troglodytes
tttttaaaagtagaaa

SEQ ID NO: 293600 - DNA, 16 bp, P. troglodytes
tttttaaaagtcaaat

SEQ ID NO: 293601 - DNA, 16 bp, P. troglodytes
tttttaaaagtcaatg

SEQ ID NO: 293602 - DNA, 16 bp, P. troglodytes
tttttaaaagttgatg

SEQ ID NO: 293603 - DNA, 16 bp, P. troglodytes
tttttaaaagtttact

SEQ ID NO: 293604 - DNA, 16 bp, P. troglodytes
tttttaaaagtttcaa

SEQ ID NO: 293605 - DNA, 16 bp, P. troglodytes
tttttaaaataatgct

SEQ ID NO: 293606 - DNA, 16 bp, P. troglodytes
tttttaaaatacagaa

SEQ ID NO: 293607 - DNA, 16 bp, P. troglodytes
tttttaaaatagacat

SEQ ID NO: 293608 - DNA, 16 bp, P. troglodytes
tttttaaaatcctaaa

SEQ ID NO: 293609 - DNA, 16 bp, P. troglodytes
tttttaaaatctagaa

SEQ ID NO: 293610 - DNA, 16 bp, P. troglodytes
tttttaaaatgacact

SEQ ID NO: 293611 - DNA, 16 bp, P. troglodytes
tttttaaaatgaggtt

SEQ ID NO: 293612 - DNA, 16 bp, P. troglodytes
tttttaaaatggaaaa

SEQ ID NO: 293613 - DNA, 16 bp, P. troglodytes
tttttaaaatgtacaa

SEQ ID NO: 293614 - DNA, 16 bp, P. troglodytes
tttttaaaatgtacat

SEQ ID NO: 293615 - DNA, 16 bp, P. troglodytes
tttttaaaatgtagaa

SEQ ID NO: 293616 - DNA, 16 bp, P. troglodytes
tttttaaaatgtgaat

SEQ ID NO: 293617 - DNA, 16 bp, P. troglodytes
tttttaaaattagcca

SEQ ID NO: 293618 - DNA, 16 bp, P. troglodytes
tttttaaaattgcatt

SEQ ID NO: 293619 - DNA, 16 bp, P. troglodytes
tttttaaacaaaatct

SEQ ID NO: 293620 - DNA, 16 bp, P. troglodytes
tttttaaacaaaatga

SEQ ID NO: 293621 - DNA, 16 bp, P. troglodytes
tttttaaacaaagaag

SEQ ID NO: 293622 - DNA, 16 bp, P. troglodytes
tttttaaacaaatcaa

SEQ ID NO: 293623 - DNA, 16 bp, P. troglodytes
tttttaaacaaatgaa

SEQ ID NO: 293624 - DNA, 16 bp, P. troglodytes
tttttaaacagagtct

SEQ ID NO: 293625 - DNA, 16 bp, P. troglodytes
tttttaaacagctttt

SEQ ID NO: 293626 - DNA, 16 bp, P. troglodytes
tttttaaacataaatg

SEQ ID NO: 293627 - DNA, 16 bp, P. troglodytes
tttttaaacatgaatt

SEQ ID NO: 293628 - DNA, 16 bp, P. troglodytes
tttttaaacatgattt

SEQ ID NO: 293629 - DNA, 16 bp, P. troglodytes
tttttaaacatgtttt

SEQ ID NO: 293630 - DNA, 16 bp, P. troglodytes
tttttaaaccaaaaat

SEQ ID NO: 293631 - DNA, 16 bp, P. troglodytes
tttttaaactatgaaa

SEQ ID NO: 293632 - DNA, 16 bp, P. troglodytes
tttttaaactcttaaa

SEQ ID NO: 293633 - DNA, 16 bp, P. troglodytes
tttttaaactgtttct

SEQ ID NO: 293634 - DNA, 16 bp, P. troglodytes
tttttaaacttgaaaa

SEQ ID NO: 293635 - DNA, 16 bp, P. troglodytes
tttttaaagaaaaact

SEQ ID NO: 293636 - DNA, 16 bp, P. troglodytes
tttttaaagaaaacaa

SEQ ID NO: 293637 - DNA, 16 bp, P. troglodytes
tttttaaagaaaatct

SEQ ID NO: 293638 - DNA, 16 bp, P. troglodytes
tttttaaagaaacaaa

SEQ ID NO: 293639 - DNA, 16 bp, P. troglodytes
tttttaaagaaacata

SEQ ID NO: 293640 - DNA, 16 bp, P. troglodytes
tttttaaagaaacatc

SEQ ID NO: 293641 - DNA, 16 bp, P. troglodytes
tttttaaagaaagttt

SEQ ID NO: 293642 - DNA, 16 bp, P. troglodytes
tttttaaagaaataca

SEQ ID NO: 293643 - DNA, 16 bp, P. troglodytes
tttttaaagaaatcct

SEQ ID NO: 293644 - DNA, 16 bp, P. troglodytes
tttttaaagaaatggg

SEQ ID NO: 293645 - DNA, 16 bp, P. troglodytes
tttttaaagaacaaag

SEQ ID NO: 293646 - DNA, 16 bp, P. troglodytes
tttttaaagaacaaat

SEQ ID NO: 293647 - DNA, 16 bp, P. troglodytes
tttttaaagaagaatt

SEQ ID NO: 293648 - DNA, 16 bp, P. troglodytes
tttttaaagaagtata

SEQ ID NO: 293649 - DNA, 16 bp, P. troglodytes
tttttaaagaatgtct

SEQ ID NO: 293650 - DNA, 16 bp, P. troglodytes
tttttaaagacaataa

SEQ ID NO: 293651 - DNA, 16 bp, P. troglodytes
tttttaaagacagaaa

SEQ ID NO: 293652 - DNA, 16 bp, P. troglodytes
tttttaaagacagaga

SEQ ID NO: 293653 - DNA, 16 bp, P. troglodytes
tttttaaagacagttt

SEQ ID NO: 293654 - DNA, 16 bp, P. troglodytes
tttttaaagacatttt

SEQ ID NO: 293655 - DNA, 16 bp, P. troglodytes
tttttaaagagaaaac

SEQ ID NO: 293656 - DNA, 16 bp, P. troglodytes
tttttaaagagaagtt

SEQ ID NO: 293657 - DNA, 16 bp, P. troglodytes
tttttaaagagagaaa

SEQ ID NO: 293658 - DNA, 16 bp, P. troglodytes
tttttaaagatctttt

SEQ ID NO: 293659 - DNA, 16 bp, P. troglodytes
tttttaaagatgaaaa

SEQ ID NO: 293660 - DNA, 16 bp, P. troglodytes
tttttaaagatgagat

SEQ ID NO: 293661 - DNA, 16 bp, P. troglodytes
tttttaaagatgtgaa

SEQ ID NO: 293662 - DNA, 16 bp, P. troglodytes
tttttaaagcaaaata

SEQ ID NO: 293663 - DNA, 16 bp, P. troglodytes
tttttaaagcaaatat

SEQ ID NO: 293664 - DNA, 16 bp, P. troglodytes
tttttaaagcaatttt

SEQ ID NO: 293665 - DNA, 16 bp, P. troglodytes
tttttaaagcactttt

SEQ ID NO: 293666 - DNA, 16 bp, P. troglodytes
tttttaaagcagcttt

SEQ ID NO: 293667 - DNA, 16 bp, P. troglodytes
tttttaaagcattaat

SEQ ID NO: 293668 - DNA, 16 bp, P. troglodytes
tttttaaagcattctt

SEQ ID NO: 293669 - DNA, 16 bp, P. troglodytes
tttttaaagccctttt

SEQ ID NO: 293670 - DNA, 16 bp, P. troglodytes
tttttaaagctcccca

SEQ ID NO: 293671 - DNA, 16 bp, P. troglodytes
tttttaaagctgtttt

SEQ ID NO: 293672 - DNA, 16 bp, P. troglodytes
tttttaaagcttcttt

SEQ ID NO: 293673 - DNA, 16 bp, P. troglodytes
tttttaaagctttatt

SEQ ID NO: 293674 - DNA, 16 bp, P. troglodytes
tttttaaaggaaaaat

SEQ ID NO: 293675 - DNA, 16 bp, P. troglodytes
tttttaaaggaaatgt

SEQ ID NO: 293676 - DNA, 16 bp, P. troglodytes
tttttaaaggaagaaa

SEQ ID NO: 293677 - DNA, 16 bp, P. troglodytes
tttttaaaggaataaa

SEQ ID NO: 293678 - DNA, 16 bp, P. troglodytes
tttttaaaggataaaa

SEQ ID NO: 293679 - DNA, 16 bp, P. troglodytes
tttttaaaggcaaaaa

SEQ ID NO: 293680 - DNA, 16 bp, P. troglodytes
tttttaaaggcaaaga

SEQ ID NO: 293681 - DNA, 16 bp, P. troglodytes
tttttaaaggctaaat

SEQ ID NO: 293682 - DNA, 16 bp, P. troglodytes
tttttaaagggaaaaa

SEQ ID NO: 293683 - DNA, 16 bp, P. troglodytes
tttttaaagtaaatgt

SEQ ID NO: 293684 - DNA, 16 bp, P. troglodytes
tttttaaagtaattct

SEQ ID NO: 293685 - DNA, 16 bp, P. troglodytes
tttttaaagtatttca

SEQ ID NO: 293686 - DNA, 16 bp, P. troglodytes
tttttaaagtcaaaat

SEQ ID NO: 293687 - DNA, 16 bp, P. troglodytes
tttttaaagtcataaa

SEQ ID NO: 293688 - DNA, 16 bp, P. troglodytes
tttttaaagtctgaaa

SEQ ID NO: 293689 - DNA, 16 bp, P. troglodytes
tttttaaagtcttctt

SEQ ID NO: 293690 - DNA, 16 bp, P. troglodytes
tttttaaagtgcattt

SEQ ID NO: 293691 - DNA, 16 bp, P. troglodytes
tttttaaagtgctttt

SEQ ID NO: 293692 - DNA, 16 bp, P. troglodytes
tttttaaagtgtttct

SEQ ID NO: 293693 - DNA, 16 bp, P. troglodytes
tttttaaagttacaaa

SEQ ID NO: 293694 - DNA, 16 bp, P. troglodytes
tttttaaataaaagct

SEQ ID NO: 293695 - DNA, 16 bp, P. troglodytes
tttttaaataaagaac

SEQ ID NO: 293696 - DNA, 16 bp, P. troglodytes
tttttaaataaagatg

SEQ ID NO: 293697 - DNA, 16 bp, P. troglodytes
tttttaaataaagcaa

SEQ ID NO: 293698 - DNA, 16 bp, P. troglodytes
tttttaaataaattgc

SEQ ID NO: 293699 - DNA, 16 bp, P. troglodytes
tttttaaataacagtt

SEQ ID NO: 293700 - DNA, 16 bp, P. troglodytes
tttttaaataagcatt

SEQ ID NO: 293701 - DNA, 16 bp, P. troglodytes
tttttaaataatagtc

SEQ ID NO: 293702 - DNA, 16 bp, P. troglodytes
tttttaaatacagagt

SEQ ID NO: 293703 - DNA, 16 bp, P. troglodytes
tttttaaatagacaaa

SEQ ID NO: 293704 - DNA, 16 bp, P. troglodytes
tttttaaataggaaat

SEQ ID NO: 293705 - DNA, 16 bp, P. troglodytes
tttttaaatagggaat

SEQ ID NO: 293706 - DNA, 16 bp, P. troglodytes
tttttaaatagtgaaa

SEQ ID NO: 293707 - DNA, 16 bp, P. troglodytes
tttttaaatattgctt

SEQ ID NO: 293708 - DNA, 16 bp, P. troglodytes
tttttaaatcaacaaa

SEQ ID NO: 293709 - DNA, 16 bp, P. troglodytes
tttttaaatcagattg

SEQ ID NO: 293710 - DNA, 16 bp, P. troglodytes
tttttaaatcagtgtt

SEQ ID NO: 293711 - DNA, 16 bp, P. troglodytes
tttttaaatcagtttt

SEQ ID NO: 293712 - DNA, 16 bp, P. troglodytes
tttttaaatcatcctt

SEQ ID NO: 293713 - DNA, 16 bp, P. troglodytes
tttttaaatcatttgt

SEQ ID NO: 293714 - DNA, 16 bp, P. troglodytes
tttttaaatccattca

SEQ ID NO: 293715 - DNA, 16 bp, P. troglodytes
tttttaaatcctaaaa

SEQ ID NO: 293716 - DNA, 16 bp, P. troglodytes
tttttaaatgaaagaa

SEQ ID NO: 293717 - DNA, 16 bp, P. troglodytes
tttttaaatgaactat

SEQ ID NO: 293718 - DNA, 16 bp, P. troglodytes
tttttaaatgaagaaa

SEQ ID NO: 293719 - DNA, 16 bp, P. troglodytes
tttttaaatgacatta

SEQ ID NO: 293720 - DNA, 16 bp, P. troglodytes
tttttaaatgacattt

SEQ ID NO: 293721 - DNA, 16 bp, P. troglodytes
tttttaaatgactaat

SEQ ID NO: 293722 - DNA, 16 bp, P. troglodytes
tttttaaatgagaaaa

SEQ ID NO: 293723 - DNA, 16 bp, P. troglodytes
tttttaaatgatgaaa

SEQ ID NO: 293724 - DNA, 16 bp, P. troglodytes
tttttaaatgatgtaa

SEQ ID NO: 293725 - DNA, 16 bp, P. troglodytes
tttttaaatgccattt

SEQ ID NO: 293726 - DNA, 16 bp, P. troglodytes
tttttaaatggaaata

SEQ ID NO: 293727 - DNA, 16 bp, P. troglodytes
tttttaaatggacaaa

SEQ ID NO: 293728 - DNA, 16 bp, P. troglodytes
tttttaaatggcatat

SEQ ID NO: 293729 - DNA, 16 bp, P. troglodytes
tttttaaatggttggg

SEQ ID NO: 293730 - DNA, 16 bp, P. troglodytes
tttttaaatgtaaaag

SEQ ID NO: 293731 - DNA, 16 bp, P. troglodytes
tttttaaatgtacaat

SEQ ID NO: 293732 - DNA, 16 bp, P. troglodytes
tttttaaatgtacaga

SEQ ID NO: 293733 - DNA, 16 bp, P. troglodytes
tttttaaatgtagaaa

SEQ ID NO: 293734 - DNA, 16 bp, P. troglodytes
tttttaaatgtcagtt

SEQ ID NO: 293735 - DNA, 16 bp, P. troglodytes
tttttaaatgtccatt

SEQ ID NO: 293736 - DNA, 16 bp, P. troglodytes
tttttaaatgtctata

SEQ ID NO: 293737 - DNA, 16 bp, P. troglodytes
tttttaaatgttcttg

SEQ ID NO: 293738 - DNA, 16 bp, P. troglodytes
tttttaaatgttgaac

SEQ ID NO: 293739 - DNA, 16 bp, P. troglodytes
tttttaaattattgct

SEQ ID NO: 293740 - DNA, 16 bp, P. troglodytes
tttttaaattctgaaa

SEQ ID NO: 293741 - DNA, 16 bp, P. troglodytes
tttttaaattgacttt

SEQ ID NO: 293742 - DNA, 16 bp, P. troglodytes
tttttaaattgctctt

SEQ ID NO: 293743 - DNA, 16 bp, P. troglodytes
tttttaaatttcaaga

SEQ ID NO: 293744 - DNA, 16 bp, P. troglodytes
tttttaaatttcccag

SEQ ID NO: 293745 - DNA, 16 bp, P. troglodytes
tttttaacaaagaaaa

SEQ ID NO: 293746 - DNA, 16 bp, P. troglodytes
tttttaacaaagaagt

SEQ ID NO: 293747 - DNA, 16 bp, P. troglodytes
tttttaacaaatggta

SEQ ID NO: 293748 - DNA, 16 bp, P. troglodytes
tttttaacatgaaaaa

SEQ ID NO: 293749 - DNA, 16 bp, P. troglodytes
tttttaacatttgtaa

SEQ ID NO: 293750 - DNA, 16 bp, P. troglodytes
tttttaactgttgttg

SEQ ID NO: 293751 - DNA, 16 bp, P. troglodytes
tttttaacttgtaaaa

SEQ ID NO: 293752 - DNA, 16 bp, P. troglodytes
tttttaactttgatga

SEQ ID NO: 293753 - DNA, 16 bp, P. troglodytes
tttttaagaaaggaag

SEQ ID NO: 293754 - DNA, 16 bp, P. troglodytes
tttttaagaaatgatt

SEQ ID NO: 293755 - DNA, 16 bp, P. troglodytes
tttttaagaacaaaat

SEQ ID NO: 293756 - DNA, 16 bp, P. troglodytes
tttttaagaagaaaga

SEQ ID NO: 293757 - DNA, 16 bp, P. troglodytes
tttttaagaagaagaa

SEQ ID NO: 293758 - DNA, 16 bp, P. troglodytes
tttttaagaatgttga

SEQ ID NO: 293759 - DNA, 16 bp, P. troglodytes
tttttaagaatttctt

SEQ ID NO: 293760 - DNA, 16 bp, P. troglodytes
tttttaagacagactt

SEQ ID NO: 293761 - DNA, 16 bp, P. troglodytes
tttttaagactatttt

SEQ ID NO: 293762 - DNA, 16 bp, P. troglodytes
tttttaagagaaagaa

SEQ ID NO: 293763 - DNA, 16 bp, P. troglodytes
tttttaagagacagtc

SEQ ID NO: 293764 - DNA, 16 bp, P. troglodytes
tttttaagagactggg

SEQ ID NO: 293765 - DNA, 16 bp, P. troglodytes
tttttaagaggaaatt

SEQ ID NO: 293766 - DNA, 16 bp, P. troglodytes
tttttaagagtaaatt

SEQ ID NO: 293767 - DNA, 16 bp, P. troglodytes
tttttaagagtataaa

SEQ ID NO: 293768 - DNA, 16 bp, P. troglodytes
tttttaagagtttaaa

SEQ ID NO: 293769 - DNA, 16 bp, P. troglodytes
tttttaagatggaaaa

SEQ ID NO: 293770 - DNA, 16 bp, P. troglodytes
tttttaagatttatcc

SEQ ID NO: 293771 - DNA, 16 bp, P. troglodytes
tttttaaggaaaaaga

SEQ ID NO: 293772 - DNA, 16 bp, P. troglodytes
tttttaaggaaaagaa

SEQ ID NO: 293773 - DNA, 16 bp, P. troglodytes
tttttaaggaaaatgt

SEQ ID NO: 293774 - DNA, 16 bp, P. troglodytes
tttttaaggaaacatt

SEQ ID NO: 293775 - DNA, 16 bp, P. troglodytes
tttttaaggaagaaaa

SEQ ID NO: 293776 - DNA, 16 bp, P. troglodytes
tttttaaggaatagaa

SEQ ID NO: 293777 - DNA, 16 bp, P. troglodytes
tttttaaggcttttga

SEQ ID NO: 293778 - DNA, 16 bp, P. troglodytes
tttttaagtaaagaaa

SEQ ID NO: 293779 - DNA, 16 bp, P. troglodytes
tttttaagtgaaaaga

SEQ ID NO: 293780 - DNA, 16 bp, P. troglodytes
tttttaagtgagaaaa

SEQ ID NO: 293781 - DNA, 16 bp, P. troglodytes
tttttaagtgttaaaa

SEQ ID NO: 293782 - DNA, 16 bp, P. troglodytes
tttttaagttccttgt

SEQ ID NO: 293783 - DNA, 16 bp, P. troglodytes
tttttaagtttagaaa

SEQ ID NO: 293784 - DNA, 16 bp, P. troglodytes
tttttaataaatgaag

SEQ ID NO: 293785 - DNA, 16 bp, P. troglodytes
tttttaataattacca

SEQ ID NO: 293786 - DNA, 16 bp, P. troglodytes
tttttaatagaaatga

SEQ ID NO: 293787 - DNA, 16 bp, P. troglodytes
tttttaatagagactg

SEQ ID NO: 293788 - DNA, 16 bp, P. troglodytes
tttttaatagagaggg

SEQ ID NO: 293789 - DNA, 16 bp, P. troglodytes
tttttaatagagatga

SEQ ID NO: 293790 - DNA, 16 bp, P. troglodytes
tttttaatcaagaaaa

SEQ ID NO: 293791 - DNA, 16 bp, P. troglodytes
tttttaatcataaaag

SEQ ID NO: 293792 - DNA, 16 bp, P. troglodytes
tttttaatcatgaaat

SEQ ID NO: 293793 - DNA, 16 bp, P. troglodytes
tttttaatcatgaata

SEQ ID NO: 293794 - DNA, 16 bp, P. troglodytes
tttttaatccaatctg

SEQ ID NO: 293795 - DNA, 16 bp, P. troglodytes
tttttaatccataaaa

SEQ ID NO: 293796 - DNA, 16 bp, P. troglodytes
tttttaatctgtaaaa

SEQ ID NO: 293797 - DNA, 16 bp, P. troglodytes
tttttaatcttagaaa

SEQ ID NO: 293798 - DNA, 16 bp, P. troglodytes
tttttaatgaaaagaa

SEQ ID NO: 293799 - DNA, 16 bp, P. troglodytes
tttttaatgaaataag

SEQ ID NO: 293800 - DNA, 16 bp, P. troglodytes
tttttaatgaacattt

SEQ ID NO: 293801 - DNA, 16 bp, P. troglodytes
tttttaatgaaggaaa

SEQ ID NO: 293802 - DNA, 16 bp, P. troglodytes
tttttaatgacatttt

SEQ ID NO: 293803 - DNA, 16 bp, P. troglodytes
tttttaatgagaaaag

SEQ ID NO: 293804 - DNA, 16 bp, P. troglodytes
tttttaatgagacaga

SEQ ID NO: 293805 - DNA, 16 bp, P. troglodytes
tttttaatgaggaaaa

SEQ ID NO: 293806 - DNA, 16 bp, P. troglodytes
tttttaatgcaatttt

SEQ ID NO: 293807 - DNA, 16 bp, P. troglodytes
tttttaatggaaacaa

SEQ ID NO: 293808 - DNA, 16 bp, P. troglodytes
tttttaatggctgctt

SEQ ID NO: 293809 - DNA, 16 bp, P. troglodytes
tttttaatgtaaaagt

SEQ ID NO: 293810 - DNA, 16 bp, P. troglodytes
tttttaatgtaaacaa

SEQ ID NO: 293811 - DNA, 16 bp, P. troglodytes
tttttaatgtacaaaa

SEQ ID NO: 293812 - DNA, 16 bp, P. troglodytes
tttttaatgtagtaaa

SEQ ID NO: 293813 - DNA, 16 bp, P. troglodytes
tttttaatgtagtcaa

SEQ ID NO: 293814 - DNA, 16 bp, P. troglodytes
tttttaatgtatgcat

SEQ ID NO: 293815 - DNA, 16 bp, P. troglodytes
tttttaatgtgaaata

SEQ ID NO: 293816 - DNA, 16 bp, P. troglodytes
tttttaatgtgctgct

SEQ ID NO: 293817 - DNA, 16 bp, P. troglodytes
tttttaatgtgggcat

SEQ ID NO: 293818 - DNA, 16 bp, P. troglodytes
tttttaatgttctaaa

SEQ ID NO: 293819 - DNA, 16 bp, P. troglodytes
tttttaatgtttcaaa

SEQ ID NO: 293820 - DNA, 16 bp, P. troglodytes
tttttaattcaatgaa

SEQ ID NO: 293821 - DNA, 16 bp, P. troglodytes
tttttaattcttgaaa

SEQ ID NO: 293822 - DNA, 16 bp, P. troglodytes
tttttaattgagacag

SEQ ID NO: 293823 - DNA, 16 bp, P. troglodytes
tttttaatttttgcaa

SEQ ID NO: 293824 - DNA, 16 bp, P. troglodytes
tttttacaaaaagaaa

SEQ ID NO: 293825 - DNA, 16 bp, P. troglodytes
tttttacaaaagaaat

SEQ ID NO: 293826 - DNA, 16 bp, P. troglodytes
tttttacaaaattgtt

SEQ ID NO: 293827 - DNA, 16 bp, P. troglodytes
tttttacaaagaaaat

SEQ ID NO: 293828 - DNA, 16 bp, P. troglodytes
tttttacaaagaaata

SEQ ID NO: 293829 - DNA, 16 bp, P. troglodytes
tttttacaaataaaga

SEQ ID NO: 293830 - DNA, 16 bp, P. troglodytes
tttttacagaaaagaa

SEQ ID NO: 293831 - DNA, 16 bp, P. troglodytes
tttttacagaaatgga

SEQ ID NO: 293832 - DNA, 16 bp, P. troglodytes
tttttacagaaattga

SEQ ID NO: 293833 - DNA, 16 bp, P. troglodytes
tttttacagaaatttt

SEQ ID NO: 293834 - DNA, 16 bp, P. troglodytes
tttttacagaatgctg

SEQ ID NO: 293835 - DNA, 16 bp, P. troglodytes
tttttacagttttaaa

SEQ ID NO: 293836 - DNA, 16 bp, P. troglodytes
tttttacatatggtgt

SEQ ID NO: 293837 - DNA, 16 bp, P. troglodytes
tttttacattgaaaaa

SEQ ID NO: 293838 - DNA, 16 bp, P. troglodytes
tttttacatttagaaa

SEQ ID NO: 293839 - DNA, 16 bp, P. troglodytes
tttttacatttcaaaa

SEQ ID NO: 293840 - DNA, 16 bp, P. troglodytes
tttttaccacaataaa

SEQ ID NO: 293841 - DNA, 16 bp, P. troglodytes
tttttaccacaattaa

SEQ ID NO: 293842 - DNA, 16 bp, P. troglodytes
tttttactcttaaaaa

SEQ ID NO: 293843 - DNA, 16 bp, P. troglodytes
tttttactgtaacttt

SEQ ID NO: 293844 - DNA, 16 bp, P. troglodytes
tttttactgtaccttt

SEQ ID NO: 293845 - DNA, 16 bp, P. troglodytes
tttttactgtgccttt

SEQ ID NO: 293846 - DNA, 16 bp, P. troglodytes
tttttacttaaagaaa

SEQ ID NO: 293847 - DNA, 16 bp, P. troglodytes
tttttacttctctgtg

SEQ ID NO: 293848 - DNA, 16 bp, P. troglodytes
tttttacttgtaaatt

SEQ ID NO: 293849 - DNA, 16 bp, P. troglodytes
tttttacttttgaaaa

SEQ ID NO: 293850 - DNA, 16 bp, P. troglodytes
tttttagaaaaatcaa

SEQ ID NO: 293851 - DNA, 16 bp, P. troglodytes
tttttagaaaagaaat

SEQ ID NO: 293852 - DNA, 16 bp, P. troglodytes
tttttagaaaatacaa

SEQ ID NO: 293853 - DNA, 16 bp, P. troglodytes
tttttagaaacacaaa

SEQ ID NO: 293854 - DNA, 16 bp, P. troglodytes
tttttagaaacttttt

SEQ ID NO: 293855 - DNA, 16 bp, P. troglodytes
tttttagaaagtaaaa

SEQ ID NO: 293856 - DNA, 16 bp, P. troglodytes
tttttagaagcatttt

SEQ ID NO: 293857 - DNA, 16 bp, P. troglodytes
tttttagaattttcag

SEQ ID NO: 293858 - DNA, 16 bp, P. troglodytes
tttttagacaaacaaa

SEQ ID NO: 293859 - DNA, 16 bp, P. troglodytes
tttttagactttttaa

SEQ ID NO: 293860 - DNA, 16 bp, P. troglodytes
tttttagagaaaaggt

SEQ ID NO: 293861 - DNA, 16 bp, P. troglodytes
tttttagagacaaggt

SEQ ID NO: 293862 - DNA, 16 bp, P. troglodytes
tttttagagagatggg

SEQ ID NO: 293863 - DNA, 16 bp, P. troglodytes
tttttagagatgagga

SEQ ID NO: 293864 - DNA, 16 bp, P. troglodytes
tttttagatcagtttt

SEQ ID NO: 293865 - DNA, 16 bp, P. troglodytes
tttttagatgaggaaa

SEQ ID NO: 293866 - DNA, 16 bp, P. troglodytes
tttttagatggaattt

SEQ ID NO: 293867 - DNA, 16 bp, P. troglodytes
tttttagcaataaagc

SEQ ID NO: 293868 - DNA, 16 bp, P. troglodytes
tttttagcagtttaat

SEQ ID NO: 293869 - DNA, 16 bp, P. troglodytes
tttttagcagttttat

SEQ ID NO: 293870 - DNA, 16 bp, P. troglodytes
tttttaggaaaataaa

SEQ ID NO: 293871 - DNA, 16 bp, P. troglodytes
tttttaggaatttatc

SEQ ID NO: 293872 - DNA, 16 bp, P. troglodytes
tttttaggccaggcat

SEQ ID NO: 293873 - DNA, 16 bp, P. troglodytes
tttttaggggaaaaaa

SEQ ID NO: 293874 - DNA, 16 bp, P. troglodytes
tttttaggttaaaaaa

SEQ ID NO: 293875 - DNA, 16 bp, P. troglodytes
tttttagtaaagacag

SEQ ID NO: 293876 - DNA, 16 bp, P. troglodytes
tttttagtaaatttac

SEQ ID NO: 293877 - DNA, 27 bp, P. troglodytes
tttttagtagagatggggttttgccat

SEQ ID NO: 293878 - DNA, 16 bp, P. troglodytes
tttttagtagaggcag

SEQ ID NO: 293879 - DNA, 16 bp, P. troglodytes
tttttagtagaggtgg

SEQ ID NO: 293880 - DNA, 16 bp, P. troglodytes
tttttagttctccttg

SEQ ID NO: 293881 - DNA, 16 bp, P. troglodytes
tttttagttttctgag

SEQ ID NO: 293882 - DNA, 16 bp, P. troglodytes
tttttataaagttcaa

SEQ ID NO: 293883 - DNA, 16 bp, P. troglodytes
tttttataaggacact

SEQ ID NO: 293884 - DNA, 16 bp, P. troglodytes
tttttatagagacagg

SEQ ID NO: 293885 - DNA, 16 bp, P. troglodytes
tttttatagagacatg

SEQ ID NO: 293886 - DNA, 16 bp, P. troglodytes
tttttatagagatggg

SEQ ID NO: 293887 - DNA, 16 bp, P. troglodytes
tttttatagcatttat

SEQ ID NO: 293888 - DNA, 16 bp, P. troglodytes
tttttatagccaaata

SEQ ID NO: 293889 - DNA, 16 bp, P. troglodytes
tttttatatacacata

SEQ ID NO: 293890 - DNA, 16 bp, P. troglodytes
tttttatataggtaaa

SEQ ID NO: 293891 - DNA, 16 bp, P. troglodytes
tttttatatatggcct

SEQ ID NO: 293892 - DNA, 16 bp, P. troglodytes
tttttatattctgaat

SEQ ID NO: 293893 - DNA, 16 bp, P. troglodytes
tttttatattgcctat

SEQ ID NO: 293894 - DNA, 16 bp, P. troglodytes
tttttatcatggaaaa

SEQ ID NO: 293895 - DNA, 16 bp, P. troglodytes
tttttatcattaaaga

SEQ ID NO: 293896 - DNA, 16 bp, P. troglodytes
tttttatcattttgaa

SEQ ID NO: 293897 - DNA, 16 bp, P. troglodytes
tttttatcctgcaact

SEQ ID NO: 293898 - DNA, 16 bp, P. troglodytes
tttttatctttaaatg

SEQ ID NO: 293899 - DNA, 16 bp, P. troglodytes
tttttatgaaaagaaa

SEQ ID NO: 293900 - DNA, 16 bp, P. troglodytes
tttttatgctattata

SEQ ID NO: 293901 - DNA, 16 bp, P. troglodytes
tttttatggacaattt

SEQ ID NO: 293902 - DNA, 16 bp, P. troglodytes
tttttatggagtctca

SEQ ID NO: 293903 - DNA, 16 bp, P. troglodytes
tttttatggataaata

SEQ ID NO: 293904 - DNA, 16 bp, P. troglodytes
tttttatggatgagta

SEQ ID NO: 293905 - DNA, 16 bp, P. troglodytes
tttttatggccaaata

SEQ ID NO: 293906 - DNA, 25 bp, P. troglodytes
tttttatggctgcatagtattccat

SEQ ID NO: 293907 - DNA, 16 bp, P. troglodytes
tttttatggctgtata

SEQ ID NO: 293908 - DNA, 16 bp, P. troglodytes
tttttatgtgaacata

SEQ ID NO: 293909 - DNA, 16 bp, P. troglodytes
tttttattaaagaaac

SEQ ID NO: 293910 - DNA, 16 bp, P. troglodytes
tttttattatctgaaa

SEQ ID NO: 293911 - DNA, 16 bp, P. troglodytes
tttttattcaacaaat

SEQ ID NO: 293912 - DNA, 16 bp, P. troglodytes
tttttattcagtttaa

SEQ ID NO: 293913 - DNA, 16 bp, P. troglodytes
tttttattcattcaac

SEQ ID NO: 293914 - DNA, 16 bp, P. troglodytes
tttttattccataaaa

SEQ ID NO: 293915 - DNA, 16 bp, P. troglodytes
tttttattctattcag

SEQ ID NO: 293916 - DNA, 16 bp, P. troglodytes
tttttattgaagtaaa

SEQ ID NO: 293917 - DNA, 16 bp, P. troglodytes
tttttattgagaaaat

SEQ ID NO: 293918 - DNA, 16 bp, P. troglodytes
tttttattgagcactt

SEQ ID NO: 293919 - DNA, 16 bp, P. troglodytes
tttttattgatgagta

SEQ ID NO: 293920 - DNA, 16 bp, P. troglodytes
tttttattgcagcact

SEQ ID NO: 293921 - DNA, 16 bp, P. troglodytes
tttttattgctgaata

SEQ ID NO: 293922 - DNA, 16 bp, P. troglodytes
tttttattgcttaaaa

SEQ ID NO: 293923 - DNA, 16 bp, P. troglodytes
tttttattgtctccat

SEQ ID NO: 293924 - DNA, 16 bp, P. troglodytes
tttttatttcacagat

SEQ ID NO: 293925 - DNA, 16 bp, P. troglodytes
tttttatttcacagtt

SEQ ID NO: 293926 - DNA, 16 bp, P. troglodytes
tttttatttcactgtg

SEQ ID NO: 293927 - DNA, 16 bp, P. troglodytes
tttttatttctgtaag

SEQ ID NO: 293928 - DNA, 16 bp, P. troglodytes
tttttatttctgtaga

SEQ ID NO: 293929 - DNA, 16 bp, P. troglodytes
tttttatttgctaaat

SEQ ID NO: 293930 - DNA, 16 bp, P. troglodytes
tttttattttaagaca

SEQ ID NO: 293931 - DNA, 16 bp, P. troglodytes
tttttattttacaagt

SEQ ID NO: 293932 - DNA, 16 bp, P. troglodytes
tttttattttacagat

SEQ ID NO: 293933 - DNA, 16 bp, P. troglodytes
tttttattttcaaatg

SEQ ID NO: 293934 - DNA, 16 bp, P. troglodytes
tttttattttctgaaa

SEQ ID NO: 293935 - DNA, 16 bp, P. troglodytes
tttttattttggagac

SEQ ID NO: 293936 - DNA, 16 bp, P. troglodytes
tttttcaaaaaaacca

SEQ ID NO: 293937 - DNA, 16 bp, P. troglodytes
tttttcaaaaaaacta

SEQ ID NO: 293938 - DNA, 16 bp, P. troglodytes
tttttcaaaagaagaa

SEQ ID NO: 293939 - DNA, 16 bp, P. troglodytes
tttttcaaaagttttt

SEQ ID NO: 293940 - DNA, 16 bp, P. troglodytes
tttttcaaaatcaaaa

SEQ ID NO: 293941 - DNA, 16 bp, P. troglodytes
tttttcaaaattgctt

SEQ ID NO: 293942 - DNA, 16 bp, P. troglodytes
tttttcaaacagaaaa

SEQ ID NO: 293943 - DNA, 16 bp, P. troglodytes
tttttcaaagagaaaa

SEQ ID NO: 293944 - DNA, 16 bp, P. troglodytes
tttttcaaagatttta

SEQ ID NO: 293945 - DNA, 16 bp, P. troglodytes
tttttcaaaggatttt

SEQ ID NO: 293946 - DNA, 16 bp, P. troglodytes
tttttcaaaggttttt

SEQ ID NO: 293947 - DNA, 16 bp, P. troglodytes
tttttcaaatatgaaa

SEQ ID NO: 293948 - DNA, 16 bp, P. troglodytes
tttttcaaatatgctt

SEQ ID NO: 293949 - DNA, 16 bp, P. troglodytes
tttttcaaatatgttt

SEQ ID NO: 293950 - DNA, 16 bp, P. troglodytes
tttttcaaatgtttat

SEQ ID NO: 293951 - DNA, 16 bp, P. troglodytes
tttttcaactgtaaat

SEQ ID NO: 293952 - DNA, 16 bp, P. troglodytes
tttttcaactttaaaa

SEQ ID NO: 293953 - DNA, 16 bp, P. troglodytes
tttttcaagaatgttt

SEQ ID NO: 293954 - DNA, 16 bp, P. troglodytes
tttttcaaggaaaaaa

SEQ ID NO: 293955 - DNA, 16 bp, P. troglodytes
tttttcaagtaaaaat

SEQ ID NO: 293956 - DNA, 16 bp, P. troglodytes
tttttcaataaaagtt

SEQ ID NO: 293957 - DNA, 16 bp, P. troglodytes
tttttcaataaagaaa

SEQ ID NO: 293958 - DNA, 16 bp, P. troglodytes
tttttcaataaagtta

SEQ ID NO: 293959 - DNA, 16 bp, P. troglodytes
tttttcaataaatggt

SEQ ID NO: 293960 - DNA, 16 bp, P. troglodytes
tttttcaatttagaaa

SEQ ID NO: 293961 - DNA, 16 bp, P. troglodytes
tttttcacagcaaaag

SEQ ID NO: 293962 - DNA, 16 bp, P. troglodytes
tttttcacataattag

SEQ ID NO: 293963 - DNA, 16 bp, P. troglodytes
tttttcacctataaaa

SEQ ID NO: 293964 - DNA, 16 bp, P. troglodytes
tttttcactgttggtg

SEQ ID NO: 293965 - DNA, 16 bp, P. troglodytes
tttttcacttaacatt

SEQ ID NO: 293966 - DNA, 16 bp, P. troglodytes
tttttcactttaaaaa

SEQ ID NO: 293967 - DNA, 16 bp, P. troglodytes
tttttcacttttcaaa

SEQ ID NO: 293968 - DNA, 16 bp, P. troglodytes
tttttcagaaaaaaaa

SEQ ID NO: 293969 - DNA, 16 bp, P. troglodytes
tttttcagaaaaagaa

SEQ ID NO: 293970 - DNA, 16 bp, P. troglodytes
tttttcagaacttttt

SEQ ID NO: 293971 - DNA, 16 bp, P. troglodytes
tttttcagaagaggaa

SEQ ID NO: 293972 - DNA, 16 bp, P. troglodytes
tttttcagacagaaaa

SEQ ID NO: 293973 - DNA, 16 bp, P. troglodytes
tttttcagacagagcc

SEQ ID NO: 293974 - DNA, 16 bp, P. troglodytes
tttttcagacttgttt

SEQ ID NO: 293975 - DNA, 16 bp, P. troglodytes
tttttcagatgaggaa

SEQ ID NO: 293976 - DNA, 16 bp, P. troglodytes
tttttcagatgatgaa

SEQ ID NO: 293977 - DNA, 16 bp, P. troglodytes
tttttcagcactttaa

SEQ ID NO: 293978 - DNA, 16 bp, P. troglodytes
tttttcagccttaaaa

SEQ ID NO: 293979 - DNA, 16 bp, P. troglodytes
tttttcagctagtttg

SEQ ID NO: 293980 - DNA, 16 bp, P. troglodytes
tttttcagctccatta

SEQ ID NO: 293981 - DNA, 16 bp, P. troglodytes
tttttcagcttaaaaa

SEQ ID NO: 293982 - DNA, 16 bp, P. troglodytes
tttttcagcttttgga

SEQ ID NO: 293983 - DNA, 16 bp, P. troglodytes
tttttcaggctgctct

SEQ ID NO: 293984 - DNA, 16 bp, P. troglodytes
tttttcagtatcaatt

SEQ ID NO: 293985 - DNA, 16 bp, P. troglodytes
tttttcagtggcctta

SEQ ID NO: 293986 - DNA, 16 bp, P. troglodytes
tttttcagtggctggt

SEQ ID NO: 293987 - DNA, 16 bp, P. troglodytes
tttttcagttttcata

SEQ ID NO: 293988 - DNA, 16 bp, P. troglodytes
tttttcataaatgttt

SEQ ID NO: 293989 - DNA, 16 bp, P. troglodytes
tttttcataatagcca

SEQ ID NO: 293990 - DNA, 16 bp, P. troglodytes
tttttcataatgaaaa

SEQ ID NO: 293991 - DNA, 16 bp, P. troglodytes
tttttcatagaattta

SEQ ID NO: 293992 - DNA, 16 bp, P. troglodytes
tttttcatatatctgt

SEQ ID NO: 293993 - DNA, 16 bp, P. troglodytes
tttttcatatgaaaaa

SEQ ID NO: 293994 - DNA, 16 bp, P. troglodytes
tttttcatattttcag

SEQ ID NO: 293995 - DNA, 16 bp, P. troglodytes
tttttcatcagtgttt

SEQ ID NO: 293996 - DNA, 16 bp, P. troglodytes
tttttcatcctttaaa

SEQ ID NO: 293997 - DNA, 16 bp, P. troglodytes
tttttcatctgtaaaa

SEQ ID NO: 293998 - DNA, 16 bp, P. troglodytes
tttttcatctttccaa

SEQ ID NO: 293999 - DNA, 16 bp, P. troglodytes
tttttcatgaaaataa

SEQ ID NO: 294000 - DNA, 16 bp, P. troglodytes
tttttcatgaaatctt

SEQ ID NO: 294001 - DNA, 16 bp, P. troglodytes
tttttcatgaaatttt

SEQ ID NO: 294002 - DNA, 16 bp, P. troglodytes
tttttcatggttctgg

SEQ ID NO: 294003 - DNA, 16 bp, P. troglodytes
tttttcatgtaaattt

SEQ ID NO: 294004 - DNA, 16 bp, P. troglodytes
tttttcatgttaaaat

SEQ ID NO: 294005 - DNA, 16 bp, P. troglodytes
tttttcattaaaatga

SEQ ID NO: 294006 - DNA, 16 bp, P. troglodytes
tttttcattaaaatgt

SEQ ID NO: 294007 - DNA, 16 bp, P. troglodytes
tttttcattaaatttg

SEQ ID NO: 294008 - DNA, 16 bp, P. troglodytes
tttttcattagaaaaa

SEQ ID NO: 294009 - DNA, 16 bp, P. troglodytes
tttttcattcaataaa

SEQ ID NO: 294010 - DNA, 16 bp, P. troglodytes
tttttcattctgttga

SEQ ID NO: 294011 - DNA, 16 bp, P. troglodytes
tttttcatttaagaaa

SEQ ID NO: 294012 - DNA, 16 bp, P. troglodytes
tttttcatttacaaaa

SEQ ID NO: 294013 - DNA, 16 bp, P. troglodytes
tttttcatttctgtaa

SEQ ID NO: 294014 - DNA, 16 bp, P. troglodytes
tttttcatttgcatga

SEQ ID NO: 294015 - DNA, 16 bp, P. troglodytes
tttttcattttagaaa

SEQ ID NO: 294016 - DNA, 16 bp, P. troglodytes
tttttcatttttaaga

SEQ ID NO: 294017 - DNA, 16 bp, P. troglodytes
tttttccaaaatgttt

SEQ ID NO: 294018 - DNA, 16 bp, P. troglodytes
tttttccaaatggaaa

SEQ ID NO: 294019 - DNA, 16 bp, P. troglodytes
tttttccaacttttaa

SEQ ID NO: 294020 - DNA, 16 bp, P. troglodytes
tttttccaaggttttt

SEQ ID NO: 294021 - DNA, 16 bp, P. troglodytes
tttttccaagttttca

SEQ ID NO: 294022 - DNA, 16 bp, P. troglodytes
tttttccaattctgca

SEQ ID NO: 294023 - DNA, 16 bp, P. troglodytes
tttttccacagaccgg

SEQ ID NO: 294024 - DNA, 16 bp, P. troglodytes
tttttccacagccttg

SEQ ID NO: 294025 - DNA, 16 bp, P. troglodytes
tttttccagagtggct

SEQ ID NO: 294026 - DNA, 16 bp, P. troglodytes
tttttccagatgagga

SEQ ID NO: 294027 - DNA, 16 bp, P. troglodytes
tttttccagcaccatt

SEQ ID NO: 294028 - DNA, 16 bp, P. troglodytes
tttttccaggaaaata

SEQ ID NO: 294029 - DNA, 16 bp, P. troglodytes
tttttccatatgtata

SEQ ID NO: 294030 - DNA, 16 bp, P. troglodytes
tttttccatttgtctg

SEQ ID NO: 294031 - DNA, 16 bp, P. troglodytes
tttttcccaaccattt

SEQ ID NO: 294032 - DNA, 16 bp, P. troglodytes
tttttcccatagcact

SEQ ID NO: 294033 - DNA, 16 bp, P. troglodytes
tttttccccaaaaaat

SEQ ID NO: 294034 - DNA, 16 bp, P. troglodytes
tttttccccaaaatta

SEQ ID NO: 294035 - DNA, 16 bp, P. troglodytes
tttttccccaaagatg

SEQ ID NO: 294036 - DNA, 16 bp, P. troglodytes
tttttccccaagtttt

SEQ ID NO: 294037 - DNA, 16 bp, P. troglodytes
tttttccccatgtttg

SEQ ID NO: 294038 - DNA, 16 bp, P. troglodytes
tttttccccccttaaa

SEQ ID NO: 294039 - DNA, 16 bp, P. troglodytes
tttttccccctttgga

SEQ ID NO: 294040 - DNA, 16 bp, P. troglodytes
tttttcccctatctgg

SEQ ID NO: 294041 - DNA, 16 bp, P. troglodytes
tttttcccctgaaaat

SEQ ID NO: 294042 - DNA, 16 bp, P. troglodytes
tttttcccctgatttt

SEQ ID NO: 294043 - DNA, 16 bp, P. troglodytes
tttttccctttaaaaa

SEQ ID NO: 294044 - DNA, 16 bp, P. troglodytes
tttttcctatacacac

SEQ ID NO: 294045 - DNA, 16 bp, P. troglodytes
tttttcctatggagtt

SEQ ID NO: 294046 - DNA, 16 bp, P. troglodytes
tttttcctccagcttt

SEQ ID NO: 294047 - DNA, 16 bp, P. troglodytes
tttttcctctgcattt

SEQ ID NO: 294048 - DNA, 16 bp, P. troglodytes
tttttcctctgcccca

SEQ ID NO: 294049 - DNA, 16 bp, P. troglodytes
tttttcctgaaaatta

SEQ ID NO: 294050 - DNA, 16 bp, P. troglodytes
tttttcctgaaagttt

SEQ ID NO: 294051 - DNA, 16 bp, P. troglodytes
tttttcctgatccttt

SEQ ID NO: 294052 - DNA, 16 bp, P. troglodytes
tttttcctgtagagtt

SEQ ID NO: 294053 - DNA, 16 bp, P. troglodytes
tttttcctgttttaaa

SEQ ID NO: 294054 - DNA, 16 bp, P. troglodytes
tttttccttaaaagaa

SEQ ID NO: 294055 - DNA, 16 bp, P. troglodytes
tttttccttaaaatct

SEQ ID NO: 294056 - DNA, 16 bp, P. troglodytes
tttttccttaataaaa

SEQ ID NO: 294057 - DNA, 16 bp, P. troglodytes
tttttccttctgatgt

SEQ ID NO: 294058 - DNA, 16 bp, P. troglodytes
tttttccttctggtgg

SEQ ID NO: 294059 - DNA, 16 bp, P. troglodytes
tttttccttgcaaatt

SEQ ID NO: 294060 - DNA, 16 bp, P. troglodytes
tttttcctttctaaaa

SEQ ID NO: 294061 - DNA, 16 bp, P. troglodytes
tttttcctttgaaatt

SEQ ID NO: 294062 - DNA, 16 bp, P. troglodytes
tttttcctttgagatg

SEQ ID NO: 294063 - DNA, 16 bp, P. troglodytes
tttttcctttgtaaat

SEQ ID NO: 294064 - DNA, 16 bp, P. troglodytes
tttttccttttatgaa

SEQ ID NO: 294065 - DNA, 16 bp, P. troglodytes
tttttccttttccaaa

SEQ ID NO: 294066 - DNA, 16 bp, P. troglodytes
tttttcctttttggag

SEQ ID NO: 294067 - DNA, 16 bp, P. troglodytes
tttttctaaaagcaaa

SEQ ID NO: 294068 - DNA, 16 bp, P. troglodytes
tttttctaaaagtttt

SEQ ID NO: 294069 - DNA, 16 bp, P. troglodytes
tttttctaaaggtttt

SEQ ID NO: 294070 - DNA, 16 bp, P. troglodytes
tttttctaaatgggaa

SEQ ID NO: 294071 - DNA, 16 bp, P. troglodytes
tttttctaaattgaaa

SEQ ID NO: 294072 - DNA, 16 bp, P. troglodytes
tttttctaagagtttt

SEQ ID NO: 294073 - DNA, 16 bp, P. troglodytes
tttttctaagcatttt

SEQ ID NO: 294074 - DNA, 16 bp, P. troglodytes
tttttctacaaaggaa

SEQ ID NO: 294075 - DNA, 16 bp, P. troglodytes
tttttctagagaaaaa

SEQ ID NO: 294076 - DNA, 16 bp, P. troglodytes
tttttctataaaatga

SEQ ID NO: 294077 - DNA, 16 bp, P. troglodytes
tttttctatgaaaaaa

SEQ ID NO: 294078 - DNA, 16 bp, P. troglodytes
tttttctatgtaaata

SEQ ID NO: 294079 - DNA, 16 bp, P. troglodytes
tttttctatgtttaaa

SEQ ID NO: 294080 - DNA, 16 bp, P. troglodytes
tttttctattccagaa

SEQ ID NO: 294081 - DNA, 16 bp, P. troglodytes
tttttctattgaaaat

SEQ ID NO: 294082 - DNA, 16 bp, P. troglodytes
tttttctcatgattat

SEQ ID NO: 294083 - DNA, 16 bp, P. troglodytes
tttttctcatttaaca

SEQ ID NO: 294084 - DNA, 16 bp, P. troglodytes
tttttctccagaaaaa

SEQ ID NO: 294085 - DNA, 16 bp, P. troglodytes
tttttctccagtgttt

SEQ ID NO: 294086 - DNA, 16 bp, P. troglodytes
tttttctccatagcac

SEQ ID NO: 294087 - DNA, 16 bp, P. troglodytes
tttttctcctctaaaa

SEQ ID NO: 294088 - DNA, 16 bp, P. troglodytes
tttttctcctgcctca

SEQ ID NO: 294089 - DNA, 16 bp, P. troglodytes
tttttctcctgcctga

SEQ ID NO: 294090 - DNA, 16 bp, P. troglodytes
tttttctcctttgaaa

SEQ ID NO: 294091 - DNA, 16 bp, P. troglodytes
tttttctccttttgga

SEQ ID NO: 294092 - DNA, 16 bp, P. troglodytes
tttttctctaaacttc

SEQ ID NO: 294093 - DNA, 16 bp, P. troglodytes
tttttctctaaataaa

SEQ ID NO: 294094 - DNA, 16 bp, P. troglodytes
tttttctctcaaaatt

SEQ ID NO: 294095 - DNA, 16 bp, P. troglodytes
tttttctctcacataa

SEQ ID NO: 294096 - DNA, 16 bp, P. troglodytes
tttttctctgataatt

SEQ ID NO: 294097 - DNA, 16 bp, P. troglodytes
tttttctcttaagaaa

SEQ ID NO: 294098 - DNA, 16 bp, P. troglodytes
tttttctcttgcctga

SEQ ID NO: 294099 - DNA, 16 bp, P. troglodytes
tttttctctttgaaat

SEQ ID NO: 294100 - DNA, 16 bp, P. troglodytes
tttttctgaaagtttt

SEQ ID NO: 294101 - DNA, 16 bp, P. troglodytes
tttttctgaaatgttt

SEQ ID NO: 294102 - DNA, 16 bp, P. troglodytes
tttttctgaataaatt

SEQ ID NO: 294103 - DNA, 16 bp, P. troglodytes
tttttctgagatggga

SEQ ID NO: 294104 - DNA, 16 bp, P. troglodytes
tttttctgagcagcag

SEQ ID NO: 294105 - DNA, 16 bp, P. troglodytes
tttttctgataattag

SEQ ID NO: 294106 - DNA, 16 bp, P. troglodytes
tttttctgcagctatt

SEQ ID NO: 294107 - DNA, 16 bp, P. troglodytes
tttttctgcatataga

SEQ ID NO: 294108 - DNA, 16 bp, P. troglodytes
tttttctgcatcaatt

SEQ ID NO: 294109 - DNA, 16 bp, P. troglodytes
tttttctgcatctgtt

SEQ ID NO: 294110 - DNA, 16 bp, P. troglodytes
tttttctgccccattc

SEQ ID NO: 294111 - DNA, 16 bp, P. troglodytes
tttttctgcctcagcc

SEQ ID NO: 294112 - DNA, 16 bp, P. troglodytes
tttttctggaaaaaga

SEQ ID NO: 294113 - DNA, 16 bp, P. troglodytes
tttttctggaataaat

SEQ ID NO: 294114 - DNA, 16 bp, P. troglodytes
tttttctggccaggtg

SEQ ID NO: 294115 - DNA, 16 bp, P. troglodytes
tttttctgggaagaaa

SEQ ID NO: 294116 - DNA, 16 bp, P. troglodytes
tttttctggtaaattt

SEQ ID NO: 294117 - DNA, 16 bp, P. troglodytes
tttttctggttttaaa

SEQ ID NO: 294118 - DNA, 16 bp, P. troglodytes
tttttctgtaaatcta

SEQ ID NO: 294119 - DNA, 16 bp, P. troglodytes
tttttctgtcccttta

SEQ ID NO: 294120 - DNA, 16 bp, P. troglodytes
tttttctgtgaactta

SEQ ID NO: 294121 - DNA, 16 bp, P. troglodytes
tttttctgtgtatata

SEQ ID NO: 294122 - DNA, 16 bp, P. troglodytes
tttttctgttaaaaat

SEQ ID NO: 294123 - DNA, 16 bp, P. troglodytes
tttttctgttaaatat

SEQ ID NO: 294124 - DNA, 16 bp, P. troglodytes
tttttctgttcaaatt

SEQ ID NO: 294125 - DNA, 16 bp, P. troglodytes
tttttctgttctggga

SEQ ID NO: 294126 - DNA, 16 bp, P. troglodytes
tttttcttaaagacaa

SEQ ID NO: 294127 - DNA, 16 bp, P. troglodytes
tttttcttaaagagga

SEQ ID NO: 294128 - DNA, 16 bp, P. troglodytes
tttttcttaaataaga

SEQ ID NO: 294129 - DNA, 16 bp, P. troglodytes
tttttcttaattgaaa

SEQ ID NO: 294130 - DNA, 16 bp, P. troglodytes
tttttcttacaaataa

SEQ ID NO: 294131 - DNA, 16 bp, P. troglodytes
tttttcttagaaaaat

SEQ ID NO: 294132 - DNA, 16 bp, P. troglodytes
tttttcttagagatgg

SEQ ID NO: 294133 - DNA, 16 bp, P. troglodytes
tttttcttattgtaaa

SEQ ID NO: 294134 - DNA, 16 bp, P. troglodytes
tttttcttcagcattt

SEQ ID NO: 294135 - DNA, 16 bp, P. troglodytes
tttttcttcatggcac

SEQ ID NO: 294136 - DNA, 16 bp, P. troglodytes
tttttcttccaaaatt

SEQ ID NO: 294137 - DNA, 16 bp, P. troglodytes
tttttcttccagtttc

SEQ ID NO: 294138 - DNA, 16 bp, P. troglodytes
tttttcttcccagtct

SEQ ID NO: 294139 - DNA, 16 bp, P. troglodytes
tttttcttcctaaaaa

SEQ ID NO: 294140 - DNA, 16 bp, P. troglodytes
tttttcttcctcaaat

SEQ ID NO: 294141 - DNA, 16 bp, P. troglodytes
tttttcttctctaaaa

SEQ ID NO: 294142 - DNA, 16 bp, P. troglodytes
tttttcttctgaaata

SEQ ID NO: 294143 - DNA, 16 bp, P. troglodytes
tttttcttctgtgaat

SEQ ID NO: 294144 - DNA, 16 bp, P. troglodytes
tttttcttctgttaaa

SEQ ID NO: 294145 - DNA, 16 bp, P. troglodytes
tttttcttcttgagac

SEQ ID NO: 294146 - DNA, 16 bp, P. troglodytes
tttttcttgccaaaaa

SEQ ID NO: 294147 - DNA, 16 bp, P. troglodytes
tttttcttgcctaact

SEQ ID NO: 294148 - DNA, 16 bp, P. troglodytes
tttttcttgcctgatt

SEQ ID NO: 294149 - DNA, 16 bp, P. troglodytes
tttttcttgctttcca

SEQ ID NO: 294150 - DNA, 16 bp, P. troglodytes
tttttcttggaaaaat

SEQ ID NO: 294151 - DNA, 16 bp, P. troglodytes
tttttcttgtaaatgt

SEQ ID NO: 294152 - DNA, 16 bp, P. troglodytes
tttttcttgtagaggt

SEQ ID NO: 294153 - DNA, 16 bp, P. troglodytes
tttttcttgtataaat

SEQ ID NO: 294154 - DNA, 16 bp, P. troglodytes
tttttcttgtgatgtc

SEQ ID NO: 294155 - DNA, 16 bp, P. troglodytes
tttttcttgttaaaaa

SEQ ID NO: 294156 - DNA, 16 bp, P. troglodytes
tttttctttaagaatg

SEQ ID NO: 294157 - DNA, 16 bp, P. troglodytes
tttttctttagaaaaa

SEQ ID NO: 294158 - DNA, 16 bp, P. troglodytes
tttttctttatcccaa

SEQ ID NO: 294159 - DNA, 16 bp, P. troglodytes
tttttctttcacaaat

SEQ ID NO: 294160 - DNA, 16 bp, P. troglodytes
tttttctttcagaaat

SEQ ID NO: 294161 - DNA, 16 bp, P. troglodytes
tttttctttccagaaa

SEQ ID NO: 294162 - DNA, 16 bp, P. troglodytes
tttttctttgaaagaa

SEQ ID NO: 294163 - DNA, 16 bp, P. troglodytes
tttttctttgaaataa

SEQ ID NO: 294164 - DNA, 16 bp, P. troglodytes
tttttctttgaacatg

SEQ ID NO: 294165 - DNA, 16 bp, P. troglodytes
tttttctttgcagaaa

SEQ ID NO: 294166 - DNA, 16 bp, P. troglodytes
tttttctttgtagaaa

SEQ ID NO: 294167 - DNA, 16 bp, P. troglodytes
tttttctttgtagata

SEQ ID NO: 294168 - DNA, 16 bp, P. troglodytes
tttttctttgtcaaca

SEQ ID NO: 294169 - DNA, 16 bp, P. troglodytes
tttttcttttaaacag

SEQ ID NO: 294170 - DNA, 16 bp, P. troglodytes
tttttcttttaaagat

SEQ ID NO: 294171 - DNA, 16 bp, P. troglodytes
tttttcttttaagaaa

SEQ ID NO: 294172 - DNA, 16 bp, P. troglodytes
tttttcttttaataga

SEQ ID NO: 294173 - DNA, 16 bp, P. troglodytes
tttttcttttgaaaat

SEQ ID NO: 294174 - DNA, 16 bp, P. troglodytes
tttttcttttgaagta

SEQ ID NO: 294175 - DNA, 16 bp, P. troglodytes
tttttcttttgaggaa

SEQ ID NO: 294176 - DNA, 16 bp, P. troglodytes
tttttcttttgaggca

SEQ ID NO: 294177 - DNA, 16 bp, P. troglodytes
tttttcttttggaaat

SEQ ID NO: 294178 - DNA, 16 bp, P. troglodytes
tttttctttttaaaga

SEQ ID NO: 294179 - DNA, 16 bp, P. troglodytes
tttttctttttaagaa

SEQ ID NO: 294180 - DNA, 16 bp, P. troglodytes
tttttctttttcagaa

SEQ ID NO: 294181 - DNA, 16 bp, P. troglodytes
tttttctttttggaaa

SEQ ID NO: 294182 - DNA, 16 bp, P. troglodytes
tttttctttttggcag

SEQ ID NO: 294183 - DNA, 16 bp, P. troglodytes
tttttgaaaaacataa

SEQ ID NO: 294184 - DNA, 16 bp, P. troglodytes
tttttgaaaagaaatt

SEQ ID NO: 294185 - DNA, 16 bp, P. troglodytes
tttttgaaaagatgaa

SEQ ID NO: 294186 - DNA, 16 bp, P. troglodytes
tttttgaaaagcaatt

SEQ ID NO: 294187 - DNA, 16 bp, P. troglodytes
tttttgaaaatacaaa

SEQ ID NO: 294188 - DNA, 16 bp, P. troglodytes
tttttgaaaatatcaa

SEQ ID NO: 294189 - DNA, 16 bp, P. troglodytes
tttttgaaaatcaatt

SEQ ID NO: 294190 - DNA, 16 bp, P. troglodytes
tttttgaaaatgagaa

SEQ ID NO: 294191 - DNA, 16 bp, P. troglodytes
tttttgaaaattgaat

SEQ ID NO: 294192 - DNA, 16 bp, P. troglodytes
tttttgaaacaaatga

SEQ ID NO: 294193 - DNA, 16 bp, P. troglodytes
tttttgaaacaaattt

SEQ ID NO: 294194 - DNA, 16 bp, P. troglodytes
tttttgaaacttgttt

SEQ ID NO: 294195 - DNA, 16 bp, P. troglodytes
tttttgaaacttttat

SEQ ID NO: 294196 - DNA, 16 bp, P. troglodytes
tttttgaaagaaatta

SEQ ID NO: 294197 - DNA, 16 bp, P. troglodytes
tttttgaaaggaaaaa

SEQ ID NO: 294198 - DNA, 16 bp, P. troglodytes
tttttgaaataaagtc

SEQ ID NO: 294199 - DNA, 16 bp, P. troglodytes
tttttgaaatgaaaag

SEQ ID NO: 294200 - DNA, 16 bp, P. troglodytes
tttttgaaatgtaaat

SEQ ID NO: 294201 - DNA, 16 bp, P. troglodytes
tttttgaaatgtagtc

SEQ ID NO: 294202 - DNA, 16 bp, P. troglodytes
tttttgaacaaagaaa

SEQ ID NO: 294203 - DNA, 16 bp, P. troglodytes
tttttgaagaaaaaga

SEQ ID NO: 294204 - DNA, 16 bp, P. troglodytes
tttttgaagaaataaa

SEQ ID NO: 294205 - DNA, 16 bp, P. troglodytes
tttttgaagaatgttt

SEQ ID NO: 294206 - DNA, 16 bp, P. troglodytes
tttttgaagggatttt

SEQ ID NO: 294207 - DNA, 16 bp, P. troglodytes
tttttgaagggctttt

SEQ ID NO: 294208 - DNA, 16 bp, P. troglodytes
tttttgaagtgctgct

SEQ ID NO: 294209 - DNA, 16 bp, P. troglodytes
tttttgacaaaagtgc

SEQ ID NO: 294210 - DNA, 16 bp, P. troglodytes
tttttgacaaggtctc

SEQ ID NO: 294211 - DNA, 16 bp, P. troglodytes
tttttgacagagtctc

SEQ ID NO: 294212 - DNA, 16 bp, P. troglodytes
tttttgacattaaaag

SEQ ID NO: 294213 - DNA, 16 bp, P. troglodytes
tttttgacttaatgat

SEQ ID NO: 294214 - DNA, 16 bp, P. troglodytes
tttttgagaaaaaata

SEQ ID NO: 294215 - DNA, 16 bp, P. troglodytes
tttttgagaaacctct

SEQ ID NO: 294216 - DNA, 16 bp, P. troglodytes
tttttgagaaactgtt

SEQ ID NO: 294217 - DNA, 16 bp, P. troglodytes
tttttgagaaatatcc

SEQ ID NO: 294218 - DNA, 16 bp, P. troglodytes
tttttgagacacagtt

SEQ ID NO: 294219 - DNA, 16 bp, P. troglodytes
tttttgagacagactg

SEQ ID NO: 294220 - DNA, 17 bp, P. troglodytes
tttttgagacagattct

SEQ ID NO: 294221 - DNA, 21 bp, P. troglodytes
tttttgagacggagtctcgcc

SEQ ID NO: 294222 - DNA, 16 bp, P. troglodytes
tttttgagcacctact

SEQ ID NO: 294223 - DNA, 16 bp, P. troglodytes
tttttgaggaagcttc

SEQ ID NO: 294224 - DNA, 16 bp, P. troglodytes
tttttgaggagtcaaa

SEQ ID NO: 294225 - DNA, 16 bp, P. troglodytes
tttttgaggccaaggc

SEQ ID NO: 294226 - DNA, 16 bp, P. troglodytes
tttttgagggacctcc

SEQ ID NO: 294227 - DNA, 16 bp, P. troglodytes
tttttgatgaagttgt

SEQ ID NO: 294228 - DNA, 16 bp, P. troglodytes
tttttgatgatcttga

SEQ ID NO: 294229 - DNA, 16 bp, P. troglodytes
tttttgatgatgatga

SEQ ID NO: 294230 - DNA, 16 bp, P. troglodytes
tttttgatggctgcat

SEQ ID NO: 294231 - DNA, 21 bp, P. troglodytes
tttttgatgtgttgctggatt

SEQ ID NO: 294232 - DNA, 16 bp, P. troglodytes
tttttgattttacagg

SEQ ID NO: 294233 - DNA, 16 bp, P. troglodytes
tttttgcaaataaaat

SEQ ID NO: 294234 - DNA, 16 bp, P. troglodytes
tttttgcaactgtgaa

SEQ ID NO: 294235 - DNA, 16 bp, P. troglodytes
tttttgcaactttttg

SEQ ID NO: 294236 - DNA, 16 bp, P. troglodytes
tttttgcaagatgaaa

SEQ ID NO: 294237 - DNA, 16 bp, P. troglodytes
tttttgcaatctatcc

SEQ ID NO: 294238 - DNA, 16 bp, P. troglodytes
tttttgcaattataaa

SEQ ID NO: 294239 - DNA, 16 bp, P. troglodytes
tttttgcaatttaccc

SEQ ID NO: 294240 - DNA, 16 bp, P. troglodytes
tttttgcacattattt

SEQ ID NO: 294241 - DNA, 16 bp, P. troglodytes
tttttgcactggtttc

SEQ ID NO: 294242 - DNA, 16 bp, P. troglodytes
tttttgcagaaatggg

SEQ ID NO: 294243 - DNA, 16 bp, P. troglodytes
tttttgcagtcttttg

SEQ ID NO: 294244 - DNA, 16 bp, P. troglodytes
tttttgcatattttaa

SEQ ID NO: 294245 - DNA, 16 bp, P. troglodytes
tttttgcatcagtatt

SEQ ID NO: 294246 - DNA, 16 bp, P. troglodytes
tttttgcatgtatatt

SEQ ID NO: 294247 - DNA, 16 bp, P. troglodytes
tttttgccagtgtttt

SEQ ID NO: 294248 - DNA, 16 bp, P. troglodytes
tttttgccatgttgcc

SEQ ID NO: 294249 - DNA, 16 bp, P. troglodytes
tttttgccattaaaag

SEQ ID NO: 294250 - DNA, 16 bp, P. troglodytes
tttttgcccatgccta

SEQ ID NO: 294251 - DNA, 16 bp, P. troglodytes
tttttgccttaatttc

SEQ ID NO: 294252 - DNA, 16 bp, P. troglodytes
tttttgccttatatat

SEQ ID NO: 294253 - DNA, 16 bp, P. troglodytes
tttttgcctttttaaa

SEQ ID NO: 294254 - DNA, 16 bp, P. troglodytes
tttttgctattaaaaa

SEQ ID NO: 294255 - DNA, 16 bp, P. troglodytes
tttttgctgctgtaac

SEQ ID NO: 294256 - DNA, 16 bp, P. troglodytes
tttttgctggtggagg

SEQ ID NO: 294257 - DNA, 16 bp, P. troglodytes
tttttgctgtctccat

SEQ ID NO: 294258 - DNA, 16 bp, P. troglodytes
tttttgctgttgtaaa

SEQ ID NO: 294259 - DNA, 16 bp, P. troglodytes
tttttgcttagaatag

SEQ ID NO: 294260 - DNA, 16 bp, P. troglodytes
tttttgcttagtattg

SEQ ID NO: 294261 - DNA, 16 bp, P. troglodytes
tttttgctttaaaaat

SEQ ID NO: 294262 - DNA, 16 bp, P. troglodytes
tttttgcttttaaaaa

SEQ ID NO: 294263 - DNA, 16 bp, P. troglodytes
tttttgcttttatgaa

SEQ ID NO: 294264 - DNA, 16 bp, P. troglodytes
tttttggaaaaaaaat

SEQ ID NO: 294265 - DNA, 16 bp, P. troglodytes
tttttggaaaaataaa

SEQ ID NO: 294266 - DNA, 16 bp, P. troglodytes
tttttggaaaaatttg

SEQ ID NO: 294267 - DNA, 16 bp, P. troglodytes
tttttggaaaacaaaa

SEQ ID NO: 294268 - DNA, 16 bp, P. troglodytes
tttttggaaaagaaat

SEQ ID NO: 294269 - DNA, 16 bp, P. troglodytes
tttttggaagaaaata

SEQ ID NO: 294270 - DNA, 16 bp, P. troglodytes
tttttggagaaagaaa

SEQ ID NO: 294271 - DNA, 16 bp, P. troglodytes
tttttggagaaatgtc

SEQ ID NO: 294272 - DNA, 16 bp, P. troglodytes
tttttggagacacagt

SEQ ID NO: 294273 - DNA, 16 bp, P. troglodytes
tttttggaggtggagt

SEQ ID NO: 294274 - DNA, 16 bp, P. troglodytes
tttttggattagggat

SEQ ID NO: 294275 - DNA, 16 bp, P. troglodytes
tttttggcaagaatac

SEQ ID NO: 294276 - DNA, 16 bp, P. troglodytes
tttttggctgataatt

SEQ ID NO: 294277 - DNA, 16 bp, P. troglodytes
tttttggtcatgaaat

SEQ ID NO: 294278 - DNA, 16 bp, P. troglodytes
tttttggtgatggagt

SEQ ID NO: 294279 - DNA, 16 bp, P. troglodytes
tttttggtgctattat

SEQ ID NO: 294280 - DNA, 16 bp, P. troglodytes
tttttggttactgtag

SEQ ID NO: 294281 - DNA, 17 bp, P. troglodytes
tttttggttggtaggct

SEQ ID NO: 294282 - DNA, 16 bp, P. troglodytes
tttttgtaaaacagaa

SEQ ID NO: 294283 - DNA, 16 bp, P. troglodytes
tttttgtaaaagagaa

SEQ ID NO: 294284 - DNA, 16 bp, P. troglodytes
tttttgtaaatacagt

SEQ ID NO: 294285 - DNA, 16 bp, P. troglodytes
tttttgtaaatcattt

SEQ ID NO: 294286 - DNA, 16 bp, P. troglodytes
tttttgtaactggctt

SEQ ID NO: 294287 - DNA, 16 bp, P. troglodytes
tttttgtaagtcaaaa

SEQ ID NO: 294288 - DNA, 16 bp, P. troglodytes
tttttgtaattgcaaa

SEQ ID NO: 294289 - DNA, 16 bp, P. troglodytes
tttttgtaattgtgaa

SEQ ID NO: 294290 - DNA, 16 bp, P. troglodytes
tttttgtacaatgatt

SEQ ID NO: 294291 - DNA, 16 bp, P. troglodytes
tttttgtacagatggg

SEQ ID NO: 294292 - DNA, 16 bp, P. troglodytes
tttttgtacagctata

SEQ ID NO: 294293 - DNA, 16 bp, P. troglodytes
tttttgtactttaaaa

SEQ ID NO: 294294 - DNA, 16 bp, P. troglodytes
tttttgtagaaatggg

SEQ ID NO: 294295 - DNA, 16 bp, P. troglodytes
tttttgtagacagagt

SEQ ID NO: 294296 - DNA, 16 bp, P. troglodytes
tttttgtagacatggg

SEQ ID NO: 294297 - DNA, 16 bp, P. troglodytes
tttttgtagagaccag

SEQ ID NO: 294298 - DNA, 16 bp, P. troglodytes
tttttgtagagacggg

SEQ ID NO: 294299 - DNA, 16 bp, P. troglodytes
tttttgtagagacgtg

SEQ ID NO: 294300 - DNA, 16 bp, P. troglodytes
tttttgtagagagggt

SEQ ID NO: 294301 - DNA, 16 bp, P. troglodytes
tttttgtagagataga

SEQ ID NO: 294302 - DNA, 16 bp, P. troglodytes
tttttgtagagatagg

SEQ ID NO: 294303 - DNA, 16 bp, P. troglodytes
tttttgtagagatgag

SEQ ID NO: 294304 - DNA, 16 bp, P. troglodytes
tttttgtagagatgga

SEQ ID NO: 294305 - DNA, 16 bp, P. troglodytes
tttttgtagagatggg

SEQ ID NO: 294306 - DNA, 16 bp, P. troglodytes
tttttgtagagattgg

SEQ ID NO: 294307 - DNA, 16 bp, P. troglodytes
tttttgtagaggcaaa

SEQ ID NO: 294308 - DNA, 16 bp, P. troglodytes
tttttgtagatgttct

SEQ ID NO: 294309 - DNA, 16 bp, P. troglodytes
tttttgtagctgttgt

SEQ ID NO: 294310 - DNA, 16 bp, P. troglodytes
tttttgtaggtcaaaa

SEQ ID NO: 294311 - DNA, 16 bp, P. troglodytes
tttttgtatcaatgtt

SEQ ID NO: 294312 - DNA, 16 bp, P. troglodytes
tttttgtatttcaata

SEQ ID NO: 294313 - DNA, 16 bp, P. troglodytes
tttttgtatttccata

SEQ ID NO: 294314 - DNA, 16 bp, P. troglodytes
tttttgtcaattaaaa

SEQ ID NO: 294315 - DNA, 16 bp, P. troglodytes
tttttgtcagccttgt

SEQ ID NO: 294316 - DNA, 16 bp, P. troglodytes
tttttgtcatctctga

SEQ ID NO: 294317 - DNA, 16 bp, P. troglodytes
tttttgtcattaaaat

SEQ ID NO: 294318 - DNA, 16 bp, P. troglodytes
tttttgtcatttaaaa

SEQ ID NO: 294319 - DNA, 16 bp, P. troglodytes
tttttgtgccagtacc

SEQ ID NO: 294320 - DNA, 16 bp, P. troglodytes
tttttgtggagatgag

SEQ ID NO: 294321 - DNA, 16 bp, P. troglodytes
tttttgtggagatggg

SEQ ID NO: 294322 - DNA, 16 bp, P. troglodytes
tttttgtgggaaaaaa

SEQ ID NO: 294323 - DNA, 16 bp, P. troglodytes
tttttgtgggtacata

SEQ ID NO: 294324 - DNA, 16 bp, P. troglodytes
tttttgtgtagacata

SEQ ID NO: 294325 - DNA, 16 bp, P. troglodytes
tttttgtgtcatctat

SEQ ID NO: 294326 - DNA, 16 bp, P. troglodytes
tttttgtgtgaatgta

SEQ ID NO: 294327 - DNA, 16 bp, P. troglodytes
tttttgtgtgtgcata

SEQ ID NO: 294328 - DNA, 16 bp, P. troglodytes
tttttgttaaaaagta

SEQ ID NO: 294329 - DNA, 16 bp, P. troglodytes
tttttgttaaagagca

SEQ ID NO: 294330 - DNA, 16 bp, P. troglodytes
tttttgttctaaaaat

SEQ ID NO: 294331 - DNA, 16 bp, P. troglodytes
tttttgttgaaaaatg

SEQ ID NO: 294332 - DNA, 16 bp, P. troglodytes
tttttgttgaaagctg

SEQ ID NO: 294333 - DNA, 16 bp, P. troglodytes
tttttgttggtaactt

SEQ ID NO: 294334 - DNA, 16 bp, P. troglodytes
tttttgtttcaaaata

SEQ ID NO: 294335 - DNA, 16 bp, P. troglodytes
tttttgttttaaacag

SEQ ID NO: 294336 - DNA, 16 bp, P. troglodytes
tttttgttttaatcca

SEQ ID NO: 294337 - DNA, 16 bp, P. troglodytes
tttttgttttcagaga

SEQ ID NO: 294338 - DNA, 16 bp, P. troglodytes
tttttgttttggaaaa

SEQ ID NO: 294339 - DNA, 16 bp, P. troglodytes
tttttgtttttcaaga

SEQ ID NO: 294340 - DNA, 16 bp, P. troglodytes
ttttttaaaaaaactc

SEQ ID NO: 294341 - DNA, 16 bp, P. troglodytes
ttttttaaaaaaagag

SEQ ID NO: 294342 - DNA, 16 bp, P. troglodytes
ttttttaaaaaaatgc

SEQ ID NO: 294343 - DNA, 16 bp, P. troglodytes
ttttttaaaaaacaca

SEQ ID NO: 294344 - DNA, 16 bp, P. troglodytes
ttttttaaaaaaccaa

SEQ ID NO: 294345 - DNA, 16 bp, P. troglodytes
ttttttaaaaaagaag

SEQ ID NO: 294346 - DNA, 16 bp, P. troglodytes
ttttttaaaaaagact

SEQ ID NO: 294347 - DNA, 16 bp, P. troglodytes
ttttttaaaaaaggaa

SEQ ID NO: 294348 - DNA, 16 bp, P. troglodytes
ttttttaaaaaaggtt

SEQ ID NO: 294349 - DNA, 16 bp, P. troglodytes
ttttttaaaaaagtga

SEQ ID NO: 294350 - DNA, 16 bp, P. troglodytes
ttttttaaaaaatctg

SEQ ID NO: 294351 - DNA, 16 bp, P. troglodytes
ttttttaaaaacaaca

SEQ ID NO: 294352 - DNA, 16 bp, P. troglodytes
ttttttaaaaacaact

SEQ ID NO: 294353 - DNA, 16 bp, P. troglodytes
ttttttaaaaacacaa

SEQ ID NO: 294354 - DNA, 16 bp, P. troglodytes
ttttttaaaaaccaag

SEQ ID NO: 294355 - DNA, 16 bp, P. troglodytes
ttttttaaaaacctaa

SEQ ID NO: 294356 - DNA, 16 bp, P. troglodytes
ttttttaaaaactact

SEQ ID NO: 294357 - DNA, 16 bp, P. troglodytes
ttttttaaaaagcaac

SEQ ID NO: 294358 - DNA, 16 bp, P. troglodytes
ttttttaaaaagcaat

SEQ ID NO: 294359 - DNA, 16 bp, P. troglodytes
ttttttaaaaagctgt

SEQ ID NO: 294360 - DNA, 16 bp, P. troglodytes
ttttttaaaaaggaaa

SEQ ID NO: 294361 - DNA, 16 bp, P. troglodytes
ttttttaaaaagtgaa

SEQ ID NO: 294362 - DNA, 16 bp, P. troglodytes
ttttttaaaaatcagt

SEQ ID NO: 294363 - DNA, 16 bp, P. troglodytes
ttttttaaaacaaaca

SEQ ID NO: 294364 - DNA, 16 bp, P. troglodytes
ttttttaaaacacaaa

SEQ ID NO: 294365 - DNA, 16 bp, P. troglodytes
ttttttaaaacacagt

SEQ ID NO: 294366 - DNA, 16 bp, P. troglodytes
ttttttaaaacagctt

SEQ ID NO: 294367 - DNA, 16 bp, P. troglodytes
ttttttaaaacccaaa

SEQ ID NO: 294368 - DNA, 16 bp, P. troglodytes
ttttttaaaactctct

SEQ ID NO: 294369 - DNA, 16 bp, P. troglodytes
ttttttaaaacttcaa

SEQ ID NO: 294370 - DNA, 16 bp, P. troglodytes
ttttttaaaagaatga

SEQ ID NO: 294371 - DNA, 16 bp, P. troglodytes
ttttttaaaagacaag

SEQ ID NO: 294372 - DNA, 16 bp, P. troglodytes
ttttttaaaagacttt

SEQ ID NO: 294373 - DNA, 16 bp, P. troglodytes
ttttttaaaagagaca

SEQ ID NO: 294374 - DNA, 16 bp, P. troglodytes
ttttttaaaagagaga

SEQ ID NO: 294375 - DNA, 16 bp, P. troglodytes
ttttttaaaagagatt

SEQ ID NO: 294376 - DNA, 16 bp, P. troglodytes
ttttttaaaagcaaaa

SEQ ID NO: 294377 - DNA, 16 bp, P. troglodytes
ttttttaaaagcttct

SEQ ID NO: 294378 - DNA, 16 bp, P. troglodytes
ttttttaaaaggaaaa

SEQ ID NO: 294379 - DNA, 16 bp, P. troglodytes
ttttttaaaaggacat

SEQ ID NO: 294380 - DNA, 16 bp, P. troglodytes
ttttttaaaaggcaga

SEQ ID NO: 294381 - DNA, 16 bp, P. troglodytes
ttttttaaaagtccag

SEQ ID NO: 294382 - DNA, 16 bp, P. troglodytes
ttttttaaaagttaag

SEQ ID NO: 294383 - DNA, 16 bp, P. troglodytes
ttttttaaaatcacat

SEQ ID NO: 294384 - DNA, 16 bp, P. troglodytes
ttttttaaaatccaaa

SEQ ID NO: 294385 - DNA, 16 bp, P. troglodytes
ttttttaaaatgaagt

SEQ ID NO: 294386 - DNA, 16 bp, P. troglodytes
ttttttaaaatggaag

SEQ ID NO: 294387 - DNA, 16 bp, P. troglodytes
ttttttaaaattccag

SEQ ID NO: 294388 - DNA, 16 bp, P. troglodytes
ttttttaaaattctga

SEQ ID NO: 294389 - DNA, 16 bp, P. troglodytes
ttttttaaacaaaaag

SEQ ID NO: 294390 - DNA, 16 bp, P. troglodytes
ttttttaaacaaacag

SEQ ID NO: 294391 - DNA, 16 bp, P. troglodytes
ttttttaaacaaatga

SEQ ID NO: 294392 - DNA, 16 bp, P. troglodytes
ttttttaaacaaatgg

SEQ ID NO: 294393 - DNA, 16 bp, P. troglodytes
ttttttaaaccagttt

SEQ ID NO: 294394 - DNA, 16 bp, P. troglodytes
ttttttaaagaaactg

SEQ ID NO: 294395 - DNA, 16 bp, P. troglodytes
ttttttaaagaaatca

SEQ ID NO: 294396 - DNA, 16 bp, P. troglodytes
ttttttaaagaacaaa

SEQ ID NO: 294397 - DNA, 16 bp, P. troglodytes
ttttttaaagaagata

SEQ ID NO: 294398 - DNA, 16 bp, P. troglodytes
ttttttaaagaatctt

SEQ ID NO: 294399 - DNA, 16 bp, P. troglodytes
ttttttaaagacacat

SEQ ID NO: 294400 - DNA, 16 bp, P. troglodytes
ttttttaaagagacag

SEQ ID NO: 294401 - DNA, 16 bp, P. troglodytes
ttttttaaagagacgg

SEQ ID NO: 294402 - DNA, 16 bp, P. troglodytes
ttttttaaagatggaa

SEQ ID NO: 294403 - DNA, 16 bp, P. troglodytes
ttttttaaagcagttt

SEQ ID NO: 294404 - DNA, 16 bp, P. troglodytes
ttttttaaagcattga

SEQ ID NO: 294405 - DNA, 16 bp, P. troglodytes
ttttttaaagctttta

SEQ ID NO: 294406 - DNA, 16 bp, P. troglodytes
ttttttaaaggaaagt

SEQ ID NO: 294407 - DNA, 16 bp, P. troglodytes
ttttttaaaggacttt

SEQ ID NO: 294408 - DNA, 16 bp, P. troglodytes
ttttttaaaggagaaa

SEQ ID NO: 294409 - DNA, 16 bp, P. troglodytes
ttttttaaaggatgaa

SEQ ID NO: 294410 - DNA, 16 bp, P. troglodytes
ttttttaaaggcagag

SEQ ID NO: 294411 - DNA, 16 bp, P. troglodytes
ttttttaaagtaaagg

SEQ ID NO: 294412 - DNA, 16 bp, P. troglodytes
ttttttaaagtaactt

SEQ ID NO: 294413 - DNA, 16 bp, P. troglodytes
ttttttaaagtaatag

SEQ ID NO: 294414 - DNA, 16 bp, P. troglodytes
ttttttaaagtgtgtg

SEQ ID NO: 294415 - DNA, 16 bp, P. troglodytes
ttttttaaagttgaga

SEQ ID NO: 294416 - DNA, 16 bp, P. troglodytes
ttttttaaatatggaa

SEQ ID NO: 294417 - DNA, 16 bp, P. troglodytes
ttttttaaatcacaga

SEQ ID NO: 294418 - DNA, 16 bp, P. troglodytes
ttttttaaatcagttt

SEQ ID NO: 294419 - DNA, 16 bp, P. troglodytes
ttttttaaatcatgtt

SEQ ID NO: 294420 - DNA, 16 bp, P. troglodytes
ttttttaaatcattga

SEQ ID NO: 294421 - DNA, 16 bp, P. troglodytes
ttttttaaatcttgaa

SEQ ID NO: 294422 - DNA, 16 bp, P. troglodytes
ttttttaaatgaaaca

SEQ ID NO: 294423 - DNA, 16 bp, P. troglodytes
ttttttaaatgaacat

SEQ ID NO: 294424 - DNA, 16 bp, P. troglodytes
ttttttaaatgaagta

SEQ ID NO: 294425 - DNA, 16 bp, P. troglodytes
ttttttaaatgacctt

SEQ ID NO: 294426 - DNA, 16 bp, P. troglodytes
ttttttaaatgagcaa

SEQ ID NO: 294427 - DNA, 16 bp, P. troglodytes
ttttttaaatgcagat

SEQ ID NO: 294428 - DNA, 16 bp, P. troglodytes
ttttttaaatgctcaa

SEQ ID NO: 294429 - DNA, 16 bp, P. troglodytes
ttttttaaatggacaa

SEQ ID NO: 294430 - DNA, 16 bp, P. troglodytes
ttttttaaatggagtt

SEQ ID NO: 294431 - DNA, 16 bp, P. troglodytes
ttttttaaatgtacaa

SEQ ID NO: 294432 - DNA, 16 bp, P. troglodytes
ttttttaaatgtttca

SEQ ID NO: 294433 - DNA, 16 bp, P. troglodytes
ttttttaaattaagga

SEQ ID NO: 294434 - DNA, 16 bp, P. troglodytes
ttttttaaatttctga

SEQ ID NO: 294435 - DNA, 16 bp, P. troglodytes
ttttttaacaaagaaa

SEQ ID NO: 294436 - DNA, 16 bp, P. troglodytes
ttttttaacaagtaaa

SEQ ID NO: 294437 - DNA, 16 bp, P. troglodytes
ttttttaacagggtct

SEQ ID NO: 294438 - DNA, 16 bp, P. troglodytes
ttttttaactgaaaat

SEQ ID NO: 294439 - DNA, 16 bp, P. troglodytes
ttttttaactggaaaa

SEQ ID NO: 294440 - DNA, 16 bp, P. troglodytes
ttttttaactttagaa

SEQ ID NO: 294441 - DNA, 16 bp, P. troglodytes
ttttttaactttctga

SEQ ID NO: 294442 - DNA, 16 bp, P. troglodytes
ttttttaactttgtaa

SEQ ID NO: 294443 - DNA, 16 bp, P. troglodytes
ttttttaagaaaaact

SEQ ID NO: 294444 - DNA, 16 bp, P. troglodytes
ttttttaagaaaaagg

SEQ ID NO: 294445 - DNA, 16 bp, P. troglodytes
ttttttaagaaagagt

SEQ ID NO: 294446 - DNA, 16 bp, P. troglodytes
ttttttaagacgaagt

SEQ ID NO: 294447 - DNA, 16 bp, P. troglodytes
ttttttaagagacaaa

SEQ ID NO: 294448 - DNA, 16 bp, P. troglodytes
ttttttaagagacaag

SEQ ID NO: 294449 - DNA, 16 bp, P. troglodytes
ttttttaagaggaaaa

SEQ ID NO: 294450 - DNA, 16 bp, P. troglodytes
ttttttaagccattaa

SEQ ID NO: 294451 - DNA, 16 bp, P. troglodytes
ttttttaaggaaatat

SEQ ID NO: 294452 - DNA, 16 bp, P. troglodytes
ttttttaagtaacttt

SEQ ID NO: 294453 - DNA, 16 bp, P. troglodytes
ttttttaagtagaaat

SEQ ID NO: 294454 - DNA, 16 bp, P. troglodytes
ttttttaagtataaag

SEQ ID NO: 294455 - DNA, 16 bp, P. troglodytes
ttttttaagtgaaaat

SEQ ID NO: 294456 - DNA, 16 bp, P. troglodytes
ttttttaagtgataaa

SEQ ID NO: 294457 - DNA, 16 bp, P. troglodytes
ttttttaagttaagaa

SEQ ID NO: 294458 - DNA, 16 bp, P. troglodytes
ttttttaataaaagga

SEQ ID NO: 294459 - DNA, 16 bp, P. troglodytes
ttttttaataagatga

SEQ ID NO: 294460 - DNA, 16 bp, P. troglodytes
ttttttaatacatgaa

SEQ ID NO: 294461 - DNA, 16 bp, P. troglodytes
ttttttaatagaaaac

SEQ ID NO: 294462 - DNA, 16 bp, P. troglodytes
ttttttaatagagaca

SEQ ID NO: 294463 - DNA, 16 bp, P. troglodytes
ttttttaatcctaaaa

SEQ ID NO: 294464 - DNA, 16 bp, P. troglodytes
ttttttaatgaaaatg

SEQ ID NO: 294465 - DNA, 16 bp, P. troglodytes
ttttttaatgaaagga

SEQ ID NO: 294466 - DNA, 16 bp, P. troglodytes
ttttttaatgaaatga

SEQ ID NO: 294467 - DNA, 16 bp, P. troglodytes
ttttttaatgaagaga

SEQ ID NO: 294468 - DNA, 16 bp, P. troglodytes
ttttttaatgagcaaa

SEQ ID NO: 294469 - DNA, 16 bp, P. troglodytes
ttttttaatgtaggca

SEQ ID NO: 294470 - DNA, 16 bp, P. troglodytes
ttttttaatgtgtcta

SEQ ID NO: 294471 - DNA, 16 bp, P. troglodytes
ttttttaattggggca

SEQ ID NO: 294472 - DNA, 16 bp, P. troglodytes
ttttttacaaactgaa

SEQ ID NO: 294473 - DNA, 16 bp, P. troglodytes
ttttttacattttaga

SEQ ID NO: 294474 - DNA, 16 bp, P. troglodytes
ttttttagaaaaatga

SEQ ID NO: 294475 - DNA, 16 bp, P. troglodytes
ttttttagacagtttt

SEQ ID NO: 294476 - DNA, 16 bp, P. troglodytes
ttttttagatgaagaa

SEQ ID NO: 294477 - DNA, 16 bp, P. troglodytes
ttttttaggctgaata

SEQ ID NO: 294478 - DNA, 16 bp, P. troglodytes
ttttttaggggaaaaa

SEQ ID NO: 294479 - DNA, 16 bp, P. troglodytes
ttttttagtagagaca

SEQ ID NO: 294480 - DNA, 21 bp, P. troglodytes
ttttttagtagagacagggtc

SEQ ID NO: 294481 - DNA, 23 bp, P. troglodytes
ttttttagtagagacagggtttt

SEQ ID NO: 294482 - DNA, 16 bp, P. troglodytes
ttttttataagtagaa

SEQ ID NO: 294483 - DNA, 16 bp, P. troglodytes
ttttttatagaaacag

SEQ ID NO: 294484 - DNA, 16 bp, P. troglodytes
ttttttatggagatgg

SEQ ID NO: 294485 - DNA, 16 bp, P. troglodytes
ttttttatggctacat

SEQ ID NO: 294486 - DNA, 16 bp, P. troglodytes
ttttttatgtagaaaa

SEQ ID NO: 294487 - DNA, 16 bp, P. troglodytes
ttttttattacagaaa

SEQ ID NO: 294488 - DNA, 16 bp, P. troglodytes
ttttttattatggcca

SEQ ID NO: 294489 - DNA, 16 bp, P. troglodytes
ttttttattcaacaaa

SEQ ID NO: 294490 - DNA, 16 bp, P. troglodytes
ttttttattgcgtctg

SEQ ID NO: 294491 - DNA, 16 bp, P. troglodytes
ttttttattgctgcat

SEQ ID NO: 294492 - DNA, 16 bp, P. troglodytes
ttttttcaaaaaacca

SEQ ID NO: 294493 - DNA, 16 bp, P. troglodytes
ttttttcaaaaacaca

SEQ ID NO: 294494 - DNA, 16 bp, P. troglodytes
ttttttcaaaagattt

SEQ ID NO: 294495 - DNA, 16 bp, P. troglodytes
ttttttcaaacaaaat

SEQ ID NO: 294496 - DNA, 16 bp, P. troglodytes
ttttttcaaagaaaat

SEQ ID NO: 294497 - DNA, 16 bp, P. troglodytes
ttttttcaaagcattt

SEQ ID NO: 294498 - DNA, 16 bp, P. troglodytes
ttttttcaaagtaaat

SEQ ID NO: 294499 - DNA, 16 bp, P. troglodytes
ttttttcaaatacata

SEQ ID NO: 294500 - DNA, 16 bp, P. troglodytes
ttttttcaaatatttg

SEQ ID NO: 294501 - DNA, 16 bp, P. troglodytes
ttttttcacaaaatat

SEQ ID NO: 294502 - DNA, 16 bp, P. troglodytes
ttttttcacatagtcc

SEQ ID NO: 294503 - DNA, 16 bp, P. troglodytes
ttttttcacttaaaaa

SEQ ID NO: 294504 - DNA, 16 bp, P. troglodytes
ttttttcagaaaacca

SEQ ID NO: 294505 - DNA, 16 bp, P. troglodytes
ttttttcagaaattga

SEQ ID NO: 294506 - DNA, 16 bp, P. troglodytes
ttttttcagaatattt

SEQ ID NO: 294507 - DNA, 16 bp, P. troglodytes
ttttttcagagatgga

SEQ ID NO: 294508 - DNA, 16 bp, P. troglodytes
ttttttcagagatggg

SEQ ID NO: 294509 - DNA, 16 bp, P. troglodytes
ttttttcagataattt

SEQ ID NO: 294510 - DNA, 16 bp, P. troglodytes
ttttttcagatgaaaa

SEQ ID NO: 294511 - DNA, 16 bp, P. troglodytes
ttttttcagttaaatt

SEQ ID NO: 294512 - DNA, 16 bp, P. troglodytes
ttttttcagttataaa

SEQ ID NO: 294513 - DNA, 16 bp, P. troglodytes
ttttttcatagaaaca

SEQ ID NO: 294514 - DNA, 16 bp, P. troglodytes
ttttttcatctgtaat

SEQ ID NO: 294515 - DNA, 16 bp, P. troglodytes
ttttttcatctgttaa

SEQ ID NO: 294516 - DNA, 16 bp, P. troglodytes
ttttttcattatgaaa

SEQ ID NO: 294517 - DNA, 16 bp, P. troglodytes
ttttttcattcagcat

SEQ ID NO: 294518 - DNA, 16 bp, P. troglodytes
ttttttcatttgagac

SEQ ID NO: 294519 - DNA, 16 bp, P. troglodytes
ttttttccagagatgg

SEQ ID NO: 294520 - DNA, 16 bp, P. troglodytes
ttttttccaggaaaaa

SEQ ID NO: 294521 - DNA, 16 bp, P. troglodytes
ttttttccatgctgtt

SEQ ID NO: 294522 - DNA, 16 bp, P. troglodytes
ttttttcccagacaga

SEQ ID NO: 294523 - DNA, 16 bp, P. troglodytes
ttttttcccattaaat

SEQ ID NO: 294524 - DNA, 16 bp, P. troglodytes
ttttttccccaaacac

SEQ ID NO: 294525 - DNA, 16 bp, P. troglodytes
ttttttccccaaagga

SEQ ID NO: 294526 - DNA, 16 bp, P. troglodytes
ttttttccccaagaca

SEQ ID NO: 294527 - DNA, 16 bp, P. troglodytes
ttttttccccacaaat

SEQ ID NO: 294528 - DNA, 16 bp, P. troglodytes
ttttttccccaggaaa

SEQ ID NO: 294529 - DNA, 16 bp, P. troglodytes
ttttttcccccaaaaa

SEQ ID NO: 294530 - DNA, 16 bp, P. troglodytes
ttttttcccccaaaac

SEQ ID NO: 294531 - DNA, 16 bp, P. troglodytes
ttttttcccccaaaat

SEQ ID NO: 294532 - DNA, 16 bp, P. troglodytes
ttttttcccccaaata

SEQ ID NO: 294533 - DNA, 16 bp, P. troglodytes
ttttttcccccaagaa

SEQ ID NO: 294534 - DNA, 16 bp, P. troglodytes
ttttttcccccaagag

SEQ ID NO: 294535 - DNA, 16 bp, P. troglodytes
ttttttcccccaagtt

SEQ ID NO: 294536 - DNA, 16 bp, P. troglodytes
ttttttcccccacaaa

SEQ ID NO: 294537 - DNA, 16 bp, P. troglodytes
ttttttcccccacatt

SEQ ID NO: 294538 - DNA, 16 bp, P. troglodytes
ttttttccccccaaaa

SEQ ID NO: 294539 - DNA, 16 bp, P. troglodytes
ttttttccccccaatt

SEQ ID NO: 294540 - DNA, 16 bp, P. troglodytes
ttttttccccctaaaa

SEQ ID NO: 294541 - DNA, 16 bp, P. troglodytes
ttttttccccctctaa

SEQ ID NO: 294542 - DNA, 16 bp, P. troglodytes
ttttttcccccttcaa

SEQ ID NO: 294543 - DNA, 16 bp, P. troglodytes
ttttttcccctgattt

SEQ ID NO: 294544 - DNA, 16 bp, P. troglodytes
ttttttcccctttaaa

SEQ ID NO: 294545 - DNA, 16 bp, P. troglodytes
ttttttccctaaatat

SEQ ID NO: 294546 - DNA, 16 bp, P. troglodytes
ttttttccctaagaaa

SEQ ID NO: 294547 - DNA, 16 bp, P. troglodytes
ttttttccctcagttt

SEQ ID NO: 294548 - DNA, 16 bp, P. troglodytes
ttttttccctgaattt

SEQ ID NO: 294549 - DNA, 16 bp, P. troglodytes
ttttttcccttaaata

SEQ ID NO: 294550 - DNA, 16 bp, P. troglodytes
ttttttccctttaaaa

SEQ ID NO: 294551 - DNA, 16 bp, P. troglodytes
ttttttcctaaataaa

SEQ ID NO: 294552 - DNA, 16 bp, P. troglodytes
ttttttcctaagagtt

SEQ ID NO: 294553 - DNA, 16 bp, P. troglodytes
ttttttcctaaggaaa

SEQ ID NO: 294554 - DNA, 16 bp, P. troglodytes
ttttttcctatgcata

SEQ ID NO: 294555 - DNA, 16 bp, P. troglodytes
ttttttcctcccaaaa

SEQ ID NO: 294556 - DNA, 16 bp, P. troglodytes
ttttttcctcctctga

SEQ ID NO: 294557 - DNA, 16 bp, P. troglodytes
ttttttcctctgaatt

SEQ ID NO: 294558 - DNA, 16 bp, P. troglodytes
ttttttcctgaaaatt

SEQ ID NO: 294559 - DNA, 16 bp, P. troglodytes
ttttttcctgagacaa

SEQ ID NO: 294560 - DNA, 16 bp, P. troglodytes
ttttttcctgtaaaat

SEQ ID NO: 294561 - DNA, 16 bp, P. troglodytes
ttttttcctgtgaatt

SEQ ID NO: 294562 - DNA, 16 bp, P. troglodytes
ttttttccttaaaaaa

SEQ ID NO: 294563 - DNA, 16 bp, P. troglodytes
ttttttccttaaaaag

SEQ ID NO: 294564 - DNA, 16 bp, P. troglodytes
ttttttccttgaagaa

SEQ ID NO: 294565 - DNA, 16 bp, P. troglodytes
ttttttccttgcaaat

SEQ ID NO: 294566 - DNA, 16 bp, P. troglodytes
ttttttcctttgaatg

SEQ ID NO: 294567 - DNA, 16 bp, P. troglodytes
ttttttccttttaaga

SEQ ID NO: 294568 - DNA, 16 bp, P. troglodytes
ttttttcgtagagatg

SEQ ID NO: 294569 - DNA, 16 bp, P. troglodytes
ttttttctaaatttga

SEQ ID NO: 294570 - DNA, 16 bp, P. troglodytes
ttttttctagaaacag

SEQ ID NO: 294571 - DNA, 16 bp, P. troglodytes
ttttttctagagacaa

SEQ ID NO: 294572 - DNA, 16 bp, P. troglodytes
ttttttctaggaattt

SEQ ID NO: 294573 - DNA, 16 bp, P. troglodytes
ttttttctattgaaaa

SEQ ID NO: 294574 - DNA, 16 bp, P. troglodytes
ttttttctatttaaag

SEQ ID NO: 294575 - DNA, 16 bp, P. troglodytes
ttttttctcaaagttt

SEQ ID NO: 294576 - DNA, 16 bp, P. troglodytes
ttttttctcaataaaa

SEQ ID NO: 294577 - DNA, 16 bp, P. troglodytes
ttttttctcagtcaac

SEQ ID NO: 294578 - DNA, 16 bp, P. troglodytes
ttttttctccaaatga

SEQ ID NO: 294579 - DNA, 16 bp, P. troglodytes
ttttttctcccagaaa

SEQ ID NO: 294580 - DNA, 16 bp, P. troglodytes
ttttttctctgaaaat

SEQ ID NO: 294581 - DNA, 16 bp, P. troglodytes
ttttttctgaaaaaaa

SEQ ID NO: 294582 - DNA, 16 bp, P. troglodytes
ttttttctgaaagaaa

SEQ ID NO: 294583 - DNA, 16 bp, P. troglodytes
ttttttctgagaaaaa

SEQ ID NO: 294584 - DNA, 16 bp, P. troglodytes
ttttttctgggaaaaa

SEQ ID NO: 294585 - DNA, 16 bp, P. troglodytes
ttttttctgtaaactt

SEQ ID NO: 294586 - DNA, 16 bp, P. troglodytes
ttttttctgtgtagat

SEQ ID NO: 294587 - DNA, 16 bp, P. troglodytes
ttttttcttaaaaaga

SEQ ID NO: 294588 - DNA, 16 bp, P. troglodytes
ttttttcttaaataga

SEQ ID NO: 294589 - DNA, 16 bp, P. troglodytes
ttttttcttaagaaat

SEQ ID NO: 294590 - DNA, 16 bp, P. troglodytes
ttttttcttaatggaa

SEQ ID NO: 294591 - DNA, 16 bp, P. troglodytes
ttttttcttacaaaaa

SEQ ID NO: 294592 - DNA, 16 bp, P. troglodytes
ttttttcttagaaaaa

SEQ ID NO: 294593 - DNA, 16 bp, P. troglodytes
ttttttcttagaaatt

SEQ ID NO: 294594 - DNA, 16 bp, P. troglodytes
ttttttcttatgaaaa

SEQ ID NO: 294595 - DNA, 16 bp, P. troglodytes
ttttttcttcaaagaa

SEQ ID NO: 294596 - DNA, 16 bp, P. troglodytes
ttttttcttccagaga

SEQ ID NO: 294597 - DNA, 16 bp, P. troglodytes
ttttttcttctaaaag

SEQ ID NO: 294598 - DNA, 16 bp, P. troglodytes
ttttttcttgagatga

SEQ ID NO: 294599 - DNA, 16 bp, P. troglodytes
ttttttctttaaagct

SEQ ID NO: 294600 - DNA, 16 bp, P. troglodytes
ttttttctttaagata

SEQ ID NO: 294601 - DNA, 16 bp, P. troglodytes
ttttttctttagaaaa

SEQ ID NO: 294602 - DNA, 16 bp, P. troglodytes
ttttttctttagaaac

SEQ ID NO: 294603 - DNA, 16 bp, P. troglodytes
ttttttctttagaaat

SEQ ID NO: 294604 - DNA, 16 bp, P. troglodytes
ttttttctttcagaga

SEQ ID NO: 294605 - DNA, 16 bp, P. troglodytes
ttttttctttgaaaaa

SEQ ID NO: 294606 - DNA, 16 bp, P. troglodytes
ttttttctttgactca

SEQ ID NO: 294607 - DNA, 16 bp, P. troglodytes
ttttttcttttagaga

SEQ ID NO: 294608 - DNA, 16 bp, P. troglodytes
ttttttcttttggaaa

SEQ ID NO: 294609 - DNA, 16 bp, P. troglodytes
ttttttgaaaagcaaa

SEQ ID NO: 294610 - DNA, 16 bp, P. troglodytes
ttttttgaaacaaagt

SEQ ID NO: 294611 - DNA, 16 bp, P. troglodytes
ttttttgaaacaggtt

SEQ ID NO: 294612 - DNA, 16 bp, P. troglodytes
ttttttgaaataaatg

SEQ ID NO: 294613 - DNA, 16 bp, P. troglodytes
ttttttgaagaaaata

SEQ ID NO: 294614 - DNA, 16 bp, P. troglodytes
ttttttgaagaaataa

SEQ ID NO: 294615 - DNA, 16 bp, P. troglodytes
ttttttgaagaaatta

SEQ ID NO: 294616 - DNA, 16 bp, P. troglodytes
ttttttgaagagatgg

SEQ ID NO: 294617 - DNA, 16 bp, P. troglodytes
ttttttgaagagtttg

SEQ ID NO: 294618 - DNA, 16 bp, P. troglodytes
ttttttgaaggaaaaa

SEQ ID NO: 294619 - DNA, 16 bp, P. troglodytes
ttttttgaatgaaaaa

SEQ ID NO: 294620 - DNA, 16 bp, P. troglodytes
ttttttgacatggagt

SEQ ID NO: 294621 - DNA, 16 bp, P. troglodytes
ttttttgagaaaaatg

SEQ ID NO: 294622 - DNA, 16 bp, P. troglodytes
ttttttgagacagaga

SEQ ID NO: 294623 - DNA, 16 bp, P. troglodytes
ttttttgagacagttt

SEQ ID NO: 294624 - DNA, 16 bp, P. troglodytes
ttttttgagacggaat

SEQ ID NO: 294625 - DNA, 16 bp, P. troglodytes
ttttttgagacggagt

SEQ ID NO: 294626 - DNA, 18 bp, P. troglodytes
ttttttgagactgagttt

SEQ ID NO: 294627 - DNA, 16 bp, P. troglodytes
ttttttgagagacaga

SEQ ID NO: 294628 - DNA, 16 bp, P. troglodytes
ttttttgagatggagc

SEQ ID NO: 294629 - DNA, 16 bp, P. troglodytes
ttttttgagatggagg

SEQ ID NO: 294630 - DNA, 16 bp, P. troglodytes
ttttttgagatggagt

SEQ ID NO: 294631 - DNA, 16 bp, P. troglodytes
ttttttgaggaatcac

SEQ ID NO: 294632 - DNA, 16 bp, P. troglodytes
ttttttgaggtggagt

SEQ ID NO: 294633 - DNA, 16 bp, P. troglodytes
ttttttgatgtgggca

SEQ ID NO: 294634 - DNA, 16 bp, P. troglodytes
ttttttgcagatgaca

SEQ ID NO: 294635 - DNA, 16 bp, P. troglodytes
ttttttgcatatggat

SEQ ID NO: 294636 - DNA, 16 bp, P. troglodytes
ttttttgccttcttaa

SEQ ID NO: 294637 - DNA, 16 bp, P. troglodytes
ttttttgctgctataa

SEQ ID NO: 294638 - DNA, 16 bp, P. troglodytes
ttttttgctttaaaat

SEQ ID NO: 294639 - DNA, 16 bp, P. troglodytes
ttttttggaaaaaaga

SEQ ID NO: 294640 - DNA, 16 bp, P. troglodytes
ttttttggaaaaagaa

SEQ ID NO: 294641 - DNA, 16 bp, P. troglodytes
ttttttggaaaagttt

SEQ ID NO: 294642 - DNA, 16 bp, P. troglodytes
ttttttggaatcattt

SEQ ID NO: 294643 - DNA, 16 bp, P. troglodytes
ttttttggagaaacag

SEQ ID NO: 294644 - DNA, 16 bp, P. troglodytes
ttttttggagacaaaa

SEQ ID NO: 294645 - DNA, 16 bp, P. troglodytes
ttttttgggacaaggt

SEQ ID NO: 294646 - DNA, 16 bp, P. troglodytes
ttttttgggacggagt

SEQ ID NO: 294647 - DNA, 16 bp, P. troglodytes
ttttttggggggcagg

SEQ ID NO: 294648 - DNA, 16 bp, P. troglodytes
ttttttggtaagaaaa

SEQ ID NO: 294649 - DNA, 16 bp, P. troglodytes
ttttttggtagagacg

SEQ ID NO: 294650 - DNA, 17 bp, P. troglodytes
ttttttggtagagatga

SEQ ID NO: 294651 - DNA, 16 bp, P. troglodytes
ttttttgtaaaaatga

SEQ ID NO: 294652 - DNA, 16 bp, P. troglodytes
ttttttgtaaagatgg

SEQ ID NO: 294653 - DNA, 16 bp, P. troglodytes
ttttttgtacatctgg

SEQ ID NO: 294654 - DNA, 16 bp, P. troglodytes
ttttttgtacttaaaa

SEQ ID NO: 294655 - DNA, 16 bp, P. troglodytes
ttttttgtagagacta

SEQ ID NO: 294656 - DNA, 16 bp, P. troglodytes
ttttttgtagcaatgg

SEQ ID NO: 294657 - DNA, 16 bp, P. troglodytes
ttttttgtagcgatgg

SEQ ID NO: 294658 - DNA, 16 bp, P. troglodytes
ttttttgtccttgaga

SEQ ID NO: 294659 - DNA, 16 bp, P. troglodytes
ttttttgtctgaaaat

SEQ ID NO: 294660 - DNA, 16 bp, P. troglodytes
ttttttgtctgagaaa

SEQ ID NO: 294661 - DNA, 16 bp, P. troglodytes
ttttttgtgataagaa

SEQ ID NO: 294662 - DNA, 16 bp, P. troglodytes
ttttttgtggagacag

SEQ ID NO: 294663 - DNA, 16 bp, P. troglodytes
ttttttgtggtgagaa

SEQ ID NO: 294664 - DNA, 16 bp, P. troglodytes
ttttttgttgttggca

SEQ ID NO: 294665 - DNA, 17 bp, P. troglodytes
ttttttgttttgagaca

SEQ ID NO: 294666 - DNA, 16 bp, P. troglodytes
tttttttaaaaaacag

SEQ ID NO: 294667 - DNA, 16 bp, P. troglodytes
tttttttaaaaaacct

SEQ ID NO: 294668 - DNA, 16 bp, P. troglodytes
tttttttaaaaaaggt

SEQ ID NO: 294669 - DNA, 16 bp, P. troglodytes
tttttttaaaaagcaa

SEQ ID NO: 294670 - DNA, 16 bp, P. troglodytes
tttttttaaaaaggag

SEQ ID NO: 294671 - DNA, 16 bp, P. troglodytes
tttttttaaaaagtca

SEQ ID NO: 294672 - DNA, 16 bp, P. troglodytes
tttttttaaaaccaca

SEQ ID NO: 294673 - DNA, 16 bp, P. troglodytes
tttttttaaaagatca

SEQ ID NO: 294674 - DNA, 16 bp, P. troglodytes
tttttttaaaagtcat

SEQ ID NO: 294675 - DNA, 16 bp, P. troglodytes
tttttttaaaatcaga

SEQ ID NO: 294676 - DNA, 16 bp, P. troglodytes
tttttttaaaatcctg

SEQ ID NO: 294677 - DNA, 16 bp, P. troglodytes
tttttttaaacatctg

SEQ ID NO: 294678 - DNA, 16 bp, P. troglodytes
tttttttaaagaaaac

SEQ ID NO: 294679 - DNA, 16 bp, P. troglodytes
tttttttaaagaaact

SEQ ID NO: 294680 - DNA, 16 bp, P. troglodytes
tttttttaaagaacac

SEQ ID NO: 294681 - DNA, 16 bp, P. troglodytes
tttttttaaagaatca

SEQ ID NO: 294682 - DNA, 16 bp, P. troglodytes
tttttttaaagctccc

SEQ ID NO: 294683 - DNA, 16 bp, P. troglodytes
tttttttaaagcttca

SEQ ID NO: 294684 - DNA, 16 bp, P. troglodytes
tttttttaaaggaaaa

SEQ ID NO: 294685 - DNA, 16 bp, P. troglodytes
tttttttaaaggacat

SEQ ID NO: 294686 - DNA, 16 bp, P. troglodytes
tttttttaaagtgaaa

SEQ ID NO: 294687 - DNA, 16 bp, P. troglodytes
tttttttaaatcacaa

SEQ ID NO: 294688 - DNA, 16 bp, P. troglodytes
tttttttaaatctctg

SEQ ID NO: 294689 - DNA, 16 bp, P. troglodytes
tttttttaaatgcagt

SEQ ID NO: 294690 - DNA, 16 bp, P. troglodytes
tttttttaaatggggt

SEQ ID NO: 294691 - DNA, 16 bp, P. troglodytes
tttttttaaattgctg

SEQ ID NO: 294692 - DNA, 16 bp, P. troglodytes
tttttttaacaaaatg

SEQ ID NO: 294693 - DNA, 16 bp, P. troglodytes
tttttttaacatttga

SEQ ID NO: 294694 - DNA, 16 bp, P. troglodytes
tttttttaaccaaaag

SEQ ID NO: 294695 - DNA, 16 bp, P. troglodytes
tttttttaacccaaag

SEQ ID NO: 294696 - DNA, 16 bp, P. troglodytes
tttttttaacttaatg

SEQ ID NO: 294697 - DNA, 16 bp, P. troglodytes
tttttttaacttgaga

SEQ ID NO: 294698 - DNA, 16 bp, P. troglodytes
tttttttaagaaacat

SEQ ID NO: 294699 - DNA, 16 bp, P. troglodytes
tttttttaagaagaga

SEQ ID NO: 294700 - DNA, 16 bp, P. troglodytes
tttttttaagagacca

SEQ ID NO: 294701 - DNA, 16 bp, P. troglodytes
tttttttaagatagaa

SEQ ID NO: 294702 - DNA, 16 bp, P. troglodytes
tttttttaagcaaatg

SEQ ID NO: 294703 - DNA, 16 bp, P. troglodytes
tttttttaaggaaaag

SEQ ID NO: 294704 - DNA, 16 bp, P. troglodytes
tttttttaaggaaaca

SEQ ID NO: 294705 - DNA, 16 bp, P. troglodytes
tttttttaaggaaatc

SEQ ID NO: 294706 - DNA, 16 bp, P. troglodytes
tttttttaaggcaaaa

SEQ ID NO: 294707 - DNA, 16 bp, P. troglodytes
tttttttaagtagaga

SEQ ID NO: 294708 - DNA, 16 bp, P. troglodytes
tttttttaagtgactt

SEQ ID NO: 294709 - DNA, 16 bp, P. troglodytes
tttttttaagtgggaa

SEQ ID NO: 294710 - DNA, 16 bp, P. troglodytes
tttttttaataaaagg

SEQ ID NO: 294711 - DNA, 16 bp, P. troglodytes
tttttttaatacagag

SEQ ID NO: 294712 - DNA, 16 bp, P. troglodytes
tttttttaatattcag

SEQ ID NO: 294713 - DNA, 16 bp, P. troglodytes
tttttttaatcactga

SEQ ID NO: 294714 - DNA, 16 bp, P. troglodytes
tttttttaatcagaag

SEQ ID NO: 294715 - DNA, 16 bp, P. troglodytes
tttttttaatcaggtt

SEQ ID NO: 294716 - DNA, 16 bp, P. troglodytes
tttttttaatgaagtg

SEQ ID NO: 294717 - DNA, 16 bp, P. troglodytes
tttttttaatgagaaa

SEQ ID NO: 294718 - DNA, 16 bp, P. troglodytes
tttttttaatgagaca

SEQ ID NO: 294719 - DNA, 16 bp, P. troglodytes
tttttttaatgaggaa

SEQ ID NO: 294720 - DNA, 16 bp, P. troglodytes
tttttttaatgaggca

SEQ ID NO: 294721 - DNA, 16 bp, P. troglodytes
tttttttaatggactt

SEQ ID NO: 294722 - DNA, 16 bp, P. troglodytes
tttttttaattgcaaa

SEQ ID NO: 294723 - DNA, 16 bp, P. troglodytes
tttttttaatttcaga

SEQ ID NO: 294724 - DNA, 16 bp, P. troglodytes
tttttttactagagat

SEQ ID NO: 294725 - DNA, 16 bp, P. troglodytes
tttttttacttagaaa

SEQ ID NO: 294726 - DNA, 16 bp, P. troglodytes
tttttttactttaaga

SEQ ID NO: 294727 - DNA, 16 bp, P. troglodytes
tttttttagaaaaact

SEQ ID NO: 294728 - DNA, 16 bp, P. troglodytes
tttttttagaaatgtg

SEQ ID NO: 294729 - DNA, 16 bp, P. troglodytes
tttttttagacggagt

SEQ ID NO: 294730 - DNA, 16 bp, P. troglodytes
tttttttagagcagtt

SEQ ID NO: 294731 - DNA, 16 bp, P. troglodytes
tttttttagtagagac

SEQ ID NO: 294732 - DNA, 23 bp, P. troglodytes
tttttttagtagagacggggttt

SEQ ID NO: 294733 - DNA, 24 bp, P. troglodytes
tttttttagtagagatggggtttc

SEQ ID NO: 294734 - DNA, 16 bp, P. troglodytes
tttttttagtagaggt

SEQ ID NO: 294735 - DNA, 16 bp, P. troglodytes
tttttttatcttgccc

SEQ ID NO: 294736 - DNA, 16 bp, P. troglodytes
tttttttattgcaaat

SEQ ID NO: 294737 - DNA, 16 bp, P. troglodytes
tttttttcaagaaaca

SEQ ID NO: 294738 - DNA, 16 bp, P. troglodytes
tttttttcaagaattt

SEQ ID NO: 294739 - DNA, 16 bp, P. troglodytes
tttttttcaagacagg

SEQ ID NO: 294740 - DNA, 16 bp, P. troglodytes
tttttttcaagatgga

SEQ ID NO: 294741 - DNA, 16 bp, P. troglodytes
tttttttcaaggaaat

SEQ ID NO: 294742 - DNA, 16 bp, P. troglodytes
tttttttcaagtgaaa

SEQ ID NO: 294743 - DNA, 16 bp, P. troglodytes
tttttttcacttagca

SEQ ID NO: 294744 - DNA, 16 bp, P. troglodytes
tttttttcagagagag

SEQ ID NO: 294745 - DNA, 16 bp, P. troglodytes
tttttttcagatatgt

SEQ ID NO: 294746 - DNA, 16 bp, P. troglodytes
tttttttcatctgtaa

SEQ ID NO: 294747 - DNA, 16 bp, P. troglodytes
tttttttcatgaaaat

SEQ ID NO: 294748 - DNA, 16 bp, P. troglodytes
tttttttcatttcaag

SEQ ID NO: 294749 - DNA, 16 bp, P. troglodytes
tttttttccaaaataa

SEQ ID NO: 294750 - DNA, 16 bp, P. troglodytes
tttttttccaaataaa

SEQ ID NO: 294751 - DNA, 16 bp, P. troglodytes
tttttttccaaatgga

SEQ ID NO: 294752 - DNA, 16 bp, P. troglodytes
tttttttccaaattga

SEQ ID NO: 294753 - DNA, 16 bp, P. troglodytes
tttttttccacagaaa

SEQ ID NO: 294754 - DNA, 16 bp, P. troglodytes
tttttttccagatata

SEQ ID NO: 294755 - DNA, 16 bp, P. troglodytes
tttttttccattggaa

SEQ ID NO: 294756 - DNA, 16 bp, P. troglodytes
tttttttcccaaaaaa

SEQ ID NO: 294757 - DNA, 16 bp, P. troglodytes
tttttttccccaagac

SEQ ID NO: 294758 - DNA, 16 bp, P. troglodytes
tttttttccccagaga

SEQ ID NO: 294759 - DNA, 16 bp, P. troglodytes
tttttttccccagagt

SEQ ID NO: 294760 - DNA, 16 bp, P. troglodytes
tttttttccccagtat

SEQ ID NO: 294761 - DNA, 16 bp, P. troglodytes
tttttttcccccaaag

SEQ ID NO: 294762 - DNA, 16 bp, P. troglodytes
tttttttcccccaaat

SEQ ID NO: 294763 - DNA, 16 bp, P. troglodytes
tttttttccccccaaa

SEQ ID NO: 294764 - DNA, 16 bp, P. troglodytes
tttttttccccccaga

SEQ ID NO: 294765 - DNA, 16 bp, P. troglodytes
tttttttcccccctaa

SEQ ID NO: 294766 - DNA, 16 bp, P. troglodytes
tttttttccccctgaa

SEQ ID NO: 294767 - DNA, 16 bp, P. troglodytes
tttttttcccccttag

SEQ ID NO: 294768 - DNA, 16 bp, P. troglodytes
tttttttcccctggag

SEQ ID NO: 294769 - DNA, 16 bp, P. troglodytes
tttttttccctgaaag

SEQ ID NO: 294770 - DNA, 16 bp, P. troglodytes
tttttttcctaagaaa

SEQ ID NO: 294771 - DNA, 16 bp, P. troglodytes
tttttttcctagaaat

SEQ ID NO: 294772 - DNA, 16 bp, P. troglodytes
tttttttcctagagaa

SEQ ID NO: 294773 - DNA, 16 bp, P. troglodytes
tttttttcctcaaaag

SEQ ID NO: 294774 - DNA, 16 bp, P. troglodytes
tttttttcctccatgt

SEQ ID NO: 294775 - DNA, 16 bp, P. troglodytes
tttttttcctccccaa

SEQ ID NO: 294776 - DNA, 16 bp, P. troglodytes
tttttttcctctgaat

SEQ ID NO: 294777 - DNA, 16 bp, P. troglodytes
tttttttcctctggta

SEQ ID NO: 294778 - DNA, 16 bp, P. troglodytes
tttttttcctcttaga

SEQ ID NO: 294779 - DNA, 16 bp, P. troglodytes
tttttttcctgaaatg

SEQ ID NO: 294780 - DNA, 16 bp, P. troglodytes
tttttttcctggagac

SEQ ID NO: 294781 - DNA, 16 bp, P. troglodytes
tttttttcctgttaca

SEQ ID NO: 294782 - DNA, 16 bp, P. troglodytes
tttttttccttaagaa

SEQ ID NO: 294783 - DNA, 16 bp, P. troglodytes
tttttttccttcaaga

SEQ ID NO: 294784 - DNA, 16 bp, P. troglodytes
tttttttccttccaaa

SEQ ID NO: 294785 - DNA, 16 bp, P. troglodytes
tttttttcctttaaag

SEQ ID NO: 294786 - DNA, 16 bp, P. troglodytes
tttttttctaaaagta

SEQ ID NO: 294787 - DNA, 16 bp, P. troglodytes
tttttttctaaaggaa

SEQ ID NO: 294788 - DNA, 16 bp, P. troglodytes
tttttttctataaaag

SEQ ID NO: 294789 - DNA, 16 bp, P. troglodytes
tttttttctcagtctc

SEQ ID NO: 294790 - DNA, 16 bp, P. troglodytes
tttttttctccaaata

SEQ ID NO: 294791 - DNA, 16 bp, P. troglodytes
tttttttctccccaaa

SEQ ID NO: 294792 - DNA, 16 bp, P. troglodytes
tttttttctcctgaaa

SEQ ID NO: 294793 - DNA, 16 bp, P. troglodytes
tttttttctccttcag

SEQ ID NO: 294794 - DNA, 16 bp, P. troglodytes
tttttttctctagaga

SEQ ID NO: 294795 - DNA, 16 bp, P. troglodytes
tttttttctctccaaa

SEQ ID NO: 294796 - DNA, 16 bp, P. troglodytes
tttttttctcttaagg

SEQ ID NO: 294797 - DNA, 16 bp, P. troglodytes
tttttttctcttcaga

SEQ ID NO: 294798 - DNA, 16 bp, P. troglodytes
tttttttctcttgaaa

SEQ ID NO: 294799 - DNA, 16 bp, P. troglodytes
tttttttctgaaaaaa

SEQ ID NO: 294800 - DNA, 16 bp, P. troglodytes
tttttttctgaaataa

SEQ ID NO: 294801 - DNA, 16 bp, P. troglodytes
tttttttctgaatgaa

SEQ ID NO: 294802 - DNA, 16 bp, P. troglodytes
tttttttctgagaaat

SEQ ID NO: 294803 - DNA, 16 bp, P. troglodytes
tttttttctgagacaa

SEQ ID NO: 294804 - DNA, 16 bp, P. troglodytes
tttttttctgagataa

SEQ ID NO: 294805 - DNA, 16 bp, P. troglodytes
tttttttctgagatga

SEQ ID NO: 294806 - DNA, 16 bp, P. troglodytes
tttttttctgatgaaa

SEQ ID NO: 294807 - DNA, 16 bp, P. troglodytes
tttttttctgattcaa

SEQ ID NO: 294808 - DNA, 16 bp, P. troglodytes
tttttttctgcctcat

SEQ ID NO: 294809 - DNA, 16 bp, P. troglodytes
tttttttctggaaaac

SEQ ID NO: 294810 - DNA, 16 bp, P. troglodytes
tttttttctggaagaa

SEQ ID NO: 294811 - DNA, 16 bp, P. troglodytes
tttttttctgggaaag

SEQ ID NO: 294812 - DNA, 16 bp, P. troglodytes
tttttttctggtagag

SEQ ID NO: 294813 - DNA, 16 bp, P. troglodytes
tttttttctggtgaga

SEQ ID NO: 294814 - DNA, 16 bp, P. troglodytes
tttttttctgtaaaat

SEQ ID NO: 294815 - DNA, 16 bp, P. troglodytes
tttttttctgtgaaat

SEQ ID NO: 294816 - DNA, 16 bp, P. troglodytes
tttttttctgtgtaaa

SEQ ID NO: 294817 - DNA, 16 bp, P. troglodytes
tttttttcttagaaaa

SEQ ID NO: 294818 - DNA, 16 bp, P. troglodytes
tttttttcttagaaat

SEQ ID NO: 294819 - DNA, 16 bp, P. troglodytes
tttttttcttaggaaa

SEQ ID NO: 294820 - DNA, 16 bp, P. troglodytes
tttttttcttatgaaa

SEQ ID NO: 294821 - DNA, 16 bp, P. troglodytes
tttttttcttgaaaaa

SEQ ID NO: 294822 - DNA, 16 bp, P. troglodytes
tttttttctttaagca

SEQ ID NO: 294823 - DNA, 16 bp, P. troglodytes
tttttttctttgcaga

SEQ ID NO: 294824 - DNA, 16 bp, P. troglodytes
tttttttgaaagaaaa

SEQ ID NO: 294825 - DNA, 16 bp, P. troglodytes
tttttttgaaatgggg

SEQ ID NO: 294826 - DNA, 16 bp, P. troglodytes
tttttttgaaggaaaa

SEQ ID NO: 294827 - DNA, 21 bp, P. troglodytes
tttttttgagacaaagtctca

SEQ ID NO: 294828 - DNA, 16 bp, P. troglodytes
tttttttgagacaaga

SEQ ID NO: 294829 - DNA, 16 bp, P. troglodytes
tttttttgagacaagc

SEQ ID NO: 294830 - DNA, 16 bp, P. troglodytes
tttttttgagacagca

SEQ ID NO: 294831 - DNA, 16 bp, P. troglodytes
tttttttgagagagag

SEQ ID NO: 294832 - DNA, 16 bp, P. troglodytes
tttttttgagagtctt

SEQ ID NO: 294833 - DNA, 21 bp, P. troglodytes
tttttttgagatggagtctta

SEQ ID NO: 294834 - DNA, 16 bp, P. troglodytes
tttttttgaggaagag

SEQ ID NO: 294835 - DNA, 16 bp, P. troglodytes
tttttttgaggagaaa

SEQ ID NO: 294836 - DNA, 16 bp, P. troglodytes
tttttttgaggaggag

SEQ ID NO: 294837 - DNA, 16 bp, P. troglodytes
tttttttgcaaagaaa

SEQ ID NO: 294838 - DNA, 16 bp, P. troglodytes
tttttttgcagaaaca

SEQ ID NO: 294839 - DNA, 16 bp, P. troglodytes
tttttttggaaacaga

SEQ ID NO: 294840 - DNA, 16 bp, P. troglodytes
tttttttggacagagt

SEQ ID NO: 294841 - DNA, 16 bp, P. troglodytes
tttttttggacagggt

SEQ ID NO: 294842 - DNA, 16 bp, P. troglodytes
tttttttggagagaga

SEQ ID NO: 294843 - DNA, 16 bp, P. troglodytes
tttttttggaggggga

SEQ ID NO: 294844 - DNA, 16 bp, P. troglodytes
tttttttggccaattt

SEQ ID NO: 294845 - DNA, 19 bp, P. troglodytes
tttttttggtagagatggg

SEQ ID NO: 294846 - DNA, 16 bp, P. troglodytes
tttttttggtgcaagt

SEQ ID NO: 294847 - DNA, 16 bp, P. troglodytes
tttttttgtaaaagaa

SEQ ID NO: 294848 - DNA, 16 bp, P. troglodytes
tttttttgtaaattgc

SEQ ID NO: 294849 - DNA, 16 bp, P. troglodytes
tttttttgtaagaaaa

SEQ ID NO: 294850 - DNA, 16 bp, P. troglodytes
tttttttgtacagata

SEQ ID NO: 294851 - DNA, 18 bp, P. troglodytes
tttttttgtagagacaga

SEQ ID NO: 294852 - DNA, 16 bp, P. troglodytes
tttttttgtagggata

SEQ ID NO: 294853 - DNA, 16 bp, P. troglodytes
tttttttgtagtgaca

SEQ ID NO: 294854 - DNA, 16 bp, P. troglodytes
tttttttgtggagtct

SEQ ID NO: 294855 - DNA, 16 bp, P. troglodytes
tttttttgttaaaaac

SEQ ID NO: 294856 - DNA, 16 bp, P. troglodytes
ttttttttaaaaagac

SEQ ID NO: 294857 - DNA, 16 bp, P. troglodytes
ttttttttaaaaatgc

SEQ ID NO: 294858 - DNA, 16 bp, P. troglodytes
ttttttttaaacagaa

SEQ ID NO: 294859 - DNA, 16 bp, P. troglodytes
ttttttttaaacatga

SEQ ID NO: 294860 - DNA, 16 bp, P. troglodytes
ttttttttaaagacac

SEQ ID NO: 294861 - DNA, 16 bp, P. troglodytes
ttttttttaaagagcc

SEQ ID NO: 294862 - DNA, 16 bp, P. troglodytes
ttttttttaaagcaca

SEQ ID NO: 294863 - DNA, 16 bp, P. troglodytes
ttttttttaaagcact

SEQ ID NO: 294864 - DNA, 16 bp, P. troglodytes
ttttttttaaaggagc

SEQ ID NO: 294865 - DNA, 16 bp, P. troglodytes
ttttttttaaaggcag

SEQ ID NO: 294866 - DNA, 16 bp, P. troglodytes
ttttttttaaagtaac

SEQ ID NO: 294867 - DNA, 16 bp, P. troglodytes
ttttttttaaatagac

SEQ ID NO: 294868 - DNA, 16 bp, P. troglodytes
ttttttttaaatgcaa

SEQ ID NO: 294869 - DNA, 16 bp, P. troglodytes
ttttttttaaatggag

SEQ ID NO: 294870 - DNA, 16 bp, P. troglodytes
ttttttttaacaagga

SEQ ID NO: 294871 - DNA, 16 bp, P. troglodytes
ttttttttaaccaaag

SEQ ID NO: 294872 - DNA, 16 bp, P. troglodytes
ttttttttaaccagtc

SEQ ID NO: 294873 - DNA, 16 bp, P. troglodytes
ttttttttaacctctg

SEQ ID NO: 294874 - DNA, 16 bp, P. troglodytes
ttttttttaactgaag

SEQ ID NO: 294875 - DNA, 16 bp, P. troglodytes
ttttttttaactgaat

SEQ ID NO: 294876 - DNA, 16 bp, P. troglodytes
ttttttttaagacata

SEQ ID NO: 294877 - DNA, 16 bp, P. troglodytes
ttttttttaagagaaa

SEQ ID NO: 294878 - DNA, 16 bp, P. troglodytes
ttttttttaagagaag

SEQ ID NO: 294879 - DNA, 16 bp, P. troglodytes
ttttttttaagagaca

SEQ ID NO: 294880 - DNA, 16 bp, P. troglodytes
ttttttttaagcctga

SEQ ID NO: 294881 - DNA, 16 bp, P. troglodytes
ttttttttaaggctga

SEQ ID NO: 294882 - DNA, 16 bp, P. troglodytes
ttttttttaagtcaca

SEQ ID NO: 294883 - DNA, 16 bp, P. troglodytes
ttttttttaagtggag

SEQ ID NO: 294884 - DNA, 16 bp, P. troglodytes
ttttttttaagtggca

SEQ ID NO: 294885 - DNA, 16 bp, P. troglodytes
ttttttttaagttaac

SEQ ID NO: 294886 - DNA, 16 bp, P. troglodytes
ttttttttaatactga

SEQ ID NO: 294887 - DNA, 16 bp, P. troglodytes
ttttttttaatagcaa

SEQ ID NO: 294888 - DNA, 16 bp, P. troglodytes
ttttttttaatcacag

SEQ ID NO: 294889 - DNA, 16 bp, P. troglodytes
ttttttttacaaatga

SEQ ID NO: 294890 - DNA, 16 bp, P. troglodytes
ttttttttacacaaaa

SEQ ID NO: 294891 - DNA, 16 bp, P. troglodytes
ttttttttacagaaat

SEQ ID NO: 294892 - DNA, 16 bp, P. troglodytes
ttttttttacatgaat

SEQ ID NO: 294893 - DNA, 16 bp, P. troglodytes
ttttttttagaagaaa

SEQ ID NO: 294894 - DNA, 16 bp, P. troglodytes
ttttttttagaagaga

SEQ ID NO: 294895 - DNA, 16 bp, P. troglodytes
ttttttttcaaagaat

SEQ ID NO: 294896 - DNA, 16 bp, P. troglodytes
ttttttttcaagattg

SEQ ID NO: 294897 - DNA, 16 bp, P. troglodytes
ttttttttcaataagt

SEQ ID NO: 294898 - DNA, 16 bp, P. troglodytes
ttttttttcagttaaa

SEQ ID NO: 294899 - DNA, 16 bp, P. troglodytes
ttttttttcatgtaga

SEQ ID NO: 294900 - DNA, 16 bp, P. troglodytes
ttttttttccaaaaaa

SEQ ID NO: 294901 - DNA, 16 bp, P. troglodytes
ttttttttccaacaaa

SEQ ID NO: 294902 - DNA, 16 bp, P. troglodytes
ttttttttccaacttg

SEQ ID NO: 294903 - DNA, 16 bp, P. troglodytes
ttttttttccacagtg

SEQ ID NO: 294904 - DNA, 16 bp, P. troglodytes
ttttttttccagaaaa

SEQ ID NO: 294905 - DNA, 16 bp, P. troglodytes
ttttttttccagcttc

SEQ ID NO: 294906 - DNA, 16 bp, P. troglodytes
ttttttttccaggaag

SEQ ID NO: 294907 - DNA, 16 bp, P. troglodytes
ttttttttccaggaga

SEQ ID NO: 294908 - DNA, 16 bp, P. troglodytes
ttttttttccagtaat

SEQ ID NO: 294909 - DNA, 16 bp, P. troglodytes
ttttttttcccaaaaa

SEQ ID NO: 294910 - DNA, 16 bp, P. troglodytes
ttttttttcccaaagg

SEQ ID NO: 294911 - DNA, 16 bp, P. troglodytes
ttttttttccccactg

SEQ ID NO: 294912 - DNA, 16 bp, P. troglodytes
ttttttttccccattg

SEQ ID NO: 294913 - DNA, 16 bp, P. troglodytes
ttttttttcccccaaa

SEQ ID NO: 294914 - DNA, 16 bp, P. troglodytes
ttttttttcccccaag

SEQ ID NO: 294915 - DNA, 16 bp, P. troglodytes
ttttttttcccctaga

SEQ ID NO: 294916 - DNA, 16 bp, P. troglodytes
ttttttttcccctgaa

SEQ ID NO: 294917 - DNA, 16 bp, P. troglodytes
ttttttttccccttga

SEQ ID NO: 294918 - DNA, 16 bp, P. troglodytes
ttttttttccctcagc

SEQ ID NO: 294919 - DNA, 16 bp, P. troglodytes
ttttttttccctgaaa

SEQ ID NO: 294920 - DNA, 16 bp, P. troglodytes
ttttttttcccttgag

SEQ ID NO: 294921 - DNA, 16 bp, P. troglodytes
ttttttttcctatgga

SEQ ID NO: 294922 - DNA, 16 bp, P. troglodytes
ttttttttcctccaaa

SEQ ID NO: 294923 - DNA, 16 bp, P. troglodytes
ttttttttcctgaaca

SEQ ID NO: 294924 - DNA, 16 bp, P. troglodytes
ttttttttcctgaaga

SEQ ID NO: 294925 - DNA, 16 bp, P. troglodytes
ttttttttcctgtcag

SEQ ID NO: 294926 - DNA, 16 bp, P. troglodytes
ttttttttccttgaag

SEQ ID NO: 294927 - DNA, 16 bp, P. troglodytes
ttttttttctaagaca

SEQ ID NO: 294928 - DNA, 16 bp, P. troglodytes
ttttttttctcaccaa

SEQ ID NO: 294929 - DNA, 16 bp, P. troglodytes
ttttttttctcactgc

SEQ ID NO: 294930 - DNA, 16 bp, P. troglodytes
ttttttttctcatcag

SEQ ID NO: 294931 - DNA, 16 bp, P. troglodytes
ttttttttctctaagc

SEQ ID NO: 294932 - DNA, 16 bp, P. troglodytes
ttttttttctgaagac

SEQ ID NO: 294933 - DNA, 16 bp, P. troglodytes
ttttttttctgataaa

SEQ ID NO: 294934 - DNA, 16 bp, P. troglodytes
ttttttttctggaaaa

SEQ ID NO: 294935 - DNA, 16 bp, P. troglodytes
ttttttttctggaatg

SEQ ID NO: 294936 - DNA, 16 bp, P. troglodytes
ttttttttcttagaca

SEQ ID NO: 294937 - DNA, 16 bp, P. troglodytes
ttttttttgaaaggaa

SEQ ID NO: 294938 - DNA, 16 bp, P. troglodytes
ttttttttgaagaaaa

SEQ ID NO: 294939 - DNA, 16 bp, P. troglodytes
ttttttttgacaaaaa

SEQ ID NO: 294940 - DNA, 16 bp, P. troglodytes
ttttttttgagaatgg

SEQ ID NO: 294941 - DNA, 16 bp, P. troglodytes
ttttttttgagacagg

SEQ ID NO: 294942 - DNA, 22 bp, P. troglodytes
ttttttttgagacggagtttcg

SEQ ID NO: 294943 - DNA, 16 bp, P. troglodytes
ttttttttgagagaaa

SEQ ID NO: 294944 - DNA, 22 bp, P. troglodytes
ttttttttgagatggagtttcg

SEQ ID NO: 294945 - DNA, 16 bp, P. troglodytes
ttttttttgagtctga

SEQ ID NO: 294946 - DNA, 16 bp, P. troglodytes
ttttttttggatacag

SEQ ID NO: 294947 - DNA, 16 bp, P. troglodytes
ttttttttggatgaag

SEQ ID NO: 294948 - DNA, 16 bp, P. troglodytes
ttttttttggcagaga

SEQ ID NO: 294949 - DNA, 16 bp, P. troglodytes
ttttttttgttgaaac

SEQ ID NO: 294950 - DNA, 16 bp, P. troglodytes
tttttttttaaacaga

SEQ ID NO: 294951 - DNA, 16 bp, P. troglodytes
tttttttttaaactgg

SEQ ID NO: 294952 - DNA, 16 bp, P. troglodytes
tttttttttaaagcca

SEQ ID NO: 294953 - DNA, 16 bp, P. troglodytes
tttttttttaaaggga

SEQ ID NO: 294954 - DNA, 16 bp, P. troglodytes
tttttttttaaagtca

SEQ ID NO: 294955 - DNA, 16 bp, P. troglodytes
tttttttttaaatcag

SEQ ID NO: 294956 - DNA, 16 bp, P. troglodytes
tttttttttaacacca

SEQ ID NO: 294957 - DNA, 16 bp, P. troglodytes
tttttttttaacatgg

SEQ ID NO: 294958 - DNA, 16 bp, P. troglodytes
tttttttttaacccaa

SEQ ID NO: 294959 - DNA, 16 bp, P. troglodytes
tttttttttaactgaa

SEQ ID NO: 294960 - DNA, 16 bp, P. troglodytes
tttttttttaagacac

SEQ ID NO: 294961 - DNA, 16 bp, P. troglodytes
tttttttttaagcaaa

SEQ ID NO: 294962 - DNA, 16 bp, P. troglodytes
tttttttttaagctca

SEQ ID NO: 294963 - DNA, 16 bp, P. troglodytes
tttttttttaaggaca

SEQ ID NO: 294964 - DNA, 16 bp, P. troglodytes
tttttttttaaggagc

SEQ ID NO: 294965 - DNA, 16 bp, P. troglodytes
tttttttttaatagca

SEQ ID NO: 294966 - DNA, 16 bp, P. troglodytes
tttttttttaatcaag

SEQ ID NO: 294967 - DNA, 16 bp, P. troglodytes
tttttttttaatgaca

SEQ ID NO: 294968 - DNA, 16 bp, P. troglodytes
tttttttttaatgcag

SEQ ID NO: 294969 - DNA, 16 bp, P. troglodytes
tttttttttaggaaag

SEQ ID NO: 294970 - DNA, 16 bp, P. troglodytes
tttttttttatcaaga

SEQ ID NO: 294971 - DNA, 16 bp, P. troglodytes
tttttttttcacccaa

SEQ ID NO: 294972 - DNA, 16 bp, P. troglodytes
tttttttttcaggaac

SEQ ID NO: 294973 - DNA, 16 bp, P. troglodytes
tttttttttcagggat

SEQ ID NO: 294974 - DNA, 16 bp, P. troglodytes
tttttttttcagtaaa

SEQ ID NO: 294975 - DNA, 16 bp, P. troglodytes
tttttttttcagtgag

SEQ ID NO: 294976 - DNA, 16 bp, P. troglodytes
tttttttttccaaaca

SEQ ID NO: 294977 - DNA, 16 bp, P. troglodytes
tttttttttccagaaa

SEQ ID NO: 294978 - DNA, 16 bp, P. troglodytes
tttttttttccagata

SEQ ID NO: 294979 - DNA, 16 bp, P. troglodytes
tttttttttccagggg

SEQ ID NO: 294980 - DNA, 16 bp, P. troglodytes
tttttttttccagtag

SEQ ID NO: 294981 - DNA, 16 bp, P. troglodytes
tttttttttcctgaga

SEQ ID NO: 294982 - DNA, 16 bp, P. troglodytes
tttttttttcgagaca

SEQ ID NO: 294983 - DNA, 16 bp, P. troglodytes
tttttttttctaagaa

SEQ ID NO: 294984 - DNA, 16 bp, P. troglodytes
tttttttttctcacag

SEQ ID NO: 294985 - DNA, 16 bp, P. troglodytes
tttttttttctggaag

SEQ ID NO: 294986 - DNA, 16 bp, P. troglodytes
tttttttttgacactg

SEQ ID NO: 294987 - DNA, 16 bp, P. troglodytes
tttttttttgagaaag

SEQ ID NO: 294988 - DNA, 16 bp, P. troglodytes
tttttttttgagacat

SEQ ID NO: 294989 - DNA, 16 bp, P. troglodytes
tttttttttgcaaata

SEQ ID NO: 294990 - DNA, 16 bp, P. troglodytes
tttttttttgcacatg

SEQ ID NO: 294991 - DNA, 16 bp, P. troglodytes
tttttttttgcctcca

SEQ ID NO: 294992 - DNA, 16 bp, P. troglodytes
tttttttttggacagg

SEQ ID NO: 294993 - DNA, 16 bp, P. troglodytes
tttttttttggtacca

SEQ ID NO: 294994 - DNA, 16 bp, P. troglodytes
ttttttttttaaagac

SEQ ID NO: 294995 - DNA, 16 bp, P. troglodytes
ttttttttttaagaca

SEQ ID NO: 294996 - DNA, 16 bp, P. troglodytes
ttttttttttaaggcg

SEQ ID NO: 294997 - DNA, 16 bp, P. troglodytes
ttttttttttagcaga

SEQ ID NO: 294998 - DNA, 16 bp, P. troglodytes
ttttttttttcagaaa

SEQ ID NO: 294999 - DNA, 16 bp, P. troglodytes
ttttttttttcagaga

SEQ ID NO: 295000 - DNA, 16 bp, P. troglodytes
ttttttttttccaaag

SEQ ID NO: 295001 - DNA, 16 bp, P. troglodytes
ttttttttttccagac

SEQ ID NO: 295002 - DNA, 16 bp, P. troglodytes
ttttttttttcccaga

SEQ ID NO: 295003 - DNA, 24 bp, P. troglodytes
ttttttttttgagacagaatctca

SEQ ID NO: 295004 - DNA, 16 bp, P. troglodytes
ttttttttttggagac

SEQ ID NO: 295005 - DNA, 16 bp, P. troglodytes
ttttttttttggccag

SEQ ID NO: 295006 - DNA, 16 bp, C. familiaris
aaaaaaaaaagcctgg

SEQ ID NO: 295007 - DNA, 16 bp, C. familiaris
aaaaaaaaaatctctg

SEQ ID NO: 295008 - DNA, 16 bp, C. familiaris
aaaaaaaaaatgcctt

SEQ ID NO: 295009 - DNA, 16 bp, C. familiaris
aaaaaaaaaattctgg

SEQ ID NO: 295010 - DNA, 16 bp, C. familiaris
aaaaaaaaaccctgtt

SEQ ID NO: 295011 - DNA, 16 bp, C. familiaris
aaaaaaaaaccctttg

SEQ ID NO: 295012 - DNA, 16 bp, C. familiaris
aaaaaaaaactctgtt

SEQ ID NO: 295013 - DNA, 16 bp, C. familiaris
aaaaaaaaactgctga

SEQ ID NO: 295014 - DNA, 16 bp, C. familiaris
aaaaaaaaactttctc

SEQ ID NO: 295015 - DNA, 16 bp, C. familiaris
aaaaaaaaaggccttc

SEQ ID NO: 295016 - DNA, 16 bp, C. familiaris
aaaaaaaaaggtgtgc

SEQ ID NO: 295017 - DNA, 16 bp, C. familiaris
aaaaaaaaagtcagtt

SEQ ID NO: 295018 - DNA, 16 bp, C. familiaris
aaaaaaaaagtcctga

SEQ ID NO: 295019 - DNA, 16 bp, C. familiaris
aaaaaaaaagtccttc

SEQ ID NO: 295020 - DNA, 16 bp, C. familiaris
aaaaaaaaagttcatt

SEQ ID NO: 295021 - DNA, 16 bp, C. familiaris
aaaaaaaaagttccag

SEQ ID NO: 295022 - DNA, 16 bp, C. familiaris
aaaaaaaaagttcctt

SEQ ID NO: 295023 - DNA, 16 bp, C. familiaris
aaaaaaaaatcactgt

SEQ ID NO: 295024 - DNA, 16 bp, C. familiaris
aaaaaaaaatcagtgc

SEQ ID NO: 295025 - DNA, 16 bp, C. familiaris
aaaaaaaaatctggac

SEQ ID NO: 295026 - DNA, 16 bp, C. familiaris
aaaaaaaaatgctcat

SEQ ID NO: 295027 - DNA, 16 bp, C. familiaris
aaaaaaaaatgtttct

SEQ ID NO: 295028 - DNA, 16 bp, C. familiaris
aaaaaaaaattccctg

SEQ ID NO: 295029 - DNA, 16 bp, C. familiaris
aaaaaaaacactggga

SEQ ID NO: 295030 - DNA, 16 bp, C. familiaris
aaaaaaaacagtggga

SEQ ID NO: 295031 - DNA, 16 bp, C. familiaris
aaaaaaaacctccaga

SEQ ID NO: 295032 - DNA, 16 bp, C. familiaris
aaaaaaaactgttttc

SEQ ID NO: 295033 - DNA, 16 bp, C. familiaris
aaaaaaaagactggtg

SEQ ID NO: 295034 - DNA, 16 bp, C. familiaris
aaaaaaaagagctacc

SEQ ID NO: 295035 - DNA, 16 bp, C. familiaris
aaaaaaaagagctgct

SEQ ID NO: 295036 - DNA, 16 bp, C. familiaris
aaaaaaaagaggcttt

SEQ ID NO: 295037 - DNA, 16 bp, C. familiaris
aaaaaaaagagtctct

SEQ ID NO: 295038 - DNA, 16 bp, C. familiaris
aaaaaaaagagttcct

SEQ ID NO: 295039 - DNA, 16 bp, C. familiaris
aaaaaaaagatatttc

SEQ ID NO: 295040 - DNA, 16 bp, C. familiaris
aaaaaaaagattccca

SEQ ID NO: 295041 - DNA, 16 bp, C. familiaris
aaaaaaaagccagagt

SEQ ID NO: 295042 - DNA, 16 bp, C. familiaris
aaaaaaaaggcatttg

SEQ ID NO: 295043 - DNA, 16 bp, C. familiaris
aaaaaaaagtatcagt

SEQ ID NO: 295044 - DNA, 16 bp, C. familiaris
aaaaaaaagtatctgg

SEQ ID NO: 295045 - DNA, 16 bp, C. familiaris
aaaaaaaagtcatcca

SEQ ID NO: 295046 - DNA, 16 bp, C. familiaris
aaaaaaaagtctgaca

SEQ ID NO: 295047 - DNA, 16 bp, C. familiaris
aaaaaaaagtctgatt

SEQ ID NO: 295048 - DNA, 16 bp, C. familiaris
aaaaaaaagtgagcat

SEQ ID NO: 295049 - DNA, 16 bp, C. familiaris
aaaaaaaagtgcatga

SEQ ID NO: 295050 - DNA, 16 bp, C. familiaris
aaaaaaaagtgctctg

SEQ ID NO: 295051 - DNA, 16 bp, C. familiaris
aaaaaaaagttcagct

SEQ ID NO: 295052 - DNA, 16 bp, C. familiaris
aaaaaaaagtttctga

SEQ ID NO: 295053 - DNA, 16 bp, C. familiaris
aaaaaaaagttttgtt

SEQ ID NO: 295054 - DNA, 16 bp, C. familiaris
aaaaaaaatactcagt

SEQ ID NO: 295055 - DNA, 16 bp, C. familiaris
aaaaaaaatcacagtg

SEQ ID NO: 295056 - DNA, 16 bp, C. familiaris
aaaaaaaatcactatg

SEQ ID NO: 295057 - DNA, 16 bp, C. familiaris
aaaaaaaatcactgca

SEQ ID NO: 295058 - DNA, 16 bp, C. familiaris
aaaaaaaatcagttac

SEQ ID NO: 295059 - DNA, 16 bp, C. familiaris
aaaaaaaatcattttg

SEQ ID NO: 295060 - DNA, 16 bp, C. familiaris
aaaaaaaatctagtta

SEQ ID NO: 295061 - DNA, 16 bp, C. familiaris
aaaaaaaatctctgcc

SEQ ID NO: 295062 - DNA, 16 bp, C. familiaris
aaaaaaaatctttcag

SEQ ID NO: 295063 - DNA, 16 bp, C. familiaris
aaaaaaaatctttgct

SEQ ID NO: 295064 - DNA, 16 bp, C. familiaris
aaaaaaaatgaatgct

SEQ ID NO: 295065 - DNA, 16 bp, C. familiaris
aaaaaaaatgatctga

SEQ ID NO: 295066 - DNA, 16 bp, C. familiaris
aaaaaaaatgctaatt

SEQ ID NO: 295067 - DNA, 16 bp, C. familiaris
aaaaaaaattagccag

SEQ ID NO: 295068 - DNA, 16 bp, C. familiaris
aaaaaaaattcagtgg

SEQ ID NO: 295069 - DNA, 16 bp, C. familiaris
aaaaaaaattctgtaa

SEQ ID NO: 295070 - DNA, 16 bp, C. familiaris
aaaaaaaatttatctg

SEQ ID NO: 295071 - DNA, 16 bp, C. familiaris
aaaaaaaatttcagca

SEQ ID NO: 295072 - DNA, 16 bp, C. familiaris
aaaaaaacattgaatt

SEQ ID NO: 295073 - DNA, 16 bp, C. familiaris
aaaaaaacatttctca

SEQ ID NO: 295074 - DNA, 16 bp, C. familiaris
aaaaaaaccatttttt

SEQ ID NO: 295075 - DNA, 16 bp, C. familiaris
aaaaaaaccctacaga

SEQ ID NO: 295076 - DNA, 16 bp, C. familiaris
aaaaaaacctctgaaa

SEQ ID NO: 295077 - DNA, 16 bp, C. familiaris
aaaaaaacctgaaatt

SEQ ID NO: 295078 - DNA, 16 bp, C. familiaris
aaaaaaactgaagatg

SEQ ID NO: 295079 - DNA, 16 bp, C. familiaris
aaaaaaagaaaggctg

SEQ ID NO: 295080 - DNA, 16 bp, C. familiaris
aaaaaaagaaatcctt

SEQ ID NO: 295081 - DNA, 16 bp, C. familiaris
aaaaaaagaaatggcc

SEQ ID NO: 295082 - DNA, 16 bp, C. familiaris
aaaaaaagaaatgtcc

SEQ ID NO: 295083 - DNA, 16 bp, C. familiaris
aaaaaaagaaattctc

SEQ ID NO: 295084 - DNA, 16 bp, C. familiaris
aaaaaaagaacatttt

SEQ ID NO: 295085 - DNA, 16 bp, C. familiaris
aaaaaaagaactctct

SEQ ID NO: 295086 - DNA, 16 bp, C. familiaris
aaaaaaagaactgatt

SEQ ID NO: 295087 - DNA, 16 bp, C. familiaris
aaaaaaagaagtcttt

SEQ ID NO: 295088 - DNA, 16 bp, C. familiaris
aaaaaaagaatactgg

SEQ ID NO: 295089 - DNA, 16 bp, C. familiaris
aaaaaaagaatagctt

SEQ ID NO: 295090 - DNA, 16 bp, C. familiaris
aaaaaaagaatcctcc

SEQ ID NO: 295091 - DNA, 16 bp, C. familiaris
aaaaaaagaatctctc

SEQ ID NO: 295092 - DNA, 16 bp, C. familiaris
aaaaaaagaattttcc

SEQ ID NO: 295093 - DNA, 16 bp, C. familiaris
aaaaaaagacatggag

SEQ ID NO: 295094 - DNA, 16 bp, C. familiaris
aaaaaaagacatttat

SEQ ID NO: 295095 - DNA, 16 bp, C. familiaris
aaaaaaagacccatct

SEQ ID NO: 295096 - DNA, 16 bp, C. familiaris
aaaaaaagactggaga

SEQ ID NO: 295097 - DNA, 16 bp, C. familiaris
aaaaaaagactttcat

SEQ ID NO: 295098 - DNA, 16 bp, C. familiaris
aaaaaaagagagactt

SEQ ID NO: 295099 - DNA, 16 bp, C. familiaris
aaaaaaagatctggaa

SEQ ID NO: 295100 - DNA, 16 bp, C. familiaris
aaaaaaagatcttcat

SEQ ID NO: 295101 - DNA, 16 bp, C. familiaris
aaaaaaagatgattct

SEQ ID NO: 295102 - DNA, 16 bp, C. familiaris
aaaaaaagatgcagag

SEQ ID NO: 295103 - DNA, 16 bp, C. familiaris
aaaaaaagatttccaa

SEQ ID NO: 295104 - DNA, 16 bp, C. familiaris
aaaaaaagatttcttt

SEQ ID NO: 295105 - DNA, 16 bp, C. familiaris
aaaaaaagcattttca

SEQ ID NO: 295106 - DNA, 16 bp, C. familiaris
aaaaaaaggaaactgt

SEQ ID NO: 295107 - DNA, 16 bp, C. familiaris
aaaaaaaggaagagct

SEQ ID NO: 295108 - DNA, 16 bp, C. familiaris
aaaaaaaggaatatgc

SEQ ID NO: 295109 - DNA, 16 bp, C. familiaris
aaaaaaaggaatggca

SEQ ID NO: 295110 - DNA, 16 bp, C. familiaris
aaaaaaaggaattctt

SEQ ID NO: 295111 - DNA, 16 bp, C. familiaris
aaaaaaaggcagattt

SEQ ID NO: 295112 - DNA, 16 bp, C. familiaris
aaaaaaagtatttcct

SEQ ID NO: 295113 - DNA, 16 bp, C. familiaris
aaaaaaagtatttctt

SEQ ID NO: 295114 - DNA, 16 bp, C. familiaris
aaaaaaagtcctttaa

SEQ ID NO: 295115 - DNA, 16 bp, C. familiaris
aaaaaaagtcttaatt

SEQ ID NO: 295116 - DNA, 16 bp, C. familiaris
aaaaaaagtcttttga

SEQ ID NO: 295117 - DNA, 16 bp, C. familiaris
aaaaaaatattttgct

SEQ ID NO: 295118 - DNA, 16 bp, C. familiaris
aaaaaaatcaaggttt

SEQ ID NO: 295119 - DNA, 16 bp, C. familiaris
aaaaaaatcaagtctt

SEQ ID NO: 295120 - DNA, 16 bp, C. familiaris
aaaaaaatcacaagtc

SEQ ID NO: 295121 - DNA, 16 bp, C. familiaris
aaaaaaatcagacatt

SEQ ID NO: 295122 - DNA, 16 bp, C. familiaris
aaaaaaatcagcatat

SEQ ID NO: 295123 - DNA, 16 bp, C. familiaris
aaaaaaatcagcttct

SEQ ID NO: 295124 - DNA, 16 bp, C. familiaris
aaaaaaatcagtttgt

SEQ ID NO: 295125 - DNA, 16 bp, C. familiaris
aaaaaaatcatctttt

SEQ ID NO: 295126 - DNA, 16 bp, C. familiaris
aaaaaaatccccttta

SEQ ID NO: 295127 - DNA, 16 bp, C. familiaris
aaaaaaatccttcaga

SEQ ID NO: 295128 - DNA, 16 bp, C. familiaris
aaaaaaatctactttt

SEQ ID NO: 295129 - DNA, 16 bp, C. familiaris
aaaaaaatctagtatt

SEQ ID NO: 295130 - DNA, 16 bp, C. familiaris
aaaaaaatctcccaag

SEQ ID NO: 295131 - DNA, 16 bp, C. familiaris
aaaaaaatctctcttc

SEQ ID NO: 295132 - DNA, 16 bp, C. familiaris
aaaaaaatctctggaa

SEQ ID NO: 295133 - DNA, 16 bp, C. familiaris
aaaaaaatctgcattt

SEQ ID NO: 295134 - DNA, 16 bp, C. familiaris
aaaaaaatcttacttt

SEQ ID NO: 295135 - DNA, 16 bp, C. familiaris
aaaaaaatcttcagag

SEQ ID NO: 295136 - DNA, 16 bp, C. familiaris
aaaaaaatcttcctaa

SEQ ID NO: 295137 - DNA, 16 bp, C. familiaris
aaaaaaatcttttcac

SEQ ID NO: 295138 - DNA, 16 bp, C. familiaris
aaaaaaatgaaacttt

SEQ ID NO: 295139 - DNA, 16 bp, C. familiaris
aaaaaaatgagttttt

SEQ ID NO: 295140 - DNA, 16 bp, C. familiaris
aaaaaaatgtatattc

SEQ ID NO: 295141 - DNA, 16 bp, C. familiaris
aaaaaaatgtatctct

SEQ ID NO: 295142 - DNA, 16 bp, C. familiaris
aaaaaaatgtatcttt

SEQ ID NO: 295143 - DNA, 16 bp, C. familiaris
aaaaaaatgtcttcta

SEQ ID NO: 295144 - DNA, 16 bp, C. familiaris
aaaaaaatgtttaact

SEQ ID NO: 295145 - DNA, 16 bp, C. familiaris
aaaaaaattccaggaa

SEQ ID NO: 295146 - DNA, 16 bp, C. familiaris
aaaaaaattcccagaa

SEQ ID NO: 295147 - DNA, 16 bp, C. familiaris
aaaaaaattctggaga

SEQ ID NO: 295148 - DNA, 16 bp, C. familiaris
aaaaaaattctttact

SEQ ID NO: 295149 - DNA, 16 bp, C. familiaris
aaaaaaattttgttct

SEQ ID NO: 295150 - DNA, 16 bp, C. familiaris
aaaaaacaaaactgtt

SEQ ID NO: 295151 - DNA, 16 bp, C. familiaris
aaaaaacaagagcttt

SEQ ID NO: 295152 - DNA, 16 bp, C. familiaris
aaaaaacaatgttttt

SEQ ID NO: 295153 - DNA, 16 bp, C. familiaris
aaaaaacatgttttat

SEQ ID NO: 295154 - DNA, 16 bp, C. familiaris
aaaaaacattgaattg

SEQ ID NO: 295155 - DNA, 16 bp, C. familiaris
aaaaaacattttgaag

SEQ ID NO: 295156 - DNA, 16 bp, C. familiaris
aaaaaacccaaatgtc

SEQ ID NO: 295157 - DNA, 16 bp, C. familiaris
aaaaaacccacaaatg

SEQ ID NO: 295158 - DNA, 16 bp, C. familiaris
aaaaaaccccagaaat

SEQ ID NO: 295159 - DNA, 16 bp, C. familiaris
aaaaaacctcaaaatg

SEQ ID NO: 295160 - DNA, 16 bp, C. familiaris
aaaaaacctgtcaacc

SEQ ID NO: 295161 - DNA, 16 bp, C. familiaris
aaaaaacctgttagaa

SEQ ID NO: 295162 - DNA, 16 bp, C. familiaris
aaaaaactattttctt

SEQ ID NO: 295163 - DNA, 16 bp, C. familiaris
aaaaaactgctaaaac

SEQ ID NO: 295164 - DNA, 16 bp, C. familiaris
aaaaaagaaaactgtc

SEQ ID NO: 295165 - DNA, 16 bp, C. familiaris
aaaaaagaaaatcctt

SEQ ID NO: 295166 - DNA, 16 bp, C. familiaris
aaaaaagaaaatggct

SEQ ID NO: 295167 - DNA, 16 bp, C. familiaris
aaaaaagaaaccttat

SEQ ID NO: 295168 - DNA, 16 bp, C. familiaris
aaaaaagaaacttttg

SEQ ID NO: 295169 - DNA, 16 bp, C. familiaris
aaaaaagaaagcagtt

SEQ ID NO: 295170 - DNA, 16 bp, C. familiaris
aaaaaagaaagtattc

SEQ ID NO: 295171 - DNA, 16 bp, C. familiaris
aaaaaagaaagttctt

SEQ ID NO: 295172 - DNA, 16 bp, C. familiaris
aaaaaagaaatacttc

SEQ ID NO: 295173 - DNA, 16 bp, C. familiaris
aaaaaagaaatcttat

SEQ ID NO: 295174 - DNA, 16 bp, C. familiaris
aaaaaagaaatgcatg

SEQ ID NO: 295175 - DNA, 16 bp, C. familiaris
aaaaaagaacatcttt

SEQ ID NO: 295176 - DNA, 16 bp, C. familiaris
aaaaaagaagaagcct

SEQ ID NO: 295177 - DNA, 16 bp, C. familiaris
aaaaaagaatagatct

SEQ ID NO: 295178 - DNA, 16 bp, C. familiaris
aaaaaagaatattctg

SEQ ID NO: 295179 - DNA, 16 bp, C. familiaris
aaaaaagaatcaagtg

SEQ ID NO: 295180 - DNA, 16 bp, C. familiaris
aaaaaagaatcacatg

SEQ ID NO: 295181 - DNA, 16 bp, C. familiaris
aaaaaagaatcacttt

SEQ ID NO: 295182 - DNA, 16 bp, C. familiaris
aaaaaagaatggccaa

SEQ ID NO: 295183 - DNA, 16 bp, C. familiaris
aaaaaagaatgtgttt

SEQ ID NO: 295184 - DNA, 16 bp, C. familiaris
aaaaaagaattatcca

SEQ ID NO: 295185 - DNA, 16 bp, C. familiaris
aaaaaagacagcctct

SEQ ID NO: 295186 - DNA, 16 bp, C. familiaris
aaaaaagacattttca

SEQ ID NO: 295187 - DNA, 16 bp, C. familiaris
aaaaaagagtacatac

SEQ ID NO: 295188 - DNA, 16 bp, C. familiaris
aaaaaagattctattt

SEQ ID NO: 295189 - DNA, 16 bp, C. familiaris
aaaaaagattctgaaa

SEQ ID NO: 295190 - DNA, 16 bp, C. familiaris
aaaaaagatttttgtt

SEQ ID NO: 295191 - DNA, 16 bp, C. familiaris
aaaaaagcacttgaca

SEQ ID NO: 295192 - DNA, 16 bp, C. familiaris
aaaaaagcattttaaa

SEQ ID NO: 295193 - DNA, 16 bp, C. familiaris
aaaaaagcccagatct

SEQ ID NO: 295194 - DNA, 16 bp, C. familiaris
aaaaaagctattagaa

SEQ ID NO: 295195 - DNA, 16 bp, C. familiaris
aaaaaagctttcaaaa

SEQ ID NO: 295196 - DNA, 16 bp, C. familiaris
aaaaaaggaaatgtgt

SEQ ID NO: 295197 - DNA, 16 bp, C. familiaris
aaaaaaggaaattcag

SEQ ID NO: 295198 - DNA, 16 bp, C. familiaris
aaaaaaggaatattct

SEQ ID NO: 295199 - DNA, 16 bp, C. familiaris
aaaaaaggaatctgaa

SEQ ID NO: 295200 - DNA, 16 bp, C. familiaris
aaaaaaggcaaatgat

SEQ ID NO: 295201 - DNA, 16 bp, C. familiaris
aaaaaagggaaatcct

SEQ ID NO: 295202 - DNA, 16 bp, C. familiaris
aaaaaaggtttttttg

SEQ ID NO: 295203 - DNA, 16 bp, C. familiaris
aaaaaagtattttcat

SEQ ID NO: 295204 - DNA, 16 bp, C. familiaris
aaaaaagtcaatcaga

SEQ ID NO: 295205 - DNA, 16 bp, C. familiaris
aaaaaagtcagaaatg

SEQ ID NO: 295206 - DNA, 16 bp, C. familiaris
aaaaaagtggaagaca

SEQ ID NO: 295207 - DNA, 16 bp, C. familiaris
aaaaaagttacatttt

SEQ ID NO: 295208 - DNA, 16 bp, C. familiaris
aaaaaagttttcaaaa

SEQ ID NO: 295209 - DNA, 16 bp, C. familiaris
aaaaaataaagacttt

SEQ ID NO: 295210 - DNA, 16 bp, C. familiaris
aaaaaataaagcattt

SEQ ID NO: 295211 - DNA, 16 bp, C. familiaris
aaaaaataaagtcagt

SEQ ID NO: 295212 - DNA, 16 bp, C. familiaris
aaaaaataaagtcctt

SEQ ID NO: 295213 - DNA, 16 bp, C. familiaris
aaaaaataaagtgcta

SEQ ID NO: 295214 - DNA, 16 bp, C. familiaris
aaaaaataaatcactg

SEQ ID NO: 295215 - DNA, 16 bp, C. familiaris
aaaaaataaatccttg

SEQ ID NO: 295216 - DNA, 16 bp, C. familiaris
aaaaaataaattcagt

SEQ ID NO: 295217 - DNA, 16 bp, C. familiaris
aaaaaataacaagtgt

SEQ ID NO: 295218 - DNA, 16 bp, C. familiaris
aaaaaataagacattt

SEQ ID NO: 295219 - DNA, 16 bp, C. familiaris
aaaaaataagcaattt

SEQ ID NO: 295220 - DNA, 16 bp, C. familiaris
aaaaaataagttttca

SEQ ID NO: 295221 - DNA, 16 bp, C. familiaris
aaaaaataatgtttca

SEQ ID NO: 295222 - DNA, 16 bp, C. familiaris
aaaaaatacatttctg

SEQ ID NO: 295223 - DNA, 16 bp, C. familiaris
aaaaaatacatttgaa

SEQ ID NO: 295224 - DNA, 16 bp, C. familiaris
aaaaaatactttaaag

SEQ ID NO: 295225 - DNA, 16 bp, C. familiaris
aaaaaatactttgaaa

SEQ ID NO: 295226 - DNA, 16 bp, C. familiaris
aaaaaatatgaacttt

SEQ ID NO: 295227 - DNA, 16 bp, C. familiaris
aaaaaatatgtatgtg

SEQ ID NO: 295228 - DNA, 16 bp, C. familiaris
aaaaaatatgtgaagt

SEQ ID NO: 295229 - DNA, 16 bp, C. familiaris
aaaaaatcaagttctt

SEQ ID NO: 295230 - DNA, 16 bp, C. familiaris
aaaaaatcacattttc

SEQ ID NO: 295231 - DNA, 16 bp, C. familiaris
aaaaaatcacttgaaa

SEQ ID NO: 295232 - DNA, 16 bp, C. familiaris
aaaaaatcagagaagg

SEQ ID NO: 295233 - DNA, 16 bp, C. familiaris
aaaaaatcagctgata

SEQ ID NO: 295234 - DNA, 16 bp, C. familiaris
aaaaaatcagctttta

SEQ ID NO: 295235 - DNA, 16 bp, C. familiaris
aaaaaatcagtgaaac

SEQ ID NO: 295236 - DNA, 16 bp, C. familiaris
aaaaaatcatagctga

SEQ ID NO: 295237 - DNA, 16 bp, C. familiaris
aaaaaatcattatttg

SEQ ID NO: 295238 - DNA, 16 bp, C. familiaris
aaaaaatcattggaaa

SEQ ID NO: 295239 - DNA, 16 bp, C. familiaris
aaaaaatcatttttca

SEQ ID NO: 295240 - DNA, 16 bp, C. familiaris
aaaaaatctcaacaag

SEQ ID NO: 295241 - DNA, 16 bp, C. familiaris
aaaaaatctcaatttt

SEQ ID NO: 295242 - DNA, 16 bp, C. familiaris
aaaaaatctgggatcc

SEQ ID NO: 295243 - DNA, 16 bp, C. familiaris
aaaaaatcttttaaga

SEQ ID NO: 295244 - DNA, 16 bp, C. familiaris
aaaaaatgaatgaact

SEQ ID NO: 295245 - DNA, 16 bp, C. familiaris
aaaaaatggacaaatt

SEQ ID NO: 295246 - DNA, 16 bp, C. familiaris
aaaaaatggtccagtt

SEQ ID NO: 295247 - DNA, 16 bp, C. familiaris
aaaaaatgtatttcat

SEQ ID NO: 295248 - DNA, 16 bp, C. familiaris
aaaaaatgtgtgtatg

SEQ ID NO: 295249 - DNA, 16 bp, C. familiaris
aaaaaatgtgttgttt

SEQ ID NO: 295250 - DNA, 16 bp, C. familiaris
aaaaaatgttaaacat

SEQ ID NO: 295251 - DNA, 16 bp, C. familiaris
aaaaaatgtttacata

SEQ ID NO: 295252 - DNA, 16 bp, C. familiaris
aaaaaatgtttgaaag

SEQ ID NO: 295253 - DNA, 16 bp, C. familiaris
aaaaaatgttttctaa

SEQ ID NO: 295254 - DNA, 16 bp, C. familiaris
aaaaaattaaaatctg

SEQ ID NO: 295255 - DNA, 16 bp, C. familiaris
aaaaaattaaagcagc

SEQ ID NO: 295256 - DNA, 16 bp, C. familiaris
aaaaaattaagtcaga

SEQ ID NO: 295257 - DNA, 16 bp, C. familiaris
aaaaaattatctactt

SEQ ID NO: 295258 - DNA, 16 bp, C. familiaris
aaaaaattatttcaag

SEQ ID NO: 295259 - DNA, 16 bp, C. familiaris
aaaaaattatttcttg

SEQ ID NO: 295260 - DNA, 16 bp, C. familiaris
aaaaaattcagaattt

SEQ ID NO: 295261 - DNA, 16 bp, C. familiaris
aaaaaattctaaaagt

SEQ ID NO: 295262 - DNA, 16 bp, C. familiaris
aaaaaattgtctttaa

SEQ ID NO: 295263 - DNA, 16 bp, C. familiaris
aaaaaatttactttct

SEQ ID NO: 295264 - DNA, 16 bp, C. familiaris
aaaaaatttcccccaa

SEQ ID NO: 295265 - DNA, 16 bp, C. familiaris
aaaaaatttgtttttg

SEQ ID NO: 295266 - DNA, 16 bp, C. familiaris
aaaaacaaaacctctt

SEQ ID NO: 295267 - DNA, 16 bp, C. familiaris
aaaaacaaaactttga

SEQ ID NO: 295268 - DNA, 16 bp, C. familiaris
aaaaacaaacatttgt

SEQ ID NO: 295269 - DNA, 16 bp, C. familiaris
aaaaacaaaccctgaa

SEQ ID NO: 295270 - DNA, 16 bp, C. familiaris
aaaaacaaagatttat

SEQ ID NO: 295271 - DNA, 16 bp, C. familiaris
aaaaacaaagtcattt

SEQ ID NO: 295272 - DNA, 16 bp, C. familiaris
aaaaacaaatggaagt

SEQ ID NO: 295273 - DNA, 16 bp, C. familiaris
aaaaacaactaatgga

SEQ ID NO: 295274 - DNA, 16 bp, C. familiaris
aaaaacaagaatattt

SEQ ID NO: 295275 - DNA, 16 bp, C. familiaris
aaaaacaagttatatt

SEQ ID NO: 295276 - DNA, 16 bp, C. familiaris
aaaaacagaatttgaa

SEQ ID NO: 295277 - DNA, 16 bp, C. familiaris
aaaaacagactctttt

SEQ ID NO: 295278 - DNA, 16 bp, C. familiaris
aaaaacagaggatcat

SEQ ID NO: 295279 - DNA, 16 bp, C. familiaris
aaaaacagcagcagca

SEQ ID NO: 295280 - DNA, 16 bp, C. familiaris
aaaaacagctttattt

SEQ ID NO: 295281 - DNA, 16 bp, C. familiaris
aaaaacagttttcaaa

SEQ ID NO: 295282 - DNA, 16 bp, C. familiaris
aaaaacataattttct

SEQ ID NO: 295283 - DNA, 16 bp, C. familiaris
aaaaacatgcaaaact

SEQ ID NO: 295284 - DNA, 16 bp, C. familiaris
aaaaacatgttatttt

SEQ ID NO: 295285 - DNA, 16 bp, C. familiaris
aaaaacattcaaaatg

SEQ ID NO: 295286 - DNA, 16 bp, C. familiaris
aaaaacatttgataaa

SEQ ID NO: 295287 - DNA, 16 bp, C. familiaris
aaaaaccataatgaga

SEQ ID NO: 295288 - DNA, 16 bp, C. familiaris
aaaaaccatgtgatca

SEQ ID NO: 295289 - DNA, 16 bp, C. familiaris
aaaaacccacagaatt

SEQ ID NO: 295290 - DNA, 16 bp, C. familiaris
aaaaacccacattttt

SEQ ID NO: 295291 - DNA, 16 bp, C. familiaris
aaaaaccccacaaatg

SEQ ID NO: 295292 - DNA, 16 bp, C. familiaris
aaaaaccctgaaaata

SEQ ID NO: 295293 - DNA, 16 bp, C. familiaris
aaaaaccttccaagac

SEQ ID NO: 295294 - DNA, 16 bp, C. familiaris
aaaaacctttcctttt

SEQ ID NO: 295295 - DNA, 16 bp, C. familiaris
aaaaactaaaggaatt

SEQ ID NO: 295296 - DNA, 16 bp, C. familiaris
aaaaactatttttgtt

SEQ ID NO: 295297 - DNA, 16 bp, C. familiaris
aaaaactcctagaaga

SEQ ID NO: 295298 - DNA, 16 bp, C. familiaris
aaaaactgaactgaaa

SEQ ID NO: 295299 - DNA, 16 bp, C. familiaris
aaaaactgagagtttt

SEQ ID NO: 295300 - DNA, 16 bp, C. familiaris
aaaaactgaggaaatt

SEQ ID NO: 295301 - DNA, 16 bp, C. familiaris
aaaaactgcttttttt

SEQ ID NO: 295302 - DNA, 16 bp, C. familiaris
aaaaactggaaaaact

SEQ ID NO: 295303 - DNA, 16 bp, C. familiaris
aaaaactggaaagaat

SEQ ID NO: 295304 - DNA, 16 bp, C. familiaris
aaaaactggagaaaat

SEQ ID NO: 295305 - DNA, 16 bp, C. familiaris
aaaaactggatattca

SEQ ID NO: 295306 - DNA, 16 bp, C. familiaris
aaaaactgtcacaaga

SEQ ID NO: 295307 - DNA, 16 bp, C. familiaris
aaaaacttgaaattaa

SEQ ID NO: 295308 - DNA, 16 bp, C. familiaris
aaaaacttgaacataa

SEQ ID NO: 295309 - DNA, 16 bp, C. familiaris
aaaaacttgatttttt

SEQ ID NO: 295310 - DNA, 16 bp, C. familiaris
aaaaacttggagaaaa

SEQ ID NO: 295311 - DNA, 16 bp, C. familiaris
aaaaactttaaagaat

SEQ ID NO: 295312 - DNA, 16 bp, C. familiaris
aaaaacttttcttcta

SEQ ID NO: 295313 - DNA, 16 bp, C. familiaris
aaaaagaaaaagcctt

SEQ ID NO: 295314 - DNA, 16 bp, C. familiaris
aaaaagaaaacctcat

SEQ ID NO: 295315 - DNA, 16 bp, C. familiaris
aaaaagaaaaggattc

SEQ ID NO: 295316 - DNA, 16 bp, C. familiaris
aaaaagaaaatccagg

SEQ ID NO: 295317 - DNA, 16 bp, C. familiaris
aaaaagaaaatcctca

SEQ ID NO: 295318 - DNA, 16 bp, C. familiaris
aaaaagaaaatcttta

SEQ ID NO: 295319 - DNA, 16 bp, C. familiaris
aaaaagaaaatgatct

SEQ ID NO: 295320 - DNA, 16 bp, C. familiaris
aaaaagaaaatgcagt

SEQ ID NO: 295321 - DNA, 16 bp, C. familiaris
aaaaagaaaatgtctg

SEQ ID NO: 295322 - DNA, 16 bp, C. familiaris
aaaaagaaaattcagc

SEQ ID NO: 295323 - DNA, 16 bp, C. familiaris
aaaaagaaaattgctg

SEQ ID NO: 295324 - DNA, 16 bp, C. familiaris
aaaaagaaacactttt

SEQ ID NO: 295325 - DNA, 16 bp, C. familiaris
aaaaagaaactccata

SEQ ID NO: 295326 - DNA, 16 bp, C. familiaris
aaaaagaaactggaat

SEQ ID NO: 295327 - DNA, 16 bp, C. familiaris
aaaaagaaacttttct

SEQ ID NO: 295328 - DNA, 16 bp, C. familiaris
aaaaagaaagatcttg

SEQ ID NO: 295329 - DNA, 16 bp, C. familiaris
aaaaagaaatactttc

SEQ ID NO: 295330 - DNA, 16 bp, C. familiaris
aaaaagaaatatttct

SEQ ID NO: 295331 - DNA, 16 bp, C. familiaris
aaaaagaaatcccaga

SEQ ID NO: 295332 - DNA, 16 bp, C. familiaris
aaaaagaaatctcttc

SEQ ID NO: 295333 - DNA, 16 bp, C. familiaris
aaaaagaaatctggaa

SEQ ID NO: 295334 - DNA, 16 bp, C. familiaris
aaaaagaaattctgta

SEQ ID NO: 295335 - DNA, 16 bp, C. familiaris
aaaaagaaattctttt

SEQ ID NO: 295336 - DNA, 16 bp, C. familiaris
aaaaagaaatttcaag

SEQ ID NO: 295337 - DNA, 16 bp, C. familiaris
aaaaagaaatttcaga

SEQ ID NO: 295338 - DNA, 16 bp, C. familiaris
aaaaagaaatttcctg

SEQ ID NO: 295339 - DNA, 16 bp, C. familiaris
aaaaagaaattttgga

SEQ ID NO: 295340 - DNA, 16 bp, C. familiaris
aaaaagaaatttttct

SEQ ID NO: 295341 - DNA, 16 bp, C. familiaris
aaaaagaacaaagctg

SEQ ID NO: 295342 - DNA, 16 bp, C. familiaris
aaaaagaacatttcat

SEQ ID NO: 295343 - DNA, 16 bp, C. familiaris
aaaaagaacattttaa

SEQ ID NO: 295344 - DNA, 16 bp, C. familiaris
aaaaagaacattttca

SEQ ID NO: 295345 - DNA, 16 bp, C. familiaris
aaaaagaatatatcat

SEQ ID NO: 295346 - DNA, 16 bp, C. familiaris
aaaaagaatatattct

SEQ ID NO: 295347 - DNA, 16 bp, C. familiaris
aaaaagaatattctct

SEQ ID NO: 295348 - DNA, 16 bp, C. familiaris
aaaaagaatccatgaa

SEQ ID NO: 295349 - DNA, 16 bp, C. familiaris
aaaaagaattacagac

SEQ ID NO: 295350 - DNA, 16 bp, C. familiaris
aaaaagaattatcttt

SEQ ID NO: 295351 - DNA, 16 bp, C. familiaris
aaaaagaattattctt

SEQ ID NO: 295352 - DNA, 16 bp, C. familiaris
aaaaagaattcatttt

SEQ ID NO: 295353 - DNA, 16 bp, C. familiaris
aaaaagaattctgaaa

SEQ ID NO: 295354 - DNA, 16 bp, C. familiaris
aaaaagaattgtattt

SEQ ID NO: 295355 - DNA, 16 bp, C. familiaris
aaaaagaatttcaaga

SEQ ID NO: 295356 - DNA, 16 bp, C. familiaris
aaaaagaatttggaag

SEQ ID NO: 295357 - DNA, 16 bp, C. familiaris
aaaaagaattttttga

SEQ ID NO: 295358 - DNA, 16 bp, C. familiaris
aaaaagacaaatgcta

SEQ ID NO: 295359 - DNA, 16 bp, C. familiaris
aaaaagacaagtgttg

SEQ ID NO: 295360 - DNA, 16 bp, C. familiaris
aaaaagacaatttctt

SEQ ID NO: 295361 - DNA, 16 bp, C. familiaris
aaaaagacatggaaga

SEQ ID NO: 295362 - DNA, 16 bp, C. familiaris
aaaaagacatggagga

SEQ ID NO: 295363 - DNA, 16 bp, C. familiaris
aaaaagaccatgagga

SEQ ID NO: 295364 - DNA, 16 bp, C. familiaris
aaaaagacttaatttt

SEQ ID NO: 295365 - DNA, 16 bp, C. familiaris
aaaaagacttcattta

SEQ ID NO: 295366 - DNA, 16 bp, C. familiaris
aaaaagactttaaaac

SEQ ID NO: 295367 - DNA, 16 bp, C. familiaris
aaaaagacttttttta

SEQ ID NO: 295368 - DNA, 16 bp, C. familiaris
aaaaagagaaatcttg

SEQ ID NO: 295369 - DNA, 16 bp, C. familiaris
aaaaagagaaatgttt

SEQ ID NO: 295370 - DNA, 16 bp, C. familiaris
aaaaagaggaattttt

SEQ ID NO: 295371 - DNA, 16 bp, C. familiaris
aaaaagatatggtata

SEQ ID NO: 295372 - DNA, 16 bp, C. familiaris
aaaaagatatttcatt

SEQ ID NO: 295373 - DNA, 16 bp, C. familiaris
aaaaagatgtgtgtgt

SEQ ID NO: 295374 - DNA, 16 bp, C. familiaris
aaaaagatgttcaata

SEQ ID NO: 295375 - DNA, 16 bp, C. familiaris
aaaaagatttacaaat

SEQ ID NO: 295376 - DNA, 16 bp, C. familiaris
aaaaagatttatttct

SEQ ID NO: 295377 - DNA, 16 bp, C. familiaris
aaaaagatttttgttt

SEQ ID NO: 295378 - DNA, 16 bp, C. familiaris
aaaaagcaagttgtag

SEQ ID NO: 295379 - DNA, 16 bp, C. familiaris
aaaaagcaatgaaatt

SEQ ID NO: 295380 - DNA, 16 bp, C. familiaris
aaaaagcacagaaatg

SEQ ID NO: 295381 - DNA, 16 bp, C. familiaris
aaaaagcatccagtgg

SEQ ID NO: 295382 - DNA, 16 bp, C. familiaris
aaaaagccaaactcat

SEQ ID NO: 295383 - DNA, 16 bp, C. familiaris
aaaaagcttatttttt

SEQ ID NO: 295384 - DNA, 16 bp, C. familiaris
aaaaagctttttcttt

SEQ ID NO: 295385 - DNA, 16 bp, C. familiaris
aaaaaggaaaatcctt

SEQ ID NO: 295386 - DNA, 16 bp, C. familiaris
aaaaaggaaacatttt

SEQ ID NO: 295387 - DNA, 16 bp, C. familiaris
aaaaaggaagaaatct

SEQ ID NO: 295388 - DNA, 16 bp, C. familiaris
aaaaaggaatttcttt

SEQ ID NO: 295389 - DNA, 16 bp, C. familiaris
aaaaaggatacatttt

SEQ ID NO: 295390 - DNA, 16 bp, C. familiaris
aaaaaggcaaatattg

SEQ ID NO: 295391 - DNA, 16 bp, C. familiaris
aaaaaggcaaatgatg

SEQ ID NO: 295392 - DNA, 16 bp, C. familiaris
aaaaaggcaagagata

SEQ ID NO: 295393 - DNA, 16 bp, C. familiaris
aaaaaggcatttaaaa

SEQ ID NO: 295394 - DNA, 16 bp, C. familiaris
aaaaaggcttttaaaa

SEQ ID NO: 295395 - DNA, 16 bp, C. familiaris
aaaaagggaaattatt

SEQ ID NO: 295396 - DNA, 16 bp, C. familiaris
aaaaaggtgatgggga

SEQ ID NO: 295397 - DNA, 16 bp, C. familiaris
aaaaagtagaagcaac

SEQ ID NO: 295398 - DNA, 16 bp, C. familiaris
aaaaagtcattttttt

SEQ ID NO: 295399 - DNA, 16 bp, C. familiaris
aaaaagtctcttcaac

SEQ ID NO: 295400 - DNA, 16 bp, C. familiaris
aaaaagtgaaattctt

SEQ ID NO: 295401 - DNA, 16 bp, C. familiaris
aaaaagtggaaacaat

SEQ ID NO: 295402 - DNA, 16 bp, C. familiaris
aaaaagtgtctttttt

SEQ ID NO: 295403 - DNA, 16 bp, C. familiaris
aaaaagtttatttgaa

SEQ ID NO: 295404 - DNA, 16 bp, C. familiaris
aaaaagtttgaaaaac

SEQ ID NO: 295405 - DNA, 16 bp, C. familiaris
aaaaagtttgacaaaa

SEQ ID NO: 295406 - DNA, 16 bp, C. familiaris
aaaaagttttattttg

SEQ ID NO: 295407 - DNA, 16 bp, C. familiaris
aaaaagttttttgaaa

SEQ ID NO: 295408 - DNA, 16 bp, C. familiaris
aaaaataaaaactgct

SEQ ID NO: 295409 - DNA, 16 bp, C. familiaris
aaaaataaaactttga

SEQ ID NO: 295410 - DNA, 16 bp, C. familiaris
aaaaataaaagcactg

SEQ ID NO: 295411 - DNA, 16 bp, C. familiaris
aaaaataaaattggca

SEQ ID NO: 295412 - DNA, 16 bp, C. familiaris
aaaaataaaccactgg

SEQ ID NO: 295413 - DNA, 16 bp, C. familiaris
aaaaataaagaagctg

SEQ ID NO: 295414 - DNA, 16 bp, C. familiaris
aaaaataaagatcatt

SEQ ID NO: 295415 - DNA, 16 bp, C. familiaris
aaaaataaagattctg

SEQ ID NO: 295416 - DNA, 16 bp, C. familiaris
aaaaataaagctatta

SEQ ID NO: 295417 - DNA, 16 bp, C. familiaris
aaaaataaagtaactt

SEQ ID NO: 295418 - DNA, 16 bp, C. familiaris
aaaaataaagtcttaa

SEQ ID NO: 295419 - DNA, 16 bp, C. familiaris
aaaaataaagtggatt

SEQ ID NO: 295420 - DNA, 16 bp, C. familiaris
aaaaataaagtgtgtg

SEQ ID NO: 295421 - DNA, 16 bp, C. familiaris
aaaaataaatctttgg

SEQ ID NO: 295422 - DNA, 16 bp, C. familiaris
aaaaataaattcttgt

SEQ ID NO: 295423 - DNA, 16 bp, C. familiaris
aaaaataagctttatt

SEQ ID NO: 295424 - DNA, 16 bp, C. familiaris
aaaaatacaaaggatt

SEQ ID NO: 295425 - DNA, 16 bp, C. familiaris
aaaaatacactggatg

SEQ ID NO: 295426 - DNA, 16 bp, C. familiaris
aaaaataccatttgat

SEQ ID NO: 295427 - DNA, 16 bp, C. familiaris
aaaaatacttgaagaa

SEQ ID NO: 295428 - DNA, 16 bp, C. familiaris
aaaaatactttaactg

SEQ ID NO: 295429 - DNA, 16 bp, C. familiaris
aaaaatactttaagaa

SEQ ID NO: 295430 - DNA, 16 bp, C. familiaris
aaaaatactttcattt

SEQ ID NO: 295431 - DNA, 16 bp, C. familiaris
aaaaatacttttcttt

SEQ ID NO: 295432 - DNA, 16 bp, C. familiaris
aaaaatagaaactgta

SEQ ID NO: 295433 - DNA, 16 bp, C. familiaris
aaaaatagatttttag

SEQ ID NO: 295434 - DNA, 16 bp, C. familiaris
aaaaataggcaaatga

SEQ ID NO: 295435 - DNA, 16 bp, C. familiaris
aaaaataggcagaaga

SEQ ID NO: 295436 - DNA, 16 bp, C. familiaris
aaaaatataaagcttt

SEQ ID NO: 295437 - DNA, 16 bp, C. familiaris
aaaaatataaatctgt

SEQ ID NO: 295438 - DNA, 16 bp, C. familiaris
aaaaatatatctgaaa

SEQ ID NO: 295439 - DNA, 16 bp, C. familiaris
aaaaatatatctgcat

SEQ ID NO: 295440 - DNA, 16 bp, C. familiaris
aaaaatatatcttttg

SEQ ID NO: 295441 - DNA, 16 bp, C. familiaris
aaaaatatattgcaaa

SEQ ID NO: 295442 - DNA, 16 bp, C. familiaris
aaaaatatctgttgaa

SEQ ID NO: 295443 - DNA, 16 bp, C. familiaris
aaaaatatgaacattt

SEQ ID NO: 295444 - DNA, 16 bp, C. familiaris
aaaaatatgatttttg

SEQ ID NO: 295445 - DNA, 16 bp, C. familiaris
aaaaatatgttttcct

SEQ ID NO: 295446 - DNA, 16 bp, C. familiaris
aaaaatattctcatta

SEQ ID NO: 295447 - DNA, 16 bp, C. familiaris
aaaaatattgagatca

SEQ ID NO: 295448 - DNA, 16 bp, C. familiaris
aaaaatattgtttctt

SEQ ID NO: 295449 - DNA, 16 bp, C. familiaris
aaaaatatttcagaaa

SEQ ID NO: 295450 - DNA, 16 bp, C. familiaris
aaaaatatttccttaa

SEQ ID NO: 295451 - DNA, 16 bp, C. familiaris
aaaaatatttgtgtgt

SEQ ID NO: 295452 - DNA, 16 bp, C. familiaris
aaaaatatttgttttc

SEQ ID NO: 295453 - DNA, 16 bp, C. familiaris
aaaaatattttaatgg

SEQ ID NO: 295454 - DNA, 16 bp, C. familiaris
aaaaatattttgaact

SEQ ID NO: 295455 - DNA, 16 bp, C. familiaris
aaaaatatttttgagg

SEQ ID NO: 295456 - DNA, 16 bp, C. familiaris
aaaaatatttttgttg

SEQ ID NO: 295457 - DNA, 16 bp, C. familiaris
aaaaatcaacaacttt

SEQ ID NO: 295458 - DNA, 16 bp, C. familiaris
aaaaatcaagagattt

SEQ ID NO: 295459 - DNA, 16 bp, C. familiaris
aaaaatcacaagggaa

SEQ ID NO: 295460 - DNA, 16 bp, C. familiaris
aaaaatcacagatttt

SEQ ID NO: 295461 - DNA, 16 bp, C. familiaris
aaaaatcacttttttt

SEQ ID NO: 295462 - DNA, 16 bp, C. familiaris
aaaaatcagaggaaga

SEQ ID NO: 295463 - DNA, 16 bp, C. familiaris
aaaaatcagagggaga

SEQ ID NO: 295464 - DNA, 16 bp, C. familiaris
aaaaatcagatgctta

SEQ ID NO: 295465 - DNA, 16 bp, C. familiaris
aaaaatcagttgtatt

SEQ ID NO: 295466 - DNA, 16 bp, C. familiaris
aaaaatccaaaagttt

SEQ ID NO: 295467 - DNA, 16 bp, C. familiaris
aaaaatccactgatag

SEQ ID NO: 295468 - DNA, 16 bp, C. familiaris
aaaaatcccaaatgaa

SEQ ID NO: 295469 - DNA, 16 bp, C. familiaris
aaaaatcctttgaaaa

SEQ ID NO: 295470 - DNA, 16 bp, C. familiaris
aaaaatctacattttt

SEQ ID NO: 295471 - DNA, 16 bp, C. familiaris
aaaaatctatgaattc

SEQ ID NO: 295472 - DNA, 16 bp, C. familiaris
aaaaatctcaaatatg

SEQ ID NO: 295473 - DNA, 16 bp, C. familiaris
aaaaatctcccaagaa

SEQ ID NO: 295474 - DNA, 16 bp, C. familiaris
aaaaatctgttaaaaa

SEQ ID NO: 295475 - DNA, 16 bp, C. familiaris
aaaaatctgttttaaa

SEQ ID NO: 295476 - DNA, 16 bp, C. familiaris
aaaaatctgttttctt

SEQ ID NO: 295477 - DNA, 16 bp, C. familiaris
aaaaatcttaatgaaa

SEQ ID NO: 295478 - DNA, 16 bp, C. familiaris
aaaaatcttgaaagca

SEQ ID NO: 295479 - DNA, 16 bp, C. familiaris
aaaaatcttttaaagt

SEQ ID NO: 295480 - DNA, 16 bp, C. familiaris
aaaaatgaaaacttca

SEQ ID NO: 295481 - DNA, 16 bp, C. familiaris
aaaaatgaaacaattt

SEQ ID NO: 295482 - DNA, 16 bp, C. familiaris
aaaaatgaaatattca

SEQ ID NO: 295483 - DNA, 16 bp, C. familiaris
aaaaatgaaccactgg

SEQ ID NO: 295484 - DNA, 16 bp, C. familiaris
aaaaatgaagcagcag

SEQ ID NO: 295485 - DNA, 16 bp, C. familiaris
aaaaatgaagcaggaa

SEQ ID NO: 295486 - DNA, 16 bp, C. familiaris
aaaaatgaatatttct

SEQ ID NO: 295487 - DNA, 16 bp, C. familiaris
aaaaatgagccaaaga

SEQ ID NO: 295488 - DNA, 16 bp, C. familiaris
aaaaatgatgatgata

SEQ ID NO: 295489 - DNA, 16 bp, C. familiaris
aaaaatgattacattt

SEQ ID NO: 295490 - DNA, 16 bp, C. familiaris
aaaaatgattcttttt

SEQ ID NO: 295491 - DNA, 16 bp, C. familiaris
aaaaatgatttctgaa

SEQ ID NO: 295492 - DNA, 16 bp, C. familiaris
aaaaatgcagattcct

SEQ ID NO: 295493 - DNA, 16 bp, C. familiaris
aaaaatgcagatttct

SEQ ID NO: 295494 - DNA, 16 bp, C. familiaris
aaaaatgcatttaata

SEQ ID NO: 295495 - DNA, 16 bp, C. familiaris
aaaaatgccatgaaaa

SEQ ID NO: 295496 - DNA, 16 bp, C. familiaris
aaaaatgcctttaaaa

SEQ ID NO: 295497 - DNA, 16 bp, C. familiaris
aaaaatgccttttttt

SEQ ID NO: 295498 - DNA, 16 bp, C. familiaris
aaaaatgctattgcta

SEQ ID NO: 295499 - DNA, 16 bp, C. familiaris
aaaaatgctcagaaaa

SEQ ID NO: 295500 - DNA, 16 bp, C. familiaris
aaaaatgctgattttt

SEQ ID NO: 295501 - DNA, 16 bp, C. familiaris
aaaaatgctggataaa

SEQ ID NO: 295502 - DNA, 16 bp, C. familiaris
aaaaatgctgttggaa

SEQ ID NO: 295503 - DNA, 16 bp, C. familiaris
aaaaatgctttataaa

SEQ ID NO: 295504 - DNA, 16 bp, C. familiaris
aaaaatgctttctctt

SEQ ID NO: 295505 - DNA, 16 bp, C. familiaris
aaaaatgctttttgaa

SEQ ID NO: 295506 - DNA, 16 bp, C. familiaris
aaaaatggacagaaga

SEQ ID NO: 295507 - DNA, 16 bp, C. familiaris
aaaaatggagaaattt

SEQ ID NO: 295508 - DNA, 16 bp, C. familiaris
aaaaatggagattttt

SEQ ID NO: 295509 - DNA, 16 bp, C. familiaris
aaaaatgggcagagaa

SEQ ID NO: 295510 - DNA, 16 bp, C. familiaris
aaaaatgggctgaaga

SEQ ID NO: 295511 - DNA, 16 bp, C. familiaris
aaaaatggtcagaaga

SEQ ID NO: 295512 - DNA, 16 bp, C. familiaris
aaaaatgtaaaattca

SEQ ID NO: 295513 - DNA, 16 bp, C. familiaris
aaaaatgtcaaaattt

SEQ ID NO: 295514 - DNA, 16 bp, C. familiaris
aaaaatgtctaaaaag

SEQ ID NO: 295515 - DNA, 16 bp, C. familiaris
aaaaatgtcttcagat

SEQ ID NO: 295516 - DNA, 16 bp, C. familiaris
aaaaatgtcttcattt

SEQ ID NO: 295517 - DNA, 16 bp, C. familiaris
aaaaatgtgaaaacca

SEQ ID NO: 295518 - DNA, 16 bp, C. familiaris
aaaaatgtgcaaaaga

SEQ ID NO: 295519 - DNA, 16 bp, C. familiaris
aaaaatgtgtattctg

SEQ ID NO: 295520 - DNA, 16 bp, C. familiaris
aaaaatgtgtattttg

SEQ ID NO: 295521 - DNA, 16 bp, C. familiaris
aaaaatgttaacattt

SEQ ID NO: 295522 - DNA, 16 bp, C. familiaris
aaaaatgttcattttg

SEQ ID NO: 295523 - DNA, 16 bp, C. familiaris
aaaaatgttgctaggg

SEQ ID NO: 295524 - DNA, 16 bp, C. familiaris
aaaaatgtttactaaa

SEQ ID NO: 295525 - DNA, 16 bp, C. familiaris
aaaaatgtttcaaatt

SEQ ID NO: 295526 - DNA, 16 bp, C. familiaris
aaaaatgtttctacag

SEQ ID NO: 295527 - DNA, 16 bp, C. familiaris
aaaaatgtttctattt

SEQ ID NO: 295528 - DNA, 16 bp, C. familiaris
aaaaatgtttgaaaac

SEQ ID NO: 295529 - DNA, 16 bp, C. familiaris
aaaaatgttttccatt

SEQ ID NO: 295530 - DNA, 16 bp, C. familiaris
aaaaatgttttgaaga

SEQ ID NO: 295531 - DNA, 16 bp, C. familiaris
aaaaatgttttgataa

SEQ ID NO: 295532 - DNA, 16 bp, C. familiaris
aaaaattaaatctgaa

SEQ ID NO: 295533 - DNA, 16 bp, C. familiaris
aaaaattaagtgactt

SEQ ID NO: 295534 - DNA, 16 bp, C. familiaris
aaaaattaatagactt

SEQ ID NO: 295535 - DNA, 16 bp, C. familiaris
aaaaattaccatttta

SEQ ID NO: 295536 - DNA, 16 bp, C. familiaris
aaaaattagagcagaa

SEQ ID NO: 295537 - DNA, 16 bp, C. familiaris
aaaaattatttcttgg

SEQ ID NO: 295538 - DNA, 16 bp, C. familiaris
aaaaattatttggaat

SEQ ID NO: 295539 - DNA, 16 bp, C. familiaris
aaaaattatttgtgtt

SEQ ID NO: 295540 - DNA, 16 bp, C. familiaris
aaaaattattttggtt

SEQ ID NO: 295541 - DNA, 16 bp, C. familiaris
aaaaattccaatattt

SEQ ID NO: 295542 - DNA, 16 bp, C. familiaris
aaaaattctcagcaag

SEQ ID NO: 295543 - DNA, 16 bp, C. familiaris
aaaaattctcttttct

SEQ ID NO: 295544 - DNA, 16 bp, C. familiaris
aaaaattctggaaaga

SEQ ID NO: 295545 - DNA, 16 bp, C. familiaris
aaaaattctggagctg

SEQ ID NO: 295546 - DNA, 16 bp, C. familiaris
aaaaattctgtaagaa

SEQ ID NO: 295547 - DNA, 16 bp, C. familiaris
aaaaattgaaaaactg

SEQ ID NO: 295548 - DNA, 16 bp, C. familiaris
aaaaattgaaaaatct

SEQ ID NO: 295549 - DNA, 16 bp, C. familiaris
aaaaattggaaaatac

SEQ ID NO: 295550 - DNA, 16 bp, C. familiaris
aaaaattggacagcca

SEQ ID NO: 295551 - DNA, 16 bp, C. familiaris
aaaaattggcagagga

SEQ ID NO: 295552 - DNA, 16 bp, C. familiaris
aaaaattgtcattttt

SEQ ID NO: 295553 - DNA, 16 bp, C. familiaris
aaaaattgtttaaatg

SEQ ID NO: 295554 - DNA, 16 bp, C. familiaris
aaaaatttatccattt

SEQ ID NO: 295555 - DNA, 16 bp, C. familiaris
aaaaatttcatcttta

SEQ ID NO: 295556 - DNA, 16 bp, C. familiaris
aaaaatttcattgaaa

SEQ ID NO: 295557 - DNA, 16 bp, C. familiaris
aaaaatttctttgtaa

SEQ ID NO: 295558 - DNA, 16 bp, C. familiaris
aaaaattttaattgtg

SEQ ID NO: 295559 - DNA, 16 bp, C. familiaris
aaaaattttagaaaca

SEQ ID NO: 295560 - DNA, 16 bp, C. familiaris
aaaaattttattcatg

SEQ ID NO: 295561 - DNA, 16 bp, C. familiaris
aaaaattttatttcct

SEQ ID NO: 295562 - DNA, 16 bp, C. familiaris
aaaaattttgcttttt

SEQ ID NO: 295563 - DNA, 16 bp, C. familiaris
aaaacaaaaatgttca

SEQ ID NO: 295564 - DNA, 16 bp, C. familiaris
aaaacaaaacacctgt

SEQ ID NO: 295565 - DNA, 16 bp, C. familiaris
aaaacaaaaccctctt

SEQ ID NO: 295566 - DNA, 16 bp, C. familiaris
aaaacaaaaccttttt

SEQ ID NO: 295567 - DNA, 16 bp, C. familiaris
aaaacaaaactgattt

SEQ ID NO: 295568 - DNA, 16 bp, C. familiaris
aaaacaaaagctttct

SEQ ID NO: 295569 - DNA, 16 bp, C. familiaris
aaaacaaaagctttta

SEQ ID NO: 295570 - DNA, 16 bp, C. familiaris
aaaacaaaatctgaga

SEQ ID NO: 295571 - DNA, 16 bp, C. familiaris
aaaacaaaattcagat

SEQ ID NO: 295572 - DNA, 16 bp, C. familiaris
aaaacaaaccattttt

SEQ ID NO: 295573 - DNA, 16 bp, C. familiaris
aaaacaaagaaatctg

SEQ ID NO: 295574 - DNA, 16 bp, C. familiaris
aaaacaaaggaatttt

SEQ ID NO: 295575 - DNA, 16 bp, C. familiaris
aaaacaaatgagctaa

SEQ ID NO: 295576 - DNA, 16 bp, C. familiaris
aaaacaaatgttaaat

SEQ ID NO: 295577 - DNA, 16 bp, C. familiaris
aaaacaaatgttttat

SEQ ID NO: 295578 - DNA, 16 bp, C. familiaris
aaaacaaattttaagt

SEQ ID NO: 295579 - DNA, 16 bp, C. familiaris
aaaacaacagaaattt

SEQ ID NO: 295580 - DNA, 16 bp, C. familiaris
aaaacaacagtgaaat

SEQ ID NO: 295581 - DNA, 16 bp, C. familiaris
aaaacaacatacattt

SEQ ID NO: 295582 - DNA, 16 bp, C. familiaris
aaaacaacctacagaa

SEQ ID NO: 295583 - DNA, 28 bp, C. familiaris
aaaacaactaattgttggtgttaacaaa

SEQ ID NO: 295584 - DNA, 16 bp, C. familiaris
aaaacaagaatcatat

SEQ ID NO: 295585 - DNA, 16 bp, C. familiaris
aaaacaagagtcagat

SEQ ID NO: 295586 - DNA, 16 bp, C. familiaris
aaaacaagtttttttt

SEQ ID NO: 295587 - DNA, 16 bp, C. familiaris
aaaacaatatgaagat

SEQ ID NO: 295588 - DNA, 16 bp, C. familiaris
aaaacaatgattttta

SEQ ID NO: 295589 - DNA, 16 bp, C. familiaris
aaaacaatggaaaatg

SEQ ID NO: 295590 - DNA, 16 bp, C. familiaris
aaaacaatttcagaaa

SEQ ID NO: 295591 - DNA, 16 bp, C. familiaris
aaaacaattttgataa

SEQ ID NO: 295592 - DNA, 16 bp, C. familiaris
aaaacacaggtttgaa

SEQ ID NO: 295593 - DNA, 16 bp, C. familiaris
aaaacacattttaaga

SEQ ID NO: 295594 - DNA, 16 bp, C. familiaris
aaaacacattttcaaa

SEQ ID NO: 295595 - DNA, 16 bp, C. familiaris
aaaacactgtgctaag

SEQ ID NO: 295596 - DNA, 16 bp, C. familiaris
aaaacacttttgaaaa

SEQ ID NO: 295597 - DNA, 16 bp, C. familiaris
aaaacagaaaatttta

SEQ ID NO: 295598 - DNA, 16 bp, C. familiaris
aaaacagaaataattt

SEQ ID NO: 295599 - DNA, 16 bp, C. familiaris
aaaacagaaatggaag

SEQ ID NO: 295600 - DNA, 16 bp, C. familiaris
aaaacagaacattttt

SEQ ID NO: 295601 - DNA, 16 bp, C. familiaris
aaaacagaagctcaga

SEQ ID NO: 295602 - DNA, 16 bp, C. familiaris
aaaacagacaaaattc

SEQ ID NO: 295603 - DNA, 16 bp, C. familiaris
aaaacagacacatgga

SEQ ID NO: 295604 - DNA, 16 bp, C. familiaris
aaaacagagaatcata

SEQ ID NO: 295605 - DNA, 16 bp, C. familiaris
aaaacagagactcaga

SEQ ID NO: 295606 - DNA, 16 bp, C. familiaris
aaaacagaggctcaga

SEQ ID NO: 295607 - DNA, 16 bp, C. familiaris
aaaacagatgaatata

SEQ ID NO: 295608 - DNA, 16 bp, C. familiaris
aaaacagcttttaaaa

SEQ ID NO: 295609 - DNA, 16 bp, C. familiaris
aaaacagtatgaaggt

SEQ ID NO: 295610 - DNA, 16 bp, C. familiaris
aaaacagtatgatact

SEQ ID NO: 295611 - DNA, 16 bp, C. familiaris
aaaacagtatggatat

SEQ ID NO: 295612 - DNA, 16 bp, C. familiaris
aaaacagtggctttga

SEQ ID NO: 295613 - DNA, 16 bp, C. familiaris
aaaacagtgtggtggt

SEQ ID NO: 295614 - DNA, 16 bp, C. familiaris
aaaacagttctaagaa

SEQ ID NO: 295615 - DNA, 16 bp, C. familiaris
aaaacagtttgaaaaa

SEQ ID NO: 295616 - DNA, 16 bp, C. familiaris
aaaacataaaggactc

SEQ ID NO: 295617 - DNA, 16 bp, C. familiaris
aaaacatatttaaaag

SEQ ID NO: 295618 - DNA, 16 bp, C. familiaris
aaaacatattttctaa

SEQ ID NO: 295619 - DNA, 16 bp, C. familiaris
aaaacatattttggaa

SEQ ID NO: 295620 - DNA, 16 bp, C. familiaris
aaaacatccagatggc

SEQ ID NO: 295621 - DNA, 16 bp, C. familiaris
aaaacatctggctttg

SEQ ID NO: 295622 - DNA, 16 bp, C. familiaris
aaaacatgaaaatatt

SEQ ID NO: 295623 - DNA, 16 bp, C. familiaris
aaaacatgaaatactt

SEQ ID NO: 295624 - DNA, 16 bp, C. familiaris
aaaacatgcaaaatat

SEQ ID NO: 295625 - DNA, 16 bp, C. familiaris
aaaacatggggaggag

SEQ ID NO: 295626 - DNA, 16 bp, C. familiaris
aaaacatgttcaacat

SEQ ID NO: 295627 - DNA, 16 bp, C. familiaris
aaaacattatttctaa

SEQ ID NO: 295628 - DNA, 16 bp, C. familiaris
aaaacattattttctt

SEQ ID NO: 295629 - DNA, 16 bp, C. familiaris
aaaacattccatgttc

SEQ ID NO: 295630 - DNA, 16 bp, C. familiaris
aaaacattgaaaatat

SEQ ID NO: 295631 - DNA, 16 bp, C. familiaris
aaaacattgtattttt

SEQ ID NO: 295632 - DNA, 16 bp, C. familiaris
aaaacatttccaaaat

SEQ ID NO: 295633 - DNA, 16 bp, C. familiaris
aaaacatttctagaaa

SEQ ID NO: 295634 - DNA, 16 bp, C. familiaris
aaaacatttgaaaata

SEQ ID NO: 295635 - DNA, 16 bp, C. familiaris
aaaacattttaagaaa

SEQ ID NO: 295636 - DNA, 16 bp, C. familiaris
aaaacattttattcat

SEQ ID NO: 295637 - DNA, 16 bp, C. familiaris
aaaacattttctattt

SEQ ID NO: 295638 - DNA, 16 bp, C. familiaris
aaaacattttgaaaga

SEQ ID NO: 295639 - DNA, 16 bp, C. familiaris
aaaacattttgagaaa

SEQ ID NO: 295640 - DNA, 16 bp, C. familiaris
aaaacattttggaaaa

SEQ ID NO: 295641 - DNA, 16 bp, C. familiaris
aaaacattttgttaaa

SEQ ID NO: 295642 - DNA, 16 bp, C. familiaris
aaaacatttttccttc

SEQ ID NO: 295643 - DNA, 16 bp, C. familiaris
aaaacatttttgaaaa

SEQ ID NO: 295644 - DNA, 16 bp, C. familiaris
aaaaccaaaagctgat

SEQ ID NO: 295645 - DNA, 16 bp, C. familiaris
aaaaccaaagatccca

SEQ ID NO: 295646 - DNA, 16 bp, C. familiaris
aaaaccaaagctgatg

SEQ ID NO: 295647 - DNA, 16 bp, C. familiaris
aaaaccaagaatctga

SEQ ID NO: 295648 - DNA, 16 bp, C. familiaris
aaaaccaagacttgga

SEQ ID NO: 295649 - DNA, 16 bp, C. familiaris
aaaaccaagagccagg

SEQ ID NO: 295650 - DNA, 16 bp, C. familiaris
aaaaccaagaggcaga

SEQ ID NO: 295651 - DNA, 16 bp, C. familiaris
aaaaccacaaatgaga

SEQ ID NO: 295652 - DNA, 16 bp, C. familiaris
aaaaccacaggcccca

SEQ ID NO: 295653 - DNA, 16 bp, C. familiaris
aaaaccactgaatttt

SEQ ID NO: 295654 - DNA, 16 bp, C. familiaris
aaaaccatctatgaaa

SEQ ID NO: 295655 - DNA, 16 bp, C. familiaris
aaaaccattgactggg

SEQ ID NO: 295656 - DNA, 16 bp, C. familiaris
aaaacccaaatagcca

SEQ ID NO: 295657 - DNA, 16 bp, C. familiaris
aaaaccccaggatcac

SEQ ID NO: 295658 - DNA, 16 bp, C. familiaris
aaaaccctcaagaaag

SEQ ID NO: 295659 - DNA, 16 bp, C. familiaris
aaaaccctgaagactc

SEQ ID NO: 295660 - DNA, 16 bp, C. familiaris
aaaacctacaaattca

SEQ ID NO: 295661 - DNA, 16 bp, C. familiaris
aaaacctacaaatttg

SEQ ID NO: 295662 - DNA, 16 bp, C. familiaris
aaaaccttccaagaca

SEQ ID NO: 295663 - DNA, 16 bp, C. familiaris
aaaacctttttataaa

SEQ ID NO: 295664 - DNA, 16 bp, C. familiaris
aaaactaaaggcaacc

SEQ ID NO: 295665 - DNA, 16 bp, C. familiaris
aaaactaagaatattt

SEQ ID NO: 295666 - DNA, 16 bp, C. familiaris
aaaactacagaccagt

SEQ ID NO: 295667 - DNA, 16 bp, C. familiaris
aaaactagaagaggaa

SEQ ID NO: 295668 - DNA, 16 bp, C. familiaris
aaaactatagtgacag

SEQ ID NO: 295669 - DNA, 16 bp, C. familiaris
aaaactatcattcaga

SEQ ID NO: 295670 - DNA, 16 bp, C. familiaris
aaaactatcccattta

SEQ ID NO: 295671 - DNA, 16 bp, C. familiaris
aaaactattttaagaa

SEQ ID NO: 295672 - DNA, 16 bp, C. familiaris
aaaactcaacagcaaa

SEQ ID NO: 295673 - DNA, 16 bp, C. familiaris
aaaactctggaaaaaa

SEQ ID NO: 295674 - DNA, 16 bp, C. familiaris
aaaactcttagaagaa

SEQ ID NO: 295675 - DNA, 16 bp, C. familiaris
aaaactgaaaactgaa

SEQ ID NO: 295676 - DNA, 16 bp, C. familiaris
aaaactgaaatgtttt

SEQ ID NO: 295677 - DNA, 16 bp, C. familiaris
aaaactgaagcaggaa

SEQ ID NO: 295678 - DNA, 16 bp, C. familiaris
aaaactgaaggaaaat

SEQ ID NO: 295679 - DNA, 16 bp, C. familiaris
aaaactgaagttaaaa

SEQ ID NO: 295680 - DNA, 16 bp, C. familiaris
aaaactgacagctttt

SEQ ID NO: 295681 - DNA, 16 bp, C. familiaris
aaaactgatgctcaga

SEQ ID NO: 295682 - DNA, 16 bp, C. familiaris
aaaactggaaaaatga

SEQ ID NO: 295683 - DNA, 16 bp, C. familiaris
aaaactggaagagaaa

SEQ ID NO: 295684 - DNA, 16 bp, C. familiaris
aaaactggacaaaata

SEQ ID NO: 295685 - DNA, 16 bp, C. familiaris
aaaactggacaaagac

SEQ ID NO: 295686 - DNA, 16 bp, C. familiaris
aaaactggagaaaata

SEQ ID NO: 295687 - DNA, 16 bp, C. familiaris
aaaactggagagctac

SEQ ID NO: 295688 - DNA, 16 bp, C. familiaris
aaaactggaggcatca

SEQ ID NO: 295689 - DNA, 16 bp, C. familiaris
aaaactgggggaaaaa

SEQ ID NO: 295690 - DNA, 16 bp, C. familiaris
aaaactggggggaaaa

SEQ ID NO: 295691 - DNA, 16 bp, C. familiaris
aaaactggtaataaaa

SEQ ID NO: 295692 - DNA, 16 bp, C. familiaris
aaaactgtagaacaga

SEQ ID NO: 295693 - DNA, 16 bp, C. familiaris
aaaactgtataaaata

SEQ ID NO: 295694 - DNA, 16 bp, C. familiaris
aaaactgtggaacaga

SEQ ID NO: 295695 - DNA, 16 bp, C. familiaris
aaaactgtgtggagtt

SEQ ID NO: 295696 - DNA, 16 bp, C. familiaris
aaaacttcacctcaaa

SEQ ID NO: 295697 - DNA, 16 bp, C. familiaris
aaaacttcagaaaaat

SEQ ID NO: 295698 - DNA, 16 bp, C. familiaris
aaaacttctagaagaa

SEQ ID NO: 295699 - DNA, 16 bp, C. familiaris
aaaacttctccaaaaa

SEQ ID NO: 295700 - DNA, 16 bp, C. familiaris
aaaacttgaaaacaac

SEQ ID NO: 295701 - DNA, 16 bp, C. familiaris
aaaacttgaagaagtt

SEQ ID NO: 295702 - DNA, 16 bp, C. familiaris
aaaacttggaaggaaa

SEQ ID NO: 295703 - DNA, 16 bp, C. familiaris
aaaacttgggatgcct

SEQ ID NO: 295704 - DNA, 16 bp, C. familiaris
aaaactttccaaattt

SEQ ID NO: 295705 - DNA, 16 bp, C. familiaris
aaaactttctggaaag

SEQ ID NO: 295706 - DNA, 16 bp, C. familiaris
aaaactttgtttttat

SEQ ID NO: 295707 - DNA, 16 bp, C. familiaris
aaaacttttaaaagaa

SEQ ID NO: 295708 - DNA, 16 bp, C. familiaris
aaaacttttaggaaaa

SEQ ID NO: 295709 - DNA, 16 bp, C. familiaris
aaaacttttattttga

SEQ ID NO: 295710 - DNA, 16 bp, C. familiaris
aaaactttttaaaaag

SEQ ID NO: 295711 - DNA, 16 bp, C. familiaris
aaaactttttgaagaa

SEQ ID NO: 295712 - DNA, 16 bp, C. familiaris
aaaactttttttgttt

SEQ ID NO: 295713 - DNA, 16 bp, C. familiaris
aaaagaaaaaactttt

SEQ ID NO: 295714 - DNA, 16 bp, C. familiaris
aaaagaaaaagattcc

SEQ ID NO: 295715 - DNA, 16 bp, C. familiaris
aaaagaaaaagctgga

SEQ ID NO: 295716 - DNA, 16 bp, C. familiaris
aaaagaaaaagtctta

SEQ ID NO: 295717 - DNA, 16 bp, C. familiaris
aaaagaaaaagttcag

SEQ ID NO: 295718 - DNA, 16 bp, C. familiaris
aaaagaaaaagttcta

SEQ ID NO: 295719 - DNA, 16 bp, C. familiaris
aaaagaaaaatctgca

SEQ ID NO: 295720 - DNA, 16 bp, C. familiaris
aaaagaaaaatttcag

SEQ ID NO: 295721 - DNA, 16 bp, C. familiaris
aaaagaaaacatcttt

SEQ ID NO: 295722 - DNA, 16 bp, C. familiaris
aaaagaaaaccagggc

SEQ ID NO: 295723 - DNA, 16 bp, C. familiaris
aaaagaaaaccatagg

SEQ ID NO: 295724 - DNA, 16 bp, C. familiaris
aaaagaaaactactta

SEQ ID NO: 295725 - DNA, 16 bp, C. familiaris
aaaagaaaagatttca

SEQ ID NO: 295726 - DNA, 16 bp, C. familiaris
aaaagaaaagcacttt

SEQ ID NO: 295727 - DNA, 16 bp, C. familiaris
aaaagaaaagtttctg

SEQ ID NO: 295728 - DNA, 16 bp, C. familiaris
aaaagaaaatacattt

SEQ ID NO: 295729 - DNA, 16 bp, C. familiaris
aaaagaaaatatcagg

SEQ ID NO: 295730 - DNA, 16 bp, C. familiaris
aaaagaaaatcactat

SEQ ID NO: 295731 - DNA, 16 bp, C. familiaris
aaaagaaaatcatgag

SEQ ID NO: 295732 - DNA, 16 bp, C. familiaris
aaaagaaaatccaatt

SEQ ID NO: 295733 - DNA, 16 bp, C. familiaris
aaaagaaaatcttttc

SEQ ID NO: 295734 - DNA, 16 bp, C. familiaris
aaaagaaaatgaatct

SEQ ID NO: 295735 - DNA, 16 bp, C. familiaris
aaaagaaaatggattt

SEQ ID NO: 295736 - DNA, 16 bp, C. familiaris
aaaagaaaatggtatt

SEQ ID NO: 295737 - DNA, 16 bp, C. familiaris
aaaagaaaattacagg

SEQ ID NO: 295738 - DNA, 16 bp, C. familiaris
aaaagaaaattatctt

SEQ ID NO: 295739 - DNA, 16 bp, C. familiaris
aaaagaaaattcactt

SEQ ID NO: 295740 - DNA, 16 bp, C. familiaris
aaaagaaaattgaagc

SEQ ID NO: 295741 - DNA, 16 bp, C. familiaris
aaaagaaacattttaa

SEQ ID NO: 295742 - DNA, 16 bp, C. familiaris
aaaagaaaccagagct

SEQ ID NO: 295743 - DNA, 16 bp, C. familiaris
aaaagaaagaaactgg

SEQ ID NO: 295744 - DNA, 16 bp, C. familiaris
aaaagaaagagatttt

SEQ ID NO: 295745 - DNA, 16 bp, C. familiaris
aaaagaaagatgattt

SEQ ID NO: 295746 - DNA, 16 bp, C. familiaris
aaaagaaagctacaga

SEQ ID NO: 295747 - DNA, 16 bp, C. familiaris
aaaagaaaggatcaga

SEQ ID NO: 295748 - DNA, 16 bp, C. familiaris
aaaagaaagtcttaaa

SEQ ID NO: 295749 - DNA, 16 bp, C. familiaris
aaaagaaagttctttt

SEQ ID NO: 295750 - DNA, 16 bp, C. familiaris
aaaagaaatacaatct

SEQ ID NO: 295751 - DNA, 16 bp, C. familiaris
aaaagaaatacatttg

SEQ ID NO: 295752 - DNA, 16 bp, C. familiaris
aaaagaaatattcaga

SEQ ID NO: 295753 - DNA, 16 bp, C. familiaris
aaaagaaatatttcaa

SEQ ID NO: 295754 - DNA, 16 bp, C. familiaris
aaaagaaatatttgtt

SEQ ID NO: 295755 - DNA, 16 bp, C. familiaris
aaaagaaatcacattt

SEQ ID NO: 295756 - DNA, 16 bp, C. familiaris
aaaagaaatcctgcaa

SEQ ID NO: 295757 - DNA, 16 bp, C. familiaris
aaaagaaatctgaaga

SEQ ID NO: 295758 - DNA, 16 bp, C. familiaris
aaaagaaatcttagaa

SEQ ID NO: 295759 - DNA, 16 bp, C. familiaris
aaaagaaatctttaaa

SEQ ID NO: 295760 - DNA, 16 bp, C. familiaris
aaaagaaatgaaatct

SEQ ID NO: 295761 - DNA, 16 bp, C. familiaris
aaaagaaatgaaccat

SEQ ID NO: 295762 - DNA, 16 bp, C. familiaris
aaaagaaatgcctttt

SEQ ID NO: 295763 - DNA, 16 bp, C. familiaris
aaaagaaatggccata

SEQ ID NO: 295764 - DNA, 16 bp, C. familiaris
aaaagaaatgtctttt

SEQ ID NO: 295765 - DNA, 16 bp, C. familiaris
aaaagaaatgttcaaa

SEQ ID NO: 295766 - DNA, 16 bp, C. familiaris
aaaagaaatgttttta

SEQ ID NO: 295767 - DNA, 16 bp, C. familiaris
aaaagaactgaaatca

SEQ ID NO: 295768 - DNA, 16 bp, C. familiaris
aaaagaacttgagaaa

SEQ ID NO: 295769 - DNA, 16 bp, C. familiaris
aaaagaagaaaactct

SEQ ID NO: 295770 - DNA, 16 bp, C. familiaris
aaaagaagaaaatcct

SEQ ID NO: 295771 - DNA, 16 bp, C. familiaris
aaaagaagaaagtctt

SEQ ID NO: 295772 - DNA, 16 bp, C. familiaris
aaaagaagaaatttgg

SEQ ID NO: 295773 - DNA, 16 bp, C. familiaris
aaaagaaggaaatgtt

SEQ ID NO: 295774 - DNA, 16 bp, C. familiaris
aaaagaaggaagctga

SEQ ID NO: 295775 - DNA, 16 bp, C. familiaris
aaaagaagtcagagaa

SEQ ID NO: 295776 - DNA, 16 bp, C. familiaris
aaaagaagtttcaaaa

SEQ ID NO: 295777 - DNA, 16 bp, C. familiaris
aaaagaataaatgtgt

SEQ ID NO: 295778 - DNA, 16 bp, C. familiaris
aaaagaataatctttt

SEQ ID NO: 295779 - DNA, 16 bp, C. familiaris
aaaagaataatttcaa

SEQ ID NO: 295780 - DNA, 16 bp, C. familiaris
aaaagaatactatgaa

SEQ ID NO: 295781 - DNA, 16 bp, C. familiaris
aaaagaatatttattc

SEQ ID NO: 295782 - DNA, 16 bp, C. familiaris
aaaagaatatttcaat

SEQ ID NO: 295783 - DNA, 16 bp, C. familiaris
aaaagaatattttagt

SEQ ID NO: 295784 - DNA, 16 bp, C. familiaris
aaaagaatatttttct

SEQ ID NO: 295785 - DNA, 16 bp, C. familiaris
aaaagaatctcaaaat

SEQ ID NO: 295786 - DNA, 16 bp, C. familiaris
aaaagaatgaaatttg

SEQ ID NO: 295787 - DNA, 16 bp, C. familiaris
aaaagaatgaactatt

SEQ ID NO: 295788 - DNA, 16 bp, C. familiaris
aaaagaatgaatttct

SEQ ID NO: 295789 - DNA, 16 bp, C. familiaris
aaaagaatgagaacat

SEQ ID NO: 295790 - DNA, 16 bp, C. familiaris
aaaagaatgtttcttt

SEQ ID NO: 295791 - DNA, 16 bp, C. familiaris
aaaagaattccagaaa

SEQ ID NO: 295792 - DNA, 16 bp, C. familiaris
aaaagaattctaaata

SEQ ID NO: 295793 - DNA, 16 bp, C. familiaris
aaaagaattctgtttt

SEQ ID NO: 295794 - DNA, 16 bp, C. familiaris
aaaagaattcttaaaa

SEQ ID NO: 295795 - DNA, 16 bp, C. familiaris
aaaagaatttcttttt

SEQ ID NO: 295796 - DNA, 16 bp, C. familiaris
aaaagaattttctttc

SEQ ID NO: 295797 - DNA, 16 bp, C. familiaris
aaaagacaaagatttt

SEQ ID NO: 295798 - DNA, 16 bp, C. familiaris
aaaagacaaatattgt

SEQ ID NO: 295799 - DNA, 16 bp, C. familiaris
aaaagacaaggatgcc

SEQ ID NO: 295800 - DNA, 16 bp, C. familiaris
aaaagacacaaatgga

SEQ ID NO: 295801 - DNA, 16 bp, C. familiaris
aaaagacatctgaaaa

SEQ ID NO: 295802 - DNA, 16 bp, C. familiaris
aaaagacatgcacaga

SEQ ID NO: 295803 - DNA, 16 bp, C. familiaris
aaaagacatggagaaa

SEQ ID NO: 295804 - DNA, 16 bp, C. familiaris
aaaagacatggatgaa

SEQ ID NO: 295805 - DNA, 16 bp, C. familiaris
aaaagacattattaaa

SEQ ID NO: 295806 - DNA, 16 bp, C. familiaris
aaaagacattttaaaa

SEQ ID NO: 295807 - DNA, 16 bp, C. familiaris
aaaagacattttaaat

SEQ ID NO: 295808 - DNA, 16 bp, C. familiaris
aaaagacattttattt

SEQ ID NO: 295809 - DNA, 16 bp, C. familiaris
aaaagaccatgaggaa

SEQ ID NO: 295810 - DNA, 16 bp, C. familiaris
aaaagaccctgaacag

SEQ ID NO: 295811 - DNA, 16 bp, C. familiaris
aaaagactatttttaa

SEQ ID NO: 295812 - DNA, 16 bp, C. familiaris
aaaagactgaaataat

SEQ ID NO: 295813 - DNA, 16 bp, C. familiaris
aaaagactgaaatctt

SEQ ID NO: 295814 - DNA, 16 bp, C. familiaris
aaaagactgagatcat

SEQ ID NO: 295815 - DNA, 16 bp, C. familiaris
aaaagactgatgaatc

SEQ ID NO: 295816 - DNA, 16 bp, C. familiaris
aaaagacttttaaaaa

SEQ ID NO: 295817 - DNA, 16 bp, C. familiaris
aaaagagaaaactcag

SEQ ID NO: 295818 - DNA, 16 bp, C. familiaris
aaaagagaaaaggctc

SEQ ID NO: 295819 - DNA, 16 bp, C. familiaris
aaaagagaattttgaa

SEQ ID NO: 295820 - DNA, 16 bp, C. familiaris
aaaagagagaagactc

SEQ ID NO: 295821 - DNA, 16 bp, C. familiaris
aaaagagagtccagaa

SEQ ID NO: 295822 - DNA, 16 bp, C. familiaris
aaaagagatcagactt

SEQ ID NO: 295823 - DNA, 16 bp, C. familiaris
aaaagagctctggaga

SEQ ID NO: 295824 - DNA, 16 bp, C. familiaris
aaaagagctggaaaaa

SEQ ID NO: 295825 - DNA, 16 bp, C. familiaris
aaaagagctggagaaa

SEQ ID NO: 295826 - DNA, 16 bp, C. familiaris
aaaagagcttttaaaa

SEQ ID NO: 295827 - DNA, 16 bp, C. familiaris
aaaagataaaattcat

SEQ ID NO: 295828 - DNA, 16 bp, C. familiaris
aaaagataacccacag

SEQ ID NO: 295829 - DNA, 16 bp, C. familiaris
aaaagataagaaccat

SEQ ID NO: 295830 - DNA, 16 bp, C. familiaris
aaaagatacattttaa

SEQ ID NO: 295831 - DNA, 16 bp, C. familiaris
aaaagatatttctttt

SEQ ID NO: 295832 - DNA, 16 bp, C. familiaris
aaaagatattttcaaa

SEQ ID NO: 295833 - DNA, 16 bp, C. familiaris
aaaagatatttttaga

SEQ ID NO: 295834 - DNA, 16 bp, C. familiaris
aaaagatcataagaga

SEQ ID NO: 295835 - DNA, 16 bp, C. familiaris
aaaagatcttatttat

SEQ ID NO: 295836 - DNA, 16 bp, C. familiaris
aaaagatctttaaaaa

SEQ ID NO: 295837 - DNA, 16 bp, C. familiaris
aaaagatgacatttga

SEQ ID NO: 295838 - DNA, 16 bp, C. familiaris
aaaagatgacttaaaa

SEQ ID NO: 295839 - DNA, 16 bp, C. familiaris
aaaagatgcagggtat

SEQ ID NO: 295840 - DNA, 16 bp, C. familiaris
aaaagatgcccaacat

SEQ ID NO: 295841 - DNA, 16 bp, C. familiaris
aaaagatgctaaaatt

SEQ ID NO: 295842 - DNA, 16 bp, C. familiaris
aaaagatgctgaaaaa

SEQ ID NO: 295843 - DNA, 16 bp, C. familiaris
aaaagatggaaaatgt

SEQ ID NO: 295844 - DNA, 16 bp, C. familiaris
aaaagatggaaacaat

SEQ ID NO: 295845 - DNA, 16 bp, C. familiaris
aaaagatgggcagagg

SEQ ID NO: 295846 - DNA, 16 bp, C. familiaris
aaaagattaaaatctt

SEQ ID NO: 295847 - DNA, 16 bp, C. familiaris
aaaagattcatgaaaa

SEQ ID NO: 295848 - DNA, 16 bp, C. familiaris
aaaagatttgaagaga

SEQ ID NO: 295849 - DNA, 16 bp, C. familiaris
aaaagattttgcttat

SEQ ID NO: 295850 - DNA, 16 bp, C. familiaris
aaaagattttgtttat

SEQ ID NO: 295851 - DNA, 16 bp, C. familiaris
aaaagcaaaacatttt

SEQ ID NO: 295852 - DNA, 16 bp, C. familiaris
aaaagcaaaactatga

SEQ ID NO: 295853 - DNA, 16 bp, C. familiaris
aaaagcaaagatgaac

SEQ ID NO: 295854 - DNA, 16 bp, C. familiaris
aaaagcaaagctagag

SEQ ID NO: 295855 - DNA, 16 bp, C. familiaris
aaaagcaaaggcagca

SEQ ID NO: 295856 - DNA, 16 bp, C. familiaris
aaaagcaaatgggaaa

SEQ ID NO: 295857 - DNA, 16 bp, C. familiaris
aaaagcaagaaaatgg

SEQ ID NO: 295858 - DNA, 16 bp, C. familiaris
aaaagcaagacacatc

SEQ ID NO: 295859 - DNA, 16 bp, C. familiaris
aaaagcaagatccaac

SEQ ID NO: 295860 - DNA, 16 bp, C. familiaris
aaaagcaaggaaatgg

SEQ ID NO: 295861 - DNA, 16 bp, C. familiaris
aaaagcagatactcaa

SEQ ID NO: 295862 - DNA, 16 bp, C. familiaris
aaaagcagattttatt

SEQ ID NO: 295863 - DNA, 16 bp, C. familiaris
aaaagcagcaaaatat

SEQ ID NO: 295864 - DNA, 16 bp, C. familiaris
aaaagcagcagcagcc

SEQ ID NO: 295865 - DNA, 16 bp, C. familiaris
aaaagcagtcctgaag

SEQ ID NO: 295866 - DNA, 16 bp, C. familiaris
aaaagcagtgctaaga

SEQ ID NO: 295867 - DNA, 16 bp, C. familiaris
aaaagcagttttaaaa

SEQ ID NO: 295868 - DNA, 16 bp, C. familiaris
aaaagcatctgcacag

SEQ ID NO: 295869 - DNA, 16 bp, C. familiaris
aaaagcatttaaaaca

SEQ ID NO: 295870 - DNA, 16 bp, C. familiaris
aaaagcatttggcaaa

SEQ ID NO: 295871 - DNA, 16 bp, C. familiaris
aaaagcatttgtcaaa

SEQ ID NO: 295872 - DNA, 16 bp, C. familiaris
aaaagcattttcattt

SEQ ID NO: 295873 - DNA, 16 bp, C. familiaris
aaaagcattttctaaa

SEQ ID NO: 295874 - DNA, 16 bp, C. familiaris
aaaagcattttggaaa

SEQ ID NO: 295875 - DNA, 16 bp, C. familiaris
aaaagcatttttaaaa

SEQ ID NO: 295876 - DNA, 16 bp, C. familiaris
aaaagccacagtttaa

SEQ ID NO: 295877 - DNA, 16 bp, C. familiaris
aaaagccaccaagtat

SEQ ID NO: 295878 - DNA, 16 bp, C. familiaris
aaaagccagatgctta

SEQ ID NO: 295879 - DNA, 16 bp, C. familiaris
aaaagccatctacaaa

SEQ ID NO: 295880 - DNA, 16 bp, C. familiaris
aaaagccatctatgag

SEQ ID NO: 295881 - DNA, 16 bp, C. familiaris
aaaagccatgaagaga

SEQ ID NO: 295882 - DNA, 16 bp, C. familiaris
aaaagcctcttcaaca

SEQ ID NO: 295883 - DNA, 16 bp, C. familiaris
aaaagccttttatttt

SEQ ID NO: 295884 - DNA, 16 bp, C. familiaris
aaaagctaaaaattat

SEQ ID NO: 295885 - DNA, 16 bp, C. familiaris
aaaagctaaaagaatt

SEQ ID NO: 295886 - DNA, 16 bp, C. familiaris
aaaagctgctgcacag

SEQ ID NO: 295887 - DNA, 16 bp, C. familiaris
aaaagctggaaaaaat

SEQ ID NO: 295888 - DNA, 16 bp, C. familiaris
aaaagctgtcagtttt

SEQ ID NO: 295889 - DNA, 16 bp, C. familiaris
aaaagcttctccacag

SEQ ID NO: 295890 - DNA, 16 bp, C. familiaris
aaaagctttacatttt

SEQ ID NO: 295891 - DNA, 16 bp, C. familiaris
aaaagctttcaacctt

SEQ ID NO: 295892 - DNA, 16 bp, C. familiaris
aaaagctttcattttt

SEQ ID NO: 295893 - DNA, 16 bp, C. familiaris
aaaagcttttaaattt

SEQ ID NO: 295894 - DNA, 16 bp, C. familiaris
aaaagcttttcaaaaa

SEQ ID NO: 295895 - DNA, 16 bp, C. familiaris
aaaagctttttttctt

SEQ ID NO: 295896 - DNA, 16 bp, C. familiaris
aaaaggaaaacatatt

SEQ ID NO: 295897 - DNA, 16 bp, C. familiaris
aaaaggaaaacttttc

SEQ ID NO: 295898 - DNA, 16 bp, C. familiaris
aaaaggaaaagcattt

SEQ ID NO: 295899 - DNA, 16 bp, C. familiaris
aaaaggaaaatacttt

SEQ ID NO: 295900 - DNA, 16 bp, C. familiaris
aaaaggaaaatcattt

SEQ ID NO: 295901 - DNA, 16 bp, C. familiaris
aaaaggaaaattcata

SEQ ID NO: 295902 - DNA, 16 bp, C. familiaris
aaaaggaaacttcctt

SEQ ID NO: 295903 - DNA, 16 bp, C. familiaris
aaaaggaaagaaacct

SEQ ID NO: 295904 - DNA, 16 bp, C. familiaris
aaaaggaaataacatt

SEQ ID NO: 295905 - DNA, 16 bp, C. familiaris
aaaaggaaatgcagaa

SEQ ID NO: 295906 - DNA, 16 bp, C. familiaris
aaaaggaaatttattg

SEQ ID NO: 295907 - DNA, 16 bp, C. familiaris
aaaaggaagaatcaga

SEQ ID NO: 295908 - DNA, 16 bp, C. familiaris
aaaaggaagagatttt

SEQ ID NO: 295909 - DNA, 16 bp, C. familiaris
aaaaggaagccattaa

SEQ ID NO: 295910 - DNA, 16 bp, C. familiaris
aaaaggaagtaagcca

SEQ ID NO: 295911 - DNA, 16 bp, C. familiaris
aaaaggaatattattc

SEQ ID NO: 295912 - DNA, 16 bp, C. familiaris
aaaaggaatccaaatt

SEQ ID NO: 295913 - DNA, 16 bp, C. familiaris
aaaaggaatgaaatct

SEQ ID NO: 295914 - DNA, 16 bp, C. familiaris
aaaaggaattctttta

SEQ ID NO: 295915 - DNA, 16 bp, C. familiaris
aaaaggaattttaaga

SEQ ID NO: 295916 - DNA, 16 bp, C. familiaris
aaaaggaattttttaa

SEQ ID NO: 295917 - DNA, 16 bp, C. familiaris
aaaaggactttaaaaa

SEQ ID NO: 295918 - DNA, 16 bp, C. familiaris
aaaaggagataatatt

SEQ ID NO: 295919 - DNA, 16 bp, C. familiaris
aaaaggatatttattt

SEQ ID NO: 295920 - DNA, 16 bp, C. familiaris
aaaaggatgagatctt

SEQ ID NO: 295921 - DNA, 16 bp, C. familiaris
aaaaggatgttgcctg

SEQ ID NO: 295922 - DNA, 16 bp, C. familiaris
aaaaggcaaatactat

SEQ ID NO: 295923 - DNA, 16 bp, C. familiaris
aaaaggcaacctgcag

SEQ ID NO: 295924 - DNA, 16 bp, C. familiaris
aaaaggcatttttaaa

SEQ ID NO: 295925 - DNA, 16 bp, C. familiaris
aaaaggccaaaaatcc

SEQ ID NO: 295926 - DNA, 16 bp, C. familiaris
aaaagggattttattt

SEQ ID NO: 295927 - DNA, 16 bp, C. familiaris
aaaagggcagcccagg

SEQ ID NO: 295928 - DNA, 16 bp, C. familiaris
aaaaggggaaactgag

SEQ ID NO: 295929 - DNA, 16 bp, C. familiaris
aaaaggggcacttggg

SEQ ID NO: 295930 - DNA, 16 bp, C. familiaris
aaaagggggggggcat

SEQ ID NO: 295931 - DNA, 16 bp, C. familiaris
aaaaggtaaatatttt

SEQ ID NO: 295932 - DNA, 16 bp, C. familiaris
aaaaggtctttttttt

SEQ ID NO: 295933 - DNA, 16 bp, C. familiaris
aaaaggtgaaattaat

SEQ ID NO: 295934 - DNA, 16 bp, C. familiaris
aaaaggttttcttttt

SEQ ID NO: 295935 - DNA, 16 bp, C. familiaris
aaaagtaaacattttt

SEQ ID NO: 295936 - DNA, 16 bp, C. familiaris
aaaagtaaactttttt

SEQ ID NO: 295937 - DNA, 16 bp, C. familiaris
aaaagtagaactacca

SEQ ID NO: 295938 - DNA, 16 bp, C. familiaris
aaaagtcaaactcaga

SEQ ID NO: 295939 - DNA, 16 bp, C. familiaris
aaaagtcaaagaattt

SEQ ID NO: 295940 - DNA, 16 bp, C. familiaris
aaaagtccttaacaaa

SEQ ID NO: 295941 - DNA, 16 bp, C. familiaris
aaaagtctagaagaaa

SEQ ID NO: 295942 - DNA, 16 bp, C. familiaris
aaaagtgaaatcatat

SEQ ID NO: 295943 - DNA, 16 bp, C. familiaris
aaaagtgaatcagaaa

SEQ ID NO: 295944 - DNA, 16 bp, C. familiaris
aaaagtgcttttaaaa

SEQ ID NO: 295945 - DNA, 16 bp, C. familiaris
aaaagtggaaacaact

SEQ ID NO: 295946 - DNA, 16 bp, C. familiaris
aaaagtggacaaaaga

SEQ ID NO: 295947 - DNA, 16 bp, C. familiaris
aaaagtggacagaaga

SEQ ID NO: 295948 - DNA, 16 bp, C. familiaris
aaaagtgtgttgcctg

SEQ ID NO: 295949 - DNA, 16 bp, C. familiaris
aaaagtgttttgtttt

SEQ ID NO: 295950 - DNA, 16 bp, C. familiaris
aaaagttaactttttt

SEQ ID NO: 295951 - DNA, 16 bp, C. familiaris
aaaagttacttttaaa

SEQ ID NO: 295952 - DNA, 16 bp, C. familiaris
aaaagttcctttttct

SEQ ID NO: 295953 - DNA, 16 bp, C. familiaris
aaaagttctcaatttt

SEQ ID NO: 295954 - DNA, 16 bp, C. familiaris
aaaagttgaaaatcaa

SEQ ID NO: 295955 - DNA, 16 bp, C. familiaris
aaaagtttcaaaaata

SEQ ID NO: 295956 - DNA, 16 bp, C. familiaris
aaaagtttcattttct

SEQ ID NO: 295957 - DNA, 16 bp, C. familiaris
aaaagtttgaaaatgt

SEQ ID NO: 295958 - DNA, 16 bp, C. familiaris
aaaagtttgagaacca

SEQ ID NO: 295959 - DNA, 16 bp, C. familiaris
aaaagtttgttttaaa

SEQ ID NO: 295960 - DNA, 16 bp, C. familiaris
aaaagttttatttcct

SEQ ID NO: 295961 - DNA, 16 bp, C. familiaris
aaaagttttcaatttt

SEQ ID NO: 295962 - DNA, 16 bp, C. familiaris
aaaagttttctatttt

SEQ ID NO: 295963 - DNA, 16 bp, C. familiaris
aaaagttttcttcttt

SEQ ID NO: 295964 - DNA, 16 bp, C. familiaris
aaaataaaaagctcct

SEQ ID NO: 295965 - DNA, 16 bp, C. familiaris
aaaataaaactccaga

SEQ ID NO: 295966 - DNA, 16 bp, C. familiaris
aaaataaaactcttga

SEQ ID NO: 295967 - DNA, 16 bp, C. familiaris
aaaataaaactctttt

SEQ ID NO: 295968 - DNA, 16 bp, C. familiaris
aaaataaaagcttcta

SEQ ID NO: 295969 - DNA, 16 bp, C. familiaris
aaaataaaagctttga

SEQ ID NO: 295970 - DNA, 16 bp, C. familiaris
aaaataaaaggcttct

SEQ ID NO: 295971 - DNA, 16 bp, C. familiaris
aaaataaaatcacagg

SEQ ID NO: 295972 - DNA, 16 bp, C. familiaris
aaaataaaatctcagt

SEQ ID NO: 295973 - DNA, 16 bp, C. familiaris
aaaataaaatgcagtt

SEQ ID NO: 295974 - DNA, 16 bp, C. familiaris
aaaataaaatgcattt

SEQ ID NO: 295975 - DNA, 16 bp, C. familiaris
aaaataaaatgctgtt

SEQ ID NO: 295976 - DNA, 16 bp, C. familiaris
aaaataaacagtttct

SEQ ID NO: 295977 - DNA, 16 bp, C. familiaris
aaaataaacatgtttt

SEQ ID NO: 295978 - DNA, 16 bp, C. familiaris
aaaataaacatttctt

SEQ ID NO: 295979 - DNA, 16 bp, C. familiaris
aaaataaactgtattt

SEQ ID NO: 295980 - DNA, 16 bp, C. familiaris
aaaataaagacacttt

SEQ ID NO: 295981 - DNA, 16 bp, C. familiaris
aaaataaagacatttt

SEQ ID NO: 295982 - DNA, 16 bp, C. familiaris
aaaataaagcaattat

SEQ ID NO: 295983 - DNA, 16 bp, C. familiaris
aaaataaagctaccct

SEQ ID NO: 295984 - DNA, 16 bp, C. familiaris
aaaataaagttcattt

SEQ ID NO: 295985 - DNA, 16 bp, C. familiaris
aaaataaagtttttct

SEQ ID NO: 295986 - DNA, 16 bp, C. familiaris
aaaataaatctgtgtt

SEQ ID NO: 295987 - DNA, 16 bp, C. familiaris
aaaataaatgagctaa

SEQ ID NO: 295988 - DNA, 16 bp, C. familiaris
aaaataaatgtcatgg

SEQ ID NO: 295989 - DNA, 16 bp, C. familiaris
aaaataaatgtttact

SEQ ID NO: 295990 - DNA, 16 bp, C. familiaris
aaaataaatttccttt

SEQ ID NO: 295991 - DNA, 16 bp, C. familiaris
aaaataacttgaaata

SEQ ID NO: 295992 - DNA, 16 bp, C. familiaris
aaaataagcttttaaa

SEQ ID NO: 295993 - DNA, 16 bp, C. familiaris
aaaataaggaaattct

SEQ ID NO: 295994 - DNA, 16 bp, C. familiaris
aaaataagtcacaggg

SEQ ID NO: 295995 - DNA, 16 bp, C. familiaris
aaaataataagcattt

SEQ ID NO: 295996 - DNA, 16 bp, C. familiaris
aaaataataattcttc

SEQ ID NO: 295997 - DNA, 16 bp, C. familiaris
aaaataatatttctct

SEQ ID NO: 295998 - DNA, 16 bp, C. familiaris
aaaataatgaaattca

SEQ ID NO: 295999 - DNA, 16 bp, C. familiaris
aaaataatgcaaaatt

SEQ ID NO: 296000 - DNA, 16 bp, C. familiaris
aaaataatgctatttt

SEQ ID NO: 296001 - DNA, 16 bp, C. familiaris
aaaataatgctgctat

SEQ ID NO: 296002 - DNA, 16 bp, C. familiaris
aaaataatggcaaaat

SEQ ID NO: 296003 - DNA, 16 bp, C. familiaris
aaaataatgtatgtat

SEQ ID NO: 296004 - DNA, 16 bp, C. familiaris
aaaataatgttttctg

SEQ ID NO: 296005 - DNA, 16 bp, C. familiaris
aaaataattctcagaa

SEQ ID NO: 296006 - DNA, 16 bp, C. familiaris
aaaataatttcagaaa

SEQ ID NO: 296007 - DNA, 16 bp, C. familiaris
aaaataatttcatgaa

SEQ ID NO: 296008 - DNA, 16 bp, C. familiaris
aaaataatttcccttt

SEQ ID NO: 296009 - DNA, 16 bp, C. familiaris
aaaataattttgtctt

SEQ ID NO: 296010 - DNA, 16 bp, C. familiaris
aaaataattttgtgat

SEQ ID NO: 296011 - DNA, 16 bp, C. familiaris
aaaatacaaaatgttt

SEQ ID NO: 296012 - DNA, 16 bp, C. familiaris
aaaatacaagtatttt

SEQ ID NO: 296013 - DNA, 16 bp, C. familiaris
aaaatacacattttat

SEQ ID NO: 296014 - DNA, 16 bp, C. familiaris
aaaatacatatgcaaa

SEQ ID NO: 296015 - DNA, 16 bp, C. familiaris
aaaatacatattttct

SEQ ID NO: 296016 - DNA, 16 bp, C. familiaris
aaaatacatggagaaa

SEQ ID NO: 296017 - DNA, 16 bp, C. familiaris
aaaatacatggaggaa

SEQ ID NO: 296018 - DNA, 16 bp, C. familiaris
aaaatacattcagaaa

SEQ ID NO: 296019 - DNA, 16 bp, C. familiaris
aaaatacatttaaagt

SEQ ID NO: 296020 - DNA, 16 bp, C. familiaris
aaaatacatttccaaa

SEQ ID NO: 296021 - DNA, 16 bp, C. familiaris
aaaatacattttcaga

SEQ ID NO: 296022 - DNA, 16 bp, C. familiaris
aaaataccacagattg

SEQ ID NO: 296023 - DNA, 16 bp, C. familiaris
aaaatacctagtaata

SEQ ID NO: 296024 - DNA, 16 bp, C. familiaris
aaaatactactactac

SEQ ID NO: 296025 - DNA, 16 bp, C. familiaris
aaaatactgaaaagga

SEQ ID NO: 296026 - DNA, 16 bp, C. familiaris
aaaatactgtgaaaat

SEQ ID NO: 296027 - DNA, 16 bp, C. familiaris
aaaatacttaagaatt

SEQ ID NO: 296028 - DNA, 16 bp, C. familiaris
aaaatacttagaaatg

SEQ ID NO: 296029 - DNA, 16 bp, C. familiaris
aaaatacttattttct

SEQ ID NO: 296030 - DNA, 16 bp, C. familiaris
aaaatacttggaaaat

SEQ ID NO: 296031 - DNA, 16 bp, C. familiaris
aaaatacttttagaaa

SEQ ID NO: 296032 - DNA, 16 bp, C. familiaris
aaaatagaaaatctga

SEQ ID NO: 296033 - DNA, 16 bp, C. familiaris
aaaatagaaattctga

SEQ ID NO: 296034 - DNA, 16 bp, C. familiaris
aaaatagacattttaa

SEQ ID NO: 296035 - DNA, 17 bp, C. familiaris
aaaatagacctgcctta

SEQ ID NO: 296036 - DNA, 16 bp, C. familiaris
aaaatagagatttgaa

SEQ ID NO: 296037 - DNA, 16 bp, C. familiaris
aaaatagccaaactgt

SEQ ID NO: 296038 - DNA, 16 bp, C. familiaris
aaaataggcagaaact

SEQ ID NO: 296039 - DNA, 16 bp, C. familiaris
aaaataggcataataa

SEQ ID NO: 296040 - DNA, 16 bp, C. familiaris
aaaatagtttgaaatt

SEQ ID NO: 296041 - DNA, 16 bp, C. familiaris
aaaatataaaatcatg

SEQ ID NO: 296042 - DNA, 16 bp, C. familiaris
aaaatataaatgactt

SEQ ID NO: 296043 - DNA, 16 bp, C. familiaris
aaaatatagtgaaagg

SEQ ID NO: 296044 - DNA, 16 bp, C. familiaris
aaaatatataatgaca

SEQ ID NO: 296045 - DNA, 16 bp, C. familiaris
aaaatatatttgcatt

SEQ ID NO: 296046 - DNA, 16 bp, C. familiaris
aaaatatattttgaga

SEQ ID NO: 296047 - DNA, 16 bp, C. familiaris
aaaatatattttggtg

SEQ ID NO: 296048 - DNA, 16 bp, C. familiaris
aaaatatctgaaaaca

SEQ ID NO: 296049 - DNA, 16 bp, C. familiaris
aaaatatctgaaaact

SEQ ID NO: 296050 - DNA, 16 bp, C. familiaris
aaaatatctgcaaaat

SEQ ID NO: 296051 - DNA, 16 bp, C. familiaris
aaaatatcttaaaagt

SEQ ID NO: 296052 - DNA, 16 bp, C. familiaris
aaaatatgaaaactta

SEQ ID NO: 296053 - DNA, 16 bp, C. familiaris
aaaatatgaattcaaa

SEQ ID NO: 296054 - DNA, 16 bp, C. familiaris
aaaatatgactcataa

SEQ ID NO: 296055 - DNA, 16 bp, C. familiaris
aaaatatggaaaatgt

SEQ ID NO: 296056 - DNA, 16 bp, C. familiaris
aaaatatgtaaattgt

SEQ ID NO: 296057 - DNA, 16 bp, C. familiaris
aaaatatgtgtgtatg

SEQ ID NO: 296058 - DNA, 16 bp, C. familiaris
aaaatatgttcaaaat

SEQ ID NO: 296059 - DNA, 16 bp, C. familiaris
aaaatatgttctaaaa

SEQ ID NO: 296060 - DNA, 16 bp, C. familiaris
aaaatattaacagtga

SEQ ID NO: 296061 - DNA, 16 bp, C. familiaris
aaaatattaagcaaat

SEQ ID NO: 296062 - DNA, 16 bp, C. familiaris
aaaatattactgaaag

SEQ ID NO: 296063 - DNA, 16 bp, C. familiaris
aaaatattagaaaact

SEQ ID NO: 296064 - DNA, 16 bp, C. familiaris
aaaatattatttgttg

SEQ ID NO: 296065 - DNA, 16 bp, C. familiaris
aaaatattcaacatca

SEQ ID NO: 296066 - DNA, 16 bp, C. familiaris
aaaatattcaagaaat

SEQ ID NO: 296067 - DNA, 16 bp, C. familiaris
aaaatattcaaggaaa

SEQ ID NO: 296068 - DNA, 16 bp, C. familiaris
aaaatattcagaagaa

SEQ ID NO: 296069 - DNA, 16 bp, C. familiaris
aaaatattccaatatt

SEQ ID NO: 296070 - DNA, 16 bp, C. familiaris
aaaatattccatgttt

SEQ ID NO: 296071 - DNA, 16 bp, C. familiaris
aaaatattccttcctt

SEQ ID NO: 296072 - DNA, 16 bp, C. familiaris
aaaatattcttaaaga

SEQ ID NO: 296073 - DNA, 16 bp, C. familiaris
aaaatattgaaaacat

SEQ ID NO: 296074 - DNA, 16 bp, C. familiaris
aaaatattgagaattt

SEQ ID NO: 296075 - DNA, 16 bp, C. familiaris
aaaatattgattcaaa

SEQ ID NO: 296076 - DNA, 16 bp, C. familiaris
aaaatattgctaaaat

SEQ ID NO: 296077 - DNA, 16 bp, C. familiaris
aaaatattgctgaaag

SEQ ID NO: 296078 - DNA, 16 bp, C. familiaris
aaaatatttaaacatg

SEQ ID NO: 296079 - DNA, 16 bp, C. familiaris
aaaatatttaaagaac

SEQ ID NO: 296080 - DNA, 16 bp, C. familiaris
aaaatatttaaagctt

SEQ ID NO: 296081 - DNA, 16 bp, C. familiaris
aaaatatttcaaagta

SEQ ID NO: 296082 - DNA, 16 bp, C. familiaris
aaaatatttcagaaag

SEQ ID NO: 296083 - DNA, 16 bp, C. familiaris
aaaatatttccatcat

SEQ ID NO: 296084 - DNA, 16 bp, C. familiaris
aaaatatttctctctc

SEQ ID NO: 296085 - DNA, 16 bp, C. familiaris
aaaatatttcttagaa

SEQ ID NO: 296086 - DNA, 16 bp, C. familiaris
aaaatatttcttctga

SEQ ID NO: 296087 - DNA, 16 bp, C. familiaris
aaaatatttgaaatgt

SEQ ID NO: 296088 - DNA, 16 bp, C. familiaris
aaaatatttgaagcaa

SEQ ID NO: 296089 - DNA, 16 bp, C. familiaris
aaaatattttcagaag

SEQ ID NO: 296090 - DNA, 16 bp, C. familiaris
aaaatattttcagctt

SEQ ID NO: 296091 - DNA, 16 bp, C. familiaris
aaaatattttccatgt

SEQ ID NO: 296092 - DNA, 16 bp, C. familiaris
aaaatattttctagtt

SEQ ID NO: 296093 - DNA, 16 bp, C. familiaris
aaaatattttgtgaaa

SEQ ID NO: 296094 - DNA, 16 bp, C. familiaris
aaaatatttttcacaa

SEQ ID NO: 296095 - DNA, 16 bp, C. familiaris
aaaatatttttgcttt

SEQ ID NO: 296096 - DNA, 16 bp, C. familiaris
aaaatatttttggagt

SEQ ID NO: 296097 - DNA, 16 bp, C. familiaris
aaaatcaaaaccacag

SEQ ID NO: 296098 - DNA, 16 bp, C. familiaris
aaaatcaaaatggatt

SEQ ID NO: 296099 - DNA, 16 bp, C. familiaris
aaaatcaaaggggaaa

SEQ ID NO: 296100 - DNA, 16 bp, C. familiaris
aaaatcaacaaggata

SEQ ID NO: 296101 - DNA, 16 bp, C. familiaris
aaaatcaagaatccaa

SEQ ID NO: 296102 - DNA, 16 bp, C. familiaris
aaaatcaagaatctga

SEQ ID NO: 296103 - DNA, 16 bp, C. familiaris
aaaatcaagagccaga

SEQ ID NO: 296104 - DNA, 16 bp, C. familiaris
aaaatcaagagtcagt

SEQ ID NO: 296105 - DNA, 16 bp, C. familiaris
aaaatcaatgaaattt

SEQ ID NO: 296106 - DNA, 16 bp, C. familiaris
aaaatcaattaatgta

SEQ ID NO: 296107 - DNA, 16 bp, C. familiaris
aaaatcaattaggaaa

SEQ ID NO: 296108 - DNA, 16 bp, C. familiaris
aaaatcagaaaatttc

SEQ ID NO: 296109 - DNA, 16 bp, C. familiaris
aaaatcagaaatattt

SEQ ID NO: 296110 - DNA, 16 bp, C. familiaris
aaaatcagaaatggaa

SEQ ID NO: 296111 - DNA, 16 bp, C. familiaris
aaaatcagaaattaag

SEQ ID NO: 296112 - DNA, 16 bp, C. familiaris
aaaatcagaatatatt

SEQ ID NO: 296113 - DNA, 16 bp, C. familiaris
aaaatcaggaaaatgt

SEQ ID NO: 296114 - DNA, 16 bp, C. familiaris
aaaatcaggaaattta

SEQ ID NO: 296115 - DNA, 16 bp, C. familiaris
aaaatcaggatttgaa

SEQ ID NO: 296116 - DNA, 16 bp, C. familiaris
aaaatcagtaaaattg

SEQ ID NO: 296117 - DNA, 16 bp, C. familiaris
aaaatcagttttgttt

SEQ ID NO: 296118 - DNA, 16 bp, C. familiaris
aaaatcatctcacaca

SEQ ID NO: 296119 - DNA, 16 bp, C. familiaris
aaaatcatgaaaaatt

SEQ ID NO: 296120 - DNA, 16 bp, C. familiaris
aaaatcatgagaaaat

SEQ ID NO: 296121 - DNA, 16 bp, C. familiaris
aaaatcattaaggaaa

SEQ ID NO: 296122 - DNA, 16 bp, C. familiaris
aaaatcatttgaaaac

SEQ ID NO: 296123 - DNA, 16 bp, C. familiaris
aaaatcatttgacaaa

SEQ ID NO: 296124 - DNA, 16 bp, C. familiaris
aaaatccaaagacaga

SEQ ID NO: 296125 - DNA, 16 bp, C. familiaris
aaaatccaaattattt

SEQ ID NO: 296126 - DNA, 16 bp, C. familiaris
aaaatccaaattcttt

SEQ ID NO: 296127 - DNA, 16 bp, C. familiaris
aaaatccagaaataca

SEQ ID NO: 296128 - DNA, 16 bp, C. familiaris
aaaatccagaaggaaa

SEQ ID NO: 296129 - DNA, 16 bp, C. familiaris
aaaatcccagaaaaga

SEQ ID NO: 296130 - DNA, 16 bp, C. familiaris
aaaatcctaaaggaaa

SEQ ID NO: 296131 - DNA, 16 bp, C. familiaris
aaaatcctagagaaca

SEQ ID NO: 296132 - DNA, 16 bp, C. familiaris
aaaatcctatttataa

SEQ ID NO: 296133 - DNA, 16 bp, C. familiaris
aaaatcctcaacaaga

SEQ ID NO: 296134 - DNA, 16 bp, C. familiaris
aaaatcctggaagaga

SEQ ID NO: 296135 - DNA, 16 bp, C. familiaris
aaaatcctggagaaca

SEQ ID NO: 296136 - DNA, 16 bp, C. familiaris
aaaatcctggaggaga

SEQ ID NO: 296137 - DNA, 16 bp, C. familiaris
aaaatccttagaaaaa

SEQ ID NO: 296138 - DNA, 16 bp, C. familiaris
aaaatccttgaggaga

SEQ ID NO: 296139 - DNA, 16 bp, C. familiaris
aaaatccttttggaaa

SEQ ID NO: 296140 - DNA, 16 bp, C. familiaris
aaaatctaaatgaaat

SEQ ID NO: 296141 - DNA, 16 bp, C. familiaris
aaaatctagtcaagaa

SEQ ID NO: 296142 - DNA, 16 bp, C. familiaris
aaaatctcaagagaaa

SEQ ID NO: 296143 - DNA, 16 bp, C. familiaris
aaaatctcaaggaaaa

SEQ ID NO: 296144 - DNA, 16 bp, C. familiaris
aaaatctcagcaagtt

SEQ ID NO: 296145 - DNA, 16 bp, C. familiaris
aaaatctcatttttat

SEQ ID NO: 296146 - DNA, 16 bp, C. familiaris
aaaatctccccacaaa

SEQ ID NO: 296147 - DNA, 16 bp, C. familiaris
aaaatctcttaaaaga

SEQ ID NO: 296148 - DNA, 16 bp, C. familiaris
aaaatctcttcaaaaa

SEQ ID NO: 296149 - DNA, 16 bp, C. familiaris
aaaatctctttggaaa

SEQ ID NO: 296150 - DNA, 16 bp, C. familiaris
aaaatctgaaagcaaa

SEQ ID NO: 296151 - DNA, 16 bp, C. familiaris
aaaatctgaataaatt

SEQ ID NO: 296152 - DNA, 16 bp, C. familiaris
aaaatctgcatttaag

SEQ ID NO: 296153 - DNA, 16 bp, C. familiaris
aaaatctggaagaaaa

SEQ ID NO: 296154 - DNA, 16 bp, C. familiaris
aaaatctggattacaa

SEQ ID NO: 296155 - DNA, 16 bp, C. familiaris
aaaatctgggggaaaa

SEQ ID NO: 296156 - DNA, 16 bp, C. familiaris
aaaatctgttgcattt

SEQ ID NO: 296157 - DNA, 16 bp, C. familiaris
aaaatctgttttattt

SEQ ID NO: 296158 - DNA, 16 bp, C. familiaris
aaaatctgtttttcct

SEQ ID NO: 296159 - DNA, 16 bp, C. familiaris
aaaatcttaaaagaca

SEQ ID NO: 296160 - DNA, 16 bp, C. familiaris
aaaatcttagaagaaa

SEQ ID NO: 296161 - DNA, 16 bp, C. familiaris
aaaatcttaggaaaaa

SEQ ID NO: 296162 - DNA, 16 bp, C. familiaris
aaaatcttcaaaagaa

SEQ ID NO: 296163 - DNA, 16 bp, C. familiaris
aaaatcttcagaaaca

SEQ ID NO: 296164 - DNA, 16 bp, C. familiaris
aaaatcttgaagaaaa

SEQ ID NO: 296165 - DNA, 16 bp, C. familiaris
aaaatctttcaaacaa

SEQ ID NO: 296166 - DNA, 16 bp, C. familiaris
aaaatctttctgaaaa

SEQ ID NO: 296167 - DNA, 16 bp, C. familiaris
aaaatctttctttctt

SEQ ID NO: 296168 - DNA, 16 bp, C. familiaris
aaaatctttgaagaaa

SEQ ID NO: 296169 - DNA, 16 bp, C. familiaris
aaaatctttgttttaa

SEQ ID NO: 296170 - DNA, 16 bp, C. familiaris
aaaatcttttctttct

SEQ ID NO: 296171 - DNA, 16 bp, C. familiaris
aaaatcttttgaaaga

SEQ ID NO: 296172 - DNA, 16 bp, C. familiaris
aaaatcttttggaaaa

SEQ ID NO: 296173 - DNA, 16 bp, C. familiaris
aaaatgaaaaacttct

SEQ ID NO: 296174 - DNA, 16 bp, C. familiaris
aaaatgaaaaatactg

SEQ ID NO: 296175 - DNA, 16 bp, C. familiaris
aaaatgaaaaccttaa

SEQ ID NO: 296176 - DNA, 16 bp, C. familiaris
aaaatgaaaagcattt

SEQ ID NO: 296177 - DNA, 16 bp, C. familiaris
aaaatgaaacattttt

SEQ ID NO: 296178 - DNA, 16 bp, C. familiaris
aaaatgaaactaaatt

SEQ ID NO: 296179 - DNA, 16 bp, C. familiaris
aaaatgaaactggacc

SEQ ID NO: 296180 - DNA, 16 bp, C. familiaris
aaaatgaaatcatgaa

SEQ ID NO: 296181 - DNA, 16 bp, C. familiaris
aaaatgaaatgtcaaa

SEQ ID NO: 296182 - DNA, 16 bp, C. familiaris
aaaatgaacagaagac

SEQ ID NO: 296183 - DNA, 16 bp, C. familiaris
aaaatgaacagagcct

SEQ ID NO: 296184 - DNA, 16 bp, C. familiaris
aaaatgaactatttgg

SEQ ID NO: 296185 - DNA, 16 bp, C. familiaris
aaaatgaactggaaaa

SEQ ID NO: 296186 - DNA, 16 bp, C. familiaris
aaaatgaacttgaaaa

SEQ ID NO: 296187 - DNA, 16 bp, C. familiaris
aaaatgaacttgaaat

SEQ ID NO: 296188 - DNA, 16 bp, C. familiaris
aaaatgaacttttaaa

SEQ ID NO: 296189 - DNA, 16 bp, C. familiaris
aaaatgaacttttggg

SEQ ID NO: 296190 - DNA, 16 bp, C. familiaris
aaaatgaagaaagcat

SEQ ID NO: 296191 - DNA, 16 bp, C. familiaris
aaaatgaagacacaac

SEQ ID NO: 296192 - DNA, 16 bp, C. familiaris
aaaatgaagacataat

SEQ ID NO: 296193 - DNA, 16 bp, C. familiaris
aaaatgaagagctggt

SEQ ID NO: 296194 - DNA, 16 bp, C. familiaris
aaaatgaaggaaaact

SEQ ID NO: 296195 - DNA, 16 bp, C. familiaris
aaaatgaagtctttaa

SEQ ID NO: 296196 - DNA, 16 bp, C. familiaris
aaaatgaatattttga

SEQ ID NO: 296197 - DNA, 16 bp, C. familiaris
aaaatgaatttacaaa

SEQ ID NO: 296198 - DNA, 16 bp, C. familiaris
aaaatgaatttgaaag

SEQ ID NO: 296199 - DNA, 16 bp, C. familiaris
aaaatgaatttttcta

SEQ ID NO: 296200 - DNA, 16 bp, C. familiaris
aaaatgacaaatttta

SEQ ID NO: 296201 - DNA, 16 bp, C. familiaris
aaaatgacaagacaga

SEQ ID NO: 296202 - DNA, 16 bp, C. familiaris
aaaatgacagaatttt

SEQ ID NO: 296203 - DNA, 16 bp, C. familiaris
aaaatgactttgaaaa

SEQ ID NO: 296204 - DNA, 16 bp, C. familiaris
aaaatgagaaaactga

SEQ ID NO: 296205 - DNA, 16 bp, C. familiaris
aaaatgaggaaattga

SEQ ID NO: 296206 - DNA, 16 bp, C. familiaris
aaaatgaggcagaaaa

SEQ ID NO: 296207 - DNA, 16 bp, C. familiaris
aaaatgagttttcttt

SEQ ID NO: 296208 - DNA, 16 bp, C. familiaris
aaaatgataaattgga

SEQ ID NO: 296209 - DNA, 16 bp, C. familiaris
aaaatgattcattttt

SEQ ID NO: 296210 - DNA, 16 bp, C. familiaris
aaaatgatttcaaaaa

SEQ ID NO: 296211 - DNA, 16 bp, C. familiaris
aaaatgatttctttct

SEQ ID NO: 296212 - DNA, 16 bp, C. familiaris
aaaatgattttttctt

SEQ ID NO: 296213 - DNA, 16 bp, C. familiaris
aaaatgcaaaatatat

SEQ ID NO: 296214 - DNA, 16 bp, C. familiaris
aaaatgcaaaatattt

SEQ ID NO: 296215 - DNA, 16 bp, C. familiaris
aaaatgcaaatattat

SEQ ID NO: 296216 - DNA, 16 bp, C. familiaris
aaaatgcaatttaaaa

SEQ ID NO: 296217 - DNA, 16 bp, C. familiaris
aaaatgcatataaaat

SEQ ID NO: 296218 - DNA, 16 bp, C. familiaris
aaaatgcatatgaaaa

SEQ ID NO: 296219 - DNA, 16 bp, C. familiaris
aaaatgcatttccttt

SEQ ID NO: 296220 - DNA, 16 bp, C. familiaris
aaaatgccatttttct

SEQ ID NO: 296221 - DNA, 16 bp, C. familiaris
aaaatgcctattcagg

SEQ ID NO: 296222 - DNA, 16 bp, C. familiaris
aaaatgctaaattaaa

SEQ ID NO: 296223 - DNA, 16 bp, C. familiaris
aaaatgctattgatat

SEQ ID NO: 296224 - DNA, 16 bp, C. familiaris
aaaatgctttattttt

SEQ ID NO: 296225 - DNA, 16 bp, C. familiaris
aaaatgctttgaaaaa

SEQ ID NO: 296226 - DNA, 16 bp, C. familiaris
aaaatgctttgaaaag

SEQ ID NO: 296227 - DNA, 16 bp, C. familiaris
aaaatgcttttagaaa

SEQ ID NO: 296228 - DNA, 16 bp, C. familiaris
aaaatggaaacttttt

SEQ ID NO: 296229 - DNA, 16 bp, C. familiaris
aaaatggaagcagaaa

SEQ ID NO: 296230 - DNA, 16 bp, C. familiaris
aaaatggaataatttt

SEQ ID NO: 296231 - DNA, 16 bp, C. familiaris
aaaatggaatctttaa

SEQ ID NO: 296232 - DNA, 16 bp, C. familiaris
aaaatggactaaaaat

SEQ ID NO: 296233 - DNA, 16 bp, C. familiaris
aaaatggagaaacaga

SEQ ID NO: 296234 - DNA, 16 bp, C. familiaris
aaaatggagatatttt

SEQ ID NO: 296235 - DNA, 16 bp, C. familiaris
aaaatggagatttttt

SEQ ID NO: 296236 - DNA, 16 bp, C. familiaris
aaaatggataaattgg

SEQ ID NO: 296237 - DNA, 16 bp, C. familiaris
aaaatggattaagacc

SEQ ID NO: 296238 - DNA, 16 bp, C. familiaris
aaaatggatttattta

SEQ ID NO: 296239 - DNA, 16 bp, C. familiaris
aaaatggattttaaat

SEQ ID NO: 296240 - DNA, 16 bp, C. familiaris
aaaatggcaaaaagca

SEQ ID NO: 296241 - DNA, 16 bp, C. familiaris
aaaatggcaaattttt

SEQ ID NO: 296242 - DNA, 16 bp, C. familiaris
aaaatggcaataagaa

SEQ ID NO: 296243 - DNA, 16 bp, C. familiaris
aaaatggcaataataa

SEQ ID NO: 296244 - DNA, 16 bp, C. familiaris
aaaatggcagaaataa

SEQ ID NO: 296245 - DNA, 16 bp, C. familiaris
aaaatggcattaaaaa

SEQ ID NO: 296246 - DNA, 16 bp, C. familiaris
aaaatggccaaaatcc

SEQ ID NO: 296247 - DNA, 16 bp, C. familiaris
aaaatggctcctcaga

SEQ ID NO: 296248 - DNA, 16 bp, C. familiaris
aaaatgggcagaaggc

SEQ ID NO: 296249 - DNA, 16 bp, C. familiaris
aaaatggggagacaga

SEQ ID NO: 296250 - DNA, 16 bp, C. familiaris
aaaatggggatgatga

SEQ ID NO: 296251 - DNA, 16 bp, C. familiaris
aaaatggggattaaaa

SEQ ID NO: 296252 - DNA, 16 bp, C. familiaris
aaaatgggggcacctg

SEQ ID NO: 296253 - DNA, 16 bp, C. familiaris
aaaatgggggtgcctg

SEQ ID NO: 296254 - DNA, 16 bp, C. familiaris
aaaatgggtgaagaag

SEQ ID NO: 296255 - DNA, 16 bp, C. familiaris
aaaatggtacagacac

SEQ ID NO: 296256 - DNA, 16 bp, C. familiaris
aaaatggtatcttttt

SEQ ID NO: 296257 - DNA, 16 bp, C. familiaris
aaaatggtattttaaa

SEQ ID NO: 296258 - DNA, 16 bp, C. familiaris
aaaatggtgaagatgg

SEQ ID NO: 296259 - DNA, 16 bp, C. familiaris
aaaatggttttacttt

SEQ ID NO: 296260 - DNA, 16 bp, C. familiaris
aaaatgtaaaagcttt

SEQ ID NO: 296261 - DNA, 16 bp, C. familiaris
aaaatgtaaaatactt

SEQ ID NO: 296262 - DNA, 16 bp, C. familiaris
aaaatgtaaacaaagt

SEQ ID NO: 296263 - DNA, 16 bp, C. familiaris
aaaatgtaaagatttt

SEQ ID NO: 296264 - DNA, 16 bp, C. familiaris
aaaatgtaaagcattt

SEQ ID NO: 296265 - DNA, 16 bp, C. familiaris
aaaatgtaaatgaatg

SEQ ID NO: 296266 - DNA, 16 bp, C. familiaris
aaaatgtaaatgtgaa

SEQ ID NO: 296267 - DNA, 16 bp, C. familiaris
aaaatgtaaatgtttt

SEQ ID NO: 296268 - DNA, 16 bp, C. familiaris
aaaatgtacacaaata

SEQ ID NO: 296269 - DNA, 16 bp, C. familiaris
aaaatgtacataaata

SEQ ID NO: 296270 - DNA, 16 bp, C. familiaris
aaaatgtacttttttt

SEQ ID NO: 296271 - DNA, 16 bp, C. familiaris
aaaatgtatacagatt

SEQ ID NO: 296272 - DNA, 16 bp, C. familiaris
aaaatgtatctttaaa

SEQ ID NO: 296273 - DNA, 16 bp, C. familiaris
aaaatgtattttcaaa

SEQ ID NO: 296274 - DNA, 16 bp, C. familiaris
aaaatgtattttgctt

SEQ ID NO: 296275 - DNA, 16 bp, C. familiaris
aaaatgtattttgtat

SEQ ID NO: 296276 - DNA, 16 bp, C. familiaris
aaaatgtcaaaaatat

SEQ ID NO: 296277 - DNA, 16 bp, C. familiaris
aaaatgtcaaaatttt

SEQ ID NO: 296278 - DNA, 16 bp, C. familiaris
aaaatgtcaaatatat

SEQ ID NO: 296279 - DNA, 16 bp, C. familiaris
aaaatgtcaattctcc

SEQ ID NO: 296280 - DNA, 16 bp, C. familiaris
aaaatgtcagtgttac

SEQ ID NO: 296281 - DNA, 16 bp, C. familiaris
aaaatgtctctggaca

SEQ ID NO: 296282 - DNA, 16 bp, C. familiaris
aaaatgtctgaaaatt

SEQ ID NO: 296283 - DNA, 16 bp, C. familiaris
aaaatgtgaaaaacag

SEQ ID NO: 296284 - DNA, 16 bp, C. familiaris
aaaatgtgaaaacaat

SEQ ID NO: 296285 - DNA, 16 bp, C. familiaris
aaaatgtgattatata

SEQ ID NO: 296286 - DNA, 16 bp, C. familiaris
aaaatgtgatttttct

SEQ ID NO: 296287 - DNA, 16 bp, C. familiaris
aaaatgtgcattttaa

SEQ ID NO: 296288 - DNA, 16 bp, C. familiaris
aaaatgtgctttttaa

SEQ ID NO: 296289 - DNA, 16 bp, C. familiaris
aaaatgtggaaaatat

SEQ ID NO: 296290 - DNA, 16 bp, C. familiaris
aaaatgtggatattaa

SEQ ID NO: 296291 - DNA, 16 bp, C. familiaris
aaaatgtgtacatgaa

SEQ ID NO: 296292 - DNA, 16 bp, C. familiaris
aaaatgtgtgtgcatg

SEQ ID NO: 296293 - DNA, 16 bp, C. familiaris
aaaatgtgttttcctt

SEQ ID NO: 296294 - DNA, 16 bp, C. familiaris
aaaatgttaaacacag

SEQ ID NO: 296295 - DNA, 16 bp, C. familiaris
aaaatgttaaatttgt

SEQ ID NO: 296296 - DNA, 16 bp, C. familiaris
aaaatgttaccatttt

SEQ ID NO: 296297 - DNA, 16 bp, C. familiaris
aaaatgttagcaaact

SEQ ID NO: 296298 - DNA, 16 bp, C. familiaris
aaaatgttcaaaaata

SEQ ID NO: 296299 - DNA, 16 bp, C. familiaris
aaaatgttcattttta

SEQ ID NO: 296300 - DNA, 16 bp, C. familiaris
aaaatgttctgtaaat

SEQ ID NO: 296301 - DNA, 16 bp, C. familiaris
aaaatgttgaaattat

SEQ ID NO: 296302 - DNA, 16 bp, C. familiaris
aaaatgttgagagaaa

SEQ ID NO: 296303 - DNA, 16 bp, C. familiaris
aaaatgttggagagga

SEQ ID NO: 296304 - DNA, 16 bp, C. familiaris
aaaatgttgtttaaaa

SEQ ID NO: 296305 - DNA, 16 bp, C. familiaris
aaaatgtttaaagtat

SEQ ID NO: 296306 - DNA, 16 bp, C. familiaris
aaaatgtttaaatact

SEQ ID NO: 296307 - DNA, 16 bp, C. familiaris
aaaatgtttacatttt

SEQ ID NO: 296308 - DNA, 16 bp, C. familiaris
aaaatgtttatgctac

SEQ ID NO: 296309 - DNA, 16 bp, C. familiaris
aaaatgtttcactttt

SEQ ID NO: 296310 - DNA, 16 bp, C. familiaris
aaaatgtttctgcaca

SEQ ID NO: 296311 - DNA, 16 bp, C. familiaris
aaaatgtttctgtttt

SEQ ID NO: 296312 - DNA, 16 bp, C. familiaris
aaaatgttttaaaaac

SEQ ID NO: 296313 - DNA, 16 bp, C. familiaris
aaaatgttttaatttc

SEQ ID NO: 296314 - DNA, 16 bp, C. familiaris
aaaatgttttcagaca

SEQ ID NO: 296315 - DNA, 16 bp, C. familiaris
aaaatgttttccttat

SEQ ID NO: 296316 - DNA, 16 bp, C. familiaris
aaaatgttttggaaaa

SEQ ID NO: 296317 - DNA, 16 bp, C. familiaris
aaaatgtttttcaaaa

SEQ ID NO: 296318 - DNA, 16 bp, C. familiaris
aaaatgttttttcaaa

SEQ ID NO: 296319 - DNA, 16 bp, C. familiaris
aaaattaaaataactg

SEQ ID NO: 296320 - DNA, 16 bp, C. familiaris
aaaattaaaatttctg

SEQ ID NO: 296321 - DNA, 16 bp, C. familiaris
aaaattaaaggttgga

SEQ ID NO: 296322 - DNA, 16 bp, C. familiaris
aaaattaaatgaggta

SEQ ID NO: 296323 - DNA, 16 bp, C. familiaris
aaaattaaatgtcttt

SEQ ID NO: 296324 - DNA, 16 bp, C. familiaris
aaaattaacaactcag

SEQ ID NO: 296325 - DNA, 16 bp, C. familiaris
aaaattaataaaactg

SEQ ID NO: 296326 - DNA, 16 bp, C. familiaris
aaaattaatgaaagac

SEQ ID NO: 296327 - DNA, 16 bp, C. familiaris
aaaattaatgaaatca

SEQ ID NO: 296328 - DNA, 16 bp, C. familiaris
aaaattaatgtacaaa

SEQ ID NO: 296329 - DNA, 16 bp, C. familiaris
aaaattaatttgcttt

SEQ ID NO: 296330 - DNA, 16 bp, C. familiaris
aaaattaattttacca

SEQ ID NO: 296331 - DNA, 16 bp, C. familiaris
aaaattaattttcctt

SEQ ID NO: 296332 - DNA, 16 bp, C. familiaris
aaaattacatttgaaa

SEQ ID NO: 296333 - DNA, 16 bp, C. familiaris
aaaattactctttaaa

SEQ ID NO: 296334 - DNA, 16 bp, C. familiaris
aaaattactgattttt

SEQ ID NO: 296335 - DNA, 16 bp, C. familiaris
aaaattacttcatttt

SEQ ID NO: 296336 - DNA, 16 bp, C. familiaris
aaaattatcttgaaaa

SEQ ID NO: 296337 - DNA, 16 bp, C. familiaris
aaaattatgaaattca

SEQ ID NO: 296338 - DNA, 16 bp, C. familiaris
aaaattattcattgtt

SEQ ID NO: 296339 - DNA, 16 bp, C. familiaris
aaaattatttctgttt

SEQ ID NO: 296340 - DNA, 16 bp, C. familiaris
aaaattatttgtaaag

SEQ ID NO: 296341 - DNA, 16 bp, C. familiaris
aaaattattttagaag

SEQ ID NO: 296342 - DNA, 16 bp, C. familiaris
aaaattcaaattctga

SEQ ID NO: 296343 - DNA, 16 bp, C. familiaris
aaaattcaacattttt

SEQ ID NO: 296344 - DNA, 16 bp, C. familiaris
aaaattcacaatgtct

SEQ ID NO: 296345 - DNA, 16 bp, C. familiaris
aaaattcacttttatt

SEQ ID NO: 296346 - DNA, 16 bp, C. familiaris
aaaattcaggaaattt

SEQ ID NO: 296347 - DNA, 16 bp, C. familiaris
aaaattccattttcat

SEQ ID NO: 296348 - DNA, 16 bp, C. familiaris
aaaattcctaaaagaa

SEQ ID NO: 296349 - DNA, 16 bp, C. familiaris
aaaattccttaaaatt

SEQ ID NO: 296350 - DNA, 16 bp, C. familiaris
aaaattccttttgaaa

SEQ ID NO: 296351 - DNA, 16 bp, C. familiaris
aaaattctcaacagaa

SEQ ID NO: 296352 - DNA, 16 bp, C. familiaris
aaaattctcaagaaaa

SEQ ID NO: 296353 - DNA, 16 bp, C. familiaris
aaaattctcagccatt

SEQ ID NO: 296354 - DNA, 16 bp, C. familiaris
aaaattctctttttaa

SEQ ID NO: 296355 - DNA, 16 bp, C. familiaris
aaaattctgaaatttt

SEQ ID NO: 296356 - DNA, 16 bp, C. familiaris
aaaattctgaacaaaa

SEQ ID NO: 296357 - DNA, 16 bp, C. familiaris
aaaattctgaaggaaa

SEQ ID NO: 296358 - DNA, 16 bp, C. familiaris
aaaattctgaggaaaa

SEQ ID NO: 296359 - DNA, 16 bp, C. familiaris
aaaattctgagggaaa

SEQ ID NO: 296360 - DNA, 16 bp, C. familiaris
aaaattcttttgaaaa

SEQ ID NO: 296361 - DNA, 16 bp, C. familiaris
aaaattgaaaatgttt

SEQ ID NO: 296362 - DNA, 16 bp, C. familiaris
aaaattgacaaatctt

SEQ ID NO: 296363 - DNA, 16 bp, C. familiaris
aaaattgagaatttta

SEQ ID NO: 296364 - DNA, 16 bp, C. familiaris
aaaattgatttcaaaa

SEQ ID NO: 296365 - DNA, 16 bp, C. familiaris
aaaattgcacccaaaa

SEQ ID NO: 296366 - DNA, 16 bp, C. familiaris
aaaattggaaaaatct

SEQ ID NO: 296367 - DNA, 16 bp, C. familiaris
aaaattgtcttcattt

SEQ ID NO: 296368 - DNA, 16 bp, C. familiaris
aaaattgtgtatattt

SEQ ID NO: 296369 - DNA, 16 bp, C. familiaris
aaaattgttattttct

SEQ ID NO: 296370 - DNA, 16 bp, C. familiaris
aaaatttaaaaagttc

SEQ ID NO: 296371 - DNA, 16 bp, C. familiaris
aaaatttaaaaccttt

SEQ ID NO: 296372 - DNA, 16 bp, C. familiaris
aaaatttaaacacaga

SEQ ID NO: 296373 - DNA, 16 bp, C. familiaris
aaaatttaattccagt

SEQ ID NO: 296374 - DNA, 16 bp, C. familiaris
aaaatttacaaagaac

SEQ ID NO: 296375 - DNA, 16 bp, C. familiaris
aaaatttacatgaaat

SEQ ID NO: 296376 - DNA, 16 bp, C. familiaris
aaaatttaccatcttt

SEQ ID NO: 296377 - DNA, 16 bp, C. familiaris
aaaatttactacaaag

SEQ ID NO: 296378 - DNA, 16 bp, C. familiaris
aaaatttatgtggaaa

SEQ ID NO: 296379 - DNA, 16 bp, C. familiaris
aaaatttcagaatttt

SEQ ID NO: 296380 - DNA, 16 bp, C. familiaris
aaaatttcatgttttt

SEQ ID NO: 296381 - DNA, 16 bp, C. familiaris
aaaatttcctaaattt

SEQ ID NO: 296382 - DNA, 16 bp, C. familiaris
aaaatttctagaaaaa

SEQ ID NO: 296383 - DNA, 16 bp, C. familiaris
aaaatttctgaagaaa

SEQ ID NO: 296384 - DNA, 16 bp, C. familiaris
aaaatttcttctttaa

SEQ ID NO: 296385 - DNA, 16 bp, C. familiaris
aaaatttctttcaaaa

SEQ ID NO: 296386 - DNA, 16 bp, C. familiaris
aaaatttctttttgaa

SEQ ID NO: 296387 - DNA, 16 bp, C. familiaris
aaaatttgccatttgc

SEQ ID NO: 296388 - DNA, 16 bp, C. familiaris
aaaatttggagaaaat

SEQ ID NO: 296389 - DNA, 16 bp, C. familiaris
aaaatttgtagaagaa

SEQ ID NO: 296390 - DNA, 16 bp, C. familiaris
aaaatttgtatggaac

SEQ ID NO: 296391 - DNA, 16 bp, C. familiaris
aaaattttaaacagaa

SEQ ID NO: 296392 - DNA, 16 bp, C. familiaris
aaaattttaaagtctt

SEQ ID NO: 296393 - DNA, 16 bp, C. familiaris
aaaattttaaatacag

SEQ ID NO: 296394 - DNA, 16 bp, C. familiaris
aaaattttactgaaat

SEQ ID NO: 296395 - DNA, 16 bp, C. familiaris
aaaattttcaagaatt

SEQ ID NO: 296396 - DNA, 16 bp, C. familiaris
aaaattttcagccatt

SEQ ID NO: 296397 - DNA, 16 bp, C. familiaris
aaaattttcattcaaa

SEQ ID NO: 296398 - DNA, 16 bp, C. familiaris
aaaattttcttgaaat

SEQ ID NO: 296399 - DNA, 16 bp, C. familiaris
aaaattttcttttgaa

SEQ ID NO: 296400 - DNA, 16 bp, C. familiaris
aaaatttttaagtgtt

SEQ ID NO: 296401 - DNA, 16 bp, C. familiaris
aaaattttttgagaaa

SEQ ID NO: 296402 - DNA, 16 bp, C. familiaris
aaaatttttttggaaa

SEQ ID NO: 296403 - DNA, 16 bp, C. familiaris
aaacaaaaaacctggc

SEQ ID NO: 296404 - DNA, 16 bp, C. familiaris
aaacaaaaaagatttc

SEQ ID NO: 296405 - DNA, 16 bp, C. familiaris
aaacaaaaacaagttt

SEQ ID NO: 296406 - DNA, 16 bp, C. familiaris
aaacaaaaacctttta

SEQ ID NO: 296407 - DNA, 16 bp, C. familiaris
aaacaaaaattttgaa

SEQ ID NO: 296408 - DNA, 16 bp, C. familiaris
aaacaaaacagaactg

SEQ ID NO: 296409 - DNA, 16 bp, C. familiaris
aaacaaaacagatttt

SEQ ID NO: 296410 - DNA, 16 bp, C. familiaris
aaacaaaacttcattt

SEQ ID NO: 296411 - DNA, 16 bp, C. familiaris
aaacaaaagtctagga

SEQ ID NO: 296412 - DNA, 16 bp, C. familiaris
aaacaaaatcatgaat

SEQ ID NO: 296413 - DNA, 16 bp, C. familiaris
aaacaaaatgtggaat

SEQ ID NO: 296414 - DNA, 16 bp, C. familiaris
aaacaaaatttccttt

SEQ ID NO: 296415 - DNA, 16 bp, C. familiaris
aaacaaagaatccagt

SEQ ID NO: 296416 - DNA, 16 bp, C. familiaris
aaacaaaggctttgaa

SEQ ID NO: 296417 - DNA, 16 bp, C. familiaris
aaacaaatatgtattt

SEQ ID NO: 296418 - DNA, 16 bp, C. familiaris
aaacaaatctttgaaa

SEQ ID NO: 296419 - DNA, 16 bp, C. familiaris
aaacaaatgatcatag

SEQ ID NO: 296420 - DNA, 16 bp, C. familiaris
aaacaacagaaatttc

SEQ ID NO: 296421 - DNA, 16 bp, C. familiaris
aaacaacatatttttt

SEQ ID NO: 296422 - DNA, 18 bp, C. familiaris
aaacaactcccactgagc

SEQ ID NO: 296423 - DNA, 16 bp, C. familiaris
aaacaactctaaaatt

SEQ ID NO: 296424 - DNA, 16 bp, C. familiaris
aaacaaggaaactgag

SEQ ID NO: 296425 - DNA, 16 bp, C. familiaris
aaacaaggtcacattc

SEQ ID NO: 296426 - DNA, 16 bp, C. familiaris
aaacaatgattataaa

SEQ ID NO: 296427 - DNA, 16 bp, C. familiaris
aaacaattttgagaaa

SEQ ID NO: 296428 - DNA, 16 bp, C. familiaris
aaacacaaatgatttt

SEQ ID NO: 296429 - DNA, 16 bp, C. familiaris
aaacacaaatttgaaa

SEQ ID NO: 296430 - DNA, 16 bp, C. familiaris
aaacacaatattttta

SEQ ID NO: 296431 - DNA, 16 bp, C. familiaris
aaacacacacatgtgc

SEQ ID NO: 296432 - DNA, 16 bp, C. familiaris
aaacacacacgtgcac

SEQ ID NO: 296433 - DNA, 16 bp, C. familiaris
aaacacagagaggcag

SEQ ID NO: 296434 - DNA, 16 bp, C. familiaris
aaacacagatgaaaga

SEQ ID NO: 296435 - DNA, 16 bp, C. familiaris
aaacacagattgctgg

SEQ ID NO: 296436 - DNA, 16 bp, C. familiaris
aaacacatttttgttt

SEQ ID NO: 296437 - DNA, 16 bp, C. familiaris
aaacactattttattt

SEQ ID NO: 296438 - DNA, 16 bp, C. familiaris
aaacactgaaatattt

SEQ ID NO: 296439 - DNA, 16 bp, C. familiaris
aaacactggaaagaac

SEQ ID NO: 296440 - DNA, 16 bp, C. familiaris
aaacactggaccagat

SEQ ID NO: 296441 - DNA, 16 bp, C. familiaris
aaacactggggtgcag

SEQ ID NO: 296442 - DNA, 16 bp, C. familiaris
aaacacttgttgaatg

SEQ ID NO: 296443 - DNA, 16 bp, C. familiaris
aaacagaaaattttaa

SEQ ID NO: 296444 - DNA, 16 bp, C. familiaris
aaacagaaaggaaatg

SEQ ID NO: 296445 - DNA, 16 bp, C. familiaris
aaacagaaattttaaa

SEQ ID NO: 296446 - DNA, 16 bp, C. familiaris
aaacagaagatcctta

SEQ ID NO: 296447 - DNA, 16 bp, C. familiaris
aaacagaattattttt

SEQ ID NO: 296448 - DNA, 16 bp, C. familiaris
aaacagaatttgagaa

SEQ ID NO: 296449 - DNA, 16 bp, C. familiaris
aaacagacatgtagat

SEQ ID NO: 296450 - DNA, 16 bp, C. familiaris
aaacagacattcaagt

SEQ ID NO: 296451 - DNA, 16 bp, C. familiaris
aaacagacccagaaat

SEQ ID NO: 296452 - DNA, 16 bp, C. familiaris
aaacagacttaactat

SEQ ID NO: 296453 - DNA, 16 bp, C. familiaris
aaacagagaacaaact

SEQ ID NO: 296454 - DNA, 16 bp, C. familiaris
aaacagagagaggggc

SEQ ID NO: 296455 - DNA, 16 bp, C. familiaris
aaacagagcttttcct

SEQ ID NO: 296456 - DNA, 16 bp, C. familiaris
aaacagaggaatatgt

SEQ ID NO: 296457 - DNA, 16 bp, C. familiaris
aaacagatatctagat

SEQ ID NO: 296458 - DNA, 16 bp, C. familiaris
aaacagatgaacaaat

SEQ ID NO: 296459 - DNA, 16 bp, C. familiaris
aaacagatgagcaaag

SEQ ID NO: 296460 - DNA, 16 bp, C. familiaris
aaacagattattaaaa

SEQ ID NO: 296461 - DNA, 16 bp, C. familiaris
aaacagattctttttt

SEQ ID NO: 296462 - DNA, 16 bp, C. familiaris
aaacagcagcagcagc

SEQ ID NO: 296463 - DNA, 16 bp, C. familiaris
aaacagcaggtgcaaa

SEQ ID NO: 296464 - DNA, 16 bp, C. familiaris
aaacagctttaaaaaa

SEQ ID NO: 296465 - DNA, 16 bp, C. familiaris
aaacaggatcttgaag

SEQ ID NO: 296466 - DNA, 16 bp, C. familiaris
aaacaggcagtgggcc

SEQ ID NO: 296467 - DNA, 16 bp, C. familiaris
aaacaggctccctgct

SEQ ID NO: 296468 - DNA, 16 bp, C. familiaris
aaacaggtgatgggaa

SEQ ID NO: 296469 - DNA, 16 bp, C. familiaris
aaacaggtgcagccac

SEQ ID NO: 296470 - DNA, 16 bp, C. familiaris
aaacaggtggcaggct

SEQ ID NO: 296471 - DNA, 16 bp, C. familiaris
aaacagtaaaatactt

SEQ ID NO: 296472 - DNA, 16 bp, C. familiaris
aaacagtaagaaaact

SEQ ID NO: 296473 - DNA, 16 bp, C. familiaris
aaacagtatgaagatt

SEQ ID NO: 296474 - DNA, 16 bp, C. familiaris
aaacagtatggtaatg

SEQ ID NO: 296475 - DNA, 16 bp, C. familiaris
aaacagtttttaaaat

SEQ ID NO: 296476 - DNA, 17 bp, C. familiaris
aaacataatggtccaaa

SEQ ID NO: 296477 - DNA, 16 bp, C. familiaris
aaacatacctcaatat

SEQ ID NO: 296478 - DNA, 16 bp, C. familiaris
aaacatagtgattcaa

SEQ ID NO: 296479 - DNA, 16 bp, C. familiaris
aaacatatgaaatgat

SEQ ID NO: 296480 - DNA, 16 bp, C. familiaris
aaacatatggtttcac

SEQ ID NO: 296481 - DNA, 16 bp, C. familiaris
aaacatatttctttta

SEQ ID NO: 296482 - DNA, 16 bp, C. familiaris
aaacatccaaattcat

SEQ ID NO: 296483 - DNA, 16 bp, C. familiaris
aaacatctgattcttg

SEQ ID NO: 296484 - DNA, 16 bp, C. familiaris
aaacatctgcctctgg

SEQ ID NO: 296485 - DNA, 16 bp, C. familiaris
aaacatcttttttctt

SEQ ID NO: 296486 - DNA, 16 bp, C. familiaris
aaacatgaaatttaaa

SEQ ID NO: 296487 - DNA, 16 bp, C. familiaris
aaacatgaatggataa

SEQ ID NO: 296488 - DNA, 16 bp, C. familiaris
aaacatggaaaatatt

SEQ ID NO: 296489 - DNA, 16 bp, C. familiaris
aaacatggggaaaaaa

SEQ ID NO: 296490 - DNA, 16 bp, C. familiaris
aaacatgtaaagaaga

SEQ ID NO: 296491 - DNA, 16 bp, C. familiaris
aaacattaaagaaatt

SEQ ID NO: 296492 - DNA, 16 bp, C. familiaris
aaacattaagaaaatg

SEQ ID NO: 296493 - DNA, 16 bp, C. familiaris
aaacattatttctgag

SEQ ID NO: 296494 - DNA, 16 bp, C. familiaris
aaacattcagaaaaat

SEQ ID NO: 296495 - DNA, 16 bp, C. familiaris
aaacattcatttattc

SEQ ID NO: 296496 - DNA, 16 bp, C. familiaris
aaacattccattctca

SEQ ID NO: 296497 - DNA, 16 bp, C. familiaris
aaacattcctttaaaa

SEQ ID NO: 296498 - DNA, 16 bp, C. familiaris
aaacattgttgaaaga

SEQ ID NO: 296499 - DNA, 16 bp, C. familiaris
aaacatttaaaaagat

SEQ ID NO: 296500 - DNA, 16 bp, C. familiaris
aaacatttaaagatga

SEQ ID NO: 296501 - DNA, 16 bp, C. familiaris
aaacatttaatgaaga

SEQ ID NO: 296502 - DNA, 16 bp, C. familiaris
aaacatttagaaaata

SEQ ID NO: 296503 - DNA, 16 bp, C. familiaris
aaacatttagaaaatg

SEQ ID NO: 296504 - DNA, 16 bp, C. familiaris
aaacatttcaagaaaa

SEQ ID NO: 296505 - DNA, 16 bp, C. familiaris
aaacatttcaagaaga

SEQ ID NO: 296506 - DNA, 16 bp, C. familiaris
aaacatttcattcttt

SEQ ID NO: 296507 - DNA, 16 bp, C. familiaris
aaacatttcctttcct

SEQ ID NO: 296508 - DNA, 16 bp, C. familiaris
aaacatttctgaaatt

SEQ ID NO: 296509 - DNA, 16 bp, C. familiaris
aaacatttgaaaatta

SEQ ID NO: 296510 - DNA, 16 bp, C. familiaris
aaacatttgttgaaat

SEQ ID NO: 296511 - DNA, 16 bp, C. familiaris
aaacattttaacattt

SEQ ID NO: 296512 - DNA, 16 bp, C. familiaris
aaacattttatataca

SEQ ID NO: 296513 - DNA, 16 bp, C. familiaris
aaacattttccccaaa

SEQ ID NO: 296514 - DNA, 16 bp, C. familiaris
aaacattttgaaaata

SEQ ID NO: 296515 - DNA, 16 bp, C. familiaris
aaacattttgaatttt

SEQ ID NO: 296516 - DNA, 16 bp, C. familiaris
aaacattttgctattt

SEQ ID NO: 296517 - DNA, 16 bp, C. familiaris
aaacatttttgaaatg

SEQ ID NO: 296518 - DNA, 16 bp, C. familiaris
aaacattttttccaaa

SEQ ID NO: 296519 - DNA, 16 bp, C. familiaris
aaaccaagactcagat

SEQ ID NO: 296520 - DNA, 16 bp, C. familiaris
aaaccaagagtcagcc

SEQ ID NO: 296521 - DNA, 16 bp, C. familiaris
aaaccaagagttgtat

SEQ ID NO: 296522 - DNA, 16 bp, C. familiaris
aaaccaaggtggctat

SEQ ID NO: 296523 - DNA, 18 bp, C. familiaris
aaaccaaggtggctatgg

SEQ ID NO: 296524 - DNA, 16 bp, C. familiaris
aaaccaataacacatt

SEQ ID NO: 296525 - DNA, 16 bp, C. familiaris
aaaccacagctggggg

SEQ ID NO: 296526 - DNA, 16 bp, C. familiaris
aaaccactgaactacc

SEQ ID NO: 296527 - DNA, 16 bp, C. familiaris
aaaccacttttttttt

SEQ ID NO: 296528 - DNA, 16 bp, C. familiaris
aaaccagaagaggagg

SEQ ID NO: 296529 - DNA, 16 bp, C. familiaris
aaaccagatctgcaag

SEQ ID NO: 296530 - DNA, 16 bp, C. familiaris
aaaccaggagctggct

SEQ ID NO: 296531 - DNA, 16 bp, C. familiaris
aaaccatcctgaaaac

SEQ ID NO: 296532 - DNA, 16 bp, C. familiaris
aaaccatctttttttt

SEQ ID NO: 296533 - DNA, 16 bp, C. familiaris
aaaccattgagccact

SEQ ID NO: 296534 - DNA, 16 bp, C. familiaris
aaacccaaagttagca

SEQ ID NO: 296535 - DNA, 16 bp, C. familiaris
aaacccagaagtggaa

SEQ ID NO: 296536 - DNA, 16 bp, C. familiaris
aaacccagcagatgca

SEQ ID NO: 296537 - DNA, 16 bp, C. familiaris
aaacccagctctgcca

SEQ ID NO: 296538 - DNA, 16 bp, C. familiaris
aaaccccagaggagga

SEQ ID NO: 296539 - DNA, 16 bp, C. familiaris
aaaccctaaagatgcc

SEQ ID NO: 296540 - DNA, 16 bp, C. familiaris
aaaccgctaagccatc

SEQ ID NO: 296541 - DNA, 16 bp, C. familiaris
aaacctgaacaggaca

SEQ ID NO: 296542 - DNA, 16 bp, C. familiaris
aaacctgaacaggcct

SEQ ID NO: 296543 - DNA, 16 bp, C. familiaris
aaacctgattttaaaa

SEQ ID NO: 296544 - DNA, 16 bp, C. familiaris
aaacctggaggcatca

SEQ ID NO: 296545 - DNA, 16 bp, C. familiaris
aaaccttcagaaggaa

SEQ ID NO: 296546 - DNA, 16 bp, C. familiaris
aaacctttaaagaaga

SEQ ID NO: 296547 - DNA, 16 bp, C. familiaris
aaacctttaatttgta

SEQ ID NO: 296548 - DNA, 16 bp, C. familiaris
aaacctttctttcttt

SEQ ID NO: 296549 - DNA, 16 bp, C. familiaris
aaaccttttaaaaaca

SEQ ID NO: 296550 - DNA, 16 bp, C. familiaris
aaacgggcagaagaca

SEQ ID NO: 296551 - DNA, 16 bp, C. familiaris
aaacgttccatgctca

SEQ ID NO: 296552 - DNA, 16 bp, C. familiaris
aaactaaagaacactt

SEQ ID NO: 296553 - DNA, 16 bp, C. familiaris
aaactaagactcagag

SEQ ID NO: 296554 - DNA, 16 bp, C. familiaris
aaactaatgagaaatg

SEQ ID NO: 296555 - DNA, 16 bp, C. familiaris
aaactagagaaagaag

SEQ ID NO: 296556 - DNA, 16 bp, C. familiaris
aaactataaaaccttt

SEQ ID NO: 296557 - DNA, 16 bp, C. familiaris
aaactataatgaaata

SEQ ID NO: 296558 - DNA, 16 bp, C. familiaris
aaactatgaagaaaat

SEQ ID NO: 296559 - DNA, 16 bp, C. familiaris
aaactcaaaacagatt

SEQ ID NO: 296560 - DNA, 16 bp, C. familiaris
aaactcaaaatgatga

SEQ ID NO: 296561 - DNA, 16 bp, C. familiaris
aaactcaaaatggact

SEQ ID NO: 296562 - DNA, 16 bp, C. familiaris
aaactcaacaatgaga

SEQ ID NO: 296563 - DNA, 16 bp, C. familiaris
aaactcaatgacattt

SEQ ID NO: 296564 - DNA, 16 bp, C. familiaris
aaactcacagaagcag

SEQ ID NO: 296565 - DNA, 16 bp, C. familiaris
aaactcacagccctga

SEQ ID NO: 296566 - DNA, 16 bp, C. familiaris
aaactcatagaagaaa

SEQ ID NO: 296567 - DNA, 16 bp, C. familiaris
aaactcatcaagaaaa

SEQ ID NO: 296568 - DNA, 16 bp, C. familiaris
aaactcatgaccccaa

SEQ ID NO: 296569 - DNA, 16 bp, C. familiaris
aaactccccattgagc

SEQ ID NO: 296570 - DNA, 16 bp, C. familiaris
aaactcctagaagaga

SEQ ID NO: 296571 - DNA, 16 bp, C. familiaris
aaactcctgagccacc

SEQ ID NO: 296572 - DNA, 16 bp, C. familiaris
aaactctaattcaaaa

SEQ ID NO: 296573 - DNA, 16 bp, C. familiaris
aaactcttagaaaaca

SEQ ID NO: 296574 - DNA, 16 bp, C. familiaris
aaactcttagaagaaa

SEQ ID NO: 296575 - DNA, 16 bp, C. familiaris
aaactctttctgtaaa

SEQ ID NO: 296576 - DNA, 16 bp, C. familiaris
aaactctttgtctctc

SEQ ID NO: 296577 - DNA, 16 bp, C. familiaris
aaactcttttagaaaa

SEQ ID NO: 296578 - DNA, 16 bp, C. familiaris
aaactgaaaatcaaca

SEQ ID NO: 296579 - DNA, 16 bp, C. familiaris
aaactgaaaatgaaga

SEQ ID NO: 296580 - DNA, 16 bp, C. familiaris
aaactgaaacaggaat

SEQ ID NO: 296581 - DNA, 16 bp, C. familiaris
aaactgaaagctgaat

SEQ ID NO: 296582 - DNA, 16 bp, C. familiaris
aaactgaaagctttcc

SEQ ID NO: 296583 - DNA, 16 bp, C. familiaris
aaactgaaataaaatt

SEQ ID NO: 296584 - DNA, 16 bp, C. familiaris
aaactgaacacccaaa

SEQ ID NO: 296585 - DNA, 16 bp, C. familiaris
aaactgaagaaaatat

SEQ ID NO: 296586 - DNA, 16 bp, C. familiaris
aaactgaagaaacaga

SEQ ID NO: 296587 - DNA, 16 bp, C. familiaris
aaactgaatgaagaaa

SEQ ID NO: 296588 - DNA, 16 bp, C. familiaris
aaactgagaaattaaa

SEQ ID NO: 296589 - DNA, 16 bp, C. familiaris
aaactgagagattttc

SEQ ID NO: 296590 - DNA, 16 bp, C. familiaris
aaactgagccaaaacc

SEQ ID NO: 296591 - DNA, 16 bp, C. familiaris
aaactgataaaagaca

SEQ ID NO: 296592 - DNA, 16 bp, C. familiaris
aaactgattttttttt

SEQ ID NO: 296593 - DNA, 16 bp, C. familiaris
aaactgcagaaaatca

SEQ ID NO: 296594 - DNA, 16 bp, C. familiaris
aaactgccaaactgtc

SEQ ID NO: 296595 - DNA, 16 bp, C. familiaris
aaactgctgaaagaaa

SEQ ID NO: 296596 - DNA, 16 bp, C. familiaris
aaactgctgagccacc

SEQ ID NO: 296597 - DNA, 16 bp, C. familiaris
aaactgctggttacca

SEQ ID NO: 296598 - DNA, 16 bp, C. familiaris
aaactgctttccaaaa

SEQ ID NO: 296599 - DNA, 16 bp, C. familiaris
aaactgctttccagaa

SEQ ID NO: 296600 - DNA, 16 bp, C. familiaris
aaactgcttttgctgc

SEQ ID NO: 296601 - DNA, 16 bp, C. familiaris
aaactggaaaaactca

SEQ ID NO: 296602 - DNA, 16 bp, C. familiaris
aaactggaaaagacaa

SEQ ID NO: 296603 - DNA, 16 bp, C. familiaris
aaactggaaaaggaaa

SEQ ID NO: 296604 - DNA, 16 bp, C. familiaris
aaactggaacaggagg

SEQ ID NO: 296605 - DNA, 16 bp, C. familiaris
aaactggaagaaatgg

SEQ ID NO: 296606 - DNA, 16 bp, C. familiaris
aaactggacagctaaa

SEQ ID NO: 296607 - DNA, 16 bp, C. familiaris
aaactggacagctatg

SEQ ID NO: 296608 - DNA, 16 bp, C. familiaris
aaactggacagtgaca

SEQ ID NO: 296609 - DNA, 16 bp, C. familiaris
aaactgggaggaaaaa

SEQ ID NO: 296610 - DNA, 16 bp, C. familiaris
aaactgggcagccctg

SEQ ID NO: 296611 - DNA, 16 bp, C. familiaris
aaactggtccagtttc

SEQ ID NO: 296612 - DNA, 16 bp, C. familiaris
aaactgtaaaataaat

SEQ ID NO: 296613 - DNA, 16 bp, C. familiaris
aaactgtgaaagaaaa

SEQ ID NO: 296614 - DNA, 16 bp, C. familiaris
aaactgtgattttttt

SEQ ID NO: 296615 - DNA, 16 bp, C. familiaris
aaactgtggactttag

SEQ ID NO: 296616 - DNA, 16 bp, C. familiaris
aaactgttttctgaag

SEQ ID NO: 296617 - DNA, 16 bp, C. familiaris
aaactgttttcttcct

SEQ ID NO: 296618 - DNA, 16 bp, C. familiaris
aaacttaaaaccctga

SEQ ID NO: 296619 - DNA, 16 bp, C. familiaris
aaacttccagattcat

SEQ ID NO: 296620 - DNA, 16 bp, C. familiaris
aaacttctaaaagata

SEQ ID NO: 296621 - DNA, 16 bp, C. familiaris
aaacttctatttcctt

SEQ ID NO: 296622 - DNA, 16 bp, C. familiaris
aaacttctgaaagaaa

SEQ ID NO: 296623 - DNA, 16 bp, C. familiaris
aaacttctgctcttca

SEQ ID NO: 296624 - DNA, 16 bp, C. familiaris
aaacttgatttaaaaa

SEQ ID NO: 296625 - DNA, 16 bp, C. familiaris
aaacttggaaaataaa

SEQ ID NO: 296626 - DNA, 16 bp, C. familiaris
aaacttgtttaaaaaa

SEQ ID NO: 296627 - DNA, 16 bp, C. familiaris
aaactttaaaaatctt

SEQ ID NO: 296628 - DNA, 16 bp, C. familiaris
aaactttattttcaaa

SEQ ID NO: 296629 - DNA, 16 bp, C. familiaris
aaactttgtttataaa

SEQ ID NO: 296630 - DNA, 16 bp, C. familiaris
aaacttttaaaatgta

SEQ ID NO: 296631 - DNA, 16 bp, C. familiaris
aaacttttagaaataa

SEQ ID NO: 296632 - DNA, 16 bp, C. familiaris
aaacttttctgaaaaa

SEQ ID NO: 296633 - DNA, 16 bp, C. familiaris
aaactttttaaaagag

SEQ ID NO: 296634 - DNA, 16 bp, C. familiaris
aaactttttattttgt

SEQ ID NO: 296635 - DNA, 16 bp, C. familiaris
aaagaaaaaaatgctt

SEQ ID NO: 296636 - DNA, 16 bp, C. familiaris
aaagaaaaaagccttt

SEQ ID NO: 296637 - DNA, 16 bp, C. familiaris
aaagaaaaaattcctt

SEQ ID NO: 296638 - DNA, 16 bp, C. familiaris
aaagaaaaaatttcat

SEQ ID NO: 296639 - DNA, 16 bp, C. familiaris
aaagaaaaacagtttt

SEQ ID NO: 296640 - DNA, 16 bp, C. familiaris
aaagaaaaacatcttt

SEQ ID NO: 296641 - DNA, 16 bp, C. familiaris
aaagaaaaacattcca

SEQ ID NO: 296642 - DNA, 16 bp, C. familiaris
aaagaaaaacatttat

SEQ ID NO: 296643 - DNA, 16 bp, C. familiaris
aaagaaaaactcattt

SEQ ID NO: 296644 - DNA, 16 bp, C. familiaris
aaagaaaaagaatgct

SEQ ID NO: 296645 - DNA, 16 bp, C. familiaris
aaagaaaaaggctgaa

SEQ ID NO: 296646 - DNA, 16 bp, C. familiaris
aaagaaaaatccaatt

SEQ ID NO: 296647 - DNA, 16 bp, C. familiaris
aaagaaaaatctctgt

SEQ ID NO: 296648 - DNA, 16 bp, C. familiaris
aaagaaaaatttcaag

SEQ ID NO: 296649 - DNA, 16 bp, C. familiaris
aaagaaaaattttcct

SEQ ID NO: 296650 - DNA, 16 bp, C. familiaris
aaagaaaacaaagctg

SEQ ID NO: 296651 - DNA, 16 bp, C. familiaris
aaagaaaacaattcat

SEQ ID NO: 296652 - DNA, 16 bp, C. familiaris
aaagaaaacagatgga

SEQ ID NO: 296653 - DNA, 16 bp, C. familiaris
aaagaaaacagttaca

SEQ ID NO: 296654 - DNA, 16 bp, C. familiaris
aaagaaaacatgattt

SEQ ID NO: 296655 - DNA, 16 bp, C. familiaris
aaagaaaacatggtat

SEQ ID NO: 296656 - DNA, 16 bp, C. familiaris
aaagaaaacatttaca

SEQ ID NO: 296657 - DNA, 16 bp, C. familiaris
aaagaaaaccaaagtt

SEQ ID NO: 296658 - DNA, 16 bp, C. familiaris
aaagaaaaccaaggct

SEQ ID NO: 296659 - DNA, 16 bp, C. familiaris
aaagaaaaccacacct

SEQ ID NO: 296660 - DNA, 16 bp, C. familiaris
aaagaaaaccatatcc

SEQ ID NO: 296661 - DNA, 16 bp, C. familiaris
aaagaaaactgaggaa

SEQ ID NO: 296662 - DNA, 16 bp, C. familiaris
aaagaaaactgtttaa

SEQ ID NO: 296663 - DNA, 16 bp, C. familiaris
aaagaaaactttcaaa

SEQ ID NO: 296664 - DNA, 16 bp, C. familiaris
aaagaaaagaaacctc

SEQ ID NO: 296665 - DNA, 16 bp, C. familiaris
aaagaaaagaaacttc

SEQ ID NO: 296666 - DNA, 16 bp, C. familiaris
aaagaaaagaaatctg

SEQ ID NO: 296667 - DNA, 16 bp, C. familiaris
aaagaaaagaatttca

SEQ ID NO: 296668 - DNA, 16 bp, C. familiaris
aaagaaaagcaaagtg

SEQ ID NO: 296669 - DNA, 16 bp, C. familiaris
aaagaaaagctacaga

SEQ ID NO: 296670 - DNA, 16 bp, C. familiaris
aaagaaaagctttcag

SEQ ID NO: 296671 - DNA, 16 bp, C. familiaris
aaagaaaaggaagcat

SEQ ID NO: 296672 - DNA, 16 bp, C. familiaris
aaagaaaaggcatcca

SEQ ID NO: 296673 - DNA, 16 bp, C. familiaris
aaagaaaagtttcttt

SEQ ID NO: 296674 - DNA, 16 bp, C. familiaris
aaagaaaatacatttg

SEQ ID NO: 296675 - DNA, 16 bp, C. familiaris
aaagaaaatatctcaa

SEQ ID NO: 296676 - DNA, 16 bp, C. familiaris
aaagaaaatatttaca

SEQ ID NO: 296677 - DNA, 16 bp, C. familiaris
aaagaaaatatttcct

SEQ ID NO: 296678 - DNA, 16 bp, C. familiaris
aaagaaaatctcattt

SEQ ID NO: 296679 - DNA, 16 bp, C. familiaris
aaagaaaatctggaaa

SEQ ID NO: 296680 - DNA, 16 bp, C. familiaris
aaagaaaatgaagttt

SEQ ID NO: 296681 - DNA, 16 bp, C. familiaris
aaagaaaatgatacag

SEQ ID NO: 296682 - DNA, 16 bp, C. familiaris
aaagaaaatgatttca

SEQ ID NO: 296683 - DNA, 16 bp, C. familiaris
aaagaaaatgcagaga

SEQ ID NO: 296684 - DNA, 16 bp, C. familiaris
aaagaaaatgtcaaga

SEQ ID NO: 296685 - DNA, 16 bp, C. familiaris
aaagaaaatgtgatta

SEQ ID NO: 296686 - DNA, 16 bp, C. familiaris
aaagaaaatgttcttt

SEQ ID NO: 296687 - DNA, 16 bp, C. familiaris
aaagaaaattattctt

SEQ ID NO: 296688 - DNA, 16 bp, C. familiaris
aaagaaaattcagaat

SEQ ID NO: 296689 - DNA, 16 bp, C. familiaris
aaagaaaattccattt

SEQ ID NO: 296690 - DNA, 16 bp, C. familiaris
aaagaaaattgcaaag

SEQ ID NO: 296691 - DNA, 16 bp, C. familiaris
aaagaaacaaaatttg

SEQ ID NO: 296692 - DNA, 16 bp, C. familiaris
aaagaaacaaacagtc

SEQ ID NO: 296693 - DNA, 16 bp, C. familiaris
aaagaaacagatatcc

SEQ ID NO: 296694 - DNA, 17 bp, C. familiaris
aaagaaacagtcaacaa

SEQ ID NO: 296695 - DNA, 16 bp, C. familiaris
aaagaaacatttcaaa

SEQ ID NO: 296696 - DNA, 16 bp, C. familiaris
aaagaaacctcatacc

SEQ ID NO: 296697 - DNA, 16 bp, C. familiaris
aaagaaacctggaaaa

SEQ ID NO: 296698 - DNA, 16 bp, C. familiaris
aaagaaactgaagaga

SEQ ID NO: 296699 - DNA, 16 bp, C. familiaris
aaagaaactgaagata

SEQ ID NO: 296700 - DNA, 16 bp, C. familiaris
aaagaaactgaagatg

SEQ ID NO: 296701 - DNA, 16 bp, C. familiaris
aaagaaactgaggctt

SEQ ID NO: 296702 - DNA, 16 bp, C. familiaris
aaagaaactttttaaa

SEQ ID NO: 296703 - DNA, 16 bp, C. familiaris
aaagaaagaaaacctt

SEQ ID NO: 296704 - DNA, 16 bp, C. familiaris
aaagaaagaaaagcct

SEQ ID NO: 296705 - DNA, 16 bp, C. familiaris
aaagaaagaaaattcc

SEQ ID NO: 296706 - DNA, 16 bp, C. familiaris
aaagaaagaaactcag

SEQ ID NO: 296707 - DNA, 16 bp, C. familiaris
aaagaaagaaactgtg

SEQ ID NO: 296708 - DNA, 16 bp, C. familiaris
aaagaaagaaacttct

SEQ ID NO: 296709 - DNA, 16 bp, C. familiaris
aaagaaagaaagagct

SEQ ID NO: 296710 - DNA, 16 bp, C. familiaris
aaagaaagaaagcatc

SEQ ID NO: 296711 - DNA, 16 bp, C. familiaris
aaagaaagaaagtcat

SEQ ID NO: 296712 - DNA, 16 bp, C. familiaris
aaagaaagaaatgatc

SEQ ID NO: 296713 - DNA, 16 bp, C. familiaris
aaagaaagaaattctc

SEQ ID NO: 296714 - DNA, 16 bp, C. familiaris
aaagaaagaaattctg

SEQ ID NO: 296715 - DNA, 16 bp, C. familiaris
aaagaaagaattttct

SEQ ID NO: 296716 - DNA, 16 bp, C. familiaris
aaagaaagagaaagct

SEQ ID NO: 296717 - DNA, 16 bp, C. familiaris
aaagaaagccaaacat

SEQ ID NO: 296718 - DNA, 16 bp, C. familiaris
aaagaaaggctgagaa

SEQ ID NO: 296719 - DNA, 16 bp, C. familiaris
aaagaaagtcatcaaa

SEQ ID NO: 296720 - DNA, 16 bp, C. familiaris
aaagaaagtttccaaa

SEQ ID NO: 296721 - DNA, 16 bp, C. familiaris
aaagaaataaaattgc

SEQ ID NO: 296722 - DNA, 16 bp, C. familiaris
aaagaaataaaccttt

SEQ ID NO: 296723 - DNA, 16 bp, C. familiaris
aaagaaataatatctt

SEQ ID NO: 296724 - DNA, 16 bp, C. familiaris
aaagaaataattcaca

SEQ ID NO: 296725 - DNA, 16 bp, C. familiaris
aaagaaataatttcat

SEQ ID NO: 296726 - DNA, 16 bp, C. familiaris
aaagaaataatttcta

SEQ ID NO: 296727 - DNA, 16 bp, C. familiaris
aaagaaatccagaaat

SEQ ID NO: 296728 - DNA, 16 bp, C. familiaris
aaagaaatctgaagag

SEQ ID NO: 296729 - DNA, 16 bp, C. familiaris
aaagaaatctttttaa

SEQ ID NO: 296730 - DNA, 16 bp, C. familiaris
aaagaaatgcaactga

SEQ ID NO: 296731 - DNA, 16 bp, C. familiaris
aaagaaatgctagaaa

SEQ ID NO: 296732 - DNA, 16 bp, C. familiaris
aaagaaatggaaatgt

SEQ ID NO: 296733 - DNA, 16 bp, C. familiaris
aaagaaatgtgatttt

SEQ ID NO: 296734 - DNA, 16 bp, C. familiaris
aaagaaattcaaatta

SEQ ID NO: 296735 - DNA, 16 bp, C. familiaris
aaagaaattcaaattt

SEQ ID NO: 296736 - DNA, 16 bp, C. familiaris
aaagaaattcaagaag

SEQ ID NO: 296737 - DNA, 16 bp, C. familiaris
aaagaaattccttttt

SEQ ID NO: 296738 - DNA, 16 bp, C. familiaris
aaagaaattctaaata

SEQ ID NO: 296739 - DNA, 16 bp, C. familiaris
aaagaaattctcaaaa

SEQ ID NO: 296740 - DNA, 16 bp, C. familiaris
aaagaaattctgaaat

SEQ ID NO: 296741 - DNA, 16 bp, C. familiaris
aaagaaattgaagacc

SEQ ID NO: 296742 - DNA, 16 bp, C. familiaris
aaagaaattgaatttg

SEQ ID NO: 296743 - DNA, 16 bp, C. familiaris
aaagaaatttcaaatt

SEQ ID NO: 296744 - DNA, 16 bp, C. familiaris
aaagaaatttctggaa

SEQ ID NO: 296745 - DNA, 16 bp, C. familiaris
aaagaacaaagtcatc

SEQ ID NO: 296746 - DNA, 16 bp, C. familiaris
aaagaacaaagttggg

SEQ ID NO: 296747 - DNA, 16 bp, C. familiaris
aaagaacaaattttaa

SEQ ID NO: 296748 - DNA, 16 bp, C. familiaris
aaagaacaagctcctg

SEQ ID NO: 296749 - DNA, 16 bp, C. familiaris
aaagaacagaaattta

SEQ ID NO: 296750 - DNA, 16 bp, C. familiaris
aaagaacagcaaatga

SEQ ID NO: 296751 - DNA, 16 bp, C. familiaris
aaagaacatttcagaa

SEQ ID NO: 296752 - DNA, 16 bp, C. familiaris
aaagaactcattaaac

SEQ ID NO: 296753 - DNA, 16 bp, C. familiaris
aaagaactcctaaaac

SEQ ID NO: 296754 - DNA, 16 bp, C. familiaris
aaagaactctcaaaac

SEQ ID NO: 296755 - DNA, 16 bp, C. familiaris
aaagaactctcaaaat

SEQ ID NO: 296756 - DNA, 16 bp, C. familiaris
aaagaactcttagaac

SEQ ID NO: 296757 - DNA, 16 bp, C. familiaris
aaagaactgaaataca

SEQ ID NO: 296758 - DNA, 16 bp, C. familiaris
aaagaactgaaggaaa

SEQ ID NO: 296759 - DNA, 16 bp, C. familiaris
aaagaactgattaaac

SEQ ID NO: 296760 - DNA, 16 bp, C. familiaris
aaagaacttataaaat

SEQ ID NO: 296761 - DNA, 16 bp, C. familiaris
aaagaacttttaaaac

SEQ ID NO: 296762 - DNA, 16 bp, C. familiaris
aaagaactttttaatt

SEQ ID NO: 296763 - DNA, 16 bp, C. familiaris
aaagaagaaaactttt

SEQ ID NO: 296764 - DNA, 16 bp, C. familiaris
aaagaagaaaatcctg

SEQ ID NO: 296765 - DNA, 16 bp, C. familiaris
aaagaagaaatcatac

SEQ ID NO: 296766 - DNA, 16 bp, C. familiaris
aaagaagaacaaagct

SEQ ID NO: 296767 - DNA, 16 bp, C. familiaris
aaagaagaacaaagtt

SEQ ID NO: 296768 - DNA, 16 bp, C. familiaris
aaagaagaagaaactg

SEQ ID NO: 296769 - DNA, 16 bp, C. familiaris
aaagaagaagaagctg

SEQ ID NO: 296770 - DNA, 16 bp, C. familiaris
aaagaagaaggaaatc

SEQ ID NO: 296771 - DNA, 16 bp, C. familiaris
aaagaagaagtgatat

SEQ ID NO: 296772 - DNA, 16 bp, C. familiaris
aaagaagaatatccac

SEQ ID NO: 296773 - DNA, 16 bp, C. familiaris
aaagaagaatgaaatc

SEQ ID NO: 296774 - DNA, 16 bp, C. familiaris
aaagaagacagaattt

SEQ ID NO: 296775 - DNA, 16 bp, C. familiaris
aaagaagacctacaaa

SEQ ID NO: 296776 - DNA, 16 bp, C. familiaris
aaagaagacttaatac

SEQ ID NO: 296777 - DNA, 16 bp, C. familiaris
aaagaagactttaaaa

SEQ ID NO: 296778 - DNA, 16 bp, C. familiaris
aaagaagagatcacaa

SEQ ID NO: 296779 - DNA, 16 bp, C. familiaris
aaagaagagatggtat

SEQ ID NO: 296780 - DNA, 16 bp, C. familiaris
aaagaagaggtagtat

SEQ ID NO: 296781 - DNA, 16 bp, C. familiaris
aaagaagatacacaca

SEQ ID NO: 296782 - DNA, 16 bp, C. familiaris
aaagaagatatatgga

SEQ ID NO: 296783 - DNA, 16 bp, C. familiaris
aaagaagatatggtat

SEQ ID NO: 296784 - DNA, 16 bp, C. familiaris
aaagaagatgcggttt

SEQ ID NO: 296785 - DNA, 16 bp, C. familiaris
aaagaagatgtgttat

SEQ ID NO: 296786 - DNA, 16 bp, C. familiaris
aaagaagatttacaaa

SEQ ID NO: 296787 - DNA, 16 bp, C. familiaris
aaagaagattttattt

SEQ ID NO: 296788 - DNA, 16 bp, C. familiaris
aaagaagcagagaaat

SEQ ID NO: 296789 - DNA, 16 bp, C. familiaris
aaagaagcataaagga

SEQ ID NO: 296790 - DNA, 16 bp, C. familiaris
aaagaagctgaagaaa

SEQ ID NO: 296791 - DNA, 16 bp, C. familiaris
aaagaaggaaaattca

SEQ ID NO: 296792 - DNA, 16 bp, C. familiaris
aaagaaggaaactgga

SEQ ID NO: 296793 - DNA, 16 bp, C. familiaris
aaagaaggaaatcctt

SEQ ID NO: 296794 - DNA, 16 bp, C. familiaris
aaagaagggcagcccc

SEQ ID NO: 296795 - DNA, 16 bp, C. familiaris
aaagaagtaaaactct

SEQ ID NO: 296796 - DNA, 16 bp, C. familiaris
aaagaagtctcaaaaa

SEQ ID NO: 296797 - DNA, 16 bp, C. familiaris
aaagaagtggaaagac

SEQ ID NO: 296798 - DNA, 16 bp, C. familiaris
aaagaatccagaaaca

SEQ ID NO: 296799 - DNA, 16 bp, C. familiaris
aaagaatcttgagcag

SEQ ID NO: 296800 - DNA, 16 bp, C. familiaris
aaagaatgaaaatttg

SEQ ID NO: 296801 - DNA, 16 bp, C. familiaris
aaagaatgaaaccata

SEQ ID NO: 296802 - DNA, 16 bp, C. familiaris
aaagaatgaaattgga

SEQ ID NO: 296803 - DNA, 16 bp, C. familiaris
aaagaatgaagtttta

SEQ ID NO: 296804 - DNA, 16 bp, C. familiaris
aaagaatgatttttaa

SEQ ID NO: 296805 - DNA, 16 bp, C. familiaris
aaagaatgcatttaaa

SEQ ID NO: 296806 - DNA, 16 bp, C. familiaris
aaagaattctttttaa

SEQ ID NO: 296807 - DNA, 16 bp, C. familiaris
aaagaatttataatct

SEQ ID NO: 296808 - DNA, 16 bp, C. familiaris
aaagaatttcaaaaat

SEQ ID NO: 296809 - DNA, 16 bp, C. familiaris
aaagaatttgaagata

SEQ ID NO: 296810 - DNA, 16 bp, C. familiaris
aaagaatttggaaaat

SEQ ID NO: 296811 - DNA, 16 bp, C. familiaris
aaagacaaaatcagag

SEQ ID NO: 296812 - DNA, 16 bp, C. familiaris
aaagacaaatacttca

SEQ ID NO: 296813 - DNA, 40 bp, C. familiaris
aaagacaacctacagaatgggagaagatatttgcaaatga

SEQ ID NO: 296814 - DNA, 16 bp, C. familiaris
aaagacaagcagactc

SEQ ID NO: 296815 - DNA, 16 bp, C. familiaris
aaagacaaggaaatgg

SEQ ID NO: 296816 - DNA, 16 bp, C. familiaris
aaagacaatctacaga

SEQ ID NO: 296817 - DNA, 16 bp, C. familiaris
aaagacaattttactt

SEQ ID NO: 296818 - DNA, 16 bp, C. familiaris
aaagacactatataat

SEQ ID NO: 296819 - DNA, 16 bp, C. familiaris
aaagacaggctcttca

SEQ ID NO: 296820 - DNA, 16 bp, C. familiaris
aaagacatctcaagaa

SEQ ID NO: 296821 - DNA, 16 bp, C. familiaris
aaagacatgaacaaat

SEQ ID NO: 296822 - DNA, 16 bp, C. familiaris
aaagacatgaaggaaa

SEQ ID NO: 296823 - DNA, 16 bp, C. familiaris
aaagacatgcagatgg

SEQ ID NO: 296824 - DNA, 16 bp, C. familiaris
aaagacatggaggaaa

SEQ ID NO: 296825 - DNA, 16 bp, C. familiaris
aaagacattcattttt

SEQ ID NO: 296826 - DNA, 16 bp, C. familiaris
aaagacatttttccaa

SEQ ID NO: 296827 - DNA, 16 bp, C. familiaris
aaagaccccacctcct

SEQ ID NO: 296828 - DNA, 16 bp, C. familiaris
aaagaccctctctcca

SEQ ID NO: 296829 - DNA, 16 bp, C. familiaris
aaagacctatatgtga

SEQ ID NO: 296830 - DNA, 16 bp, C. familiaris
aaagacctcattttaa

SEQ ID NO: 296831 - DNA, 16 bp, C. familiaris
aaagacctgtaaccct

SEQ ID NO: 296832 - DNA, 16 bp, C. familiaris
aaagactaaaatattt

SEQ ID NO: 296833 - DNA, 16 bp, C. familiaris
aaagactattatttcc

SEQ ID NO: 296834 - DNA, 16 bp, C. familiaris
aaagactcctccaaaa

SEQ ID NO: 296835 - DNA, 16 bp, C. familiaris
aaagactgaaaacttt

SEQ ID NO: 296836 - DNA, 16 bp, C. familiaris
aaagactgaaactgga

SEQ ID NO: 296837 - DNA, 16 bp, C. familiaris
aaagactgaatgcttt

SEQ ID NO: 296838 - DNA, 16 bp, C. familiaris
aaagactggaagaaaa

SEQ ID NO: 296839 - DNA, 16 bp, C. familiaris
aaagacttgaaagaaa

SEQ ID NO: 296840 - DNA, 16 bp, C. familiaris
aaagacttgaacataa

SEQ ID NO: 296841 - DNA, 16 bp, C. familiaris
aaagacttgaaggaag

SEQ ID NO: 296842 - DNA, 16 bp, C. familiaris
aaagacttgaaggaga

SEQ ID NO: 296843 - DNA, 16 bp, C. familiaris
aaagactttattaaaa

SEQ ID NO: 296844 - DNA, 16 bp, C. familiaris
aaagactttgaaagct

SEQ ID NO: 296845 - DNA, 16 bp, C. familiaris
aaagagaaaaatctga

SEQ ID NO: 296846 - DNA, 16 bp, C. familiaris
aaagagaaaaattcag

SEQ ID NO: 296847 - DNA, 16 bp, C. familiaris
aaagagaaaatgcatt

SEQ ID NO: 296848 - DNA, 16 bp, C. familiaris
aaagagaaaattcttt

SEQ ID NO: 296849 - DNA, 16 bp, C. familiaris
aaagagaaagaaatcc

SEQ ID NO: 296850 - DNA, 16 bp, C. familiaris
aaagagaaaggaatcc

SEQ ID NO: 296851 - DNA, 16 bp, C. familiaris
aaagagaaatcaaggg

SEQ ID NO: 296852 - DNA, 16 bp, C. familiaris
aaagagaagaaatact

SEQ ID NO: 296853 - DNA, 16 bp, C. familiaris
aaagagaagcagcagc

SEQ ID NO: 296854 - DNA, 16 bp, C. familiaris
aaagagaaggaaattt

SEQ ID NO: 296855 - DNA, 16 bp, C. familiaris
aaagagaatcctgaag

SEQ ID NO: 296856 - DNA, 16 bp, C. familiaris
aaagagaatgtgtgtg

SEQ ID NO: 296857 - DNA, 16 bp, C. familiaris
aaagagacaaaaatcc

SEQ ID NO: 296858 - DNA, 16 bp, C. familiaris
aaagagacaacagctg

SEQ ID NO: 296859 - DNA, 16 bp, C. familiaris
aaagagacagacacag

SEQ ID NO: 296860 - DNA, 16 bp, C. familiaris
aaagagacagagacat

SEQ ID NO: 296861 - DNA, 16 bp, C. familiaris
aaagagagaattcaaa

SEQ ID NO: 296862 - DNA, 16 bp, C. familiaris
aaagagagaattctga

SEQ ID NO: 296863 - DNA, 16 bp, C. familiaris
aaagagagagaaactg

SEQ ID NO: 296864 - DNA, 16 bp, C. familiaris
aaagagagagatcaca

SEQ ID NO: 296865 - DNA, 16 bp, C. familiaris
aaagagagagcagctg

SEQ ID NO: 296866 - DNA, 16 bp, C. familiaris
aaagagagcaagagtg

SEQ ID NO: 296867 - DNA, 16 bp, C. familiaris
aaagagagcctctgca

SEQ ID NO: 296868 - DNA, 16 bp, C. familiaris
aaagagagtgagagtg

SEQ ID NO: 296869 - DNA, 16 bp, C. familiaris
aaagagagtgagcatg

SEQ ID NO: 296870 - DNA, 16 bp, C. familiaris
aaagagatccagaaat

SEQ ID NO: 296871 - DNA, 16 bp, C. familiaris
aaagagatcttgccat

SEQ ID NO: 296872 - DNA, 16 bp, C. familiaris
aaagagatttatttat

SEQ ID NO: 296873 - DNA, 16 bp, C. familiaris
aaagagatttgtaaaa

SEQ ID NO: 296874 - DNA, 16 bp, C. familiaris
aaagagattttatttg

SEQ ID NO: 296875 - DNA, 16 bp, C. familiaris
aaagagcagaaatcaa

SEQ ID NO: 296876 - DNA, 16 bp, C. familiaris
aaagagccaagatgtc

SEQ ID NO: 296877 - DNA, 16 bp, C. familiaris
aaagagctcaaataca

SEQ ID NO: 296878 - DNA, 16 bp, C. familiaris
aaagagctcttaaaac

SEQ ID NO: 296879 - DNA, 16 bp, C. familiaris
aaagagctcttggaaa

SEQ ID NO: 296880 - DNA, 16 bp, C. familiaris
aaagagctggagaaag

SEQ ID NO: 296881 - DNA, 16 bp, C. familiaris
aaagaggaaaaggatc

SEQ ID NO: 296882 - DNA, 16 bp, C. familiaris
aaagaggaaagactat

SEQ ID NO: 296883 - DNA, 16 bp, C. familiaris
aaagaggacatccaga

SEQ ID NO: 296884 - DNA, 16 bp, C. familiaris
aaagaggagaaaatca

SEQ ID NO: 296885 - DNA, 16 bp, C. familiaris
aaagaggcagaaaact

SEQ ID NO: 296886 - DNA, 16 bp, C. familiaris
aaagaggcagaaataa

SEQ ID NO: 296887 - DNA, 16 bp, C. familiaris
aaagaggcagacatag

SEQ ID NO: 296888 - DNA, 16 bp, C. familiaris
aaagaggggcagcccc

SEQ ID NO: 296889 - DNA, 16 bp, C. familiaris
aaagaggttaaataac

SEQ ID NO: 296890 - DNA, 16 bp, C. familiaris
aaagagtcctctttaa

SEQ ID NO: 296891 - DNA, 16 bp, C. familiaris
aaagagtgagcacaag

SEQ ID NO: 296892 - DNA, 16 bp, C. familiaris
aaagagtgagcatgag

SEQ ID NO: 296893 - DNA, 16 bp, C. familiaris
aaagagtggaagacat

SEQ ID NO: 296894 - DNA, 16 bp, C. familiaris
aaagagttaatactta

SEQ ID NO: 296895 - DNA, 16 bp, C. familiaris
aaagataaaacatttt

SEQ ID NO: 296896 - DNA, 16 bp, C. familiaris
aaagataaaggaattt

SEQ ID NO: 296897 - DNA, 16 bp, C. familiaris
aaagataagggaagtt

SEQ ID NO: 296898 - DNA, 16 bp, C. familiaris
aaagataattttcaga

SEQ ID NO: 296899 - DNA, 16 bp, C. familiaris
aaagatacatttttat

SEQ ID NO: 296900 - DNA, 16 bp, C. familiaris
aaagataccactaaaa

SEQ ID NO: 296901 - DNA, 16 bp, C. familiaris
aaagatactttttaaa

SEQ ID NO: 296902 - DNA, 16 bp, C. familiaris
aaagatatcattaaaa

SEQ ID NO: 296903 - DNA, 16 bp, C. familiaris
aaagatatttgcaaat

SEQ ID NO: 296904 - DNA, 16 bp, C. familiaris
aaagatattttttcaa

SEQ ID NO: 296905 - DNA, 16 bp, C. familiaris
aaagatcagaacgaaa

SEQ ID NO: 296906 - DNA, 16 bp, C. familiaris
aaagatctagaaaaat

SEQ ID NO: 296907 - DNA, 16 bp, C. familiaris
aaagatctcaaataaa

SEQ ID NO: 296908 - DNA, 16 bp, C. familiaris
aaagatctttattttt

SEQ ID NO: 296909 - DNA, 16 bp, C. familiaris
aaagatgaaagcagaa

SEQ ID NO: 296910 - DNA, 16 bp, C. familiaris
aaagatgaacaaagct

SEQ ID NO: 296911 - DNA, 16 bp, C. familiaris
aaagatgaatggacaa

SEQ ID NO: 296912 - DNA, 16 bp, C. familiaris
aaagatgacatccaga

SEQ ID NO: 296913 - DNA, 16 bp, C. familiaris
aaagatgagaacagaa

SEQ ID NO: 296914 - DNA, 16 bp, C. familiaris
aaagatgatattttaa

SEQ ID NO: 296915 - DNA, 16 bp, C. familiaris
aaagatgatgatgatg

SEQ ID NO: 296916 - DNA, 16 bp, C. familiaris
aaagatgcagaaaaag

SEQ ID NO: 296917 - DNA, 16 bp, C. familiaris
aaagatgctcaacatg

SEQ ID NO: 296918 - DNA, 16 bp, C. familiaris
aaagatggaaaaacat

SEQ ID NO: 296919 - DNA, 16 bp, C. familiaris
aaagatggaaattcta

SEQ ID NO: 296920 - DNA, 16 bp, C. familiaris
aaagatgggacacctg

SEQ ID NO: 296921 - DNA, 16 bp, C. familiaris
aaagatgtaaaatatg

SEQ ID NO: 296922 - DNA, 16 bp, C. familiaris
aaagatgtatatatat

SEQ ID NO: 296923 - DNA, 16 bp, C. familiaris
aaagatgtctttaaaa

SEQ ID NO: 296924 - DNA, 16 bp, C. familiaris
aaagatgtggaaaaat

SEQ ID NO: 296925 - DNA, 16 bp, C. familiaris
aaagatgtggagaaag

SEQ ID NO: 296926 - DNA, 16 bp, C. familiaris
aaagatgtggtttatg

SEQ ID NO: 296927 - DNA, 16 bp, C. familiaris
aaagatgtttgaaaaa

SEQ ID NO: 296928 - DNA, 16 bp, C. familiaris
aaagattaagggaaat

SEQ ID NO: 296929 - DNA, 16 bp, C. familiaris
aaagattaatgaaact

SEQ ID NO: 296930 - DNA, 16 bp, C. familiaris
aaagattatacaccat

SEQ ID NO: 296931 - DNA, 16 bp, C. familiaris
aaagattattttttca

SEQ ID NO: 296932 - DNA, 16 bp, C. familiaris
aaagattcatttaaaa

SEQ ID NO: 296933 - DNA, 16 bp, C. familiaris
aaagattccatcaaaa

SEQ ID NO: 296934 - DNA, 16 bp, C. familiaris
aaagatttaaatgtga

SEQ ID NO: 296935 - DNA, 16 bp, C. familiaris
aaagatttattataag

SEQ ID NO: 296936 - DNA, 16 bp, C. familiaris
aaagatttattttctt

SEQ ID NO: 296937 - DNA, 16 bp, C. familiaris
aaagatttcaatttta

SEQ ID NO: 296938 - DNA, 16 bp, C. familiaris
aaagatttcttaaaaa

SEQ ID NO: 296939 - DNA, 16 bp, C. familiaris
aaagatttgagagaga

SEQ ID NO: 296940 - DNA, 16 bp, C. familiaris
aaagatttgggcagcc

SEQ ID NO: 296941 - DNA, 16 bp, C. familiaris
aaagatttgtttattc

SEQ ID NO: 296942 - DNA, 16 bp, C. familiaris
aaagattttaagaaag

SEQ ID NO: 296943 - DNA, 16 bp, C. familiaris
aaagattttacatttt

SEQ ID NO: 296944 - DNA, 16 bp, C. familiaris
aaagattttacttatg

SEQ ID NO: 296945 - DNA, 16 bp, C. familiaris
aaagattttatgattt

SEQ ID NO: 296946 - DNA, 16 bp, C. familiaris
aaagattttcaagaaa

SEQ ID NO: 296947 - DNA, 16 bp, C. familiaris
aaagattttgaaaatg

SEQ ID NO: 296948 - DNA, 16 bp, C. familiaris
aaagatttttctattt

SEQ ID NO: 296949 - DNA, 16 bp, C. familiaris
aaagcaaaagtttaaa

SEQ ID NO: 296950 - DNA, 16 bp, C. familiaris
aaagcaaaatcatttt

SEQ ID NO: 296951 - DNA, 16 bp, C. familiaris
aaagcaaaattaaatt

SEQ ID NO: 296952 - DNA, 16 bp, C. familiaris
aaagcaaagaaaattt

SEQ ID NO: 296953 - DNA, 16 bp, C. familiaris
aaagcaaagctggaag

SEQ ID NO: 296954 - DNA, 16 bp, C. familiaris
aaagcaaatattgcaa

SEQ ID NO: 296955 - DNA, 16 bp, C. familiaris
aaagcaaatatttatt

SEQ ID NO: 296956 - DNA, 16 bp, C. familiaris
aaagcaaatcaaaact

SEQ ID NO: 296957 - DNA, 16 bp, C. familiaris
aaagcaaatgtgaaaa

SEQ ID NO: 296958 - DNA, 16 bp, C. familiaris
aaagcaaattaaaatc

SEQ ID NO: 296959 - DNA, 16 bp, C. familiaris
aaagcaacacaaatgt

SEQ ID NO: 296960 - DNA, 16 bp, C. familiaris
aaagcaacagaaatat

SEQ ID NO: 296961 - DNA, 16 bp, C. familiaris
aaagcaactttaaaaa

SEQ ID NO: 296962 - DNA, 16 bp, C. familiaris
aaagcaagaatgaact

SEQ ID NO: 296963 - DNA, 16 bp, C. familiaris
aaagcaatcttttaaa

SEQ ID NO: 296964 - DNA, 16 bp, C. familiaris
aaagcaatgagagaaa

SEQ ID NO: 296965 - DNA, 16 bp, C. familiaris
aaagcaattctaaaat

SEQ ID NO: 296966 - DNA, 16 bp, C. familiaris
aaagcaatttttattt

SEQ ID NO: 296967 - DNA, 16 bp, C. familiaris
aaagcacatatttaaa

SEQ ID NO: 296968 - DNA, 16 bp, C. familiaris
aaagcacttagaacaa

SEQ ID NO: 296969 - DNA, 16 bp, C. familiaris
aaagcagaaatgaaag

SEQ ID NO: 296970 - DNA, 16 bp, C. familiaris
aaagcagactccccat

SEQ ID NO: 296971 - DNA, 16 bp, C. familiaris
aaagcagacttttttt

SEQ ID NO: 296972 - DNA, 16 bp, C. familiaris
aaagcagagcctgaga

SEQ ID NO: 296973 - DNA, 16 bp, C. familiaris
aaagcagatgctcagc

SEQ ID NO: 296974 - DNA, 16 bp, C. familiaris
aaagcagattttaaaa

SEQ ID NO: 296975 - DNA, 16 bp, C. familiaris
aaagcaggaaaggcta

SEQ ID NO: 296976 - DNA, 16 bp, C. familiaris
aaagcagtatggagat

SEQ ID NO: 296977 - DNA, 16 bp, C. familiaris
aaagcagttattaaaa

SEQ ID NO: 296978 - DNA, 16 bp, C. familiaris
aaagcagttttctttt

SEQ ID NO: 296979 - DNA, 16 bp, C. familiaris
aaagcatcctgctaaa

SEQ ID NO: 296980 - DNA, 16 bp, C. familiaris
aaagcatctgaaaaaa

SEQ ID NO: 296981 - DNA, 16 bp, C. familiaris
aaagcatctgataaaa

SEQ ID NO: 296982 - DNA, 16 bp, C. familiaris
aaagcatgaaatcttg

SEQ ID NO: 296983 - DNA, 16 bp, C. familiaris
aaagcattattattat

SEQ ID NO: 296984 - DNA, 16 bp, C. familiaris
aaagcatttgaaaaaa

SEQ ID NO: 296985 - DNA, 16 bp, C. familiaris
aaagcatttgacaata

SEQ ID NO: 296986 - DNA, 16 bp, C. familiaris
aaagcatttgccaaaa

SEQ ID NO: 296987 - DNA, 16 bp, C. familiaris
aaagcattttaaaagc

SEQ ID NO: 296988 - DNA, 16 bp, C. familiaris
aaagcatttttcaaat

SEQ ID NO: 296989 - DNA, 16 bp, C. familiaris
aaagccaaatcagaag

SEQ ID NO: 296990 - DNA, 16 bp, C. familiaris
aaagccaatttagaag

SEQ ID NO: 296991 - DNA, 16 bp, C. familiaris
aaagccacaatgaaat

SEQ ID NO: 296992 - DNA, 16 bp, C. familiaris
aaagccactttggaaa

SEQ ID NO: 296993 - DNA, 16 bp, C. familiaris
aaagccagaattcaaa

SEQ ID NO: 296994 - DNA, 16 bp, C. familiaris
aaagccagaatttgaa

SEQ ID NO: 296995 - DNA, 16 bp, C. familiaris
aaagccatccaaatca

SEQ ID NO: 296996 - DNA, 16 bp, C. familiaris
aaagccatcttgaaaa

SEQ ID NO: 296997 - DNA, 16 bp, C. familiaris
aaagccattgttttct

SEQ ID NO: 296998 - DNA, 16 bp, C. familiaris
aaagcctcagaaggaa

SEQ ID NO: 296999 - DNA, 16 bp, C. familiaris
aaagcctttatttctc

SEQ ID NO: 297000 - DNA, 16 bp, C. familiaris
aaagctaaaaatggaa

SEQ ID NO: 297001 - DNA, 16 bp, C. familiaris
aaagctacattaatca

SEQ ID NO: 297002 - DNA, 16 bp, C. familiaris
aaagctactttttaaa

SEQ ID NO: 297003 - DNA, 16 bp, C. familiaris
aaagctataaaaatta

SEQ ID NO: 297004 - DNA, 16 bp, C. familiaris
aaagctatgaagaaaa

SEQ ID NO: 297005 - DNA, 16 bp, C. familiaris
aaagctcaaataaaca

SEQ ID NO: 297006 - DNA, 16 bp, C. familiaris
aaagctcagatgatag

SEQ ID NO: 297007 - DNA, 16 bp, C. familiaris
aaagctcccaggtgat

SEQ ID NO: 297008 - DNA, 16 bp, C. familiaris
aaagctctggtcatca

SEQ ID NO: 297009 - DNA, 16 bp, C. familiaris
aaagctgctatgaata

SEQ ID NO: 297010 - DNA, 16 bp, C. familiaris
aaagctggaaagaata

SEQ ID NO: 297011 - DNA, 16 bp, C. familiaris
aaagctggagtagcta

SEQ ID NO: 297012 - DNA, 16 bp, C. familiaris
aaagctggggacatca

SEQ ID NO: 297013 - DNA, 16 bp, C. familiaris
aaagctgggggtgggg

SEQ ID NO: 297014 - DNA, 16 bp, C. familiaris
aaagctgtcatcatca

SEQ ID NO: 297015 - DNA, 16 bp, C. familiaris
aaagcttctgcacagt

SEQ ID NO: 297016 - DNA, 16 bp, C. familiaris
aaagctttaaaaaatc

SEQ ID NO: 297017 - DNA, 16 bp, C. familiaris
aaagcttttaaaaaaa

SEQ ID NO: 297018 - DNA, 16 bp, C. familiaris
aaagcttttattcatt

SEQ ID NO: 297019 - DNA, 16 bp, C. familiaris
aaagcttttatttatt

SEQ ID NO: 297020 - DNA, 16 bp, C. familiaris
aaagctttttattttt

SEQ ID NO: 297021 - DNA, 16 bp, C. familiaris
aaaggaaaaaatgtca

SEQ ID NO: 297022 - DNA, 16 bp, C. familiaris
aaaggaaaaactttca

SEQ ID NO: 297023 - DNA, 16 bp, C. familiaris
aaaggaaaaagcttta

SEQ ID NO: 297024 - DNA, 16 bp, C. familiaris
aaaggaaaagattgat

SEQ ID NO: 297025 - DNA, 16 bp, C. familiaris
aaaggaaaagcaaatg

SEQ ID NO: 297026 - DNA, 16 bp, C. familiaris
aaaggaaaatattttc

SEQ ID NO: 297027 - DNA, 16 bp, C. familiaris
aaaggaaactcaaaat

SEQ ID NO: 297028 - DNA, 16 bp, C. familiaris
aaaggaaacttttaaa

SEQ ID NO: 297029 - DNA, 16 bp, C. familiaris
aaaggaaagaaaactt

SEQ ID NO: 297030 - DNA, 16 bp, C. familiaris
aaaggaaagaaatact

SEQ ID NO: 297031 - DNA, 16 bp, C. familiaris
aaaggaaaggaaaatc

SEQ ID NO: 297032 - DNA, 16 bp, C. familiaris
aaaggaaataaaactt

SEQ ID NO: 297033 - DNA, 16 bp, C. familiaris
aaaggaaataaacatt

SEQ ID NO: 297034 - DNA, 16 bp, C. familiaris
aaaggaaatatttgaa

SEQ ID NO: 297035 - DNA, 16 bp, C. familiaris
aaaggaaatcatgaaa

SEQ ID NO: 297036 - DNA, 16 bp, C. familiaris
aaaggaaatgaaatca

SEQ ID NO: 297037 - DNA, 16 bp, C. familiaris
aaaggaaatgatacca

SEQ ID NO: 297038 - DNA, 16 bp, C. familiaris
aaaggaaatgttatta

SEQ ID NO: 297039 - DNA, 16 bp, C. familiaris
aaaggaaatttggaaa

SEQ ID NO: 297040 - DNA, 16 bp, C. familiaris
aaaggaaattttgaaa

SEQ ID NO: 297041 - DNA, 16 bp, C. familiaris
aaaggaacctttgtgc

SEQ ID NO: 297042 - DNA, 16 bp, C. familiaris
aaaggaagaaaaatct

SEQ ID NO: 297043 - DNA, 16 bp, C. familiaris
aaaggaagaaaatgct

SEQ ID NO: 297044 - DNA, 16 bp, C. familiaris
aaaggaagaagtcaaa

SEQ ID NO: 297045 - DNA, 16 bp, C. familiaris
aaaggaagacaaaatt

SEQ ID NO: 297046 - DNA, 16 bp, C. familiaris
aaaggaagacaaatac

SEQ ID NO: 297047 - DNA, 16 bp, C. familiaris
aaaggaagacactcaa

SEQ ID NO: 297048 - DNA, 16 bp, C. familiaris
aaaggaagagaattct

SEQ ID NO: 297049 - DNA, 16 bp, C. familiaris
aaaggaaggaagctga

SEQ ID NO: 297050 - DNA, 16 bp, C. familiaris
aaaggaagttcttcaa

SEQ ID NO: 297051 - DNA, 16 bp, C. familiaris
aaaggaagttcttcag

SEQ ID NO: 297052 - DNA, 16 bp, C. familiaris
aaaggaagtttccaga

SEQ ID NO: 297053 - DNA, 16 bp, C. familiaris
aaaggaatattttaat

SEQ ID NO: 297054 - DNA, 16 bp, C. familiaris
aaaggaatgaaatctt

SEQ ID NO: 297055 - DNA, 16 bp, C. familiaris
aaaggaatgaagcact

SEQ ID NO: 297056 - DNA, 16 bp, C. familiaris
aaaggaatggaatctt

SEQ ID NO: 297057 - DNA, 16 bp, C. familiaris
aaaggaattgaaagca

SEQ ID NO: 297058 - DNA, 16 bp, C. familiaris
aaaggaatttcctcaa

SEQ ID NO: 297059 - DNA, 16 bp, C. familiaris
aaaggacaagaaccat

SEQ ID NO: 297060 - DNA, 16 bp, C. familiaris
aaaggacagtcttttc

SEQ ID NO: 297061 - DNA, 16 bp, C. familiaris
aaaggacatctatgaa

SEQ ID NO: 297062 - DNA, 16 bp, C. familiaris
aaaggacccaagtaaa

SEQ ID NO: 297063 - DNA, 16 bp, C. familiaris
aaaggacctgaacaga

SEQ ID NO: 297064 - DNA, 16 bp, C. familiaris
aaaggacctggagaaa

SEQ ID NO: 297065 - DNA, 16 bp, C. familiaris
aaaggagaaatacaga

SEQ ID NO: 297066 - DNA, 16 bp, C. familiaris
aaaggagaaatagaca

SEQ ID NO: 297067 - DNA, 16 bp, C. familiaris
aaaggagaaatgttta

SEQ ID NO: 297068 - DNA, 16 bp, C. familiaris
aaaggagaaattgaca

SEQ ID NO: 297069 - DNA, 16 bp, C. familiaris
aaaggagaagcagatt

SEQ ID NO: 297070 - DNA, 16 bp, C. familiaris
aaaggagaattatagg

SEQ ID NO: 297071 - DNA, 16 bp, C. familiaris
aaaggagacacacagg

SEQ ID NO: 297072 - DNA, 16 bp, C. familiaris
aaaggagagaatctca

SEQ ID NO: 297073 - DNA, 16 bp, C. familiaris
aaaggagctagataaa

SEQ ID NO: 297074 - DNA, 16 bp, C. familiaris
aaaggagctgaagaaa

SEQ ID NO: 297075 - DNA, 16 bp, C. familiaris
aaaggagctggaaaag

SEQ ID NO: 297076 - DNA, 16 bp, C. familiaris
aaaggaggaaatcttg

SEQ ID NO: 297077 - DNA, 16 bp, C. familiaris
aaaggaggaaattctg

SEQ ID NO: 297078 - DNA, 16 bp, C. familiaris
aaaggaggagaactga

SEQ ID NO: 297079 - DNA, 16 bp, C. familiaris
aaaggaggcaagaata

SEQ ID NO: 297080 - DNA, 16 bp, C. familiaris
aaaggagggaaactaa

SEQ ID NO: 297081 - DNA, 16 bp, C. familiaris
aaaggagttggagaaa

SEQ ID NO: 297082 - DNA, 16 bp, C. familiaris
aaaggatacaaaagta

SEQ ID NO: 297083 - DNA, 16 bp, C. familiaris
aaaggatccaacagta

SEQ ID NO: 297084 - DNA, 16 bp, C. familiaris
aaaggatgaaactgga

SEQ ID NO: 297085 - DNA, 16 bp, C. familiaris
aaaggatgaaattgga

SEQ ID NO: 297086 - DNA, 16 bp, C. familiaris
aaaggatgattttttt

SEQ ID NO: 297087 - DNA, 16 bp, C. familiaris
aaaggatgctgtactt

SEQ ID NO: 297088 - DNA, 16 bp, C. familiaris
aaaggatggaaaaaca

SEQ ID NO: 297089 - DNA, 16 bp, C. familiaris
aaaggatttgaacaga

SEQ ID NO: 297090 - DNA, 16 bp, C. familiaris
aaaggattttgcagat

SEQ ID NO: 297091 - DNA, 16 bp, C. familiaris
aaaggattttttaaaa

SEQ ID NO: 297092 - DNA, 16 bp, C. familiaris
aaaggcaaaaggaact

SEQ ID NO: 297093 - DNA, 16 bp, C. familiaris
aaaggcaaatggaaaa

SEQ ID NO: 297094 - DNA, 16 bp, C. familiaris
aaaggcaagaaaatga

SEQ ID NO: 297095 - DNA, 16 bp, C. familiaris
aaaggcagacttttaa

SEQ ID NO: 297096 - DNA, 16 bp, C. familiaris
aaaggcagagagacac

SEQ ID NO: 297097 - DNA, 16 bp, C. familiaris
aaaggcagagattggc

SEQ ID NO: 297098 - DNA, 16 bp, C. familiaris
aaaggcagagccaccc

SEQ ID NO: 297099 - DNA, 16 bp, C. familiaris
aaaggcagatactgaa

SEQ ID NO: 297100 - DNA, 16 bp, C. familiaris
aaaggcagatattcaa

SEQ ID NO: 297101 - DNA, 16 bp, C. familiaris
aaaggcagatgctaaa

SEQ ID NO: 297102 - DNA, 16 bp, C. familiaris
aaaggcagatgcttca

SEQ ID NO: 297103 - DNA, 16 bp, C. familiaris
aaaggccctgaggcag

SEQ ID NO: 297104 - DNA, 16 bp, C. familiaris
aaaggccctgaggttg

SEQ ID NO: 297105 - DNA, 16 bp, C. familiaris
aaaggccctgcctcca

SEQ ID NO: 297106 - DNA, 16 bp, C. familiaris
aaaggccgagaagcaa

SEQ ID NO: 297107 - DNA, 16 bp, C. familiaris
aaaggctcttttcaga

SEQ ID NO: 297108 - DNA, 16 bp, C. familiaris
aaagggaaaagcaggc

SEQ ID NO: 297109 - DNA, 19 bp, C. familiaris
aaagggacagaatacttcc

SEQ ID NO: 297110 - DNA, 16 bp, C. familiaris
aaagggagaagcagat

SEQ ID NO: 297111 - DNA, 16 bp, C. familiaris
aaaggggatccctggg

SEQ ID NO: 297112 - DNA, 16 bp, C. familiaris
aaaggggcagccctgg

SEQ ID NO: 297113 - DNA, 16 bp, C. familiaris
aaagggtgcctggctg

SEQ ID NO: 297114 - DNA, 16 bp, C. familiaris
aaagggttggtatcca

SEQ ID NO: 297115 - DNA, 16 bp, C. familiaris
aaaggtgcagggtttc

SEQ ID NO: 297116 - DNA, 16 bp, C. familiaris
aaagtaaaaatcttaa

SEQ ID NO: 297117 - DNA, 16 bp, C. familiaris
aaagtaaactagagaa

SEQ ID NO: 297118 - DNA, 16 bp, C. familiaris
aaagtaacaaagacta

SEQ ID NO: 297119 - DNA, 16 bp, C. familiaris
aaagtaattctttttt

SEQ ID NO: 297120 - DNA, 16 bp, C. familiaris
aaagtacagagagttc

SEQ ID NO: 297121 - DNA, 16 bp, C. familiaris
aaagtacatccattca

SEQ ID NO: 297122 - DNA, 16 bp, C. familiaris
aaagtactttaaaaaa

SEQ ID NO: 297123 - DNA, 16 bp, C. familiaris
aaagtaggcttagagg

SEQ ID NO: 297124 - DNA, 16 bp, C. familiaris
aaagtattttaaaatg

SEQ ID NO: 297125 - DNA, 16 bp, C. familiaris
aaagtattttgaacta

SEQ ID NO: 297126 - DNA, 16 bp, C. familiaris
aaagtcagcagaagga

SEQ ID NO: 297127 - DNA, 16 bp, C. familiaris
aaagtcaggaacaaga

SEQ ID NO: 297128 - DNA, 16 bp, C. familiaris
aaagtcatatatgaaa

SEQ ID NO: 297129 - DNA, 16 bp, C. familiaris
aaagtccaggaacaga

SEQ ID NO: 297130 - DNA, 16 bp, C. familiaris
aaagtccagggacaga

SEQ ID NO: 297131 - DNA, 16 bp, C. familiaris
aaagtccaggtccaga

SEQ ID NO: 297132 - DNA, 16 bp, C. familiaris
aaagtcctagaagaga

SEQ ID NO: 297133 - DNA, 16 bp, C. familiaris
aaagtcctttatcaga

SEQ ID NO: 297134 - DNA, 16 bp, C. familiaris
aaagtcctttttattt

SEQ ID NO: 297135 - DNA, 16 bp, C. familiaris
aaagtcttctttaaaa

SEQ ID NO: 297136 - DNA, 16 bp, C. familiaris
aaagtcttttattttt

SEQ ID NO: 297137 - DNA, 16 bp, C. familiaris
aaagtgaaaaggcaat

SEQ ID NO: 297138 - DNA, 16 bp, C. familiaris
aaagtgaacatttatt

SEQ ID NO: 297139 - DNA, 16 bp, C. familiaris
aaagtgaagaagtact

SEQ ID NO: 297140 - DNA, 16 bp, C. familiaris
aaagtgaagtggcata

SEQ ID NO: 297141 - DNA, 16 bp, C. familiaris
aaagtgaatatttatt

SEQ ID NO: 297142 - DNA, 16 bp, C. familiaris
aaagtgagaatttcaa

SEQ ID NO: 297143 - DNA, 16 bp, C. familiaris
aaagtgaggagacaga

SEQ ID NO: 297144 - DNA, 16 bp, C. familiaris
aaagtgatagaagttt

SEQ ID NO: 297145 - DNA, 16 bp, C. familiaris
aaagtgcagattctga

SEQ ID NO: 297146 - DNA, 16 bp, C. familiaris
aaagtgccattggaat

SEQ ID NO: 297147 - DNA, 16 bp, C. familiaris
aaagtggatgaaagac

SEQ ID NO: 297148 - DNA, 16 bp, C. familiaris
aaagtgggcagcccag

SEQ ID NO: 297149 - DNA, 16 bp, C. familiaris
aaagtggtccagcttc

SEQ ID NO: 297150 - DNA, 16 bp, C. familiaris
aaagtggtttcttgag

SEQ ID NO: 297151 - DNA, 16 bp, C. familiaris
aaagtgtctttatttt

SEQ ID NO: 297152 - DNA, 16 bp, C. familiaris
aaagtgtggtccctga

SEQ ID NO: 297153 - DNA, 16 bp, C. familiaris
aaagttacaaaggaaa

SEQ ID NO: 297154 - DNA, 16 bp, C. familiaris
aaagttacattaaaaa

SEQ ID NO: 297155 - DNA, 16 bp, C. familiaris
aaagttagtagaagga

SEQ ID NO: 297156 - DNA, 16 bp, C. familiaris
aaagttattttctttt

SEQ ID NO: 297157 - DNA, 17 bp, C. familiaris
aaagttcaaggtccact

SEQ ID NO: 297158 - DNA, 18 bp, C. familiaris
aaagttcagctcttattc

SEQ ID NO: 297159 - DNA, 16 bp, C. familiaris
aaagttcatttatttt

SEQ ID NO: 297160 - DNA, 16 bp, C. familiaris
aaagttctcattacaa

SEQ ID NO: 297161 - DNA, 16 bp, C. familiaris
aaagtttaacttcttc

SEQ ID NO: 297162 - DNA, 16 bp, C. familiaris
aaagtttcattggaac

SEQ ID NO: 297163 - DNA, 16 bp, C. familiaris
aaagttttattggaat

SEQ ID NO: 297164 - DNA, 16 bp, C. familiaris
aaataaaaagaacttt

SEQ ID NO: 297165 - DNA, 16 bp, C. familiaris
aaataaaaatgactat

SEQ ID NO: 297166 - DNA, 16 bp, C. familiaris
aaataaaaattctcag

SEQ ID NO: 297167 - DNA, 16 bp, C. familiaris
aaataaaacttctgta

SEQ ID NO: 297168 - DNA, 16 bp, C. familiaris
aaataaaactttgaaa

SEQ ID NO: 297169 - DNA, 16 bp, C. familiaris
aaataaaactttgaag

SEQ ID NO: 297170 - DNA, 16 bp, C. familiaris
aaataaaactttggaa

SEQ ID NO: 297171 - DNA, 16 bp, C. familiaris
aaataaaagaattcca

SEQ ID NO: 297172 - DNA, 16 bp, C. familiaris
aaataaaaggaaactt

SEQ ID NO: 297173 - DNA, 16 bp, C. familiaris
aaataaaaggaattca

SEQ ID NO: 297174 - DNA, 16 bp, C. familiaris
aaataaaatactgttt

SEQ ID NO: 297175 - DNA, 16 bp, C. familiaris
aaataaaatagttctt

SEQ ID NO: 297176 - DNA, 16 bp, C. familiaris
aaataaaatctctaga

SEQ ID NO: 297177 - DNA, 16 bp, C. familiaris
aaataaaatcttccaa

SEQ ID NO: 297178 - DNA, 16 bp, C. familiaris
aaataaaatcttttct

SEQ ID NO: 297179 - DNA, 16 bp, C. familiaris
aaataaaatgccattt

SEQ ID NO: 297180 - DNA, 16 bp, C. familiaris
aaataaaatgctcaaa

SEQ ID NO: 297181 - DNA, 16 bp, C. familiaris
aaataaaatggcagaa

SEQ ID NO: 297182 - DNA, 16 bp, C. familiaris
aaataaaatgttatct

SEQ ID NO: 297183 - DNA, 16 bp, C. familiaris
aaataaaatgttctat

SEQ ID NO: 297184 - DNA, 16 bp, C. familiaris
aaataaaatgtttgtt

SEQ ID NO: 297185 - DNA, 16 bp, C. familiaris
aaataaaatgttttct

SEQ ID NO: 297186 - DNA, 16 bp, C. familiaris
aaataaaattctcatt

SEQ ID NO: 297187 - DNA, 16 bp, C. familiaris
aaataaaattgacatt

SEQ ID NO: 297188 - DNA, 16 bp, C. familiaris
aaataaaattgtttca

SEQ ID NO: 297189 - DNA, 16 bp, C. familiaris
aaataaaattttgctt

SEQ ID NO: 297190 - DNA, 16 bp, C. familiaris
aaataaacacatagat

SEQ ID NO: 297191 - DNA, 16 bp, C. familiaris
aaataaacagaatctt

SEQ ID NO: 297192 - DNA, 16 bp, C. familiaris
aaataaacattttact

SEQ ID NO: 297193 - DNA, 16 bp, C. familiaris
aaataaactgaaaatg

SEQ ID NO: 297194 - DNA, 16 bp, C. familiaris
aaataaactggagaaa

SEQ ID NO: 297195 - DNA, 16 bp, C. familiaris
aaataaactgtggtat

SEQ ID NO: 297196 - DNA, 16 bp, C. familiaris
aaataaactgttttta

SEQ ID NO: 297197 - DNA, 16 bp, C. familiaris
aaataaagaaaagctt

SEQ ID NO: 297198 - DNA, 16 bp, C. familiaris
aaataaagaaatcctt

SEQ ID NO: 297199 - DNA, 16 bp, C. familiaris
aaataaagactttaaa

SEQ ID NO: 297200 - DNA, 16 bp, C. familiaris
aaataaagcatttaaa

SEQ ID NO: 297201 - DNA, 16 bp, C. familiaris
aaataaagctattaaa

SEQ ID NO: 297202 - DNA, 16 bp, C. familiaris
aaataaagctgtcttt

SEQ ID NO: 297203 - DNA, 16 bp, C. familiaris
aaataaagctttattg

SEQ ID NO: 297204 - DNA, 16 bp, C. familiaris
aaataaagtagtattg

SEQ ID NO: 297205 - DNA, 16 bp, C. familiaris
aaataaagtctttttt

SEQ ID NO: 297206 - DNA, 16 bp, C. familiaris
aaataaagtttgtttt

SEQ ID NO: 297207 - DNA, 16 bp, C. familiaris
aaataaagttttcttt

SEQ ID NO: 297208 - DNA, 16 bp, C. familiaris
aaataaataaagactt

SEQ ID NO: 297209 - DNA, 16 bp, C. familiaris
aaataaatacaatgtt

SEQ ID NO: 297210 - DNA, 16 bp, C. familiaris
aaataaatagcttatt

SEQ ID NO: 297211 - DNA, 16 bp, C. familiaris
aaataaatatttctct

SEQ ID NO: 297212 - DNA, 16 bp, C. familiaris
aaataaatcaaaatgg

SEQ ID NO: 297213 - DNA, 16 bp, C. familiaris
aaataaatcatgtaat

SEQ ID NO: 297214 - DNA, 16 bp, C. familiaris
aaataaatctttcttt

SEQ ID NO: 297215 - DNA, 16 bp, C. familiaris
aaataaatgaagtact

SEQ ID NO: 297216 - DNA, 16 bp, C. familiaris
aaataaatgcaaaact

SEQ ID NO: 297217 - DNA, 16 bp, C. familiaris
aaataaatggagatat

SEQ ID NO: 297218 - DNA, 16 bp, C. familiaris
aaataaatgtaatctt

SEQ ID NO: 297219 - DNA, 16 bp, C. familiaris
aaataaatgtttcttt

SEQ ID NO: 297220 - DNA, 16 bp, C. familiaris
aaataaattcagaatt

SEQ ID NO: 297221 - DNA, 16 bp, C. familiaris
aaataaattcagttta

SEQ ID NO: 297222 - DNA, 16 bp, C. familiaris
aaataaattccagaaa

SEQ ID NO: 297223 - DNA, 16 bp, C. familiaris
aaataaatttgccttt

SEQ ID NO: 297224 - DNA, 16 bp, C. familiaris
aaataaattttcttcc

SEQ ID NO: 297225 - DNA, 16 bp, C. familiaris
aaataacaacagcatt

SEQ ID NO: 297226 - DNA, 16 bp, C. familiaris
aaataacatctttgaa

SEQ ID NO: 297227 - DNA, 16 bp, C. familiaris
aaataacatttatgaa

SEQ ID NO: 297228 - DNA, 16 bp, C. familiaris
aaataacatttgaaaa

SEQ ID NO: 297229 - DNA, 16 bp, C. familiaris
aaataacattttgttt

SEQ ID NO: 297230 - DNA, 16 bp, C. familiaris
aaataagaaatctttt

SEQ ID NO: 297231 - DNA, 16 bp, C. familiaris
aaataagaacttttta

SEQ ID NO: 297232 - DNA, 16 bp, C. familiaris
aaataagcaattattt

SEQ ID NO: 297233 - DNA, 16 bp, C. familiaris
aaataagcatatggaa

SEQ ID NO: 297234 - DNA, 16 bp, C. familiaris
aaataagcatttaaaa

SEQ ID NO: 297235 - DNA, 16 bp, C. familiaris
aaataagccaaaggaa

SEQ ID NO: 297236 - DNA, 16 bp, C. familiaris
aaataaggaaatcttg

SEQ ID NO: 297237 - DNA, 16 bp, C. familiaris
aaataagttttctgct

SEQ ID NO: 297238 - DNA, 16 bp, C. familiaris
aaataagtttttcttt

SEQ ID NO: 297239 - DNA, 16 bp, C. familiaris
aaataataaagtactt

SEQ ID NO: 297240 - DNA, 16 bp, C. familiaris
aaataatccaaatgcc

SEQ ID NO: 297241 - DNA, 16 bp, C. familiaris
aaataatcccattaaa

SEQ ID NO: 297242 - DNA, 16 bp, C. familiaris
aaataatgaaactgga

SEQ ID NO: 297243 - DNA, 16 bp, C. familiaris
aaataatgacatattt

SEQ ID NO: 297244 - DNA, 16 bp, C. familiaris
aaataatgactgaaaa

SEQ ID NO: 297245 - DNA, 16 bp, C. familiaris
aaataatgatatggaa

SEQ ID NO: 297246 - DNA, 16 bp, C. familiaris
aaataatgctgcagta

SEQ ID NO: 297247 - DNA, 16 bp, C. familiaris
aaataatggatttttt

SEQ ID NO: 297248 - DNA, 16 bp, C. familiaris
aaataatggctgagaa

SEQ ID NO: 297249 - DNA, 16 bp, C. familiaris
aaataatggctttgaa

SEQ ID NO: 297250 - DNA, 16 bp, C. familiaris
aaataatggtgaaagg

SEQ ID NO: 297251 - DNA, 16 bp, C. familiaris
aaataatgtcattttt

SEQ ID NO: 297252 - DNA, 16 bp, C. familiaris
aaataattctgaaaag

SEQ ID NO: 297253 - DNA, 16 bp, C. familiaris
aaataatttactcttt

SEQ ID NO: 297254 - DNA, 16 bp, C. familiaris
aaataatttattcaag

SEQ ID NO: 297255 - DNA, 16 bp, C. familiaris
aaataatttctgaaat

SEQ ID NO: 297256 - DNA, 16 bp, C. familiaris
aaataatttgttttca

SEQ ID NO: 297257 - DNA, 16 bp, C. familiaris
aaataattttaaagac

SEQ ID NO: 297258 - DNA, 16 bp, C. familiaris
aaataattttaagaca

SEQ ID NO: 297259 - DNA, 16 bp, C. familiaris
aaatacaaagactgaa

SEQ ID NO: 297260 - DNA, 16 bp, C. familiaris
aaatacaaagcttctg

SEQ ID NO: 297261 - DNA, 16 bp, C. familiaris
aaatacaaataattgt

SEQ ID NO: 297262 - DNA, 16 bp, C. familiaris
aaatacacagagagag

SEQ ID NO: 297263 - DNA, 16 bp, C. familiaris
aaatacacatacacat

SEQ ID NO: 297264 - DNA, 16 bp, C. familiaris
aaatacacctttaaaa

SEQ ID NO: 297265 - DNA, 16 bp, C. familiaris
aaatacagaaatttct

SEQ ID NO: 297266 - DNA, 16 bp, C. familiaris
aaatacagagaactga

SEQ ID NO: 297267 - DNA, 16 bp, C. familiaris
aaatacagattcccag

SEQ ID NO: 297268 - DNA, 16 bp, C. familiaris
aaatacaggatgctca

SEQ ID NO: 297269 - DNA, 16 bp, C. familiaris
aaatacagtacaatac

SEQ ID NO: 297270 - DNA, 16 bp, C. familiaris
aaatacagtatttatt

SEQ ID NO: 297271 - DNA, 16 bp, C. familiaris
aaatacatacacatat

SEQ ID NO: 297272 - DNA, 16 bp, C. familiaris
aaatacatcatttttt

SEQ ID NO: 297273 - DNA, 16 bp, C. familiaris
aaatacatgaaaaatg

SEQ ID NO: 297274 - DNA, 16 bp, C. familiaris
aaatacatgcattttt

SEQ ID NO: 297275 - DNA, 16 bp, C. familiaris
aaatacattgaaaata

SEQ ID NO: 297276 - DNA, 16 bp, C. familiaris
aaatacatttgcattt

SEQ ID NO: 297277 - DNA, 16 bp, C. familiaris
aaatacattttatgaa

SEQ ID NO: 297278 - DNA, 16 bp, C. familiaris
aaataccagattaaca

SEQ ID NO: 297279 - DNA, 16 bp, C. familiaris
aaataccatgcacttt

SEQ ID NO: 297280 - DNA, 16 bp, C. familiaris
aaatactattcagcaa

SEQ ID NO: 297281 - DNA, 16 bp, C. familiaris
aaatactgagaacaaa

SEQ ID NO: 297282 - DNA, 16 bp, C. familiaris
aaatactgtatgtttt

SEQ ID NO: 297283 - DNA, 16 bp, C. familiaris
aaatacttccaggttt

SEQ ID NO: 297284 - DNA, 16 bp, C. familiaris
aaatacttgctgaatt

SEQ ID NO: 297285 - DNA, 16 bp, C. familiaris
aaatactttgtatttt

SEQ ID NO: 297286 - DNA, 16 bp, C. familiaris
aaatactttttgaatg

SEQ ID NO: 297287 - DNA, 16 bp, C. familiaris
aaatagaaaaacattt

SEQ ID NO: 297288 - DNA, 16 bp, C. familiaris
aaatagaaaacatttt

SEQ ID NO: 297289 - DNA, 16 bp, C. familiaris
aaatagaaagcctgaa

SEQ ID NO: 297290 - DNA, 16 bp, C. familiaris
aaatagaattatttct

SEQ ID NO: 297291 - DNA, 16 bp, C. familiaris
aaatagaattttactt

SEQ ID NO: 297292 - DNA, 16 bp, C. familiaris
aaatagacttttaaaa

SEQ ID NO: 297293 - DNA, 16 bp, C. familiaris
aaatagagaacaggaa

SEQ ID NO: 297294 - DNA, 16 bp, C. familiaris
aaatagcattttcaaa

SEQ ID NO: 297295 - DNA, 16 bp, C. familiaris
aaataggaaatctgaa

SEQ ID NO: 297296 - DNA, 16 bp, C. familiaris
aaatagggactcctgg

SEQ ID NO: 297297 - DNA, 16 bp, C. familiaris
aaatagtctttaaaat

SEQ ID NO: 297298 - DNA, 16 bp, C. familiaris
aaatagtgaaagtgaa

SEQ ID NO: 297299 - DNA, 16 bp, C. familiaris
aaatagttttatttct

SEQ ID NO: 297300 - DNA, 16 bp, C. familiaris
aaatataaagacacag

SEQ ID NO: 297301 - DNA, 16 bp, C. familiaris
aaatataaagcatttt

SEQ ID NO: 297302 - DNA, 16 bp, C. familiaris
aaatatacatttgaaa

SEQ ID NO: 297303 - DNA, 16 bp, C. familiaris
aaatatataatacagt

SEQ ID NO: 297304 - DNA, 16 bp, C. familiaris
aaatatatctaagaaa

SEQ ID NO: 297305 - DNA, 16 bp, C. familiaris
aaatatatgaagcaaa

SEQ ID NO: 297306 - DNA, 16 bp, C. familiaris
aaatatatgaatatgt

SEQ ID NO: 297307 - DNA, 16 bp, C. familiaris
aaatatatgcatttaa

SEQ ID NO: 297308 - DNA, 16 bp, C. familiaris
aaatatatgtgtatac

SEQ ID NO: 297309 - DNA, 16 bp, C. familiaris
aaatatattacagaaa

SEQ ID NO: 297310 - DNA, 16 bp, C. familiaris
aaatatattccatgct

SEQ ID NO: 297311 - DNA, 16 bp, C. familiaris
aaatatatttctaaag

SEQ ID NO: 297312 - DNA, 16 bp, C. familiaris
aaatatatttggaaat

SEQ ID NO: 297313 - DNA, 16 bp, C. familiaris
aaatatatttggaata

SEQ ID NO: 297314 - DNA, 16 bp, C. familiaris
aaatatattttatctg

SEQ ID NO: 297315 - DNA, 16 bp, C. familiaris
aaatatcaggaaggga

SEQ ID NO: 297316 - DNA, 16 bp, C. familiaris
aaatatccagaataga

SEQ ID NO: 297317 - DNA, 16 bp, C. familiaris
aaatatctgaaaaaga

SEQ ID NO: 297318 - DNA, 16 bp, C. familiaris
aaatatcttctcttat

SEQ ID NO: 297319 - DNA, 16 bp, C. familiaris
aaatatcttgaaaaat

SEQ ID NO: 297320 - DNA, 16 bp, C. familiaris
aaatatgaacaaatga

SEQ ID NO: 297321 - DNA, 16 bp, C. familiaris
aaatatgaagatattt

SEQ ID NO: 297322 - DNA, 16 bp, C. familiaris
aaatatgacaaaatgt

SEQ ID NO: 297323 - DNA, 16 bp, C. familiaris
aaatatgacattaaaa

SEQ ID NO: 297324 - DNA, 16 bp, C. familiaris
aaatatgcagaggaca

SEQ ID NO: 297325 - DNA, 16 bp, C. familiaris
aaatatggaaacaaat

SEQ ID NO: 297326 - DNA, 16 bp, C. familiaris
aaatatgtaagaaatg

SEQ ID NO: 297327 - DNA, 16 bp, C. familiaris
aaatatgtattatttc

SEQ ID NO: 297328 - DNA, 16 bp, C. familiaris
aaatatgtattgaatg

SEQ ID NO: 297329 - DNA, 16 bp, C. familiaris
aaatatgtcaaaatat

SEQ ID NO: 297330 - DNA, 16 bp, C. familiaris
aaatatgtcaatattt

SEQ ID NO: 297331 - DNA, 16 bp, C. familiaris
aaatatgtgaagaaat

SEQ ID NO: 297332 - DNA, 16 bp, C. familiaris
aaatatgtttccattt

SEQ ID NO: 297333 - DNA, 16 bp, C. familiaris
aaatattacacatttt

SEQ ID NO: 297334 - DNA, 16 bp, C. familiaris
aaatattacagagaaa

SEQ ID NO: 297335 - DNA, 16 bp, C. familiaris
aaatattagagcagaa

SEQ ID NO: 297336 - DNA, 16 bp, C. familiaris
aaatattagcaaacaa

SEQ ID NO: 297337 - DNA, 16 bp, C. familiaris
aaatattcaaagtaat

SEQ ID NO: 297338 - DNA, 16 bp, C. familiaris
aaatattcaacaaatg

SEQ ID NO: 297339 - DNA, 16 bp, C. familiaris
aaatattcagaaatat

SEQ ID NO: 297340 - DNA, 16 bp, C. familiaris
aaatattcagagaata

SEQ ID NO: 297341 - DNA, 16 bp, C. familiaris
aaatattcagtatttt

SEQ ID NO: 297342 - DNA, 16 bp, C. familiaris
aaatattcatgaaaat

SEQ ID NO: 297343 - DNA, 16 bp, C. familiaris
aaatattccagaaaaa

SEQ ID NO: 297344 - DNA, 16 bp, C. familiaris
aaatattccattttta

SEQ ID NO: 297345 - DNA, 16 bp, C. familiaris
aaatattcctttcaaa

SEQ ID NO: 297346 - DNA, 16 bp, C. familiaris
aaatattctacatttt

SEQ ID NO: 297347 - DNA, 16 bp, C. familiaris
aaatattctccagaat

SEQ ID NO: 297348 - DNA, 16 bp, C. familiaris
aaatattctttccttt

SEQ ID NO: 297349 - DNA, 16 bp, C. familiaris
aaatattgaaatatgt

SEQ ID NO: 297350 - DNA, 16 bp, C. familiaris
aaatattgaatattga

SEQ ID NO: 297351 - DNA, 16 bp, C. familiaris
aaatattgagatattt

SEQ ID NO: 297352 - DNA, 16 bp, C. familiaris
aaatattgccatttgt

SEQ ID NO: 297353 - DNA, 16 bp, C. familiaris
aaatattggggggaaa

SEQ ID NO: 297354 - DNA, 16 bp, C. familiaris
aaatatttaaaaagca

SEQ ID NO: 297355 - DNA, 16 bp, C. familiaris
aaatatttaaagtgtt

SEQ ID NO: 297356 - DNA, 16 bp, C. familiaris
aaatatttagcacagt

SEQ ID NO: 297357 - DNA, 16 bp, C. familiaris
aaatatttattcagca

SEQ ID NO: 297358 - DNA, 16 bp, C. familiaris
aaatatttattgtctg

SEQ ID NO: 297359 - DNA, 16 bp, C. familiaris
aaatatttatttcaga

SEQ ID NO: 297360 - DNA, 16 bp, C. familiaris
aaatatttcaaaagat

SEQ ID NO: 297361 - DNA, 16 bp, C. familiaris
aaatatttcagataaa

SEQ ID NO: 297362 - DNA, 16 bp, C. familiaris
aaatatttcagtaaaa

SEQ ID NO: 297363 - DNA, 16 bp, C. familiaris
aaatatttcatatttg

SEQ ID NO: 297364 - DNA, 16 bp, C. familiaris
aaatatttcatcaaat

SEQ ID NO: 297365 - DNA, 16 bp, C. familiaris
aaatatttccataata

SEQ ID NO: 297366 - DNA, 16 bp, C. familiaris
aaatatttctaagttt

SEQ ID NO: 297367 - DNA, 16 bp, C. familiaris
aaatatttctgaaaag

SEQ ID NO: 297368 - DNA, 16 bp, C. familiaris
aaatatttctgtgaaa

SEQ ID NO: 297369 - DNA, 16 bp, C. familiaris
aaatatttctgttttt

SEQ ID NO: 297370 - DNA, 16 bp, C. familiaris
aaatatttcttagata

SEQ ID NO: 297371 - DNA, 16 bp, C. familiaris
aaatatttcttcctct

SEQ ID NO: 297372 - DNA, 16 bp, C. familiaris
aaatatttcttctgct

SEQ ID NO: 297373 - DNA, 16 bp, C. familiaris
aaatatttctttcaaa

SEQ ID NO: 297374 - DNA, 16 bp, C. familiaris
aaatatttctttcaat

SEQ ID NO: 297375 - DNA, 16 bp, C. familiaris
aaatatttctttcctt

SEQ ID NO: 297376 - DNA, 16 bp, C. familiaris
aaatatttgaaaacat

SEQ ID NO: 297377 - DNA, 16 bp, C. familiaris
aaatatttgaaggaaa

SEQ ID NO: 297378 - DNA, 16 bp, C. familiaris
aaatatttgagaatat

SEQ ID NO: 297379 - DNA, 16 bp, C. familiaris
aaatatttgatgaata

SEQ ID NO: 297380 - DNA, 16 bp, C. familiaris
aaatatttgcaaagat

SEQ ID NO: 297381 - DNA, 16 bp, C. familiaris
aaatatttgcaaagca

SEQ ID NO: 297382 - DNA, 16 bp, C. familiaris
aaatatttggaaagga

SEQ ID NO: 297383 - DNA, 16 bp, C. familiaris
aaatatttggaatata

SEQ ID NO: 297384 - DNA, 16 bp, C. familiaris
aaatatttggcaaaat

SEQ ID NO: 297385 - DNA, 16 bp, C. familiaris
aaatatttgtaaattg

SEQ ID NO: 297386 - DNA, 16 bp, C. familiaris
aaatatttgtgaaaat

SEQ ID NO: 297387 - DNA, 16 bp, C. familiaris
aaatatttgttcttcc

SEQ ID NO: 297388 - DNA, 16 bp, C. familiaris
aaatatttgttgatgg

SEQ ID NO: 297389 - DNA, 16 bp, C. familiaris
aaatatttgtttaaag

SEQ ID NO: 297390 - DNA, 16 bp, C. familiaris
aaatattttaaaacag

SEQ ID NO: 297391 - DNA, 16 bp, C. familiaris
aaatattttaaacaga

SEQ ID NO: 297392 - DNA, 16 bp, C. familiaris
aaatattttattcact

SEQ ID NO: 297393 - DNA, 16 bp, C. familiaris
aaatattttattgaca

SEQ ID NO: 297394 - DNA, 16 bp, C. familiaris
aaatattttcaaagaa

SEQ ID NO: 297395 - DNA, 16 bp, C. familiaris
aaatattttcatcacc

SEQ ID NO: 297396 - DNA, 16 bp, C. familiaris
aaatattttccctctt

SEQ ID NO: 297397 - DNA, 16 bp, C. familiaris
aaatattttcctcttt

SEQ ID NO: 297398 - DNA, 16 bp, C. familiaris
aaatattttcctgaat

SEQ ID NO: 297399 - DNA, 16 bp, C. familiaris
aaatattttccttaaa

SEQ ID NO: 297400 - DNA, 16 bp, C. familiaris
aaatattttctaagtt

SEQ ID NO: 297401 - DNA, 16 bp, C. familiaris
aaatattttctcacag

SEQ ID NO: 297402 - DNA, 16 bp, C. familiaris
aaatattttctcagaa

SEQ ID NO: 297403 - DNA, 16 bp, C. familiaris
aaatattttctcttgg

SEQ ID NO: 297404 - DNA, 16 bp, C. familiaris
aaatattttctgtaat

SEQ ID NO: 297405 - DNA, 16 bp, C. familiaris
aaatattttcttcaaa

SEQ ID NO: 297406 - DNA, 16 bp, C. familiaris
aaatattttgaatatc

SEQ ID NO: 297407 - DNA, 16 bp, C. familiaris
aaatattttgaatgaa

SEQ ID NO: 297408 - DNA, 16 bp, C. familiaris
aaatattttgactttt

SEQ ID NO: 297409 - DNA, 16 bp, C. familiaris
aaatattttgctttgt

SEQ ID NO: 297410 - DNA, 16 bp, C. familiaris
aaatattttgttgaat

SEQ ID NO: 297411 - DNA, 16 bp, C. familiaris
aaatatttttatgcaa

SEQ ID NO: 297412 - DNA, 16 bp, C. familiaris
aaatatttttcaaaga

SEQ ID NO: 297413 - DNA, 16 bp, C. familiaris
aaatatttttctgatt

SEQ ID NO: 297414 - DNA, 16 bp, C. familiaris
aaatatttttctttga

SEQ ID NO: 297415 - DNA, 16 bp, C. familiaris
aaatatttttgagatt

SEQ ID NO: 297416 - DNA, 16 bp, C. familiaris
aaatattttttcagta

SEQ ID NO: 297417 - DNA, 16 bp, C. familiaris
aaatatttttttcaca

SEQ ID NO: 297418 - DNA, 16 bp, C. familiaris
aaatcaaaaaccagta

SEQ ID NO: 297419 - DNA, 16 bp, C. familiaris
aaatcaaaaccgcaat

SEQ ID NO: 297420 - DNA, 16 bp, C. familiaris
aaatcaaaagggaaat

SEQ ID NO: 297421 - DNA, 16 bp, C. familiaris
aaatcaaaatcatgat

SEQ ID NO: 297422 - DNA, 16 bp, C. familiaris
aaatcaaaatggaaat

SEQ ID NO: 297423 - DNA, 16 bp, C. familiaris
aaatcaaaatggatca

SEQ ID NO: 297424 - DNA, 16 bp, C. familiaris
aaatcaaagcccagaa

SEQ ID NO: 297425 - DNA, 16 bp, C. familiaris
aaatcaaaggagaaat

SEQ ID NO: 297426 - DNA, 16 bp, C. familiaris
aaatcaagaaaatgat

SEQ ID NO: 297427 - DNA, 16 bp, C. familiaris
aaatcaagagtcagct

SEQ ID NO: 297428 - DNA, 16 bp, C. familiaris
aaatcaaggaaacatg

SEQ ID NO: 297429 - DNA, 16 bp, C. familiaris
aaatcaaggaattaat

SEQ ID NO: 297430 - DNA, 16 bp, C. familiaris
aaatcaataaaaatgt

SEQ ID NO: 297431 - DNA, 16 bp, C. familiaris
aaatcaatcaaccaat

SEQ ID NO: 297432 - DNA, 16 bp, C. familiaris
aaatcaatgaaactga

SEQ ID NO: 297433 - DNA, 16 bp, C. familiaris
aaatcaattacaagaa

SEQ ID NO: 297434 - DNA, 16 bp, C. familiaris
aaatcaattgtatttc

SEQ ID NO: 297435 - DNA, 16 bp, C. familiaris
aaatcaatttctgttg

SEQ ID NO: 297436 - DNA, 16 bp, C. familiaris
aaatcacaagaagaag

SEQ ID NO: 297437 - DNA, 16 bp, C. familiaris
aaatcacaagggaaat

SEQ ID NO: 297438 - DNA, 16 bp, C. familiaris
aaatcaccctgaaaac

SEQ ID NO: 297439 - DNA, 16 bp, C. familiaris
aaatcactttgaaaaa

SEQ ID NO: 297440 - DNA, 16 bp, C. familiaris
aaatcagaaaattaat

SEQ ID NO: 297441 - DNA, 16 bp, C. familiaris
aaatcagaaagagaag

SEQ ID NO: 297442 - DNA, 16 bp, C. familiaris
aaatcagaagagaccc

SEQ ID NO: 297443 - DNA, 16 bp, C. familiaris
aaatcagaaggaagaa

SEQ ID NO: 297444 - DNA, 16 bp, C. familiaris
aaatcagaatataatt

SEQ ID NO: 297445 - DNA, 16 bp, C. familiaris
aaatcagaattttgga

SEQ ID NO: 297446 - DNA, 16 bp, C. familiaris
aaatcagagaaattaa

SEQ ID NO: 297447 - DNA, 16 bp, C. familiaris
aaatcagagaagaaat

SEQ ID NO: 297448 - DNA, 16 bp, C. familiaris
aaatcagagaaggaga

SEQ ID NO: 297449 - DNA, 16 bp, C. familiaris
aaatcagattgttttt

SEQ ID NO: 297450 - DNA, 16 bp, C. familiaris
aaatcagatttttaaa

SEQ ID NO: 297451 - DNA, 16 bp, C. familiaris
aaatcagcaagagaaa

SEQ ID NO: 297452 - DNA, 16 bp, C. familiaris
aaatcagcaaggaaac

SEQ ID NO: 297453 - DNA, 16 bp, C. familiaris
aaatcagccagtcaca

SEQ ID NO: 297454 - DNA, 16 bp, C. familiaris
aaatcaggatccctgg

SEQ ID NO: 297455 - DNA, 16 bp, C. familiaris
aaatcaggtcttaact

SEQ ID NO: 297456 - DNA, 16 bp, C. familiaris
aaatcagtgaaacaaa

SEQ ID NO: 297457 - DNA, 16 bp, C. familiaris
aaatcagtgagagaaa

SEQ ID NO: 297458 - DNA, 16 bp, C. familiaris
aaatcagtgctggata

SEQ ID NO: 297459 - DNA, 16 bp, C. familiaris
aaatcagtttcatttc

SEQ ID NO: 297460 - DNA, 16 bp, C. familiaris
aaatcatagaaacaga

SEQ ID NO: 297461 - DNA, 16 bp, C. familiaris
aaatcatatttgtctt

SEQ ID NO: 297462 - DNA, 16 bp, C. familiaris
aaatcatcaaggaaga

SEQ ID NO: 297463 - DNA, 16 bp, C. familiaris
aaatcatcatcatcat

SEQ ID NO: 297464 - DNA, 16 bp, C. familiaris
aaatcatccaattaaa

SEQ ID NO: 297465 - DNA, 16 bp, C. familiaris
aaatcatcctaagatt

SEQ ID NO: 297466 - DNA, 16 bp, C. familiaris
aaatcatgagagaaga

SEQ ID NO: 297467 - DNA, 16 bp, C. familiaris
aaatcatgttttcatt

SEQ ID NO: 297468 - DNA, 16 bp, C. familiaris
aaatcattaaggaaat

SEQ ID NO: 297469 - DNA, 16 bp, C. familiaris
aaatcattatttttgt

SEQ ID NO: 297470 - DNA, 16 bp, C. familiaris
aaatcatttatctgat

SEQ ID NO: 297471 - DNA, 16 bp, C. familiaris
aaatcatttccaaata

SEQ ID NO: 297472 - DNA, 16 bp, C. familiaris
aaatcattttacttct

SEQ ID NO: 297473 - DNA, 16 bp, C. familiaris
aaatcattttgatttt

SEQ ID NO: 297474 - DNA, 16 bp, C. familiaris
aaatccaacagtatat

SEQ ID NO: 297475 - DNA, 16 bp, C. familiaris
aaatccaagaagcaca

SEQ ID NO: 297476 - DNA, 16 bp, C. familiaris
aaatccaagaagctca

SEQ ID NO: 297477 - DNA, 16 bp, C. familiaris
aaatccacaaatatgt

SEQ ID NO: 297478 - DNA, 16 bp, C. familiaris
aaatcctaaaatattt

SEQ ID NO: 297479 - DNA, 16 bp, C. familiaris
aaatcctagaacagaa

SEQ ID NO: 297480 - DNA, 16 bp, C. familiaris
aaatcctcaagaaaat

SEQ ID NO: 297481 - DNA, 16 bp, C. familiaris
aaatcctggctctgcc

SEQ ID NO: 297482 - DNA, 16 bp, C. familiaris
aaatccttcagtggct

SEQ ID NO: 297483 - DNA, 16 bp, C. familiaris
aaatccttccaaactt

SEQ ID NO: 297484 - DNA, 16 bp, C. familiaris
aaatccttgggatgca

SEQ ID NO: 297485 - DNA, 16 bp, C. familiaris
aaatcctttatcagat

SEQ ID NO: 297486 - DNA, 16 bp, C. familiaris
aaatcctttgagattt

SEQ ID NO: 297487 - DNA, 16 bp, C. familiaris
aaatccttttaaattt

SEQ ID NO: 297488 - DNA, 16 bp, C. familiaris
aaatcctttttctgca

SEQ ID NO: 297489 - DNA, 16 bp, C. familiaris
aaatcgaaaccacaat

SEQ ID NO: 297490 - DNA, 19 bp, C. familiaris
aaatcgaactccaataaaa

SEQ ID NO: 297491 - DNA, 16 bp, C. familiaris
aaatctatgtatatat

SEQ ID NO: 297492 - DNA, 16 bp, C. familiaris
aaatctattttcaaaa

SEQ ID NO: 297493 - DNA, 16 bp, C. familiaris
aaatctcagagacaaa

SEQ ID NO: 297494 - DNA, 16 bp, C. familiaris
aaatctccagaaacag

SEQ ID NO: 297495 - DNA, 16 bp, C. familiaris
aaatctcccaagaaac

SEQ ID NO: 297496 - DNA, 16 bp, C. familiaris
aaatctctaaatttta

SEQ ID NO: 297497 - DNA, 16 bp, C. familiaris
aaatctctttttaaaa

SEQ ID NO: 297498 - DNA, 16 bp, C. familiaris
aaatctgaaaaaaatt

SEQ ID NO: 297499 - DNA, 16 bp, C. familiaris
aaatctgaaaaacaga

SEQ ID NO: 297500 - DNA, 16 bp, C. familiaris
aaatctgaaatcaagg

SEQ ID NO: 297501 - DNA, 16 bp, C. familiaris
aaatctgaagaagaaa

SEQ ID NO: 297502 - DNA, 16 bp, C. familiaris
aaatctgcacagcaaa

SEQ ID NO: 297503 - DNA, 16 bp, C. familiaris
aaatctggaagaaaaa

SEQ ID NO: 297504 - DNA, 16 bp, C. familiaris
aaatctggaattatga

SEQ ID NO: 297505 - DNA, 16 bp, C. familiaris
aaatctggagagacag

SEQ ID NO: 297506 - DNA, 16 bp, C. familiaris
aaatctggcattgtga

SEQ ID NO: 297507 - DNA, 16 bp, C. familiaris
aaatctgggattatga

SEQ ID NO: 297508 - DNA, 16 bp, C. familiaris
aaatctgtaagaaaaa

SEQ ID NO: 297509 - DNA, 16 bp, C. familiaris
aaatcttaaaagaaat

SEQ ID NO: 297510 - DNA, 16 bp, C. familiaris
aaatcttaaaagaagt

SEQ ID NO: 297511 - DNA, 16 bp, C. familiaris
aaatcttaaaggaaaa

SEQ ID NO: 297512 - DNA, 16 bp, C. familiaris
aaatcttaagaaagaa

SEQ ID NO: 297513 - DNA, 16 bp, C. familiaris
aaatcttaagaaatat

SEQ ID NO: 297514 - DNA, 16 bp, C. familiaris
aaatcttagagaagaa

SEQ ID NO: 297515 - DNA, 16 bp, C. familiaris
aaatcttaggagaaaa

SEQ ID NO: 297516 - DNA, 16 bp, C. familiaris
aaatcttcaaaaagaa

SEQ ID NO: 297517 - DNA, 16 bp, C. familiaris
aaatcttcattttaaa

SEQ ID NO: 297518 - DNA, 16 bp, C. familiaris
aaatcttccacaaaat

SEQ ID NO: 297519 - DNA, 16 bp, C. familiaris
aaatcttgaaagcaaa

SEQ ID NO: 297520 - DNA, 16 bp, C. familiaris
aaatcttgctgtttgt

SEQ ID NO: 297521 - DNA, 16 bp, C. familiaris
aaatcttggggcagcc

SEQ ID NO: 297522 - DNA, 16 bp, C. familiaris
aaatctttaaaatctg

SEQ ID NO: 297523 - DNA, 16 bp, C. familiaris
aaatctttaaaatgta

SEQ ID NO: 297524 - DNA, 16 bp, C. familiaris
aaatctttaaaatttc

SEQ ID NO: 297525 - DNA, 16 bp, C. familiaris
aaatctttatttgaaa

SEQ ID NO: 297526 - DNA, 16 bp, C. familiaris
aaatctttgaaaaaca

SEQ ID NO: 297527 - DNA, 16 bp, C. familiaris
aaatctttgaagaaaa

SEQ ID NO: 297528 - DNA, 16 bp, C. familiaris
aaatctttgggatgaa

SEQ ID NO: 297529 - DNA, 16 bp, C. familiaris
aaatcttttaagaaaa

SEQ ID NO: 297530 - DNA, 16 bp, C. familiaris
aaatcttttccaaaaa

SEQ ID NO: 297531 - DNA, 16 bp, C. familiaris
aaatcttttctaaaaa

SEQ ID NO: 297532 - DNA, 16 bp, C. familiaris
aaatcttttttaagat

SEQ ID NO: 297533 - DNA, 16 bp, C. familiaris
aaatgaaaacacaatt

SEQ ID NO: 297534 - DNA, 16 bp, C. familiaris
aaatgaaaacattgaa

SEQ ID NO: 297535 - DNA, 16 bp, C. familiaris
aaatgaaaaccagaat

SEQ ID NO: 297536 - DNA, 16 bp, C. familiaris
aaatgaaaacttgaaa

SEQ ID NO: 297537 - DNA, 16 bp, C. familiaris
aaatgaaaaggcaact

SEQ ID NO: 297538 - DNA, 16 bp, C. familiaris
aaatgaaaatacagat

SEQ ID NO: 297539 - DNA, 16 bp, C. familiaris
aaatgaaaatacagga

SEQ ID NO: 297540 - DNA, 16 bp, C. familiaris
aaatgaaaatactttt

SEQ ID NO: 297541 - DNA, 16 bp, C. familiaris
aaatgaaaatgatttt

SEQ ID NO: 297542 - DNA, 16 bp, C. familiaris
aaatgaaaatggaaac

SEQ ID NO: 297543 - DNA, 16 bp, C. familiaris
aaatgaaaatggattt

SEQ ID NO: 297544 - DNA, 16 bp, C. familiaris
aaatgaaaatggcaga

SEQ ID NO: 297545 - DNA, 16 bp, C. familiaris
aaatgaaaatgtatgt

SEQ ID NO: 297546 - DNA, 16 bp, C. familiaris
aaatgaaaatgtttca

SEQ ID NO: 297547 - DNA, 16 bp, C. familiaris
aaatgaaaatgtttga

SEQ ID NO: 297548 - DNA, 16 bp, C. familiaris
aaatgaaaattatgtt

SEQ ID NO: 297549 - DNA, 16 bp, C. familiaris
aaatgaaacaaagtat

SEQ ID NO: 297550 - DNA, 16 bp, C. familiaris
aaatgaaacagaaact

SEQ ID NO: 297551 - DNA, 16 bp, C. familiaris
aaatgaaacagatgaa

SEQ ID NO: 297552 - DNA, 16 bp, C. familiaris
aaatgaaagaatgcta

SEQ ID NO: 297553 - DNA, 16 bp, C. familiaris
aaatgaaagagaagtt

SEQ ID NO: 297554 - DNA, 16 bp, C. familiaris
aaatgaaagcagaaat

SEQ ID NO: 297555 - DNA, 16 bp, C. familiaris
aaatgaaaggacacta

SEQ ID NO: 297556 - DNA, 16 bp, C. familiaris
aaatgaaataatttct

SEQ ID NO: 297557 - DNA, 16 bp, C. familiaris
aaatgaaatctataaa

SEQ ID NO: 297558 - DNA, 16 bp, C. familiaris
aaatgaaatctttgaa

SEQ ID NO: 297559 - DNA, 16 bp, C. familiaris
aaatgaaatgcatttt

SEQ ID NO: 297560 - DNA, 16 bp, C. familiaris
aaatgaaattgaaatg

SEQ ID NO: 297561 - DNA, 16 bp, C. familiaris
aaatgaaatttggaaa

SEQ ID NO: 297562 - DNA, 16 bp, C. familiaris
aaatgaacaaaagatt

SEQ ID NO: 297563 - DNA, 16 bp, C. familiaris
aaatgaacaaaggact

SEQ ID NO: 297564 - DNA, 16 bp, C. familiaris
aaatgaacaaagggga

SEQ ID NO: 297565 - DNA, 16 bp, C. familiaris
aaatgaacaaagtgag

SEQ ID NO: 297566 - DNA, 16 bp, C. familiaris
aaatgaacaaatggaa

SEQ ID NO: 297567 - DNA, 16 bp, C. familiaris
aaatgaacagaaattt

SEQ ID NO: 297568 - DNA, 16 bp, C. familiaris
aaatgaactaaattct

SEQ ID NO: 297569 - DNA, 16 bp, C. familiaris
aaatgaagaaattgag

SEQ ID NO: 297570 - DNA, 16 bp, C. familiaris
aaatgaagaaggggta

SEQ ID NO: 297571 - DNA, 16 bp, C. familiaris
aaatgaagcaaatgaa

SEQ ID NO: 297572 - DNA, 16 bp, C. familiaris
aaatgaagcagagaaa

SEQ ID NO: 297573 - DNA, 16 bp, C. familiaris
aaatgaagtttttggt

SEQ ID NO: 297574 - DNA, 16 bp, C. familiaris
aaatgaataaatacat

SEQ ID NO: 297575 - DNA, 16 bp, C. familiaris
aaatgaatatttcatt

SEQ ID NO: 297576 - DNA, 16 bp, C. familiaris
aaatgaatgaaaatgt

SEQ ID NO: 297577 - DNA, 16 bp, C. familiaris
aaatgaatgaaagacc

SEQ ID NO: 297578 - DNA, 16 bp, C. familiaris
aaatgaattcagtgaa

SEQ ID NO: 297579 - DNA, 16 bp, C. familiaris
aaatgaattctgccaa

SEQ ID NO: 297580 - DNA, 16 bp, C. familiaris
aaatgaatttaattct

SEQ ID NO: 297581 - DNA, 16 bp, C. familiaris
aaatgaatttttctta

SEQ ID NO: 297582 - DNA, 16 bp, C. familiaris
aaatgacaattttaaa

SEQ ID NO: 297583 - DNA, 17 bp, C. familiaris
aaatgacagatcttcta

SEQ ID NO: 297584 - DNA, 16 bp, C. familiaris
aaatgacatttttaat

SEQ ID NO: 297585 - DNA, 16 bp, C. familiaris
aaatgactagaatgaa

SEQ ID NO: 297586 - DNA, 16 bp, C. familiaris
aaatgactgaagaaaa

SEQ ID NO: 297587 - DNA, 16 bp, C. familiaris
aaatgacttgaaagaa

SEQ ID NO: 297588 - DNA, 16 bp, C. familiaris
aaatgagaacatgcag

SEQ ID NO: 297589 - DNA, 16 bp, C. familiaris
aaatgagaagacagaa

SEQ ID NO: 297590 - DNA, 16 bp, C. familiaris
aaatgagaattcctgt

SEQ ID NO: 297591 - DNA, 16 bp, C. familiaris
aaatgagacaatgcat

SEQ ID NO: 297592 - DNA, 16 bp, C. familiaris
aaatgagactgagaaa

SEQ ID NO: 297593 - DNA, 16 bp, C. familiaris
aaatgagatcatactg

SEQ ID NO: 297594 - DNA, 16 bp, C. familiaris
aaatgagcaaaagact

SEQ ID NO: 297595 - DNA, 16 bp, C. familiaris
aaatgaggaaattgag

SEQ ID NO: 297596 - DNA, 16 bp, C. familiaris
aaatgaggtgtgcctg

SEQ ID NO: 297597 - DNA, 16 bp, C. familiaris
aaatgagtcaatcaga

SEQ ID NO: 297598 - DNA, 16 bp, C. familiaris
aaatgagtctcctgta

SEQ ID NO: 297599 - DNA, 16 bp, C. familiaris
aaatgagtctcttgga

SEQ ID NO: 297600 - DNA, 16 bp, C. familiaris
aaatgagtgaaggtgg

SEQ ID NO: 297601 - DNA, 16 bp, C. familiaris
aaatgagttgatacat

SEQ ID NO: 297602 - DNA, 16 bp, C. familiaris
aaatgataaaacattt

SEQ ID NO: 297603 - DNA, 16 bp, C. familiaris
aaatgataaagattag

SEQ ID NO: 297604 - DNA, 16 bp, C. familiaris
aaatgatcatatgttt

SEQ ID NO: 297605 - DNA, 16 bp, C. familiaris
aaatgatcatgtggtt

SEQ ID NO: 297606 - DNA, 16 bp, C. familiaris
aaatgatcctccttct

SEQ ID NO: 297607 - DNA, 16 bp, C. familiaris
aaatgatgaaatattt

SEQ ID NO: 297608 - DNA, 16 bp, C. familiaris
aaatgatgaaattatt

SEQ ID NO: 297609 - DNA, 16 bp, C. familiaris
aaatgatgaaatttta

SEQ ID NO: 297610 - DNA, 16 bp, C. familiaris
aaatgatgatgatgat

SEQ ID NO: 297611 - DNA, 16 bp, C. familiaris
aaatgatgctggaaaa

SEQ ID NO: 297612 - DNA, 16 bp, C. familiaris
aaatgatgctgggaaa

SEQ ID NO: 297613 - DNA, 16 bp, C. familiaris
aaatgatgggacacct

SEQ ID NO: 297614 - DNA, 16 bp, C. familiaris
aaatgatgtattttct

SEQ ID NO: 297615 - DNA, 16 bp, C. familiaris
aaatgatgttgggaaa

SEQ ID NO: 297616 - DNA, 16 bp, C. familiaris
aaatgattctggaaaa

SEQ ID NO: 297617 - DNA, 16 bp, C. familiaris
aaatgatttctctgta

SEQ ID NO: 297618 - DNA, 16 bp, C. familiaris
aaatgattttctttct

SEQ ID NO: 297619 - DNA, 16 bp, C. familiaris
aaatgattttgaaaat

SEQ ID NO: 297620 - DNA, 16 bp, C. familiaris
aaatgcaaaaatattc

SEQ ID NO: 297621 - DNA, 16 bp, C. familiaris
aaatgcaaaacttaaa

SEQ ID NO: 297622 - DNA, 16 bp, C. familiaris
aaatgcaaaatataat

SEQ ID NO: 297623 - DNA, 16 bp, C. familiaris
aaatgcaaagaaggaa

SEQ ID NO: 297624 - DNA, 16 bp, C. familiaris
aaatgcaaaggattat

SEQ ID NO: 297625 - DNA, 16 bp, C. familiaris
aaatgcaagggaaaaa

SEQ ID NO: 297626 - DNA, 16 bp, C. familiaris
aaatgcaagttctcag

SEQ ID NO: 297627 - DNA, 16 bp, C. familiaris
aaatgcaatgtggtat

SEQ ID NO: 297628 - DNA, 16 bp, C. familiaris
aaatgcacaaaataca

SEQ ID NO: 297629 - DNA, 16 bp, C. familiaris
aaatgcacatggaaca

SEQ ID NO: 297630 - DNA, 16 bp, C. familiaris
aaatgcacattttatt

SEQ ID NO: 297631 - DNA, 16 bp, C. familiaris
aaatgcataaaaatgt

SEQ ID NO: 297632 - DNA, 16 bp, C. familiaris
aaatgcatatatattt

SEQ ID NO: 297633 - DNA, 16 bp, C. familiaris
aaatgcatatgtatat

SEQ ID NO: 297634 - DNA, 16 bp, C. familiaris
aaatgcatgaaaagat

SEQ ID NO: 297635 - DNA, 16 bp, C. familiaris
aaatgcatggaaacaa

SEQ ID NO: 297636 - DNA, 16 bp, C. familiaris
aaatgcatgtttttaa

SEQ ID NO: 297637 - DNA, 16 bp, C. familiaris
aaatgcatttaatatt

SEQ ID NO: 297638 - DNA, 16 bp, C. familiaris
aaatgcatttgaaata

SEQ ID NO: 297639 - DNA, 16 bp, C. familiaris
aaatgcattttaaaaa

SEQ ID NO: 297640 - DNA, 16 bp, C. familiaris
aaatgcattttatttt

SEQ ID NO: 297641 - DNA, 16 bp, C. familiaris
aaatgcatttttaaaa

SEQ ID NO: 297642 - DNA, 16 bp, C. familiaris
aaatgccaacaaattg

SEQ ID NO: 297643 - DNA, 16 bp, C. familiaris
aaatgccatgaagaaa

SEQ ID NO: 297644 - DNA, 16 bp, C. familiaris
aaatgctaaaaatatt

SEQ ID NO: 297645 - DNA, 16 bp, C. familiaris
aaatgctaaggagaaa

SEQ ID NO: 297646 - DNA, 16 bp, C. familiaris
aaatgctaattttaaa

SEQ ID NO: 297647 - DNA, 16 bp, C. familiaris
aaatgctataaaaatg

SEQ ID NO: 297648 - DNA, 16 bp, C. familiaris
aaatgctatggaaaaa

SEQ ID NO: 297649 - DNA, 16 bp, C. familiaris
aaatgctatggagaaa

SEQ ID NO: 297650 - DNA, 16 bp, C. familiaris
aaatgctattaaaatt

SEQ ID NO: 297651 - DNA, 16 bp, C. familiaris
aaatgctattggaaaa

SEQ ID NO: 297652 - DNA, 16 bp, C. familiaris
aaatgctattgttatt

SEQ ID NO: 297653 - DNA, 16 bp, C. familiaris
aaatgctatttatttt

SEQ ID NO: 297654 - DNA, 16 bp, C. familiaris
aaatgctattttaaaa

SEQ ID NO: 297655 - DNA, 16 bp, C. familiaris
aaatgctattttattt

SEQ ID NO: 297656 - DNA, 16 bp, C. familiaris
aaatgctctaatcaaa

SEQ ID NO: 297657 - DNA, 16 bp, C. familiaris
aaatgctgaaaagaaa

SEQ ID NO: 297658 - DNA, 16 bp, C. familiaris
aaatgctgaaagaaaa

SEQ ID NO: 297659 - DNA, 16 bp, C. familiaris
aaatgctgagagaaaa

SEQ ID NO: 297660 - DNA, 16 bp, C. familiaris
aaatgctgatgaggat

SEQ ID NO: 297661 - DNA, 16 bp, C. familiaris
aaatgctgctggaaaa

SEQ ID NO: 297662 - DNA, 16 bp, C. familiaris
aaatgctgtttttgtt

SEQ ID NO: 297663 - DNA, 16 bp, C. familiaris
aaatgcttctgcacag

SEQ ID NO: 297664 - DNA, 16 bp, C. familiaris
aaatgcttctttaaaa

SEQ ID NO: 297665 - DNA, 16 bp, C. familiaris
aaatgcttcttttttt

SEQ ID NO: 297666 - DNA, 16 bp, C. familiaris
aaatgcttgttttttt

SEQ ID NO: 297667 - DNA, 16 bp, C. familiaris
aaatgctttaaaaatt

SEQ ID NO: 297668 - DNA, 16 bp, C. familiaris
aaatgctttaaaacaa

SEQ ID NO: 297669 - DNA, 16 bp, C. familiaris
aaatgctttcagaaaa

SEQ ID NO: 297670 - DNA, 16 bp, C. familiaris
aaatgcttttggaaaa

SEQ ID NO: 297671 - DNA, 16 bp, C. familiaris
aaatgctttttctctt

SEQ ID NO: 297672 - DNA, 16 bp, C. familiaris
aaatggaaaaatcatt

SEQ ID NO: 297673 - DNA, 16 bp, C. familiaris
aaatggaaaatacaga

SEQ ID NO: 297674 - DNA, 16 bp, C. familiaris
aaatggaaaatacatt

SEQ ID NO: 297675 - DNA, 16 bp, C. familiaris
aaatggaaagaaatca

SEQ ID NO: 297676 - DNA, 16 bp, C. familiaris
aaatggaaataatttc

SEQ ID NO: 297677 - DNA, 16 bp, C. familiaris
aaatggaaatacaact

SEQ ID NO: 297678 - DNA, 16 bp, C. familiaris
aaatggaaatcaaaag

SEQ ID NO: 297679 - DNA, 16 bp, C. familiaris
aaatggaacagatttc

SEQ ID NO: 297680 - DNA, 16 bp, C. familiaris
aaatggaacatttaaa

SEQ ID NO: 297681 - DNA, 16 bp, C. familiaris
aaatggaaggaaagct

SEQ ID NO: 297682 - DNA, 16 bp, C. familiaris
aaatggaaggatttcc

SEQ ID NO: 297683 - DNA, 16 bp, C. familiaris
aaatggaagttttttt

SEQ ID NO: 297684 - DNA, 16 bp, C. familiaris
aaatggaatattttca

SEQ ID NO: 297685 - DNA, 16 bp, C. familiaris
aaatggaatcatatta

SEQ ID NO: 297686 - DNA, 16 bp, C. familiaris
aaatggaattctaaaa

SEQ ID NO: 297687 - DNA, 16 bp, C. familiaris
aaatggaattttaaat

SEQ ID NO: 297688 - DNA, 16 bp, C. familiaris
aaatggacaaaatatt

SEQ ID NO: 297689 - DNA, 16 bp, C. familiaris
aaatggacaaattcct

SEQ ID NO: 297690 - DNA, 16 bp, C. familiaris
aaatggaccctgaact

SEQ ID NO: 297691 - DNA, 16 bp, C. familiaris
aaatggactcaatgct

SEQ ID NO: 297692 - DNA, 16 bp, C. familiaris
aaatggagaaaaatca

SEQ ID NO: 297693 - DNA, 16 bp, C. familiaris
aaatggagaaactgag

SEQ ID NO: 297694 - DNA, 16 bp, C. familiaris
aaatggatagtggtga

SEQ ID NO: 297695 - DNA, 16 bp, C. familiaris
aaatggatcacagacc

SEQ ID NO: 297696 - DNA, 16 bp, C. familiaris
aaatggatgaaagatt

SEQ ID NO: 297697 - DNA, 16 bp, C. familiaris
aaatggatgtcaaaaa

SEQ ID NO: 297698 - DNA, 16 bp, C. familiaris
aaatggatgttgaatt

SEQ ID NO: 297699 - DNA, 16 bp, C. familiaris
aaatggattattttct

SEQ ID NO: 297700 - DNA, 16 bp, C. familiaris
aaatggatttcatttt

SEQ ID NO: 297701 - DNA, 16 bp, C. familiaris
aaatggatttttttct

SEQ ID NO: 297702 - DNA, 16 bp, C. familiaris
aaatggcaaaaggaaa

SEQ ID NO: 297703 - DNA, 16 bp, C. familiaris
aaatggcaaatcaaaa

SEQ ID NO: 297704 - DNA, 16 bp, C. familiaris
aaatggcacagctgct

SEQ ID NO: 297705 - DNA, 16 bp, C. familiaris
aaatggcagaactggg

SEQ ID NO: 297706 - DNA, 16 bp, C. familiaris
aaatggccaaaaagca

SEQ ID NO: 297707 - DNA, 16 bp, C. familiaris
aaatggccaacaaaca

SEQ ID NO: 297708 - DNA, 16 bp, C. familiaris
aaatggccaagaagca

SEQ ID NO: 297709 - DNA, 16 bp, C. familiaris
aaatggctttaaaaaa

SEQ ID NO: 297710 - DNA, 16 bp, C. familiaris
aaatgggaaaaatatg

SEQ ID NO: 297711 - DNA, 16 bp, C. familiaris
aaatgggaaagaaaac

SEQ ID NO: 297712 - DNA, 16 bp, C. familiaris
aaatgggaagatattc

SEQ ID NO: 297713 - DNA, 16 bp, C. familiaris
aaatgggaatgaaaat

SEQ ID NO: 297714 - DNA, 16 bp, C. familiaris
aaatgggagacaagaa

SEQ ID NO: 297715 - DNA, 16 bp, C. familiaris
aaatgggattgattct

SEQ ID NO: 297716 - DNA, 16 bp, C. familiaris
aaatgggattttctta

SEQ ID NO: 297717 - DNA, 16 bp, C. familiaris
aaatgggcaaaagatc

SEQ ID NO: 297718 - DNA, 16 bp, C. familiaris
aaatgggctgaagaca

SEQ ID NO: 297719 - DNA, 16 bp, C. familiaris
aaatggggataatggt

SEQ ID NO: 297720 - DNA, 16 bp, C. familiaris
aaatgggtgatgagta

SEQ ID NO: 297721 - DNA, 16 bp, C. familiaris
aaatggtaggatttct

SEQ ID NO: 297722 - DNA, 16 bp, C. familiaris
aaatggtattttgaaa

SEQ ID NO: 297723 - DNA, 16 bp, C. familiaris
aaatggtcaaaagaca

SEQ ID NO: 297724 - DNA, 16 bp, C. familiaris
aaatggtctaaataca

SEQ ID NO: 297725 - DNA, 16 bp, C. familiaris
aaatggtgctggagca

SEQ ID NO: 297726 - DNA, 16 bp, C. familiaris
aaatggttgtatcttc

SEQ ID NO: 297727 - DNA, 16 bp, C. familiaris
aaatgtaaaaataact

SEQ ID NO: 297728 - DNA, 16 bp, C. familiaris
aaatgtaaaacttttg

SEQ ID NO: 297729 - DNA, 16 bp, C. familiaris
aaatgtaaatgggatt

SEQ ID NO: 297730 - DNA, 16 bp, C. familiaris
aaatgtaactttattt

SEQ ID NO: 297731 - DNA, 16 bp, C. familiaris
aaatgtaagaaatgta

SEQ ID NO: 297732 - DNA, 16 bp, C. familiaris
aaatgtacaaaaatgt

SEQ ID NO: 297733 - DNA, 16 bp, C. familiaris
aaatgtacattatttt

SEQ ID NO: 297734 - DNA, 16 bp, C. familiaris
aaatgtataaaatctt

SEQ ID NO: 297735 - DNA, 16 bp, C. familiaris
aaatgtatttcctctt

SEQ ID NO: 297736 - DNA, 16 bp, C. familiaris
aaatgtatttgcaaat

SEQ ID NO: 297737 - DNA, 16 bp, C. familiaris
aaatgtattttttcct

SEQ ID NO: 297738 - DNA, 16 bp, C. familiaris
aaatgtcaattttttt

SEQ ID NO: 297739 - DNA, 16 bp, C. familiaris
aaatgtcataaaatat

SEQ ID NO: 297740 - DNA, 16 bp, C. familiaris
aaatgtcattaaaatt

SEQ ID NO: 297741 - DNA, 16 bp, C. familiaris
aaatgtccaaaataga

SEQ ID NO: 297742 - DNA, 16 bp, C. familiaris
aaatgtctccagaaat

SEQ ID NO: 297743 - DNA, 16 bp, C. familiaris
aaatgtcttttcaaat

SEQ ID NO: 297744 - DNA, 16 bp, C. familiaris
aaatgtcttttcagat

SEQ ID NO: 297745 - DNA, 16 bp, C. familiaris
aaatgtcttttcttct

SEQ ID NO: 297746 - DNA, 16 bp, C. familiaris
aaatgtgaaaaatgtg

SEQ ID NO: 297747 - DNA, 16 bp, C. familiaris
aaatgtgaacatttta

SEQ ID NO: 297748 - DNA, 16 bp, C. familiaris
aaatgtgaagaaaatg

SEQ ID NO: 297749 - DNA, 16 bp, C. familiaris
aaatgtgaattttatt

SEQ ID NO: 297750 - DNA, 16 bp, C. familiaris
aaatgtgacacaagat

SEQ ID NO: 297751 - DNA, 16 bp, C. familiaris
aaatgtgagacctaaa

SEQ ID NO: 297752 - DNA, 16 bp, C. familiaris
aaatgtggaaaataca

SEQ ID NO: 297753 - DNA, 16 bp, C. familiaris
aaatgtgtaaatgtgt

SEQ ID NO: 297754 - DNA, 16 bp, C. familiaris
aaatgtgtaaattatt

SEQ ID NO: 297755 - DNA, 16 bp, C. familiaris
aaatgtgtaatatata

SEQ ID NO: 297756 - DNA, 16 bp, C. familiaris
aaatgtgtatttaaat

SEQ ID NO: 297757 - DNA, 16 bp, C. familiaris
aaatgtgtattttctt

SEQ ID NO: 297758 - DNA, 16 bp, C. familiaris
aaatgtgtcattttct

SEQ ID NO: 297759 - DNA, 16 bp, C. familiaris
aaatgtgtgttttaaa

SEQ ID NO: 297760 - DNA, 16 bp, C. familiaris
aaatgtgtttttcatt

SEQ ID NO: 297761 - DNA, 16 bp, C. familiaris
aaatgttaaaagattt

SEQ ID NO: 297762 - DNA, 16 bp, C. familiaris
aaatgttaaaggaaat

SEQ ID NO: 297763 - DNA, 16 bp, C. familiaris
aaatgttacttcctca

SEQ ID NO: 297764 - DNA, 16 bp, C. familiaris
aaatgttagttattat

SEQ ID NO: 297765 - DNA, 16 bp, C. familiaris
aaatgttcaagaaata

SEQ ID NO: 297766 - DNA, 16 bp, C. familiaris
aaatgttccatgtgca

SEQ ID NO: 297767 - DNA, 16 bp, C. familiaris
aaatgttgattttaaa

SEQ ID NO: 297768 - DNA, 16 bp, C. familiaris
aaatgttgggagagga

SEQ ID NO: 297769 - DNA, 16 bp, C. familiaris
aaatgtttaaaatggt

SEQ ID NO: 297770 - DNA, 16 bp, C. familiaris
aaatgtttacaaaaat

SEQ ID NO: 297771 - DNA, 16 bp, C. familiaris
aaatgtttcatctttg

SEQ ID NO: 297772 - DNA, 16 bp, C. familiaris
aaatgtttcctttaaa

SEQ ID NO: 297773 - DNA, 16 bp, C. familiaris
aaatgtttgataaatg

SEQ ID NO: 297774 - DNA, 16 bp, C. familiaris
aaatgtttgctgtttt

SEQ ID NO: 297775 - DNA, 16 bp, C. familiaris
aaatgtttgtatttct

SEQ ID NO: 297776 - DNA, 16 bp, C. familiaris
aaatgtttgttgcttt

SEQ ID NO: 297777 - DNA, 16 bp, C. familiaris
aaatgtttgtttataa

SEQ ID NO: 297778 - DNA, 16 bp, C. familiaris
aaatgttttacatatt

SEQ ID NO: 297779 - DNA, 16 bp, C. familiaris
aaatgttttcatttct

SEQ ID NO: 297780 - DNA, 16 bp, C. familiaris
aaatgttttgaaatat

SEQ ID NO: 297781 - DNA, 16 bp, C. familiaris
aaatgtttttccatct

SEQ ID NO: 297782 - DNA, 16 bp, C. familiaris
aaatgttttttcttca

SEQ ID NO: 297783 - DNA, 16 bp, C. familiaris
aaattaaaaaatgcat

SEQ ID NO: 297784 - DNA, 16 bp, C. familiaris
aaattaaaaatcagta

SEQ ID NO: 297785 - DNA, 16 bp, C. familiaris
aaattaaaaatgtttg

SEQ ID NO: 297786 - DNA, 16 bp, C. familiaris
aaattaaaacattttg

SEQ ID NO: 297787 - DNA, 16 bp, C. familiaris
aaattaaaaccttttt

SEQ ID NO: 297788 - DNA, 16 bp, C. familiaris
aaattaaaattcagaa

SEQ ID NO: 297789 - DNA, 16 bp, C. familiaris
aaattaaacagaattt

SEQ ID NO: 297790 - DNA, 16 bp, C. familiaris
aaattaaacccaaagt

SEQ ID NO: 297791 - DNA, 16 bp, C. familiaris
aaattaaagacatttt

SEQ ID NO: 297792 - DNA, 16 bp, C. familiaris
aaattaaagaggaatt

SEQ ID NO: 297793 - DNA, 16 bp, C. familiaris
aaattaaaggaattca

SEQ ID NO: 297794 - DNA, 16 bp, C. familiaris
aaattaaatttgccaa

SEQ ID NO: 297795 - DNA, 20 bp, C. familiaris
aaattaacaaggcaggaaac

SEQ ID NO: 297796 - DNA, 16 bp, C. familiaris
aaattaactcaaaaga

SEQ ID NO: 297797 - DNA, 16 bp, C. familiaris
aaattaagaaacagac

SEQ ID NO: 297798 - DNA, 16 bp, C. familiaris
aaattaagcaaaatat

SEQ ID NO: 297799 - DNA, 16 bp, C. familiaris
aaattaaggtttctaa

SEQ ID NO: 297800 - DNA, 16 bp, C. familiaris
aaattaatatccagaa

SEQ ID NO: 297801 - DNA, 16 bp, C. familiaris
aaattaatcaatgtga

SEQ ID NO: 297802 - DNA, 16 bp, C. familiaris
aaattaatgaacaaat

SEQ ID NO: 297803 - DNA, 16 bp, C. familiaris
aaattacaatgaaaat

SEQ ID NO: 297804 - DNA, 16 bp, C. familiaris
aaattacagaaatgga

SEQ ID NO: 297805 - DNA, 16 bp, C. familiaris
aaattacagaagaaat

SEQ ID NO: 297806 - DNA, 16 bp, C. familiaris
aaattacaggccagta

SEQ ID NO: 297807 - DNA, 16 bp, C. familiaris
aaattactctaaaatt

SEQ ID NO: 297808 - DNA, 16 bp, C. familiaris
aaattacttaacttct

SEQ ID NO: 297809 - DNA, 16 bp, C. familiaris
aaattagaaaatgttt

SEQ ID NO: 297810 - DNA, 16 bp, C. familiaris
aaattagaagtaaatc

SEQ ID NO: 297811 - DNA, 16 bp, C. familiaris
aaattagtgaaaggaa

SEQ ID NO: 297812 - DNA, 16 bp, C. familiaris
aaattatattcagaaa

SEQ ID NO: 297813 - DNA, 16 bp, C. familiaris
aaattatcaaagaaat

SEQ ID NO: 297814 - DNA, 16 bp, C. familiaris
aaattatccttcagaa

SEQ ID NO: 297815 - DNA, 16 bp, C. familiaris
aaattatgaaattatg

SEQ ID NO: 297816 - DNA, 16 bp, C. familiaris
aaattatggggaaaaa

SEQ ID NO: 297817 - DNA, 16 bp, C. familiaris
aaattattctgaaaaa

SEQ ID NO: 297818 - DNA, 16 bp, C. familiaris
aaattattgggaaaaa

SEQ ID NO: 297819 - DNA, 16 bp, C. familiaris
aaattatttaccatga

SEQ ID NO: 297820 - DNA, 16 bp, C. familiaris
aaattatttcagtttt

SEQ ID NO: 297821 - DNA, 16 bp, C. familiaris
aaattatttcatcaaa

SEQ ID NO: 297822 - DNA, 16 bp, C. familiaris
aaattatttctgtatt

SEQ ID NO: 297823 - DNA, 16 bp, C. familiaris
aaattatttcttcaaa

SEQ ID NO: 297824 - DNA, 16 bp, C. familiaris
aaattatttgggaaaa

SEQ ID NO: 297825 - DNA, 16 bp, C. familiaris
aaattattttaaagtg

SEQ ID NO: 297826 - DNA, 16 bp, C. familiaris
aaattattttctgcaa

SEQ ID NO: 297827 - DNA, 16 bp, C. familiaris
aaattcaaagacaaag

SEQ ID NO: 297828 - DNA, 16 bp, C. familiaris
aaattcaaaggaaaat

SEQ ID NO: 297829 - DNA, 16 bp, C. familiaris
aaattcaaaggagaaa

SEQ ID NO: 297830 - DNA, 16 bp, C. familiaris
aaattcaacatcaatt

SEQ ID NO: 297831 - DNA, 16 bp, C. familiaris
aaattcaagaaaaatt

SEQ ID NO: 297832 - DNA, 16 bp, C. familiaris
aaattcaagagttgga

SEQ ID NO: 297833 - DNA, 16 bp, C. familiaris
aaattcaagttaaaat

SEQ ID NO: 297834 - DNA, 16 bp, C. familiaris
aaattcaagttaatta

SEQ ID NO: 297835 - DNA, 16 bp, C. familiaris
aaattcaatttgttaa

SEQ ID NO: 297836 - DNA, 16 bp, C. familiaris
aaattcacatggaaat

SEQ ID NO: 297837 - DNA, 16 bp, C. familiaris
aaattcaccatcttaa

SEQ ID NO: 297838 - DNA, 16 bp, C. familiaris
aaattcagaaaaatta

SEQ ID NO: 297839 - DNA, 16 bp, C. familiaris
aaattcagaataattt

SEQ ID NO: 297840 - DNA, 16 bp, C. familiaris
aaattcagaatttatt

SEQ ID NO: 297841 - DNA, 16 bp, C. familiaris
aaattcagacatttaa

SEQ ID NO: 297842 - DNA, 16 bp, C. familiaris
aaattcagagagacag

SEQ ID NO: 297843 - DNA, 16 bp, C. familiaris
aaattcagtaaatttt

SEQ ID NO: 297844 - DNA, 16 bp, C. familiaris
aaattcagtatatttt

SEQ ID NO: 297845 - DNA, 16 bp, C. familiaris
aaattcataaaaacag

SEQ ID NO: 297846 - DNA, 16 bp, C. familiaris
aaattcataaataaag

SEQ ID NO: 297847 - DNA, 16 bp, C. familiaris
aaattcatagaaatgg

SEQ ID NO: 297848 - DNA, 16 bp, C. familiaris
aaattcatagacacag

SEQ ID NO: 297849 - DNA, 16 bp, C. familiaris
aaattcatatatttca

SEQ ID NO: 297850 - DNA, 16 bp, C. familiaris
aaattccatttataaa

SEQ ID NO: 297851 - DNA, 16 bp, C. familiaris
aaattcctcaacaaaa

SEQ ID NO: 297852 - DNA, 16 bp, C. familiaris
aaattcctttaaaatg

SEQ ID NO: 297853 - DNA, 16 bp, C. familiaris
aaattctagaaaatgt

SEQ ID NO: 297854 - DNA, 16 bp, C. familiaris
aaattctagaagagag

SEQ ID NO: 297855 - DNA, 16 bp, C. familiaris
aaattctagagctgaa

SEQ ID NO: 297856 - DNA, 16 bp, C. familiaris
aaattctcaacagaat

SEQ ID NO: 297857 - DNA, 16 bp, C. familiaris
aaattctcaacaggat

SEQ ID NO: 297858 - DNA, 16 bp, C. familiaris
aaattctcaagaaaat

SEQ ID NO: 297859 - DNA, 16 bp, C. familiaris
aaattctcagctataa

SEQ ID NO: 297860 - DNA, 16 bp, C. familiaris
aaattctgaaaataaa

SEQ ID NO: 297861 - DNA, 16 bp, C. familiaris
aaattctgaaagcagc

SEQ ID NO: 297862 - DNA, 16 bp, C. familiaris
aaattctgaagaaaat

SEQ ID NO: 297863 - DNA, 16 bp, C. familiaris
aaattctgaataaaat

SEQ ID NO: 297864 - DNA, 16 bp, C. familiaris
aaattctgtcatttgc

SEQ ID NO: 297865 - DNA, 16 bp, C. familiaris
aaattcttaggaataa

SEQ ID NO: 297866 - DNA, 16 bp, C. familiaris
aaattcttcaaagaaa

SEQ ID NO: 297867 - DNA, 16 bp, C. familiaris
aaattcttccaaattt

SEQ ID NO: 297868 - DNA, 16 bp, C. familiaris
aaattcttccttcctc

SEQ ID NO: 297869 - DNA, 16 bp, C. familiaris
aaattctttaaaatgt

SEQ ID NO: 297870 - DNA, 16 bp, C. familiaris
aaattctttgaagaaa

SEQ ID NO: 297871 - DNA, 16 bp, C. familiaris
aaattgaaaacttttt

SEQ ID NO: 297872 - DNA, 16 bp, C. familiaris
aaattgaaaatatttg

SEQ ID NO: 297873 - DNA, 16 bp, C. familiaris
aaattgaaagactaaa

SEQ ID NO: 297874 - DNA, 16 bp, C. familiaris
aaattgaagaaggcac

SEQ ID NO: 297875 - DNA, 16 bp, C. familiaris
aaattgaaggacattc

SEQ ID NO: 297876 - DNA, 16 bp, C. familiaris
aaattgagaggaaagt

SEQ ID NO: 297877 - DNA, 16 bp, C. familiaris
aaattgaggcatagag

SEQ ID NO: 297878 - DNA, 16 bp, C. familiaris
aaattgaggtgaaatt

SEQ ID NO: 297879 - DNA, 16 bp, C. familiaris
aaattgagtttttaaa

SEQ ID NO: 297880 - DNA, 16 bp, C. familiaris
aaattgataaaactct

SEQ ID NO: 297881 - DNA, 16 bp, C. familiaris
aaattgcttttaaaat

SEQ ID NO: 297882 - DNA, 16 bp, C. familiaris
aaattggatatccaca

SEQ ID NO: 297883 - DNA, 16 bp, C. familiaris
aaattggcaaagaagg

SEQ ID NO: 297884 - DNA, 16 bp, C. familiaris
aaattggcaaggaaga

SEQ ID NO: 297885 - DNA, 16 bp, C. familiaris
aaattgggttgtttat

SEQ ID NO: 297886 - DNA, 16 bp, C. familiaris
aaattgtattttcttt

SEQ ID NO: 297887 - DNA, 16 bp, C. familiaris
aaattgtcaaagaaga

SEQ ID NO: 297888 - DNA, 16 bp, C. familiaris
aaattgtgaatatttt

SEQ ID NO: 297889 - DNA, 16 bp, C. familiaris
aaattgtggaaagagc

SEQ ID NO: 297890 - DNA, 16 bp, C. familiaris
aaattgttaagaattt

SEQ ID NO: 297891 - DNA, 16 bp, C. familiaris
aaattgttttaaagaa

SEQ ID NO: 297892 - DNA, 16 bp, C. familiaris
aaattgttttactttt

SEQ ID NO: 297893 - DNA, 16 bp, C. familiaris
aaattgttttgaaaaa

SEQ ID NO: 297894 - DNA, 16 bp, C. familiaris
aaatttaaaaacactg

SEQ ID NO: 297895 - DNA, 16 bp, C. familiaris
aaatttaaaaagccat

SEQ ID NO: 297896 - DNA, 16 bp, C. familiaris
aaatttagaagtattt

SEQ ID NO: 297897 - DNA, 16 bp, C. familiaris
aaatttagaattttga

SEQ ID NO: 297898 - DNA, 16 bp, C. familiaris
aaatttagtgccattg

SEQ ID NO: 297899 - DNA, 16 bp, C. familiaris
aaatttatttgcaacc

SEQ ID NO: 297900 - DNA, 16 bp, C. familiaris
aaatttcaaagaagaa

SEQ ID NO: 297901 - DNA, 16 bp, C. familiaris
aaatttcagaaaattt

SEQ ID NO: 297902 - DNA, 16 bp, C. familiaris
aaatttcagaactgaa

SEQ ID NO: 297903 - DNA, 16 bp, C. familiaris
aaatttcagaataaaa

SEQ ID NO: 297904 - DNA, 16 bp, C. familiaris
aaatttcagttttaaa

SEQ ID NO: 297905 - DNA, 16 bp, C. familiaris
aaatttcatttcaaat

SEQ ID NO: 297906 - DNA, 16 bp, C. familiaris
aaatttcattttgttt

SEQ ID NO: 297907 - DNA, 16 bp, C. familiaris
aaatttccaaagaaaa

SEQ ID NO: 297908 - DNA, 16 bp, C. familiaris
aaatttccagaaataa

SEQ ID NO: 297909 - DNA, 16 bp, C. familiaris
aaatttccccccaaaa

SEQ ID NO: 297910 - DNA, 16 bp, C. familiaris
aaatttctaaaggaaa

SEQ ID NO: 297911 - DNA, 16 bp, C. familiaris
aaatttctaaggaaaa

SEQ ID NO: 297912 - DNA, 16 bp, C. familiaris
aaatttctagaagaaa

SEQ ID NO: 297913 - DNA, 16 bp, C. familiaris
aaatttctatatcatt

SEQ ID NO: 297914 - DNA, 16 bp, C. familiaris
aaatttctattgttta

SEQ ID NO: 297915 - DNA, 16 bp, C. familiaris
aaatttctcaacagaa

SEQ ID NO: 297916 - DNA, 16 bp, C. familiaris
aaatttctggaagaaa

SEQ ID NO: 297917 - DNA, 16 bp, C. familiaris
aaatttctgtacattg

SEQ ID NO: 297918 - DNA, 16 bp, C. familiaris
aaatttctgtaccttc

SEQ ID NO: 297919 - DNA, 16 bp, C. familiaris
aaatttcttcttaaaa

SEQ ID NO: 297920 - DNA, 16 bp, C. familiaris
aaatttctttaaaagt

SEQ ID NO: 297921 - DNA, 16 bp, C. familiaris
aaatttctttttgtgt

SEQ ID NO: 297922 - DNA, 16 bp, C. familiaris
aaatttgaaaatgttt

SEQ ID NO: 297923 - DNA, 16 bp, C. familiaris
aaatttgaaagaaact

SEQ ID NO: 297924 - DNA, 16 bp, C. familiaris
aaatttgaagatctaa

SEQ ID NO: 297925 - DNA, 16 bp, C. familiaris
aaatttgaatttcaga

SEQ ID NO: 297926 - DNA, 16 bp, C. familiaris
aaatttgagaaatatt

SEQ ID NO: 297927 - DNA, 16 bp, C. familiaris
aaatttggaaaaaatg

SEQ ID NO: 297928 - DNA, 16 bp, C. familiaris
aaatttggaaaatgtt

SEQ ID NO: 297929 - DNA, 16 bp, C. familiaris
aaatttggaaagtttt

SEQ ID NO: 297930 - DNA, 16 bp, C. familiaris
aaatttggaagaaact

SEQ ID NO: 297931 - DNA, 16 bp, C. familiaris
aaatttggaagaaatt

SEQ ID NO: 297932 - DNA, 16 bp, C. familiaris
aaatttgggttgtttc

SEQ ID NO: 297933 - DNA, 16 bp, C. familiaris
aaatttgtatggaatg

SEQ ID NO: 297934 - DNA, 16 bp, C. familiaris
aaatttgtccatttca

SEQ ID NO: 297935 - DNA, 16 bp, C. familiaris
aaatttgtttttctcc

SEQ ID NO: 297936 - DNA, 16 bp, C. familiaris
aaattttaaaagacaa

SEQ ID NO: 297937 - DNA, 16 bp, C. familiaris
aaattttaaaagtcaa

SEQ ID NO: 297938 - DNA, 16 bp, C. familiaris
aaattttaaagtttga

SEQ ID NO: 297939 - DNA, 16 bp, C. familiaris
aaattttaaatgcttt

SEQ ID NO: 297940 - DNA, 16 bp, C. familiaris
aaattttacaaaagca

SEQ ID NO: 297941 - DNA, 16 bp, C. familiaris
aaattttagaaatcaa

SEQ ID NO: 297942 - DNA, 16 bp, C. familiaris
aaattttaggagaaaa

SEQ ID NO: 297943 - DNA, 16 bp, C. familiaris
aaattttaggatgttt

SEQ ID NO: 297944 - DNA, 16 bp, C. familiaris
aaattttcagttatta

SEQ ID NO: 297945 - DNA, 16 bp, C. familiaris
aaattttctaaatgtt

SEQ ID NO: 297946 - DNA, 16 bp, C. familiaris
aaattttgaaaaacat

SEQ ID NO: 297947 - DNA, 16 bp, C. familiaris
aaattttgaaaactga

SEQ ID NO: 297948 - DNA, 16 bp, C. familiaris
aaattttgagttttga

SEQ ID NO: 297949 - DNA, 16 bp, C. familiaris
aaattttgataaattg

SEQ ID NO: 297950 - DNA, 16 bp, C. familiaris
aaattttggaactgaa

SEQ ID NO: 297951 - DNA, 16 bp, C. familiaris
aaatttttatgaagtc

SEQ ID NO: 297952 - DNA, 16 bp, C. familiaris
aaatttttattggaaa

SEQ ID NO: 297953 - DNA, 16 bp, C. familiaris
aaatttttatttctgt

SEQ ID NO: 297954 - DNA, 16 bp, C. familiaris
aaatttttccaaattt

SEQ ID NO: 297955 - DNA, 16 bp, C. familiaris
aaatttttgagaaact

SEQ ID NO: 297956 - DNA, 16 bp, C. familiaris
aaattttttgaagaaa

SEQ ID NO: 297957 - DNA, 16 bp, C. familiaris
aaattttttttgaaga

SEQ ID NO: 297958 - DNA, 16 bp, C. familiaris
aacaaaaaagacattt

SEQ ID NO: 297959 - DNA, 16 bp, C. familiaris
aacaaaaaggcaactt

SEQ ID NO: 297960 - DNA, 16 bp, C. familiaris
aacaaaacaaaacttg

SEQ ID NO: 297961 - DNA, 16 bp, C. familiaris
aacaaaacaaaagctt

SEQ ID NO: 297962 - DNA, 16 bp, C. familiaris
aacaaaacaagatcat

SEQ ID NO: 297963 - DNA, 16 bp, C. familiaris
aacaaaacagagaatc

SEQ ID NO: 297964 - DNA, 16 bp, C. familiaris
aacaaaaccaaaactg

SEQ ID NO: 297965 - DNA, 16 bp, C. familiaris
aacaaaaccagaagtt

SEQ ID NO: 297966 - DNA, 16 bp, C. familiaris
aacaaaacgaggcaga

SEQ ID NO: 297967 - DNA, 16 bp, C. familiaris
aacaaaagcaaacatg

SEQ ID NO: 297968 - DNA, 16 bp, C. familiaris
aacaaaaggaaaactg

SEQ ID NO: 297969 - DNA, 16 bp, C. familiaris
aacaaaatactataga

SEQ ID NO: 297970 - DNA, 16 bp, C. familiaris
aacaaaatacttagga

SEQ ID NO: 297971 - DNA, 16 bp, C. familiaris
aacaaaatgaacattt

SEQ ID NO: 297972 - DNA, 16 bp, C. familiaris
aacaaaatggaaatat

SEQ ID NO: 297973 - DNA, 16 bp, C. familiaris
aacaaaattctttttt

SEQ ID NO: 297974 - DNA, 16 bp, C. familiaris
aacaaaattgaattta

SEQ ID NO: 297975 - DNA, 16 bp, C. familiaris
aacaaaatttcatttt

SEQ ID NO: 297976 - DNA, 16 bp, C. familiaris
aacaaacataaaggga

SEQ ID NO: 297977 - DNA, 16 bp, C. familiaris
aacaaacatggtggac

SEQ ID NO: 297978 - DNA, 16 bp, C. familiaris
aacaaactgaattcaa

SEQ ID NO: 297979 - DNA, 16 bp, C. familiaris
aacaaactgatggtca

SEQ ID NO: 297980 - DNA, 16 bp, C. familiaris
aacaaacttcacaact

SEQ ID NO: 297981 - DNA, 16 bp, C. familiaris
aacaaagaaaactcca

SEQ ID NO: 297982 - DNA, 16 bp, C. familiaris
aacaaagataatttta

SEQ ID NO: 297983 - DNA, 16 bp, C. familiaris
aacaaagccaagaagg

SEQ ID NO: 297984 - DNA, 16 bp, C. familiaris
aacaaagccacccagg

SEQ ID NO: 297985 - DNA, 16 bp, C. familiaris
aacaaaggagatagaa

SEQ ID NO: 297986 - DNA, 16 bp, C. familiaris
aacaaagtatcacaga

SEQ ID NO: 297987 - DNA, 16 bp, C. familiaris
aacaaatagtaaaatg

SEQ ID NO: 297988 - DNA, 16 bp, C. familiaris
aacaaatatgaaaatg

SEQ ID NO: 297989 - DNA, 16 bp, C. familiaris
aacaaatatttgttta

SEQ ID NO: 297990 - DNA, 16 bp, C. familiaris
aacaaatcaggaaaca

SEQ ID NO: 297991 - DNA, 16 bp, C. familiaris
aacaaatgaagcctaa

SEQ ID NO: 297992 - DNA, 16 bp, C. familiaris
aacaaatgtggcaaaa

SEQ ID NO: 297993 - DNA, 16 bp, C. familiaris
aacaaattcagaaaga

SEQ ID NO: 297994 - DNA, 16 bp, C. familiaris
aacaaattggtgattg

SEQ ID NO: 297995 - DNA, 16 bp, C. familiaris
aacaaatttggaagaa

SEQ ID NO: 297996 - DNA, 16 bp, C. familiaris
aacaacaaaaatcttg

SEQ ID NO: 297997 - DNA, 16 bp, C. familiaris
aacaacaacaaccctg

SEQ ID NO: 297998 - DNA, 16 bp, C. familiaris
aacaacaataataatg

SEQ ID NO: 297999 - DNA, 16 bp, C. familiaris
aacaacagacacatag

SEQ ID NO: 298000 - DNA, 16 bp, C. familiaris
aacaacagatttattt

SEQ ID NO: 298001 - DNA, 16 bp, C. familiaris
aacaaccccagtggca

SEQ ID NO: 298002 - DNA, 16 bp, C. familiaris
aacaactgaaaatgaa

SEQ ID NO: 298003 - DNA, 16 bp, C. familiaris
aacaagaaaagtctga

SEQ ID NO: 298004 - DNA, 16 bp, C. familiaris
aacaagaaatatttat

SEQ ID NO: 298005 - DNA, 16 bp, C. familiaris
aacaagacagaggatc

SEQ ID NO: 298006 - DNA, 16 bp, C. familiaris
aacaagaccccacctc

SEQ ID NO: 298007 - DNA, 16 bp, C. familiaris
aacaagatctccaggt

SEQ ID NO: 298008 - DNA, 16 bp, C. familiaris
aacaaggaaactgagg

SEQ ID NO: 298009 - DNA, 16 bp, C. familiaris
aacaaggatgcctggg

SEQ ID NO: 298010 - DNA, 16 bp, C. familiaris
aacaagtattgttaaa

SEQ ID NO: 298011 - DNA, 16 bp, C. familiaris
aacaagtggaaagata

SEQ ID NO: 298012 - DNA, 16 bp, C. familiaris
aacaagttttggcaag

SEQ ID NO: 298013 - DNA, 16 bp, C. familiaris
aacaataaagtatttt

SEQ ID NO: 298014 - DNA, 16 bp, C. familiaris
aacaataataataagg

SEQ ID NO: 298015 - DNA, 16 bp, C. familiaris
aacaataatgatgatg

SEQ ID NO: 298016 - DNA, 16 bp, C. familiaris
aacaatatggatgaat

SEQ ID NO: 298017 - DNA, 16 bp, C. familiaris
aacaatgaatattttt

SEQ ID NO: 298018 - DNA, 16 bp, C. familiaris
aacaatgactttgaat

SEQ ID NO: 298019 - DNA, 16 bp, C. familiaris
aacaatgcaaatgtcc

SEQ ID NO: 298020 - DNA, 16 bp, C. familiaris
aacaatgtgaatggaa

SEQ ID NO: 298021 - DNA, 16 bp, C. familiaris
aacaattctactccta

SEQ ID NO: 298022 - DNA, 16 bp, C. familiaris
aacaatttggcaattt

SEQ ID NO: 298023 - DNA, 16 bp, C. familiaris
aacaattttaaaaatg

SEQ ID NO: 298024 - DNA, 16 bp, C. familiaris
aacaatttttgttctt

SEQ ID NO: 298025 - DNA, 16 bp, C. familiaris
aacacaatttttaaag

SEQ ID NO: 298026 - DNA, 16 bp, C. familiaris
aacacagaagaaaatc

SEQ ID NO: 298027 - DNA, 16 bp, C. familiaris
aacacagagacagagg

SEQ ID NO: 298028 - DNA, 16 bp, C. familiaris
aacacaggagagagag

SEQ ID NO: 298029 - DNA, 16 bp, C. familiaris
aacacaggcagaagga

SEQ ID NO: 298030 - DNA, 16 bp, C. familiaris
aacacatccatcatct

SEQ ID NO: 298031 - DNA, 16 bp, C. familiaris
aacacattttaagaaa

SEQ ID NO: 298032 - DNA, 16 bp, C. familiaris
aacaccaaaagcatga

SEQ ID NO: 298033 - DNA, 16 bp, C. familiaris
aacaccgagtgctcat

SEQ ID NO: 298034 - DNA, 16 bp, C. familiaris
aacacctacagcctga

SEQ ID NO: 298035 - DNA, 16 bp, C. familiaris
aacactcctaaagcaa

SEQ ID NO: 298036 - DNA, 16 bp, C. familiaris
aacactgcccacaaca

SEQ ID NO: 298037 - DNA, 16 bp, C. familiaris
aacacttctaaaagaa

SEQ ID NO: 298038 - DNA, 16 bp, C. familiaris
aacacttgttattttg

SEQ ID NO: 298039 - DNA, 16 bp, C. familiaris
aacactttgacattta

SEQ ID NO: 298040 - DNA, 16 bp, C. familiaris
aacagaaaagaatatc

SEQ ID NO: 298041 - DNA, 16 bp, C. familiaris
aacagaaaatccagaa

SEQ ID NO: 298042 - DNA, 16 bp, C. familiaris
aacagaaaatttcaaa

SEQ ID NO: 298043 - DNA, 16 bp, C. familiaris
aacagaaaattttaaa

SEQ ID NO: 298044 - DNA, 16 bp, C. familiaris
aacagaaacagattca

SEQ ID NO: 298045 - DNA, 16 bp, C. familiaris
aacagaaagatggaaa

SEQ ID NO: 298046 - DNA, 16 bp, C. familiaris
aacagaaatatttttt

SEQ ID NO: 298047 - DNA, 16 bp, C. familiaris
aacagaaatcaatgaa

SEQ ID NO: 298048 - DNA, 16 bp, C. familiaris
aacagaaatctattct

SEQ ID NO: 298049 - DNA, 16 bp, C. familiaris
aacagaaattaatttt

SEQ ID NO: 298050 - DNA, 16 bp, C. familiaris
aacagaaattttaaaa

SEQ ID NO: 298051 - DNA, 16 bp, C. familiaris
aacagaactttctgca

SEQ ID NO: 298052 - DNA, 16 bp, C. familiaris
aacagaagaaaacatt

SEQ ID NO: 298053 - DNA, 16 bp, C. familiaris
aacagaagaaatattt

SEQ ID NO: 298054 - DNA, 16 bp, C. familiaris
aacagaatagaaaatg

SEQ ID NO: 298055 - DNA, 16 bp, C. familiaris
aacagaatagaaaatt

SEQ ID NO: 298056 - DNA, 16 bp, C. familiaris
aacagaatagagtcca

SEQ ID NO: 298057 - DNA, 16 bp, C. familiaris
aacagaatatggcaaa

SEQ ID NO: 298058 - DNA, 16 bp, C. familiaris
aacagacacatgagaa

SEQ ID NO: 298059 - DNA, 16 bp, C. familiaris
aacagacatctctcca

SEQ ID NO: 298060 - DNA, 16 bp, C. familiaris
aacagactctgaacta

SEQ ID NO: 298061 - DNA, 16 bp, C. familiaris
aacagactcttcactg

SEQ ID NO: 298062 - DNA, 16 bp, C. familiaris
aacagacttcctgctg

SEQ ID NO: 298063 - DNA, 16 bp, C. familiaris
aacagactttaaaata

SEQ ID NO: 298064 - DNA, 16 bp, C. familiaris
aacagactttttaaaa

SEQ ID NO: 298065 - DNA, 16 bp, C. familiaris
aacagagaacccagaa

SEQ ID NO: 298066 - DNA, 16 bp, C. familiaris
aacagagaactacaaa

SEQ ID NO: 298067 - DNA, 16 bp, C. familiaris
aacagagagcccagaa

SEQ ID NO: 298068 - DNA, 16 bp, C. familiaris
aacagagagtccagaa

SEQ ID NO: 298069 - DNA, 16 bp, C. familiaris
aacagagatttttaaa

SEQ ID NO: 298070 - DNA, 16 bp, C. familiaris
aacagaggatcacagg

SEQ ID NO: 298071 - DNA, 16 bp, C. familiaris
aacagaggcagagaca

SEQ ID NO: 298072 - DNA, 16 bp, C. familiaris
aacagaggcccagaga

SEQ ID NO: 298073 - DNA, 16 bp, C. familiaris
aacagagggagcagca

SEQ ID NO: 298074 - DNA, 16 bp, C. familiaris
aacagatacattaaaa

SEQ ID NO: 298075 - DNA, 16 bp, C. familiaris
aacagatacttgtaca

SEQ ID NO: 298076 - DNA, 16 bp, C. familiaris
aacagatatttcttca

SEQ ID NO: 298077 - DNA, 16 bp, C. familiaris
aacagatatttcttga

SEQ ID NO: 298078 - DNA, 16 bp, C. familiaris
aacagatgaacaaagg

SEQ ID NO: 298079 - DNA, 16 bp, C. familiaris
aacagatgaagaaaca

SEQ ID NO: 298080 - DNA, 16 bp, C. familiaris
aacagatgaataaata

SEQ ID NO: 298081 - DNA, 16 bp, C. familiaris
aacagatgagtggata

SEQ ID NO: 298082 - DNA, 16 bp, C. familiaris
aacagatttttgtttt

SEQ ID NO: 298083 - DNA, 16 bp, C. familiaris
aacagattttttttct

SEQ ID NO: 298084 - DNA, 16 bp, C. familiaris
aacagcaaaatacaca

SEQ ID NO: 298085 - DNA, 16 bp, C. familiaris
aacagcagaatataca

SEQ ID NO: 298086 - DNA, 16 bp, C. familiaris
aacagcagcagcagca

SEQ ID NO: 298087 - DNA, 16 bp, C. familiaris
aacagcattcttcaca

SEQ ID NO: 298088 - DNA, 16 bp, C. familiaris
aacagccaaatgaaga

SEQ ID NO: 298089 - DNA, 16 bp, C. familiaris
aacagctcaagtgtcc

SEQ ID NO: 298090 - DNA, 16 bp, C. familiaris
aacagctgatttctca

SEQ ID NO: 298091 - DNA, 16 bp, C. familiaris
aacagctggaatgcca

SEQ ID NO: 298092 - DNA, 16 bp, C. familiaris
aacagcttcagaagaa

SEQ ID NO: 298093 - DNA, 16 bp, C. familiaris
aacagctttagaagaa

SEQ ID NO: 298094 - DNA, 16 bp, C. familiaris
aacaggaaaaggacat

SEQ ID NO: 298095 - DNA, 16 bp, C. familiaris
aacaggaacatgaaaa

SEQ ID NO: 298096 - DNA, 16 bp, C. familiaris
aacaggaagaaatgga

SEQ ID NO: 298097 - DNA, 16 bp, C. familiaris
aacaggaggaaataga

SEQ ID NO: 298098 - DNA, 16 bp, C. familiaris
aacaggatttgctgat

SEQ ID NO: 298099 - DNA, 16 bp, C. familiaris
aacaggccaataacaa

SEQ ID NO: 298100 - DNA, 16 bp, C. familiaris
aacaggctccatgtag

SEQ ID NO: 298101 - DNA, 16 bp, C. familiaris
aacaggctccgtgcag

SEQ ID NO: 298102 - DNA, 16 bp, C. familiaris
aacagggaaatacaaa

SEQ ID NO: 298103 - DNA, 16 bp, C. familiaris
aacagggaagcctggg

SEQ ID NO: 298104 - DNA, 16 bp, C. familiaris
aacaggggcacctggg

SEQ ID NO: 298105 - DNA, 16 bp, C. familiaris
aacagtatttttcaca

SEQ ID NO: 298106 - DNA, 16 bp, C. familiaris
aacagtgaacaaaact

SEQ ID NO: 298107 - DNA, 16 bp, C. familiaris
aacagtgcaggagggt

SEQ ID NO: 298108 - DNA, 16 bp, C. familiaris
aacagtggtgagagtg

SEQ ID NO: 298109 - DNA, 16 bp, C. familiaris
aacagtgtctggaaca

SEQ ID NO: 298110 - DNA, 16 bp, C. familiaris
aacagtgtgaaggttc

SEQ ID NO: 298111 - DNA, 16 bp, C. familiaris
aacagttacatgaaaa

SEQ ID NO: 298112 - DNA, 16 bp, C. familiaris
aacagttcatttttgc

SEQ ID NO: 298113 - DNA, 16 bp, C. familiaris
aacagttttatttatt

SEQ ID NO: 298114 - DNA, 16 bp, C. familiaris
aacataaagaaatgga

SEQ ID NO: 298115 - DNA, 16 bp, C. familiaris
aacataatgttctcaa

SEQ ID NO: 298116 - DNA, 16 bp, C. familiaris
aacataatttcttaaa

SEQ ID NO: 298117 - DNA, 16 bp, C. familiaris
aacatacaaaaattcc

SEQ ID NO: 298118 - DNA, 16 bp, C. familiaris
aacatacattttttaa

SEQ ID NO: 298119 - DNA, 16 bp, C. familiaris
aacatagaagaaatgg

SEQ ID NO: 298120 - DNA, 16 bp, C. familiaris
aacatagagggagaag

SEQ ID NO: 298121 - DNA, 16 bp, C. familiaris
aacatatgaaagtaaa

SEQ ID NO: 298122 - DNA, 16 bp, C. familiaris
aacatcaccagaaaca

SEQ ID NO: 298123 - DNA, 16 bp, C. familiaris
aacatcaccatcatca

SEQ ID NO: 298124 - DNA, 16 bp, C. familiaris
aacatctccaaagaag

SEQ ID NO: 298125 - DNA, 16 bp, C. familiaris
aacatcttaaaagaaa

SEQ ID NO: 298126 - DNA, 16 bp, C. familiaris
aacatcttttcaaatg

SEQ ID NO: 298127 - DNA, 16 bp, C. familiaris
aacatgaataaatctc

SEQ ID NO: 298128 - DNA, 16 bp, C. familiaris
aacatgagggtgcaga

SEQ ID NO: 298129 - DNA, 16 bp, C. familiaris
aacatggaagtgcaga

SEQ ID NO: 298130 - DNA, 16 bp, C. familiaris
aacatggatgaccctt

SEQ ID NO: 298131 - DNA, 16 bp, C. familiaris
aacatgtatcagaatt

SEQ ID NO: 298132 - DNA, 16 bp, C. familiaris
aacatgtattttaaaa

SEQ ID NO: 298133 - DNA, 16 bp, C. familiaris
aacatgttttatattt

SEQ ID NO: 298134 - DNA, 16 bp, C. familiaris
aacattaaaaatgttt

SEQ ID NO: 298135 - DNA, 16 bp, C. familiaris
aacattaagaaaatga

SEQ ID NO: 298136 - DNA, 16 bp, C. familiaris
aacattatgctaagtg

SEQ ID NO: 298137 - DNA, 16 bp, C. familiaris
aacattattaagaaaa

SEQ ID NO: 298138 - DNA, 16 bp, C. familiaris
aacattcaaaatattt

SEQ ID NO: 298139 - DNA, 16 bp, C. familiaris
aacattccattgtgta

SEQ ID NO: 298140 - DNA, 16 bp, C. familiaris
aacattgctgaaagaa

SEQ ID NO: 298141 - DNA, 16 bp, C. familiaris
aacattggggtgaagg

SEQ ID NO: 298142 - DNA, 16 bp, C. familiaris
aacattgtggtctgaa

SEQ ID NO: 298143 - DNA, 16 bp, C. familiaris
aacatttaaaaatgaa

SEQ ID NO: 298144 - DNA, 16 bp, C. familiaris
aacatttaaaagaaag

SEQ ID NO: 298145 - DNA, 16 bp, C. familiaris
aacatttacagaagaa

SEQ ID NO: 298146 - DNA, 16 bp, C. familiaris
aacatttattgagagc

SEQ ID NO: 298147 - DNA, 16 bp, C. familiaris
aacatttctgaaatta

SEQ ID NO: 298148 - DNA, 16 bp, C. familiaris
aacatttgaagaaaaa

SEQ ID NO: 298149 - DNA, 16 bp, C. familiaris
aacatttgaagaaaat

SEQ ID NO: 298150 - DNA, 16 bp, C. familiaris
aacatttggaaaaaaa

SEQ ID NO: 298151 - DNA, 16 bp, C. familiaris
aacatttgttgaacac

SEQ ID NO: 298152 - DNA, 16 bp, C. familiaris
aacatttgtttttaaa

SEQ ID NO: 298153 - DNA, 16 bp, C. familiaris
aacattttcagaaaat

SEQ ID NO: 298154 - DNA, 16 bp, C. familiaris
aacattttcatcaacc

SEQ ID NO: 298155 - DNA, 16 bp, C. familiaris
aacattttccttttct

SEQ ID NO: 298156 - DNA, 16 bp, C. familiaris
aacattttgaaatata

SEQ ID NO: 298157 - DNA, 16 bp, C. familiaris
aacattttgaatttta

SEQ ID NO: 298158 - DNA, 16 bp, C. familiaris
aacattttggaaaatg

SEQ ID NO: 298159 - DNA, 16 bp, C. familiaris
aacatttttcaaatgt

SEQ ID NO: 298160 - DNA, 16 bp, C. familiaris
aacatttttctcattt

SEQ ID NO: 298161 - DNA, 16 bp, C. familiaris
aaccaaaaacatctcc

SEQ ID NO: 298162 - DNA, 16 bp, C. familiaris
aaccaaaaatgtcccc

SEQ ID NO: 298163 - DNA, 16 bp, C. familiaris
aaccaaaaccacagtg

SEQ ID NO: 298164 - DNA, 16 bp, C. familiaris
aaccaaagaagtgaaa

SEQ ID NO: 298165 - DNA, 16 bp, C. familiaris
aaccaaagagttaaag

SEQ ID NO: 298166 - DNA, 16 bp, C. familiaris
aaccaaaggaaatgaa

SEQ ID NO: 298167 - DNA, 16 bp, C. familiaris
aaccaaagtaaagaga

SEQ ID NO: 298168 - DNA, 16 bp, C. familiaris
aaccaaatgttcatca

SEQ ID NO: 298169 - DNA, 16 bp, C. familiaris
aaccaaattatggaaa

SEQ ID NO: 298170 - DNA, 16 bp, C. familiaris
aaccaacagagccatc

SEQ ID NO: 298171 - DNA, 16 bp, C. familiaris
aaccaagaaacagaat

SEQ ID NO: 298172 - DNA, 16 bp, C. familiaris
aaccaagaaattaaag

SEQ ID NO: 298173 - DNA, 16 bp, C. familiaris
aaccaagaattttata

SEQ ID NO: 298174 - DNA, 16 bp, C. familiaris
aaccaaggaggtaaag

SEQ ID NO: 298175 - DNA, 16 bp, C. familiaris
aaccaaggctcagaga

SEQ ID NO: 298176 - DNA, 16 bp, C. familiaris
aaccaatatttgacaa

SEQ ID NO: 298177 - DNA, 16 bp, C. familiaris
aaccaatggaacagaa

SEQ ID NO: 298178 - DNA, 16 bp, C. familiaris
aaccaatttaaaaatg

SEQ ID NO: 298179 - DNA, 16 bp, C. familiaris
aaccacagtgagatgt

SEQ ID NO: 298180 - DNA, 16 bp, C. familiaris
aaccacccagatgccc

SEQ ID NO: 298181 - DNA, 16 bp, C. familiaris
aaccacctcctggttt

SEQ ID NO: 298182 - DNA, 16 bp, C. familiaris
aaccacctgaaccacc

SEQ ID NO: 298183 - DNA, 16 bp, C. familiaris
aaccacctgggctgcc

SEQ ID NO: 298184 - DNA, 16 bp, C. familiaris
aaccactttgaaaaac

SEQ ID NO: 298185 - DNA, 16 bp, C. familiaris
aaccagaatttaaaac

SEQ ID NO: 298186 - DNA, 16 bp, C. familiaris
aaccagacacaggagg

SEQ ID NO: 298187 - DNA, 16 bp, C. familiaris
aaccagaggggctgaa

SEQ ID NO: 298188 - DNA, 16 bp, C. familiaris
aaccagagtgtattat

SEQ ID NO: 298189 - DNA, 16 bp, C. familiaris
aaccagatttttaaaa

SEQ ID NO: 298190 - DNA, 16 bp, C. familiaris
aaccagccaagtgccc

SEQ ID NO: 298191 - DNA, 16 bp, C. familiaris
aaccagccaggtgccc

SEQ ID NO: 298192 - DNA, 16 bp, C. familiaris
aaccagctcctgcttt

SEQ ID NO: 298193 - DNA, 16 bp, C. familiaris
aaccagctctgcagga

SEQ ID NO: 298194 - DNA, 16 bp, C. familiaris
aaccagctcttcaaga

SEQ ID NO: 298195 - DNA, 16 bp, C. familiaris
aaccagctgaaccacc

SEQ ID NO: 298196 - DNA, 16 bp, C. familiaris
aaccaggaaagaaatt

SEQ ID NO: 298197 - DNA, 30 bp, C. familiaris
aaccaggagttggttctttgaaagaattaa

SEQ ID NO: 298198 - DNA, 16 bp, C. familiaris
aaccaggcagagggag

SEQ ID NO: 298199 - DNA, 16 bp, C. familiaris
aaccaggctccctgtg

SEQ ID NO: 298200 - DNA, 16 bp, C. familiaris
aaccagttcttttttt

SEQ ID NO: 298201 - DNA, 16 bp, C. familiaris
aaccatcaggaaaatg

SEQ ID NO: 298202 - DNA, 17 bp, C. familiaris
aaccatcctgaacacct

SEQ ID NO: 298203 - DNA, 16 bp, C. familiaris
aaccatgaaaagacat

SEQ ID NO: 298204 - DNA, 16 bp, C. familiaris
aaccatgaacaaaaca

SEQ ID NO: 298205 - DNA, 16 bp, C. familiaris
aaccatggagacagta

SEQ ID NO: 298206 - DNA, 16 bp, C. familiaris
aaccatttaaaaatgc

SEQ ID NO: 298207 - DNA, 16 bp, C. familiaris
aacccaacaagaagat

SEQ ID NO: 298208 - DNA, 16 bp, C. familiaris
aacccagaaatggacc

SEQ ID NO: 298209 - DNA, 16 bp, C. familiaris
aacccagaaatgggcc

SEQ ID NO: 298210 - DNA, 16 bp, C. familiaris
aaccccaagaccaaga

SEQ ID NO: 298211 - DNA, 16 bp, C. familiaris
aacccccagcacctca

SEQ ID NO: 298212 - DNA, 16 bp, C. familiaris
aacccctaagccaccc

SEQ ID NO: 298213 - DNA, 16 bp, C. familiaris
aacccctgggccactg

SEQ ID NO: 298214 - DNA, 16 bp, C. familiaris
aaccctcagtttgtct

SEQ ID NO: 298215 - DNA, 16 bp, C. familiaris
aaccctgctttctttt

SEQ ID NO: 298216 - DNA, 16 bp, C. familiaris
aaccctggctctgcca

SEQ ID NO: 298217 - DNA, 16 bp, C. familiaris
aaccgcctgagccacc

SEQ ID NO: 298218 - DNA, 17 bp, C. familiaris
aaccgcgcaggcccctc

SEQ ID NO: 298219 - DNA, 16 bp, C. familiaris
aaccgctgagccaccc

SEQ ID NO: 298220 - DNA, 16 bp, C. familiaris
aaccgctgcgccatca

SEQ ID NO: 298221 - DNA, 16 bp, C. familiaris
aacctaaaggaactgg

SEQ ID NO: 298222 - DNA, 16 bp, C. familiaris
aacctaatcaaagagg

SEQ ID NO: 298223 - DNA, 16 bp, C. familiaris
aacctacaaccccaag

SEQ ID NO: 298224 - DNA, 16 bp, C. familiaris
aacctacatactgttt

SEQ ID NO: 298225 - DNA, 16 bp, C. familiaris
aacctcaaaaacattt

SEQ ID NO: 298226 - DNA, 16 bp, C. familiaris
aacctccaaattcatt

SEQ ID NO: 298227 - DNA, 16 bp, C. familiaris
aacctccagcccctct

SEQ ID NO: 298228 - DNA, 16 bp, C. familiaris
aacctccctgagcctt

SEQ ID NO: 298229 - DNA, 16 bp, C. familiaris
aacctctctgaacttt

SEQ ID NO: 298230 - DNA, 16 bp, C. familiaris
aacctctgcgccacca

SEQ ID NO: 298231 - DNA, 16 bp, C. familiaris
aacctctgggatgcag

SEQ ID NO: 298232 - DNA, 17 bp, C. familiaris
aacctctgggccaccgg

SEQ ID NO: 298233 - DNA, 16 bp, C. familiaris
aacctgaaactttaaa

SEQ ID NO: 298234 - DNA, 16 bp, C. familiaris
aacctgaacaggacaa

SEQ ID NO: 298235 - DNA, 16 bp, C. familiaris
aacctgaactgaaatc

SEQ ID NO: 298236 - DNA, 16 bp, C. familiaris
aacctgaggaagaaaa

SEQ ID NO: 298237 - DNA, 16 bp, C. familiaris
aacctggggcttgaac

SEQ ID NO: 298238 - DNA, 16 bp, C. familiaris
aaccttccaagactga

SEQ ID NO: 298239 - DNA, 16 bp, C. familiaris
aacctttccttttctg

SEQ ID NO: 298240 - DNA, 16 bp, C. familiaris
aacctttttatcttga

SEQ ID NO: 298241 - DNA, 16 bp, C. familiaris
aacctttttttcccca

SEQ ID NO: 298242 - DNA, 16 bp, C. familiaris
aacggaaggcagatgc

SEQ ID NO: 298243 - DNA, 16 bp, C. familiaris
aactaaaaagcttttt

SEQ ID NO: 298244 - DNA, 16 bp, C. familiaris
aactaaatgaaataga

SEQ ID NO: 298245 - DNA, 16 bp, C. familiaris
aactaaatgaaattaa

SEQ ID NO: 298246 - DNA, 16 bp, C. familiaris
aactaagtggaattta

SEQ ID NO: 298247 - DNA, 16 bp, C. familiaris
aactaatgaaaatgaa

SEQ ID NO: 298248 - DNA, 16 bp, C. familiaris
aactaattacatctgc

SEQ ID NO: 298249 - DNA, 16 bp, C. familiaris
aactaccacatgatcc

SEQ ID NO: 298250 - DNA, 16 bp, C. familiaris
aactactatatgatct

SEQ ID NO: 298251 - DNA, 16 bp, C. familiaris
aactactggaactaca

SEQ ID NO: 298252 - DNA, 16 bp, C. familiaris
aactagaacaggaaga

SEQ ID NO: 298253 - DNA, 16 bp, C. familiaris
aactatactgggatta

SEQ ID NO: 298254 - DNA, 16 bp, C. familiaris
aactataggaagcaaa

SEQ ID NO: 298255 - DNA, 16 bp, C. familiaris
aactatcatatgatct

SEQ ID NO: 298256 - DNA, 16 bp, C. familiaris
aactattggtacttca

SEQ ID NO: 298257 - DNA, 16 bp, C. familiaris
aactcaaaatatatca

SEQ ID NO: 298258 - DNA, 16 bp, C. familiaris
aactcaaaggagaaat

SEQ ID NO: 298259 - DNA, 16 bp, C. familiaris
aactcaaatataaaag

SEQ ID NO: 298260 - DNA, 16 bp, C. familiaris
aactcaacaataaaga

SEQ ID NO: 298261 - DNA, 18 bp, C. familiaris
aactcaatgaaattgaga

SEQ ID NO: 298262 - DNA, 16 bp, C. familiaris
aactcagagaagttaa

SEQ ID NO: 298263 - DNA, 16 bp, C. familiaris
aactcaggcacagaga

SEQ ID NO: 298264 - DNA, 16 bp, C. familiaris
aactcagtattttaaa

SEQ ID NO: 298265 - DNA, 16 bp, C. familiaris
aactcagtcagagaaa

SEQ ID NO: 298266 - DNA, 17 bp, C. familiaris
aactcatacagcaattg

SEQ ID NO: 298267 - DNA, 16 bp, C. familiaris
aactcatcaaactcaa

SEQ ID NO: 298268 - DNA, 16 bp, C. familiaris
aactcatgacactgag

SEQ ID NO: 298269 - DNA, 16 bp, C. familiaris
aactccaagaagaaaa

SEQ ID NO: 298270 - DNA, 16 bp, C. familiaris
aactccacatatgagt

SEQ ID NO: 298271 - DNA, 16 bp, C. familiaris
aactccagttaaaaaa

SEQ ID NO: 298272 - DNA, 16 bp, C. familiaris
aactccatgagggcag

SEQ ID NO: 298273 - DNA, 16 bp, C. familiaris
aactcctactatgtgc

SEQ ID NO: 298274 - DNA, 16 bp, C. familiaris
aactccttgaagaaaa

SEQ ID NO: 298275 - DNA, 16 bp, C. familiaris
aactctcagaaaaata

SEQ ID NO: 298276 - DNA, 16 bp, C. familiaris
aactctcagaagtaag

SEQ ID NO: 298277 - DNA, 16 bp, C. familiaris
aactctctgaagaaag

SEQ ID NO: 298278 - DNA, 16 bp, C. familiaris
aactctgccattatag

SEQ ID NO: 298279 - DNA, 16 bp, C. familiaris
aactctggaaaataaa

SEQ ID NO: 298280 - DNA, 16 bp, C. familiaris
aactctggaaatgaac

SEQ ID NO: 298281 - DNA, 16 bp, C. familiaris
aactctgtgctgagca

SEQ ID NO: 298282 - DNA, 16 bp, C. familiaris
aactctgtgttcaccc

SEQ ID NO: 298283 - DNA, 16 bp, C. familiaris
aactcttaaaaatttt

SEQ ID NO: 298284 - DNA, 16 bp, C. familiaris
aactcttcaaactcaa

SEQ ID NO: 298285 - DNA, 16 bp, C. familiaris
aactcttccagaaaac

SEQ ID NO: 298286 - DNA, 16 bp, C. familiaris
aactcttctgaagaaa

SEQ ID NO: 298287 - DNA, 16 bp, C. familiaris
aactcttggaaatgaa

SEQ ID NO: 298288 - DNA, 16 bp, C. familiaris
aactgaaaaaaatatt

SEQ ID NO: 298289 - DNA, 16 bp, C. familiaris
aactgaaaagagaaat

SEQ ID NO: 298290 - DNA, 16 bp, C. familiaris
aactgaaaataatttt

SEQ ID NO: 298291 - DNA, 16 bp, C. familiaris
aactgaaaatgacaca

SEQ ID NO: 298292 - DNA, 16 bp, C. familiaris
aactgaaaatttgtac

SEQ ID NO: 298293 - DNA, 16 bp, C. familiaris
aactgaaacaggaaga

SEQ ID NO: 298294 - DNA, 16 bp, C. familiaris
aactgaaatcatacag

SEQ ID NO: 298295 - DNA, 16 bp, C. familiaris
aactgaacaaaaacca

SEQ ID NO: 298296 - DNA, 16 bp, C. familiaris
aactgaacccacaata

SEQ ID NO: 298297 - DNA, 16 bp, C. familiaris
aactgaagaaaatatt

SEQ ID NO: 298298 - DNA, 16 bp, C. familiaris
aactgaagaaagagaa

SEQ ID NO: 298299 - DNA, 16 bp, C. familiaris
aactgaagacagatgc

SEQ ID NO: 298300 - DNA, 16 bp, C. familiaris
aactgaagaggacaca

SEQ ID NO: 298301 - DNA, 16 bp, C. familiaris
aactgaaggcagactc

SEQ ID NO: 298302 - DNA, 16 bp, C. familiaris
aactgaatggaaaaaa

SEQ ID NO: 298303 - DNA, 16 bp, C. familiaris
aactgactcttggttt

SEQ ID NO: 298304 - DNA, 16 bp, C. familiaris
aactgactgagctccc

SEQ ID NO: 298305 - DNA, 16 bp, C. familiaris
aactgacttttaaaaa

SEQ ID NO: 298306 - DNA, 16 bp, C. familiaris
aactgagccaccaaag

SEQ ID NO: 298307 - DNA, 16 bp, C. familiaris
aactgagccacccagg

SEQ ID NO: 298308 - DNA, 16 bp, C. familiaris
aactgaggcatagaga

SEQ ID NO: 298309 - DNA, 16 bp, C. familiaris
aactgaggccagggag

SEQ ID NO: 298310 - DNA, 16 bp, C. familiaris
aactgagtcacccagg

SEQ ID NO: 298311 - DNA, 16 bp, C. familiaris
aactgagtgacttaaa

SEQ ID NO: 298312 - DNA, 16 bp, C. familiaris
aactgagtgagaaaaa

SEQ ID NO: 298313 - DNA, 16 bp, C. familiaris
aactgatgagtggata

SEQ ID NO: 298314 - DNA, 16 bp, C. familiaris
aactgatggacatttg

SEQ ID NO: 298315 - DNA, 16 bp, C. familiaris
aactgcaaggaactga

SEQ ID NO: 298316 - DNA, 16 bp, C. familiaris
aactgcaccacccaga

SEQ ID NO: 298317 - DNA, 16 bp, C. familiaris
aactgcatatatttaa

SEQ ID NO: 298318 - DNA, 16 bp, C. familiaris
aactgcctgagccact

SEQ ID NO: 298319 - DNA, 16 bp, C. familiaris
aactgctgcgctaccc

SEQ ID NO: 298320 - DNA, 16 bp, C. familiaris
aactgctgggccactg

SEQ ID NO: 298321 - DNA, 16 bp, C. familiaris
aactggaaaaaggaaa

SEQ ID NO: 298322 - DNA, 16 bp, C. familiaris
aactggaaaagaagaa

SEQ ID NO: 298323 - DNA, 16 bp, C. familiaris
aactggaaagaaactc

SEQ ID NO: 298324 - DNA, 16 bp, C. familiaris
aactggaagatattat

SEQ ID NO: 298325 - DNA, 16 bp, C. familiaris
aactggaaggatggag

SEQ ID NO: 298326 - DNA, 16 bp, C. familiaris
aactggaagtatcaca

SEQ ID NO: 298327 - DNA, 16 bp, C. familiaris
aactggaattgaaata

SEQ ID NO: 298328 - DNA, 16 bp, C. familiaris
aactggacagtaacat

SEQ ID NO: 298329 - DNA, 16 bp, C. familiaris
aactggactttttttt

SEQ ID NO: 298330 - DNA, 16 bp, C. familiaris
aactggagaaagaaaa

SEQ ID NO: 298331 - DNA, 16 bp, C. familiaris
aactggatagctacat

SEQ ID NO: 298332 - DNA, 16 bp, C. familiaris
aactggatgatgggca

SEQ ID NO: 298333 - DNA, 16 bp, C. familiaris
aactggggatgcctgg

SEQ ID NO: 298334 - DNA, 16 bp, C. familiaris
aactggggcacagaga

SEQ ID NO: 298335 - DNA, 16 bp, C. familiaris
aactgggtgatgggca

SEQ ID NO: 298336 - DNA, 16 bp, C. familiaris
aactggtacagccact

SEQ ID NO: 298337 - DNA, 16 bp, C. familiaris
aactgtatggtatgtg

SEQ ID NO: 298338 - DNA, 16 bp, C. familiaris
aactgtgagaaagtaa

SEQ ID NO: 298339 - DNA, 16 bp, C. familiaris
aactgtgagaaataag

SEQ ID NO: 298340 - DNA, 16 bp, C. familiaris
aactgtgagatcaaga

SEQ ID NO: 298341 - DNA, 16 bp, C. familiaris
aactgtgaggaaataa

SEQ ID NO: 298342 - DNA, 16 bp, C. familiaris
aactgtggaagagatc

SEQ ID NO: 298343 - DNA, 16 bp, C. familiaris
aactgtggaaggaggc

SEQ ID NO: 298344 - DNA, 16 bp, C. familiaris
aactgtggctcagaga

SEQ ID NO: 298345 - DNA, 16 bp, C. familiaris
aacttaagcagactct

SEQ ID NO: 298346 - DNA, 16 bp, C. familiaris
aacttatagaagaaaa

SEQ ID NO: 298347 - DNA, 16 bp, C. familiaris
aacttatttggaaaaa

SEQ ID NO: 298348 - DNA, 16 bp, C. familiaris
aacttatttttgtata

SEQ ID NO: 298349 - DNA, 16 bp, C. familiaris
aacttcacagaggaag

SEQ ID NO: 298350 - DNA, 16 bp, C. familiaris
aacttccaaaagaaaa

SEQ ID NO: 298351 - DNA, 16 bp, C. familiaris
aacttccagaaggaaa

SEQ ID NO: 298352 - DNA, 16 bp, C. familiaris
aacttccagttttaaa

SEQ ID NO: 298353 - DNA, 16 bp, C. familiaris
aacttcctcaacatga

SEQ ID NO: 298354 - DNA, 16 bp, C. familiaris
aacttctagaaatgaa

SEQ ID NO: 298355 - DNA, 16 bp, C. familiaris
aacttctatggggaga

SEQ ID NO: 298356 - DNA, 16 bp, C. familiaris
aacttctctgagcctt

SEQ ID NO: 298357 - DNA, 16 bp, C. familiaris
aacttctgctctgtga

SEQ ID NO: 298358 - DNA, 16 bp, C. familiaris
aacttcttgaggaatc

SEQ ID NO: 298359 - DNA, 20 bp, C. familiaris
aacttcttgcaagatacatc

SEQ ID NO: 298360 - DNA, 16 bp, C. familiaris
aacttctttctaaata

SEQ ID NO: 298361 - DNA, 16 bp, C. familiaris
aacttgaaagaaaaat

SEQ ID NO: 298362 - DNA, 16 bp, C. familiaris
aacttgctcttctcct

SEQ ID NO: 298363 - DNA, 16 bp, C. familiaris
aacttggaaaaagaaa

SEQ ID NO: 298364 - DNA, 16 bp, C. familiaris
aacttggcttcttaca

SEQ ID NO: 298365 - DNA, 16 bp, C. familiaris
aacttgtatacaaatg

SEQ ID NO: 298366 - DNA, 17 bp, C. familiaris
aacttgtccgtccagct

SEQ ID NO: 298367 - DNA, 16 bp, C. familiaris
aacttgttacagcagc

SEQ ID NO: 298368 - DNA, 16 bp, C. familiaris
aactttaaaaagcaaa

SEQ ID NO: 298369 - DNA, 16 bp, C. familiaris
aactttaaattttcta

SEQ ID NO: 298370 - DNA, 16 bp, C. familiaris
aactttatgaaaaaaa

SEQ ID NO: 298371 - DNA, 16 bp, C. familiaris
aactttattgaaatat

SEQ ID NO: 298372 - DNA, 16 bp, C. familiaris
aactttcccaagatca

SEQ ID NO: 298373 - DNA, 16 bp, C. familiaris
aactttcctatatatc

SEQ ID NO: 298374 - DNA, 16 bp, C. familiaris
aactttctgagatgat

SEQ ID NO: 298375 - DNA, 16 bp, C. familiaris
aactttgaaaatatta

SEQ ID NO: 298376 - DNA, 16 bp, C. familiaris
aactttgtaccctttg

SEQ ID NO: 298377 - DNA, 16 bp, C. familiaris
aactttgttcttattt

SEQ ID NO: 298378 - DNA, 16 bp, C. familiaris
aacttttaaaggaaaa

SEQ ID NO: 298379 - DNA, 16 bp, C. familiaris
aacttttagaagaaaa

SEQ ID NO: 298380 - DNA, 16 bp, C. familiaris
aacttttctgtatttt

SEQ ID NO: 298381 - DNA, 16 bp, C. familiaris
aacttttgaaaagcag

SEQ ID NO: 298382 - DNA, 16 bp, C. familiaris
aacttttgaaaataat

SEQ ID NO: 298383 - DNA, 16 bp, C. familiaris
aacttttgactcctca

SEQ ID NO: 298384 - DNA, 16 bp, C. familiaris
aactttttaaggaaac

SEQ ID NO: 298385 - DNA, 16 bp, C. familiaris
aactttttaaggaacc

SEQ ID NO: 298386 - DNA, 16 bp, C. familiaris
aactttttaaggaact

SEQ ID NO: 298387 - DNA, 16 bp, C. familiaris
aactttttcttaaaag

SEQ ID NO: 298388 - DNA, 16 bp, C. familiaris
aactttttgaaaaact

SEQ ID NO: 298389 - DNA, 16 bp, C. familiaris
aagaaaaaaaaccctg

SEQ ID NO: 298390 - DNA, 16 bp, C. familiaris
aagaaaaaaaatctgg

SEQ ID NO: 298391 - DNA, 16 bp, C. familiaris
aagaaaaaaaatctgt

SEQ ID NO: 298392 - DNA, 16 bp, C. familiaris
aagaaaaaaacccttt

SEQ ID NO: 298393 - DNA, 16 bp, C. familiaris
aagaaaaaaaggcatt

SEQ ID NO: 298394 - DNA, 16 bp, C. familiaris
aagaaaaaagaattct

SEQ ID NO: 298395 - DNA, 16 bp, C. familiaris
aagaaaaaagatgttt

SEQ ID NO: 298396 - DNA, 16 bp, C. familiaris
aagaaaaaaggatttt

SEQ ID NO: 298397 - DNA, 16 bp, C. familiaris
aagaaaaaagtgattt

SEQ ID NO: 298398 - DNA, 16 bp, C. familiaris
aagaaaaaagtgttgg

SEQ ID NO: 298399 - DNA, 16 bp, C. familiaris
aagaaaaaatacatct

SEQ ID NO: 298400 - DNA, 16 bp, C. familiaris
aagaaaaaatctggga

SEQ ID NO: 298401 - DNA, 16 bp, C. familiaris
aagaaaaaatgtttct

SEQ ID NO: 298402 - DNA, 16 bp, C. familiaris
aagaaaaacaaatctg

SEQ ID NO: 298403 - DNA, 16 bp, C. familiaris
aagaaaaacaattcca

SEQ ID NO: 298404 - DNA, 16 bp, C. familiaris
aagaaaaacatgattt

SEQ ID NO: 298405 - DNA, 16 bp, C. familiaris
aagaaaaactggaaga

SEQ ID NO: 298406 - DNA, 16 bp, C. familiaris
aagaaaaactttgaaa

SEQ ID NO: 298407 - DNA, 16 bp, C. familiaris
aagaaaaagaaactgc

SEQ ID NO: 298408 - DNA, 16 bp, C. familiaris
aagaaaaagaaatgct

SEQ ID NO: 298409 - DNA, 16 bp, C. familiaris
aagaaaaagaatttct

SEQ ID NO: 298410 - DNA, 16 bp, C. familiaris
aagaaaaaggaaactt

SEQ ID NO: 298411 - DNA, 16 bp, C. familiaris
aagaaaaaggaactct

SEQ ID NO: 298412 - DNA, 16 bp, C. familiaris
aagaaaaaggactcaa

SEQ ID NO: 298413 - DNA, 16 bp, C. familiaris
aagaaaaataagtcag

SEQ ID NO: 298414 - DNA, 16 bp, C. familiaris
aagaaaaataatcttt

SEQ ID NO: 298415 - DNA, 16 bp, C. familiaris
aagaaaaataccacat

SEQ ID NO: 298416 - DNA, 16 bp, C. familiaris
aagaaaaatcaaattt

SEQ ID NO: 298417 - DNA, 16 bp, C. familiaris
aagaaaaatcctgaaa

SEQ ID NO: 298418 - DNA, 16 bp, C. familiaris
aagaaaaatgaaactg

SEQ ID NO: 298419 - DNA, 16 bp, C. familiaris
aagaaaaattttggaa

SEQ ID NO: 298420 - DNA, 16 bp, C. familiaris
aagaaaacaaaggctt

SEQ ID NO: 298421 - DNA, 16 bp, C. familiaris
aagaaaacaattatat

SEQ ID NO: 298422 - DNA, 16 bp, C. familiaris
aagaaaacactttttt

SEQ ID NO: 298423 - DNA, 16 bp, C. familiaris
aagaaaacataattat

SEQ ID NO: 298424 - DNA, 16 bp, C. familiaris
aagaaaacatatttga

SEQ ID NO: 298425 - DNA, 16 bp, C. familiaris
aagaaaacatttcaaa

SEQ ID NO: 298426 - DNA, 16 bp, C. familiaris
aagaaaacatttgaaa

SEQ ID NO: 298427 - DNA, 16 bp, C. familiaris
aagaaaacattttatt

SEQ ID NO: 298428 - DNA, 16 bp, C. familiaris
aagaaaacattttcca

SEQ ID NO: 298429 - DNA, 16 bp, C. familiaris
aagaaaacattttttt

SEQ ID NO: 298430 - DNA, 16 bp, C. familiaris
aagaaaaccacaggct

SEQ ID NO: 298431 - DNA, 16 bp, C. familiaris
aagaaaaccagagcca

SEQ ID NO: 298432 - DNA, 16 bp, C. familiaris
aagaaaaccagagcct

SEQ ID NO: 298433 - DNA, 16 bp, C. familiaris
aagaaaacccttaaaa

SEQ ID NO: 298434 - DNA, 16 bp, C. familiaris
aagaaaactattttta

SEQ ID NO: 298435 - DNA, 16 bp, C. familiaris
aagaaaactggaaaat

SEQ ID NO: 298436 - DNA, 16 bp, C. familiaris
aagaaaactggagaaa

SEQ ID NO: 298437 - DNA, 16 bp, C. familiaris
aagaaaagaaaacttt

SEQ ID NO: 298438 - DNA, 16 bp, C. familiaris
aagaaaagaaaatctg

SEQ ID NO: 298439 - DNA, 16 bp, C. familiaris
aagaaaagaaaatggc

SEQ ID NO: 298440 - DNA, 16 bp, C. familiaris
aagaaaagaaacattt

SEQ ID NO: 298441 - DNA, 16 bp, C. familiaris
aagaaaagaaactctt

SEQ ID NO: 298442 - DNA, 16 bp, C. familiaris
aagaaaagaaagctta

SEQ ID NO: 298443 - DNA, 16 bp, C. familiaris
aagaaaagaaagcttt

SEQ ID NO: 298444 - DNA, 16 bp, C. familiaris
aagaaaagaattgctg

SEQ ID NO: 298445 - DNA, 16 bp, C. familiaris
aagaaaagagaacatt

SEQ ID NO: 298446 - DNA, 16 bp, C. familiaris
aagaaaagagggatcc

SEQ ID NO: 298447 - DNA, 16 bp, C. familiaris
aagaaaagcaaagctg

SEQ ID NO: 298448 - DNA, 16 bp, C. familiaris
aagaaaaggaatattt

SEQ ID NO: 298449 - DNA, 16 bp, C. familiaris
aagaaaataaaactgt

SEQ ID NO: 298450 - DNA, 16 bp, C. familiaris
aagaaaataagcaatt

SEQ ID NO: 298451 - DNA, 16 bp, C. familiaris
aagaaaatacaggaga

SEQ ID NO: 298452 - DNA, 16 bp, C. familiaris
aagaaaatacatattt

SEQ ID NO: 298453 - DNA, 16 bp, C. familiaris
aagaaaataccatttt

SEQ ID NO: 298454 - DNA, 16 bp, C. familiaris
aagaaaatatccagat

SEQ ID NO: 298455 - DNA, 16 bp, C. familiaris
aagaaaatatctggaa

SEQ ID NO: 298456 - DNA, 16 bp, C. familiaris
aagaaaatatgcaaat

SEQ ID NO: 298457 - DNA, 16 bp, C. familiaris
aagaaaatattgcaaa

SEQ ID NO: 298458 - DNA, 16 bp, C. familiaris
aagaaaatatttcaga

SEQ ID NO: 298459 - DNA, 16 bp, C. familiaris
aagaaaatcaaagctg

SEQ ID NO: 298460 - DNA, 16 bp, C. familiaris
aagaaaatcctaagga

SEQ ID NO: 298461 - DNA, 16 bp, C. familiaris
aagaaaatcctgaaag

SEQ ID NO: 298462 - DNA, 16 bp, C. familiaris
aagaaaatctgtattt

SEQ ID NO: 298463 - DNA, 16 bp, C. familiaris
aagaaaatgaaatcag

SEQ ID NO: 298464 - DNA, 16 bp, C. familiaris
aagaaaatgaagcaag

SEQ ID NO: 298465 - DNA, 16 bp, C. familiaris
aagaaaatgatatttt

SEQ ID NO: 298466 - DNA, 16 bp, C. familiaris
aagaaaatgctagaaa

SEQ ID NO: 298467 - DNA, 16 bp, C. familiaris
aagaaaatggacaaat

SEQ ID NO: 298468 - DNA, 16 bp, C. familiaris
aagaaaatggattttc

SEQ ID NO: 298469 - DNA, 16 bp, C. familiaris
aagaaaatgtgataca

SEQ ID NO: 298470 - DNA, 16 bp, C. familiaris
aagaaaatgttatcaa

SEQ ID NO: 298471 - DNA, 16 bp, C. familiaris
aagaaaatgtttattt

SEQ ID NO: 298472 - DNA, 16 bp, C. familiaris
aagaaaatgtttgaaa

SEQ ID NO: 298473 - DNA, 16 bp, C. familiaris
aagaaaatgtttgcaa

SEQ ID NO: 298474 - DNA, 16 bp, C. familiaris
aagaaaattaaagcca

SEQ ID NO: 298475 - DNA, 16 bp, C. familiaris
aagaaaattattcatc

SEQ ID NO: 298476 - DNA, 16 bp, C. familiaris
aagaaaattcaggaaa

SEQ ID NO: 298477 - DNA, 16 bp, C. familiaris
aagaaacaaaaactct

SEQ ID NO: 298478 - DNA, 16 bp, C. familiaris
aagaaacaaaggcttt

SEQ ID NO: 298479 - DNA, 16 bp, C. familiaris
aagaaacaaatgaatg

SEQ ID NO: 298480 - DNA, 16 bp, C. familiaris
aagaaacaagaaatgt

SEQ ID NO: 298481 - DNA, 16 bp, C. familiaris
aagaaacagaaatcca

SEQ ID NO: 298482 - DNA, 16 bp, C. familiaris
aagaaacagcaaatgt

SEQ ID NO: 298483 - DNA, 16 bp, C. familiaris
aagaaacaggaaaatg

SEQ ID NO: 298484 - DNA, 16 bp, C. familiaris
aagaaacattttaaaa

SEQ ID NO: 298485 - DNA, 16 bp, C. familiaris
aagaaaccaaccctgc

SEQ ID NO: 298486 - DNA, 16 bp, C. familiaris
aagaaaccatatctat

SEQ ID NO: 298487 - DNA, 16 bp, C. familiaris
aagaaaccatgcctat

SEQ ID NO: 298488 - DNA, 16 bp, C. familiaris
aagaaaccctcatgca

SEQ ID NO: 298489 - DNA, 16 bp, C. familiaris
aagaaaccttgaaaaa

SEQ ID NO: 298490 - DNA, 16 bp, C. familiaris
aagaaactgaaaccca

SEQ ID NO: 298491 - DNA, 16 bp, C. familiaris
aagaaactgaagaaat

SEQ ID NO: 298492 - DNA, 16 bp, C. familiaris
aagaaactgaagaaga

SEQ ID NO: 298493 - DNA, 16 bp, C. familiaris
aagaaactgaagacaa

SEQ ID NO: 298494 - DNA, 16 bp, C. familiaris
aagaaactgaagccca

SEQ ID NO: 298495 - DNA, 16 bp, C. familiaris
aagaaactgaatttta

SEQ ID NO: 298496 - DNA, 16 bp, C. familiaris
aagaaactgaggaaga

SEQ ID NO: 298497 - DNA, 16 bp, C. familiaris
aagaaactggaaaaag

SEQ ID NO: 298498 - DNA, 16 bp, C. familiaris
aagaaactttgaaaaa

SEQ ID NO: 298499 - DNA, 16 bp, C. familiaris
aagaaagaaaaatctt

SEQ ID NO: 298500 - DNA, 16 bp, C. familiaris
aagaaagaaaacagct

SEQ ID NO: 298501 - DNA, 16 bp, C. familiaris
aagaaagaaaacaggt

SEQ ID NO: 298502 - DNA, 16 bp, C. familiaris
aagaaagaaaacatgg

SEQ ID NO: 298503 - DNA, 16 bp, C. familiaris
aagaaagaaaaccttt

SEQ ID NO: 298504 - DNA, 16 bp, C. familiaris
aagaaagaaaactctg

SEQ ID NO: 298505 - DNA, 16 bp, C. familiaris
aagaaagaaaacttta

SEQ ID NO: 298506 - DNA, 16 bp, C. familiaris
aagaaagaaaatctct

SEQ ID NO: 298507 - DNA, 16 bp, C. familiaris
aagaaagaaaatgttt

SEQ ID NO: 298508 - DNA, 16 bp, C. familiaris
aagaaagaaaattcat

SEQ ID NO: 298509 - DNA, 16 bp, C. familiaris
aagaaagaaactgaat

SEQ ID NO: 298510 - DNA, 16 bp, C. familiaris
aagaaagaaagaagct

SEQ ID NO: 298511 - DNA, 16 bp, C. familiaris
aagaaagaaagacttt

SEQ ID NO: 298512 - DNA, 16 bp, C. familiaris
aagaaagaaagattca

SEQ ID NO: 298513 - DNA, 16 bp, C. familiaris
aagaaagaaagcacat

SEQ ID NO: 298514 - DNA, 16 bp, C. familiaris
aagaaagaaagtttta

SEQ ID NO: 298515 - DNA, 16 bp, C. familiaris
aagaaagaaatctttt

SEQ ID NO: 298516 - DNA, 16 bp, C. familiaris
aagaaagaaattatac

SEQ ID NO: 298517 - DNA, 16 bp, C. familiaris
aagaaagaaattcaga

SEQ ID NO: 298518 - DNA, 16 bp, C. familiaris
aagaaagaactggaag

SEQ ID NO: 298519 - DNA, 16 bp, C. familiaris
aagaaagaatttttga

SEQ ID NO: 298520 - DNA, 16 bp, C. familiaris
aagaaagaatttttta

SEQ ID NO: 298521 - DNA, 16 bp, C. familiaris
aagaaagagcacaagc

SEQ ID NO: 298522 - DNA, 16 bp, C. familiaris
aagaaagatagtctct

SEQ ID NO: 298523 - DNA, 16 bp, C. familiaris
aagaaagattcagaaa

SEQ ID NO: 298524 - DNA, 16 bp, C. familiaris
aagaaagatttcaaat

SEQ ID NO: 298525 - DNA, 16 bp, C. familiaris
aagaaagcataaagga

SEQ ID NO: 298526 - DNA, 16 bp, C. familiaris
aagaaagccctgactt

SEQ ID NO: 298527 - DNA, 16 bp, C. familiaris
aagaaagctgaagaaa

SEQ ID NO: 298528 - DNA, 16 bp, C. familiaris
aagaaagctgaggaaa

SEQ ID NO: 298529 - DNA, 16 bp, C. familiaris
aagaaagctttaaaat

SEQ ID NO: 298530 - DNA, 16 bp, C. familiaris
aagaaaggatattttt

SEQ ID NO: 298531 - DNA, 16 bp, C. familiaris
aagaaagtatttttaa

SEQ ID NO: 298532 - DNA, 16 bp, C. familiaris
aagaaagtccatggaa

SEQ ID NO: 298533 - DNA, 16 bp, C. familiaris
aagaaagtgacatgat

SEQ ID NO: 298534 - DNA, 16 bp, C. familiaris
aagaaagttttattgg

SEQ ID NO: 298535 - DNA, 16 bp, C. familiaris
aagaaataaaagtcat

SEQ ID NO: 298536 - DNA, 16 bp, C. familiaris
aagaaataaaatactt

SEQ ID NO: 298537 - DNA, 16 bp, C. familiaris
aagaaataaaatgtgt

SEQ ID NO: 298538 - DNA, 16 bp, C. familiaris
aagaaataaatgagca

SEQ ID NO: 298539 - DNA, 16 bp, C. familiaris
aagaaataatacagag

SEQ ID NO: 298540 - DNA, 16 bp, C. familiaris
aagaaataatgcagag

SEQ ID NO: 298541 - DNA, 16 bp, C. familiaris
aagaaatacaaggcat

SEQ ID NO: 298542 - DNA, 16 bp, C. familiaris
aagaaatacatatttc

SEQ ID NO: 298543 - DNA, 16 bp, C. familiaris
aagaaatacatggaaa

SEQ ID NO: 298544 - DNA, 16 bp, C. familiaris
aagaaatactgaaaga

SEQ ID NO: 298545 - DNA, 16 bp, C. familiaris
aagaaatagaaacttt

SEQ ID NO: 298546 - DNA, 16 bp, C. familiaris
aagaaatagaaatttc

SEQ ID NO: 298547 - DNA, 16 bp, C. familiaris
aagaaatagatgaatt

SEQ ID NO: 298548 - DNA, 16 bp, C. familiaris
aagaaatattattcag

SEQ ID NO: 298549 - DNA, 16 bp, C. familiaris
aagaaatatttcaaaa

SEQ ID NO: 298550 - DNA, 16 bp, C. familiaris
aagaaatatttcaaat

SEQ ID NO: 298551 - DNA, 16 bp, C. familiaris
aagaaatatttcttga

SEQ ID NO: 298552 - DNA, 16 bp, C. familiaris
aagaaatatttgctga

SEQ ID NO: 298553 - DNA, 16 bp, C. familiaris
aagaaatcaaagatat

SEQ ID NO: 298554 - DNA, 16 bp, C. familiaris
aagaaatcaaaggaga

SEQ ID NO: 298555 - DNA, 16 bp, C. familiaris
aagaaatcaagaaatt

SEQ ID NO: 298556 - DNA, 16 bp, C. familiaris
aagaaatcatttttaa

SEQ ID NO: 298557 - DNA, 16 bp, C. familiaris
aagaaatctgaagagg

SEQ ID NO: 298558 - DNA, 16 bp, C. familiaris
aagaaatcttggaaaa

SEQ ID NO: 298559 - DNA, 16 bp, C. familiaris
aagaaatgaaattctg

SEQ ID NO: 298560 - DNA, 16 bp, C. familiaris
aagaaatgagcaaaag

SEQ ID NO: 298561 - DNA, 16 bp, C. familiaris
aagaaatgctaaagga

SEQ ID NO: 298562 - DNA, 16 bp, C. familiaris
aagaaatggaaaatct

SEQ ID NO: 298563 - DNA, 16 bp, C. familiaris
aagaaatggaaagatt

SEQ ID NO: 298564 - DNA, 16 bp, C. familiaris
aagaaatggaaatttt

SEQ ID NO: 298565 - DNA, 16 bp, C. familiaris
aagaaatggccagaag

SEQ ID NO: 298566 - DNA, 16 bp, C. familiaris
aagaaatgggaagaca

SEQ ID NO: 298567 - DNA, 16 bp, C. familiaris
aagaaatgtgggaaat

SEQ ID NO: 298568 - DNA, 16 bp, C. familiaris
aagaaattacagaaga

SEQ ID NO: 298569 - DNA, 16 bp, C. familiaris
aagaaattactttaaa

SEQ ID NO: 298570 - DNA, 16 bp, C. familiaris
aagaaattatacaact

SEQ ID NO: 298571 - DNA, 16 bp, C. familiaris
aagaaattatttcaaa

SEQ ID NO: 298572 - DNA, 16 bp, C. familiaris
aagaaattattttgaa

SEQ ID NO: 298573 - DNA, 16 bp, C. familiaris
aagaaattcaagatga

SEQ ID NO: 298574 - DNA, 16 bp, C. familiaris
aagaaattcacttcaa

SEQ ID NO: 298575 - DNA, 16 bp, C. familiaris
aagaaattcaggaaga

SEQ ID NO: 298576 - DNA, 16 bp, C. familiaris
aagaaattgaagaaca

SEQ ID NO: 298577 - DNA, 16 bp, C. familiaris
aagaaattgaagacaa

SEQ ID NO: 298578 - DNA, 16 bp, C. familiaris
aagaaattgaagacat

SEQ ID NO: 298579 - DNA, 16 bp, C. familiaris
aagaaattgaatttat

SEQ ID NO: 298580 - DNA, 16 bp, C. familiaris
aagaaattgaggaaca

SEQ ID NO: 298581 - DNA, 16 bp, C. familiaris
aagaaattgaggatga

SEQ ID NO: 298582 - DNA, 16 bp, C. familiaris
aagaaattgaggcaca

SEQ ID NO: 298583 - DNA, 16 bp, C. familiaris
aagaaattggcagaag

SEQ ID NO: 298584 - DNA, 16 bp, C. familiaris
aagaaattgtggaaga

SEQ ID NO: 298585 - DNA, 16 bp, C. familiaris
aagaaatttaaaaact

SEQ ID NO: 298586 - DNA, 16 bp, C. familiaris
aagaaatttaaaatca

SEQ ID NO: 298587 - DNA, 16 bp, C. familiaris
aagaaatttctttttc

SEQ ID NO: 298588 - DNA, 16 bp, C. familiaris
aagaaatttgaggaag

SEQ ID NO: 298589 - DNA, 16 bp, C. familiaris
aagaaatttggaagca

SEQ ID NO: 298590 - DNA, 16 bp, C. familiaris
aagaaattttaaggaa

SEQ ID NO: 298591 - DNA, 16 bp, C. familiaris
aagaaattttacattt

SEQ ID NO: 298592 - DNA, 16 bp, C. familiaris
aagaaattttggaaaa

SEQ ID NO: 298593 - DNA, 16 bp, C. familiaris
aagaacaaaactggag

SEQ ID NO: 298594 - DNA, 16 bp, C. familiaris
aagaacaaagctggag

SEQ ID NO: 298595 - DNA, 16 bp, C. familiaris
aagaacaaatattgtt

SEQ ID NO: 298596 - DNA, 16 bp, C. familiaris
aagaacaaatgaagcc

SEQ ID NO: 298597 - DNA, 16 bp, C. familiaris
aagaacaaggctggag

SEQ ID NO: 298598 - DNA, 16 bp, C. familiaris
aagaacagaaattaga

SEQ ID NO: 298599 - DNA, 16 bp, C. familiaris
aagaacaggggtgcct

SEQ ID NO: 298600 - DNA, 16 bp, C. familiaris
aagaacatggagaaaa

SEQ ID NO: 298601 - DNA, 16 bp, C. familiaris
aagaacattttggaaa

SEQ ID NO: 298602 - DNA, 16 bp, C. familiaris
aagaaccaaatggaaa

SEQ ID NO: 298603 - DNA, 16 bp, C. familiaris
aagaaccaactcctgg

SEQ ID NO: 298604 - DNA, 16 bp, C. familiaris
aagaaccgtatgatcc

SEQ ID NO: 298605 - DNA, 16 bp, C. familiaris
aagaactaaaggaaac

SEQ ID NO: 298606 - DNA, 16 bp, C. familiaris
aagaactaatacaact

SEQ ID NO: 298607 - DNA, 16 bp, C. familiaris
aagaactacaggccaa

SEQ ID NO: 298608 - DNA, 16 bp, C. familiaris
aagaactcttaaaagt

SEQ ID NO: 298609 - DNA, 16 bp, C. familiaris
aagaactctttaaaaa

SEQ ID NO: 298610 - DNA, 16 bp, C. familiaris
aagaactgaaaaatat

SEQ ID NO: 298611 - DNA, 16 bp, C. familiaris
aagaactgaaagcaaa

SEQ ID NO: 298612 - DNA, 16 bp, C. familiaris
aagaactgtttttttt

SEQ ID NO: 298613 - DNA, 16 bp, C. familiaris
aagaacttatgaaatt

SEQ ID NO: 298614 - DNA, 16 bp, C. familiaris
aagaactttctttttt

SEQ ID NO: 298615 - DNA, 16 bp, C. familiaris
aagaagaaaaactttc

SEQ ID NO: 298616 - DNA, 16 bp, C. familiaris
aagaagaaaatctcaa

SEQ ID NO: 298617 - DNA, 16 bp, C. familiaris
aagaagaaagaatttg

SEQ ID NO: 298618 - DNA, 16 bp, C. familiaris
aagaagaaagctgaaa

SEQ ID NO: 298619 - DNA, 16 bp, C. familiaris
aagaagaaatcaaact

SEQ ID NO: 298620 - DNA, 16 bp, C. familiaris
aagaagaaatcacagg

SEQ ID NO: 298621 - DNA, 16 bp, C. familiaris
aagaagaaatcagaga

SEQ ID NO: 298622 - DNA, 16 bp, C. familiaris
aagaagaaatgtgtgg

SEQ ID NO: 298623 - DNA, 16 bp, C. familiaris
aagaagaaattacaag

SEQ ID NO: 298624 - DNA, 16 bp, C. familiaris
aagaagaaatttttta

SEQ ID NO: 298625 - DNA, 16 bp, C. familiaris
aagaagaacaaaactg

SEQ ID NO: 298626 - DNA, 16 bp, C. familiaris
aagaagaacttaatca

SEQ ID NO: 298627 - DNA, 16 bp, C. familiaris
aagaagaagaaaatcc

SEQ ID NO: 298628 - DNA, 16 bp, C. familiaris
aagaagaagaaatttt

SEQ ID NO: 298629 - DNA, 16 bp, C. familiaris
aagaagaattaacacc

SEQ ID NO: 298630 - DNA, 16 bp, C. familiaris
aagaagaattaatacc

SEQ ID NO: 298631 - DNA, 16 bp, C. familiaris
aagaagacgtggttta

SEQ ID NO: 298632 - DNA, 16 bp, C. familiaris
aagaagactgaaataa

SEQ ID NO: 298633 - DNA, 16 bp, C. familiaris
aagaagagaatcttaa

SEQ ID NO: 298634 - DNA, 16 bp, C. familiaris
aagaagagaattttaa

SEQ ID NO: 298635 - DNA, 16 bp, C. familiaris
aagaagagacaccaga

SEQ ID NO: 298636 - DNA, 16 bp, C. familiaris
aagaagagataccaga

SEQ ID NO: 298637 - DNA, 16 bp, C. familiaris
aagaagagatttggaa

SEQ ID NO: 298638 - DNA, 16 bp, C. familiaris
aagaagagggacaagc

SEQ ID NO: 298639 - DNA, 16 bp, C. familiaris
aagaagagggatgcct

SEQ ID NO: 298640 - DNA, 16 bp, C. familiaris
aagaagatataacatt

SEQ ID NO: 298641 - DNA, 16 bp, C. familiaris
aagaagatatgtaaat

SEQ ID NO: 298642 - DNA, 16 bp, C. familiaris
aagaagatgatgatga

SEQ ID NO: 298643 - DNA, 16 bp, C. familiaris
aagaagatgcaaataa

SEQ ID NO: 298644 - DNA, 16 bp, C. familiaris
aagaagatgtgtttta

SEQ ID NO: 298645 - DNA, 16 bp, C. familiaris
aagaagattaaaatca

SEQ ID NO: 298646 - DNA, 16 bp, C. familiaris
aagaagattgaaatca

SEQ ID NO: 298647 - DNA, 16 bp, C. familiaris
aagaagcaagagaaat

SEQ ID NO: 298648 - DNA, 16 bp, C. familiaris
aagaagcagcagcaga

SEQ ID NO: 298649 - DNA, 16 bp, C. familiaris
aagaagcccaatgtgg

SEQ ID NO: 298650 - DNA, 16 bp, C. familiaris
aagaagcctgagaagg

SEQ ID NO: 298651 - DNA, 16 bp, C. familiaris
aagaagctgagagaag

SEQ ID NO: 298652 - DNA, 16 bp, C. familiaris
aagaagctgaggctca

SEQ ID NO: 298653 - DNA, 16 bp, C. familiaris
aagaagctgccaaact

SEQ ID NO: 298654 - DNA, 16 bp, C. familiaris
aagaagctgctgtggc

SEQ ID NO: 298655 - DNA, 16 bp, C. familiaris
aagaagctggaaaaag

SEQ ID NO: 298656 - DNA, 16 bp, C. familiaris
aagaaggaaaacttcc

SEQ ID NO: 298657 - DNA, 16 bp, C. familiaris
aagaaggaagctgagg

SEQ ID NO: 298658 - DNA, 16 bp, C. familiaris
aagaaggacaaagctg

SEQ ID NO: 298659 - DNA, 16 bp, C. familiaris
aagaaggcaggcaggc

SEQ ID NO: 298660 - DNA, 16 bp, C. familiaris
aagaaggccagtgtgg

SEQ ID NO: 298661 - DNA, 16 bp, C. familiaris
aagaaggggaaatttg

SEQ ID NO: 298662 - DNA, 16 bp, C. familiaris
aagaaggtgaaagacc

SEQ ID NO: 298663 - DNA, 16 bp, C. familiaris
aagaaggtggtccagt

SEQ ID NO: 298664 - DNA, 16 bp, C. familiaris
aagaagtaaaggaaca

SEQ ID NO: 298665 - DNA, 16 bp, C. familiaris
aagaagtaatggctga

SEQ ID NO: 298666 - DNA, 16 bp, C. familiaris
aagaagtcaaagaaga

SEQ ID NO: 298667 - DNA, 16 bp, C. familiaris
aagaagtcagatacaa

SEQ ID NO: 298668 - DNA, 16 bp, C. familiaris
aagaagtgaaagatct

SEQ ID NO: 298669 - DNA, 16 bp, C. familiaris
aagaagtgacatttga

SEQ ID NO: 298670 - DNA, 16 bp, C. familiaris
aagaagtgggtaggaa

SEQ ID NO: 298671 - DNA, 16 bp, C. familiaris
aagaagtggtagtgga

SEQ ID NO: 298672 - DNA, 16 bp, C. familiaris
aagaagtgttggcaag

SEQ ID NO: 298673 - DNA, 16 bp, C. familiaris
aagaagttactgcagc

SEQ ID NO: 298674 - DNA, 16 bp, C. familiaris
aagaagttcagtggaa

SEQ ID NO: 298675 - DNA, 16 bp, C. familiaris
aagaagttgaggaaga

SEQ ID NO: 298676 - DNA, 16 bp, C. familiaris
aagaagtttggaagaa

SEQ ID NO: 298677 - DNA, 16 bp, C. familiaris
aagaataaaaatactt

SEQ ID NO: 298678 - DNA, 16 bp, C. familiaris
aagaataaaatacttg

SEQ ID NO: 298679 - DNA, 16 bp, C. familiaris
aagaataaatttggag

SEQ ID NO: 298680 - DNA, 16 bp, C. familiaris
aagaatacaaaaatgc

SEQ ID NO: 298681 - DNA, 16 bp, C. familiaris
aagaatacatttaaaa

SEQ ID NO: 298682 - DNA, 16 bp, C. familiaris
aagaatataaaatggg

SEQ ID NO: 298683 - DNA, 16 bp, C. familiaris
aagaatatgaaaacat

SEQ ID NO: 298684 - DNA, 16 bp, C. familiaris
aagaatatgggctttg

SEQ ID NO: 298685 - DNA, 16 bp, C. familiaris
aagaatattcactgga

SEQ ID NO: 298686 - DNA, 16 bp, C. familiaris
aagaatcaaatggaaa

SEQ ID NO: 298687 - DNA, 16 bp, C. familiaris
aagaatcaaattgaat

SEQ ID NO: 298688 - DNA, 16 bp, C. familiaris
aagaatcacatgttct

SEQ ID NO: 298689 - DNA, 16 bp, C. familiaris
aagaatcagaaacact

SEQ ID NO: 298690 - DNA, 16 bp, C. familiaris
aagaatcagaaatagt

SEQ ID NO: 298691 - DNA, 16 bp, C. familiaris
aagaatcagaagcagt

SEQ ID NO: 298692 - DNA, 16 bp, C. familiaris
aagaatcagacactca

SEQ ID NO: 298693 - DNA, 16 bp, C. familiaris
aagaatcagctcttag

SEQ ID NO: 298694 - DNA, 16 bp, C. familiaris
aagaatctcaagaaga

SEQ ID NO: 298695 - DNA, 16 bp, C. familiaris
aagaatctcaaggcca

SEQ ID NO: 298696 - DNA, 16 bp, C. familiaris
aagaatctgttttttt

SEQ ID NO: 298697 - DNA, 16 bp, C. familiaris
aagaatgaaactggtc

SEQ ID NO: 298698 - DNA, 16 bp, C. familiaris
aagaatgaaactttgc

SEQ ID NO: 298699 - DNA, 16 bp, C. familiaris
aagaatgaaatcctgc

SEQ ID NO: 298700 - DNA, 16 bp, C. familiaris
aagaatgaaatcttgg

SEQ ID NO: 298701 - DNA, 16 bp, C. familiaris
aagaatgaaattttgt

SEQ ID NO: 298702 - DNA, 16 bp, C. familiaris
aagaatgactttaaaa

SEQ ID NO: 298703 - DNA, 16 bp, C. familiaris
aagaatgagaagacaa

SEQ ID NO: 298704 - DNA, 16 bp, C. familiaris
aagaatgagatcttgt

SEQ ID NO: 298705 - DNA, 16 bp, C. familiaris
aagaatgcatttattt

SEQ ID NO: 298706 - DNA, 16 bp, C. familiaris
aagaatgggatccctg

SEQ ID NO: 298707 - DNA, 16 bp, C. familiaris
aagaatgtgaattctg

SEQ ID NO: 298708 - DNA, 16 bp, C. familiaris
aagaatgtgggctctg

SEQ ID NO: 298709 - DNA, 16 bp, C. familiaris
aagaattagaaaacct

SEQ ID NO: 298710 - DNA, 16 bp, C. familiaris
aagaattattttcatt

SEQ ID NO: 298711 - DNA, 16 bp, C. familiaris
aagaattatttttcat

SEQ ID NO: 298712 - DNA, 16 bp, C. familiaris
aagaattcaatgaatg

SEQ ID NO: 298713 - DNA, 16 bp, C. familiaris
aagaattcattaaaaa

SEQ ID NO: 298714 - DNA, 16 bp, C. familiaris
aagaattctttttttt

SEQ ID NO: 298715 - DNA, 16 bp, C. familiaris
aagaattgtaaatatt

SEQ ID NO: 298716 - DNA, 16 bp, C. familiaris
aagaatttgagaagaa

SEQ ID NO: 298717 - DNA, 16 bp, C. familiaris
aagaatttggagaaaa

SEQ ID NO: 298718 - DNA, 16 bp, C. familiaris
aagaatttgtccattt

SEQ ID NO: 298719 - DNA, 16 bp, C. familiaris
aagaattttcaaaatt

SEQ ID NO: 298720 - DNA, 16 bp, C. familiaris
aagacaaaagaagtcc

SEQ ID NO: 298721 - DNA, 16 bp, C. familiaris
aagacaaaatgatgaa

SEQ ID NO: 298722 - DNA, 16 bp, C. familiaris
aagacaaagaaaggct

SEQ ID NO: 298723 - DNA, 16 bp, C. familiaris
aagacaaagagaatat

SEQ ID NO: 298724 - DNA, 16 bp, C. familiaris
aagacaaatatcatat

SEQ ID NO: 298725 - DNA, 16 bp, C. familiaris
aagacaaattttaaaa

SEQ ID NO: 298726 - DNA, 16 bp, C. familiaris
aagacaagcaaaaact

SEQ ID NO: 298727 - DNA, 16 bp, C. familiaris
aagacaataacaagtg

SEQ ID NO: 298728 - DNA, 16 bp, C. familiaris
aagacacagatgtagt

SEQ ID NO: 298729 - DNA, 16 bp, C. familiaris
aagacaccagagaaac

SEQ ID NO: 298730 - DNA, 16 bp, C. familiaris
aagacaccattaagag

SEQ ID NO: 298731 - DNA, 16 bp, C. familiaris
aagacactgatgaaaa

SEQ ID NO: 298732 - DNA, 16 bp, C. familiaris
aagacactgtcttttt

SEQ ID NO: 298733 - DNA, 16 bp, C. familiaris
aagacacttgtgatga

SEQ ID NO: 298734 - DNA, 16 bp, C. familiaris
aagacagaaagagatg

SEQ ID NO: 298735 - DNA, 16 bp, C. familiaris
aagacagaacatgaag

SEQ ID NO: 298736 - DNA, 16 bp, C. familiaris
aagacagaagccacag

SEQ ID NO: 298737 - DNA, 16 bp, C. familiaris
aagacagaggcagaga

SEQ ID NO: 298738 - DNA, 16 bp, C. familiaris
aagacagagtaatgga

SEQ ID NO: 298739 - DNA, 16 bp, C. familiaris
aagacaggcagaaact

SEQ ID NO: 298740 - DNA, 16 bp, C. familiaris
aagacaggggcacctg

SEQ ID NO: 298741 - DNA, 16 bp, C. familiaris
aagacagtatgatatt

SEQ ID NO: 298742 - DNA, 16 bp, C. familiaris
aagacagtgacagcag

SEQ ID NO: 298743 - DNA, 16 bp, C. familiaris
aagacagtttttaaaa

SEQ ID NO: 298744 - DNA, 16 bp, C. familiaris
aagacatctacaaaaa

SEQ ID NO: 298745 - DNA, 16 bp, C. familiaris
aagacatctatgaaaa

SEQ ID NO: 298746 - DNA, 16 bp, C. familiaris
aagacatctttttttt

SEQ ID NO: 298747 - DNA, 16 bp, C. familiaris
aagacatgaaacagaa

SEQ ID NO: 298748 - DNA, 16 bp, C. familiaris
aagacatgaaagaaat

SEQ ID NO: 298749 - DNA, 16 bp, C. familiaris
aagacatggaagaaac

SEQ ID NO: 298750 - DNA, 16 bp, C. familiaris
aagacatggaagaaat

SEQ ID NO: 298751 - DNA, 16 bp, C. familiaris
aagacatggaggaaat

SEQ ID NO: 298752 - DNA, 16 bp, C. familiaris
aagacattaaaatatt

SEQ ID NO: 298753 - DNA, 16 bp, C. familiaris
aagacattctcttcaa

SEQ ID NO: 298754 - DNA, 16 bp, C. familiaris
aagacattgaggaaga

SEQ ID NO: 298755 - DNA, 16 bp, C. familiaris
aagacatttgaaaaaa

SEQ ID NO: 298756 - DNA, 16 bp, C. familiaris
aagacattttatttta

SEQ ID NO: 298757 - DNA, 16 bp, C. familiaris
aagacatttttgaaaa

SEQ ID NO: 298758 - DNA, 16 bp, C. familiaris
aagacattttttaaaa

SEQ ID NO: 298759 - DNA, 16 bp, C. familiaris
aagaccaagccatgat

SEQ ID NO: 298760 - DNA, 16 bp, C. familiaris
aagaccatgccctggg

SEQ ID NO: 298761 - DNA, 16 bp, C. familiaris
aagaccctcccccaga

SEQ ID NO: 298762 - DNA, 16 bp, C. familiaris
aagaccctgaaaagcc

SEQ ID NO: 298763 - DNA, 16 bp, C. familiaris
aagacctctctgagga

SEQ ID NO: 298764 - DNA, 16 bp, C. familiaris
aagacctggagatcat

SEQ ID NO: 298765 - DNA, 16 bp, C. familiaris
aagacctgtgctctga

SEQ ID NO: 298766 - DNA, 17 bp, C. familiaris
aagactcacatcaacat

SEQ ID NO: 298767 - DNA, 16 bp, C. familiaris
aagactccaaagaaat

SEQ ID NO: 298768 - DNA, 16 bp, C. familiaris
aagactccaccaagaa

SEQ ID NO: 298769 - DNA, 16 bp, C. familiaris
aagactgatgtcaaag

SEQ ID NO: 298770 - DNA, 16 bp, C. familiaris
aagacttccagtacta

SEQ ID NO: 298771 - DNA, 16 bp, C. familiaris
aagacttcctggagaa

SEQ ID NO: 298772 - DNA, 16 bp, C. familiaris
aagactttatttattt

SEQ ID NO: 298773 - DNA, 16 bp, C. familiaris
aagactttctctccct

SEQ ID NO: 298774 - DNA, 16 bp, C. familiaris
aagactttggctttta

SEQ ID NO: 298775 - DNA, 16 bp, C. familiaris
aagactttttaaaaga

SEQ ID NO: 298776 - DNA, 16 bp, C. familiaris
aagactttttaaataa

SEQ ID NO: 298777 - DNA, 16 bp, C. familiaris
aagagaaaaacaattg

SEQ ID NO: 298778 - DNA, 16 bp, C. familiaris
aagagaaaaacagtta

SEQ ID NO: 298779 - DNA, 16 bp, C. familiaris
aagagaaaaagactga

SEQ ID NO: 298780 - DNA, 16 bp, C. familiaris
aagagaaaaatgtgtt

SEQ ID NO: 298781 - DNA, 16 bp, C. familiaris
aagagaaaatacactt

SEQ ID NO: 298782 - DNA, 16 bp, C. familiaris
aagagaaaatatttgc

SEQ ID NO: 298783 - DNA, 16 bp, C. familiaris
aagagaaaatccagaa

SEQ ID NO: 298784 - DNA, 16 bp, C. familiaris
aagagaaaatctgaag

SEQ ID NO: 298785 - DNA, 16 bp, C. familiaris
aagagaaactgagaaa

SEQ ID NO: 298786 - DNA, 16 bp, C. familiaris
aagagaaagagatttt

SEQ ID NO: 298787 - DNA, 16 bp, C. familiaris
aagagaaattaaggat

SEQ ID NO: 298788 - DNA, 16 bp, C. familiaris
aagagaactttttttt

SEQ ID NO: 298789 - DNA, 16 bp, C. familiaris
aagagaagaacaaagt

SEQ ID NO: 298790 - DNA, 16 bp, C. familiaris
aagagaatatctttat

SEQ ID NO: 298791 - DNA, 16 bp, C. familiaris
aagagaatattattca

SEQ ID NO: 298792 - DNA, 16 bp, C. familiaris
aagagaatcttaagta

SEQ ID NO: 298793 - DNA, 16 bp, C. familiaris
aagagaatgaaaacat

SEQ ID NO: 298794 - DNA, 17 bp, C. familiaris
aagagacacaggcagag

SEQ ID NO: 298795 - DNA, 16 bp, C. familiaris
aagagactgccttttt

SEQ ID NO: 298796 - DNA, 16 bp, C. familiaris
aagagactgtctttgt

SEQ ID NO: 298797 - DNA, 16 bp, C. familiaris
aagagacttttttttt

SEQ ID NO: 298798 - DNA, 16 bp, C. familiaris
aagagagaaaacatga

SEQ ID NO: 298799 - DNA, 16 bp, C. familiaris
aagagagaaagcaaat

SEQ ID NO: 298800 - DNA, 16 bp, C. familiaris
aagagagaagactcaa

SEQ ID NO: 298801 - DNA, 16 bp, C. familiaris
aagagagaattttgaa

SEQ ID NO: 298802 - DNA, 16 bp, C. familiaris
aagagagaccaaaagc

SEQ ID NO: 298803 - DNA, 16 bp, C. familiaris
aagagagagaaagact

SEQ ID NO: 298804 - DNA, 16 bp, C. familiaris
aagagagagagactga

SEQ ID NO: 298805 - DNA, 16 bp, C. familiaris
aagagagagagcatga

SEQ ID NO: 298806 - DNA, 16 bp, C. familiaris
aagagagagagcatgt

SEQ ID NO: 298807 - DNA, 16 bp, C. familiaris
aagagagagagcgtgc

SEQ ID NO: 298808 - DNA, 16 bp, C. familiaris
aagagagagcacacat

SEQ ID NO: 298809 - DNA, 16 bp, C. familiaris
aagagagagcccagaa

SEQ ID NO: 298810 - DNA, 16 bp, C. familiaris
aagagagagtcagtga

SEQ ID NO: 298811 - DNA, 16 bp, C. familiaris
aagagagagtgagagt

SEQ ID NO: 298812 - DNA, 16 bp, C. familiaris
aagagagcatgaatgg

SEQ ID NO: 298813 - DNA, 16 bp, C. familiaris
aagagaggcaaaccat

SEQ ID NO: 298814 - DNA, 16 bp, C. familiaris
aagagagtggtccagt

SEQ ID NO: 298815 - DNA, 16 bp, C. familiaris
aagagagtttcccttt

SEQ ID NO: 298816 - DNA, 16 bp, C. familiaris
aagagataatttttaa

SEQ ID NO: 298817 - DNA, 16 bp, C. familiaris
aagagatacatgcatc

SEQ ID NO: 298818 - DNA, 16 bp, C. familiaris
aagagatgaacaacaa

SEQ ID NO: 298819 - DNA, 16 bp, C. familiaris
aagagatgcagagaaa

SEQ ID NO: 298820 - DNA, 16 bp, C. familiaris
aagagatgcagagaga

SEQ ID NO: 298821 - DNA, 16 bp, C. familiaris
aagagattattttaaa

SEQ ID NO: 298822 - DNA, 16 bp, C. familiaris
aagagattattttgaa

SEQ ID NO: 298823 - DNA, 16 bp, C. familiaris
aagagattcttaacca

SEQ ID NO: 298824 - DNA, 16 bp, C. familiaris
aagagattgccttttt

SEQ ID NO: 298825 - DNA, 16 bp, C. familiaris
aagagattgtctttct

SEQ ID NO: 298826 - DNA, 16 bp, C. familiaris
aagagcacatgactct

SEQ ID NO: 298827 - DNA, 16 bp, C. familiaris
aagagcagaatacaca

SEQ ID NO: 298828 - DNA, 16 bp, C. familiaris
aagagcagacctctcc

SEQ ID NO: 298829 - DNA, 16 bp, C. familiaris
aagagcaggagcaggg

SEQ ID NO: 298830 - DNA, 16 bp, C. familiaris
aagagcatgagcagga

SEQ ID NO: 298831 - DNA, 16 bp, C. familiaris
aagagctggagaaaga

SEQ ID NO: 298832 - DNA, 16 bp, C. familiaris
aagaggaagacaaacc

SEQ ID NO: 298833 - DNA, 16 bp, C. familiaris
aagaggaagtttggaa

SEQ ID NO: 298834 - DNA, 16 bp, C. familiaris
aagaggagaaataaca

SEQ ID NO: 298835 - DNA, 16 bp, C. familiaris
aagaggagcctaagga

SEQ ID NO: 298836 - DNA, 16 bp, C. familiaris
aagaggatatttgcaa

SEQ ID NO: 298837 - DNA, 16 bp, C. familiaris
aagaggatgtggagaa

SEQ ID NO: 298838 - DNA, 16 bp, C. familiaris
aagaggcaaaagatct

SEQ ID NO: 298839 - DNA, 16 bp, C. familiaris
aagaggcagagacaag

SEQ ID NO: 298840 - DNA, 16 bp, C. familiaris
aagaggccatatcaaa

SEQ ID NO: 298841 - DNA, 16 bp, C. familiaris
aagaggctcctgggtg

SEQ ID NO: 298842 - DNA, 16 bp, C. familiaris
aagagggaatctcaag

SEQ ID NO: 298843 - DNA, 16 bp, C. familiaris
aagagggcagcccagg

SEQ ID NO: 298844 - DNA, 16 bp, C. familiaris
aagagggggatccctg

SEQ ID NO: 298845 - DNA, 16 bp, C. familiaris
aagaggtgaaagacct

SEQ ID NO: 298846 - DNA, 16 bp, C. familiaris
aagaggtggtggaaag

SEQ ID NO: 298847 - DNA, 16 bp, C. familiaris
aagagtactgtttctg

SEQ ID NO: 298848 - DNA, 16 bp, C. familiaris
aagagtatgtttagtt

SEQ ID NO: 298849 - DNA, 16 bp, C. familiaris
aagagtcaaaggctta

SEQ ID NO: 298850 - DNA, 16 bp, C. familiaris
aagagtctcttatgat

SEQ ID NO: 298851 - DNA, 16 bp, C. familiaris
aagagtgagagagagt

SEQ ID NO: 298852 - DNA, 16 bp, C. familiaris
aagagtgctgaatttt

SEQ ID NO: 298853 - DNA, 16 bp, C. familiaris
aagagtggcatgctct

SEQ ID NO: 298854 - DNA, 16 bp, C. familiaris
aagagttacatgctcc

SEQ ID NO: 298855 - DNA, 16 bp, C. familiaris
aagagttctcttttct

SEQ ID NO: 298856 - DNA, 16 bp, C. familiaris
aagagttgcatgtttt

SEQ ID NO: 298857 - DNA, 16 bp, C. familiaris
aagagtttaaaatttt

SEQ ID NO: 298858 - DNA, 16 bp, C. familiaris
aagagtttcccagaca

SEQ ID NO: 298859 - DNA, 16 bp, C. familiaris
aagagtttcttttttt

SEQ ID NO: 298860 - DNA, 18 bp, C. familiaris
aagagttttgatcaggaa

SEQ ID NO: 298861 - DNA, 16 bp, C. familiaris
aagataaaaaactttt

SEQ ID NO: 298862 - DNA, 16 bp, C. familiaris
aagataaacttaaaat

SEQ ID NO: 298863 - DNA, 16 bp, C. familiaris
aagataaagacagaga

SEQ ID NO: 298864 - DNA, 16 bp, C. familiaris
aagataatctcaaaat

SEQ ID NO: 298865 - DNA, 16 bp, C. familiaris
aagataatgatgatga

SEQ ID NO: 298866 - DNA, 16 bp, C. familiaris
aagatacagagagagg

SEQ ID NO: 298867 - DNA, 16 bp, C. familiaris
aagatacatcaatgaa

SEQ ID NO: 298868 - DNA, 16 bp, C. familiaris
aagatacctttttttt

SEQ ID NO: 298869 - DNA, 16 bp, C. familiaris
aagatactcaacatca

SEQ ID NO: 298870 - DNA, 16 bp, C. familiaris
aagatactcactgggc

SEQ ID NO: 298871 - DNA, 16 bp, C. familiaris
aagatacttgtaaatg

SEQ ID NO: 298872 - DNA, 16 bp, C. familiaris
aagatatggaaacaac

SEQ ID NO: 298873 - DNA, 16 bp, C. familiaris
aagatatggcatatat

SEQ ID NO: 298874 - DNA, 16 bp, C. familiaris
aagatattacaagaaa

SEQ ID NO: 298875 - DNA, 16 bp, C. familiaris
aagatattagccaata

SEQ ID NO: 298876 - DNA, 16 bp, C. familiaris
aagatatttgaaaatg

SEQ ID NO: 298877 - DNA, 16 bp, C. familiaris
aagatatttgcaaagg

SEQ ID NO: 298878 - DNA, 16 bp, C. familiaris
aagatcaagacttgag

SEQ ID NO: 298879 - DNA, 16 bp, C. familiaris
aagatcaagatcaaga

SEQ ID NO: 298880 - DNA, 16 bp, C. familiaris
aagatcaagatctgag

SEQ ID NO: 298881 - DNA, 16 bp, C. familiaris
aagatcaagatgttgg

SEQ ID NO: 298882 - DNA, 16 bp, C. familiaris
aagatcaaggcaccag

SEQ ID NO: 298883 - DNA, 16 bp, C. familiaris
aagatcaaggtgctgg

SEQ ID NO: 298884 - DNA, 16 bp, C. familiaris
aagatcaaggtgtctg

SEQ ID NO: 298885 - DNA, 16 bp, C. familiaris
aagatcacaaagattt

SEQ ID NO: 298886 - DNA, 16 bp, C. familiaris
aagatcagaaacatga

SEQ ID NO: 298887 - DNA, 16 bp, C. familiaris
aagatcaggaacaaaa

SEQ ID NO: 298888 - DNA, 16 bp, C. familiaris
aagatcaggaaccaga

SEQ ID NO: 298889 - DNA, 16 bp, C. familiaris
aagatcagggtgctgg

SEQ ID NO: 298890 - DNA, 16 bp, C. familiaris
aagatcattaatgaag

SEQ ID NO: 298891 - DNA, 16 bp, C. familiaris
aagatcatttttaaaa

SEQ ID NO: 298892 - DNA, 16 bp, C. familiaris
aagatcctagaggaga

SEQ ID NO: 298893 - DNA, 16 bp, C. familiaris
aagatctgaggatcta

SEQ ID NO: 298894 - DNA, 16 bp, C. familiaris
aagatctttaaatttt

SEQ ID NO: 298895 - DNA, 16 bp, C. familiaris
aagatgaaaaaattct

SEQ ID NO: 298896 - DNA, 16 bp, C. familiaris
aagatgaaaaagttct

SEQ ID NO: 298897 - DNA, 16 bp, C. familiaris
aagatgaaagcagaga

SEQ ID NO: 298898 - DNA, 16 bp, C. familiaris
aagatgaagaaattga

SEQ ID NO: 298899 - DNA, 16 bp, C. familiaris
aagatgaagacaaaga

SEQ ID NO: 298900 - DNA, 16 bp, C. familiaris
aagatgacacaaatag

SEQ ID NO: 298901 - DNA, 16 bp, C. familiaris
aagatgacataaacaa

SEQ ID NO: 298902 - DNA, 16 bp, C. familiaris
aagatgacataaagaa

SEQ ID NO: 298903 - DNA, 16 bp, C. familiaris
aagatgacatccagat

SEQ ID NO: 298904 - DNA, 16 bp, C. familiaris
aagatgaggaacaaga

SEQ ID NO: 298905 - DNA, 16 bp, C. familiaris
aagatgatgatgaaga

SEQ ID NO: 298906 - DNA, 16 bp, C. familiaris
aagatgatgcaaagaa

SEQ ID NO: 298907 - DNA, 16 bp, C. familiaris
aagatgatgtggtata

SEQ ID NO: 298908 - DNA, 16 bp, C. familiaris
aagatgattttgaaaa

SEQ ID NO: 298909 - DNA, 16 bp, C. familiaris
aagatgcagagaaaag

SEQ ID NO: 298910 - DNA, 16 bp, C. familiaris
aagatgctcaacagca

SEQ ID NO: 298911 - DNA, 16 bp, C. familiaris
aagatgctcaacattg

SEQ ID NO: 298912 - DNA, 16 bp, C. familiaris
aagatgctcactgaac

SEQ ID NO: 298913 - DNA, 16 bp, C. familiaris
aagatgctcagtgtca

SEQ ID NO: 298914 - DNA, 16 bp, C. familiaris
aagatgctgaagaatg

SEQ ID NO: 298915 - DNA, 16 bp, C. familiaris
aagatgctgaggaatg

SEQ ID NO: 298916 - DNA, 16 bp, C. familiaris
aagatggaaacagaga

SEQ ID NO: 298917 - DNA, 16 bp, C. familiaris
aagatggaaagagatg

SEQ ID NO: 298918 - DNA, 16 bp, C. familiaris
aagatggagccccatg

SEQ ID NO: 298919 - DNA, 16 bp, C. familiaris
aagatggggcacctgg

SEQ ID NO: 298920 - DNA, 16 bp, C. familiaris
aagatggtgatgatga

SEQ ID NO: 298921 - DNA, 19 bp, C. familiaris
aagatggtggaagagtagg

SEQ ID NO: 298922 - DNA, 16 bp, C. familiaris
aagatgtccttcagga

SEQ ID NO: 298923 - DNA, 16 bp, C. familiaris
aagatgtggttcatgt

SEQ ID NO: 298924 - DNA, 16 bp, C. familiaris
aagatgttatttatat

SEQ ID NO: 298925 - DNA, 16 bp, C. familiaris
aagatgttgctgtggc

SEQ ID NO: 298926 - DNA, 16 bp, C. familiaris
aagattagagcaggaa

SEQ ID NO: 298927 - DNA, 16 bp, C. familiaris
aagattcaaacccaga

SEQ ID NO: 298928 - DNA, 16 bp, C. familiaris
aagattcatttaaaaa

SEQ ID NO: 298929 - DNA, 16 bp, C. familiaris
aagattccacaaaaaa

SEQ ID NO: 298930 - DNA, 16 bp, C. familiaris
aagattccattaaaat

SEQ ID NO: 298931 - DNA, 16 bp, C. familiaris
aagattctctctttat

SEQ ID NO: 298932 - DNA, 16 bp, C. familiaris
aagattctctttctct

SEQ ID NO: 298933 - DNA, 16 bp, C. familiaris
aagattgaaactagac

SEQ ID NO: 298934 - DNA, 16 bp, C. familiaris
aagattgagccctgtg

SEQ ID NO: 298935 - DNA, 16 bp, C. familiaris
aagattgctggatcat

SEQ ID NO: 298936 - DNA, 16 bp, C. familiaris
aagattgcttttccct

SEQ ID NO: 298937 - DNA, 16 bp, C. familiaris
aagatttaagaaattt

SEQ ID NO: 298938 - DNA, 16 bp, C. familiaris
aagatttatgtggaat

SEQ ID NO: 298939 - DNA, 16 bp, C. familiaris
aagatttcatgctttt

SEQ ID NO: 298940 - DNA, 16 bp, C. familiaris
aagatttcatttactt

SEQ ID NO: 298941 - DNA, 16 bp, C. familiaris
aagatttgaaaacaaa

SEQ ID NO: 298942 - DNA, 16 bp, C. familiaris
aagatttgttcatttt

SEQ ID NO: 298943 - DNA, 16 bp, C. familiaris
aagatttgtttttaaa

SEQ ID NO: 298944 - DNA, 16 bp, C. familiaris
aagattttaaaaatca

SEQ ID NO: 298945 - DNA, 16 bp, C. familiaris
aagattttaaaagaga

SEQ ID NO: 298946 - DNA, 16 bp, C. familiaris
aagattttaaacagtt

SEQ ID NO: 298947 - DNA, 16 bp, C. familiaris
aagattttattcatga

SEQ ID NO: 298948 - DNA, 16 bp, C. familiaris
aagattttcttaaaat

SEQ ID NO: 298949 - DNA, 16 bp, C. familiaris
aagattttgagaaaga

SEQ ID NO: 298950 - DNA, 16 bp, C. familiaris
aagattttgagaaata

SEQ ID NO: 298951 - DNA, 16 bp, C. familiaris
aagattttgatggttt

SEQ ID NO: 298952 - DNA, 16 bp, C. familiaris
aagatttttaacattt

SEQ ID NO: 298953 - DNA, 16 bp, C. familiaris
aagattttttaaaaga

SEQ ID NO: 298954 - DNA, 16 bp, C. familiaris
aagattttttcattta

SEQ ID NO: 298955 - DNA, 16 bp, C. familiaris
aagattttttctttct

SEQ ID NO: 298956 - DNA, 16 bp, C. familiaris
aagcaaaacaagtcag

SEQ ID NO: 298957 - DNA, 16 bp, C. familiaris
aagcaaaatgaaatga

SEQ ID NO: 298958 - DNA, 16 bp, C. familiaris
aagcaaactcccctct

SEQ ID NO: 298959 - DNA, 16 bp, C. familiaris
aagcaaagaaagtggt

SEQ ID NO: 298960 - DNA, 16 bp, C. familiaris
aagcaaagaaattgaa

SEQ ID NO: 298961 - DNA, 16 bp, C. familiaris
aagcaaatgaaaagat

SEQ ID NO: 298962 - DNA, 16 bp, C. familiaris
aagcaaatgaaaatta

SEQ ID NO: 298963 - DNA, 16 bp, C. familiaris
aagcaaatttttattt

SEQ ID NO: 298964 - DNA, 16 bp, C. familiaris
aagcaacagaagttta

SEQ ID NO: 298965 - DNA, 16 bp, C. familiaris
aagcaacagatgttgg

SEQ ID NO: 298966 - DNA, 16 bp, C. familiaris
aagcaacccatgtgtc

SEQ ID NO: 298967 - DNA, 16 bp, C. familiaris
aagcaacttgcccaaa

SEQ ID NO: 298968 - DNA, 16 bp, C. familiaris
aagcaagagagagcac

SEQ ID NO: 298969 - DNA, 22 bp, C. familiaris
aagcaagagatggctagtgctt

SEQ ID NO: 298970 - DNA, 16 bp, C. familiaris
aagcaagcaagcaaat

SEQ ID NO: 298971 - DNA, 16 bp, C. familiaris
aagcaagctccctact

SEQ ID NO: 298972 - DNA, 16 bp, C. familiaris
aagcaaggagagcagc

SEQ ID NO: 298973 - DNA, 16 bp, C. familiaris
aagcaagtcaatcaga

SEQ ID NO: 298974 - DNA, 16 bp, C. familiaris
aagcaagtcacaggtc

SEQ ID NO: 298975 - DNA, 16 bp, C. familiaris
aagcaagttccatgcc

SEQ ID NO: 298976 - DNA, 16 bp, C. familiaris
aagcaatcttcagaaa

SEQ ID NO: 298977 - DNA, 16 bp, C. familiaris
aagcaatgaaaatgaa

SEQ ID NO: 298978 - DNA, 16 bp, C. familiaris
aagcacaaaaatgtga

SEQ ID NO: 298979 - DNA, 17 bp, C. familiaris
aagcacaacatcaccaa

SEQ ID NO: 298980 - DNA, 16 bp, C. familiaris
aagcacaattatgaag

SEQ ID NO: 298981 - DNA, 16 bp, C. familiaris
aagcacctggctcttg

SEQ ID NO: 298982 - DNA, 16 bp, C. familiaris
aagcacttttaaaata

SEQ ID NO: 298983 - DNA, 16 bp, C. familiaris
aagcagaagaaataat

SEQ ID NO: 298984 - DNA, 16 bp, C. familiaris
aagcagaagcagcagc

SEQ ID NO: 298985 - DNA, 16 bp, C. familiaris
aagcagaagctgccag

SEQ ID NO: 298986 - DNA, 16 bp, C. familiaris
aagcagaatgaagaaa

SEQ ID NO: 298987 - DNA, 16 bp, C. familiaris
aagcagacccctgctg

SEQ ID NO: 298988 - DNA, 16 bp, C. familiaris
aagcagacttgctgct

SEQ ID NO: 298989 - DNA, 16 bp, C. familiaris
aagcagactttatgct

SEQ ID NO: 298990 - DNA, 16 bp, C. familiaris
aagcagagaagcaggc

SEQ ID NO: 298991 - DNA, 16 bp, C. familiaris
aagcagagacacaggt

SEQ ID NO: 298992 - DNA, 16 bp, C. familiaris
aagcagagagacacag

SEQ ID NO: 298993 - DNA, 16 bp, C. familiaris
aagcagagagagaagc

SEQ ID NO: 298994 - DNA, 16 bp, C. familiaris
aagcagagagatgaaa

SEQ ID NO: 298995 - DNA, 16 bp, C. familiaris
aagcagagatacagag

SEQ ID NO: 298996 - DNA, 16 bp, C. familiaris
aagcagaggcaacaaa

SEQ ID NO: 298997 - DNA, 16 bp, C. familiaris
aagcagataccctgct

SEQ ID NO: 298998 - DNA, 16 bp, C. familiaris
aagcagatgatccttc

SEQ ID NO: 298999 - DNA, 16 bp, C. familiaris
aagcagatggtcctcc

SEQ ID NO: 299000 - DNA, 16 bp, C. familiaris
aagcagcagaatatac

SEQ ID NO: 299001 - DNA, 16 bp, C. familiaris
aagcagcagcagcagg

SEQ ID NO: 299002 - DNA, 16 bp, C. familiaris
aagcagcaggaagaga

SEQ ID NO: 299003 - DNA, 16 bp, C. familiaris
aagcagccacagaaaa

SEQ ID NO: 299004 - DNA, 16 bp, C. familiaris
aagcagcccaaatatc

SEQ ID NO: 299005 - DNA, 16 bp, C. familiaris
aagcagcctccctgcg

SEQ ID NO: 299006 - DNA, 16 bp, C. familiaris
aagcagctccctgcag

SEQ ID NO: 299007 - DNA, 16 bp, C. familiaris
aagcagctgcttaacc

SEQ ID NO: 299008 - DNA, 16 bp, C. familiaris
aagcagctgctttcag

SEQ ID NO: 299009 - DNA, 16 bp, C. familiaris
aagcaggaaaatatga

SEQ ID NO: 299010 - DNA, 16 bp, C. familiaris
aagcaggagcagaggg

SEQ ID NO: 299011 - DNA, 16 bp, C. familiaris
aagcaggaggaacagc

SEQ ID NO: 299012 - DNA, 16 bp, C. familiaris
aagcaggaggagaagc

SEQ ID NO: 299013 - DNA, 16 bp, C. familiaris
aagcaggcaccatgcc

SEQ ID NO: 299014 - DNA, 16 bp, C. familiaris
aagcaggcagagggag

SEQ ID NO: 299015 - DNA, 16 bp, C. familiaris
aagcaggctccgtgct

SEQ ID NO: 299016 - DNA, 16 bp, C. familiaris
aagcaggctcctcaga

SEQ ID NO: 299017 - DNA, 16 bp, C. familiaris
aagcaggctgagcagg

SEQ ID NO: 299018 - DNA, 16 bp, C. familiaris
aagcaggctttctgca

SEQ ID NO: 299019 - DNA, 16 bp, C. familiaris
aagcagggaggagcag

SEQ ID NO: 299020 - DNA, 16 bp, C. familiaris
aagcagggcagcccag

SEQ ID NO: 299021 - DNA, 16 bp, C. familiaris
aagcagggctccctgc

SEQ ID NO: 299022 - DNA, 16 bp, C. familiaris
aagcagggggaacagg

SEQ ID NO: 299023 - DNA, 16 bp, C. familiaris
aagcagggtggagggg

SEQ ID NO: 299024 - DNA, 16 bp, C. familiaris
aagcagtcatcagaaa

SEQ ID NO: 299025 - DNA, 16 bp, C. familiaris
aagcagtcctgaggga

SEQ ID NO: 299026 - DNA, 16 bp, C. familiaris
aagcagttatcaaaaa

SEQ ID NO: 299027 - DNA, 16 bp, C. familiaris
aagcatatgaagaaaa

SEQ ID NO: 299028 - DNA, 16 bp, C. familiaris
aagcatatttaatttt

SEQ ID NO: 299029 - DNA, 16 bp, C. familiaris
aagcatctgactttga

SEQ ID NO: 299030 - DNA, 16 bp, C. familiaris
aagcatctgacttttt

SEQ ID NO: 299031 - DNA, 16 bp, C. familiaris
aagcatctgcctgcag

SEQ ID NO: 299032 - DNA, 16 bp, C. familiaris
aagcatttaataaaat

SEQ ID NO: 299033 - DNA, 16 bp, C. familiaris
aagcatttgaaaatat

SEQ ID NO: 299034 - DNA, 16 bp, C. familiaris
aagcatttgacaaggt

SEQ ID NO: 299035 - DNA, 16 bp, C. familiaris
aagcatttgagaaaat

SEQ ID NO: 299036 - DNA, 16 bp, C. familiaris
aagcattttaaataat

SEQ ID NO: 299037 - DNA, 16 bp, C. familiaris
aagcattttattaaaa

SEQ ID NO: 299038 - DNA, 16 bp, C. familiaris
aagcattttatttatt

SEQ ID NO: 299039 - DNA, 16 bp, C. familiaris
aagcattttttcatat

SEQ ID NO: 299040 - DNA, 16 bp, C. familiaris
aagcattttttctttt

SEQ ID NO: 299041 - DNA, 16 bp, C. familiaris
aagccaaaagcagatg

SEQ ID NO: 299042 - DNA, 16 bp, C. familiaris
aagccaaaatcaagaa

SEQ ID NO: 299043 - DNA, 16 bp, C. familiaris
aagccaaagccaaagc

SEQ ID NO: 299044 - DNA, 16 bp, C. familiaris
aagccaaaggcaggca

SEQ ID NO: 299045 - DNA, 16 bp, C. familiaris
aagccaacctacagaa

SEQ ID NO: 299046 - DNA, 16 bp, C. familiaris
aagccaagaagagagc

SEQ ID NO: 299047 - DNA, 16 bp, C. familiaris
aagccaaggtgaagga

SEQ ID NO: 299048 - DNA, 16 bp, C. familiaris
aagccaatcataaaag

SEQ ID NO: 299049 - DNA, 16 bp, C. familiaris
aagccaatttgatctt

SEQ ID NO: 299050 - DNA, 16 bp, C. familiaris
aagccaccaccttaaa

SEQ ID NO: 299051 - DNA, 16 bp, C. familiaris
aagccacccagggacc

SEQ ID NO: 299052 - DNA, 16 bp, C. familiaris
aagccagccctgcaag

SEQ ID NO: 299053 - DNA, 16 bp, C. familiaris
aagccaggaagaaagc

SEQ ID NO: 299054 - DNA, 16 bp, C. familiaris
aagccaggtgctaaac

SEQ ID NO: 299055 - DNA, 16 bp, C. familiaris
aagccatgtgaggaca

SEQ ID NO: 299056 - DNA, 16 bp, C. familiaris
aagcccaatatgggac

SEQ ID NO: 299057 - DNA, 16 bp, C. familiaris
aagcccagagagggga

SEQ ID NO: 299058 - DNA, 16 bp, C. familiaris
aagcccagagaggtga

SEQ ID NO: 299059 - DNA, 16 bp, C. familiaris
aagcccagccctgggg

SEQ ID NO: 299060 - DNA, 16 bp, C. familiaris
aagcccaggaccctgg

SEQ ID NO: 299061 - DNA, 16 bp, C. familiaris
aagcccagggacagga

SEQ ID NO: 299062 - DNA, 16 bp, C. familiaris
aagcctatttctccct

SEQ ID NO: 299063 - DNA, 16 bp, C. familiaris
aagcctctgcacagca

SEQ ID NO: 299064 - DNA, 16 bp, C. familiaris
aagcctctgccttctg

SEQ ID NO: 299065 - DNA, 16 bp, C. familiaris
aagcctgacttggggc

SEQ ID NO: 299066 - DNA, 16 bp, C. familiaris
aagcctgagatcaagg

SEQ ID NO: 299067 - DNA, 16 bp, C. familiaris
aagccttggactcttg

SEQ ID NO: 299068 - DNA, 16 bp, C. familiaris
aagcgtctgctttcag

SEQ ID NO: 299069 - DNA, 16 bp, C. familiaris
aagctaaaaatagagc

SEQ ID NO: 299070 - DNA, 16 bp, C. familiaris
aagctaaacatagaat

SEQ ID NO: 299071 - DNA, 16 bp, C. familiaris
aagctaaaggcagatg

SEQ ID NO: 299072 - DNA, 27 bp, C. familiaris
aagctacaggttacaacagatttgtga

SEQ ID NO: 299073 - DNA, 16 bp, C. familiaris
aagctacctttttttt

SEQ ID NO: 299074 - DNA, 16 bp, C. familiaris
aagctagagaaaaatg

SEQ ID NO: 299075 - DNA, 16 bp, C. familiaris
aagctagagaaaataa

SEQ ID NO: 299076 - DNA, 16 bp, C. familiaris
aagctagagaaaatat

SEQ ID NO: 299077 - DNA, 16 bp, C. familiaris
aagctcagagaggtga

SEQ ID NO: 299078 - DNA, 16 bp, C. familiaris
aagctcagatgatggt

SEQ ID NO: 299079 - DNA, 16 bp, C. familiaris
aagctccacaaggaca

SEQ ID NO: 299080 - DNA, 21 bp, C. familiaris
aagctccctaagggctgcagc

SEQ ID NO: 299081 - DNA, 16 bp, C. familiaris
aagctccttgacattg

SEQ ID NO: 299082 - DNA, 16 bp, C. familiaris
aagctctgtgttgggc

SEQ ID NO: 299083 - DNA, 16 bp, C. familiaris
aagctctttggggtcc

SEQ ID NO: 299084 - DNA, 16 bp, C. familiaris
aagctgaaaagaaagg

SEQ ID NO: 299085 - DNA, 16 bp, C. familiaris
aagctgaaatgaaaag

SEQ ID NO: 299086 - DNA, 16 bp, C. familiaris
aagctgaacaaaagag

SEQ ID NO: 299087 - DNA, 16 bp, C. familiaris
aagctgaaggagtttg

SEQ ID NO: 299088 - DNA, 16 bp, C. familiaris
aagctgaaggcagaca

SEQ ID NO: 299089 - DNA, 16 bp, C. familiaris
aagctgaaggcagagg

SEQ ID NO: 299090 - DNA, 16 bp, C. familiaris
aagctgaaggcaggca

SEQ ID NO: 299091 - DNA, 16 bp, C. familiaris
aagctgacaccctgca

SEQ ID NO: 299092 - DNA, 16 bp, C. familiaris
aagctgagaaaagaaa

SEQ ID NO: 299093 - DNA, 16 bp, C. familiaris
aagctgagagaagaaa

SEQ ID NO: 299094 - DNA, 16 bp, C. familiaris
aagctgaggaaaaagg

SEQ ID NO: 299095 - DNA, 16 bp, C. familiaris
aagctgagggccctct

SEQ ID NO: 299096 - DNA, 16 bp, C. familiaris
aagctgattttaaaaa

SEQ ID NO: 299097 - DNA, 16 bp, C. familiaris
aagctgcaaaacagga

SEQ ID NO: 299098 - DNA, 16 bp, C. familiaris
aagctgcagaaggaaa

SEQ ID NO: 299099 - DNA, 16 bp, C. familiaris
aagctgctcaacatca

SEQ ID NO: 299100 - DNA, 16 bp, C. familiaris
aagctgctgcgccacc

SEQ ID NO: 299101 - DNA, 16 bp, C. familiaris
aagctggaaaaagcaa

SEQ ID NO: 299102 - DNA, 16 bp, C. familiaris
aagctggaaaagaaaa

SEQ ID NO: 299103 - DNA, 16 bp, C. familiaris
aagctggaaagaaaaa

SEQ ID NO: 299104 - DNA, 20 bp, C. familiaris
aagctggaagatggtcccaa

SEQ ID NO: 299105 - DNA, 16 bp, C. familiaris
aagctggagaaagaaa

SEQ ID NO: 299106 - DNA, 16 bp, C. familiaris
aagctggagacatcat

SEQ ID NO: 299107 - DNA, 16 bp, C. familiaris
aagctggagacccagg

SEQ ID NO: 299108 - DNA, 16 bp, C. familiaris
aagctggaggcatcac

SEQ ID NO: 299109 - DNA, 16 bp, C. familiaris
aagctggaggcccagg

SEQ ID NO: 299110 - DNA, 16 bp, C. familiaris
aagctggtgcagctgc

SEQ ID NO: 299111 - DNA, 16 bp, C. familiaris
aagcttaaaagcaaga

SEQ ID NO: 299112 - DNA, 16 bp, C. familiaris
aagcttatctaacaca

SEQ ID NO: 299113 - DNA, 17 bp, C. familiaris
aagcttctgcacaccaa

SEQ ID NO: 299114 - DNA, 16 bp, C. familiaris
aagcttctgcacagtg

SEQ ID NO: 299115 - DNA, 16 bp, C. familiaris
aagcttctgcatggca

SEQ ID NO: 299116 - DNA, 16 bp, C. familiaris
aagcttcttgagagca

SEQ ID NO: 299117 - DNA, 16 bp, C. familiaris
aagctttaaaaaaatt

SEQ ID NO: 299118 - DNA, 16 bp, C. familiaris
aagctttaaaaaagaa

SEQ ID NO: 299119 - DNA, 16 bp, C. familiaris
aagctttaaaagaaaa

SEQ ID NO: 299120 - DNA, 16 bp, C. familiaris
aaggaaaaaaatcctc

SEQ ID NO: 299121 - DNA, 16 bp, C. familiaris
aaggaaaaagaatttt

SEQ ID NO: 299122 - DNA, 16 bp, C. familiaris
aaggaaaaattatttc

SEQ ID NO: 299123 - DNA, 16 bp, C. familiaris
aaggaaaacaaatgga

SEQ ID NO: 299124 - DNA, 16 bp, C. familiaris
aaggaaaacagtatgg

SEQ ID NO: 299125 - DNA, 16 bp, C. familiaris
aaggaaaacatttaaa

SEQ ID NO: 299126 - DNA, 16 bp, C. familiaris
aaggaaaacctccaaa

SEQ ID NO: 299127 - DNA, 16 bp, C. familiaris
aaggaaaacttcaaaa

SEQ ID NO: 299128 - DNA, 16 bp, C. familiaris
aaggaaaacttcacct

SEQ ID NO: 299129 - DNA, 16 bp, C. familiaris
aaggaaaactttcaaa

SEQ ID NO: 299130 - DNA, 16 bp, C. familiaris
aaggaaaagaaagctg

SEQ ID NO: 299131 - DNA, 16 bp, C. familiaris
aaggaaaagaaaggct

SEQ ID NO: 299132 - DNA, 16 bp, C. familiaris
aaggaaaagaacatga

SEQ ID NO: 299133 - DNA, 16 bp, C. familiaris
aaggaaaagataattt

SEQ ID NO: 299134 - DNA, 16 bp, C. familiaris
aaggaaaagcaaatga

SEQ ID NO: 299135 - DNA, 16 bp, C. familiaris
aaggaaaatagtattt

SEQ ID NO: 299136 - DNA, 16 bp, C. familiaris
aaggaaaatgatccca

SEQ ID NO: 299137 - DNA, 16 bp, C. familiaris
aaggaaaatgcaaatt

SEQ ID NO: 299138 - DNA, 16 bp, C. familiaris
aaggaaaatggaaaca

SEQ ID NO: 299139 - DNA, 16 bp, C. familiaris
aaggaaacaatccaca

SEQ ID NO: 299140 - DNA, 17 bp, C. familiaris
aaggaaacagtcaacaa

SEQ ID NO: 299141 - DNA, 16 bp, C. familiaris
aaggaaacatttgaaa

SEQ ID NO: 299142 - DNA, 16 bp, C. familiaris
aaggaaactgaagccc

SEQ ID NO: 299143 - DNA, 16 bp, C. familiaris
aaggaaactgagaaaa

SEQ ID NO: 299144 - DNA, 16 bp, C. familiaris
aaggaaagatttcttt

SEQ ID NO: 299145 - DNA, 16 bp, C. familiaris
aaggaaatattttata

SEQ ID NO: 299146 - DNA, 16 bp, C. familiaris
aaggaaatgaaatcag

SEQ ID NO: 299147 - DNA, 16 bp, C. familiaris
aaggaaattctgatgc

SEQ ID NO: 299148 - DNA, 16 bp, C. familiaris
aaggaaattgaagcaa

SEQ ID NO: 299149 - DNA, 16 bp, C. familiaris
aaggaacaaggggtgg

SEQ ID NO: 299150 - DNA, 16 bp, C. familiaris
aaggaactggaaaaag

SEQ ID NO: 299151 - DNA, 16 bp, C. familiaris
aaggaacttatcaaac

SEQ ID NO: 299152 - DNA, 16 bp, C. familiaris
aaggaagaaaatgaac

SEQ ID NO: 299153 - DNA, 16 bp, C. familiaris
aaggaagaaacaatac

SEQ ID NO: 299154 - DNA, 16 bp, C. familiaris
aaggaagaaattatac

SEQ ID NO: 299155 - DNA, 16 bp, C. familiaris
aaggaagaagcagact

SEQ ID NO: 299156 - DNA, 16 bp, C. familiaris
aaggaagaagccaaac

SEQ ID NO: 299157 - DNA, 16 bp, C. familiaris
aaggaagaagtaaact

SEQ ID NO: 299158 - DNA, 16 bp, C. familiaris
aaggaagaagtaaagc

SEQ ID NO: 299159 - DNA, 16 bp, C. familiaris
aaggaagaattttaaa

SEQ ID NO: 299160 - DNA, 16 bp, C. familiaris
aaggaagaggctcaac

SEQ ID NO: 299161 - DNA, 16 bp, C. familiaris
aaggaagagttaatac

SEQ ID NO: 299162 - DNA, 16 bp, C. familiaris
aaggaagctgaaaaga

SEQ ID NO: 299163 - DNA, 16 bp, C. familiaris
aaggaagctgaagaaa

SEQ ID NO: 299164 - DNA, 16 bp, C. familiaris
aaggaagctgaggaga

SEQ ID NO: 299165 - DNA, 16 bp, C. familiaris
aaggaagtaatttttt

SEQ ID NO: 299166 - DNA, 16 bp, C. familiaris
aaggaagtctgggaaa

SEQ ID NO: 299167 - DNA, 16 bp, C. familiaris
aaggaagtggtccagt

SEQ ID NO: 299168 - DNA, 16 bp, C. familiaris
aaggaatacttcccaa

SEQ ID NO: 299169 - DNA, 16 bp, C. familiaris
aaggaatattattcag

SEQ ID NO: 299170 - DNA, 16 bp, C. familiaris
aaggaatctcaagcag

SEQ ID NO: 299171 - DNA, 16 bp, C. familiaris
aaggaatctgtttctc

SEQ ID NO: 299172 - DNA, 16 bp, C. familiaris
aaggaatgaataaatt

SEQ ID NO: 299173 - DNA, 16 bp, C. familiaris
aaggaatgccaaagat

SEQ ID NO: 299174 - DNA, 16 bp, C. familiaris
aaggaattattgttaa

SEQ ID NO: 299175 - DNA, 16 bp, C. familiaris
aaggaattatttttaa

SEQ ID NO: 299176 - DNA, 16 bp, C. familiaris
aaggaattggctcata

SEQ ID NO: 299177 - DNA, 16 bp, C. familiaris
aaggaatttattttaa

SEQ ID NO: 299178 - DNA, 16 bp, C. familiaris
aaggaatttggatttt

SEQ ID NO: 299179 - DNA, 16 bp, C. familiaris
aaggaatttttaaaga

SEQ ID NO: 299180 - DNA, 16 bp, C. familiaris
aaggacaaaaggcaat

SEQ ID NO: 299181 - DNA, 16 bp, C. familiaris
aaggacaagcagactg

SEQ ID NO: 299182 - DNA, 16 bp, C. familiaris
aaggacaaggacaagg

SEQ ID NO: 299183 - DNA, 16 bp, C. familiaris
aaggacacctatagcc

SEQ ID NO: 299184 - DNA, 16 bp, C. familiaris
aaggacatcgaggctc

SEQ ID NO: 299185 - DNA, 16 bp, C. familiaris
aaggacattatcaaga

SEQ ID NO: 299186 - DNA, 16 bp, C. familiaris
aaggacattgaggaca

SEQ ID NO: 299187 - DNA, 16 bp, C. familiaris
aaggaccctgatgtgg

SEQ ID NO: 299188 - DNA, 16 bp, C. familiaris
aaggacctcaaacacg

SEQ ID NO: 299189 - DNA, 16 bp, C. familiaris
aaggacgctcctgccc

SEQ ID NO: 299190 - DNA, 16 bp, C. familiaris
aaggagaaactgaggc

SEQ ID NO: 299191 - DNA, 16 bp, C. familiaris
aaggagaaatcaaaga

SEQ ID NO: 299192 - DNA, 16 bp, C. familiaris
aaggagaagatggcca

SEQ ID NO: 299193 - DNA, 16 bp, C. familiaris
aaggagaagcagactg

SEQ ID NO: 299194 - DNA, 16 bp, C. familiaris
aaggagaagcagatgc

SEQ ID NO: 299195 - DNA, 16 bp, C. familiaris
aaggagaagcagattc

SEQ ID NO: 299196 - DNA, 16 bp, C. familiaris
aaggagaagcaggcac

SEQ ID NO: 299197 - DNA, 16 bp, C. familiaris
aaggagaagcaggctc

SEQ ID NO: 299198 - DNA, 16 bp, C. familiaris
aaggagaattacagat

SEQ ID NO: 299199 - DNA, 16 bp, C. familiaris
aaggagaatttttaaa

SEQ ID NO: 299200 - DNA, 16 bp, C. familiaris
aaggagaccagtgtgg

SEQ ID NO: 299201 - DNA, 16 bp, C. familiaris
aaggagactgaggccc

SEQ ID NO: 299202 - DNA, 16 bp, C. familiaris
aaggagagagcacaag

SEQ ID NO: 299203 - DNA, 16 bp, C. familiaris
aaggagagcatgtgat

SEQ ID NO: 299204 - DNA, 16 bp, C. familiaris
aaggagatggagaagc

SEQ ID NO: 299205 - DNA, 16 bp, C. familiaris
aaggagcacctgcacc

SEQ ID NO: 299206 - DNA, 16 bp, C. familiaris
aaggagcatgcttctc

SEQ ID NO: 299207 - DNA, 16 bp, C. familiaris
aaggagccaaaaatat

SEQ ID NO: 299208 - DNA, 16 bp, C. familiaris
aaggagcccattgtgg

SEQ ID NO: 299209 - DNA, 16 bp, C. familiaris
aaggagccccacatgg

SEQ ID NO: 299210 - DNA, 16 bp, C. familiaris
aaggagcctgggaaat

SEQ ID NO: 299211 - DNA, 16 bp, C. familiaris
aaggagccttcttctc

SEQ ID NO: 299212 - DNA, 16 bp, C. familiaris
aaggagctggagaagg

SEQ ID NO: 299213 - DNA, 16 bp, C. familiaris
aaggagctggatgtgg

SEQ ID NO: 299214 - DNA, 16 bp, C. familiaris
aaggaggaaaataatt

SEQ ID NO: 299215 - DNA, 16 bp, C. familiaris
aaggaggaaactgagg

SEQ ID NO: 299216 - DNA, 16 bp, C. familiaris
aaggaggctgagaaat

SEQ ID NO: 299217 - DNA, 16 bp, C. familiaris
aaggagggccggctgc

SEQ ID NO: 299218 - DNA, 16 bp, C. familiaris
aaggagtgcctggctg

SEQ ID NO: 299219 - DNA, 16 bp, C. familiaris
aaggagttcatcatca

SEQ ID NO: 299220 - DNA, 16 bp, C. familiaris
aaggatgagaaggagc

SEQ ID NO: 299221 - DNA, 16 bp, C. familiaris
aaggatgcaaagaaag

SEQ ID NO: 299222 - DNA, 16 bp, C. familiaris
aaggatgcagagaaag

SEQ ID NO: 299223 - DNA, 16 bp, C. familiaris
aaggatgtgaagaaac

SEQ ID NO: 299224 - DNA, 16 bp, C. familiaris
aaggatgtgaagaaag

SEQ ID NO: 299225 - DNA, 16 bp, C. familiaris
aaggatgtggagaaag

SEQ ID NO: 299226 - DNA, 16 bp, C. familiaris
aaggatgtggagaaat

SEQ ID NO: 299227 - DNA, 16 bp, C. familiaris
aaggattttaaagcag

SEQ ID NO: 299228 - DNA, 16 bp, C. familiaris
aaggattttctctttt

SEQ ID NO: 299229 - DNA, 16 bp, C. familiaris
aaggcaaaatgagaaa

SEQ ID NO: 299230 - DNA, 16 bp, C. familiaris
aaggcaaagctggagg

SEQ ID NO: 299231 - DNA, 16 bp, C. familiaris
aaggcaacctgctgaa

SEQ ID NO: 299232 - DNA, 16 bp, C. familiaris
aaggcaaggaaaataa

SEQ ID NO: 299233 - DNA, 16 bp, C. familiaris
aaggcagaaattaaaa

SEQ ID NO: 299234 - DNA, 16 bp, C. familiaris
aaggcagaagcttaac

SEQ ID NO: 299235 - DNA, 16 bp, C. familiaris
aaggcagacacttcac

SEQ ID NO: 299236 - DNA, 16 bp, C. familiaris
aaggcagagctgggat

SEQ ID NO: 299237 - DNA, 16 bp, C. familiaris
aaggcagcaggtgcag

SEQ ID NO: 299238 - DNA, 16 bp, C. familiaris
aaggcagccatctaca

SEQ ID NO: 299239 - DNA, 16 bp, C. familiaris
aaggcagcccaaatat

SEQ ID NO: 299240 - DNA, 16 bp, C. familiaris
aaggcagcccgggtgg

SEQ ID NO: 299241 - DNA, 16 bp, C. familiaris
aaggcagctgcccaac

SEQ ID NO: 299242 - DNA, 16 bp, C. familiaris
aaggcaggcagggaag

SEQ ID NO: 299243 - DNA, 16 bp, C. familiaris
aaggcaggtgcaaaac

SEQ ID NO: 299244 - DNA, 16 bp, C. familiaris
aaggcaggtgctacac

SEQ ID NO: 299245 - DNA, 16 bp, C. familiaris
aaggcagttttttttt

SEQ ID NO: 299246 - DNA, 16 bp, C. familiaris
aaggcatctgggtggc

SEQ ID NO: 299247 - DNA, 16 bp, C. familiaris
aaggcatttaacaaaa

SEQ ID NO: 299248 - DNA, 16 bp, C. familiaris
aaggccaaggccaagg

SEQ ID NO: 299249 - DNA, 16 bp, C. familiaris
aaggccagggatgctg

SEQ ID NO: 299250 - DNA, 16 bp, C. familiaris
aaggcccagaggcagg

SEQ ID NO: 299251 - DNA, 16 bp, C. familiaris
aaggccctggggcagc

SEQ ID NO: 299252 - DNA, 18 bp, C. familiaris
aaggcctccaagggggag

SEQ ID NO: 299253 - DNA, 16 bp, C. familiaris
aaggctctcatttaga

SEQ ID NO: 299254 - DNA, 16 bp, C. familiaris
aaggctggaggcatca

SEQ ID NO: 299255 - DNA, 16 bp, C. familiaris
aaggctggggcgagtg

SEQ ID NO: 299256 - DNA, 16 bp, C. familiaris
aaggctttctggaaga

SEQ ID NO: 299257 - DNA, 16 bp, C. familiaris
aagggaaaaaaatttt

SEQ ID NO: 299258 - DNA, 16 bp, C. familiaris
aagggaaatcaaggaa

SEQ ID NO: 299259 - DNA, 16 bp, C. familiaris
aagggaacttcctcaa

SEQ ID NO: 299260 - DNA, 16 bp, C. familiaris
aagggaagcagcagag

SEQ ID NO: 299261 - DNA, 16 bp, C. familiaris
aagggagaagaaattt

SEQ ID NO: 299262 - DNA, 16 bp, C. familiaris
aagggcatcctgggct

SEQ ID NO: 299263 - DNA, 16 bp, C. familiaris
aagggctgcctgggtg

SEQ ID NO: 299264 - DNA, 16 bp, C. familiaris
aagggctggagcaatt

SEQ ID NO: 299265 - DNA, 16 bp, C. familiaris
aaggggaatccctggg

SEQ ID NO: 299266 - DNA, 16 bp, C. familiaris
aaggggagccctcttg

SEQ ID NO: 299267 - DNA, 16 bp, C. familiaris
aaggggatcaggacca

SEQ ID NO: 299268 - DNA, 16 bp, C. familiaris
aaggggcagttaagac

SEQ ID NO: 299269 - DNA, 16 bp, C. familiaris
aagggggatccctggg

SEQ ID NO: 299270 - DNA, 16 bp, C. familiaris
aagggggcagcccagg

SEQ ID NO: 299271 - DNA, 16 bp, C. familiaris
aagggttcctctttct

SEQ ID NO: 299272 - DNA, 16 bp, C. familiaris
aagggtttcagactgg

SEQ ID NO: 299273 - DNA, 16 bp, C. familiaris
aaggtactgttggatc

SEQ ID NO: 299274 - DNA, 16 bp, C. familiaris
aaggtatacaacttga

SEQ ID NO: 299275 - DNA, 16 bp, C. familiaris
aaggtatgtgggaagg

SEQ ID NO: 299276 - DNA, 16 bp, C. familiaris
aaggtcaagtaacttg

SEQ ID NO: 299277 - DNA, 16 bp, C. familiaris
aaggtcacacaactgg

SEQ ID NO: 299278 - DNA, 16 bp, C. familiaris
aaggtcaggaacaaga

SEQ ID NO: 299279 - DNA, 16 bp, C. familiaris
aaggtcatgcagctgg

SEQ ID NO: 299280 - DNA, 16 bp, C. familiaris
aaggtgaaaggagatg

SEQ ID NO: 299281 - DNA, 16 bp, C. familiaris
aaggtgatgctggact

SEQ ID NO: 299282 - DNA, 16 bp, C. familiaris
aaggtggatggaagag

SEQ ID NO: 299283 - DNA, 16 bp, C. familiaris
aaggtttccaggaccc

SEQ ID NO: 299284 - DNA, 16 bp, C. familiaris
aaggttttattcattc

SEQ ID NO: 299285 - DNA, 16 bp, C. familiaris
aaggttttctattttt

SEQ ID NO: 299286 - DNA, 16 bp, C. familiaris
aagtaaaaaatctttt

SEQ ID NO: 299287 - DNA, 16 bp, C. familiaris
aagtaaaaatgatgtt

SEQ ID NO: 299288 - DNA, 16 bp, C. familiaris
aagtaaaagccaaagt

SEQ ID NO: 299289 - DNA, 16 bp, C. familiaris
aagtaaaaggatggga

SEQ ID NO: 299290 - DNA, 16 bp, C. familiaris
aagtaaaataaatcag

SEQ ID NO: 299291 - DNA, 16 bp, C. familiaris
aagtaaatattttgaa

SEQ ID NO: 299292 - DNA, 16 bp, C. familiaris
aagtaaatttttcaaa

SEQ ID NO: 299293 - DNA, 16 bp, C. familiaris
aagtaacatttttaat

SEQ ID NO: 299294 - DNA, 16 bp, C. familiaris
aagtaacttgtctgaa

SEQ ID NO: 299295 - DNA, 16 bp, C. familiaris
aagtaagcagaaggaa

SEQ ID NO: 299296 - DNA, 16 bp, C. familiaris
aagtaatcacagaaac

SEQ ID NO: 299297 - DNA, 16 bp, C. familiaris
aagtaatgctgcagta

SEQ ID NO: 299298 - DNA, 16 bp, C. familiaris
aagtaattactgataa

SEQ ID NO: 299299 - DNA, 16 bp, C. familiaris
aagtaatttctacact

SEQ ID NO: 299300 - DNA, 16 bp, C. familiaris
aagtacaaaaagggtg

SEQ ID NO: 299301 - DNA, 16 bp, C. familiaris
aagtacaaaatgaaat

SEQ ID NO: 299302 - DNA, 16 bp, C. familiaris
aagtacattccttaat

SEQ ID NO: 299303 - DNA, 16 bp, C. familiaris
aagtactatgttaaat

SEQ ID NO: 299304 - DNA, 16 bp, C. familiaris
aagtagaagtagaagt

SEQ ID NO: 299305 - DNA, 16 bp, C. familiaris
aagtagacccatgcag

SEQ ID NO: 299306 - DNA, 16 bp, C. familiaris
aagtagattccccact

SEQ ID NO: 299307 - DNA, 16 bp, C. familiaris
aagtagtagtagtagt

SEQ ID NO: 299308 - DNA, 16 bp, C. familiaris
aagtatatatactttt

SEQ ID NO: 299309 - DNA, 16 bp, C. familiaris
aagtatatgcatatat

SEQ ID NO: 299310 - DNA, 16 bp, C. familiaris
aagtatattttcattt

SEQ ID NO: 299311 - DNA, 16 bp, C. familiaris
aagtatattttttctt

SEQ ID NO: 299312 - DNA, 16 bp, C. familiaris
aagtatctgactttgg

SEQ ID NO: 299313 - DNA, 16 bp, C. familiaris
aagtatgtgaagaaaa

SEQ ID NO: 299314 - DNA, 16 bp, C. familiaris
aagtattccatgctca

SEQ ID NO: 299315 - DNA, 16 bp, C. familiaris
aagtattcttttaaaa

SEQ ID NO: 299316 - DNA, 16 bp, C. familiaris
aagtattgctggttta

SEQ ID NO: 299317 - DNA, 16 bp, C. familiaris
aagtatttaaagaaga

SEQ ID NO: 299318 - DNA, 16 bp, C. familiaris
aagtatttaagtattt

SEQ ID NO: 299319 - DNA, 16 bp, C. familiaris
aagtatttgtaaatca

SEQ ID NO: 299320 - DNA, 16 bp, C. familiaris
aagtatttttctttct

SEQ ID NO: 299321 - DNA, 16 bp, C. familiaris
aagtcaaagaaagaca

SEQ ID NO: 299322 - DNA, 16 bp, C. familiaris
aagtcaatgaaataga

SEQ ID NO: 299323 - DNA, 16 bp, C. familiaris
aagtcacaaggatgaa

SEQ ID NO: 299324 - DNA, 16 bp, C. familiaris
aagtcacacagctcat

SEQ ID NO: 299325 - DNA, 16 bp, C. familiaris
aagtcacatattcttt

SEQ ID NO: 299326 - DNA, 16 bp, C. familiaris
aagtcacccgtcccca

SEQ ID NO: 299327 - DNA, 16 bp, C. familiaris
aagtcagaatttgaac

SEQ ID NO: 299328 - DNA, 16 bp, C. familiaris
aagtcagagaagacaa

SEQ ID NO: 299329 - DNA, 16 bp, C. familiaris
aagtcatattacaaag

SEQ ID NO: 299330 - DNA, 16 bp, C. familiaris
aagtcatgaggatgaa

SEQ ID NO: 299331 - DNA, 16 bp, C. familiaris
aagtcatgatctcaga

SEQ ID NO: 299332 - DNA, 16 bp, C. familiaris
aagtcatttaacttct

SEQ ID NO: 299333 - DNA, 16 bp, C. familiaris
aagtccaaaatcaaga

SEQ ID NO: 299334 - DNA, 16 bp, C. familiaris
aagtccaagaccaagg

SEQ ID NO: 299335 - DNA, 16 bp, C. familiaris
aagtccaaggaaataa

SEQ ID NO: 299336 - DNA, 16 bp, C. familiaris
aagtccatggcatttt

SEQ ID NO: 299337 - DNA, 16 bp, C. familiaris
aagtcccacatctggc

SEQ ID NO: 299338 - DNA, 16 bp, C. familiaris
aagtccctgctctgct

SEQ ID NO: 299339 - DNA, 16 bp, C. familiaris
aagtcctaacctccag

SEQ ID NO: 299340 - DNA, 16 bp, C. familiaris
aagtcctggagatgta

SEQ ID NO: 299341 - DNA, 16 bp, C. familiaris
aagtcgggctccctgc

SEQ ID NO: 299342 - DNA, 16 bp, C. familiaris
aagtctaccaaatatt

SEQ ID NO: 299343 - DNA, 16 bp, C. familiaris
aagtctatctggtcca

SEQ ID NO: 299344 - DNA, 16 bp, C. familiaris
aagtctcacatcaggc

SEQ ID NO: 299345 - DNA, 16 bp, C. familiaris
aagtctcacatttaga

SEQ ID NO: 299346 - DNA, 16 bp, C. familiaris
aagtctcccctcccac

SEQ ID NO: 299347 - DNA, 16 bp, C. familiaris
aagtctctgaagaaag

SEQ ID NO: 299348 - DNA, 16 bp, C. familiaris
aagtctgtttttaaaa

SEQ ID NO: 299349 - DNA, 16 bp, C. familiaris
aagtctttaaaatata

SEQ ID NO: 299350 - DNA, 16 bp, C. familiaris
aagtctttcatttttt

SEQ ID NO: 299351 - DNA, 16 bp, C. familiaris
aagtgaaaagaaaacc

SEQ ID NO: 299352 - DNA, 16 bp, C. familiaris
aagtgaaaagaaagct

SEQ ID NO: 299353 - DNA, 16 bp, C. familiaris
aagtgaaagaaaccag

SEQ ID NO: 299354 - DNA, 16 bp, C. familiaris
aagtgaaagaacagga

SEQ ID NO: 299355 - DNA, 16 bp, C. familiaris
aagtgaaagaagctgg

SEQ ID NO: 299356 - DNA, 16 bp, C. familiaris
aagtgaaatgaatgaa

SEQ ID NO: 299357 - DNA, 16 bp, C. familiaris
aagtgaaattgctgga

SEQ ID NO: 299358 - DNA, 16 bp, C. familiaris
aagtgaagaaatattt

SEQ ID NO: 299359 - DNA, 16 bp, C. familiaris
aagtgaataaatacat

SEQ ID NO: 299360 - DNA, 16 bp, C. familiaris
aagtgaatgaaaatga

SEQ ID NO: 299361 - DNA, 16 bp, C. familiaris
aagtgagaaaactgag

SEQ ID NO: 299362 - DNA, 16 bp, C. familiaris
aagtgatgagaatgga

SEQ ID NO: 299363 - DNA, 16 bp, C. familiaris
aagtgcaaaggccttg

SEQ ID NO: 299364 - DNA, 17 bp, C. familiaris
aagtgcccccgtcagtg

SEQ ID NO: 299365 - DNA, 16 bp, C. familiaris
aagtgctccagtttca

SEQ ID NO: 299366 - DNA, 16 bp, C. familiaris
aagtgctctgaagaaa

SEQ ID NO: 299367 - DNA, 16 bp, C. familiaris
aagtggaatcatacat

SEQ ID NO: 299368 - DNA, 16 bp, C. familiaris
aagtggaatcatataa

SEQ ID NO: 299369 - DNA, 16 bp, C. familiaris
aagtggacaaattcct

SEQ ID NO: 299370 - DNA, 16 bp, C. familiaris
aagtggactccctgct

SEQ ID NO: 299371 - DNA, 16 bp, C. familiaris
aagtggactctgtgct

SEQ ID NO: 299372 - DNA, 16 bp, C. familiaris
aagtggagcctgaaga

SEQ ID NO: 299373 - DNA, 16 bp, C. familiaris
aagtggatcatagacc

SEQ ID NO: 299374 - DNA, 16 bp, C. familiaris
aagtggcaaagctgga

SEQ ID NO: 299375 - DNA, 16 bp, C. familiaris
aagtggcagagctgaa

SEQ ID NO: 299376 - DNA, 16 bp, C. familiaris
aagtggggaagggcag

SEQ ID NO: 299377 - DNA, 16 bp, C. familiaris
aagtgggtgatggaca

SEQ ID NO: 299378 - DNA, 16 bp, C. familiaris
aagtgggtttttaaaa

SEQ ID NO: 299379 - DNA, 16 bp, C. familiaris
aagtggttttatttat

SEQ ID NO: 299380 - DNA, 16 bp, C. familiaris
aagtgtacaatatggt

SEQ ID NO: 299381 - DNA, 16 bp, C. familiaris
aagtgtacaatttagt

SEQ ID NO: 299382 - DNA, 16 bp, C. familiaris
aagtgtacagttcagc

SEQ ID NO: 299383 - DNA, 16 bp, C. familiaris
aagtgtatttgaacaa

SEQ ID NO: 299384 - DNA, 16 bp, C. familiaris
aagtgtccattgactg

SEQ ID NO: 299385 - DNA, 16 bp, C. familiaris
aagtgtctgactttgg

SEQ ID NO: 299386 - DNA, 16 bp, C. familiaris
aagtgtctgcctttga

SEQ ID NO: 299387 - DNA, 16 bp, C. familiaris
aagtgtctgttcatgt

SEQ ID NO: 299388 - DNA, 16 bp, C. familiaris
aagtgtgagtcctcca

SEQ ID NO: 299389 - DNA, 16 bp, C. familiaris
aagtgtgtgtatatat

SEQ ID NO: 299390 - DNA, 16 bp, C. familiaris
aagtgtttccttttct

SEQ ID NO: 299391 - DNA, 16 bp, C. familiaris
aagtgttttattttga

SEQ ID NO: 299392 - DNA, 16 bp, C. familiaris
aagtgtttttttaaaa

SEQ ID NO: 299393 - DNA, 16 bp, C. familiaris
aagttaaaatgccaca

SEQ ID NO: 299394 - DNA, 16 bp, C. familiaris
aagttaagaaacttgc

SEQ ID NO: 299395 - DNA, 16 bp, C. familiaris
aagttaggttattgat

SEQ ID NO: 299396 - DNA, 16 bp, C. familiaris
aagttatgttacaaag

SEQ ID NO: 299397 - DNA, 16 bp, C. familiaris
aagttatttgaaaata

SEQ ID NO: 299398 - DNA, 16 bp, C. familiaris
aagttcaagatcaaga

SEQ ID NO: 299399 - DNA, 16 bp, C. familiaris
aagttcaagatcaggg

SEQ ID NO: 299400 - DNA, 16 bp, C. familiaris
aagttcaagcctcatg

SEQ ID NO: 299401 - DNA, 16 bp, C. familiaris
aagttcatttatttta

SEQ ID NO: 299402 - DNA, 16 bp, C. familiaris
aagttcctgcttctcc

SEQ ID NO: 299403 - DNA, 16 bp, C. familiaris
aagttccttccttttt

SEQ ID NO: 299404 - DNA, 16 bp, C. familiaris
aagttctagagatcta

SEQ ID NO: 299405 - DNA, 16 bp, C. familiaris
aagttctccaactttg

SEQ ID NO: 299406 - DNA, 16 bp, C. familiaris
aagttctggagatgaa

SEQ ID NO: 299407 - DNA, 16 bp, C. familiaris
aagttctggaggccag

SEQ ID NO: 299408 - DNA, 16 bp, C. familiaris
aagttctttataaatc

SEQ ID NO: 299409 - DNA, 16 bp, C. familiaris
aagttctttatacatc

SEQ ID NO: 299410 - DNA, 16 bp, C. familiaris
aagttgaaaatatcat

SEQ ID NO: 299411 - DNA, 16 bp, C. familiaris
aagttgagatttttaa

SEQ ID NO: 299412 - DNA, 16 bp, C. familiaris
aagttgatgatatttt

SEQ ID NO: 299413 - DNA, 16 bp, C. familiaris
aagttgctaagagaat

SEQ ID NO: 299414 - DNA, 16 bp, C. familiaris
aagttgctgcagctga

SEQ ID NO: 299415 - DNA, 16 bp, C. familiaris
aagttgtcagtcagtc

SEQ ID NO: 299416 - DNA, 16 bp, C. familiaris
aagttgtgacaaccaa

SEQ ID NO: 299417 - DNA, 16 bp, C. familiaris
aagtttactgaccaag

SEQ ID NO: 299418 - DNA, 16 bp, C. familiaris
aagtttattgaccaag

SEQ ID NO: 299419 - DNA, 16 bp, C. familiaris
aagtttcactatgaaa

SEQ ID NO: 299420 - DNA, 16 bp, C. familiaris
aagtttcactattaaa

SEQ ID NO: 299421 - DNA, 16 bp, C. familiaris
aagtttccttttttct

SEQ ID NO: 299422 - DNA, 16 bp, C. familiaris
aagtttctctccctct

SEQ ID NO: 299423 - DNA, 16 bp, C. familiaris
aagtttctcttgagcc

SEQ ID NO: 299424 - DNA, 16 bp, C. familiaris
aagtttctgcacagtg

SEQ ID NO: 299425 - DNA, 16 bp, C. familiaris
aagtttcttcaacaaa

SEQ ID NO: 299426 - DNA, 16 bp, C. familiaris
aagtttgagaagaatt

SEQ ID NO: 299427 - DNA, 16 bp, C. familiaris
aagtttgaggagaaac

SEQ ID NO: 299428 - DNA, 16 bp, C. familiaris
aagtttgccaacccct

SEQ ID NO: 299429 - DNA, 17 bp, C. familiaris
aagtttgctgagctgaa

SEQ ID NO: 299430 - DNA, 16 bp, C. familiaris
aagtttggggaaaaaa

SEQ ID NO: 299431 - DNA, 16 bp, C. familiaris
aagtttggggcacctg

SEQ ID NO: 299432 - DNA, 16 bp, C. familiaris
aagtttgtatcttttg

SEQ ID NO: 299433 - DNA, 16 bp, C. familiaris
aagtttgtgtgtatgt

SEQ ID NO: 299434 - DNA, 16 bp, C. familiaris
aagttttaaaatatga

SEQ ID NO: 299435 - DNA, 16 bp, C. familiaris
aagttttacagtttta

SEQ ID NO: 299436 - DNA, 16 bp, C. familiaris
aagttttacatttaaa

SEQ ID NO: 299437 - DNA, 16 bp, C. familiaris
aagttttactggaaaa

SEQ ID NO: 299438 - DNA, 16 bp, C. familiaris
aagttttatttcaaaa

SEQ ID NO: 299439 - DNA, 16 bp, C. familiaris
aagttttatttcttcc

SEQ ID NO: 299440 - DNA, 16 bp, C. familiaris
aagttttcaaaaaaaa

SEQ ID NO: 299441 - DNA, 16 bp, C. familiaris
aagttttcaaaggaat

SEQ ID NO: 299442 - DNA, 16 bp, C. familiaris
aagttttcaaatattt

SEQ ID NO: 299443 - DNA, 16 bp, C. familiaris
aagttttgaaattaga

SEQ ID NO: 299444 - DNA, 16 bp, C. familiaris
aagttttgaagaaaaa

SEQ ID NO: 299445 - DNA, 16 bp, C. familiaris
aagttttgacaaatgt

SEQ ID NO: 299446 - DNA, 16 bp, C. familiaris
aagttttgataaattt

SEQ ID NO: 299447 - DNA, 16 bp, C. familiaris
aagttttgtagttttc

SEQ ID NO: 299448 - DNA, 16 bp, C. familiaris
aagtttttcattttaa

SEQ ID NO: 299449 - DNA, 16 bp, C. familiaris
aataaaaactctgaaa

SEQ ID NO: 299450 - DNA, 16 bp, C. familiaris
aataaaaataagtcat

SEQ ID NO: 299451 - DNA, 16 bp, C. familiaris
aataaaaatcttagaa

SEQ ID NO: 299452 - DNA, 16 bp, C. familiaris
aataaaaatcttttca

SEQ ID NO: 299453 - DNA, 16 bp, C. familiaris
aataaaacctatacca

SEQ ID NO: 299454 - DNA, 16 bp, C. familiaris
aataaaaccttgaaaa

SEQ ID NO: 299455 - DNA, 16 bp, C. familiaris
aataaaactgtattta

SEQ ID NO: 299456 - DNA, 16 bp, C. familiaris
aataaaactgtcaaaa

SEQ ID NO: 299457 - DNA, 16 bp, C. familiaris
aataaaagcaaacttt

SEQ ID NO: 299458 - DNA, 16 bp, C. familiaris
aataaaataaatgtct

SEQ ID NO: 299459 - DNA, 16 bp, C. familiaris
aataaaatactttgaa

SEQ ID NO: 299460 - DNA, 16 bp, C. familiaris
aataaaatcttgagaa

SEQ ID NO: 299461 - DNA, 16 bp, C. familiaris
aataaaatgtgttttt

SEQ ID NO: 299462 - DNA, 16 bp, C. familiaris
aataaaatgttttcta

SEQ ID NO: 299463 - DNA, 16 bp, C. familiaris
aataaaattccaaatg

SEQ ID NO: 299464 - DNA, 16 bp, C. familiaris
aataaacaaaatgtag

SEQ ID NO: 299465 - DNA, 16 bp, C. familiaris
aataaacaaggaaatg

SEQ ID NO: 299466 - DNA, 16 bp, C. familiaris
aataaacacagaggtg

SEQ ID NO: 299467 - DNA, 16 bp, C. familiaris
aataaacatctttttt

SEQ ID NO: 299468 - DNA, 16 bp, C. familiaris
aataaaccttttttta

SEQ ID NO: 299469 - DNA, 16 bp, C. familiaris
aataaactgctttgtg

SEQ ID NO: 299470 - DNA, 16 bp, C. familiaris
aataaagaaaatcttt

SEQ ID NO: 299471 - DNA, 16 bp, C. familiaris
aataaagaaaatgtgc

SEQ ID NO: 299472 - DNA, 16 bp, C. familiaris
aataaagaaaatgtgg

SEQ ID NO: 299473 - DNA, 16 bp, C. familiaris
aataaagacattttga

SEQ ID NO: 299474 - DNA, 16 bp, C. familiaris
aataaagatgagagca

SEQ ID NO: 299475 - DNA, 16 bp, C. familiaris
aataaagatttgttga

SEQ ID NO: 299476 - DNA, 16 bp, C. familiaris
aataaagctgaacaaa

SEQ ID NO: 299477 - DNA, 16 bp, C. familiaris
aataaagcttctgtga

SEQ ID NO: 299478 - DNA, 16 bp, C. familiaris
aataaagtattttctt

SEQ ID NO: 299479 - DNA, 16 bp, C. familiaris
aataaagtgtttttaa

SEQ ID NO: 299480 - DNA, 16 bp, C. familiaris
aataaagttttactga

SEQ ID NO: 299481 - DNA, 16 bp, C. familiaris
aataaataaaacactg

SEQ ID NO: 299482 - DNA, 16 bp, C. familiaris
aataaataaaaccttg

SEQ ID NO: 299483 - DNA, 16 bp, C. familiaris
aataaatactgtgaaa

SEQ ID NO: 299484 - DNA, 16 bp, C. familiaris
aataaatatgttttga

SEQ ID NO: 299485 - DNA, 16 bp, C. familiaris
aataaatattcatgtt

SEQ ID NO: 299486 - DNA, 16 bp, C. familiaris
aataaatatttcctga

SEQ ID NO: 299487 - DNA, 16 bp, C. familiaris
aataaatattttccca

SEQ ID NO: 299488 - DNA, 16 bp, C. familiaris
aataaatattttgggg

SEQ ID NO: 299489 - DNA, 16 bp, C. familiaris
aataaatcatctttaa

SEQ ID NO: 299490 - DNA, 16 bp, C. familiaris
aataaatctctttcta

SEQ ID NO: 299491 - DNA, 16 bp, C. familiaris
aataaatgaaatccta

SEQ ID NO: 299492 - DNA, 16 bp, C. familiaris
aataaatgaacagaat

SEQ ID NO: 299493 - DNA, 16 bp, C. familiaris
aataaatgaagcaaat

SEQ ID NO: 299494 - DNA, 16 bp, C. familiaris
aataaatggtatagaa

SEQ ID NO: 299495 - DNA, 16 bp, C. familiaris
aataaatgtacatatt

SEQ ID NO: 299496 - DNA, 16 bp, C. familiaris
aataaatgtttacaaa

SEQ ID NO: 299497 - DNA, 16 bp, C. familiaris
aataaatgttttaaga

SEQ ID NO: 299498 - DNA, 16 bp, C. familiaris
aataaatttgtgctgt

SEQ ID NO: 299499 - DNA, 16 bp, C. familiaris
aataacaaacttaaag

SEQ ID NO: 299500 - DNA, 16 bp, C. familiaris
aataacagcagcaaca

SEQ ID NO: 299501 - DNA, 16 bp, C. familiaris
aataacatctattttt

SEQ ID NO: 299502 - DNA, 16 bp, C. familiaris
aataacatggatggaa

SEQ ID NO: 299503 - DNA, 16 bp, C. familiaris
aataacattaaaatgt

SEQ ID NO: 299504 - DNA, 16 bp, C. familiaris
aataacatttacatta

SEQ ID NO: 299505 - DNA, 16 bp, C. familiaris
aataacattttccttt

SEQ ID NO: 299506 - DNA, 16 bp, C. familiaris
aataaccaagatgtgg

SEQ ID NO: 299507 - DNA, 16 bp, C. familiaris
aataaccacatgaaaa

SEQ ID NO: 299508 - DNA, 16 bp, C. familiaris
aataactgaaatgaaa

SEQ ID NO: 299509 - DNA, 16 bp, C. familiaris
aataacttctttgaca

SEQ ID NO: 299510 - DNA, 16 bp, C. familiaris
aataagacatttgcaa

SEQ ID NO: 299511 - DNA, 16 bp, C. familiaris
aataaggaagctgaaa

SEQ ID NO: 299512 - DNA, 16 bp, C. familiaris
aataagtcagggaaag

SEQ ID NO: 299513 - DNA, 16 bp, C. familiaris
aataagttcacattca

SEQ ID NO: 299514 - DNA, 16 bp, C. familiaris
aataataaaatggcaa

SEQ ID NO: 299515 - DNA, 16 bp, C. familiaris
aataataataatcagt

SEQ ID NO: 299516 - DNA, 17 bp, C. familiaris
aataatacactggacca

SEQ ID NO: 299517 - DNA, 16 bp, C. familiaris
aataatactgtaataa

SEQ ID NO: 299518 - DNA, 16 bp, C. familiaris
aataatagaggaaact

SEQ ID NO: 299519 - DNA, 16 bp, C. familiaris
aataatgaagcagaaa

SEQ ID NO: 299520 - DNA, 16 bp, C. familiaris
aataatgaagcagcaa

SEQ ID NO: 299521 - DNA, 16 bp, C. familiaris
aataatgaagcagcag

SEQ ID NO: 299522 - DNA, 16 bp, C. familiaris
aataatgaagcaggag

SEQ ID NO: 299523 - DNA, 16 bp, C. familiaris
aataatgatgataatg

SEQ ID NO: 299524 - DNA, 16 bp, C. familiaris
aataatgcaattaaaa

SEQ ID NO: 299525 - DNA, 16 bp, C. familiaris
aataatggtgctatga

SEQ ID NO: 299526 - DNA, 16 bp, C. familiaris
aataatgtcctttata

SEQ ID NO: 299527 - DNA, 16 bp, C. familiaris
aataattaatgatgtt

SEQ ID NO: 299528 - DNA, 16 bp, C. familiaris
aataattactttaaac

SEQ ID NO: 299529 - DNA, 16 bp, C. familiaris
aataatttcaagaaaa

SEQ ID NO: 299530 - DNA, 16 bp, C. familiaris
aataatttctcttctg

SEQ ID NO: 299531 - DNA, 16 bp, C. familiaris
aatacaaaatttgaac

SEQ ID NO: 299532 - DNA, 16 bp, C. familiaris
aatacaagatcaatat

SEQ ID NO: 299533 - DNA, 16 bp, C. familiaris
aatacaatggagaaaa

SEQ ID NO: 299534 - DNA, 16 bp, C. familiaris
aatacacaaaaatctg

SEQ ID NO: 299535 - DNA, 16 bp, C. familiaris
aatacacagaaatcag

SEQ ID NO: 299536 - DNA, 16 bp, C. familiaris
aatacagaaacactaa

SEQ ID NO: 299537 - DNA, 16 bp, C. familiaris
aatacagaattatttt

SEQ ID NO: 299538 - DNA, 16 bp, C. familiaris
aatacagtattatgaa

SEQ ID NO: 299539 - DNA, 16 bp, C. familiaris
aatacagttttaaaat

SEQ ID NO: 299540 - DNA, 16 bp, C. familiaris
aatacataaagaacta

SEQ ID NO: 299541 - DNA, 16 bp, C. familiaris
aatacatagaaatgaa

SEQ ID NO: 299542 - DNA, 16 bp, C. familiaris
aatacatgaaagaaat

SEQ ID NO: 299543 - DNA, 16 bp, C. familiaris
aatacatttgtatttt

SEQ ID NO: 299544 - DNA, 16 bp, C. familiaris
aataccaacaatattt

SEQ ID NO: 299545 - DNA, 16 bp, C. familiaris
aataccaggaccctga

SEQ ID NO: 299546 - DNA, 16 bp, C. familiaris
aataccatgtaatttc

SEQ ID NO: 299547 - DNA, 16 bp, C. familiaris
aatacctacctcacag

SEQ ID NO: 299548 - DNA, 16 bp, C. familiaris
aatactaagcaaaata

SEQ ID NO: 299549 - DNA, 16 bp, C. familiaris
aatactgaagaagaaa

SEQ ID NO: 299550 - DNA, 16 bp, C. familiaris
aatacttaagaaaaat

SEQ ID NO: 299551 - DNA, 16 bp, C. familiaris
aatacttcaaaatatt

SEQ ID NO: 299552 - DNA, 16 bp, C. familiaris
aatacttcagcatgca

SEQ ID NO: 299553 - DNA, 16 bp, C. familiaris
aatagaaaaacatttt

SEQ ID NO: 299554 - DNA, 16 bp, C. familiaris
aatagaaaatctaaat

SEQ ID NO: 299555 - DNA, 16 bp, C. familiaris
aatagaaaatctgaat

SEQ ID NO: 299556 - DNA, 16 bp, C. familiaris
aatagaacagagagcc

SEQ ID NO: 299557 - DNA, 16 bp, C. familiaris
aatagaaccaccctat

SEQ ID NO: 299558 - DNA, 16 bp, C. familiaris
aatagaatatggcaaa

SEQ ID NO: 299559 - DNA, 16 bp, C. familiaris
aatagacatttgggtt

SEQ ID NO: 299560 - DNA, 17 bp, C. familiaris
aatagagaatccagaaa

SEQ ID NO: 299561 - DNA, 16 bp, C. familiaris
aatagataaagatgtg

SEQ ID NO: 299562 - DNA, 16 bp, C. familiaris
aatagatattcaataa

SEQ ID NO: 299563 - DNA, 16 bp, C. familiaris
aatagatttagggaac

SEQ ID NO: 299564 - DNA, 16 bp, C. familiaris
aatagcacagaggatc

SEQ ID NO: 299565 - DNA, 16 bp, C. familiaris
aatagcatcaaaaaga

SEQ ID NO: 299566 - DNA, 16 bp, C. familiaris
aatagctccaaactgg

SEQ ID NO: 299567 - DNA, 16 bp, C. familiaris
aatagcttttaaaaat

SEQ ID NO: 299568 - DNA, 16 bp, C. familiaris
aataggggaaggggat

SEQ ID NO: 299569 - DNA, 16 bp, C. familiaris
aataggtgatgggaat

SEQ ID NO: 299570 - DNA, 16 bp, C. familiaris
aatagtgaaagtgaat

SEQ ID NO: 299571 - DNA, 16 bp, C. familiaris
aatagttctttaaaaa

SEQ ID NO: 299572 - DNA, 16 bp, C. familiaris
aatagtttgtttcttt

SEQ ID NO: 299573 - DNA, 16 bp, C. familiaris
aatataaaatctgaat

SEQ ID NO: 299574 - DNA, 16 bp, C. familiaris
aatataaaatgaacat

SEQ ID NO: 299575 - DNA, 16 bp, C. familiaris
aatataaaatgcaaat

SEQ ID NO: 299576 - DNA, 16 bp, C. familiaris
aatataaagatgaatg

SEQ ID NO: 299577 - DNA, 16 bp, C. familiaris
aatataaataacagtg

SEQ ID NO: 299578 - DNA, 16 bp, C. familiaris
aatataaatgacattt

SEQ ID NO: 299579 - DNA, 16 bp, C. familiaris
aatataaatgtgtgtg

SEQ ID NO: 299580 - DNA, 16 bp, C. familiaris
aatataagaaatagtg

SEQ ID NO: 299581 - DNA, 16 bp, C. familiaris
aatataataatgacaa

SEQ ID NO: 299582 - DNA, 16 bp, C. familiaris
aatatacaaagaacac

SEQ ID NO: 299583 - DNA, 16 bp, C. familiaris
aatatacttaacatta

SEQ ID NO: 299584 - DNA, 16 bp, C. familiaris
aatatagtgattcaaa

SEQ ID NO: 299585 - DNA, 16 bp, C. familiaris
aatatatgtatgttat

SEQ ID NO: 299586 - DNA, 16 bp, C. familiaris
aatatattcacatttt

SEQ ID NO: 299587 - DNA, 16 bp, C. familiaris
aatatattgtcatttt

SEQ ID NO: 299588 - DNA, 16 bp, C. familiaris
aatatatttctgaaaa

SEQ ID NO: 299589 - DNA, 16 bp, C. familiaris
aatatatttgaaatgt

SEQ ID NO: 299590 - DNA, 16 bp, C. familiaris
aatatatttggaaaat

SEQ ID NO: 299591 - DNA, 16 bp, C. familiaris
aatatcaataaaattg

SEQ ID NO: 299592 - DNA, 16 bp, C. familiaris
aatatcaccaaagaaa

SEQ ID NO: 299593 - DNA, 16 bp, C. familiaris
aatatcagaaaggtag

SEQ ID NO: 299594 - DNA, 16 bp, C. familiaris
aatatcagtttcaggt

SEQ ID NO: 299595 - DNA, 16 bp, C. familiaris
aatatcatcaaatatc

SEQ ID NO: 299596 - DNA, 16 bp, C. familiaris
aatatcatcacactgg

SEQ ID NO: 299597 - DNA, 16 bp, C. familiaris
aatatcattcagtcat

SEQ ID NO: 299598 - DNA, 16 bp, C. familiaris
aatatccaacagaaaa

SEQ ID NO: 299599 - DNA, 16 bp, C. familiaris
aatatccagaacatat

SEQ ID NO: 299600 - DNA, 16 bp, C. familiaris
aatatcctttatgaat

SEQ ID NO: 299601 - DNA, 16 bp, C. familiaris
aatatctaatggaaaa

SEQ ID NO: 299602 - DNA, 16 bp, C. familiaris
aatatctgaagacatt

SEQ ID NO: 299603 - DNA, 16 bp, C. familiaris
aatatcttctccattt

SEQ ID NO: 299604 - DNA, 16 bp, C. familiaris
aatatctttgatgaac

SEQ ID NO: 299605 - DNA, 16 bp, C. familiaris
aatatgagtgggaaat

SEQ ID NO: 299606 - DNA, 16 bp, C. familiaris
aatatgatgatgatga

SEQ ID NO: 299607 - DNA, 16 bp, C. familiaris
aatatgcaaatatgca

SEQ ID NO: 299608 - DNA, 16 bp, C. familiaris
aatatgggattttttt

SEQ ID NO: 299609 - DNA, 16 bp, C. familiaris
aatatggtaaaaatgt

SEQ ID NO: 299610 - DNA, 16 bp, C. familiaris
aatatggtttcactca

SEQ ID NO: 299611 - DNA, 16 bp, C. familiaris
aatatgtattcttctg

SEQ ID NO: 299612 - DNA, 16 bp, C. familiaris
aatatgtctttaaaat

SEQ ID NO: 299613 - DNA, 16 bp, C. familiaris
aatatgttcaagaaaa

SEQ ID NO: 299614 - DNA, 16 bp, C. familiaris
aatatgttttaaatgt

SEQ ID NO: 299615 - DNA, 16 bp, C. familiaris
aatattaaagaggatc

SEQ ID NO: 299616 - DNA, 16 bp, C. familiaris
aatattaacaaactga

SEQ ID NO: 299617 - DNA, 16 bp, C. familiaris
aatattaagaaaatca

SEQ ID NO: 299618 - DNA, 16 bp, C. familiaris
aatattagaaaactga

SEQ ID NO: 299619 - DNA, 16 bp, C. familiaris
aatattagacaaagta

SEQ ID NO: 299620 - DNA, 16 bp, C. familiaris
aatattatgttgaata

SEQ ID NO: 299621 - DNA, 16 bp, C. familiaris
aatattattcttttga

SEQ ID NO: 299622 - DNA, 16 bp, C. familiaris
aatattcatcttattg

SEQ ID NO: 299623 - DNA, 16 bp, C. familiaris
aatattccactgtgta

SEQ ID NO: 299624 - DNA, 16 bp, C. familiaris
aatattccattcaaaa

SEQ ID NO: 299625 - DNA, 16 bp, C. familiaris
aatattccattttctg

SEQ ID NO: 299626 - DNA, 16 bp, C. familiaris
aatattccattttgtg

SEQ ID NO: 299627 - DNA, 16 bp, C. familiaris
aatattccttatgaat

SEQ ID NO: 299628 - DNA, 16 bp, C. familiaris
aatattctattttatg

SEQ ID NO: 299629 - DNA, 16 bp, C. familiaris
aatattgaatcttcct

SEQ ID NO: 299630 - DNA, 16 bp, C. familiaris
aatattgagacttcac

SEQ ID NO: 299631 - DNA, 16 bp, C. familiaris
aatattgagcattttt

SEQ ID NO: 299632 - DNA, 16 bp, C. familiaris
aatattgcaataactt

SEQ ID NO: 299633 - DNA, 16 bp, C. familiaris
aatattgcactgcatg

SEQ ID NO: 299634 - DNA, 16 bp, C. familiaris
aatattgcttttattt

SEQ ID NO: 299635 - DNA, 16 bp, C. familiaris
aatattggctcatcaa

SEQ ID NO: 299636 - DNA, 16 bp, C. familiaris
aatattgtgaaaatat

SEQ ID NO: 299637 - DNA, 16 bp, C. familiaris
aatattgttttggcta

SEQ ID NO: 299638 - DNA, 16 bp, C. familiaris
aatatttaagaaggaa

SEQ ID NO: 299639 - DNA, 16 bp, C. familiaris
aatatttacagatttt

SEQ ID NO: 299640 - DNA, 16 bp, C. familiaris
aatatttatcaagtat

SEQ ID NO: 299641 - DNA, 16 bp, C. familiaris
aatatttattgacttt

SEQ ID NO: 299642 - DNA, 16 bp, C. familiaris
aatatttcaagttttt

SEQ ID NO: 299643 - DNA, 16 bp, C. familiaris
aatatttcagagaaaa

SEQ ID NO: 299644 - DNA, 16 bp, C. familiaris
aatatttcctgcagag

SEQ ID NO: 299645 - DNA, 16 bp, C. familiaris
aatatttgatttttct

SEQ ID NO: 299646 - DNA, 16 bp, C. familiaris
aatatttgcattttct

SEQ ID NO: 299647 - DNA, 16 bp, C. familiaris
aatatttggaaattag

SEQ ID NO: 299648 - DNA, 16 bp, C. familiaris
aatatttggagaaaat

SEQ ID NO: 299649 - DNA, 16 bp, C. familiaris
aatatttggagatttt

SEQ ID NO: 299650 - DNA, 16 bp, C. familiaris
aatatttgtaaatgat

SEQ ID NO: 299651 - DNA, 16 bp, C. familiaris
aatatttgtccttttt

SEQ ID NO: 299652 - DNA, 16 bp, C. familiaris
aatattttaaaagttg

SEQ ID NO: 299653 - DNA, 16 bp, C. familiaris
aatattttaagaattc

SEQ ID NO: 299654 - DNA, 16 bp, C. familiaris
aatattttaagcaaaa

SEQ ID NO: 299655 - DNA, 16 bp, C. familiaris
aatattttaagtactt

SEQ ID NO: 299656 - DNA, 16 bp, C. familiaris
aatattttactgaatt

SEQ ID NO: 299657 - DNA, 16 bp, C. familiaris
aatattttatttggga

SEQ ID NO: 299658 - DNA, 16 bp, C. familiaris
aatattttcaaataca

SEQ ID NO: 299659 - DNA, 16 bp, C. familiaris
aatattttcagtttat

SEQ ID NO: 299660 - DNA, 16 bp, C. familiaris
aatattttccaaaaca

SEQ ID NO: 299661 - DNA, 16 bp, C. familiaris
aatattttccaaaata

SEQ ID NO: 299662 - DNA, 16 bp, C. familiaris
aatattttccaaataa

SEQ ID NO: 299663 - DNA, 16 bp, C. familiaris
aatattttctccaaaa

SEQ ID NO: 299664 - DNA, 16 bp, C. familiaris
aatattttgaaaaact

SEQ ID NO: 299665 - DNA, 16 bp, C. familiaris
aatattttgaaaatag

SEQ ID NO: 299666 - DNA, 16 bp, C. familiaris
aatattttgaagattt

SEQ ID NO: 299667 - DNA, 16 bp, C. familiaris
aatattttgaggaaat

SEQ ID NO: 299668 - DNA, 16 bp, C. familiaris
aatattttgcattttt

SEQ ID NO: 299669 - DNA, 16 bp, C. familiaris
aatattttggaaaata

SEQ ID NO: 299670 - DNA, 16 bp, C. familiaris
aatatttttaaaacag

SEQ ID NO: 299671 - DNA, 16 bp, C. familiaris
aatatttttaaaacca

SEQ ID NO: 299672 - DNA, 16 bp, C. familiaris
aatatttttaaggaaa

SEQ ID NO: 299673 - DNA, 16 bp, C. familiaris
aatatttttccaaaaa

SEQ ID NO: 299674 - DNA, 16 bp, C. familiaris
aatatttttggaaaaa

SEQ ID NO: 299675 - DNA, 16 bp, C. familiaris
aatatttttgtgtgtg

SEQ ID NO: 299676 - DNA, 16 bp, C. familiaris
aatcaaaacagtatgt

SEQ ID NO: 299677 - DNA, 16 bp, C. familiaris
aatcaaaactacaagg

SEQ ID NO: 299678 - DNA, 16 bp, C. familiaris
aatcaaaagtctgatg

SEQ ID NO: 299679 - DNA, 16 bp, C. familiaris
aatcaaaatcaccatg

SEQ ID NO: 299680 - DNA, 16 bp, C. familiaris
aatcaaagaagaaatg

SEQ ID NO: 299681 - DNA, 16 bp, C. familiaris
aatcaaagaagacaca

SEQ ID NO: 299682 - DNA, 16 bp, C. familiaris
aatcaaagaagaccta

SEQ ID NO: 299683 - DNA, 16 bp, C. familiaris
aatcaaatgaaaatga

SEQ ID NO: 299684 - DNA, 16 bp, C. familiaris
aatcaaattgctaaaa

SEQ ID NO: 299685 - DNA, 16 bp, C. familiaris
aatcaaattgctcaaa

SEQ ID NO: 299686 - DNA, 16 bp, C. familiaris
aatcaacagaatgaaa

SEQ ID NO: 299687 - DNA, 16 bp, C. familiaris
aatcaactacaagaaa

SEQ ID NO: 299688 - DNA, 16 bp, C. familiaris
aatcaagaaaatattt

SEQ ID NO: 299689 - DNA, 16 bp, C. familiaris
aatcaagaaattaaca

SEQ ID NO: 299690 - DNA, 16 bp, C. familiaris
aatcaagaatctgatg

SEQ ID NO: 299691 - DNA, 16 bp, C. familiaris
aatcaagagccagctg

SEQ ID NO: 299692 - DNA, 16 bp, C. familiaris
aatcaagctccctgct

SEQ ID NO: 299693 - DNA, 16 bp, C. familiaris
aatcaatcaaatcaat

SEQ ID NO: 299694 - DNA, 16 bp, C. familiaris
aatcaatcaataaatc

SEQ ID NO: 299695 - DNA, 16 bp, C. familiaris
aatcaatcaatgtaat

SEQ ID NO: 299696 - DNA, 16 bp, C. familiaris
aatcaatgaaatagaa

SEQ ID NO: 299697 - DNA, 16 bp, C. familiaris
aatcaattaatatgat

SEQ ID NO: 299698 - DNA, 16 bp, C. familiaris
aatcacattttcttta

SEQ ID NO: 299699 - DNA, 16 bp, C. familiaris
aatcagaaattcaaaa

SEQ ID NO: 299700 - DNA, 16 bp, C. familiaris
aatcagaagctctggg

SEQ ID NO: 299701 - DNA, 16 bp, C. familiaris
aatcagaaggaaggaa

SEQ ID NO: 299702 - DNA, 16 bp, C. familiaris
aatcagaatcagaatc

SEQ ID NO: 299703 - DNA, 16 bp, C. familiaris
aatcagaatttttatt

SEQ ID NO: 299704 - DNA, 16 bp, C. familiaris
aatcagacaagaaata

SEQ ID NO: 299705 - DNA, 16 bp, C. familiaris
aatcagacaatgaaaa

SEQ ID NO: 299706 - DNA, 16 bp, C. familiaris
aatcagagaaggacaa

SEQ ID NO: 299707 - DNA, 16 bp, C. familiaris
aatcagagaaggcttc

SEQ ID NO: 299708 - DNA, 16 bp, C. familiaris
aatcagagatggagac

SEQ ID NO: 299709 - DNA, 16 bp, C. familiaris
aatcagcaaatatttt

SEQ ID NO: 299710 - DNA, 16 bp, C. familiaris
aatcaggaaaatgcaa

SEQ ID NO: 299711 - DNA, 16 bp, C. familiaris
aatcaggaacaagaca

SEQ ID NO: 299712 - DNA, 16 bp, C. familiaris
aatcaggaagaaatag

SEQ ID NO: 299713 - DNA, 16 bp, C. familiaris
aatcaggaatgaaaga

SEQ ID NO: 299714 - DNA, 16 bp, C. familiaris
aatcaggtaacaaaaa

SEQ ID NO: 299715 - DNA, 16 bp, C. familiaris
aatcagtaaaattgat

SEQ ID NO: 299716 - DNA, 16 bp, C. familiaris
aatcagtcagagaaaa

SEQ ID NO: 299717 - DNA, 16 bp, C. familiaris
aatcagtgaaaccaaa

SEQ ID NO: 299718 - DNA, 16 bp, C. familiaris
aatcatcaccaccacc

SEQ ID NO: 299719 - DNA, 16 bp, C. familiaris
aatcatcagaaaaatg

SEQ ID NO: 299720 - DNA, 16 bp, C. familiaris
aatcatcagggagatg

SEQ ID NO: 299721 - DNA, 16 bp, C. familiaris
aatcatgaagaaacat

SEQ ID NO: 299722 - DNA, 16 bp, C. familiaris
aatcatgaagaaatag

SEQ ID NO: 299723 - DNA, 16 bp, C. familiaris
aatcatgagaaaataa

SEQ ID NO: 299724 - DNA, 16 bp, C. familiaris
aatcatgagttggatg

SEQ ID NO: 299725 - DNA, 16 bp, C. familiaris
aatcatggagatgaaa

SEQ ID NO: 299726 - DNA, 16 bp, C. familiaris
aatcattaagaaaaat

SEQ ID NO: 299727 - DNA, 16 bp, C. familiaris
aatcattatcatcatc

SEQ ID NO: 299728 - DNA, 16 bp, C. familiaris
aatcattcaacaaata

SEQ ID NO: 299729 - DNA, 16 bp, C. familiaris
aatcatttaccacaat

SEQ ID NO: 299730 - DNA, 16 bp, C. familiaris
aatcatttgaagaaaa

SEQ ID NO: 299731 - DNA, 16 bp, C. familiaris
aatcattttgaaaaaa

SEQ ID NO: 299732 - DNA, 16 bp, C. familiaris
aatccaaaaatgaaga

SEQ ID NO: 299733 - DNA, 16 bp, C. familiaris
aatccaacaatatatt

SEQ ID NO: 299734 - DNA, 16 bp, C. familiaris
aatccacaagcatgga

SEQ ID NO: 299735 - DNA, 16 bp, C. familiaris
aatccagaagtggaaa

SEQ ID NO: 299736 - DNA, 16 bp, C. familiaris
aatccaggaaaatctc

SEQ ID NO: 299737 - DNA, 16 bp, C. familiaris
aatccattttgagcta

SEQ ID NO: 299738 - DNA, 16 bp, C. familiaris
aatcccacagaggaag

SEQ ID NO: 299739 - DNA, 16 bp, C. familiaris
aatcccaccaccctga

SEQ ID NO: 299740 - DNA, 16 bp, C. familiaris
aatcccaggactggga

SEQ ID NO: 299741 - DNA, 16 bp, C. familiaris
aatcccaggactttga

SEQ ID NO: 299742 - DNA, 16 bp, C. familiaris
aatcccatgatcctga

SEQ ID NO: 299743 - DNA, 16 bp, C. familiaris
aatccccagaccctgg

SEQ ID NO: 299744 - DNA, 16 bp, C. familiaris
aatccccagactccag

SEQ ID NO: 299745 - DNA, 16 bp, C. familiaris
aatccccttcacctac

SEQ ID NO: 299746 - DNA, 16 bp, C. familiaris
aatcctaaaatatttt

SEQ ID NO: 299747 - DNA, 16 bp, C. familiaris
aatcctcaaaaatatt

SEQ ID NO: 299748 - DNA, 16 bp, C. familiaris
aatcctcaagcagagt

SEQ ID NO: 299749 - DNA, 16 bp, C. familiaris
aatcctgaaaaagaaa

SEQ ID NO: 299750 - DNA, 16 bp, C. familiaris
aatcctggaccccagg

SEQ ID NO: 299751 - DNA, 16 bp, C. familiaris
aatcctggagacccag

SEQ ID NO: 299752 - DNA, 16 bp, C. familiaris
aatcctggagacctga

SEQ ID NO: 299753 - DNA, 16 bp, C. familiaris
aatcctggagacctgg

SEQ ID NO: 299754 - DNA, 16 bp, C. familiaris
aatcctgggattctgg

SEQ ID NO: 299755 - DNA, 16 bp, C. familiaris
aatccttaagcagatt

SEQ ID NO: 299756 - DNA, 16 bp, C. familiaris
aatctaaaattgctct

SEQ ID NO: 299757 - DNA, 16 bp, C. familiaris
aatctacagccaagaa

SEQ ID NO: 299758 - DNA, 16 bp, C. familiaris
aatctaccaagactga

SEQ ID NO: 299759 - DNA, 16 bp, C. familiaris
aatctcaagaagactc

SEQ ID NO: 299760 - DNA, 16 bp, C. familiaris
aatctcaaggccatgg

SEQ ID NO: 299761 - DNA, 16 bp, C. familiaris
aatctcaccactctga

SEQ ID NO: 299762 - DNA, 16 bp, C. familiaris
aatctcagaaaaagaa

SEQ ID NO: 299763 - DNA, 16 bp, C. familiaris
aatctcaggacctcag

SEQ ID NO: 299764 - DNA, 16 bp, C. familiaris
aatctcaggaccttgg

SEQ ID NO: 299765 - DNA, 16 bp, C. familiaris
aatctcagggttctga

SEQ ID NO: 299766 - DNA, 16 bp, C. familiaris
aatctcatgatcaaac

SEQ ID NO: 299767 - DNA, 16 bp, C. familiaris
aatctccatcaaaata

SEQ ID NO: 299768 - DNA, 16 bp, C. familiaris
aatctccatcacctgt

SEQ ID NO: 299769 - DNA, 16 bp, C. familiaris
aatctccatgtatttt

SEQ ID NO: 299770 - DNA, 16 bp, C. familiaris
aatctctctaaaataa

SEQ ID NO: 299771 - DNA, 16 bp, C. familiaris
aatctcttaaaaaaga

SEQ ID NO: 299772 - DNA, 16 bp, C. familiaris
aatctctttctatata

SEQ ID NO: 299773 - DNA, 16 bp, C. familiaris
aatctgaaattaaaaa

SEQ ID NO: 299774 - DNA, 16 bp, C. familiaris
aatctgaaattgtgat

SEQ ID NO: 299775 - DNA, 16 bp, C. familiaris
aatctgatgaaagcta

SEQ ID NO: 299776 - DNA, 16 bp, C. familiaris
aatctgcattttaatg

SEQ ID NO: 299777 - DNA, 16 bp, C. familiaris
aatctgcttttccctc

SEQ ID NO: 299778 - DNA, 16 bp, C. familiaris
aatctggaaaacagta

SEQ ID NO: 299779 - DNA, 16 bp, C. familiaris
aatctggaaaataaaa

SEQ ID NO: 299780 - DNA, 16 bp, C. familiaris
aatctggagaaggaaa

SEQ ID NO: 299781 - DNA, 16 bp, C. familiaris
aatctgtatttaaaaa

SEQ ID NO: 299782 - DNA, 16 bp, C. familiaris
aatcttaaaaagccaa

SEQ ID NO: 299783 - DNA, 16 bp, C. familiaris
aatcttaaagaaaaag

SEQ ID NO: 299784 - DNA, 16 bp, C. familiaris
aatcttaaagaagaaa

SEQ ID NO: 299785 - DNA, 16 bp, C. familiaris
aatcttaaatgaaaaa

SEQ ID NO: 299786 - DNA, 16 bp, C. familiaris
aatcttaagatttgta

SEQ ID NO: 299787 - DNA, 16 bp, C. familiaris
aatcttaagcaaattc

SEQ ID NO: 299788 - DNA, 16 bp, C. familiaris
aatcttaagcagctcc

SEQ ID NO: 299789 - DNA, 16 bp, C. familiaris
aatcttagaaaaaaag

SEQ ID NO: 299790 - DNA, 16 bp, C. familiaris
aatcttcaagcagacc

SEQ ID NO: 299791 - DNA, 16 bp, C. familiaris
aatcttcataataatc

SEQ ID NO: 299792 - DNA, 16 bp, C. familiaris
aatcttgaaaaagaag

SEQ ID NO: 299793 - DNA, 16 bp, C. familiaris
aatcttggagcacctg

SEQ ID NO: 299794 - DNA, 16 bp, C. familiaris
aatcttgtcattttca

SEQ ID NO: 299795 - DNA, 16 bp, C. familiaris
aatctttaaaaaaagt

SEQ ID NO: 299796 - DNA, 16 bp, C. familiaris
aatctttagaaataaa

SEQ ID NO: 299797 - DNA, 16 bp, C. familiaris
aatctttctcaaactc

SEQ ID NO: 299798 - DNA, 16 bp, C. familiaris
aatctttgggatgctg

SEQ ID NO: 299799 - DNA, 16 bp, C. familiaris
aatcttttaaaaaatc

SEQ ID NO: 299800 - DNA, 16 bp, C. familiaris
aatcttttaaaaacag

SEQ ID NO: 299801 - DNA, 16 bp, C. familiaris
aatcttttaaaagaat

SEQ ID NO: 299802 - DNA, 16 bp, C. familiaris
aatcttttcaaaaaat

SEQ ID NO: 299803 - DNA, 16 bp, C. familiaris
aatcttttcagcaaat

SEQ ID NO: 299804 - DNA, 16 bp, C. familiaris
aatcttttttcaaaaa

SEQ ID NO: 299805 - DNA, 16 bp, C. familiaris
aatgaaaacacaaatt

SEQ ID NO: 299806 - DNA, 16 bp, C. familiaris
aatgaaaacataatag

SEQ ID NO: 299807 - DNA, 16 bp, C. familiaris
aatgaaaactggaaaa

SEQ ID NO: 299808 - DNA, 16 bp, C. familiaris
aatgaaaacttttaaa

SEQ ID NO: 299809 - DNA, 16 bp, C. familiaris
aatgaaaataatttca

SEQ ID NO: 299810 - DNA, 16 bp, C. familiaris
aatgaaaatgaataca

SEQ ID NO: 299811 - DNA, 16 bp, C. familiaris
aatgaaaatgacaata

SEQ ID NO: 299812 - DNA, 16 bp, C. familiaris
aatgaaaatgattttt

SEQ ID NO: 299813 - DNA, 16 bp, C. familiaris
aatgaaaatggaaaac

SEQ ID NO: 299814 - DNA, 16 bp, C. familiaris
aatgaaaatggaatca

SEQ ID NO: 299815 - DNA, 16 bp, C. familiaris
aatgaaaatggaattt

SEQ ID NO: 299816 - DNA, 16 bp, C. familiaris
aatgaaaatgttctga

SEQ ID NO: 299817 - DNA, 16 bp, C. familiaris
aatgaaaattgctttt

SEQ ID NO: 299818 - DNA, 16 bp, C. familiaris
aatgaaaattggtgca

SEQ ID NO: 299819 - DNA, 16 bp, C. familiaris
aatgaaaattgttttt

SEQ ID NO: 299820 - DNA, 16 bp, C. familiaris
aatgaaacagaaacca

SEQ ID NO: 299821 - DNA, 16 bp, C. familiaris
aatgaaacatttaaat

SEQ ID NO: 299822 - DNA, 16 bp, C. familiaris
aatgaaactaaaagtt

SEQ ID NO: 299823 - DNA, 16 bp, C. familiaris
aatgaaactgaataaa

SEQ ID NO: 299824 - DNA, 16 bp, C. familiaris
aatgaaactttcattt

SEQ ID NO: 299825 - DNA, 16 bp, C. familiaris
aatgaaagaaaccaat

SEQ ID NO: 299826 - DNA, 16 bp, C. familiaris
aatgaaagaacaagat

SEQ ID NO: 299827 - DNA, 16 bp, C. familiaris
aatgaaagaacaggaa

SEQ ID NO: 299828 - DNA, 16 bp, C. familiaris
aatgaaagaacaggat

SEQ ID NO: 299829 - DNA, 16 bp, C. familiaris
aatgaaagaagacaga

SEQ ID NO: 299830 - DNA, 16 bp, C. familiaris
aatgaaagaagagaca

SEQ ID NO: 299831 - DNA, 16 bp, C. familiaris
aatgaaagaatgaatg

SEQ ID NO: 299832 - DNA, 16 bp, C. familiaris
aatgaaagaggaaaca

SEQ ID NO: 299833 - DNA, 16 bp, C. familiaris
aatgaaagatatcaaa

SEQ ID NO: 299834 - DNA, 16 bp, C. familiaris
aatgaaagtgaaaaca

SEQ ID NO: 299835 - DNA, 16 bp, C. familiaris
aatgaaatcttgcaat

SEQ ID NO: 299836 - DNA, 16 bp, C. familiaris
aatgaaatgaaatctt

SEQ ID NO: 299837 - DNA, 16 bp, C. familiaris
aatgaaattgaaattt

SEQ ID NO: 299838 - DNA, 16 bp, C. familiaris
aatgaaatttctaaaa

SEQ ID NO: 299839 - DNA, 16 bp, C. familiaris
aatgaaatttttggtt

SEQ ID NO: 299840 - DNA, 16 bp, C. familiaris
aatgaacagaatagaa

SEQ ID NO: 299841 - DNA, 16 bp, C. familiaris
aatgaacatgggaatg

SEQ ID NO: 299842 - DNA, 16 bp, C. familiaris
aatgaacctggaccac

SEQ ID NO: 299843 - DNA, 16 bp, C. familiaris
aatgaaccttgaggac

SEQ ID NO: 299844 - DNA, 16 bp, C. familiaris
aatgaactaaatgctc

SEQ ID NO: 299845 - DNA, 16 bp, C. familiaris
aatgaacttaaaaata

SEQ ID NO: 299846 - DNA, 16 bp, C. familiaris
aatgaagaaatcaaag

SEQ ID NO: 299847 - DNA, 16 bp, C. familiaris
aatgaagaaattgaag

SEQ ID NO: 299848 - DNA, 16 bp, C. familiaris
aatgaagatacaacaa

SEQ ID NO: 299849 - DNA, 16 bp, C. familiaris
aatgaagcagaagaaa

SEQ ID NO: 299850 - DNA, 16 bp, C. familiaris
aatgaagcagaataaa

SEQ ID NO: 299851 - DNA, 16 bp, C. familiaris
aatgaagctgaaaaga

SEQ ID NO: 299852 - DNA, 16 bp, C. familiaris
aatgaagctgttaaaa

SEQ ID NO: 299853 - DNA, 16 bp, C. familiaris
aatgaaggcaaaagaa

SEQ ID NO: 299854 - DNA, 16 bp, C. familiaris
aatgaagttgaaaata

SEQ ID NO: 299855 - DNA, 16 bp, C. familiaris
aatgaataaaggaatg

SEQ ID NO: 299856 - DNA, 16 bp, C. familiaris
aatgaatatttcaaaa

SEQ ID NO: 299857 - DNA, 16 bp, C. familiaris
aatgaatattttgaaa

SEQ ID NO: 299858 - DNA, 16 bp, C. familiaris
aatgaatcagtgaatg

SEQ ID NO: 299859 - DNA, 16 bp, C. familiaris
aatgaatctttaaaaa

SEQ ID NO: 299860 - DNA, 16 bp, C. familiaris
aatgaatgaatttctg

SEQ ID NO: 299861 - DNA, 16 bp, C. familiaris
aatgaatgacagcaat

SEQ ID NO: 299862 - DNA, 16 bp, C. familiaris
aatgaatgattttaaa

SEQ ID NO: 299863 - DNA, 16 bp, C. familiaris
aatgaatggataagca

SEQ ID NO: 299864 - DNA, 16 bp, C. familiaris
aatgaatgtttgttga

SEQ ID NO: 299865 - DNA, 16 bp, C. familiaris
aatgaattactagaaa

SEQ ID NO: 299866 - DNA, 16 bp, C. familiaris
aatgaattcttttttt

SEQ ID NO: 299867 - DNA, 16 bp, C. familiaris
aatgaatttttgggac

SEQ ID NO: 299868 - DNA, 16 bp, C. familiaris
aatgacaaataccaac

SEQ ID NO: 299869 - DNA, 16 bp, C. familiaris
aatgacaacaacaaca

SEQ ID NO: 299870 - DNA, 16 bp, C. familiaris
aatgacaattttattt

SEQ ID NO: 299871 - DNA, 16 bp, C. familiaris
aatgacacactggatc

SEQ ID NO: 299872 - DNA, 16 bp, C. familiaris
aatgacagtctcagaa

SEQ ID NO: 299873 - DNA, 16 bp, C. familiaris
aatgacatatttaaaa

SEQ ID NO: 299874 - DNA, 16 bp, C. familiaris
aatgacatggatggac

SEQ ID NO: 299875 - DNA, 16 bp, C. familiaris
aatgacatttattttt

SEQ ID NO: 299876 - DNA, 16 bp, C. familiaris
aatgacatttctgata

SEQ ID NO: 299877 - DNA, 16 bp, C. familiaris
aatgaccccatcaaag

SEQ ID NO: 299878 - DNA, 16 bp, C. familiaris
aatgacttattttttt

SEQ ID NO: 299879 - DNA, 16 bp, C. familiaris
aatgagaaaaatagtt

SEQ ID NO: 299880 - DNA, 16 bp, C. familiaris
aatgagaaatatttta

SEQ ID NO: 299881 - DNA, 16 bp, C. familiaris
aatgagaactggtgca

SEQ ID NO: 299882 - DNA, 16 bp, C. familiaris
aatgagaagacagaaa

SEQ ID NO: 299883 - DNA, 16 bp, C. familiaris
aatgagacagaagaaa

SEQ ID NO: 299884 - DNA, 16 bp, C. familiaris
aatgagacagagaaaa

SEQ ID NO: 299885 - DNA, 16 bp, C. familiaris
aatgagacccagagag

SEQ ID NO: 299886 - DNA, 16 bp, C. familiaris
aatgagagaaaatact

SEQ ID NO: 299887 - DNA, 16 bp, C. familiaris
aatgagaggcagagag

SEQ ID NO: 299888 - DNA, 16 bp, C. familiaris
aatgagatttcttttt

SEQ ID NO: 299889 - DNA, 16 bp, C. familiaris
aatgagcaaatgaata

SEQ ID NO: 299890 - DNA, 16 bp, C. familiaris
aatgaggaaaacaaag

SEQ ID NO: 299891 - DNA, 16 bp, C. familiaris
aatgaggaaacagaag

SEQ ID NO: 299892 - DNA, 16 bp, C. familiaris
aatgaggaagcagagg

SEQ ID NO: 299893 - DNA, 16 bp, C. familiaris
aatgaggacaataata

SEQ ID NO: 299894 - DNA, 16 bp, C. familiaris
aatgaggcagaagaaa

SEQ ID NO: 299895 - DNA, 16 bp, C. familiaris
aatgagtaaagaagat

SEQ ID NO: 299896 - DNA, 16 bp, C. familiaris
aatgagtactgggtgt

SEQ ID NO: 299897 - DNA, 16 bp, C. familiaris
aatgagtattttaaaa

SEQ ID NO: 299898 - DNA, 16 bp, C. familiaris
aatgagtcaaagaaga

SEQ ID NO: 299899 - DNA, 16 bp, C. familiaris
aatgagtggggaaaat

SEQ ID NO: 299900 - DNA, 16 bp, C. familiaris
aatgataaagaagatg

SEQ ID NO: 299901 - DNA, 16 bp, C. familiaris
aatgataatgaaaatg

SEQ ID NO: 299902 - DNA, 16 bp, C. familiaris
aatgatcatatggttc

SEQ ID NO: 299903 - DNA, 16 bp, C. familiaris
aatgatgatgatgatg

SEQ ID NO: 299904 - DNA, 16 bp, C. familiaris
aatgatggaaatattc

SEQ ID NO: 299905 - DNA, 16 bp, C. familiaris
aatgatggaattagaa

SEQ ID NO: 299906 - DNA, 16 bp, C. familiaris
aatgatgtgaatggag

SEQ ID NO: 299907 - DNA, 16 bp, C. familiaris
aatgattttaaaaaca

SEQ ID NO: 299908 - DNA, 16 bp, C. familiaris
aatgcaaaactacaaa

SEQ ID NO: 299909 - DNA, 16 bp, C. familiaris
aatgcaaaactgtaaa

SEQ ID NO: 299910 - DNA, 16 bp, C. familiaris
aatgcaaagaaatgga

SEQ ID NO: 299911 - DNA, 16 bp, C. familiaris
aatgcaaataaaaact

SEQ ID NO: 299912 - DNA, 16 bp, C. familiaris
aatgcaaatcaaaccc

SEQ ID NO: 299913 - DNA, 16 bp, C. familiaris
aatgcaaatctgatca

SEQ ID NO: 299914 - DNA, 16 bp, C. familiaris
aatgcaaattggtaca

SEQ ID NO: 299915 - DNA, 16 bp, C. familiaris
aatgcaagaaacaaca

SEQ ID NO: 299916 - DNA, 16 bp, C. familiaris
aatgcaatccctctca

SEQ ID NO: 299917 - DNA, 16 bp, C. familiaris
aatgcagagagagagg

SEQ ID NO: 299918 - DNA, 16 bp, C. familiaris
aatgcagccctgctga

SEQ ID NO: 299919 - DNA, 16 bp, C. familiaris
aatgcaggcagcttct

SEQ ID NO: 299920 - DNA, 16 bp, C. familiaris
aatgcatagaaacaaa

SEQ ID NO: 299921 - DNA, 16 bp, C. familiaris
aatgcatttaaatata

SEQ ID NO: 299922 - DNA, 16 bp, C. familiaris
aatgcattttattctt

SEQ ID NO: 299923 - DNA, 16 bp, C. familiaris
aatgccagatctcagg

SEQ ID NO: 299924 - DNA, 16 bp, C. familiaris
aatgccaggacacctg

SEQ ID NO: 299925 - DNA, 16 bp, C. familiaris
aatgccattgacttct

SEQ ID NO: 299926 - DNA, 16 bp, C. familiaris
aatgcccagtgtgatg

SEQ ID NO: 299927 - DNA, 16 bp, C. familiaris
aatgcctggaacatag

SEQ ID NO: 299928 - DNA, 16 bp, C. familiaris
aatgctaatctcttct

SEQ ID NO: 299929 - DNA, 16 bp, C. familiaris
aatgctattggcattt

SEQ ID NO: 299930 - DNA, 16 bp, C. familiaris
aatgctcaataaatgg

SEQ ID NO: 299931 - DNA, 16 bp, C. familiaris
aatgctcattttattt

SEQ ID NO: 299932 - DNA, 16 bp, C. familiaris
aatgctgaaataaaca

SEQ ID NO: 299933 - DNA, 16 bp, C. familiaris
aatgctgctaaaaaca

SEQ ID NO: 299934 - DNA, 16 bp, C. familiaris
aatgctggcaaggatg

SEQ ID NO: 299935 - DNA, 16 bp, C. familiaris
aatgctggggcacctg

SEQ ID NO: 299936 - DNA, 16 bp, C. familiaris
aatgctgtatgatctc

SEQ ID NO: 299937 - DNA, 16 bp, C. familiaris
aatgctgtgtgtgtgt

SEQ ID NO: 299938 - DNA, 16 bp, C. familiaris
aatgcttatttttatt

SEQ ID NO: 299939 - DNA, 16 bp, C. familiaris
aatgcttctgtgaaca

SEQ ID NO: 299940 - DNA, 16 bp, C. familiaris
aatgctttcctttttt

SEQ ID NO: 299941 - DNA, 16 bp, C. familiaris
aatggaaaacaaattt

SEQ ID NO: 299942 - DNA, 16 bp, C. familiaris
aatggaaaacatgaaa

SEQ ID NO: 299943 - DNA, 16 bp, C. familiaris
aatggaaaacccagaa

SEQ ID NO: 299944 - DNA, 16 bp, C. familiaris
aatggaaaatcatttt

SEQ ID NO: 299945 - DNA, 16 bp, C. familiaris
aatggaaaccagaaga

SEQ ID NO: 299946 - DNA, 16 bp, C. familiaris
aatggaaagcccagaa

SEQ ID NO: 299947 - DNA, 16 bp, C. familiaris
aatggaaatgaaaatg

SEQ ID NO: 299948 - DNA, 16 bp, C. familiaris
aatggaaattattttt

SEQ ID NO: 299949 - DNA, 16 bp, C. familiaris
aatggaacaaaatgaa

SEQ ID NO: 299950 - DNA, 16 bp, C. familiaris
aatggaacagaaatag

SEQ ID NO: 299951 - DNA, 16 bp, C. familiaris
aatggaaccacaaaag

SEQ ID NO: 299952 - DNA, 16 bp, C. familiaris
aatggaagaaaatact

SEQ ID NO: 299953 - DNA, 16 bp, C. familiaris
aatggaagaagacatt

SEQ ID NO: 299954 - DNA, 16 bp, C. familiaris
aatggaagaaggtatt

SEQ ID NO: 299955 - DNA, 16 bp, C. familiaris
aatggaaggaaaattt

SEQ ID NO: 299956 - DNA, 16 bp, C. familiaris
aatggaagttcagaga

SEQ ID NO: 299957 - DNA, 16 bp, C. familiaris
aatggaatatcattta

SEQ ID NO: 299958 - DNA, 16 bp, C. familiaris
aatggaatattgttta

SEQ ID NO: 299959 - DNA, 16 bp, C. familiaris
aatggaatcatacaaa

SEQ ID NO: 299960 - DNA, 16 bp, C. familiaris
aatggaatcctacaat

SEQ ID NO: 299961 - DNA, 16 bp, C. familiaris
aatggacaaagaaaat

SEQ ID NO: 299962 - DNA, 16 bp, C. familiaris
aatggacatttgggct

SEQ ID NO: 299963 - DNA, 16 bp, C. familiaris
aatggactcaatgctc

SEQ ID NO: 299964 - DNA, 16 bp, C. familiaris
aatggagaaaagatgg

SEQ ID NO: 299965 - DNA, 16 bp, C. familiaris
aatggagaagatattt

SEQ ID NO: 299966 - DNA, 16 bp, C. familiaris
aatggagctgggaaaa

SEQ ID NO: 299967 - DNA, 16 bp, C. familiaris
aatggaggaaaatatt

SEQ ID NO: 299968 - DNA, 16 bp, C. familiaris
aatggagttaataatt

SEQ ID NO: 299969 - DNA, 16 bp, C. familiaris
aatggataaaaaagca

SEQ ID NO: 299970 - DNA, 16 bp, C. familiaris
aatggataaactgtgg

SEQ ID NO: 299971 - DNA, 16 bp, C. familiaris
aatggataagaagatg

SEQ ID NO: 299972 - DNA, 16 bp, C. familiaris
aatggataatgaagat

SEQ ID NO: 299973 - DNA, 16 bp, C. familiaris
aatggatacacaaaat

SEQ ID NO: 299974 - DNA, 16 bp, C. familiaris
aatggatacagaaaaa

SEQ ID NO: 299975 - DNA, 16 bp, C. familiaris
aatggatagtctttct

SEQ ID NO: 299976 - DNA, 16 bp, C. familiaris
aatggatatagaaaat

SEQ ID NO: 299977 - DNA, 16 bp, C. familiaris
aatggatatggattta

SEQ ID NO: 299978 - DNA, 16 bp, C. familiaris
aatggatattattcag

SEQ ID NO: 299979 - DNA, 16 bp, C. familiaris
aatggatattgtattt

SEQ ID NO: 299980 - DNA, 16 bp, C. familiaris
aatggatatttgagtt

SEQ ID NO: 299981 - DNA, 16 bp, C. familiaris
aatggatgaaagaact

SEQ ID NO: 299982 - DNA, 16 bp, C. familiaris
aatggatgaagaaaat

SEQ ID NO: 299983 - DNA, 16 bp, C. familiaris
aatggatgaataatat

SEQ ID NO: 299984 - DNA, 16 bp, C. familiaris
aatggatgaggaagat

SEQ ID NO: 299985 - DNA, 16 bp, C. familiaris
aatggatttggaagtt

SEQ ID NO: 299986 - DNA, 16 bp, C. familiaris
aatggatttttaaaag

SEQ ID NO: 299987 - DNA, 16 bp, C. familiaris
aatggcacagccactc

SEQ ID NO: 299988 - DNA, 16 bp, C. familiaris
aatggcagaaaaaaat

SEQ ID NO: 299989 - DNA, 16 bp, C. familiaris
aatggcagagctgggg

SEQ ID NO: 299990 - DNA, 16 bp, C. familiaris
aatggcagagttgagt

SEQ ID NO: 299991 - DNA, 16 bp, C. familiaris
aatggcaggatttcct

SEQ ID NO: 299992 - DNA, 16 bp, C. familiaris
aatggcataaagcaaa

SEQ ID NO: 299993 - DNA, 16 bp, C. familiaris
aatggcattttaattt

SEQ ID NO: 299994 - DNA, 16 bp, C. familiaris
aatggcattttttata

SEQ ID NO: 299995 - DNA, 16 bp, C. familiaris
aatggccaaaatccaa

SEQ ID NO: 299996 - DNA, 16 bp, C. familiaris
aatggctaacattaaa

SEQ ID NO: 299997 - DNA, 16 bp, C. familiaris
aatggctggtatcaaa

SEQ ID NO: 299998 - DNA, 16 bp, C. familiaris
aatggcttaaaacaat

SEQ ID NO: 299999 - DNA, 16 bp, C. familiaris
aatgggaaaaaatcag

SEQ ID NO: 300000 - DNA, 16 bp, C. familiaris
aatgggaaaaatattt

SEQ ID NO: 300001 - DNA, 16 bp, C. familiaris
aatgggaaaaggacag

SEQ ID NO: 300002 - DNA, 16 bp, C. familiaris
aatgggaataccagaa

SEQ ID NO: 300003 - DNA, 16 bp, C. familiaris
aatgggagaaaaattt

SEQ ID NO: 300004 - DNA, 16 bp, C. familiaris
aatgggagaaaacatt

SEQ ID NO: 300005 - DNA, 16 bp, C. familiaris
aatgggatttatttct

SEQ ID NO: 300006 - DNA, 16 bp, C. familiaris
aatggggaaaaatcag

SEQ ID NO: 300007 - DNA, 16 bp, C. familiaris
aatggggacctcagtc

SEQ ID NO: 300008 - DNA, 16 bp, C. familiaris
aatgggtgaaggtggt

SEQ ID NO: 300009 - DNA, 16 bp, C. familiaris
aatgggtgaattatat

SEQ ID NO: 300010 - DNA, 16 bp, C. familiaris
aatggtaaatatatag

SEQ ID NO: 300011 - DNA, 16 bp, C. familiaris
aatggtactgtaatag

SEQ ID NO: 300012 - DNA, 16 bp, C. familiaris
aatggtcaaaatccag

SEQ ID NO: 300013 - DNA, 16 bp, C. familiaris
aatggttaaaattgta

SEQ ID NO: 300014 - DNA, 16 bp, C. familiaris
aatggttctcaaattt

SEQ ID NO: 300015 - DNA, 16 bp, C. familiaris
aatggttttggaaaaa

SEQ ID NO: 300016 - DNA, 16 bp, C. familiaris
aatgtaaaaattctca

SEQ ID NO: 300017 - DNA, 16 bp, C. familiaris
aatgtaagacttaaaa

SEQ ID NO: 300018 - DNA, 16 bp, C. familiaris
aatgtaatattattca

SEQ ID NO: 300019 - DNA, 16 bp, C. familiaris
aatgtacagttggatc

SEQ ID NO: 300020 - DNA, 16 bp, C. familiaris
aatgtaccacagtttg

SEQ ID NO: 300021 - DNA, 16 bp, C. familiaris
aatgtactgttggacc

SEQ ID NO: 300022 - DNA, 16 bp, C. familiaris
aatgtatatttaactt

SEQ ID NO: 300023 - DNA, 16 bp, C. familiaris
aatgtattattttctt

SEQ ID NO: 300024 - DNA, 16 bp, C. familiaris
aatgtattcaatttaa

SEQ ID NO: 300025 - DNA, 16 bp, C. familiaris
aatgtatttttcatat

SEQ ID NO: 300026 - DNA, 16 bp, C. familiaris
aatgtcaaagaatttg

SEQ ID NO: 300027 - DNA, 16 bp, C. familiaris
aatgtcaccaaagaag

SEQ ID NO: 300028 - DNA, 16 bp, C. familiaris
aatgtcactgaattgt

SEQ ID NO: 300029 - DNA, 16 bp, C. familiaris
aatgtcactttttaaa

SEQ ID NO: 300030 - DNA, 16 bp, C. familiaris
aatgtccaccaacaga

SEQ ID NO: 300031 - DNA, 16 bp, C. familiaris
aatgtccagggccaga

SEQ ID NO: 300032 - DNA, 16 bp, C. familiaris
aatgtccattcaagtc

SEQ ID NO: 300033 - DNA, 16 bp, C. familiaris
aatgtccctctttgtc

SEQ ID NO: 300034 - DNA, 16 bp, C. familiaris
aatgtcctcattttaa

SEQ ID NO: 300035 - DNA, 16 bp, C. familiaris
aatgtctctttttaaa

SEQ ID NO: 300036 - DNA, 16 bp, C. familiaris
aatgtctggagacatt

SEQ ID NO: 300037 - DNA, 16 bp, C. familiaris
aatgtcttagtgattt

SEQ ID NO: 300038 - DNA, 16 bp, C. familiaris
aatgtcttcaaggttt

SEQ ID NO: 300039 - DNA, 16 bp, C. familiaris
aatgtcttctttggag

SEQ ID NO: 300040 - DNA, 16 bp, C. familiaris
aatgtcttttcatttc

SEQ ID NO: 300041 - DNA, 16 bp, C. familiaris
aatgtgaactggtaca

SEQ ID NO: 300042 - DNA, 16 bp, C. familiaris
aatgtgagaaaatatt

SEQ ID NO: 300043 - DNA, 16 bp, C. familiaris
aatgtgatttataata

SEQ ID NO: 300044 - DNA, 16 bp, C. familiaris
aatgtgatttttttcc

SEQ ID NO: 300045 - DNA, 16 bp, C. familiaris
aatgtgcagccaagtt

SEQ ID NO: 300046 - DNA, 16 bp, C. familiaris
aatgtggagaaaggag

SEQ ID NO: 300047 - DNA, 16 bp, C. familiaris
aatgtggatggaacca

SEQ ID NO: 300048 - DNA, 16 bp, C. familiaris
aatgtggctactaaaa

SEQ ID NO: 300049 - DNA, 16 bp, C. familiaris
aatgtggctgtgttcc

SEQ ID NO: 300050 - DNA, 17 bp, C. familiaris
aatgtgggaactgccaa

SEQ ID NO: 300051 - DNA, 17 bp, C. familiaris
aatgtgggagctgccaa

SEQ ID NO: 300052 - DNA, 16 bp, C. familiaris
aatgtggtaaaatata

SEQ ID NO: 300053 - DNA, 16 bp, C. familiaris
aatgtgtgtgagtgtg

SEQ ID NO: 300054 - DNA, 16 bp, C. familiaris
aatgttaaaagaagtt

SEQ ID NO: 300055 - DNA, 16 bp, C. familiaris
aatgttacaactgaag

SEQ ID NO: 300056 - DNA, 16 bp, C. familiaris
aatgttagaaagccaa

SEQ ID NO: 300057 - DNA, 16 bp, C. familiaris
aatgttagccattctg

SEQ ID NO: 300058 - DNA, 16 bp, C. familiaris
aatgttcagagcagca

SEQ ID NO: 300059 - DNA, 16 bp, C. familiaris
aatgttccatgtgtgc

SEQ ID NO: 300060 - DNA, 16 bp, C. familiaris
aatgttgaaaatgaaa

SEQ ID NO: 300061 - DNA, 16 bp, C. familiaris
aatgttgcagaggatg

SEQ ID NO: 300062 - DNA, 35 bp, C. familiaris
aatgttggagaggatgcggagaaaagggaaccctc

SEQ ID NO: 300063 - DNA, 16 bp, C. familiaris
aatgttgttttgcttt

SEQ ID NO: 300064 - DNA, 16 bp, C. familiaris
aatgtttcagaaaaaa

SEQ ID NO: 300065 - DNA, 16 bp, C. familiaris
aatgtttcattatttt

SEQ ID NO: 300066 - DNA, 16 bp, C. familiaris
aatgtttctccatccc

SEQ ID NO: 300067 - DNA, 16 bp, C. familiaris
aatgtttctccatcct

SEQ ID NO: 300068 - DNA, 16 bp, C. familiaris
aatgtttctttccttt

SEQ ID NO: 300069 - DNA, 16 bp, C. familiaris
aatgtttctttttaaa

SEQ ID NO: 300070 - DNA, 16 bp, C. familiaris
aatgtttgcaaatcat

SEQ ID NO: 300071 - DNA, 16 bp, C. familiaris
aatgtttgtccttttc

SEQ ID NO: 300072 - DNA, 16 bp, C. familiaris
aatgttttcatgtttt

SEQ ID NO: 300073 - DNA, 16 bp, C. familiaris
aatgttttcattttaa

SEQ ID NO: 300074 - DNA, 16 bp, C. familiaris
aatgttttctagtttt

SEQ ID NO: 300075 - DNA, 16 bp, C. familiaris
aatgttttctttttaa

SEQ ID NO: 300076 - DNA, 16 bp, C. familiaris
aatgtttttatatgaa

SEQ ID NO: 300077 - DNA, 16 bp, C. familiaris
aatgtttttctttcca

SEQ ID NO: 300078 - DNA, 16 bp, C. familiaris
aatgtttttgtattct

SEQ ID NO: 300079 - DNA, 16 bp, C. familiaris
aattaaaaaatggcaa

SEQ ID NO: 300080 - DNA, 16 bp, C. familiaris
aattaaaaaccttctg

SEQ ID NO: 300081 - DNA, 16 bp, C. familiaris
aattaaaaagtacttt

SEQ ID NO: 300082 - DNA, 16 bp, C. familiaris
aattaaaaatggatga

SEQ ID NO: 300083 - DNA, 16 bp, C. familiaris
aattaaaacagtgtgg

SEQ ID NO: 300084 - DNA, 16 bp, C. familiaris
aattaaaactgaaaat

SEQ ID NO: 300085 - DNA, 16 bp, C. familiaris
aattaaaactgcaatg

SEQ ID NO: 300086 - DNA, 16 bp, C. familiaris
aattaaaagaaatctt

SEQ ID NO: 300087 - DNA, 16 bp, C. familiaris
aattaaaagacaatga

SEQ ID NO: 300088 - DNA, 16 bp, C. familiaris
aattaaaagacataga

SEQ ID NO: 300089 - DNA, 16 bp, C. familiaris
aattaaaagtaatcaa

SEQ ID NO: 300090 - DNA, 16 bp, C. familiaris
aattaaaatgaggcca

SEQ ID NO: 300091 - DNA, 16 bp, C. familiaris
aattaaaattttagag

SEQ ID NO: 300092 - DNA, 16 bp, C. familiaris
aattaaagaaattcat

SEQ ID NO: 300093 - DNA, 16 bp, C. familiaris
aattaaagagagaaca

SEQ ID NO: 300094 - DNA, 16 bp, C. familiaris
aattaaatatagaact

SEQ ID NO: 300095 - DNA, 16 bp, C. familiaris
aattaaatgaggtcat

SEQ ID NO: 300096 - DNA, 16 bp, C. familiaris
aattaacacaagaaac

SEQ ID NO: 300097 - DNA, 16 bp, C. familiaris
aattaacctctctgtg

SEQ ID NO: 300098 - DNA, 16 bp, C. familiaris
aattaacttaaccaag

SEQ ID NO: 300099 - DNA, 16 bp, C. familiaris
aattaaggcacagaga

SEQ ID NO: 300100 - DNA, 16 bp, C. familiaris
aattaaggggaaagga

SEQ ID NO: 300101 - DNA, 16 bp, C. familiaris
aattacaaaatgggca

SEQ ID NO: 300102 - DNA, 16 bp, C. familiaris
aattacagaaggaaaa

SEQ ID NO: 300103 - DNA, 16 bp, C. familiaris
aattacaggaagaaaa

SEQ ID NO: 300104 - DNA, 16 bp, C. familiaris
aattacatctcaatta

SEQ ID NO: 300105 - DNA, 16 bp, C. familiaris
aattacatgaagaaaa

SEQ ID NO: 300106 - DNA, 16 bp, C. familiaris
aattacattttgtttt

SEQ ID NO: 300107 - DNA, 16 bp, C. familiaris
aattaccaaacatctg

SEQ ID NO: 300108 - DNA, 16 bp, C. familiaris
aattacctctctaaag

SEQ ID NO: 300109 - DNA, 16 bp, C. familiaris
aattactgaaatattt

SEQ ID NO: 300110 - DNA, 16 bp, C. familiaris
aattactgttaatttt

SEQ ID NO: 300111 - DNA, 16 bp, C. familiaris
aattagaaaatactga

SEQ ID NO: 300112 - DNA, 16 bp, C. familiaris
aattagatagtgatga

SEQ ID NO: 300113 - DNA, 16 bp, C. familiaris
aattagtgacctagaa

SEQ ID NO: 300114 - DNA, 16 bp, C. familiaris
aattataaaacttcta

SEQ ID NO: 300115 - DNA, 16 bp, C. familiaris
aattatacttgaaaaa

SEQ ID NO: 300116 - DNA, 16 bp, C. familiaris
aattatatatgtgtat

SEQ ID NO: 300117 - DNA, 16 bp, C. familiaris
aattatatgacaacaa

SEQ ID NO: 300118 - DNA, 16 bp, C. familiaris
aattatattcacaatg

SEQ ID NO: 300119 - DNA, 16 bp, C. familiaris
aattatcctcatttta

SEQ ID NO: 300120 - DNA, 16 bp, C. familiaris
aattatgaaaagagcc

SEQ ID NO: 300121 - DNA, 16 bp, C. familiaris
aattatgtagaaaaca

SEQ ID NO: 300122 - DNA, 16 bp, C. familiaris
aattattgatagataa

SEQ ID NO: 300123 - DNA, 16 bp, C. familiaris
aattatttcaaaagaa

SEQ ID NO: 300124 - DNA, 16 bp, C. familiaris
aattatttcaaatgtt

SEQ ID NO: 300125 - DNA, 16 bp, C. familiaris
aattattttcagtttt

SEQ ID NO: 300126 - DNA, 16 bp, C. familiaris
aattattttgagaaaa

SEQ ID NO: 300127 - DNA, 16 bp, C. familiaris
aattattttgaggatt

SEQ ID NO: 300128 - DNA, 16 bp, C. familiaris
aattcaaaacaatgat

SEQ ID NO: 300129 - DNA, 16 bp, C. familiaris
aattcaaacatgtgga

SEQ ID NO: 300130 - DNA, 16 bp, C. familiaris
aattcaaagaaaacat

SEQ ID NO: 300131 - DNA, 16 bp, C. familiaris
aattcaaattcaattt

SEQ ID NO: 300132 - DNA, 16 bp, C. familiaris
aattcaaatttaaatg

SEQ ID NO: 300133 - DNA, 16 bp, C. familiaris
aattcaagaaaacttt

SEQ ID NO: 300134 - DNA, 16 bp, C. familiaris
aattcaagaaacagaa

SEQ ID NO: 300135 - DNA, 16 bp, C. familiaris
aattcaatgaatattt

SEQ ID NO: 300136 - DNA, 16 bp, C. familiaris
aattcaatttcaaaat

SEQ ID NO: 300137 - DNA, 16 bp, C. familiaris
aattcacgaccctgag

SEQ ID NO: 300138 - DNA, 16 bp, C. familiaris
aattcagatgttgaag

SEQ ID NO: 300139 - DNA, 16 bp, C. familiaris
aattcagcaagtattt

SEQ ID NO: 300140 - DNA, 16 bp, C. familiaris
aattcaggaaatttaa

SEQ ID NO: 300141 - DNA, 16 bp, C. familiaris
aattcagtcccatctt

SEQ ID NO: 300142 - DNA, 16 bp, C. familiaris
aattcagttttctaat

SEQ ID NO: 300143 - DNA, 16 bp, C. familiaris
aattcatccatttttt

SEQ ID NO: 300144 - DNA, 16 bp, C. familiaris
aattcattgatttttt

SEQ ID NO: 300145 - DNA, 16 bp, C. familiaris
aattccaagcaggctc

SEQ ID NO: 300146 - DNA, 16 bp, C. familiaris
aattccaagtaattta

SEQ ID NO: 300147 - DNA, 16 bp, C. familiaris
aattccagacttcagg

SEQ ID NO: 300148 - DNA, 16 bp, C. familiaris
aattccatttttaaat

SEQ ID NO: 300149 - DNA, 16 bp, C. familiaris
aattcccagcagtgca

SEQ ID NO: 300150 - DNA, 16 bp, C. familiaris
aattcccttcttctct

SEQ ID NO: 300151 - DNA, 16 bp, C. familiaris
aattccctttaacatt

SEQ ID NO: 300152 - DNA, 16 bp, C. familiaris
aattcctataaaaatc

SEQ ID NO: 300153 - DNA, 16 bp, C. familiaris
aattcctataataaat

SEQ ID NO: 300154 - DNA, 16 bp, C. familiaris
aattcctcaaagaatt

SEQ ID NO: 300155 - DNA, 16 bp, C. familiaris
aattcctcataataaa

SEQ ID NO: 300156 - DNA, 16 bp, C. familiaris
aattcctcctgaagaa

SEQ ID NO: 300157 - DNA, 16 bp, C. familiaris
aattctaaagaaaata

SEQ ID NO: 300158 - DNA, 16 bp, C. familiaris
aattctaatggcattt

SEQ ID NO: 300159 - DNA, 16 bp, C. familiaris
aattctactactgggt

SEQ ID NO: 300160 - DNA, 16 bp, C. familiaris
aattctcaacaaaatg

SEQ ID NO: 300161 - DNA, 16 bp, C. familiaris
aattctcagcaaaata

SEQ ID NO: 300162 - DNA, 16 bp, C. familiaris
aattctccaaagaaga

SEQ ID NO: 300163 - DNA, 16 bp, C. familiaris
aattctgaaaaagaac

SEQ ID NO: 300164 - DNA, 16 bp, C. familiaris
aattctgaaaataatt

SEQ ID NO: 300165 - DNA, 16 bp, C. familiaris
aattctgaattccaaa

SEQ ID NO: 300166 - DNA, 16 bp, C. familiaris
aattctgacactgtct

SEQ ID NO: 300167 - DNA, 16 bp, C. familiaris
aattctggaaaataca

SEQ ID NO: 300168 - DNA, 16 bp, C. familiaris
aattctggaattgtga

SEQ ID NO: 300169 - DNA, 16 bp, C. familiaris
aattctggagactgga

SEQ ID NO: 300170 - DNA, 16 bp, C. familiaris
aattctggccaatgag

SEQ ID NO: 300171 - DNA, 16 bp, C. familiaris
aattctgggttttttt

SEQ ID NO: 300172 - DNA, 16 bp, C. familiaris
aattctgtgaaggctg

SEQ ID NO: 300173 - DNA, 16 bp, C. familiaris
aattctgtggcagaga

SEQ ID NO: 300174 - DNA, 16 bp, C. familiaris
aattctgttttcattt

SEQ ID NO: 300175 - DNA, 16 bp, C. familiaris
aattctgtttttaatt

SEQ ID NO: 300176 - DNA, 16 bp, C. familiaris
aattctgtttttcttc

SEQ ID NO: 300177 - DNA, 16 bp, C. familiaris
aattcttgaaggaaat

SEQ ID NO: 300178 - DNA, 16 bp, C. familiaris
aattctttaaaaaaga

SEQ ID NO: 300179 - DNA, 16 bp, C. familiaris
aattctttaaaatatc

SEQ ID NO: 300180 - DNA, 16 bp, C. familiaris
aattctttaaacattt

SEQ ID NO: 300181 - DNA, 16 bp, C. familiaris
aattcttttaatgtat

SEQ ID NO: 300182 - DNA, 16 bp, C. familiaris
aattctttttggtggg

SEQ ID NO: 300183 - DNA, 16 bp, C. familiaris
aattgaaaaggaaaac

SEQ ID NO: 300184 - DNA, 16 bp, C. familiaris
aattgaaacaaaaatt

SEQ ID NO: 300185 - DNA, 16 bp, C. familiaris
aattgaaactctgtac

SEQ ID NO: 300186 - DNA, 16 bp, C. familiaris
aattgaaagactaaag

SEQ ID NO: 300187 - DNA, 16 bp, C. familiaris
aattgaaataaaaact

SEQ ID NO: 300188 - DNA, 16 bp, C. familiaris
aattgaagacacaaag

SEQ ID NO: 300189 - DNA, 16 bp, C. familiaris
aattgaattcaaataa

SEQ ID NO: 300190 - DNA, 16 bp, C. familiaris
aattgaatttaaacaa

SEQ ID NO: 300191 - DNA, 16 bp, C. familiaris
aattgacaagtaaaat

SEQ ID NO: 300192 - DNA, 16 bp, C. familiaris
aattgacttatttttt

SEQ ID NO: 300193 - DNA, 16 bp, C. familiaris
aattgaggaagtcaca

SEQ ID NO: 300194 - DNA, 16 bp, C. familiaris
aattgagtggaaggta

SEQ ID NO: 300195 - DNA, 16 bp, C. familiaris
aattgatgcaaccact

SEQ ID NO: 300196 - DNA, 16 bp, C. familiaris
aattgatttcttaatt

SEQ ID NO: 300197 - DNA, 16 bp, C. familiaris
aattgcactacagggt

SEQ ID NO: 300198 - DNA, 16 bp, C. familiaris
aattgctctttaaaaa

SEQ ID NO: 300199 - DNA, 16 bp, C. familiaris
aattgctggattgtat

SEQ ID NO: 300200 - DNA, 16 bp, C. familiaris
aattggaaaatgaaat

SEQ ID NO: 300201 - DNA, 16 bp, C. familiaris
aattggaagtttgtat

SEQ ID NO: 300202 - DNA, 16 bp, C. familiaris
aattggaattttgata

SEQ ID NO: 300203 - DNA, 16 bp, C. familiaris
aattggagaaaaacaa

SEQ ID NO: 300204 - DNA, 16 bp, C. familiaris
aattggagaagaacaa

SEQ ID NO: 300205 - DNA, 16 bp, C. familiaris
aattggatattcatat

SEQ ID NO: 300206 - DNA, 16 bp, C. familiaris
aattggatatttacat

SEQ ID NO: 300207 - DNA, 16 bp, C. familiaris
aattggtagagcatgt

SEQ ID NO: 300208 - DNA, 16 bp, C. familiaris
aattgtatttctttat

SEQ ID NO: 300209 - DNA, 16 bp, C. familiaris
aattgtggaagcagcc

SEQ ID NO: 300210 - DNA, 16 bp, C. familiaris
aattgttaacattttg

SEQ ID NO: 300211 - DNA, 16 bp, C. familiaris
aattgttggcaaggat

SEQ ID NO: 300212 - DNA, 16 bp, C. familiaris
aatttaaaaagtcaag

SEQ ID NO: 300213 - DNA, 16 bp, C. familiaris
aatttaaaaatcactt

SEQ ID NO: 300214 - DNA, 16 bp, C. familiaris
aatttaaaaatgggga

SEQ ID NO: 300215 - DNA, 16 bp, C. familiaris
aatttaaacatgtttt

SEQ ID NO: 300216 - DNA, 16 bp, C. familiaris
aatttaaatggaatta

SEQ ID NO: 300217 - DNA, 16 bp, C. familiaris
aatttaaatttcagtg

SEQ ID NO: 300218 - DNA, 16 bp, C. familiaris
aatttaatgtcagaaa

SEQ ID NO: 300219 - DNA, 16 bp, C. familiaris
aatttaatttcattgt

SEQ ID NO: 300220 - DNA, 16 bp, C. familiaris
aatttacatttaaagt

SEQ ID NO: 300221 - DNA, 16 bp, C. familiaris
aatttaccagtgaaac

SEQ ID NO: 300222 - DNA, 16 bp, C. familiaris
aatttagaaaatacaa

SEQ ID NO: 300223 - DNA, 16 bp, C. familiaris
aatttagaacattttt

SEQ ID NO: 300224 - DNA, 16 bp, C. familiaris
aatttagaagaaactc

SEQ ID NO: 300225 - DNA, 16 bp, C. familiaris
aatttagattcttcta

SEQ ID NO: 300226 - DNA, 16 bp, C. familiaris
aatttagcatttcctt

SEQ ID NO: 300227 - DNA, 16 bp, C. familiaris
aatttatcaaacattt

SEQ ID NO: 300228 - DNA, 16 bp, C. familiaris
aatttatcatccaaat

SEQ ID NO: 300229 - DNA, 16 bp, C. familiaris
aatttatccacttctt

SEQ ID NO: 300230 - DNA, 16 bp, C. familiaris
aatttatttcaaagtt

SEQ ID NO: 300231 - DNA, 16 bp, C. familiaris
aatttatttgagagac

SEQ ID NO: 300232 - DNA, 16 bp, C. familiaris
aatttattttccaaaa

SEQ ID NO: 300233 - DNA, 16 bp, C. familiaris
aatttcaaattgtttt

SEQ ID NO: 300234 - DNA, 16 bp, C. familiaris
aatttcaaatttcagt

SEQ ID NO: 300235 - DNA, 16 bp, C. familiaris
aatttcaacaaagaga

SEQ ID NO: 300236 - DNA, 16 bp, C. familiaris
aatttcaccaaagaaa

SEQ ID NO: 300237 - DNA, 16 bp, C. familiaris
aatttcagaaaaggaa

SEQ ID NO: 300238 - DNA, 16 bp, C. familiaris
aatttcagaaacaaaa

SEQ ID NO: 300239 - DNA, 16 bp, C. familiaris
aatttcagaaatatat

SEQ ID NO: 300240 - DNA, 16 bp, C. familiaris
aatttcagaaattaaa

SEQ ID NO: 300241 - DNA, 16 bp, C. familiaris
aatttcagaacatttc

SEQ ID NO: 300242 - DNA, 16 bp, C. familiaris
aatttcagaaggaaaa

SEQ ID NO: 300243 - DNA, 16 bp, C. familiaris
aatttcatttgtaaaa

SEQ ID NO: 300244 - DNA, 16 bp, C. familiaris
aatttcctaattttga

SEQ ID NO: 300245 - DNA, 16 bp, C. familiaris
aatttcctccttggtt

SEQ ID NO: 300246 - DNA, 16 bp, C. familiaris
aatttccttcagaagt

SEQ ID NO: 300247 - DNA, 16 bp, C. familiaris
aatttccttttctgtg

SEQ ID NO: 300248 - DNA, 16 bp, C. familiaris
aatttctacaaagaaa

SEQ ID NO: 300249 - DNA, 16 bp, C. familiaris
aatttctagaaaaaaa

SEQ ID NO: 300250 - DNA, 16 bp, C. familiaris
aatttctagaatttct

SEQ ID NO: 300251 - DNA, 16 bp, C. familiaris
aatttctctctctctc

SEQ ID NO: 300252 - DNA, 16 bp, C. familiaris
aatttctgaaattaaa

SEQ ID NO: 300253 - DNA, 16 bp, C. familiaris
aatttctgattcagta

SEQ ID NO: 300254 - DNA, 16 bp, C. familiaris
aatttcttgaggaacc

SEQ ID NO: 300255 - DNA, 16 bp, C. familiaris
aatttctttgcctttt

SEQ ID NO: 300256 - DNA, 16 bp, C. familiaris
aatttgaaaagctata

SEQ ID NO: 300257 - DNA, 16 bp, C. familiaris
aatttgaaaatttgaa

SEQ ID NO: 300258 - DNA, 16 bp, C. familiaris
aatttgaaacattttt

SEQ ID NO: 300259 - DNA, 16 bp, C. familiaris
aatttgaaaggaagaa

SEQ ID NO: 300260 - DNA, 16 bp, C. familiaris
aatttgaaatgccttt

SEQ ID NO: 300261 - DNA, 16 bp, C. familiaris
aatttgaagatatttt

SEQ ID NO: 300262 - DNA, 16 bp, C. familiaris
aatttgaatctcagat

SEQ ID NO: 300263 - DNA, 16 bp, C. familiaris
aatttgacaacttaga

SEQ ID NO: 300264 - DNA, 16 bp, C. familiaris
aatttgagaaaaatct

SEQ ID NO: 300265 - DNA, 16 bp, C. familiaris
aatttgagaaacaaaa

SEQ ID NO: 300266 - DNA, 16 bp, C. familiaris
aatttgatgaaaacta

SEQ ID NO: 300267 - DNA, 16 bp, C. familiaris
aatttgcaaatatttt

SEQ ID NO: 300268 - DNA, 16 bp, C. familiaris
aatttgcattgttttt

SEQ ID NO: 300269 - DNA, 16 bp, C. familiaris
aatttgcatttaaaat

SEQ ID NO: 300270 - DNA, 16 bp, C. familiaris
aatttgcatttctgtg

SEQ ID NO: 300271 - DNA, 16 bp, C. familiaris
aatttgcattttttat

SEQ ID NO: 300272 - DNA, 16 bp, C. familiaris
aatttgcctaaagtca

SEQ ID NO: 300273 - DNA, 16 bp, C. familiaris
aatttgctaagaaagt

SEQ ID NO: 300274 - DNA, 16 bp, C. familiaris
aatttggaaaaacaaa

SEQ ID NO: 300275 - DNA, 16 bp, C. familiaris
aatttggaaacatttt

SEQ ID NO: 300276 - DNA, 16 bp, C. familiaris
aatttggaaataaatt

SEQ ID NO: 300277 - DNA, 16 bp, C. familiaris
aatttggagaaaatat

SEQ ID NO: 300278 - DNA, 16 bp, C. familiaris
aatttggagaaagaaa

SEQ ID NO: 300279 - DNA, 16 bp, C. familiaris
aatttggatgattttt

SEQ ID NO: 300280 - DNA, 16 bp, C. familiaris
aatttggatttgtctg

SEQ ID NO: 300281 - DNA, 16 bp, C. familiaris
aatttgggaaagaaaa

SEQ ID NO: 300282 - DNA, 16 bp, C. familiaris
aatttgggagaaaata

SEQ ID NO: 300283 - DNA, 16 bp, C. familiaris
aatttgtaaggaagaa

SEQ ID NO: 300284 - DNA, 16 bp, C. familiaris
aatttgtgtattttct

SEQ ID NO: 300285 - DNA, 16 bp, C. familiaris
aattttaaaaagtgat

SEQ ID NO: 300286 - DNA, 16 bp, C. familiaris
aattttaaaagaggaa

SEQ ID NO: 300287 - DNA, 16 bp, C. familiaris
aattttaaaagcatca

SEQ ID NO: 300288 - DNA, 16 bp, C. familiaris
aattttaaagcatttt

SEQ ID NO: 300289 - DNA, 16 bp, C. familiaris
aattttaacaaaagaa

SEQ ID NO: 300290 - DNA, 16 bp, C. familiaris
aattttaagagatttt

SEQ ID NO: 300291 - DNA, 16 bp, C. familiaris
aattttaagagttctt

SEQ ID NO: 300292 - DNA, 16 bp, C. familiaris
aattttaatggaaatt

SEQ ID NO: 300293 - DNA, 16 bp, C. familiaris
aattttacagaaaaaa

SEQ ID NO: 300294 - DNA, 16 bp, C. familiaris
aattttacctcaaaaa

SEQ ID NO: 300295 - DNA, 16 bp, C. familiaris
aattttagagcatttt

SEQ ID NO: 300296 - DNA, 16 bp, C. familiaris
aattttaggattgctt

SEQ ID NO: 300297 - DNA, 16 bp, C. familiaris
aattttagtacatttt

SEQ ID NO: 300298 - DNA, 16 bp, C. familiaris
aattttatatttgctt

SEQ ID NO: 300299 - DNA, 16 bp, C. familiaris
aattttatttatctgt

SEQ ID NO: 300300 - DNA, 16 bp, C. familiaris
aattttatttctttgg

SEQ ID NO: 300301 - DNA, 16 bp, C. familiaris
aattttcagaaaaaga

SEQ ID NO: 300302 - DNA, 16 bp, C. familiaris
aattttcagaaaaata

SEQ ID NO: 300303 - DNA, 16 bp, C. familiaris
aattttcagaaaatat

SEQ ID NO: 300304 - DNA, 16 bp, C. familiaris
aattttcagaggaaaa

SEQ ID NO: 300305 - DNA, 16 bp, C. familiaris
aattttcaggaaaaaa

SEQ ID NO: 300306 - DNA, 16 bp, C. familiaris
aattttccaaatattt

SEQ ID NO: 300307 - DNA, 16 bp, C. familiaris
aattttccaaatgaaa

SEQ ID NO: 300308 - DNA, 16 bp, C. familiaris
aattttctcagcacca

SEQ ID NO: 300309 - DNA, 16 bp, C. familiaris
aattttctcatcttta

SEQ ID NO: 300310 - DNA, 16 bp, C. familiaris
aattttctgaaaaaga

SEQ ID NO: 300311 - DNA, 16 bp, C. familiaris
aattttctgaggaatc

SEQ ID NO: 300312 - DNA, 16 bp, C. familiaris
aattttctgcattttt

SEQ ID NO: 300313 - DNA, 16 bp, C. familiaris
aattttgaagaagaaa

SEQ ID NO: 300314 - DNA, 16 bp, C. familiaris
aattttgacatatgta

SEQ ID NO: 300315 - DNA, 16 bp, C. familiaris
aattttgaggaaaaaa

SEQ ID NO: 300316 - DNA, 16 bp, C. familiaris
aattttgataaagttc

SEQ ID NO: 300317 - DNA, 16 bp, C. familiaris
aattttgcaaagaaaa

SEQ ID NO: 300318 - DNA, 16 bp, C. familiaris
aattttgcatttttgt

SEQ ID NO: 300319 - DNA, 16 bp, C. familiaris
aattttggaagaaaaa

SEQ ID NO: 300320 - DNA, 16 bp, C. familiaris
aattttgttttccaaa

SEQ ID NO: 300321 - DNA, 16 bp, C. familiaris
aattttgtttttcact

SEQ ID NO: 300322 - DNA, 16 bp, C. familiaris
aatttttaaagacttt

SEQ ID NO: 300323 - DNA, 16 bp, C. familiaris
aatttttaaagaggaa

SEQ ID NO: 300324 - DNA, 16 bp, C. familiaris
aatttttacatgttaa

SEQ ID NO: 300325 - DNA, 16 bp, C. familiaris
aatttttcaaaagttt

SEQ ID NO: 300326 - DNA, 16 bp, C. familiaris
aatttttgaaaaagat

SEQ ID NO: 300327 - DNA, 16 bp, C. familiaris
aatttttgtagatata

SEQ ID NO: 300328 - DNA, 16 bp, C. familiaris
aatttttgtatgttga

SEQ ID NO: 300329 - DNA, 16 bp, C. familiaris
aatttttgttctttaa

SEQ ID NO: 300330 - DNA, 16 bp, C. familiaris
aatttttgttgaaaaa

SEQ ID NO: 300331 - DNA, 16 bp, C. familiaris
aatttttgtttcaaaa

SEQ ID NO: 300332 - DNA, 16 bp, C. familiaris
aattttttcaagtttt

SEQ ID NO: 300333 - DNA, 16 bp, C. familiaris
aattttttgagagaaa

SEQ ID NO: 300334 - DNA, 16 bp, C. familiaris
aattttttgttgaaaa

SEQ ID NO: 300335 - DNA, 16 bp, C. familiaris
aatttttttcaaaagt

SEQ ID NO: 300336 - DNA, 16 bp, C. familiaris
aatttttttcttcatg

SEQ ID NO: 300337 - DNA, 16 bp, C. familiaris
aattttttttcatgaa

SEQ ID NO: 300338 - DNA, 16 bp, C. familiaris
acaaaaacttgtacaa

SEQ ID NO: 300339 - DNA, 16 bp, C. familiaris
acaaaaagagatggaa

SEQ ID NO: 300340 - DNA, 16 bp, C. familiaris
acaaaaaggagaatta

SEQ ID NO: 300341 - DNA, 16 bp, C. familiaris
acaaaaataccacaga

SEQ ID NO: 300342 - DNA, 16 bp, C. familiaris
acaaaacaaatggaca

SEQ ID NO: 300343 - DNA, 16 bp, C. familiaris
acaaaaccaggagctg

SEQ ID NO: 300344 - DNA, 16 bp, C. familiaris
acaaaactagaggtat

SEQ ID NO: 300345 - DNA, 16 bp, C. familiaris
acaaaagaatatttaa

SEQ ID NO: 300346 - DNA, 16 bp, C. familiaris
acaaaagagatgaaca

SEQ ID NO: 300347 - DNA, 16 bp, C. familiaris
acaaaagatctgaata

SEQ ID NO: 300348 - DNA, 16 bp, C. familiaris
acaaaagcaaaagtga

SEQ ID NO: 300349 - DNA, 16 bp, C. familiaris
acaaaagcccagggcc

SEQ ID NO: 300350 - DNA, 16 bp, C. familiaris
acaaaagctgaaagaa

SEQ ID NO: 300351 - DNA, 16 bp, C. familiaris
acaaaaggaaaatatt

SEQ ID NO: 300352 - DNA, 16 bp, C. familiaris
acaaaataaagaattt

SEQ ID NO: 300353 - DNA, 16 bp, C. familiaris
acaaaatacattattt

SEQ ID NO: 300354 - DNA, 16 bp, C. familiaris
acaaaatagattttaa

SEQ ID NO: 300355 - DNA, 16 bp, C. familiaris
acaaaatattttactt

SEQ ID NO: 300356 - DNA, 16 bp, C. familiaris
acaaaatccaacacct

SEQ ID NO: 300357 - DNA, 16 bp, C. familiaris
acaaaatctctctctc

SEQ ID NO: 300358 - DNA, 16 bp, C. familiaris
acaaaatgagcaaatg

SEQ ID NO: 300359 - DNA, 16 bp, C. familiaris
acaaaatgagcctgga

SEQ ID NO: 300360 - DNA, 16 bp, C. familiaris
acaaaatgatttaaaa

SEQ ID NO: 300361 - DNA, 16 bp, C. familiaris
acaaaatggaaaagca

SEQ ID NO: 300362 - DNA, 16 bp, C. familiaris
acaaaatggaaatttt

SEQ ID NO: 300363 - DNA, 24 bp, C. familiaris
acaaaattggtggtattggtactg

SEQ ID NO: 300364 - DNA, 16 bp, C. familiaris
acaaaatttctgaaaa

SEQ ID NO: 300365 - DNA, 16 bp, C. familiaris
acaaaattttcatttt

SEQ ID NO: 300366 - DNA, 16 bp, C. familiaris
acaaaatttttcttta

SEQ ID NO: 300367 - DNA, 16 bp, C. familiaris
acaaacagaagttaaa

SEQ ID NO: 300368 - DNA, 16 bp, C. familiaris
acaaaccaaggaacag

SEQ ID NO: 300369 - DNA, 16 bp, C. familiaris
acaaaccagaagagac

SEQ ID NO: 300370 - DNA, 16 bp, C. familiaris
acaaacccaaattgaa

SEQ ID NO: 300371 - DNA, 16 bp, C. familiaris
acaaacctttaatttg

SEQ ID NO: 300372 - DNA, 16 bp, C. familiaris
acaaactggacaacct

SEQ ID NO: 300373 - DNA, 16 bp, C. familiaris
acaaagaacaaattgg

SEQ ID NO: 300374 - DNA, 16 bp, C. familiaris
acaaagaaggtaagaa

SEQ ID NO: 300375 - DNA, 16 bp, C. familiaris
acaaagaattcttaaa

SEQ ID NO: 300376 - DNA, 16 bp, C. familiaris
acaaagaccaaatata

SEQ ID NO: 300377 - DNA, 16 bp, C. familiaris
acaaagactccaccaa

SEQ ID NO: 300378 - DNA, 16 bp, C. familiaris
acaaagagacagagac

SEQ ID NO: 300379 - DNA, 16 bp, C. familiaris
acaaagagcctgatgt

SEQ ID NO: 300380 - DNA, 16 bp, C. familiaris
acaaagatcccaccaa

SEQ ID NO: 300381 - DNA, 16 bp, C. familiaris
acaaagcaaaactgaa

SEQ ID NO: 300382 - DNA, 16 bp, C. familiaris
acaaaggagccaagaa

SEQ ID NO: 300383 - DNA, 16 bp, C. familiaris
acaaaggattagtatc

SEQ ID NO: 300384 - DNA, 16 bp, C. familiaris
acaaaggattataaga

SEQ ID NO: 300385 - DNA, 16 bp, C. familiaris
acaaaggcaaaatgaa

SEQ ID NO: 300386 - DNA, 16 bp, C. familiaris
acaaaggccatatatg

SEQ ID NO: 300387 - DNA, 16 bp, C. familiaris
acaaagggctgcagaa

SEQ ID NO: 300388 - DNA, 16 bp, C. familiaris
acaaagggggcaagaa

SEQ ID NO: 300389 - DNA, 16 bp, C. familiaris
acaaaggtccagggcc

SEQ ID NO: 300390 - DNA, 16 bp, C. familiaris
acaaagtataacatcc

SEQ ID NO: 300391 - DNA, 16 bp, C. familiaris
acaaagttgcaggata

SEQ ID NO: 300392 - DNA, 16 bp, C. familiaris
acaaagttttattttt

SEQ ID NO: 300393 - DNA, 16 bp, C. familiaris
acaaataatctgattt

SEQ ID NO: 300394 - DNA, 16 bp, C. familiaris
acaaatacaaagactg

SEQ ID NO: 300395 - DNA, 16 bp, C. familiaris
acaaatacacagaggt

SEQ ID NO: 300396 - DNA, 16 bp, C. familiaris
acaaatacagacacat

SEQ ID NO: 300397 - DNA, 16 bp, C. familiaris
acaaatacatggaaag

SEQ ID NO: 300398 - DNA, 21 bp, C. familiaris
acaaatacccaccatttgctt

SEQ ID NO: 300399 - DNA, 16 bp, C. familiaris
acaaatacttattttt

SEQ ID NO: 300400 - DNA, 16 bp, C. familiaris
acaaatatatgatttc

SEQ ID NO: 300401 - DNA, 16 bp, C. familiaris
acaaatatgtgaagat

SEQ ID NO: 300402 - DNA, 16 bp, C. familiaris
acaaatatttggaaat

SEQ ID NO: 300403 - DNA, 16 bp, C. familiaris
acaaatcagatctcaa

SEQ ID NO: 300404 - DNA, 16 bp, C. familiaris
acaaatcagggcagcc

SEQ ID NO: 300405 - DNA, 16 bp, C. familiaris
acaaatcatgtatctg

SEQ ID NO: 300406 - DNA, 16 bp, C. familiaris
acaaatgaatgaataa

SEQ ID NO: 300407 - DNA, 16 bp, C. familiaris
acaaatgagaacactg

SEQ ID NO: 300408 - DNA, 18 bp, C. familiaris
acaaatgcaatgaaacgc

SEQ ID NO: 300409 - DNA, 16 bp, C. familiaris
acaaatgtattatctc

SEQ ID NO: 300410 - DNA, 19 bp, C. familiaris
acaaatgttggagaggatg

SEQ ID NO: 300411 - DNA, 16 bp, C. familiaris
acaaatgttggtgagg

SEQ ID NO: 300412 - DNA, 16 bp, C. familiaris
acaaattaccacaacc

SEQ ID NO: 300413 - DNA, 16 bp, C. familiaris
acaaattatttcaaga

SEQ ID NO: 300414 - DNA, 16 bp, C. familiaris
acaaattcaaaatgat

SEQ ID NO: 300415 - DNA, 16 bp, C. familiaris
acaaattcctagaaag

SEQ ID NO: 300416 - DNA, 16 bp, C. familiaris
acaaatttgaaagaat

SEQ ID NO: 300417 - DNA, 16 bp, C. familiaris
acaacaaaaaggcatt

SEQ ID NO: 300418 - DNA, 16 bp, C. familiaris
acaacaacaaaagatt

SEQ ID NO: 300419 - DNA, 16 bp, C. familiaris
acaacaacaaaagtat

SEQ ID NO: 300420 - DNA, 16 bp, C. familiaris
acaacaacaacaactg

SEQ ID NO: 300421 - DNA, 16 bp, C. familiaris
acaacaatggacagat

SEQ ID NO: 300422 - DNA, 16 bp, C. familiaris
acaacactaaatgctg

SEQ ID NO: 300423 - DNA, 16 bp, C. familiaris
acaacagcagagctga

SEQ ID NO: 300424 - DNA, 16 bp, C. familiaris
acaacagcagagttga

SEQ ID NO: 300425 - DNA, 16 bp, C. familiaris
acaacagcagcagcag

SEQ ID NO: 300426 - DNA, 18 bp, C. familiaris
acaacagccaaactgtgg

SEQ ID NO: 300427 - DNA, 16 bp, C. familiaris
acaacataatggtttg

SEQ ID NO: 300428 - DNA, 17 bp, C. familiaris
acaacatcaccaaagaa

SEQ ID NO: 300429 - DNA, 27 bp, C. familiaris
acaacatgctggagccaagtgctaaca

SEQ ID NO: 300430 - DNA, 16 bp, C. familiaris
acaacatgggtgaacc

SEQ ID NO: 300431 - DNA, 16 bp, C. familiaris
acaaccaaaaatgttt

SEQ ID NO: 300432 - DNA, 16 bp, C. familiaris
acaaccacactggcgg

SEQ ID NO: 300433 - DNA, 16 bp, C. familiaris
acaaccagtgggtcaa

SEQ ID NO: 300434 - DNA, 16 bp, C. familiaris
acaacccaaagatcaa

SEQ ID NO: 300435 - DNA, 16 bp, C. familiaris
acaacccaagtgtcca

SEQ ID NO: 300436 - DNA, 16 bp, C. familiaris
acaaccctgaaatcat

SEQ ID NO: 300437 - DNA, 16 bp, C. familiaris
acaacctgagccacag

SEQ ID NO: 300438 - DNA, 16 bp, C. familiaris
acaactactttgaaaa

SEQ ID NO: 300439 - DNA, 16 bp, C. familiaris
acaactgaaaaaaatt

SEQ ID NO: 300440 - DNA, 18 bp, C. familiaris
acaacttccaggagaagc

SEQ ID NO: 300441 - DNA, 16 bp, C. familiaris
acaactttcactgagc

SEQ ID NO: 300442 - DNA, 16 bp, C. familiaris
acaactttttaaattt

SEQ ID NO: 300443 - DNA, 16 bp, C. familiaris
acaagaaacaagtgtt

SEQ ID NO: 300444 - DNA, 16 bp, C. familiaris
acaagaaataaatgtt

SEQ ID NO: 300445 - DNA, 16 bp, C. familiaris
acaagaaataatgagt

SEQ ID NO: 300446 - DNA, 16 bp, C. familiaris
acaagaagaaatggaa

SEQ ID NO: 300447 - DNA, 16 bp, C. familiaris
acaagaagagatttgg

SEQ ID NO: 300448 - DNA, 16 bp, C. familiaris
acaagaagatacaaca

SEQ ID NO: 300449 - DNA, 16 bp, C. familiaris
acaagaatatacaatg

SEQ ID NO: 300450 - DNA, 16 bp, C. familiaris
acaagaatcatatgat

SEQ ID NO: 300451 - DNA, 16 bp, C. familiaris
acaagacagagatgtc

SEQ ID NO: 300452 - DNA, 16 bp, C. familiaris
acaagacaggagacaa

SEQ ID NO: 300453 - DNA, 16 bp, C. familiaris
acaagagtgccaagac

SEQ ID NO: 300454 - DNA, 16 bp, C. familiaris
acaagatgaaaaggca

SEQ ID NO: 300455 - DNA, 16 bp, C. familiaris
acaagcacaggagaaa

SEQ ID NO: 300456 - DNA, 16 bp, C. familiaris
acaagcactgggtgtt

SEQ ID NO: 300457 - DNA, 16 bp, C. familiaris
acaagcagaggaagca

SEQ ID NO: 300458 - DNA, 16 bp, C. familiaris
acaagcaggaggagag

SEQ ID NO: 300459 - DNA, 16 bp, C. familiaris
acaagcaggcagagag

SEQ ID NO: 300460 - DNA, 16 bp, C. familiaris
acaagcaggtggagca

SEQ ID NO: 300461 - DNA, 16 bp, C. familiaris
acaagcagtggggaga

SEQ ID NO: 300462 - DNA, 16 bp, C. familiaris
acaagcatttattgaa

SEQ ID NO: 300463 - DNA, 16 bp, C. familiaris
acaagctgattctgaa

SEQ ID NO: 300464 - DNA, 16 bp, C. familiaris
acaagctgtgtgacct

SEQ ID NO: 300465 - DNA, 16 bp, C. familiaris
acaagctgtgtgactt

SEQ ID NO: 300466 - DNA, 16 bp, C. familiaris
acaaggagactgaggc

SEQ ID NO: 300467 - DNA, 16 bp, C. familiaris
acaaggagggggagtg

SEQ ID NO: 300468 - DNA, 16 bp, C. familiaris
acaaggatgtgaagaa

SEQ ID NO: 300469 - DNA, 16 bp, C. familiaris
acaaggatgtggagca

SEQ ID NO: 300470 - DNA, 16 bp, C. familiaris
acaaggattccttttt

SEQ ID NO: 300471 - DNA, 16 bp, C. familiaris
acaaggcagaaggaga

SEQ ID NO: 300472 - DNA, 16 bp, C. familiaris
acaaggcaggaaataa

SEQ ID NO: 300473 - DNA, 16 bp, C. familiaris
acaagggatagtggaa

SEQ ID NO: 300474 - DNA, 16 bp, C. familiaris
acaagggatgcctggg

SEQ ID NO: 300475 - DNA, 16 bp, C. familiaris
acaagggcagccccag

SEQ ID NO: 300476 - DNA, 16 bp, C. familiaris
acaagtacccaccatt

SEQ ID NO: 300477 - DNA, 16 bp, C. familiaris
acaagtcaagaaacaa

SEQ ID NO: 300478 - DNA, 16 bp, C. familiaris
acaagttcactcctta

SEQ ID NO: 300479 - DNA, 16 bp, C. familiaris
acaagttccaggagaa

SEQ ID NO: 300480 - DNA, 16 bp, C. familiaris
acaagttttttttgtt

SEQ ID NO: 300481 - DNA, 16 bp, C. familiaris
acaatatatagaaaac

SEQ ID NO: 300482 - DNA, 16 bp, C. familiaris
acaatatttcattctt

SEQ ID NO: 300483 - DNA, 16 bp, C. familiaris
acaatcctaaaatttg

SEQ ID NO: 300484 - DNA, 16 bp, C. familiaris
acaatctacaggaaca

SEQ ID NO: 300485 - DNA, 16 bp, C. familiaris
acaatctcatttacaa

SEQ ID NO: 300486 - DNA, 16 bp, C. familiaris
acaatctgcagaaaca

SEQ ID NO: 300487 - DNA, 16 bp, C. familiaris
acaatgaaaagaccat

SEQ ID NO: 300488 - DNA, 16 bp, C. familiaris
acaatgaaactgaaga

SEQ ID NO: 300489 - DNA, 16 bp, C. familiaris
acaatgaacacaagtg

SEQ ID NO: 300490 - DNA, 16 bp, C. familiaris
acaatgaacatgggag

SEQ ID NO: 300491 - DNA, 16 bp, C. familiaris
acaatgaaggaaacaa

SEQ ID NO: 300492 - DNA, 16 bp, C. familiaris
acaatgacactgaaga

SEQ ID NO: 300493 - DNA, 16 bp, C. familiaris
acaatgaccaagtggg

SEQ ID NO: 300494 - DNA, 16 bp, C. familiaris
acaatgagaaggcagc

SEQ ID NO: 300495 - DNA, 34 bp, C. familiaris
acaatgagataccacctcacaccagtgagaatgg

SEQ ID NO: 300496 - DNA, 16 bp, C. familiaris
acaatgatgaataaaa

SEQ ID NO: 300497 - DNA, 16 bp, C. familiaris
acaatgattttttttt

SEQ ID NO: 300498 - DNA, 16 bp, C. familiaris
acaatgccagatatca

SEQ ID NO: 300499 - DNA, 16 bp, C. familiaris
acaatgctgcaatgaa

SEQ ID NO: 300500 - DNA, 16 bp, C. familiaris
acaatgctgctatgaa

SEQ ID NO: 300501 - DNA, 16 bp, C. familiaris
acaatggaccagatgg

SEQ ID NO: 300502 - DNA, 16 bp, C. familiaris
acaatggcagatttca

SEQ ID NO: 300503 - DNA, 16 bp, C. familiaris
acaatggctttttttt

SEQ ID NO: 300504 - DNA, 16 bp, C. familiaris
acaatgtcctcaaggt

SEQ ID NO: 300505 - DNA, 16 bp, C. familiaris
acaatgttgcaatgaa

SEQ ID NO: 300506 - DNA, 16 bp, C. familiaris
acaattatatagtcaa

SEQ ID NO: 300507 - DNA, 16 bp, C. familiaris
acaattcaattcaatt

SEQ ID NO: 300508 - DNA, 16 bp, C. familiaris
acaattcataaaagaa

SEQ ID NO: 300509 - DNA, 41 bp, C. familiaris
acaattgcacccaaaagcataagatacctaggaataaacct

SEQ ID NO: 300510 - DNA, 16 bp, C. familiaris
acaatttaattcaatt

SEQ ID NO: 300511 - DNA, 16 bp, C. familiaris
acaatttaccaaaact

SEQ ID NO: 300512 - DNA, 16 bp, C. familiaris
acaatttagaaaatat

SEQ ID NO: 300513 - DNA, 16 bp, C. familiaris
acaatttattgaagag

SEQ ID NO: 300514 - DNA, 16 bp, C. familiaris
acaatttatttaacca

SEQ ID NO: 300515 - DNA, 16 bp, C. familiaris
acaatttcagacttca

SEQ ID NO: 300516 - DNA, 16 bp, C. familiaris
acacaaaaagccacat

SEQ ID NO: 300517 - DNA, 16 bp, C. familiaris
acacaaaaataaagtc

SEQ ID NO: 300518 - DNA, 16 bp, C. familiaris
acacaaaagataatga

SEQ ID NO: 300519 - DNA, 16 bp, C. familiaris
acacaaactcaaaatg

SEQ ID NO: 300520 - DNA, 16 bp, C. familiaris
acacaaagaaatggaa

SEQ ID NO: 300521 - DNA, 16 bp, C. familiaris
acacaaatttatttta

SEQ ID NO: 300522 - DNA, 16 bp, C. familiaris
acacaacagagagaga

SEQ ID NO: 300523 - DNA, 16 bp, C. familiaris
acacaagcagaggaag

SEQ ID NO: 300524 - DNA, 16 bp, C. familiaris
acacaataaatgaaat

SEQ ID NO: 300525 - DNA, 16 bp, C. familiaris
acacacacaaaatctg

SEQ ID NO: 300526 - DNA, 16 bp, C. familiaris
acacacacaaaggtaa

SEQ ID NO: 300527 - DNA, 16 bp, C. familiaris
acacacacaaagtaaa

SEQ ID NO: 300528 - DNA, 16 bp, C. familiaris
acacacacaaatgttt

SEQ ID NO: 300529 - DNA, 16 bp, C. familiaris
acacacacacaaattt

SEQ ID NO: 300530 - DNA, 16 bp, C. familiaris
acacacacacacatat

SEQ ID NO: 300531 - DNA, 16 bp, C. familiaris
acacacacacactgct

SEQ ID NO: 300532 - DNA, 16 bp, C. familiaris
acacacacacaggtac

SEQ ID NO: 300533 - DNA, 16 bp, C. familiaris
acacacacacagtgct

SEQ ID NO: 300534 - DNA, 16 bp, C. familiaris
acacacacacatacat

SEQ ID NO: 300535 - DNA, 16 bp, C. familiaris
acacacacaccaagag

SEQ ID NO: 300536 - DNA, 16 bp, C. familiaris
acacacacaccaggga

SEQ ID NO: 300537 - DNA, 16 bp, C. familiaris
acacacacacccttgt

SEQ ID NO: 300538 - DNA, 16 bp, C. familiaris
acacacacacctctgc

SEQ ID NO: 300539 - DNA, 16 bp, C. familiaris
acacacacacctcttt

SEQ ID NO: 300540 - DNA, 16 bp, C. familiaris
acacacacacgcgcgc

SEQ ID NO: 300541 - DNA, 16 bp, C. familiaris
acacacacactctctc

SEQ ID NO: 300542 - DNA, 16 bp, C. familiaris
acacacacagaggaga

SEQ ID NO: 300543 - DNA, 16 bp, C. familiaris
acacacacagtggaat

SEQ ID NO: 300544 - DNA, 16 bp, C. familiaris
acacacacatacacat

SEQ ID NO: 300545 - DNA, 16 bp, C. familiaris
acacacagaaggaaga

SEQ ID NO: 300546 - DNA, 16 bp, C. familiaris
acacacagaataacac

SEQ ID NO: 300547 - DNA, 16 bp, C. familiaris
acacacagaggcaggc

SEQ ID NO: 300548 - DNA, 16 bp, C. familiaris
acacacagcagaagaa

SEQ ID NO: 300549 - DNA, 16 bp, C. familiaris
acacacaggagagaga

SEQ ID NO: 300550 - DNA, 16 bp, C. familiaris
acacacaggagggaaa

SEQ ID NO: 300551 - DNA, 16 bp, C. familiaris
acacacagtgttatat

SEQ ID NO: 300552 - DNA, 16 bp, C. familiaris
acacacatatacacac

SEQ ID NO: 300553 - DNA, 16 bp, C. familiaris
acacacatatatacat

SEQ ID NO: 300554 - DNA, 16 bp, C. familiaris
acacacatgagagaga

SEQ ID NO: 300555 - DNA, 16 bp, C. familiaris
acacacatgcatgcac

SEQ ID NO: 300556 - DNA, 16 bp, C. familiaris
acacacctatgataaa

SEQ ID NO: 300557 - DNA, 16 bp, C. familiaris
acacacgtatgtatat

SEQ ID NO: 300558 - DNA, 16 bp, C. familiaris
acacactatatatata

SEQ ID NO: 300559 - DNA, 16 bp, C. familiaris
acacactgattttttt

SEQ ID NO: 300560 - DNA, 16 bp, C. familiaris
acacacttgtgttcat

SEQ ID NO: 300561 - DNA, 16 bp, C. familiaris
acacagaaaaatattt

SEQ ID NO: 300562 - DNA, 16 bp, C. familiaris
acacagaaaacaaact

SEQ ID NO: 300563 - DNA, 16 bp, C. familiaris
acacagaaaagcagag

SEQ ID NO: 300564 - DNA, 16 bp, C. familiaris
acacagaaacagagag

SEQ ID NO: 300565 - DNA, 16 bp, C. familiaris
acacagaagagaaaat

SEQ ID NO: 300566 - DNA, 16 bp, C. familiaris
acacagaagcagagag

SEQ ID NO: 300567 - DNA, 16 bp, C. familiaris
acacagacaacaccct

SEQ ID NO: 300568 - DNA, 16 bp, C. familiaris
acacagagaaagatgc

SEQ ID NO: 300569 - DNA, 16 bp, C. familiaris
acacagagaaaggggc

SEQ ID NO: 300570 - DNA, 16 bp, C. familiaris
acacagagaaatgaaa

SEQ ID NO: 300571 - DNA, 16 bp, C. familiaris
acacagagaaattaaa

SEQ ID NO: 300572 - DNA, 16 bp, C. familiaris
acacagagacagacat

SEQ ID NO: 300573 - DNA, 16 bp, C. familiaris
acacagagagaaggag

SEQ ID NO: 300574 - DNA, 16 bp, C. familiaris
acacagagaggagcag

SEQ ID NO: 300575 - DNA, 16 bp, C. familiaris
acacagagagggaggt

SEQ ID NO: 300576 - DNA, 16 bp, C. familiaris
acacagagatggaaaa

SEQ ID NO: 300577 - DNA, 16 bp, C. familiaris
acacagaggaagagac

SEQ ID NO: 300578 - DNA, 16 bp, C. familiaris
acacagaggccgagac

SEQ ID NO: 300579 - DNA, 16 bp, C. familiaris
acacagataaagagag

SEQ ID NO: 300580 - DNA, 16 bp, C. familiaris
acacaggaaggaagga

SEQ ID NO: 300581 - DNA, 16 bp, C. familiaris
acacaggaagtgctca

SEQ ID NO: 300582 - DNA, 16 bp, C. familiaris
acacaggaggagagag

SEQ ID NO: 300583 - DNA, 16 bp, C. familiaris
acacaggcacatacac

SEQ ID NO: 300584 - DNA, 16 bp, C. familiaris
acacaggcacccctaa

SEQ ID NO: 300585 - DNA, 16 bp, C. familiaris
acacaggcagagaaga

SEQ ID NO: 300586 - DNA, 16 bp, C. familiaris
acacaggcagagggga

SEQ ID NO: 300587 - DNA, 16 bp, C. familiaris
acacagggaaagcacc

SEQ ID NO: 300588 - DNA, 16 bp, C. familiaris
acacagggagaggcag

SEQ ID NO: 300589 - DNA, 16 bp, C. familiaris
acacagtgctcatcac

SEQ ID NO: 300590 - DNA, 16 bp, C. familiaris
acacagtttgaagaga

SEQ ID NO: 300591 - DNA, 16 bp, C. familiaris
acacatacacagagag

SEQ ID NO: 300592 - DNA, 16 bp, C. familiaris
acacatacagatacac

SEQ ID NO: 300593 - DNA, 16 bp, C. familiaris
acacatacatatacac

SEQ ID NO: 300594 - DNA, 16 bp, C. familiaris
acacatacatatgcat

SEQ ID NO: 300595 - DNA, 16 bp, C. familiaris
acacatagaaagagag

SEQ ID NO: 300596 - DNA, 16 bp, C. familiaris
acacatatatatgaat

SEQ ID NO: 300597 - DNA, 16 bp, C. familiaris
acacatatatttttaa

SEQ ID NO: 300598 - DNA, 16 bp, C. familiaris
acacatgaaaaaatac

SEQ ID NO: 300599 - DNA, 16 bp, C. familiaris
acacatgaagcaaaaa

SEQ ID NO: 300600 - DNA, 16 bp, C. familiaris
acacatgtgcgcacac

SEQ ID NO: 300601 - DNA, 16 bp, C. familiaris
acacattaaaatattt

SEQ ID NO: 300602 - DNA, 16 bp, C. familiaris
acacattattttatta

SEQ ID NO: 300603 - DNA, 16 bp, C. familiaris
acacatttaatgcatt

SEQ ID NO: 300604 - DNA, 16 bp, C. familiaris
acacatttctggaaaa

SEQ ID NO: 300605 - DNA, 16 bp, C. familiaris
acacattttctttctt

SEQ ID NO: 300606 - DNA, 16 bp, C. familiaris
acaccaacagcatttt

SEQ ID NO: 300607 - DNA, 16 bp, C. familiaris
acaccaagataaactc

SEQ ID NO: 300608 - DNA, 16 bp, C. familiaris
acaccatcttctttat

SEQ ID NO: 300609 - DNA, 16 bp, C. familiaris
acaccatgaccaagtg

SEQ ID NO: 300610 - DNA, 16 bp, C. familiaris
acaccatttacaaaaa

SEQ ID NO: 300611 - DNA, 16 bp, C. familiaris
acacccagaataatat

SEQ ID NO: 300612 - DNA, 16 bp, C. familiaris
acacccagtgctcaca

SEQ ID NO: 300613 - DNA, 16 bp, C. familiaris
acaccccaagctgcag

SEQ ID NO: 300614 - DNA, 16 bp, C. familiaris
acaccccaggctgcag

SEQ ID NO: 300615 - DNA, 16 bp, C. familiaris
acaccctttctgaact

SEQ ID NO: 300616 - DNA, 16 bp, C. familiaris
acaccggtcagaatgg

SEQ ID NO: 300617 - DNA, 16 bp, C. familiaris
acacctatgaatttga

SEQ ID NO: 300618 - DNA, 16 bp, C. familiaris
acacctcaggctgcag

SEQ ID NO: 300619 - DNA, 16 bp, C. familiaris
acacctcatcaaagaa

SEQ ID NO: 300620 - DNA, 16 bp, C. familiaris
acacctgaaaccataa

SEQ ID NO: 300621 - DNA, 16 bp, C. familiaris
acacctgcacccgatg

SEQ ID NO: 300622 - DNA, 16 bp, C. familiaris
acacctggaaatcagc

SEQ ID NO: 300623 - DNA, 16 bp, C. familiaris
acacctgggcagctca

SEQ ID NO: 300624 - DNA, 16 bp, C. familiaris
acacctgtcagaatgg

SEQ ID NO: 300625 - DNA, 16 bp, C. familiaris
acacgcacacgcacat

SEQ ID NO: 300626 - DNA, 16 bp, C. familiaris
acactatattttaact

SEQ ID NO: 300627 - DNA, 16 bp, C. familiaris
acactcaatggactga

SEQ ID NO: 300628 - DNA, 16 bp, C. familiaris
acactctgcctctctc

SEQ ID NO: 300629 - DNA, 16 bp, C. familiaris
acactcttccaactga

SEQ ID NO: 300630 - DNA, 16 bp, C. familiaris
acactgaaaactgtaa

SEQ ID NO: 300631 - DNA, 16 bp, C. familiaris
acactgaaaatctgtt

SEQ ID NO: 300632 - DNA, 16 bp, C. familiaris
acactgaggcccagag

SEQ ID NO: 300633 - DNA, 17 bp, C. familiaris
acactgaggctccttcc

SEQ ID NO: 300634 - DNA, 16 bp, C. familiaris
acactgataccaaaac

SEQ ID NO: 300635 - DNA, 16 bp, C. familiaris
acactgatgaaagaag

SEQ ID NO: 300636 - DNA, 16 bp, C. familiaris
acactgcagagagttt

SEQ ID NO: 300637 - DNA, 16 bp, C. familiaris
acactgcccactgcag

SEQ ID NO: 300638 - DNA, 16 bp, C. familiaris
acactggagaaaggcc

SEQ ID NO: 300639 - DNA, 16 bp, C. familiaris
acactggagcagatgg

SEQ ID NO: 300640 - DNA, 16 bp, C. familiaris
acactgggccagatgg

SEQ ID NO: 300641 - DNA, 16 bp, C. familiaris
acactgggctggatcc

SEQ ID NO: 300642 - DNA, 16 bp, C. familiaris
acactggtgcagccac

SEQ ID NO: 300643 - DNA, 16 bp, C. familiaris
acactgtcttcatgac

SEQ ID NO: 300644 - DNA, 16 bp, C. familiaris
acactgtttgtgggaa

SEQ ID NO: 300645 - DNA, 16 bp, C. familiaris
acacttaaaagtggtt

SEQ ID NO: 300646 - DNA, 16 bp, C. familiaris
acacttaaccagctga

SEQ ID NO: 300647 - DNA, 16 bp, C. familiaris
acacttctgaaggaaa

SEQ ID NO: 300648 - DNA, 16 bp, C. familiaris
acacttgggtttcttc

SEQ ID NO: 300649 - DNA, 16 bp, C. familiaris
acacttgtgttgcttc

SEQ ID NO: 300650 - DNA, 16 bp, C. familiaris
acagaaaaaaatttta

SEQ ID NO: 300651 - DNA, 16 bp, C. familiaris
acagaaaaagctctca

SEQ ID NO: 300652 - DNA, 16 bp, C. familiaris
acagaaaaatataatt

SEQ ID NO: 300653 - DNA, 16 bp, C. familiaris
acagaaaatcattaag

SEQ ID NO: 300654 - DNA, 16 bp, C. familiaris
acagaaaatgagagaa

SEQ ID NO: 300655 - DNA, 16 bp, C. familiaris
acagaaaattattttt

SEQ ID NO: 300656 - DNA, 16 bp, C. familiaris
acagaaaatttggaaa

SEQ ID NO: 300657 - DNA, 16 bp, C. familiaris
acagaaacagagacag

SEQ ID NO: 300658 - DNA, 16 bp, C. familiaris
acagaaagacaggcag

SEQ ID NO: 300659 - DNA, 16 bp, C. familiaris
acagaaagacattaaa

SEQ ID NO: 300660 - DNA, 16 bp, C. familiaris
acagaaagagaaaatg

SEQ ID NO: 300661 - DNA, 16 bp, C. familiaris
acagaaagcagaatgg

SEQ ID NO: 300662 - DNA, 16 bp, C. familiaris
acagaaagcagatcag

SEQ ID NO: 300663 - DNA, 16 bp, C. familiaris
acagaaaggaaataat

SEQ ID NO: 300664 - DNA, 16 bp, C. familiaris
acagaaagggaaaata

SEQ ID NO: 300665 - DNA, 16 bp, C. familiaris
acagaaagggaggcaa

SEQ ID NO: 300666 - DNA, 16 bp, C. familiaris
acagaaagtagatcag

SEQ ID NO: 300667 - DNA, 16 bp, C. familiaris
acagaaatattattca

SEQ ID NO: 300668 - DNA, 16 bp, C. familiaris
acagaaatctgtggca

SEQ ID NO: 300669 - DNA, 16 bp, C. familiaris
acagaaatcttaaaaa

SEQ ID NO: 300670 - DNA, 16 bp, C. familiaris
acagaaatgaaagcat

SEQ ID NO: 300671 - DNA, 16 bp, C. familiaris
acagaaatgcaaagga

SEQ ID NO: 300672 - DNA, 16 bp, C. familiaris
acagaaatggaaacaa

SEQ ID NO: 300673 - DNA, 16 bp, C. familiaris
acagaaatggaaggaa

SEQ ID NO: 300674 - DNA, 16 bp, C. familiaris
acagaaattcagaaaa

SEQ ID NO: 300675 - DNA, 16 bp, C. familiaris
acagaacaaactccac

SEQ ID NO: 300676 - DNA, 18 bp, C. familiaris
acagaacgtaaagactgc

SEQ ID NO: 300677 - DNA, 16 bp, C. familiaris
acagaacttgaaaaat

SEQ ID NO: 300678 - DNA, 16 bp, C. familiaris
acagaagaaagaatca

SEQ ID NO: 300679 - DNA, 16 bp, C. familiaris
acagaagaaatatttg

SEQ ID NO: 300680 - DNA, 17 bp, C. familiaris
acagaagaactgtggaa

SEQ ID NO: 300681 - DNA, 16 bp, C. familiaris
acagaagacaagttga

SEQ ID NO: 300682 - DNA, 16 bp, C. familiaris
acagaagcagagagag

SEQ ID NO: 300683 - DNA, 16 bp, C. familiaris
acagaagcagaggcag

SEQ ID NO: 300684 - DNA, 16 bp, C. familiaris
acagaaggagtaaaga

SEQ ID NO: 300685 - DNA, 16 bp, C. familiaris
acagaaggcagacact

SEQ ID NO: 300686 - DNA, 16 bp, C. familiaris
acagaaggcaggtgct

SEQ ID NO: 300687 - DNA, 16 bp, C. familiaris
acagaagtgaacaaaa

SEQ ID NO: 300688 - DNA, 16 bp, C. familiaris
acagaatacagcatcc

SEQ ID NO: 300689 - DNA, 16 bp, C. familiaris
acagaatgaaagagaa

SEQ ID NO: 300690 - DNA, 16 bp, C. familiaris
acagaatgcttctgaa

SEQ ID NO: 300691 - DNA, 16 bp, C. familiaris
acagaattaaaaggaa

SEQ ID NO: 300692 - DNA, 16 bp, C. familiaris
acagaattcagagaaa

SEQ ID NO: 300693 - DNA, 16 bp, C. familiaris
acagacacagaaagag

SEQ ID NO: 300694 - DNA, 16 bp, C. familiaris
acagacacaggcaggg

SEQ ID NO: 300695 - DNA, 16 bp, C. familiaris
acagacacagttcaaa

SEQ ID NO: 300696 - DNA, 16 bp, C. familiaris
acagacagacagacaa

SEQ ID NO: 300697 - DNA, 16 bp, C. familiaris
acagacatttttaaaa

SEQ ID NO: 300698 - DNA, 16 bp, C. familiaris
acagaccaggaaactg

SEQ ID NO: 300699 - DNA, 16 bp, C. familiaris
acagactgagaaagag

SEQ ID NO: 300700 - DNA, 16 bp, C. familiaris
acagactgggagaaaa

SEQ ID NO: 300701 - DNA, 16 bp, C. familiaris
acagacttcctgctga

SEQ ID NO: 300702 - DNA, 16 bp, C. familiaris
acagagaaaatagaag

SEQ ID NO: 300703 - DNA, 16 bp, C. familiaris
acagagaaacagacac

SEQ ID NO: 300704 - DNA, 16 bp, C. familiaris
acagagaaaggaaata

SEQ ID NO: 300705 - DNA, 16 bp, C. familiaris
acagagaaaggcacag

SEQ ID NO: 300706 - DNA, 16 bp, C. familiaris
acagagaacaagctga

SEQ ID NO: 300707 - DNA, 16 bp, C. familiaris
acagagaaggaaacta

SEQ ID NO: 300708 - DNA, 16 bp, C. familiaris
acagagaatgagagaa

SEQ ID NO: 300709 - DNA, 16 bp, C. familiaris
acagagacacagacag

SEQ ID NO: 300710 - DNA, 16 bp, C. familiaris
acagagacacagcaga

SEQ ID NO: 300711 - DNA, 16 bp, C. familiaris
acagagacagaaagta

SEQ ID NO: 300712 - DNA, 16 bp, C. familiaris
acagagacagagagac

SEQ ID NO: 300713 - DNA, 16 bp, C. familiaris
acagagacagagagag

SEQ ID NO: 300714 - DNA, 16 bp, C. familiaris
acagagactttttttt

SEQ ID NO: 300715 - DNA, 16 bp, C. familiaris
acagagagagagaggc

SEQ ID NO: 300716 - DNA, 16 bp, C. familiaris
acagagagagtacaag

SEQ ID NO: 300717 - DNA, 16 bp, C. familiaris
acagagagagtgtgag

SEQ ID NO: 300718 - DNA, 16 bp, C. familiaris
acagagagatgcagag

SEQ ID NO: 300719 - DNA, 16 bp, C. familiaris
acagagagcaaggcag

SEQ ID NO: 300720 - DNA, 16 bp, C. familiaris
acagagagcccagaaa

SEQ ID NO: 300721 - DNA, 16 bp, C. familiaris
acagagaggagcagag

SEQ ID NO: 300722 - DNA, 16 bp, C. familiaris
acagagaggcagagga

SEQ ID NO: 300723 - DNA, 16 bp, C. familiaris
acagagatcccagaaa

SEQ ID NO: 300724 - DNA, 16 bp, C. familiaris
acagagattttccata

SEQ ID NO: 300725 - DNA, 16 bp, C. familiaris
acagagcaaggaaata

SEQ ID NO: 300726 - DNA, 16 bp, C. familiaris
acagagcagagagccc

SEQ ID NO: 300727 - DNA, 16 bp, C. familiaris
acagagcaggagagag

SEQ ID NO: 300728 - DNA, 16 bp, C. familiaris
acagagccagacatgg

SEQ ID NO: 300729 - DNA, 16 bp, C. familiaris
acagagccagagccag

SEQ ID NO: 300730 - DNA, 16 bp, C. familiaris
acagagccagccaggc

SEQ ID NO: 300731 - DNA, 16 bp, C. familiaris
acagagcccaatgtag

SEQ ID NO: 300732 - DNA, 16 bp, C. familiaris
acagagcccagaaata

SEQ ID NO: 300733 - DNA, 16 bp, C. familiaris
acagagcctgacaggg

SEQ ID NO: 300734 - DNA, 16 bp, C. familiaris
acagagctagaaaaaa

SEQ ID NO: 300735 - DNA, 16 bp, C. familiaris
acagagctctcagtct

SEQ ID NO: 300736 - DNA, 16 bp, C. familiaris
acagagctggacatgg

SEQ ID NO: 300737 - DNA, 16 bp, C. familiaris
acagagcttctaaaac

SEQ ID NO: 300738 - DNA, 16 bp, C. familiaris
acagaggaagaaaatg

SEQ ID NO: 300739 - DNA, 16 bp, C. familiaris
acagaggaatttatcc

SEQ ID NO: 300740 - DNA, 16 bp, C. familiaris
acagaggaccagaaag

SEQ ID NO: 300741 - DNA, 16 bp, C. familiaris
acagaggagacagaga

SEQ ID NO: 300742 - DNA, 16 bp, C. familiaris
acagaggaggaaatga

SEQ ID NO: 300743 - DNA, 16 bp, C. familiaris
acagaggaggcaagaa

SEQ ID NO: 300744 - DNA, 16 bp, C. familiaris
acagaggaggcagaga

SEQ ID NO: 300745 - DNA, 16 bp, C. familiaris
acagaggcagagatat

SEQ ID NO: 300746 - DNA, 16 bp, C. familiaris
acagaggcagaggcag

SEQ ID NO: 300747 - DNA, 16 bp, C. familiaris
acagaggcagaggcat

SEQ ID NO: 300748 - DNA, 16 bp, C. familiaris
acagaggcagagtgag

SEQ ID NO: 300749 - DNA, 16 bp, C. familiaris
acagaggcaggcagag

SEQ ID NO: 300750 - DNA, 16 bp, C. familiaris
acagaggctcagggag

SEQ ID NO: 300751 - DNA, 16 bp, C. familiaris
acagagggagagacac

SEQ ID NO: 300752 - DNA, 16 bp, C. familiaris
acagagggatggatgg

SEQ ID NO: 300753 - DNA, 16 bp, C. familiaris
acagatacagaaaaca

SEQ ID NO: 300754 - DNA, 16 bp, C. familiaris
acagatagagaagcag

SEQ ID NO: 300755 - DNA, 16 bp, C. familiaris
acagatcacatactgg

SEQ ID NO: 300756 - DNA, 16 bp, C. familiaris
acagatcagaaaactg

SEQ ID NO: 300757 - DNA, 16 bp, C. familiaris
acagatccagcaggca

SEQ ID NO: 300758 - DNA, 16 bp, C. familiaris
acagatcttcctcaac

SEQ ID NO: 300759 - DNA, 16 bp, C. familiaris
acagatgaaaaactga

SEQ ID NO: 300760 - DNA, 16 bp, C. familiaris
acagatgaaaatgaaa

SEQ ID NO: 300761 - DNA, 16 bp, C. familiaris
acagatgaagaaaata

SEQ ID NO: 300762 - DNA, 16 bp, C. familiaris
acagatgaagaaacag

SEQ ID NO: 300763 - DNA, 16 bp, C. familiaris
acagatgaagaaactg

SEQ ID NO: 300764 - DNA, 16 bp, C. familiaris
acagatgaatgaagaa

SEQ ID NO: 300765 - DNA, 16 bp, C. familiaris
acagatgaatggatga

SEQ ID NO: 300766 - DNA, 16 bp, C. familiaris
acagatgagaaaacta

SEQ ID NO: 300767 - DNA, 16 bp, C. familiaris
acagatgaggaaacag

SEQ ID NO: 300768 - DNA, 16 bp, C. familiaris
acagatgaggaaattg

SEQ ID NO: 300769 - DNA, 16 bp, C. familiaris
acagatgatgaaacta

SEQ ID NO: 300770 - DNA, 16 bp, C. familiaris
acagatgatgaaattg

SEQ ID NO: 300771 - DNA, 16 bp, C. familiaris
acagatggagaaggag

SEQ ID NO: 300772 - DNA, 16 bp, C. familiaris
acagatggcagctaca

SEQ ID NO: 300773 - DNA, 16 bp, C. familiaris
acagatggccaaaaga

SEQ ID NO: 300774 - DNA, 16 bp, C. familiaris
acagatgtcttttttt

SEQ ID NO: 300775 - DNA, 16 bp, C. familiaris
acagattctgattcag

SEQ ID NO: 300776 - DNA, 16 bp, C. familiaris
acagattgaaaataaa

SEQ ID NO: 300777 - DNA, 16 bp, C. familiaris
acagatttctgcatgt

SEQ ID NO: 300778 - DNA, 16 bp, C. familiaris
acagcaaaatatacat

SEQ ID NO: 300779 - DNA, 16 bp, C. familiaris
acagcaaacagatggg

SEQ ID NO: 300780 - DNA, 16 bp, C. familiaris
acagcaaaggaaacag

SEQ ID NO: 300781 - DNA, 16 bp, C. familiaris
acagcaaaggaaacca

SEQ ID NO: 300782 - DNA, 16 bp, C. familiaris
acagcaaaggaaaccg

SEQ ID NO: 300783 - DNA, 16 bp, C. familiaris
acagcaaagggaacaa

SEQ ID NO: 300784 - DNA, 16 bp, C. familiaris
acagcaacacctagat

SEQ ID NO: 300785 - DNA, 16 bp, C. familiaris
acagcaactgcgcccc

SEQ ID NO: 300786 - DNA, 16 bp, C. familiaris
acagcaagagagcaca

SEQ ID NO: 300787 - DNA, 16 bp, C. familiaris
acagcaatagaaaact

SEQ ID NO: 300788 - DNA, 16 bp, C. familiaris
acagcaccaagagtga

SEQ ID NO: 300789 - DNA, 16 bp, C. familiaris
acagcagacctcttca

SEQ ID NO: 300790 - DNA, 16 bp, C. familiaris
acagcagcaacagcag

SEQ ID NO: 300791 - DNA, 16 bp, C. familiaris
acagcagcaacaggaa

SEQ ID NO: 300792 - DNA, 16 bp, C. familiaris
acagcagcagcaggaa

SEQ ID NO: 300793 - DNA, 16 bp, C. familiaris
acagcagccacaggaa

SEQ ID NO: 300794 - DNA, 16 bp, C. familiaris
acagcagccatagaaa

SEQ ID NO: 300795 - DNA, 16 bp, C. familiaris
acagcagccccaggaa

SEQ ID NO: 300796 - DNA, 16 bp, C. familiaris
acagcagctcttcctg

SEQ ID NO: 300797 - DNA, 16 bp, C. familiaris
acagcaggacccgggg

SEQ ID NO: 300798 - DNA, 16 bp, C. familiaris
acagcagggggagcag

SEQ ID NO: 300799 - DNA, 16 bp, C. familiaris
acagcatctggcacat

SEQ ID NO: 300800 - DNA, 16 bp, C. familiaris
acagcattctttcttg

SEQ ID NO: 300801 - DNA, 16 bp, C. familiaris
acagccacaagccaag

SEQ ID NO: 300802 - DNA, 16 bp, C. familiaris
acagccactctgcact

SEQ ID NO: 300803 - DNA, 16 bp, C. familiaris
acagccactgtgggaa

SEQ ID NO: 300804 - DNA, 16 bp, C. familiaris
acagccatcaccacca

SEQ ID NO: 300805 - DNA, 16 bp, C. familiaris
acagccatgtgaagac

SEQ ID NO: 300806 - DNA, 16 bp, C. familiaris
acagcccagaatccgg

SEQ ID NO: 300807 - DNA, 16 bp, C. familiaris
acagcccagatgtcca

SEQ ID NO: 300808 - DNA, 16 bp, C. familiaris
acagcccagggcatga

SEQ ID NO: 300809 - DNA, 16 bp, C. familiaris
acagcccaggtggctc

SEQ ID NO: 300810 - DNA, 17 bp, C. familiaris
acagcctgagccgaagg

SEQ ID NO: 300811 - DNA, 16 bp, C. familiaris
acagctgctctggaaa

SEQ ID NO: 300812 - DNA, 16 bp, C. familiaris
acagctgggggcatca

SEQ ID NO: 300813 - DNA, 16 bp, C. familiaris
acagctgtgtgtgtgt

SEQ ID NO: 300814 - DNA, 16 bp, C. familiaris
acaggaaaccattaaa

SEQ ID NO: 300815 - DNA, 16 bp, C. familiaris
acaggaaatcatcaaa

SEQ ID NO: 300816 - DNA, 16 bp, C. familiaris
acaggaacagacattt

SEQ ID NO: 300817 - DNA, 16 bp, C. familiaris
acaggaacccatcaaa

SEQ ID NO: 300818 - DNA, 16 bp, C. familiaris
acaggaagatgaaaaa

SEQ ID NO: 300819 - DNA, 16 bp, C. familiaris
acaggacaaaaatcac

SEQ ID NO: 300820 - DNA, 16 bp, C. familiaris
acaggacagcaaggac

SEQ ID NO: 300821 - DNA, 16 bp, C. familiaris
acaggaggaaatagaa

SEQ ID NO: 300822 - DNA, 16 bp, C. familiaris
acaggaggagggataa

SEQ ID NO: 300823 - DNA, 16 bp, C. familiaris
acaggatacaaaatca

SEQ ID NO: 300824 - DNA, 16 bp, C. familiaris
acaggatacaagatca

SEQ ID NO: 300825 - DNA, 16 bp, C. familiaris
acaggatcctggaggc

SEQ ID NO: 300826 - DNA, 16 bp, C. familiaris
acaggatgagcgctgg

SEQ ID NO: 300827 - DNA, 16 bp, C. familiaris
acaggcaaagggagaa

SEQ ID NO: 300828 - DNA, 16 bp, C. familiaris
acaggcacagagactt

SEQ ID NO: 300829 - DNA, 16 bp, C. familiaris
acaggcacatctcagg

SEQ ID NO: 300830 - DNA, 16 bp, C. familiaris
acaggcactgaggtgg

SEQ ID NO: 300831 - DNA, 17 bp, C. familiaris
acaggcagagagaagca

SEQ ID NO: 300832 - DNA, 16 bp, C. familiaris
acaggcagcaacctcc

SEQ ID NO: 300833 - DNA, 16 bp, C. familiaris
acaggccctggagccc

SEQ ID NO: 300834 - DNA, 16 bp, C. familiaris
acaggctaaagaaaaa

SEQ ID NO: 300835 - DNA, 16 bp, C. familiaris
acaggctccccactaa

SEQ ID NO: 300836 - DNA, 16 bp, C. familiaris
acagggaaaagcagac

SEQ ID NO: 300837 - DNA, 16 bp, C. familiaris
acagggaagcctgggt

SEQ ID NO: 300838 - DNA, 16 bp, C. familiaris
acagggaccctgatgc

SEQ ID NO: 300839 - DNA, 16 bp, C. familiaris
acagggactgaagagg

SEQ ID NO: 300840 - DNA, 16 bp, C. familiaris
acagggagcctccttc

SEQ ID NO: 300841 - DNA, 16 bp, C. familiaris
acagggagcctgattt

SEQ ID NO: 300842 - DNA, 16 bp, C. familiaris
acagggctccatccta

SEQ ID NO: 300843 - DNA, 16 bp, C. familiaris
acaggggaagcagcag

SEQ ID NO: 300844 - DNA, 16 bp, C. familiaris
acaggggcagccccag

SEQ ID NO: 300845 - DNA, 16 bp, C. familiaris
acaggggctcctgggt

SEQ ID NO: 300846 - DNA, 16 bp, C. familiaris
acaggtgaagaaactg

SEQ ID NO: 300847 - DNA, 16 bp, C. familiaris
acaggtggaaggagaa

SEQ ID NO: 300848 - DNA, 16 bp, C. familiaris
acaggtggatggatgg

SEQ ID NO: 300849 - DNA, 16 bp, C. familiaris
acaggtttttaaaaat

SEQ ID NO: 300850 - DNA, 16 bp, C. familiaris
acaggtttttgatttg

SEQ ID NO: 300851 - DNA, 16 bp, C. familiaris
acaggttttttgtttt

SEQ ID NO: 300852 - DNA, 16 bp, C. familiaris
acagtaagctagagaa

SEQ ID NO: 300853 - DNA, 16 bp, C. familiaris
acagtacctggcacag

SEQ ID NO: 300854 - DNA, 16 bp, C. familiaris
acagtataatgctaag

SEQ ID NO: 300855 - DNA, 16 bp, C. familiaris
acagtatggatattcc

SEQ ID NO: 300856 - DNA, 16 bp, C. familiaris
acagtattttttttaa

SEQ ID NO: 300857 - DNA, 16 bp, C. familiaris
acagtctgggagaaaa

SEQ ID NO: 300858 - DNA, 16 bp, C. familiaris
acagtgaaggaaacag

SEQ ID NO: 300859 - DNA, 16 bp, C. familiaris
acagtgatgatgatga

SEQ ID NO: 300860 - DNA, 16 bp, C. familiaris
acagtgcctgaaacat

SEQ ID NO: 300861 - DNA, 16 bp, C. familiaris
acagtgctgctgtgaa

SEQ ID NO: 300862 - DNA, 16 bp, C. familiaris
acagtgctgggaaaat

SEQ ID NO: 300863 - DNA, 16 bp, C. familiaris
acagtggctgggaagg

SEQ ID NO: 300864 - DNA, 16 bp, C. familiaris
acagtgtggtcctggc

SEQ ID NO: 300865 - DNA, 16 bp, C. familiaris
acagttcaaagctctg

SEQ ID NO: 300866 - DNA, 16 bp, C. familiaris
acagttcttctggcct

SEQ ID NO: 300867 - DNA, 16 bp, C. familiaris
acagtttctcagattt

SEQ ID NO: 300868 - DNA, 16 bp, C. familiaris
acagtttgatgaattt

SEQ ID NO: 300869 - DNA, 16 bp, C. familiaris
acagttttattttctt

SEQ ID NO: 300870 - DNA, 16 bp, C. familiaris
acataaaaacttgtat

SEQ ID NO: 300871 - DNA, 16 bp, C. familiaris
acataaaatgtttaaa

SEQ ID NO: 300872 - DNA, 16 bp, C. familiaris
acataaagaaaatatt

SEQ ID NO: 300873 - DNA, 16 bp, C. familiaris
acataaagaaatggaa

SEQ ID NO: 300874 - DNA, 16 bp, C. familiaris
acataaagcagctaat

SEQ ID NO: 300875 - DNA, 16 bp, C. familiaris
acataagaattttgag

SEQ ID NO: 300876 - DNA, 16 bp, C. familiaris
acataatgataaagaa

SEQ ID NO: 300877 - DNA, 16 bp, C. familiaris
acatacagaacattcc

SEQ ID NO: 300878 - DNA, 16 bp, C. familiaris
acatacagagggagaa

SEQ ID NO: 300879 - DNA, 16 bp, C. familiaris
acatacagatggcaaa

SEQ ID NO: 300880 - DNA, 16 bp, C. familiaris
acatacataattttat

SEQ ID NO: 300881 - DNA, 16 bp, C. familiaris
acatacatatatacat

SEQ ID NO: 300882 - DNA, 16 bp, C. familiaris
acatacattttagaaa

SEQ ID NO: 300883 - DNA, 16 bp, C. familiaris
acataccacatcttct

SEQ ID NO: 300884 - DNA, 16 bp, C. familiaris
acatactttttaaaaa

SEQ ID NO: 300885 - DNA, 16 bp, C. familiaris
acatagacacatacac

SEQ ID NO: 300886 - DNA, 16 bp, C. familiaris
acatagagagtgagag

SEQ ID NO: 300887 - DNA, 16 bp, C. familiaris
acatagaggagagaga

SEQ ID NO: 300888 - DNA, 16 bp, C. familiaris
acatagtagatgctta

SEQ ID NO: 300889 - DNA, 16 bp, C. familiaris
acatagtattttaaaa

SEQ ID NO: 300890 - DNA, 16 bp, C. familiaris
acatagtttttaaaat

SEQ ID NO: 300891 - DNA, 16 bp, C. familiaris
acatatacaatggaat

SEQ ID NO: 300892 - DNA, 16 bp, C. familiaris
acatatacatatattt

SEQ ID NO: 300893 - DNA, 16 bp, C. familiaris
acatatgtacacatat

SEQ ID NO: 300894 - DNA, 16 bp, C. familiaris
acatatgtgcacatgt

SEQ ID NO: 300895 - DNA, 16 bp, C. familiaris
acatattcagaacatt

SEQ ID NO: 300896 - DNA, 16 bp, C. familiaris
acatattctggatatt

SEQ ID NO: 300897 - DNA, 16 bp, C. familiaris
acatatttatatatct

SEQ ID NO: 300898 - DNA, 16 bp, C. familiaris
acatcagaaagggaga

SEQ ID NO: 300899 - DNA, 16 bp, C. familiaris
acatcagaatacacat

SEQ ID NO: 300900 - DNA, 16 bp, C. familiaris
acatcagctccctgct

SEQ ID NO: 300901 - DNA, 16 bp, C. familiaris
acatcaggctccccgg

SEQ ID NO: 300902 - DNA, 16 bp, C. familiaris
acatcataatcatcca

SEQ ID NO: 300903 - DNA, 16 bp, C. familiaris
acatcatcaccaacat

SEQ ID NO: 300904 - DNA, 16 bp, C. familiaris
acatccaaatcagcaa

SEQ ID NO: 300905 - DNA, 16 bp, C. familiaris
acatccaagaaacaaa

SEQ ID NO: 300906 - DNA, 16 bp, C. familiaris
acatccagatagccaa

SEQ ID NO: 300907 - DNA, 16 bp, C. familiaris
acatccagctccctgc

SEQ ID NO: 300908 - DNA, 16 bp, C. familiaris
acatccggctccccgc

SEQ ID NO: 300909 - DNA, 16 bp, C. familiaris
acatccgtgtcttgtt

SEQ ID NO: 300910 - DNA, 16 bp, C. familiaris
acatcctcaccaacaa

SEQ ID NO: 300911 - DNA, 16 bp, C. familiaris
acatcctcaccagcac

SEQ ID NO: 300912 - DNA, 16 bp, C. familiaris
acatcctcatcaacac

SEQ ID NO: 300913 - DNA, 16 bp, C. familiaris
acatcctctccaacaa

SEQ ID NO: 300914 - DNA, 16 bp, C. familiaris
acatcctcttcaacat

SEQ ID NO: 300915 - DNA, 17 bp, C. familiaris
acatcgggttcctggtg

SEQ ID NO: 300916 - DNA, 16 bp, C. familiaris
acatctgcaaagacct

SEQ ID NO: 300917 - DNA, 16 bp, C. familiaris
acatctgtcatttcct

SEQ ID NO: 300918 - DNA, 16 bp, C. familiaris
acatctgtggtttcct

SEQ ID NO: 300919 - DNA, 16 bp, C. familiaris
acatcttaaaagctat

SEQ ID NO: 300920 - DNA, 16 bp, C. familiaris
acatctttttccatcc

SEQ ID NO: 300921 - DNA, 16 bp, C. familiaris
acatgaaaaaaatcat

SEQ ID NO: 300922 - DNA, 16 bp, C. familiaris
acatgaacacacacac

SEQ ID NO: 300923 - DNA, 16 bp, C. familiaris
acatgaacttgaaaaa

SEQ ID NO: 300924 - DNA, 16 bp, C. familiaris
acatgaagaaactgaa

SEQ ID NO: 300925 - DNA, 16 bp, C. familiaris
acatgaagaaatggaa

SEQ ID NO: 300926 - DNA, 16 bp, C. familiaris
acatgacaccaccaaa

SEQ ID NO: 300927 - DNA, 16 bp, C. familiaris
acatgaccaagtggga

SEQ ID NO: 300928 - DNA, 16 bp, C. familiaris
acatgagaagaatgtg

SEQ ID NO: 300929 - DNA, 16 bp, C. familiaris
acatgagactcttgat

SEQ ID NO: 300930 - DNA, 16 bp, C. familiaris
acatgagcaaggggag

SEQ ID NO: 300931 - DNA, 16 bp, C. familiaris
acatgagtggaatcat

SEQ ID NO: 300932 - DNA, 16 bp, C. familiaris
acatgagtgggggtgg

SEQ ID NO: 300933 - DNA, 16 bp, C. familiaris
acatgatattctacat

SEQ ID NO: 300934 - DNA, 16 bp, C. familiaris
acatgatccagcaatt

SEQ ID NO: 300935 - DNA, 16 bp, C. familiaris
acatgatcccaggact

SEQ ID NO: 300936 - DNA, 16 bp, C. familiaris
acatgatgatgatgat

SEQ ID NO: 300937 - DNA, 16 bp, C. familiaris
acatgcacatgaggaa

SEQ ID NO: 300938 - DNA, 16 bp, C. familiaris
acatgcactcctatgt

SEQ ID NO: 300939 - DNA, 16 bp, C. familiaris
acatgcaggtggccaa

SEQ ID NO: 300940 - DNA, 16 bp, C. familiaris
acatgctctaccagct

SEQ ID NO: 300941 - DNA, 16 bp, C. familiaris
acatggaaaaatgctc

SEQ ID NO: 300942 - DNA, 16 bp, C. familiaris
acatggaaacaaatga

SEQ ID NO: 300943 - DNA, 16 bp, C. familiaris
acatggaaagaaaaga

SEQ ID NO: 300944 - DNA, 16 bp, C. familiaris
acatggagaaattgga

SEQ ID NO: 300945 - DNA, 16 bp, C. familiaris
acatggagagagacag

SEQ ID NO: 300946 - DNA, 16 bp, C. familiaris
acatggagattaaaga

SEQ ID NO: 300947 - DNA, 16 bp, C. familiaris
acatggatgaaagaaa

SEQ ID NO: 300948 - DNA, 16 bp, C. familiaris
acatggatgaacttga

SEQ ID NO: 300949 - DNA, 16 bp, C. familiaris
acatggatggaccttg

SEQ ID NO: 300950 - DNA, 16 bp, C. familiaris
acatggccagcaagca

SEQ ID NO: 300951 - DNA, 16 bp, C. familiaris
acatgggcagaggaag

SEQ ID NO: 300952 - DNA, 16 bp, C. familiaris
acatggggcagcccag

SEQ ID NO: 300953 - DNA, 16 bp, C. familiaris
acatggggctcctcac

SEQ ID NO: 300954 - DNA, 16 bp, C. familiaris
acatgggggaggggag

SEQ ID NO: 300955 - DNA, 16 bp, C. familiaris
acatggggttcaaatt

SEQ ID NO: 300956 - DNA, 16 bp, C. familiaris
acatgggtggcacagt

SEQ ID NO: 300957 - DNA, 16 bp, C. familiaris
acatggtgacagatgg

SEQ ID NO: 300958 - DNA, 16 bp, C. familiaris
acatggtgctgggaaa

SEQ ID NO: 300959 - DNA, 16 bp, C. familiaris
acatgtacatacacac

SEQ ID NO: 300960 - DNA, 17 bp, C. familiaris
acatgtagatctttcat

SEQ ID NO: 300961 - DNA, 16 bp, C. familiaris
acatgtatacatatac

SEQ ID NO: 300962 - DNA, 16 bp, C. familiaris
acatgtgaattatatc

SEQ ID NO: 300963 - DNA, 16 bp, C. familiaris
acatgtgcattctctc

SEQ ID NO: 300964 - DNA, 16 bp, C. familiaris
acatgtggaatccaaa

SEQ ID NO: 300965 - DNA, 16 bp, C. familiaris
acattaaaaaaatgtt

SEQ ID NO: 300966 - DNA, 16 bp, C. familiaris
acattaagaaaataat

SEQ ID NO: 300967 - DNA, 16 bp, C. familiaris
acattaagggaaataa

SEQ ID NO: 300968 - DNA, 16 bp, C. familiaris
acattaatagaagaaa

SEQ ID NO: 300969 - DNA, 16 bp, C. familiaris
acattagcaaaatgaa

SEQ ID NO: 300970 - DNA, 16 bp, C. familiaris
acattatatagtttca

SEQ ID NO: 300971 - DNA, 16 bp, C. familiaris
acattatatccccagg

SEQ ID NO: 300972 - DNA, 16 bp, C. familiaris
acattatatttgaaat

SEQ ID NO: 300973 - DNA, 16 bp, C. familiaris
acattatgaatgtact

SEQ ID NO: 300974 - DNA, 16 bp, C. familiaris
acattatgctatgctt

SEQ ID NO: 300975 - DNA, 16 bp, C. familiaris
acattattgcaaatgg

SEQ ID NO: 300976 - DNA, 16 bp, C. familiaris
acattcaaaaatcagt

SEQ ID NO: 300977 - DNA, 16 bp, C. familiaris
acattcctggaaagcc

SEQ ID NO: 300978 - DNA, 16 bp, C. familiaris
acattctaaaagaaaa

SEQ ID NO: 300979 - DNA, 16 bp, C. familiaris
acattctagaaaaaaa

SEQ ID NO: 300980 - DNA, 16 bp, C. familiaris
acattctcaacaagat

SEQ ID NO: 300981 - DNA, 16 bp, C. familiaris
acattctgcattccat

SEQ ID NO: 300982 - DNA, 16 bp, C. familiaris
acattctggaaaagac

SEQ ID NO: 300983 - DNA, 16 bp, C. familiaris
acattgaaaactataa

SEQ ID NO: 300984 - DNA, 16 bp, C. familiaris
acattgaaagaaaaat

SEQ ID NO: 300985 - DNA, 16 bp, C. familiaris
acattgaaaggatcat

SEQ ID NO: 300986 - DNA, 16 bp, C. familiaris
acattgctactataaa

SEQ ID NO: 300987 - DNA, 16 bp, C. familiaris
acattgctggctttga

SEQ ID NO: 300988 - DNA, 16 bp, C. familiaris
acattgggctcgctgc

SEQ ID NO: 300989 - DNA, 16 bp, C. familiaris
acattgggtgcaggtg

SEQ ID NO: 300990 - DNA, 16 bp, C. familiaris
acattgtactgaaagt

SEQ ID NO: 300991 - DNA, 16 bp, C. familiaris
acatttaaaaaatctt

SEQ ID NO: 300992 - DNA, 16 bp, C. familiaris
acatttaaagaaataa

SEQ ID NO: 300993 - DNA, 16 bp, C. familiaris
acatttaaagaataaa

SEQ ID NO: 300994 - DNA, 16 bp, C. familiaris
acatttaaagaattaa

SEQ ID NO: 300995 - DNA, 16 bp, C. familiaris
acatttacatttacat

SEQ ID NO: 300996 - DNA, 16 bp, C. familiaris
acatttagaaaataaa

SEQ ID NO: 300997 - DNA, 16 bp, C. familiaris
acatttagaattgtta

SEQ ID NO: 300998 - DNA, 16 bp, C. familiaris
acatttatagaagaaa

SEQ ID NO: 300999 - DNA, 16 bp, C. familiaris
acatttattgtttcct

SEQ ID NO: 301000 - DNA, 16 bp, C. familiaris
acatttccatcatccc

SEQ ID NO: 301001 - DNA, 16 bp, C. familiaris
acatttctcagcatct

SEQ ID NO: 301002 - DNA, 16 bp, C. familiaris
acatttctgtttcctt

SEQ ID NO: 301003 - DNA, 16 bp, C. familiaris
acatttcttaaaaatg

SEQ ID NO: 301004 - DNA, 16 bp, C. familiaris
acatttgaaaagaatg

SEQ ID NO: 301005 - DNA, 16 bp, C. familiaris
acatttgaaattttcc

SEQ ID NO: 301006 - DNA, 16 bp, C. familiaris
acatttgggaaatgct

SEQ ID NO: 301007 - DNA, 16 bp, C. familiaris
acatttgtatgtgtgt

SEQ ID NO: 301008 - DNA, 16 bp, C. familiaris
acattttaaaaagcaa

SEQ ID NO: 301009 - DNA, 16 bp, C. familiaris
acattttaaaagcaaa

SEQ ID NO: 301010 - DNA, 16 bp, C. familiaris
acattttaagaaatat

SEQ ID NO: 301011 - DNA, 16 bp, C. familiaris
acattttcagaaaaaa

SEQ ID NO: 301012 - DNA, 16 bp, C. familiaris
acattttcatatttaa

SEQ ID NO: 301013 - DNA, 16 bp, C. familiaris
acattttcttccagaa

SEQ ID NO: 301014 - DNA, 16 bp, C. familiaris
acattttctttatcca

SEQ ID NO: 301015 - DNA, 16 bp, C. familiaris
acattttggagctagg

SEQ ID NO: 301016 - DNA, 16 bp, C. familiaris
acattttgttttatgt

SEQ ID NO: 301017 - DNA, 16 bp, C. familiaris
acatttttaaaagaga

SEQ ID NO: 301018 - DNA, 16 bp, C. familiaris
acatttttaacaaaat

SEQ ID NO: 301019 - DNA, 16 bp, C. familiaris
acatttttaattgttt

SEQ ID NO: 301020 - DNA, 16 bp, C. familiaris
acatttttacatatat

SEQ ID NO: 301021 - DNA, 16 bp, C. familiaris
acatttttgaaaatat

SEQ ID NO: 301022 - DNA, 16 bp, C. familiaris
acattttttcatatgt

SEQ ID NO: 301023 - DNA, 16 bp, C. familiaris
acattttttgtgtgtg

SEQ ID NO: 301024 - DNA, 16 bp, C. familiaris
accaaaaccagataag

SEQ ID NO: 301025 - DNA, 16 bp, C. familiaris
accaaaagcaaaggca

SEQ ID NO: 301026 - DNA, 16 bp, C. familiaris
accaaacatttttaaa

SEQ ID NO: 301027 - DNA, 16 bp, C. familiaris
accaaagaagacacag

SEQ ID NO: 301028 - DNA, 16 bp, C. familiaris
accaaagaagacatag

SEQ ID NO: 301029 - DNA, 16 bp, C. familiaris
accaaagagataaaag

SEQ ID NO: 301030 - DNA, 16 bp, C. familiaris
accaaatattttttaa

SEQ ID NO: 301031 - DNA, 16 bp, C. familiaris
accaaatgggagaaaa

SEQ ID NO: 301032 - DNA, 16 bp, C. familiaris
accaacagaaatttat

SEQ ID NO: 301033 - DNA, 16 bp, C. familiaris
accaacatttttcaca

SEQ ID NO: 301034 - DNA, 16 bp, C. familiaris
accaaccctgctgaca

SEQ ID NO: 301035 - DNA, 16 bp, C. familiaris
accaactgtaccaccc

SEQ ID NO: 301036 - DNA, 16 bp, C. familiaris
accaagactgatgtca

SEQ ID NO: 301037 - DNA, 16 bp, C. familiaris
accaagagatggaaaa

SEQ ID NO: 301038 - DNA, 16 bp, C. familiaris
accaagagctggacac

SEQ ID NO: 301039 - DNA, 16 bp, C. familiaris
accaagagtgcaagag

SEQ ID NO: 301040 - DNA, 16 bp, C. familiaris
accaagatgtcctttg

SEQ ID NO: 301041 - DNA, 16 bp, C. familiaris
accaagatgttcttca

SEQ ID NO: 301042 - DNA, 16 bp, C. familiaris
accaagcaattctctg

SEQ ID NO: 301043 - DNA, 16 bp, C. familiaris
accaagtctttttttt

SEQ ID NO: 301044 - DNA, 16 bp, C. familiaris
accaatggaatagaat

SEQ ID NO: 301045 - DNA, 16 bp, C. familiaris
accaatttcttatttt

SEQ ID NO: 301046 - DNA, 16 bp, C. familiaris
accacagaaatgtatt

SEQ ID NO: 301047 - DNA, 16 bp, C. familiaris
accacagtttgagaac

SEQ ID NO: 301048 - DNA, 16 bp, C. familiaris
accacatcctctccaa

SEQ ID NO: 301049 - DNA, 16 bp, C. familiaris
accaccaaagtttcca

SEQ ID NO: 301050 - DNA, 16 bp, C. familiaris
accaccaactgcttgg

SEQ ID NO: 301051 - DNA, 16 bp, C. familiaris
accaccaaggagccca

SEQ ID NO: 301052 - DNA, 16 bp, C. familiaris
accaccaccaccactg

SEQ ID NO: 301053 - DNA, 16 bp, C. familiaris
accaccaccatcatca

SEQ ID NO: 301054 - DNA, 16 bp, C. familiaris
accaccaccattacca

SEQ ID NO: 301055 - DNA, 16 bp, C. familiaris
accaccagcaccagca

SEQ ID NO: 301056 - DNA, 16 bp, C. familiaris
accaccatcaccatta

SEQ ID NO: 301057 - DNA, 16 bp, C. familiaris
accaccatcatcatca

SEQ ID NO: 301058 - DNA, 16 bp, C. familiaris
accacctgagcccccc

SEQ ID NO: 301059 - DNA, 16 bp, C. familiaris
accacctgcagcccag

SEQ ID NO: 301060 - DNA, 16 bp, C. familiaris
accaccttcctccaat

SEQ ID NO: 301061 - DNA, 16 bp, C. familiaris
accacgccctgggccg

SEQ ID NO: 301062 - DNA, 16 bp, C. familiaris
accactgagacaccag

SEQ ID NO: 301063 - DNA, 16 bp, C. familiaris
accactgagccagcca

SEQ ID NO: 301064 - DNA, 16 bp, C. familiaris
accactgagctaccag

SEQ ID NO: 301065 - DNA, 16 bp, C. familiaris
accactgatttgtttt

SEQ ID NO: 301066 - DNA, 16 bp, C. familiaris
accagaaaatgaaaac

SEQ ID NO: 301067 - DNA, 16 bp, C. familiaris
accagaagaaaatatt

SEQ ID NO: 301068 - DNA, 16 bp, C. familiaris
accagaagccagaaga

SEQ ID NO: 301069 - DNA, 16 bp, C. familiaris
accagacaaaactaag

SEQ ID NO: 301070 - DNA, 16 bp, C. familiaris
accagagacacttcct

SEQ ID NO: 301071 - DNA, 16 bp, C. familiaris
accagagccgggggca

SEQ ID NO: 301072 - DNA, 16 bp, C. familiaris
accagagctgggggca

SEQ ID NO: 301073 - DNA, 16 bp, C. familiaris
accagagggaggtggg

SEQ ID NO: 301074 - DNA, 16 bp, C. familiaris
accagatttatttttt

SEQ ID NO: 301075 - DNA, 16 bp, C. familiaris
accagcaaagaaatta

SEQ ID NO: 301076 - DNA, 16 bp, C. familiaris
accagcaccagcagca

SEQ ID NO: 301077 - DNA, 16 bp, C. familiaris
accagcaccccaatgt

SEQ ID NO: 301078 - DNA, 16 bp, C. familiaris
accagcagaaggaagg

SEQ ID NO: 301079 - DNA, 16 bp, C. familiaris
accagcagagccaccc

SEQ ID NO: 301080 - DNA, 16 bp, C. familiaris
accagcagcaacagca

SEQ ID NO: 301081 - DNA, 16 bp, C. familiaris
accagcagcctcagca

SEQ ID NO: 301082 - DNA, 16 bp, C. familiaris
accagcagggagaggg

SEQ ID NO: 301083 - DNA, 16 bp, C. familiaris
accagcatttggtatt

SEQ ID NO: 301084 - DNA, 16 bp, C. familiaris
accagcatttttcaca

SEQ ID NO: 301085 - DNA, 16 bp, C. familiaris
accagccaggagcccc

SEQ ID NO: 301086 - DNA, 16 bp, C. familiaris
accagctgagccacct

SEQ ID NO: 301087 - DNA, 16 bp, C. familiaris
accagctgcatgacct

SEQ ID NO: 301088 - DNA, 16 bp, C. familiaris
accagctttgtgtccc

SEQ ID NO: 301089 - DNA, 16 bp, C. familiaris
accaggacctgagcca

SEQ ID NO: 301090 - DNA, 16 bp, C. familiaris
accaggagctggaaga

SEQ ID NO: 301091 - DNA, 16 bp, C. familiaris
accaggaggaacaaca

SEQ ID NO: 301092 - DNA, 16 bp, C. familiaris
accaggaggtggttct

SEQ ID NO: 301093 - DNA, 16 bp, C. familiaris
accaggagttgattct

SEQ ID NO: 301094 - DNA, 16 bp, C. familiaris
accaggccctggacag

SEQ ID NO: 301095 - DNA, 16 bp, C. familiaris
accaggccctgggccg

SEQ ID NO: 301096 - DNA, 16 bp, C. familiaris
accaggccctgggctg

SEQ ID NO: 301097 - DNA, 16 bp, C. familiaris
accaggctccatgccc

SEQ ID NO: 301098 - DNA, 16 bp, C. familiaris
accagggaagaaattg

SEQ ID NO: 301099 - DNA, 16 bp, C. familiaris
accagggatcacaccc

SEQ ID NO: 301100 - DNA, 16 bp, C. familiaris
accagggccagatggc

SEQ ID NO: 301101 - DNA, 16 bp, C. familiaris
accagggctgcccgga

SEQ ID NO: 301102 - DNA, 16 bp, C. familiaris
accaggtgatgtatga

SEQ ID NO: 301103 - DNA, 16 bp, C. familiaris
accaggttgtctcctg

SEQ ID NO: 301104 - DNA, 16 bp, C. familiaris
accagtgagaatggca

SEQ ID NO: 301105 - DNA, 16 bp, C. familiaris
accagtgtgaggtggt

SEQ ID NO: 301106 - DNA, 16 bp, C. familiaris
accatacacaagacca

SEQ ID NO: 301107 - DNA, 16 bp, C. familiaris
accatactgttttggt

SEQ ID NO: 301108 - DNA, 16 bp, C. familiaris
accatatgaattcact

SEQ ID NO: 301109 - DNA, 16 bp, C. familiaris
accatcaacttaatat

SEQ ID NO: 301110 - DNA, 16 bp, C. familiaris
accatcaccaccatca

SEQ ID NO: 301111 - DNA, 16 bp, C. familiaris
accatcatcaccacca

SEQ ID NO: 301112 - DNA, 16 bp, C. familiaris
accatcatcatcatcc

SEQ ID NO: 301113 - DNA, 16 bp, C. familiaris
accatccactggaaaa

SEQ ID NO: 301114 - DNA, 17 bp, C. familiaris
accatgaagctttgagt

SEQ ID NO: 301115 - DNA, 16 bp, C. familiaris
accatgacctgagccg

SEQ ID NO: 301116 - DNA, 16 bp, C. familiaris
accatgatgagcactg

SEQ ID NO: 301117 - DNA, 16 bp, C. familiaris
accattaagtataatg

SEQ ID NO: 301118 - DNA, 16 bp, C. familiaris
accattcagatggtcc

SEQ ID NO: 301119 - DNA, 16 bp, C. familiaris
accatttaaaaaattt

SEQ ID NO: 301120 - DNA, 16 bp, C. familiaris
accatttaaaattttt

SEQ ID NO: 301121 - DNA, 16 bp, C. familiaris
accatttgtcaaagag

SEQ ID NO: 301122 - DNA, 16 bp, C. familiaris
accattttaataattt

SEQ ID NO: 301123 - DNA, 16 bp, C. familiaris
accattttacattctt

SEQ ID NO: 301124 - DNA, 16 bp, C. familiaris
accattttttaaaaga

SEQ ID NO: 301125 - DNA, 16 bp, C. familiaris
acccaaaagaatggaa

SEQ ID NO: 301126 - DNA, 16 bp, C. familiaris
acccaaagctatctac

SEQ ID NO: 301127 - DNA, 16 bp, C. familiaris
acccaacaggaagaga

SEQ ID NO: 301128 - DNA, 16 bp, C. familiaris
acccaacatggtgctt

SEQ ID NO: 301129 - DNA, 16 bp, C. familiaris
acccaagaccctggga

SEQ ID NO: 301130 - DNA, 16 bp, C. familiaris
acccaagagctctgat

SEQ ID NO: 301131 - DNA, 16 bp, C. familiaris
acccaagcacccctgg

SEQ ID NO: 301132 - DNA, 16 bp, C. familiaris
acccaagtgccccagt

SEQ ID NO: 301133 - DNA, 16 bp, C. familiaris
acccacacagttcaaa

SEQ ID NO: 301134 - DNA, 16 bp, C. familiaris
acccacagaatgcaca

SEQ ID NO: 301135 - DNA, 16 bp, C. familiaris
acccacagagaggcag

SEQ ID NO: 301136 - DNA, 16 bp, C. familiaris
acccacatggggctcc

SEQ ID NO: 301137 - DNA, 16 bp, C. familiaris
acccactgaggcaccc

SEQ ID NO: 301138 - DNA, 16 bp, C. familiaris
acccactgagtcagaa

SEQ ID NO: 301139 - DNA, 16 bp, C. familiaris
acccacttccctttct

SEQ ID NO: 301140 - DNA, 16 bp, C. familiaris
acccagaagccccaga

SEQ ID NO: 301141 - DNA, 16 bp, C. familiaris
acccagagatccccca

SEQ ID NO: 301142 - DNA, 16 bp, C. familiaris
acccagagctcatccc

SEQ ID NO: 301143 - DNA, 16 bp, C. familiaris
acccagagggacctgg

SEQ ID NO: 301144 - DNA, 16 bp, C. familiaris
acccagatgccccact

SEQ ID NO: 301145 - DNA, 16 bp, C. familiaris
acccagatgcccccat

SEQ ID NO: 301146 - DNA, 16 bp, C. familiaris
acccagcaagtgcact

SEQ ID NO: 301147 - DNA, 16 bp, C. familiaris
acccagcaattgcact

SEQ ID NO: 301148 - DNA, 16 bp, C. familiaris
acccagcagaagaaga

SEQ ID NO: 301149 - DNA, 16 bp, C. familiaris
acccagcatgaagccc

SEQ ID NO: 301150 - DNA, 16 bp, C. familiaris
acccagcgcagagccc

SEQ ID NO: 301151 - DNA, 16 bp, C. familiaris
acccagctcagagccc

SEQ ID NO: 301152 - DNA, 16 bp, C. familiaris
acccagctgactgccc

SEQ ID NO: 301153 - DNA, 16 bp, C. familiaris
acccaggaaagctggt

SEQ ID NO: 301154 - DNA, 16 bp, C. familiaris
acccaggaaattccaa

SEQ ID NO: 301155 - DNA, 16 bp, C. familiaris
acccaggaatccctgt

SEQ ID NO: 301156 - DNA, 16 bp, C. familiaris
acccaggaatctgcat

SEQ ID NO: 301157 - DNA, 16 bp, C. familiaris
acccaggaccctggaa

SEQ ID NO: 301158 - DNA, 16 bp, C. familiaris
acccaggagaagaagg

SEQ ID NO: 301159 - DNA, 16 bp, C. familiaris
acccaggagcccccag

SEQ ID NO: 301160 - DNA, 16 bp, C. familiaris
acccaggagcccccca

SEQ ID NO: 301161 - DNA, 16 bp, C. familiaris
acccaggagtccctct

SEQ ID NO: 301162 - DNA, 16 bp, C. familiaris
acccaggcacagacac

SEQ ID NO: 301163 - DNA, 16 bp, C. familiaris
acccaggcacccaaat

SEQ ID NO: 301164 - DNA, 16 bp, C. familiaris
acccaggcacccatga

SEQ ID NO: 301165 - DNA, 16 bp, C. familiaris
acccaggcacccccct

SEQ ID NO: 301166 - DNA, 16 bp, C. familiaris
acccaggcacccctgc

SEQ ID NO: 301167 - DNA, 16 bp, C. familiaris
acccaggcaccctgca

SEQ ID NO: 301168 - DNA, 16 bp, C. familiaris
acccaggcacctcaga

SEQ ID NO: 301169 - DNA, 16 bp, C. familiaris
acccaggcactcctga

SEQ ID NO: 301170 - DNA, 16 bp, C. familiaris
acccaggcagccctga

SEQ ID NO: 301171 - DNA, 16 bp, C. familiaris
acccaggcatcctggc

SEQ ID NO: 301172 - DNA, 16 bp, C. familiaris
acccaggcatctcata

SEQ ID NO: 301173 - DNA, 16 bp, C. familiaris
acccaggcatctccat

SEQ ID NO: 301174 - DNA, 16 bp, C. familiaris
acccaggcccccctgg

SEQ ID NO: 301175 - DNA, 16 bp, C. familiaris
acccaggcgtcctggg

SEQ ID NO: 301176 - DNA, 16 bp, C. familiaris
acccaggctcccctat

SEQ ID NO: 301177 - DNA, 16 bp, C. familiaris
acccaggctcccctga

SEQ ID NO: 301178 - DNA, 16 bp, C. familiaris
acccaggctgccccgg

SEQ ID NO: 301179 - DNA, 16 bp, C. familiaris
acccaggctgccctga

SEQ ID NO: 301180 - DNA, 16 bp, C. familiaris
acccaggctgcctgct

SEQ ID NO: 301181 - DNA, 16 bp, C. familiaris
acccagggacgcctgg

SEQ ID NO: 301182 - DNA, 16 bp, C. familiaris
acccagggatcctcag

SEQ ID NO: 301183 - DNA, 16 bp, C. familiaris
acccagggatcctgga

SEQ ID NO: 301184 - DNA, 16 bp, C. familiaris
acccagggatcctgtt

SEQ ID NO: 301185 - DNA, 16 bp, C. familiaris
acccagggatgccccc

SEQ ID NO: 301186 - DNA, 16 bp, C. familiaris
acccagggatgcccta

SEQ ID NO: 301187 - DNA, 16 bp, C. familiaris
acccagggcacctggg

SEQ ID NO: 301188 - DNA, 16 bp, C. familiaris
acccagggcagcccag

SEQ ID NO: 301189 - DNA, 16 bp, C. familiaris
acccagggccgaaggc

SEQ ID NO: 301190 - DNA, 16 bp, C. familiaris
acccaggggcccctgt

SEQ ID NO: 301191 - DNA, 16 bp, C. familiaris
acccaggggtccctgg

SEQ ID NO: 301192 - DNA, 16 bp, C. familiaris
acccaggtacccctct

SEQ ID NO: 301193 - DNA, 16 bp, C. familiaris
acccaggtatccccta

SEQ ID NO: 301194 - DNA, 16 bp, C. familiaris
acccaggtatccctga

SEQ ID NO: 301195 - DNA, 16 bp, C. familiaris
acccaggtgacccagg

SEQ ID NO: 301196 - DNA, 16 bp, C. familiaris
acccaggtgccacccc

SEQ ID NO: 301197 - DNA, 16 bp, C. familiaris
acccaggtgccccaga

SEQ ID NO: 301198 - DNA, 16 bp, C. familiaris
acccaggtgccccagg

SEQ ID NO: 301199 - DNA, 16 bp, C. familiaris
acccaggtgcccccaa

SEQ ID NO: 301200 - DNA, 16 bp, C. familiaris
acccaggtgcccctgg

SEQ ID NO: 301201 - DNA, 16 bp, C. familiaris
acccaggtgtcccttg

SEQ ID NO: 301202 - DNA, 16 bp, C. familiaris
acccaggtgtcctgaa

SEQ ID NO: 301203 - DNA, 16 bp, C. familiaris
acccaggtgtcctgcc

SEQ ID NO: 301204 - DNA, 16 bp, C. familiaris
acccagtcacccatcc

SEQ ID NO: 301205 - DNA, 16 bp, C. familiaris
acccagtgcagagcca

SEQ ID NO: 301206 - DNA, 16 bp, C. familiaris
acccagtgctcagcac

SEQ ID NO: 301207 - DNA, 16 bp, C. familiaris
acccagtgcttatccc

SEQ ID NO: 301208 - DNA, 16 bp, C. familiaris
acccatccatccttcc

SEQ ID NO: 301209 - DNA, 16 bp, C. familiaris
acccatctatatactg

SEQ ID NO: 301210 - DNA, 16 bp, C. familiaris
acccatctgggcctgg

SEQ ID NO: 301211 - DNA, 16 bp, C. familiaris
acccatgaccccaaga

SEQ ID NO: 301212 - DNA, 16 bp, C. familiaris
acccatgagatcaaga

SEQ ID NO: 301213 - DNA, 16 bp, C. familiaris
accccaatcccctgcc

SEQ ID NO: 301214 - DNA, 16 bp, C. familiaris
accccacagatacaga

SEQ ID NO: 301215 - DNA, 16 bp, C. familiaris
accccagacctgctga

SEQ ID NO: 301216 - DNA, 16 bp, C. familiaris
accccagagagctccc

SEQ ID NO: 301217 - DNA, 16 bp, C. familiaris
accccagagccctggg

SEQ ID NO: 301218 - DNA, 16 bp, C. familiaris
accccagctgaaatca

SEQ ID NO: 301219 - DNA, 16 bp, C. familiaris
accccaggaccccaag

SEQ ID NO: 301220 - DNA, 16 bp, C. familiaris
accccaggacctcagg

SEQ ID NO: 301221 - DNA, 16 bp, C. familiaris
accccaggaggggcag

SEQ ID NO: 301222 - DNA, 16 bp, C. familiaris
accccaggccacaggc

SEQ ID NO: 301223 - DNA, 16 bp, C. familiaris
accccaggctgcagga

SEQ ID NO: 301224 - DNA, 16 bp, C. familiaris
accccagggccccagg

SEQ ID NO: 301225 - DNA, 16 bp, C. familiaris
accccatgacccagca

SEQ ID NO: 301226 - DNA, 16 bp, C. familiaris
acccccaaccactgag

SEQ ID NO: 301227 - DNA, 16 bp, C. familiaris
acccccagatcaagag

SEQ ID NO: 301228 - DNA, 16 bp, C. familiaris
acccccaggacctcag

SEQ ID NO: 301229 - DNA, 16 bp, C. familiaris
accccccagcccctgg

SEQ ID NO: 301230 - DNA, 16 bp, C. familiaris
accccctgccctcctg

SEQ ID NO: 301231 - DNA, 16 bp, C. familiaris
accccgagactaagaa

SEQ ID NO: 301232 - DNA, 16 bp, C. familiaris
accccgagatcaaggg

SEQ ID NO: 301233 - DNA, 16 bp, C. familiaris
accccgaggtcccggg

SEQ ID NO: 301234 - DNA, 16 bp, C. familiaris
accccgcggccgagct

SEQ ID NO: 301235 - DNA, 16 bp, C. familiaris
accccggagtcctggg

SEQ ID NO: 301236 - DNA, 16 bp, C. familiaris
accccggggacctggg

SEQ ID NO: 301237 - DNA, 16 bp, C. familiaris
accccggggatcatga

SEQ ID NO: 301238 - DNA, 16 bp, C. familiaris
acccctgagatcacaa

SEQ ID NO: 301239 - DNA, 16 bp, C. familiaris
acccctgagccaccag

SEQ ID NO: 301240 - DNA, 16 bp, C. familiaris
acccctgagccaccca

SEQ ID NO: 301241 - DNA, 16 bp, C. familiaris
acccctgccctggccc

SEQ ID NO: 301242 - DNA, 16 bp, C. familiaris
acccctggatcacgcc

SEQ ID NO: 301243 - DNA, 16 bp, C. familiaris
acccctgtcagaatgg

SEQ ID NO: 301244 - DNA, 16 bp, C. familiaris
acccggaggagcagga

SEQ ID NO: 301245 - DNA, 16 bp, C. familiaris
accctaaaaaggaagt

SEQ ID NO: 301246 - DNA, 16 bp, C. familiaris
accctaatatcatgac

SEQ ID NO: 301247 - DNA, 16 bp, C. familiaris
accctaccacccagca

SEQ ID NO: 301248 - DNA, 16 bp, C. familiaris
accctagaatcatgac

SEQ ID NO: 301249 - DNA, 16 bp, C. familiaris
accctcaacaaggtag

SEQ ID NO: 301250 - DNA, 16 bp, C. familiaris
accctccatttgtttc

SEQ ID NO: 301251 - DNA, 16 bp, C. familiaris
accctgacctcagact

SEQ ID NO: 301252 - DNA, 16 bp, C. familiaris
accctgagaaaggcat

SEQ ID NO: 301253 - DNA, 16 bp, C. familiaris
accctgagagcaagag

SEQ ID NO: 301254 - DNA, 16 bp, C. familiaris
accctgagcccaagac

SEQ ID NO: 301255 - DNA, 16 bp, C. familiaris
accctgagctgaaatc

SEQ ID NO: 301256 - DNA, 16 bp, C. familiaris
accctgctcttccgcc

SEQ ID NO: 301257 - DNA, 16 bp, C. familiaris
accctgctcttctgcc

SEQ ID NO: 301258 - DNA, 16 bp, C. familiaris
accctggaatcatgcc

SEQ ID NO: 301259 - DNA, 16 bp, C. familiaris
accctggaccagatgg

SEQ ID NO: 301260 - DNA, 16 bp, C. familiaris
accctggactgcaggc

SEQ ID NO: 301261 - DNA, 16 bp, C. familiaris
accctggagaccctgg

SEQ ID NO: 301262 - DNA, 16 bp, C. familiaris
accctgggcaaaggca

SEQ ID NO: 301263 - DNA, 16 bp, C. familiaris
accctgggggtcctgg

SEQ ID NO: 301264 - DNA, 16 bp, C. familiaris
accctggggtcccagg

SEQ ID NO: 301265 - DNA, 16 bp, C. familiaris
accctgggttgcaggc

SEQ ID NO: 301266 - DNA, 16 bp, C. familiaris
accctgtgccaggcac

SEQ ID NO: 301267 - DNA, 16 bp, C. familiaris
accctgtgctgaaggc

SEQ ID NO: 301268 - DNA, 16 bp, C. familiaris
acccttgaacaacagg

SEQ ID NO: 301269 - DNA, 16 bp, C. familiaris
accctttcatctttga

SEQ ID NO: 301270 - DNA, 16 bp, C. familiaris
accgagccccacattg

SEQ ID NO: 301271 - DNA, 16 bp, C. familiaris
accgaggcaccttcca

SEQ ID NO: 301272 - DNA, 16 bp, C. familiaris
accgcaccctgggcca

SEQ ID NO: 301273 - DNA, 16 bp, C. familiaris
accgcagagccacccg

SEQ ID NO: 301274 - DNA, 16 bp, C. familiaris
accgccgagccacccg

SEQ ID NO: 301275 - DNA, 17 bp, C. familiaris
accgctgagccagctgg

SEQ ID NO: 301276 - DNA, 16 bp, C. familiaris
accgctgcaccaccgg

SEQ ID NO: 301277 - DNA, 16 bp, C. familiaris
accgggcagccctggt

SEQ ID NO: 301278 - DNA, 16 bp, C. familiaris
accggggctgcccaag

SEQ ID NO: 301279 - DNA, 16 bp, C. familiaris
accggggctgccctca

SEQ ID NO: 301280 - DNA, 16 bp, C. familiaris
acctaaagcctgaaaa

SEQ ID NO: 301281 - DNA, 16 bp, C. familiaris
acctaaatgtgagatg

SEQ ID NO: 301282 - DNA, 16 bp, C. familiaris
acctaaccaaaggggt

SEQ ID NO: 301283 - DNA, 16 bp, C. familiaris
acctaattacctctca

SEQ ID NO: 301284 - DNA, 16 bp, C. familiaris
acctacattaagaaaa

SEQ ID NO: 301285 - DNA, 16 bp, C. familiaris
acctaccatgtgccag

SEQ ID NO: 301286 - DNA, 16 bp, C. familiaris
acctactacgtgccag

SEQ ID NO: 301287 - DNA, 16 bp, C. familiaris
acctactatgttctag

SEQ ID NO: 301288 - DNA, 16 bp, C. familiaris
acctacttctccctct

SEQ ID NO: 301289 - DNA, 16 bp, C. familiaris
acctaggagtggaatg

SEQ ID NO: 301290 - DNA, 16 bp, C. familiaris
acctatctcacccatc

SEQ ID NO: 301291 - DNA, 16 bp, C. familiaris
acctatgggcagaaag

SEQ ID NO: 301292 - DNA, 16 bp, C. familiaris
acctatttcacccatt

SEQ ID NO: 301293 - DNA, 16 bp, C. familiaris
acctcaacaaatttaa

SEQ ID NO: 301294 - DNA, 16 bp, C. familiaris
acctcaacataataat

SEQ ID NO: 301295 - DNA, 16 bp, C. familiaris
acctcaagaccatgac

SEQ ID NO: 301296 - DNA, 16 bp, C. familiaris
acctcacaccaatcag

SEQ ID NO: 301297 - DNA, 16 bp, C. familiaris
acctcacaccagtcag

SEQ ID NO: 301298 - DNA, 16 bp, C. familiaris
acctcacacctgtcaa

SEQ ID NO: 301299 - DNA, 16 bp, C. familiaris
acctcacctacattcc

SEQ ID NO: 301300 - DNA, 16 bp, C. familiaris
acctcagaaagaaacc

SEQ ID NO: 301301 - DNA, 16 bp, C. familiaris
acctcagaatgtggct

SEQ ID NO: 301302 - DNA, 16 bp, C. familiaris
acctcagccacagcaa

SEQ ID NO: 301303 - DNA, 16 bp, C. familiaris
acctcagtgtccatca

SEQ ID NO: 301304 - DNA, 16 bp, C. familiaris
acctcatataaatgga

SEQ ID NO: 301305 - DNA, 16 bp, C. familiaris
acctcattaaccctgg

SEQ ID NO: 301306 - DNA, 16 bp, C. familiaris
acctcatttggaaata

SEQ ID NO: 301307 - DNA, 16 bp, C. familiaris
acctccagaagggctg

SEQ ID NO: 301308 - DNA, 16 bp, C. familiaris
acctcccaaagaccct

SEQ ID NO: 301309 - DNA, 16 bp, C. familiaris
acctcctcccctccag

SEQ ID NO: 301310 - DNA, 16 bp, C. familiaris
acctcctctgagaagc

SEQ ID NO: 301311 - DNA, 16 bp, C. familiaris
acctcctggatctgaa

SEQ ID NO: 301312 - DNA, 16 bp, C. familiaris
acctctcctccagcaa

SEQ ID NO: 301313 - DNA, 16 bp, C. familiaris
acctctctggacctca

SEQ ID NO: 301314 - DNA, 16 bp, C. familiaris
acctctctggacttca

SEQ ID NO: 301315 - DNA, 16 bp, C. familiaris
acctctctgggcccca

SEQ ID NO: 301316 - DNA, 16 bp, C. familiaris
acctctgcctccatct

SEQ ID NO: 301317 - DNA, 16 bp, C. familiaris
acctctttaaaaaaaa

SEQ ID NO: 301318 - DNA, 16 bp, C. familiaris
acctctttgtgcctca

SEQ ID NO: 301319 - DNA, 16 bp, C. familiaris
acctgaaagtaatatt

SEQ ID NO: 301320 - DNA, 16 bp, C. familiaris
acctgaaatgtggcta

SEQ ID NO: 301321 - DNA, 16 bp, C. familiaris
acctgaaccaaaggaa

SEQ ID NO: 301322 - DNA, 16 bp, C. familiaris
acctgaacctaaacca

SEQ ID NO: 301323 - DNA, 16 bp, C. familiaris
acctgaactgaaacca

SEQ ID NO: 301324 - DNA, 16 bp, C. familiaris
acctgagaggaaatca

SEQ ID NO: 301325 - DNA, 16 bp, C. familiaris
acctgagcagaaggaa

SEQ ID NO: 301326 - DNA, 16 bp, C. familiaris
acctgagccaaagaaa

SEQ ID NO: 301327 - DNA, 16 bp, C. familiaris
acctgagccaacacca

SEQ ID NO: 301328 - DNA, 16 bp, C. familiaris
acctgagccaagacca

SEQ ID NO: 301329 - DNA, 16 bp, C. familiaris
acctgagtggaaatca

SEQ ID NO: 301330 - DNA, 16 bp, C. familiaris
acctgcaaccaagaat

SEQ ID NO: 301331 - DNA, 16 bp, C. familiaris
acctgcacagcttggg

SEQ ID NO: 301332 - DNA, 16 bp, C. familiaris
acctgcacccagatgt

SEQ ID NO: 301333 - DNA, 17 bp, C. familiaris
acctgcacccccgatgt

SEQ ID NO: 301334 - DNA, 16 bp, C. familiaris
acctgcccccaggagc

SEQ ID NO: 301335 - DNA, 16 bp, C. familiaris
acctgcccttggctca

SEQ ID NO: 301336 - DNA, 16 bp, C. familiaris
acctgccttcggccca

SEQ ID NO: 301337 - DNA, 16 bp, C. familiaris
acctgctcctcctcct

SEQ ID NO: 301338 - DNA, 16 bp, C. familiaris
acctgctctccctctg

SEQ ID NO: 301339 - DNA, 16 bp, C. familiaris
acctgctgcacctgct

SEQ ID NO: 301340 - DNA, 16 bp, C. familiaris
acctgctgctgctgct

SEQ ID NO: 301341 - DNA, 16 bp, C. familiaris
acctgctgtgtgacct

SEQ ID NO: 301342 - DNA, 16 bp, C. familiaris
acctgctgttccttct

SEQ ID NO: 301343 - DNA, 16 bp, C. familiaris
acctgcttcagattct

SEQ ID NO: 301344 - DNA, 16 bp, C. familiaris
acctgcttttggctca

SEQ ID NO: 301345 - DNA, 16 bp, C. familiaris
acctggaaggtattat

SEQ ID NO: 301346 - DNA, 16 bp, C. familiaris
acctggagccaccaga

SEQ ID NO: 301347 - DNA, 16 bp, C. familiaris
acctggatgtcttctt

SEQ ID NO: 301348 - DNA, 16 bp, C. familiaris
acctggatgtgctcaa

SEQ ID NO: 301349 - DNA, 16 bp, C. familiaris
acctggcagctcccac

SEQ ID NO: 301350 - DNA, 16 bp, C. familiaris
acctggcaggccataa

SEQ ID NO: 301351 - DNA, 16 bp, C. familiaris
acctgggccaaaggta

SEQ ID NO: 301352 - DNA, 16 bp, C. familiaris
acctgggctgcccgcc

SEQ ID NO: 301353 - DNA, 16 bp, C. familiaris
acctgggctgccctgc

SEQ ID NO: 301354 - DNA, 16 bp, C. familiaris
acctgggctgcccttc

SEQ ID NO: 301355 - DNA, 16 bp, C. familiaris
acctgggctgcctggg

SEQ ID NO: 301356 - DNA, 16 bp, C. familiaris
acctgggctggcctgg

SEQ ID NO: 301357 - DNA, 16 bp, C. familiaris
acctggggatccctgg

SEQ ID NO: 301358 - DNA, 16 bp, C. familiaris
acctggggcagcccgg

SEQ ID NO: 301359 - DNA, 16 bp, C. familiaris
acctgggtgcccctca

SEQ ID NO: 301360 - DNA, 16 bp, C. familiaris
acctggtgactctgat

SEQ ID NO: 301361 - DNA, 16 bp, C. familiaris
acctgtattttaaaaa

SEQ ID NO: 301362 - DNA, 16 bp, C. familiaris
acctgtcagagtggct

SEQ ID NO: 301363 - DNA, 16 bp, C. familiaris
acctgtgactatgtta

SEQ ID NO: 301364 - DNA, 16 bp, C. familiaris
acctgtgacttgcttc

SEQ ID NO: 301365 - DNA, 16 bp, C. familiaris
acctgtgcttctgact

SEQ ID NO: 301366 - DNA, 16 bp, C. familiaris
acctgtgtggaggttc

SEQ ID NO: 301367 - DNA, 16 bp, C. familiaris
acctgtttaaaaaaaa

SEQ ID NO: 301368 - DNA, 16 bp, C. familiaris
acctgttttatttatt

SEQ ID NO: 301369 - DNA, 16 bp, C. familiaris
acctgttttccaaagt

SEQ ID NO: 301370 - DNA, 16 bp, C. familiaris
accttaaaaatttttt

SEQ ID NO: 301371 - DNA, 16 bp, C. familiaris
accttataatgtttgt

SEQ ID NO: 301372 - DNA, 16 bp, C. familiaris
accttcaacaaagaga

SEQ ID NO: 301373 - DNA, 16 bp, C. familiaris
accttccagttctatc

SEQ ID NO: 301374 - DNA, 26 bp, C. familiaris
accttcccgggcggaaaggggctcgc

SEQ ID NO: 301375 - DNA, 16 bp, C. familiaris
accttcccttctgcaa

SEQ ID NO: 301376 - DNA, 16 bp, C. familiaris
accttcctgcctccct

SEQ ID NO: 301377 - DNA, 16 bp, C. familiaris
accttcttggttaaat

SEQ ID NO: 301378 - DNA, 16 bp, C. familiaris
accttctttttttaaa

SEQ ID NO: 301379 - DNA, 16 bp, C. familiaris
accttgaaaacatttt

SEQ ID NO: 301380 - DNA, 16 bp, C. familiaris
accttgatcttggact

SEQ ID NO: 301381 - DNA, 16 bp, C. familiaris
accttgatggctcagt

SEQ ID NO: 301382 - DNA, 16 bp, C. familiaris
accttgctgaactcac

SEQ ID NO: 301383 - DNA, 16 bp, C. familiaris
accttggacaagtcac

SEQ ID NO: 301384 - DNA, 16 bp, C. familiaris
accttgggcaagtaac

SEQ ID NO: 301385 - DNA, 16 bp, C. familiaris
accttggggtccaagt

SEQ ID NO: 301386 - DNA, 16 bp, C. familiaris
accttgggtttggtga

SEQ ID NO: 301387 - DNA, 16 bp, C. familiaris
accttgtttggaaata

SEQ ID NO: 301388 - DNA, 16 bp, C. familiaris
acctttaaaaagaaaa

SEQ ID NO: 301389 - DNA, 16 bp, C. familiaris
acctttaaaaatgtaa

SEQ ID NO: 301390 - DNA, 16 bp, C. familiaris
acctttcattttcagg

SEQ ID NO: 301391 - DNA, 16 bp, C. familiaris
acctttgcacttgctg

SEQ ID NO: 301392 - DNA, 16 bp, C. familiaris
accttttaaattttaa

SEQ ID NO: 301393 - DNA, 16 bp, C. familiaris
acgaatccaacagcgc

SEQ ID NO: 301394 - DNA, 16 bp, C. familiaris
acgacccacaggaaag

SEQ ID NO: 301395 - DNA, 16 bp, C. familiaris
acgacgacgacgacga

SEQ ID NO: 301396 - DNA, 16 bp, C. familiaris
acgaggctccttccac

SEQ ID NO: 301397 - DNA, 16 bp, C. familiaris
acgatctcactcatat

SEQ ID NO: 301398 - DNA, 16 bp, C. familiaris
acgatgatgatgatga

SEQ ID NO: 301399 - DNA, 16 bp, C. familiaris
acgcaggagctgcacc

SEQ ID NO: 301400 - DNA, 16 bp, C. familiaris
acgcgcgcgcgcacac

SEQ ID NO: 301401 - DNA, 16 bp, C. familiaris
acgctgctggtgggaa

SEQ ID NO: 301402 - DNA, 16 bp, C. familiaris
acggagagctccggag

SEQ ID NO: 301403 - DNA, 16 bp, C. familiaris
acggatttggtaatga

SEQ ID NO: 301404 - DNA, 16 bp, C. familiaris
acggcagcctgggtgg

SEQ ID NO: 301405 - DNA, 16 bp, C. familiaris
acggccaccctgacca

SEQ ID NO: 301406 - DNA, 16 bp, C. familiaris
acggggcagcccgggt

SEQ ID NO: 301407 - DNA, 16 bp, C. familiaris
acgggggctgccctat

SEQ ID NO: 301408 - DNA, 16 bp, C. familiaris
acgtcagaaagccaat

SEQ ID NO: 301409 - DNA, 16 bp, C. familiaris
acgtggagctcgatcc

SEQ ID NO: 301410 - DNA, 16 bp, C. familiaris
acgtgggattctatcc

SEQ ID NO: 301411 - DNA, 16 bp, C. familiaris
acgtggggcttgattc

SEQ ID NO: 301412 - DNA, 16 bp, C. familiaris
acgtggtctatgtata

SEQ ID NO: 301413 - DNA, 16 bp, C. familiaris
acgtgtgtttgtgtgt

SEQ ID NO: 301414 - DNA, 16 bp, C. familiaris
acgttgggctacctgc

SEQ ID NO: 301415 - DNA, 16 bp, C. familiaris
actaaaaccagataaa

SEQ ID NO: 301416 - DNA, 16 bp, C. familiaris
actaaaggagtttatg

SEQ ID NO: 301417 - DNA, 16 bp, C. familiaris
actaacaatgaattat

SEQ ID NO: 301418 - DNA, 16 bp, C. familiaris
actaactggaatttta

SEQ ID NO: 301419 - DNA, 16 bp, C. familiaris
actaagaggcaaccta

SEQ ID NO: 301420 - DNA, 16 bp, C. familiaris
actaagctgaaatcaa

SEQ ID NO: 301421 - DNA, 16 bp, C. familiaris
actaaggagaaggggg

SEQ ID NO: 301422 - DNA, 16 bp, C. familiaris
actaagtggggagtct

SEQ ID NO: 301423 - DNA, 16 bp, C. familiaris
actaataaattcagca

SEQ ID NO: 301424 - DNA, 16 bp, C. familiaris
actaatcatcaaagaa

SEQ ID NO: 301425 - DNA, 16 bp, C. familiaris
actaatcatcagagaa

SEQ ID NO: 301426 - DNA, 16 bp, C. familiaris
actaatctaatttctg

SEQ ID NO: 301427 - DNA, 16 bp, C. familiaris
actaatgaaagaaatt

SEQ ID NO: 301428 - DNA, 16 bp, C. familiaris
actaatttgcattccc

SEQ ID NO: 301429 - DNA, 16 bp, C. familiaris
actacagaaagagccc

SEQ ID NO: 301430 - DNA, 16 bp, C. familiaris
actacagagaacaaat

SEQ ID NO: 301431 - DNA, 16 bp, C. familiaris
actacagagagaagag

SEQ ID NO: 301432 - DNA, 16 bp, C. familiaris
actacatcttccttat

SEQ ID NO: 301433 - DNA, 16 bp, C. familiaris
actacatttcccagga

SEQ ID NO: 301434 - DNA, 16 bp, C. familiaris
actacatttttaaaaa

SEQ ID NO: 301435 - DNA, 16 bp, C. familiaris
actaccaaaagtggaa

SEQ ID NO: 301436 - DNA, 16 bp, C. familiaris
actaccagtttgttct

SEQ ID NO: 301437 - DNA, 16 bp, C. familiaris
actacccaaagcagtc

SEQ ID NO: 301438 - DNA, 16 bp, C. familiaris
actactactactacta

SEQ ID NO: 301439 - DNA, 16 bp, C. familiaris
actactcagcagtaaa

SEQ ID NO: 301440 - DNA, 16 bp, C. familiaris
actactgagtcagcca

SEQ ID NO: 301441 - DNA, 16 bp, C. familiaris
actagaaggaaaactt

SEQ ID NO: 301442 - DNA, 16 bp, C. familiaris
actagatagtggtgat

SEQ ID NO: 301443 - DNA, 16 bp, C. familiaris
actagggcagccccag

SEQ ID NO: 301444 - DNA, 16 bp, C. familiaris
actatacatatatata

SEQ ID NO: 301445 - DNA, 16 bp, C. familiaris
actatccactgggaaa

SEQ ID NO: 301446 - DNA, 16 bp, C. familiaris
actatcctttctccat

SEQ ID NO: 301447 - DNA, 16 bp, C. familiaris
actatcttgatgatta

SEQ ID NO: 301448 - DNA, 16 bp, C. familiaris
actattactattattg

SEQ ID NO: 301449 - DNA, 16 bp, C. familiaris
actattgagactacat

SEQ ID NO: 301450 - DNA, 16 bp, C. familiaris
actatttctttaaaaa

SEQ ID NO: 301451 - DNA, 16 bp, C. familiaris
actattttccaaagaa

SEQ ID NO: 301452 - DNA, 16 bp, C. familiaris
actcaacatcaaagaa

SEQ ID NO: 301453 - DNA, 16 bp, C. familiaris
actcaaccaactgtgc

SEQ ID NO: 301454 - DNA, 16 bp, C. familiaris
actcaagccaaaggca

SEQ ID NO: 301455 - DNA, 16 bp, C. familiaris
actcagaaaactacag

SEQ ID NO: 301456 - DNA, 16 bp, C. familiaris
actcagaaaatatttt

SEQ ID NO: 301457 - DNA, 16 bp, C. familiaris
actcagaatctgcatt

SEQ ID NO: 301458 - DNA, 16 bp, C. familiaris
actcagagaggagtct

SEQ ID NO: 301459 - DNA, 16 bp, C. familiaris
actcagatacagagaa

SEQ ID NO: 301460 - DNA, 16 bp, C. familiaris
actcagcatcagagaa

SEQ ID NO: 301461 - DNA, 16 bp, C. familiaris
actcagcattatactc

SEQ ID NO: 301462 - DNA, 18 bp, C. familiaris
actcagctattagaaatg

SEQ ID NO: 301463 - DNA, 16 bp, C. familiaris
actcagctgcctcgat

SEQ ID NO: 301464 - DNA, 16 bp, C. familiaris
actcagcttccttcct

SEQ ID NO: 301465 - DNA, 16 bp, C. familiaris
actcaggcatcaaaaa

SEQ ID NO: 301466 - DNA, 16 bp, C. familiaris
actcaggtgccccacc

SEQ ID NO: 301467 - DNA, 16 bp, C. familiaris
actcaggtgcccccag

SEQ ID NO: 301468 - DNA, 16 bp, C. familiaris
actcagtatgtgatct

SEQ ID NO: 301469 - DNA, 16 bp, C. familiaris
actcagtggagagtct

SEQ ID NO: 301470 - DNA, 16 bp, C. familiaris
actcagttactccatc

SEQ ID NO: 301471 - DNA, 16 bp, C. familiaris
actcagttgaattttg

SEQ ID NO: 301472 - DNA, 16 bp, C. familiaris
actcatcatcaaagaa

SEQ ID NO: 301473 - DNA, 16 bp, C. familiaris
actcatcatcagagaa

SEQ ID NO: 301474 - DNA, 16 bp, C. familiaris
actcatcctgggactc

SEQ ID NO: 301475 - DNA, 16 bp, C. familiaris
actcatcctttctgat

SEQ ID NO: 301476 - DNA, 16 bp, C. familiaris
actcatgtatggaatt

SEQ ID NO: 301477 - DNA, 16 bp, C. familiaris
actcatgtgtgtgtgt

SEQ ID NO: 301478 - DNA, 16 bp, C. familiaris
actcatttaaccctca

SEQ ID NO: 301479 - DNA, 16 bp, C. familiaris
actccaataaaaaatg

SEQ ID NO: 301480 - DNA, 16 bp, C. familiaris
actccaccaagaaact

SEQ ID NO: 301481 - DNA, 16 bp, C. familiaris
actccaccactgagcc

SEQ ID NO: 301482 - DNA, 16 bp, C. familiaris
actccactaaaaagga

SEQ ID NO: 301483 - DNA, 16 bp, C. familiaris
actccaggatcaccct

SEQ ID NO: 301484 - DNA, 16 bp, C. familiaris
actccaggcagaggga

SEQ ID NO: 301485 - DNA, 16 bp, C. familiaris
actccagggtcacacc

SEQ ID NO: 301486 - DNA, 16 bp, C. familiaris
actccatcccagatct

SEQ ID NO: 301487 - DNA, 16 bp, C. familiaris
actccatccccagacc

SEQ ID NO: 301488 - DNA, 16 bp, C. familiaris
actcccagcccctggc

SEQ ID NO: 301489 - DNA, 16 bp, C. familiaris
actccccactgggcag

SEQ ID NO: 301490 - DNA, 16 bp, C. familiaris
actccctccatggagc

SEQ ID NO: 301491 - DNA, 16 bp, C. familiaris
actccctgctgaacat

SEQ ID NO: 301492 - DNA, 16 bp, C. familiaris
actccctgctgagggc

SEQ ID NO: 301493 - DNA, 16 bp, C. familiaris
actccctgctgagtac

SEQ ID NO: 301494 - DNA, 16 bp, C. familiaris
actcctcattgagcag

SEQ ID NO: 301495 - DNA, 16 bp, C. familiaris
actcctccctgagcag

SEQ ID NO: 301496 - DNA, 16 bp, C. familiaris
actcctgaaagaaatt

SEQ ID NO: 301497 - DNA, 16 bp, C. familiaris
actcctgattttggtt

SEQ ID NO: 301498 - DNA, 16 bp, C. familiaris
actcctggctggctca

SEQ ID NO: 301499 - DNA, 16 bp, C. familiaris
actcctgggtcagaga

SEQ ID NO: 301500 - DNA, 41 bp, C. familiaris
actcgataggtcttctaagcaaaacatctccaaagaaacga

SEQ ID NO: 301501 - DNA, 16 bp, C. familiaris
actctaatgacctcat

SEQ ID NO: 301502 - DNA, 16 bp, C. familiaris
actctagaaaatgcaa

SEQ ID NO: 301503 - DNA, 16 bp, C. familiaris
actctatactgttttc

SEQ ID NO: 301504 - DNA, 16 bp, C. familiaris
actctatgctgagcat

SEQ ID NO: 301505 - DNA, 16 bp, C. familiaris
actctcctcactgttg

SEQ ID NO: 301506 - DNA, 16 bp, C. familiaris
actctcctgctgctgg

SEQ ID NO: 301507 - DNA, 16 bp, C. familiaris
actctctctgattttt

SEQ ID NO: 301508 - DNA, 16 bp, C. familiaris
actctctcttctacct

SEQ ID NO: 301509 - DNA, 16 bp, C. familiaris
actctgaaaaaaatat

SEQ ID NO: 301510 - DNA, 16 bp, C. familiaris
actctgacaatctctg

SEQ ID NO: 301511 - DNA, 16 bp, C. familiaris
actctgacaggtgtga

SEQ ID NO: 301512 - DNA, 16 bp, C. familiaris
actctgagaaacaaag

SEQ ID NO: 301513 - DNA, 16 bp, C. familiaris
actctgagctgagcag

SEQ ID NO: 301514 - DNA, 16 bp, C. familiaris
actctgatgaaagaaa

SEQ ID NO: 301515 - DNA, 16 bp, C. familiaris
actctgccaccatctt

SEQ ID NO: 301516 - DNA, 16 bp, C. familiaris
actctgccacccaggt

SEQ ID NO: 301517 - DNA, 16 bp, C. familiaris
actctgcctatttgtg

SEQ ID NO: 301518 - DNA, 16 bp, C. familiaris
actctgctgctgtgtt

SEQ ID NO: 301519 - DNA, 16 bp, C. familiaris
actctggaaaacaaat

SEQ ID NO: 301520 - DNA, 16 bp, C. familiaris
actctggcatcatgac

SEQ ID NO: 301521 - DNA, 16 bp, C. familiaris
actctgtgaatatatt

SEQ ID NO: 301522 - DNA, 16 bp, C. familiaris
actctgtgctgagctc

SEQ ID NO: 301523 - DNA, 16 bp, C. familiaris
actcttaaaaagaaaa

SEQ ID NO: 301524 - DNA, 16 bp, C. familiaris
actcttccgtcatctt

SEQ ID NO: 301525 - DNA, 16 bp, C. familiaris
actcttgagatcatga

SEQ ID NO: 301526 - DNA, 16 bp, C. familiaris
actcttgattttggtt

SEQ ID NO: 301527 - DNA, 16 bp, C. familiaris
actctttaaaaatgtg

SEQ ID NO: 301528 - DNA, 16 bp, C. familiaris
actgaaaactatgaaa

SEQ ID NO: 301529 - DNA, 16 bp, C. familiaris
actgaaaataattttt

SEQ ID NO: 301530 - DNA, 16 bp, C. familiaris
actgaaaatggattaa

SEQ ID NO: 301531 - DNA, 16 bp, C. familiaris
actgaaactctgtact

SEQ ID NO: 301532 - DNA, 16 bp, C. familiaris
actgaaagaaaaagtg

SEQ ID NO: 301533 - DNA, 16 bp, C. familiaris
actgaaagctttttct

SEQ ID NO: 301534 - DNA, 16 bp, C. familiaris
actgaaagtgaaggaa

SEQ ID NO: 301535 - DNA, 16 bp, C. familiaris
actgaaatgaaaaata

SEQ ID NO: 301536 - DNA, 16 bp, C. familiaris
actgaaattttttaaa

SEQ ID NO: 301537 - DNA, 16 bp, C. familiaris
actgaacagcaacatg

SEQ ID NO: 301538 - DNA, 16 bp, C. familiaris
actgaagaaagtgaaa

SEQ ID NO: 301539 - DNA, 16 bp, C. familiaris
actgaagaagaaatag

SEQ ID NO: 301540 - DNA, 16 bp, C. familiaris
actgaagctcagaaaa

SEQ ID NO: 301541 - DNA, 16 bp, C. familiaris
actgaaggaaaaagtg

SEQ ID NO: 301542 - DNA, 16 bp, C. familiaris
actgaaggaaaagaaa

SEQ ID NO: 301543 - DNA, 16 bp, C. familiaris
actgaaggcagaagct

SEQ ID NO: 301544 - DNA, 16 bp, C. familiaris
actgaagggaaaaaaa

SEQ ID NO: 301545 - DNA, 16 bp, C. familiaris
actgaagtcaccaagt

SEQ ID NO: 301546 - DNA, 16 bp, C. familiaris
actgaagttcagagaa

SEQ ID NO: 301547 - DNA, 16 bp, C. familiaris
actgaagttcagagag

SEQ ID NO: 301548 - DNA, 16 bp, C. familiaris
actgaataaaaatgaa

SEQ ID NO: 301549 - DNA, 16 bp, C. familiaris
actgaattatgaagaa

SEQ ID NO: 301550 - DNA, 16 bp, C. familiaris
actgaatttattttaa

SEQ ID NO: 301551 - DNA, 16 bp, C. familiaris
actgaatttttttaaa

SEQ ID NO: 301552 - DNA, 16 bp, C. familiaris
actgacaaaatccaaa

SEQ ID NO: 301553 - DNA, 16 bp, C. familiaris
actgactgagccccca

SEQ ID NO: 301554 - DNA, 16 bp, C. familiaris
actgacttaaaaaaaa

SEQ ID NO: 301555 - DNA, 16 bp, C. familiaris
actgacttatttttct

SEQ ID NO: 301556 - DNA, 16 bp, C. familiaris
actgagaaccactgct

SEQ ID NO: 301557 - DNA, 16 bp, C. familiaris
actgagaatccagaaa

SEQ ID NO: 301558 - DNA, 16 bp, C. familiaris
actgagacccagagaa

SEQ ID NO: 301559 - DNA, 16 bp, C. familiaris
actgagagaggcagag

SEQ ID NO: 301560 - DNA, 16 bp, C. familiaris
actgagattcagagaa

SEQ ID NO: 301561 - DNA, 16 bp, C. familiaris
actgagcaaggagctg

SEQ ID NO: 301562 - DNA, 16 bp, C. familiaris
actgagcagaaaccaa

SEQ ID NO: 301563 - DNA, 16 bp, C. familiaris
actgagcagggagccc

SEQ ID NO: 301564 - DNA, 16 bp, C. familiaris
actgagccacacaagc

SEQ ID NO: 301565 - DNA, 16 bp, C. familiaris
actgagccagccaagc

SEQ ID NO: 301566 - DNA, 16 bp, C. familiaris
actgagccccacactg

SEQ ID NO: 301567 - DNA, 16 bp, C. familiaris
actgagctaaaaccaa

SEQ ID NO: 301568 - DNA, 16 bp, C. familiaris
actgaggcacaaagag

SEQ ID NO: 301569 - DNA, 16 bp, C. familiaris
actgaggcacagaaag

SEQ ID NO: 301570 - DNA, 16 bp, C. familiaris
actgaggcagagaaag

SEQ ID NO: 301571 - DNA, 16 bp, C. familiaris
actgaggcctcctgcc

SEQ ID NO: 301572 - DNA, 16 bp, C. familiaris
actgagggttgctggg

SEQ ID NO: 301573 - DNA, 16 bp, C. familiaris
actgagtattatataa

SEQ ID NO: 301574 - DNA, 16 bp, C. familiaris
actgagtcactcaggc

SEQ ID NO: 301575 - DNA, 27 bp, C. familiaris
actgagtccagccggctataaatctaa

SEQ ID NO: 301576 - DNA, 16 bp, C. familiaris
actgatctgctcagct

SEQ ID NO: 301577 - DNA, 16 bp, C. familiaris
actgatgaaaaaaatt

SEQ ID NO: 301578 - DNA, 16 bp, C. familiaris
actgatgcccagagag

SEQ ID NO: 301579 - DNA, 16 bp, C. familiaris
actgattcaaatgtta

SEQ ID NO: 301580 - DNA, 16 bp, C. familiaris
actgattttcaaaaaa

SEQ ID NO: 301581 - DNA, 16 bp, C. familiaris
actgcaggagctgaat

SEQ ID NO: 301582 - DNA, 16 bp, C. familiaris
actgcattgtatattt

SEQ ID NO: 301583 - DNA, 16 bp, C. familiaris
actgcatttaaaaaaa

SEQ ID NO: 301584 - DNA, 16 bp, C. familiaris
actgcattttttaaaa

SEQ ID NO: 301585 - DNA, 16 bp, C. familiaris
actgccaccttcagcc

SEQ ID NO: 301586 - DNA, 16 bp, C. familiaris
actgcccctcctgcgg

SEQ ID NO: 301587 - DNA, 16 bp, C. familiaris
actgcctacagcccag

SEQ ID NO: 301588 - DNA, 16 bp, C. familiaris
actgcctctggctcag

SEQ ID NO: 301589 - DNA, 16 bp, C. familiaris
actgcctgtgctctct

SEQ ID NO: 301590 - DNA, 16 bp, C. familiaris
actgctataaacatca

SEQ ID NO: 301591 - DNA, 16 bp, C. familiaris
actgctcaggaaaaaa

SEQ ID NO: 301592 - DNA, 16 bp, C. familiaris
actgctgaaaatcaaa

SEQ ID NO: 301593 - DNA, 16 bp, C. familiaris
actgctgagcctccca

SEQ ID NO: 301594 - DNA, 16 bp, C. familiaris
actgctggaagaacaa

SEQ ID NO: 301595 - DNA, 16 bp, C. familiaris
actgctgggccacctg

SEQ ID NO: 301596 - DNA, 16 bp, C. familiaris
actgctgggccattgg

SEQ ID NO: 301597 - DNA, 16 bp, C. familiaris
actgcttctccccctg

SEQ ID NO: 301598 - DNA, 16 bp, C. familiaris
actgcttctctctctg

SEQ ID NO: 301599 - DNA, 16 bp, C. familiaris
actgctttaagaattt

SEQ ID NO: 301600 - DNA, 16 bp, C. familiaris
actgctttgttttaaa

SEQ ID NO: 301601 - DNA, 16 bp, C. familiaris
actgcttttgtgcttc

SEQ ID NO: 301602 - DNA, 16 bp, C. familiaris
actggaaaaaacacaa

SEQ ID NO: 301603 - DNA, 16 bp, C. familiaris
actggaaaaaagacaa

SEQ ID NO: 301604 - DNA, 16 bp, C. familiaris
actggaacaaataatc

SEQ ID NO: 301605 - DNA, 16 bp, C. familiaris
actggaacacagccat

SEQ ID NO: 301606 - DNA, 16 bp, C. familiaris
actggaactggaagaa

SEQ ID NO: 301607 - DNA, 16 bp, C. familiaris
actggaagaaaaaaat

SEQ ID NO: 301608 - DNA, 16 bp, C. familiaris
actggaagaaaaagaa

SEQ ID NO: 301609 - DNA, 16 bp, C. familiaris
actggaagaaaataaa

SEQ ID NO: 301610 - DNA, 16 bp, C. familiaris
actggaaggtattatg

SEQ ID NO: 301611 - DNA, 16 bp, C. familiaris
actggaattaaaagaa

SEQ ID NO: 301612 - DNA, 16 bp, C. familiaris
actggacaacctagaa

SEQ ID NO: 301613 - DNA, 16 bp, C. familiaris
actggagaaaagacag

SEQ ID NO: 301614 - DNA, 16 bp, C. familiaris
actggagagaaacctt

SEQ ID NO: 301615 - DNA, 16 bp, C. familiaris
actggagcagccactg

SEQ ID NO: 301616 - DNA, 16 bp, C. familiaris
actggagctgaaatca

SEQ ID NO: 301617 - DNA, 16 bp, C. familiaris
actggatcagatggac

SEQ ID NO: 301618 - DNA, 16 bp, C. familiaris
actggatcccagggcc

SEQ ID NO: 301619 - DNA, 16 bp, C. familiaris
actggatgaaaaagca

SEQ ID NO: 301620 - DNA, 16 bp, C. familiaris
actggatgacaggcat

SEQ ID NO: 301621 - DNA, 16 bp, C. familiaris
actggattcttcccag

SEQ ID NO: 301622 - DNA, 16 bp, C. familiaris
actggattctttcact

SEQ ID NO: 301623 - DNA, 16 bp, C. familiaris
actggcacaagaacag

SEQ ID NO: 301624 - DNA, 16 bp, C. familiaris
actggcagaaggagaa

SEQ ID NO: 301625 - DNA, 16 bp, C. familiaris
actggccacccaggtg

SEQ ID NO: 301626 - DNA, 16 bp, C. familiaris
actgggaaaactggac

SEQ ID NO: 301627 - DNA, 16 bp, C. familiaris
actgggaaaaggaaga

SEQ ID NO: 301628 - DNA, 16 bp, C. familiaris
actgggaaaatatttg

SEQ ID NO: 301629 - DNA, 16 bp, C. familiaris
actgggactcctgggt

SEQ ID NO: 301630 - DNA, 16 bp, C. familiaris
actgggagctctttca

SEQ ID NO: 301631 - DNA, 16 bp, C. familiaris
actgggccagatggac

SEQ ID NO: 301632 - DNA, 16 bp, C. familiaris
actggggaaactgagg

SEQ ID NO: 301633 - DNA, 16 bp, C. familiaris
actggggagccatgga

SEQ ID NO: 301634 - DNA, 16 bp, C. familiaris
actggggcatctgggt

SEQ ID NO: 301635 - DNA, 16 bp, C. familiaris
actgggggcacctggg

SEQ ID NO: 301636 - DNA, 16 bp, C. familiaris
actgggggcagagacc

SEQ ID NO: 301637 - DNA, 16 bp, C. familiaris
actgggtgtagagcct

SEQ ID NO: 301638 - DNA, 16 bp, C. familiaris
actggtggtcaccaga

SEQ ID NO: 301639 - DNA, 16 bp, C. familiaris
actggtgtgaggtggc

SEQ ID NO: 301640 - DNA, 23 bp, C. familiaris
actggttaatgataacaatgcat

SEQ ID NO: 301641 - DNA, 16 bp, C. familiaris
actggttcttttttat

SEQ ID NO: 301642 - DNA, 16 bp, C. familiaris
actgtaaatgtgtttt

SEQ ID NO: 301643 - DNA, 16 bp, C. familiaris
actgtaagaaaatgaa

SEQ ID NO: 301644 - DNA, 16 bp, C. familiaris
actgtaagaaataaat

SEQ ID NO: 301645 - DNA, 16 bp, C. familiaris
actgtaagaaatacat

SEQ ID NO: 301646 - DNA, 16 bp, C. familiaris
actgtaagctctgtga

SEQ ID NO: 301647 - DNA, 16 bp, C. familiaris
actgtaataaaagtta

SEQ ID NO: 301648 - DNA, 17 bp, C. familiaris
actgtatcatacttaaa

SEQ ID NO: 301649 - DNA, 16 bp, C. familiaris
actgtattccctgtgc

SEQ ID NO: 301650 - DNA, 16 bp, C. familiaris
actgtattctttgctg

SEQ ID NO: 301651 - DNA, 16 bp, C. familiaris
actgtatttatttatt

SEQ ID NO: 301652 - DNA, 16 bp, C. familiaris
actgtcaacccagaat

SEQ ID NO: 301653 - DNA, 16 bp, C. familiaris
actgtccttctccgat

SEQ ID NO: 301654 - DNA, 16 bp, C. familiaris
actgtgcaaaagtttt

SEQ ID NO: 301655 - DNA, 16 bp, C. familiaris
actgtgccacccagat

SEQ ID NO: 301656 - DNA, 16 bp, C. familiaris
actgtggaacagatta

SEQ ID NO: 301657 - DNA, 16 bp, C. familiaris
actgtggagggagcct

SEQ ID NO: 301658 - DNA, 16 bp, C. familiaris
actgtggccattgctg

SEQ ID NO: 301659 - DNA, 16 bp, C. familiaris
actgtggctttgattt

SEQ ID NO: 301660 - DNA, 16 bp, C. familiaris
actgtgtacttctggt

SEQ ID NO: 301661 - DNA, 16 bp, C. familiaris
actgtgtgccaagcat

SEQ ID NO: 301662 - DNA, 16 bp, C. familiaris
actgtgtgccagatac

SEQ ID NO: 301663 - DNA, 16 bp, C. familiaris
actgtgtgccaggccc

SEQ ID NO: 301664 - DNA, 16 bp, C. familiaris
actgtgtgtttgtgtg

SEQ ID NO: 301665 - DNA, 16 bp, C. familiaris
actgttctggaggcca

SEQ ID NO: 301666 - DNA, 16 bp, C. familiaris
actgttctggaggctg

SEQ ID NO: 301667 - DNA, 16 bp, C. familiaris
actgttgaaagaaatt

SEQ ID NO: 301668 - DNA, 16 bp, C. familiaris
actgtttcatttgctg

SEQ ID NO: 301669 - DNA, 16 bp, C. familiaris
actgtttccagagtgg

SEQ ID NO: 301670 - DNA, 16 bp, C. familiaris
actgtttgattactat

SEQ ID NO: 301671 - DNA, 16 bp, C. familiaris
actgttttctatagtg

SEQ ID NO: 301672 - DNA, 16 bp, C. familiaris
actgttttctctttgt

SEQ ID NO: 301673 - DNA, 16 bp, C. familiaris
actgtttttattatta

SEQ ID NO: 301674 - DNA, 16 bp, C. familiaris
actgtttttcaaagtg

SEQ ID NO: 301675 - DNA, 16 bp, C. familiaris
actgtttttccaaagt

SEQ ID NO: 301676 - DNA, 16 bp, C. familiaris
acttaaaaatgaaaag

SEQ ID NO: 301677 - DNA, 16 bp, C. familiaris
acttaaaaatgaatga

SEQ ID NO: 301678 - DNA, 16 bp, C. familiaris
acttaaaataagtaaa

SEQ ID NO: 301679 - DNA, 16 bp, C. familiaris
acttaaaatggataaa

SEQ ID NO: 301680 - DNA, 16 bp, C. familiaris
acttaaagaaactcat

SEQ ID NO: 301681 - DNA, 16 bp, C. familiaris
acttaaagaagaaata

SEQ ID NO: 301682 - DNA, 16 bp, C. familiaris
acttaaagaagagtta

SEQ ID NO: 301683 - DNA, 16 bp, C. familiaris
acttaaagcctggaat

SEQ ID NO: 301684 - DNA, 16 bp, C. familiaris
acttaaccaaatgaac

SEQ ID NO: 301685 - DNA, 16 bp, C. familiaris
acttaatggtgaaata

SEQ ID NO: 301686 - DNA, 16 bp, C. familiaris
acttagaagaaatgaa

SEQ ID NO: 301687 - DNA, 16 bp, C. familiaris
acttagcatggagcct

SEQ ID NO: 301688 - DNA, 16 bp, C. familiaris
acttagccacccaggc

SEQ ID NO: 301689 - DNA, 16 bp, C. familiaris
acttataatagcatca

SEQ ID NO: 301690 - DNA, 16 bp, C. familiaris
acttatctgatatgag

SEQ ID NO: 301691 - DNA, 16 bp, C. familiaris
acttatgaaagaaatt

SEQ ID NO: 301692 - DNA, 16 bp, C. familiaris
acttattcatcagaga

SEQ ID NO: 301693 - DNA, 16 bp, C. familiaris
acttattcttctcaaa

SEQ ID NO: 301694 - DNA, 16 bp, C. familiaris
acttatttatgagaca

SEQ ID NO: 301695 - DNA, 16 bp, C. familiaris
acttcaacatggtgct

SEQ ID NO: 301696 - DNA, 16 bp, C. familiaris
acttcaagcctccaga

SEQ ID NO: 301697 - DNA, 16 bp, C. familiaris
acttcaatttcctcat

SEQ ID NO: 301698 - DNA, 16 bp, C. familiaris
acttcaccaaagaaaa

SEQ ID NO: 301699 - DNA, 16 bp, C. familiaris
acttcacctctgtggt

SEQ ID NO: 301700 - DNA, 16 bp, C. familiaris
acttcagagagaaaga

SEQ ID NO: 301701 - DNA, 16 bp, C. familiaris
acttcagcttcctcat

SEQ ID NO: 301702 - DNA, 16 bp, C. familiaris
acttcaggggcacctg

SEQ ID NO: 301703 - DNA, 16 bp, C. familiaris
acttcagtggaagaag

SEQ ID NO: 301704 - DNA, 16 bp, C. familiaris
acttcagtttcttcat

SEQ ID NO: 301705 - DNA, 16 bp, C. familiaris
acttcatataagtgaa

SEQ ID NO: 301706 - DNA, 16 bp, C. familiaris
acttcattttacaaat

SEQ ID NO: 301707 - DNA, 16 bp, C. familiaris
acttcattttacctta

SEQ ID NO: 301708 - DNA, 16 bp, C. familiaris
acttccaaaatcattc

SEQ ID NO: 301709 - DNA, 16 bp, C. familiaris
acttccagatttcaaa

SEQ ID NO: 301710 - DNA, 16 bp, C. familiaris
acttccagtacaatgt

SEQ ID NO: 301711 - DNA, 16 bp, C. familiaris
acttcctcaaggtcac

SEQ ID NO: 301712 - DNA, 16 bp, C. familiaris
acttcctctttgaccc

SEQ ID NO: 301713 - DNA, 16 bp, C. familiaris
acttcctgctgagtgc

SEQ ID NO: 301714 - DNA, 16 bp, C. familiaris
acttcctggaggagga

SEQ ID NO: 301715 - DNA, 16 bp, C. familiaris
acttcctggggcacct

SEQ ID NO: 301716 - DNA, 16 bp, C. familiaris
acttcctgtctctatg

SEQ ID NO: 301717 - DNA, 16 bp, C. familiaris
acttcgtcaccaccac

SEQ ID NO: 301718 - DNA, 16 bp, C. familiaris
acttctccaaagaaga

SEQ ID NO: 301719 - DNA, 16 bp, C. familiaris
acttctccctgtgcct

SEQ ID NO: 301720 - DNA, 16 bp, C. familiaris
acttctctgtgcctct

SEQ ID NO: 301721 - DNA, 16 bp, C. familiaris
acttctgaaagttctg

SEQ ID NO: 301722 - DNA, 16 bp, C. familiaris
acttcttaaaggggaa

SEQ ID NO: 301723 - DNA, 16 bp, C. familiaris
acttcttccttgccaa

SEQ ID NO: 301724 - DNA, 16 bp, C. familiaris
acttcttccttgccag

SEQ ID NO: 301725 - DNA, 16 bp, C. familiaris
acttcttcttttccaa

SEQ ID NO: 301726 - DNA, 16 bp, C. familiaris
acttctttaaaaaatt

SEQ ID NO: 301727 - DNA, 16 bp, C. familiaris
acttctttgtcaattt

SEQ ID NO: 301728 - DNA, 16 bp, C. familiaris
acttgaaaatatttta

SEQ ID NO: 301729 - DNA, 16 bp, C. familiaris
acttgaaagagagaga

SEQ ID NO: 301730 - DNA, 16 bp, C. familiaris
acttgaacccaggcag

SEQ ID NO: 301731 - DNA, 16 bp, C. familiaris
acttgacaaaatacag

SEQ ID NO: 301732 - DNA, 16 bp, C. familiaris
acttgagaaagagaga

SEQ ID NO: 301733 - DNA, 16 bp, C. familiaris
acttgagccaaaaaca

SEQ ID NO: 301734 - DNA, 16 bp, C. familiaris
acttgagggatccctg

SEQ ID NO: 301735 - DNA, 16 bp, C. familiaris
acttgaggtttttttt

SEQ ID NO: 301736 - DNA, 16 bp, C. familiaris
acttgatcacaggact

SEQ ID NO: 301737 - DNA, 16 bp, C. familiaris
acttgatcctgggacc

SEQ ID NO: 301738 - DNA, 16 bp, C. familiaris
acttgattccagatcc

SEQ ID NO: 301739 - DNA, 16 bp, C. familiaris
acttgctatttcttgt

SEQ ID NO: 301740 - DNA, 16 bp, C. familiaris
acttgggctgcctcca

SEQ ID NO: 301741 - DNA, 16 bp, C. familiaris
acttgggggtggggtg

SEQ ID NO: 301742 - DNA, 16 bp, C. familiaris
acttgggtggcacagt

SEQ ID NO: 301743 - DNA, 16 bp, C. familiaris
acttggtcaaggtgaa

SEQ ID NO: 301744 - DNA, 16 bp, C. familiaris
acttgtacattgaaaa

SEQ ID NO: 301745 - DNA, 16 bp, C. familiaris
acttgtgaagttcaca

SEQ ID NO: 301746 - DNA, 16 bp, C. familiaris
acttgttgaagagatt

SEQ ID NO: 301747 - DNA, 16 bp, C. familiaris
acttgtttcttgtctt

SEQ ID NO: 301748 - DNA, 16 bp, C. familiaris
acttgtttttggccat

SEQ ID NO: 301749 - DNA, 16 bp, C. familiaris
actttaaaaatgttaa

SEQ ID NO: 301750 - DNA, 16 bp, C. familiaris
actttaaaagcaaggc

SEQ ID NO: 301751 - DNA, 16 bp, C. familiaris
actttaaaatcttaaa

SEQ ID NO: 301752 - DNA, 16 bp, C. familiaris
actttaaagaaaaaga

SEQ ID NO: 301753 - DNA, 16 bp, C. familiaris
actttaaagagagaga

SEQ ID NO: 301754 - DNA, 16 bp, C. familiaris
actttaaatgtaaaga

SEQ ID NO: 301755 - DNA, 16 bp, C. familiaris
actttaagaaattttt

SEQ ID NO: 301756 - DNA, 16 bp, C. familiaris
actttatttatgtatt

SEQ ID NO: 301757 - DNA, 16 bp, C. familiaris
actttcaaactcattt

SEQ ID NO: 301758 - DNA, 16 bp, C. familiaris
actttcaagagcaaga

SEQ ID NO: 301759 - DNA, 16 bp, C. familiaris
actttccttaaaaaaa

SEQ ID NO: 301760 - DNA, 16 bp, C. familiaris
actttctggctgtgtg

SEQ ID NO: 301761 - DNA, 16 bp, C. familiaris
actttgaaagacagtt

SEQ ID NO: 301762 - DNA, 16 bp, C. familiaris
actttgaatatattat

SEQ ID NO: 301763 - DNA, 16 bp, C. familiaris
actttgagaaagaaaa

SEQ ID NO: 301764 - DNA, 16 bp, C. familiaris
actttgatctttttga

SEQ ID NO: 301765 - DNA, 16 bp, C. familiaris
actttgcagatgtggt

SEQ ID NO: 301766 - DNA, 16 bp, C. familiaris
actttggaaaaaaaga

SEQ ID NO: 301767 - DNA, 16 bp, C. familiaris
actttggaaaacagcc

SEQ ID NO: 301768 - DNA, 16 bp, C. familiaris
actttggagtggtgct

SEQ ID NO: 301769 - DNA, 16 bp, C. familiaris
actttgggaaccactg

SEQ ID NO: 301770 - DNA, 16 bp, C. familiaris
actttgtggttttcca

SEQ ID NO: 301771 - DNA, 16 bp, C. familiaris
actttgttgaagattt

SEQ ID NO: 301772 - DNA, 16 bp, C. familiaris
actttgtttacatttt

SEQ ID NO: 301773 - DNA, 16 bp, C. familiaris
actttgttttaaaata

SEQ ID NO: 301774 - DNA, 16 bp, C. familiaris
acttttaaaaaatgtt

SEQ ID NO: 301775 - DNA, 16 bp, C. familiaris
acttttattttggaaa

SEQ ID NO: 301776 - DNA, 16 bp, C. familiaris
acttttctaaagaaaa

SEQ ID NO: 301777 - DNA, 16 bp, C. familiaris
acttttctttttgaaa

SEQ ID NO: 301778 - DNA, 16 bp, C. familiaris
acttttgacttcccca

SEQ ID NO: 301779 - DNA, 16 bp, C. familiaris
acttttgtttcttggg

SEQ ID NO: 301780 - DNA, 16 bp, C. familiaris
actttttaaaaagctt

SEQ ID NO: 301781 - DNA, 16 bp, C. familiaris
actttttaaagaaaat

SEQ ID NO: 301782 - DNA, 16 bp, C. familiaris
actttttaagaaattg

SEQ ID NO: 301783 - DNA, 16 bp, C. familiaris
actttttagaaatttt

SEQ ID NO: 301784 - DNA, 16 bp, C. familiaris
actttttagcaataaa

SEQ ID NO: 301785 - DNA, 16 bp, C. familiaris
actttttcattattgt

SEQ ID NO: 301786 - DNA, 16 bp, C. familiaris
actttttctttgccaa

SEQ ID NO: 301787 - DNA, 16 bp, C. familiaris
actttttggctcttat

SEQ ID NO: 301788 - DNA, 16 bp, C. familiaris
actttttgggaaaaaa

SEQ ID NO: 301789 - DNA, 16 bp, C. familiaris
actttttgttgtgatt

SEQ ID NO: 301790 - DNA, 16 bp, C. familiaris
acttttttccccactt

SEQ ID NO: 301791 - DNA, 16 bp, C. familiaris
acttttttgtttaaaa

SEQ ID NO: 301792 - DNA, 16 bp, C. familiaris
agaaaaaaaatctgtt

SEQ ID NO: 301793 - DNA, 16 bp, C. familiaris
agaaaaaaaatctttt

SEQ ID NO: 301794 - DNA, 16 bp, C. familiaris
agaaaaaaaatgttct

SEQ ID NO: 301795 - DNA, 16 bp, C. familiaris
agaaaaaaacatcttt

SEQ ID NO: 301796 - DNA, 16 bp, C. familiaris
agaaaaaaagatctca

SEQ ID NO: 301797 - DNA, 16 bp, C. familiaris
agaaaaaaagtgtttt

SEQ ID NO: 301798 - DNA, 16 bp, C. familiaris
agaaaaaaatactgga

SEQ ID NO: 301799 - DNA, 16 bp, C. familiaris
agaaaaaaatattcca

SEQ ID NO: 301800 - DNA, 16 bp, C. familiaris
agaaaaaaatcatttt

SEQ ID NO: 301801 - DNA, 16 bp, C. familiaris
agaaaaaaatcctgaa

SEQ ID NO: 301802 - DNA, 16 bp, C. familiaris
agaaaaaaatctattt

SEQ ID NO: 301803 - DNA, 16 bp, C. familiaris
agaaaaaaatgcattt

SEQ ID NO: 301804 - DNA, 16 bp, C. familiaris
agaaaaaaatgttact

SEQ ID NO: 301805 - DNA, 16 bp, C. familiaris
agaaaaaaatttgttt

SEQ ID NO: 301806 - DNA, 16 bp, C. familiaris
agaaaaaagaaagctg

SEQ ID NO: 301807 - DNA, 16 bp, C. familiaris
agaaaaaagaaccctc

SEQ ID NO: 301808 - DNA, 16 bp, C. familiaris
agaaaaaagactggaa

SEQ ID NO: 301809 - DNA, 16 bp, C. familiaris
agaaaaaagacttttt

SEQ ID NO: 301810 - DNA, 16 bp, C. familiaris
agaaaaaatgtatttt

SEQ ID NO: 301811 - DNA, 16 bp, C. familiaris
agaaaaaattattttc

SEQ ID NO: 301812 - DNA, 16 bp, C. familiaris
agaaaaaattttcaaa

SEQ ID NO: 301813 - DNA, 16 bp, C. familiaris
agaaaaacaaatattg

SEQ ID NO: 301814 - DNA, 16 bp, C. familiaris
agaaaaacagtatgga

SEQ ID NO: 301815 - DNA, 16 bp, C. familiaris
agaaaaacatttgaaa

SEQ ID NO: 301816 - DNA, 16 bp, C. familiaris
agaaaaaccaagaact

SEQ ID NO: 301817 - DNA, 16 bp, C. familiaris
agaaaaactgaacagg

SEQ ID NO: 301818 - DNA, 16 bp, C. familiaris
agaaaaacttcagaaa

SEQ ID NO: 301819 - DNA, 16 bp, C. familiaris
agaaaaacttccaaat

SEQ ID NO: 301820 - DNA, 16 bp, C. familiaris
agaaaaacttgaaata

SEQ ID NO: 301821 - DNA, 16 bp, C. familiaris
agaaaaactttcaaaa

SEQ ID NO: 301822 - DNA, 16 bp, C. familiaris
agaaaaagaaaatctg

SEQ ID NO: 301823 - DNA, 16 bp, C. familiaris
agaaaaagaaagatgc

SEQ ID NO: 301824 - DNA, 16 bp, C. familiaris
agaaaaagaaattcag

SEQ ID NO: 301825 - DNA, 16 bp, C. familiaris
agaaaaagaaattgca

SEQ ID NO: 301826 - DNA, 16 bp, C. familiaris
agaaaaagaatctgaa

SEQ ID NO: 301827 - DNA, 16 bp, C. familiaris
agaaaaagactggaaa

SEQ ID NO: 301828 - DNA, 16 bp, C. familiaris
agaaaaagagaagact

SEQ ID NO: 301829 - DNA, 16 bp, C. familiaris
agaaaaagatattcca

SEQ ID NO: 301830 - DNA, 16 bp, C. familiaris
agaaaaagcagcagca

SEQ ID NO: 301831 - DNA, 16 bp, C. familiaris
agaaaaaggaaacctc

SEQ ID NO: 301832 - DNA, 16 bp, C. familiaris
agaaaaaggaaatgtt

SEQ ID NO: 301833 - DNA, 16 bp, C. familiaris
agaaaaaggaacactc

SEQ ID NO: 301834 - DNA, 16 bp, C. familiaris
agaaaaaggaaccatt

SEQ ID NO: 301835 - DNA, 16 bp, C. familiaris
agaaaaagtgaaattt

SEQ ID NO: 301836 - DNA, 16 bp, C. familiaris
agaaaaagttttgaaa

SEQ ID NO: 301837 - DNA, 16 bp, C. familiaris
agaaaaataaattcat

SEQ ID NO: 301838 - DNA, 16 bp, C. familiaris
agaaaaataattttct

SEQ ID NO: 301839 - DNA, 16 bp, C. familiaris
agaaaaatatttcatg

SEQ ID NO: 301840 - DNA, 16 bp, C. familiaris
agaaaaatcagaattt

SEQ ID NO: 301841 - DNA, 16 bp, C. familiaris
agaaaaatcatgtgat

SEQ ID NO: 301842 - DNA, 16 bp, C. familiaris
agaaaaatctccagaa

SEQ ID NO: 301843 - DNA, 16 bp, C. familiaris
agaaaaatctgaaaca

SEQ ID NO: 301844 - DNA, 16 bp, C. familiaris
agaaaaatctgagaaa

SEQ ID NO: 301845 - DNA, 16 bp, C. familiaris
agaaaaatgaactatt

SEQ ID NO: 301846 - DNA, 16 bp, C. familiaris
agaaaaatgagaattt

SEQ ID NO: 301847 - DNA, 16 bp, C. familiaris
agaaaaatgctgctat

SEQ ID NO: 301848 - DNA, 16 bp, C. familiaris
agaaaaatggaagcaa

SEQ ID NO: 301849 - DNA, 16 bp, C. familiaris
agaaaaatgtgatttt

SEQ ID NO: 301850 - DNA, 16 bp, C. familiaris
agaaaaatgtgtattt

SEQ ID NO: 301851 - DNA, 16 bp, C. familiaris
agaaaaatgttgcaaa

SEQ ID NO: 301852 - DNA, 16 bp, C. familiaris
agaaaaatgttgctat

SEQ ID NO: 301853 - DNA, 16 bp, C. familiaris
agaaaaatgttttatt

SEQ ID NO: 301854 - DNA, 16 bp, C. familiaris
agaaaaattgtgaaga

SEQ ID NO: 301855 - DNA, 16 bp, C. familiaris
agaaaacaaaaacttt

SEQ ID NO: 301856 - DNA, 16 bp, C. familiaris
agaaaacaaaaattct

SEQ ID NO: 301857 - DNA, 16 bp, C. familiaris
agaaaacaaaaccatt

SEQ ID NO: 301858 - DNA, 16 bp, C. familiaris
agaaaacaaacatttt

SEQ ID NO: 301859 - DNA, 16 bp, C. familiaris
agaaaacaaattattt

SEQ ID NO: 301860 - DNA, 16 bp, C. familiaris
agaaaacaataaattt

SEQ ID NO: 301861 - DNA, 16 bp, C. familiaris
agaaaacactattttt

SEQ ID NO: 301862 - DNA, 16 bp, C. familiaris
agaaaacactcaaatt

SEQ ID NO: 301863 - DNA, 16 bp, C. familiaris
agaaaacagaatggaa

SEQ ID NO: 301864 - DNA, 16 bp, C. familiaris
agaaaacagatatcca

SEQ ID NO: 301865 - DNA, 16 bp, C. familiaris
agaaaacagtatggca

SEQ ID NO: 301866 - DNA, 16 bp, C. familiaris
agaaaacagtttggca

SEQ ID NO: 301867 - DNA, 16 bp, C. familiaris
agaaaacatatatttt

SEQ ID NO: 301868 - DNA, 16 bp, C. familiaris
agaaaacatgaaatat

SEQ ID NO: 301869 - DNA, 16 bp, C. familiaris
agaaaacatgagagaa

SEQ ID NO: 301870 - DNA, 16 bp, C. familiaris
agaaaacatgtttttt

SEQ ID NO: 301871 - DNA, 16 bp, C. familiaris
agaaaacattcttttt

SEQ ID NO: 301872 - DNA, 16 bp, C. familiaris
agaaaacatttgccaa

SEQ ID NO: 301873 - DNA, 16 bp, C. familiaris
agaaaacattttgaaa

SEQ ID NO: 301874 - DNA, 16 bp, C. familiaris
agaaaaccaaaatatt

SEQ ID NO: 301875 - DNA, 16 bp, C. familiaris
agaaaaccatttatca

SEQ ID NO: 301876 - DNA, 16 bp, C. familiaris
agaaaaccattttttt

SEQ ID NO: 301877 - DNA, 17 bp, C. familiaris
agaaaacccaaagcctc

SEQ ID NO: 301878 - DNA, 16 bp, C. familiaris
agaaaacccataaatg

SEQ ID NO: 301879 - DNA, 16 bp, C. familiaris
agaaaaccctacaaaa

SEQ ID NO: 301880 - DNA, 16 bp, C. familiaris
agaaaacctcaagcag

SEQ ID NO: 301881 - DNA, 16 bp, C. familiaris
agaaaacctgaacaaa

SEQ ID NO: 301882 - DNA, 16 bp, C. familiaris
agaaaactacagacta

SEQ ID NO: 301883 - DNA, 16 bp, C. familiaris
agaaaactctagaaaa

SEQ ID NO: 301884 - DNA, 16 bp, C. familiaris
agaaaactgaaaccca

SEQ ID NO: 301885 - DNA, 16 bp, C. familiaris
agaaaactgaagcaga

SEQ ID NO: 301886 - DNA, 16 bp, C. familiaris
agaaaactgaattttt

SEQ ID NO: 301887 - DNA, 16 bp, C. familiaris
agaaaacttaaaaatt

SEQ ID NO: 301888 - DNA, 16 bp, C. familiaris
agaaaacttctaaatt

SEQ ID NO: 301889 - DNA, 16 bp, C. familiaris
agaaaacttgaaagaa

SEQ ID NO: 301890 - DNA, 16 bp, C. familiaris
agaaaacttggaaaaa

SEQ ID NO: 301891 - DNA, 16 bp, C. familiaris
agaaaactttaaaaca

SEQ ID NO: 301892 - DNA, 16 bp, C. familiaris
agaaaactttttattt

SEQ ID NO: 301893 - DNA, 16 bp, C. familiaris
agaaaagaaaagcctt

SEQ ID NO: 301894 - DNA, 16 bp, C. familiaris
agaaaagaaaatctca

SEQ ID NO: 301895 - DNA, 16 bp, C. familiaris
agaaaagaaaatgcag

SEQ ID NO: 301896 - DNA, 16 bp, C. familiaris
agaaaagaaaatgctg

SEQ ID NO: 301897 - DNA, 16 bp, C. familiaris
agaaaagaaaatgctt

SEQ ID NO: 301898 - DNA, 16 bp, C. familiaris
agaaaagaaaattcac

SEQ ID NO: 301899 - DNA, 16 bp, C. familiaris
agaaaagaaagctgaa

SEQ ID NO: 301900 - DNA, 16 bp, C. familiaris
agaaaagaatatttca

SEQ ID NO: 301901 - DNA, 16 bp, C. familiaris
agaaaagaatcagaga

SEQ ID NO: 301902 - DNA, 16 bp, C. familiaris
agaaaagaccccaagt

SEQ ID NO: 301903 - DNA, 16 bp, C. familiaris
agaaaagactgaagaa

SEQ ID NO: 301904 - DNA, 16 bp, C. familiaris
agaaaagcatttgaaa

SEQ ID NO: 301905 - DNA, 16 bp, C. familiaris
agaaaagctgaacagg

SEQ ID NO: 301906 - DNA, 16 bp, C. familiaris
agaaaaggaaactgag

SEQ ID NO: 301907 - DNA, 16 bp, C. familiaris
agaaaaggaaatgatt

SEQ ID NO: 301908 - DNA, 16 bp, C. familiaris
agaaaaggaagaaact

SEQ ID NO: 301909 - DNA, 16 bp, C. familiaris
agaaaaggattttaaa

SEQ ID NO: 301910 - DNA, 16 bp, C. familiaris
agaaaagggaattttt

SEQ ID NO: 301911 - DNA, 16 bp, C. familiaris
agaaaagggatccctg

SEQ ID NO: 301912 - DNA, 16 bp, C. familiaris
agaaaaggggatccct

SEQ ID NO: 301913 - DNA, 16 bp, C. familiaris
agaaaataaaaggcat

SEQ ID NO: 301914 - DNA, 16 bp, C. familiaris
agaaaataaatgaact

SEQ ID NO: 301915 - DNA, 16 bp, C. familiaris
agaaaataacatttat

SEQ ID NO: 301916 - DNA, 16 bp, C. familiaris
agaaaatacaggagaa

SEQ ID NO: 301917 - DNA, 16 bp, C. familiaris
agaaaatacatataca

SEQ ID NO: 301918 - DNA, 16 bp, C. familiaris
agaaaatacatttgca

SEQ ID NO: 301919 - DNA, 16 bp, C. familiaris
agaaaatacttgaaaa

SEQ ID NO: 301920 - DNA, 16 bp, C. familiaris
agaaaatatcttagaa

SEQ ID NO: 301921 - DNA, 16 bp, C. familiaris
agaaaatatctttaaa

SEQ ID NO: 301922 - DNA, 16 bp, C. familiaris
agaaaatatgcatttt

SEQ ID NO: 301923 - DNA, 16 bp, C. familiaris
agaaaatatggcaaaa

SEQ ID NO: 301924 - DNA, 16 bp, C. familiaris
agaaaatatttgaaga

SEQ ID NO: 301925 - DNA, 16 bp, C. familiaris
agaaaatatttgcaga

SEQ ID NO: 301926 - DNA, 16 bp, C. familiaris
agaaaatatttgccaa

SEQ ID NO: 301927 - DNA, 16 bp, C. familiaris
agaaaatatttgtcaa

SEQ ID NO: 301928 - DNA, 16 bp, C. familiaris
agaaaatcaaatccaa

SEQ ID NO: 301929 - DNA, 16 bp, C. familiaris
agaaaatcaacaagga

SEQ ID NO: 301930 - DNA, 16 bp, C. familiaris
agaaaatcaacaatga

SEQ ID NO: 301931 - DNA, 16 bp, C. familiaris
agaaaatcaataagga

SEQ ID NO: 301932 - DNA, 16 bp, C. familiaris
agaaaatcaatgaaac

SEQ ID NO: 301933 - DNA, 16 bp, C. familiaris
agaaaatcagcaaaac

SEQ ID NO: 301934 - DNA, 16 bp, C. familiaris
agaaaatcagcaaaga

SEQ ID NO: 301935 - DNA, 16 bp, C. familiaris
agaaaatcagcaagaa

SEQ ID NO: 301936 - DNA, 16 bp, C. familiaris
agaaaatcatcaagga

SEQ ID NO: 301937 - DNA, 16 bp, C. familiaris
agaaaatccaaatgaa

SEQ ID NO: 301938 - DNA, 16 bp, C. familiaris
agaaaatccaatttaa

SEQ ID NO: 301939 - DNA, 16 bp, C. familiaris
agaaaatccagaaata

SEQ ID NO: 301940 - DNA, 16 bp, C. familiaris
agaaaatcccaaagaa

SEQ ID NO: 301941 - DNA, 16 bp, C. familiaris
agaaaatcctgaaaac

SEQ ID NO: 301942 - DNA, 16 bp, C. familiaris
agaaaatcctgaagac

SEQ ID NO: 301943 - DNA, 16 bp, C. familiaris
agaaaatctcaagaag

SEQ ID NO: 301944 - DNA, 16 bp, C. familiaris
agaaaatctccagcag

SEQ ID NO: 301945 - DNA, 16 bp, C. familiaris
agaaaatctctctctc

SEQ ID NO: 301946 - DNA, 16 bp, C. familiaris
agaaaatctgaacaaa

SEQ ID NO: 301947 - DNA, 16 bp, C. familiaris
agaaaatcttcagaaa

SEQ ID NO: 301948 - DNA, 16 bp, C. familiaris
agaaaatctttcaaaa

SEQ ID NO: 301949 - DNA, 16 bp, C. familiaris
agaaaatctttgtaaa

SEQ ID NO: 301950 - DNA, 16 bp, C. familiaris
agaaaatgaaaaggca

SEQ ID NO: 301951 - DNA, 16 bp, C. familiaris
agaaaatgaaaatacc

SEQ ID NO: 301952 - DNA, 16 bp, C. familiaris
agaaaatgaaaatcac

SEQ ID NO: 301953 - DNA, 16 bp, C. familiaris
agaaaatgaaactgga

SEQ ID NO: 301954 - DNA, 16 bp, C. familiaris
agaaaatgaaactttt

SEQ ID NO: 301955 - DNA, 16 bp, C. familiaris
agaaaatgaaaggcaa

SEQ ID NO: 301956 - DNA, 16 bp, C. familiaris
agaaaatgaatttaag

SEQ ID NO: 301957 - DNA, 16 bp, C. familiaris
agaaaatgacaaatat

SEQ ID NO: 301958 - DNA, 16 bp, C. familiaris
agaaaatgagagactc

SEQ ID NO: 301959 - DNA, 16 bp, C. familiaris
agaaaatgaggaagac

SEQ ID NO: 301960 - DNA, 16 bp, C. familiaris
agaaaatgagtatttt

SEQ ID NO: 301961 - DNA, 16 bp, C. familiaris
agaaaatgatttttat

SEQ ID NO: 301962 - DNA, 16 bp, C. familiaris
agaaaatgcagaaaca

SEQ ID NO: 301963 - DNA, 16 bp, C. familiaris
agaaaatgcagaaatg

SEQ ID NO: 301964 - DNA, 16 bp, C. familiaris
agaaaatggaaaatca

SEQ ID NO: 301965 - DNA, 16 bp, C. familiaris
agaaaatggaaacaca

SEQ ID NO: 301966 - DNA, 16 bp, C. familiaris
agaaaatggataaatt

SEQ ID NO: 301967 - DNA, 16 bp, C. familiaris
agaaaatgtgggaaat

SEQ ID NO: 301968 - DNA, 16 bp, C. familiaris
agaaaatgttaagaat

SEQ ID NO: 301969 - DNA, 16 bp, C. familiaris
agaaaatgttccatat

SEQ ID NO: 301970 - DNA, 16 bp, C. familiaris
agaaaatgttctcaaa

SEQ ID NO: 301971 - DNA, 16 bp, C. familiaris
agaaaatgttttgttt

SEQ ID NO: 301972 - DNA, 16 bp, C. familiaris
agaaaattattcattt

SEQ ID NO: 301973 - DNA, 16 bp, C. familiaris
agaaaattatttcaga

SEQ ID NO: 301974 - DNA, 16 bp, C. familiaris
agaaaattcaaatgaa

SEQ ID NO: 301975 - DNA, 16 bp, C. familiaris
agaaaattctaaaagc

SEQ ID NO: 301976 - DNA, 16 bp, C. familiaris
agaaaattctcaaata

SEQ ID NO: 301977 - DNA, 16 bp, C. familiaris
agaaaattcttaaatt

SEQ ID NO: 301978 - DNA, 16 bp, C. familiaris
agaaaattcttttctt

SEQ ID NO: 301979 - DNA, 16 bp, C. familiaris
agaaaattgaagcagt

SEQ ID NO: 301980 - DNA, 16 bp, C. familiaris
agaaaattgaggccca

SEQ ID NO: 301981 - DNA, 16 bp, C. familiaris
agaaaatttccaaaat

SEQ ID NO: 301982 - DNA, 16 bp, C. familiaris
agaaaatttccagaaa

SEQ ID NO: 301983 - DNA, 16 bp, C. familiaris
agaaaatttctggaaa

SEQ ID NO: 301984 - DNA, 16 bp, C. familiaris
agaaaatttctttctt

SEQ ID NO: 301985 - DNA, 16 bp, C. familiaris
agaaaatttggaagaa

SEQ ID NO: 301986 - DNA, 16 bp, C. familiaris
agaaaattttaaggaa

SEQ ID NO: 301987 - DNA, 16 bp, C. familiaris
agaaaattttcaaaca

SEQ ID NO: 301988 - DNA, 16 bp, C. familiaris
agaaaattttcaaaga

SEQ ID NO: 301989 - DNA, 16 bp, C. familiaris
agaaaattttgaaatt

SEQ ID NO: 301990 - DNA, 16 bp, C. familiaris
agaaaattttgaagaa

SEQ ID NO: 301991 - DNA, 16 bp, C. familiaris
agaaacaaaaatttca

SEQ ID NO: 301992 - DNA, 16 bp, C. familiaris
agaaacaaaagagatg

SEQ ID NO: 301993 - DNA, 16 bp, C. familiaris
agaaacaagaaagcat

SEQ ID NO: 301994 - DNA, 16 bp, C. familiaris
agaaacaagagctttg

SEQ ID NO: 301995 - DNA, 16 bp, C. familiaris
agaaacaagaggatca

SEQ ID NO: 301996 - DNA, 16 bp, C. familiaris
agaaacaagccaaatg

SEQ ID NO: 301997 - DNA, 16 bp, C. familiaris
agaaacaatcagaaac

SEQ ID NO: 301998 - DNA, 16 bp, C. familiaris
agaaacagaaaatgga

SEQ ID NO: 301999 - DNA, 16 bp, C. familiaris
agaaacagaaaattta

SEQ ID NO: 302000 - DNA, 16 bp, C. familiaris
agaaacagaaagtaga

SEQ ID NO: 302001 - DNA, 16 bp, C. familiaris
agaaacagacacagag

SEQ ID NO: 302002 - DNA, 16 bp, C. familiaris
agaaacagactcacag

SEQ ID NO: 302003 - DNA, 16 bp, C. familiaris
agaaacagactcagaa

SEQ ID NO: 302004 - DNA, 16 bp, C. familiaris
agaaacagacttaact

SEQ ID NO: 302005 - DNA, 16 bp, C. familiaris
agaaacagcaaataga

SEQ ID NO: 302006 - DNA, 16 bp, C. familiaris
agaaacagcacagagg

SEQ ID NO: 302007 - DNA, 16 bp, C. familiaris
agaaacagcagcagca

SEQ ID NO: 302008 - DNA, 16 bp, C. familiaris
agaaacaggaaaacat

SEQ ID NO: 302009 - DNA, 16 bp, C. familiaris
agaaacatgggcagag

SEQ ID NO: 302010 - DNA, 16 bp, C. familiaris
agaaacattattttat

SEQ ID NO: 302011 - DNA, 16 bp, C. familiaris
agaaaccagaagaact

SEQ ID NO: 302012 - DNA, 16 bp, C. familiaris
agaaactacagaacac

SEQ ID NO: 302013 - DNA, 16 bp, C. familiaris
agaaactcaaccactg

SEQ ID NO: 302014 - DNA, 16 bp, C. familiaris
agaaactcatttcaga

SEQ ID NO: 302015 - DNA, 16 bp, C. familiaris
agaaactcattttaga

SEQ ID NO: 302016 - DNA, 16 bp, C. familiaris
agaaactgaaaataga

SEQ ID NO: 302017 - DNA, 16 bp, C. familiaris
agaaactgaaagtaga

SEQ ID NO: 302018 - DNA, 16 bp, C. familiaris
agaaactgaaatttaa

SEQ ID NO: 302019 - DNA, 16 bp, C. familiaris
agaaactgaagacaac

SEQ ID NO: 302020 - DNA, 16 bp, C. familiaris
agaaactgaagacaca

SEQ ID NO: 302021 - DNA, 16 bp, C. familiaris
agaaactgaagttcag

SEQ ID NO: 302022 - DNA, 16 bp, C. familiaris
agaaactgaattttaa

SEQ ID NO: 302023 - DNA, 16 bp, C. familiaris
agaaactgagaagaaa

SEQ ID NO: 302024 - DNA, 16 bp, C. familiaris
agaaactgaggaaaaa

SEQ ID NO: 302025 - DNA, 16 bp, C. familiaris
agaaactgaggaaaag

SEQ ID NO: 302026 - DNA, 16 bp, C. familiaris
agaaactgaggctctg

SEQ ID NO: 302027 - DNA, 16 bp, C. familiaris
agaaactggaaaaaga

SEQ ID NO: 302028 - DNA, 16 bp, C. familiaris
agaaactggaagaaaa

SEQ ID NO: 302029 - DNA, 16 bp, C. familiaris
agaaactggagaaaga

SEQ ID NO: 302030 - DNA, 16 bp, C. familiaris
agaaacttccagttat

SEQ ID NO: 302031 - DNA, 16 bp, C. familiaris
agaaacttgcccaaga

SEQ ID NO: 302032 - DNA, 16 bp, C. familiaris
agaaacttgcccaagg

SEQ ID NO: 302033 - DNA, 16 bp, C. familiaris
agaaacttttcttttt

SEQ ID NO: 302034 - DNA, 16 bp, C. familiaris
agaaagaaaaacagtt

SEQ ID NO: 302035 - DNA, 16 bp, C. familiaris
agaaagaaaaactcac

SEQ ID NO: 302036 - DNA, 16 bp, C. familiaris
agaaagaaaaacttta

SEQ ID NO: 302037 - DNA, 16 bp, C. familiaris
agaaagaaaaatacct

SEQ ID NO: 302038 - DNA, 16 bp, C. familiaris
agaaagaaaaatctca

SEQ ID NO: 302039 - DNA, 16 bp, C. familiaris
agaaagaaaaatctga

SEQ ID NO: 302040 - DNA, 16 bp, C. familiaris
agaaagaaaatatttg

SEQ ID NO: 302041 - DNA, 16 bp, C. familiaris
agaaagaaaatcctca

SEQ ID NO: 302042 - DNA, 16 bp, C. familiaris
agaaagaaactggact

SEQ ID NO: 302043 - DNA, 16 bp, C. familiaris
agaaagaaatctgaaa

SEQ ID NO: 302044 - DNA, 16 bp, C. familiaris
agaaagaacttataaa

SEQ ID NO: 302045 - DNA, 16 bp, C. familiaris
agaaagaagagcaaat

SEQ ID NO: 302046 - DNA, 16 bp, C. familiaris
agaaagaatcagagaa

SEQ ID NO: 302047 - DNA, 16 bp, C. familiaris
agaaagaatcttcaag

SEQ ID NO: 302048 - DNA, 16 bp, C. familiaris
agaaagaatttcagaa

SEQ ID NO: 302049 - DNA, 16 bp, C. familiaris
agaaagacaaacacta

SEQ ID NO: 302050 - DNA, 16 bp, C. familiaris
agaaagacaataatca

SEQ ID NO: 302051 - DNA, 16 bp, C. familiaris
agaaagacagtgtctt

SEQ ID NO: 302052 - DNA, 16 bp, C. familiaris
agaaagagaaaatttg

SEQ ID NO: 302053 - DNA, 16 bp, C. familiaris
agaaagagaacatgca

SEQ ID NO: 302054 - DNA, 16 bp, C. familiaris
agaaagagaacttaag

SEQ ID NO: 302055 - DNA, 16 bp, C. familiaris
agaaagagaagactca

SEQ ID NO: 302056 - DNA, 16 bp, C. familiaris
agaaagagaagcaggc

SEQ ID NO: 302057 - DNA, 16 bp, C. familiaris
agaaagagaatgtgca

SEQ ID NO: 302058 - DNA, 16 bp, C. familiaris
agaaagagagcaagtg

SEQ ID NO: 302059 - DNA, 16 bp, C. familiaris
agaaagagagcatgca

SEQ ID NO: 302060 - DNA, 16 bp, C. familiaris
agaaagagatcatgag

SEQ ID NO: 302061 - DNA, 16 bp, C. familiaris
agaaagagatggagca

SEQ ID NO: 302062 - DNA, 16 bp, C. familiaris
agaaagagcaagcagg

SEQ ID NO: 302063 - DNA, 16 bp, C. familiaris
agaaagagccagagag

SEQ ID NO: 302064 - DNA, 16 bp, C. familiaris
agaaagaggctgagac

SEQ ID NO: 302065 - DNA, 16 bp, C. familiaris
agaaagagggacaagc

SEQ ID NO: 302066 - DNA, 16 bp, C. familiaris
agaaagagggagccca

SEQ ID NO: 302067 - DNA, 16 bp, C. familiaris
agaaagagtggcagag

SEQ ID NO: 302068 - DNA, 16 bp, C. familiaris
agaaagatcagtggtt

SEQ ID NO: 302069 - DNA, 16 bp, C. familiaris
agaaagatctaaatgt

SEQ ID NO: 302070 - DNA, 16 bp, C. familiaris
agaaagcacagaaata

SEQ ID NO: 302071 - DNA, 16 bp, C. familiaris
agaaagcagatcagtg

SEQ ID NO: 302072 - DNA, 16 bp, C. familiaris
agaaagccaaatacca

SEQ ID NO: 302073 - DNA, 17 bp, C. familiaris
agaaagccaattcagag

SEQ ID NO: 302074 - DNA, 16 bp, C. familiaris
agaaagccctggccct

SEQ ID NO: 302075 - DNA, 16 bp, C. familiaris
agaaagccttcaggga

SEQ ID NO: 302076 - DNA, 16 bp, C. familiaris
agaaaggaaactgaaa

SEQ ID NO: 302077 - DNA, 16 bp, C. familiaris
agaaaggaaataattt

SEQ ID NO: 302078 - DNA, 16 bp, C. familiaris
agaaaggacccaaata

SEQ ID NO: 302079 - DNA, 16 bp, C. familiaris
agaaaggactggcatg

SEQ ID NO: 302080 - DNA, 16 bp, C. familiaris
agaaaggagaatcctc

SEQ ID NO: 302081 - DNA, 17 bp, C. familiaris
agaaaggcagaaacata

SEQ ID NO: 302082 - DNA, 16 bp, C. familiaris
agaaaggttaagtgat

SEQ ID NO: 302083 - DNA, 16 bp, C. familiaris
agaaagtagaatgctg

SEQ ID NO: 302084 - DNA, 16 bp, C. familiaris
agaaagtatttgaaat

SEQ ID NO: 302085 - DNA, 16 bp, C. familiaris
agaaagtgagcaagag

SEQ ID NO: 302086 - DNA, 17 bp, C. familiaris
agaaagtggcccagttt

SEQ ID NO: 302087 - DNA, 16 bp, C. familiaris
agaaagttctagaaaa

SEQ ID NO: 302088 - DNA, 16 bp, C. familiaris
agaaagttgcacagtc

SEQ ID NO: 302089 - DNA, 16 bp, C. familiaris
agaaagttttttgttt

SEQ ID NO: 302090 - DNA, 16 bp, C. familiaris
agaaataaaagcatcc

SEQ ID NO: 302091 - DNA, 16 bp, C. familiaris
agaaataaaatcatga

SEQ ID NO: 302092 - DNA, 16 bp, C. familiaris
agaaataaaatttcaa

SEQ ID NO: 302093 - DNA, 16 bp, C. familiaris
agaaataaacaaatcc

SEQ ID NO: 302094 - DNA, 16 bp, C. familiaris
agaaataaacccagaa

SEQ ID NO: 302095 - DNA, 16 bp, C. familiaris
agaaataaagatttca

SEQ ID NO: 302096 - DNA, 16 bp, C. familiaris
agaaataaaggaagtt

SEQ ID NO: 302097 - DNA, 16 bp, C. familiaris
agaaataaatgtgtgt

SEQ ID NO: 302098 - DNA, 16 bp, C. familiaris
agaaataacagcaaat

SEQ ID NO: 302099 - DNA, 16 bp, C. familiaris
agaaataatggctgga

SEQ ID NO: 302100 - DNA, 16 bp, C. familiaris
agaaataattgctgaa

SEQ ID NO: 302101 - DNA, 16 bp, C. familiaris
agaaataatttcaaaa

SEQ ID NO: 302102 - DNA, 16 bp, C. familiaris
agaaatacaaaggatt

SEQ ID NO: 302103 - DNA, 16 bp, C. familiaris
agaaatacaaatacta

SEQ ID NO: 302104 - DNA, 16 bp, C. familiaris
agaaatacatatttat

SEQ ID NO: 302105 - DNA, 16 bp, C. familiaris
agaaatacatttattt

SEQ ID NO: 302106 - DNA, 16 bp, C. familiaris
agaaatactaaaggga

SEQ ID NO: 302107 - DNA, 16 bp, C. familiaris
agaaatactttaaaat

SEQ ID NO: 302108 - DNA, 16 bp, C. familiaris
agaaatagaaaaattc

SEQ ID NO: 302109 - DNA, 16 bp, C. familiaris
agaaatagaaaggatt

SEQ ID NO: 302110 - DNA, 16 bp, C. familiaris
agaaatatatttctca

SEQ ID NO: 302111 - DNA, 16 bp, C. familiaris
agaaatatcagaaagg

SEQ ID NO: 302112 - DNA, 16 bp, C. familiaris
agaaatattcagaata

SEQ ID NO: 302113 - DNA, 16 bp, C. familiaris
agaaatatttcataaa

SEQ ID NO: 302114 - DNA, 16 bp, C. familiaris
agaaatcaaagaatca

SEQ ID NO: 302115 - DNA, 16 bp, C. familiaris
agaaatcaagaaacag

SEQ ID NO: 302116 - DNA, 16 bp, C. familiaris
agaaatcaaggaattt

SEQ ID NO: 302117 - DNA, 16 bp, C. familiaris
agaaatcacaacaaat

SEQ ID NO: 302118 - DNA, 16 bp, C. familiaris
agaaatcacaaccaat

SEQ ID NO: 302119 - DNA, 17 bp, C. familiaris
agaaatcagtggcattt

SEQ ID NO: 302120 - DNA, 16 bp, C. familiaris
agaaatcagtggcttt

SEQ ID NO: 302121 - DNA, 16 bp, C. familiaris
agaaatcattgccaaa

SEQ ID NO: 302122 - DNA, 16 bp, C. familiaris
agaaatcattttttaa

SEQ ID NO: 302123 - DNA, 37 bp, C. familiaris
agaaatctcacagaggaagacatagacatggccaaca

SEQ ID NO: 302124 - DNA, 16 bp, C. familiaris
agaaatctcagaaaaa

SEQ ID NO: 302125 - DNA, 16 bp, C. familiaris
agaaatctgagatcaa

SEQ ID NO: 302126 - DNA, 16 bp, C. familiaris
agaaatgaaaaattca

SEQ ID NO: 302127 - DNA, 16 bp, C. familiaris
agaaatgaaagcaggg

SEQ ID NO: 302128 - DNA, 16 bp, C. familiaris
agaaatgaagaatgct

SEQ ID NO: 302129 - DNA, 16 bp, C. familiaris
agaaatgaagaatgtc

SEQ ID NO: 302130 - DNA, 16 bp, C. familiaris
agaaatgagctctcaa

SEQ ID NO: 302131 - DNA, 16 bp, C. familiaris
agaaatgagtgggaaa

SEQ ID NO: 302132 - DNA, 16 bp, C. familiaris
agaaatgcaaaatctc

SEQ ID NO: 302133 - DNA, 16 bp, C. familiaris
agaaatgcaaagattt

SEQ ID NO: 302134 - DNA, 16 bp, C. familiaris
agaaatgcaaagtaaa

SEQ ID NO: 302135 - DNA, 16 bp, C. familiaris
agaaatgcacattctc

SEQ ID NO: 302136 - DNA, 16 bp, C. familiaris
agaaatgcagcagatt

SEQ ID NO: 302137 - DNA, 16 bp, C. familiaris
agaaatgcagtggatt

SEQ ID NO: 302138 - DNA, 16 bp, C. familiaris
agaaatggaaaaatgt

SEQ ID NO: 302139 - DNA, 16 bp, C. familiaris
agaaatggaaaaattt

SEQ ID NO: 302140 - DNA, 16 bp, C. familiaris
agaaatggaaaacctg

SEQ ID NO: 302141 - DNA, 16 bp, C. familiaris
agaaatggatacattt

SEQ ID NO: 302142 - DNA, 16 bp, C. familiaris
agaaatggatgaattc

SEQ ID NO: 302143 - DNA, 16 bp, C. familiaris
agaaatggcaaaagaa

SEQ ID NO: 302144 - DNA, 16 bp, C. familiaris
agaaatggcccctcaa

SEQ ID NO: 302145 - DNA, 16 bp, C. familiaris
agaaatgggatttgaa

SEQ ID NO: 302146 - DNA, 16 bp, C. familiaris
agaaatgggcagaaga

SEQ ID NO: 302147 - DNA, 16 bp, C. familiaris
agaaatgtgtattttt

SEQ ID NO: 302148 - DNA, 16 bp, C. familiaris
agaaatgttatttatt

SEQ ID NO: 302149 - DNA, 16 bp, C. familiaris
agaaatgttgaaagaa

SEQ ID NO: 302150 - DNA, 16 bp, C. familiaris
agaaatgtttcttttt

SEQ ID NO: 302151 - DNA, 16 bp, C. familiaris
agaaattaagaaattg

SEQ ID NO: 302152 - DNA, 16 bp, C. familiaris
agaaattagaatcctt

SEQ ID NO: 302153 - DNA, 16 bp, C. familiaris
agaaattcaaaatgga

SEQ ID NO: 302154 - DNA, 16 bp, C. familiaris
agaaattcaaagaaat

SEQ ID NO: 302155 - DNA, 16 bp, C. familiaris
agaaattcaagatgac

SEQ ID NO: 302156 - DNA, 16 bp, C. familiaris
agaaattcagagaaaa

SEQ ID NO: 302157 - DNA, 16 bp, C. familiaris
agaaattgaaaatgat

SEQ ID NO: 302158 - DNA, 16 bp, C. familiaris
agaaattgaagaagat

SEQ ID NO: 302159 - DNA, 16 bp, C. familiaris
agaaattgaggaaaac

SEQ ID NO: 302160 - DNA, 16 bp, C. familiaris
agaaattgaggaagat

SEQ ID NO: 302161 - DNA, 16 bp, C. familiaris
agaaattgatgaaata

SEQ ID NO: 302162 - DNA, 16 bp, C. familiaris
agaaattggcaagctg

SEQ ID NO: 302163 - DNA, 16 bp, C. familiaris
agaaatttactttctc

SEQ ID NO: 302164 - DNA, 16 bp, C. familiaris
agaaatttatcttctc

SEQ ID NO: 302165 - DNA, 16 bp, C. familiaris
agaaatttattcattt

SEQ ID NO: 302166 - DNA, 16 bp, C. familiaris
agaaatttcaaaaaat

SEQ ID NO: 302167 - DNA, 16 bp, C. familiaris
agaaatttcaaaaaca

SEQ ID NO: 302168 - DNA, 16 bp, C. familiaris
agaaatttcttaaaaa

SEQ ID NO: 302169 - DNA, 16 bp, C. familiaris
agaaatttggaaaatt

SEQ ID NO: 302170 - DNA, 16 bp, C. familiaris
agaaattttggaaaat

SEQ ID NO: 302171 - DNA, 16 bp, C. familiaris
agaacaaaagatgctt

SEQ ID NO: 302172 - DNA, 16 bp, C. familiaris
agaacaaacaatctta

SEQ ID NO: 302173 - DNA, 16 bp, C. familiaris
agaacaaacttgtggt

SEQ ID NO: 302174 - DNA, 16 bp, C. familiaris
agaacaaagctgaaga

SEQ ID NO: 302175 - DNA, 16 bp, C. familiaris
agaacaaagtgatggt

SEQ ID NO: 302176 - DNA, 16 bp, C. familiaris
agaacaaagtggtggt

SEQ ID NO: 302177 - DNA, 16 bp, C. familiaris
agaacaagcagtgggg

SEQ ID NO: 302178 - DNA, 16 bp, C. familiaris
agaacaagctggtggt

SEQ ID NO: 302179 - DNA, 28 bp, C. familiaris
agaacacaggcaacaccctttttgaact

SEQ ID NO: 302180 - DNA, 16 bp, C. familiaris
agaacacaggcgacac

SEQ ID NO: 302181 - DNA, 16 bp, C. familiaris
agaacagaaaatccag

SEQ ID NO: 302182 - DNA, 16 bp, C. familiaris
agaacagatgaatgaa

SEQ ID NO: 302183 - DNA, 16 bp, C. familiaris
agaacagattggtggt

SEQ ID NO: 302184 - DNA, 16 bp, C. familiaris
agaacagcaaggaggc

SEQ ID NO: 302185 - DNA, 16 bp, C. familiaris
agaacagcaggcagag

SEQ ID NO: 302186 - DNA, 16 bp, C. familiaris
agaacaggaacaagac

SEQ ID NO: 302187 - DNA, 16 bp, C. familiaris
agaacaggcaaatcca

SEQ ID NO: 302188 - DNA, 16 bp, C. familiaris
agaacagtgagaaaat

SEQ ID NO: 302189 - DNA, 16 bp, C. familiaris
agaacagtgcttgaca

SEQ ID NO: 302190 - DNA, 16 bp, C. familiaris
agaacataaagacccc

SEQ ID NO: 302191 - DNA, 16 bp, C. familiaris
agaacatgacttgagc

SEQ ID NO: 302192 - DNA, 16 bp, C. familiaris
agaacatgagaaactc

SEQ ID NO: 302193 - DNA, 16 bp, C. familiaris
agaacatgcaactttt

SEQ ID NO: 302194 - DNA, 16 bp, C. familiaris
agaacattccagaagg

SEQ ID NO: 302195 - DNA, 16 bp, C. familiaris
agaacattctggaaaa

SEQ ID NO: 302196 - DNA, 16 bp, C. familiaris
agaacattttaaaaaa

SEQ ID NO: 302197 - DNA, 16 bp, C. familiaris
agaacattttgaaaaa

SEQ ID NO: 302198 - DNA, 16 bp, C. familiaris
agaaccaagaaaatca

SEQ ID NO: 302199 - DNA, 16 bp, C. familiaris
agaaccagcttctggt

SEQ ID NO: 302200 - DNA, 16 bp, C. familiaris
agaacccaaaaatggg

SEQ ID NO: 302201 - DNA, 16 bp, C. familiaris
agaaccctatgatcct

SEQ ID NO: 302202 - DNA, 16 bp, C. familiaris
agaacctagaaataaa

SEQ ID NO: 302203 - DNA, 16 bp, C. familiaris
agaacctgaccatgct

SEQ ID NO: 302204 - DNA, 16 bp, C. familiaris
agaacctgtgaatgtt

SEQ ID NO: 302205 - DNA, 16 bp, C. familiaris
agaactacaaaagcaa

SEQ ID NO: 302206 - DNA, 16 bp, C. familiaris
agaactacactatgat

SEQ ID NO: 302207 - DNA, 16 bp, C. familiaris
agaactaccagatgat

SEQ ID NO: 302208 - DNA, 16 bp, C. familiaris
agaactcaaagaaata

SEQ ID NO: 302209 - DNA, 16 bp, C. familiaris
agaactcagagaaata

SEQ ID NO: 302210 - DNA, 16 bp, C. familiaris
agaactctcaaaattc

SEQ ID NO: 302211 - DNA, 16 bp, C. familiaris
agaactcttaaaattc

SEQ ID NO: 302212 - DNA, 16 bp, C. familiaris
agaactcttcatcttg

SEQ ID NO: 302213 - DNA, 16 bp, C. familiaris
agaactgaaaacatat

SEQ ID NO: 302214 - DNA, 16 bp, C. familiaris
agaactgaccagggag

SEQ ID NO: 302215 - DNA, 16 bp, C. familiaris
agaactgagaaataaa

SEQ ID NO: 302216 - DNA, 16 bp, C. familiaris
agaactggggcacctg

SEQ ID NO: 302217 - DNA, 16 bp, C. familiaris
agaactgtgagaaaag

SEQ ID NO: 302218 - DNA, 16 bp, C. familiaris
agaactgtgagaaaga

SEQ ID NO: 302219 - DNA, 16 bp, C. familiaris
agaactgtgagaaata

SEQ ID NO: 302220 - DNA, 16 bp, C. familiaris
agaactgtgatgcctc

SEQ ID NO: 302221 - DNA, 16 bp, C. familiaris
agaactgtgcctggca

SEQ ID NO: 302222 - DNA, 16 bp, C. familiaris
agaactgtggaaacag

SEQ ID NO: 302223 - DNA, 16 bp, C. familiaris
agaacttaagaaacaa

SEQ ID NO: 302224 - DNA, 16 bp, C. familiaris
agaacttatcaaaccc

SEQ ID NO: 302225 - DNA, 16 bp, C. familiaris
agaacttttaggattt

SEQ ID NO: 302226 - DNA, 16 bp, C. familiaris
agaacttttcattttt

SEQ ID NO: 302227 - DNA, 16 bp, C. familiaris
agaagaaaaagaactt

SEQ ID NO: 302228 - DNA, 16 bp, C. familiaris
agaagaaaaatctcaa

SEQ ID NO: 302229 - DNA, 16 bp, C. familiaris
agaagaaaacagaatt

SEQ ID NO: 302230 - DNA, 16 bp, C. familiaris
agaagaaaacataatt

SEQ ID NO: 302231 - DNA, 16 bp, C. familiaris
agaagaaaacatattt

SEQ ID NO: 302232 - DNA, 16 bp, C. familiaris
agaagaaaacatggga

SEQ ID NO: 302233 - DNA, 16 bp, C. familiaris
agaagaaaagtaattt

SEQ ID NO: 302234 - DNA, 16 bp, C. familiaris
agaagaaaagtctgaa

SEQ ID NO: 302235 - DNA, 16 bp, C. familiaris
agaagaaaatacagga

SEQ ID NO: 302236 - DNA, 16 bp, C. familiaris
agaagaaaatagtttt

SEQ ID NO: 302237 - DNA, 16 bp, C. familiaris
agaagaaaattatttt

SEQ ID NO: 302238 - DNA, 16 bp, C. familiaris
agaagaaaattttgaa

SEQ ID NO: 302239 - DNA, 16 bp, C. familiaris
agaagaaacaaaatct

SEQ ID NO: 302240 - DNA, 16 bp, C. familiaris
agaagaaaccaaacct

SEQ ID NO: 302241 - DNA, 16 bp, C. familiaris
agaagaaaccatgcct

SEQ ID NO: 302242 - DNA, 16 bp, C. familiaris
agaagaaagaatattt

SEQ ID NO: 302243 - DNA, 16 bp, C. familiaris
agaagaaaggaaatca

SEQ ID NO: 302244 - DNA, 16 bp, C. familiaris
agaagaaatacaaatg

SEQ ID NO: 302245 - DNA, 16 bp, C. familiaris
agaagaaatagatgca

SEQ ID NO: 302246 - DNA, 16 bp, C. familiaris
agaagaaatatgtgaa

SEQ ID NO: 302247 - DNA, 16 bp, C. familiaris
agaagaaatcaaacct

SEQ ID NO: 302248 - DNA, 16 bp, C. familiaris
agaagaaatcaaggaa

SEQ ID NO: 302249 - DNA, 16 bp, C. familiaris
agaagaaatcacaaga

SEQ ID NO: 302250 - DNA, 16 bp, C. familiaris
agaagaaatcataaag

SEQ ID NO: 302251 - DNA, 16 bp, C. familiaris
agaagaaatgaacaga

SEQ ID NO: 302252 - DNA, 16 bp, C. familiaris
agaagaaatgaatgca

SEQ ID NO: 302253 - DNA, 16 bp, C. familiaris
agaagaaatggataat

SEQ ID NO: 302254 - DNA, 16 bp, C. familiaris
agaagaaatggatgca

SEQ ID NO: 302255 - DNA, 16 bp, C. familiaris
agaagaaattgggaag

SEQ ID NO: 302256 - DNA, 16 bp, C. familiaris
agaagaaattttgaaa

SEQ ID NO: 302257 - DNA, 16 bp, C. familiaris
agaagaaatttttttt

SEQ ID NO: 302258 - DNA, 16 bp, C. familiaris
agaagaacattccaga

SEQ ID NO: 302259 - DNA, 16 bp, C. familiaris
agaagaaccaagctgg

SEQ ID NO: 302260 - DNA, 16 bp, C. familiaris
agaagaactgtagaag

SEQ ID NO: 302261 - DNA, 16 bp, C. familiaris
agaagaactgtggaaa

SEQ ID NO: 302262 - DNA, 16 bp, C. familiaris
agaagaactttttttt

SEQ ID NO: 302263 - DNA, 16 bp, C. familiaris
agaagaagaaaacatt

SEQ ID NO: 302264 - DNA, 16 bp, C. familiaris
agaagaagaaactgga

SEQ ID NO: 302265 - DNA, 16 bp, C. familiaris
agaagaagaagaaact

SEQ ID NO: 302266 - DNA, 16 bp, C. familiaris
agaagaagaagcagcc

SEQ ID NO: 302267 - DNA, 16 bp, C. familiaris
agaagaagagacacca

SEQ ID NO: 302268 - DNA, 16 bp, C. familiaris
agaagaagagatttaa

SEQ ID NO: 302269 - DNA, 16 bp, C. familiaris
agaagaagaggctccg

SEQ ID NO: 302270 - DNA, 17 bp, C. familiaris
agaagaagccaaactct

SEQ ID NO: 302271 - DNA, 16 bp, C. familiaris
agaagaaggaaactgg

SEQ ID NO: 302272 - DNA, 16 bp, C. familiaris
agaagaatagctatta

SEQ ID NO: 302273 - DNA, 16 bp, C. familiaris
agaagaatggatcagt

SEQ ID NO: 302274 - DNA, 16 bp, C. familiaris
agaagaatgtggattc

SEQ ID NO: 302275 - DNA, 16 bp, C. familiaris
agaagacaagaatata

SEQ ID NO: 302276 - DNA, 16 bp, C. familiaris
agaagacaaggtgatg

SEQ ID NO: 302277 - DNA, 16 bp, C. familiaris
agaagacaatgaaata

SEQ ID NO: 302278 - DNA, 16 bp, C. familiaris
agaagacacaagactc

SEQ ID NO: 302279 - DNA, 16 bp, C. familiaris
agaagacacagaaata

SEQ ID NO: 302280 - DNA, 16 bp, C. familiaris
agaagacattcagatg

SEQ ID NO: 302281 - DNA, 16 bp, C. familiaris
agaagacatttaaaaa

SEQ ID NO: 302282 - DNA, 16 bp, C. familiaris
agaagactgaaatcat

SEQ ID NO: 302283 - DNA, 16 bp, C. familiaris
agaagagaaaactgaa

SEQ ID NO: 302284 - DNA, 16 bp, C. familiaris
agaagagaagccacag

SEQ ID NO: 302285 - DNA, 16 bp, C. familiaris
agaagagaatggcatg

SEQ ID NO: 302286 - DNA, 16 bp, C. familiaris
agaagagagagaatct

SEQ ID NO: 302287 - DNA, 16 bp, C. familiaris
agaagagagagcccag

SEQ ID NO: 302288 - DNA, 16 bp, C. familiaris
agaagagatcactacc

SEQ ID NO: 302289 - DNA, 16 bp, C. familiaris
agaagagattttaaaa

SEQ ID NO: 302290 - DNA, 16 bp, C. familiaris
agaagagcatgggact

SEQ ID NO: 302291 - DNA, 16 bp, C. familiaris
agaagaggaagctgag

SEQ ID NO: 302292 - DNA, 16 bp, C. familiaris
agaagaggcagagaca

SEQ ID NO: 302293 - DNA, 16 bp, C. familiaris
agaagagtcagatgct

SEQ ID NO: 302294 - DNA, 16 bp, C. familiaris
agaagagtcttttcaa

SEQ ID NO: 302295 - DNA, 16 bp, C. familiaris
agaagagttttaaaaa

SEQ ID NO: 302296 - DNA, 16 bp, C. familiaris
agaagataacatagga

SEQ ID NO: 302297 - DNA, 16 bp, C. familiaris
agaagatatacagatg

SEQ ID NO: 302298 - DNA, 16 bp, C. familiaris
agaagatatgaacaaa

SEQ ID NO: 302299 - DNA, 16 bp, C. familiaris
agaagatcaataagga

SEQ ID NO: 302300 - DNA, 16 bp, C. familiaris
agaagatcagaacaaa

SEQ ID NO: 302301 - DNA, 16 bp, C. familiaris
agaagatgtggaatat

SEQ ID NO: 302302 - DNA, 16 bp, C. familiaris
agaagatgtgttttat

SEQ ID NO: 302303 - DNA, 16 bp, C. familiaris
agaagattctcaaaga

SEQ ID NO: 302304 - DNA, 16 bp, C. familiaris
agaagatttatttgaa

SEQ ID NO: 302305 - DNA, 16 bp, C. familiaris
agaagattttgtttat

SEQ ID NO: 302306 - DNA, 16 bp, C. familiaris
agaagcaaaactttca

SEQ ID NO: 302307 - DNA, 16 bp, C. familiaris
agaagcaaacagaaat

SEQ ID NO: 302308 - DNA, 16 bp, C. familiaris
agaagcaaagacacag

SEQ ID NO: 302309 - DNA, 16 bp, C. familiaris
agaagcaagatccatg

SEQ ID NO: 302310 - DNA, 16 bp, C. familiaris
agaagcaaggaaagat

SEQ ID NO: 302311 - DNA, 16 bp, C. familiaris
agaagcaaggaaggat

SEQ ID NO: 302312 - DNA, 16 bp, C. familiaris
agaagcacaattataa

SEQ ID NO: 302313 - DNA, 16 bp, C. familiaris
agaagcacaggcagag

SEQ ID NO: 302314 - DNA, 16 bp, C. familiaris
agaagcacaggtaaca

SEQ ID NO: 302315 - DNA, 16 bp, C. familiaris
agaagcagaaacacag

SEQ ID NO: 302316 - DNA, 16 bp, C. familiaris
agaagcagaatcccca

SEQ ID NO: 302317 - DNA, 16 bp, C. familiaris
agaagcagacccctca

SEQ ID NO: 302318 - DNA, 16 bp, C. familiaris
agaagcagactcccag

SEQ ID NO: 302319 - DNA, 16 bp, C. familiaris
agaagcagactgcccg

SEQ ID NO: 302320 - DNA, 16 bp, C. familiaris
agaagcagacttcctc

SEQ ID NO: 302321 - DNA, 16 bp, C. familiaris
agaagcagactttcca

SEQ ID NO: 302322 - DNA, 16 bp, C. familiaris
agaagcagagacagag

SEQ ID NO: 302323 - DNA, 16 bp, C. familiaris
agaagcagagatagag

SEQ ID NO: 302324 - DNA, 16 bp, C. familiaris
agaagcagagcaggga

SEQ ID NO: 302325 - DNA, 16 bp, C. familiaris
agaagcagagcctgag

SEQ ID NO: 302326 - DNA, 16 bp, C. familiaris
agaagcagagggacag

SEQ ID NO: 302327 - DNA, 16 bp, C. familiaris
agaagcagaggtcaga

SEQ ID NO: 302328 - DNA, 16 bp, C. familiaris
agaagcagaggttgga

SEQ ID NO: 302329 - DNA, 16 bp, C. familiaris
agaagcagagtccttg

SEQ ID NO: 302330 - DNA, 16 bp, C. familiaris
agaagcagagtctctg

SEQ ID NO: 302331 - DNA, 16 bp, C. familiaris
agaagcagatggagag

SEQ ID NO: 302332 - DNA, 16 bp, C. familiaris
agaagcagcagcagca

SEQ ID NO: 302333 - DNA, 16 bp, C. familiaris
agaagcagcagcagct

SEQ ID NO: 302334 - DNA, 16 bp, C. familiaris
agaagcagccttcatg

SEQ ID NO: 302335 - DNA, 16 bp, C. familiaris
agaagcagctcctcat

SEQ ID NO: 302336 - DNA, 16 bp, C. familiaris
agaagcaggaagcctg

SEQ ID NO: 302337 - DNA, 16 bp, C. familiaris
agaagcaggagcccga

SEQ ID NO: 302338 - DNA, 16 bp, C. familiaris
agaagcaggatccatg

SEQ ID NO: 302339 - DNA, 16 bp, C. familiaris
agaagcaggcagagga

SEQ ID NO: 302340 - DNA, 16 bp, C. familiaris
agaagcagggagccct

SEQ ID NO: 302341 - DNA, 16 bp, C. familiaris
agaagcagggtccctg

SEQ ID NO: 302342 - DNA, 16 bp, C. familiaris
agaagcaggttccctg

SEQ ID NO: 302343 - DNA, 16 bp, C. familiaris
agaagccaaactgaaa

SEQ ID NO: 302344 - DNA, 16 bp, C. familiaris
agaagccagaaatctg

SEQ ID NO: 302345 - DNA, 16 bp, C. familiaris
agaagccagaagccag

SEQ ID NO: 302346 - DNA, 16 bp, C. familiaris
agaagccagacacaga

SEQ ID NO: 302347 - DNA, 16 bp, C. familiaris
agaagccagtcataaa

SEQ ID NO: 302348 - DNA, 16 bp, C. familiaris
agaagcccgacgtggg

SEQ ID NO: 302349 - DNA, 16 bp, C. familiaris
agaagcgaaaaccctt

SEQ ID NO: 302350 - DNA, 16 bp, C. familiaris
agaagctcaacatcac

SEQ ID NO: 302351 - DNA, 16 bp, C. familiaris
agaagctcaagcagac

SEQ ID NO: 302352 - DNA, 16 bp, C. familiaris
agaagctcagccactg

SEQ ID NO: 302353 - DNA, 16 bp, C. familiaris
agaagctctgtgccag

SEQ ID NO: 302354 - DNA, 16 bp, C. familiaris
agaagctgagagaaga

SEQ ID NO: 302355 - DNA, 16 bp, C. familiaris
agaagctgagagagag

SEQ ID NO: 302356 - DNA, 16 bp, C. familiaris
agaagctggaaaaggc

SEQ ID NO: 302357 - DNA, 16 bp, C. familiaris
agaagctggaagaagc

SEQ ID NO: 302358 - DNA, 16 bp, C. familiaris
agaagctggagaaaaa

SEQ ID NO: 302359 - DNA, 16 bp, C. familiaris
agaagctttctttttt

SEQ ID NO: 302360 - DNA, 16 bp, C. familiaris
agaaggaaaaatctac

SEQ ID NO: 302361 - DNA, 16 bp, C. familiaris
agaaggaaaacctcac

SEQ ID NO: 302362 - DNA, 16 bp, C. familiaris
agaaggaaaactgaaa

SEQ ID NO: 302363 - DNA, 16 bp, C. familiaris
agaaggaaaatcagaa

SEQ ID NO: 302364 - DNA, 16 bp, C. familiaris
agaaggaaaatgatgt

SEQ ID NO: 302365 - DNA, 16 bp, C. familiaris
agaaggaaacaaatca

SEQ ID NO: 302366 - DNA, 16 bp, C. familiaris
agaaggaaataatttt

SEQ ID NO: 302367 - DNA, 16 bp, C. familiaris
agaaggaaatcctgtc

SEQ ID NO: 302368 - DNA, 16 bp, C. familiaris
agaaggaaatttagaa

SEQ ID NO: 302369 - DNA, 16 bp, C. familiaris
agaaggaacagcatgt

SEQ ID NO: 302370 - DNA, 16 bp, C. familiaris
agaaggaatttttaaa

SEQ ID NO: 302371 - DNA, 16 bp, C. familiaris
agaaggaccttgaagg

SEQ ID NO: 302372 - DNA, 16 bp, C. familiaris
agaaggagaagcagct

SEQ ID NO: 302373 - DNA, 16 bp, C. familiaris
agaaggagaagctggc

SEQ ID NO: 302374 - DNA, 16 bp, C. familiaris
agaaggagagagtctt

SEQ ID NO: 302375 - DNA, 16 bp, C. familiaris
agaaggaggagcaggc

SEQ ID NO: 302376 - DNA, 16 bp, C. familiaris
agaaggaggctccctg

SEQ ID NO: 302377 - DNA, 16 bp, C. familiaris
agaaggatgagtacag

SEQ ID NO: 302378 - DNA, 16 bp, C. familiaris
agaaggcagaggcaga

SEQ ID NO: 302379 - DNA, 16 bp, C. familiaris
agaaggcagctgctta

SEQ ID NO: 302380 - DNA, 16 bp, C. familiaris
agaaggcagctgtctg

SEQ ID NO: 302381 - DNA, 16 bp, C. familiaris
agaaggcaggcagagg

SEQ ID NO: 302382 - DNA, 16 bp, C. familiaris
agaaggctccacgcag

SEQ ID NO: 302383 - DNA, 16 bp, C. familiaris
agaaggcttcctggag

SEQ ID NO: 302384 - DNA, 16 bp, C. familiaris
agaaggggagccccgc

SEQ ID NO: 302385 - DNA, 16 bp, C. familiaris
agaagggtgaatacag

SEQ ID NO: 302386 - DNA, 16 bp, C. familiaris
agaaggtgaaagacct

SEQ ID NO: 302387 - DNA, 16 bp, C. familiaris
agaaggtgaagcaggc

SEQ ID NO: 302388 - DNA, 16 bp, C. familiaris
agaaggtggcatttga

SEQ ID NO: 302389 - DNA, 16 bp, C. familiaris
agaaggtttatttgaa

SEQ ID NO: 302390 - DNA, 16 bp, C. familiaris
agaagtaaaatcttaa

SEQ ID NO: 302391 - DNA, 16 bp, C. familiaris
agaagtagactcccta

SEQ ID NO: 302392 - DNA, 16 bp, C. familiaris
agaagtcaaccacaag

SEQ ID NO: 302393 - DNA, 16 bp, C. familiaris
agaagtcagacagaga

SEQ ID NO: 302394 - DNA, 16 bp, C. familiaris
agaagtcagagaaaga

SEQ ID NO: 302395 - DNA, 16 bp, C. familiaris
agaagtcagagaagga

SEQ ID NO: 302396 - DNA, 16 bp, C. familiaris
agaagtccaagatcaa

SEQ ID NO: 302397 - DNA, 16 bp, C. familiaris
agaagtgaggtcacag

SEQ ID NO: 302398 - DNA, 16 bp, C. familiaris
agaagtggagcctgaa

SEQ ID NO: 302399 - DNA, 16 bp, C. familiaris
agaagtgtgaactctt

SEQ ID NO: 302400 - DNA, 16 bp, C. familiaris
agaagttaaaacattt

SEQ ID NO: 302401 - DNA, 16 bp, C. familiaris
agaagttgcaaaaata

SEQ ID NO: 302402 - DNA, 16 bp, C. familiaris
agaagtttaattatga

SEQ ID NO: 302403 - DNA, 16 bp, C. familiaris
agaagttttgcatcca

SEQ ID NO: 302404 - DNA, 16 bp, C. familiaris
agaataaaacatttaa

SEQ ID NO: 302405 - DNA, 16 bp, C. familiaris
agaataaacaatccta

SEQ ID NO: 302406 - DNA, 17 bp, C. familiaris
agaataacaccagtgct

SEQ ID NO: 302407 - DNA, 16 bp, C. familiaris
agaataattttagatt

SEQ ID NO: 302408 - DNA, 16 bp, C. familiaris
agaatacacaaagaac

SEQ ID NO: 302409 - DNA, 16 bp, C. familiaris
agaatacagagaaagg

SEQ ID NO: 302410 - DNA, 16 bp, C. familiaris
agaatacattcttttt

SEQ ID NO: 302411 - DNA, 16 bp, C. familiaris
agaatactgtatataa

SEQ ID NO: 302412 - DNA, 16 bp, C. familiaris
agaatagaaaagaatc

SEQ ID NO: 302413 - DNA, 16 bp, C. familiaris
agaatagccaagaaaa

SEQ ID NO: 302414 - DNA, 16 bp, C. familiaris
agaataggaaaatcca

SEQ ID NO: 302415 - DNA, 16 bp, C. familiaris
agaatataaaaatgtg

SEQ ID NO: 302416 - DNA, 16 bp, C. familiaris
agaatatgaagactcc

SEQ ID NO: 302417 - DNA, 16 bp, C. familiaris
agaatatgatcttatt

SEQ ID NO: 302418 - DNA, 16 bp, C. familiaris
agaatatgtatttttg

SEQ ID NO: 302419 - DNA, 16 bp, C. familiaris
agaatatgtcccaaat

SEQ ID NO: 302420 - DNA, 17 bp, C. familiaris
agaatatgtggccacca

SEQ ID NO: 302421 - DNA, 16 bp, C. familiaris
agaatattaaaagcag

SEQ ID NO: 302422 - DNA, 16 bp, C. familiaris
agaatattaagcagac

SEQ ID NO: 302423 - DNA, 16 bp, C. familiaris
agaatattatggaaaa

SEQ ID NO: 302424 - DNA, 16 bp, C. familiaris
agaatatttctatttt

SEQ ID NO: 302425 - DNA, 16 bp, C. familiaris
agaatattttctttct

SEQ ID NO: 302426 - DNA, 16 bp, C. familiaris
agaatcacctgaaggg

SEQ ID NO: 302427 - DNA, 16 bp, C. familiaris
agaatcacctggagga

SEQ ID NO: 302428 - DNA, 16 bp, C. familiaris
agaatcactgaactct

SEQ ID NO: 302429 - DNA, 16 bp, C. familiaris
agaatcactgctctag

SEQ ID NO: 302430 - DNA, 16 bp, C. familiaris
agaatcagaaacagaa

SEQ ID NO: 302431 - DNA, 16 bp, C. familiaris
agaatcatcatcatca

SEQ ID NO: 302432 - DNA, 16 bp, C. familiaris
agaatcccaaggaggc

SEQ ID NO: 302433 - DNA, 16 bp, C. familiaris
agaatcctgaaacaga

SEQ ID NO: 302434 - DNA, 16 bp, C. familiaris
agaatctgaatttcta

SEQ ID NO: 302435 - DNA, 16 bp, C. familiaris
agaatctgctggagat

SEQ ID NO: 302436 - DNA, 16 bp, C. familiaris
agaatctgttccatgc

SEQ ID NO: 302437 - DNA, 16 bp, C. familiaris
agaatcttcaagctga

SEQ ID NO: 302438 - DNA, 16 bp, C. familiaris
agaatctttcaagcag

SEQ ID NO: 302439 - DNA, 16 bp, C. familiaris
agaatgaacttttttt

SEQ ID NO: 302440 - DNA, 16 bp, C. familiaris
agaatgaagaaaacag

SEQ ID NO: 302441 - DNA, 16 bp, C. familiaris
agaatgaatacatgaa

SEQ ID NO: 302442 - DNA, 16 bp, C. familiaris
agaatgaccaaaatcc

SEQ ID NO: 302443 - DNA, 16 bp, C. familiaris
agaatgagacagagaa

SEQ ID NO: 302444 - DNA, 16 bp, C. familiaris
agaatgagagaagaca

SEQ ID NO: 302445 - DNA, 16 bp, C. familiaris
agaatgaggaaaatta

SEQ ID NO: 302446 - DNA, 16 bp, C. familiaris
agaatgatttgaaagt

SEQ ID NO: 302447 - DNA, 16 bp, C. familiaris
agaatgatttgatagc

SEQ ID NO: 302448 - DNA, 16 bp, C. familiaris
agaatgcagagaaagg

SEQ ID NO: 302449 - DNA, 16 bp, C. familiaris
agaatgcttttttctt

SEQ ID NO: 302450 - DNA, 16 bp, C. familiaris
agaatggaatgttttt

SEQ ID NO: 302451 - DNA, 16 bp, C. familiaris
agaatggatatccttg

SEQ ID NO: 302452 - DNA, 16 bp, C. familiaris
agaatggcaggcagag

SEQ ID NO: 302453 - DNA, 16 bp, C. familiaris
agaatggctaaaataa

SEQ ID NO: 302454 - DNA, 16 bp, C. familiaris
agaatgggagaaagat

SEQ ID NO: 302455 - DNA, 16 bp, C. familiaris
agaatggggagaagat

SEQ ID NO: 302456 - DNA, 16 bp, C. familiaris
agaatgtcctcggcag

SEQ ID NO: 302457 - DNA, 16 bp, C. familiaris
agaatgtggaggaaaa

SEQ ID NO: 302458 - DNA, 16 bp, C. familiaris
agaatgttctgaatat

SEQ ID NO: 302459 - DNA, 16 bp, C. familiaris
agaatgttctggaatt

SEQ ID NO: 302460 - DNA, 16 bp, C. familiaris
agaatgtttttaaaga

SEQ ID NO: 302461 - DNA, 17 bp, C. familiaris
agaattaaagagagacc

SEQ ID NO: 302462 - DNA, 16 bp, C. familiaris
agaattaaatgaaatg

SEQ ID NO: 302463 - DNA, 41 bp, C. familiaris
agaattaatattgtgaaaatgtcaatgttacccagggcaat

SEQ ID NO: 302464 - DNA, 16 bp, C. familiaris
agaattacagaatttg

SEQ ID NO: 302465 - DNA, 16 bp, C. familiaris
agaattagaattagaa

SEQ ID NO: 302466 - DNA, 16 bp, C. familiaris
agaattagcagacaag

SEQ ID NO: 302467 - DNA, 16 bp, C. familiaris
agaattatagaccaat

SEQ ID NO: 302468 - DNA, 16 bp, C. familiaris
agaattcaaaagattc

SEQ ID NO: 302469 - DNA, 16 bp, C. familiaris
agaattcatacaggaa

SEQ ID NO: 302470 - DNA, 16 bp, C. familiaris
agaattcatcaatgaa

SEQ ID NO: 302471 - DNA, 16 bp, C. familiaris
agaattcattttcttg

SEQ ID NO: 302472 - DNA, 16 bp, C. familiaris
agaattctatttattt

SEQ ID NO: 302473 - DNA, 16 bp, C. familiaris
agaattctcctgtgaa

SEQ ID NO: 302474 - DNA, 16 bp, C. familiaris
agaattctgatttttt

SEQ ID NO: 302475 - DNA, 16 bp, C. familiaris
agaattgaaagcaaga

SEQ ID NO: 302476 - DNA, 16 bp, C. familiaris
agaattgaaagcagaa

SEQ ID NO: 302477 - DNA, 16 bp, C. familiaris
agaattggaaaatata

SEQ ID NO: 302478 - DNA, 16 bp, C. familiaris
agaattgtaagaaaat

SEQ ID NO: 302479 - DNA, 16 bp, C. familiaris
agaatttaaagaattt

SEQ ID NO: 302480 - DNA, 16 bp, C. familiaris
agaatttaattccttt

SEQ ID NO: 302481 - DNA, 16 bp, C. familiaris
agaatttaccagtaaa

SEQ ID NO: 302482 - DNA, 16 bp, C. familiaris
agaatttatttaaaga

SEQ ID NO: 302483 - DNA, 16 bp, C. familiaris
agaatttcaaataaat

SEQ ID NO: 302484 - DNA, 16 bp, C. familiaris
agaatttcaacagaga

SEQ ID NO: 302485 - DNA, 16 bp, C. familiaris
agaatttcaagaaaat

SEQ ID NO: 302486 - DNA, 16 bp, C. familiaris
agaatttcaagcagac

SEQ ID NO: 302487 - DNA, 16 bp, C. familiaris
agaatttcaagcagag

SEQ ID NO: 302488 - DNA, 16 bp, C. familiaris
agaatttcatttattt

SEQ ID NO: 302489 - DNA, 16 bp, C. familiaris
agaatttcattttgat

SEQ ID NO: 302490 - DNA, 16 bp, C. familiaris
agaatttccatctttt

SEQ ID NO: 302491 - DNA, 16 bp, C. familiaris
agaatttccttctttt

SEQ ID NO: 302492 - DNA, 16 bp, C. familiaris
agaatttccttttaaa

SEQ ID NO: 302493 - DNA, 16 bp, C. familiaris
agaatttcttaatttt

SEQ ID NO: 302494 - DNA, 16 bp, C. familiaris
agaatttggaaaatat

SEQ ID NO: 302495 - DNA, 16 bp, C. familiaris
agaatttgtttaaaaa

SEQ ID NO: 302496 - DNA, 16 bp, C. familiaris
agaatttgttttaaaa

SEQ ID NO: 302497 - DNA, 16 bp, C. familiaris
agaattttaaaatgca

SEQ ID NO: 302498 - DNA, 16 bp, C. familiaris
agaattttctctttct

SEQ ID NO: 302499 - DNA, 16 bp, C. familiaris
agaattttctttttct

SEQ ID NO: 302500 - DNA, 16 bp, C. familiaris
agaattttgagaaaat

SEQ ID NO: 302501 - DNA, 16 bp, C. familiaris
agaatttttaagatct

SEQ ID NO: 302502 - DNA, 16 bp, C. familiaris
agaatttttatcaaga

SEQ ID NO: 302503 - DNA, 16 bp, C. familiaris
agaatttttatttctt

SEQ ID NO: 302504 - DNA, 16 bp, C. familiaris
agaatttttgaaaaat

SEQ ID NO: 302505 - DNA, 16 bp, C. familiaris
agaatttttttaaaag

SEQ ID NO: 302506 - DNA, 16 bp, C. familiaris
agaatttttttcctct

SEQ ID NO: 302507 - DNA, 16 bp, C. familiaris
agacaaacaaaagtta

SEQ ID NO: 302508 - DNA, 16 bp, C. familiaris
agacaaagaaggtcat

SEQ ID NO: 302509 - DNA, 17 bp, C. familiaris
agacaaagaccccacca

SEQ ID NO: 302510 - DNA, 16 bp, C. familiaris
agacaaagagaaaatc

SEQ ID NO: 302511 - DNA, 16 bp, C. familiaris
agacaaagagaaaatt

SEQ ID NO: 302512 - DNA, 16 bp, C. familiaris
agacaaagagagaatc

SEQ ID NO: 302513 - DNA, 16 bp, C. familiaris
agacaaagagatggaa

SEQ ID NO: 302514 - DNA, 16 bp, C. familiaris
agacaaaggactttat

SEQ ID NO: 302515 - DNA, 16 bp, C. familiaris
agacaaaggcagagga

SEQ ID NO: 302516 - DNA, 16 bp, C. familiaris
agacaaatgaaaatga

SEQ ID NO: 302517 - DNA, 16 bp, C. familiaris
agacaaattagatttt

SEQ ID NO: 302518 - DNA, 16 bp, C. familiaris
agacaacccagaaatg

SEQ ID NO: 302519 - DNA, 16 bp, C. familiaris
agacaagaaagaatca

SEQ ID NO: 302520 - DNA, 17 bp, C. familiaris
agacaagattccattaa

SEQ ID NO: 302521 - DNA, 16 bp, C. familiaris
agacaaggaaattgag

SEQ ID NO: 302522 - DNA, 16 bp, C. familiaris
agacaaggacaccaca

SEQ ID NO: 302523 - DNA, 16 bp, C. familiaris
agacaatacataaaca

SEQ ID NO: 302524 - DNA, 16 bp, C. familiaris
agacaatcatgtcatc

SEQ ID NO: 302525 - DNA, 16 bp, C. familiaris
agacaattaaaagacc

SEQ ID NO: 302526 - DNA, 16 bp, C. familiaris
agacacaaagtgaaca

SEQ ID NO: 302527 - DNA, 16 bp, C. familiaris
agacacaagcagagaa

SEQ ID NO: 302528 - DNA, 16 bp, C. familiaris
agacacaaggcagagg

SEQ ID NO: 302529 - DNA, 16 bp, C. familiaris
agacacacacacacag

SEQ ID NO: 302530 - DNA, 16 bp, C. familiaris
agacacacacacagag

SEQ ID NO: 302531 - DNA, 16 bp, C. familiaris
agacacacacactcac

SEQ ID NO: 302532 - DNA, 16 bp, C. familiaris
agacacacacagggag

SEQ ID NO: 302533 - DNA, 16 bp, C. familiaris
agacacacagacacat

SEQ ID NO: 302534 - DNA, 16 bp, C. familiaris
agacacagaaaggtta

SEQ ID NO: 302535 - DNA, 16 bp, C. familiaris
agacacagaagagagg

SEQ ID NO: 302536 - DNA, 16 bp, C. familiaris
agacacagaagcagag

SEQ ID NO: 302537 - DNA, 16 bp, C. familiaris
agacacagaaggacaa

SEQ ID NO: 302538 - DNA, 16 bp, C. familiaris
agacacagagacagaa

SEQ ID NO: 302539 - DNA, 16 bp, C. familiaris
agacacagagacagat

SEQ ID NO: 302540 - DNA, 16 bp, C. familiaris
agacacaggagaagca

SEQ ID NO: 302541 - DNA, 16 bp, C. familiaris
agacacaggagaagct

SEQ ID NO: 302542 - DNA, 16 bp, C. familiaris
agacacaggaggaggg

SEQ ID NO: 302543 - DNA, 16 bp, C. familiaris
agacacaggcaaagaa

SEQ ID NO: 302544 - DNA, 16 bp, C. familiaris
agacacaggcaatggg

SEQ ID NO: 302545 - DNA, 16 bp, C. familiaris
agacacaggcatagga

SEQ ID NO: 302546 - DNA, 16 bp, C. familiaris
agacacagggaaagag

SEQ ID NO: 302547 - DNA, 16 bp, C. familiaris
agacacagtccctgcc

SEQ ID NO: 302548 - DNA, 16 bp, C. familiaris
agacacatggaaaaat

SEQ ID NO: 302549 - DNA, 16 bp, C. familiaris
agacaccagagaatcc

SEQ ID NO: 302550 - DNA, 16 bp, C. familiaris
agacaccattaagaaa

SEQ ID NO: 302551 - DNA, 16 bp, C. familiaris
agacacctacagcctg

SEQ ID NO: 302552 - DNA, 16 bp, C. familiaris
agacacctgagaatca

SEQ ID NO: 302553 - DNA, 16 bp, C. familiaris
agacacggccaacaag

SEQ ID NO: 302554 - DNA, 16 bp, C. familiaris
agacactcaaccaact

SEQ ID NO: 302555 - DNA, 16 bp, C. familiaris
agacactgcagaagaa

SEQ ID NO: 302556 - DNA, 16 bp, C. familiaris
agacagaaaatctgaa

SEQ ID NO: 302557 - DNA, 16 bp, C. familiaris
agacagaaagcagatt

SEQ ID NO: 302558 - DNA, 16 bp, C. familiaris
agacagaaatgagaga

SEQ ID NO: 302559 - DNA, 16 bp, C. familiaris
agacagaagataaaga

SEQ ID NO: 302560 - DNA, 16 bp, C. familiaris
agacagaagcagaagg

SEQ ID NO: 302561 - DNA, 16 bp, C. familiaris
agacagagaaagaggc

SEQ ID NO: 302562 - DNA, 16 bp, C. familiaris
agacagagaagcagag

SEQ ID NO: 302563 - DNA, 16 bp, C. familiaris
agacagagaagcaggc

SEQ ID NO: 302564 - DNA, 16 bp, C. familiaris
agacagagacagtgag

SEQ ID NO: 302565 - DNA, 16 bp, C. familiaris
agacagagagagagca

SEQ ID NO: 302566 - DNA, 16 bp, C. familiaris
agacagagagagtgag

SEQ ID NO: 302567 - DNA, 16 bp, C. familiaris
agacagagagagtgtg

SEQ ID NO: 302568 - DNA, 16 bp, C. familiaris
agacagagagccagag

SEQ ID NO: 302569 - DNA, 16 bp, C. familiaris
agacagagatggagac

SEQ ID NO: 302570 - DNA, 16 bp, C. familiaris
agacagaggaccagaa

SEQ ID NO: 302571 - DNA, 16 bp, C. familiaris
agacagaggcagagga

SEQ ID NO: 302572 - DNA, 16 bp, C. familiaris
agacagagggacagag

SEQ ID NO: 302573 - DNA, 16 bp, C. familiaris
agacagagtgagagag

SEQ ID NO: 302574 - DNA, 16 bp, C. familiaris
agacagatccaaaaaa

SEQ ID NO: 302575 - DNA, 16 bp, C. familiaris
agacagatggagagag

SEQ ID NO: 302576 - DNA, 16 bp, C. familiaris
agacagcccaggtggc

SEQ ID NO: 302577 - DNA, 16 bp, C. familiaris
agacaggaaaactgag

SEQ ID NO: 302578 - DNA, 16 bp, C. familiaris
agacaggagaagcagg

SEQ ID NO: 302579 - DNA, 16 bp, C. familiaris
agacaggcaggcagag

SEQ ID NO: 302580 - DNA, 16 bp, C. familiaris
agacaggcccaagatg

SEQ ID NO: 302581 - DNA, 16 bp, C. familiaris
agacagtgtggtcctg

SEQ ID NO: 302582 - DNA, 19 bp, C. familiaris
agacatagacatggccaag

SEQ ID NO: 302583 - DNA, 16 bp, C. familiaris
agacatgagagagaga

SEQ ID NO: 302584 - DNA, 16 bp, C. familiaris
agacatgcacacacag

SEQ ID NO: 302585 - DNA, 16 bp, C. familiaris
agacatgcagagggag

SEQ ID NO: 302586 - DNA, 16 bp, C. familiaris
agacatggagagagag

SEQ ID NO: 302587 - DNA, 16 bp, C. familiaris
agacattgatgaaaga

SEQ ID NO: 302588 - DNA, 16 bp, C. familiaris
agacattgcagaagaa

SEQ ID NO: 302589 - DNA, 16 bp, C. familiaris
agacattgtgaatttt

SEQ ID NO: 302590 - DNA, 16 bp, C. familiaris
agacatttctccagag

SEQ ID NO: 302591 - DNA, 16 bp, C. familiaris
agacatttggattatt

SEQ ID NO: 302592 - DNA, 16 bp, C. familiaris
agacatttgggctctt

SEQ ID NO: 302593 - DNA, 16 bp, C. familiaris
agacattttcttaaaa

SEQ ID NO: 302594 - DNA, 16 bp, C. familiaris
agacattttcttttat

SEQ ID NO: 302595 - DNA, 50 bp, C. familiaris
agaccaatatccctgatgaacatggatgcaaaaattctcaacaagatact

SEQ ID NO: 302596 - DNA, 16 bp, C. familiaris
agaccaatgaaaccag

SEQ ID NO: 302597 - DNA, 16 bp, C. familiaris
agaccacaacttcttt

SEQ ID NO: 302598 - DNA, 16 bp, C. familiaris
agaccacgccctgggc

SEQ ID NO: 302599 - DNA, 30 bp, C. familiaris
agaccagaagaactgtggaacagatcaaca

SEQ ID NO: 302600 - DNA, 16 bp, C. familiaris
agaccagcaaggacag

SEQ ID NO: 302601 - DNA, 16 bp, C. familiaris
agaccagtgtggctgg

SEQ ID NO: 302602 - DNA, 16 bp, C. familiaris
agacccagaagagcca

SEQ ID NO: 302603 - DNA, 16 bp, C. familiaris
agacccagaatcaaat

SEQ ID NO: 302604 - DNA, 16 bp, C. familiaris
agacccaggatgaagt

SEQ ID NO: 302605 - DNA, 16 bp, C. familiaris
agaccccaaaaagcca

SEQ ID NO: 302606 - DNA, 16 bp, C. familiaris
agaccccaccagaaag

SEQ ID NO: 302607 - DNA, 16 bp, C. familiaris
agacccgggatcaagc

SEQ ID NO: 302608 - DNA, 16 bp, C. familiaris
agacccgggcagaggg

SEQ ID NO: 302609 - DNA, 16 bp, C. familiaris
agaccctgaaatcaag

SEQ ID NO: 302610 - DNA, 16 bp, C. familiaris
agaccctgagccagaa

SEQ ID NO: 302611 - DNA, 16 bp, C. familiaris
agaccctggagaccct

SEQ ID NO: 302612 - DNA, 16 bp, C. familiaris
agaccgagagctccgg

SEQ ID NO: 302613 - DNA, 16 bp, C. familiaris
agaccgcatcttcttt

SEQ ID NO: 302614 - DNA, 16 bp, C. familiaris
agacctaaaggtgaga

SEQ ID NO: 302615 - DNA, 16 bp, C. familiaris
agacctacagatggcc

SEQ ID NO: 302616 - DNA, 16 bp, C. familiaris
agacctacctcaagaa

SEQ ID NO: 302617 - DNA, 16 bp, C. familiaris
agacctagagaaagag

SEQ ID NO: 302618 - DNA, 16 bp, C. familiaris
agacctatctagaaaa

SEQ ID NO: 302619 - DNA, 16 bp, C. familiaris
agacctcaccccacca

SEQ ID NO: 302620 - DNA, 16 bp, C. familiaris
agacctccagcctcca

SEQ ID NO: 302621 - DNA, 16 bp, C. familiaris
agacctgaaaccagaa

SEQ ID NO: 302622 - DNA, 16 bp, C. familiaris
agacctggcaggacag

SEQ ID NO: 302623 - DNA, 16 bp, C. familiaris
agacgctcaacttctg

SEQ ID NO: 302624 - DNA, 16 bp, C. familiaris
agactatgcactggaa

SEQ ID NO: 302625 - DNA, 16 bp, C. familiaris
agactattatgaacaa

SEQ ID NO: 302626 - DNA, 16 bp, C. familiaris
agactatttattcatg

SEQ ID NO: 302627 - DNA, 16 bp, C. familiaris
agactcagaaaagaaa

SEQ ID NO: 302628 - DNA, 16 bp, C. familiaris
agactcaggcagaggg

SEQ ID NO: 302629 - DNA, 16 bp, C. familiaris
agactccaggatcagg

SEQ ID NO: 302630 - DNA, 16 bp, C. familiaris
agactccaggctgagc

SEQ ID NO: 302631 - DNA, 16 bp, C. familiaris
agactccatgcccagg

SEQ ID NO: 302632 - DNA, 16 bp, C. familiaris
agactccccaccaagc

SEQ ID NO: 302633 - DNA, 16 bp, C. familiaris
agactcctggcaggga

SEQ ID NO: 302634 - DNA, 16 bp, C. familiaris
agactctcatgttctg

SEQ ID NO: 302635 - DNA, 16 bp, C. familiaris
agactctccagcagac

SEQ ID NO: 302636 - DNA, 16 bp, C. familiaris
agactctcctgtgtgg

SEQ ID NO: 302637 - DNA, 16 bp, C. familiaris
agactctgaagcagac

SEQ ID NO: 302638 - DNA, 16 bp, C. familiaris
agactctgctgagtgt

SEQ ID NO: 302639 - DNA, 16 bp, C. familiaris
agactctgcttctccc

SEQ ID NO: 302640 - DNA, 16 bp, C. familiaris
agactctggagtcaga

SEQ ID NO: 302641 - DNA, 16 bp, C. familiaris
agactctgtgctaagc

SEQ ID NO: 302642 - DNA, 16 bp, C. familiaris
agactgaaggaaaaaa

SEQ ID NO: 302643 - DNA, 16 bp, C. familiaris
agactgatgtcaaaga

SEQ ID NO: 302644 - DNA, 16 bp, C. familiaris
agactgcttcttcctc

SEQ ID NO: 302645 - DNA, 16 bp, C. familiaris
agactggataaaagag

SEQ ID NO: 302646 - DNA, 16 bp, C. familiaris
agactgggaaaaaaaa

SEQ ID NO: 302647 - DNA, 16 bp, C. familiaris
agactggtgttcttaa

SEQ ID NO: 302648 - DNA, 16 bp, C. familiaris
agacttaaatatgaga

SEQ ID NO: 302649 - DNA, 16 bp, C. familiaris
agacttactttttttt

SEQ ID NO: 302650 - DNA, 16 bp, C. familiaris
agacttgtcaaatcac

SEQ ID NO: 302651 - DNA, 16 bp, C. familiaris
agactttaaaacaaga

SEQ ID NO: 302652 - DNA, 16 bp, C. familiaris
agactttcccagacaa

SEQ ID NO: 302653 - DNA, 16 bp, C. familiaris
agactttttttttaaa

SEQ ID NO: 302654 - DNA, 16 bp, C. familiaris
agagaaaaacatttaa

SEQ ID NO: 302655 - DNA, 16 bp, C. familiaris
agagaaaaaggaaact

SEQ ID NO: 302656 - DNA, 16 bp, C. familiaris
agagaaaaatctcaag

SEQ ID NO: 302657 - DNA, 16 bp, C. familiaris
agagaaaaatgaattt

SEQ ID NO: 302658 - DNA, 16 bp, C. familiaris
agagaaaacaatttta

SEQ ID NO: 302659 - DNA, 16 bp, C. familiaris
agagaaaacactgaaa

SEQ ID NO: 302660 - DNA, 16 bp, C. familiaris
agagaaaacagactga

SEQ ID NO: 302661 - DNA, 16 bp, C. familiaris
agagaaaacagctgga

SEQ ID NO: 302662 - DNA, 16 bp, C. familiaris
agagaaaactggaaaa

SEQ ID NO: 302663 - DNA, 16 bp, C. familiaris
agagaaaagaaagcat

SEQ ID NO: 302664 - DNA, 16 bp, C. familiaris
agagaaaagatttttt

SEQ ID NO: 302665 - DNA, 16 bp, C. familiaris
agagaaaagcaaatta

SEQ ID NO: 302666 - DNA, 16 bp, C. familiaris
agagaaaataatacat

SEQ ID NO: 302667 - DNA, 16 bp, C. familiaris
agagaaaatactgaaa

SEQ ID NO: 302668 - DNA, 16 bp, C. familiaris
agagaaaatagacttt

SEQ ID NO: 302669 - DNA, 16 bp, C. familiaris
agagaaaatatttaca

SEQ ID NO: 302670 - DNA, 16 bp, C. familiaris
agagaaaatattttga

SEQ ID NO: 302671 - DNA, 16 bp, C. familiaris
agagaaaatctgaaaa

SEQ ID NO: 302672 - DNA, 16 bp, C. familiaris
agagaaaatcttgagc

SEQ ID NO: 302673 - DNA, 16 bp, C. familiaris
agagaaaatgaaagca

SEQ ID NO: 302674 - DNA, 16 bp, C. familiaris
agagaaaatgagttgg

SEQ ID NO: 302675 - DNA, 16 bp, C. familiaris
agagaaaatgcagaaa

SEQ ID NO: 302676 - DNA, 16 bp, C. familiaris
agagaaaattattatt

SEQ ID NO: 302677 - DNA, 16 bp, C. familiaris
agagaaacaagcagac

SEQ ID NO: 302678 - DNA, 16 bp, C. familiaris
agagaaacacaaatta

SEQ ID NO: 302679 - DNA, 16 bp, C. familiaris
agagaaacattttcct

SEQ ID NO: 302680 - DNA, 16 bp, C. familiaris
agagaaaccaagaaat

SEQ ID NO: 302681 - DNA, 16 bp, C. familiaris
agagaaaccagaaatg

SEQ ID NO: 302682 - DNA, 16 bp, C. familiaris
agagaaacctgacaaa

SEQ ID NO: 302683 - DNA, 16 bp, C. familiaris
agagaaagaaaacagt

SEQ ID NO: 302684 - DNA, 16 bp, C. familiaris
agagaaagaaaattca

SEQ ID NO: 302685 - DNA, 16 bp, C. familiaris
agagaaagaaatccaa

SEQ ID NO: 302686 - DNA, 16 bp, C. familiaris
agagaaagaagccagt

SEQ ID NO: 302687 - DNA, 16 bp, C. familiaris
agagaaagaccacatt

SEQ ID NO: 302688 - DNA, 16 bp, C. familiaris
agagaaagagaaaact

SEQ ID NO: 302689 - DNA, 16 bp, C. familiaris
agagaaagagaatcct

SEQ ID NO: 302690 - DNA, 16 bp, C. familiaris
agagaaagagacatag

SEQ ID NO: 302691 - DNA, 16 bp, C. familiaris
agagaaagagcaagtg

SEQ ID NO: 302692 - DNA, 16 bp, C. familiaris
agagaaagagcagagc

SEQ ID NO: 302693 - DNA, 16 bp, C. familiaris
agagaaagagcataaa

SEQ ID NO: 302694 - DNA, 16 bp, C. familiaris
agagaaagagtgcaag

SEQ ID NO: 302695 - DNA, 16 bp, C. familiaris
agagaaagagtgcatg

SEQ ID NO: 302696 - DNA, 16 bp, C. familiaris
agagaaagcagaggca

SEQ ID NO: 302697 - DNA, 16 bp, C. familiaris
agagaaagcatgaaag

SEQ ID NO: 302698 - DNA, 16 bp, C. familiaris
agagaaaggggagccc

SEQ ID NO: 302699 - DNA, 16 bp, C. familiaris
agagaaagtacattta

SEQ ID NO: 302700 - DNA, 16 bp, C. familiaris
agagaaagtgagagtg

SEQ ID NO: 302701 - DNA, 16 bp, C. familiaris
agagaaataaatattg

SEQ ID NO: 302702 - DNA, 16 bp, C. familiaris
agagaaatatgttcca

SEQ ID NO: 302703 - DNA, 16 bp, C. familiaris
agagaaatgaaaactt

SEQ ID NO: 302704 - DNA, 16 bp, C. familiaris
agagaaatgaagactt

SEQ ID NO: 302705 - DNA, 16 bp, C. familiaris
agagaaatgaatccaa

SEQ ID NO: 302706 - DNA, 16 bp, C. familiaris
agagaaatggaaaaac

SEQ ID NO: 302707 - DNA, 16 bp, C. familiaris
agagaaatggaaactt

SEQ ID NO: 302708 - DNA, 16 bp, C. familiaris
agagaaatggaaccaa

SEQ ID NO: 302709 - DNA, 16 bp, C. familiaris
agagaaattaagtagt

SEQ ID NO: 302710 - DNA, 16 bp, C. familiaris
agagaaattgttttta

SEQ ID NO: 302711 - DNA, 16 bp, C. familiaris
agagaaatttcatttt

SEQ ID NO: 302712 - DNA, 16 bp, C. familiaris
agagaacaaaatgaga

SEQ ID NO: 302713 - DNA, 16 bp, C. familiaris
agagaacaaacagatg

SEQ ID NO: 302714 - DNA, 16 bp, C. familiaris
agagaacaaactgggg

SEQ ID NO: 302715 - DNA, 16 bp, C. familiaris
agagaacaacaaatac

SEQ ID NO: 302716 - DNA, 16 bp, C. familiaris
agagaacaactggaat

SEQ ID NO: 302717 - DNA, 16 bp, C. familiaris
agagaacaagcacaag

SEQ ID NO: 302718 - DNA, 16 bp, C. familiaris
agagaacaagcatgag

SEQ ID NO: 302719 - DNA, 16 bp, C. familiaris
agagaacaagctgatg

SEQ ID NO: 302720 - DNA, 16 bp, C. familiaris
agagaacatgagagag

SEQ ID NO: 302721 - DNA, 16 bp, C. familiaris
agagaacattatgaaa

SEQ ID NO: 302722 - DNA, 16 bp, C. familiaris
agagaacattccagaa

SEQ ID NO: 302723 - DNA, 16 bp, C. familiaris
agagaacccaacatgg

SEQ ID NO: 302724 - DNA, 16 bp, C. familiaris
agagaacctgaagcag

SEQ ID NO: 302725 - DNA, 16 bp, C. familiaris
agagaacttcaagcag

SEQ ID NO: 302726 - DNA, 16 bp, C. familiaris
agagaactttctggaa

SEQ ID NO: 302727 - DNA, 16 bp, C. familiaris
agagaagaatccatca

SEQ ID NO: 302728 - DNA, 16 bp, C. familiaris
agagaagacataaatt

SEQ ID NO: 302729 - DNA, 16 bp, C. familiaris
agagaagattttattt

SEQ ID NO: 302730 - DNA, 16 bp, C. familiaris
agagaagcaagaaaat

SEQ ID NO: 302731 - DNA, 16 bp, C. familiaris
agagaagcagaagcag

SEQ ID NO: 302732 - DNA, 16 bp, C. familiaris
agagaagcagacacag

SEQ ID NO: 302733 - DNA, 16 bp, C. familiaris
agagaagcagcagcag

SEQ ID NO: 302734 - DNA, 16 bp, C. familiaris
agagaagctctgaaaa

SEQ ID NO: 302735 - DNA, 16 bp, C. familiaris
agagaagcttaagcag

SEQ ID NO: 302736 - DNA, 16 bp, C. familiaris
agagaaggaaatgtga

SEQ ID NO: 302737 - DNA, 16 bp, C. familiaris
agagaaggaagacaat

SEQ ID NO: 302738 - DNA, 16 bp, C. familiaris
agagaaggagagaatc

SEQ ID NO: 302739 - DNA, 16 bp, C. familiaris
agagaaggagagcatg

SEQ ID NO: 302740 - DNA, 16 bp, C. familiaris
agagaataaatctctg

SEQ ID NO: 302741 - DNA, 16 bp, C. familiaris
agagaataaatttcta

SEQ ID NO: 302742 - DNA, 16 bp, C. familiaris
agagaatatttccaaa

SEQ ID NO: 302743 - DNA, 16 bp, C. familiaris
agagaatatttgcaaa

SEQ ID NO: 302744 - DNA, 16 bp, C. familiaris
agagaatcccaagccg

SEQ ID NO: 302745 - DNA, 16 bp, C. familiaris
agagaatcctcaagca

SEQ ID NO: 302746 - DNA, 16 bp, C. familiaris
agagaatctcaagctg

SEQ ID NO: 302747 - DNA, 16 bp, C. familiaris
agagaatctgaggcag

SEQ ID NO: 302748 - DNA, 16 bp, C. familiaris
agagaatcttaatcag

SEQ ID NO: 302749 - DNA, 16 bp, C. familiaris
agagaatgagaacatg

SEQ ID NO: 302750 - DNA, 16 bp, C. familiaris
agagaatgcagaaatg

SEQ ID NO: 302751 - DNA, 16 bp, C. familiaris
agagaatgtgcatgtg

SEQ ID NO: 302752 - DNA, 16 bp, C. familiaris
agagaatgtgtgcatg

SEQ ID NO: 302753 - DNA, 16 bp, C. familiaris
agagaatttcaagaag

SEQ ID NO: 302754 - DNA, 16 bp, C. familiaris
agagacaaagacacag

SEQ ID NO: 302755 - DNA, 16 bp, C. familiaris
agagacacaaggagag

SEQ ID NO: 302756 - DNA, 16 bp, C. familiaris
agagacacacaggaga

SEQ ID NO: 302757 - DNA, 16 bp, C. familiaris
agagacacagacacag

SEQ ID NO: 302758 - DNA, 16 bp, C. familiaris
agagacacagagaagc

SEQ ID NO: 302759 - DNA, 16 bp, C. familiaris
agagacacagagacag

SEQ ID NO: 302760 - DNA, 16 bp, C. familiaris
agagacacagagcaca

SEQ ID NO: 302761 - DNA, 16 bp, C. familiaris
agagacacagaggggc

SEQ ID NO: 302762 - DNA, 16 bp, C. familiaris
agagacacagcaagag

SEQ ID NO: 302763 - DNA, 16 bp, C. familiaris
agagacacagcagaga

SEQ ID NO: 302764 - DNA, 16 bp, C. familiaris
agagacacagtgaggg

SEQ ID NO: 302765 - DNA, 16 bp, C. familiaris
agagacacggagagaa

SEQ ID NO: 302766 - DNA, 16 bp, C. familiaris
agagacactgaactct

SEQ ID NO: 302767 - DNA, 16 bp, C. familiaris
agagacagaacaagca

SEQ ID NO: 302768 - DNA, 16 bp, C. familiaris
agagacagaacatgaa

SEQ ID NO: 302769 - DNA, 16 bp, C. familiaris
agagacagacaaatac

SEQ ID NO: 302770 - DNA, 16 bp, C. familiaris
agagacagagaaaatg

SEQ ID NO: 302771 - DNA, 16 bp, C. familiaris
agagacagagaggctg

SEQ ID NO: 302772 - DNA, 16 bp, C. familiaris
agagacagagatgcag

SEQ ID NO: 302773 - DNA, 16 bp, C. familiaris
agagacaggagacaga

SEQ ID NO: 302774 - DNA, 16 bp, C. familiaris
agagacaggggcagag

SEQ ID NO: 302775 - DNA, 16 bp, C. familiaris
agagaccagaaaataa

SEQ ID NO: 302776 - DNA, 16 bp, C. familiaris
agagacccagaaagag

SEQ ID NO: 302777 - DNA, 16 bp, C. familiaris
agagacccagagggag

SEQ ID NO: 302778 - DNA, 16 bp, C. familiaris
agagacccaggatcca

SEQ ID NO: 302779 - DNA, 16 bp, C. familiaris
agagaccgagagagag

SEQ ID NO: 302780 - DNA, 16 bp, C. familiaris
agagacggagaggcag

SEQ ID NO: 302781 - DNA, 16 bp, C. familiaris
agagactgaggcagag

SEQ ID NO: 302782 - DNA, 16 bp, C. familiaris
agagactgcctttctt

SEQ ID NO: 302783 - DNA, 16 bp, C. familiaris
agagactggaagaaaa

SEQ ID NO: 302784 - DNA, 16 bp, C. familiaris
agagacttcattactg

SEQ ID NO: 302785 - DNA, 16 bp, C. familiaris
agagacttttaaaata

SEQ ID NO: 302786 - DNA, 16 bp, C. familiaris
agagagaaaaatccca

SEQ ID NO: 302787 - DNA, 16 bp, C. familiaris
agagagaaaatatatt

SEQ ID NO: 302788 - DNA, 16 bp, C. familiaris
agagagaaaatatcaa

SEQ ID NO: 302789 - DNA, 16 bp, C. familiaris
agagagaaaatcagag

SEQ ID NO: 302790 - DNA, 16 bp, C. familiaris
agagagaaaatgtgca

SEQ ID NO: 302791 - DNA, 16 bp, C. familiaris
agagagaaagcatgaa

SEQ ID NO: 302792 - DNA, 16 bp, C. familiaris
agagagaaagcgagca

SEQ ID NO: 302793 - DNA, 16 bp, C. familiaris
agagagaaagcgcaca

SEQ ID NO: 302794 - DNA, 16 bp, C. familiaris
agagagaacagaggca

SEQ ID NO: 302795 - DNA, 16 bp, C. familiaris
agagagaagaaaatca

SEQ ID NO: 302796 - DNA, 16 bp, C. familiaris
agagagaagcagagac

SEQ ID NO: 302797 - DNA, 16 bp, C. familiaris
agagagaagcagcttc

SEQ ID NO: 302798 - DNA, 16 bp, C. familiaris
agagagaaggcagcca

SEQ ID NO: 302799 - DNA, 16 bp, C. familiaris
agagagaatcctgaag

SEQ ID NO: 302800 - DNA, 16 bp, C. familiaris
agagagaatcttcaag

SEQ ID NO: 302801 - DNA, 16 bp, C. familiaris
agagagaattctgaaa

SEQ ID NO: 302802 - DNA, 16 bp, C. familiaris
agagagacagaaaatg

SEQ ID NO: 302803 - DNA, 16 bp, C. familiaris
agagagacagaaagta

SEQ ID NO: 302804 - DNA, 16 bp, C. familiaris
agagagacagagagtg

SEQ ID NO: 302805 - DNA, 16 bp, C. familiaris
agagagacagcaggag

SEQ ID NO: 302806 - DNA, 16 bp, C. familiaris
agagagactgagagaa

SEQ ID NO: 302807 - DNA, 16 bp, C. familiaris
agagagagaaaagtca

SEQ ID NO: 302808 - DNA, 16 bp, C. familiaris
agagagagaaaatctc

SEQ ID NO: 302809 - DNA, 16 bp, C. familiaris
agagagagaaaatgtg

SEQ ID NO: 302810 - DNA, 16 bp, C. familiaris
agagagagaaaccagg

SEQ ID NO: 302811 - DNA, 16 bp, C. familiaris
agagagagaaagccca

SEQ ID NO: 302812 - DNA, 16 bp, C. familiaris
agagagagaacctcag

SEQ ID NO: 302813 - DNA, 16 bp, C. familiaris
agagagagaagacatg

SEQ ID NO: 302814 - DNA, 16 bp, C. familiaris
agagagagaagactga

SEQ ID NO: 302815 - DNA, 16 bp, C. familiaris
agagagagaagcacag

SEQ ID NO: 302816 - DNA, 16 bp, C. familiaris
agagagagaatatgag

SEQ ID NO: 302817 - DNA, 16 bp, C. familiaris
agagagagacagcaag

SEQ ID NO: 302818 - DNA, 16 bp, C. familiaris
agagagagacagcagg

SEQ ID NO: 302819 - DNA, 16 bp, C. familiaris
agagagagagaaactc

SEQ ID NO: 302820 - DNA, 16 bp, C. familiaris
agagagagagaagcca

SEQ ID NO: 302821 - DNA, 16 bp, C. familiaris
agagagagagaatgta

SEQ ID NO: 302822 - DNA, 16 bp, C. familiaris
agagagagagaatgtg

SEQ ID NO: 302823 - DNA, 16 bp, C. familiaris
agagagagagaattca

SEQ ID NO: 302824 - DNA, 16 bp, C. familiaris
agagagagagaatttc

SEQ ID NO: 302825 - DNA, 16 bp, C. familiaris
agagagagagactgaa

SEQ ID NO: 302826 - DNA, 16 bp, C. familiaris
agagagagagagacca

SEQ ID NO: 302827 - DNA, 16 bp, C. familiaris
agagagagagagatta

SEQ ID NO: 302828 - DNA, 16 bp, C. familiaris
agagagagagagttgg

SEQ ID NO: 302829 - DNA, 16 bp, C. familiaris
agagagagagatttaa

SEQ ID NO: 302830 - DNA, 16 bp, C. familiaris
agagagagagcagagc

SEQ ID NO: 302831 - DNA, 16 bp, C. familiaris
agagagagagcagcag

SEQ ID NO: 302832 - DNA, 16 bp, C. familiaris
agagagagaggatgtg

SEQ ID NO: 302833 - DNA, 16 bp, C. familiaris
agagagagagtgtgga

SEQ ID NO: 302834 - DNA, 16 bp, C. familiaris
agagagagagttagag

SEQ ID NO: 302835 - DNA, 16 bp, C. familiaris
agagagagcacgtgtg

SEQ ID NO: 302836 - DNA, 16 bp, C. familiaris
agagagagcagctgga

SEQ ID NO: 302837 - DNA, 16 bp, C. familiaris
agagagaggaccagaa

SEQ ID NO: 302838 - DNA, 16 bp, C. familiaris
agagagaggagacaca

SEQ ID NO: 302839 - DNA, 16 bp, C. familiaris
agagagaggagcaggc

SEQ ID NO: 302840 - DNA, 16 bp, C. familiaris
agagagaggcggagac

SEQ ID NO: 302841 - DNA, 16 bp, C. familiaris
agagagagggacacag

SEQ ID NO: 302842 - DNA, 16 bp, C. familiaris
agagagagggcagccc

SEQ ID NO: 302843 - DNA, 16 bp, C. familiaris
agagagaggtagaggc

SEQ ID NO: 302844 - DNA, 16 bp, C. familiaris
agagagatagatgata

SEQ ID NO: 302845 - DNA, 16 bp, C. familiaris
agagagatcccccccc

SEQ ID NO: 302846 - DNA, 16 bp, C. familiaris
agagagatggaaatcc

SEQ ID NO: 302847 - DNA, 16 bp, C. familiaris
agagagattgacagag

SEQ ID NO: 302848 - DNA, 16 bp, C. familiaris
agagagatttgaagca

SEQ ID NO: 302849 - DNA, 16 bp, C. familiaris
agagagcaagaagcag

SEQ ID NO: 302850 - DNA, 16 bp, C. familiaris
agagagcaagcacaga

SEQ ID NO: 302851 - DNA, 16 bp, C. familiaris
agagagcaagcacagc

SEQ ID NO: 302852 - DNA, 16 bp, C. familiaris
agagagcacaagtgca

SEQ ID NO: 302853 - DNA, 16 bp, C. familiaris
agagagcacacatgtg

SEQ ID NO: 302854 - DNA, 16 bp, C. familiaris
agagagcacagagaga

SEQ ID NO: 302855 - DNA, 16 bp, C. familiaris
agagagcacagaggaa

SEQ ID NO: 302856 - DNA, 16 bp, C. familiaris
agagagcacaggcagt

SEQ ID NO: 302857 - DNA, 16 bp, C. familiaris
agagagcacgagtgga

SEQ ID NO: 302858 - DNA, 16 bp, C. familiaris
agagagcacgtgcatg

SEQ ID NO: 302859 - DNA, 16 bp, C. familiaris
agagagcagaagtggg

SEQ ID NO: 302860 - DNA, 16 bp, C. familiaris
agagagcagagcaggg

SEQ ID NO: 302861 - DNA, 16 bp, C. familiaris
agagagcaggagcaga

SEQ ID NO: 302862 - DNA, 16 bp, C. familiaris
agagagcatgagcagt

SEQ ID NO: 302863 - DNA, 16 bp, C. familiaris
agagagcatgaggaga

SEQ ID NO: 302864 - DNA, 16 bp, C. familiaris
agagagccagagaaca

SEQ ID NO: 302865 - DNA, 16 bp, C. familiaris
agagagccagagagcc

SEQ ID NO: 302866 - DNA, 16 bp, C. familiaris
agagagcctcaagcag

SEQ ID NO: 302867 - DNA, 16 bp, C. familiaris
agagagcctctgcaga

SEQ ID NO: 302868 - DNA, 16 bp, C. familiaris
agagagcctgagtggg

SEQ ID NO: 302869 - DNA, 16 bp, C. familiaris
agagagctcaagcagg

SEQ ID NO: 302870 - DNA, 16 bp, C. familiaris
agagagctcagaaata

SEQ ID NO: 302871 - DNA, 16 bp, C. familiaris
agagagctctggtgtc

SEQ ID NO: 302872 - DNA, 16 bp, C. familiaris
agagaggaaactgagg

SEQ ID NO: 302873 - DNA, 16 bp, C. familiaris
agagaggacacaagca

SEQ ID NO: 302874 - DNA, 16 bp, C. familiaris
agagaggagagagatt

SEQ ID NO: 302875 - DNA, 16 bp, C. familiaris
agagaggcagaaacgc

SEQ ID NO: 302876 - DNA, 17 bp, C. familiaris
agagaggcagacacaca

SEQ ID NO: 302877 - DNA, 16 bp, C. familiaris
agagaggcagactctc

SEQ ID NO: 302878 - DNA, 16 bp, C. familiaris
agagaggctgagaccc

SEQ ID NO: 302879 - DNA, 16 bp, C. familiaris
agagagggaacacaag

SEQ ID NO: 302880 - DNA, 16 bp, C. familiaris
agagagggacaggcag

SEQ ID NO: 302881 - DNA, 16 bp, C. familiaris
agagagggagacaggc

SEQ ID NO: 302882 - DNA, 16 bp, C. familiaris
agagagggagagccag

SEQ ID NO: 302883 - DNA, 16 bp, C. familiaris
agagagggagatgcag

SEQ ID NO: 302884 - DNA, 16 bp, C. familiaris
agagaggggcacctgg

SEQ ID NO: 302885 - DNA, 16 bp, C. familiaris
agagagtaaatatttt

SEQ ID NO: 302886 - DNA, 16 bp, C. familiaris
agagagtgaaaagaca

SEQ ID NO: 302887 - DNA, 16 bp, C. familiaris
agagagtgagacagag

SEQ ID NO: 302888 - DNA, 16 bp, C. familiaris
agagagtgagagcgag

SEQ ID NO: 302889 - DNA, 16 bp, C. familiaris
agagagtgagagtaag

SEQ ID NO: 302890 - DNA, 16 bp, C. familiaris
agagagtgagagtgtg

SEQ ID NO: 302891 - DNA, 16 bp, C. familiaris
agagagtgagcatgag

SEQ ID NO: 302892 - DNA, 16 bp, C. familiaris
agagagtgagccagag

SEQ ID NO: 302893 - DNA, 16 bp, C. familiaris
agagagtggagtgaaa

SEQ ID NO: 302894 - DNA, 16 bp, C. familiaris
agagagtggcatgata

SEQ ID NO: 302895 - DNA, 16 bp, C. familiaris
agagataaagaatttc

SEQ ID NO: 302896 - DNA, 16 bp, C. familiaris
agagataaaggaaatt

SEQ ID NO: 302897 - DNA, 16 bp, C. familiaris
agagataatgagagag

SEQ ID NO: 302898 - DNA, 16 bp, C. familiaris
agagatatttttggtt

SEQ ID NO: 302899 - DNA, 16 bp, C. familiaris
agagatcattttaaaa

SEQ ID NO: 302900 - DNA, 16 bp, C. familiaris
agagatccaggcagag

SEQ ID NO: 302901 - DNA, 16 bp, C. familiaris
agagatcgagagagag

SEQ ID NO: 302902 - DNA, 16 bp, C. familiaris
agagatctcacagagg

SEQ ID NO: 302903 - DNA, 16 bp, C. familiaris
agagatgaagaaacag

SEQ ID NO: 302904 - DNA, 34 bp, C. familiaris
agagatgaagagggacactatatcatacttaaag

SEQ ID NO: 302905 - DNA, 16 bp, C. familiaris
agagatgaagatggac

SEQ ID NO: 302906 - DNA, 16 bp, C. familiaris
agagatgatggaatta

SEQ ID NO: 302907 - DNA, 16 bp, C. familiaris
agagatgatttaaaaa

SEQ ID NO: 302908 - DNA, 16 bp, C. familiaris
agagatgctgaatcac

SEQ ID NO: 302909 - DNA, 16 bp, C. familiaris
agagatggaaaacaga

SEQ ID NO: 302910 - DNA, 16 bp, C. familiaris
agagatggaaagcaga

SEQ ID NO: 302911 - DNA, 16 bp, C. familiaris
agagatggaatttgaa

SEQ ID NO: 302912 - DNA, 16 bp, C. familiaris
agagatggagaaactg

SEQ ID NO: 302913 - DNA, 16 bp, C. familiaris
agagatggagacaaac

SEQ ID NO: 302914 - DNA, 16 bp, C. familiaris
agagatggggaaactg

SEQ ID NO: 302915 - DNA, 16 bp, C. familiaris
agagatgttggaatta

SEQ ID NO: 302916 - DNA, 16 bp, C. familiaris
agagattactgaaaaa

SEQ ID NO: 302917 - DNA, 16 bp, C. familiaris
agagattattattatt

SEQ ID NO: 302918 - DNA, 16 bp, C. familiaris
agagattgaggcagag

SEQ ID NO: 302919 - DNA, 16 bp, C. familiaris
agagattggaatgatg

SEQ ID NO: 302920 - DNA, 16 bp, C. familiaris
agagattggcagagac

SEQ ID NO: 302921 - DNA, 16 bp, C. familiaris
agagattgtctttttt

SEQ ID NO: 302922 - DNA, 16 bp, C. familiaris
agagatttattctctc

SEQ ID NO: 302923 - DNA, 16 bp, C. familiaris
agagcaaactgatggt

SEQ ID NO: 302924 - DNA, 16 bp, C. familiaris
agagcaagagaagcag

SEQ ID NO: 302925 - DNA, 16 bp, C. familiaris
agagcaagagcaagag

SEQ ID NO: 302926 - DNA, 16 bp, C. familiaris
agagcaatctacatat

SEQ ID NO: 302927 - DNA, 16 bp, C. familiaris
agagcacaagcagcag

SEQ ID NO: 302928 - DNA, 16 bp, C. familiaris
agagcacgagtgggga

SEQ ID NO: 302929 - DNA, 16 bp, C. familiaris
agagcagaagcagagg

SEQ ID NO: 302930 - DNA, 16 bp, C. familiaris
agagcagagagcagag

SEQ ID NO: 302931 - DNA, 16 bp, C. familiaris
agagcagaggctctgg

SEQ ID NO: 302932 - DNA, 16 bp, C. familiaris
agagcagcagcagcag

SEQ ID NO: 302933 - DNA, 16 bp, C. familiaris
agagcagccccagtgg

SEQ ID NO: 302934 - DNA, 16 bp, C. familiaris
agagcaggagagagca

SEQ ID NO: 302935 - DNA, 16 bp, C. familiaris
agagcaggagcagaga

SEQ ID NO: 302936 - DNA, 16 bp, C. familiaris
agagcaggagtgggag

SEQ ID NO: 302937 - DNA, 16 bp, C. familiaris
agagcaggagtggggg

SEQ ID NO: 302938 - DNA, 16 bp, C. familiaris
agagcagggcagagag

SEQ ID NO: 302939 - DNA, 16 bp, C. familiaris
agagcaggggcacctg

SEQ ID NO: 302940 - DNA, 16 bp, C. familiaris
agagcatctcaagcag

SEQ ID NO: 302941 - DNA, 16 bp, C. familiaris
agagcatctccagcag

SEQ ID NO: 302942 - DNA, 16 bp, C. familiaris
agagcatgacctgagc

SEQ ID NO: 302943 - DNA, 16 bp, C. familiaris
agagcatgagcaagag

SEQ ID NO: 302944 - DNA, 16 bp, C. familiaris
agagcatgagcatggg

SEQ ID NO: 302945 - DNA, 16 bp, C. familiaris
agagcatgatcctgga

SEQ ID NO: 302946 - DNA, 16 bp, C. familiaris
agagccaaaaagtgga

SEQ ID NO: 302947 - DNA, 16 bp, C. familiaris
agagccaactcctggt

SEQ ID NO: 302948 - DNA, 16 bp, C. familiaris
agagccacagagagaa

SEQ ID NO: 302949 - DNA, 16 bp, C. familiaris
agagccagagccagag

SEQ ID NO: 302950 - DNA, 16 bp, C. familiaris
agagccaggcagaggg

SEQ ID NO: 302951 - DNA, 16 bp, C. familiaris
agagccaggtgatcaa

SEQ ID NO: 302952 - DNA, 16 bp, C. familiaris
agagcccaaatatcca

SEQ ID NO: 302953 - DNA, 16 bp, C. familiaris
agagcccaacctgggg

SEQ ID NO: 302954 - DNA, 16 bp, C. familiaris
agagccccacgtggga

SEQ ID NO: 302955 - DNA, 16 bp, C. familiaris
agagccccagagagag

SEQ ID NO: 302956 - DNA, 16 bp, C. familiaris
agagcctgaagcaggg

SEQ ID NO: 302957 - DNA, 16 bp, C. familiaris
agagcctgagcagagg

SEQ ID NO: 302958 - DNA, 16 bp, C. familiaris
agagcctgaggtggga

SEQ ID NO: 302959 - DNA, 16 bp, C. familiaris
agagcctgcttctctc

SEQ ID NO: 302960 - DNA, 16 bp, C. familiaris
agagcctggcatatag

SEQ ID NO: 302961 - DNA, 16 bp, C. familiaris
agagcgagaggcagag

SEQ ID NO: 302962 - DNA, 16 bp, C. familiaris
agagcgagcgagcgag

SEQ ID NO: 302963 - DNA, 16 bp, C. familiaris
agagcggctgtaccag

SEQ ID NO: 302964 - DNA, 16 bp, C. familiaris
agagctgagattcaaa

SEQ ID NO: 302965 - DNA, 16 bp, C. familiaris
agagctgcaggcagag

SEQ ID NO: 302966 - DNA, 16 bp, C. familiaris
agagctgctgctgctg

SEQ ID NO: 302967 - DNA, 16 bp, C. familiaris
agagctggaaaaagaa

SEQ ID NO: 302968 - DNA, 16 bp, C. familiaris
agagctggagaaagaa

SEQ ID NO: 302969 - DNA, 16 bp, C. familiaris
agagctggagaagcag

SEQ ID NO: 302970 - DNA, 16 bp, C. familiaris
agagctggccaccacc

SEQ ID NO: 302971 - DNA, 16 bp, C. familiaris
agagctggccgcagcc

SEQ ID NO: 302972 - DNA, 16 bp, C. familiaris
agagctggggcaggag

SEQ ID NO: 302973 - DNA, 16 bp, C. familiaris
agagctttgaatgaca

SEQ ID NO: 302974 - DNA, 16 bp, C. familiaris
agaggaaaataaagca

SEQ ID NO: 302975 - DNA, 16 bp, C. familiaris
agaggaaattcttcct

SEQ ID NO: 302976 - DNA, 16 bp, C. familiaris
agaggaacaagcagac

SEQ ID NO: 302977 - DNA, 16 bp, C. familiaris
agaggaacagacacag

SEQ ID NO: 302978 - DNA, 16 bp, C. familiaris
agaggaagaaaattct

SEQ ID NO: 302979 - DNA, 16 bp, C. familiaris
agaggaagaaatgctt

SEQ ID NO: 302980 - DNA, 16 bp, C. familiaris
agaggaagaagcaagc

SEQ ID NO: 302981 - DNA, 16 bp, C. familiaris
agaggaagaagcaggc

SEQ ID NO: 302982 - DNA, 16 bp, C. familiaris
agaggaagaagccggc

SEQ ID NO: 302983 - DNA, 16 bp, C. familiaris
agaggaagaatttttc

SEQ ID NO: 302984 - DNA, 16 bp, C. familiaris
agaggaagacaaatca

SEQ ID NO: 302985 - DNA, 16 bp, C. familiaris
agaggaagacatagat

SEQ ID NO: 302986 - DNA, 16 bp, C. familiaris
agaggaagagacacag

SEQ ID NO: 302987 - DNA, 16 bp, C. familiaris
agaggaagattttttt

SEQ ID NO: 302988 - DNA, 16 bp, C. familiaris
agaggacataaagaaa

SEQ ID NO: 302989 - DNA, 16 bp, C. familiaris
agaggacccaaataaa

SEQ ID NO: 302990 - DNA, 16 bp, C. familiaris
agaggactcaaataaa

SEQ ID NO: 302991 - DNA, 16 bp, C. familiaris
agaggagaaaactgaa

SEQ ID NO: 302992 - DNA, 16 bp, C. familiaris
agaggagaaaattgag

SEQ ID NO: 302993 - DNA, 16 bp, C. familiaris
agaggagaaggccatg

SEQ ID NO: 302994 - DNA, 16 bp, C. familiaris
agaggagacatcacaa

SEQ ID NO: 302995 - DNA, 16 bp, C. familiaris
agaggagcaggagcag

SEQ ID NO: 302996 - DNA, 16 bp, C. familiaris
agaggagcctgatgca

SEQ ID NO: 302997 - DNA, 16 bp, C. familiaris
agaggaggaaaccgag

SEQ ID NO: 302998 - DNA, 16 bp, C. familiaris
agaggaggcagaggca

SEQ ID NO: 302999 - DNA, 16 bp, C. familiaris
agaggagggagccctg

SEQ ID NO: 303000 - DNA, 16 bp, C. familiaris
agaggatctcaggcag

SEQ ID NO: 303001 - DNA, 16 bp, C. familiaris
agaggatgctgagaaa

SEQ ID NO: 303002 - DNA, 16 bp, C. familiaris
agaggatgtggagcaa

SEQ ID NO: 303003 - DNA, 16 bp, C. familiaris
agaggatttggagaaa

SEQ ID NO: 303004 - DNA, 16 bp, C. familiaris
agaggattttattttt

SEQ ID NO: 303005 - DNA, 16 bp, C. familiaris
agaggcacacacagag

SEQ ID NO: 303006 - DNA, 16 bp, C. familiaris
agaggcacagggagag

SEQ ID NO: 303007 - DNA, 16 bp, C. familiaris
agaggcagaaacacag

SEQ ID NO: 303008 - DNA, 16 bp, C. familiaris
agaggcagaaaggcag

SEQ ID NO: 303009 - DNA, 16 bp, C. familiaris
agaggcagacagacag

SEQ ID NO: 303010 - DNA, 16 bp, C. familiaris
agaggcagagaagcag

SEQ ID NO: 303011 - DNA, 16 bp, C. familiaris
agaggcagagacattg

SEQ ID NO: 303012 - DNA, 16 bp, C. familiaris
agaggcagagactcag

SEQ ID NO: 303013 - DNA, 16 bp, C. familiaris
agaggcagagagacag

SEQ ID NO: 303014 - DNA, 16 bp, C. familiaris
agaggcagagccagag

SEQ ID NO: 303015 - DNA, 16 bp, C. familiaris
agaggcagagccagga

SEQ ID NO: 303016 - DNA, 16 bp, C. familiaris
agaggcagaggcaaga

SEQ ID NO: 303017 - DNA, 16 bp, C. familiaris
agaggcagaggcgcag

SEQ ID NO: 303018 - DNA, 16 bp, C. familiaris
agaggcagaggtggag

SEQ ID NO: 303019 - DNA, 16 bp, C. familiaris
agaggcagatggggag

SEQ ID NO: 303020 - DNA, 16 bp, C. familiaris
agaggcagcccgggtg

SEQ ID NO: 303021 - DNA, 16 bp, C. familiaris
agaggcaggaacacag

SEQ ID NO: 303022 - DNA, 16 bp, C. familiaris
agaggcaggattcaaa

SEQ ID NO: 303023 - DNA, 16 bp, C. familiaris
agaggccacactgaag

SEQ ID NO: 303024 - DNA, 16 bp, C. familiaris
agaggccagaagtcca

SEQ ID NO: 303025 - DNA, 16 bp, C. familiaris
agaggccctgcctctc

SEQ ID NO: 303026 - DNA, 16 bp, C. familiaris
agaggcctgggtggct

SEQ ID NO: 303027 - DNA, 16 bp, C. familiaris
agaggctgagacccag

SEQ ID NO: 303028 - DNA, 16 bp, C. familiaris
agagggaaactgaggc

SEQ ID NO: 303029 - DNA, 16 bp, C. familiaris
agagggaaagaatctc

SEQ ID NO: 303030 - DNA, 16 bp, C. familiaris
agagggaagattatag

SEQ ID NO: 303031 - DNA, 16 bp, C. familiaris
agagggacaagcaaac

SEQ ID NO: 303032 - DNA, 16 bp, C. familiaris
agagggagaaaatatt

SEQ ID NO: 303033 - DNA, 16 bp, C. familiaris
agagggagaaggagcc

SEQ ID NO: 303034 - DNA, 16 bp, C. familiaris
agagggagaagtgggc

SEQ ID NO: 303035 - DNA, 16 bp, C. familiaris
agagggagacgcagac

SEQ ID NO: 303036 - DNA, 16 bp, C. familiaris
agagggagagaatatc

SEQ ID NO: 303037 - DNA, 16 bp, C. familiaris
agagggagagacaggc

SEQ ID NO: 303038 - DNA, 16 bp, C. familiaris
agagggagagcagcag

SEQ ID NO: 303039 - DNA, 16 bp, C. familiaris
agagggagcacgagca

SEQ ID NO: 303040 - DNA, 16 bp, C. familiaris
agagggagcagcagcc

SEQ ID NO: 303041 - DNA, 16 bp, C. familiaris
agagggagcagcaggc

SEQ ID NO: 303042 - DNA, 16 bp, C. familiaris
agagggagctgcagag

SEQ ID NO: 303043 - DNA, 16 bp, C. familiaris
agagggagctgcaggc

SEQ ID NO: 303044 - DNA, 16 bp, C. familiaris
agagggaggagactcc

SEQ ID NO: 303045 - DNA, 16 bp, C. familiaris
agagggaggagctggc

SEQ ID NO: 303046 - DNA, 16 bp, C. familiaris
agagggagggcagccc

SEQ ID NO: 303047 - DNA, 17 bp, C. familiaris
agagggcagccccggtg

SEQ ID NO: 303048 - DNA, 16 bp, C. familiaris
agaggggaaagcaggc

SEQ ID NO: 303049 - DNA, 16 bp, C. familiaris
agaggggagcagagac

SEQ ID NO: 303050 - DNA, 16 bp, C. familiaris
agaggggcagagaaac

SEQ ID NO: 303051 - DNA, 16 bp, C. familiaris
agaggggcatctgggt

SEQ ID NO: 303052 - DNA, 16 bp, C. familiaris
agaggggcctgggtgg

SEQ ID NO: 303053 - DNA, 16 bp, C. familiaris
agagggggctgcgcgg

SEQ ID NO: 303054 - DNA, 16 bp, C. familiaris
agaggggggcacctgg

SEQ ID NO: 303055 - DNA, 16 bp, C. familiaris
agaggtagaagcagac

SEQ ID NO: 303056 - DNA, 16 bp, C. familiaris
agaggtagaggcagag

SEQ ID NO: 303057 - DNA, 16 bp, C. familiaris
agaggtcaaggatgct

SEQ ID NO: 303058 - DNA, 16 bp, C. familiaris
agaggtcccccccaaa

SEQ ID NO: 303059 - DNA, 16 bp, C. familiaris
agaggtgaaagatctg

SEQ ID NO: 303060 - DNA, 16 bp, C. familiaris
agaggtgacatttgaa

SEQ ID NO: 303061 - DNA, 16 bp, C. familiaris
agaggtggaattgctg

SEQ ID NO: 303062 - DNA, 16 bp, C. familiaris
agaggtggtatatata

SEQ ID NO: 303063 - DNA, 16 bp, C. familiaris
agaggttcaaatcttc

SEQ ID NO: 303064 - DNA, 16 bp, C. familiaris
agaggttgagaagcag

SEQ ID NO: 303065 - DNA, 16 bp, C. familiaris
agagtaaatcttaaaa

SEQ ID NO: 303066 - DNA, 16 bp, C. familiaris
agagtagaattcagtg

SEQ ID NO: 303067 - DNA, 16 bp, C. familiaris
agagtatgagcaggag

SEQ ID NO: 303068 - DNA, 16 bp, C. familiaris
agagtatttttggttg

SEQ ID NO: 303069 - DNA, 16 bp, C. familiaris
agagtcacagaaagaa

SEQ ID NO: 303070 - DNA, 16 bp, C. familiaris
agagtcacagagaaag

SEQ ID NO: 303071 - DNA, 16 bp, C. familiaris
agagtcacagagagaa

SEQ ID NO: 303072 - DNA, 16 bp, C. familiaris
agagtcagagaaagag

SEQ ID NO: 303073 - DNA, 16 bp, C. familiaris
agagtcagagagaaag

SEQ ID NO: 303074 - DNA, 16 bp, C. familiaris
agagtcagaggcagag

SEQ ID NO: 303075 - DNA, 16 bp, C. familiaris
agagtcctggcatcaa

SEQ ID NO: 303076 - DNA, 16 bp, C. familiaris
agagtcctggggtgga

SEQ ID NO: 303077 - DNA, 16 bp, C. familiaris
agagtccttgctgagc

SEQ ID NO: 303078 - DNA, 16 bp, C. familiaris
agagtctgacatggga

SEQ ID NO: 303079 - DNA, 16 bp, C. familiaris
agagtctgactcttaa

SEQ ID NO: 303080 - DNA, 16 bp, C. familiaris
agagtctgccttgggc

SEQ ID NO: 303081 - DNA, 16 bp, C. familiaris
agagtctgcttcttgg

SEQ ID NO: 303082 - DNA, 16 bp, C. familiaris
agagtctgcttgaaga

SEQ ID NO: 303083 - DNA, 16 bp, C. familiaris
agagtctgtttttggt

SEQ ID NO: 303084 - DNA, 16 bp, C. familiaris
agagtcttcaagcaga

SEQ ID NO: 303085 - DNA, 16 bp, C. familiaris
agagtgagagaggcag

SEQ ID NO: 303086 - DNA, 16 bp, C. familiaris
agagtgagagcaagca

SEQ ID NO: 303087 - DNA, 16 bp, C. familiaris
agagtgagagccagag

SEQ ID NO: 303088 - DNA, 16 bp, C. familiaris
agagtgagcacaagtg

SEQ ID NO: 303089 - DNA, 16 bp, C. familiaris
agagtgagcaggagag

SEQ ID NO: 303090 - DNA, 16 bp, C. familiaris
agagtgagccacccag

SEQ ID NO: 303091 - DNA, 16 bp, C. familiaris
agagtgagcgagagag

SEQ ID NO: 303092 - DNA, 16 bp, C. familiaris
agagtggggagcagag

SEQ ID NO: 303093 - DNA, 16 bp, C. familiaris
agagtggttgtaccag

SEQ ID NO: 303094 - DNA, 16 bp, C. familiaris
agagtgtgagcagggg

SEQ ID NO: 303095 - DNA, 16 bp, C. familiaris
agagtgtgtgagtgtg

SEQ ID NO: 303096 - DNA, 16 bp, C. familiaris
agagttggaaaaatat

SEQ ID NO: 303097 - DNA, 16 bp, C. familiaris
agagttggatgcttgg

SEQ ID NO: 303098 - DNA, 16 bp, C. familiaris
agagttggctgctcaa

SEQ ID NO: 303099 - DNA, 16 bp, C. familiaris
agagtttatcccaaag

SEQ ID NO: 303100 - DNA, 16 bp, C. familiaris
agagtttccttaaaaa

SEQ ID NO: 303101 - DNA, 16 bp, C. familiaris
agagttttctacatat

SEQ ID NO: 303102 - DNA, 16 bp, C. familiaris
agagtttttgttttct

SEQ ID NO: 303103 - DNA, 16 bp, C. familiaris
agataaaaaagatgtg

SEQ ID NO: 303104 - DNA, 16 bp, C. familiaris
agataaaaagattctg

SEQ ID NO: 303105 - DNA, 16 bp, C. familiaris
agataaaagacttaaa

SEQ ID NO: 303106 - DNA, 16 bp, C. familiaris
agataaaataaaatct

SEQ ID NO: 303107 - DNA, 16 bp, C. familiaris
agataaaataaacttt

SEQ ID NO: 303108 - DNA, 16 bp, C. familiaris
agataaaatcacaaat

SEQ ID NO: 303109 - DNA, 16 bp, C. familiaris
agataaaatgagtgaa

SEQ ID NO: 303110 - DNA, 16 bp, C. familiaris
agataaattagatttt

SEQ ID NO: 303111 - DNA, 16 bp, C. familiaris
agataacaggaaaatc

SEQ ID NO: 303112 - DNA, 16 bp, C. familiaris
agataacatatataaa

SEQ ID NO: 303113 - DNA, 16 bp, C. familiaris
agataagaaaacagag

SEQ ID NO: 303114 - DNA, 16 bp, C. familiaris
agataatatttgtaaa

SEQ ID NO: 303115 - DNA, 16 bp, C. familiaris
agataatgaatgtgaa

SEQ ID NO: 303116 - DNA, 16 bp, C. familiaris
agataattttcaaaaa

SEQ ID NO: 303117 - DNA, 16 bp, C. familiaris
agatacaaaaattctt

SEQ ID NO: 303118 - DNA, 16 bp, C. familiaris
agatacaaagagaaag

SEQ ID NO: 303119 - DNA, 16 bp, C. familiaris
agatacacaaatggcc

SEQ ID NO: 303120 - DNA, 16 bp, C. familiaris
agatacagaaagagaa

SEQ ID NO: 303121 - DNA, 16 bp, C. familiaris
agatacagactgagag

SEQ ID NO: 303122 - DNA, 16 bp, C. familiaris
agatacagagaaaaag

SEQ ID NO: 303123 - DNA, 16 bp, C. familiaris
agatacagagaaagaa

SEQ ID NO: 303124 - DNA, 16 bp, C. familiaris
agatacagagatcaat

SEQ ID NO: 303125 - DNA, 16 bp, C. familiaris
agatacatccatgttg

SEQ ID NO: 303126 - DNA, 16 bp, C. familiaris
agataccacctcactc

SEQ ID NO: 303127 - DNA, 16 bp, C. familiaris
agataccacctcccac

SEQ ID NO: 303128 - DNA, 16 bp, C. familiaris
agatactgtgtttttt

SEQ ID NO: 303129 - DNA, 16 bp, C. familiaris
agatagaaaaactgag

SEQ ID NO: 303130 - DNA, 16 bp, C. familiaris
agatagacagagggag

SEQ ID NO: 303131 - DNA, 16 bp, C. familiaris
agatagagaaactgag

SEQ ID NO: 303132 - DNA, 16 bp, C. familiaris
agatagatagatatca

SEQ ID NO: 303133 - DNA, 16 bp, C. familiaris
agatagtgacctgagc

SEQ ID NO: 303134 - DNA, 16 bp, C. familiaris
agatataaaaatgaac

SEQ ID NO: 303135 - DNA, 16 bp, C. familiaris
agatataaatgacata

SEQ ID NO: 303136 - DNA, 16 bp, C. familiaris
agatatatagatatat

SEQ ID NO: 303137 - DNA, 16 bp, C. familiaris
agatatattcagaata

SEQ ID NO: 303138 - DNA, 16 bp, C. familiaris
agatatattttacata

SEQ ID NO: 303139 - DNA, 16 bp, C. familiaris
agatatccaagtggag

SEQ ID NO: 303140 - DNA, 16 bp, C. familiaris
agatatccagatggcc

SEQ ID NO: 303141 - DNA, 16 bp, C. familiaris
agatatggaagcaaac

SEQ ID NO: 303142 - DNA, 16 bp, C. familiaris
agatatgtgatttgaa

SEQ ID NO: 303143 - DNA, 16 bp, C. familiaris
agatatttattttaag

SEQ ID NO: 303144 - DNA, 16 bp, C. familiaris
agatatttccattttt

SEQ ID NO: 303145 - DNA, 16 bp, C. familiaris
agatatttgtacactc

SEQ ID NO: 303146 - DNA, 16 bp, C. familiaris
agatattttaacaatg

SEQ ID NO: 303147 - DNA, 16 bp, C. familiaris
agatatttttaaagaa

SEQ ID NO: 303148 - DNA, 16 bp, C. familiaris
agatatttttgaaata

SEQ ID NO: 303149 - DNA, 16 bp, C. familiaris
agatcaaagaagaaat

SEQ ID NO: 303150 - DNA, 16 bp, C. familiaris
agatcaaagtgccagc

SEQ ID NO: 303151 - DNA, 16 bp, C. familiaris
agatcaagaaatagaa

SEQ ID NO: 303152 - DNA, 16 bp, C. familiaris
agatcaagactcagat

SEQ ID NO: 303153 - DNA, 16 bp, C. familiaris
agatcaagactggagc

SEQ ID NO: 303154 - DNA, 16 bp, C. familiaris
agatcaagagtttcat

SEQ ID NO: 303155 - DNA, 16 bp, C. familiaris
agatcaagatacagaa

SEQ ID NO: 303156 - DNA, 16 bp, C. familiaris
agatcaaggtgtgggc

SEQ ID NO: 303157 - DNA, 16 bp, C. familiaris
agatcaataaagaact

SEQ ID NO: 303158 - DNA, 16 bp, C. familiaris
agatcacagtcctgca

SEQ ID NO: 303159 - DNA, 16 bp, C. familiaris
agatcagaaagaaata

SEQ ID NO: 303160 - DNA, 16 bp, C. familiaris
agatcagtgaaaccag

SEQ ID NO: 303161 - DNA, 16 bp, C. familiaris
agatcatgacctgaag

SEQ ID NO: 303162 - DNA, 16 bp, C. familiaris
agatcatgacttgtgc

SEQ ID NO: 303163 - DNA, 16 bp, C. familiaris
agatcatggtcctggg

SEQ ID NO: 303164 - DNA, 16 bp, C. familiaris
agatcattttaatttt

SEQ ID NO: 303165 - DNA, 16 bp, C. familiaris
agatccaaccatgttg

SEQ ID NO: 303166 - DNA, 16 bp, C. familiaris
agatccaagaatctca

SEQ ID NO: 303167 - DNA, 16 bp, C. familiaris
agatccagaaaataga

SEQ ID NO: 303168 - DNA, 16 bp, C. familiaris
agatccaggagatgga

SEQ ID NO: 303169 - DNA, 16 bp, C. familiaris
agatcccagaagaaga

SEQ ID NO: 303170 - DNA, 16 bp, C. familiaris
agatcctcaactgctg

SEQ ID NO: 303171 - DNA, 17 bp, C. familiaris
agatcctgggctgtgtc

SEQ ID NO: 303172 - DNA, 16 bp, C. familiaris
agatccttaatcacat

SEQ ID NO: 303173 - DNA, 16 bp, C. familiaris
agatcgagagagagag

SEQ ID NO: 303174 - DNA, 16 bp, C. familiaris
agatctactctctcag

SEQ ID NO: 303175 - DNA, 16 bp, C. familiaris
agatctcaggacccca

SEQ ID NO: 303176 - DNA, 16 bp, C. familiaris
agatctctgcctctct

SEQ ID NO: 303177 - DNA, 16 bp, C. familiaris
agatcttattggcttt

SEQ ID NO: 303178 - DNA, 16 bp, C. familiaris
agatcttgttatttaa

SEQ ID NO: 303179 - DNA, 16 bp, C. familiaris
agatctttaaaaatga

SEQ ID NO: 303180 - DNA, 16 bp, C. familiaris
agatcttttacttctt

SEQ ID NO: 303181 - DNA, 16 bp, C. familiaris
agatgaaaaaactgaa

SEQ ID NO: 303182 - DNA, 16 bp, C. familiaris
agatgaaaaaattgag

SEQ ID NO: 303183 - DNA, 16 bp, C. familiaris
agatgaaaaatacaat

SEQ ID NO: 303184 - DNA, 16 bp, C. familiaris
agatgaaaacactgag

SEQ ID NO: 303185 - DNA, 16 bp, C. familiaris
agatgaaaagagctct

SEQ ID NO: 303186 - DNA, 16 bp, C. familiaris
agatgaaagacctata

SEQ ID NO: 303187 - DNA, 16 bp, C. familiaris
agatgaaatggaaaat

SEQ ID NO: 303188 - DNA, 16 bp, C. familiaris
agatgaacaacaacaa

SEQ ID NO: 303189 - DNA, 16 bp, C. familiaris
agatgaacaacaataa

SEQ ID NO: 303190 - DNA, 16 bp, C. familiaris
agatgaacaagagaac

SEQ ID NO: 303191 - DNA, 16 bp, C. familiaris
agatgaacacagagga

SEQ ID NO: 303192 - DNA, 16 bp, C. familiaris
agatgaacatgggggg

SEQ ID NO: 303193 - DNA, 16 bp, C. familiaris
agatgaagaaacagaa

SEQ ID NO: 303194 - DNA, 16 bp, C. familiaris
agatgaagaaaccaaa

SEQ ID NO: 303195 - DNA, 16 bp, C. familiaris
agatgaagaaactaaa

SEQ ID NO: 303196 - DNA, 16 bp, C. familiaris
agatgaagaaactaag

SEQ ID NO: 303197 - DNA, 16 bp, C. familiaris
agatgaagaaactgaa

SEQ ID NO: 303198 - DNA, 16 bp, C. familiaris
agatgaagaaactggg

SEQ ID NO: 303199 - DNA, 16 bp, C. familiaris
agatgaagaaatggag

SEQ ID NO: 303200 - DNA, 16 bp, C. familiaris
agatgaagaacataat

SEQ ID NO: 303201 - DNA, 16 bp, C. familiaris
agatgaagaacctgag

SEQ ID NO: 303202 - DNA, 16 bp, C. familiaris
agatgaagaagcaggc

SEQ ID NO: 303203 - DNA, 16 bp, C. familiaris
agatgaagaagctgaa

SEQ ID NO: 303204 - DNA, 16 bp, C. familiaris
agatgaagaagctgag

SEQ ID NO: 303205 - DNA, 16 bp, C. familiaris
agatgaagaaggacat

SEQ ID NO: 303206 - DNA, 16 bp, C. familiaris
agatgaagacactgaa

SEQ ID NO: 303207 - DNA, 16 bp, C. familiaris
agatgaagacactgag

SEQ ID NO: 303208 - DNA, 16 bp, C. familiaris
agatgaagagaaagca

SEQ ID NO: 303209 - DNA, 16 bp, C. familiaris
agatgaagagagttct

SEQ ID NO: 303210 - DNA, 16 bp, C. familiaris
agatgaagatactgag

SEQ ID NO: 303211 - DNA, 16 bp, C. familiaris
agatgaaggcagagat

SEQ ID NO: 303212 - DNA, 16 bp, C. familiaris
agatgaatggattaag

SEQ ID NO: 303213 - DNA, 16 bp, C. familiaris
agatgaatgggtaaaa

SEQ ID NO: 303214 - DNA, 16 bp, C. familiaris
agatgaatgtataaag

SEQ ID NO: 303215 - DNA, 16 bp, C. familiaris
agatgacatgattgtt

SEQ ID NO: 303216 - DNA, 16 bp, C. familiaris
agatgactggactgaa

SEQ ID NO: 303217 - DNA, 16 bp, C. familiaris
agatgactttgagaag

SEQ ID NO: 303218 - DNA, 16 bp, C. familiaris
agatgagaaaacagat

SEQ ID NO: 303219 - DNA, 16 bp, C. familiaris
agatgagaaaatggag

SEQ ID NO: 303220 - DNA, 16 bp, C. familiaris
agatgagaaaattgaa

SEQ ID NO: 303221 - DNA, 16 bp, C. familiaris
agatgagaaagctaag

SEQ ID NO: 303222 - DNA, 16 bp, C. familiaris
agatgaggaaaacaaa

SEQ ID NO: 303223 - DNA, 16 bp, C. familiaris
agatgaggaaaactga

SEQ ID NO: 303224 - DNA, 16 bp, C. familiaris
agatgaggaaaccaaa

SEQ ID NO: 303225 - DNA, 16 bp, C. familiaris
agatgaggaaactgaa

SEQ ID NO: 303226 - DNA, 16 bp, C. familiaris
agatgaggaaagtgaa

SEQ ID NO: 303227 - DNA, 16 bp, C. familiaris
agatgaggaaattaag

SEQ ID NO: 303228 - DNA, 16 bp, C. familiaris
agatgaggaagatgag

SEQ ID NO: 303229 - DNA, 16 bp, C. familiaris
agatgaggaagctgag

SEQ ID NO: 303230 - DNA, 16 bp, C. familiaris
agatgaggaaggtgag

SEQ ID NO: 303231 - DNA, 16 bp, C. familiaris
agatgaggacatggag

SEQ ID NO: 303232 - DNA, 16 bp, C. familiaris
agatgagggagctgag

SEQ ID NO: 303233 - DNA, 16 bp, C. familiaris
agatgaggggactgag

SEQ ID NO: 303234 - DNA, 16 bp, C. familiaris
agatgagtcttgtttt

SEQ ID NO: 303235 - DNA, 16 bp, C. familiaris
agatgataaaactgag

SEQ ID NO: 303236 - DNA, 16 bp, C. familiaris
agatgataaaatgccc

SEQ ID NO: 303237 - DNA, 16 bp, C. familiaris
agatgataaatatttt

SEQ ID NO: 303238 - DNA, 16 bp, C. familiaris
agatgatacaaagaaa

SEQ ID NO: 303239 - DNA, 16 bp, C. familiaris
agatgatagatgatga

SEQ ID NO: 303240 - DNA, 16 bp, C. familiaris
agatgatgaaaaagtt

SEQ ID NO: 303241 - DNA, 16 bp, C. familiaris
agatgatgaaattgaa

SEQ ID NO: 303242 - DNA, 16 bp, C. familiaris
agatgatgacttgagc

SEQ ID NO: 303243 - DNA, 16 bp, C. familiaris
agatgatgatctgagc

SEQ ID NO: 303244 - DNA, 16 bp, C. familiaris
agatgatgatggtgat

SEQ ID NO: 303245 - DNA, 16 bp, C. familiaris
agatgatggtggtggt

SEQ ID NO: 303246 - DNA, 16 bp, C. familiaris
agatgatttgaaagtt

SEQ ID NO: 303247 - DNA, 16 bp, C. familiaris
agatgcaaaaatcctt

SEQ ID NO: 303248 - DNA, 16 bp, C. familiaris
agatgcacacagagag

SEQ ID NO: 303249 - DNA, 16 bp, C. familiaris
agatgcagagaaatca

SEQ ID NO: 303250 - DNA, 16 bp, C. familiaris
agatgcagaggcagag

SEQ ID NO: 303251 - DNA, 16 bp, C. familiaris
agatgcagataaagca

SEQ ID NO: 303252 - DNA, 16 bp, C. familiaris
agatgcagatgcagtg

SEQ ID NO: 303253 - DNA, 16 bp, C. familiaris
agatgcagtgaaagac

SEQ ID NO: 303254 - DNA, 16 bp, C. familiaris
agatgccagtggcacc

SEQ ID NO: 303255 - DNA, 16 bp, C. familiaris
agatgctcaagcgctg

SEQ ID NO: 303256 - DNA, 16 bp, C. familiaris
agatgcttaccaactg

SEQ ID NO: 303257 - DNA, 16 bp, C. familiaris
agatgctttttatctt

SEQ ID NO: 303258 - DNA, 16 bp, C. familiaris
agatggaaaaaatatt

SEQ ID NO: 303259 - DNA, 16 bp, C. familiaris
agatggaaaaatactc

SEQ ID NO: 303260 - DNA, 16 bp, C. familiaris
agatggaagagataca

SEQ ID NO: 303261 - DNA, 16 bp, C. familiaris
agatggagaaacaggc

SEQ ID NO: 303262 - DNA, 16 bp, C. familiaris
agatggagaagtagac

SEQ ID NO: 303263 - DNA, 16 bp, C. familiaris
agatggagacagagac

SEQ ID NO: 303264 - DNA, 16 bp, C. familiaris
agatggagagaaagca

SEQ ID NO: 303265 - DNA, 16 bp, C. familiaris
agatggagatggagat

SEQ ID NO: 303266 - DNA, 16 bp, C. familiaris
agatggagccctgcat

SEQ ID NO: 303267 - DNA, 16 bp, C. familiaris
agatggaggaaggagc

SEQ ID NO: 303268 - DNA, 16 bp, C. familiaris
agatggaggcagagat

SEQ ID NO: 303269 - DNA, 16 bp, C. familiaris
agatggatggagagat

SEQ ID NO: 303270 - DNA, 16 bp, C. familiaris
agatggatgtctcagc

SEQ ID NO: 303271 - DNA, 16 bp, C. familiaris
agatggatttaacaaa

SEQ ID NO: 303272 - DNA, 16 bp, C. familiaris
agatggcagaggagga

SEQ ID NO: 303273 - DNA, 16 bp, C. familiaris
agatggcagattgtgg

SEQ ID NO: 303274 - DNA, 16 bp, C. familiaris
agatggccatcttctt

SEQ ID NO: 303275 - DNA, 16 bp, C. familiaris
agatggcttttcagat

SEQ ID NO: 303276 - DNA, 16 bp, C. familiaris
agatgggaaaactgaa

SEQ ID NO: 303277 - DNA, 16 bp, C. familiaris
agatgggaaaaggctc

SEQ ID NO: 303278 - DNA, 16 bp, C. familiaris
agatgggaaaatggag

SEQ ID NO: 303279 - DNA, 16 bp, C. familiaris
agatgggaagactgag

SEQ ID NO: 303280 - DNA, 16 bp, C. familiaris
agatgggcagccccag

SEQ ID NO: 303281 - DNA, 16 bp, C. familiaris
agatggtccctgactt

SEQ ID NO: 303282 - DNA, 16 bp, C. familiaris
agatggtgtgtgtgtg

SEQ ID NO: 303283 - DNA, 16 bp, C. familiaris
agatgtctgttcatgt

SEQ ID NO: 303284 - DNA, 16 bp, C. familiaris
agatgtgaagaaaagg

SEQ ID NO: 303285 - DNA, 16 bp, C. familiaris
agatgtgacaaccaaa

SEQ ID NO: 303286 - DNA, 16 bp, C. familiaris
agatgtgacaatggaa

SEQ ID NO: 303287 - DNA, 16 bp, C. familiaris
agatgtgattaaatta

SEQ ID NO: 303288 - DNA, 16 bp, C. familiaris
agatgtggaagctgag

SEQ ID NO: 303289 - DNA, 16 bp, C. familiaris
agatgtggacactgag

SEQ ID NO: 303290 - DNA, 16 bp, C. familiaris
agatgtggagcttgat

SEQ ID NO: 303291 - DNA, 16 bp, C. familiaris
agatgttcaactactg

SEQ ID NO: 303292 - DNA, 16 bp, C. familiaris
agatgttccacatcat

SEQ ID NO: 303293 - DNA, 16 bp, C. familiaris
agatgttgctgatgct

SEQ ID NO: 303294 - DNA, 16 bp, C. familiaris
agatgttggcgaggat

SEQ ID NO: 303295 - DNA, 16 bp, C. familiaris
agatgttgtgcttagg

SEQ ID NO: 303296 - DNA, 16 bp, C. familiaris
agatgtttaacatcac

SEQ ID NO: 303297 - DNA, 16 bp, C. familiaris
agatgtttctgtgaag

SEQ ID NO: 303298 - DNA, 16 bp, C. familiaris
agattaagacctgagt

SEQ ID NO: 303299 - DNA, 16 bp, C. familiaris
agattaatggaataga

SEQ ID NO: 303300 - DNA, 16 bp, C. familiaris
agattacttaaaaaga

SEQ ID NO: 303301 - DNA, 16 bp, C. familiaris
agattagtggctgcca

SEQ ID NO: 303302 - DNA, 16 bp, C. familiaris
agattagttttctttt

SEQ ID NO: 303303 - DNA, 16 bp, C. familiaris
agattatttctaattt

SEQ ID NO: 303304 - DNA, 16 bp, C. familiaris
agattcagaaaaaaat

SEQ ID NO: 303305 - DNA, 16 bp, C. familiaris
agattcagtgtctggt

SEQ ID NO: 303306 - DNA, 16 bp, C. familiaris
agattcattcattcat

SEQ ID NO: 303307 - DNA, 16 bp, C. familiaris
agattcatttttcttt

SEQ ID NO: 303308 - DNA, 16 bp, C. familiaris
agattccacatacaaa

SEQ ID NO: 303309 - DNA, 16 bp, C. familiaris
agattcctttctcatt

SEQ ID NO: 303310 - DNA, 16 bp, C. familiaris
agattctacagatatt

SEQ ID NO: 303311 - DNA, 16 bp, C. familiaris
agattctacatataaa

SEQ ID NO: 303312 - DNA, 16 bp, C. familiaris
agattctctccctcct

SEQ ID NO: 303313 - DNA, 16 bp, C. familiaris
agattctctctctccc

SEQ ID NO: 303314 - DNA, 16 bp, C. familiaris
agattctcttcctctt

SEQ ID NO: 303315 - DNA, 16 bp, C. familiaris
agattgaaagtgaaga

SEQ ID NO: 303316 - DNA, 16 bp, C. familiaris
agattgaaagtgagag

SEQ ID NO: 303317 - DNA, 16 bp, C. familiaris
agattgagagaaagag

SEQ ID NO: 303318 - DNA, 16 bp, C. familiaris
agattgagcccagtgt

SEQ ID NO: 303319 - DNA, 16 bp, C. familiaris
agattgaggaagacac

SEQ ID NO: 303320 - DNA, 16 bp, C. familiaris
agattgcattgaatgt

SEQ ID NO: 303321 - DNA, 16 bp, C. familiaris
agattgccctccccag

SEQ ID NO: 303322 - DNA, 16 bp, C. familiaris
agattgctacaactca

SEQ ID NO: 303323 - DNA, 16 bp, C. familiaris
agattgctggagggga

SEQ ID NO: 303324 - DNA, 16 bp, C. familiaris
agattgcttttttaaa

SEQ ID NO: 303325 - DNA, 16 bp, C. familiaris
agattggagcagaact

SEQ ID NO: 303326 - DNA, 16 bp, C. familiaris
agatttaaggaaactt

SEQ ID NO: 303327 - DNA, 16 bp, C. familiaris
agatttaaggaaagaa

SEQ ID NO: 303328 - DNA, 16 bp, C. familiaris
agatttagcaaagaaa

SEQ ID NO: 303329 - DNA, 16 bp, C. familiaris
agatttatttactaat

SEQ ID NO: 303330 - DNA, 16 bp, C. familiaris
agatttcattattttc

SEQ ID NO: 303331 - DNA, 16 bp, C. familiaris
agatttcattctttgt

SEQ ID NO: 303332 - DNA, 16 bp, C. familiaris
agatttccttaatttt

SEQ ID NO: 303333 - DNA, 16 bp, C. familiaris
agatttgaaaaagaac

SEQ ID NO: 303334 - DNA, 16 bp, C. familiaris
agatttgaatgtaaga

SEQ ID NO: 303335 - DNA, 16 bp, C. familiaris
agatttgagaagtttt

SEQ ID NO: 303336 - DNA, 16 bp, C. familiaris
agatttgagcagaact

SEQ ID NO: 303337 - DNA, 16 bp, C. familiaris
agattttaaaagcaaa

SEQ ID NO: 303338 - DNA, 16 bp, C. familiaris
agattttaaaatgtaa

SEQ ID NO: 303339 - DNA, 16 bp, C. familiaris
agattttaaaatgttt

SEQ ID NO: 303340 - DNA, 16 bp, C. familiaris
agattttaaacaaaag

SEQ ID NO: 303341 - DNA, 16 bp, C. familiaris
agattttacttctttg

SEQ ID NO: 303342 - DNA, 16 bp, C. familiaris
agattttattttgaga

SEQ ID NO: 303343 - DNA, 16 bp, C. familiaris
agattttatttttact

SEQ ID NO: 303344 - DNA, 16 bp, C. familiaris
agattttctattactt

SEQ ID NO: 303345 - DNA, 16 bp, C. familiaris
agattttctccctctg

SEQ ID NO: 303346 - DNA, 16 bp, C. familiaris
agattttgaaagaaaa

SEQ ID NO: 303347 - DNA, 16 bp, C. familiaris
agattttgcagatgta

SEQ ID NO: 303348 - DNA, 16 bp, C. familiaris
agattttgtttcttta

SEQ ID NO: 303349 - DNA, 16 bp, C. familiaris
agatttttaaaaaatg

SEQ ID NO: 303350 - DNA, 16 bp, C. familiaris
agatttttcaaaatgt

SEQ ID NO: 303351 - DNA, 16 bp, C. familiaris
agatttttccatttct

SEQ ID NO: 303352 - DNA, 16 bp, C. familiaris
agatttttctagatat

SEQ ID NO: 303353 - DNA, 16 bp, C. familiaris
agatttttttattcat

SEQ ID NO: 303354 - DNA, 16 bp, C. familiaris
agatttttttgaaaaa

SEQ ID NO: 303355 - DNA, 16 bp, C. familiaris
agatttttttgaaaat

SEQ ID NO: 303356 - DNA, 16 bp, C. familiaris
agcaaaaataaactgt

SEQ ID NO: 303357 - DNA, 16 bp, C. familiaris
agcaaaaatgaacaag

SEQ ID NO: 303358 - DNA, 34 bp, C. familiaris
agcaaaaatgacccaccaatggaagcagctggct

SEQ ID NO: 303359 - DNA, 16 bp, C. familiaris
agcaaaaattttaaaa

SEQ ID NO: 303360 - DNA, 16 bp, C. familiaris
agcaaaacaaaacagt

SEQ ID NO: 303361 - DNA, 16 bp, C. familiaris
agcaaaagaaaaggat

SEQ ID NO: 303362 - DNA, 16 bp, C. familiaris
agcaaaagaaaatatt

SEQ ID NO: 303363 - DNA, 16 bp, C. familiaris
agcaaaagagaaatta

SEQ ID NO: 303364 - DNA, 16 bp, C. familiaris
agcaaaatcatttttt

SEQ ID NO: 303365 - DNA, 16 bp, C. familiaris
agcaaacagaatccaa

SEQ ID NO: 303366 - DNA, 16 bp, C. familiaris
agcaaacatttatata

SEQ ID NO: 303367 - DNA, 16 bp, C. familiaris
agcaaagaaaatgaat

SEQ ID NO: 303368 - DNA, 16 bp, C. familiaris
agcaaagaaattgaaa

SEQ ID NO: 303369 - DNA, 16 bp, C. familiaris
agcaaagatatggaaa

SEQ ID NO: 303370 - DNA, 16 bp, C. familiaris
agcaaagctgaaggca

SEQ ID NO: 303371 - DNA, 16 bp, C. familiaris
agcaaaggcccagagg

SEQ ID NO: 303372 - DNA, 16 bp, C. familiaris
agcaaatgaagaaaca

SEQ ID NO: 303373 - DNA, 16 bp, C. familiaris
agcaaatgtggcaaaa

SEQ ID NO: 303374 - DNA, 16 bp, C. familiaris
agcaaatgttggagag

SEQ ID NO: 303375 - DNA, 16 bp, C. familiaris
agcaaattaatcaaac

SEQ ID NO: 303376 - DNA, 16 bp, C. familiaris
agcaacaagaactctc

SEQ ID NO: 303377 - DNA, 16 bp, C. familiaris
agcaacagaaatttat

SEQ ID NO: 303378 - DNA, 16 bp, C. familiaris
agcaacaggaactctc

SEQ ID NO: 303379 - DNA, 16 bp, C. familiaris
agcaacatgcagaaga

SEQ ID NO: 303380 - DNA, 16 bp, C. familiaris
agcaacatggaaaaga

SEQ ID NO: 303381 - DNA, 16 bp, C. familiaris
agcaaccaagatgccc

SEQ ID NO: 303382 - DNA, 16 bp, C. familiaris
agcaacccatgtgtcc

SEQ ID NO: 303383 - DNA, 21 bp, C. familiaris
agcaactgcgcgcccaggaga

SEQ ID NO: 303384 - DNA, 16 bp, C. familiaris
agcaacttgcccaggg

SEQ ID NO: 303385 - DNA, 16 bp, C. familiaris
agcaacttttaagtat

SEQ ID NO: 303386 - DNA, 16 bp, C. familiaris
agcaactttttgcaag

SEQ ID NO: 303387 - DNA, 16 bp, C. familiaris
agcaagaaggaattct

SEQ ID NO: 303388 - DNA, 16 bp, C. familiaris
agcaagaaggcagcca

SEQ ID NO: 303389 - DNA, 16 bp, C. familiaris
agcaagaaggtagcca

SEQ ID NO: 303390 - DNA, 16 bp, C. familiaris
agcaagaaggtggcca

SEQ ID NO: 303391 - DNA, 16 bp, C. familiaris
agcaagaaggtggctg

SEQ ID NO: 303392 - DNA, 16 bp, C. familiaris
agcaagagaaaagtaa

SEQ ID NO: 303393 - DNA, 16 bp, C. familiaris
agcaagagacagagca

SEQ ID NO: 303394 - DNA, 16 bp, C. familiaris
agcaagagagatcaca

SEQ ID NO: 303395 - DNA, 16 bp, C. familiaris
agcaagagcaggagca

SEQ ID NO: 303396 - DNA, 16 bp, C. familiaris
agcaagcacaagcagg

SEQ ID NO: 303397 - DNA, 16 bp, C. familiaris
agcaagctctctgtgg

SEQ ID NO: 303398 - DNA, 16 bp, C. familiaris
agcaaggaaacagatt

SEQ ID NO: 303399 - DNA, 16 bp, C. familiaris
agcaaggagccccatg

SEQ ID NO: 303400 - DNA, 16 bp, C. familiaris
agcaaggatatggaga

SEQ ID NO: 303401 - DNA, 16 bp, C. familiaris
agcaaggcagagggag

SEQ ID NO: 303402 - DNA, 16 bp, C. familiaris
agcaaggctctcactc

SEQ ID NO: 303403 - DNA, 16 bp, C. familiaris
agcaagttctggacca

SEQ ID NO: 303404 - DNA, 16 bp, C. familiaris
agcaatacaggccttc

SEQ ID NO: 303405 - DNA, 16 bp, C. familiaris
agcaatcaaagaagaa

SEQ ID NO: 303406 - DNA, 16 bp, C. familiaris
agcaatctggaagaaa

SEQ ID NO: 303407 - DNA, 16 bp, C. familiaris
agcaatggaaaagaaa

SEQ ID NO: 303408 - DNA, 16 bp, C. familiaris
agcaatgggaaactaa

SEQ ID NO: 303409 - DNA, 16 bp, C. familiaris
agcaatggttctcagg

SEQ ID NO: 303410 - DNA, 16 bp, C. familiaris
agcaattcaatggaga

SEQ ID NO: 303411 - DNA, 16 bp, C. familiaris
agcaattccacatctg

SEQ ID NO: 303412 - DNA, 16 bp, C. familiaris
agcacaaaatcagaac

SEQ ID NO: 303413 - DNA, 16 bp, C. familiaris
agcacaaacccctgcc

SEQ ID NO: 303414 - DNA, 16 bp, C. familiaris
agcacaaagcctggca

SEQ ID NO: 303415 - DNA, 16 bp, C. familiaris
agcacaacatggggct

SEQ ID NO: 303416 - DNA, 16 bp, C. familiaris
agcacaagaaacaagt

SEQ ID NO: 303417 - DNA, 16 bp, C. familiaris
agcacaagcaggagaa

SEQ ID NO: 303418 - DNA, 16 bp, C. familiaris
agcacaagcaggggag

SEQ ID NO: 303419 - DNA, 16 bp, C. familiaris
agcacagaacctggca

SEQ ID NO: 303420 - DNA, 16 bp, C. familiaris
agcacagaatattttt

SEQ ID NO: 303421 - DNA, 16 bp, C. familiaris
agcacagacacaggca

SEQ ID NO: 303422 - DNA, 16 bp, C. familiaris
agcacagagaagggag

SEQ ID NO: 303423 - DNA, 16 bp, C. familiaris
agcacagagagagaag

SEQ ID NO: 303424 - DNA, 16 bp, C. familiaris
agcacagagcccagca

SEQ ID NO: 303425 - DNA, 16 bp, C. familiaris
agcacagagctggaca

SEQ ID NO: 303426 - DNA, 16 bp, C. familiaris
agcacagagcttgatg

SEQ ID NO: 303427 - DNA, 16 bp, C. familiaris
agcacagaggaagaag

SEQ ID NO: 303428 - DNA, 16 bp, C. familiaris
agcacagaggatgttt

SEQ ID NO: 303429 - DNA, 16 bp, C. familiaris
agcacagagggaaagg

SEQ ID NO: 303430 - DNA, 16 bp, C. familiaris
agcacaggagcaggag

SEQ ID NO: 303431 - DNA, 16 bp, C. familiaris
agcacaggcccaggag

SEQ ID NO: 303432 - DNA, 16 bp, C. familiaris
agcacagggagaagca

SEQ ID NO: 303433 - DNA, 16 bp, C. familiaris
agcacagggccctgga

SEQ ID NO: 303434 - DNA, 16 bp, C. familiaris
agcacagtccctggca

SEQ ID NO: 303435 - DNA, 16 bp, C. familiaris
agcacagtgcccagca

SEQ ID NO: 303436 - DNA, 16 bp, C. familiaris
agcacagtgcctggga

SEQ ID NO: 303437 - DNA, 16 bp, C. familiaris
agcacatgaagaaatg

SEQ ID NO: 303438 - DNA, 16 bp, C. familiaris
agcacattaaaaagat

SEQ ID NO: 303439 - DNA, 16 bp, C. familiaris
agcaccaccaccatca

SEQ ID NO: 303440 - DNA, 16 bp, C. familiaris
agcaccacctccagcc

SEQ ID NO: 303441 - DNA, 26 bp, C. familiaris
agcaccagatcaaacaggctgtgaag

SEQ ID NO: 303442 - DNA, 16 bp, C. familiaris
agcaccagcatcaccc

SEQ ID NO: 303443 - DNA, 16 bp, C. familiaris
agcacccagatcttgg

SEQ ID NO: 303444 - DNA, 16 bp, C. familiaris
agcacccagcacagag

SEQ ID NO: 303445 - DNA, 16 bp, C. familiaris
agcacccaggggcccc

SEQ ID NO: 303446 - DNA, 16 bp, C. familiaris
agcacctactgtgttc

SEQ ID NO: 303447 - DNA, 16 bp, C. familiaris
agcacctactttgtgc

SEQ ID NO: 303448 - DNA, 16 bp, C. familiaris
agcacctcctgcagcc

SEQ ID NO: 303449 - DNA, 16 bp, C. familiaris
agcacctgcatggctc

SEQ ID NO: 303450 - DNA, 16 bp, C. familiaris
agcacctgcctgtggc

SEQ ID NO: 303451 - DNA, 16 bp, C. familiaris
agcacctgcttttggc

SEQ ID NO: 303452 - DNA, 16 bp, C. familiaris
agcacctggcacaggg

SEQ ID NO: 303453 - DNA, 16 bp, C. familiaris
agcacctgggtgtctc

SEQ ID NO: 303454 - DNA, 16 bp, C. familiaris
agcacctgtgtggctc

SEQ ID NO: 303455 - DNA, 16 bp, C. familiaris
agcacggagcccaaca

SEQ ID NO: 303456 - DNA, 16 bp, C. familiaris
agcactgcatcaggct

SEQ ID NO: 303457 - DNA, 16 bp, C. familiaris
agcactgcctgcagcc

SEQ ID NO: 303458 - DNA, 16 bp, C. familiaris
agcactgccttccgcc

SEQ ID NO: 303459 - DNA, 16 bp, C. familiaris
agcactggatgttaca

SEQ ID NO: 303460 - DNA, 16 bp, C. familiaris
agcactgggtgtttta

SEQ ID NO: 303461 - DNA, 16 bp, C. familiaris
agcacttactgagcac

SEQ ID NO: 303462 - DNA, 16 bp, C. familiaris
agcacttcattccttt

SEQ ID NO: 303463 - DNA, 16 bp, C. familiaris
agcactttaaatatgt

SEQ ID NO: 303464 - DNA, 16 bp, C. familiaris
agcactttgaaaatat

SEQ ID NO: 303465 - DNA, 16 bp, C. familiaris
agcagaaaaatgagaa

SEQ ID NO: 303466 - DNA, 16 bp, C. familiaris
agcagaaacaaatgaa

SEQ ID NO: 303467 - DNA, 16 bp, C. familiaris
agcagaaaccaagagt

SEQ ID NO: 303468 - DNA, 16 bp, C. familiaris
agcagaaaccaatgaa

SEQ ID NO: 303469 - DNA, 16 bp, C. familiaris
agcagaaagagaaata

SEQ ID NO: 303470 - DNA, 16 bp, C. familiaris
agcagaaagagaaatc

SEQ ID NO: 303471 - DNA, 16 bp, C. familiaris
agcagaaagagaaatt

SEQ ID NO: 303472 - DNA, 16 bp, C. familiaris
agcagaactcaaagaa

SEQ ID NO: 303473 - DNA, 16 bp, C. familiaris
agcagaagaaacagtc

SEQ ID NO: 303474 - DNA, 16 bp, C. familiaris
agcagaagaaatattt

SEQ ID NO: 303475 - DNA, 16 bp, C. familiaris
agcagaagaagaaaat

SEQ ID NO: 303476 - DNA, 16 bp, C. familiaris
agcagaagaagagagt

SEQ ID NO: 303477 - DNA, 16 bp, C. familiaris
agcagaagagaattaa

SEQ ID NO: 303478 - DNA, 16 bp, C. familiaris
agcagaagagagataa

SEQ ID NO: 303479 - DNA, 16 bp, C. familiaris
agcagaagaggagagt

SEQ ID NO: 303480 - DNA, 16 bp, C. familiaris
agcagaagatactccc

SEQ ID NO: 303481 - DNA, 16 bp, C. familiaris
agcagaagatcaataa

SEQ ID NO: 303482 - DNA, 16 bp, C. familiaris
agcagaagcagcagca

SEQ ID NO: 303483 - DNA, 16 bp, C. familiaris
agcagaaggaacagca

SEQ ID NO: 303484 - DNA, 16 bp, C. familiaris
agcagaaggaagagca

SEQ ID NO: 303485 - DNA, 16 bp, C. familiaris
agcagaaggcagaagc

SEQ ID NO: 303486 - DNA, 16 bp, C. familiaris
agcagaaggggaggtg

SEQ ID NO: 303487 - DNA, 16 bp, C. familiaris
agcagaattgctggat

SEQ ID NO: 303488 - DNA, 16 bp, C. familiaris
agcagacagcctgatg

SEQ ID NO: 303489 - DNA, 16 bp, C. familiaris
agcagaccccactgag

SEQ ID NO: 303490 - DNA, 16 bp, C. familiaris
agcagacccctccccc

SEQ ID NO: 303491 - DNA, 16 bp, C. familiaris
agcagacggagaggga

SEQ ID NO: 303492 - DNA, 16 bp, C. familiaris
agcagactccatactg

SEQ ID NO: 303493 - DNA, 16 bp, C. familiaris
agcagactccccatta

SEQ ID NO: 303494 - DNA, 16 bp, C. familiaris
agcagagaacccaatg

SEQ ID NO: 303495 - DNA, 16 bp, C. familiaris
agcagagaagcagcag

SEQ ID NO: 303496 - DNA, 16 bp, C. familiaris
agcagagacagaagca

SEQ ID NO: 303497 - DNA, 16 bp, C. familiaris
agcagagagaaaataa

SEQ ID NO: 303498 - DNA, 16 bp, C. familiaris
agcagagagaagcagg

SEQ ID NO: 303499 - DNA, 16 bp, C. familiaris
agcagagagaggagca

SEQ ID NO: 303500 - DNA, 16 bp, C. familiaris
agcagagcagagggaa

SEQ ID NO: 303501 - DNA, 16 bp, C. familiaris
agcagagcaggaagga

SEQ ID NO: 303502 - DNA, 16 bp, C. familiaris
agcagagccagccagg

SEQ ID NO: 303503 - DNA, 16 bp, C. familiaris
agcagagcctgatgca

SEQ ID NO: 303504 - DNA, 16 bp, C. familiaris
agcagagcctgatgtg

SEQ ID NO: 303505 - DNA, 16 bp, C. familiaris
agcagagctggaggca

SEQ ID NO: 303506 - DNA, 16 bp, C. familiaris
agcagaggcagaggaa

SEQ ID NO: 303507 - DNA, 16 bp, C. familiaris
agcagagggacaggaa

SEQ ID NO: 303508 - DNA, 16 bp, C. familiaris
agcagagggcagcccc

SEQ ID NO: 303509 - DNA, 16 bp, C. familiaris
agcagatggaccctac

SEQ ID NO: 303510 - DNA, 16 bp, C. familiaris
agcagcaagagagaag

SEQ ID NO: 303511 - DNA, 16 bp, C. familiaris
agcagcaatatccaca

SEQ ID NO: 303512 - DNA, 16 bp, C. familiaris
agcagcaatgtacaca

SEQ ID NO: 303513 - DNA, 16 bp, C. familiaris
agcagcacaggcccca

SEQ ID NO: 303514 - DNA, 16 bp, C. familiaris
agcagcacctgggtgg

SEQ ID NO: 303515 - DNA, 16 bp, C. familiaris
agcagcactgttcaca

SEQ ID NO: 303516 - DNA, 16 bp, C. familiaris
agcagcagaaagaaat

SEQ ID NO: 303517 - DNA, 16 bp, C. familiaris
agcagcagaaagtgaa

SEQ ID NO: 303518 - DNA, 16 bp, C. familiaris
agcagcagaagcagca

SEQ ID NO: 303519 - DNA, 16 bp, C. familiaris
agcagcagaaggagaa

SEQ ID NO: 303520 - DNA, 16 bp, C. familiaris
agcagcagagcagcag

SEQ ID NO: 303521 - DNA, 16 bp, C. familiaris
agcagcagatggagag

SEQ ID NO: 303522 - DNA, 16 bp, C. familiaris
agcagcagcaacaaca

SEQ ID NO: 303523 - DNA, 16 bp, C. familiaris
agcagcagcaacagca

SEQ ID NO: 303524 - DNA, 19 bp, C. familiaris
agcagcagcaacagcagca

SEQ ID NO: 303525 - DNA, 16 bp, C. familiaris
agcagcagcaccacca

SEQ ID NO: 303526 - DNA, 16 bp, C. familiaris
agcagcagcagaagca

SEQ ID NO: 303527 - DNA, 16 bp, C. familiaris
agcagcagcagcacag

SEQ ID NO: 303528 - DNA, 16 bp, C. familiaris
agcagcagcagcacca

SEQ ID NO: 303529 - DNA, 16 bp, C. familiaris
agcagcagcagcacct

SEQ ID NO: 303530 - DNA, 16 bp, C. familiaris
agcagcagcagcactg

SEQ ID NO: 303531 - DNA, 16 bp, C. familiaris
agcagcagcagcagca

SEQ ID NO: 303532 - DNA, 16 bp, C. familiaris
agcagcagcagcagcg

SEQ ID NO: 303533 - DNA, 17 bp, C. familiaris
agcagcagcagcagcga

SEQ ID NO: 303534 - DNA, 18 bp, C. familiaris
agcagcagcagcagctgc

SEQ ID NO: 303535 - DNA, 16 bp, C. familiaris
agcagcagcagcaggc

SEQ ID NO: 303536 - DNA, 16 bp, C. familiaris
agcagcagcagcagta

SEQ ID NO: 303537 - DNA, 16 bp, C. familiaris
agcagcagcagcatcc

SEQ ID NO: 303538 - DNA, 16 bp, C. familiaris
agcagcagcagcatct

SEQ ID NO: 303539 - DNA, 16 bp, C. familiaris
agcagcagcagccagg

SEQ ID NO: 303540 - DNA, 16 bp, C. familiaris
agcagcagcagcccag

SEQ ID NO: 303541 - DNA, 18 bp, C. familiaris
agcagcagcagcggcagc

SEQ ID NO: 303542 - DNA, 16 bp, C. familiaris
agcagcagcagctgga

SEQ ID NO: 303543 - DNA, 16 bp, C. familiaris
agcagcagcagtagca

SEQ ID NO: 303544 - DNA, 16 bp, C. familiaris
agcagcagcagtagta

SEQ ID NO: 303545 - DNA, 16 bp, C. familiaris
agcagcagcagtggca

SEQ ID NO: 303546 - DNA, 16 bp, C. familiaris
agcagcaggaggagag

SEQ ID NO: 303547 - DNA, 16 bp, C. familiaris
agcagcaggcagaggg

SEQ ID NO: 303548 - DNA, 16 bp, C. familiaris
agcagcagggagaggc

SEQ ID NO: 303549 - DNA, 16 bp, C. familiaris
agcagcagtagcagca

SEQ ID NO: 303550 - DNA, 16 bp, C. familiaris
agcagcagtagtagta

SEQ ID NO: 303551 - DNA, 16 bp, C. familiaris
agcagcagtggccaca

SEQ ID NO: 303552 - DNA, 16 bp, C. familiaris
agcagcatcagcagca

SEQ ID NO: 303553 - DNA, 16 bp, C. familiaris
agcagcatccccggcc

SEQ ID NO: 303554 - DNA, 16 bp, C. familiaris
agcagccacagacagt

SEQ ID NO: 303555 - DNA, 16 bp, C. familiaris
agcagccagccagcca

SEQ ID NO: 303556 - DNA, 16 bp, C. familiaris
agcagccatccaaaaa

SEQ ID NO: 303557 - DNA, 16 bp, C. familiaris
agcagccccaggacac

SEQ ID NO: 303558 - DNA, 16 bp, C. familiaris
agcagcccctgcccca

SEQ ID NO: 303559 - DNA, 16 bp, C. familiaris
agcagccctatggaga

SEQ ID NO: 303560 - DNA, 16 bp, C. familiaris
agcagccctggtggcc

SEQ ID NO: 303561 - DNA, 16 bp, C. familiaris
agcagccctggtggct

SEQ ID NO: 303562 - DNA, 16 bp, C. familiaris
agcagctcggaggcgg

SEQ ID NO: 303563 - DNA, 16 bp, C. familiaris
agcagctgcaccagct

SEQ ID NO: 303564 - DNA, 16 bp, C. familiaris
agcagctggaggggct

SEQ ID NO: 303565 - DNA, 16 bp, C. familiaris
agcagctttattttta

SEQ ID NO: 303566 - DNA, 16 bp, C. familiaris
agcaggaaagaaaatc

SEQ ID NO: 303567 - DNA, 16 bp, C. familiaris
agcaggaagagaggca

SEQ ID NO: 303568 - DNA, 16 bp, C. familiaris
agcaggaagagcagca

SEQ ID NO: 303569 - DNA, 16 bp, C. familiaris
agcaggaagaggagca

SEQ ID NO: 303570 - DNA, 16 bp, C. familiaris
agcaggaagcctgctt

SEQ ID NO: 303571 - DNA, 16 bp, C. familiaris
agcaggaagtctactt

SEQ ID NO: 303572 - DNA, 16 bp, C. familiaris
agcaggaagtctgcct

SEQ ID NO: 303573 - DNA, 16 bp, C. familiaris
agcaggacagaagaca

SEQ ID NO: 303574 - DNA, 16 bp, C. familiaris
agcaggagaaggagca

SEQ ID NO: 303575 - DNA, 16 bp, C. familiaris
agcaggagctgcacca

SEQ ID NO: 303576 - DNA, 16 bp, C. familiaris
agcaggaggcagagag

SEQ ID NO: 303577 - DNA, 16 bp, C. familiaris
agcaggattttatttt

SEQ ID NO: 303578 - DNA, 16 bp, C. familiaris
agcaggcagcctgctt

SEQ ID NO: 303579 - DNA, 16 bp, C. familiaris
agcaggcagcctgggt

SEQ ID NO: 303580 - DNA, 16 bp, C. familiaris
agcaggccccacacag

SEQ ID NO: 303581 - DNA, 16 bp, C. familiaris
agcaggcccctgcagg

SEQ ID NO: 303582 - DNA, 16 bp, C. familiaris
agcaggccctctgctg

SEQ ID NO: 303583 - DNA, 16 bp, C. familiaris
agcaggcgccatgcag

SEQ ID NO: 303584 - DNA, 16 bp, C. familiaris
agcaggctccaaaccc

SEQ ID NO: 303585 - DNA, 16 bp, C. familiaris
agcaggctccatgacc

SEQ ID NO: 303586 - DNA, 16 bp, C. familiaris
agcaggctcccaatgg

SEQ ID NO: 303587 - DNA, 16 bp, C. familiaris
agcaggctcccactgg

SEQ ID NO: 303588 - DNA, 16 bp, C. familiaris
agcaggctccccacag

SEQ ID NO: 303589 - DNA, 16 bp, C. familiaris
agcaggctccccatgg

SEQ ID NO: 303590 - DNA, 16 bp, C. familiaris
agcaggctccctagag

SEQ ID NO: 303591 - DNA, 16 bp, C. familiaris
agcaggctcctcaccc

SEQ ID NO: 303592 - DNA, 16 bp, C. familiaris
agcaggctctcagctg

SEQ ID NO: 303593 - DNA, 16 bp, C. familiaris
agcaggctctccacca

SEQ ID NO: 303594 - DNA, 16 bp, C. familiaris
agcaggctggagaccc

SEQ ID NO: 303595 - DNA, 16 bp, C. familiaris
agcaggcttcatgaag

SEQ ID NO: 303596 - DNA, 16 bp, C. familiaris
agcaggcttcctgcag

SEQ ID NO: 303597 - DNA, 16 bp, C. familiaris
agcagggaatctgctt

SEQ ID NO: 303598 - DNA, 16 bp, C. familiaris
agcagggagagcagca

SEQ ID NO: 303599 - DNA, 16 bp, C. familiaris
agcagggagcccagga

SEQ ID NO: 303600 - DNA, 16 bp, C. familiaris
agcagggagccctggg

SEQ ID NO: 303601 - DNA, 16 bp, C. familiaris
agcagggagcctgaga

SEQ ID NO: 303602 - DNA, 16 bp, C. familiaris
agcagggagcctggga

SEQ ID NO: 303603 - DNA, 16 bp, C. familiaris
agcagggagtttgcct

SEQ ID NO: 303604 - DNA, 16 bp, C. familiaris
agcagggcagcccggg

SEQ ID NO: 303605 - DNA, 16 bp, C. familiaris
agcagggctccatgca

SEQ ID NO: 303606 - DNA, 16 bp, C. familiaris
agcagggctgcaggcc

SEQ ID NO: 303607 - DNA, 16 bp, C. familiaris
agcagggggagcagca

SEQ ID NO: 303608 - DNA, 16 bp, C. familiaris
agcagggggagcagtg

SEQ ID NO: 303609 - DNA, 16 bp, C. familiaris
agcagggggcagggca

SEQ ID NO: 303610 - DNA, 16 bp, C. familiaris
agcaggggtagcagca

SEQ ID NO: 303611 - DNA, 16 bp, C. familiaris
agcaggtgagcatctg

SEQ ID NO: 303612 - DNA, 16 bp, C. familiaris
agcaggtgctaaactg

SEQ ID NO: 303613 - DNA, 16 bp, C. familiaris
agcaggtgctcaactg

SEQ ID NO: 303614 - DNA, 16 bp, C. familiaris
agcaggtgctcaggga

SEQ ID NO: 303615 - DNA, 16 bp, C. familiaris
agcaggtgctcagtga

SEQ ID NO: 303616 - DNA, 16 bp, C. familiaris
agcaggtggagaggca

SEQ ID NO: 303617 - DNA, 16 bp, C. familiaris
agcaggtggaggagca

SEQ ID NO: 303618 - DNA, 16 bp, C. familiaris
agcagtagcagcagca

SEQ ID NO: 303619 - DNA, 16 bp, C. familiaris
agcagtagtgagagtg

SEQ ID NO: 303620 - DNA, 16 bp, C. familiaris
agcagtgaacaaaata

SEQ ID NO: 303621 - DNA, 16 bp, C. familiaris
agcagtgaatgagaat

SEQ ID NO: 303622 - DNA, 16 bp, C. familiaris
agcagtgcctgacaca

SEQ ID NO: 303623 - DNA, 16 bp, C. familiaris
agcagtgctgtccaat

SEQ ID NO: 303624 - DNA, 16 bp, C. familiaris
agcagtggaattactg

SEQ ID NO: 303625 - DNA, 16 bp, C. familiaris
agcagtggagtgtctg

SEQ ID NO: 303626 - DNA, 16 bp, C. familiaris
agcagtgtgtgagggt

SEQ ID NO: 303627 - DNA, 16 bp, C. familiaris
agcagttaaagcatct

SEQ ID NO: 303628 - DNA, 17 bp, C. familiaris
agcagttgggggagctg

SEQ ID NO: 303629 - DNA, 16 bp, C. familiaris
agcagttttgggttca

SEQ ID NO: 303630 - DNA, 16 bp, C. familiaris
agcagtttttattgat

SEQ ID NO: 303631 - DNA, 16 bp, C. familiaris
agcataagacccagtg

SEQ ID NO: 303632 - DNA, 16 bp, C. familiaris
agcataatactcttta

SEQ ID NO: 303633 - DNA, 16 bp, C. familiaris
agcataatattttcta

SEQ ID NO: 303634 - DNA, 16 bp, C. familiaris
agcatacaaaatcaat

SEQ ID NO: 303635 - DNA, 16 bp, C. familiaris
agcatattttaatttt

SEQ ID NO: 303636 - DNA, 16 bp, C. familiaris
agcatcatcaccatca

SEQ ID NO: 303637 - DNA, 16 bp, C. familiaris
agcatccaggccctgc

SEQ ID NO: 303638 - DNA, 16 bp, C. familiaris
agcatccatctcttga

SEQ ID NO: 303639 - DNA, 16 bp, C. familiaris
agcatcctcactgtcc

SEQ ID NO: 303640 - DNA, 16 bp, C. familiaris
agcatcggactcttgg

SEQ ID NO: 303641 - DNA, 16 bp, C. familiaris
agcatctgacttcagc

SEQ ID NO: 303642 - DNA, 16 bp, C. familiaris
agcatctgacttctga

SEQ ID NO: 303643 - DNA, 16 bp, C. familiaris
agcatctgcctgcctt

SEQ ID NO: 303644 - DNA, 16 bp, C. familiaris
agcatctgccttgtgc

SEQ ID NO: 303645 - DNA, 16 bp, C. familiaris
agcatctgcttctggc

SEQ ID NO: 303646 - DNA, 16 bp, C. familiaris
agcatctgctttcagg

SEQ ID NO: 303647 - DNA, 16 bp, C. familiaris
agcatctggctccctg

SEQ ID NO: 303648 - DNA, 16 bp, C. familiaris
agcatcttcctttggc

SEQ ID NO: 303649 - DNA, 16 bp, C. familiaris
agcatgaacaaggtgg

SEQ ID NO: 303650 - DNA, 16 bp, C. familiaris
agcatgaatgaatctc

SEQ ID NO: 303651 - DNA, 16 bp, C. familiaris
agcatgagctggagga

SEQ ID NO: 303652 - DNA, 16 bp, C. familiaris
agcatgattttaaaaa

SEQ ID NO: 303653 - DNA, 16 bp, C. familiaris
agcatgctccctgctg

SEQ ID NO: 303654 - DNA, 16 bp, C. familiaris
agcatggcatctgctt

SEQ ID NO: 303655 - DNA, 16 bp, C. familiaris
agcatgggatccctgg

SEQ ID NO: 303656 - DNA, 16 bp, C. familiaris
agcatgtgattcctga

SEQ ID NO: 303657 - DNA, 16 bp, C. familiaris
agcatgtgtgtgcatg

SEQ ID NO: 303658 - DNA, 16 bp, C. familiaris
agcattaaaatattta

SEQ ID NO: 303659 - DNA, 16 bp, C. familiaris
agcattctgttcttaa

SEQ ID NO: 303660 - DNA, 16 bp, C. familiaris
agcatttactgtgtgc

SEQ ID NO: 303661 - DNA, 16 bp, C. familiaris
agcatttatttttaaa

SEQ ID NO: 303662 - DNA, 16 bp, C. familiaris
agcatttgaagaaaaa

SEQ ID NO: 303663 - DNA, 16 bp, C. familiaris
agcatttggctttgaa

SEQ ID NO: 303664 - DNA, 16 bp, C. familiaris
agcattttataatttt

SEQ ID NO: 303665 - DNA, 16 bp, C. familiaris
agcattttccacagag

SEQ ID NO: 303666 - DNA, 16 bp, C. familiaris
agcattttctatttct

SEQ ID NO: 303667 - DNA, 16 bp, C. familiaris
agcattttctcttgtg

SEQ ID NO: 303668 - DNA, 16 bp, C. familiaris
agcattttttaaagat

SEQ ID NO: 303669 - DNA, 16 bp, C. familiaris
agcattttttatagaa

SEQ ID NO: 303670 - DNA, 16 bp, C. familiaris
agccaaaaaagtggaa

SEQ ID NO: 303671 - DNA, 16 bp, C. familiaris
agccaaaaacaagagt

SEQ ID NO: 303672 - DNA, 16 bp, C. familiaris
agccaaaaagtgggaa

SEQ ID NO: 303673 - DNA, 16 bp, C. familiaris
agccaaaaatatttac

SEQ ID NO: 303674 - DNA, 16 bp, C. familiaris
agccaaaaccaagaat

SEQ ID NO: 303675 - DNA, 16 bp, C. familiaris
agccaaaacctggaaa

SEQ ID NO: 303676 - DNA, 16 bp, C. familiaris
agccaaaaggcagatg

SEQ ID NO: 303677 - DNA, 16 bp, C. familiaris
agccaaaatatagaaa

SEQ ID NO: 303678 - DNA, 16 bp, C. familiaris
agccaaaatcaaagag

SEQ ID NO: 303679 - DNA, 16 bp, C. familiaris
agccaaaatcaaggat

SEQ ID NO: 303680 - DNA, 16 bp, C. familiaris
agccaaaatgaagaat

SEQ ID NO: 303681 - DNA, 16 bp, C. familiaris
agccaaagacagactc

SEQ ID NO: 303682 - DNA, 16 bp, C. familiaris
agccaaagaggtgaaa

SEQ ID NO: 303683 - DNA, 16 bp, C. familiaris
agccaaaggaaatgaa

SEQ ID NO: 303684 - DNA, 16 bp, C. familiaris
agccaaaggcagaaag

SEQ ID NO: 303685 - DNA, 16 bp, C. familiaris
agccaaaggcagtgct

SEQ ID NO: 303686 - DNA, 16 bp, C. familiaris
agccaaaggccgacgc

SEQ ID NO: 303687 - DNA, 16 bp, C. familiaris
agccaacatcaagagt

SEQ ID NO: 303688 - DNA, 16 bp, C. familiaris
agccaagaatatacag

SEQ ID NO: 303689 - DNA, 16 bp, C. familiaris
agccaagacatagaag

SEQ ID NO: 303690 - DNA, 16 bp, C. familiaris
agccaagagtctgctt

SEQ ID NO: 303691 - DNA, 16 bp, C. familiaris
agccaagctatggaag

SEQ ID NO: 303692 - DNA, 16 bp, C. familiaris
agccaaggtggctcag

SEQ ID NO: 303693 - DNA, 16 bp, C. familiaris
agccaagtgccccaag

SEQ ID NO: 303694 - DNA, 16 bp, C. familiaris
agccaagttgacacaa

SEQ ID NO: 303695 - DNA, 16 bp, C. familiaris
agccaatgcagggctc

SEQ ID NO: 303696 - DNA, 16 bp, C. familiaris
agccacacaagtgccc

SEQ ID NO: 303697 - DNA, 16 bp, C. familiaris
agccacacagatgccc

SEQ ID NO: 303698 - DNA, 16 bp, C. familiaris
agccacacaggggccc

SEQ ID NO: 303699 - DNA, 16 bp, C. familiaris
agccacacaggtaccc

SEQ ID NO: 303700 - DNA, 16 bp, C. familiaris
agccacagagccaccc

SEQ ID NO: 303701 - DNA, 16 bp, C. familiaris
agccacagagtgggag

SEQ ID NO: 303702 - DNA, 16 bp, C. familiaris
agccacagattgggag

SEQ ID NO: 303703 - DNA, 16 bp, C. familiaris
agccacagccacagcc

SEQ ID NO: 303704 - DNA, 16 bp, C. familiaris
agccacagggctgccc

SEQ ID NO: 303705 - DNA, 16 bp, C. familiaris
agccacatgtggctgt

SEQ ID NO: 303706 - DNA, 16 bp, C. familiaris
agccaccagggcttcc

SEQ ID NO: 303707 - DNA, 16 bp, C. familiaris
agccacccagagaccc

SEQ ID NO: 303708 - DNA, 16 bp, C. familiaris
agccacccaggcgacc

SEQ ID NO: 303709 - DNA, 16 bp, C. familiaris
agccacccaggctccc

SEQ ID NO: 303710 - DNA, 16 bp, C. familiaris
agccacccagggaatc

SEQ ID NO: 303711 - DNA, 16 bp, C. familiaris
agccacccagggctcc

SEQ ID NO: 303712 - DNA, 16 bp, C. familiaris
agccacccagtgccct

SEQ ID NO: 303713 - DNA, 16 bp, C. familiaris
agccacccagttggtg

SEQ ID NO: 303714 - DNA, 16 bp, C. familiaris
agccacccgggctccc

SEQ ID NO: 303715 - DNA, 16 bp, C. familiaris
agccaccctggcatcc

SEQ ID NO: 303716 - DNA, 16 bp, C. familiaris
agccaccgaggcaccc

SEQ ID NO: 303717 - DNA, 16 bp, C. familiaris
agccaccgaggtgccc

SEQ ID NO: 303718 - DNA, 16 bp, C. familiaris
agccaccggagctgcc

SEQ ID NO: 303719 - DNA, 16 bp, C. familiaris
agccaccgggctgcct

SEQ ID NO: 303720 - DNA, 16 bp, C. familiaris
agccacctagagatcc

SEQ ID NO: 303721 - DNA, 16 bp, C. familiaris
agccacctaggcaacc

SEQ ID NO: 303722 - DNA, 16 bp, C. familiaris
agccacctgggccacc

SEQ ID NO: 303723 - DNA, 16 bp, C. familiaris
agccaccttcagccca

SEQ ID NO: 303724 - DNA, 16 bp, C. familiaris
agccaccttctccctc

SEQ ID NO: 303725 - DNA, 16 bp, C. familiaris
agccactcagagatcc

SEQ ID NO: 303726 - DNA, 16 bp, C. familiaris
agccactcagatgcct

SEQ ID NO: 303727 - DNA, 16 bp, C. familiaris
agccactcagccaccc

SEQ ID NO: 303728 - DNA, 16 bp, C. familiaris
agccactcaggggccc

SEQ ID NO: 303729 - DNA, 16 bp, C. familiaris
agccactctgggaaat

SEQ ID NO: 303730 - DNA, 16 bp, C. familiaris
agccactggggctgtc

SEQ ID NO: 303731 - DNA, 16 bp, C. familiaris
agccactttggaaaaa

SEQ ID NO: 303732 - DNA, 16 bp, C. familiaris
agccagaaagtggaaa

SEQ ID NO: 303733 - DNA, 16 bp, C. familiaris
agccagaaccacccag

SEQ ID NO: 303734 - DNA, 16 bp, C. familiaris
agccagaagacaatgg

SEQ ID NO: 303735 - DNA, 16 bp, C. familiaris
agccagactcagggct

SEQ ID NO: 303736 - DNA, 16 bp, C. familiaris
agccagagaaaggcaa

SEQ ID NO: 303737 - DNA, 16 bp, C. familiaris
agccagagccacccag

SEQ ID NO: 303738 - DNA, 16 bp, C. familiaris
agccagagccagagca

SEQ ID NO: 303739 - DNA, 16 bp, C. familiaris
agccagaggcagaagc

SEQ ID NO: 303740 - DNA, 16 bp, C. familiaris
agccagatgagggact

SEQ ID NO: 303741 - DNA, 16 bp, C. familiaris
agccagccagagaaag

SEQ ID NO: 303742 - DNA, 16 bp, C. familiaris
agccagccagccagcc

SEQ ID NO: 303743 - DNA, 16 bp, C. familiaris
agccagccaggcacca

SEQ ID NO: 303744 - DNA, 16 bp, C. familiaris
agccagccaggcaggc

SEQ ID NO: 303745 - DNA, 16 bp, C. familiaris
agccagccaggctccc

SEQ ID NO: 303746 - DNA, 16 bp, C. familiaris
agccagccaggctctc

SEQ ID NO: 303747 - DNA, 16 bp, C. familiaris
agccagccaggggccc

SEQ ID NO: 303748 - DNA, 16 bp, C. familiaris
agccagccaggtactc

SEQ ID NO: 303749 - DNA, 16 bp, C. familiaris
agccagcctggcaccc

SEQ ID NO: 303750 - DNA, 16 bp, C. familiaris
agccagcttgagattc

SEQ ID NO: 303751 - DNA, 16 bp, C. familiaris
agccaggagtctgctg

SEQ ID NO: 303752 - DNA, 16 bp, C. familiaris
agccaggcaccccatg

SEQ ID NO: 303753 - DNA, 16 bp, C. familiaris
agccaggcacccccag

SEQ ID NO: 303754 - DNA, 16 bp, C. familiaris
agccaggcacccctgc

SEQ ID NO: 303755 - DNA, 16 bp, C. familiaris
agccaggcgcccccac

SEQ ID NO: 303756 - DNA, 16 bp, C. familiaris
agccaggggaatatta

SEQ ID NO: 303757 - DNA, 16 bp, C. familiaris
agccagggtggcccag

SEQ ID NO: 303758 - DNA, 16 bp, C. familiaris
agccagggtgtgatcc

SEQ ID NO: 303759 - DNA, 16 bp, C. familiaris
agccaggtgcccctgg

SEQ ID NO: 303760 - DNA, 16 bp, C. familiaris
agccagtagccacatg

SEQ ID NO: 303761 - DNA, 16 bp, C. familiaris
agccagtcacagaaga

SEQ ID NO: 303762 - DNA, 16 bp, C. familiaris
agccagtcagatgccc

SEQ ID NO: 303763 - DNA, 16 bp, C. familiaris
agccagtcaggtgctc

SEQ ID NO: 303764 - DNA, 16 bp, C. familiaris
agccatagaaaagaat

SEQ ID NO: 303765 - DNA, 16 bp, C. familiaris
agccatagccacagcc

SEQ ID NO: 303766 - DNA, 16 bp, C. familiaris
agccatatatgaaaag

SEQ ID NO: 303767 - DNA, 16 bp, C. familiaris
agccatcaaaaaagaa

SEQ ID NO: 303768 - DNA, 16 bp, C. familiaris
agccatcacaaagaat

SEQ ID NO: 303769 - DNA, 16 bp, C. familiaris
agccatcagaagagac

SEQ ID NO: 303770 - DNA, 16 bp, C. familiaris
agccatccagccaccc

SEQ ID NO: 303771 - DNA, 16 bp, C. familiaris
agccatccaggtggcc

SEQ ID NO: 303772 - DNA, 16 bp, C. familiaris
agccatccccactgcc

SEQ ID NO: 303773 - DNA, 16 bp, C. familiaris
agccatctatgaacca

SEQ ID NO: 303774 - DNA, 16 bp, C. familiaris
agccatctggccctgg

SEQ ID NO: 303775 - DNA, 16 bp, C. familiaris
agccatctggctctgg

SEQ ID NO: 303776 - DNA, 16 bp, C. familiaris
agccatctgtaagcca

SEQ ID NO: 303777 - DNA, 16 bp, C. familiaris
agccatgcaggcatcc

SEQ ID NO: 303778 - DNA, 16 bp, C. familiaris
agccattaaggaaatg

SEQ ID NO: 303779 - DNA, 16 bp, C. familiaris
agccattgaaaagaat

SEQ ID NO: 303780 - DNA, 16 bp, C. familiaris
agccattgaagagttt

SEQ ID NO: 303781 - DNA, 16 bp, C. familiaris
agccattttctttttt

SEQ ID NO: 303782 - DNA, 16 bp, C. familiaris
agccattttggaagat

SEQ ID NO: 303783 - DNA, 16 bp, C. familiaris
agcccaaagtggagct

SEQ ID NO: 303784 - DNA, 16 bp, C. familiaris
agcccaacaaggggct

SEQ ID NO: 303785 - DNA, 16 bp, C. familiaris
agcccaatctgggact

SEQ ID NO: 303786 - DNA, 16 bp, C. familiaris
agcccagattcaaagg

SEQ ID NO: 303787 - DNA, 16 bp, C. familiaris
agcccagcatccagct

SEQ ID NO: 303788 - DNA, 16 bp, C. familiaris
agcccagcccagccag

SEQ ID NO: 303789 - DNA, 17 bp, C. familiaris
agcccagcccagcccag

SEQ ID NO: 303790 - DNA, 16 bp, C. familiaris
agcccagcccaggccc

SEQ ID NO: 303791 - DNA, 16 bp, C. familiaris
agcccagccctggaga

SEQ ID NO: 303792 - DNA, 16 bp, C. familiaris
agcccaggaagtgatc

SEQ ID NO: 303793 - DNA, 16 bp, C. familiaris
agcccaggaggctcag

SEQ ID NO: 303794 - DNA, 16 bp, C. familiaris
agcccaggcctggaga

SEQ ID NO: 303795 - DNA, 16 bp, C. familiaris
agcccagggagcccag

SEQ ID NO: 303796 - DNA, 16 bp, C. familiaris
agcccagggccagatg

SEQ ID NO: 303797 - DNA, 16 bp, C. familiaris
agcccagggcctcatc

SEQ ID NO: 303798 - DNA, 16 bp, C. familiaris
agcccagggcctgctc

SEQ ID NO: 303799 - DNA, 16 bp, C. familiaris
agcccaggtccctctg

SEQ ID NO: 303800 - DNA, 16 bp, C. familiaris
agcccaggtggtgcag

SEQ ID NO: 303801 - DNA, 16 bp, C. familiaris
agcccagtgaaaccca

SEQ ID NO: 303802 - DNA, 16 bp, C. familiaris
agcccagtgcccagca

SEQ ID NO: 303803 - DNA, 16 bp, C. familiaris
agcccagtggctcagc

SEQ ID NO: 303804 - DNA, 16 bp, C. familiaris
agcccagtgtgggatt

SEQ ID NO: 303805 - DNA, 16 bp, C. familiaris
agcccatcccccacct

SEQ ID NO: 303806 - DNA, 16 bp, C. familiaris
agcccattggtcagtt

SEQ ID NO: 303807 - DNA, 16 bp, C. familiaris
agccccacattgagct

SEQ ID NO: 303808 - DNA, 16 bp, C. familiaris
agccccacgtccagct

SEQ ID NO: 303809 - DNA, 16 bp, C. familiaris
agccccagcccccagg

SEQ ID NO: 303810 - DNA, 16 bp, C. familiaris
agccccagccctgccc

SEQ ID NO: 303811 - DNA, 16 bp, C. familiaris
agccccagcctcctcc

SEQ ID NO: 303812 - DNA, 16 bp, C. familiaris
agccccaggcagggct

SEQ ID NO: 303813 - DNA, 16 bp, C. familiaris
agccccaggcccccag

SEQ ID NO: 303814 - DNA, 16 bp, C. familiaris
agccccaggtggggct

SEQ ID NO: 303815 - DNA, 16 bp, C. familiaris
agccccagtcccagcc

SEQ ID NO: 303816 - DNA, 16 bp, C. familiaris
agccccatgcctggct

SEQ ID NO: 303817 - DNA, 16 bp, C. familiaris
agccccatgtggtact

SEQ ID NO: 303818 - DNA, 16 bp, C. familiaris
agccccattttataga

SEQ ID NO: 303819 - DNA, 16 bp, C. familiaris
agcccccagcccctgc

SEQ ID NO: 303820 - DNA, 16 bp, C. familiaris
agccccctgggcaccc

SEQ ID NO: 303821 - DNA, 16 bp, C. familiaris
agcccctccccttcct

SEQ ID NO: 303822 - DNA, 16 bp, C. familiaris
agcccctgcttctccc

SEQ ID NO: 303823 - DNA, 16 bp, C. familiaris
agcccctggatccagc

SEQ ID NO: 303824 - DNA, 16 bp, C. familiaris
agcccctggggctgcc

SEQ ID NO: 303825 - DNA, 16 bp, C. familiaris
agcccgaggcagatgc

SEQ ID NO: 303826 - DNA, 16 bp, C. familiaris
agcccgattcagggct

SEQ ID NO: 303827 - DNA, 16 bp, C. familiaris
agccctagcctcagca

SEQ ID NO: 303828 - DNA, 16 bp, C. familiaris
agccctatgctgggct

SEQ ID NO: 303829 - DNA, 16 bp, C. familiaris
agccctccaggtgact

SEQ ID NO: 303830 - DNA, 16 bp, C. familiaris
agccctgagtctggct

SEQ ID NO: 303831 - DNA, 16 bp, C. familiaris
agccctgcactgggtt

SEQ ID NO: 303832 - DNA, 16 bp, C. familiaris
agccctgcatcgagct

SEQ ID NO: 303833 - DNA, 16 bp, C. familiaris
agccctgccctcaggg

SEQ ID NO: 303834 - DNA, 16 bp, C. familiaris
agccctgccctctggg

SEQ ID NO: 303835 - DNA, 16 bp, C. familiaris
agccctgcctgtccct

SEQ ID NO: 303836 - DNA, 16 bp, C. familiaris
agccctgccttgggct

SEQ ID NO: 303837 - DNA, 16 bp, C. familiaris
agccctggaaagctcc

SEQ ID NO: 303838 - DNA, 16 bp, C. familiaris
agccctggccccagcc

SEQ ID NO: 303839 - DNA, 16 bp, C. familiaris
agccctgggggtgggg

SEQ ID NO: 303840 - DNA, 16 bp, C. familiaris
agccctttagggagct

SEQ ID NO: 303841 - DNA, 16 bp, C. familiaris
agccctttctgggcct

SEQ ID NO: 303842 - DNA, 16 bp, C. familiaris
agccgcagccccagcc

SEQ ID NO: 303843 - DNA, 16 bp, C. familiaris
agccgcctgggctgcc

SEQ ID NO: 303844 - DNA, 16 bp, C. familiaris
agccggagccggagcg

SEQ ID NO: 303845 - DNA, 16 bp, C. familiaris
agccggatgcggggct

SEQ ID NO: 303846 - DNA, 16 bp, C. familiaris
agccgggagcccgatg

SEQ ID NO: 303847 - DNA, 16 bp, C. familiaris
agccgggctgaggcca

SEQ ID NO: 303848 - DNA, 16 bp, C. familiaris
agccgggctgaggccg

SEQ ID NO: 303849 - DNA, 16 bp, C. familiaris
agcctactttaaaaat

SEQ ID NO: 303850 - DNA, 16 bp, C. familiaris
agcctatggaatggga

SEQ ID NO: 303851 - DNA, 16 bp, C. familiaris
agcctcaatgtccatc

SEQ ID NO: 303852 - DNA, 16 bp, C. familiaris
agcctcagccccagcc

SEQ ID NO: 303853 - DNA, 16 bp, C. familiaris
agcctcagtgtcctca

SEQ ID NO: 303854 - DNA, 16 bp, C. familiaris
agcctccacctcaaga

SEQ ID NO: 303855 - DNA, 16 bp, C. familiaris
agcctccaggacagga

SEQ ID NO: 303856 - DNA, 16 bp, C. familiaris
agcctccaggatcacg

SEQ ID NO: 303857 - DNA, 16 bp, C. familiaris
agcctcccagacaccc

SEQ ID NO: 303858 - DNA, 16 bp, C. familiaris
agcctcccagatgccc

SEQ ID NO: 303859 - DNA, 16 bp, C. familiaris
agcctcccaggtgcct

SEQ ID NO: 303860 - DNA, 16 bp, C. familiaris
agcctcctcctccctc

SEQ ID NO: 303861 - DNA, 16 bp, C. familiaris
agcctcctcctcctcc

SEQ ID NO: 303862 - DNA, 16 bp, C. familiaris
agcctccttctcctcc

SEQ ID NO: 303863 - DNA, 16 bp, C. familiaris
agcctctgagccaccc

SEQ ID NO: 303864 - DNA, 16 bp, C. familiaris
agcctctgcctccagc

SEQ ID NO: 303865 - DNA, 16 bp, C. familiaris
agcctctgcctctgtc

SEQ ID NO: 303866 - DNA, 16 bp, C. familiaris
agcctctgcctgtccc

SEQ ID NO: 303867 - DNA, 16 bp, C. familiaris
agcctctgccttcaac

SEQ ID NO: 303868 - DNA, 16 bp, C. familiaris
agcctctgcctttggc

SEQ ID NO: 303869 - DNA, 16 bp, C. familiaris
agcctgacaaggggct

SEQ ID NO: 303870 - DNA, 16 bp, C. familiaris
agcctgacatggagct

SEQ ID NO: 303871 - DNA, 16 bp, C. familiaris
agcctgaccaggggct

SEQ ID NO: 303872 - DNA, 16 bp, C. familiaris
agcctgactctgggcc

SEQ ID NO: 303873 - DNA, 16 bp, C. familiaris
agcctgagacagggct

SEQ ID NO: 303874 - DNA, 16 bp, C. familiaris
agcctgagatgggact

SEQ ID NO: 303875 - DNA, 16 bp, C. familiaris
agcctgagatgtgcct

SEQ ID NO: 303876 - DNA, 16 bp, C. familiaris
agcctgagccgaaggc

SEQ ID NO: 303877 - DNA, 16 bp, C. familiaris
agcctgatgaggaact

SEQ ID NO: 303878 - DNA, 16 bp, C. familiaris
agcctgatgctgggct

SEQ ID NO: 303879 - DNA, 16 bp, C. familiaris
agcctgatggggaact

SEQ ID NO: 303880 - DNA, 16 bp, C. familiaris
agcctgatgtgaggct

SEQ ID NO: 303881 - DNA, 16 bp, C. familiaris
agcctgattcagggct

SEQ ID NO: 303882 - DNA, 16 bp, C. familiaris
agcctgattctccctt

SEQ ID NO: 303883 - DNA, 16 bp, C. familiaris
agcctgcactgggctc

SEQ ID NO: 303884 - DNA, 16 bp, C. familiaris
agcctgccctctgcct

SEQ ID NO: 303885 - DNA, 16 bp, C. familiaris
agcctgcctctcccac

SEQ ID NO: 303886 - DNA, 16 bp, C. familiaris
agcctgcctctgccta

SEQ ID NO: 303887 - DNA, 16 bp, C. familiaris
agcctgccttcggccc

SEQ ID NO: 303888 - DNA, 16 bp, C. familiaris
agcctgctccctctgc

SEQ ID NO: 303889 - DNA, 16 bp, C. familiaris
agcctgctcctccccc

SEQ ID NO: 303890 - DNA, 16 bp, C. familiaris
agcctgctcctccttc

SEQ ID NO: 303891 - DNA, 16 bp, C. familiaris
agcctgctgcttctcc

SEQ ID NO: 303892 - DNA, 16 bp, C. familiaris
agcctgcttcttctcc

SEQ ID NO: 303893 - DNA, 16 bp, C. familiaris
agcctgcttgagattc

SEQ ID NO: 303894 - DNA, 16 bp, C. familiaris
agcctgcttgggagtc

SEQ ID NO: 303895 - DNA, 16 bp, C. familiaris
agcctgctttcccctc

SEQ ID NO: 303896 - DNA, 16 bp, C. familiaris
agcctgctttcttcct

SEQ ID NO: 303897 - DNA, 16 bp, C. familiaris
agcctgcttttccctc

SEQ ID NO: 303898 - DNA, 16 bp, C. familiaris
agcctggagacctggg

SEQ ID NO: 303899 - DNA, 16 bp, C. familiaris
agcctggaggaggggc

SEQ ID NO: 303900 - DNA, 16 bp, C. familiaris
agcctggatgacagca

SEQ ID NO: 303901 - DNA, 16 bp, C. familiaris
agcctggcatggggct

SEQ ID NO: 303902 - DNA, 16 bp, C. familiaris
agcctggcttggggct

SEQ ID NO: 303903 - DNA, 16 bp, C. familiaris
agcctgggatccctgg

SEQ ID NO: 303904 - DNA, 16 bp, C. familiaris
agcctggggcacaggg

SEQ ID NO: 303905 - DNA, 16 bp, C. familiaris
agcctggggtcctggg

SEQ ID NO: 303906 - DNA, 16 bp, C. familiaris
agcctggtgcaggact

SEQ ID NO: 303907 - DNA, 16 bp, C. familiaris
agcctggtggctcagc

SEQ ID NO: 303908 - DNA, 16 bp, C. familiaris
agcctggttctccttc

SEQ ID NO: 303909 - DNA, 16 bp, C. familiaris
agcctgttgcgggact

SEQ ID NO: 303910 - DNA, 16 bp, C. familiaris
agccttccagctgttc

SEQ ID NO: 303911 - DNA, 16 bp, C. familiaris
agccttcctggaggag

SEQ ID NO: 303912 - DNA, 16 bp, C. familiaris
agccttctgttggaag

SEQ ID NO: 303913 - DNA, 16 bp, C. familiaris
agccttcttctctctc

SEQ ID NO: 303914 - DNA, 16 bp, C. familiaris
agccttggtggcccag

SEQ ID NO: 303915 - DNA, 16 bp, C. familiaris
agcctttaaaaaggaa

SEQ ID NO: 303916 - DNA, 16 bp, C. familiaris
agcctttgctttggct

SEQ ID NO: 303917 - DNA, 16 bp, C. familiaris
agcgaaaggcagatgc

SEQ ID NO: 303918 - DNA, 16 bp, C. familiaris
agcgagaagcaggccc

SEQ ID NO: 303919 - DNA, 16 bp, C. familiaris
agcgagagggagaagc

SEQ ID NO: 303920 - DNA, 16 bp, C. familiaris
agcgaggcagagacat

SEQ ID NO: 303921 - DNA, 16 bp, C. familiaris
agcgccacctgcagct

SEQ ID NO: 303922 - DNA, 16 bp, C. familiaris
agcgccaccttcagct

SEQ ID NO: 303923 - DNA, 16 bp, C. familiaris
agcgccaccttccgcc

SEQ ID NO: 303924 - DNA, 16 bp, C. familiaris
agcgccgcctgcaacc

SEQ ID NO: 303925 - DNA, 16 bp, C. familiaris
agcgcctcctgcagcc

SEQ ID NO: 303926 - DNA, 16 bp, C. familiaris
agcgcctgcctgcagc

SEQ ID NO: 303927 - DNA, 16 bp, C. familiaris
agcgcctgccttctgc

SEQ ID NO: 303928 - DNA, 16 bp, C. familiaris
agcgcggcctgcagcc

SEQ ID NO: 303929 - DNA, 16 bp, C. familiaris
agcgctgcctgcagct

SEQ ID NO: 303930 - DNA, 16 bp, C. familiaris
agcgctgccttcaccc

SEQ ID NO: 303931 - DNA, 16 bp, C. familiaris
agcggcagcggcagcg

SEQ ID NO: 303932 - DNA, 16 bp, C. familiaris
agcggcaggcagaggc

SEQ ID NO: 303933 - DNA, 16 bp, C. familiaris
agcggcggcagcagca

SEQ ID NO: 303934 - DNA, 16 bp, C. familiaris
agcgggagcgggagcc

SEQ ID NO: 303935 - DNA, 16 bp, C. familiaris
agcgggatccctgggt

SEQ ID NO: 303936 - DNA, 16 bp, C. familiaris
agcgggctccctgtgg

SEQ ID NO: 303937 - DNA, 16 bp, C. familiaris
agcgtcgcctgcagcc

SEQ ID NO: 303938 - DNA, 16 bp, C. familiaris
agcgtctgcctacagc

SEQ ID NO: 303939 - DNA, 16 bp, C. familiaris
agctaaaaggagaaat

SEQ ID NO: 303940 - DNA, 16 bp, C. familiaris
agctaagaatgttttt

SEQ ID NO: 303941 - DNA, 16 bp, C. familiaris
agctactgctggctct

SEQ ID NO: 303942 - DNA, 24 bp, C. familiaris
agctactggtggctctagaaaaaa

SEQ ID NO: 303943 - DNA, 16 bp, C. familiaris
agctagaaaaggaaca

SEQ ID NO: 303944 - DNA, 16 bp, C. familiaris
agctagagaaagacaa

SEQ ID NO: 303945 - DNA, 16 bp, C. familiaris
agctagagacccagga

SEQ ID NO: 303946 - DNA, 16 bp, C. familiaris
agctatcaagtcatga

SEQ ID NO: 303947 - DNA, 16 bp, C. familiaris
agctatcagaaagaga

SEQ ID NO: 303948 - DNA, 16 bp, C. familiaris
agctatttacccaaag

SEQ ID NO: 303949 - DNA, 16 bp, C. familiaris
agctattttattattt

SEQ ID NO: 303950 - DNA, 16 bp, C. familiaris
agctcaactctcagaa

SEQ ID NO: 303951 - DNA, 16 bp, C. familiaris
agctcaagcaggggga

SEQ ID NO: 303952 - DNA, 16 bp, C. familiaris
agctcaatgcccttga

SEQ ID NO: 303953 - DNA, 16 bp, C. familiaris
agctcagagcctgatc

SEQ ID NO: 303954 - DNA, 16 bp, C. familiaris
agctcagagtctactt

SEQ ID NO: 303955 - DNA, 16 bp, C. familiaris
agctcaggcagcagct

SEQ ID NO: 303956 - DNA, 16 bp, C. familiaris
agctcagggtcctggg

SEQ ID NO: 303957 - DNA, 16 bp, C. familiaris
agctcatgttctctct

SEQ ID NO: 303958 - DNA, 16 bp, C. familiaris
agctccaaccacatca

SEQ ID NO: 303959 - DNA, 16 bp, C. familiaris
agctccagctgccttc

SEQ ID NO: 303960 - DNA, 16 bp, C. familiaris
agctccaggagggcag

SEQ ID NO: 303961 - DNA, 16 bp, C. familiaris
agctccatccatgtca

SEQ ID NO: 303962 - DNA, 16 bp, C. familiaris
agctccatccatgtct

SEQ ID NO: 303963 - DNA, 16 bp, C. familiaris
agctccatctacatca

SEQ ID NO: 303964 - DNA, 16 bp, C. familiaris
agctccatgaagggag

SEQ ID NO: 303965 - DNA, 16 bp, C. familiaris
agctcccagcatggag

SEQ ID NO: 303966 - DNA, 16 bp, C. familiaris
agctccctgaaggcag

SEQ ID NO: 303967 - DNA, 16 bp, C. familiaris
agctccctgctcagtg

SEQ ID NO: 303968 - DNA, 16 bp, C. familiaris
agctccgtgctcagca

SEQ ID NO: 303969 - DNA, 16 bp, C. familiaris
agctcctccctctgcc

SEQ ID NO: 303970 - DNA, 16 bp, C. familiaris
agctcctcctcctcct

SEQ ID NO: 303971 - DNA, 16 bp, C. familiaris
agctcctgagggcagg

SEQ ID NO: 303972 - DNA, 16 bp, C. familiaris
agctcctgcttctccg

SEQ ID NO: 303973 - DNA, 16 bp, C. familiaris
agctcctttaggtgtg

SEQ ID NO: 303974 - DNA, 16 bp, C. familiaris
agctctggtttctttt

SEQ ID NO: 303975 - DNA, 16 bp, C. familiaris
agctctgtgaaggcag

SEQ ID NO: 303976 - DNA, 16 bp, C. familiaris
agctctgtgactttgg

SEQ ID NO: 303977 - DNA, 16 bp, C. familiaris
agctctgtggaaaatg

SEQ ID NO: 303978 - DNA, 16 bp, C. familiaris
agctctttacatattc

SEQ ID NO: 303979 - DNA, 16 bp, C. familiaris
agctctttgaggacaa

SEQ ID NO: 303980 - DNA, 16 bp, C. familiaris
agctgaaaagaagaaa

SEQ ID NO: 303981 - DNA, 16 bp, C. familiaris
agctgaaaagtacaat

SEQ ID NO: 303982 - DNA, 16 bp, C. familiaris
agctgaaataaaaagt

SEQ ID NO: 303983 - DNA, 16 bp, C. familiaris
agctgaacaaaagaga

SEQ ID NO: 303984 - DNA, 16 bp, C. familiaris
agctgaagcccagaga

SEQ ID NO: 303985 - DNA, 16 bp, C. familiaris
agctgaaggaagacgc

SEQ ID NO: 303986 - DNA, 16 bp, C. familiaris
agctgaaggcagcact

SEQ ID NO: 303987 - DNA, 16 bp, C. familiaris
agctgaaggccgacgc

SEQ ID NO: 303988 - DNA, 16 bp, C. familiaris
agctgaagggagacgc

SEQ ID NO: 303989 - DNA, 21 bp, C. familiaris
agctgaaggggctcgggcggc

SEQ ID NO: 303990 - DNA, 16 bp, C. familiaris
agctgaaggtggacac

SEQ ID NO: 303991 - DNA, 16 bp, C. familiaris
agctgaagtcaggagt

SEQ ID NO: 303992 - DNA, 16 bp, C. familiaris
agctgacagccaagaa

SEQ ID NO: 303993 - DNA, 16 bp, C. familiaris
agctgactctctgctg

SEQ ID NO: 303994 - DNA, 16 bp, C. familiaris
agctgagcacatcagc

SEQ ID NO: 303995 - DNA, 21 bp, C. familiaris
agctgagcagatcagcggccc

SEQ ID NO: 303996 - DNA, 16 bp, C. familiaris
agctgagcgtggagcc

SEQ ID NO: 303997 - DNA, 16 bp, C. familiaris
agctgagggagttcat

SEQ ID NO: 303998 - DNA, 16 bp, C. familiaris
agctgagggcaggtgc

SEQ ID NO: 303999 - DNA, 16 bp, C. familiaris
agctgcaccagtttgc

SEQ ID NO: 304000 - DNA, 16 bp, C. familiaris
agctgcagagaaagca

SEQ ID NO: 304001 - DNA, 16 bp, C. familiaris
agctgcagagggaaag

SEQ ID NO: 304002 - DNA, 16 bp, C. familiaris
agctgcagcaacttct

SEQ ID NO: 304003 - DNA, 16 bp, C. familiaris
agctgcaggcggcgct

SEQ ID NO: 304004 - DNA, 16 bp, C. familiaris
agctgcccaggctgcc

SEQ ID NO: 304005 - DNA, 16 bp, C. familiaris
agctgcccagtctgtg

SEQ ID NO: 304006 - DNA, 16 bp, C. familiaris
agctgcccccgagccc

SEQ ID NO: 304007 - DNA, 18 bp, C. familiaris
agctgccctacgacccag

SEQ ID NO: 304008 - DNA, 16 bp, C. familiaris
agctgctcccagggcc

SEQ ID NO: 304009 - DNA, 16 bp, C. familiaris
agctgctcccgggccc

SEQ ID NO: 304010 - DNA, 16 bp, C. familiaris
agctgctccgggtccc

SEQ ID NO: 304011 - DNA, 16 bp, C. familiaris
agctgctccgggtcct

SEQ ID NO: 304012 - DNA, 16 bp, C. familiaris
agctgctcctggagcc

SEQ ID NO: 304013 - DNA, 16 bp, C. familiaris
agctgctcctggtccc

SEQ ID NO: 304014 - DNA, 17 bp, C. familiaris
agctgctctgccccctg

SEQ ID NO: 304015 - DNA, 16 bp, C. familiaris
agctgctctgtcccct

SEQ ID NO: 304016 - DNA, 16 bp, C. familiaris
agctgctcttcctgcc

SEQ ID NO: 304017 - DNA, 16 bp, C. familiaris
agctgctgcagccact

SEQ ID NO: 304018 - DNA, 16 bp, C. familiaris
agctgctgcctgagct

SEQ ID NO: 304019 - DNA, 16 bp, C. familiaris
agctgctgctgctgct

SEQ ID NO: 304020 - DNA, 16 bp, C. familiaris
agctgctggtggctct

SEQ ID NO: 304021 - DNA, 16 bp, C. familiaris
agctgcttctccttct

SEQ ID NO: 304022 - DNA, 16 bp, C. familiaris
agctgctttaaaaaat

SEQ ID NO: 304023 - DNA, 16 bp, C. familiaris
agctggaaaaagaaaa

SEQ ID NO: 304024 - DNA, 16 bp, C. familiaris
agctggaagaacaagg

SEQ ID NO: 304025 - DNA, 16 bp, C. familiaris
agctggaagagacaag

SEQ ID NO: 304026 - DNA, 16 bp, C. familiaris
agctggaaggcagacg

SEQ ID NO: 304027 - DNA, 16 bp, C. familiaris
agctggagaaaaaaga

SEQ ID NO: 304028 - DNA, 16 bp, C. familiaris
agctggagagggagaa

SEQ ID NO: 304029 - DNA, 16 bp, C. familiaris
agctggaggcagacac

SEQ ID NO: 304030 - DNA, 16 bp, C. familiaris
agctggaggcagatac

SEQ ID NO: 304031 - DNA, 16 bp, C. familiaris
agctggatgtggaact

SEQ ID NO: 304032 - DNA, 16 bp, C. familiaris
agctggcaaaggagaa

SEQ ID NO: 304033 - DNA, 16 bp, C. familiaris
agctggcaggtggcag

SEQ ID NO: 304034 - DNA, 16 bp, C. familiaris
agctggcctgcctggg

SEQ ID NO: 304035 - DNA, 16 bp, C. familiaris
agctggccttctgggg

SEQ ID NO: 304036 - DNA, 16 bp, C. familiaris
agctgggcagccccgg

SEQ ID NO: 304037 - DNA, 16 bp, C. familiaris
agctgggcttgaaaga

SEQ ID NO: 304038 - DNA, 16 bp, C. familiaris
agctggggacatcaca

SEQ ID NO: 304039 - DNA, 16 bp, C. familiaris
agctggggaggagcag

SEQ ID NO: 304040 - DNA, 16 bp, C. familiaris
agctggggaggcaggg

SEQ ID NO: 304041 - DNA, 16 bp, C. familiaris
agctggggcaggagct

SEQ ID NO: 304042 - DNA, 16 bp, C. familiaris
agctgggggagtggca

SEQ ID NO: 304043 - DNA, 16 bp, C. familiaris
agctgggtggccttgg

SEQ ID NO: 304044 - DNA, 16 bp, C. familiaris
agctggtcttctgggg

SEQ ID NO: 304045 - DNA, 16 bp, C. familiaris
agctggtgtctgagaa

SEQ ID NO: 304046 - DNA, 16 bp, C. familiaris
agctgtcctgccaggg

SEQ ID NO: 304047 - DNA, 16 bp, C. familiaris
agctgtggttctcaaa

SEQ ID NO: 304048 - DNA, 16 bp, C. familiaris
agctgtggttttcttt

SEQ ID NO: 304049 - DNA, 16 bp, C. familiaris
agctgtgtgactttgg

SEQ ID NO: 304050 - DNA, 16 bp, C. familiaris
agctgtgtgattttgg

SEQ ID NO: 304051 - DNA, 16 bp, C. familiaris
agctgtttcttttctt

SEQ ID NO: 304052 - DNA, 16 bp, C. familiaris
agctgtttgtcctgtg

SEQ ID NO: 304053 - DNA, 16 bp, C. familiaris
agctgttttcttcctg

SEQ ID NO: 304054 - DNA, 16 bp, C. familiaris
agcttaataaatattt

SEQ ID NO: 304055 - DNA, 16 bp, C. familiaris
agcttcaagtttctca

SEQ ID NO: 304056 - DNA, 16 bp, C. familiaris
agcttcatggaggagg

SEQ ID NO: 304057 - DNA, 16 bp, C. familiaris
agcttccagaaggaaa

SEQ ID NO: 304058 - DNA, 16 bp, C. familiaris
agcttccaggttgatg

SEQ ID NO: 304059 - DNA, 16 bp, C. familiaris
agcttcctgagggcag

SEQ ID NO: 304060 - DNA, 16 bp, C. familiaris
agcttcttttgaaaaa

SEQ ID NO: 304061 - DNA, 16 bp, C. familiaris
agcttgcagacagcag

SEQ ID NO: 304062 - DNA, 16 bp, C. familiaris
agcttgcttctctctc

SEQ ID NO: 304063 - DNA, 16 bp, C. familiaris
agcttggaagtcacca

SEQ ID NO: 304064 - DNA, 16 bp, C. familiaris
agcttggaattttcag

SEQ ID NO: 304065 - DNA, 16 bp, C. familiaris
agcttgtcttttcatc

SEQ ID NO: 304066 - DNA, 16 bp, C. familiaris
agcttgttgctccaga

SEQ ID NO: 304067 - DNA, 89 bp, C. familiaris
agctttaaatgatacactggaccagatggatttcacagatatctacagaactttacatccaaactcaactgaatacacattcttctcaa

SEQ ID NO: 304068 - DNA, 16 bp, C. familiaris
agctttattaaaatat

SEQ ID NO: 304069 - DNA, 16 bp, C. familiaris
agctttatttttaaaa

SEQ ID NO: 304070 - DNA, 16 bp, C. familiaris
agctttcattcttttt

SEQ ID NO: 304071 - DNA, 16 bp, C. familiaris
agctttcttttccttt

SEQ ID NO: 304072 - DNA, 16 bp, C. familiaris
agctttcttttcttgt

SEQ ID NO: 304073 - DNA, 16 bp, C. familiaris
agctttctttttaaaa

SEQ ID NO: 304074 - DNA, 16 bp, C. familiaris
agctttgcttttattt

SEQ ID NO: 304075 - DNA, 16 bp, C. familiaris
agctttgtgactttgg

SEQ ID NO: 304076 - DNA, 16 bp, C. familiaris
agcttttaaaaatttt

SEQ ID NO: 304077 - DNA, 16 bp, C. familiaris
agcttttattttcagg

SEQ ID NO: 304078 - DNA, 16 bp, C. familiaris
agcttttgtatttgag

SEQ ID NO: 304079 - DNA, 16 bp, C. familiaris
agcttttgttgaattt

SEQ ID NO: 304080 - DNA, 16 bp, C. familiaris
aggaaaaaaatgacat

SEQ ID NO: 304081 - DNA, 16 bp, C. familiaris
aggaaaaaatctgcag

SEQ ID NO: 304082 - DNA, 16 bp, C. familiaris
aggaaaaactgcagaa

SEQ ID NO: 304083 - DNA, 16 bp, C. familiaris
aggaaaaagaaatcca

SEQ ID NO: 304084 - DNA, 16 bp, C. familiaris
aggaaaaagacagtct

SEQ ID NO: 304085 - DNA, 16 bp, C. familiaris
aggaaaaagcataaag

SEQ ID NO: 304086 - DNA, 16 bp, C. familiaris
aggaaaaatacttttt

SEQ ID NO: 304087 - DNA, 16 bp, C. familiaris
aggaaaaatattttca

SEQ ID NO: 304088 - DNA, 16 bp, C. familiaris
aggaaaaatcttaaaa

SEQ ID NO: 304089 - DNA, 16 bp, C. familiaris
aggaaaaattcttgaa

SEQ ID NO: 304090 - DNA, 16 bp, C. familiaris
aggaaaacagaaaagt

SEQ ID NO: 304091 - DNA, 16 bp, C. familiaris
aggaaaacaggaaaat

SEQ ID NO: 304092 - DNA, 16 bp, C. familiaris
aggaaaacatgaaaat

SEQ ID NO: 304093 - DNA, 16 bp, C. familiaris
aggaaaaccaggagag

SEQ ID NO: 304094 - DNA, 16 bp, C. familiaris
aggaaaacctcacttc

SEQ ID NO: 304095 - DNA, 16 bp, C. familiaris
aggaaaactgaatggg

SEQ ID NO: 304096 - DNA, 16 bp, C. familiaris
aggaaaagaaaatcca

SEQ ID NO: 304097 - DNA, 16 bp, C. familiaris
aggaaaagaaaattca

SEQ ID NO: 304098 - DNA, 16 bp, C. familiaris
aggaaaagaaattctg

SEQ ID NO: 304099 - DNA, 16 bp, C. familiaris
aggaaaagaatctcaa

SEQ ID NO: 304100 - DNA, 16 bp, C. familiaris
aggaaaagattttaaa

SEQ ID NO: 304101 - DNA, 16 bp, C. familiaris
aggaaaaggaactctt

SEQ ID NO: 304102 - DNA, 16 bp, C. familiaris
aggaaaatacaaatat

SEQ ID NO: 304103 - DNA, 16 bp, C. familiaris
aggaaaatatttttca

SEQ ID NO: 304104 - DNA, 16 bp, C. familiaris
aggaaaatgatgaaat

SEQ ID NO: 304105 - DNA, 16 bp, C. familiaris
aggaaacaaaatcagt

SEQ ID NO: 304106 - DNA, 16 bp, C. familiaris
aggaaacaaaatggaa

SEQ ID NO: 304107 - DNA, 19 bp, C. familiaris
aggaaacaaagcttagcag

SEQ ID NO: 304108 - DNA, 16 bp, C. familiaris
aggaaacaacagatat

SEQ ID NO: 304109 - DNA, 16 bp, C. familiaris
aggaaacagaaatcaa

SEQ ID NO: 304110 - DNA, 16 bp, C. familiaris
aggaaacagaaattca

SEQ ID NO: 304111 - DNA, 16 bp, C. familiaris
aggaaacagatggcac

SEQ ID NO: 304112 - DNA, 16 bp, C. familiaris
aggaaacattcctcag

SEQ ID NO: 304113 - DNA, 16 bp, C. familiaris
aggaaactgaaaaaca

SEQ ID NO: 304114 - DNA, 16 bp, C. familiaris
aggaaactgaggatca

SEQ ID NO: 304115 - DNA, 16 bp, C. familiaris
aggaaacttcctcaac

SEQ ID NO: 304116 - DNA, 16 bp, C. familiaris
aggaaagaaaaaagct

SEQ ID NO: 304117 - DNA, 16 bp, C. familiaris
aggaaagaaaaatttt

SEQ ID NO: 304118 - DNA, 16 bp, C. familiaris
aggaaagtccatggta

SEQ ID NO: 304119 - DNA, 16 bp, C. familiaris
aggaaataaatttctg

SEQ ID NO: 304120 - DNA, 16 bp, C. familiaris
aggaaataacaaatat

SEQ ID NO: 304121 - DNA, 16 bp, C. familiaris
aggaaatatacaagat

SEQ ID NO: 304122 - DNA, 16 bp, C. familiaris
aggaaatatagtcaat

SEQ ID NO: 304123 - DNA, 16 bp, C. familiaris
aggaaatatattattt

SEQ ID NO: 304124 - DNA, 16 bp, C. familiaris
aggaaatcagaaaaca

SEQ ID NO: 304125 - DNA, 16 bp, C. familiaris
aggaaatgaaaacatg

SEQ ID NO: 304126 - DNA, 16 bp, C. familiaris
aggaaatgaaaacatt

SEQ ID NO: 304127 - DNA, 16 bp, C. familiaris
aggaaatgaaatcatt

SEQ ID NO: 304128 - DNA, 16 bp, C. familiaris
aggaaatgaatatttt

SEQ ID NO: 304129 - DNA, 16 bp, C. familiaris
aggaaattgaacaaaa

SEQ ID NO: 304130 - DNA, 16 bp, C. familiaris
aggaaattgaagctca

SEQ ID NO: 304131 - DNA, 16 bp, C. familiaris
aggaaattgaggctca

SEQ ID NO: 304132 - DNA, 16 bp, C. familiaris
aggaacaacagtggca

SEQ ID NO: 304133 - DNA, 16 bp, C. familiaris
aggaacagaagaaata

SEQ ID NO: 304134 - DNA, 16 bp, C. familiaris
aggaacagcaggtgca

SEQ ID NO: 304135 - DNA, 16 bp, C. familiaris
aggaaccaaggctcag

SEQ ID NO: 304136 - DNA, 16 bp, C. familiaris
aggaacctaaccctgt

SEQ ID NO: 304137 - DNA, 16 bp, C. familiaris
aggaacctgagatcat

SEQ ID NO: 304138 - DNA, 16 bp, C. familiaris
aggaactagagaaaga

SEQ ID NO: 304139 - DNA, 16 bp, C. familiaris
aggaactgccaaattg

SEQ ID NO: 304140 - DNA, 16 bp, C. familiaris
aggaactgccacactg

SEQ ID NO: 304141 - DNA, 16 bp, C. familiaris
aggaacttgcccaaag

SEQ ID NO: 304142 - DNA, 16 bp, C. familiaris
aggaactttaaaaatc

SEQ ID NO: 304143 - DNA, 16 bp, C. familiaris
aggaagaaatagaaca

SEQ ID NO: 304144 - DNA, 16 bp, C. familiaris
aggaagaaatcaaact

SEQ ID NO: 304145 - DNA, 16 bp, C. familiaris
aggaagaacagcaaat

SEQ ID NO: 304146 - DNA, 16 bp, C. familiaris
aggaagaagcagagtc

SEQ ID NO: 304147 - DNA, 16 bp, C. familiaris
aggaagaaggaggctc

SEQ ID NO: 304148 - DNA, 16 bp, C. familiaris
aggaagaagttaaact

SEQ ID NO: 304149 - DNA, 16 bp, C. familiaris
aggaagaattttctct

SEQ ID NO: 304150 - DNA, 16 bp, C. familiaris
aggaagagaaatcaag

SEQ ID NO: 304151 - DNA, 16 bp, C. familiaris
aggaagagaatcttca

SEQ ID NO: 304152 - DNA, 16 bp, C. familiaris
aggaagagagtcctca

SEQ ID NO: 304153 - DNA, 16 bp, C. familiaris
aggaagagcaagttct

SEQ ID NO: 304154 - DNA, 16 bp, C. familiaris
aggaagaggctccatg

SEQ ID NO: 304155 - DNA, 16 bp, C. familiaris
aggaagaggctccgcg

SEQ ID NO: 304156 - DNA, 16 bp, C. familiaris
aggaagaggctggagg

SEQ ID NO: 304157 - DNA, 16 bp, C. familiaris
aggaagcaaatgaaaa

SEQ ID NO: 304158 - DNA, 16 bp, C. familiaris
aggaagcagcagcagc

SEQ ID NO: 304159 - DNA, 16 bp, C. familiaris
aggaagcaggaagcag

SEQ ID NO: 304160 - DNA, 16 bp, C. familiaris
aggaagcccaaagaaa

SEQ ID NO: 304161 - DNA, 16 bp, C. familiaris
aggaagcctgatgtag

SEQ ID NO: 304162 - DNA, 16 bp, C. familiaris
aggaagctcccaactg

SEQ ID NO: 304163 - DNA, 16 bp, C. familiaris
aggaagctgagaaaaa

SEQ ID NO: 304164 - DNA, 16 bp, C. familiaris
aggaagctgaggagaa

SEQ ID NO: 304165 - DNA, 16 bp, C. familiaris
aggaaggaaattctgg

SEQ ID NO: 304166 - DNA, 16 bp, C. familiaris
aggaaggaggctgagg

SEQ ID NO: 304167 - DNA, 16 bp, C. familiaris
aggaaggctgatgtgg

SEQ ID NO: 304168 - DNA, 16 bp, C. familiaris
aggaaggcttctctga

SEQ ID NO: 304169 - DNA, 16 bp, C. familiaris
aggaagggaaacaggc

SEQ ID NO: 304170 - DNA, 16 bp, C. familiaris
aggaagtaaggaagta

SEQ ID NO: 304171 - DNA, 16 bp, C. familiaris
aggaagtctgatgcag

SEQ ID NO: 304172 - DNA, 16 bp, C. familiaris
aggaagtgaaggctaa

SEQ ID NO: 304173 - DNA, 16 bp, C. familiaris
aggaagtggtggtgga

SEQ ID NO: 304174 - DNA, 16 bp, C. familiaris
aggaatctgagatcat

SEQ ID NO: 304175 - DNA, 16 bp, C. familiaris
aggaatgcagccctgc

SEQ ID NO: 304176 - DNA, 16 bp, C. familiaris
aggaatggaatttctg

SEQ ID NO: 304177 - DNA, 16 bp, C. familiaris
aggaatggctgattat

SEQ ID NO: 304178 - DNA, 16 bp, C. familiaris
aggaattccagtacta

SEQ ID NO: 304179 - DNA, 16 bp, C. familiaris
aggaattctttctttt

SEQ ID NO: 304180 - DNA, 16 bp, C. familiaris
aggaattggttcatgt

SEQ ID NO: 304181 - DNA, 16 bp, C. familiaris
aggaatttaacaaaaa

SEQ ID NO: 304182 - DNA, 16 bp, C. familiaris
aggaatttatacattt

SEQ ID NO: 304183 - DNA, 16 bp, C. familiaris
aggaatttggaagaaa

SEQ ID NO: 304184 - DNA, 16 bp, C. familiaris
aggaattttataattt

SEQ ID NO: 304185 - DNA, 16 bp, C. familiaris
aggaatttttaaagaa

SEQ ID NO: 304186 - DNA, 16 bp, C. familiaris
aggaatttttttaaaa

SEQ ID NO: 304187 - DNA, 16 bp, C. familiaris
aggacacagagggaag

SEQ ID NO: 304188 - DNA, 16 bp, C. familiaris
aggacacaggcaacac

SEQ ID NO: 304189 - DNA, 16 bp, C. familiaris
aggacaccatcaagaa

SEQ ID NO: 304190 - DNA, 16 bp, C. familiaris
aggacacctccagcct

SEQ ID NO: 304191 - DNA, 16 bp, C. familiaris
aggacactataagaaa

SEQ ID NO: 304192 - DNA, 16 bp, C. familiaris
aggacagaagcagaga

SEQ ID NO: 304193 - DNA, 16 bp, C. familiaris
aggacagagcctggca

SEQ ID NO: 304194 - DNA, 16 bp, C. familiaris
aggacagcagaggaga

SEQ ID NO: 304195 - DNA, 16 bp, C. familiaris
aggacagcccccacca

SEQ ID NO: 304196 - DNA, 16 bp, C. familiaris
aggacagtgaaaatac

SEQ ID NO: 304197 - DNA, 17 bp, C. familiaris
aggacagtgaggacgct

SEQ ID NO: 304198 - DNA, 16 bp, C. familiaris
aggacatccttgcctt

SEQ ID NO: 304199 - DNA, 16 bp, C. familiaris
aggacatctgggtggc

SEQ ID NO: 304200 - DNA, 16 bp, C. familiaris
aggacatgaacagaca

SEQ ID NO: 304201 - DNA, 16 bp, C. familiaris
aggacatgaagagaaa

SEQ ID NO: 304202 - DNA, 16 bp, C. familiaris
aggacatgatcctgag

SEQ ID NO: 304203 - DNA, 16 bp, C. familiaris
aggacattctgacaca

SEQ ID NO: 304204 - DNA, 16 bp, C. familiaris
aggaccaggagcagga

SEQ ID NO: 304205 - DNA, 16 bp, C. familiaris
aggaccaggccctgga

SEQ ID NO: 304206 - DNA, 16 bp, C. familiaris
aggacccagcaattcc

SEQ ID NO: 304207 - DNA, 16 bp, C. familiaris
aggacccaggacccca

SEQ ID NO: 304208 - DNA, 16 bp, C. familiaris
aggacccagggatcat

SEQ ID NO: 304209 - DNA, 16 bp, C. familiaris
aggaccccagccagga

SEQ ID NO: 304210 - DNA, 16 bp, C. familiaris
aggaccccaggttcac

SEQ ID NO: 304211 - DNA, 16 bp, C. familiaris
aggacccccaggatca

SEQ ID NO: 304212 - DNA, 16 bp, C. familiaris
aggaccccgacgtggg

SEQ ID NO: 304213 - DNA, 16 bp, C. familiaris
aggacccctactcctc

SEQ ID NO: 304214 - DNA, 16 bp, C. familiaris
aggaccctgaaattat

SEQ ID NO: 304215 - DNA, 16 bp, C. familiaris
aggaccctgagaccag

SEQ ID NO: 304216 - DNA, 16 bp, C. familiaris
aggaccctgagaccct

SEQ ID NO: 304217 - DNA, 16 bp, C. familiaris
aggaccctgagatcat

SEQ ID NO: 304218 - DNA, 16 bp, C. familiaris
aggaccctggggtcag

SEQ ID NO: 304219 - DNA, 16 bp, C. familiaris
aggaccctgtgatcac

SEQ ID NO: 304220 - DNA, 16 bp, C. familiaris
aggacctgaagagaca

SEQ ID NO: 304221 - DNA, 16 bp, C. familiaris
aggacctgctccagga

SEQ ID NO: 304222 - DNA, 16 bp, C. familiaris
aggacctggtcctgga

SEQ ID NO: 304223 - DNA, 16 bp, C. familiaris
aggacgtgatcctgga

SEQ ID NO: 304224 - DNA, 16 bp, C. familiaris
aggacgtgatcctggt

SEQ ID NO: 304225 - DNA, 16 bp, C. familiaris
aggactacctcaagaa

SEQ ID NO: 304226 - DNA, 16 bp, C. familiaris
aggactcaaatccagg

SEQ ID NO: 304227 - DNA, 16 bp, C. familiaris
aggactccaccccaag

SEQ ID NO: 304228 - DNA, 16 bp, C. familiaris
aggactccgggatcaa

SEQ ID NO: 304229 - DNA, 24 bp, C. familiaris
aggactgtatttgtgactaattgt

SEQ ID NO: 304230 - DNA, 16 bp, C. familiaris
aggactgtttctgaat

SEQ ID NO: 304231 - DNA, 16 bp, C. familiaris
aggacttactattgcc

SEQ ID NO: 304232 - DNA, 16 bp, C. familiaris
aggacttcaacatgaa

SEQ ID NO: 304233 - DNA, 16 bp, C. familiaris
aggacttccagtacca

SEQ ID NO: 304234 - DNA, 16 bp, C. familiaris
aggacttcctggagga

SEQ ID NO: 304235 - DNA, 16 bp, C. familiaris
aggagaaaaaaatgca

SEQ ID NO: 304236 - DNA, 16 bp, C. familiaris
aggagaaaaacaatta

SEQ ID NO: 304237 - DNA, 16 bp, C. familiaris
aggagaaaaatcatat

SEQ ID NO: 304238 - DNA, 16 bp, C. familiaris
aggagaaaagactcaa

SEQ ID NO: 304239 - DNA, 16 bp, C. familiaris
aggagaaaatatttat

SEQ ID NO: 304240 - DNA, 16 bp, C. familiaris
aggagaaaatcttgaa

SEQ ID NO: 304241 - DNA, 17 bp, C. familiaris
aggagaaacaagcttga

SEQ ID NO: 304242 - DNA, 16 bp, C. familiaris
aggagaaacagactcc

SEQ ID NO: 304243 - DNA, 16 bp, C. familiaris
aggagaaatggatgaa

SEQ ID NO: 304244 - DNA, 16 bp, C. familiaris
aggagaacagaggcag

SEQ ID NO: 304245 - DNA, 16 bp, C. familiaris
aggagaagaagcaggc

SEQ ID NO: 304246 - DNA, 16 bp, C. familiaris
aggagaagaaggctcc

SEQ ID NO: 304247 - DNA, 16 bp, C. familiaris
aggagaagcagagaca

SEQ ID NO: 304248 - DNA, 16 bp, C. familiaris
aggagaagcagcagag

SEQ ID NO: 304249 - DNA, 16 bp, C. familiaris
aggagaagctgactcc

SEQ ID NO: 304250 - DNA, 16 bp, C. familiaris
aggagaaggacaagca

SEQ ID NO: 304251 - DNA, 16 bp, C. familiaris
aggagaaggagaatct

SEQ ID NO: 304252 - DNA, 16 bp, C. familiaris
aggagaatgccatgtg

SEQ ID NO: 304253 - DNA, 16 bp, C. familiaris
aggagaattgacatct

SEQ ID NO: 304254 - DNA, 16 bp, C. familiaris
aggagacagagctgag

SEQ ID NO: 304255 - DNA, 16 bp, C. familiaris
aggagactctgtgctg

SEQ ID NO: 304256 - DNA, 16 bp, C. familiaris
aggagacttctccaag

SEQ ID NO: 304257 - DNA, 17 bp, C. familiaris
aggagacttggtgtcca

SEQ ID NO: 304258 - DNA, 16 bp, C. familiaris
aggagagaaaactgaa

SEQ ID NO: 304259 - DNA, 16 bp, C. familiaris
aggagagaaaatgagc

SEQ ID NO: 304260 - DNA, 16 bp, C. familiaris
aggagagaagcaggct

SEQ ID NO: 304261 - DNA, 16 bp, C. familiaris
aggagagagacagaca

SEQ ID NO: 304262 - DNA, 16 bp, C. familiaris
aggagagcagaggcag

SEQ ID NO: 304263 - DNA, 16 bp, C. familiaris
aggagaggaaatgagt

SEQ ID NO: 304264 - DNA, 16 bp, C. familiaris
aggagaggacacagag

SEQ ID NO: 304265 - DNA, 16 bp, C. familiaris
aggagaggcagagatg

SEQ ID NO: 304266 - DNA, 16 bp, C. familiaris
aggagatatttgtaaa

SEQ ID NO: 304267 - DNA, 16 bp, C. familiaris
aggagatggagaaaca

SEQ ID NO: 304268 - DNA, 16 bp, C. familiaris
aggagattgaattagt

SEQ ID NO: 304269 - DNA, 16 bp, C. familiaris
aggagcaagaaaaatc

SEQ ID NO: 304270 - DNA, 16 bp, C. familiaris
aggagcacagggagag

SEQ ID NO: 304271 - DNA, 16 bp, C. familiaris
aggagcagagacagag

SEQ ID NO: 304272 - DNA, 16 bp, C. familiaris
aggagcagcagaggaa

SEQ ID NO: 304273 - DNA, 16 bp, C. familiaris
aggagcaggccctggg

SEQ ID NO: 304274 - DNA, 16 bp, C. familiaris
aggagccaagggagag

SEQ ID NO: 304275 - DNA, 16 bp, C. familiaris
aggagccaggctgagg

SEQ ID NO: 304276 - DNA, 16 bp, C. familiaris
aggagccccagggagg

SEQ ID NO: 304277 - DNA, 16 bp, C. familiaris
aggagcccgacacggg

SEQ ID NO: 304278 - DNA, 16 bp, C. familiaris
aggagcccgatggggg

SEQ ID NO: 304279 - DNA, 16 bp, C. familiaris
aggagcctgggtgtcc

SEQ ID NO: 304280 - DNA, 16 bp, C. familiaris
aggagcgcctggctgg

SEQ ID NO: 304281 - DNA, 18 bp, C. familiaris
aggagcgtccttgcggtc

SEQ ID NO: 304282 - DNA, 16 bp, C. familiaris
aggagctagaaaagga

SEQ ID NO: 304283 - DNA, 16 bp, C. familiaris
aggagctccatcccag

SEQ ID NO: 304284 - DNA, 16 bp, C. familiaris
aggagctgagggagag

SEQ ID NO: 304285 - DNA, 16 bp, C. familiaris
aggagctggaaaaaaa

SEQ ID NO: 304286 - DNA, 16 bp, C. familiaris
aggagctggaaaagga

SEQ ID NO: 304287 - DNA, 16 bp, C. familiaris
aggagctggaagaggc

SEQ ID NO: 304288 - DNA, 16 bp, C. familiaris
aggagctggagaaaga

SEQ ID NO: 304289 - DNA, 16 bp, C. familiaris
aggagctgggctgagg

SEQ ID NO: 304290 - DNA, 16 bp, C. familiaris
aggagctgggggagag

SEQ ID NO: 304291 - DNA, 16 bp, C. familiaris
aggaggaaaaccagga

SEQ ID NO: 304292 - DNA, 16 bp, C. familiaris
aggaggaaagattatc

SEQ ID NO: 304293 - DNA, 16 bp, C. familiaris
aggaggaacaacaaca

SEQ ID NO: 304294 - DNA, 16 bp, C. familiaris
aggaggacatagacat

SEQ ID NO: 304295 - DNA, 16 bp, C. familiaris
aggaggacggagaagc

SEQ ID NO: 304296 - DNA, 16 bp, C. familiaris
aggaggagcagcaggc

SEQ ID NO: 304297 - DNA, 16 bp, C. familiaris
aggaggaggaggacca

SEQ ID NO: 304298 - DNA, 16 bp, C. familiaris
aggaggaggcagaagc

SEQ ID NO: 304299 - DNA, 16 bp, C. familiaris
aggaggaggcaggtgg

SEQ ID NO: 304300 - DNA, 16 bp, C. familiaris
aggaggaggctgaggc

SEQ ID NO: 304301 - DNA, 16 bp, C. familiaris
aggaggaggggctgag

SEQ ID NO: 304302 - DNA, 16 bp, C. familiaris
aggaggagggtcagag

SEQ ID NO: 304303 - DNA, 16 bp, C. familiaris
aggaggatcacctgct

SEQ ID NO: 304304 - DNA, 16 bp, C. familiaris
aggaggatcagaggga

SEQ ID NO: 304305 - DNA, 16 bp, C. familiaris
aggaggatggccctgg

SEQ ID NO: 304306 - DNA, 16 bp, C. familiaris
aggaggcagggctggg

SEQ ID NO: 304307 - DNA, 16 bp, C. familiaris
aggaggccaggccagg

SEQ ID NO: 304308 - DNA, 16 bp, C. familiaris
aggagggcagccccag

SEQ ID NO: 304309 - DNA, 16 bp, C. familiaris
aggagggcagcccggg

SEQ ID NO: 304310 - DNA, 16 bp, C. familiaris
aggagggcttcctgga

SEQ ID NO: 304311 - DNA, 16 bp, C. familiaris
aggaggggagcctggg

SEQ ID NO: 304312 - DNA, 16 bp, C. familiaris
aggaggggcagtggag

SEQ ID NO: 304313 - DNA, 16 bp, C. familiaris
aggaggggcagtggga

SEQ ID NO: 304314 - DNA, 16 bp, C. familiaris
aggaggggcgcctggg

SEQ ID NO: 304315 - DNA, 16 bp, C. familiaris
aggaggggctggggcc

SEQ ID NO: 304316 - DNA, 16 bp, C. familiaris
aggagtcaatgccatt

SEQ ID NO: 304317 - DNA, 16 bp, C. familiaris
aggagtcacatgcttt

SEQ ID NO: 304318 - DNA, 16 bp, C. familiaris
aggagtccaacttcat

SEQ ID NO: 304319 - DNA, 16 bp, C. familiaris
aggagttggatgctca

SEQ ID NO: 304320 - DNA, 16 bp, C. familiaris
aggagttggttctctg

SEQ ID NO: 304321 - DNA, 16 bp, C. familiaris
aggatatcaaagagat

SEQ ID NO: 304322 - DNA, 16 bp, C. familiaris
aggatatgaagaaatt

SEQ ID NO: 304323 - DNA, 16 bp, C. familiaris
aggatattttttcttt

SEQ ID NO: 304324 - DNA, 16 bp, C. familiaris
aggatcaaatgagaaa

SEQ ID NO: 304325 - DNA, 16 bp, C. familiaris
aggatcaagccctagg

SEQ ID NO: 304326 - DNA, 16 bp, C. familiaris
aggatcaagtccagca

SEQ ID NO: 304327 - DNA, 16 bp, C. familiaris
aggatcacgccctgaa

SEQ ID NO: 304328 - DNA, 16 bp, C. familiaris
aggatcaggatctgag

SEQ ID NO: 304329 - DNA, 16 bp, C. familiaris
aggatcaggccatggg

SEQ ID NO: 304330 - DNA, 16 bp, C. familiaris
aggatcccagagtcct

SEQ ID NO: 304331 - DNA, 16 bp, C. familiaris
aggatcctcaaaaagt

SEQ ID NO: 304332 - DNA, 16 bp, C. familiaris
aggatcctggaattga

SEQ ID NO: 304333 - DNA, 16 bp, C. familiaris
aggatcctgggggtca

SEQ ID NO: 304334 - DNA, 16 bp, C. familiaris
aggatcctggggtcct

SEQ ID NO: 304335 - DNA, 16 bp, C. familiaris
aggatctagcttcctt

SEQ ID NO: 304336 - DNA, 16 bp, C. familiaris
aggatctcaagcagac

SEQ ID NO: 304337 - DNA, 16 bp, C. familiaris
aggatctcactgatgt

SEQ ID NO: 304338 - DNA, 16 bp, C. familiaris
aggatctgccttcagc

SEQ ID NO: 304339 - DNA, 16 bp, C. familiaris
aggatgaaatgagata

SEQ ID NO: 304340 - DNA, 16 bp, C. familiaris
aggatgacctcatctt

SEQ ID NO: 304341 - DNA, 16 bp, C. familiaris
aggatgactttttttt

SEQ ID NO: 304342 - DNA, 16 bp, C. familiaris
aggatgaggatgatga

SEQ ID NO: 304343 - DNA, 16 bp, C. familiaris
aggatgatgatgatgg

SEQ ID NO: 304344 - DNA, 16 bp, C. familiaris
aggatgatgccctgag

SEQ ID NO: 304345 - DNA, 16 bp, C. familiaris
aggatgcccactttca

SEQ ID NO: 304346 - DNA, 16 bp, C. familiaris
aggatgcctgggtgcc

SEQ ID NO: 304347 - DNA, 16 bp, C. familiaris
aggatgcctgggtggc

SEQ ID NO: 304348 - DNA, 16 bp, C. familiaris
aggatggaagaaacag

SEQ ID NO: 304349 - DNA, 16 bp, C. familiaris
aggatggagccccagg

SEQ ID NO: 304350 - DNA, 16 bp, C. familiaris
aggatggagccctggg

SEQ ID NO: 304351 - DNA, 16 bp, C. familiaris
aggatggtgagatgga

SEQ ID NO: 304352 - DNA, 16 bp, C. familiaris
aggatgtagagaaagg

SEQ ID NO: 304353 - DNA, 16 bp, C. familiaris
aggatgtgaagaaact

SEQ ID NO: 304354 - DNA, 16 bp, C. familiaris
aggatgtgaccccggg

SEQ ID NO: 304355 - DNA, 16 bp, C. familiaris
aggatgtggaaaaatt

SEQ ID NO: 304356 - DNA, 16 bp, C. familiaris
aggatgtggaagaaaa

SEQ ID NO: 304357 - DNA, 16 bp, C. familiaris
aggatgtggacaaagg

SEQ ID NO: 304358 - DNA, 16 bp, C. familiaris
aggatgtggagagaaa

SEQ ID NO: 304359 - DNA, 16 bp, C. familiaris
aggattatgagattga

SEQ ID NO: 304360 - DNA, 16 bp, C. familiaris
aggattctctctcctt

SEQ ID NO: 304361 - DNA, 16 bp, C. familiaris
aggattcttcagagaa

SEQ ID NO: 304362 - DNA, 16 bp, C. familiaris
aggatttgaacagaca

SEQ ID NO: 304363 - DNA, 16 bp, C. familiaris
aggatttgaacccaga

SEQ ID NO: 304364 - DNA, 16 bp, C. familiaris
aggatttgaatagaca

SEQ ID NO: 304365 - DNA, 16 bp, C. familiaris
aggattttatttatga

SEQ ID NO: 304366 - DNA, 16 bp, C. familiaris
aggattttctctttct

SEQ ID NO: 304367 - DNA, 16 bp, C. familiaris
aggatttttacagttt

SEQ ID NO: 304368 - DNA, 16 bp, C. familiaris
aggatttttcacagaa

SEQ ID NO: 304369 - DNA, 16 bp, C. familiaris
aggcaaaaaaattttt

SEQ ID NO: 304370 - DNA, 16 bp, C. familiaris
aggcaaaaacataggc

SEQ ID NO: 304371 - DNA, 16 bp, C. familiaris
aggcaaaagaaacaat

SEQ ID NO: 304372 - DNA, 16 bp, C. familiaris
aggcaaaagacccaga

SEQ ID NO: 304373 - DNA, 16 bp, C. familiaris
aggcaaaatcaagagt

SEQ ID NO: 304374 - DNA, 16 bp, C. familiaris
aggcaaacacttaacc

SEQ ID NO: 304375 - DNA, 16 bp, C. familiaris
aggcaaactccctgct

SEQ ID NO: 304376 - DNA, 16 bp, C. familiaris
aggcaaagcacagagg

SEQ ID NO: 304377 - DNA, 16 bp, C. familiaris
aggcaaaggaaatgaa

SEQ ID NO: 304378 - DNA, 16 bp, C. familiaris
aggcaaaggaagaagc

SEQ ID NO: 304379 - DNA, 16 bp, C. familiaris
aggcaaaggcaacaaa

SEQ ID NO: 304380 - DNA, 16 bp, C. familiaris
aggcaaatgcaaatca

SEQ ID NO: 304381 - DNA, 16 bp, C. familiaris
aggcaagaaaggattc

SEQ ID NO: 304382 - DNA, 16 bp, C. familiaris
aggcaagagaaataaa

SEQ ID NO: 304383 - DNA, 16 bp, C. familiaris
aggcaaggatgtctgc

SEQ ID NO: 304384 - DNA, 16 bp, C. familiaris
aggcacagacacacac

SEQ ID NO: 304385 - DNA, 16 bp, C. familiaris
aggcacagagaaggca

SEQ ID NO: 304386 - DNA, 16 bp, C. familiaris
aggcacagagagacta

SEQ ID NO: 304387 - DNA, 16 bp, C. familiaris
aggcacagagaggcag

SEQ ID NO: 304388 - DNA, 16 bp, C. familiaris
aggcacagggagaagc

SEQ ID NO: 304389 - DNA, 16 bp, C. familiaris
aggcacccaggtgctc

SEQ ID NO: 304390 - DNA, 16 bp, C. familiaris
aggcacccctgaattt

SEQ ID NO: 304391 - DNA, 16 bp, C. familiaris
aggcactgtgccaggt

SEQ ID NO: 304392 - DNA, 16 bp, C. familiaris
aggcactgttccaggt

SEQ ID NO: 304393 - DNA, 16 bp, C. familiaris
aggcacttttcaaact

SEQ ID NO: 304394 - DNA, 16 bp, C. familiaris
aggcagaaaatatttt

SEQ ID NO: 304395 - DNA, 16 bp, C. familiaris
aggcagaaactgaaaa

SEQ ID NO: 304396 - DNA, 16 bp, C. familiaris
aggcagaaggagaacc

SEQ ID NO: 304397 - DNA, 16 bp, C. familiaris
aggcagaagggagcag

SEQ ID NO: 304398 - DNA, 16 bp, C. familiaris
aggcagaattctaaga

SEQ ID NO: 304399 - DNA, 16 bp, C. familiaris
aggcagacacccaact

SEQ ID NO: 304400 - DNA, 16 bp, C. familiaris
aggcagacactcacca

SEQ ID NO: 304401 - DNA, 16 bp, C. familiaris
aggcagacatacaggc

SEQ ID NO: 304402 - DNA, 16 bp, C. familiaris
aggcagacgccaaacc

SEQ ID NO: 304403 - DNA, 16 bp, C. familiaris
aggcagagaaaataaa

SEQ ID NO: 304404 - DNA, 16 bp, C. familiaris
aggcagagaaagataa

SEQ ID NO: 304405 - DNA, 16 bp, C. familiaris
aggcagagaagaagca

SEQ ID NO: 304406 - DNA, 16 bp, C. familiaris
aggcagagaagcaggc

SEQ ID NO: 304407 - DNA, 16 bp, C. familiaris
aggcagagacattggc

SEQ ID NO: 304408 - DNA, 16 bp, C. familiaris
aggcagagatagaggc

SEQ ID NO: 304409 - DNA, 16 bp, C. familiaris
aggcagagcagcaggc

SEQ ID NO: 304410 - DNA, 16 bp, C. familiaris
aggcagagctgcaggc

SEQ ID NO: 304411 - DNA, 16 bp, C. familiaris
aggcagaggaagacag

SEQ ID NO: 304412 - DNA, 16 bp, C. familiaris
aggcagaggaagtagc

SEQ ID NO: 304413 - DNA, 16 bp, C. familiaris
aggcagaggagaggca

SEQ ID NO: 304414 - DNA, 16 bp, C. familiaris
aggcagaggaggaagc

SEQ ID NO: 304415 - DNA, 16 bp, C. familiaris
aggcagaggcaggcag

SEQ ID NO: 304416 - DNA, 16 bp, C. familiaris
aggcagaggccaggag

SEQ ID NO: 304417 - DNA, 16 bp, C. familiaris
aggcagagggaaaagc

SEQ ID NO: 304418 - DNA, 16 bp, C. familiaris
aggcagagggaactgc

SEQ ID NO: 304419 - DNA, 16 bp, C. familiaris
aggcagagggaccttc

SEQ ID NO: 304420 - DNA, 16 bp, C. familiaris
aggcagagggagcctg

SEQ ID NO: 304421 - DNA, 16 bp, C. familiaris
aggcagaggtgggagg

SEQ ID NO: 304422 - DNA, 16 bp, C. familiaris
aggcagatgatgctca

SEQ ID NO: 304423 - DNA, 16 bp, C. familiaris
aggcagatgctcagac

SEQ ID NO: 304424 - DNA, 16 bp, C. familiaris
aggcagatgctgagcc

SEQ ID NO: 304425 - DNA, 16 bp, C. familiaris
aggcagatgtgcaacc

SEQ ID NO: 304426 - DNA, 16 bp, C. familiaris
aggcagcaaatagatg

SEQ ID NO: 304427 - DNA, 16 bp, C. familiaris
aggcagcagggcgcag

SEQ ID NO: 304428 - DNA, 16 bp, C. familiaris
aggcagcatgtagatg

SEQ ID NO: 304429 - DNA, 16 bp, C. familiaris
aggcagcccgacatgg

SEQ ID NO: 304430 - DNA, 16 bp, C. familiaris
aggcagcgggagaagc

SEQ ID NO: 304431 - DNA, 16 bp, C. familiaris
aggcaggacacaggca

SEQ ID NO: 304432 - DNA, 16 bp, C. familiaris
aggcaggcaggaagga

SEQ ID NO: 304433 - DNA, 16 bp, C. familiaris
aggcaggcaggggcca

SEQ ID NO: 304434 - DNA, 16 bp, C. familiaris
aggcaggctccccatg

SEQ ID NO: 304435 - DNA, 16 bp, C. familiaris
aggcagggagaagcag

SEQ ID NO: 304436 - DNA, 16 bp, C. familiaris
aggcagggccctgggg

SEQ ID NO: 304437 - DNA, 16 bp, C. familiaris
aggcagggctggaggg

SEQ ID NO: 304438 - DNA, 16 bp, C. familiaris
aggcaggtggaggtgg

SEQ ID NO: 304439 - DNA, 24 bp, C. familiaris
aggcagtggcaaaaagagaggttt

SEQ ID NO: 304440 - DNA, 16 bp, C. familiaris
aggcagttgagtccct

SEQ ID NO: 304441 - DNA, 16 bp, C. familiaris
aggcatttcaaattgg

SEQ ID NO: 304442 - DNA, 16 bp, C. familiaris
aggccaaattcatagg

SEQ ID NO: 304443 - DNA, 16 bp, C. familiaris
aggccaatatcactga

SEQ ID NO: 304444 - DNA, 16 bp, C. familiaris
aggccaatatccttga

SEQ ID NO: 304445 - DNA, 16 bp, C. familiaris
aggccaatattaccct

SEQ ID NO: 304446 - DNA, 16 bp, C. familiaris
aggccagagatgctgc

SEQ ID NO: 304447 - DNA, 16 bp, C. familiaris
aggccagcaggctgga

SEQ ID NO: 304448 - DNA, 16 bp, C. familiaris
aggccagcatcacatt

SEQ ID NO: 304449 - DNA, 16 bp, C. familiaris
aggccagcatcaccct

SEQ ID NO: 304450 - DNA, 16 bp, C. familiaris
aggccagtggtctgca

SEQ ID NO: 304451 - DNA, 16 bp, C. familiaris
aggccagtgtggctga

SEQ ID NO: 304452 - DNA, 16 bp, C. familiaris
aggccatgaccctggg

SEQ ID NO: 304453 - DNA, 16 bp, C. familiaris
aggcccagagaaggga

SEQ ID NO: 304454 - DNA, 16 bp, C. familiaris
aggcccagagaagtga

SEQ ID NO: 304455 - DNA, 16 bp, C. familiaris
aggcccagcccaggcc

SEQ ID NO: 304456 - DNA, 16 bp, C. familiaris
aggcccaggagcccag

SEQ ID NO: 304457 - DNA, 16 bp, C. familiaris
aggcccagggagaagc

SEQ ID NO: 304458 - DNA, 16 bp, C. familiaris
aggcccagggaggtga

SEQ ID NO: 304459 - DNA, 16 bp, C. familiaris
aggcccagggcccagg

SEQ ID NO: 304460 - DNA, 16 bp, C. familiaris
aggccccaggctgcag

SEQ ID NO: 304461 - DNA, 16 bp, C. familiaris
aggcccctgccccaga

SEQ ID NO: 304462 - DNA, 16 bp, C. familiaris
aggcccgggagcacag

SEQ ID NO: 304463 - DNA, 16 bp, C. familiaris
aggcccgggagcactg

SEQ ID NO: 304464 - DNA, 17 bp, C. familiaris
aggccctcagctgctgg

SEQ ID NO: 304465 - DNA, 16 bp, C. familiaris
aggccctgaggctgga

SEQ ID NO: 304466 - DNA, 16 bp, C. familiaris
aggccctgatcctgga

SEQ ID NO: 304467 - DNA, 16 bp, C. familiaris
aggccctgatcctggg

SEQ ID NO: 304468 - DNA, 16 bp, C. familiaris
aggccctgcatcaggc

SEQ ID NO: 304469 - DNA, 16 bp, C. familiaris
aggccctgggctgaag

SEQ ID NO: 304470 - DNA, 16 bp, C. familiaris
aggccctggggcagga

SEQ ID NO: 304471 - DNA, 16 bp, C. familiaris
aggccctggggctgaa

SEQ ID NO: 304472 - DNA, 16 bp, C. familiaris
aggccctggggtggga

SEQ ID NO: 304473 - DNA, 16 bp, C. familiaris
aggccctggggtgggg

SEQ ID NO: 304474 - DNA, 16 bp, C. familiaris
aggccctgtgctgaag

SEQ ID NO: 304475 - DNA, 16 bp, C. familiaris
aggccgagggagaagc

SEQ ID NO: 304476 - DNA, 16 bp, C. familiaris
aggcctacctcaagaa

SEQ ID NO: 304477 - DNA, 16 bp, C. familiaris
aggcctacttcaagaa

SEQ ID NO: 304478 - DNA, 16 bp, C. familiaris
aggcctctgtccttgg

SEQ ID NO: 304479 - DNA, 16 bp, C. familiaris
aggcctgctgtgctga

SEQ ID NO: 304480 - DNA, 16 bp, C. familiaris
aggcctgcttctccct

SEQ ID NO: 304481 - DNA, 16 bp, C. familiaris
aggcctggggaggagg

SEQ ID NO: 304482 - DNA, 16 bp, C. familiaris
aggcctggggagggag

SEQ ID NO: 304483 - DNA, 16 bp, C. familiaris
aggccttcctcaagaa

SEQ ID NO: 304484 - DNA, 16 bp, C. familiaris
aggccttcctggagga

SEQ ID NO: 304485 - DNA, 16 bp, C. familiaris
aggcgcccaactgctg

SEQ ID NO: 304486 - DNA, 16 bp, C. familiaris
aggcggaaggagaagc

SEQ ID NO: 304487 - DNA, 16 bp, C. familiaris
aggcggaggaagaagc

SEQ ID NO: 304488 - DNA, 17 bp, C. familiaris
aggcggtgctgaaccgc

SEQ ID NO: 304489 - DNA, 16 bp, C. familiaris
aggctacagtgagaag

SEQ ID NO: 304490 - DNA, 16 bp, C. familiaris
aggctcagagcagtga

SEQ ID NO: 304491 - DNA, 16 bp, C. familiaris
aggctccacagccagc

SEQ ID NO: 304492 - DNA, 16 bp, C. familiaris
aggctccagagagatc

SEQ ID NO: 304493 - DNA, 16 bp, C. familiaris
aggctccatacaggga

SEQ ID NO: 304494 - DNA, 16 bp, C. familiaris
aggctccatgaagaga

SEQ ID NO: 304495 - DNA, 16 bp, C. familiaris
aggctccatgctgagc

SEQ ID NO: 304496 - DNA, 16 bp, C. familiaris
aggctccatggtcagt

SEQ ID NO: 304497 - DNA, 16 bp, C. familiaris
aggctccatgttggga

SEQ ID NO: 304498 - DNA, 16 bp, C. familiaris
aggctcccagtgcttt

SEQ ID NO: 304499 - DNA, 16 bp, C. familiaris
aggctccctgcgggga

SEQ ID NO: 304500 - DNA, 16 bp, C. familiaris
aggctccctggggaga

SEQ ID NO: 304501 - DNA, 16 bp, C. familiaris
aggctccctttgggga

SEQ ID NO: 304502 - DNA, 16 bp, C. familiaris
aggctccgggtgcatg

SEQ ID NO: 304503 - DNA, 16 bp, C. familiaris
aggctcctcagggagc

SEQ ID NO: 304504 - DNA, 16 bp, C. familiaris
aggctcctgcagggac

SEQ ID NO: 304505 - DNA, 16 bp, C. familiaris
aggctcctggcatgaa

SEQ ID NO: 304506 - DNA, 16 bp, C. familiaris
aggctcctggctcagc

SEQ ID NO: 304507 - DNA, 16 bp, C. familiaris
aggctccttgcatgca

SEQ ID NO: 304508 - DNA, 16 bp, C. familiaris
aggctccttggggagc

SEQ ID NO: 304509 - DNA, 16 bp, C. familiaris
aggctctgaggaagaa

SEQ ID NO: 304510 - DNA, 16 bp, C. familiaris
aggctctggagtcaga

SEQ ID NO: 304511 - DNA, 16 bp, C. familiaris
aggctctggagtcagg

SEQ ID NO: 304512 - DNA, 16 bp, C. familiaris
aggctctggggaagaa

SEQ ID NO: 304513 - DNA, 16 bp, C. familiaris
aggctctgggggagaa

SEQ ID NO: 304514 - DNA, 16 bp, C. familiaris
aggctctgtgcaagga

SEQ ID NO: 304515 - DNA, 16 bp, C. familiaris
aggctcttcctgggga

SEQ ID NO: 304516 - DNA, 16 bp, C. familiaris
aggctctttgctcagc

SEQ ID NO: 304517 - DNA, 16 bp, C. familiaris
aggctgaaggagaagc

SEQ ID NO: 304518 - DNA, 16 bp, C. familiaris
aggctgaaggcagacg

SEQ ID NO: 304519 - DNA, 16 bp, C. familiaris
aggctgaggctgaggc

SEQ ID NO: 304520 - DNA, 16 bp, C. familiaris
aggctgagggagcagc

SEQ ID NO: 304521 - DNA, 16 bp, C. familiaris
aggctgaggggcagag

SEQ ID NO: 304522 - DNA, 16 bp, C. familiaris
aggctgctgctgctgc

SEQ ID NO: 304523 - DNA, 16 bp, C. familiaris
aggctgcttctctccc

SEQ ID NO: 304524 - DNA, 16 bp, C. familiaris
aggctggaggtctgag

SEQ ID NO: 304525 - DNA, 16 bp, C. familiaris
aggctggaggtgtcct

SEQ ID NO: 304526 - DNA, 16 bp, C. familiaris
aggctgttgcctgtgt

SEQ ID NO: 304527 - DNA, 16 bp, C. familiaris
aggcttattttatttt

SEQ ID NO: 304528 - DNA, 16 bp, C. familiaris
aggcttcacagagaag

SEQ ID NO: 304529 - DNA, 16 bp, C. familiaris
aggcttcatgcccagc

SEQ ID NO: 304530 - DNA, 16 bp, C. familiaris
aggcttcttggaggag

SEQ ID NO: 304531 - DNA, 16 bp, C. familiaris
aggcttgctgcaggga

SEQ ID NO: 304532 - DNA, 16 bp, C. familiaris
aggcttggctctggga

SEQ ID NO: 304533 - DNA, 16 bp, C. familiaris
agggaaaaaaaatcac

SEQ ID NO: 304534 - DNA, 16 bp, C. familiaris
agggaaaagctggctc

SEQ ID NO: 304535 - DNA, 16 bp, C. familiaris
agggaaacagaacata

SEQ ID NO: 304536 - DNA, 16 bp, C. familiaris
agggaaagacaattat

SEQ ID NO: 304537 - DNA, 16 bp, C. familiaris
agggaaataaatggca

SEQ ID NO: 304538 - DNA, 16 bp, C. familiaris
agggaaatcagaaaat

SEQ ID NO: 304539 - DNA, 16 bp, C. familiaris
agggaaatgcaactca

SEQ ID NO: 304540 - DNA, 16 bp, C. familiaris
agggaacagaggcctc

SEQ ID NO: 304541 - DNA, 16 bp, C. familiaris
agggaacagcatgtgc

SEQ ID NO: 304542 - DNA, 20 bp, C. familiaris
agggaacattcctcagcatc

SEQ ID NO: 304543 - DNA, 16 bp, C. familiaris
agggaaccctgggtgg

SEQ ID NO: 304544 - DNA, 16 bp, C. familiaris
agggaacccttatgca

SEQ ID NO: 304545 - DNA, 16 bp, C. familiaris
agggaagcagcaggca

SEQ ID NO: 304546 - DNA, 16 bp, C. familiaris
agggaagcaggctcca

SEQ ID NO: 304547 - DNA, 16 bp, C. familiaris
agggaagcaggtggag

SEQ ID NO: 304548 - DNA, 16 bp, C. familiaris
agggaagccagctgcc

SEQ ID NO: 304549 - DNA, 16 bp, C. familiaris
agggaaggtgggcagg

SEQ ID NO: 304550 - DNA, 16 bp, C. familiaris
agggaatatagtgaat

SEQ ID NO: 304551 - DNA, 16 bp, C. familiaris
agggacacagcccagg

SEQ ID NO: 304552 - DNA, 16 bp, C. familiaris
agggacccaggctcct

SEQ ID NO: 304553 - DNA, 16 bp, C. familiaris
agggacccctggatgg

SEQ ID NO: 304554 - DNA, 16 bp, C. familiaris
agggacttcttttgtc

SEQ ID NO: 304555 - DNA, 16 bp, C. familiaris
agggagaaccaggctc

SEQ ID NO: 304556 - DNA, 16 bp, C. familiaris
agggagaagaaggccc

SEQ ID NO: 304557 - DNA, 16 bp, C. familiaris
agggagaagcagcagc

SEQ ID NO: 304558 - DNA, 16 bp, C. familiaris
agggagaagcagcagg

SEQ ID NO: 304559 - DNA, 16 bp, C. familiaris
agggagaagcaggatt

SEQ ID NO: 304560 - DNA, 16 bp, C. familiaris
agggagaagcaggtgc

SEQ ID NO: 304561 - DNA, 16 bp, C. familiaris
agggagaagcgggccc

SEQ ID NO: 304562 - DNA, 16 bp, C. familiaris
agggagaaggacaagc

SEQ ID NO: 304563 - DNA, 16 bp, C. familiaris
agggagacacacacac

SEQ ID NO: 304564 - DNA, 16 bp, C. familiaris
agggagacagaacaag

SEQ ID NO: 304565 - DNA, 16 bp, C. familiaris
agggagagaatcccca

SEQ ID NO: 304566 - DNA, 16 bp, C. familiaris
agggagagaatcttca

SEQ ID NO: 304567 - DNA, 16 bp, C. familiaris
agggagagagagaacc

SEQ ID NO: 304568 - DNA, 16 bp, C. familiaris
agggagagagcaagca

SEQ ID NO: 304569 - DNA, 16 bp, C. familiaris
agggagagccagagag

SEQ ID NO: 304570 - DNA, 16 bp, C. familiaris
agggagaggcagcctc

SEQ ID NO: 304571 - DNA, 16 bp, C. familiaris
agggagaggggctgga

SEQ ID NO: 304572 - DNA, 16 bp, C. familiaris
agggagcacagccctg

SEQ ID NO: 304573 - DNA, 16 bp, C. familiaris
agggagcagggagcct

SEQ ID NO: 304574 - DNA, 16 bp, C. familiaris
agggagcccaaagtgg

SEQ ID NO: 304575 - DNA, 16 bp, C. familiaris
agggagcccagcacag

SEQ ID NO: 304576 - DNA, 16 bp, C. familiaris
agggagcccgatgctg

SEQ ID NO: 304577 - DNA, 16 bp, C. familiaris
agggagccggaggtgg

SEQ ID NO: 304578 - DNA, 16 bp, C. familiaris
agggagcctgaagcag

SEQ ID NO: 304579 - DNA, 16 bp, C. familiaris
agggagcctgacacag

SEQ ID NO: 304580 - DNA, 16 bp, C. familiaris
agggagcctgatggtg

SEQ ID NO: 304581 - DNA, 16 bp, C. familiaris
agggagctcaatgtga

SEQ ID NO: 304582 - DNA, 16 bp, C. familiaris
agggagctgactccag

SEQ ID NO: 304583 - DNA, 16 bp, C. familiaris
agggagctggacgtgg

SEQ ID NO: 304584 - DNA, 16 bp, C. familiaris
agggagctggaggtgg

SEQ ID NO: 304585 - DNA, 16 bp, C. familiaris
agggagcttgcctctc

SEQ ID NO: 304586 - DNA, 16 bp, C. familiaris
agggaggacttcctgg

SEQ ID NO: 304587 - DNA, 16 bp, C. familiaris
agggaggagaagcagt

SEQ ID NO: 304588 - DNA, 16 bp, C. familiaris
agggaggagcagactt

SEQ ID NO: 304589 - DNA, 16 bp, C. familiaris
agggaggagcaggctt

SEQ ID NO: 304590 - DNA, 16 bp, C. familiaris
agggaggagctgaggg

SEQ ID NO: 304591 - DNA, 16 bp, C. familiaris
agggaggaggctggag

SEQ ID NO: 304592 - DNA, 16 bp, C. familiaris
agggagggaaaactgg

SEQ ID NO: 304593 - DNA, 16 bp, C. familiaris
agggagggatcctgga

SEQ ID NO: 304594 - DNA, 17 bp, C. familiaris
agggaggtttgtgtctg

SEQ ID NO: 304595 - DNA, 16 bp, C. familiaris
agggatcaaatcccac

SEQ ID NO: 304596 - DNA, 16 bp, C. familiaris
agggatcccaaaagga

SEQ ID NO: 304597 - DNA, 16 bp, C. familiaris
agggatccccagaaga

SEQ ID NO: 304598 - DNA, 16 bp, C. familiaris
agggatccccaggaaa

SEQ ID NO: 304599 - DNA, 16 bp, C. familiaris
agggatccccttcttt

SEQ ID NO: 304600 - DNA, 16 bp, C. familiaris
agggatccctgactct

SEQ ID NO: 304601 - DNA, 16 bp, C. familiaris
agggatgaaattgaag

SEQ ID NO: 304602 - DNA, 16 bp, C. familiaris
agggatgaccatgaag

SEQ ID NO: 304603 - DNA, 16 bp, C. familiaris
agggatgcagaggtgg

SEQ ID NO: 304604 - DNA, 16 bp, C. familiaris
agggatttacagtata

SEQ ID NO: 304605 - DNA, 16 bp, C. familiaris
agggatttattcctgg

SEQ ID NO: 304606 - DNA, 16 bp, C. familiaris
agggattttgcagata

SEQ ID NO: 304607 - DNA, 16 bp, C. familiaris
agggcaccagggtggc

SEQ ID NO: 304608 - DNA, 16 bp, C. familiaris
agggcagcctggtggc

SEQ ID NO: 304609 - DNA, 16 bp, C. familiaris
agggcagctcccccag

SEQ ID NO: 304610 - DNA, 16 bp, C. familiaris
agggcaggggctggga

SEQ ID NO: 304611 - DNA, 16 bp, C. familiaris
agggcaggtgagggca

SEQ ID NO: 304612 - DNA, 16 bp, C. familiaris
agggccaaagggagag

SEQ ID NO: 304613 - DNA, 16 bp, C. familiaris
agggccacactccctc

SEQ ID NO: 304614 - DNA, 16 bp, C. familiaris
agggccagagggccag

SEQ ID NO: 304615 - DNA, 16 bp, C. familiaris
agggccctcttcctgg

SEQ ID NO: 304616 - DNA, 16 bp, C. familiaris
agggccctgaggtcat

SEQ ID NO: 304617 - DNA, 16 bp, C. familiaris
agggcctgaccccggg

SEQ ID NO: 304618 - DNA, 16 bp, C. familiaris
agggcctgaccctggg

SEQ ID NO: 304619 - DNA, 16 bp, C. familiaris
agggcctggggcaggg

SEQ ID NO: 304620 - DNA, 16 bp, C. familiaris
agggcctggggcctgg

SEQ ID NO: 304621 - DNA, 16 bp, C. familiaris
agggcgagatcctggg

SEQ ID NO: 304622 - DNA, 17 bp, C. familiaris
agggcgccatcctggag

SEQ ID NO: 304623 - DNA, 16 bp, C. familiaris
agggcgtgatcctgag

SEQ ID NO: 304624 - DNA, 16 bp, C. familiaris
agggctcattcccagg

SEQ ID NO: 304625 - DNA, 16 bp, C. familiaris
agggctccccactcag

SEQ ID NO: 304626 - DNA, 16 bp, C. familiaris
agggctccttccaggg

SEQ ID NO: 304627 - DNA, 16 bp, C. familiaris
agggctctgccctcat

SEQ ID NO: 304628 - DNA, 16 bp, C. familiaris
agggctgcagcgcggg

SEQ ID NO: 304629 - DNA, 16 bp, C. familiaris
agggctgctgctgctg

SEQ ID NO: 304630 - DNA, 16 bp, C. familiaris
agggctgctgtgagga

SEQ ID NO: 304631 - DNA, 16 bp, C. familiaris
agggctggatcctgga

SEQ ID NO: 304632 - DNA, 16 bp, C. familiaris
agggctggattccagg

SEQ ID NO: 304633 - DNA, 16 bp, C. familiaris
agggcttcctggaaga

SEQ ID NO: 304634 - DNA, 16 bp, C. familiaris
aggggaaaaaatgcaa

SEQ ID NO: 304635 - DNA, 16 bp, C. familiaris
aggggaaactgaggaa

SEQ ID NO: 304636 - DNA, 16 bp, C. familiaris
aggggaacctcttaca

SEQ ID NO: 304637 - DNA, 16 bp, C. familiaris
aggggaagaagcaggc

SEQ ID NO: 304638 - DNA, 16 bp, C. familiaris
aggggaagcaggctcc

SEQ ID NO: 304639 - DNA, 16 bp, C. familiaris
aggggacccagaccca

SEQ ID NO: 304640 - DNA, 16 bp, C. familiaris
aggggagcagcaggca

SEQ ID NO: 304641 - DNA, 16 bp, C. familiaris
aggggatgggcagagg

SEQ ID NO: 304642 - DNA, 16 bp, C. familiaris
aggggatgtgggacag

SEQ ID NO: 304643 - DNA, 16 bp, C. familiaris
aggggatttccagaag

SEQ ID NO: 304644 - DNA, 16 bp, C. familiaris
aggggcaaaggcagag

SEQ ID NO: 304645 - DNA, 16 bp, C. familiaris
aggggcaaatggagag

SEQ ID NO: 304646 - DNA, 16 bp, C. familiaris
aggggcacccagctgg

SEQ ID NO: 304647 - DNA, 16 bp, C. familiaris
aggggcagagacagag

SEQ ID NO: 304648 - DNA, 16 bp, C. familiaris
aggggcagagagtgag

SEQ ID NO: 304649 - DNA, 16 bp, C. familiaris
aggggcagagccagga

SEQ ID NO: 304650 - DNA, 16 bp, C. familiaris
aggggcagaggatgag

SEQ ID NO: 304651 - DNA, 16 bp, C. familiaris
aggggcagatggaggg

SEQ ID NO: 304652 - DNA, 16 bp, C. familiaris
aggggcagcctggatg

SEQ ID NO: 304653 - DNA, 16 bp, C. familiaris
aggggcagctcgggtg

SEQ ID NO: 304654 - DNA, 16 bp, C. familiaris
aggggcctggaggggc

SEQ ID NO: 304655 - DNA, 16 bp, C. familiaris
aggggcgcctgagtgg

SEQ ID NO: 304656 - DNA, 16 bp, C. familiaris
aggggcgcctggctgg

SEQ ID NO: 304657 - DNA, 16 bp, C. familiaris
aggggctgaaggagag

SEQ ID NO: 304658 - DNA, 16 bp, C. familiaris
aggggctgaatccagg

SEQ ID NO: 304659 - DNA, 16 bp, C. familiaris
aggggctggaaggagg

SEQ ID NO: 304660 - DNA, 16 bp, C. familiaris
aggggctggagattga

SEQ ID NO: 304661 - DNA, 16 bp, C. familiaris
aggggctggaggaagg

SEQ ID NO: 304662 - DNA, 16 bp, C. familiaris
aggggctgggaggcag

SEQ ID NO: 304663 - DNA, 16 bp, C. familiaris
aggggctgggccaggg

SEQ ID NO: 304664 - DNA, 16 bp, C. familiaris
agggggaaaaaaccct

SEQ ID NO: 304665 - DNA, 16 bp, C. familiaris
agggggagcaggctcc

SEQ ID NO: 304666 - DNA, 16 bp, C. familiaris
agggggaggggcccca

SEQ ID NO: 304667 - DNA, 16 bp, C. familiaris
agggggagtggcaggc

SEQ ID NO: 304668 - DNA, 16 bp, C. familiaris
agggggatgggcagag

SEQ ID NO: 304669 - DNA, 16 bp, C. familiaris
agggggcagccccagt

SEQ ID NO: 304670 - DNA, 16 bp, C. familiaris
agggggcagcctgggt

SEQ ID NO: 304671 - DNA, 16 bp, C. familiaris
agggggcggggcctgc

SEQ ID NO: 304672 - DNA, 16 bp, C. familiaris
agggggctcagcagtt

SEQ ID NO: 304673 - DNA, 16 bp, C. familiaris
agggggggcacctggg

SEQ ID NO: 304674 - DNA, 16 bp, C. familiaris
agggggtcctgggtgg

SEQ ID NO: 304675 - DNA, 16 bp, C. familiaris
agggggtctgcttgtc

SEQ ID NO: 304676 - DNA, 16 bp, C. familiaris
agggggtggggatgac

SEQ ID NO: 304677 - DNA, 16 bp, C. familiaris
aggggtacctggctgg

SEQ ID NO: 304678 - DNA, 16 bp, C. familiaris
aggggtcccagaagga

SEQ ID NO: 304679 - DNA, 16 bp, C. familiaris
aggggtgcctgtgtgg

SEQ ID NO: 304680 - DNA, 16 bp, C. familiaris
aggggttaagcatctg

SEQ ID NO: 304681 - DNA, 16 bp, C. familiaris
aggggttttctttttt

SEQ ID NO: 304682 - DNA, 16 bp, C. familiaris
agggtaaaccaggaaa

SEQ ID NO: 304683 - DNA, 16 bp, C. familiaris
agggtcccaggatcga

SEQ ID NO: 304684 - DNA, 16 bp, C. familiaris
agggtccctggaggag

SEQ ID NO: 304685 - DNA, 16 bp, C. familiaris
agggtcctgaaattga

SEQ ID NO: 304686 - DNA, 16 bp, C. familiaris
agggtcctgggttgga

SEQ ID NO: 304687 - DNA, 16 bp, C. familiaris
agggtcctggtatgga

SEQ ID NO: 304688 - DNA, 16 bp, C. familiaris
agggtctatttctggg

SEQ ID NO: 304689 - DNA, 16 bp, C. familiaris
agggtgacaggacatg

SEQ ID NO: 304690 - DNA, 16 bp, C. familiaris
agggtgcctgcatggc

SEQ ID NO: 304691 - DNA, 16 bp, C. familiaris
agggtgtgatcctgga

SEQ ID NO: 304692 - DNA, 16 bp, C. familiaris
agggtgtgatcgtgga

SEQ ID NO: 304693 - DNA, 16 bp, C. familiaris
agggtgtggtcctgaa

SEQ ID NO: 304694 - DNA, 16 bp, C. familiaris
agggtgtggtcctgga

SEQ ID NO: 304695 - DNA, 16 bp, C. familiaris
agggttcccttctctc

SEQ ID NO: 304696 - DNA, 16 bp, C. familiaris
agggttcttctttctc

SEQ ID NO: 304697 - DNA, 16 bp, C. familiaris
agggtttttttccccc

SEQ ID NO: 304698 - DNA, 16 bp, C. familiaris
aggtaatctctatacc

SEQ ID NO: 304699 - DNA, 16 bp, C. familiaris
aggtacaactccaaga

SEQ ID NO: 304700 - DNA, 16 bp, C. familiaris
aggtacagagatttct

SEQ ID NO: 304701 - DNA, 16 bp, C. familiaris
aggtagaggccaggga

SEQ ID NO: 304702 - DNA, 16 bp, C. familiaris
aggtagataaaccatt

SEQ ID NO: 304703 - DNA, 16 bp, C. familiaris
aggtagcaatacttat

SEQ ID NO: 304704 - DNA, 16 bp, C. familiaris
aggtagcccaggtggc

SEQ ID NO: 304705 - DNA, 16 bp, C. familiaris
aggtagtaaggaaatt

SEQ ID NO: 304706 - DNA, 16 bp, C. familiaris
aggtcaacaccttgac

SEQ ID NO: 304707 - DNA, 16 bp, C. familiaris
aggtcacacagccagg

SEQ ID NO: 304708 - DNA, 16 bp, C. familiaris
aggtcacattcccacc

SEQ ID NO: 304709 - DNA, 16 bp, C. familiaris
aggtcacctgtcccca

SEQ ID NO: 304710 - DNA, 16 bp, C. familiaris
aggtcagtcagagaaa

SEQ ID NO: 304711 - DNA, 16 bp, C. familiaris
aggtcatgattctgag

SEQ ID NO: 304712 - DNA, 16 bp, C. familiaris
aggtccataccaagac

SEQ ID NO: 304713 - DNA, 16 bp, C. familiaris
aggtcccaggtcccag

SEQ ID NO: 304714 - DNA, 16 bp, C. familiaris
aggtcccatctccaaa

SEQ ID NO: 304715 - DNA, 16 bp, C. familiaris
aggtcgtgatccagga

SEQ ID NO: 304716 - DNA, 16 bp, C. familiaris
aggtctcacacttcct

SEQ ID NO: 304717 - DNA, 16 bp, C. familiaris
aggtctccaagatcat

SEQ ID NO: 304718 - DNA, 16 bp, C. familiaris
aggtctccaggatagc

SEQ ID NO: 304719 - DNA, 16 bp, C. familiaris
aggtctcctgactccc

SEQ ID NO: 304720 - DNA, 16 bp, C. familiaris
aggtctctgcccctct

SEQ ID NO: 304721 - DNA, 16 bp, C. familiaris
aggtctctggagaggt

SEQ ID NO: 304722 - DNA, 16 bp, C. familiaris
aggtctttcatctatt

SEQ ID NO: 304723 - DNA, 16 bp, C. familiaris
aggtctttcttctttt

SEQ ID NO: 304724 - DNA, 16 bp, C. familiaris
aggtcttttattttta

SEQ ID NO: 304725 - DNA, 16 bp, C. familiaris
aggtgaaaccaagagt

SEQ ID NO: 304726 - DNA, 16 bp, C. familiaris
aggtgaaatcaagagt

SEQ ID NO: 304727 - DNA, 16 bp, C. familiaris
aggtgagcatctgcct

SEQ ID NO: 304728 - DNA, 16 bp, C. familiaris
aggtgaggaaactgaa

SEQ ID NO: 304729 - DNA, 16 bp, C. familiaris
aggtgaggagcagagg

SEQ ID NO: 304730 - DNA, 16 bp, C. familiaris
aggtgatgatgatgat

SEQ ID NO: 304731 - DNA, 16 bp, C. familiaris
aggtgatggaagtgtt

SEQ ID NO: 304732 - DNA, 16 bp, C. familiaris
aggtgcaaaaatcctc

SEQ ID NO: 304733 - DNA, 16 bp, C. familiaris
aggtgccccaaaaagt

SEQ ID NO: 304734 - DNA, 16 bp, C. familiaris
aggtgccccagaagtt

SEQ ID NO: 304735 - DNA, 16 bp, C. familiaris
aggtgccccccgcccc

SEQ ID NO: 304736 - DNA, 16 bp, C. familiaris
aggtgcccctctcctg

SEQ ID NO: 304737 - DNA, 16 bp, C. familiaris
aggtgcccctcttcta

SEQ ID NO: 304738 - DNA, 16 bp, C. familiaris
aggtgcccctgtttct

SEQ ID NO: 304739 - DNA, 16 bp, C. familiaris
aggtgcctgatgtggg

SEQ ID NO: 304740 - DNA, 16 bp, C. familiaris
aggtgctcaacaaatg

SEQ ID NO: 304741 - DNA, 16 bp, C. familiaris
aggtgctcagtaaaca

SEQ ID NO: 304742 - DNA, 16 bp, C. familiaris
aggtgctgacttcctt

SEQ ID NO: 304743 - DNA, 16 bp, C. familiaris
aggtggaagagtgggt

SEQ ID NO: 304744 - DNA, 16 bp, C. familiaris
aggtggaatataagaa

SEQ ID NO: 304745 - DNA, 16 bp, C. familiaris
aggtggagcaggtgag

SEQ ID NO: 304746 - DNA, 16 bp, C. familiaris
aggtggaggaaggggc

SEQ ID NO: 304747 - DNA, 16 bp, C. familiaris
aggtggatggatgaat

SEQ ID NO: 304748 - DNA, 16 bp, C. familiaris
aggtggatttcacaga

SEQ ID NO: 304749 - DNA, 16 bp, C. familiaris
aggtggcaggtggcag

SEQ ID NO: 304750 - DNA, 16 bp, C. familiaris
aggtggcccagcagtt

SEQ ID NO: 304751 - DNA, 16 bp, C. familiaris
aggtggctcaggcagt

SEQ ID NO: 304752 - DNA, 16 bp, C. familiaris
aggtggcttcggtggc

SEQ ID NO: 304753 - DNA, 16 bp, C. familiaris
aggtgggaagggcaga

SEQ ID NO: 304754 - DNA, 16 bp, C. familiaris
aggtgggcagcctggg

SEQ ID NO: 304755 - DNA, 16 bp, C. familiaris
aggtggggtgcctggg

SEQ ID NO: 304756 - DNA, 16 bp, C. familiaris
aggtgggtgggaagat

SEQ ID NO: 304757 - DNA, 16 bp, C. familiaris
aggtggtcctaagagg

SEQ ID NO: 304758 - DNA, 16 bp, C. familiaris
aggtggtgagagtgga

SEQ ID NO: 304759 - DNA, 16 bp, C. familiaris
aggtggtgatcctgga

SEQ ID NO: 304760 - DNA, 16 bp, C. familiaris
aggtgtccagggtgag

SEQ ID NO: 304761 - DNA, 16 bp, C. familiaris
aggtgtgctcattgct

SEQ ID NO: 304762 - DNA, 16 bp, C. familiaris
aggtgttgatgaggat

SEQ ID NO: 304763 - DNA, 16 bp, C. familiaris
aggttaagtgtctgct

SEQ ID NO: 304764 - DNA, 16 bp, C. familiaris
aggttagaagtccaag

SEQ ID NO: 304765 - DNA, 16 bp, C. familiaris
aggttattgataagaa

SEQ ID NO: 304766 - DNA, 16 bp, C. familiaris
aggttccatgccagga

SEQ ID NO: 304767 - DNA, 16 bp, C. familiaris
aggttccctgctcagc

SEQ ID NO: 304768 - DNA, 16 bp, C. familiaris
aggttctctgcatgga

SEQ ID NO: 304769 - DNA, 16 bp, C. familiaris
aggttctggtgagagc

SEQ ID NO: 304770 - DNA, 16 bp, C. familiaris
aggttcttaataaata

SEQ ID NO: 304771 - DNA, 16 bp, C. familiaris
aggttcttcaaaaaat

SEQ ID NO: 304772 - DNA, 16 bp, C. familiaris
aggttcttcaagaagt

SEQ ID NO: 304773 - DNA, 16 bp, C. familiaris
aggttgagatcccagg

SEQ ID NO: 304774 - DNA, 16 bp, C. familiaris
aggttgctacctgtgt

SEQ ID NO: 304775 - DNA, 16 bp, C. familiaris
agtaaaatattagcaa

SEQ ID NO: 304776 - DNA, 16 bp, C. familiaris
agtaaaccaaatccaa

SEQ ID NO: 304777 - DNA, 16 bp, C. familiaris
agtaaatatttcaggc

SEQ ID NO: 304778 - DNA, 16 bp, C. familiaris
agtaaatattttaggt

SEQ ID NO: 304779 - DNA, 16 bp, C. familiaris
agtaaatgctcaacaa

SEQ ID NO: 304780 - DNA, 16 bp, C. familiaris
agtaacctcttgcaag

SEQ ID NO: 304781 - DNA, 16 bp, C. familiaris
agtaactctgaaagtg

SEQ ID NO: 304782 - DNA, 16 bp, C. familiaris
agtaataatagtaaca

SEQ ID NO: 304783 - DNA, 16 bp, C. familiaris
agtaatcagtctattc

SEQ ID NO: 304784 - DNA, 16 bp, C. familiaris
agtaatcagtctgttc

SEQ ID NO: 304785 - DNA, 16 bp, C. familiaris
agtacaacctgaaatc

SEQ ID NO: 304786 - DNA, 16 bp, C. familiaris
agtacaattgctgagt

SEQ ID NO: 304787 - DNA, 16 bp, C. familiaris
agtacagatttttttt

SEQ ID NO: 304788 - DNA, 16 bp, C. familiaris
agtacagtttgaaatc

SEQ ID NO: 304789 - DNA, 16 bp, C. familiaris
agtactaggagtccta

SEQ ID NO: 304790 - DNA, 16 bp, C. familiaris
agtagaagaaaatatt

SEQ ID NO: 304791 - DNA, 16 bp, C. familiaris
agtagaatggataaat

SEQ ID NO: 304792 - DNA, 16 bp, C. familiaris
agtagatattattatt

SEQ ID NO: 304793 - DNA, 16 bp, C. familiaris
agtagccaaactgtgg

SEQ ID NO: 304794 - DNA, 16 bp, C. familiaris
agtagctttaaaaaaa

SEQ ID NO: 304795 - DNA, 16 bp, C. familiaris
agtagtgatggttgca

SEQ ID NO: 304796 - DNA, 16 bp, C. familiaris
agtagttgagcgcctg

SEQ ID NO: 304797 - DNA, 16 bp, C. familiaris
agtatatagaaatgca

SEQ ID NO: 304798 - DNA, 16 bp, C. familiaris
agtatatctgtaaaaa

SEQ ID NO: 304799 - DNA, 16 bp, C. familiaris
agtatattatgctaag

SEQ ID NO: 304800 - DNA, 16 bp, C. familiaris
agtatcacaaccagga

SEQ ID NO: 304801 - DNA, 16 bp, C. familiaris
agtatctggcacagag

SEQ ID NO: 304802 - DNA, 16 bp, C. familiaris
agtatcttctgtttct

SEQ ID NO: 304803 - DNA, 16 bp, C. familiaris
agtatctttaaataaa

SEQ ID NO: 304804 - DNA, 16 bp, C. familiaris
agtatgattctaccca

SEQ ID NO: 304805 - DNA, 16 bp, C. familiaris
agtatggtgtaagaaa

SEQ ID NO: 304806 - DNA, 16 bp, C. familiaris
agtatgtgcaaaggcc

SEQ ID NO: 304807 - DNA, 16 bp, C. familiaris
agtatgtggagaaatt

SEQ ID NO: 304808 - DNA, 16 bp, C. familiaris
agtattaaggagggca

SEQ ID NO: 304809 - DNA, 16 bp, C. familiaris
agtattataagcagca

SEQ ID NO: 304810 - DNA, 16 bp, C. familiaris
agtattatatttaatg

SEQ ID NO: 304811 - DNA, 16 bp, C. familiaris
agtattattgactata

SEQ ID NO: 304812 - DNA, 16 bp, C. familiaris
agtattattgactgta

SEQ ID NO: 304813 - DNA, 16 bp, C. familiaris
agtatttaaacatttt

SEQ ID NO: 304814 - DNA, 16 bp, C. familiaris
agtatttgtttttctg

SEQ ID NO: 304815 - DNA, 16 bp, C. familiaris
agtattttgaactgaa

SEQ ID NO: 304816 - DNA, 16 bp, C. familiaris
agtattttgaatatat

SEQ ID NO: 304817 - DNA, 16 bp, C. familiaris
agtcaaagcaatcctg

SEQ ID NO: 304818 - DNA, 16 bp, C. familiaris
agtcaactggagaaag

SEQ ID NO: 304819 - DNA, 16 bp, C. familiaris
agtcaagaaataggca

SEQ ID NO: 304820 - DNA, 16 bp, C. familiaris
agtcaagatatggaaa

SEQ ID NO: 304821 - DNA, 16 bp, C. familiaris
agtcaatgaaaataaa

SEQ ID NO: 304822 - DNA, 16 bp, C. familiaris
agtcaattaaatgaga

SEQ ID NO: 304823 - DNA, 16 bp, C. familiaris
agtcacacagcaagta

SEQ ID NO: 304824 - DNA, 17 bp, C. familiaris
agtcacagagagagaga

SEQ ID NO: 304825 - DNA, 16 bp, C. familiaris
agtcacatgctttacc

SEQ ID NO: 304826 - DNA, 16 bp, C. familiaris
agtcaccagatccagg

SEQ ID NO: 304827 - DNA, 16 bp, C. familiaris
agtcacccaggggtcc

SEQ ID NO: 304828 - DNA, 16 bp, C. familiaris
agtcactcaggtgctc

SEQ ID NO: 304829 - DNA, 16 bp, C. familiaris
agtcacttaaaaaaaa

SEQ ID NO: 304830 - DNA, 16 bp, C. familiaris
agtcacttgcccaagg

SEQ ID NO: 304831 - DNA, 16 bp, C. familiaris
agtcagaaaaatattt

SEQ ID NO: 304832 - DNA, 16 bp, C. familiaris
agtcagaaggagaagc

SEQ ID NO: 304833 - DNA, 16 bp, C. familiaris
agtcagacagagaaag

SEQ ID NO: 304834 - DNA, 16 bp, C. familiaris
agtcagagaaaagcaa

SEQ ID NO: 304835 - DNA, 16 bp, C. familiaris
agtcagagaaggaaaa

SEQ ID NO: 304836 - DNA, 16 bp, C. familiaris
agtcagagagagaggc

SEQ ID NO: 304837 - DNA, 16 bp, C. familiaris
agtcagagagaggcag

SEQ ID NO: 304838 - DNA, 16 bp, C. familiaris
agtcagagatcaaggt

SEQ ID NO: 304839 - DNA, 16 bp, C. familiaris
agtcagagggaggagg

SEQ ID NO: 304840 - DNA, 16 bp, C. familiaris
agtcagctgctcaacc

SEQ ID NO: 304841 - DNA, 16 bp, C. familiaris
agtcagggcagcctgg

SEQ ID NO: 304842 - DNA, 16 bp, C. familiaris
agtcataaaaaagaag

SEQ ID NO: 304843 - DNA, 16 bp, C. familiaris
agtcatcagagaggga

SEQ ID NO: 304844 - DNA, 16 bp, C. familiaris
agtcatctccacaccc

SEQ ID NO: 304845 - DNA, 16 bp, C. familiaris
agtcattaaaaataaa

SEQ ID NO: 304846 - DNA, 16 bp, C. familiaris
agtcattatttcttta

SEQ ID NO: 304847 - DNA, 16 bp, C. familiaris
agtcattctttaaaaa

SEQ ID NO: 304848 - DNA, 16 bp, C. familiaris
agtcattgccaagacc

SEQ ID NO: 304849 - DNA, 16 bp, C. familiaris
agtcatttaaaatttt

SEQ ID NO: 304850 - DNA, 16 bp, C. familiaris
agtcatttcaataaat

SEQ ID NO: 304851 - DNA, 16 bp, C. familiaris
agtccagggccagagg

SEQ ID NO: 304852 - DNA, 23 bp, C. familiaris
agtccagggccagatggcttccc

SEQ ID NO: 304853 - DNA, 16 bp, C. familiaris
agtcccaagaccctga

SEQ ID NO: 304854 - DNA, 16 bp, C. familiaris
agtcccacagcaggct

SEQ ID NO: 304855 - DNA, 16 bp, C. familiaris
agtcccagaaaaagag

SEQ ID NO: 304856 - DNA, 16 bp, C. familiaris
agtcccagggccctgg

SEQ ID NO: 304857 - DNA, 16 bp, C. familiaris
agtcccatattgggct

SEQ ID NO: 304858 - DNA, 16 bp, C. familiaris
agtcccatgctctacc

SEQ ID NO: 304859 - DNA, 16 bp, C. familiaris
agtcccatgctgggct

SEQ ID NO: 304860 - DNA, 16 bp, C. familiaris
agtccctgctgagcac

SEQ ID NO: 304861 - DNA, 16 bp, C. familiaris
agtccgcttctctctc

SEQ ID NO: 304862 - DNA, 16 bp, C. familiaris
agtcctacatccagct

SEQ ID NO: 304863 - DNA, 16 bp, C. familiaris
agtcctacatctggct

SEQ ID NO: 304864 - DNA, 16 bp, C. familiaris
agtcctggagatggat

SEQ ID NO: 304865 - DNA, 16 bp, C. familiaris
agtcctggcctcagca

SEQ ID NO: 304866 - DNA, 16 bp, C. familiaris
agtcctggggtcctgg

SEQ ID NO: 304867 - DNA, 16 bp, C. familiaris
agtctcacagaggaag

SEQ ID NO: 304868 - DNA, 16 bp, C. familiaris
agtctcacagccctga

SEQ ID NO: 304869 - DNA, 16 bp, C. familiaris
agtctcctcctccctc

SEQ ID NO: 304870 - DNA, 16 bp, C. familiaris
agtctctcatgctctg

SEQ ID NO: 304871 - DNA, 65 bp, C. familiaris
agtctcttcaataaatggtgctgggaaaattggacatccacatgcagaagaatgaaactagacca

SEQ ID NO: 304872 - DNA, 16 bp, C. familiaris
agtctcttcctcttct

SEQ ID NO: 304873 - DNA, 16 bp, C. familiaris
agtctgaaaaggctgc

SEQ ID NO: 304874 - DNA, 16 bp, C. familiaris
agtctgaaagcctgag

SEQ ID NO: 304875 - DNA, 16 bp, C. familiaris
agtctgattctccttc

SEQ ID NO: 304876 - DNA, 16 bp, C. familiaris
agtctgctggagatcc

SEQ ID NO: 304877 - DNA, 16 bp, C. familiaris
agtctgcttaagaatt

SEQ ID NO: 304878 - DNA, 16 bp, C. familiaris
agtctgcttcagagtc

SEQ ID NO: 304879 - DNA, 16 bp, C. familiaris
agtctgctttccctct

SEQ ID NO: 304880 - DNA, 16 bp, C. familiaris
agtctggaaaaggcaa

SEQ ID NO: 304881 - DNA, 16 bp, C. familiaris
agtctggatgcctttt

SEQ ID NO: 304882 - DNA, 16 bp, C. familiaris
agtctggatttgaacc

SEQ ID NO: 304883 - DNA, 16 bp, C. familiaris
agtctgggtggctcag

SEQ ID NO: 304884 - DNA, 16 bp, C. familiaris
agtctgttctctgtgt

SEQ ID NO: 304885 - DNA, 16 bp, C. familiaris
agtctgtttgtccttc

SEQ ID NO: 304886 - DNA, 16 bp, C. familiaris
agtcttcaggatcagg

SEQ ID NO: 304887 - DNA, 16 bp, C. familiaris
agtcttggtttgctga

SEQ ID NO: 304888 - DNA, 16 bp, C. familiaris
agtctttaggattttc

SEQ ID NO: 304889 - DNA, 16 bp, C. familiaris
agtctttcacctcctt

SEQ ID NO: 304890 - DNA, 16 bp, C. familiaris
agtcttttcagattgg

SEQ ID NO: 304891 - DNA, 16 bp, C. familiaris
agtcttttgtgtctgg

SEQ ID NO: 304892 - DNA, 16 bp, C. familiaris
agtctttttaaagaaa

SEQ ID NO: 304893 - DNA, 16 bp, C. familiaris
agtgaaaatatcaatg

SEQ ID NO: 304894 - DNA, 17 bp, C. familiaris
agtgaaaatatcagtga

SEQ ID NO: 304895 - DNA, 16 bp, C. familiaris
agtgaaatattattca

SEQ ID NO: 304896 - DNA, 16 bp, C. familiaris
agtgaaattgtatggt

SEQ ID NO: 304897 - DNA, 16 bp, C. familiaris
agtgaacatttattga

SEQ ID NO: 304898 - DNA, 16 bp, C. familiaris
agtgaagagagagccc

SEQ ID NO: 304899 - DNA, 16 bp, C. familiaris
agtgaagcagcagaaa

SEQ ID NO: 304900 - DNA, 16 bp, C. familiaris
agtgaagcatccaact

SEQ ID NO: 304901 - DNA, 16 bp, C. familiaris
agtgaaggagacagaa

SEQ ID NO: 304902 - DNA, 16 bp, C. familiaris
agtgaagtatctgcct

SEQ ID NO: 304903 - DNA, 16 bp, C. familiaris
agtgaagtttgcaaat

SEQ ID NO: 304904 - DNA, 16 bp, C. familiaris
agtgacacagacagag

SEQ ID NO: 304905 - DNA, 16 bp, C. familiaris
agtgacacccactctt

SEQ ID NO: 304906 - DNA, 16 bp, C. familiaris
agtgacactgagcatc

SEQ ID NO: 304907 - DNA, 16 bp, C. familiaris
agtgacagaaagcaaa

SEQ ID NO: 304908 - DNA, 16 bp, C. familiaris
agtgacagttttattt

SEQ ID NO: 304909 - DNA, 16 bp, C. familiaris
agtgacattgagcatt

SEQ ID NO: 304910 - DNA, 16 bp, C. familiaris
agtgacctggaggaca

SEQ ID NO: 304911 - DNA, 16 bp, C. familiaris
agtgactcacagaact

SEQ ID NO: 304912 - DNA, 16 bp, C. familiaris
agtgactgcaccagct

SEQ ID NO: 304913 - DNA, 16 bp, C. familiaris
agtgactgggtgacag

SEQ ID NO: 304914 - DNA, 16 bp, C. familiaris
agtgactgtaccattt

SEQ ID NO: 304915 - DNA, 16 bp, C. familiaris
agtgacttagaagaca

SEQ ID NO: 304916 - DNA, 16 bp, C. familiaris
agtgagaatgatgaaa

SEQ ID NO: 304917 - DNA, 16 bp, C. familiaris
agtgagaatgtggaga

SEQ ID NO: 304918 - DNA, 16 bp, C. familiaris
agtgagagaaagagca

SEQ ID NO: 304919 - DNA, 16 bp, C. familiaris
agtgagagacagcaca

SEQ ID NO: 304920 - DNA, 16 bp, C. familiaris
agtgagcaagcaagca

SEQ ID NO: 304921 - DNA, 16 bp, C. familiaris
agtgagcaagtgagca

SEQ ID NO: 304922 - DNA, 16 bp, C. familiaris
agtgagctggaagaca

SEQ ID NO: 304923 - DNA, 16 bp, C. familiaris
agtgaggagcctgaca

SEQ ID NO: 304924 - DNA, 16 bp, C. familiaris
agtgaggatgtggaga

SEQ ID NO: 304925 - DNA, 16 bp, C. familiaris
agtgaggtgaatgatg

SEQ ID NO: 304926 - DNA, 16 bp, C. familiaris
agtgagtgagagtgag

SEQ ID NO: 304927 - DNA, 16 bp, C. familiaris
agtgatgagagtggac

SEQ ID NO: 304928 - DNA, 16 bp, C. familiaris
agtgatttttaaaaat

SEQ ID NO: 304929 - DNA, 16 bp, C. familiaris
agtgcaacagggttcc

SEQ ID NO: 304930 - DNA, 16 bp, C. familiaris
agtgcagaggaccata

SEQ ID NO: 304931 - DNA, 16 bp, C. familiaris
agtgcagcctgcagcc

SEQ ID NO: 304932 - DNA, 16 bp, C. familiaris
agtgccaggattgagt

SEQ ID NO: 304933 - DNA, 16 bp, C. familiaris
agtgcccatcacccca

SEQ ID NO: 304934 - DNA, 16 bp, C. familiaris
agtgcccgggtggctc

SEQ ID NO: 304935 - DNA, 16 bp, C. familiaris
agtgccgcctccagcc

SEQ ID NO: 304936 - DNA, 16 bp, C. familiaris
agtgcctcctgcagcc

SEQ ID NO: 304937 - DNA, 16 bp, C. familiaris
agtgccttcctcagtg

SEQ ID NO: 304938 - DNA, 16 bp, C. familiaris
agtgctatgaaggaaa

SEQ ID NO: 304939 - DNA, 16 bp, C. familiaris
agtgctcatcctgcca

SEQ ID NO: 304940 - DNA, 16 bp, C. familiaris
agtgctccaggcagag

SEQ ID NO: 304941 - DNA, 16 bp, C. familiaris
agtgctcgcttcggca

SEQ ID NO: 304942 - DNA, 16 bp, C. familiaris
agtgctgaaggaaaaa

SEQ ID NO: 304943 - DNA, 16 bp, C. familiaris
agtgctgccctcagtg

SEQ ID NO: 304944 - DNA, 16 bp, C. familiaris
agtgctgccttcaccc

SEQ ID NO: 304945 - DNA, 16 bp, C. familiaris
agtgctgggcacacag

SEQ ID NO: 304946 - DNA, 16 bp, C. familiaris
agtgcttaaagggaaa

SEQ ID NO: 304947 - DNA, 16 bp, C. familiaris
agtgctttgaagaaaa

SEQ ID NO: 304948 - DNA, 16 bp, C. familiaris
agtggaaaaactggtg

SEQ ID NO: 304949 - DNA, 16 bp, C. familiaris
agtggaaagagcatgg

SEQ ID NO: 304950 - DNA, 16 bp, C. familiaris
agtggaaaggaaaaac

SEQ ID NO: 304951 - DNA, 16 bp, C. familiaris
agtggaacagaataca

SEQ ID NO: 304952 - DNA, 16 bp, C. familiaris
agtggaagggcagagg

SEQ ID NO: 304953 - DNA, 16 bp, C. familiaris
agtggaattagtggat

SEQ ID NO: 304954 - DNA, 16 bp, C. familiaris
agtggagcatgtgatt

SEQ ID NO: 304955 - DNA, 16 bp, C. familiaris
agtggaggatctcagt

SEQ ID NO: 304956 - DNA, 16 bp, C. familiaris
agtggagggagaagca

SEQ ID NO: 304957 - DNA, 16 bp, C. familiaris
agtggatgagcatctg

SEQ ID NO: 304958 - DNA, 16 bp, C. familiaris
agtggatgtggagaaa

SEQ ID NO: 304959 - DNA, 16 bp, C. familiaris
agtggcaagcagaggg

SEQ ID NO: 304960 - DNA, 16 bp, C. familiaris
agtggcagaactggga

SEQ ID NO: 304961 - DNA, 16 bp, C. familiaris
agtggcagagggggag

SEQ ID NO: 304962 - DNA, 16 bp, C. familiaris
agtggcagcaccagtt

SEQ ID NO: 304963 - DNA, 16 bp, C. familiaris
agtggcagggaggggc

SEQ ID NO: 304964 - DNA, 16 bp, C. familiaris
agtggcagggccagct

SEQ ID NO: 304965 - DNA, 16 bp, C. familiaris
agtggcagggctgggg

SEQ ID NO: 304966 - DNA, 16 bp, C. familiaris
agtggcagttttactt

SEQ ID NO: 304967 - DNA, 16 bp, C. familiaris
agtggcccatcttggg

SEQ ID NO: 304968 - DNA, 16 bp, C. familiaris
agtggctataccagct

SEQ ID NO: 304969 - DNA, 16 bp, C. familiaris
agtggctcaatcagtt

SEQ ID NO: 304970 - DNA, 16 bp, C. familiaris
agtggctcagtggctt

SEQ ID NO: 304971 - DNA, 16 bp, C. familiaris
agtggctctggaaaaa

SEQ ID NO: 304972 - DNA, 16 bp, C. familiaris
agtggctgagtgcctg

SEQ ID NO: 304973 - DNA, 16 bp, C. familiaris
agtggctgcagcagct

SEQ ID NO: 304974 - DNA, 16 bp, C. familiaris
agtggctttcaaactt

SEQ ID NO: 304975 - DNA, 16 bp, C. familiaris
agtgggaaaaaattag

SEQ ID NO: 304976 - DNA, 16 bp, C. familiaris
agtgggaaatatcagt

SEQ ID NO: 304977 - DNA, 16 bp, C. familiaris
agtgggagcagcagag

SEQ ID NO: 304978 - DNA, 16 bp, C. familiaris
agtgggaggagggcag

SEQ ID NO: 304979 - DNA, 16 bp, C. familiaris
agtgggatttatacct

SEQ ID NO: 304980 - DNA, 16 bp, C. familiaris
agtgggcaggacagca

SEQ ID NO: 304981 - DNA, 16 bp, C. familiaris
agtgggcagtctgctt

SEQ ID NO: 304982 - DNA, 16 bp, C. familiaris
agtggggaatctgctt

SEQ ID NO: 304983 - DNA, 16 bp, C. familiaris
agtggggacacctggg

SEQ ID NO: 304984 - DNA, 16 bp, C. familiaris
agtgggggcgcctggg

SEQ ID NO: 304985 - DNA, 16 bp, C. familiaris
agtgggggctgtttac

SEQ ID NO: 304986 - DNA, 16 bp, C. familiaris
agtgggtaaagaagat

SEQ ID NO: 304987 - DNA, 16 bp, C. familiaris
agtgggtggagcatgt

SEQ ID NO: 304988 - DNA, 16 bp, C. familiaris
agtggtacagccactc

SEQ ID NO: 304989 - DNA, 16 bp, C. familiaris
agtggtgggcagaggg

SEQ ID NO: 304990 - DNA, 16 bp, C. familiaris
agtggtttttattgat

SEQ ID NO: 304991 - DNA, 16 bp, C. familiaris
agtgtataaaaacaca

SEQ ID NO: 304992 - DNA, 16 bp, C. familiaris
agtgtattattatcta

SEQ ID NO: 304993 - DNA, 16 bp, C. familiaris
agtgtccaccttcagc

SEQ ID NO: 304994 - DNA, 16 bp, C. familiaris
agtgtccatcagtaga

SEQ ID NO: 304995 - DNA, 16 bp, C. familiaris
agtgtccatcagtgga

SEQ ID NO: 304996 - DNA, 16 bp, C. familiaris
agtgtcctcgctgtcc

SEQ ID NO: 304997 - DNA, 16 bp, C. familiaris
agtgtctgattttggc

SEQ ID NO: 304998 - DNA, 16 bp, C. familiaris
agtgtgagtgtgtgtg

SEQ ID NO: 304999 - DNA, 16 bp, C. familiaris
agtgtgcatgagtggg

SEQ ID NO: 305000 - DNA, 16 bp, C. familiaris
agtgtggagccagatg

SEQ ID NO: 305001 - DNA, 16 bp, C. familiaris
agtgtggggaagggca

SEQ ID NO: 305002 - DNA, 16 bp, C. familiaris
agtgtggggaggagca

SEQ ID NO: 305003 - DNA, 16 bp, C. familiaris
agtgtggtcctggaga

SEQ ID NO: 305004 - DNA, 16 bp, C. familiaris
agtgtgtcattcaaaa

SEQ ID NO: 305005 - DNA, 16 bp, C. familiaris
agtgtgtgcacctggg

SEQ ID NO: 305006 - DNA, 16 bp, C. familiaris
agtgttctacagtttt

SEQ ID NO: 305007 - DNA, 16 bp, C. familiaris
agtgttctgtagattt

SEQ ID NO: 305008 - DNA, 16 bp, C. familiaris
agtgttgaataatatt

SEQ ID NO: 305009 - DNA, 16 bp, C. familiaris
agtgttgatgagaatg

SEQ ID NO: 305010 - DNA, 16 bp, C. familiaris
agtgttttcatttact

SEQ ID NO: 305011 - DNA, 16 bp, C. familiaris
agtgttttcatttctt

SEQ ID NO: 305012 - DNA, 22 bp, C. familiaris
agttaaaaatatacctgcccta

SEQ ID NO: 305013 - DNA, 16 bp, C. familiaris
agttaaatgtgaattt

SEQ ID NO: 305014 - DNA, 16 bp, C. familiaris
agttaaatttgagttt

SEQ ID NO: 305015 - DNA, 16 bp, C. familiaris
agttaacaaacagtgt

SEQ ID NO: 305016 - DNA, 16 bp, C. familiaris
agttaagaaatactta

SEQ ID NO: 305017 - DNA, 16 bp, C. familiaris
agttaagcaagatgaa

SEQ ID NO: 305018 - DNA, 16 bp, C. familiaris
agttacaggaagaaaa

SEQ ID NO: 305019 - DNA, 16 bp, C. familiaris
agttacatttttaaaa

SEQ ID NO: 305020 - DNA, 16 bp, C. familiaris
agttagaatttcaaca

SEQ ID NO: 305021 - DNA, 16 bp, C. familiaris
agttagtagaagaaag

SEQ ID NO: 305022 - DNA, 16 bp, C. familiaris
agttcaaattccagct

SEQ ID NO: 305023 - DNA, 16 bp, C. familiaris
agttcaagccccacac

SEQ ID NO: 305024 - DNA, 16 bp, C. familiaris
agttcaagtcccacgt

SEQ ID NO: 305025 - DNA, 16 bp, C. familiaris
agttcaattaaaaaat

SEQ ID NO: 305026 - DNA, 16 bp, C. familiaris
agttcacagaaaaaaa

SEQ ID NO: 305027 - DNA, 16 bp, C. familiaris
agttcacattcccaca

SEQ ID NO: 305028 - DNA, 16 bp, C. familiaris
agttcaccaattcaaa

SEQ ID NO: 305029 - DNA, 16 bp, C. familiaris
agttcagaggaagaaa

SEQ ID NO: 305030 - DNA, 16 bp, C. familiaris
agttcaggggcacctg

SEQ ID NO: 305031 - DNA, 16 bp, C. familiaris
agttcattaattttca

SEQ ID NO: 305032 - DNA, 16 bp, C. familiaris
agttccagaagaagaa

SEQ ID NO: 305033 - DNA, 16 bp, C. familiaris
agttccagttgcttca

SEQ ID NO: 305034 - DNA, 16 bp, C. familiaris
agttccatgagggcag

SEQ ID NO: 305035 - DNA, 16 bp, C. familiaris
agttcctgcaggagct

SEQ ID NO: 305036 - DNA, 16 bp, C. familiaris
agttcctgggtggctc

SEQ ID NO: 305037 - DNA, 16 bp, C. familiaris
agttctcaacacaaga

SEQ ID NO: 305038 - DNA, 16 bp, C. familiaris
agttctgcttttaatt

SEQ ID NO: 305039 - DNA, 16 bp, C. familiaris
agttcttcatttctga

SEQ ID NO: 305040 - DNA, 16 bp, C. familiaris
agttcttctggtctct

SEQ ID NO: 305041 - DNA, 16 bp, C. familiaris
agttctttccagtgtt

SEQ ID NO: 305042 - DNA, 16 bp, C. familiaris
agttcttttggataaa

SEQ ID NO: 305043 - DNA, 16 bp, C. familiaris
agttgaccatataatt

SEQ ID NO: 305044 - DNA, 16 bp, C. familiaris
agttgagcacctccct

SEQ ID NO: 305045 - DNA, 16 bp, C. familiaris
agttgagtcagaccag

SEQ ID NO: 305046 - DNA, 16 bp, C. familiaris
agttgagtttttaaaa

SEQ ID NO: 305047 - DNA, 16 bp, C. familiaris
agttgatggcaaagaa

SEQ ID NO: 305048 - DNA, 16 bp, C. familiaris
agttgatggcaaggaa

SEQ ID NO: 305049 - DNA, 16 bp, C. familiaris
agttgcaagagttctt

SEQ ID NO: 305050 - DNA, 16 bp, C. familiaris
agttgctcaagccaaa

SEQ ID NO: 305051 - DNA, 16 bp, C. familiaris
agttgctgctgctgct

SEQ ID NO: 305052 - DNA, 16 bp, C. familiaris
agttggggaagatgaa

SEQ ID NO: 305053 - DNA, 16 bp, C. familiaris
agttgtaaatggaatt

SEQ ID NO: 305054 - DNA, 16 bp, C. familiaris
agttgtgggatccagc

SEQ ID NO: 305055 - DNA, 16 bp, C. familiaris
agttgtgtgactttgg

SEQ ID NO: 305056 - DNA, 16 bp, C. familiaris
agtttaaaatattttc

SEQ ID NO: 305057 - DNA, 16 bp, C. familiaris
agtttaaaattatttc

SEQ ID NO: 305058 - DNA, 16 bp, C. familiaris
agtttaatttctaaat

SEQ ID NO: 305059 - DNA, 16 bp, C. familiaris
agtttatgttaatgag

SEQ ID NO: 305060 - DNA, 16 bp, C. familiaris
agtttattaaagcaaa

SEQ ID NO: 305061 - DNA, 16 bp, C. familiaris
agtttcaataaattta

SEQ ID NO: 305062 - DNA, 16 bp, C. familiaris
agtttcaggtgtacca

SEQ ID NO: 305063 - DNA, 16 bp, C. familiaris
agtttcattggaacac

SEQ ID NO: 305064 - DNA, 17 bp, C. familiaris
agtttccatgaatgttt

SEQ ID NO: 305065 - DNA, 16 bp, C. familiaris
agtttccatttctcta

SEQ ID NO: 305066 - DNA, 16 bp, C. familiaris
agtttccctccttccc

SEQ ID NO: 305067 - DNA, 16 bp, C. familiaris
agtttcctcaaaaagt

SEQ ID NO: 305068 - DNA, 16 bp, C. familiaris
agtttcctcaactata

SEQ ID NO: 305069 - DNA, 16 bp, C. familiaris
agtttcctcaagaaat

SEQ ID NO: 305070 - DNA, 16 bp, C. familiaris
agtttccttatcagta

SEQ ID NO: 305071 - DNA, 16 bp, C. familiaris
agtttccttatctgta

SEQ ID NO: 305072 - DNA, 16 bp, C. familiaris
agtttccttttctgtg

SEQ ID NO: 305073 - DNA, 16 bp, C. familiaris
agtttctccatctata

SEQ ID NO: 305074 - DNA, 16 bp, C. familiaris
agtttctctgcaataa

SEQ ID NO: 305075 - DNA, 16 bp, C. familiaris
agtttctctttcttca

SEQ ID NO: 305076 - DNA, 16 bp, C. familiaris
agtttctgattcagaa

SEQ ID NO: 305077 - DNA, 16 bp, C. familiaris
agtttctgattcagga

SEQ ID NO: 305078 - DNA, 16 bp, C. familiaris
agtttctgcctctctt

SEQ ID NO: 305079 - DNA, 16 bp, C. familiaris
agtttctgtggccaag

SEQ ID NO: 305080 - DNA, 16 bp, C. familiaris
agtttctgtttgtcct

SEQ ID NO: 305081 - DNA, 16 bp, C. familiaris
agtttctgtttgttct

SEQ ID NO: 305082 - DNA, 16 bp, C. familiaris
agtttcttaaaaaaca

SEQ ID NO: 305083 - DNA, 16 bp, C. familiaris
agtttcttaaaaatta

SEQ ID NO: 305084 - DNA, 16 bp, C. familiaris
agtttctttcttctgc

SEQ ID NO: 305085 - DNA, 16 bp, C. familiaris
agtttgaaagtaaaaa

SEQ ID NO: 305086 - DNA, 16 bp, C. familiaris
agtttgacttcctctt

SEQ ID NO: 305087 - DNA, 16 bp, C. familiaris
agtttgactttttaaa

SEQ ID NO: 305088 - DNA, 16 bp, C. familiaris
agtttgagaactgctg

SEQ ID NO: 305089 - DNA, 16 bp, C. familiaris
agtttgagccccaggt

SEQ ID NO: 305090 - DNA, 16 bp, C. familiaris
agtttgctccttttta

SEQ ID NO: 305091 - DNA, 16 bp, C. familiaris
agtttggacatatgca

SEQ ID NO: 305092 - DNA, 16 bp, C. familiaris
agtttggagtctgctt

SEQ ID NO: 305093 - DNA, 16 bp, C. familiaris
agtttggatcaggaat

SEQ ID NO: 305094 - DNA, 16 bp, C. familiaris
agtttgggtttttaaa

SEQ ID NO: 305095 - DNA, 16 bp, C. familiaris
agtttgtaattttaaa

SEQ ID NO: 305096 - DNA, 16 bp, C. familiaris
agtttgtgatctcagg

SEQ ID NO: 305097 - DNA, 16 bp, C. familiaris
agtttgtggtaacttg

SEQ ID NO: 305098 - DNA, 16 bp, C. familiaris
agtttgttctgtcagt

SEQ ID NO: 305099 - DNA, 16 bp, C. familiaris
agtttgttgactgttt

SEQ ID NO: 305100 - DNA, 16 bp, C. familiaris
agttttaaaataactt

SEQ ID NO: 305101 - DNA, 16 bp, C. familiaris
agttttaaaatctttt

SEQ ID NO: 305102 - DNA, 16 bp, C. familiaris
agttttaatttttcct

SEQ ID NO: 305103 - DNA, 16 bp, C. familiaris
agttttataagaaact

SEQ ID NO: 305104 - DNA, 16 bp, C. familiaris
agttttcaacaaaaaa

SEQ ID NO: 305105 - DNA, 16 bp, C. familiaris
agttttcaataattca

SEQ ID NO: 305106 - DNA, 16 bp, C. familiaris
agttttcagctatgat

SEQ ID NO: 305107 - DNA, 16 bp, C. familiaris
agttttcaggatgatt

SEQ ID NO: 305108 - DNA, 16 bp, C. familiaris
agttttcccaagacca

SEQ ID NO: 305109 - DNA, 16 bp, C. familiaris
agttttctaaattatg

SEQ ID NO: 305110 - DNA, 16 bp, C. familiaris
agttttcttcttgtaa

SEQ ID NO: 305111 - DNA, 16 bp, C. familiaris
agttttctttccttct

SEQ ID NO: 305112 - DNA, 16 bp, C. familiaris
agttttgaaattggga

SEQ ID NO: 305113 - DNA, 16 bp, C. familiaris
agttttggtcatttat

SEQ ID NO: 305114 - DNA, 16 bp, C. familiaris
agttttgtcttttcta

SEQ ID NO: 305115 - DNA, 16 bp, C. familiaris
agtttttaaatacaaa

SEQ ID NO: 305116 - DNA, 16 bp, C. familiaris
agtttttaaggaaaaa

SEQ ID NO: 305117 - DNA, 16 bp, C. familiaris
agtttttatttattca

SEQ ID NO: 305118 - DNA, 16 bp, C. familiaris
agtttttcttcctctt

SEQ ID NO: 305119 - DNA, 16 bp, C. familiaris
agtttttgaaaaagaa

SEQ ID NO: 305120 - DNA, 16 bp, C. familiaris
ataaaaaacttctgca

SEQ ID NO: 305121 - DNA, 16 bp, C. familiaris
ataaaaacagagccca

SEQ ID NO: 305122 - DNA, 16 bp, C. familiaris
ataaaaacatatttgt

SEQ ID NO: 305123 - DNA, 16 bp, C. familiaris
ataaaaacttgaaaag

SEQ ID NO: 305124 - DNA, 16 bp, C. familiaris
ataaaaagactgaaat

SEQ ID NO: 305125 - DNA, 16 bp, C. familiaris
ataaaaagcttttcca

SEQ ID NO: 305126 - DNA, 16 bp, C. familiaris
ataaaaaggaaatctt

SEQ ID NO: 305127 - DNA, 16 bp, C. familiaris
ataaaaataaatgtct

SEQ ID NO: 305128 - DNA, 16 bp, C. familiaris
ataaaaatacagaatt

SEQ ID NO: 305129 - DNA, 16 bp, C. familiaris
ataaaaatatccagca

SEQ ID NO: 305130 - DNA, 16 bp, C. familiaris
ataaaaatctcagaat

SEQ ID NO: 305131 - DNA, 16 bp, C. familiaris
ataaaaatctgaaaat

SEQ ID NO: 305132 - DNA, 16 bp, C. familiaris
ataaaaatctgtattt

SEQ ID NO: 305133 - DNA, 16 bp, C. familiaris
ataaaaatgcaaatta

SEQ ID NO: 305134 - DNA, 16 bp, C. familiaris
ataaaaatgtacatat

SEQ ID NO: 305135 - DNA, 16 bp, C. familiaris
ataaaaatgtagtgat

SEQ ID NO: 305136 - DNA, 16 bp, C. familiaris
ataaaaatgtagtttt

SEQ ID NO: 305137 - DNA, 16 bp, C. familiaris
ataaaaatgttctgga

SEQ ID NO: 305138 - DNA, 16 bp, C. familiaris
ataaaaattcttttgg

SEQ ID NO: 305139 - DNA, 16 bp, C. familiaris
ataaaaatttcaagaa

SEQ ID NO: 305140 - DNA, 16 bp, C. familiaris
ataaaacagaggatca

SEQ ID NO: 305141 - DNA, 16 bp, C. familiaris
ataaaacagatgaaag

SEQ ID NO: 305142 - DNA, 16 bp, C. familiaris
ataaaacatttctttt

SEQ ID NO: 305143 - DNA, 16 bp, C. familiaris
ataaaaccttatttta

SEQ ID NO: 305144 - DNA, 16 bp, C. familiaris
ataaaaccttttttaa

SEQ ID NO: 305145 - DNA, 16 bp, C. familiaris
ataaaactccaagaag

SEQ ID NO: 305146 - DNA, 16 bp, C. familiaris
ataaaactgaaaaatg

SEQ ID NO: 305147 - DNA, 16 bp, C. familiaris
ataaaactgtttttaa

SEQ ID NO: 305148 - DNA, 16 bp, C. familiaris
ataaaacttctttaaa

SEQ ID NO: 305149 - DNA, 16 bp, C. familiaris
ataaaactttcactat

SEQ ID NO: 305150 - DNA, 16 bp, C. familiaris
ataaaacttttgaaaa

SEQ ID NO: 305151 - DNA, 16 bp, C. familiaris
ataaaagaaaaatctc

SEQ ID NO: 305152 - DNA, 16 bp, C. familiaris
ataaaagactttaaaa

SEQ ID NO: 305153 - DNA, 16 bp, C. familiaris
ataaaagattttgttt

SEQ ID NO: 305154 - DNA, 16 bp, C. familiaris
ataaaagcaatgagaa

SEQ ID NO: 305155 - DNA, 16 bp, C. familiaris
ataaaaggaattcaaa

SEQ ID NO: 305156 - DNA, 16 bp, C. familiaris
ataaaatacatcttta

SEQ ID NO: 305157 - DNA, 16 bp, C. familiaris
ataaaatactagtaaa

SEQ ID NO: 305158 - DNA, 16 bp, C. familiaris
ataaaatatcagcaaa

SEQ ID NO: 305159 - DNA, 16 bp, C. familiaris
ataaaatattggcaaa

SEQ ID NO: 305160 - DNA, 16 bp, C. familiaris
ataaaatcatgaaata

SEQ ID NO: 305161 - DNA, 16 bp, C. familiaris
ataaaatctcaagaaa

SEQ ID NO: 305162 - DNA, 16 bp, C. familiaris
ataaaatcttagaaat

SEQ ID NO: 305163 - DNA, 16 bp, C. familiaris
ataaaatcttggaaga

SEQ ID NO: 305164 - DNA, 16 bp, C. familiaris
ataaaatcttttctaa

SEQ ID NO: 305165 - DNA, 16 bp, C. familiaris
ataaaatgaatgaatg

SEQ ID NO: 305166 - DNA, 16 bp, C. familiaris
ataaaatgctaatttt

SEQ ID NO: 305167 - DNA, 16 bp, C. familiaris
ataaaatggaatttta

SEQ ID NO: 305168 - DNA, 16 bp, C. familiaris
ataaaatgtaaaacca

SEQ ID NO: 305169 - DNA, 16 bp, C. familiaris
ataaaatgtttcattt

SEQ ID NO: 305170 - DNA, 16 bp, C. familiaris
ataaaatgttttgaaa

SEQ ID NO: 305171 - DNA, 16 bp, C. familiaris
ataaaattatttggaa

SEQ ID NO: 305172 - DNA, 16 bp, C. familiaris
ataaaattcatctttt

SEQ ID NO: 305173 - DNA, 16 bp, C. familiaris
ataaacaaatggaaag

SEQ ID NO: 305174 - DNA, 16 bp, C. familiaris
ataaacaacagaaatc

SEQ ID NO: 305175 - DNA, 17 bp, C. familiaris
ataaacaacagcctgag

SEQ ID NO: 305176 - DNA, 16 bp, C. familiaris
ataaacagtgttggga

SEQ ID NO: 305177 - DNA, 16 bp, C. familiaris
ataaacattgtgaaaa

SEQ ID NO: 305178 - DNA, 16 bp, C. familiaris
ataaacattttacttt

SEQ ID NO: 305179 - DNA, 16 bp, C. familiaris
ataaaccatatcttct

SEQ ID NO: 305180 - DNA, 16 bp, C. familiaris
ataaacctaatggtaa

SEQ ID NO: 305181 - DNA, 16 bp, C. familiaris
ataaactagacttcat

SEQ ID NO: 305182 - DNA, 16 bp, C. familiaris
ataaacttgaaaataa

SEQ ID NO: 305183 - DNA, 16 bp, C. familiaris
ataaagaaactaaggc

SEQ ID NO: 305184 - DNA, 16 bp, C. familiaris
ataaagaaatatattc

SEQ ID NO: 305185 - DNA, 16 bp, C. familiaris
ataaagaacttttaaa

SEQ ID NO: 305186 - DNA, 16 bp, C. familiaris
ataaagaagatacagt

SEQ ID NO: 305187 - DNA, 16 bp, C. familiaris
ataaagaatttccaag

SEQ ID NO: 305188 - DNA, 16 bp, C. familiaris
ataaagagaaaaatcc

SEQ ID NO: 305189 - DNA, 16 bp, C. familiaris
ataaagatcaatggaa

SEQ ID NO: 305190 - DNA, 16 bp, C. familiaris
ataaagatcagagaag

SEQ ID NO: 305191 - DNA, 16 bp, C. familiaris
ataaagatgcaaaaat

SEQ ID NO: 305192 - DNA, 16 bp, C. familiaris
ataaagcagaagaaag

SEQ ID NO: 305193 - DNA, 16 bp, C. familiaris
ataaagcaggaaagaa

SEQ ID NO: 305194 - DNA, 16 bp, C. familiaris
ataaagctgttaccaa

SEQ ID NO: 305195 - DNA, 16 bp, C. familiaris
ataaagctttttgcag

SEQ ID NO: 305196 - DNA, 16 bp, C. familiaris
ataaaggaaggaaatt

SEQ ID NO: 305197 - DNA, 16 bp, C. familiaris
ataaaggagaattata

SEQ ID NO: 305198 - DNA, 16 bp, C. familiaris
ataaaggaggaaactg

SEQ ID NO: 305199 - DNA, 16 bp, C. familiaris
ataaaggcaaaggaaa

SEQ ID NO: 305200 - DNA, 16 bp, C. familiaris
ataaagtctttttttt

SEQ ID NO: 305201 - DNA, 16 bp, C. familiaris
ataaagttgctgtgaa

SEQ ID NO: 305202 - DNA, 16 bp, C. familiaris
ataaagtttaaaaaca

SEQ ID NO: 305203 - DNA, 16 bp, C. familiaris
ataaagtttgaaacaa

SEQ ID NO: 305204 - DNA, 16 bp, C. familiaris
ataaataaaagcattt

SEQ ID NO: 305205 - DNA, 16 bp, C. familiaris
ataaataaaatgcttt

SEQ ID NO: 305206 - DNA, 17 bp, C. familiaris
ataaataaagtcttaaa

SEQ ID NO: 305207 - DNA, 16 bp, C. familiaris
ataaataaatatcttc

SEQ ID NO: 305208 - DNA, 16 bp, C. familiaris
ataaataaatgtgtta

SEQ ID NO: 305209 - DNA, 16 bp, C. familiaris
ataaataagcattttt

SEQ ID NO: 305210 - DNA, 16 bp, C. familiaris
ataaatacatgtatat

SEQ ID NO: 305211 - DNA, 16 bp, C. familiaris
ataaatacccagaatt

SEQ ID NO: 305212 - DNA, 16 bp, C. familiaris
ataaatactagtgaaa

SEQ ID NO: 305213 - DNA, 16 bp, C. familiaris
ataaatatatgtgtgt

SEQ ID NO: 305214 - DNA, 16 bp, C. familiaris
ataaatattccattgt

SEQ ID NO: 305215 - DNA, 16 bp, C. familiaris
ataaatcagacaaaga

SEQ ID NO: 305216 - DNA, 16 bp, C. familiaris
ataaatctctttaaat

SEQ ID NO: 305217 - DNA, 16 bp, C. familiaris
ataaatctgaaaaata

SEQ ID NO: 305218 - DNA, 16 bp, C. familiaris
ataaatctttaaaaga

SEQ ID NO: 305219 - DNA, 16 bp, C. familiaris
ataaatctttggaaaa

SEQ ID NO: 305220 - DNA, 16 bp, C. familiaris
ataaatgaaatggaga

SEQ ID NO: 305221 - DNA, 16 bp, C. familiaris
ataaatgacatagaaa

SEQ ID NO: 305222 - DNA, 16 bp, C. familiaris
ataaatgcaattaaaa

SEQ ID NO: 305223 - DNA, 16 bp, C. familiaris
ataaatgcttaataaa

SEQ ID NO: 305224 - DNA, 16 bp, C. familiaris
ataaatggaaaaatct

SEQ ID NO: 305225 - DNA, 16 bp, C. familiaris
ataaatggaatgatat

SEQ ID NO: 305226 - DNA, 16 bp, C. familiaris
ataaatggatggatga

SEQ ID NO: 305227 - DNA, 16 bp, C. familiaris
ataaatggattaaact

SEQ ID NO: 305228 - DNA, 16 bp, C. familiaris
ataaatggattttaaa

SEQ ID NO: 305229 - DNA, 16 bp, C. familiaris
ataaatgggaaaatat

SEQ ID NO: 305230 - DNA, 16 bp, C. familiaris
ataaatgtatatacat

SEQ ID NO: 305231 - DNA, 16 bp, C. familiaris
ataaatgtgtgtatat

SEQ ID NO: 305232 - DNA, 16 bp, C. familiaris
ataaatgtttacaaat

SEQ ID NO: 305233 - DNA, 16 bp, C. familiaris
ataaatgtttattgag

SEQ ID NO: 305234 - DNA, 16 bp, C. familiaris
ataaattaagaatctc

SEQ ID NO: 305235 - DNA, 16 bp, C. familiaris
ataaatttaacaaaga

SEQ ID NO: 305236 - DNA, 16 bp, C. familiaris
ataaatttaaggtgta

SEQ ID NO: 305237 - DNA, 16 bp, C. familiaris
ataaattttagcatca

SEQ ID NO: 305238 - DNA, 16 bp, C. familiaris
ataaattttcctctaa

SEQ ID NO: 305239 - DNA, 16 bp, C. familiaris
ataaattttgacaaat

SEQ ID NO: 305240 - DNA, 16 bp, C. familiaris
ataaattttggatact

SEQ ID NO: 305241 - DNA, 16 bp, C. familiaris
ataaatttttgttgaa

SEQ ID NO: 305242 - DNA, 16 bp, C. familiaris
ataacaaagtagcaga

SEQ ID NO: 305243 - DNA, 16 bp, C. familiaris
ataacacaggagaaaa

SEQ ID NO: 305244 - DNA, 16 bp, C. familiaris
ataacactaagtgaaa

SEQ ID NO: 305245 - DNA, 16 bp, C. familiaris
ataacagtgaacaaaa

SEQ ID NO: 305246 - DNA, 16 bp, C. familiaris
ataacatctccaaaga

SEQ ID NO: 305247 - DNA, 16 bp, C. familiaris
ataacattacattagt

SEQ ID NO: 305248 - DNA, 16 bp, C. familiaris
ataacattttggatat

SEQ ID NO: 305249 - DNA, 16 bp, C. familiaris
ataaccagaagtggaa

SEQ ID NO: 305250 - DNA, 50 bp, C. familiaris
ataaccagggaggaaattgaagcagtcatcaaaaacctcccaagacacaa

SEQ ID NO: 305251 - DNA, 16 bp, C. familiaris
ataaccccaaactgga

SEQ ID NO: 305252 - DNA, 16 bp, C. familiaris
ataacctctctgagcc

SEQ ID NO: 305253 - DNA, 16 bp, C. familiaris
ataactgtgcttctga

SEQ ID NO: 305254 - DNA, 16 bp, C. familiaris
ataacttttaaaaagt

SEQ ID NO: 305255 - DNA, 16 bp, C. familiaris
ataactttttaaaaga

SEQ ID NO: 305256 - DNA, 16 bp, C. familiaris
ataagaaaaatatcta

SEQ ID NO: 305257 - DNA, 16 bp, C. familiaris
ataagacattctggaa

SEQ ID NO: 305258 - DNA, 16 bp, C. familiaris
ataagagatgaagagg

SEQ ID NO: 305259 - DNA, 16 bp, C. familiaris
ataagagatgctgaac

SEQ ID NO: 305260 - DNA, 16 bp, C. familiaris
ataagatacctagaaa

SEQ ID NO: 305261 - DNA, 16 bp, C. familiaris
ataagcaaaattttaa

SEQ ID NO: 305262 - DNA, 16 bp, C. familiaris
ataagccaaggagaga

SEQ ID NO: 305263 - DNA, 16 bp, C. familiaris
ataagctgaacttcat

SEQ ID NO: 305264 - DNA, 16 bp, C. familiaris
ataaggaaaacaaatt

SEQ ID NO: 305265 - DNA, 16 bp, C. familiaris
ataaggaaaacatttt

SEQ ID NO: 305266 - DNA, 16 bp, C. familiaris
ataaggaaacagaaga

SEQ ID NO: 305267 - DNA, 16 bp, C. familiaris
ataaggaaacagtggc

SEQ ID NO: 305268 - DNA, 16 bp, C. familiaris
ataaggaaacattgga

SEQ ID NO: 305269 - DNA, 16 bp, C. familiaris
ataaggaaattgaggt

SEQ ID NO: 305270 - DNA, 16 bp, C. familiaris
ataaggaagagaaaac

SEQ ID NO: 305271 - DNA, 16 bp, C. familiaris
ataaggacccttgtga

SEQ ID NO: 305272 - DNA, 16 bp, C. familiaris
ataagggcagccccgg

SEQ ID NO: 305273 - DNA, 16 bp, C. familiaris
ataagtactttaaaaa

SEQ ID NO: 305274 - DNA, 16 bp, C. familiaris
ataagtatataagtat

SEQ ID NO: 305275 - DNA, 16 bp, C. familiaris
ataagtcagagaaaga

SEQ ID NO: 305276 - DNA, 16 bp, C. familiaris
ataagtgatgatgagc

SEQ ID NO: 305277 - DNA, 16 bp, C. familiaris
ataagtttaaccaagg

SEQ ID NO: 305278 - DNA, 16 bp, C. familiaris
ataagttttgacaaat

SEQ ID NO: 305279 - DNA, 16 bp, C. familiaris
ataataaaactgtaat

SEQ ID NO: 305280 - DNA, 16 bp, C. familiaris
ataataaaagggtcta

SEQ ID NO: 305281 - DNA, 16 bp, C. familiaris
ataataaaatgcattt

SEQ ID NO: 305282 - DNA, 16 bp, C. familiaris
ataataaatatttctc

SEQ ID NO: 305283 - DNA, 16 bp, C. familiaris
ataataaatgtgtgtt

SEQ ID NO: 305284 - DNA, 16 bp, C. familiaris
ataataaatgttggtg

SEQ ID NO: 305285 - DNA, 16 bp, C. familiaris
ataataataattccta

SEQ ID NO: 305286 - DNA, 16 bp, C. familiaris
ataataatagcaaaca

SEQ ID NO: 305287 - DNA, 16 bp, C. familiaris
ataataatggtgatga

SEQ ID NO: 305288 - DNA, 16 bp, C. familiaris
ataataccaagtgttg

SEQ ID NO: 305289 - DNA, 16 bp, C. familiaris
ataatattgcaataac

SEQ ID NO: 305290 - DNA, 16 bp, C. familiaris
ataatcatcaccatca

SEQ ID NO: 305291 - DNA, 16 bp, C. familiaris
ataatcctaaccaaag

SEQ ID NO: 305292 - DNA, 16 bp, C. familiaris
ataatcctcatgccaa

SEQ ID NO: 305293 - DNA, 16 bp, C. familiaris
ataatctctacactca

SEQ ID NO: 305294 - DNA, 16 bp, C. familiaris
ataatcttcttaaagt

SEQ ID NO: 305295 - DNA, 16 bp, C. familiaris
ataatgaagaagcaga

SEQ ID NO: 305296 - DNA, 16 bp, C. familiaris
ataatgaaggccatat

SEQ ID NO: 305297 - DNA, 16 bp, C. familiaris
ataatgaagttgaaaa

SEQ ID NO: 305298 - DNA, 16 bp, C. familiaris
ataatgacctgaacca

SEQ ID NO: 305299 - DNA, 16 bp, C. familiaris
ataatgagtttttaaa

SEQ ID NO: 305300 - DNA, 16 bp, C. familiaris
ataatgatagatacat

SEQ ID NO: 305301 - DNA, 16 bp, C. familiaris
ataatgatgataatta

SEQ ID NO: 305302 - DNA, 16 bp, C. familiaris
ataatgatgatgatga

SEQ ID NO: 305303 - DNA, 16 bp, C. familiaris
ataatgcattatatgt

SEQ ID NO: 305304 - DNA, 16 bp, C. familiaris
ataatgctataatgaa

SEQ ID NO: 305305 - DNA, 16 bp, C. familiaris
ataatggaatgttatt

SEQ ID NO: 305306 - DNA, 16 bp, C. familiaris
ataatgttttcaaaat

SEQ ID NO: 305307 - DNA, 16 bp, C. familiaris
ataattccatatttat

SEQ ID NO: 305308 - DNA, 16 bp, C. familiaris
ataattctgatttttt

SEQ ID NO: 305309 - DNA, 16 bp, C. familiaris
ataattctttttatgt

SEQ ID NO: 305310 - DNA, 16 bp, C. familiaris
ataattgtgtttctga

SEQ ID NO: 305311 - DNA, 16 bp, C. familiaris
ataatttctctgacat

SEQ ID NO: 305312 - DNA, 16 bp, C. familiaris
ataattttcaccagtt

SEQ ID NO: 305313 - DNA, 16 bp, C. familiaris
ataattttccaaaata

SEQ ID NO: 305314 - DNA, 16 bp, C. familiaris
ataattttcctaaaat

SEQ ID NO: 305315 - DNA, 16 bp, C. familiaris
ataattttgcttttct

SEQ ID NO: 305316 - DNA, 16 bp, C. familiaris
ataatttttatgttct

SEQ ID NO: 305317 - DNA, 16 bp, C. familiaris
atacaaaataaatgca

SEQ ID NO: 305318 - DNA, 16 bp, C. familiaris
atacaaataaatggaa

SEQ ID NO: 305319 - DNA, 16 bp, C. familiaris
atacaacctacagaat

SEQ ID NO: 305320 - DNA, 16 bp, C. familiaris
atacaatatttgtttt

SEQ ID NO: 305321 - DNA, 16 bp, C. familiaris
atacaatcttttttaa

SEQ ID NO: 305322 - DNA, 16 bp, C. familiaris
atacaatgtattatta

SEQ ID NO: 305323 - DNA, 16 bp, C. familiaris
atacaattcacctatt

SEQ ID NO: 305324 - DNA, 16 bp, C. familiaris
atacacacatacacac

SEQ ID NO: 305325 - DNA, 16 bp, C. familiaris
atacacacgtacacac

SEQ ID NO: 305326 - DNA, 16 bp, C. familiaris
atacacatacagaaaa

SEQ ID NO: 305327 - DNA, 16 bp, C. familiaris
atacacatatatattt

SEQ ID NO: 305328 - DNA, 16 bp, C. familiaris
atacagaaatataatt

SEQ ID NO: 305329 - DNA, 16 bp, C. familiaris
atacagaacatttcta

SEQ ID NO: 305330 - DNA, 16 bp, C. familiaris
atacagaccaatggaa

SEQ ID NO: 305331 - DNA, 16 bp, C. familiaris
atacagagaaagaaag

SEQ ID NO: 305332 - DNA, 16 bp, C. familiaris
atacagagaagaaact

SEQ ID NO: 305333 - DNA, 16 bp, C. familiaris
atacagatgtagtgaa

SEQ ID NO: 305334 - DNA, 16 bp, C. familiaris
atacagattttagaat

SEQ ID NO: 305335 - DNA, 16 bp, C. familiaris
atacagcagtgaaaat

SEQ ID NO: 305336 - DNA, 16 bp, C. familiaris
atacagtaaatatttt

SEQ ID NO: 305337 - DNA, 16 bp, C. familiaris
atacatacaaatatca

SEQ ID NO: 305338 - DNA, 16 bp, C. familiaris
atacatacatatatat

SEQ ID NO: 305339 - DNA, 16 bp, C. familiaris
atacatatagatatat

SEQ ID NO: 305340 - DNA, 16 bp, C. familiaris
atacatatatgatata

SEQ ID NO: 305341 - DNA, 16 bp, C. familiaris
atacatatattcatat

SEQ ID NO: 305342 - DNA, 16 bp, C. familiaris
atacatatttctccaa

SEQ ID NO: 305343 - DNA, 16 bp, C. familiaris
atacatatttgttgaa

SEQ ID NO: 305344 - DNA, 16 bp, C. familiaris
atacatgtataatttt

SEQ ID NO: 305345 - DNA, 16 bp, C. familiaris
atacatgtgtgtgttt

SEQ ID NO: 305346 - DNA, 16 bp, C. familiaris
atacatttaagaaaaa

SEQ ID NO: 305347 - DNA, 16 bp, C. familiaris
atacatttatttacat

SEQ ID NO: 305348 - DNA, 16 bp, C. familiaris
atacatttatttgaaa

SEQ ID NO: 305349 - DNA, 16 bp, C. familiaris
atacatttttaatgta

SEQ ID NO: 305350 - DNA, 16 bp, C. familiaris
ataccaaaaccagata

SEQ ID NO: 305351 - DNA, 18 bp, C. familiaris
ataccaaaagattgggat

SEQ ID NO: 305352 - DNA, 16 bp, C. familiaris
ataccaaaatcagaaa

SEQ ID NO: 305353 - DNA, 16 bp, C. familiaris
ataccacctcataccc

SEQ ID NO: 305354 - DNA, 16 bp, C. familiaris
ataccacgtcttcttt

SEQ ID NO: 305355 - DNA, 16 bp, C. familiaris
ataccatgttttgttt

SEQ ID NO: 305356 - DNA, 16 bp, C. familiaris
atacccaaagaaaatg

SEQ ID NO: 305357 - DNA, 24 bp, C. familiaris
atacctattctcctaaagctgttc

SEQ ID NO: 305358 - DNA, 16 bp, C. familiaris
atacctgggggcatca

SEQ ID NO: 305359 - DNA, 16 bp, C. familiaris
ataccttctttggaaa

SEQ ID NO: 305360 - DNA, 16 bp, C. familiaris
ataccttggagatatt

SEQ ID NO: 305361 - DNA, 16 bp, C. familiaris
atacgatttcattcat

SEQ ID NO: 305362 - DNA, 16 bp, C. familiaris
atactacaacatgaat

SEQ ID NO: 305363 - DNA, 16 bp, C. familiaris
atactacccaaaggaa

SEQ ID NO: 305364 - DNA, 16 bp, C. familiaris
atactacctcttcttt

SEQ ID NO: 305365 - DNA, 16 bp, C. familiaris
atactatatgttagca

SEQ ID NO: 305366 - DNA, 16 bp, C. familiaris
atactcaatgataaaa

SEQ ID NO: 305367 - DNA, 16 bp, C. familiaris
atactcagaaacaaga

SEQ ID NO: 305368 - DNA, 16 bp, C. familiaris
atactcattcttttca

SEQ ID NO: 305369 - DNA, 16 bp, C. familiaris
atactctccagctcca

SEQ ID NO: 305370 - DNA, 16 bp, C. familiaris
atactctgaaaaccat

SEQ ID NO: 305371 - DNA, 16 bp, C. familiaris
atactctttagatcca

SEQ ID NO: 305372 - DNA, 16 bp, C. familiaris
atactgagtatctttt

SEQ ID NO: 305373 - DNA, 16 bp, C. familiaris
atactgcatgatatca

SEQ ID NO: 305374 - DNA, 16 bp, C. familiaris
atactgcatttttttt

SEQ ID NO: 305375 - DNA, 16 bp, C. familiaris
atactggaaataaaat

SEQ ID NO: 305376 - DNA, 16 bp, C. familiaris
atactgttttcctcag

SEQ ID NO: 305377 - DNA, 16 bp, C. familiaris
atacttgggtttattt

SEQ ID NO: 305378 - DNA, 16 bp, C. familiaris
atactttaaacttaca

SEQ ID NO: 305379 - DNA, 16 bp, C. familiaris
atactttgtttaaaaa

SEQ ID NO: 305380 - DNA, 16 bp, C. familiaris
atacttttcatccctg

SEQ ID NO: 305381 - DNA, 16 bp, C. familiaris
atacttttgcatttta

SEQ ID NO: 305382 - DNA, 16 bp, C. familiaris
atagaaaaatacatat

SEQ ID NO: 305383 - DNA, 16 bp, C. familiaris
atagaaaacccaggaa

SEQ ID NO: 305384 - DNA, 16 bp, C. familiaris
atagaaaacctggaaa

SEQ ID NO: 305385 - DNA, 16 bp, C. familiaris
atagaaaatctttttt

SEQ ID NO: 305386 - DNA, 16 bp, C. familiaris
atagaaaatttgaaga

SEQ ID NO: 305387 - DNA, 16 bp, C. familiaris
atagaaaatttggaaa

SEQ ID NO: 305388 - DNA, 16 bp, C. familiaris
atagaaactaatgaaa

SEQ ID NO: 305389 - DNA, 16 bp, C. familiaris
atagaaagagagaggc

SEQ ID NO: 305390 - DNA, 16 bp, C. familiaris
atagaaagcccaaaaa

SEQ ID NO: 305391 - DNA, 16 bp, C. familiaris
atagaaatgaaacaga

SEQ ID NO: 305392 - DNA, 16 bp, C. familiaris
atagaaatgatccctg

SEQ ID NO: 305393 - DNA, 16 bp, C. familiaris
atagaaatgcaaataa

SEQ ID NO: 305394 - DNA, 16 bp, C. familiaris
atagaaatgcagctga

SEQ ID NO: 305395 - DNA, 16 bp, C. familiaris
atagaaatgctactga

SEQ ID NO: 305396 - DNA, 16 bp, C. familiaris
atagaacacatactgg

SEQ ID NO: 305397 - DNA, 16 bp, C. familiaris
atagaacatttataaa

SEQ ID NO: 305398 - DNA, 16 bp, C. familiaris
atagaaccagaaaaga

SEQ ID NO: 305399 - DNA, 16 bp, C. familiaris
atagaactttctgtga

SEQ ID NO: 305400 - DNA, 16 bp, C. familiaris
atagaagaagaaactg

SEQ ID NO: 305401 - DNA, 16 bp, C. familiaris
atagaagatttgaaca

SEQ ID NO: 305402 - DNA, 16 bp, C. familiaris
atagaatatatacata

SEQ ID NO: 305403 - DNA, 16 bp, C. familiaris
atagaatattatttgg

SEQ ID NO: 305404 - DNA, 16 bp, C. familiaris
atagaattgttgaata

SEQ ID NO: 305405 - DNA, 16 bp, C. familiaris
atagaattgttttctt

SEQ ID NO: 305406 - DNA, 16 bp, C. familiaris
atagaatttttaaatg

SEQ ID NO: 305407 - DNA, 16 bp, C. familiaris
atagaatttttgaatc

SEQ ID NO: 305408 - DNA, 16 bp, C. familiaris
atagacatggccagca

SEQ ID NO: 305409 - DNA, 16 bp, C. familiaris
atagacattttccaaa

SEQ ID NO: 305410 - DNA, 16 bp, C. familiaris
atagacctgccctacc

SEQ ID NO: 305411 - DNA, 16 bp, C. familiaris
atagactgggtgactt

SEQ ID NO: 305412 - DNA, 16 bp, C. familiaris
atagagaaaatcaatg

SEQ ID NO: 305413 - DNA, 16 bp, C. familiaris
atagagagagagaagc

SEQ ID NO: 305414 - DNA, 16 bp, C. familiaris
atagagagatgataga

SEQ ID NO: 305415 - DNA, 16 bp, C. familiaris
atagaggccagggatg

SEQ ID NO: 305416 - DNA, 16 bp, C. familiaris
atagagggaacatccc

SEQ ID NO: 305417 - DNA, 16 bp, C. familiaris
atagatacagagaaca

SEQ ID NO: 305418 - DNA, 16 bp, C. familiaris
atagatagatagatag

SEQ ID NO: 305419 - DNA, 16 bp, C. familiaris
atagatcaaagaagaa

SEQ ID NO: 305420 - DNA, 16 bp, C. familiaris
atagatgaacaagaga

SEQ ID NO: 305421 - DNA, 16 bp, C. familiaris
atagatgaatggaaaa

SEQ ID NO: 305422 - DNA, 16 bp, C. familiaris
atagatgatagagaga

SEQ ID NO: 305423 - DNA, 16 bp, C. familiaris
atagatgatgaggatt

SEQ ID NO: 305424 - DNA, 16 bp, C. familiaris
atagatgctgaatttt

SEQ ID NO: 305425 - DNA, 16 bp, C. familiaris
atagatgctttaagta

SEQ ID NO: 305426 - DNA, 16 bp, C. familiaris
atagatgtggaaaaag

SEQ ID NO: 305427 - DNA, 16 bp, C. familiaris
atagattttggacact

SEQ ID NO: 305428 - DNA, 16 bp, C. familiaris
atagatttttaaagat

SEQ ID NO: 305429 - DNA, 16 bp, C. familiaris
atagcaaaaatatttt

SEQ ID NO: 305430 - DNA, 16 bp, C. familiaris
atagcaaaattatgga

SEQ ID NO: 305431 - DNA, 16 bp, C. familiaris
atagcagcaatattca

SEQ ID NO: 305432 - DNA, 16 bp, C. familiaris
atagcagcattattga

SEQ ID NO: 305433 - DNA, 16 bp, C. familiaris
atagcagctatgtcca

SEQ ID NO: 305434 - DNA, 16 bp, C. familiaris
atagcagtggttctca

SEQ ID NO: 305435 - DNA, 16 bp, C. familiaris
atagcatcaaaaacaa

SEQ ID NO: 305436 - DNA, 16 bp, C. familiaris
atagccaaaagctgga

SEQ ID NO: 305437 - DNA, 24 bp, C. familiaris
atagccaaactgtggaaggagcct

SEQ ID NO: 305438 - DNA, 16 bp, C. familiaris
atagctgaaaacattc

SEQ ID NO: 305439 - DNA, 16 bp, C. familiaris
ataggaaaaatatttg

SEQ ID NO: 305440 - DNA, 16 bp, C. familiaris
ataggaaacagactga

SEQ ID NO: 305441 - DNA, 16 bp, C. familiaris
ataggagaagatattt

SEQ ID NO: 305442 - DNA, 16 bp, C. familiaris
ataggcagaaagagaa

SEQ ID NO: 305443 - DNA, 16 bp, C. familiaris
ataggcagagagaaaa

SEQ ID NO: 305444 - DNA, 16 bp, C. familiaris
ataggcatggttgatt

SEQ ID NO: 305445 - DNA, 16 bp, C. familiaris
atagggatcacattga

SEQ ID NO: 305446 - DNA, 16 bp, C. familiaris
atagggattatattga

SEQ ID NO: 305447 - DNA, 16 bp, C. familiaris
ataggtaaagaaaatg

SEQ ID NO: 305448 - DNA, 16 bp, C. familiaris
ataggtcaatggaaca

SEQ ID NO: 305449 - DNA, 16 bp, C. familiaris
ataggtcagagaaaga

SEQ ID NO: 305450 - DNA, 16 bp, C. familiaris
ataggtcccctgaggc

SEQ ID NO: 305451 - DNA, 16 bp, C. familiaris
atagtagtacatcatt

SEQ ID NO: 305452 - DNA, 16 bp, C. familiaris
atagtcaaaatgtgga

SEQ ID NO: 305453 - DNA, 16 bp, C. familiaris
atagtcacaggttcca

SEQ ID NO: 305454 - DNA, 16 bp, C. familiaris
atagtcatagtcacag

SEQ ID NO: 305455 - DNA, 16 bp, C. familiaris
atagtcatggccaaca

SEQ ID NO: 305456 - DNA, 16 bp, C. familiaris
atagtgaacaaactga

SEQ ID NO: 305457 - DNA, 16 bp, C. familiaris
atagttctggaggtta

SEQ ID NO: 305458 - DNA, 16 bp, C. familiaris
atagtttattttgctt

SEQ ID NO: 305459 - DNA, 16 bp, C. familiaris
atataaaaatcctcaa

SEQ ID NO: 305460 - DNA, 16 bp, C. familiaris
atataaaaattctgaa

SEQ ID NO: 305461 - DNA, 16 bp, C. familiaris
atataaagaactttaa

SEQ ID NO: 305462 - DNA, 16 bp, C. familiaris
atataaagcaaacatt

SEQ ID NO: 305463 - DNA, 16 bp, C. familiaris
atataaatacaacaga

SEQ ID NO: 305464 - DNA, 16 bp, C. familiaris
atataaatacaatgaa

SEQ ID NO: 305465 - DNA, 16 bp, C. familiaris
atataaatgtatatgt

SEQ ID NO: 305466 - DNA, 16 bp, C. familiaris
atataaatgtatgtat

SEQ ID NO: 305467 - DNA, 16 bp, C. familiaris
atataagaatggctac

SEQ ID NO: 305468 - DNA, 16 bp, C. familiaris
atataaggaaaatgtg

SEQ ID NO: 305469 - DNA, 16 bp, C. familiaris
atataatggaatatga

SEQ ID NO: 305470 - DNA, 16 bp, C. familiaris
atataatggaattata

SEQ ID NO: 305471 - DNA, 16 bp, C. familiaris
atataattacatacat

SEQ ID NO: 305472 - DNA, 16 bp, C. familiaris
atataattatgtgtat

SEQ ID NO: 305473 - DNA, 16 bp, C. familiaris
atataattgaaatcat

SEQ ID NO: 305474 - DNA, 16 bp, C. familiaris
atatacacaacagaat

SEQ ID NO: 305475 - DNA, 16 bp, C. familiaris
atatacacacatttta

SEQ ID NO: 305476 - DNA, 16 bp, C. familiaris
atatacacatgcaaaa

SEQ ID NO: 305477 - DNA, 16 bp, C. familiaris
atatacatggaatatt

SEQ ID NO: 305478 - DNA, 16 bp, C. familiaris
atatacatgtatatat

SEQ ID NO: 305479 - DNA, 16 bp, C. familiaris
atatacctaaaacata

SEQ ID NO: 305480 - DNA, 16 bp, C. familiaris
atatactaaatgccac

SEQ ID NO: 305481 - DNA, 16 bp, C. familiaris
atatactatatatact

SEQ ID NO: 305482 - DNA, 16 bp, C. familiaris
atatagaaaatcctaa

SEQ ID NO: 305483 - DNA, 16 bp, C. familiaris
atatagagttgttgaa

SEQ ID NO: 305484 - DNA, 16 bp, C. familiaris
atatagatatagatat

SEQ ID NO: 305485 - DNA, 16 bp, C. familiaris
atatagatgtagtgaa

SEQ ID NO: 305486 - DNA, 16 bp, C. familiaris
atatagcatttttaaa

SEQ ID NO: 305487 - DNA, 16 bp, C. familiaris
atatagtgaaaatgtc

SEQ ID NO: 305488 - DNA, 16 bp, C. familiaris
atatataaacaaatgg

SEQ ID NO: 305489 - DNA, 16 bp, C. familiaris
atatataaggaactta

SEQ ID NO: 305490 - DNA, 16 bp, C. familiaris
atatatacacacatat

SEQ ID NO: 305491 - DNA, 16 bp, C. familiaris
atatatacagaatatt

SEQ ID NO: 305492 - DNA, 16 bp, C. familiaris
atatatacagtatata

SEQ ID NO: 305493 - DNA, 16 bp, C. familiaris
atatatacatatgtat

SEQ ID NO: 305494 - DNA, 16 bp, C. familiaris
atatatagatgtgtgt

SEQ ID NO: 305495 - DNA, 16 bp, C. familiaris
atatatatacgtatat

SEQ ID NO: 305496 - DNA, 16 bp, C. familiaris
atatatatataaagca

SEQ ID NO: 305497 - DNA, 16 bp, C. familiaris
atatatatatgaagag

SEQ ID NO: 305498 - DNA, 16 bp, C. familiaris
atatatatctttttga

SEQ ID NO: 305499 - DNA, 16 bp, C. familiaris
atatatatggttatat

SEQ ID NO: 305500 - DNA, 16 bp, C. familiaris
atatatatgtaatgaa

SEQ ID NO: 305501 - DNA, 16 bp, C. familiaris
atatatatttgtgaga

SEQ ID NO: 305502 - DNA, 16 bp, C. familiaris
atatatcagaatatat

SEQ ID NO: 305503 - DNA, 16 bp, C. familiaris
atatatctatatatag

SEQ ID NO: 305504 - DNA, 16 bp, C. familiaris
atatatgaaaaattca

SEQ ID NO: 305505 - DNA, 16 bp, C. familiaris
atatatgaaaagatgt

SEQ ID NO: 305506 - DNA, 16 bp, C. familiaris
atatatgaaatgtata

SEQ ID NO: 305507 - DNA, 16 bp, C. familiaris
atatatgaatgtatgt

SEQ ID NO: 305508 - DNA, 16 bp, C. familiaris
atatatgattttcaaa

SEQ ID NO: 305509 - DNA, 16 bp, C. familiaris
atatatgcatacattt

SEQ ID NO: 305510 - DNA, 16 bp, C. familiaris
atatatgcatggattt

SEQ ID NO: 305511 - DNA, 16 bp, C. familiaris
atatatgtatatatac

SEQ ID NO: 305512 - DNA, 16 bp, C. familiaris
atatattatgtacata

SEQ ID NO: 305513 - DNA, 16 bp, C. familiaris
atatattcaaagtgat

SEQ ID NO: 305514 - DNA, 16 bp, C. familiaris
atatattcagaaaaat

SEQ ID NO: 305515 - DNA, 16 bp, C. familiaris
atatattcctaagtat

SEQ ID NO: 305516 - DNA, 16 bp, C. familiaris
atatatttaaagtgta

SEQ ID NO: 305517 - DNA, 16 bp, C. familiaris
atatatttcacatctt

SEQ ID NO: 305518 - DNA, 16 bp, C. familiaris
atatatttcagaaaga

SEQ ID NO: 305519 - DNA, 16 bp, C. familiaris
atatatttcttgttat

SEQ ID NO: 305520 - DNA, 16 bp, C. familiaris
atatatttgagagaga

SEQ ID NO: 305521 - DNA, 16 bp, C. familiaris
atatattttcagtttt

SEQ ID NO: 305522 - DNA, 16 bp, C. familiaris
atatattttgccattt

SEQ ID NO: 305523 - DNA, 16 bp, C. familiaris
atatattttgggtatt

SEQ ID NO: 305524 - DNA, 16 bp, C. familiaris
atatatttttcctttg

SEQ ID NO: 305525 - DNA, 16 bp, C. familiaris
atatatttttggaaaa

SEQ ID NO: 305526 - DNA, 16 bp, C. familiaris
atatcaagtgttggtg

SEQ ID NO: 305527 - DNA, 16 bp, C. familiaris
atatcacatattcttt

SEQ ID NO: 305528 - DNA, 16 bp, C. familiaris
atatcagaatttaaaa

SEQ ID NO: 305529 - DNA, 16 bp, C. familiaris
atatcagtgaggatga

SEQ ID NO: 305530 - DNA, 16 bp, C. familiaris
atatcagtttcagatg

SEQ ID NO: 305531 - DNA, 16 bp, C. familiaris
atatcatctttggaaa

SEQ ID NO: 305532 - DNA, 16 bp, C. familiaris
atatcattgactgtat

SEQ ID NO: 305533 - DNA, 16 bp, C. familiaris
atatcattgtgatttt

SEQ ID NO: 305534 - DNA, 16 bp, C. familiaris
atatccaggagtggaa

SEQ ID NO: 305535 - DNA, 16 bp, C. familiaris
atatcctgccactttg

SEQ ID NO: 305536 - DNA, 16 bp, C. familiaris
atatcctttcctgctt

SEQ ID NO: 305537 - DNA, 16 bp, C. familiaris
atatctacatctatat

SEQ ID NO: 305538 - DNA, 16 bp, C. familiaris
atatctcacatatata

SEQ ID NO: 305539 - DNA, 16 bp, C. familiaris
atatcttctcccagtt

SEQ ID NO: 305540 - DNA, 16 bp, C. familiaris
atatcttctttaccca

SEQ ID NO: 305541 - DNA, 16 bp, C. familiaris
atatcttgaaaaaaaa

SEQ ID NO: 305542 - DNA, 16 bp, C. familiaris
atatcttttcatttgt

SEQ ID NO: 305543 - DNA, 16 bp, C. familiaris
atatctttttattgga

SEQ ID NO: 305544 - DNA, 16 bp, C. familiaris
atatgaaaagacattt

SEQ ID NO: 305545 - DNA, 16 bp, C. familiaris
atatgaaaagatactc

SEQ ID NO: 305546 - DNA, 16 bp, C. familiaris
atatgaaaagtccaga

SEQ ID NO: 305547 - DNA, 16 bp, C. familiaris
atatgaaaatcaataa

SEQ ID NO: 305548 - DNA, 16 bp, C. familiaris
atatgaaacatttttt

SEQ ID NO: 305549 - DNA, 16 bp, C. familiaris
atatgaagatgaataa

SEQ ID NO: 305550 - DNA, 16 bp, C. familiaris
atatgacccagaaatt

SEQ ID NO: 305551 - DNA, 16 bp, C. familiaris
atatgacccagccatt

SEQ ID NO: 305552 - DNA, 16 bp, C. familiaris
atatgagactttctac

SEQ ID NO: 305553 - DNA, 16 bp, C. familiaris
atatgaggacacagca

SEQ ID NO: 305554 - DNA, 16 bp, C. familiaris
atatgagtgagataat

SEQ ID NO: 305555 - DNA, 16 bp, C. familiaris
atatgataagcccaca

SEQ ID NO: 305556 - DNA, 16 bp, C. familiaris
atatgattttactcct

SEQ ID NO: 305557 - DNA, 16 bp, C. familiaris
atatgcaaaaaaatta

SEQ ID NO: 305558 - DNA, 16 bp, C. familiaris
atatgcaaaaattaaa

SEQ ID NO: 305559 - DNA, 16 bp, C. familiaris
atatgcagatttttaa

SEQ ID NO: 305560 - DNA, 16 bp, C. familiaris
atatgcatatatatct

SEQ ID NO: 305561 - DNA, 16 bp, C. familiaris
atatgcatattaaaat

SEQ ID NO: 305562 - DNA, 16 bp, C. familiaris
atatgcatgtatatgt

SEQ ID NO: 305563 - DNA, 16 bp, C. familiaris
atatgcccaagagaaa

SEQ ID NO: 305564 - DNA, 16 bp, C. familiaris
atatgccctgaatgtg

SEQ ID NO: 305565 - DNA, 16 bp, C. familiaris
atatgctaaaatattt

SEQ ID NO: 305566 - DNA, 16 bp, C. familiaris
atatgctttattttat

SEQ ID NO: 305567 - DNA, 16 bp, C. familiaris
atatggaaaatctctg

SEQ ID NO: 305568 - DNA, 16 bp, C. familiaris
atatggaaacaaatga

SEQ ID NO: 305569 - DNA, 16 bp, C. familiaris
atatggaaatgcaaat

SEQ ID NO: 305570 - DNA, 16 bp, C. familiaris
atatggaagaaatgga

SEQ ID NO: 305571 - DNA, 16 bp, C. familiaris
atatggagaaaaggga

SEQ ID NO: 305572 - DNA, 16 bp, C. familiaris
atatggagagaaatat

SEQ ID NO: 305573 - DNA, 16 bp, C. familiaris
atatggatatccagtt

SEQ ID NO: 305574 - DNA, 16 bp, C. familiaris
atatggatatggatat

SEQ ID NO: 305575 - DNA, 16 bp, C. familiaris
atatggatgaacctag

SEQ ID NO: 305576 - DNA, 16 bp, C. familiaris
atatgggggaaagggt

SEQ ID NO: 305577 - DNA, 16 bp, C. familiaris
atatggtgaattaatc

SEQ ID NO: 305578 - DNA, 16 bp, C. familiaris
atatgtaaaatctaaa

SEQ ID NO: 305579 - DNA, 16 bp, C. familiaris
atatgtacagtttatt

SEQ ID NO: 305580 - DNA, 16 bp, C. familiaris
atatgtatgaatgtat

SEQ ID NO: 305581 - DNA, 16 bp, C. familiaris
atatgtattatatagt

SEQ ID NO: 305582 - DNA, 16 bp, C. familiaris
atatgtattatatatg

SEQ ID NO: 305583 - DNA, 16 bp, C. familiaris
atatgtcaaaattaag

SEQ ID NO: 305584 - DNA, 16 bp, C. familiaris
atatgtccaaaggaaa

SEQ ID NO: 305585 - DNA, 16 bp, C. familiaris
atatgtgaaggagatt

SEQ ID NO: 305586 - DNA, 16 bp, C. familiaris
atatgtgaattatatc

SEQ ID NO: 305587 - DNA, 16 bp, C. familiaris
atatgtgaccacaaaa

SEQ ID NO: 305588 - DNA, 16 bp, C. familiaris
atatgtggccttttat

SEQ ID NO: 305589 - DNA, 16 bp, C. familiaris
atatgtgtaaatatat

SEQ ID NO: 305590 - DNA, 16 bp, C. familiaris
atatgttgaaactcta

SEQ ID NO: 305591 - DNA, 16 bp, C. familiaris
atatgtttgtcaaaac

SEQ ID NO: 305592 - DNA, 16 bp, C. familiaris
atatgttttcatttct

SEQ ID NO: 305593 - DNA, 16 bp, C. familiaris
atattaaaagagagag

SEQ ID NO: 305594 - DNA, 16 bp, C. familiaris
atattaaacactcaaa

SEQ ID NO: 305595 - DNA, 16 bp, C. familiaris
atattaaccctttatt

SEQ ID NO: 305596 - DNA, 16 bp, C. familiaris
atattaagcatatttt

SEQ ID NO: 305597 - DNA, 16 bp, C. familiaris
atattaatgaaatcat

SEQ ID NO: 305598 - DNA, 16 bp, C. familiaris
atattacaagaaaact

SEQ ID NO: 305599 - DNA, 16 bp, C. familiaris
atattacacattttat

SEQ ID NO: 305600 - DNA, 16 bp, C. familiaris
atattacactgtatgt

SEQ ID NO: 305601 - DNA, 16 bp, C. familiaris
atattatcattgtttt

SEQ ID NO: 305602 - DNA, 16 bp, C. familiaris
atattattcagtctta

SEQ ID NO: 305603 - DNA, 16 bp, C. familiaris
atattcaagtattttt

SEQ ID NO: 305604 - DNA, 16 bp, C. familiaris
atattcacaaatatat

SEQ ID NO: 305605 - DNA, 16 bp, C. familiaris
atattcagaagtggaa

SEQ ID NO: 305606 - DNA, 16 bp, C. familiaris
atattcataaaatgga

SEQ ID NO: 305607 - DNA, 16 bp, C. familiaris
atattcatagcaacat

SEQ ID NO: 305608 - DNA, 16 bp, C. familiaris
atattcatgatagaga

SEQ ID NO: 305609 - DNA, 16 bp, C. familiaris
atattccacaaatgaa

SEQ ID NO: 305610 - DNA, 16 bp, C. familiaris
atattccacatataag

SEQ ID NO: 305611 - DNA, 16 bp, C. familiaris
atattccatttaaaaa

SEQ ID NO: 305612 - DNA, 16 bp, C. familiaris
atattcctcagccttt

SEQ ID NO: 305613 - DNA, 16 bp, C. familiaris
atattctgaaaatgaa

SEQ ID NO: 305614 - DNA, 16 bp, C. familiaris
atattctggatgttaa

SEQ ID NO: 305615 - DNA, 16 bp, C. familiaris
atattctgttgcttta

SEQ ID NO: 305616 - DNA, 16 bp, C. familiaris
atattcttggctccct

SEQ ID NO: 305617 - DNA, 16 bp, C. familiaris
atattgaaaagaaaac

SEQ ID NO: 305618 - DNA, 16 bp, C. familiaris
atattgacaaattgaa

SEQ ID NO: 305619 - DNA, 16 bp, C. familiaris
atattgagtctttcaa

SEQ ID NO: 305620 - DNA, 16 bp, C. familiaris
atattgataaaatgtc

SEQ ID NO: 305621 - DNA, 16 bp, C. familiaris
atattgatattgatat

SEQ ID NO: 305622 - DNA, 16 bp, C. familiaris
atattgatgatgatga

SEQ ID NO: 305623 - DNA, 16 bp, C. familiaris
atattgcaaagctata

SEQ ID NO: 305624 - DNA, 16 bp, C. familiaris
atattgcactgtatgt

SEQ ID NO: 305625 - DNA, 16 bp, C. familiaris
atattggaaaggaaaa

SEQ ID NO: 305626 - DNA, 16 bp, C. familiaris
atattggtctatgatt

SEQ ID NO: 305627 - DNA, 16 bp, C. familiaris
atattgtgaaattatt

SEQ ID NO: 305628 - DNA, 16 bp, C. familiaris
atattgttgattcatt

SEQ ID NO: 305629 - DNA, 16 bp, C. familiaris
atatttaaaaatggtt

SEQ ID NO: 305630 - DNA, 16 bp, C. familiaris
atatttaaaacatctt

SEQ ID NO: 305631 - DNA, 16 bp, C. familiaris
atatttaagaaacaaa

SEQ ID NO: 305632 - DNA, 16 bp, C. familiaris
atatttaatagtgaaa

SEQ ID NO: 305633 - DNA, 16 bp, C. familiaris
atatttacagaaaaat

SEQ ID NO: 305634 - DNA, 16 bp, C. familiaris
atatttaccacatttt

SEQ ID NO: 305635 - DNA, 16 bp, C. familiaris
atatttagaaattaag

SEQ ID NO: 305636 - DNA, 16 bp, C. familiaris
atatttaggatgattt

SEQ ID NO: 305637 - DNA, 16 bp, C. familiaris
atatttatatacacac

SEQ ID NO: 305638 - DNA, 16 bp, C. familiaris
atatttatgaaatatg

SEQ ID NO: 305639 - DNA, 16 bp, C. familiaris
atatttattgccattt

SEQ ID NO: 305640 - DNA, 16 bp, C. familiaris
atatttcaaaagcaaa

SEQ ID NO: 305641 - DNA, 16 bp, C. familiaris
atatttcaaagaaaga

SEQ ID NO: 305642 - DNA, 16 bp, C. familiaris
atatttcatagaaata

SEQ ID NO: 305643 - DNA, 16 bp, C. familiaris
atatttccaaagaaga

SEQ ID NO: 305644 - DNA, 16 bp, C. familiaris
atatttctaaaattca

SEQ ID NO: 305645 - DNA, 16 bp, C. familiaris
atatttctccagagaa

SEQ ID NO: 305646 - DNA, 16 bp, C. familiaris
atatttctgaaaaaaa

SEQ ID NO: 305647 - DNA, 16 bp, C. familiaris
atatttctgaaaatgt

SEQ ID NO: 305648 - DNA, 16 bp, C. familiaris
atatttctgaatattt

SEQ ID NO: 305649 - DNA, 16 bp, C. familiaris
atatttcttgaataaa

SEQ ID NO: 305650 - DNA, 16 bp, C. familiaris
atatttcttttgaaaa

SEQ ID NO: 305651 - DNA, 16 bp, C. familiaris
atatttgaaaagtttt

SEQ ID NO: 305652 - DNA, 16 bp, C. familiaris
atatttgaacattttt

SEQ ID NO: 305653 - DNA, 16 bp, C. familiaris
atatttgaagaaaatg

SEQ ID NO: 305654 - DNA, 16 bp, C. familiaris
atatttgaagagatga

SEQ ID NO: 305655 - DNA, 16 bp, C. familiaris
atatttgatcattttt

SEQ ID NO: 305656 - DNA, 16 bp, C. familiaris
atatttgcaaatgata

SEQ ID NO: 305657 - DNA, 16 bp, C. familiaris
atatttgcattaaaaa

SEQ ID NO: 305658 - DNA, 16 bp, C. familiaris
atatttgcatttctaa

SEQ ID NO: 305659 - DNA, 16 bp, C. familiaris
atatttggaaaacaaa

SEQ ID NO: 305660 - DNA, 16 bp, C. familiaris
atatttggaaaagaaa

SEQ ID NO: 305661 - DNA, 16 bp, C. familiaris
atatttggaaatatat

SEQ ID NO: 305662 - DNA, 16 bp, C. familiaris
atatttggattatttc

SEQ ID NO: 305663 - DNA, 16 bp, C. familiaris
atatttgtcaaataaa

SEQ ID NO: 305664 - DNA, 16 bp, C. familiaris
atatttgtctataatt

SEQ ID NO: 305665 - DNA, 16 bp, C. familiaris
atatttgtgaatttcc

SEQ ID NO: 305666 - DNA, 16 bp, C. familiaris
atattttaaaaacctt

SEQ ID NO: 305667 - DNA, 16 bp, C. familiaris
atattttaaaaatgga

SEQ ID NO: 305668 - DNA, 16 bp, C. familiaris
atattttaaaagcaga

SEQ ID NO: 305669 - DNA, 16 bp, C. familiaris
atattttaaagagaat

SEQ ID NO: 305670 - DNA, 16 bp, C. familiaris
atattttaatgcaaaa

SEQ ID NO: 305671 - DNA, 16 bp, C. familiaris
atattttactgtattt

SEQ ID NO: 305672 - DNA, 16 bp, C. familiaris
atattttagaaatgtt

SEQ ID NO: 305673 - DNA, 16 bp, C. familiaris
atattttatcattttg

SEQ ID NO: 305674 - DNA, 16 bp, C. familiaris
atattttatctcaaaa

SEQ ID NO: 305675 - DNA, 16 bp, C. familiaris
atattttcaaaagtaa

SEQ ID NO: 305676 - DNA, 16 bp, C. familiaris
atattttcagttttat

SEQ ID NO: 305677 - DNA, 16 bp, C. familiaris
atattttccataaaat

SEQ ID NO: 305678 - DNA, 16 bp, C. familiaris
atattttcttgatgaa

SEQ ID NO: 305679 - DNA, 16 bp, C. familiaris
atattttgaaaaacaa

SEQ ID NO: 305680 - DNA, 16 bp, C. familiaris
atattttgaaagataa

SEQ ID NO: 305681 - DNA, 16 bp, C. familiaris
atattttgaagaaaga

SEQ ID NO: 305682 - DNA, 16 bp, C. familiaris
atattttgaaggaaaa

SEQ ID NO: 305683 - DNA, 16 bp, C. familiaris
atattttgtcaaatgc

SEQ ID NO: 305684 - DNA, 16 bp, C. familiaris
atatttttaaagtagt

SEQ ID NO: 305685 - DNA, 16 bp, C. familiaris
atatttttaaattgga

SEQ ID NO: 305686 - DNA, 16 bp, C. familiaris
atatttttagagaaat

SEQ ID NO: 305687 - DNA, 16 bp, C. familiaris
atatttttcttaaaga

SEQ ID NO: 305688 - DNA, 16 bp, C. familiaris
atatttttgaaaatgt

SEQ ID NO: 305689 - DNA, 16 bp, C. familiaris
atatttttgaaatgta

SEQ ID NO: 305690 - DNA, 16 bp, C. familiaris
atatttttgacaaact

SEQ ID NO: 305691 - DNA, 16 bp, C. familiaris
atatttttggcaaaaa

SEQ ID NO: 305692 - DNA, 16 bp, C. familiaris
atatttttgtattcct

SEQ ID NO: 305693 - DNA, 16 bp, C. familiaris
atattttttaaaggaa

SEQ ID NO: 305694 - DNA, 16 bp, C. familiaris
atattttttaagagat

SEQ ID NO: 305695 - DNA, 16 bp, C. familiaris
atcaaaaagaaatgct

SEQ ID NO: 305696 - DNA, 16 bp, C. familiaris
atcaaaaagctcccaa

SEQ ID NO: 305697 - DNA, 16 bp, C. familiaris
atcaaaaatctcctaa

SEQ ID NO: 305698 - DNA, 16 bp, C. familiaris
atcaaaaccaagaaat

SEQ ID NO: 305699 - DNA, 16 bp, C. familiaris
atcaaaaccataatga

SEQ ID NO: 305700 - DNA, 16 bp, C. familiaris
atcaaaacccagcaga

SEQ ID NO: 305701 - DNA, 16 bp, C. familiaris
atcaaaaggtacaaat

SEQ ID NO: 305702 - DNA, 16 bp, C. familiaris
atcaaaataccaggga

SEQ ID NO: 305703 - DNA, 16 bp, C. familiaris
atcaaaatcaggaaat

SEQ ID NO: 305704 - DNA, 16 bp, C. familiaris
atcaaaatcctagaag

SEQ ID NO: 305705 - DNA, 16 bp, C. familiaris
atcaaaatcctggagg

SEQ ID NO: 305706 - DNA, 16 bp, C. familiaris
atcaaaattgaaaact

SEQ ID NO: 305707 - DNA, 16 bp, C. familiaris
atcaaaccccacattg

SEQ ID NO: 305708 - DNA, 16 bp, C. familiaris
atcaaactaaaaggct

SEQ ID NO: 305709 - DNA, 16 bp, C. familiaris
atcaaagaagaaatca

SEQ ID NO: 305710 - DNA, 16 bp, C. familiaris
atcaaatatttaaaga

SEQ ID NO: 305711 - DNA, 16 bp, C. familiaris
atcaaatatttactga

SEQ ID NO: 305712 - DNA, 16 bp, C. familiaris
atcaaatgaatgaatg

SEQ ID NO: 305713 - DNA, 16 bp, C. familiaris
atcaaattgaaaagaa

SEQ ID NO: 305714 - DNA, 16 bp, C. familiaris
atcaacaaaatgacaa

SEQ ID NO: 305715 - DNA, 16 bp, C. familiaris
atcaacaaaatgagaa

SEQ ID NO: 305716 - DNA, 16 bp, C. familiaris
atcaacagatgaacag

SEQ ID NO: 305717 - DNA, 16 bp, C. familiaris
atcaacagttgcatgc

SEQ ID NO: 305718 - DNA, 16 bp, C. familiaris
atcaaccaagaaatca

SEQ ID NO: 305719 - DNA, 16 bp, C. familiaris
atcaactgaatgagat

SEQ ID NO: 305720 - DNA, 16 bp, C. familiaris
atcaactgtttatgtt

SEQ ID NO: 305721 - DNA, 16 bp, C. familiaris
atcaagaaaaaattac

SEQ ID NO: 305722 - DNA, 16 bp, C. familiaris
atcaagaaactgaaaa

SEQ ID NO: 305723 - DNA, 16 bp, C. familiaris
atcaagaaagtgaaaa

SEQ ID NO: 305724 - DNA, 16 bp, C. familiaris
atcaagacacagaaca

SEQ ID NO: 305725 - DNA, 16 bp, C. familiaris
atcaagacttggacac

SEQ ID NO: 305726 - DNA, 16 bp, C. familiaris
atcaagagtagaatgc

SEQ ID NO: 305727 - DNA, 16 bp, C. familiaris
atcaagatagaaagct

SEQ ID NO: 305728 - DNA, 16 bp, C. familiaris
atcaagatctagaaca

SEQ ID NO: 305729 - DNA, 16 bp, C. familiaris
atcaagccccaggttg

SEQ ID NO: 305730 - DNA, 16 bp, C. familiaris
atcaagccccttgttg

SEQ ID NO: 305731 - DNA, 16 bp, C. familiaris
atcaagccctgcgtca

SEQ ID NO: 305732 - DNA, 16 bp, C. familiaris
atcaagccctgcgtgg

SEQ ID NO: 305733 - DNA, 16 bp, C. familiaris
atcaagctctacatca

SEQ ID NO: 305734 - DNA, 16 bp, C. familiaris
atcaaggcccacattg

SEQ ID NO: 305735 - DNA, 16 bp, C. familiaris
atcaaggcctgagctg

SEQ ID NO: 305736 - DNA, 16 bp, C. familiaris
atcaaggtgtcagcag

SEQ ID NO: 305737 - DNA, 16 bp, C. familiaris
atcaagtcccacatcc

SEQ ID NO: 305738 - DNA, 16 bp, C. familiaris
atcaagtcccacatgg

SEQ ID NO: 305739 - DNA, 16 bp, C. familiaris
atcaagtcccccatca

SEQ ID NO: 305740 - DNA, 16 bp, C. familiaris
atcaagtctcatgttg

SEQ ID NO: 305741 - DNA, 16 bp, C. familiaris
atcaagtgatatttat

SEQ ID NO: 305742 - DNA, 16 bp, C. familiaris
atcaagtgttgcatgc

SEQ ID NO: 305743 - DNA, 16 bp, C. familiaris
atcaagttgggaagaa

SEQ ID NO: 305744 - DNA, 16 bp, C. familiaris
atcaagttgtcagcag

SEQ ID NO: 305745 - DNA, 16 bp, C. familiaris
atcaataaaaactgct

SEQ ID NO: 305746 - DNA, 16 bp, C. familiaris
atcaataaaaaggaat

SEQ ID NO: 305747 - DNA, 16 bp, C. familiaris
atcaataacagaaagg

SEQ ID NO: 305748 - DNA, 16 bp, C. familiaris
atcaataagaaaacat

SEQ ID NO: 305749 - DNA, 16 bp, C. familiaris
atcaataccaaaagat

SEQ ID NO: 305750 - DNA, 16 bp, C. familiaris
atcaatgaacttgaag

SEQ ID NO: 305751 - DNA, 16 bp, C. familiaris
atcaatgaccccttca

SEQ ID NO: 305752 - DNA, 16 bp, C. familiaris
atcaatggaacagaga

SEQ ID NO: 305753 - DNA, 16 bp, C. familiaris
atcaatggacatttgg

SEQ ID NO: 305754 - DNA, 16 bp, C. familiaris
atcaattaaaagagat

SEQ ID NO: 305755 - DNA, 16 bp, C. familiaris
atcacaaaaagaaatt

SEQ ID NO: 305756 - DNA, 16 bp, C. familiaris
atcacaacaagaaatt

SEQ ID NO: 305757 - DNA, 16 bp, C. familiaris
atcacaacccaagctg

SEQ ID NO: 305758 - DNA, 16 bp, C. familiaris
atcacaatcccagatt

SEQ ID NO: 305759 - DNA, 16 bp, C. familiaris
atcacaccccaagcca

SEQ ID NO: 305760 - DNA, 16 bp, C. familiaris
atcacaccctggctga

SEQ ID NO: 305761 - DNA, 16 bp, C. familiaris
atcacactgtggtttt

SEQ ID NO: 305762 - DNA, 16 bp, C. familiaris
atcacagacacacaca

SEQ ID NO: 305763 - DNA, 16 bp, C. familiaris
atcacagaggaagagg

SEQ ID NO: 305764 - DNA, 16 bp, C. familiaris
atcacaggaccccagg

SEQ ID NO: 305765 - DNA, 16 bp, C. familiaris
atcacaggaccctgag

SEQ ID NO: 305766 - DNA, 16 bp, C. familiaris
atcacatgtgtagatt

SEQ ID NO: 305767 - DNA, 16 bp, C. familiaris
atcaccaccactacca

SEQ ID NO: 305768 - DNA, 16 bp, C. familiaris
atcaccaccatcatca

SEQ ID NO: 305769 - DNA, 16 bp, C. familiaris
atcaccatattgtaca

SEQ ID NO: 305770 - DNA, 16 bp, C. familiaris
atcaccatcatcacca

SEQ ID NO: 305771 - DNA, 16 bp, C. familiaris
atcacccatctagccc

SEQ ID NO: 305772 - DNA, 16 bp, C. familiaris
atcacctgccctcctt

SEQ ID NO: 305773 - DNA, 16 bp, C. familiaris
atcacctggaaggctt

SEQ ID NO: 305774 - DNA, 16 bp, C. familiaris
atcacgacctgagcag

SEQ ID NO: 305775 - DNA, 16 bp, C. familiaris
atcactaatcatgagg

SEQ ID NO: 305776 - DNA, 16 bp, C. familiaris
atcactaccaatacca

SEQ ID NO: 305777 - DNA, 16 bp, C. familiaris
atcactatcaccacca

SEQ ID NO: 305778 - DNA, 16 bp, C. familiaris
atcactgcagaaagtt

SEQ ID NO: 305779 - DNA, 16 bp, C. familiaris
atcacttatttttaaa

SEQ ID NO: 305780 - DNA, 16 bp, C. familiaris
atcagaaaaatggaaa

SEQ ID NO: 305781 - DNA, 16 bp, C. familiaris
atcagaaagaataaat

SEQ ID NO: 305782 - DNA, 16 bp, C. familiaris
atcagaaagagaaatt

SEQ ID NO: 305783 - DNA, 16 bp, C. familiaris
atcagaaagggagaca

SEQ ID NO: 305784 - DNA, 16 bp, C. familiaris
atcagaaatcagaaaa

SEQ ID NO: 305785 - DNA, 16 bp, C. familiaris
atcagaatcagctgga

SEQ ID NO: 305786 - DNA, 16 bp, C. familiaris
atcagaatgaaataaa

SEQ ID NO: 305787 - DNA, 16 bp, C. familiaris
atcagactccctgctg

SEQ ID NO: 305788 - DNA, 16 bp, C. familiaris
atcagagaaagacagt

SEQ ID NO: 305789 - DNA, 16 bp, C. familiaris
atcagagaagaagaca

SEQ ID NO: 305790 - DNA, 16 bp, C. familiaris
atcagcacaacagacc

SEQ ID NO: 305791 - DNA, 16 bp, C. familiaris
atcagcacagcaggct

SEQ ID NO: 305792 - DNA, 16 bp, C. familiaris
atcagcggggagtctg

SEQ ID NO: 305793 - DNA, 16 bp, C. familiaris
atcaggaaaaagataa

SEQ ID NO: 305794 - DNA, 16 bp, C. familiaris
atcaggaaagaagaaa

SEQ ID NO: 305795 - DNA, 16 bp, C. familiaris
atcaggagcaagacaa

SEQ ID NO: 305796 - DNA, 16 bp, C. familiaris
atcaggagttggacac

SEQ ID NO: 305797 - DNA, 16 bp, C. familiaris
atcaggccctgggtgg

SEQ ID NO: 305798 - DNA, 16 bp, C. familiaris
atcaggctcctctcag

SEQ ID NO: 305799 - DNA, 16 bp, C. familiaris
atcaggctctctgtga

SEQ ID NO: 305800 - DNA, 16 bp, C. familiaris
atcagggaaacgcaaa

SEQ ID NO: 305801 - DNA, 16 bp, C. familiaris
atcagggatatacaaa

SEQ ID NO: 305802 - DNA, 16 bp, C. familiaris
atcagggattttggtc

SEQ ID NO: 305803 - DNA, 16 bp, C. familiaris
atcagtgatctggaag

SEQ ID NO: 305804 - DNA, 16 bp, C. familiaris
atcagtgattgccagg

SEQ ID NO: 305805 - DNA, 16 bp, C. familiaris
atcagtggatgaatga

SEQ ID NO: 305806 - DNA, 16 bp, C. familiaris
atcagtgtacagaaat

SEQ ID NO: 305807 - DNA, 16 bp, C. familiaris
atcagttgcatacaac

SEQ ID NO: 305808 - DNA, 16 bp, C. familiaris
atcagtttattttatt

SEQ ID NO: 305809 - DNA, 16 bp, C. familiaris
atcataaaaatgaaat

SEQ ID NO: 305810 - DNA, 16 bp, C. familiaris
atcataaataaatctt

SEQ ID NO: 305811 - DNA, 16 bp, C. familiaris
atcatataaatagaat

SEQ ID NO: 305812 - DNA, 16 bp, C. familiaris
atcatatgatatcact

SEQ ID NO: 305813 - DNA, 16 bp, C. familiaris
atcatatttaaagggt

SEQ ID NO: 305814 - DNA, 16 bp, C. familiaris
atcatcacactgtaca

SEQ ID NO: 305815 - DNA, 16 bp, C. familiaris
atcatcaccaacatca

SEQ ID NO: 305816 - DNA, 16 bp, C. familiaris
atcatcatcaccatca

SEQ ID NO: 305817 - DNA, 16 bp, C. familiaris
atcatcatcatcaatg

SEQ ID NO: 305818 - DNA, 16 bp, C. familiaris
atcatcatcatcacaa

SEQ ID NO: 305819 - DNA, 16 bp, C. familiaris
atcatcatcatcacca

SEQ ID NO: 305820 - DNA, 16 bp, C. familiaris
atcatcatcatcatca

SEQ ID NO: 305821 - DNA, 16 bp, C. familiaris
atcatcatcatcatcg

SEQ ID NO: 305822 - DNA, 16 bp, C. familiaris
atcatcatcatcctca

SEQ ID NO: 305823 - DNA, 16 bp, C. familiaris
atcatcatcattaata

SEQ ID NO: 305824 - DNA, 16 bp, C. familiaris
atcatcattatcatca

SEQ ID NO: 305825 - DNA, 16 bp, C. familiaris
atcatccaggtgcccc

SEQ ID NO: 305826 - DNA, 16 bp, C. familiaris
atcatctcaactgatg

SEQ ID NO: 305827 - DNA, 16 bp, C. familiaris
atcatcttaaatattt

SEQ ID NO: 305828 - DNA, 16 bp, C. familiaris
atcatgaagaaatgga

SEQ ID NO: 305829 - DNA, 16 bp, C. familiaris
atcatgaatgaaagag

SEQ ID NO: 305830 - DNA, 16 bp, C. familiaris
atcatgaccgagctga

SEQ ID NO: 305831 - DNA, 16 bp, C. familiaris
atcatgagatggcagc

SEQ ID NO: 305832 - DNA, 16 bp, C. familiaris
atcatgagctcaagcc

SEQ ID NO: 305833 - DNA, 16 bp, C. familiaris
atcatgatgaccctaa

SEQ ID NO: 305834 - DNA, 16 bp, C. familiaris
atcatgcccagggctg

SEQ ID NO: 305835 - DNA, 16 bp, C. familiaris
atcatgggaaaaaaaa

SEQ ID NO: 305836 - DNA, 16 bp, C. familiaris
atcatggggtcatgag

SEQ ID NO: 305837 - DNA, 16 bp, C. familiaris
atcatgtggtttttct

SEQ ID NO: 305838 - DNA, 16 bp, C. familiaris
atcatgttatttgtct

SEQ ID NO: 305839 - DNA, 16 bp, C. familiaris
atcattagaaaaaaat

SEQ ID NO: 305840 - DNA, 16 bp, C. familiaris
atcattccccctggct

SEQ ID NO: 305841 - DNA, 16 bp, C. familiaris
atcattgtattgtaca

SEQ ID NO: 305842 - DNA, 16 bp, C. familiaris
atcatttattgaagag

SEQ ID NO: 305843 - DNA, 16 bp, C. familiaris
atcatttcatatgctt

SEQ ID NO: 305844 - DNA, 16 bp, C. familiaris
atcatttcttcaaata

SEQ ID NO: 305845 - DNA, 16 bp, C. familiaris
atcatttttaaagatt

SEQ ID NO: 305846 - DNA, 16 bp, C. familiaris
atccaaaataaatgaa

SEQ ID NO: 305847 - DNA, 16 bp, C. familiaris
atccaaatttttaaaa

SEQ ID NO: 305848 - DNA, 16 bp, C. familiaris
atccaacaatcacact

SEQ ID NO: 305849 - DNA, 16 bp, C. familiaris
atccaacacccattca

SEQ ID NO: 305850 - DNA, 16 bp, C. familiaris
atccaacacttccata

SEQ ID NO: 305851 - DNA, 16 bp, C. familiaris
atccaacatatataaa

SEQ ID NO: 305852 - DNA, 16 bp, C. familiaris
atccaagaaaatgaaa

SEQ ID NO: 305853 - DNA, 16 bp, C. familiaris
atccaagaaggcaaaa

SEQ ID NO: 305854 - DNA, 16 bp, C. familiaris
atccaagagaattgaa

SEQ ID NO: 305855 - DNA, 16 bp, C. familiaris
atccacatgaagaaat

SEQ ID NO: 305856 - DNA, 16 bp, C. familiaris
atccaccaccacctcg

SEQ ID NO: 305857 - DNA, 16 bp, C. familiaris
atccagaaatcacact

SEQ ID NO: 305858 - DNA, 16 bp, C. familiaris
atccagaatatagaaa

SEQ ID NO: 305859 - DNA, 16 bp, C. familiaris
atccagaggtcctggg

SEQ ID NO: 305860 - DNA, 16 bp, C. familiaris
atccagatggaagaga

SEQ ID NO: 305861 - DNA, 16 bp, C. familiaris
atccagcaaggctgcc

SEQ ID NO: 305862 - DNA, 16 bp, C. familiaris
atccagcagcgcaggc

SEQ ID NO: 305863 - DNA, 16 bp, C. familiaris
atccagccccaggtca

SEQ ID NO: 305864 - DNA, 16 bp, C. familiaris
atccagcctgccacct

SEQ ID NO: 305865 - DNA, 16 bp, C. familiaris
atccagcgtctccagg

SEQ ID NO: 305866 - DNA, 16 bp, C. familiaris
atccagctccccacag

SEQ ID NO: 305867 - DNA, 16 bp, C. familiaris
atccagctcttgatct

SEQ ID NO: 305868 - DNA, 16 bp, C. familiaris
atccaggaaacagaga

SEQ ID NO: 305869 - DNA, 16 bp, C. familiaris
atccaggaaatacaga

SEQ ID NO: 305870 - DNA, 16 bp, C. familiaris
atccaggagacagaga

SEQ ID NO: 305871 - DNA, 16 bp, C. familiaris
atccaggagagagaga

SEQ ID NO: 305872 - DNA, 16 bp, C. familiaris
atccaggagatggaga

SEQ ID NO: 305873 - DNA, 16 bp, C. familiaris
atccaggaggtagaga

SEQ ID NO: 305874 - DNA, 16 bp, C. familiaris
atccaggatatagaga

SEQ ID NO: 305875 - DNA, 16 bp, C. familiaris
atccaggcacccccaa

SEQ ID NO: 305876 - DNA, 16 bp, C. familiaris
atccaggcatcccagg

SEQ ID NO: 305877 - DNA, 16 bp, C. familiaris
atccaggccctgcaga

SEQ ID NO: 305878 - DNA, 17 bp, C. familiaris
atccagggcctccagga

SEQ ID NO: 305879 - DNA, 16 bp, C. familiaris
atccaggggaatattg

SEQ ID NO: 305880 - DNA, 16 bp, C. familiaris
atccagtcccacatgg

SEQ ID NO: 305881 - DNA, 16 bp, C. familiaris
atccagtgctcatcat

SEQ ID NO: 305882 - DNA, 16 bp, C. familiaris
atccagtgggggaggg

SEQ ID NO: 305883 - DNA, 16 bp, C. familiaris
atccatatgttgaagt

SEQ ID NO: 305884 - DNA, 16 bp, C. familiaris
atccatctgtccatct

SEQ ID NO: 305885 - DNA, 16 bp, C. familiaris
atccatgaacatgaaa

SEQ ID NO: 305886 - DNA, 16 bp, C. familiaris
atccatgagacacaga

SEQ ID NO: 305887 - DNA, 16 bp, C. familiaris
atccatgttcctcagg

SEQ ID NO: 305888 - DNA, 16 bp, C. familiaris
atccattcatcaggtg

SEQ ID NO: 305889 - DNA, 16 bp, C. familiaris
atccattcattctttc

SEQ ID NO: 305890 - DNA, 16 bp, C. familiaris
atccattctgataccc

SEQ ID NO: 305891 - DNA, 16 bp, C. familiaris
atccattggaagaaaa

SEQ ID NO: 305892 - DNA, 16 bp, C. familiaris
atccatttacaattgc

SEQ ID NO: 305893 - DNA, 16 bp, C. familiaris
atcccaaacagaaact

SEQ ID NO: 305894 - DNA, 16 bp, C. familiaris
atcccaaagactttga

SEQ ID NO: 305895 - DNA, 16 bp, C. familiaris
atcccaaagattctga

SEQ ID NO: 305896 - DNA, 16 bp, C. familiaris
atcccaagaagactcc

SEQ ID NO: 305897 - DNA, 16 bp, C. familiaris
atcccaagaccccgga

SEQ ID NO: 305898 - DNA, 16 bp, C. familiaris
atcccaagaccccggg

SEQ ID NO: 305899 - DNA, 16 bp, C. familiaris
atcccaagatttcatt

SEQ ID NO: 305900 - DNA, 16 bp, C. familiaris
atcccactcatgaggg

SEQ ID NO: 305901 - DNA, 16 bp, C. familiaris
atcccagaaccatggg

SEQ ID NO: 305902 - DNA, 16 bp, C. familiaris
atcccagaagaagaaa

SEQ ID NO: 305903 - DNA, 16 bp, C. familiaris
atcccagaagcctggg

SEQ ID NO: 305904 - DNA, 16 bp, C. familiaris
atcccagaggagaaca

SEQ ID NO: 305905 - DNA, 16 bp, C. familiaris
atcccagagtccccag

SEQ ID NO: 305906 - DNA, 16 bp, C. familiaris
atcccagagttccaga

SEQ ID NO: 305907 - DNA, 17 bp, C. familiaris
atcccagatcctgggat

SEQ ID NO: 305908 - DNA, 16 bp, C. familiaris
atcccagcaccctggg

SEQ ID NO: 305909 - DNA, 16 bp, C. familiaris
atcccagctctccagg

SEQ ID NO: 305910 - DNA, 16 bp, C. familiaris
atcccaggaccccggg

SEQ ID NO: 305911 - DNA, 16 bp, C. familiaris
atcccaggacctagag

SEQ ID NO: 305912 - DNA, 16 bp, C. familiaris
atcccaggcctccagg

SEQ ID NO: 305913 - DNA, 16 bp, C. familiaris
atcccaggcttctggg

SEQ ID NO: 305914 - DNA, 16 bp, C. familiaris
atcccagggcccctgg

SEQ ID NO: 305915 - DNA, 16 bp, C. familiaris
atcccagggctctggg

SEQ ID NO: 305916 - DNA, 16 bp, C. familiaris
atcccagggtccaggg

SEQ ID NO: 305917 - DNA, 16 bp, C. familiaris
atcccagggtccctgg

SEQ ID NO: 305918 - DNA, 16 bp, C. familiaris
atcccaggtctctggg

SEQ ID NO: 305919 - DNA, 16 bp, C. familiaris
atcccaggttcccagg

SEQ ID NO: 305920 - DNA, 16 bp, C. familiaris
atcccaggttcctgag

SEQ ID NO: 305921 - DNA, 16 bp, C. familiaris
atcccagtgtcctgga

SEQ ID NO: 305922 - DNA, 16 bp, C. familiaris
atcccatggtcctgga

SEQ ID NO: 305923 - DNA, 16 bp, C. familiaris
atccccaaaatgctga

SEQ ID NO: 305924 - DNA, 16 bp, C. familiaris
atccccatggcttatt

SEQ ID NO: 305925 - DNA, 16 bp, C. familiaris
atcccctggtcctggg

SEQ ID NO: 305926 - DNA, 16 bp, C. familiaris
atcccctgtctccagg

SEQ ID NO: 305927 - DNA, 16 bp, C. familiaris
atcccggagtccctgg

SEQ ID NO: 305928 - DNA, 16 bp, C. familiaris
atcccgggcctccagg

SEQ ID NO: 305929 - DNA, 16 bp, C. familiaris
atcccggggccctgag

SEQ ID NO: 305930 - DNA, 16 bp, C. familiaris
atccctgacctttatg

SEQ ID NO: 305931 - DNA, 16 bp, C. familiaris
atccctgcttccactg

SEQ ID NO: 305932 - DNA, 16 bp, C. familiaris
atccctggactccagg

SEQ ID NO: 305933 - DNA, 16 bp, C. familiaris
atccctggctggctca

SEQ ID NO: 305934 - DNA, 16 bp, C. familiaris
atccctgggatgcaag

SEQ ID NO: 305935 - DNA, 16 bp, C. familiaris
atccctgggggctcag

SEQ ID NO: 305936 - DNA, 17 bp, C. familiaris
atccctgggtggctcag

SEQ ID NO: 305937 - DNA, 16 bp, C. familiaris
atccctttcacctatt

SEQ ID NO: 305938 - DNA, 16 bp, C. familiaris
atcccttttatctatt

SEQ ID NO: 305939 - DNA, 16 bp, C. familiaris
atccggggatccctgg

SEQ ID NO: 305940 - DNA, 16 bp, C. familiaris
atccgggtccccagga

SEQ ID NO: 305941 - DNA, 16 bp, C. familiaris
atcctaaatgagaaga

SEQ ID NO: 305942 - DNA, 16 bp, C. familiaris
atcctaaggaaaaaaa

SEQ ID NO: 305943 - DNA, 16 bp, C. familiaris
atcctactcttggttt

SEQ ID NO: 305944 - DNA, 16 bp, C. familiaris
atcctagaagagaaca

SEQ ID NO: 305945 - DNA, 16 bp, C. familiaris
atcctatcaagtgccc

SEQ ID NO: 305946 - DNA, 16 bp, C. familiaris
atcctcaatggtgaaa

SEQ ID NO: 305947 - DNA, 16 bp, C. familiaris
atcctcacagcagccc

SEQ ID NO: 305948 - DNA, 16 bp, C. familiaris
atcctcagggtcatga

SEQ ID NO: 305949 - DNA, 16 bp, C. familiaris
atcctcagtttgttct

SEQ ID NO: 305950 - DNA, 16 bp, C. familiaris
atcctctcatgaaaaa

SEQ ID NO: 305951 - DNA, 16 bp, C. familiaris
atcctctccaacatat

SEQ ID NO: 305952 - DNA, 16 bp, C. familiaris
atcctgaagcagactc

SEQ ID NO: 305953 - DNA, 16 bp, C. familiaris
atcctgaatatataaa

SEQ ID NO: 305954 - DNA, 16 bp, C. familiaris
atcctgcaaacttgct

SEQ ID NO: 305955 - DNA, 16 bp, C. familiaris
atcctgcatcttttga

SEQ ID NO: 305956 - DNA, 17 bp, C. familiaris
atcctgctaaagatgaa

SEQ ID NO: 305957 - DNA, 16 bp, C. familiaris
atcctggaaatccggg

SEQ ID NO: 305958 - DNA, 16 bp, C. familiaris
atcctggaaccccagg

SEQ ID NO: 305959 - DNA, 16 bp, C. familiaris
atcctggacaccctgg

SEQ ID NO: 305960 - DNA, 16 bp, C. familiaris
atcctggagaacctgg

SEQ ID NO: 305961 - DNA, 16 bp, C. familiaris
atcctggagaagcagg

SEQ ID NO: 305962 - DNA, 17 bp, C. familiaris
atcctggagaccaagga

SEQ ID NO: 305963 - DNA, 16 bp, C. familiaris
atcctggagaccagag

SEQ ID NO: 305964 - DNA, 16 bp, C. familiaris
atcctggagaccagga

SEQ ID NO: 305965 - DNA, 16 bp, C. familiaris
atcctggagaccctgg

SEQ ID NO: 305966 - DNA, 16 bp, C. familiaris
atcctggagaccctgt

SEQ ID NO: 305967 - DNA, 16 bp, C. familiaris
atcctggagacctgtg

SEQ ID NO: 305968 - DNA, 17 bp, C. familiaris
atcctggagactcagga

SEQ ID NO: 305969 - DNA, 16 bp, C. familiaris
atcctggagactccag

SEQ ID NO: 305970 - DNA, 16 bp, C. familiaris
atcctggagactgagg

SEQ ID NO: 305971 - DNA, 16 bp, C. familiaris
atcctggagatcccgg

SEQ ID NO: 305972 - DNA, 16 bp, C. familiaris
atcctggagatcctgg

SEQ ID NO: 305973 - DNA, 16 bp, C. familiaris
atcctggagatgcagg

SEQ ID NO: 305974 - DNA, 16 bp, C. familiaris
atcctggagcccccgg

SEQ ID NO: 305975 - DNA, 16 bp, C. familiaris
atcctggagcccctgg

SEQ ID NO: 305976 - DNA, 16 bp, C. familiaris
atcctggaggagaaca

SEQ ID NO: 305977 - DNA, 16 bp, C. familiaris
atcctggagtgccggg

SEQ ID NO: 305978 - DNA, 16 bp, C. familiaris
atcctggagttcccgg

SEQ ID NO: 305979 - DNA, 16 bp, C. familiaris
atcctggatcctgggg

SEQ ID NO: 305980 - DNA, 17 bp, C. familiaris
atcctggcactccagga

SEQ ID NO: 305981 - DNA, 16 bp, C. familiaris
atcctgggaacctggg

SEQ ID NO: 305982 - DNA, 16 bp, C. familiaris
atcctgggaccccaag

SEQ ID NO: 305983 - DNA, 16 bp, C. familiaris
atcctgggaccccagg

SEQ ID NO: 305984 - DNA, 16 bp, C. familiaris
atcctgggactccgga

SEQ ID NO: 305985 - DNA, 16 bp, C. familiaris
atcctgggactctggg

SEQ ID NO: 305986 - DNA, 17 bp, C. familiaris
atcctgggacttcagga

SEQ ID NO: 305987 - DNA, 16 bp, C. familiaris
atcctgggatcaaacc

SEQ ID NO: 305988 - DNA, 16 bp, C. familiaris
atcctgggatcctgag

SEQ ID NO: 305989 - DNA, 16 bp, C. familiaris
atcctgggatcctgga

SEQ ID NO: 305990 - DNA, 16 bp, C. familiaris
atcctgggatggagac

SEQ ID NO: 305991 - DNA, 16 bp, C. familiaris
atcctgggctccctgc

SEQ ID NO: 305992 - DNA, 16 bp, C. familiaris
atcctggggacctgga

SEQ ID NO: 305993 - DNA, 16 bp, C. familiaris
atcctggggacctggg

SEQ ID NO: 305994 - DNA, 16 bp, C. familiaris
atcctggggatccagg

SEQ ID NO: 305995 - DNA, 16 bp, C. familiaris
atcctggggtctccag

SEQ ID NO: 305996 - DNA, 16 bp, C. familiaris
atcctgtcttgttcct

SEQ ID NO: 305997 - DNA, 17 bp, C. familiaris
atcctgtgtctccagga

SEQ ID NO: 305998 - DNA, 16 bp, C. familiaris
atccttaaagcagcag

SEQ ID NO: 305999 - DNA, 16 bp, C. familiaris
atccttattaaaaaga

SEQ ID NO: 306000 - DNA, 16 bp, C. familiaris
atccttctcaacacag

SEQ ID NO: 306001 - DNA, 16 bp, C. familiaris
atccttgccaatgctt

SEQ ID NO: 306002 - DNA, 16 bp, C. familiaris
atccttgtcttgctcc

SEQ ID NO: 306003 - DNA, 16 bp, C. familiaris
atcctttcatcagttg

SEQ ID NO: 306004 - DNA, 16 bp, C. familiaris
atcgagcagattgtgg

SEQ ID NO: 306005 - DNA, 16 bp, C. familiaris
atcgagccccacctca

SEQ ID NO: 306006 - DNA, 16 bp, C. familiaris
atcgagtcctacatcg

SEQ ID NO: 306007 - DNA, 16 bp, C. familiaris
atcgataaagaagatg

SEQ ID NO: 306008 - DNA, 16 bp, C. familiaris
atcgcaaatggcaaga

SEQ ID NO: 306009 - DNA, 16 bp, C. familiaris
atcgggctccctgcat

SEQ ID NO: 306010 - DNA, 16 bp, C. familiaris
atcggggtctccagga

SEQ ID NO: 306011 - DNA, 16 bp, C. familiaris
atcgtgccccaggcca

SEQ ID NO: 306012 - DNA, 17 bp, C. familiaris
atcgtggagacccggga

SEQ ID NO: 306013 - DNA, 16 bp, C. familiaris
atcgtggccattgctg

SEQ ID NO: 306014 - DNA, 16 bp, C. familiaris
atcgtggcctgggcca

SEQ ID NO: 306015 - DNA, 17 bp, C. familiaris
atctaactccaataaaa

SEQ ID NO: 306016 - DNA, 16 bp, C. familiaris
atctacaaaatccctt

SEQ ID NO: 306017 - DNA, 16 bp, C. familiaris
atctacaagaaatgga

SEQ ID NO: 306018 - DNA, 16 bp, C. familiaris
atctacatctacatct

SEQ ID NO: 306019 - DNA, 16 bp, C. familiaris
atctagagacattttt

SEQ ID NO: 306020 - DNA, 16 bp, C. familiaris
atctagggcagccctg

SEQ ID NO: 306021 - DNA, 16 bp, C. familiaris
atctataaaatagaaa

SEQ ID NO: 306022 - DNA, 16 bp, C. familiaris
atctatgtgtgttttt

SEQ ID NO: 306023 - DNA, 16 bp, C. familiaris
atctattgaaggacat

SEQ ID NO: 306024 - DNA, 16 bp, C. familiaris
atctatttgagagaaa

SEQ ID NO: 306025 - DNA, 16 bp, C. familiaris
atctcaaaagcattat

SEQ ID NO: 306026 - DNA, 16 bp, C. familiaris
atctcaagaccctggg

SEQ ID NO: 306027 - DNA, 16 bp, C. familiaris
atctcaatattttaaa

SEQ ID NO: 306028 - DNA, 16 bp, C. familiaris
atctcacagaggagga

SEQ ID NO: 306029 - DNA, 16 bp, C. familiaris
atctcacagtttctat

SEQ ID NO: 306030 - DNA, 16 bp, C. familiaris
atctcacttaattctc

SEQ ID NO: 306031 - DNA, 16 bp, C. familiaris
atctcagacttccagc

SEQ ID NO: 306032 - DNA, 16 bp, C. familiaris
atctcaggacacctgg

SEQ ID NO: 306033 - DNA, 16 bp, C. familiaris
atctcaggaccctgag

SEQ ID NO: 306034 - DNA, 16 bp, C. familiaris
atctcaggacctcaag

SEQ ID NO: 306035 - DNA, 16 bp, C. familiaris
atctcaggaccttggg

SEQ ID NO: 306036 - DNA, 16 bp, C. familiaris
atctcaggactctggg

SEQ ID NO: 306037 - DNA, 16 bp, C. familiaris
atctcaggcagacttc

SEQ ID NO: 306038 - DNA, 16 bp, C. familiaris
atctcaggcttccagc

SEQ ID NO: 306039 - DNA, 16 bp, C. familiaris
atctcagggccccggg

SEQ ID NO: 306040 - DNA, 16 bp, C. familiaris
atctcagtaaatggca

SEQ ID NO: 306041 - DNA, 16 bp, C. familiaris
atctcatcaccctgag

SEQ ID NO: 306042 - DNA, 16 bp, C. familiaris
atctcatgaccctgag

SEQ ID NO: 306043 - DNA, 16 bp, C. familiaris
atctccaaaagcaagg

SEQ ID NO: 306044 - DNA, 16 bp, C. familiaris
atctccacacccaaca

SEQ ID NO: 306045 - DNA, 16 bp, C. familiaris
atctccagaacctgtg

SEQ ID NO: 306046 - DNA, 16 bp, C. familiaris
atctccagctctggag

SEQ ID NO: 306047 - DNA, 16 bp, C. familiaris
atctcccagaggaaga

SEQ ID NO: 306048 - DNA, 16 bp, C. familiaris
atctccctttggctca

SEQ ID NO: 306049 - DNA, 16 bp, C. familiaris
atctccttgaagatga

SEQ ID NO: 306050 - DNA, 16 bp, C. familiaris
atctcctttggctcag

SEQ ID NO: 306051 - DNA, 16 bp, C. familiaris
atctcgggtcctggga

SEQ ID NO: 306052 - DNA, 16 bp, C. familiaris
atctctatgcccagca

SEQ ID NO: 306053 - DNA, 16 bp, C. familiaris
atctctccaaagaaga

SEQ ID NO: 306054 - DNA, 16 bp, C. familiaris
atctctccaagcctca

SEQ ID NO: 306055 - DNA, 16 bp, C. familiaris
atctctcctttcattc

SEQ ID NO: 306056 - DNA, 16 bp, C. familiaris
atctctctgaatctca

SEQ ID NO: 306057 - DNA, 16 bp, C. familiaris
atctctctggagcctc

SEQ ID NO: 306058 - DNA, 16 bp, C. familiaris
atctctggattttttt

SEQ ID NO: 306059 - DNA, 16 bp, C. familiaris
atctctgggaaatgaa

SEQ ID NO: 306060 - DNA, 16 bp, C. familiaris
atctctgggttctgag

SEQ ID NO: 306061 - DNA, 16 bp, C. familiaris
atctcttcatgtgctt

SEQ ID NO: 306062 - DNA, 16 bp, C. familiaris
atctctttttaaaaga

SEQ ID NO: 306063 - DNA, 16 bp, C. familiaris
atctgaaaaatgagga

SEQ ID NO: 306064 - DNA, 16 bp, C. familiaris
atctgaaagaaatgaa

SEQ ID NO: 306065 - DNA, 16 bp, C. familiaris
atctgaagaaaataaa

SEQ ID NO: 306066 - DNA, 16 bp, C. familiaris
atctgaaggaaaaaaa

SEQ ID NO: 306067 - DNA, 16 bp, C. familiaris
atctgaataaatattt

SEQ ID NO: 306068 - DNA, 16 bp, C. familiaris
atctgacatgtcattt

SEQ ID NO: 306069 - DNA, 16 bp, C. familiaris
atctgagatgaaaaat

SEQ ID NO: 306070 - DNA, 16 bp, C. familiaris
atctgagctgaaacca

SEQ ID NO: 306071 - DNA, 16 bp, C. familiaris
atctgaggaccctgag

SEQ ID NO: 306072 - DNA, 16 bp, C. familiaris
atctgagggttgtgag

SEQ ID NO: 306073 - DNA, 25 bp, C. familiaris
atctgatctacaaatgtggtgggat

SEQ ID NO: 306074 - DNA, 16 bp, C. familiaris
atctgattaaaaaaat

SEQ ID NO: 306075 - DNA, 16 bp, C. familiaris
atctgatttaaaaatt

SEQ ID NO: 306076 - DNA, 16 bp, C. familiaris
atctgatttgtttctt

SEQ ID NO: 306077 - DNA, 16 bp, C. familiaris
atctgcaaaccaagga

SEQ ID NO: 306078 - DNA, 16 bp, C. familiaris
atctgcaaagaaggag

SEQ ID NO: 306079 - DNA, 16 bp, C. familiaris
atctgcaccccgatgt

SEQ ID NO: 306080 - DNA, 16 bp, C. familiaris
atctgcactcccatgt

SEQ ID NO: 306081 - DNA, 16 bp, C. familiaris
atctgcccaaggtcac

SEQ ID NO: 306082 - DNA, 16 bp, C. familiaris
atctgcctctggccca

SEQ ID NO: 306083 - DNA, 16 bp, C. familiaris
atctgccttccattca

SEQ ID NO: 306084 - DNA, 16 bp, C. familiaris
atctgccttcgaccca

SEQ ID NO: 306085 - DNA, 16 bp, C. familiaris
atctgccttctgctgg

SEQ ID NO: 306086 - DNA, 16 bp, C. familiaris
atctgctgttggctca

SEQ ID NO: 306087 - DNA, 16 bp, C. familiaris
atctggaaaaaaacaa

SEQ ID NO: 306088 - DNA, 16 bp, C. familiaris
atctggaaatattttt

SEQ ID NO: 306089 - DNA, 16 bp, C. familiaris
atctggacctggtgac

SEQ ID NO: 306090 - DNA, 16 bp, C. familiaris
atctggagaaagaaca

SEQ ID NO: 306091 - DNA, 16 bp, C. familiaris
atctggagaaggaaac

SEQ ID NO: 306092 - DNA, 16 bp, C. familiaris
atctggagacccagga

SEQ ID NO: 306093 - DNA, 16 bp, C. familiaris
atctggagcacctggg

SEQ ID NO: 306094 - DNA, 16 bp, C. familiaris
atctggatagctcagt

SEQ ID NO: 306095 - DNA, 16 bp, C. familiaris
atctggatgtcttcct

SEQ ID NO: 306096 - DNA, 16 bp, C. familiaris
atctggatgtctttta

SEQ ID NO: 306097 - DNA, 16 bp, C. familiaris
atctggcccaggactt

SEQ ID NO: 306098 - DNA, 16 bp, C. familiaris
atctggctccctgcat

SEQ ID NO: 306099 - DNA, 16 bp, C. familiaris
atctgggctctttcca

SEQ ID NO: 306100 - DNA, 16 bp, C. familiaris
atctggggggctcagt

SEQ ID NO: 306101 - DNA, 16 bp, C. familiaris
atctgtaaaacaagga

SEQ ID NO: 306102 - DNA, 16 bp, C. familiaris
atctgtatgtttgggg

SEQ ID NO: 306103 - DNA, 16 bp, C. familiaris
atctgtcaaatggaga

SEQ ID NO: 306104 - DNA, 16 bp, C. familiaris
atctgtcacctcacat

SEQ ID NO: 306105 - DNA, 16 bp, C. familiaris
atctgtgaaatgggag

SEQ ID NO: 306106 - DNA, 16 bp, C. familiaris
atctgtgagtttatag

SEQ ID NO: 306107 - DNA, 16 bp, C. familiaris
atctgtgttttcacaa

SEQ ID NO: 306108 - DNA, 16 bp, C. familiaris
atctgttctctgtgtc

SEQ ID NO: 306109 - DNA, 16 bp, C. familiaris
atctgttgttttctga

SEQ ID NO: 306110 - DNA, 16 bp, C. familiaris
atctgtttatccattc

SEQ ID NO: 306111 - DNA, 16 bp, C. familiaris
atcttaaaaaaattct

SEQ ID NO: 306112 - DNA, 16 bp, C. familiaris
atcttaaaaacaagaa

SEQ ID NO: 306113 - DNA, 16 bp, C. familiaris
atcttaaaaaggaaaa

SEQ ID NO: 306114 - DNA, 16 bp, C. familiaris
atcttaaaagaaaaag

SEQ ID NO: 306115 - DNA, 16 bp, C. familiaris
atcttaaaagaaaaga

SEQ ID NO: 306116 - DNA, 16 bp, C. familiaris
atcttaaaagaaagaa

SEQ ID NO: 306117 - DNA, 16 bp, C. familiaris
atcttaaagaaaaaga

SEQ ID NO: 306118 - DNA, 16 bp, C. familiaris
atcttacaaatgaaga

SEQ ID NO: 306119 - DNA, 16 bp, C. familiaris
atcttacagaggagga

SEQ ID NO: 306120 - DNA, 16 bp, C. familiaris
atcttacagataagaa

SEQ ID NO: 306121 - DNA, 16 bp, C. familiaris
atcttactcatctttg

SEQ ID NO: 306122 - DNA, 16 bp, C. familiaris
atcttaggaccccggg

SEQ ID NO: 306123 - DNA, 16 bp, C. familiaris
atcttatttattttag

SEQ ID NO: 306124 - DNA, 16 bp, C. familiaris
atcttcaaaaaaagaa

SEQ ID NO: 306125 - DNA, 16 bp, C. familiaris
atcttcaaattctttc

SEQ ID NO: 306126 - DNA, 16 bp, C. familiaris
atcttcaacaacaaca

SEQ ID NO: 306127 - DNA, 16 bp, C. familiaris
atcttcaggtcctggg

SEQ ID NO: 306128 - DNA, 16 bp, C. familiaris
atcttcattttcatta

SEQ ID NO: 306129 - DNA, 16 bp, C. familiaris
atcttccaagactgaa

SEQ ID NO: 306130 - DNA, 16 bp, C. familiaris
atcttcccatttattt

SEQ ID NO: 306131 - DNA, 16 bp, C. familiaris
atcttcctgatgaatt

SEQ ID NO: 306132 - DNA, 16 bp, C. familiaris
atcttcctttaaaaaa

SEQ ID NO: 306133 - DNA, 16 bp, C. familiaris
atcttctatgtgccag

SEQ ID NO: 306134 - DNA, 16 bp, C. familiaris
atcttctcatgtgtct

SEQ ID NO: 306135 - DNA, 16 bp, C. familiaris
atcttctcccattctt

SEQ ID NO: 306136 - DNA, 16 bp, C. familiaris
atcttcttaaaaatta

SEQ ID NO: 306137 - DNA, 16 bp, C. familiaris
atcttctttattcact

SEQ ID NO: 306138 - DNA, 16 bp, C. familiaris
atcttgaaagcagcca

SEQ ID NO: 306139 - DNA, 16 bp, C. familiaris
atcttgagaaagaaaa

SEQ ID NO: 306140 - DNA, 16 bp, C. familiaris
atcttggaacagaaaa

SEQ ID NO: 306141 - DNA, 16 bp, C. familiaris
atcttgtggttgtgag

SEQ ID NO: 306142 - DNA, 16 bp, C. familiaris
atctttaaaaaaagtt

SEQ ID NO: 306143 - DNA, 16 bp, C. familiaris
atctttaaaagaaaat

SEQ ID NO: 306144 - DNA, 16 bp, C. familiaris
atctttaaaagaacaa

SEQ ID NO: 306145 - DNA, 16 bp, C. familiaris
atctttaaaataaatg

SEQ ID NO: 306146 - DNA, 16 bp, C. familiaris
atctttaaagaaaaag

SEQ ID NO: 306147 - DNA, 16 bp, C. familiaris
atctttaaagaagaaa

SEQ ID NO: 306148 - DNA, 16 bp, C. familiaris
atctttaaatgataca

SEQ ID NO: 306149 - DNA, 16 bp, C. familiaris
atctttaagaaaaaag

SEQ ID NO: 306150 - DNA, 16 bp, C. familiaris
atctttataaaatgaa

SEQ ID NO: 306151 - DNA, 16 bp, C. familiaris
atctttatctggtttg

SEQ ID NO: 306152 - DNA, 16 bp, C. familiaris
atctttcaaaagtgaa

SEQ ID NO: 306153 - DNA, 16 bp, C. familiaris
atctttcaacagtaac

SEQ ID NO: 306154 - DNA, 16 bp, C. familiaris
atctttcaatcatttt

SEQ ID NO: 306155 - DNA, 16 bp, C. familiaris
atctttccaaacagtt

SEQ ID NO: 306156 - DNA, 16 bp, C. familiaris
atctttgaaaatattt

SEQ ID NO: 306157 - DNA, 16 bp, C. familiaris
atctttgagcaggatg

SEQ ID NO: 306158 - DNA, 16 bp, C. familiaris
atctttggaatgcagc

SEQ ID NO: 306159 - DNA, 16 bp, C. familiaris
atctttgggacacctg

SEQ ID NO: 306160 - DNA, 16 bp, C. familiaris
atctttgggtcatttt

SEQ ID NO: 306161 - DNA, 16 bp, C. familiaris
atctttgtctttctct

SEQ ID NO: 306162 - DNA, 16 bp, C. familiaris
atcttttaaaaaaagg

SEQ ID NO: 306163 - DNA, 16 bp, C. familiaris
atcttttaaaaaaatc

SEQ ID NO: 306164 - DNA, 16 bp, C. familiaris
atcttttaaaaagtct

SEQ ID NO: 306165 - DNA, 16 bp, C. familiaris
atcttttaagaaagaa

SEQ ID NO: 306166 - DNA, 16 bp, C. familiaris
atcttttcatgtgctt

SEQ ID NO: 306167 - DNA, 16 bp, C. familiaris
atcttttcatgtgtat

SEQ ID NO: 306168 - DNA, 16 bp, C. familiaris
atcttttgaattttga

SEQ ID NO: 306169 - DNA, 16 bp, C. familiaris
atctttttaaaaaatg

SEQ ID NO: 306170 - DNA, 16 bp, C. familiaris
atctttttaaaaacta

SEQ ID NO: 306171 - DNA, 16 bp, C. familiaris
atctttttgaaaaaat

SEQ ID NO: 306172 - DNA, 16 bp, C. familiaris
atcttttttaaagttt

SEQ ID NO: 306173 - DNA, 16 bp, C. familiaris
atcttttttgtgtgtg

SEQ ID NO: 306174 - DNA, 16 bp, C. familiaris
atgaaaaaaaaatctt

SEQ ID NO: 306175 - DNA, 16 bp, C. familiaris
atgaaaaaaaattcat

SEQ ID NO: 306176 - DNA, 16 bp, C. familiaris
atgaaaaaaatgcatt

SEQ ID NO: 306177 - DNA, 16 bp, C. familiaris
atgaaaaaaattcaga

SEQ ID NO: 306178 - DNA, 16 bp, C. familiaris
atgaaaaaatgcttaa

SEQ ID NO: 306179 - DNA, 16 bp, C. familiaris
atgaaaaagaaaatct

SEQ ID NO: 306180 - DNA, 16 bp, C. familiaris
atgaaaaagaagatca

SEQ ID NO: 306181 - DNA, 16 bp, C. familiaris
atgaaaaagatgttca

SEQ ID NO: 306182 - DNA, 16 bp, C. familiaris
atgaaaaagtgctcaa

SEQ ID NO: 306183 - DNA, 16 bp, C. familiaris
atgaaaaagttctaga

SEQ ID NO: 306184 - DNA, 16 bp, C. familiaris
atgaaaaagttctgga

SEQ ID NO: 306185 - DNA, 16 bp, C. familiaris
atgaaaaatattcaaa

SEQ ID NO: 306186 - DNA, 16 bp, C. familiaris
atgaaaaatctcaaat

SEQ ID NO: 306187 - DNA, 16 bp, C. familiaris
atgaaaaatgtatttt

SEQ ID NO: 306188 - DNA, 16 bp, C. familiaris
atgaaaaattctggaa

SEQ ID NO: 306189 - DNA, 16 bp, C. familiaris
atgaaaaatttcaaaa

SEQ ID NO: 306190 - DNA, 16 bp, C. familiaris
atgaaaaccacagtga

SEQ ID NO: 306191 - DNA, 16 bp, C. familiaris
atgaaaagacatttca

SEQ ID NO: 306192 - DNA, 16 bp, C. familiaris
atgaaaagagcccaga

SEQ ID NO: 306193 - DNA, 16 bp, C. familiaris
atgaaaagatactgaa

SEQ ID NO: 306194 - DNA, 16 bp, C. familiaris
atgaaaagatgcccaa

SEQ ID NO: 306195 - DNA, 16 bp, C. familiaris
atgaaaagatgctgaa

SEQ ID NO: 306196 - DNA, 16 bp, C. familiaris
atgaaaagatgcttac

SEQ ID NO: 306197 - DNA, 16 bp, C. familiaris
atgaaaagattctcaa

SEQ ID NO: 306198 - DNA, 16 bp, C. familiaris
atgaaaagctgaaagc

SEQ ID NO: 306199 - DNA, 16 bp, C. familiaris
atgaaaagttccagca

SEQ ID NO: 306200 - DNA, 16 bp, C. familiaris
atgaaaataattttga

SEQ ID NO: 306201 - DNA, 16 bp, C. familiaris
atgaaaatattctttt

SEQ ID NO: 306202 - DNA, 16 bp, C. familiaris
atgaaaatgaaaactc

SEQ ID NO: 306203 - DNA, 16 bp, C. familiaris
atgaaaatgaaaatgt

SEQ ID NO: 306204 - DNA, 16 bp, C. familiaris
atgaaaatgaaaattc

SEQ ID NO: 306205 - DNA, 16 bp, C. familiaris
atgaaaatgaaagcaa

SEQ ID NO: 306206 - DNA, 16 bp, C. familiaris
atgaaaatgaagacat

SEQ ID NO: 306207 - DNA, 16 bp, C. familiaris
atgaaaatgaagatat

SEQ ID NO: 306208 - DNA, 16 bp, C. familiaris
atgaaaatgatgatga

SEQ ID NO: 306209 - DNA, 16 bp, C. familiaris
atgaaaatgttccaga

SEQ ID NO: 306210 - DNA, 16 bp, C. familiaris
atgaaacactgatgaa

SEQ ID NO: 306211 - DNA, 16 bp, C. familiaris
atgaaacagaaaatat

SEQ ID NO: 306212 - DNA, 16 bp, C. familiaris
atgaaactgaagaaaa

SEQ ID NO: 306213 - DNA, 16 bp, C. familiaris
atgaaactggatccct

SEQ ID NO: 306214 - DNA, 16 bp, C. familiaris
atgaaagaaaccaaag

SEQ ID NO: 306215 - DNA, 16 bp, C. familiaris
atgaaagaacaagaca

SEQ ID NO: 306216 - DNA, 16 bp, C. familiaris
atgaaagaatgttgaa

SEQ ID NO: 306217 - DNA, 16 bp, C. familiaris
atgaaagacacagaca

SEQ ID NO: 306218 - DNA, 16 bp, C. familiaris
atgaaagagctaaatg

SEQ ID NO: 306219 - DNA, 16 bp, C. familiaris
atgaaagcttgccatt

SEQ ID NO: 306220 - DNA, 16 bp, C. familiaris
atgaaatacttttttt

SEQ ID NO: 306221 - DNA, 16 bp, C. familiaris
atgaaatatctttttc

SEQ ID NO: 306222 - DNA, 16 bp, C. familiaris
atgaaatatttaggga

SEQ ID NO: 306223 - DNA, 16 bp, C. familiaris
atgaaatatttaggta

SEQ ID NO: 306224 - DNA, 16 bp, C. familiaris
atgaaatatttcaaat

SEQ ID NO: 306225 - DNA, 16 bp, C. familiaris
atgaaatatttcagac

SEQ ID NO: 306226 - DNA, 16 bp, C. familiaris
atgaaatcaaagaaga

SEQ ID NO: 306227 - DNA, 16 bp, C. familiaris
atgaaatgatatttca

SEQ ID NO: 306228 - DNA, 16 bp, C. familiaris
atgaaatgatgctcaa

SEQ ID NO: 306229 - DNA, 16 bp, C. familiaris
atgaaatggaaaaatt

SEQ ID NO: 306230 - DNA, 16 bp, C. familiaris
atgaaatggatgaatt

SEQ ID NO: 306231 - DNA, 16 bp, C. familiaris
atgaaatgttcaaaat

SEQ ID NO: 306232 - DNA, 16 bp, C. familiaris
atgaaattatttctaa

SEQ ID NO: 306233 - DNA, 16 bp, C. familiaris
atgaaattattttctt

SEQ ID NO: 306234 - DNA, 16 bp, C. familiaris
atgaaattatttttct

SEQ ID NO: 306235 - DNA, 16 bp, C. familiaris
atgaaattctagaaaa

SEQ ID NO: 306236 - DNA, 16 bp, C. familiaris
atgaaattctggaaaa

SEQ ID NO: 306237 - DNA, 16 bp, C. familiaris
atgaaattgaaaacag

SEQ ID NO: 306238 - DNA, 16 bp, C. familiaris
atgaaattgaagatga

SEQ ID NO: 306239 - DNA, 16 bp, C. familiaris
atgaaattgaagcagt

SEQ ID NO: 306240 - DNA, 16 bp, C. familiaris
atgaaattgtttcctt

SEQ ID NO: 306241 - DNA, 16 bp, C. familiaris
atgaaattttaaaaca

SEQ ID NO: 306242 - DNA, 16 bp, C. familiaris
atgaacaaaggaagaa

SEQ ID NO: 306243 - DNA, 16 bp, C. familiaris
atgaacaaaggggaaa

SEQ ID NO: 306244 - DNA, 16 bp, C. familiaris
atgaacaaggtggtgg

SEQ ID NO: 306245 - DNA, 16 bp, C. familiaris
atgaacagaaaattca

SEQ ID NO: 306246 - DNA, 16 bp, C. familiaris
atgaacatacatttct

SEQ ID NO: 306247 - DNA, 16 bp, C. familiaris
atgaacatatatttct

SEQ ID NO: 306248 - DNA, 16 bp, C. familiaris
atgaacatgaatgcaa

SEQ ID NO: 306249 - DNA, 16 bp, C. familiaris
atgaacattttcaaat

SEQ ID NO: 306250 - DNA, 16 bp, C. familiaris
atgaaccaggaagcag

SEQ ID NO: 306251 - DNA, 16 bp, C. familiaris
atgaaccaggaagtgg

SEQ ID NO: 306252 - DNA, 16 bp, C. familiaris
atgaacccagaagccc

SEQ ID NO: 306253 - DNA, 16 bp, C. familiaris
atgaactagaggtggt

SEQ ID NO: 306254 - DNA, 16 bp, C. familiaris
atgaactatctgaaaa

SEQ ID NO: 306255 - DNA, 16 bp, C. familiaris
atgaactcttctttaa

SEQ ID NO: 306256 - DNA, 16 bp, C. familiaris
atgaactttgaagaca

SEQ ID NO: 306257 - DNA, 16 bp, C. familiaris
atgaagaaaaacattt

SEQ ID NO: 306258 - DNA, 16 bp, C. familiaris
atgaagaaaataatca

SEQ ID NO: 306259 - DNA, 16 bp, C. familiaris
atgaagaaaatccaaa

SEQ ID NO: 306260 - DNA, 16 bp, C. familiaris
atgaagaaaatgaatg

SEQ ID NO: 306261 - DNA, 16 bp, C. familiaris
atgaagaaaccaagac

SEQ ID NO: 306262 - DNA, 16 bp, C. familiaris
atgaagaaactgaggc

SEQ ID NO: 306263 - DNA, 16 bp, C. familiaris
atgaagaaactgagtc

SEQ ID NO: 306264 - DNA, 16 bp, C. familiaris
atgaagaaatatttta

SEQ ID NO: 306265 - DNA, 16 bp, C. familiaris
atgaagaaatcaaaga

SEQ ID NO: 306266 - DNA, 16 bp, C. familiaris
atgaagaaatggaaat

SEQ ID NO: 306267 - DNA, 16 bp, C. familiaris
atgaagaacttatcaa

SEQ ID NO: 306268 - DNA, 16 bp, C. familiaris
atgaagaagcagaaag

SEQ ID NO: 306269 - DNA, 16 bp, C. familiaris
atgaagaagctgtggt

SEQ ID NO: 306270 - DNA, 16 bp, C. familiaris
atgaagaagtaaaact

SEQ ID NO: 306271 - DNA, 16 bp, C. familiaris
atgaagaatttcaaga

SEQ ID NO: 306272 - DNA, 16 bp, C. familiaris
atgaagacaaagaaga

SEQ ID NO: 306273 - DNA, 16 bp, C. familiaris
atgaagagagaatata

SEQ ID NO: 306274 - DNA, 16 bp, C. familiaris
atgaagagtcagacgc

SEQ ID NO: 306275 - DNA, 16 bp, C. familiaris
atgaagatattctcct

SEQ ID NO: 306276 - DNA, 16 bp, C. familiaris
atgaagatgaaaacac

SEQ ID NO: 306277 - DNA, 16 bp, C. familiaris
atgaagatgatgaaga

SEQ ID NO: 306278 - DNA, 16 bp, C. familiaris
atgaagatgatgatga

SEQ ID NO: 306279 - DNA, 16 bp, C. familiaris
atgaagatgatgatgg

SEQ ID NO: 306280 - DNA, 16 bp, C. familiaris
atgaagcagaagaaaa

SEQ ID NO: 306281 - DNA, 16 bp, C. familiaris
atgaagctcagagagg

SEQ ID NO: 306282 - DNA, 16 bp, C. familiaris
atgaagctgaacaaaa

SEQ ID NO: 306283 - DNA, 16 bp, C. familiaris
atgaagctgttaaaaa

SEQ ID NO: 306284 - DNA, 16 bp, C. familiaris
atgaaggcaaagaaaa

SEQ ID NO: 306285 - DNA, 16 bp, C. familiaris
atgaagtccatctggt

SEQ ID NO: 306286 - DNA, 16 bp, C. familiaris
atgaagttcaaaaaca

SEQ ID NO: 306287 - DNA, 16 bp, C. familiaris
atgaagttcaagaaca

SEQ ID NO: 306288 - DNA, 16 bp, C. familiaris
atgaataaagaagatg

SEQ ID NO: 306289 - DNA, 16 bp, C. familiaris
atgaataatctttttt

SEQ ID NO: 306290 - DNA, 16 bp, C. familiaris
atgaataatgctgtta

SEQ ID NO: 306291 - DNA, 16 bp, C. familiaris
atgaatataaatacaa

SEQ ID NO: 306292 - DNA, 16 bp, C. familiaris
atgaatataccacagt

SEQ ID NO: 306293 - DNA, 16 bp, C. familiaris
atgaatatatcttttt

SEQ ID NO: 306294 - DNA, 16 bp, C. familiaris
atgaatattcatttat

SEQ ID NO: 306295 - DNA, 16 bp, C. familiaris
atgaatcaataaataa

SEQ ID NO: 306296 - DNA, 16 bp, C. familiaris
atgaatcagtacttca

SEQ ID NO: 306297 - DNA, 16 bp, C. familiaris
atgaatctccagagaa

SEQ ID NO: 306298 - DNA, 16 bp, C. familiaris
atgaatctttgacaaa

SEQ ID NO: 306299 - DNA, 16 bp, C. familiaris
atgaatcttttttaat

SEQ ID NO: 306300 - DNA, 16 bp, C. familiaris
atgaatgaaataattt

SEQ ID NO: 306301 - DNA, 16 bp, C. familiaris
atgaatgaaatggaaa

SEQ ID NO: 306302 - DNA, 16 bp, C. familiaris
atgaatgaaattgaag

SEQ ID NO: 306303 - DNA, 16 bp, C. familiaris
atgaatgaagaagatg

SEQ ID NO: 306304 - DNA, 16 bp, C. familiaris
atgaatgagagaatga

SEQ ID NO: 306305 - DNA, 16 bp, C. familiaris
atgaatggacagatgg

SEQ ID NO: 306306 - DNA, 16 bp, C. familiaris
atgaatggatgaagaa

SEQ ID NO: 306307 - DNA, 16 bp, C. familiaris
atgaatggatgaatga

SEQ ID NO: 306308 - DNA, 16 bp, C. familiaris
atgaatgggtattgaa

SEQ ID NO: 306309 - DNA, 16 bp, C. familiaris
atgaattaatacataa

SEQ ID NO: 306310 - DNA, 16 bp, C. familiaris
atgaattaatatatgt

SEQ ID NO: 306311 - DNA, 16 bp, C. familiaris
atgaattagaagaaca

SEQ ID NO: 306312 - DNA, 16 bp, C. familiaris
atgaattcagcaaggt

SEQ ID NO: 306313 - DNA, 16 bp, C. familiaris
atgaattctttaaaaa

SEQ ID NO: 306314 - DNA, 16 bp, C. familiaris
atgaatttggagagga

SEQ ID NO: 306315 - DNA, 16 bp, C. familiaris
atgaattttgagagga

SEQ ID NO: 306316 - DNA, 16 bp, C. familiaris
atgaatttttaaaatc

SEQ ID NO: 306317 - DNA, 16 bp, C. familiaris
atgacaaagaaggcaa

SEQ ID NO: 306318 - DNA, 16 bp, C. familiaris
atgacaaaggagacaa

SEQ ID NO: 306319 - DNA, 16 bp, C. familiaris
atgacacaaagaaatg

SEQ ID NO: 306320 - DNA, 16 bp, C. familiaris
atgacagaaacagaga

SEQ ID NO: 306321 - DNA, 16 bp, C. familiaris
atgacagacacagaaa

SEQ ID NO: 306322 - DNA, 16 bp, C. familiaris
atgacagagccaggat

SEQ ID NO: 306323 - DNA, 16 bp, C. familiaris
atgacagagggagaga

SEQ ID NO: 306324 - DNA, 16 bp, C. familiaris
atgacagccctaggaa

SEQ ID NO: 306325 - DNA, 16 bp, C. familiaris
atgacatatttgataa

SEQ ID NO: 306326 - DNA, 16 bp, C. familiaris
atgacatcatatacat

SEQ ID NO: 306327 - DNA, 16 bp, C. familiaris
atgacatggatggagg

SEQ ID NO: 306328 - DNA, 16 bp, C. familiaris
atgacattctgaaaaa

SEQ ID NO: 306329 - DNA, 16 bp, C. familiaris
atgacattctggaaag

SEQ ID NO: 306330 - DNA, 16 bp, C. familiaris
atgacattctggaaga

SEQ ID NO: 306331 - DNA, 16 bp, C. familiaris
atgacattggatttgg

SEQ ID NO: 306332 - DNA, 16 bp, C. familiaris
atgacatttattttat

SEQ ID NO: 306333 - DNA, 16 bp, C. familiaris
atgacattttagaaaa

SEQ ID NO: 306334 - DNA, 16 bp, C. familiaris
atgaccaacagacaca

SEQ ID NO: 306335 - DNA, 16 bp, C. familiaris
atgaccacaatagcca

SEQ ID NO: 306336 - DNA, 16 bp, C. familiaris
atgacccagagatcaa

SEQ ID NO: 306337 - DNA, 16 bp, C. familiaris
atgaccccagcagaaa

SEQ ID NO: 306338 - DNA, 16 bp, C. familiaris
atgaccccagtgcagc

SEQ ID NO: 306339 - DNA, 16 bp, C. familiaris
atgaccctgacatcaa

SEQ ID NO: 306340 - DNA, 16 bp, C. familiaris
atgaccctgagatcaa

SEQ ID NO: 306341 - DNA, 16 bp, C. familiaris
atgacctgaacaaaag

SEQ ID NO: 306342 - DNA, 16 bp, C. familiaris
atgaccttgagaccat

SEQ ID NO: 306343 - DNA, 16 bp, C. familiaris
atgacgatgacgatga

SEQ ID NO: 306344 - DNA, 16 bp, C. familiaris
atgacgatgatgatga

SEQ ID NO: 306345 - DNA, 16 bp, C. familiaris
atgactatcattaaaa

SEQ ID NO: 306346 - DNA, 16 bp, C. familiaris
atgactcaacaattct

SEQ ID NO: 306347 - DNA, 16 bp, C. familiaris
atgactggtgtccttt

SEQ ID NO: 306348 - DNA, 16 bp, C. familiaris
atgactttaaaatttt

SEQ ID NO: 306349 - DNA, 16 bp, C. familiaris
atgactttgagcccca

SEQ ID NO: 306350 - DNA, 16 bp, C. familiaris
atgacttttttaaaga

SEQ ID NO: 306351 - DNA, 16 bp, C. familiaris
atgagaaaaacagaga

SEQ ID NO: 306352 - DNA, 16 bp, C. familiaris
atgagaaaaataaagc

SEQ ID NO: 306353 - DNA, 16 bp, C. familiaris
atgagaaaaataagtt

SEQ ID NO: 306354 - DNA, 16 bp, C. familiaris
atgagaaaactgagaa

SEQ ID NO: 306355 - DNA, 16 bp, C. familiaris
atgagaaaactgaggt

SEQ ID NO: 306356 - DNA, 16 bp, C. familiaris
atgagaaaatgctcaa

SEQ ID NO: 306357 - DNA, 26 bp, C. familiaris
atgagaaaatgctctgcatcacttgc

SEQ ID NO: 306358 - DNA, 16 bp, C. familiaris
atgagaaaatggagac

SEQ ID NO: 306359 - DNA, 16 bp, C. familiaris
atgagaaaattgaagt

SEQ ID NO: 306360 - DNA, 16 bp, C. familiaris
atgagaaactgaggca

SEQ ID NO: 306361 - DNA, 16 bp, C. familiaris
atgagaaagaagaaca

SEQ ID NO: 306362 - DNA, 16 bp, C. familiaris
atgagaaagacagaga

SEQ ID NO: 306363 - DNA, 16 bp, C. familiaris
atgagaaagttctgga

SEQ ID NO: 306364 - DNA, 16 bp, C. familiaris
atgagaagacagaaaa

SEQ ID NO: 306365 - DNA, 16 bp, C. familiaris
atgagaagatgttcaa

SEQ ID NO: 306366 - DNA, 16 bp, C. familiaris
atgagaagcacagaga

SEQ ID NO: 306367 - DNA, 16 bp, C. familiaris
atgagaatattttaaa

SEQ ID NO: 306368 - DNA, 16 bp, C. familiaris
atgagaatgaaatgaa

SEQ ID NO: 306369 - DNA, 16 bp, C. familiaris
atgagaattttaaaag

SEQ ID NO: 306370 - DNA, 16 bp, C. familiaris
atgagaccaagcccca

SEQ ID NO: 306371 - DNA, 16 bp, C. familiaris
atgagaccatatgttt

SEQ ID NO: 306372 - DNA, 16 bp, C. familiaris
atgagagaatatattt

SEQ ID NO: 306373 - DNA, 16 bp, C. familiaris
atgagagacacacaag

SEQ ID NO: 306374 - DNA, 16 bp, C. familiaris
atgagagacagaaagg

SEQ ID NO: 306375 - DNA, 16 bp, C. familiaris
atgagagacatggaga

SEQ ID NO: 306376 - DNA, 16 bp, C. familiaris
atgagagacccagaca

SEQ ID NO: 306377 - DNA, 16 bp, C. familiaris
atgagagactcaaaga

SEQ ID NO: 306378 - DNA, 16 bp, C. familiaris
atgagagactgagaga

SEQ ID NO: 306379 - DNA, 16 bp, C. familiaris
atgagagagagcgaga

SEQ ID NO: 306380 - DNA, 16 bp, C. familiaris
atgagagaggcagaga

SEQ ID NO: 306381 - DNA, 16 bp, C. familiaris
atgagagatacacaga

SEQ ID NO: 306382 - DNA, 16 bp, C. familiaris
atgagagatgagagag

SEQ ID NO: 306383 - DNA, 16 bp, C. familiaris
atgagagatgcagaaa

SEQ ID NO: 306384 - DNA, 16 bp, C. familiaris
atgagagcgagagaga

SEQ ID NO: 306385 - DNA, 16 bp, C. familiaris
atgagaggcagagagg

SEQ ID NO: 306386 - DNA, 16 bp, C. familiaris
atgagatattactaca

SEQ ID NO: 306387 - DNA, 16 bp, C. familiaris
atgagatcctgacctg

SEQ ID NO: 306388 - DNA, 16 bp, C. familiaris
atgagatggaagaaag

SEQ ID NO: 306389 - DNA, 16 bp, C. familiaris
atgagatgtctttcca

SEQ ID NO: 306390 - DNA, 16 bp, C. familiaris
atgagattgagtcctg

SEQ ID NO: 306391 - DNA, 16 bp, C. familiaris
atgagattgctttctt

SEQ ID NO: 306392 - DNA, 16 bp, C. familiaris
atgagcaaactgaagc

SEQ ID NO: 306393 - DNA, 16 bp, C. familiaris
atgagcaaggaggaga

SEQ ID NO: 306394 - DNA, 16 bp, C. familiaris
atgagcactgggtgtt

SEQ ID NO: 306395 - DNA, 16 bp, C. familiaris
atgagcagagggaagg

SEQ ID NO: 306396 - DNA, 16 bp, C. familiaris
atgagcagggaagagg

SEQ ID NO: 306397 - DNA, 16 bp, C. familiaris
atgagcagggacagag

SEQ ID NO: 306398 - DNA, 16 bp, C. familiaris
atgagcaggggcaggg

SEQ ID NO: 306399 - DNA, 16 bp, C. familiaris
atgagcagggggaaag

SEQ ID NO: 306400 - DNA, 16 bp, C. familiaris
atgagcagggggaagg

SEQ ID NO: 306401 - DNA, 16 bp, C. familiaris
atgagcaggtgggagg

SEQ ID NO: 306402 - DNA, 16 bp, C. familiaris
atgagcatctttatga

SEQ ID NO: 306403 - DNA, 16 bp, C. familiaris
atgagccacccaagca

SEQ ID NO: 306404 - DNA, 16 bp, C. familiaris
atgagccagccaggca

SEQ ID NO: 306405 - DNA, 16 bp, C. familiaris
atgagctgggagaggg

SEQ ID NO: 306406 - DNA, 16 bp, C. familiaris
atgaggaaaacatcag

SEQ ID NO: 306407 - DNA, 16 bp, C. familiaris
atgaggaaaatgaagt

SEQ ID NO: 306408 - DNA, 16 bp, C. familiaris
atgaggaaactcaggc

SEQ ID NO: 306409 - DNA, 16 bp, C. familiaris
atgaggaaactgaacc

SEQ ID NO: 306410 - DNA, 16 bp, C. familiaris
atgaggaaactgaggc

SEQ ID NO: 306411 - DNA, 16 bp, C. familiaris
atgaggaaatgctcca

SEQ ID NO: 306412 - DNA, 16 bp, C. familiaris
atgaggaacaagacaa

SEQ ID NO: 306413 - DNA, 16 bp, C. familiaris
atgaggagaaaaatca

SEQ ID NO: 306414 - DNA, 16 bp, C. familiaris
atgaggagacagaaga

SEQ ID NO: 306415 - DNA, 16 bp, C. familiaris
atgaggagacagagga

SEQ ID NO: 306416 - DNA, 16 bp, C. familiaris
atgaggagaccaaggc

SEQ ID NO: 306417 - DNA, 16 bp, C. familiaris
atgaggagggcacttg

SEQ ID NO: 306418 - DNA, 16 bp, C. familiaris
atgaggaggggcagag

SEQ ID NO: 306419 - DNA, 16 bp, C. familiaris
atgaggatgatgataa

SEQ ID NO: 306420 - DNA, 16 bp, C. familiaris
atgaggatgatgatga

SEQ ID NO: 306421 - DNA, 16 bp, C. familiaris
atgaggattaaggagg

SEQ ID NO: 306422 - DNA, 16 bp, C. familiaris
atgaggattttaaaaa

SEQ ID NO: 306423 - DNA, 16 bp, C. familiaris
atgaggcaaaaagaaa

SEQ ID NO: 306424 - DNA, 16 bp, C. familiaris
atgaggcccctgttcc

SEQ ID NO: 306425 - DNA, 16 bp, C. familiaris
atgaggctccctgctc

SEQ ID NO: 306426 - DNA, 16 bp, C. familiaris
atgagggacacagaca

SEQ ID NO: 306427 - DNA, 16 bp, C. familiaris
atgagtctgaagaaag

SEQ ID NO: 306428 - DNA, 16 bp, C. familiaris
atgagtctgtttctgt

SEQ ID NO: 306429 - DNA, 16 bp, C. familiaris
atgagtgatgctgaac

SEQ ID NO: 306430 - DNA, 16 bp, C. familiaris
atgagtgggaagggca

SEQ ID NO: 306431 - DNA, 16 bp, C. familiaris
atgagttagggacaaa

SEQ ID NO: 306432 - DNA, 16 bp, C. familiaris
atgagtttgggagtgt

SEQ ID NO: 306433 - DNA, 16 bp, C. familiaris
atgataaaaaccctta

SEQ ID NO: 306434 - DNA, 16 bp, C. familiaris
atgataaaaataatct

SEQ ID NO: 306435 - DNA, 16 bp, C. familiaris
atgataatgaaaatac

SEQ ID NO: 306436 - DNA, 16 bp, C. familiaris
atgatacactggaccc

SEQ ID NO: 306437 - DNA, 16 bp, C. familiaris
atgataccatttatat

SEQ ID NO: 306438 - DNA, 16 bp, C. familiaris
atgatacctctagctt

SEQ ID NO: 306439 - DNA, 16 bp, C. familiaris
atgatacttttaaaaa

SEQ ID NO: 306440 - DNA, 16 bp, C. familiaris
atgatagagacagaga

SEQ ID NO: 306441 - DNA, 16 bp, C. familiaris
atgatagatgatgata

SEQ ID NO: 306442 - DNA, 16 bp, C. familiaris
atgatagtcacacaaa

SEQ ID NO: 306443 - DNA, 16 bp, C. familiaris
atgatagtgatgatga

SEQ ID NO: 306444 - DNA, 16 bp, C. familiaris
atgatattgatgatga

SEQ ID NO: 306445 - DNA, 16 bp, C. familiaris
atgatatttgcatttt

SEQ ID NO: 306446 - DNA, 16 bp, C. familiaris
atgatcatagctttgt

SEQ ID NO: 306447 - DNA, 16 bp, C. familiaris
atgatccagaaattgc

SEQ ID NO: 306448 - DNA, 16 bp, C. familiaris
atgatcccaatctttt

SEQ ID NO: 306449 - DNA, 16 bp, C. familiaris
atgatcctgaaatcat

SEQ ID NO: 306450 - DNA, 16 bp, C. familiaris
atgatctcagggctct

SEQ ID NO: 306451 - DNA, 16 bp, C. familiaris
atgatgaaaaactgaa

SEQ ID NO: 306452 - DNA, 16 bp, C. familiaris
atgatgaaaatgatga

SEQ ID NO: 306453 - DNA, 16 bp, C. familiaris
atgatgaaacagaaaa

SEQ ID NO: 306454 - DNA, 16 bp, C. familiaris
atgatgaaactaaggc

SEQ ID NO: 306455 - DNA, 16 bp, C. familiaris
atgatgaaagactaaa

SEQ ID NO: 306456 - DNA, 16 bp, C. familiaris
atgatgaacatctttt

SEQ ID NO: 306457 - DNA, 16 bp, C. familiaris
atgatgacaacaacaa

SEQ ID NO: 306458 - DNA, 23 bp, C. familiaris
atgatgacactaaactcatatct

SEQ ID NO: 306459 - DNA, 16 bp, C. familiaris
atgatgacattaaatt

SEQ ID NO: 306460 - DNA, 16 bp, C. familiaris
atgatgactttttttt

SEQ ID NO: 306461 - DNA, 16 bp, C. familiaris
atgatgagcactgagt

SEQ ID NO: 306462 - DNA, 16 bp, C. familiaris
atgatgaggaggagga

SEQ ID NO: 306463 - DNA, 16 bp, C. familiaris
atgatgaggatgagga

SEQ ID NO: 306464 - DNA, 16 bp, C. familiaris
atgatgagtgattttg

SEQ ID NO: 306465 - DNA, 16 bp, C. familiaris
atgatgatgaagaaga

SEQ ID NO: 306466 - DNA, 17 bp, C. familiaris
atgatgatgaagaagaa

SEQ ID NO: 306467 - DNA, 16 bp, C. familiaris
atgatgatgacagtga

SEQ ID NO: 306468 - DNA, 16 bp, C. familiaris
atgatgatgacgatga

SEQ ID NO: 306469 - DNA, 16 bp, C. familiaris
atgatgatgataatga

SEQ ID NO: 306470 - DNA, 16 bp, C. familiaris
atgatgatgatagata

SEQ ID NO: 306471 - DNA, 16 bp, C. familiaris
atgatgatgatagtaa

SEQ ID NO: 306472 - DNA, 16 bp, C. familiaris
atgatgatgatgatgg

SEQ ID NO: 306473 - DNA, 16 bp, C. familiaris
atgatgatgatgatgt

SEQ ID NO: 306474 - DNA, 16 bp, C. familiaris
atgatgatgatggaga

SEQ ID NO: 306475 - DNA, 16 bp, C. familiaris
atgatgatgattttga

SEQ ID NO: 306476 - DNA, 16 bp, C. familiaris
atgatgatgttgatga

SEQ ID NO: 306477 - DNA, 16 bp, C. familiaris
atgatgattatgatga

SEQ ID NO: 306478 - DNA, 16 bp, C. familiaris
atgatggaaatatttt

SEQ ID NO: 306479 - DNA, 16 bp, C. familiaris
atgatggcaaattgaa

SEQ ID NO: 306480 - DNA, 16 bp, C. familiaris
atgatggtgatagtga

SEQ ID NO: 306481 - DNA, 16 bp, C. familiaris
atgatggtgatgataa

SEQ ID NO: 306482 - DNA, 16 bp, C. familiaris
atgatggtgatggtgg

SEQ ID NO: 306483 - DNA, 19 bp, C. familiaris
atgatgtatcagataaagg

SEQ ID NO: 306484 - DNA, 16 bp, C. familiaris
atgatgtgaggcaggg

SEQ ID NO: 306485 - DNA, 16 bp, C. familiaris
atgatgtgtgtgtgtg

SEQ ID NO: 306486 - DNA, 16 bp, C. familiaris
atgatgttgatgatga

SEQ ID NO: 306487 - DNA, 16 bp, C. familiaris
atgattaagggtctct

SEQ ID NO: 306488 - DNA, 16 bp, C. familiaris
atgattcagtcttgga

SEQ ID NO: 306489 - DNA, 16 bp, C. familiaris
atgattctctctctcc

SEQ ID NO: 306490 - DNA, 16 bp, C. familiaris
atgattgtcacacaga

SEQ ID NO: 306491 - DNA, 16 bp, C. familiaris
atgatttcattcatgt

SEQ ID NO: 306492 - DNA, 16 bp, C. familiaris
atgatttccttctttt

SEQ ID NO: 306493 - DNA, 16 bp, C. familiaris
atgatttgacttacat

SEQ ID NO: 306494 - DNA, 16 bp, C. familiaris
atgattttctctttat

SEQ ID NO: 306495 - DNA, 16 bp, C. familiaris
atgattttgactattt

SEQ ID NO: 306496 - DNA, 16 bp, C. familiaris
atgatttttatttcct

SEQ ID NO: 306497 - DNA, 16 bp, C. familiaris
atgcaaaaatcctcaa

SEQ ID NO: 306498 - DNA, 16 bp, C. familiaris
atgcaaaagcatgaaa

SEQ ID NO: 306499 - DNA, 16 bp, C. familiaris
atgcaaagaaaaggga

SEQ ID NO: 306500 - DNA, 16 bp, C. familiaris
atgcaaagaaagggga

SEQ ID NO: 306501 - DNA, 16 bp, C. familiaris
atgcaaaggaaatgaa

SEQ ID NO: 306502 - DNA, 16 bp, C. familiaris
atgcaaattaaaacca

SEQ ID NO: 306503 - DNA, 16 bp, C. familiaris
atgcaacagtgaggag

SEQ ID NO: 306504 - DNA, 16 bp, C. familiaris
atgcaactcaacacca

SEQ ID NO: 306505 - DNA, 16 bp, C. familiaris
atgcaagagaatgaaa

SEQ ID NO: 306506 - DNA, 16 bp, C. familiaris
atgcaatgcctatcaa

SEQ ID NO: 306507 - DNA, 16 bp, C. familiaris
atgcaattaaaaaaat

SEQ ID NO: 306508 - DNA, 16 bp, C. familiaris
atgcacagtatcatgt

SEQ ID NO: 306509 - DNA, 16 bp, C. familiaris
atgcacatacatacat

SEQ ID NO: 306510 - DNA, 16 bp, C. familiaris
atgcacatgaggaaat

SEQ ID NO: 306511 - DNA, 16 bp, C. familiaris
atgcactccaagaagg

SEQ ID NO: 306512 - DNA, 16 bp, C. familiaris
atgcagaaaaagaatt

SEQ ID NO: 306513 - DNA, 16 bp, C. familiaris
atgcagaaaagcattt

SEQ ID NO: 306514 - DNA, 16 bp, C. familiaris
atgcagaaaaggcatt

SEQ ID NO: 306515 - DNA, 16 bp, C. familiaris
atgcagaaagagagag

SEQ ID NO: 306516 - DNA, 16 bp, C. familiaris
atgcagaagaatcaaa

SEQ ID NO: 306517 - DNA, 16 bp, C. familiaris
atgcagaagcttttaa

SEQ ID NO: 306518 - DNA, 16 bp, C. familiaris
atgcagactccatgct

SEQ ID NO: 306519 - DNA, 16 bp, C. familiaris
atgcagagaaggcatt

SEQ ID NO: 306520 - DNA, 16 bp, C. familiaris
atgcagagagagaagc

SEQ ID NO: 306521 - DNA, 16 bp, C. familiaris
atgcagatttttgact

SEQ ID NO: 306522 - DNA, 16 bp, C. familiaris
atgcagctgcaagcca

SEQ ID NO: 306523 - DNA, 16 bp, C. familiaris
atgcaggaagcccaag

SEQ ID NO: 306524 - DNA, 16 bp, C. familiaris
atgcaggaagcctggt

SEQ ID NO: 306525 - DNA, 16 bp, C. familiaris
atgcagggagcttgat

SEQ ID NO: 306526 - DNA, 16 bp, C. familiaris
atgcagggatcccaac

SEQ ID NO: 306527 - DNA, 16 bp, C. familiaris
atgcagggcagcccag

SEQ ID NO: 306528 - DNA, 16 bp, C. familiaris
atgcagtgaaacgccg

SEQ ID NO: 306529 - DNA, 16 bp, C. familiaris
atgcatatatgttttt

SEQ ID NO: 306530 - DNA, 16 bp, C. familiaris
atgcatgagacacaga

SEQ ID NO: 306531 - DNA, 16 bp, C. familiaris
atgcatgtttgtgtgt

SEQ ID NO: 306532 - DNA, 16 bp, C. familiaris
atgcattatatactgt

SEQ ID NO: 306533 - DNA, 16 bp, C. familiaris
atgcattgctggtggg

SEQ ID NO: 306534 - DNA, 16 bp, C. familiaris
atgcatttaaaaaaat

SEQ ID NO: 306535 - DNA, 16 bp, C. familiaris
atgcatttgtaatttt

SEQ ID NO: 306536 - DNA, 16 bp, C. familiaris
atgcattttatatatg

SEQ ID NO: 306537 - DNA, 16 bp, C. familiaris
atgcatttttcaaaac

SEQ ID NO: 306538 - DNA, 16 bp, C. familiaris
atgccaaagtggccca

SEQ ID NO: 306539 - DNA, 16 bp, C. familiaris
atgccaagatggagga

SEQ ID NO: 306540 - DNA, 16 bp, C. familiaris
atgccagtagcactcc

SEQ ID NO: 306541 - DNA, 16 bp, C. familiaris
atgccattaagaacat

SEQ ID NO: 306542 - DNA, 16 bp, C. familiaris
atgccattctggaaaa

SEQ ID NO: 306543 - DNA, 16 bp, C. familiaris
atgccattggtatttt

SEQ ID NO: 306544 - DNA, 16 bp, C. familiaris
atgcccaagagtgcaa

SEQ ID NO: 306545 - DNA, 16 bp, C. familiaris
atgcccagtgtgatgg

SEQ ID NO: 306546 - DNA, 16 bp, C. familiaris
atgcccattttgcaga

SEQ ID NO: 306547 - DNA, 16 bp, C. familiaris
atgccctgagccaaaa

SEQ ID NO: 306548 - DNA, 16 bp, C. familiaris
atgccctgagccagag

SEQ ID NO: 306549 - DNA, 16 bp, C. familiaris
atgcccttcttcatct

SEQ ID NO: 306550 - DNA, 16 bp, C. familiaris
atgcctggatggttca

SEQ ID NO: 306551 - DNA, 16 bp, C. familiaris
atgcctggcttcaaag

SEQ ID NO: 306552 - DNA, 16 bp, C. familiaris
atgcctgggctgaagg

SEQ ID NO: 306553 - DNA, 16 bp, C. familiaris
atgccttatatttctt

SEQ ID NO: 306554 - DNA, 16 bp, C. familiaris
atgccttcagctttgc

SEQ ID NO: 306555 - DNA, 16 bp, C. familiaris
atgctaaatgggaaaa

SEQ ID NO: 306556 - DNA, 16 bp, C. familiaris
atgctaaattttatgt

SEQ ID NO: 306557 - DNA, 16 bp, C. familiaris
atgctaagaaaaataa

SEQ ID NO: 306558 - DNA, 16 bp, C. familiaris
atgctaattttttaaa

SEQ ID NO: 306559 - DNA, 16 bp, C. familiaris
atgctacagagagaaa

SEQ ID NO: 306560 - DNA, 16 bp, C. familiaris
atgctataatgaacat

SEQ ID NO: 306561 - DNA, 16 bp, C. familiaris
atgctcaacatcacaa

SEQ ID NO: 306562 - DNA, 16 bp, C. familiaris
atgctcaacatcaccc

SEQ ID NO: 306563 - DNA, 16 bp, C. familiaris
atgctctaatgactga

SEQ ID NO: 306564 - DNA, 16 bp, C. familiaris
atgctctaccaagtga

SEQ ID NO: 306565 - DNA, 16 bp, C. familiaris
atgctctcagggtcat

SEQ ID NO: 306566 - DNA, 16 bp, C. familiaris
atgctctccttaatgc

SEQ ID NO: 306567 - DNA, 16 bp, C. familiaris
atgctctctcactctc

SEQ ID NO: 306568 - DNA, 16 bp, C. familiaris
atgctctctctgtctc

SEQ ID NO: 306569 - DNA, 16 bp, C. familiaris
atgctgaacaaaagaa

SEQ ID NO: 306570 - DNA, 16 bp, C. familiaris
atgctgaacccactga

SEQ ID NO: 306571 - DNA, 16 bp, C. familiaris
atgctgagaaaaggga

SEQ ID NO: 306572 - DNA, 16 bp, C. familiaris
atgctgagcattttct

SEQ ID NO: 306573 - DNA, 16 bp, C. familiaris
atgctgagcctggagc

SEQ ID NO: 306574 - DNA, 16 bp, C. familiaris
atgctgagtatctttt

SEQ ID NO: 306575 - DNA, 16 bp, C. familiaris
atgctgatatgaacat

SEQ ID NO: 306576 - DNA, 16 bp, C. familiaris
atgctgctgaacatcc

SEQ ID NO: 306577 - DNA, 16 bp, C. familiaris
atgctgctgctgctgc

SEQ ID NO: 306578 - DNA, 16 bp, C. familiaris
atgctgctgtaaatat

SEQ ID NO: 306579 - DNA, 16 bp, C. familiaris
atgctggcagaagaca

SEQ ID NO: 306580 - DNA, 16 bp, C. familiaris
atgctgggacacctgg

SEQ ID NO: 306581 - DNA, 16 bp, C. familiaris
atgctgggcagcccag

SEQ ID NO: 306582 - DNA, 16 bp, C. familiaris
atgctgggctccctgc

SEQ ID NO: 306583 - DNA, 16 bp, C. familiaris
atgctggggcacctgg

SEQ ID NO: 306584 - DNA, 16 bp, C. familiaris
atgctggggcgcctgg

SEQ ID NO: 306585 - DNA, 16 bp, C. familiaris
atgctgggggcacctg

SEQ ID NO: 306586 - DNA, 16 bp, C. familiaris
atgctgtacatgacat

SEQ ID NO: 306587 - DNA, 16 bp, C. familiaris
atgctgtcttgatgac

SEQ ID NO: 306588 - DNA, 16 bp, C. familiaris
atgctgtgaagactgt

SEQ ID NO: 306589 - DNA, 16 bp, C. familiaris
atgctgttccctctgt

SEQ ID NO: 306590 - DNA, 16 bp, C. familiaris
atgctgtttgtatttt

SEQ ID NO: 306591 - DNA, 16 bp, C. familiaris
atgctgttttaattac

SEQ ID NO: 306592 - DNA, 16 bp, C. familiaris
atgctgttttccagag

SEQ ID NO: 306593 - DNA, 16 bp, C. familiaris
atgctgtttttttaaa

SEQ ID NO: 306594 - DNA, 16 bp, C. familiaris
atgcttgggaactctg

SEQ ID NO: 306595 - DNA, 16 bp, C. familiaris
atgctttaagaaaaaa

SEQ ID NO: 306596 - DNA, 16 bp, C. familiaris
atgctttgattccttt

SEQ ID NO: 306597 - DNA, 16 bp, C. familiaris
atgcttttaaaaaaaa

SEQ ID NO: 306598 - DNA, 16 bp, C. familiaris
atggaaaaaagacagt

SEQ ID NO: 306599 - DNA, 16 bp, C. familiaris
atggaaaaaagggaac

SEQ ID NO: 306600 - DNA, 16 bp, C. familiaris
atggaaaaacatttat

SEQ ID NO: 306601 - DNA, 16 bp, C. familiaris
atggaaaaagatattc

SEQ ID NO: 306602 - DNA, 16 bp, C. familiaris
atggaaaaaggacagt

SEQ ID NO: 306603 - DNA, 16 bp, C. familiaris
atggaaaaatatggaa

SEQ ID NO: 306604 - DNA, 16 bp, C. familiaris
atggaaaacaatgaag

SEQ ID NO: 306605 - DNA, 16 bp, C. familiaris
atggaaaacagaagaa

SEQ ID NO: 306606 - DNA, 16 bp, C. familiaris
atggaaaacattttta

SEQ ID NO: 306607 - DNA, 16 bp, C. familiaris
atggaaaacttccaaa

SEQ ID NO: 306608 - DNA, 16 bp, C. familiaris
atggaaaagcaaagga

SEQ ID NO: 306609 - DNA, 16 bp, C. familiaris
atggaaaagcatttat

SEQ ID NO: 306610 - DNA, 16 bp, C. familiaris
atggaaaataatgaag

SEQ ID NO: 306611 - DNA, 16 bp, C. familiaris
atggaaacacattcca

SEQ ID NO: 306612 - DNA, 16 bp, C. familiaris
atggaaacagaaaata

SEQ ID NO: 306613 - DNA, 16 bp, C. familiaris
atggaaacatttttct

SEQ ID NO: 306614 - DNA, 16 bp, C. familiaris
atggaaaccatcaaca

SEQ ID NO: 306615 - DNA, 16 bp, C. familiaris
atggaaactaaagaaa

SEQ ID NO: 306616 - DNA, 16 bp, C. familiaris
atggaaagaaaatcaa

SEQ ID NO: 306617 - DNA, 16 bp, C. familiaris
atggaaagacaaagga

SEQ ID NO: 306618 - DNA, 16 bp, C. familiaris
atggaaatgaaaacca

SEQ ID NO: 306619 - DNA, 16 bp, C. familiaris
atggaaatgaaaatga

SEQ ID NO: 306620 - DNA, 16 bp, C. familiaris
atggaaatggaaggaa

SEQ ID NO: 306621 - DNA, 16 bp, C. familiaris
atggaaatggagggta

SEQ ID NO: 306622 - DNA, 16 bp, C. familiaris
atggaaatgttttaaa

SEQ ID NO: 306623 - DNA, 16 bp, C. familiaris
atggaaatttaaattt

SEQ ID NO: 306624 - DNA, 16 bp, C. familiaris
atggaacagaatacag

SEQ ID NO: 306625 - DNA, 16 bp, C. familiaris
atggaacattcaccaa

SEQ ID NO: 306626 - DNA, 16 bp, C. familiaris
atggaactacaaaaga

SEQ ID NO: 306627 - DNA, 16 bp, C. familiaris
atggaactggagggaa

SEQ ID NO: 306628 - DNA, 16 bp, C. familiaris
atggaacttcctccag

SEQ ID NO: 306629 - DNA, 16 bp, C. familiaris
atggaagaaaacattt

SEQ ID NO: 306630 - DNA, 16 bp, C. familiaris
atggaagaaatttaaa

SEQ ID NO: 306631 - DNA, 16 bp, C. familiaris
atggaagaacaaatat

SEQ ID NO: 306632 - DNA, 16 bp, C. familiaris
atggaagatttttcca

SEQ ID NO: 306633 - DNA, 16 bp, C. familiaris
atggaagccagaagac

SEQ ID NO: 306634 - DNA, 16 bp, C. familiaris
atggaatatgactcag

SEQ ID NO: 306635 - DNA, 16 bp, C. familiaris
atggaatattactctg

SEQ ID NO: 306636 - DNA, 16 bp, C. familiaris
atggaatcttctctca

SEQ ID NO: 306637 - DNA, 16 bp, C. familiaris
atggaatgaaactaga

SEQ ID NO: 306638 - DNA, 16 bp, C. familiaris
atggaatgtctttcca

SEQ ID NO: 306639 - DNA, 16 bp, C. familiaris
atggaatgtttctcca

SEQ ID NO: 306640 - DNA, 16 bp, C. familiaris
atggaattaaactaga

SEQ ID NO: 306641 - DNA, 16 bp, C. familiaris
atggaattaaggttgc

SEQ ID NO: 306642 - DNA, 16 bp, C. familiaris
atggaattgcaaggga

SEQ ID NO: 306643 - DNA, 16 bp, C. familiaris
atggaattgctgagtc

SEQ ID NO: 306644 - DNA, 16 bp, C. familiaris
atggaatttaaaaaac

SEQ ID NO: 306645 - DNA, 16 bp, C. familiaris
atggaatttttaaaaa

SEQ ID NO: 306646 - DNA, 16 bp, C. familiaris
atggacaaataaaaat

SEQ ID NO: 306647 - DNA, 16 bp, C. familiaris
atggacagaaatttca

SEQ ID NO: 306648 - DNA, 16 bp, C. familiaris
atggacagaagatatg

SEQ ID NO: 306649 - DNA, 16 bp, C. familiaris
atggacatgaaggagg

SEQ ID NO: 306650 - DNA, 16 bp, C. familiaris
atggacatttgggatg

SEQ ID NO: 306651 - DNA, 16 bp, C. familiaris
atggacatttggtttg

SEQ ID NO: 306652 - DNA, 16 bp, C. familiaris
atggaccctcagctct

SEQ ID NO: 306653 - DNA, 16 bp, C. familiaris
atggagaaaagggaac

SEQ ID NO: 306654 - DNA, 16 bp, C. familiaris
atggagaaaagggaat

SEQ ID NO: 306655 - DNA, 16 bp, C. familiaris
atggagaaaataaagt

SEQ ID NO: 306656 - DNA, 16 bp, C. familiaris
atggagaaactggaac

SEQ ID NO: 306657 - DNA, 16 bp, C. familiaris
atggagaagcaaaaga

SEQ ID NO: 306658 - DNA, 16 bp, C. familiaris
atggagaagctgcagc

SEQ ID NO: 306659 - DNA, 16 bp, C. familiaris
atggagaatttaaagt

SEQ ID NO: 306660 - DNA, 16 bp, C. familiaris
atggagacactgaggc

SEQ ID NO: 306661 - DNA, 16 bp, C. familiaris
atggagagcctgcttc

SEQ ID NO: 306662 - DNA, 16 bp, C. familiaris
atggagatgcctgggt

SEQ ID NO: 306663 - DNA, 16 bp, C. familiaris
atggagatggtaaaaa

SEQ ID NO: 306664 - DNA, 16 bp, C. familiaris
atggagccactcaggc

SEQ ID NO: 306665 - DNA, 16 bp, C. familiaris
atggagcctgacacgg

SEQ ID NO: 306666 - DNA, 16 bp, C. familiaris
atggagcctgacaggg

SEQ ID NO: 306667 - DNA, 16 bp, C. familiaris
atggagcctgatgagg

SEQ ID NO: 306668 - DNA, 16 bp, C. familiaris
atggagcctgcctggg

SEQ ID NO: 306669 - DNA, 16 bp, C. familiaris
atggagcctgcttaag

SEQ ID NO: 306670 - DNA, 16 bp, C. familiaris
atggagcctggttctt

SEQ ID NO: 306671 - DNA, 16 bp, C. familiaris
atggagctcacattct

SEQ ID NO: 306672 - DNA, 16 bp, C. familiaris
atggagctggacatgg

SEQ ID NO: 306673 - DNA, 16 bp, C. familiaris
atggagctggatgcag

SEQ ID NO: 306674 - DNA, 16 bp, C. familiaris
atggaggttcttcaag

SEQ ID NO: 306675 - DNA, 16 bp, C. familiaris
atggagtccccacatc

SEQ ID NO: 306676 - DNA, 16 bp, C. familiaris
atggagtcctgcattg

SEQ ID NO: 306677 - DNA, 16 bp, C. familiaris
atggagtctgcttgtt

SEQ ID NO: 306678 - DNA, 16 bp, C. familiaris
atggagtctgtttctc

SEQ ID NO: 306679 - DNA, 16 bp, C. familiaris
atggagtggaagaatt

SEQ ID NO: 306680 - DNA, 16 bp, C. familiaris
atggataaagaagaca

SEQ ID NO: 306681 - DNA, 16 bp, C. familiaris
atggataaagcagatg

SEQ ID NO: 306682 - DNA, 16 bp, C. familiaris
atggatcttggagaat

SEQ ID NO: 306683 - DNA, 16 bp, C. familiaris
atggatgaaagatgta

SEQ ID NO: 306684 - DNA, 16 bp, C. familiaris
atggatgaaatagatg

SEQ ID NO: 306685 - DNA, 16 bp, C. familiaris
atggatgaacaaataa

SEQ ID NO: 306686 - DNA, 16 bp, C. familiaris
atggatgaaggggagt

SEQ ID NO: 306687 - DNA, 16 bp, C. familiaris
atggatggaactgggg

SEQ ID NO: 306688 - DNA, 16 bp, C. familiaris
atggatggaaggaagg

SEQ ID NO: 306689 - DNA, 16 bp, C. familiaris
atggatggacggatgg

SEQ ID NO: 306690 - DNA, 16 bp, C. familiaris
atggatggtgatgatg

SEQ ID NO: 306691 - DNA, 16 bp, C. familiaris
atggatggtggtaatg

SEQ ID NO: 306692 - DNA, 16 bp, C. familiaris
atggatttcacaaata

SEQ ID NO: 306693 - DNA, 16 bp, C. familiaris
atggatttctttcttt

SEQ ID NO: 306694 - DNA, 16 bp, C. familiaris
atggatttggaaagaa

SEQ ID NO: 306695 - DNA, 16 bp, C. familiaris
atggcaaaataatatt

SEQ ID NO: 306696 - DNA, 16 bp, C. familiaris
atggcaaagaaggaag

SEQ ID NO: 306697 - DNA, 16 bp, C. familiaris
atggcaaagaggaatt

SEQ ID NO: 306698 - DNA, 17 bp, C. familiaris
atggcaagtgatgtgga

SEQ ID NO: 306699 - DNA, 16 bp, C. familiaris
atggcagacacagaga

SEQ ID NO: 306700 - DNA, 16 bp, C. familiaris
atggcagaggcagagg

SEQ ID NO: 306701 - DNA, 16 bp, C. familiaris
atggcagcccaggtgg

SEQ ID NO: 306702 - DNA, 16 bp, C. familiaris
atggcagccccaggaa

SEQ ID NO: 306703 - DNA, 16 bp, C. familiaris
atggcagcccgggtgg

SEQ ID NO: 306704 - DNA, 16 bp, C. familiaris
atggcagccttagcaa

SEQ ID NO: 306705 - DNA, 16 bp, C. familiaris
atggccaagaagcaca

SEQ ID NO: 306706 - DNA, 16 bp, C. familiaris
atggccatcttctcct

SEQ ID NO: 306707 - DNA, 16 bp, C. familiaris
atggcctatgaccgct

SEQ ID NO: 306708 - DNA, 16 bp, C. familiaris
atggcctttattacat

SEQ ID NO: 306709 - DNA, 16 bp, C. familiaris
atggctaaaagaaaaa

SEQ ID NO: 306710 - DNA, 16 bp, C. familiaris
atggctaaaataagaa

SEQ ID NO: 306711 - DNA, 16 bp, C. familiaris
atggctgcaccagctt

SEQ ID NO: 306712 - DNA, 16 bp, C. familiaris
atggctgctatgaaca

SEQ ID NO: 306713 - DNA, 16 bp, C. familiaris
atggctgctgactgat

SEQ ID NO: 306714 - DNA, 16 bp, C. familiaris
atggctgctgtaacaa

SEQ ID NO: 306715 - DNA, 16 bp, C. familiaris
atggcttgtcttttca

SEQ ID NO: 306716 - DNA, 16 bp, C. familiaris
atggctttgaatggca

SEQ ID NO: 306717 - DNA, 16 bp, C. familiaris
atggcttttaaatttt

SEQ ID NO: 306718 - DNA, 16 bp, C. familiaris
atgggaaaaatatgta

SEQ ID NO: 306719 - DNA, 16 bp, C. familiaris
atgggaaaaatatttg

SEQ ID NO: 306720 - DNA, 16 bp, C. familiaris
atgggaaaacaaaaca

SEQ ID NO: 306721 - DNA, 16 bp, C. familiaris
atgggaaaactgaagc

SEQ ID NO: 306722 - DNA, 16 bp, C. familiaris
atgggaaaactgaggc

SEQ ID NO: 306723 - DNA, 16 bp, C. familiaris
atgggaaaattgaagt

SEQ ID NO: 306724 - DNA, 16 bp, C. familiaris
atgggaaacagagaga

SEQ ID NO: 306725 - DNA, 16 bp, C. familiaris
atgggaagaaatcaga

SEQ ID NO: 306726 - DNA, 16 bp, C. familiaris
atgggaagggaaacag

SEQ ID NO: 306727 - DNA, 16 bp, C. familiaris
atgggagacacacaca

SEQ ID NO: 306728 - DNA, 16 bp, C. familiaris
atgggatccaacagta

SEQ ID NO: 306729 - DNA, 16 bp, C. familiaris
atgggatgagcatggg

SEQ ID NO: 306730 - DNA, 16 bp, C. familiaris
atgggcaaaagaaatg

SEQ ID NO: 306731 - DNA, 16 bp, C. familiaris
atgggcacctggatgg

SEQ ID NO: 306732 - DNA, 16 bp, C. familiaris
atgggcagcccccgtg

SEQ ID NO: 306733 - DNA, 16 bp, C. familiaris
atggggaaattgaggc

SEQ ID NO: 306734 - DNA, 16 bp, C. familiaris
atggggaacctgatgc

SEQ ID NO: 306735 - DNA, 16 bp, C. familiaris
atggggacaggaggga

SEQ ID NO: 306736 - DNA, 16 bp, C. familiaris
atggggaccctgcttc

SEQ ID NO: 306737 - DNA, 16 bp, C. familiaris
atggggagaggggcag

SEQ ID NO: 306738 - DNA, 16 bp, C. familiaris
atggggagcagcaggc

SEQ ID NO: 306739 - DNA, 16 bp, C. familiaris
atggggagccccatgc

SEQ ID NO: 306740 - DNA, 16 bp, C. familiaris
atggggataatgataa

SEQ ID NO: 306741 - DNA, 16 bp, C. familiaris
atggggcacttgggtg

SEQ ID NO: 306742 - DNA, 16 bp, C. familiaris
atgggggaatccctgg

SEQ ID NO: 306743 - DNA, 16 bp, C. familiaris
atgggttgtgagattg

SEQ ID NO: 306744 - DNA, 16 bp, C. familiaris
atgggtttttaaaaat

SEQ ID NO: 306745 - DNA, 16 bp, C. familiaris
atggtaaaaacaaaca

SEQ ID NO: 306746 - DNA, 16 bp, C. familiaris
atggtaaaatatatat

SEQ ID NO: 306747 - DNA, 16 bp, C. familiaris
atggtaagattttttt

SEQ ID NO: 306748 - DNA, 16 bp, C. familiaris
atggtagccaccagcc

SEQ ID NO: 306749 - DNA, 16 bp, C. familiaris
atggtatatctttcca

SEQ ID NO: 306750 - DNA, 16 bp, C. familiaris
atggtatttgtcttat

SEQ ID NO: 306751 - DNA, 16 bp, C. familiaris
atggtcaactgatttt

SEQ ID NO: 306752 - DNA, 16 bp, C. familiaris
atggtctcatccattt

SEQ ID NO: 306753 - DNA, 16 bp, C. familiaris
atggtctctgccttca

SEQ ID NO: 306754 - DNA, 16 bp, C. familiaris
atggtctgtcaccctc

SEQ ID NO: 306755 - DNA, 16 bp, C. familiaris
atggtgcagccactgt

SEQ ID NO: 306756 - DNA, 16 bp, C. familiaris
atggtgcagctgctct

SEQ ID NO: 306757 - DNA, 16 bp, C. familiaris
atggtgctgggaaatt

SEQ ID NO: 306758 - DNA, 16 bp, C. familiaris
atggtggcagtggtgg

SEQ ID NO: 306759 - DNA, 16 bp, C. familiaris
atggtgggtgccaggg

SEQ ID NO: 306760 - DNA, 16 bp, C. familiaris
atggtggtcacctttg

SEQ ID NO: 306761 - DNA, 16 bp, C. familiaris
atggtgttgggaaaag

SEQ ID NO: 306762 - DNA, 16 bp, C. familiaris
atggttgtgaggatta

SEQ ID NO: 306763 - DNA, 16 bp, C. familiaris
atggttttctttgctg

SEQ ID NO: 306764 - DNA, 16 bp, C. familiaris
atggttttggaattaa

SEQ ID NO: 306765 - DNA, 16 bp, C. familiaris
atggttttgggtgcaa

SEQ ID NO: 306766 - DNA, 16 bp, C. familiaris
atgtaaaatatacaaa

SEQ ID NO: 306767 - DNA, 16 bp, C. familiaris
atgtaaacaatataaa

SEQ ID NO: 306768 - DNA, 16 bp, C. familiaris
atgtaaagaacttata

SEQ ID NO: 306769 - DNA, 16 bp, C. familiaris
atgtaaatatacatat

SEQ ID NO: 306770 - DNA, 16 bp, C. familiaris
atgtaaatggaccaaa

SEQ ID NO: 306771 - DNA, 16 bp, C. familiaris
atgtaaatgtaaatat

SEQ ID NO: 306772 - DNA, 16 bp, C. familiaris
atgtaaattgactaaa

SEQ ID NO: 306773 - DNA, 16 bp, C. familiaris
atgtaatctctatacc

SEQ ID NO: 306774 - DNA, 16 bp, C. familiaris
atgtacacttaaaaaa

SEQ ID NO: 306775 - DNA, 16 bp, C. familiaris
atgtacagagggaaga

SEQ ID NO: 306776 - DNA, 16 bp, C. familiaris
atgtacagcatgatga

SEQ ID NO: 306777 - DNA, 16 bp, C. familiaris
atgtactcctatgttt

SEQ ID NO: 306778 - DNA, 16 bp, C. familiaris
atgtacttcttcctca

SEQ ID NO: 306779 - DNA, 16 bp, C. familiaris
atgtactttctcttcc

SEQ ID NO: 306780 - DNA, 16 bp, C. familiaris
atgtagaaaacctgaa

SEQ ID NO: 306781 - DNA, 16 bp, C. familiaris
atgtagaatctaaaac

SEQ ID NO: 306782 - DNA, 16 bp, C. familiaris
atgtagaatttaagaa

SEQ ID NO: 306783 - DNA, 16 bp, C. familiaris
atgtagagagagagag

SEQ ID NO: 306784 - DNA, 16 bp, C. familiaris
atgtagatatatatgt

SEQ ID NO: 306785 - DNA, 16 bp, C. familiaris
atgtagatgaaatgga

SEQ ID NO: 306786 - DNA, 16 bp, C. familiaris
atgtagccactgtgga

SEQ ID NO: 306787 - DNA, 16 bp, C. familiaris
atgtatataaaaatgt

SEQ ID NO: 306788 - DNA, 16 bp, C. familiaris
atgtatatacacacat

SEQ ID NO: 306789 - DNA, 16 bp, C. familiaris
atgtatatgtatgtat

SEQ ID NO: 306790 - DNA, 16 bp, C. familiaris
atgtatattcatttat

SEQ ID NO: 306791 - DNA, 16 bp, C. familiaris
atgtatattgcaaact

SEQ ID NO: 306792 - DNA, 16 bp, C. familiaris
atgtatccatttcttt

SEQ ID NO: 306793 - DNA, 16 bp, C. familiaris
atgtatgaaaaaccca

SEQ ID NO: 306794 - DNA, 16 bp, C. familiaris
atgtatgcatttatat

SEQ ID NO: 306795 - DNA, 16 bp, C. familiaris
atgtatgtaaatatat

SEQ ID NO: 306796 - DNA, 16 bp, C. familiaris
atgtatgtaaattata

SEQ ID NO: 306797 - DNA, 16 bp, C. familiaris
atgtatgtatacatgt

SEQ ID NO: 306798 - DNA, 16 bp, C. familiaris
atgtatgtatgcatgt

SEQ ID NO: 306799 - DNA, 16 bp, C. familiaris
atgtatgtatgtatgt

SEQ ID NO: 306800 - DNA, 16 bp, C. familiaris
atgtatgtgtatatct

SEQ ID NO: 306801 - DNA, 16 bp, C. familiaris
atgtatgtgtatatgt

SEQ ID NO: 306802 - DNA, 16 bp, C. familiaris
atgtatgtgtatattt

SEQ ID NO: 306803 - DNA, 16 bp, C. familiaris
atgtatgtgtgtatat

SEQ ID NO: 306804 - DNA, 16 bp, C. familiaris
atgtattagaaaagaa

SEQ ID NO: 306805 - DNA, 16 bp, C. familiaris
atgtatttatttactt

SEQ ID NO: 306806 - DNA, 16 bp, C. familiaris
atgtatttgtggcctt

SEQ ID NO: 306807 - DNA, 16 bp, C. familiaris
atgtattttttccttc

SEQ ID NO: 306808 - DNA, 16 bp, C. familiaris
atgtatttttttccct

SEQ ID NO: 306809 - DNA, 16 bp, C. familiaris
atgtcaaatttaagaa

SEQ ID NO: 306810 - DNA, 16 bp, C. familiaris
atgtcagagctggaag

SEQ ID NO: 306811 - DNA, 16 bp, C. familiaris
atgtcagatttttttt

SEQ ID NO: 306812 - DNA, 16 bp, C. familiaris
atgtcaggcttcctgt

SEQ ID NO: 306813 - DNA, 16 bp, C. familiaris
atgtcatctatgaaga

SEQ ID NO: 306814 - DNA, 16 bp, C. familiaris
atgtcatctgtgaata

SEQ ID NO: 306815 - DNA, 16 bp, C. familiaris
atgtcatctttgaaga

SEQ ID NO: 306816 - DNA, 16 bp, C. familiaris
atgtcatttgcaaaat

SEQ ID NO: 306817 - DNA, 16 bp, C. familiaris
atgtcattttaaaaat

SEQ ID NO: 306818 - DNA, 16 bp, C. familiaris
atgtccattctcacca

SEQ ID NO: 306819 - DNA, 16 bp, C. familiaris
atgtctacaatggaat

SEQ ID NO: 306820 - DNA, 16 bp, C. familiaris
atgtctcccaaggcaa

SEQ ID NO: 306821 - DNA, 16 bp, C. familiaris
atgtctctgagtctct

SEQ ID NO: 306822 - DNA, 16 bp, C. familiaris
atgtctctgctgctct

SEQ ID NO: 306823 - DNA, 16 bp, C. familiaris
atgtctctgtctctgt

SEQ ID NO: 306824 - DNA, 16 bp, C. familiaris
atgtctggaaacattt

SEQ ID NO: 306825 - DNA, 16 bp, C. familiaris
atgtctgtctctgtgt

SEQ ID NO: 306826 - DNA, 16 bp, C. familiaris
atgtcttatttggaga

SEQ ID NO: 306827 - DNA, 16 bp, C. familiaris
atgtcttcatttattt

SEQ ID NO: 306828 - DNA, 16 bp, C. familiaris
atgtcttctttgagaa

SEQ ID NO: 306829 - DNA, 16 bp, C. familiaris
atgtcttctttggaaa

SEQ ID NO: 306830 - DNA, 16 bp, C. familiaris
atgtctttagagaaat

SEQ ID NO: 306831 - DNA, 16 bp, C. familiaris
atgtcttttgaaaata

SEQ ID NO: 306832 - DNA, 16 bp, C. familiaris
atgtgaaaattatttt

SEQ ID NO: 306833 - DNA, 16 bp, C. familiaris
atgtgaaatttcagaa

SEQ ID NO: 306834 - DNA, 16 bp, C. familiaris
atgtgaactttttttt

SEQ ID NO: 306835 - DNA, 16 bp, C. familiaris
atgtgaagaaattgga

SEQ ID NO: 306836 - DNA, 16 bp, C. familiaris
atgtgaagacacagag

SEQ ID NO: 306837 - DNA, 16 bp, C. familiaris
atgtgaagagaaagga

SEQ ID NO: 306838 - DNA, 16 bp, C. familiaris
atgtgaagattaaatg

SEQ ID NO: 306839 - DNA, 16 bp, C. familiaris
atgtgaatatacatat

SEQ ID NO: 306840 - DNA, 16 bp, C. familiaris
atgtgacacagacaca

SEQ ID NO: 306841 - DNA, 16 bp, C. familiaris
atgtgaccctgggcaa

SEQ ID NO: 306842 - DNA, 16 bp, C. familiaris
atgtgactcttgatct

SEQ ID NO: 306843 - DNA, 16 bp, C. familiaris
atgtgactgtgtttgg

SEQ ID NO: 306844 - DNA, 16 bp, C. familiaris
atgtgatgaaaatggc

SEQ ID NO: 306845 - DNA, 16 bp, C. familiaris
atgtgatgacagaagc

SEQ ID NO: 306846 - DNA, 16 bp, C. familiaris
atgtgatggtatttgg

SEQ ID NO: 306847 - DNA, 16 bp, C. familiaris
atgtgcaaatatatat

SEQ ID NO: 306848 - DNA, 16 bp, C. familiaris
atgtgcacttgaggag

SEQ ID NO: 306849 - DNA, 16 bp, C. familiaris
atgtgccaggctctgt

SEQ ID NO: 306850 - DNA, 16 bp, C. familiaris
atgtgctcttgagaag

SEQ ID NO: 306851 - DNA, 16 bp, C. familiaris
atgtgctttctctctc

SEQ ID NO: 306852 - DNA, 16 bp, C. familiaris
atgtggaaaaagagga

SEQ ID NO: 306853 - DNA, 16 bp, C. familiaris
atgtggaaacaaccta

SEQ ID NO: 306854 - DNA, 16 bp, C. familiaris
atgtggaatacaagaa

SEQ ID NO: 306855 - DNA, 16 bp, C. familiaris
atgtggaatatctttt

SEQ ID NO: 306856 - DNA, 16 bp, C. familiaris
atgtggaatctcaaaa

SEQ ID NO: 306857 - DNA, 16 bp, C. familiaris
atgtggaatttaagca

SEQ ID NO: 306858 - DNA, 16 bp, C. familiaris
atgtggagaaaaagga

SEQ ID NO: 306859 - DNA, 16 bp, C. familiaris
atgtggagaaaagggg

SEQ ID NO: 306860 - DNA, 16 bp, C. familiaris
atgtggagaaactgga

SEQ ID NO: 306861 - DNA, 16 bp, C. familiaris
atgtggagaaagaaga

SEQ ID NO: 306862 - DNA, 16 bp, C. familiaris
atgtggagaaatcaga

SEQ ID NO: 306863 - DNA, 16 bp, C. familiaris
atgtggagaaatcgga

SEQ ID NO: 306864 - DNA, 16 bp, C. familiaris
atgtggagaaatggga

SEQ ID NO: 306865 - DNA, 16 bp, C. familiaris
atgtggagaagctgga

SEQ ID NO: 306866 - DNA, 16 bp, C. familiaris
atgtggagaatttttt

SEQ ID NO: 306867 - DNA, 16 bp, C. familiaris
atgtggagagagagag

SEQ ID NO: 306868 - DNA, 16 bp, C. familiaris
atgtggagatgaaagg

SEQ ID NO: 306869 - DNA, 16 bp, C. familiaris
atgtggagcaactaga

SEQ ID NO: 306870 - DNA, 16 bp, C. familiaris
atgtggagctggatcc

SEQ ID NO: 306871 - DNA, 16 bp, C. familiaris
atgtggatatccagct

SEQ ID NO: 306872 - DNA, 16 bp, C. familiaris
atgtggattttcaact

SEQ ID NO: 306873 - DNA, 16 bp, C. familiaris
atgtggccctggactt

SEQ ID NO: 306874 - DNA, 16 bp, C. familiaris
atgtggcttgggcttc

SEQ ID NO: 306875 - DNA, 16 bp, C. familiaris
atgtgggacttggtct

SEQ ID NO: 306876 - DNA, 16 bp, C. familiaris
atgtgggagatgccaa

SEQ ID NO: 306877 - DNA, 16 bp, C. familiaris
atgtggggaaaaagga

SEQ ID NO: 306878 - DNA, 16 bp, C. familiaris
atgtggtacacacaca

SEQ ID NO: 306879 - DNA, 16 bp, C. familiaris
atgtggtgagcactgg

SEQ ID NO: 306880 - DNA, 16 bp, C. familiaris
atgtggtttcactcat

SEQ ID NO: 306881 - DNA, 16 bp, C. familiaris
atgtgtatatattata

SEQ ID NO: 306882 - DNA, 16 bp, C. familiaris
atgtgtatatattgtg

SEQ ID NO: 306883 - DNA, 16 bp, C. familiaris
atgtgtctgtgtatat

SEQ ID NO: 306884 - DNA, 16 bp, C. familiaris
atgtgtgtacatattt

SEQ ID NO: 306885 - DNA, 16 bp, C. familiaris
atgtgtgtgcactctc

SEQ ID NO: 306886 - DNA, 16 bp, C. familiaris
atgtgtgtgcgtgtgt

SEQ ID NO: 306887 - DNA, 16 bp, C. familiaris
atgtgtgtgctgtgtg

SEQ ID NO: 306888 - DNA, 16 bp, C. familiaris
atgtgtgtgtgcacgc

SEQ ID NO: 306889 - DNA, 16 bp, C. familiaris
atgtgtgtgtgtatat

SEQ ID NO: 306890 - DNA, 16 bp, C. familiaris
atgtgtgtgtgtttca

SEQ ID NO: 306891 - DNA, 16 bp, C. familiaris
atgtgttaaataaatg

SEQ ID NO: 306892 - DNA, 16 bp, C. familiaris
atgtgttttaaaaaaa

SEQ ID NO: 306893 - DNA, 16 bp, C. familiaris
atgtgttttctaaaaa

SEQ ID NO: 306894 - DNA, 16 bp, C. familiaris
atgtgtttttgtgcca

SEQ ID NO: 306895 - DNA, 16 bp, C. familiaris
atgttaaatatgttaa

SEQ ID NO: 306896 - DNA, 16 bp, C. familiaris
atgttaactaaaatta

SEQ ID NO: 306897 - DNA, 16 bp, C. familiaris
atgttaagtaaaagaa

SEQ ID NO: 306898 - DNA, 16 bp, C. familiaris
atgttacattttattt

SEQ ID NO: 306899 - DNA, 16 bp, C. familiaris
atgttactattattat

SEQ ID NO: 306900 - DNA, 16 bp, C. familiaris
atgttagagaggatgc

SEQ ID NO: 306901 - DNA, 16 bp, C. familiaris
atgttattttacattt

SEQ ID NO: 306902 - DNA, 16 bp, C. familiaris
atgttcaaccaactga

SEQ ID NO: 306903 - DNA, 16 bp, C. familiaris
atgttcacttaaaaaa

SEQ ID NO: 306904 - DNA, 16 bp, C. familiaris
atgttcatggcaacat

SEQ ID NO: 306905 - DNA, 16 bp, C. familiaris
atgttcatgtttttct

SEQ ID NO: 306906 - DNA, 16 bp, C. familiaris
atgttcattgcaatat

SEQ ID NO: 306907 - DNA, 16 bp, C. familiaris
atgttccctatgctgt

SEQ ID NO: 306908 - DNA, 16 bp, C. familiaris
atgttctgaaattaga

SEQ ID NO: 306909 - DNA, 16 bp, C. familiaris
atgttctgcttagaag

SEQ ID NO: 306910 - DNA, 16 bp, C. familiaris
atgttgaagagcagtg

SEQ ID NO: 306911 - DNA, 16 bp, C. familiaris
atgttgaagcaaatag

SEQ ID NO: 306912 - DNA, 16 bp, C. familiaris
atgttgaagctctaac

SEQ ID NO: 306913 - DNA, 16 bp, C. familiaris
atgttgaagtcttaac

SEQ ID NO: 306914 - DNA, 16 bp, C. familiaris
atgttgaatctaaaaa

SEQ ID NO: 306915 - DNA, 16 bp, C. familiaris
atgttgatttttttca

SEQ ID NO: 306916 - DNA, 16 bp, C. familiaris
atgttgccatttgcaa

SEQ ID NO: 306917 - DNA, 16 bp, C. familiaris
atgttgctgttcagtt

SEQ ID NO: 306918 - DNA, 16 bp, C. familiaris
atgttggaaaagaaaa

SEQ ID NO: 306919 - DNA, 16 bp, C. familiaris
atgttggcaaagtgaa

SEQ ID NO: 306920 - DNA, 16 bp, C. familiaris
atgttggcctcataga

SEQ ID NO: 306921 - DNA, 16 bp, C. familiaris
atgttgggaaaactga

SEQ ID NO: 306922 - DNA, 16 bp, C. familiaris
atgttgggctcctggt

SEQ ID NO: 306923 - DNA, 16 bp, C. familiaris
atgttgggtacagaga

SEQ ID NO: 306924 - DNA, 16 bp, C. familiaris
atgttgtatgattcca

SEQ ID NO: 306925 - DNA, 16 bp, C. familiaris
atgttgtatttaaaaa

SEQ ID NO: 306926 - DNA, 16 bp, C. familiaris
atgttgttggaaaaat

SEQ ID NO: 306927 - DNA, 16 bp, C. familiaris
atgtttaatgcagcat

SEQ ID NO: 306928 - DNA, 16 bp, C. familiaris
atgtttatacattttt

SEQ ID NO: 306929 - DNA, 16 bp, C. familiaris
atgtttatattcattt

SEQ ID NO: 306930 - DNA, 16 bp, C. familiaris
atgtttccaaagaaga

SEQ ID NO: 306931 - DNA, 16 bp, C. familiaris
atgtttccttttttaa

SEQ ID NO: 306932 - DNA, 16 bp, C. familiaris
atgtttcttgcagagc

SEQ ID NO: 306933 - DNA, 16 bp, C. familiaris
atgtttgtgtctgtgt

SEQ ID NO: 306934 - DNA, 16 bp, C. familiaris
atgtttgttgaacaaa

SEQ ID NO: 306935 - DNA, 16 bp, C. familiaris
atgttttaaaaataag

SEQ ID NO: 306936 - DNA, 16 bp, C. familiaris
atgttttaaagtatat

SEQ ID NO: 306937 - DNA, 16 bp, C. familiaris
atgttttagaaatatt

SEQ ID NO: 306938 - DNA, 16 bp, C. familiaris
atgttttatatactgt

SEQ ID NO: 306939 - DNA, 16 bp, C. familiaris
atgttttcataatttt

SEQ ID NO: 306940 - DNA, 16 bp, C. familiaris
atgttttcttctaaga

SEQ ID NO: 306941 - DNA, 16 bp, C. familiaris
atgttttctttgaaaa

SEQ ID NO: 306942 - DNA, 16 bp, C. familiaris
atgttttcttttatga

SEQ ID NO: 306943 - DNA, 16 bp, C. familiaris
atgtttttaaaaagat

SEQ ID NO: 306944 - DNA, 16 bp, C. familiaris
atgtttttaaaagaga

SEQ ID NO: 306945 - DNA, 16 bp, C. familiaris
atgtttttaaaattca

SEQ ID NO: 306946 - DNA, 16 bp, C. familiaris
atgtttttgaaaaaaa

SEQ ID NO: 306947 - DNA, 16 bp, C. familiaris
atgtttttgagattta

SEQ ID NO: 306948 - DNA, 16 bp, C. familiaris
atgttttttaaaactt

SEQ ID NO: 306949 - DNA, 16 bp, C. familiaris
atgttttttatctcaa

SEQ ID NO: 306950 - DNA, 16 bp, C. familiaris
attaaaaaatgagcca

SEQ ID NO: 306951 - DNA, 16 bp, C. familiaris
attaaaaacaagagag

SEQ ID NO: 306952 - DNA, 16 bp, C. familiaris
attaaaaacatgaaat

SEQ ID NO: 306953 - DNA, 16 bp, C. familiaris
attaaaaacttttgct

SEQ ID NO: 306954 - DNA, 16 bp, C. familiaris
attaaaaattcagttt

SEQ ID NO: 306955 - DNA, 16 bp, C. familiaris
attaaaaccacaatga

SEQ ID NO: 306956 - DNA, 16 bp, C. familiaris
attaaaaccatgatga

SEQ ID NO: 306957 - DNA, 16 bp, C. familiaris
attaaaacttgaaaaa

SEQ ID NO: 306958 - DNA, 16 bp, C. familiaris
attaaaagtaaatgga

SEQ ID NO: 306959 - DNA, 16 bp, C. familiaris
attaaaatgtatcaaa

SEQ ID NO: 306960 - DNA, 16 bp, C. familiaris
attaaaatgtcaaaat

SEQ ID NO: 306961 - DNA, 16 bp, C. familiaris
attaaaatttgagaag

SEQ ID NO: 306962 - DNA, 16 bp, C. familiaris
attaaacaaaataatg

SEQ ID NO: 306963 - DNA, 16 bp, C. familiaris
attaaactcaacacca

SEQ ID NO: 306964 - DNA, 16 bp, C. familiaris
attaaaggaaactgaa

SEQ ID NO: 306965 - DNA, 16 bp, C. familiaris
attaaaggcatttaaa

SEQ ID NO: 306966 - DNA, 16 bp, C. familiaris
attaaataaggtaatg

SEQ ID NO: 306967 - DNA, 16 bp, C. familiaris
attaaatgagatggaa

SEQ ID NO: 306968 - DNA, 16 bp, C. familiaris
attaaatttggaaaat

SEQ ID NO: 306969 - DNA, 16 bp, C. familiaris
attaacaaaatgaagg

SEQ ID NO: 306970 - DNA, 16 bp, C. familiaris
attaacaagatagata

SEQ ID NO: 306971 - DNA, 16 bp, C. familiaris
attaacaggagaaaag

SEQ ID NO: 306972 - DNA, 16 bp, C. familiaris
attaactatattccct

SEQ ID NO: 306973 - DNA, 16 bp, C. familiaris
attaactgaaaatgga

SEQ ID NO: 306974 - DNA, 16 bp, C. familiaris
attaatcatcagagaa

SEQ ID NO: 306975 - DNA, 16 bp, C. familiaris
attaatcattagagaa

SEQ ID NO: 306976 - DNA, 16 bp, C. familiaris
attaatgaaagaaact

SEQ ID NO: 306977 - DNA, 16 bp, C. familiaris
attaatgaaagacaga

SEQ ID NO: 306978 - DNA, 16 bp, C. familiaris
attaatgatgttgaat

SEQ ID NO: 306979 - DNA, 16 bp, C. familiaris
attaatggaaaatatt

SEQ ID NO: 306980 - DNA, 16 bp, C. familiaris
attaattaatgatagt

SEQ ID NO: 306981 - DNA, 16 bp, C. familiaris
attaattctcccaatc

SEQ ID NO: 306982 - DNA, 16 bp, C. familiaris
attaatttcagatgta

SEQ ID NO: 306983 - DNA, 16 bp, C. familiaris
attaattttgtgaaaa

SEQ ID NO: 306984 - DNA, 16 bp, C. familiaris
attacaaagcagtagt

SEQ ID NO: 306985 - DNA, 16 bp, C. familiaris
attacaaataatactg

SEQ ID NO: 306986 - DNA, 16 bp, C. familiaris
attacaaatgaagctg

SEQ ID NO: 306987 - DNA, 16 bp, C. familiaris
attacagaatttggat

SEQ ID NO: 306988 - DNA, 16 bp, C. familiaris
attacagtattatttt

SEQ ID NO: 306989 - DNA, 16 bp, C. familiaris
attacagtatttttaa

SEQ ID NO: 306990 - DNA, 16 bp, C. familiaris
attacatccagtcagt

SEQ ID NO: 306991 - DNA, 16 bp, C. familiaris
attacatttgaaaata

SEQ ID NO: 306992 - DNA, 16 bp, C. familiaris
attaccaaaaagacaa

SEQ ID NO: 306993 - DNA, 16 bp, C. familiaris
attacctctgtaaaga

SEQ ID NO: 306994 - DNA, 16 bp, C. familiaris
attactagtaataaaa

SEQ ID NO: 306995 - DNA, 16 bp, C. familiaris
attactagtaatcagt

SEQ ID NO: 306996 - DNA, 16 bp, C. familiaris
attactcagcccttag

SEQ ID NO: 306997 - DNA, 16 bp, C. familiaris
attactgaactgtaca

SEQ ID NO: 306998 - DNA, 16 bp, C. familiaris
attactgatttaattt

SEQ ID NO: 306999 - DNA, 16 bp, C. familiaris
attactgtttttgtat

SEQ ID NO: 307000 - DNA, 16 bp, C. familiaris
attacttggaaaaaaa

SEQ ID NO: 307001 - DNA, 16 bp, C. familiaris
attactttaaatgaaa

SEQ ID NO: 307002 - DNA, 16 bp, C. familiaris
attactttgaactttt

SEQ ID NO: 307003 - DNA, 16 bp, C. familiaris
attagaaaatgacaaa

SEQ ID NO: 307004 - DNA, 16 bp, C. familiaris
attagaacaaattatt

SEQ ID NO: 307005 - DNA, 16 bp, C. familiaris
attagagaacccagaa

SEQ ID NO: 307006 - DNA, 16 bp, C. familiaris
attagagaagaattca

SEQ ID NO: 307007 - DNA, 16 bp, C. familiaris
attagagagagagcaa

SEQ ID NO: 307008 - DNA, 16 bp, C. familiaris
attagagagggtgaca

SEQ ID NO: 307009 - DNA, 17 bp, C. familiaris
attagccagccttacta

SEQ ID NO: 307010 - DNA, 16 bp, C. familiaris
attagccatagcaaca

SEQ ID NO: 307011 - DNA, 16 bp, C. familiaris
attaggacatggatat

SEQ ID NO: 307012 - DNA, 16 bp, C. familiaris
attaggactttttttt

SEQ ID NO: 307013 - DNA, 16 bp, C. familiaris
attagtcatcaaggaa

SEQ ID NO: 307014 - DNA, 16 bp, C. familiaris
attagtgaaaatatca

SEQ ID NO: 307015 - DNA, 16 bp, C. familiaris
attagtgatgctgaac

SEQ ID NO: 307016 - DNA, 16 bp, C. familiaris
attagtgttcaattta

SEQ ID NO: 307017 - DNA, 16 bp, C. familiaris
attagtttcagattta

SEQ ID NO: 307018 - DNA, 16 bp, C. familiaris
attatacaatatttgt

SEQ ID NO: 307019 - DNA, 16 bp, C. familiaris
attatagagaacaaat

SEQ ID NO: 307020 - DNA, 16 bp, C. familiaris
attatatacctgaaat

SEQ ID NO: 307021 - DNA, 16 bp, C. familiaris
attatatgttctcact

SEQ ID NO: 307022 - DNA, 16 bp, C. familiaris
attatcaaatatgtaa

SEQ ID NO: 307023 - DNA, 16 bp, C. familiaris
attatcagaaaaaaat

SEQ ID NO: 307024 - DNA, 16 bp, C. familiaris
attatctggaaaaaaa

SEQ ID NO: 307025 - DNA, 16 bp, C. familiaris
attatgaaaatatcaa

SEQ ID NO: 307026 - DNA, 16 bp, C. familiaris
attatgacctgggcca

SEQ ID NO: 307027 - DNA, 16 bp, C. familiaris
attatgatgatgatga

SEQ ID NO: 307028 - DNA, 16 bp, C. familiaris
attatgcatttttaaa

SEQ ID NO: 307029 - DNA, 16 bp, C. familiaris
attatgctacatgaaa

SEQ ID NO: 307030 - DNA, 16 bp, C. familiaris
attatgtttttaaaga

SEQ ID NO: 307031 - DNA, 16 bp, C. familiaris
attattatgtcttctt

SEQ ID NO: 307032 - DNA, 16 bp, C. familiaris
attattattatcacat

SEQ ID NO: 307033 - DNA, 16 bp, C. familiaris
attattcaaactagcc

SEQ ID NO: 307034 - DNA, 20 bp, C. familiaris
attattcaccatgaccaagt

SEQ ID NO: 307035 - DNA, 16 bp, C. familiaris
attattcagcatgacc

SEQ ID NO: 307036 - DNA, 16 bp, C. familiaris
attattgcaaatggca

SEQ ID NO: 307037 - DNA, 16 bp, C. familiaris
attattgtcctcattt

SEQ ID NO: 307038 - DNA, 16 bp, C. familiaris
attattgttattatca

SEQ ID NO: 307039 - DNA, 16 bp, C. familiaris
attatttatattccac

SEQ ID NO: 307040 - DNA, 16 bp, C. familiaris
attatttattgaagag

SEQ ID NO: 307041 - DNA, 16 bp, C. familiaris
attatttcaaaatgaa

SEQ ID NO: 307042 - DNA, 16 bp, C. familiaris
attatttcaaagaacc

SEQ ID NO: 307043 - DNA, 16 bp, C. familiaris
attatttcaaatacat

SEQ ID NO: 307044 - DNA, 16 bp, C. familiaris
attatttcttaaatgt

SEQ ID NO: 307045 - DNA, 16 bp, C. familiaris
attatttgaaaatcaa

SEQ ID NO: 307046 - DNA, 16 bp, C. familiaris
attatttgaccataaa

SEQ ID NO: 307047 - DNA, 16 bp, C. familiaris
attattttatattctg

SEQ ID NO: 307048 - DNA, 16 bp, C. familiaris
attattttcaaagtat

SEQ ID NO: 307049 - DNA, 16 bp, C. familiaris
attattttgaacaaat

SEQ ID NO: 307050 - DNA, 16 bp, C. familiaris
attattttgaagtaaa

SEQ ID NO: 307051 - DNA, 16 bp, C. familiaris
attattttgcctacca

SEQ ID NO: 307052 - DNA, 16 bp, C. familiaris
attatttttagtttca

SEQ ID NO: 307053 - DNA, 16 bp, C. familiaris
attatttttattgctg

SEQ ID NO: 307054 - DNA, 16 bp, C. familiaris
attatttttattggag

SEQ ID NO: 307055 - DNA, 16 bp, C. familiaris
attatttttgtaatct

SEQ ID NO: 307056 - DNA, 16 bp, C. familiaris
attcaaaatatatgaa

SEQ ID NO: 307057 - DNA, 16 bp, C. familiaris
attcaaacccagattt

SEQ ID NO: 307058 - DNA, 16 bp, C. familiaris
attcaaacttaagtga

SEQ ID NO: 307059 - DNA, 16 bp, C. familiaris
attcaaagaagaatta

SEQ ID NO: 307060 - DNA, 16 bp, C. familiaris
attcaaatatttactg

SEQ ID NO: 307061 - DNA, 16 bp, C. familiaris
attcaaatgaaaattt

SEQ ID NO: 307062 - DNA, 16 bp, C. familiaris
attcaaatgtttaaaa

SEQ ID NO: 307063 - DNA, 16 bp, C. familiaris
attcaaatgttttaaa

SEQ ID NO: 307064 - DNA, 16 bp, C. familiaris
attcaacaaatgtttg

SEQ ID NO: 307065 - DNA, 16 bp, C. familiaris
attcaacacccaagaa

SEQ ID NO: 307066 - DNA, 16 bp, C. familiaris
attcaacacttccatt

SEQ ID NO: 307067 - DNA, 16 bp, C. familiaris
attcaagaaataaaac

SEQ ID NO: 307068 - DNA, 16 bp, C. familiaris
attcaagattttatta

SEQ ID NO: 307069 - DNA, 16 bp, C. familiaris
attcaaggggtgcctg

SEQ ID NO: 307070 - DNA, 16 bp, C. familiaris
attcaagttgtgattt

SEQ ID NO: 307071 - DNA, 16 bp, C. familiaris
attcaatgaatgaatg

SEQ ID NO: 307072 - DNA, 16 bp, C. familiaris
attcaatttgtcaaca

SEQ ID NO: 307073 - DNA, 16 bp, C. familiaris
attcacactgctgtgc

SEQ ID NO: 307074 - DNA, 16 bp, C. familiaris
attcaccatggccaag

SEQ ID NO: 307075 - DNA, 16 bp, C. familiaris
attcacccaaagaaaa

SEQ ID NO: 307076 - DNA, 16 bp, C. familiaris
attcacttttaaaaat

SEQ ID NO: 307077 - DNA, 16 bp, C. familiaris
attcagaaaacattta

SEQ ID NO: 307078 - DNA, 16 bp, C. familiaris
attcagaaataatttt

SEQ ID NO: 307079 - DNA, 16 bp, C. familiaris
attcagaagaaagaaa

SEQ ID NO: 307080 - DNA, 16 bp, C. familiaris
attcagaagcacaaat

SEQ ID NO: 307081 - DNA, 16 bp, C. familiaris
attcagaattgaagaa

SEQ ID NO: 307082 - DNA, 16 bp, C. familiaris
attcagagaaagaaaa

SEQ ID NO: 307083 - DNA, 16 bp, C. familiaris
attcagagaaggaaaa

SEQ ID NO: 307084 - DNA, 16 bp, C. familiaris
attcagatccaggaca

SEQ ID NO: 307085 - DNA, 16 bp, C. familiaris
attcagatttttaaaa

SEQ ID NO: 307086 - DNA, 16 bp, C. familiaris
attcagcaaataaaaa

SEQ ID NO: 307087 - DNA, 16 bp, C. familiaris
attcagcaaatattca

SEQ ID NO: 307088 - DNA, 16 bp, C. familiaris
attcagcatttaaaaa

SEQ ID NO: 307089 - DNA, 16 bp, C. familiaris
attcagctattagaaa

SEQ ID NO: 307090 - DNA, 16 bp, C. familiaris
attcaggaccctgaga

SEQ ID NO: 307091 - DNA, 16 bp, C. familiaris
attcaggaggcacaga

SEQ ID NO: 307092 - DNA, 16 bp, C. familiaris
attcaggtcctctgcc

SEQ ID NO: 307093 - DNA, 16 bp, C. familiaris
attcagtaaagtcaca

SEQ ID NO: 307094 - DNA, 16 bp, C. familiaris
attcagttcaaaatac

SEQ ID NO: 307095 - DNA, 16 bp, C. familiaris
attcagtttttcctcc

SEQ ID NO: 307096 - DNA, 16 bp, C. familiaris
attcataaagaaagaa

SEQ ID NO: 307097 - DNA, 16 bp, C. familiaris
attcataagagaggca

SEQ ID NO: 307098 - DNA, 16 bp, C. familiaris
attcataatagagaga

SEQ ID NO: 307099 - DNA, 17 bp, C. familiaris
attcatagacacagaga

SEQ ID NO: 307100 - DNA, 16 bp, C. familiaris
attcataggttgaaat

SEQ ID NO: 307101 - DNA, 16 bp, C. familiaris
attcatattataggag

SEQ ID NO: 307102 - DNA, 16 bp, C. familiaris
attcatcaaatatttt

SEQ ID NO: 307103 - DNA, 16 bp, C. familiaris
attcatcattttaaat

SEQ ID NO: 307104 - DNA, 16 bp, C. familiaris
attcatccatattttt

SEQ ID NO: 307105 - DNA, 16 bp, C. familiaris
attcatcctttaaaaa

SEQ ID NO: 307106 - DNA, 16 bp, C. familiaris
attcatctatttctcc

SEQ ID NO: 307107 - DNA, 16 bp, C. familiaris
attcatgaaaggaaga

SEQ ID NO: 307108 - DNA, 16 bp, C. familiaris
attcatgagaaaaaca

SEQ ID NO: 307109 - DNA, 16 bp, C. familiaris
attcatgagagacaca

SEQ ID NO: 307110 - DNA, 16 bp, C. familiaris
attcatgagagagaca

SEQ ID NO: 307111 - DNA, 16 bp, C. familiaris
attcatgagagatcca

SEQ ID NO: 307112 - DNA, 16 bp, C. familiaris
attcatgagagatgca

SEQ ID NO: 307113 - DNA, 16 bp, C. familiaris
attcatgagagggaca

SEQ ID NO: 307114 - DNA, 16 bp, C. familiaris
attcattaaatatcta

SEQ ID NO: 307115 - DNA, 16 bp, C. familiaris
attcattcaacaaaat

SEQ ID NO: 307116 - DNA, 16 bp, C. familiaris
attcattcaggagaga

SEQ ID NO: 307117 - DNA, 16 bp, C. familiaris
attcattcatccaccc

SEQ ID NO: 307118 - DNA, 16 bp, C. familiaris
attcattcattcaaaa

SEQ ID NO: 307119 - DNA, 16 bp, C. familiaris
attcattcattttaag

SEQ ID NO: 307120 - DNA, 16 bp, C. familiaris
attcattctttgcagc

SEQ ID NO: 307121 - DNA, 16 bp, C. familiaris
attcatttatttgaca

SEQ ID NO: 307122 - DNA, 16 bp, C. familiaris
attcatttgacagaga

SEQ ID NO: 307123 - DNA, 16 bp, C. familiaris
attcatttgagagagg

SEQ ID NO: 307124 - DNA, 16 bp, C. familiaris
attccaaaaaataaga

SEQ ID NO: 307125 - DNA, 16 bp, C. familiaris
attccaaaatattttc

SEQ ID NO: 307126 - DNA, 16 bp, C. familiaris
attccaaaggttttga

SEQ ID NO: 307127 - DNA, 16 bp, C. familiaris
attccaaagtttatat

SEQ ID NO: 307128 - DNA, 16 bp, C. familiaris
attccaagaaagaaaa

SEQ ID NO: 307129 - DNA, 16 bp, C. familiaris
attccaaggataaaga

SEQ ID NO: 307130 - DNA, 16 bp, C. familiaris
attccaccaaatattt

SEQ ID NO: 307131 - DNA, 16 bp, C. familiaris
attccacttctggaaa

SEQ ID NO: 307132 - DNA, 16 bp, C. familiaris
attccagaagaagaga

SEQ ID NO: 307133 - DNA, 16 bp, C. familiaris
attccagaagaggctg

SEQ ID NO: 307134 - DNA, 16 bp, C. familiaris
attccagacttcaaac

SEQ ID NO: 307135 - DNA, 16 bp, C. familiaris
attccagagatgcaag

SEQ ID NO: 307136 - DNA, 16 bp, C. familiaris
attccaggaccccagg

SEQ ID NO: 307137 - DNA, 16 bp, C. familiaris
attccagggtgctggg

SEQ ID NO: 307138 - DNA, 16 bp, C. familiaris
attccattgtacagat

SEQ ID NO: 307139 - DNA, 16 bp, C. familiaris
attccattgtatccat

SEQ ID NO: 307140 - DNA, 16 bp, C. familiaris
attcccagaacctgtg

SEQ ID NO: 307141 - DNA, 16 bp, C. familiaris
attcccatttacaatt

SEQ ID NO: 307142 - DNA, 16 bp, C. familiaris
attccccagtggattc

SEQ ID NO: 307143 - DNA, 16 bp, C. familiaris
attcccccccaaaaaa

SEQ ID NO: 307144 - DNA, 16 bp, C. familiaris
attccctctatcccta

SEQ ID NO: 307145 - DNA, 16 bp, C. familiaris
attccctgctgagtag

SEQ ID NO: 307146 - DNA, 16 bp, C. familiaris
attcctagaaaaatat

SEQ ID NO: 307147 - DNA, 16 bp, C. familiaris
attcctccccataaaa

SEQ ID NO: 307148 - DNA, 16 bp, C. familiaris
attccttcattccttc

SEQ ID NO: 307149 - DNA, 16 bp, C. familiaris
attcctttggctattt

SEQ ID NO: 307150 - DNA, 16 bp, C. familiaris
attccttttgatgcta

SEQ ID NO: 307151 - DNA, 16 bp, C. familiaris
attctactaaaactgt

SEQ ID NO: 307152 - DNA, 16 bp, C. familiaris
attctactctctgctt

SEQ ID NO: 307153 - DNA, 16 bp, C. familiaris
attctagaaaaggcaa

SEQ ID NO: 307154 - DNA, 16 bp, C. familiaris
attctagggcacctgg

SEQ ID NO: 307155 - DNA, 16 bp, C. familiaris
attctataaaacattt

SEQ ID NO: 307156 - DNA, 16 bp, C. familiaris
attctatgtatttatt

SEQ ID NO: 307157 - DNA, 16 bp, C. familiaris
attctcaacaaaatat

SEQ ID NO: 307158 - DNA, 16 bp, C. familiaris
attctcatcagcaatg

SEQ ID NO: 307159 - DNA, 16 bp, C. familiaris
attctccagaaaaaca

SEQ ID NO: 307160 - DNA, 16 bp, C. familiaris
attctccagagtggct

SEQ ID NO: 307161 - DNA, 16 bp, C. familiaris
attctccttcttggtg

SEQ ID NO: 307162 - DNA, 16 bp, C. familiaris
attctcttctggcctg

SEQ ID NO: 307163 - DNA, 16 bp, C. familiaris
attctctttggagaaa

SEQ ID NO: 307164 - DNA, 16 bp, C. familiaris
attctgaaaaagaaaa

SEQ ID NO: 307165 - DNA, 16 bp, C. familiaris
attctgaatgagagtc

SEQ ID NO: 307166 - DNA, 16 bp, C. familiaris
attctgactggtgtga

SEQ ID NO: 307167 - DNA, 16 bp, C. familiaris
attctgaggttctggg

SEQ ID NO: 307168 - DNA, 16 bp, C. familiaris
attctgatggattctt

SEQ ID NO: 307169 - DNA, 16 bp, C. familiaris
attctgcagccatgaa

SEQ ID NO: 307170 - DNA, 16 bp, C. familiaris
attctgcttctctctc

SEQ ID NO: 307171 - DNA, 16 bp, C. familiaris
attctgctttgcagcc

SEQ ID NO: 307172 - DNA, 16 bp, C. familiaris
attctggaaagggcaa

SEQ ID NO: 307173 - DNA, 16 bp, C. familiaris
attctggagaaagttt

SEQ ID NO: 307174 - DNA, 16 bp, C. familiaris
attctggagacccaga

SEQ ID NO: 307175 - DNA, 16 bp, C. familiaris
attctggatcaggcat

SEQ ID NO: 307176 - DNA, 16 bp, C. familiaris
attctggcctcataga

SEQ ID NO: 307177 - DNA, 16 bp, C. familiaris
attctgggaaacaaag

SEQ ID NO: 307178 - DNA, 16 bp, C. familiaris
attctgggatctggga

SEQ ID NO: 307179 - DNA, 16 bp, C. familiaris
attctgtatttcattt

SEQ ID NO: 307180 - DNA, 16 bp, C. familiaris
attctgtttttcaaaa

SEQ ID NO: 307181 - DNA, 16 bp, C. familiaris
attcttaatggggaag

SEQ ID NO: 307182 - DNA, 16 bp, C. familiaris
attcttaccagcagtg

SEQ ID NO: 307183 - DNA, 16 bp, C. familiaris
attcttcatttaaaaa

SEQ ID NO: 307184 - DNA, 16 bp, C. familiaris
attcttccctgctttg

SEQ ID NO: 307185 - DNA, 16 bp, C. familiaris
attcttcctttttgac

SEQ ID NO: 307186 - DNA, 16 bp, C. familiaris
attcttgatctcagag

SEQ ID NO: 307187 - DNA, 16 bp, C. familiaris
attcttgatttctgtt

SEQ ID NO: 307188 - DNA, 16 bp, C. familiaris
attcttgattttgatt

SEQ ID NO: 307189 - DNA, 16 bp, C. familiaris
attcttggctcccttg

SEQ ID NO: 307190 - DNA, 16 bp, C. familiaris
attcttgtcaagtgca

SEQ ID NO: 307191 - DNA, 16 bp, C. familiaris
attcttgttcagatat

SEQ ID NO: 307192 - DNA, 16 bp, C. familiaris
attctttagaaaataa

SEQ ID NO: 307193 - DNA, 16 bp, C. familiaris
attctttagaattttt

SEQ ID NO: 307194 - DNA, 16 bp, C. familiaris
attctttatatttctg

SEQ ID NO: 307195 - DNA, 16 bp, C. familiaris
attctttcaaaaacca

SEQ ID NO: 307196 - DNA, 16 bp, C. familiaris
attctttcaaagaaac

SEQ ID NO: 307197 - DNA, 16 bp, C. familiaris
attctttcaccattaa

SEQ ID NO: 307198 - DNA, 16 bp, C. familiaris
attctttgaaaataaa

SEQ ID NO: 307199 - DNA, 16 bp, C. familiaris
attcttttcaaaatat

SEQ ID NO: 307200 - DNA, 16 bp, C. familiaris
attgaaaaagaaaacc

SEQ ID NO: 307201 - DNA, 16 bp, C. familiaris
attgaaaaatcatttt

SEQ ID NO: 307202 - DNA, 16 bp, C. familiaris
attgaaaacaggaaaa

SEQ ID NO: 307203 - DNA, 16 bp, C. familiaris
attgaaaactacatct

SEQ ID NO: 307204 - DNA, 16 bp, C. familiaris
attgaaaatgagggga

SEQ ID NO: 307205 - DNA, 16 bp, C. familiaris
attgaaacaggaagaa

SEQ ID NO: 307206 - DNA, 16 bp, C. familiaris
attgaaagatttaata

SEQ ID NO: 307207 - DNA, 16 bp, C. familiaris
attgaaatcatacaga

SEQ ID NO: 307208 - DNA, 16 bp, C. familiaris
attgaaatgaatgaaa

SEQ ID NO: 307209 - DNA, 16 bp, C. familiaris
attgaactgctgggga

SEQ ID NO: 307210 - DNA, 16 bp, C. familiaris
attgaagaagaaaacc

SEQ ID NO: 307211 - DNA, 16 bp, C. familiaris
attgaagaagaacaaa

SEQ ID NO: 307212 - DNA, 16 bp, C. familiaris
attgaagatgatatta

SEQ ID NO: 307213 - DNA, 16 bp, C. familiaris
attgaaggacattcta

SEQ ID NO: 307214 - DNA, 16 bp, C. familiaris
attgaagtagagttga

SEQ ID NO: 307215 - DNA, 16 bp, C. familiaris
attgaagtgaaattca

SEQ ID NO: 307216 - DNA, 16 bp, C. familiaris
attgaatcagaatctg

SEQ ID NO: 307217 - DNA, 16 bp, C. familiaris
attgaatcctgcattg

SEQ ID NO: 307218 - DNA, 16 bp, C. familiaris
attgaattacatttta

SEQ ID NO: 307219 - DNA, 16 bp, C. familiaris
attgaattcttcagct

SEQ ID NO: 307220 - DNA, 16 bp, C. familiaris
attgaatttaaataac

SEQ ID NO: 307221 - DNA, 16 bp, C. familiaris
attgacaatgatattt

SEQ ID NO: 307222 - DNA, 16 bp, C. familiaris
attgacatggatggaa

SEQ ID NO: 307223 - DNA, 16 bp, C. familiaris
attgacctttttatca

SEQ ID NO: 307224 - DNA, 16 bp, C. familiaris
attgactatatatata

SEQ ID NO: 307225 - DNA, 16 bp, C. familiaris
attgactcagccaccc

SEQ ID NO: 307226 - DNA, 16 bp, C. familiaris
attgactcttggtttc

SEQ ID NO: 307227 - DNA, 16 bp, C. familiaris
attgactttttaaaaa

SEQ ID NO: 307228 - DNA, 16 bp, C. familiaris
attgagaatgatattg

SEQ ID NO: 307229 - DNA, 16 bp, C. familiaris
attgagcatcttctaa

SEQ ID NO: 307230 - DNA, 16 bp, C. familiaris
attgagcatctttcca

SEQ ID NO: 307231 - DNA, 16 bp, C. familiaris
attgagcccatgttgg

SEQ ID NO: 307232 - DNA, 16 bp, C. familiaris
attgaggaagacaaag

SEQ ID NO: 307233 - DNA, 16 bp, C. familiaris
attgagtatgatgtca

SEQ ID NO: 307234 - DNA, 16 bp, C. familiaris
attgagtctgtagatt

SEQ ID NO: 307235 - DNA, 16 bp, C. familiaris
attgagtgccacatca

SEQ ID NO: 307236 - DNA, 16 bp, C. familiaris
attgagtgcctgctgt

SEQ ID NO: 307237 - DNA, 16 bp, C. familiaris
attgagttccacgtca

SEQ ID NO: 307238 - DNA, 17 bp, C. familiaris
attgatatatttggcag

SEQ ID NO: 307239 - DNA, 16 bp, C. familiaris
attgatattgttaaaa

SEQ ID NO: 307240 - DNA, 16 bp, C. familiaris
attgatcatatcaaca

SEQ ID NO: 307241 - DNA, 16 bp, C. familiaris
attgatgatagacata

SEQ ID NO: 307242 - DNA, 16 bp, C. familiaris
attgatggacagttgg

SEQ ID NO: 307243 - DNA, 16 bp, C. familiaris
attgattctttcttct

SEQ ID NO: 307244 - DNA, 16 bp, C. familiaris
attgattgatttatct

SEQ ID NO: 307245 - DNA, 16 bp, C. familiaris
attgattttaaagaaa

SEQ ID NO: 307246 - DNA, 16 bp, C. familiaris
attgattttagatctt

SEQ ID NO: 307247 - DNA, 16 bp, C. familiaris
attgattttcttatgt

SEQ ID NO: 307248 - DNA, 16 bp, C. familiaris
attgcaaatagtaaga

SEQ ID NO: 307249 - DNA, 16 bp, C. familiaris
attgcacccaaaacca

SEQ ID NO: 307250 - DNA, 16 bp, C. familiaris
attgcaccccaaagca

SEQ ID NO: 307251 - DNA, 16 bp, C. familiaris
attgcagctataaaca

SEQ ID NO: 307252 - DNA, 16 bp, C. familiaris
attgcattattttatt

SEQ ID NO: 307253 - DNA, 16 bp, C. familiaris
attgcattttaatatt

SEQ ID NO: 307254 - DNA, 16 bp, C. familiaris
attgccaaaattaatt

SEQ ID NO: 307255 - DNA, 16 bp, C. familiaris
attgcctgtgcttttg

SEQ ID NO: 307256 - DNA, 16 bp, C. familiaris
attgctatatacttct

SEQ ID NO: 307257 - DNA, 16 bp, C. familiaris
attgctattattatta

SEQ ID NO: 307258 - DNA, 16 bp, C. familiaris
attgctgaataatatc

SEQ ID NO: 307259 - DNA, 16 bp, C. familiaris
attgctgaatactatt

SEQ ID NO: 307260 - DNA, 16 bp, C. familiaris
attgctgccatgaaca

SEQ ID NO: 307261 - DNA, 16 bp, C. familiaris
attgctggattatatg

SEQ ID NO: 307262 - DNA, 16 bp, C. familiaris
attgctggggcacctg

SEQ ID NO: 307263 - DNA, 16 bp, C. familiaris
attgcttaaaaaaaaa

SEQ ID NO: 307264 - DNA, 16 bp, C. familiaris
attgcttattattatt

SEQ ID NO: 307265 - DNA, 16 bp, C. familiaris
attgcttttgctgcat

SEQ ID NO: 307266 - DNA, 16 bp, C. familiaris
attggaaaaacctcaa

SEQ ID NO: 307267 - DNA, 16 bp, C. familiaris
attggaagaaaatatt

SEQ ID NO: 307268 - DNA, 16 bp, C. familiaris
attggaatattactca

SEQ ID NO: 307269 - DNA, 16 bp, C. familiaris
attggacagtgcagct

SEQ ID NO: 307270 - DNA, 16 bp, C. familiaris
attggagaaagagaga

SEQ ID NO: 307271 - DNA, 16 bp, C. familiaris
attggagcagaaatca

SEQ ID NO: 307272 - DNA, 16 bp, C. familiaris
attggagttccagaag

SEQ ID NO: 307273 - DNA, 16 bp, C. familiaris
attggatattcacatg

SEQ ID NO: 307274 - DNA, 16 bp, C. familiaris
attggcaaagaagatg

SEQ ID NO: 307275 - DNA, 16 bp, C. familiaris
attgggaaaaactcaa

SEQ ID NO: 307276 - DNA, 16 bp, C. familiaris
attgggaaaaggagag

SEQ ID NO: 307277 - DNA, 16 bp, C. familiaris
attgggaagtgtgagt

SEQ ID NO: 307278 - DNA, 16 bp, C. familiaris
attgggatgcaggtgt

SEQ ID NO: 307279 - DNA, 16 bp, C. familiaris
attggtctctgccccc

SEQ ID NO: 307280 - DNA, 16 bp, C. familiaris
attggtgcagctgcta

SEQ ID NO: 307281 - DNA, 18 bp, C. familiaris
attggtgttccatttgcc

SEQ ID NO: 307282 - DNA, 16 bp, C. familiaris
attgtaaatggcattg

SEQ ID NO: 307283 - DNA, 16 bp, C. familiaris
attgtatatagagacc

SEQ ID NO: 307284 - DNA, 16 bp, C. familiaris
attgtatatgttggca

SEQ ID NO: 307285 - DNA, 16 bp, C. familiaris
attgtatcagttcttt

SEQ ID NO: 307286 - DNA, 16 bp, C. familiaris
attgtatttatctatt

SEQ ID NO: 307287 - DNA, 16 bp, C. familiaris
attgtgaaaatgtcta

SEQ ID NO: 307288 - DNA, 16 bp, C. familiaris
attgtgacctgaactg

SEQ ID NO: 307289 - DNA, 16 bp, C. familiaris
attgtgatgatcattt

SEQ ID NO: 307290 - DNA, 16 bp, C. familiaris
attgtgatgctcccag

SEQ ID NO: 307291 - DNA, 16 bp, C. familiaris
attgtgattttgactt

SEQ ID NO: 307292 - DNA, 16 bp, C. familiaris
attgtgccatttgtga

SEQ ID NO: 307293 - DNA, 16 bp, C. familiaris
attgtggactttgctg

SEQ ID NO: 307294 - DNA, 16 bp, C. familiaris
attgtggatttaattt

SEQ ID NO: 307295 - DNA, 16 bp, C. familiaris
attgtgggcattgctg

SEQ ID NO: 307296 - DNA, 16 bp, C. familiaris
attgtggtcatcattt

SEQ ID NO: 307297 - DNA, 16 bp, C. familiaris
attgtgtgtatatata

SEQ ID NO: 307298 - DNA, 16 bp, C. familiaris
attgttaaatcctctt

SEQ ID NO: 307299 - DNA, 16 bp, C. familiaris
attgttaagtggaaaa

SEQ ID NO: 307300 - DNA, 16 bp, C. familiaris
attgttcatttttgct

SEQ ID NO: 307301 - DNA, 16 bp, C. familiaris
attgttgcaaatgaca

SEQ ID NO: 307302 - DNA, 16 bp, C. familiaris
attgttgttgttgctg

SEQ ID NO: 307303 - DNA, 16 bp, C. familiaris
attgtttctgttcctt

SEQ ID NO: 307304 - DNA, 16 bp, C. familiaris
attgttttaccagtgt

SEQ ID NO: 307305 - DNA, 16 bp, C. familiaris
attgttttccacaatg

SEQ ID NO: 307306 - DNA, 16 bp, C. familiaris
atttaaaaaaatgctt

SEQ ID NO: 307307 - DNA, 16 bp, C. familiaris
atttaaaaagaaaact

SEQ ID NO: 307308 - DNA, 16 bp, C. familiaris
atttaaaaaggggaaa

SEQ ID NO: 307309 - DNA, 16 bp, C. familiaris
atttaaaaattcatca

SEQ ID NO: 307310 - DNA, 16 bp, C. familiaris
atttaaaacaagcaaa

SEQ ID NO: 307311 - DNA, 16 bp, C. familiaris
atttaaaacactgaaa

SEQ ID NO: 307312 - DNA, 16 bp, C. familiaris
atttaaaagatgattt

SEQ ID NO: 307313 - DNA, 16 bp, C. familiaris
atttaaaatactgtat

SEQ ID NO: 307314 - DNA, 16 bp, C. familiaris
atttaaagaagaatga

SEQ ID NO: 307315 - DNA, 16 bp, C. familiaris
atttaaagattttctt

SEQ ID NO: 307316 - DNA, 16 bp, C. familiaris
atttaaagtgagagac

SEQ ID NO: 307317 - DNA, 16 bp, C. familiaris
atttaaatgcatattt

SEQ ID NO: 307318 - DNA, 16 bp, C. familiaris
atttaaattcacattt

SEQ ID NO: 307319 - DNA, 16 bp, C. familiaris
atttaaattgtttcca

SEQ ID NO: 307320 - DNA, 16 bp, C. familiaris
atttaacagataagga

SEQ ID NO: 307321 - DNA, 16 bp, C. familiaris
atttaaccaagaaaaa

SEQ ID NO: 307322 - DNA, 16 bp, C. familiaris
atttaagaaaacattt

SEQ ID NO: 307323 - DNA, 16 bp, C. familiaris
atttaagaaacaaatg

SEQ ID NO: 307324 - DNA, 16 bp, C. familiaris
atttaagaacattttt

SEQ ID NO: 307325 - DNA, 16 bp, C. familiaris
atttaagaagaaattt

SEQ ID NO: 307326 - DNA, 16 bp, C. familiaris
atttaagacttttttt

SEQ ID NO: 307327 - DNA, 16 bp, C. familiaris
atttaagatctattct

SEQ ID NO: 307328 - DNA, 16 bp, C. familiaris
atttaaggaagaaaat

SEQ ID NO: 307329 - DNA, 16 bp, C. familiaris
atttaaggttccttca

SEQ ID NO: 307330 - DNA, 16 bp, C. familiaris
atttaatagatgagga

SEQ ID NO: 307331 - DNA, 16 bp, C. familiaris
atttaatcctcacaag

SEQ ID NO: 307332 - DNA, 16 bp, C. familiaris
atttaatgaacattta

SEQ ID NO: 307333 - DNA, 16 bp, C. familiaris
atttaattttctcaaa

SEQ ID NO: 307334 - DNA, 16 bp, C. familiaris
atttacaaaaacaggt

SEQ ID NO: 307335 - DNA, 16 bp, C. familiaris
atttacaaagtaaaaa

SEQ ID NO: 307336 - DNA, 16 bp, C. familiaris
atttacaaatgaagaa

SEQ ID NO: 307337 - DNA, 16 bp, C. familiaris
atttacaattgcacct

SEQ ID NO: 307338 - DNA, 16 bp, C. familiaris
atttacagatgaagaa

SEQ ID NO: 307339 - DNA, 16 bp, C. familiaris
atttacaggaaaattg

SEQ ID NO: 307340 - DNA, 16 bp, C. familiaris
atttacataatttaca

SEQ ID NO: 307341 - DNA, 16 bp, C. familiaris
atttacccaaaagaaa

SEQ ID NO: 307342 - DNA, 16 bp, C. familiaris
atttactatttatttg

SEQ ID NO: 307343 - DNA, 16 bp, C. familiaris
atttactcaggagaga

SEQ ID NO: 307344 - DNA, 16 bp, C. familiaris
atttacttgaagaaat

SEQ ID NO: 307345 - DNA, 16 bp, C. familiaris
atttacttgaattttt

SEQ ID NO: 307346 - DNA, 16 bp, C. familiaris
atttacttgtttttaa

SEQ ID NO: 307347 - DNA, 16 bp, C. familiaris
atttacttttcaaaat

SEQ ID NO: 307348 - DNA, 16 bp, C. familiaris
atttagaaaacacaaa

SEQ ID NO: 307349 - DNA, 16 bp, C. familiaris
atttagaaaacagaaa

SEQ ID NO: 307350 - DNA, 16 bp, C. familiaris
atttagaaaataaaca

SEQ ID NO: 307351 - DNA, 16 bp, C. familiaris
atttagaaaattcaaa

SEQ ID NO: 307352 - DNA, 16 bp, C. familiaris
atttagattgtttcca

SEQ ID NO: 307353 - DNA, 16 bp, C. familiaris
atttaggaataaatct

SEQ ID NO: 307354 - DNA, 16 bp, C. familiaris
atttaggtcttttaaa

SEQ ID NO: 307355 - DNA, 16 bp, C. familiaris
atttatagcttttatt

SEQ ID NO: 307356 - DNA, 16 bp, C. familiaris
atttatcaccactaaa

SEQ ID NO: 307357 - DNA, 16 bp, C. familiaris
atttatccatgagaaa

SEQ ID NO: 307358 - DNA, 16 bp, C. familiaris
atttatccatgggaga

SEQ ID NO: 307359 - DNA, 16 bp, C. familiaris
atttatcccagaaaaa

SEQ ID NO: 307360 - DNA, 16 bp, C. familiaris
atttatccccgggata

SEQ ID NO: 307361 - DNA, 16 bp, C. familiaris
atttatctctgggatg

SEQ ID NO: 307362 - DNA, 16 bp, C. familiaris
atttatgcaaagaaaa

SEQ ID NO: 307363 - DNA, 16 bp, C. familiaris
atttatggatatgtct

SEQ ID NO: 307364 - DNA, 16 bp, C. familiaris
atttatgttttagaaa

SEQ ID NO: 307365 - DNA, 16 bp, C. familiaris
atttattagaaagaga

SEQ ID NO: 307366 - DNA, 16 bp, C. familiaris
atttattagagcacaa

SEQ ID NO: 307367 - DNA, 16 bp, C. familiaris
atttattatgcaaata

SEQ ID NO: 307368 - DNA, 16 bp, C. familiaris
atttattcaccagaga

SEQ ID NO: 307369 - DNA, 16 bp, C. familiaris
atttattcatgaaata

SEQ ID NO: 307370 - DNA, 16 bp, C. familiaris
atttattcatgaagga

SEQ ID NO: 307371 - DNA, 16 bp, C. familiaris
atttattccagagatg

SEQ ID NO: 307372 - DNA, 16 bp, C. familiaris
atttattcctgaaaga

SEQ ID NO: 307373 - DNA, 16 bp, C. familiaris
atttattcttcaaaac

SEQ ID NO: 307374 - DNA, 16 bp, C. familiaris
atttattgaagagatg

SEQ ID NO: 307375 - DNA, 16 bp, C. familiaris
atttattgaatgaaaa

SEQ ID NO: 307376 - DNA, 16 bp, C. familiaris
atttattgagagttta

SEQ ID NO: 307377 - DNA, 16 bp, C. familiaris
atttattggagagaaa

SEQ ID NO: 307378 - DNA, 16 bp, C. familiaris
atttattggggaaaaa

SEQ ID NO: 307379 - DNA, 16 bp, C. familiaris
atttatttactcatga

SEQ ID NO: 307380 - DNA, 16 bp, C. familiaris
atttatttaggaaaaa

SEQ ID NO: 307381 - DNA, 16 bp, C. familiaris
atttatttaggtctta

SEQ ID NO: 307382 - DNA, 16 bp, C. familiaris
atttatttagtcattt

SEQ ID NO: 307383 - DNA, 16 bp, C. familiaris
atttatttatacatgt

SEQ ID NO: 307384 - DNA, 16 bp, C. familiaris
atttatttctttgaaa

SEQ ID NO: 307385 - DNA, 16 bp, C. familiaris
atttatttgaaaagga

SEQ ID NO: 307386 - DNA, 16 bp, C. familiaris
atttatttgacacaga

SEQ ID NO: 307387 - DNA, 16 bp, C. familiaris
atttatttgggaggtg

SEQ ID NO: 307388 - DNA, 16 bp, C. familiaris
atttattttcacaaaa

SEQ ID NO: 307389 - DNA, 16 bp, C. familiaris
atttattttcatgaga

SEQ ID NO: 307390 - DNA, 16 bp, C. familiaris
atttattttgcatatt

SEQ ID NO: 307391 - DNA, 16 bp, C. familiaris
atttatttttctaatg

SEQ ID NO: 307392 - DNA, 16 bp, C. familiaris
atttcaaaaagaaaag

SEQ ID NO: 307393 - DNA, 16 bp, C. familiaris
atttcaaaatgaaaaa

SEQ ID NO: 307394 - DNA, 16 bp, C. familiaris
atttcaaaatgtgaaa

SEQ ID NO: 307395 - DNA, 16 bp, C. familiaris
atttcaaaattcattt

SEQ ID NO: 307396 - DNA, 16 bp, C. familiaris
atttcaaaatttaaag

SEQ ID NO: 307397 - DNA, 16 bp, C. familiaris
atttcaaagatgaaga

SEQ ID NO: 307398 - DNA, 16 bp, C. familiaris
atttcaaagattttat

SEQ ID NO: 307399 - DNA, 16 bp, C. familiaris
atttcaaataaaatct

SEQ ID NO: 307400 - DNA, 16 bp, C. familiaris
atttcaaatactttct

SEQ ID NO: 307401 - DNA, 16 bp, C. familiaris
atttcaacaatcttca

SEQ ID NO: 307402 - DNA, 16 bp, C. familiaris
atttcaagaaaaacaa

SEQ ID NO: 307403 - DNA, 16 bp, C. familiaris
atttcaagaacttggg

SEQ ID NO: 307404 - DNA, 16 bp, C. familiaris
atttcaagatttaaaa

SEQ ID NO: 307405 - DNA, 16 bp, C. familiaris
atttcaagtatttttt

SEQ ID NO: 307406 - DNA, 16 bp, C. familiaris
atttcaataaaactat

SEQ ID NO: 307407 - DNA, 16 bp, C. familiaris
atttcaataaagctat

SEQ ID NO: 307408 - DNA, 16 bp, C. familiaris
atttcacaaagaaaat

SEQ ID NO: 307409 - DNA, 16 bp, C. familiaris
atttcacagaagaaga

SEQ ID NO: 307410 - DNA, 16 bp, C. familiaris
atttcacagatgaaaa

SEQ ID NO: 307411 - DNA, 16 bp, C. familiaris
atttcacagatgaagg

SEQ ID NO: 307412 - DNA, 16 bp, C. familiaris
atttcacctcaataaa

SEQ ID NO: 307413 - DNA, 16 bp, C. familiaris
atttcacttagaataa

SEQ ID NO: 307414 - DNA, 16 bp, C. familiaris
atttcagaaaaataat

SEQ ID NO: 307415 - DNA, 16 bp, C. familiaris
atttcagaaagaaaaa

SEQ ID NO: 307416 - DNA, 16 bp, C. familiaris
atttcagaatcagttt

SEQ ID NO: 307417 - DNA, 16 bp, C. familiaris
atttcagaatttttaa

SEQ ID NO: 307418 - DNA, 16 bp, C. familiaris
atttcagagacagaaa

SEQ ID NO: 307419 - DNA, 16 bp, C. familiaris
atttcagagagagaga

SEQ ID NO: 307420 - DNA, 16 bp, C. familiaris
atttcagttctttgaa

SEQ ID NO: 307421 - DNA, 16 bp, C. familiaris
atttcagtttcctttt

SEQ ID NO: 307422 - DNA, 16 bp, C. familiaris
atttcataaaaagaaa

SEQ ID NO: 307423 - DNA, 16 bp, C. familiaris
atttcataaaaatgga

SEQ ID NO: 307424 - DNA, 16 bp, C. familiaris
atttcatatttgaaaa

SEQ ID NO: 307425 - DNA, 16 bp, C. familiaris
atttcatcaaatttta

SEQ ID NO: 307426 - DNA, 16 bp, C. familiaris
atttcatggatgaaga

SEQ ID NO: 307427 - DNA, 16 bp, C. familiaris
atttcatgtaatttta

SEQ ID NO: 307428 - DNA, 16 bp, C. familiaris
atttcattaatttgag

SEQ ID NO: 307429 - DNA, 16 bp, C. familiaris
atttcattatatgtaa

SEQ ID NO: 307430 - DNA, 16 bp, C. familiaris
atttcattatgatttt

SEQ ID NO: 307431 - DNA, 16 bp, C. familiaris
atttcattattttgca

SEQ ID NO: 307432 - DNA, 16 bp, C. familiaris
atttcattcatttgtg

SEQ ID NO: 307433 - DNA, 16 bp, C. familiaris
atttcattgatctttt

SEQ ID NO: 307434 - DNA, 16 bp, C. familiaris
atttcatttacatgtg

SEQ ID NO: 307435 - DNA, 16 bp, C. familiaris
atttcatttagcacaa

SEQ ID NO: 307436 - DNA, 16 bp, C. familiaris
atttcatttattcact

SEQ ID NO: 307437 - DNA, 16 bp, C. familiaris
atttcatttgcaaata

SEQ ID NO: 307438 - DNA, 16 bp, C. familiaris
atttccaaaaggaaaa

SEQ ID NO: 307439 - DNA, 16 bp, C. familiaris
atttccaaacatttgg

SEQ ID NO: 307440 - DNA, 16 bp, C. familiaris
atttccaaagagaaaa

SEQ ID NO: 307441 - DNA, 16 bp, C. familiaris
atttccaaaggaaaat

SEQ ID NO: 307442 - DNA, 16 bp, C. familiaris
atttccaaagttactt

SEQ ID NO: 307443 - DNA, 16 bp, C. familiaris
atttccaaatgaaaaa

SEQ ID NO: 307444 - DNA, 16 bp, C. familiaris
atttccaaatggaaaa

SEQ ID NO: 307445 - DNA, 16 bp, C. familiaris
atttccaaattttttc

SEQ ID NO: 307446 - DNA, 16 bp, C. familiaris
atttccaagaaaaaaa

SEQ ID NO: 307447 - DNA, 16 bp, C. familiaris
atttccaccagcagtg

SEQ ID NO: 307448 - DNA, 16 bp, C. familiaris
atttccagaaatgaaa

SEQ ID NO: 307449 - DNA, 16 bp, C. familiaris
atttccagaactcttt

SEQ ID NO: 307450 - DNA, 16 bp, C. familiaris
atttccagcctccaga

SEQ ID NO: 307451 - DNA, 16 bp, C. familiaris
atttccatgtcttggc

SEQ ID NO: 307452 - DNA, 16 bp, C. familiaris
atttccattttcattc

SEQ ID NO: 307453 - DNA, 16 bp, C. familiaris
atttcccagactcctt

SEQ ID NO: 307454 - DNA, 16 bp, C. familiaris
atttcccaggctccct

SEQ ID NO: 307455 - DNA, 16 bp, C. familiaris
atttccccattttaca

SEQ ID NO: 307456 - DNA, 16 bp, C. familiaris
atttccctaatgatga

SEQ ID NO: 307457 - DNA, 16 bp, C. familiaris
atttccctgatgaaaa

SEQ ID NO: 307458 - DNA, 16 bp, C. familiaris
atttccctgatgacaa

SEQ ID NO: 307459 - DNA, 16 bp, C. familiaris
atttccctggtaatta

SEQ ID NO: 307460 - DNA, 16 bp, C. familiaris
atttccctggtggcaa

SEQ ID NO: 307461 - DNA, 18 bp, C. familiaris
atttccgattagggtgtg

SEQ ID NO: 307462 - DNA, 16 bp, C. familiaris
atttcctgaaaataaa

SEQ ID NO: 307463 - DNA, 16 bp, C. familiaris
atttcctgttctttct

SEQ ID NO: 307464 - DNA, 16 bp, C. familiaris
atttccttcaagaatt

SEQ ID NO: 307465 - DNA, 16 bp, C. familiaris
atttccttccttctga

SEQ ID NO: 307466 - DNA, 16 bp, C. familiaris
atttcctttagatttt

SEQ ID NO: 307467 - DNA, 16 bp, C. familiaris
atttcctttataaaaa

SEQ ID NO: 307468 - DNA, 16 bp, C. familiaris
atttcctttgggaaat

SEQ ID NO: 307469 - DNA, 16 bp, C. familiaris
atttccttttctgtat

SEQ ID NO: 307470 - DNA, 16 bp, C. familiaris
atttctaagaaagaaa

SEQ ID NO: 307471 - DNA, 16 bp, C. familiaris
atttctaagaatatat

SEQ ID NO: 307472 - DNA, 16 bp, C. familiaris
atttctaagcaaagtg

SEQ ID NO: 307473 - DNA, 16 bp, C. familiaris
atttctagtctccaga

SEQ ID NO: 307474 - DNA, 16 bp, C. familiaris
atttctataaagaaaa

SEQ ID NO: 307475 - DNA, 16 bp, C. familiaris
atttctatggtgtaaa

SEQ ID NO: 307476 - DNA, 16 bp, C. familiaris
atttctattcaacatt

SEQ ID NO: 307477 - DNA, 16 bp, C. familiaris
atttctattggtgaca

SEQ ID NO: 307478 - DNA, 16 bp, C. familiaris
atttctcatatttaaa

SEQ ID NO: 307479 - DNA, 16 bp, C. familiaris
atttctccaaaaatga

SEQ ID NO: 307480 - DNA, 16 bp, C. familiaris
atttctccaaggaaga

SEQ ID NO: 307481 - DNA, 16 bp, C. familiaris
atttctctgtgcctca

SEQ ID NO: 307482 - DNA, 16 bp, C. familiaris
atttctcttccttcag

SEQ ID NO: 307483 - DNA, 16 bp, C. familiaris
atttctctttctttag

SEQ ID NO: 307484 - DNA, 16 bp, C. familiaris
atttctgaaaattaaa

SEQ ID NO: 307485 - DNA, 16 bp, C. familiaris
atttctgaaatattaa

SEQ ID NO: 307486 - DNA, 16 bp, C. familiaris
atttctgaatttctga

SEQ ID NO: 307487 - DNA, 16 bp, C. familiaris
atttctgattatttct

SEQ ID NO: 307488 - DNA, 16 bp, C. familiaris
atttctgcaaagaaga

SEQ ID NO: 307489 - DNA, 16 bp, C. familiaris
atttctgccacattct

SEQ ID NO: 307490 - DNA, 16 bp, C. familiaris
atttctgctgagaaat

SEQ ID NO: 307491 - DNA, 16 bp, C. familiaris
atttctggaaaaataa

SEQ ID NO: 307492 - DNA, 16 bp, C. familiaris
atttctggaaacccac

SEQ ID NO: 307493 - DNA, 16 bp, C. familiaris
atttctggaaataaaa

SEQ ID NO: 307494 - DNA, 16 bp, C. familiaris
atttctggaaattttt

SEQ ID NO: 307495 - DNA, 16 bp, C. familiaris
atttctggattctctg

SEQ ID NO: 307496 - DNA, 16 bp, C. familiaris
atttctgggtatttat

SEQ ID NO: 307497 - DNA, 16 bp, C. familiaris
atttctgggttctttt

SEQ ID NO: 307498 - DNA, 16 bp, C. familiaris
atttctgtacactgat

SEQ ID NO: 307499 - DNA, 16 bp, C. familiaris
atttctgtctcatttt

SEQ ID NO: 307500 - DNA, 16 bp, C. familiaris
atttctgtcttctctt

SEQ ID NO: 307501 - DNA, 16 bp, C. familiaris
atttctgtttcttcaa

SEQ ID NO: 307502 - DNA, 16 bp, C. familiaris
atttcttaaatgttta

SEQ ID NO: 307503 - DNA, 16 bp, C. familiaris
atttcttaagctctgt

SEQ ID NO: 307504 - DNA, 16 bp, C. familiaris
atttcttaaggaaaaa

SEQ ID NO: 307505 - DNA, 16 bp, C. familiaris
atttcttcaaaattta

SEQ ID NO: 307506 - DNA, 16 bp, C. familiaris
atttcttcctctgtaa

SEQ ID NO: 307507 - DNA, 16 bp, C. familiaris
atttcttgcctggatt

SEQ ID NO: 307508 - DNA, 16 bp, C. familiaris
atttctttaaaaatga

SEQ ID NO: 307509 - DNA, 16 bp, C. familiaris
atttctttaggaaaaa

SEQ ID NO: 307510 - DNA, 16 bp, C. familiaris
atttctttctagaaat

SEQ ID NO: 307511 - DNA, 16 bp, C. familiaris
atttctttctgttgcc

SEQ ID NO: 307512 - DNA, 16 bp, C. familiaris
atttctttctgttgct

SEQ ID NO: 307513 - DNA, 16 bp, C. familiaris
atttctttgatgatga

SEQ ID NO: 307514 - DNA, 16 bp, C. familiaris
atttctttggagtctt

SEQ ID NO: 307515 - DNA, 16 bp, C. familiaris
atttcttttaaaagtt

SEQ ID NO: 307516 - DNA, 16 bp, C. familiaris
atttcttttaaagttt

SEQ ID NO: 307517 - DNA, 16 bp, C. familiaris
atttcttttacagaaa

SEQ ID NO: 307518 - DNA, 16 bp, C. familiaris
atttcttttgtgaatt

SEQ ID NO: 307519 - DNA, 16 bp, C. familiaris
atttctttttagtgat

SEQ ID NO: 307520 - DNA, 16 bp, C. familiaris
atttcttttttaagat

SEQ ID NO: 307521 - DNA, 16 bp, C. familiaris
atttgaaaaatacttt

SEQ ID NO: 307522 - DNA, 16 bp, C. familiaris
atttgaaaataagatt

SEQ ID NO: 307523 - DNA, 16 bp, C. familiaris
atttgaaaatattgaa

SEQ ID NO: 307524 - DNA, 16 bp, C. familiaris
atttgaaaatcaatta

SEQ ID NO: 307525 - DNA, 16 bp, C. familiaris
atttgaaaatgaaatt

SEQ ID NO: 307526 - DNA, 16 bp, C. familiaris
atttgaaaatttagaa

SEQ ID NO: 307527 - DNA, 16 bp, C. familiaris
atttgaaagaaagaga

SEQ ID NO: 307528 - DNA, 16 bp, C. familiaris
atttgaaagagagaat

SEQ ID NO: 307529 - DNA, 16 bp, C. familiaris
atttgaacaaaccaat

SEQ ID NO: 307530 - DNA, 16 bp, C. familiaris
atttgaacaaatcatg

SEQ ID NO: 307531 - DNA, 16 bp, C. familiaris
atttgaacattttatt

SEQ ID NO: 307532 - DNA, 16 bp, C. familiaris
atttgaacttttaaaa

SEQ ID NO: 307533 - DNA, 16 bp, C. familiaris
atttgaagaaattata

SEQ ID NO: 307534 - DNA, 16 bp, C. familiaris
atttgaagcaaaaaaa

SEQ ID NO: 307535 - DNA, 16 bp, C. familiaris
atttgaatatcttctt

SEQ ID NO: 307536 - DNA, 16 bp, C. familiaris
atttgaatatttttca

SEQ ID NO: 307537 - DNA, 16 bp, C. familiaris
atttgaatgcctttga

SEQ ID NO: 307538 - DNA, 16 bp, C. familiaris
atttgaatttctaaaa

SEQ ID NO: 307539 - DNA, 16 bp, C. familiaris
atttgaatttttaaag

SEQ ID NO: 307540 - DNA, 16 bp, C. familiaris
atttgacaaagcacaa

SEQ ID NO: 307541 - DNA, 16 bp, C. familiaris
atttgacagagaagag

SEQ ID NO: 307542 - DNA, 16 bp, C. familiaris
atttgacagataaaga

SEQ ID NO: 307543 - DNA, 16 bp, C. familiaris
atttgacattttgaaa

SEQ ID NO: 307544 - DNA, 16 bp, C. familiaris
atttgagagagaagaa

SEQ ID NO: 307545 - DNA, 16 bp, C. familiaris
atttgagggagagaga

SEQ ID NO: 307546 - DNA, 16 bp, C. familiaris
atttgagttccttcca

SEQ ID NO: 307547 - DNA, 16 bp, C. familiaris
atttgagttcttttca

SEQ ID NO: 307548 - DNA, 16 bp, C. familiaris
atttgataaagggtta

SEQ ID NO: 307549 - DNA, 16 bp, C. familiaris
atttgatacatttttt

SEQ ID NO: 307550 - DNA, 16 bp, C. familiaris
atttgatagagaaaga

SEQ ID NO: 307551 - DNA, 16 bp, C. familiaris
atttgatagatgagga

SEQ ID NO: 307552 - DNA, 16 bp, C. familiaris
atttgatgatgatgat

SEQ ID NO: 307553 - DNA, 16 bp, C. familiaris
atttgatttgaaaaat

SEQ ID NO: 307554 - DNA, 16 bp, C. familiaris
atttgcaaaattattt

SEQ ID NO: 307555 - DNA, 16 bp, C. familiaris
atttgcaaagattttt

SEQ ID NO: 307556 - DNA, 16 bp, C. familiaris
atttgcaaatacagaa

SEQ ID NO: 307557 - DNA, 16 bp, C. familiaris
atttgcaaatattctt

SEQ ID NO: 307558 - DNA, 16 bp, C. familiaris
atttgcaaatattgaa

SEQ ID NO: 307559 - DNA, 16 bp, C. familiaris
atttgcaaattaatca

SEQ ID NO: 307560 - DNA, 16 bp, C. familiaris
atttgcaagagagaga

SEQ ID NO: 307561 - DNA, 16 bp, C. familiaris
atttgcaatgacattg

SEQ ID NO: 307562 - DNA, 16 bp, C. familiaris
atttgcacatgacata

SEQ ID NO: 307563 - DNA, 16 bp, C. familiaris
atttgcacattttaaa

SEQ ID NO: 307564 - DNA, 16 bp, C. familiaris
atttgcatatattgaa

SEQ ID NO: 307565 - DNA, 16 bp, C. familiaris
atttgcatgttttctt

SEQ ID NO: 307566 - DNA, 16 bp, C. familiaris
atttgcattgttttaa

SEQ ID NO: 307567 - DNA, 16 bp, C. familiaris
atttgcatttccttca

SEQ ID NO: 307568 - DNA, 16 bp, C. familiaris
atttgcatttgaaaaa

SEQ ID NO: 307569 - DNA, 16 bp, C. familiaris
atttgcattttaacaa

SEQ ID NO: 307570 - DNA, 16 bp, C. familiaris
atttgccaagatatag

SEQ ID NO: 307571 - DNA, 16 bp, C. familiaris
atttgctaagaaaata

SEQ ID NO: 307572 - DNA, 16 bp, C. familiaris
atttgctacaacatgg

SEQ ID NO: 307573 - DNA, 16 bp, C. familiaris
atttgctgaaaatatt

SEQ ID NO: 307574 - DNA, 16 bp, C. familiaris
atttgctgatgacatg

SEQ ID NO: 307575 - DNA, 16 bp, C. familiaris
atttgctgtttcttgt

SEQ ID NO: 307576 - DNA, 17 bp, C. familiaris
atttgcttcaacgtggg

SEQ ID NO: 307577 - DNA, 16 bp, C. familiaris
atttgcttctctttct

SEQ ID NO: 307578 - DNA, 16 bp, C. familiaris
atttgctttatgtatt

SEQ ID NO: 307579 - DNA, 16 bp, C. familiaris
atttgctttgctttgt

SEQ ID NO: 307580 - DNA, 16 bp, C. familiaris
atttggaaaaattcaa

SEQ ID NO: 307581 - DNA, 16 bp, C. familiaris
atttggaaaagaaaag

SEQ ID NO: 307582 - DNA, 16 bp, C. familiaris
atttggaaaatataga

SEQ ID NO: 307583 - DNA, 16 bp, C. familiaris
atttggaaaatatgaa

SEQ ID NO: 307584 - DNA, 16 bp, C. familiaris
atttggaaaatattga

SEQ ID NO: 307585 - DNA, 16 bp, C. familiaris
atttggaaaatatttt

SEQ ID NO: 307586 - DNA, 16 bp, C. familiaris
atttggaaaatggaga

SEQ ID NO: 307587 - DNA, 16 bp, C. familiaris
atttggaaaattttta

SEQ ID NO: 307588 - DNA, 16 bp, C. familiaris
atttggaaacaaaata

SEQ ID NO: 307589 - DNA, 16 bp, C. familiaris
atttggaaagaactga

SEQ ID NO: 307590 - DNA, 16 bp, C. familiaris
atttggaaagaagaaa

SEQ ID NO: 307591 - DNA, 16 bp, C. familiaris
atttggaaatatttta

SEQ ID NO: 307592 - DNA, 16 bp, C. familiaris
atttggaagaaatgga

SEQ ID NO: 307593 - DNA, 16 bp, C. familiaris
atttggaagcattcct

SEQ ID NO: 307594 - DNA, 16 bp, C. familiaris
atttggaagtttttct

SEQ ID NO: 307595 - DNA, 16 bp, C. familiaris
atttggagggagaaaa

SEQ ID NO: 307596 - DNA, 16 bp, C. familiaris
atttggattaaaattc

SEQ ID NO: 307597 - DNA, 16 bp, C. familiaris
atttggcaaaacaaaa

SEQ ID NO: 307598 - DNA, 16 bp, C. familiaris
atttgggaaagaaaaa

SEQ ID NO: 307599 - DNA, 16 bp, C. familiaris
atttgggaaggaagaa

SEQ ID NO: 307600 - DNA, 16 bp, C. familiaris
atttgggacatatttt

SEQ ID NO: 307601 - DNA, 16 bp, C. familiaris
atttgggagaaaaaaa

SEQ ID NO: 307602 - DNA, 16 bp, C. familiaris
atttgggcagccccag

SEQ ID NO: 307603 - DNA, 16 bp, C. familiaris
atttggggaaaaaaat

SEQ ID NO: 307604 - DNA, 16 bp, C. familiaris
atttggggaaaatatt

SEQ ID NO: 307605 - DNA, 16 bp, C. familiaris
atttgggggatataaa

SEQ ID NO: 307606 - DNA, 16 bp, C. familiaris
atttggtttgcttcca

SEQ ID NO: 307607 - DNA, 16 bp, C. familiaris
atttgtaaaaaacaca

SEQ ID NO: 307608 - DNA, 16 bp, C. familiaris
atttgtaaaaacaaaa

SEQ ID NO: 307609 - DNA, 16 bp, C. familiaris
atttgtaaatgataca

SEQ ID NO: 307610 - DNA, 16 bp, C. familiaris
atttgtaacccagtat

SEQ ID NO: 307611 - DNA, 16 bp, C. familiaris
atttgtaagtattttc

SEQ ID NO: 307612 - DNA, 16 bp, C. familiaris
atttgtaataaaagtt

SEQ ID NO: 307613 - DNA, 16 bp, C. familiaris
atttgtattgtttcca

SEQ ID NO: 307614 - DNA, 16 bp, C. familiaris
atttgtcagcaagaaa

SEQ ID NO: 307615 - DNA, 16 bp, C. familiaris
atttgtctgatatttt

SEQ ID NO: 307616 - DNA, 16 bp, C. familiaris
atttgtcttttaaaat

SEQ ID NO: 307617 - DNA, 16 bp, C. familiaris
atttgtgaaaacatgg

SEQ ID NO: 307618 - DNA, 16 bp, C. familiaris
atttgtgaaatggaaa

SEQ ID NO: 307619 - DNA, 16 bp, C. familiaris
atttgtgaatttccca

SEQ ID NO: 307620 - DNA, 16 bp, C. familiaris
atttgtgagacacaca

SEQ ID NO: 307621 - DNA, 16 bp, C. familiaris
atttgtgccttcttca

SEQ ID NO: 307622 - DNA, 16 bp, C. familiaris
atttgtgtacaagttt

SEQ ID NO: 307623 - DNA, 16 bp, C. familiaris
atttgtgtggattcag

SEQ ID NO: 307624 - DNA, 16 bp, C. familiaris
atttgtgttttaaaaa

SEQ ID NO: 307625 - DNA, 16 bp, C. familiaris
atttgtgttttaagaa

SEQ ID NO: 307626 - DNA, 16 bp, C. familiaris
atttgttaaaattcaa

SEQ ID NO: 307627 - DNA, 16 bp, C. familiaris
atttgttaaacatttt

SEQ ID NO: 307628 - DNA, 16 bp, C. familiaris
atttgttcaaatattt

SEQ ID NO: 307629 - DNA, 16 bp, C. familiaris
atttgttgaagaaaat

SEQ ID NO: 307630 - DNA, 16 bp, C. familiaris
atttgttgaatgctta

SEQ ID NO: 307631 - DNA, 16 bp, C. familiaris
atttgtttaaaaagaa

SEQ ID NO: 307632 - DNA, 16 bp, C. familiaris
atttgtttgaaagaaa

SEQ ID NO: 307633 - DNA, 16 bp, C. familiaris
atttgttttcaaatat

SEQ ID NO: 307634 - DNA, 16 bp, C. familiaris
atttgttttccagagt

SEQ ID NO: 307635 - DNA, 16 bp, C. familiaris
atttgttttcccattt

SEQ ID NO: 307636 - DNA, 16 bp, C. familiaris
attttaaaaacagaat

SEQ ID NO: 307637 - DNA, 16 bp, C. familiaris
attttaaaaactgcca

SEQ ID NO: 307638 - DNA, 16 bp, C. familiaris
attttaaaaatgactt

SEQ ID NO: 307639 - DNA, 16 bp, C. familiaris
attttaaaaatgcaaa

SEQ ID NO: 307640 - DNA, 16 bp, C. familiaris
attttaaaacatatca

SEQ ID NO: 307641 - DNA, 16 bp, C. familiaris
attttaaaagcctctt

SEQ ID NO: 307642 - DNA, 16 bp, C. familiaris
attttaaaatagcaat

SEQ ID NO: 307643 - DNA, 16 bp, C. familiaris
attttaaaatgagcag

SEQ ID NO: 307644 - DNA, 16 bp, C. familiaris
attttaaaatggattt

SEQ ID NO: 307645 - DNA, 16 bp, C. familiaris
attttaaaatgtcagt

SEQ ID NO: 307646 - DNA, 16 bp, C. familiaris
attttaaaatgtgcta

SEQ ID NO: 307647 - DNA, 16 bp, C. familiaris
attttaaaattcagaa

SEQ ID NO: 307648 - DNA, 16 bp, C. familiaris
attttaaagacaaaga

SEQ ID NO: 307649 - DNA, 16 bp, C. familiaris
attttaaagcaaagac

SEQ ID NO: 307650 - DNA, 16 bp, C. familiaris
attttaaataatgctg

SEQ ID NO: 307651 - DNA, 16 bp, C. familiaris
attttaaatacataca

SEQ ID NO: 307652 - DNA, 16 bp, C. familiaris
attttaaatatctcat

SEQ ID NO: 307653 - DNA, 16 bp, C. familiaris
attttaaatgaaatga

SEQ ID NO: 307654 - DNA, 16 bp, C. familiaris
attttaaatgttcttt

SEQ ID NO: 307655 - DNA, 16 bp, C. familiaris
attttaaattcagttt

SEQ ID NO: 307656 - DNA, 16 bp, C. familiaris
attttaaattttctag

SEQ ID NO: 307657 - DNA, 16 bp, C. familiaris
attttaacagattttt

SEQ ID NO: 307658 - DNA, 16 bp, C. familiaris
attttaagaaaaagga

SEQ ID NO: 307659 - DNA, 16 bp, C. familiaris
attttaagaaagaaga

SEQ ID NO: 307660 - DNA, 16 bp, C. familiaris
attttaagaatgttat

SEQ ID NO: 307661 - DNA, 16 bp, C. familiaris
attttaaggatgagaa

SEQ ID NO: 307662 - DNA, 16 bp, C. familiaris
attttaaggttttctt

SEQ ID NO: 307663 - DNA, 16 bp, C. familiaris
attttaatatgcctca

SEQ ID NO: 307664 - DNA, 16 bp, C. familiaris
attttaatgaaaacat

SEQ ID NO: 307665 - DNA, 16 bp, C. familiaris
attttacaaaatgaaa

SEQ ID NO: 307666 - DNA, 16 bp, C. familiaris
attttacaaagaaaat

SEQ ID NO: 307667 - DNA, 16 bp, C. familiaris
attttacaaagagaaa

SEQ ID NO: 307668 - DNA, 16 bp, C. familiaris
attttacaaataaaga

SEQ ID NO: 307669 - DNA, 16 bp, C. familiaris
attttacaaataaatg

SEQ ID NO: 307670 - DNA, 16 bp, C. familiaris
attttacaagaaaaaa

SEQ ID NO: 307671 - DNA, 16 bp, C. familiaris
attttacaataagaaa

SEQ ID NO: 307672 - DNA, 16 bp, C. familiaris
attttacagaagaaac

SEQ ID NO: 307673 - DNA, 16 bp, C. familiaris
attttacagatgaaaa

SEQ ID NO: 307674 - DNA, 16 bp, C. familiaris
attttacagttgaaga

SEQ ID NO: 307675 - DNA, 16 bp, C. familiaris
attttacatttccacc

SEQ ID NO: 307676 - DNA, 16 bp, C. familiaris
attttaccaaatgctt

SEQ ID NO: 307677 - DNA, 16 bp, C. familiaris
attttactaatgagga

SEQ ID NO: 307678 - DNA, 16 bp, C. familiaris
attttagaaagagcat

SEQ ID NO: 307679 - DNA, 16 bp, C. familiaris
attttagaaatacatt

SEQ ID NO: 307680 - DNA, 16 bp, C. familiaris
attttagaagataatt

SEQ ID NO: 307681 - DNA, 16 bp, C. familiaris
attttagaagttcttt

SEQ ID NO: 307682 - DNA, 16 bp, C. familiaris
attttagaatacattt

SEQ ID NO: 307683 - DNA, 16 bp, C. familiaris
attttagacagaaaga

SEQ ID NO: 307684 - DNA, 16 bp, C. familiaris
attttagacttgccag

SEQ ID NO: 307685 - DNA, 16 bp, C. familiaris
attttagagaaagaga

SEQ ID NO: 307686 - DNA, 16 bp, C. familiaris
attttagagagaaagt

SEQ ID NO: 307687 - DNA, 16 bp, C. familiaris
attttagagatgaaaa

SEQ ID NO: 307688 - DNA, 16 bp, C. familiaris
attttagaggaaaaac

SEQ ID NO: 307689 - DNA, 16 bp, C. familiaris
attttagaggaagaga

SEQ ID NO: 307690 - DNA, 16 bp, C. familiaris
attttagatgaagaaa

SEQ ID NO: 307691 - DNA, 16 bp, C. familiaris
attttagcatttttaa

SEQ ID NO: 307692 - DNA, 16 bp, C. familiaris
attttagctttaaaat

SEQ ID NO: 307693 - DNA, 16 bp, C. familiaris
attttaggaaaaaatt

SEQ ID NO: 307694 - DNA, 16 bp, C. familiaris
attttaggacaaaatt

SEQ ID NO: 307695 - DNA, 16 bp, C. familiaris
attttagtcattttat

SEQ ID NO: 307696 - DNA, 16 bp, C. familiaris
attttagtcattttga

SEQ ID NO: 307697 - DNA, 16 bp, C. familiaris
attttataatttgctt

SEQ ID NO: 307698 - DNA, 16 bp, C. familiaris
attttatagatacaga

SEQ ID NO: 307699 - DNA, 16 bp, C. familiaris
attttatagatataga

SEQ ID NO: 307700 - DNA, 16 bp, C. familiaris
attttatcagattttt

SEQ ID NO: 307701 - DNA, 16 bp, C. familiaris
attttatcaggaaaaa

SEQ ID NO: 307702 - DNA, 16 bp, C. familiaris
attttatcatctcata

SEQ ID NO: 307703 - DNA, 16 bp, C. familiaris
attttatccattctga

SEQ ID NO: 307704 - DNA, 16 bp, C. familiaris
attttatgaagaaaat

SEQ ID NO: 307705 - DNA, 16 bp, C. familiaris
attttatgacttattt

SEQ ID NO: 307706 - DNA, 16 bp, C. familiaris
attttatgatgaaaat

SEQ ID NO: 307707 - DNA, 16 bp, C. familiaris
attttatggatgaaga

SEQ ID NO: 307708 - DNA, 16 bp, C. familiaris
attttattaaaggaaa

SEQ ID NO: 307709 - DNA, 16 bp, C. familiaris
attttattactgaaat

SEQ ID NO: 307710 - DNA, 16 bp, C. familiaris
attttattcttcagaa

SEQ ID NO: 307711 - DNA, 16 bp, C. familiaris
attttattgagtcttc

SEQ ID NO: 307712 - DNA, 16 bp, C. familiaris
attttattgtgaaaaa

SEQ ID NO: 307713 - DNA, 16 bp, C. familiaris
attttatttaacccag

SEQ ID NO: 307714 - DNA, 16 bp, C. familiaris
attttatttagcattt

SEQ ID NO: 307715 - DNA, 16 bp, C. familiaris
attttatttctcacag

SEQ ID NO: 307716 - DNA, 16 bp, C. familiaris
attttatttggagaaa

SEQ ID NO: 307717 - DNA, 16 bp, C. familiaris
attttattttctcctg

SEQ ID NO: 307718 - DNA, 16 bp, C. familiaris
attttatttttacaga

SEQ ID NO: 307719 - DNA, 16 bp, C. familiaris
attttcaaaaagaaaa

SEQ ID NO: 307720 - DNA, 16 bp, C. familiaris
attttcaaaacatata

SEQ ID NO: 307721 - DNA, 16 bp, C. familiaris
attttcaaaagagaaa

SEQ ID NO: 307722 - DNA, 16 bp, C. familiaris
attttcaaaatatatc

SEQ ID NO: 307723 - DNA, 16 bp, C. familiaris
attttcaaagaaaaga

SEQ ID NO: 307724 - DNA, 16 bp, C. familiaris
attttcaaatgtttaa

SEQ ID NO: 307725 - DNA, 16 bp, C. familiaris
attttcaagaaaatat

SEQ ID NO: 307726 - DNA, 16 bp, C. familiaris
attttcaagaaaatgt

SEQ ID NO: 307727 - DNA, 16 bp, C. familiaris
attttcaagaagaaaa

SEQ ID NO: 307728 - DNA, 16 bp, C. familiaris
attttcaagagaaaaa

SEQ ID NO: 307729 - DNA, 16 bp, C. familiaris
attttcaattttcaaa

SEQ ID NO: 307730 - DNA, 16 bp, C. familiaris
attttcacaatgttaa

SEQ ID NO: 307731 - DNA, 16 bp, C. familiaris
attttcacattttcaa

SEQ ID NO: 307732 - DNA, 16 bp, C. familiaris
attttcagaaattttg

SEQ ID NO: 307733 - DNA, 16 bp, C. familiaris
attttcagaacatttt

SEQ ID NO: 307734 - DNA, 16 bp, C. familiaris
attttcagaatataaa

SEQ ID NO: 307735 - DNA, 16 bp, C. familiaris
attttcagaatatttt

SEQ ID NO: 307736 - DNA, 16 bp, C. familiaris
attttcagatattttt

SEQ ID NO: 307737 - DNA, 16 bp, C. familiaris
attttcaggaaaaaca

SEQ ID NO: 307738 - DNA, 16 bp, C. familiaris
attttcaggaaaataa

SEQ ID NO: 307739 - DNA, 16 bp, C. familiaris
attttcaggaaaattt

SEQ ID NO: 307740 - DNA, 16 bp, C. familiaris
attttcagtttttaaa

SEQ ID NO: 307741 - DNA, 16 bp, C. familiaris
attttcatcagatttt

SEQ ID NO: 307742 - DNA, 16 bp, C. familiaris
attttcatcatcattt

SEQ ID NO: 307743 - DNA, 16 bp, C. familiaris
attttcatgaaatatt

SEQ ID NO: 307744 - DNA, 16 bp, C. familiaris
attttcattaaaatgt

SEQ ID NO: 307745 - DNA, 16 bp, C. familiaris
attttcattgtaaaaa

SEQ ID NO: 307746 - DNA, 16 bp, C. familiaris
attttcatttcaaata

SEQ ID NO: 307747 - DNA, 16 bp, C. familiaris
attttcattttcttga

SEQ ID NO: 307748 - DNA, 16 bp, C. familiaris
attttccagaactgat

SEQ ID NO: 307749 - DNA, 16 bp, C. familiaris
attttccagataagga

SEQ ID NO: 307750 - DNA, 16 bp, C. familiaris
attttccatttcatct

SEQ ID NO: 307751 - DNA, 16 bp, C. familiaris
attttcctctttaaaa

SEQ ID NO: 307752 - DNA, 16 bp, C. familiaris
attttccttttaaaaa

SEQ ID NO: 307753 - DNA, 16 bp, C. familiaris
attttccttttctgga

SEQ ID NO: 307754 - DNA, 16 bp, C. familiaris
attttctagaagaaaa

SEQ ID NO: 307755 - DNA, 16 bp, C. familiaris
attttctatttcaaaa

SEQ ID NO: 307756 - DNA, 16 bp, C. familiaris
attttctatttcctca

SEQ ID NO: 307757 - DNA, 16 bp, C. familiaris
attttctcaaaattct

SEQ ID NO: 307758 - DNA, 16 bp, C. familiaris
attttctcaaagtttt

SEQ ID NO: 307759 - DNA, 16 bp, C. familiaris
attttctcaaatgttt

SEQ ID NO: 307760 - DNA, 16 bp, C. familiaris
attttctcagtttttg

SEQ ID NO: 307761 - DNA, 16 bp, C. familiaris
attttctcatatgttt

SEQ ID NO: 307762 - DNA, 16 bp, C. familiaris
attttctcttttgaaa

SEQ ID NO: 307763 - DNA, 16 bp, C. familiaris
attttctgaaaaagaa

SEQ ID NO: 307764 - DNA, 16 bp, C. familiaris
attttctgagaaaaaa

SEQ ID NO: 307765 - DNA, 16 bp, C. familiaris
attttctgcattattt

SEQ ID NO: 307766 - DNA, 16 bp, C. familiaris
attttcttaaaaagtt

SEQ ID NO: 307767 - DNA, 16 bp, C. familiaris
attttcttcagtttct

SEQ ID NO: 307768 - DNA, 16 bp, C. familiaris
attttcttccatttgt

SEQ ID NO: 307769 - DNA, 16 bp, C. familiaris
attttcttctgcttac

SEQ ID NO: 307770 - DNA, 16 bp, C. familiaris
attttcttgaaaatat

SEQ ID NO: 307771 - DNA, 16 bp, C. familiaris
attttctttaaaagaa

SEQ ID NO: 307772 - DNA, 16 bp, C. familiaris
attttctttaatgata

SEQ ID NO: 307773 - DNA, 16 bp, C. familiaris
attttctttatagaaa

SEQ ID NO: 307774 - DNA, 16 bp, C. familiaris
attttctttcattctg

SEQ ID NO: 307775 - DNA, 16 bp, C. familiaris
attttctttctctgct

SEQ ID NO: 307776 - DNA, 16 bp, C. familiaris
attttcttttaaagaa

SEQ ID NO: 307777 - DNA, 16 bp, C. familiaris
attttcttttgagaaa

SEQ ID NO: 307778 - DNA, 16 bp, C. familiaris
attttgaaaaaacaaa

SEQ ID NO: 307779 - DNA, 16 bp, C. familiaris
attttgaaaaagaaga

SEQ ID NO: 307780 - DNA, 16 bp, C. familiaris
attttgaaaacaaaat

SEQ ID NO: 307781 - DNA, 16 bp, C. familiaris
attttgaaaagacaaa

SEQ ID NO: 307782 - DNA, 16 bp, C. familiaris
attttgaaaatacttt

SEQ ID NO: 307783 - DNA, 16 bp, C. familiaris
attttgaaacagaaaa

SEQ ID NO: 307784 - DNA, 16 bp, C. familiaris
attttgaaataatcat

SEQ ID NO: 307785 - DNA, 16 bp, C. familiaris
attttgaaatatcaaa

SEQ ID NO: 307786 - DNA, 16 bp, C. familiaris
attttgaaatatgcca

SEQ ID NO: 307787 - DNA, 16 bp, C. familiaris
attttgaaatatggaa

SEQ ID NO: 307788 - DNA, 16 bp, C. familiaris
attttgaaatgatcac

SEQ ID NO: 307789 - DNA, 16 bp, C. familiaris
attttgaagaatttta

SEQ ID NO: 307790 - DNA, 16 bp, C. familiaris
attttgaagtaaatcc

SEQ ID NO: 307791 - DNA, 16 bp, C. familiaris
attttgaatttcaaat

SEQ ID NO: 307792 - DNA, 16 bp, C. familiaris
attttgaattttctct

SEQ ID NO: 307793 - DNA, 16 bp, C. familiaris
attttgacattttctt

SEQ ID NO: 307794 - DNA, 16 bp, C. familiaris
attttgacatttttaa

SEQ ID NO: 307795 - DNA, 16 bp, C. familiaris
attttgagaaaattaa

SEQ ID NO: 307796 - DNA, 16 bp, C. familiaris
attttgagaaacaaaa

SEQ ID NO: 307797 - DNA, 16 bp, C. familiaris
attttgagaagaatag

SEQ ID NO: 307798 - DNA, 16 bp, C. familiaris
attttgagagagagag

SEQ ID NO: 307799 - DNA, 16 bp, C. familiaris
attttgaggaaaaaaa

SEQ ID NO: 307800 - DNA, 16 bp, C. familiaris
attttgaggaaaaaga

SEQ ID NO: 307801 - DNA, 16 bp, C. familiaris
attttgaggaagtcca

SEQ ID NO: 307802 - DNA, 16 bp, C. familiaris
attttgagtaaagcag

SEQ ID NO: 307803 - DNA, 16 bp, C. familiaris
attttgataaggattg

SEQ ID NO: 307804 - DNA, 16 bp, C. familiaris
attttgatgaagtcca

SEQ ID NO: 307805 - DNA, 16 bp, C. familiaris
attttgatgaagtccc

SEQ ID NO: 307806 - DNA, 16 bp, C. familiaris
attttgatgaagttca

SEQ ID NO: 307807 - DNA, 16 bp, C. familiaris
attttgatgaattcct

SEQ ID NO: 307808 - DNA, 16 bp, C. familiaris
attttgatggattatt

SEQ ID NO: 307809 - DNA, 16 bp, C. familiaris
attttgattgggattg

SEQ ID NO: 307810 - DNA, 16 bp, C. familiaris
attttgcaaatttaac

SEQ ID NO: 307811 - DNA, 16 bp, C. familiaris
attttgcagataaaaa

SEQ ID NO: 307812 - DNA, 16 bp, C. familiaris
attttgcatatatttt

SEQ ID NO: 307813 - DNA, 16 bp, C. familiaris
attttgcatattattt

SEQ ID NO: 307814 - DNA, 16 bp, C. familiaris
attttgcatctatatt

SEQ ID NO: 307815 - DNA, 16 bp, C. familiaris
attttgctgatatttt

SEQ ID NO: 307816 - DNA, 16 bp, C. familiaris
attttgctgattgttt

SEQ ID NO: 307817 - DNA, 16 bp, C. familiaris
attttgcttttaaaat

SEQ ID NO: 307818 - DNA, 16 bp, C. familiaris
attttggaaaaacaaa

SEQ ID NO: 307819 - DNA, 16 bp, C. familiaris
attttggaaaagaaaa

SEQ ID NO: 307820 - DNA, 16 bp, C. familiaris
attttggaaaagacaa

SEQ ID NO: 307821 - DNA, 16 bp, C. familiaris
attttggaaaaggcaa

SEQ ID NO: 307822 - DNA, 16 bp, C. familiaris
attttggaaagagaga

SEQ ID NO: 307823 - DNA, 16 bp, C. familiaris
attttggaaattataa

SEQ ID NO: 307824 - DNA, 16 bp, C. familiaris
attttggaaggaaaaa

SEQ ID NO: 307825 - DNA, 16 bp, C. familiaris
attttggactttccag

SEQ ID NO: 307826 - DNA, 38 bp, C. familiaris
attttggcaattacaacaatcaatcctcaaattttgga

SEQ ID NO: 307827 - DNA, 16 bp, C. familiaris
attttggcaattataa

SEQ ID NO: 307828 - DNA, 16 bp, C. familiaris
attttgggaaaaaaaa

SEQ ID NO: 307829 - DNA, 16 bp, C. familiaris
attttggggaaaaaaa

SEQ ID NO: 307830 - DNA, 16 bp, C. familiaris
attttggggtggagtc

SEQ ID NO: 307831 - DNA, 16 bp, C. familiaris
attttggttattgtga

SEQ ID NO: 307832 - DNA, 16 bp, C. familiaris
attttgtaatgataaa

SEQ ID NO: 307833 - DNA, 16 bp, C. familiaris
attttgtcaaatttat

SEQ ID NO: 307834 - DNA, 16 bp, C. familiaris
attttgtcaggtgctt

SEQ ID NO: 307835 - DNA, 16 bp, C. familiaris
attttgtctatccatt

SEQ ID NO: 307836 - DNA, 16 bp, C. familiaris
attttgtggaaaaaaa

SEQ ID NO: 307837 - DNA, 16 bp, C. familiaris
attttgtgtatctctt

SEQ ID NO: 307838 - DNA, 16 bp, C. familiaris
attttgttgaaattaa

SEQ ID NO: 307839 - DNA, 16 bp, C. familiaris
attttgttttcaaaat

SEQ ID NO: 307840 - DNA, 16 bp, C. familiaris
atttttaaaaagcaag

SEQ ID NO: 307841 - DNA, 16 bp, C. familiaris
atttttaaaaattcct

SEQ ID NO: 307842 - DNA, 16 bp, C. familiaris
atttttaaaactgtaa

SEQ ID NO: 307843 - DNA, 16 bp, C. familiaris
atttttaaaagcattt

SEQ ID NO: 307844 - DNA, 16 bp, C. familiaris
atttttaaaagccttt

SEQ ID NO: 307845 - DNA, 16 bp, C. familiaris
atttttaaagaatcaa

SEQ ID NO: 307846 - DNA, 16 bp, C. familiaris
atttttaaagatcttt

SEQ ID NO: 307847 - DNA, 16 bp, C. familiaris
atttttaaagcaaaat

SEQ ID NO: 307848 - DNA, 16 bp, C. familiaris
atttttaaagcacttt

SEQ ID NO: 307849 - DNA, 16 bp, C. familiaris
atttttaaaggaatca

SEQ ID NO: 307850 - DNA, 16 bp, C. familiaris
atttttaaaggtgaaa

SEQ ID NO: 307851 - DNA, 16 bp, C. familiaris
atttttaaatctgttt

SEQ ID NO: 307852 - DNA, 16 bp, C. familiaris
atttttaaatgtactt

SEQ ID NO: 307853 - DNA, 16 bp, C. familiaris
atttttaagaaatgaa

SEQ ID NO: 307854 - DNA, 16 bp, C. familiaris
atttttaagaagattt

SEQ ID NO: 307855 - DNA, 16 bp, C. familiaris
atttttaagaaggaaa

SEQ ID NO: 307856 - DNA, 16 bp, C. familiaris
atttttaagagtgaaa

SEQ ID NO: 307857 - DNA, 16 bp, C. familiaris
atttttaagtactctc

SEQ ID NO: 307858 - DNA, 16 bp, C. familiaris
atttttaagtgcttaa

SEQ ID NO: 307859 - DNA, 16 bp, C. familiaris
atttttacaaagattt

SEQ ID NO: 307860 - DNA, 16 bp, C. familiaris
atttttacagaaaaaa

SEQ ID NO: 307861 - DNA, 16 bp, C. familiaris
atttttacagaaatat

SEQ ID NO: 307862 - DNA, 16 bp, C. familiaris
atttttacagatattt

SEQ ID NO: 307863 - DNA, 16 bp, C. familiaris
atttttagaaacaaaa

SEQ ID NO: 307864 - DNA, 16 bp, C. familiaris
atttttagaaggaaaa

SEQ ID NO: 307865 - DNA, 16 bp, C. familiaris
atttttagatgaagaa

SEQ ID NO: 307866 - DNA, 16 bp, C. familiaris
atttttataaaaggaa

SEQ ID NO: 307867 - DNA, 16 bp, C. familiaris
atttttatagagattg

SEQ ID NO: 307868 - DNA, 16 bp, C. familiaris
atttttatagatgaag

SEQ ID NO: 307869 - DNA, 16 bp, C. familiaris
atttttatgaaaaaga

SEQ ID NO: 307870 - DNA, 16 bp, C. familiaris
atttttatgtgaaaat

SEQ ID NO: 307871 - DNA, 16 bp, C. familiaris
atttttattccccaaa

SEQ ID NO: 307872 - DNA, 16 bp, C. familiaris
atttttatttgcaaaa

SEQ ID NO: 307873 - DNA, 16 bp, C. familiaris
atttttcaaaagaaga

SEQ ID NO: 307874 - DNA, 16 bp, C. familiaris
atttttcaaaataatg

SEQ ID NO: 307875 - DNA, 16 bp, C. familiaris
atttttcaaaatcaaa

SEQ ID NO: 307876 - DNA, 16 bp, C. familiaris
atttttcaaaatgttt

SEQ ID NO: 307877 - DNA, 16 bp, C. familiaris
atttttcaaatagaaa

SEQ ID NO: 307878 - DNA, 16 bp, C. familiaris
atttttcaaattttga

SEQ ID NO: 307879 - DNA, 16 bp, C. familiaris
atttttcaagttaaaa

SEQ ID NO: 307880 - DNA, 16 bp, C. familiaris
atttttcacaaagaaa

SEQ ID NO: 307881 - DNA, 16 bp, C. familiaris
atttttcagagaacta

SEQ ID NO: 307882 - DNA, 16 bp, C. familiaris
atttttcagataaata

SEQ ID NO: 307883 - DNA, 16 bp, C. familiaris
atttttcagatgagga

SEQ ID NO: 307884 - DNA, 16 bp, C. familiaris
atttttcatgcatttt

SEQ ID NO: 307885 - DNA, 16 bp, C. familiaris
atttttcatggaaaat

SEQ ID NO: 307886 - DNA, 16 bp, C. familiaris
atttttcatgtgtctg

SEQ ID NO: 307887 - DNA, 16 bp, C. familiaris
atttttcattttgaaa

SEQ ID NO: 307888 - DNA, 16 bp, C. familiaris
atttttccaaggaaaa

SEQ ID NO: 307889 - DNA, 16 bp, C. familiaris
atttttccagagaaaa

SEQ ID NO: 307890 - DNA, 16 bp, C. familiaris
atttttccagcagcat

SEQ ID NO: 307891 - DNA, 16 bp, C. familiaris
atttttccatgtattt

SEQ ID NO: 307892 - DNA, 16 bp, C. familiaris
atttttcccaaagaag

SEQ ID NO: 307893 - DNA, 16 bp, C. familiaris
atttttcccactcctt

SEQ ID NO: 307894 - DNA, 16 bp, C. familiaris
atttttcctgaaaaat

SEQ ID NO: 307895 - DNA, 16 bp, C. familiaris
atttttcctttctaaa

SEQ ID NO: 307896 - DNA, 16 bp, C. familiaris
atttttctaaagaaaa

SEQ ID NO: 307897 - DNA, 16 bp, C. familiaris
atttttctaaagaaga

SEQ ID NO: 307898 - DNA, 16 bp, C. familiaris
atttttctaaggaaaa

SEQ ID NO: 307899 - DNA, 16 bp, C. familiaris
atttttctactttgta

SEQ ID NO: 307900 - DNA, 16 bp, C. familiaris
atttttctcattcagc

SEQ ID NO: 307901 - DNA, 16 bp, C. familiaris
atttttctccaaaata

SEQ ID NO: 307902 - DNA, 16 bp, C. familiaris
atttttctcctatgtt

SEQ ID NO: 307903 - DNA, 16 bp, C. familiaris
atttttctctacatcc

SEQ ID NO: 307904 - DNA, 16 bp, C. familiaris
atttttctgaaaagaa

SEQ ID NO: 307905 - DNA, 16 bp, C. familiaris
atttttctgaagaaaa

SEQ ID NO: 307906 - DNA, 16 bp, C. familiaris
atttttctgaagaaga

SEQ ID NO: 307907 - DNA, 16 bp, C. familiaris
atttttctgatgatga

SEQ ID NO: 307908 - DNA, 16 bp, C. familiaris
atttttcttccttaaa

SEQ ID NO: 307909 - DNA, 16 bp, C. familiaris
atttttcttcttgagg

SEQ ID NO: 307910 - DNA, 16 bp, C. familiaris
atttttgaaaaataca

SEQ ID NO: 307911 - DNA, 16 bp, C. familiaris
atttttgaatgaaaaa

SEQ ID NO: 307912 - DNA, 16 bp, C. familiaris
atttttgacaaagaag

SEQ ID NO: 307913 - DNA, 16 bp, C. familiaris
atttttgcatatattt

SEQ ID NO: 307914 - DNA, 16 bp, C. familiaris
atttttgcatatgtgt

SEQ ID NO: 307915 - DNA, 16 bp, C. familiaris
atttttgccattattt

SEQ ID NO: 307916 - DNA, 16 bp, C. familiaris
atttttggattcagtt

SEQ ID NO: 307917 - DNA, 16 bp, C. familiaris
atttttgtgccaatac

SEQ ID NO: 307918 - DNA, 16 bp, C. familiaris
atttttgtgccattac

SEQ ID NO: 307919 - DNA, 16 bp, C. familiaris
atttttgtggaaaaaa

SEQ ID NO: 307920 - DNA, 16 bp, C. familiaris
atttttgttttcaaat

SEQ ID NO: 307921 - DNA, 16 bp, C. familiaris
attttttaaagttctt

SEQ ID NO: 307922 - DNA, 16 bp, C. familiaris
attttttaaatgaaga

SEQ ID NO: 307923 - DNA, 16 bp, C. familiaris
attttttaaatgcctt

SEQ ID NO: 307924 - DNA, 16 bp, C. familiaris
attttttaaatggtaa

SEQ ID NO: 307925 - DNA, 16 bp, C. familiaris
attttttagaagaaaa

SEQ ID NO: 307926 - DNA, 16 bp, C. familiaris
attttttattggatgc

SEQ ID NO: 307927 - DNA, 16 bp, C. familiaris
attttttcaaaacaaa

SEQ ID NO: 307928 - DNA, 16 bp, C. familiaris
attttttcatgattca

SEQ ID NO: 307929 - DNA, 16 bp, C. familiaris
attttttcatttgaaa

SEQ ID NO: 307930 - DNA, 16 bp, C. familiaris
attttttccagattgc

SEQ ID NO: 307931 - DNA, 16 bp, C. familiaris
attttttccccttgtt

SEQ ID NO: 307932 - DNA, 16 bp, C. familiaris
attttttgaagaaatt

SEQ ID NO: 307933 - DNA, 16 bp, C. familiaris
attttttgagaaaact

SEQ ID NO: 307934 - DNA, 16 bp, C. familiaris
atttttttaaggcaaa

SEQ ID NO: 307935 - DNA, 16 bp, C. familiaris
atttttttcataaaca

SEQ ID NO: 307936 - DNA, 16 bp, C. familiaris
atttttttctccaaag

SEQ ID NO: 307937 - DNA, 16 bp, C. familiaris
atttttttctgcatct

SEQ ID NO: 307938 - DNA, 16 bp, C. familiaris
atttttttgaagaaat

SEQ ID NO: 307939 - DNA, 16 bp, C. familiaris
attttttttcaaatgt

SEQ ID NO: 307940 - DNA, 16 bp, C. familiaris
caaaaaaattgaatca

SEQ ID NO: 307941 - DNA, 16 bp, C. familiaris
caaaaaattggaagaa

SEQ ID NO: 307942 - DNA, 16 bp, C. familiaris
caaaaacagacacatc

SEQ ID NO: 307943 - DNA, 16 bp, C. familiaris
caaaaacagactcata

SEQ ID NO: 307944 - DNA, 16 bp, C. familiaris
caaaaacaggcagtgg

SEQ ID NO: 307945 - DNA, 16 bp, C. familiaris
caaaaacattttttaa

SEQ ID NO: 307946 - DNA, 16 bp, C. familiaris
caaaaaccaagagttg

SEQ ID NO: 307947 - DNA, 16 bp, C. familiaris
caaaaaccagggagga

SEQ ID NO: 307948 - DNA, 16 bp, C. familiaris
caaaaactgggaagaa

SEQ ID NO: 307949 - DNA, 16 bp, C. familiaris
caaaaacttgaaaata

SEQ ID NO: 307950 - DNA, 16 bp, C. familiaris
caaaaagacaagaagt

SEQ ID NO: 307951 - DNA, 16 bp, C. familiaris
caaaaagatatatgta

SEQ ID NO: 307952 - DNA, 16 bp, C. familiaris
caaaaagatgagaaat

SEQ ID NO: 307953 - DNA, 16 bp, C. familiaris
caaaaagcatatgaaa

SEQ ID NO: 307954 - DNA, 16 bp, C. familiaris
caaaaagttaaaaatg

SEQ ID NO: 307955 - DNA, 16 bp, C. familiaris
caaaaagttaaagata

SEQ ID NO: 307956 - DNA, 16 bp, C. familiaris
caaaaatatttccttt

SEQ ID NO: 307957 - DNA, 16 bp, C. familiaris
caaaaatattttgatt

SEQ ID NO: 307958 - DNA, 16 bp, C. familiaris
caaaaatcaactgaaa

SEQ ID NO: 307959 - DNA, 16 bp, C. familiaris
caaaaatcctcaagaa

SEQ ID NO: 307960 - DNA, 16 bp, C. familiaris
caaaaatggaaagata

SEQ ID NO: 307961 - DNA, 16 bp, C. familiaris
caaaaatgtctcaaga

SEQ ID NO: 307962 - DNA, 16 bp, C. familiaris
caaaaatgtttccaga

SEQ ID NO: 307963 - DNA, 16 bp, C. familiaris
caaaaattaactgaaa

SEQ ID NO: 307964 - DNA, 16 bp, C. familiaris
caaaaattctcaagaa

SEQ ID NO: 307965 - DNA, 16 bp, C. familiaris
caaaaatttattttct

SEQ ID NO: 307966 - DNA, 16 bp, C. familiaris
caaaacaaaaaacctg

SEQ ID NO: 307967 - DNA, 16 bp, C. familiaris
caaaacaaaacagtct

SEQ ID NO: 307968 - DNA, 16 bp, C. familiaris
caaaacaaaactctgt

SEQ ID NO: 307969 - DNA, 16 bp, C. familiaris
caaaacaattttggaa

SEQ ID NO: 307970 - DNA, 16 bp, C. familiaris
caaaacagaaacagat

SEQ ID NO: 307971 - DNA, 16 bp, C. familiaris
caaaacagacaaaatc

SEQ ID NO: 307972 - DNA, 16 bp, C. familiaris
caaaacagacaaaatt

SEQ ID NO: 307973 - DNA, 16 bp, C. familiaris
caaaacagattttttt

SEQ ID NO: 307974 - DNA, 16 bp, C. familiaris
caaaacatgaaagact

SEQ ID NO: 307975 - DNA, 16 bp, C. familiaris
caaaaccaatgtcaag

SEQ ID NO: 307976 - DNA, 16 bp, C. familiaris
caaaactaaaggacaa

SEQ ID NO: 307977 - DNA, 16 bp, C. familiaris
caaaactataaagaca

SEQ ID NO: 307978 - DNA, 16 bp, C. familiaris
caaaactatagaacac

SEQ ID NO: 307979 - DNA, 16 bp, C. familiaris
caaaactgacaaacct

SEQ ID NO: 307980 - DNA, 16 bp, C. familiaris
caaaactgatgaacat

SEQ ID NO: 307981 - DNA, 16 bp, C. familiaris
caaaactggaacaaga

SEQ ID NO: 307982 - DNA, 16 bp, C. familiaris
caaaactggaacagaa

SEQ ID NO: 307983 - DNA, 16 bp, C. familiaris
caaaactgttttggct

SEQ ID NO: 307984 - DNA, 16 bp, C. familiaris
caaaagaaaactggag

SEQ ID NO: 307985 - DNA, 16 bp, C. familiaris
caaaagaaagctgaag

SEQ ID NO: 307986 - DNA, 16 bp, C. familiaris
caaaagaaaggaaatt

SEQ ID NO: 307987 - DNA, 16 bp, C. familiaris
caaaagaaatatttga

SEQ ID NO: 307988 - DNA, 16 bp, C. familiaris
caaaagaaattgagga

SEQ ID NO: 307989 - DNA, 16 bp, C. familiaris
caaaagaatgaaattt

SEQ ID NO: 307990 - DNA, 16 bp, C. familiaris
caaaagaatgaatttg

SEQ ID NO: 307991 - DNA, 16 bp, C. familiaris
caaaagatgttttaaa

SEQ ID NO: 307992 - DNA, 16 bp, C. familiaris
caaaagatttgaagag

SEQ ID NO: 307993 - DNA, 16 bp, C. familiaris
caaaagcaaaaatact

SEQ ID NO: 307994 - DNA, 16 bp, C. familiaris
caaaagcaataatgaa

SEQ ID NO: 307995 - DNA, 16 bp, C. familiaris
caaaagcagatgcttc

SEQ ID NO: 307996 - DNA, 16 bp, C. familiaris
caaaagcagggggagc

SEQ ID NO: 307997 - DNA, 16 bp, C. familiaris
caaaagcatttttcac

SEQ ID NO: 307998 - DNA, 16 bp, C. familiaris
caaaagctagaaatga

SEQ ID NO: 307999 - DNA, 16 bp, C. familiaris
caaaagcttttatttt

SEQ ID NO: 308000 - DNA, 16 bp, C. familiaris
caaaaggaaatgagaa

SEQ ID NO: 308001 - DNA, 16 bp, C. familiaris
caaaagtgaaattgct

SEQ ID NO: 308002 - DNA, 16 bp, C. familiaris
caaaagttgcatgctc

SEQ ID NO: 308003 - DNA, 16 bp, C. familiaris
caaaataaaaagtttt

SEQ ID NO: 308004 - DNA, 16 bp, C. familiaris
caaaataaaagcttct

SEQ ID NO: 308005 - DNA, 16 bp, C. familiaris
caaaataaagaatttt

SEQ ID NO: 308006 - DNA, 16 bp, C. familiaris
caaaataaagatattt

SEQ ID NO: 308007 - DNA, 16 bp, C. familiaris
caaaataatattgaaa

SEQ ID NO: 308008 - DNA, 16 bp, C. familiaris
caaaataatgttttta

SEQ ID NO: 308009 - DNA, 16 bp, C. familiaris
caaaataattccattt

SEQ ID NO: 308010 - DNA, 16 bp, C. familiaris
caaaataatttgtttt

SEQ ID NO: 308011 - DNA, 16 bp, C. familiaris
caaaatacatgaagaa

SEQ ID NO: 308012 - DNA, 16 bp, C. familiaris
caaaatacattcagaa

SEQ ID NO: 308013 - DNA, 16 bp, C. familiaris
caaaataccagagact

SEQ ID NO: 308014 - DNA, 16 bp, C. familiaris
caaaataccagcagca

SEQ ID NO: 308015 - DNA, 16 bp, C. familiaris
caaaatagcaacagca

SEQ ID NO: 308016 - DNA, 16 bp, C. familiaris
caaaatagttttttaa

SEQ ID NO: 308017 - DNA, 16 bp, C. familiaris
caaaatatataaagca

SEQ ID NO: 308018 - DNA, 16 bp, C. familiaris
caaaatatatgaagag

SEQ ID NO: 308019 - DNA, 16 bp, C. familiaris
caaaatatggaaaaag

SEQ ID NO: 308020 - DNA, 16 bp, C. familiaris
caaaatattatttcaa

SEQ ID NO: 308021 - DNA, 16 bp, C. familiaris
caaaatattgaaagaa

SEQ ID NO: 308022 - DNA, 16 bp, C. familiaris
caaaatatttgaagat

SEQ ID NO: 308023 - DNA, 16 bp, C. familiaris
caaaatattttacttt

SEQ ID NO: 308024 - DNA, 16 bp, C. familiaris
caaaatcaagagtaga

SEQ ID NO: 308025 - DNA, 16 bp, C. familiaris
caaaatcaatgcccaa

SEQ ID NO: 308026 - DNA, 16 bp, C. familiaris
caaaatcagaaaagga

SEQ ID NO: 308027 - DNA, 16 bp, C. familiaris
caaaatcagaaatgaa

SEQ ID NO: 308028 - DNA, 16 bp, C. familiaris
caaaatcagagaggaa

SEQ ID NO: 308029 - DNA, 16 bp, C. familiaris
caaaatctggattata

SEQ ID NO: 308030 - DNA, 129 bp, C. familiaris
caaaatctttgggatgcagcaaaagcagtcctaagggggaaatacatcgcaatacaagcatccattcaaaaactggaaagaactcaaatacaaaagctaaccttacacataaaggagctagagaaaaaa

SEQ ID NO: 308031 - DNA, 16 bp, C. familiaris
caaaatgaactttaaa

SEQ ID NO: 308032 - DNA, 16 bp, C. familiaris
caaaatgaagagttgg

SEQ ID NO: 308033 - DNA, 16 bp, C. familiaris
caaaatgaataatcca

SEQ ID NO: 308034 - DNA, 16 bp, C. familiaris
caaaatgatgaaagat

SEQ ID NO: 308035 - DNA, 16 bp, C. familiaris
caaaatgctatttttt

SEQ ID NO: 308036 - DNA, 16 bp, C. familiaris
caaaatggacgaaaga

SEQ ID NO: 308037 - DNA, 16 bp, C. familiaris
caaaatggatgaagga

SEQ ID NO: 308038 - DNA, 16 bp, C. familiaris
caaaatggtgtagcca

SEQ ID NO: 308039 - DNA, 16 bp, C. familiaris
caaaatgtaaaatgta

SEQ ID NO: 308040 - DNA, 16 bp, C. familiaris
caaaatgtataaggaa

SEQ ID NO: 308041 - DNA, 16 bp, C. familiaris
caaaatgtattatttt

SEQ ID NO: 308042 - DNA, 16 bp, C. familiaris
caaaatgtcaacagtg

SEQ ID NO: 308043 - DNA, 16 bp, C. familiaris
caaaatgtggaaagag

SEQ ID NO: 308044 - DNA, 16 bp, C. familiaris
caaaattaaaaatgtt

SEQ ID NO: 308045 - DNA, 16 bp, C. familiaris
caaaattaaacatttt

SEQ ID NO: 308046 - DNA, 16 bp, C. familiaris
caaaattaaactattt

SEQ ID NO: 308047 - DNA, 16 bp, C. familiaris
caaaattaagaatttt

SEQ ID NO: 308048 - DNA, 16 bp, C. familiaris
caaaattaatgaaaga

SEQ ID NO: 308049 - DNA, 16 bp, C. familiaris
caaaattatagagaca

SEQ ID NO: 308050 - DNA, 16 bp, C. familiaris
caaaattatgaaaata

SEQ ID NO: 308051 - DNA, 16 bp, C. familiaris
caaaattcaacacctt

SEQ ID NO: 308052 - DNA, 16 bp, C. familiaris
caaaattcaactgaat

SEQ ID NO: 308053 - DNA, 16 bp, C. familiaris
caaaattgagaagaag

SEQ ID NO: 308054 - DNA, 16 bp, C. familiaris
caaaattttagcaaac

SEQ ID NO: 308055 - DNA, 16 bp, C. familiaris
caaacactgcccacaa

SEQ ID NO: 308056 - DNA, 16 bp, C. familiaris
caaacagacagacaga

SEQ ID NO: 308057 - DNA, 16 bp, C. familiaris
caaacagggatgcctg

SEQ ID NO: 308058 - DNA, 16 bp, C. familiaris
caaacatcctcaacaa

SEQ ID NO: 308059 - DNA, 16 bp, C. familiaris
caaacatttaaaaaag

SEQ ID NO: 308060 - DNA, 16 bp, C. familiaris
caaacatttattattt

SEQ ID NO: 308061 - DNA, 16 bp, C. familiaris
caaaccaaggagagag

SEQ ID NO: 308062 - DNA, 16 bp, C. familiaris
caaaccagccctacaa

SEQ ID NO: 308063 - DNA, 16 bp, C. familiaris
caaaccatcttccaaa

SEQ ID NO: 308064 - DNA, 16 bp, C. familiaris
caaaccctgctgctgc

SEQ ID NO: 308065 - DNA, 16 bp, C. familiaris
caaactaccaacactg

SEQ ID NO: 308066 - DNA, 16 bp, C. familiaris
caaactcatgactctg

SEQ ID NO: 308067 - DNA, 16 bp, C. familiaris
caaactcattctacaa

SEQ ID NO: 308068 - DNA, 17 bp, C. familiaris
caaactctccctctttg

SEQ ID NO: 308069 - DNA, 16 bp, C. familiaris
caaactgagggacatt

SEQ ID NO: 308070 - DNA, 16 bp, C. familiaris
caaactgctgagccac

SEQ ID NO: 308071 - DNA, 16 bp, C. familiaris
caaactggaaaggaag

SEQ ID NO: 308072 - DNA, 16 bp, C. familiaris
caaactggataaaaaa

SEQ ID NO: 308073 - DNA, 16 bp, C. familiaris
caaactgtgagaaaat

SEQ ID NO: 308074 - DNA, 16 bp, C. familiaris
caaactgtggaagaag

SEQ ID NO: 308075 - DNA, 16 bp, C. familiaris
caaacttgaaaaagaa

SEQ ID NO: 308076 - DNA, 16 bp, C. familiaris
caaacttgtgcagcca

SEQ ID NO: 308077 - DNA, 16 bp, C. familiaris
caaacttttcattatt

SEQ ID NO: 308078 - DNA, 16 bp, C. familiaris
caaagaaaattccagg

SEQ ID NO: 308079 - DNA, 16 bp, C. familiaris
caaagaaaattttaaa

SEQ ID NO: 308080 - DNA, 16 bp, C. familiaris
caaagaaacaactttt

SEQ ID NO: 308081 - DNA, 16 bp, C. familiaris
caaagaaacagctctt

SEQ ID NO: 308082 - DNA, 16 bp, C. familiaris
caaagaaagtgaaaac

SEQ ID NO: 308083 - DNA, 16 bp, C. familiaris
caaagaaataatccac

SEQ ID NO: 308084 - DNA, 16 bp, C. familiaris
caaagaaatatttttt

SEQ ID NO: 308085 - DNA, 16 bp, C. familiaris
caaagaaatctacaga

SEQ ID NO: 308086 - DNA, 16 bp, C. familiaris
caaagaaatcttgaga

SEQ ID NO: 308087 - DNA, 16 bp, C. familiaris
caaagaaatgaaagac

SEQ ID NO: 308088 - DNA, 16 bp, C. familiaris
caaagaaatggaaaga

SEQ ID NO: 308089 - DNA, 16 bp, C. familiaris
caaagaaattgaaaac

SEQ ID NO: 308090 - DNA, 16 bp, C. familiaris
caaagaaccatctcct

SEQ ID NO: 308091 - DNA, 16 bp, C. familiaris
caaagaacttttgttt

SEQ ID NO: 308092 - DNA, 16 bp, C. familiaris
caaagaagaaatggaa

SEQ ID NO: 308093 - DNA, 16 bp, C. familiaris
caaagaagaactcaaa

SEQ ID NO: 308094 - DNA, 16 bp, C. familiaris
caaagaagacatcaaa

SEQ ID NO: 308095 - DNA, 16 bp, C. familiaris
caaagaagcaaacaat

SEQ ID NO: 308096 - DNA, 16 bp, C. familiaris
caaagaagttgaaaat

SEQ ID NO: 308097 - DNA, 16 bp, C. familiaris
caaagaatacatacag

SEQ ID NO: 308098 - DNA, 16 bp, C. familiaris
caaagaatattttttt

SEQ ID NO: 308099 - DNA, 16 bp, C. familiaris
caaagaatgaaattgg

SEQ ID NO: 308100 - DNA, 16 bp, C. familiaris
caaagaatgaagaggt

SEQ ID NO: 308101 - DNA, 16 bp, C. familiaris
caaagaattattaaaa

SEQ ID NO: 308102 - DNA, 16 bp, C. familiaris
caaagacacaagcaga

SEQ ID NO: 308103 - DNA, 16 bp, C. familiaris
caaagacagacattca

SEQ ID NO: 308104 - DNA, 16 bp, C. familiaris
caaagacatctccaga

SEQ ID NO: 308105 - DNA, 16 bp, C. familiaris
caaagaccaaatgtat

SEQ ID NO: 308106 - DNA, 16 bp, C. familiaris
caaagacctgaaggag

SEQ ID NO: 308107 - DNA, 16 bp, C. familiaris
caaagactccatcaaa

SEQ ID NO: 308108 - DNA, 16 bp, C. familiaris
caaagactgtaacaaa

SEQ ID NO: 308109 - DNA, 16 bp, C. familiaris
caaagactgtaagaag

SEQ ID NO: 308110 - DNA, 16 bp, C. familiaris
caaagactttattttt

SEQ ID NO: 308111 - DNA, 16 bp, C. familiaris
caaagagaaaattctg

SEQ ID NO: 308112 - DNA, 16 bp, C. familiaris
caaagagatggaaaat

SEQ ID NO: 308113 - DNA, 16 bp, C. familiaris
caaagagctaaaggaa

SEQ ID NO: 308114 - DNA, 16 bp, C. familiaris
caaagaggtaaaggat

SEQ ID NO: 308115 - DNA, 16 bp, C. familiaris
caaagagtacaaactt

SEQ ID NO: 308116 - DNA, 16 bp, C. familiaris
caaagagttaataata

SEQ ID NO: 308117 - DNA, 16 bp, C. familiaris
caaagataaaactcaa

SEQ ID NO: 308118 - DNA, 16 bp, C. familiaris
caaagatcaagagttg

SEQ ID NO: 308119 - DNA, 16 bp, C. familiaris
caaagatctttatttt

SEQ ID NO: 308120 - DNA, 16 bp, C. familiaris
caaagatgaaacattt

SEQ ID NO: 308121 - DNA, 16 bp, C. familiaris
caaagatgacatccag

SEQ ID NO: 308122 - DNA, 16 bp, C. familiaris
caaagatgcagagaaa

SEQ ID NO: 308123 - DNA, 16 bp, C. familiaris
caaagatgtaaaagat

SEQ ID NO: 308124 - DNA, 16 bp, C. familiaris
caaagatgtgaagaaa

SEQ ID NO: 308125 - DNA, 16 bp, C. familiaris
caaagatgtggagaga

SEQ ID NO: 308126 - DNA, 29 bp, C. familiaris
caaagcaaaggctttgaaagctaagaaag

SEQ ID NO: 308127 - DNA, 16 bp, C. familiaris
caaagcaatttacaaa

SEQ ID NO: 308128 - DNA, 16 bp, C. familiaris
caaagcagcagaaaga

SEQ ID NO: 308129 - DNA, 16 bp, C. familiaris
caaagcatttcttttt

SEQ ID NO: 308130 - DNA, 16 bp, C. familiaris
caaagcatttttttaa

SEQ ID NO: 308131 - DNA, 16 bp, C. familiaris
caaagccaaaggcaga

SEQ ID NO: 308132 - DNA, 16 bp, C. familiaris
caaagccagacaaaga

SEQ ID NO: 308133 - DNA, 16 bp, C. familiaris
caaagcctttgtttcc

SEQ ID NO: 308134 - DNA, 16 bp, C. familiaris
caaagctgaaacagga

SEQ ID NO: 308135 - DNA, 16 bp, C. familiaris
caaagctgtcatcatc

SEQ ID NO: 308136 - DNA, 16 bp, C. familiaris
caaagctgtgatcacc

SEQ ID NO: 308137 - DNA, 16 bp, C. familiaris
caaaggaaacaaaact

SEQ ID NO: 308138 - DNA, 16 bp, C. familiaris
caaaggaaacaattga

SEQ ID NO: 308139 - DNA, 16 bp, C. familiaris
caaaggaaatcagaaa

SEQ ID NO: 308140 - DNA, 16 bp, C. familiaris
caaaggaactacaaaa

SEQ ID NO: 308141 - DNA, 16 bp, C. familiaris
caaaggacatcatcaa

SEQ ID NO: 308142 - DNA, 16 bp, C. familiaris
caaaggacattgtggc

SEQ ID NO: 308143 - DNA, 16 bp, C. familiaris
caaaggagaaaaatca

SEQ ID NO: 308144 - DNA, 16 bp, C. familiaris
caaaggagaaatcaca

SEQ ID NO: 308145 - DNA, 16 bp, C. familiaris
caaaggaggcaaggat

SEQ ID NO: 308146 - DNA, 16 bp, C. familiaris
caaaggatacagtcac

SEQ ID NO: 308147 - DNA, 16 bp, C. familiaris
caaaggcagaagctga

SEQ ID NO: 308148 - DNA, 16 bp, C. familiaris
caaaggcagacatcca

SEQ ID NO: 308149 - DNA, 16 bp, C. familiaris
caaaggcagagatgct

SEQ ID NO: 308150 - DNA, 16 bp, C. familiaris
caaaggcaggggctta

SEQ ID NO: 308151 - DNA, 16 bp, C. familiaris
caaaggcaggtgccca

SEQ ID NO: 308152 - DNA, 16 bp, C. familiaris
caaaggcatacactta

SEQ ID NO: 308153 - DNA, 16 bp, C. familiaris
caaaggcggcgccaaa

SEQ ID NO: 308154 - DNA, 16 bp, C. familiaris
caaaggctccatctcc

SEQ ID NO: 308155 - DNA, 16 bp, C. familiaris
caaaggctctgagaag

SEQ ID NO: 308156 - DNA, 16 bp, C. familiaris
caaagggagaaccagg

SEQ ID NO: 308157 - DNA, 16 bp, C. familiaris
caaagggagaagctgg

SEQ ID NO: 308158 - DNA, 16 bp, C. familiaris
caaagggagatgctca

SEQ ID NO: 308159 - DNA, 16 bp, C. familiaris
caaagtaatggaaagt

SEQ ID NO: 308160 - DNA, 16 bp, C. familiaris
caaagtcaacacacaa

SEQ ID NO: 308161 - DNA, 16 bp, C. familiaris
caaagtcacacagctg

SEQ ID NO: 308162 - DNA, 16 bp, C. familiaris
caaagtcatccatgac

SEQ ID NO: 308163 - DNA, 16 bp, C. familiaris
caaagttagtagaaag

SEQ ID NO: 308164 - DNA, 16 bp, C. familiaris
caaagtttctactgaa

SEQ ID NO: 308165 - DNA, 16 bp, C. familiaris
caaataaactctttaa

SEQ ID NO: 308166 - DNA, 16 bp, C. familiaris
caaataaatctttatt

SEQ ID NO: 308167 - DNA, 16 bp, C. familiaris
caaataaatgagaaca

SEQ ID NO: 308168 - DNA, 16 bp, C. familiaris
caaataaattacattt

SEQ ID NO: 308169 - DNA, 16 bp, C. familiaris
caaataaggaaaatga

SEQ ID NO: 308170 - DNA, 16 bp, C. familiaris
caaatacatgaaacaa

SEQ ID NO: 308171 - DNA, 16 bp, C. familiaris
caaatacattttctgt

SEQ ID NO: 308172 - DNA, 16 bp, C. familiaris
caaatactgtattatt

SEQ ID NO: 308173 - DNA, 16 bp, C. familiaris
caaatacttactgagc

SEQ ID NO: 308174 - DNA, 16 bp, C. familiaris
caaatatatgaaaaga

SEQ ID NO: 308175 - DNA, 16 bp, C. familiaris
caaatatcttttccca

SEQ ID NO: 308176 - DNA, 16 bp, C. familiaris
caaatatttatgaaca

SEQ ID NO: 308177 - DNA, 16 bp, C. familiaris
caaatattttcttcta

SEQ ID NO: 308178 - DNA, 16 bp, C. familiaris
caaatcaaactccagt

SEQ ID NO: 308179 - DNA, 16 bp, C. familiaris
caaatcactaaattct

SEQ ID NO: 308180 - DNA, 16 bp, C. familiaris
caaatcatgagagact

SEQ ID NO: 308181 - DNA, 16 bp, C. familiaris
caaatcatttttcttt

SEQ ID NO: 308182 - DNA, 16 bp, C. familiaris
caaatccaaaccacag

SEQ ID NO: 308183 - DNA, 16 bp, C. familiaris
caaatccccaccattt

SEQ ID NO: 308184 - DNA, 16 bp, C. familiaris
caaatcctttgcccat

SEQ ID NO: 308185 - DNA, 16 bp, C. familiaris
caaatgaaaataggaa

SEQ ID NO: 308186 - DNA, 16 bp, C. familiaris
caaatgaaaatgaaga

SEQ ID NO: 308187 - DNA, 16 bp, C. familiaris
caaatgaaagtggaaa

SEQ ID NO: 308188 - DNA, 16 bp, C. familiaris
caaatgaatgagaaga

SEQ ID NO: 308189 - DNA, 16 bp, C. familiaris
caaatgaatgagaata

SEQ ID NO: 308190 - DNA, 16 bp, C. familiaris
caaatgaatgaggcca

SEQ ID NO: 308191 - DNA, 16 bp, C. familiaris
caaatgacatgatctt

SEQ ID NO: 308192 - DNA, 16 bp, C. familiaris
caaatgagtgaaatca

SEQ ID NO: 308193 - DNA, 16 bp, C. familiaris
caaatgatttcatttt

SEQ ID NO: 308194 - DNA, 16 bp, C. familiaris
caaatgcttttctgta

SEQ ID NO: 308195 - DNA, 16 bp, C. familiaris
caaatggaaagatttt

SEQ ID NO: 308196 - DNA, 16 bp, C. familiaris
caaatgggattatttt

SEQ ID NO: 308197 - DNA, 16 bp, C. familiaris
caaatgtaccactctg

SEQ ID NO: 308198 - DNA, 16 bp, C. familiaris
caaatgtattattttt

SEQ ID NO: 308199 - DNA, 16 bp, C. familiaris
caaattatgaaaacag

SEQ ID NO: 308200 - DNA, 16 bp, C. familiaris
caaattatggaaataa

SEQ ID NO: 308201 - DNA, 16 bp, C. familiaris
caaattcaacacccaa

SEQ ID NO: 308202 - DNA, 16 bp, C. familiaris
caaattcattttatga

SEQ ID NO: 308203 - DNA, 16 bp, C. familiaris
caaattccttgaaaga

SEQ ID NO: 308204 - DNA, 16 bp, C. familiaris
caaattgaggaagttc

SEQ ID NO: 308205 - DNA, 16 bp, C. familiaris
caaattggccaagaag

SEQ ID NO: 308206 - DNA, 16 bp, C. familiaris
caaattgttttccaaa

SEQ ID NO: 308207 - DNA, 16 bp, C. familiaris
caaatttaaaagaata

SEQ ID NO: 308208 - DNA, 16 bp, C. familiaris
caaatttatctttaaa

SEQ ID NO: 308209 - DNA, 16 bp, C. familiaris
caaatttgacctgaga

SEQ ID NO: 308210 - DNA, 16 bp, C. familiaris
caaattttctgaaaaa

SEQ ID NO: 308211 - DNA, 16 bp, C. familiaris
caaattttgaaatttt

SEQ ID NO: 308212 - DNA, 16 bp, C. familiaris
caacaaaaaggagaat

SEQ ID NO: 308213 - DNA, 16 bp, C. familiaris
caacaaaagtgaaaat

SEQ ID NO: 308214 - DNA, 16 bp, C. familiaris
caacaaaccatgaaag

SEQ ID NO: 308215 - DNA, 16 bp, C. familiaris
caacaaagtactagaa

SEQ ID NO: 308216 - DNA, 16 bp, C. familiaris
caacaaagtgaaaaga

SEQ ID NO: 308217 - DNA, 16 bp, C. familiaris
caacaaatatttttga

SEQ ID NO: 308218 - DNA, 16 bp, C. familiaris
caacaaatggtgttgt

SEQ ID NO: 308219 - DNA, 16 bp, C. familiaris
caacaaatgttgctgg

SEQ ID NO: 308220 - DNA, 16 bp, C. familiaris
caacaaattcaagaag

SEQ ID NO: 308221 - DNA, 16 bp, C. familiaris
caacaaatttgacaac

SEQ ID NO: 308222 - DNA, 16 bp, C. familiaris
caacaacaacagcagc

SEQ ID NO: 308223 - DNA, 16 bp, C. familiaris
caacaagactaaaaga

SEQ ID NO: 308224 - DNA, 35 bp, C. familiaris
caacaagaggacttaacaatcctcaatatatatgc

SEQ ID NO: 308225 - DNA, 16 bp, C. familiaris
caacaagcacaggaga

SEQ ID NO: 308226 - DNA, 16 bp, C. familiaris
caacaaggatgccaag

SEQ ID NO: 308227 - DNA, 16 bp, C. familiaris
caacaaggctatcatt

SEQ ID NO: 308228 - DNA, 16 bp, C. familiaris
caacaataaccaaatt

SEQ ID NO: 308229 - DNA, 16 bp, C. familiaris
caacaattccactcct

SEQ ID NO: 308230 - DNA, 16 bp, C. familiaris
caacaattccacttct

SEQ ID NO: 308231 - DNA, 16 bp, C. familiaris
caacacaaatttatca

SEQ ID NO: 308232 - DNA, 16 bp, C. familiaris
caacacagggcttcat

SEQ ID NO: 308233 - DNA, 16 bp, C. familiaris
caacacattaaaagaa

SEQ ID NO: 308234 - DNA, 16 bp, C. familiaris
caacaccaagagtcag

SEQ ID NO: 308235 - DNA, 16 bp, C. familiaris
caacaccaagatcaag

SEQ ID NO: 308236 - DNA, 16 bp, C. familiaris
caacaccatcaagcat

SEQ ID NO: 308237 - DNA, 16 bp, C. familiaris
caacacctgctgtttc

SEQ ID NO: 308238 - DNA, 16 bp, C. familiaris
caacacggcactttct

SEQ ID NO: 308239 - DNA, 16 bp, C. familiaris
caacactctttttgaa

SEQ ID NO: 308240 - DNA, 16 bp, C. familiaris
caacactggaaagttc

SEQ ID NO: 308241 - DNA, 16 bp, C. familiaris
caacagaaccacccag

SEQ ID NO: 308242 - DNA, 16 bp, C. familiaris
caacagacaaatgaaa

SEQ ID NO: 308243 - DNA, 16 bp, C. familiaris
caacagcaacaacagc

SEQ ID NO: 308244 - DNA, 16 bp, C. familiaris
caacagcacaggcccc

SEQ ID NO: 308245 - DNA, 16 bp, C. familiaris
caacagcagcagcagc

SEQ ID NO: 308246 - DNA, 16 bp, C. familiaris
caacagcatggatgaa

SEQ ID NO: 308247 - DNA, 16 bp, C. familiaris
caacagccctgtgagg

SEQ ID NO: 308248 - DNA, 16 bp, C. familiaris
caacaggaagatataa

SEQ ID NO: 308249 - DNA, 16 bp, C. familiaris
caacaggagagggaga

SEQ ID NO: 308250 - DNA, 16 bp, C. familiaris
caacaggcctctcccc

SEQ ID NO: 308251 - DNA, 16 bp, C. familiaris
caacagggcagcctgg

SEQ ID NO: 308252 - DNA, 16 bp, C. familiaris
caacagggggatccct

SEQ ID NO: 308253 - DNA, 16 bp, C. familiaris
caacagtacattaaag

SEQ ID NO: 308254 - DNA, 16 bp, C. familiaris
caacagtgcaggagga

SEQ ID NO: 308255 - DNA, 16 bp, C. familiaris
caacagtgtacaagag

SEQ ID NO: 308256 - DNA, 16 bp, C. familiaris
caacatacagaatggg

SEQ ID NO: 308257 - DNA, 16 bp, C. familiaris
caacatcagcatcacc

SEQ ID NO: 308258 - DNA, 16 bp, C. familiaris
caacatccaaagaaca

SEQ ID NO: 308259 - DNA, 16 bp, C. familiaris
caacatccccaaagaa

SEQ ID NO: 308260 - DNA, 16 bp, C. familiaris
caacatctattgtttc

SEQ ID NO: 308261 - DNA, 16 bp, C. familiaris
caacatgaatgaatct

SEQ ID NO: 308262 - DNA, 16 bp, C. familiaris
caacatgcagaagaat

SEQ ID NO: 308263 - DNA, 16 bp, C. familiaris
caacatgggactggat

SEQ ID NO: 308264 - DNA, 16 bp, C. familiaris
caacattttcatcaac

SEQ ID NO: 308265 - DNA, 16 bp, C. familiaris
caaccaaagaggtaaa

SEQ ID NO: 308266 - DNA, 16 bp, C. familiaris
caaccaatatttgaca

SEQ ID NO: 308267 - DNA, 16 bp, C. familiaris
caaccacagtggcagc

SEQ ID NO: 308268 - DNA, 16 bp, C. familiaris
caaccacgtgcagaag

SEQ ID NO: 308269 - DNA, 16 bp, C. familiaris
caaccactgagccctc

SEQ ID NO: 308270 - DNA, 16 bp, C. familiaris
caaccactgatctgct

SEQ ID NO: 308271 - DNA, 16 bp, C. familiaris
caaccagccccatcct

SEQ ID NO: 308272 - DNA, 16 bp, C. familiaris
caaccatgagaaagaa

SEQ ID NO: 308273 - DNA, 16 bp, C. familiaris
caaccattctggaaaa

SEQ ID NO: 308274 - DNA, 16 bp, C. familiaris
caaccattttggaaaa

SEQ ID NO: 308275 - DNA, 16 bp, C. familiaris
caaccccaaggtcaag

SEQ ID NO: 308276 - DNA, 16 bp, C. familiaris
caaccctgacatcatg

SEQ ID NO: 308277 - DNA, 16 bp, C. familiaris
caaccgactgagccac

SEQ ID NO: 308278 - DNA, 16 bp, C. familiaris
caacctaaatgtccag

SEQ ID NO: 308279 - DNA, 16 bp, C. familiaris
caacctaagtgttcac

SEQ ID NO: 308280 - DNA, 16 bp, C. familiaris
caacctacagaatgag

SEQ ID NO: 308281 - DNA, 16 bp, C. familiaris
caacctcttcaacctc

SEQ ID NO: 308282 - DNA, 16 bp, C. familiaris
caacctgaaaataaaa

SEQ ID NO: 308283 - DNA, 16 bp, C. familiaris
caacctggggcacctg

SEQ ID NO: 308284 - DNA, 16 bp, C. familiaris
caacctgtcttctatg

SEQ ID NO: 308285 - DNA, 16 bp, C. familiaris
caaccttcagcaacca

SEQ ID NO: 308286 - DNA, 16 bp, C. familiaris
caactcagccacccag

SEQ ID NO: 308287 - DNA, 16 bp, C. familiaris
caactcccctccagca

SEQ ID NO: 308288 - DNA, 16 bp, C. familiaris
caactcctgcttttgt

SEQ ID NO: 308289 - DNA, 16 bp, C. familiaris
caactctctaaagaaa

SEQ ID NO: 308290 - DNA, 16 bp, C. familiaris
caactctgtgaagaaa

SEQ ID NO: 308291 - DNA, 16 bp, C. familiaris
caactcttggattcag

SEQ ID NO: 308292 - DNA, 16 bp, C. familiaris
caactgaatcacccag

SEQ ID NO: 308293 - DNA, 16 bp, C. familiaris
caactgagccagccag

SEQ ID NO: 308294 - DNA, 16 bp, C. familiaris
caactgataccaaaga

SEQ ID NO: 308295 - DNA, 16 bp, C. familiaris
caactgcaccaaaaac

SEQ ID NO: 308296 - DNA, 16 bp, C. familiaris
caactgcaccatccag

SEQ ID NO: 308297 - DNA, 16 bp, C. familiaris
caactgcagagccacc

SEQ ID NO: 308298 - DNA, 16 bp, C. familiaris
caactgccgagccacc

SEQ ID NO: 308299 - DNA, 16 bp, C. familiaris
caactgcggagccacc

SEQ ID NO: 308300 - DNA, 16 bp, C. familiaris
caactggaagccagag

SEQ ID NO: 308301 - DNA, 16 bp, C. familiaris
caactggaagtttgta

SEQ ID NO: 308302 - DNA, 16 bp, C. familiaris
caactggactgaagga

SEQ ID NO: 308303 - DNA, 16 bp, C. familiaris
caactggagaaagaca

SEQ ID NO: 308304 - DNA, 16 bp, C. familiaris
caactgtggaaggagc

SEQ ID NO: 308305 - DNA, 16 bp, C. familiaris
caactgtgtggaggtt

SEQ ID NO: 308306 - DNA, 16 bp, C. familiaris
caacttaccaagactg

SEQ ID NO: 308307 - DNA, 16 bp, C. familiaris
caacttcactgaattt

SEQ ID NO: 308308 - DNA, 16 bp, C. familiaris
caacttccagaggaag

SEQ ID NO: 308309 - DNA, 16 bp, C. familiaris
caacttcttcaccacc

SEQ ID NO: 308310 - DNA, 16 bp, C. familiaris
caacttgtcttctacg

SEQ ID NO: 308311 - DNA, 16 bp, C. familiaris
caactttactgaattt

SEQ ID NO: 308312 - DNA, 16 bp, C. familiaris
caactttctgaagaaa

SEQ ID NO: 308313 - DNA, 16 bp, C. familiaris
caacttttcttctgca

SEQ ID NO: 308314 - DNA, 16 bp, C. familiaris
caacttttgatcttgg

SEQ ID NO: 308315 - DNA, 16 bp, C. familiaris
caagaaaactacagat

SEQ ID NO: 308316 - DNA, 16 bp, C. familiaris
caagaaaagatgctca

SEQ ID NO: 308317 - DNA, 16 bp, C. familiaris
caagaaaatatatgaa

SEQ ID NO: 308318 - DNA, 16 bp, C. familiaris
caagaaaatctaacaa

SEQ ID NO: 308319 - DNA, 16 bp, C. familiaris
caagaaacaagtattg

SEQ ID NO: 308320 - DNA, 16 bp, C. familiaris
caagaaacagactctt

SEQ ID NO: 308321 - DNA, 16 bp, C. familiaris
caagaaacattaaagg

SEQ ID NO: 308322 - DNA, 16 bp, C. familiaris
caagaaactcacaaaa

SEQ ID NO: 308323 - DNA, 16 bp, C. familiaris
caagaaagtgaaatga

SEQ ID NO: 308324 - DNA, 16 bp, C. familiaris
caagaaatatttttaa

SEQ ID NO: 308325 - DNA, 16 bp, C. familiaris
caagaaatattttttg

SEQ ID NO: 308326 - DNA, 16 bp, C. familiaris
caagaaatggactctt

SEQ ID NO: 308327 - DNA, 16 bp, C. familiaris
caagaaatgggcaaaa

SEQ ID NO: 308328 - DNA, 16 bp, C. familiaris
caagaaattcagaaaa

SEQ ID NO: 308329 - DNA, 16 bp, C. familiaris
caagaacagatgggta

SEQ ID NO: 308330 - DNA, 16 bp, C. familiaris
caagaacctgagatca

SEQ ID NO: 308331 - DNA, 16 bp, C. familiaris
caagaactcacaaaat

SEQ ID NO: 308332 - DNA, 16 bp, C. familiaris
caagaagaaatttgga

SEQ ID NO: 308333 - DNA, 16 bp, C. familiaris
caagaagatttaacaa

SEQ ID NO: 308334 - DNA, 16 bp, C. familiaris
caagaagcaacaggtg

SEQ ID NO: 308335 - DNA, 16 bp, C. familiaris
caagaagtagaaacaa

SEQ ID NO: 308336 - DNA, 16 bp, C. familiaris
caagaagtggaattgc

SEQ ID NO: 308337 - DNA, 16 bp, C. familiaris
caagaatgcagagaaa

SEQ ID NO: 308338 - DNA, 16 bp, C. familiaris
caagaatgggcagacc

SEQ ID NO: 308339 - DNA, 16 bp, C. familiaris
caagaatgtgaagaaa

SEQ ID NO: 308340 - DNA, 16 bp, C. familiaris
caagaatgtggaaaaa

SEQ ID NO: 308341 - DNA, 16 bp, C. familiaris
caagaatgtggaggaa

SEQ ID NO: 308342 - DNA, 16 bp, C. familiaris
caagaattttccaaaa

SEQ ID NO: 308343 - DNA, 16 bp, C. familiaris
caagacacctgcaccc

SEQ ID NO: 308344 - DNA, 16 bp, C. familiaris
caagacagaggaattc

SEQ ID NO: 308345 - DNA, 16 bp, C. familiaris
caagacatggaaacag

SEQ ID NO: 308346 - DNA, 16 bp, C. familiaris
caagaccctgaaatca

SEQ ID NO: 308347 - DNA, 16 bp, C. familiaris
caagaccctgaggtca

SEQ ID NO: 308348 - DNA, 16 bp, C. familiaris
caagagaaaacccaag

SEQ ID NO: 308349 - DNA, 16 bp, C. familiaris
caagagaaacacagag

SEQ ID NO: 308350 - DNA, 16 bp, C. familiaris
caagagaaatgaaaat

SEQ ID NO: 308351 - DNA, 16 bp, C. familiaris
caagagaatgaaaaga

SEQ ID NO: 308352 - DNA, 16 bp, C. familiaris
caagagacaaaagatc

SEQ ID NO: 308353 - DNA, 16 bp, C. familiaris
caagagatgaagaaga

SEQ ID NO: 308354 - DNA, 16 bp, C. familiaris
caagagcaggagcagg

SEQ ID NO: 308355 - DNA, 16 bp, C. familiaris
caagagcaggaggagg

SEQ ID NO: 308356 - DNA, 16 bp, C. familiaris
caagagcctccaggac

SEQ ID NO: 308357 - DNA, 16 bp, C. familiaris
caagaggcacctgggt

SEQ ID NO: 308358 - DNA, 16 bp, C. familiaris
caagagtcagatcctc

SEQ ID NO: 308359 - DNA, 16 bp, C. familiaris
caagagttgaatgctc

SEQ ID NO: 308360 - DNA, 16 bp, C. familiaris
caagagttgggtgctc

SEQ ID NO: 308361 - DNA, 16 bp, C. familiaris
caagatagagaacatt

SEQ ID NO: 308362 - DNA, 16 bp, C. familiaris
caagatagtgattcaa

SEQ ID NO: 308363 - DNA, 16 bp, C. familiaris
caagatatagaagcag

SEQ ID NO: 308364 - DNA, 16 bp, C. familiaris
caagatcaagagctgt

SEQ ID NO: 308365 - DNA, 16 bp, C. familiaris
caagatcacacagctg

SEQ ID NO: 308366 - DNA, 16 bp, C. familiaris
caagatcctgctggcc

SEQ ID NO: 308367 - DNA, 16 bp, C. familiaris
caagatcttggcaggg

SEQ ID NO: 308368 - DNA, 16 bp, C. familiaris
caagatgaaaagaatt

SEQ ID NO: 308369 - DNA, 16 bp, C. familiaris
caagatgaaaaggcaa

SEQ ID NO: 308370 - DNA, 16 bp, C. familiaris
caagatgagcctggag

SEQ ID NO: 308371 - DNA, 16 bp, C. familiaris
caagatgatgatgatg

SEQ ID NO: 308372 - DNA, 16 bp, C. familiaris
caagatggaggaagag

SEQ ID NO: 308373 - DNA, 16 bp, C. familiaris
caagatggcagaggag

SEQ ID NO: 308374 - DNA, 16 bp, C. familiaris
caagatggcttcccag

SEQ ID NO: 308375 - DNA, 16 bp, C. familiaris
caagatgggaaacaac

SEQ ID NO: 308376 - DNA, 16 bp, C. familiaris
caagattcaaacccag

SEQ ID NO: 308377 - DNA, 16 bp, C. familiaris
caagatttcatttttc

SEQ ID NO: 308378 - DNA, 16 bp, C. familiaris
caagcaagaggagcag

SEQ ID NO: 308379 - DNA, 16 bp, C. familiaris
caagcacgtggaggtt

SEQ ID NO: 308380 - DNA, 16 bp, C. familiaris
caagcagaaatcaaga

SEQ ID NO: 308381 - DNA, 16 bp, C. familiaris
caagcagaaggagcag

SEQ ID NO: 308382 - DNA, 16 bp, C. familiaris
caagcagagagagaga

SEQ ID NO: 308383 - DNA, 16 bp, C. familiaris
caagcagaggaagagg

SEQ ID NO: 308384 - DNA, 16 bp, C. familiaris
caagcagaggcagaag

SEQ ID NO: 308385 - DNA, 16 bp, C. familiaris
caagcagattccacgc

SEQ ID NO: 308386 - DNA, 16 bp, C. familiaris
caagcagcactggaaa

SEQ ID NO: 308387 - DNA, 16 bp, C. familiaris
caagcagcagcagcag

SEQ ID NO: 308388 - DNA, 16 bp, C. familiaris
caagcaggagcagcag

SEQ ID NO: 308389 - DNA, 16 bp, C. familiaris
caagcaggaggagcag

SEQ ID NO: 308390 - DNA, 16 bp, C. familiaris
caagcaggaggagcgg

SEQ ID NO: 308391 - DNA, 19 bp, C. familiaris
caagcaggaggagctgcag

SEQ ID NO: 308392 - DNA, 16 bp, C. familiaris
caagcaggaggaggag

SEQ ID NO: 308393 - DNA, 16 bp, C. familiaris
caagcagggagagagg

SEQ ID NO: 308394 - DNA, 16 bp, C. familiaris
caagcagggggaagag

SEQ ID NO: 308395 - DNA, 16 bp, C. familiaris
caagcatctctcaaaa

SEQ ID NO: 308396 - DNA, 16 bp, C. familiaris
caagcatgagcagggg

SEQ ID NO: 308397 - DNA, 16 bp, C. familiaris
caagcatgtggagaaa

SEQ ID NO: 308398 - DNA, 16 bp, C. familiaris
caagcattatatggtc

SEQ ID NO: 308399 - DNA, 16 bp, C. familiaris
caagccaagaaacacc

SEQ ID NO: 308400 - DNA, 16 bp, C. familiaris
caagccaagaaacaga

SEQ ID NO: 308401 - DNA, 16 bp, C. familiaris
caagccaagggatgcc

SEQ ID NO: 308402 - DNA, 16 bp, C. familiaris
caagccacatgtggct

SEQ ID NO: 308403 - DNA, 16 bp, C. familiaris
caagccacccaggagc

SEQ ID NO: 308404 - DNA, 16 bp, C. familiaris
caagccagaagagaat

SEQ ID NO: 308405 - DNA, 16 bp, C. familiaris
caagccccatgtcaga

SEQ ID NO: 308406 - DNA, 16 bp, C. familiaris
caagccccatgtgagg

SEQ ID NO: 308407 - DNA, 16 bp, C. familiaris
caagccttccaggtga

SEQ ID NO: 308408 - DNA, 16 bp, C. familiaris
caagctagaagaaatg

SEQ ID NO: 308409 - DNA, 16 bp, C. familiaris
caagctcatgagaaaa

SEQ ID NO: 308410 - DNA, 16 bp, C. familiaris
caagctccatgcagga

SEQ ID NO: 308411 - DNA, 16 bp, C. familiaris
caagctccctgcaggg

SEQ ID NO: 308412 - DNA, 16 bp, C. familiaris
caagctccctggtcag

SEQ ID NO: 308413 - DNA, 16 bp, C. familiaris
caagctgatggttgcc

SEQ ID NO: 308414 - DNA, 16 bp, C. familiaris
caagctggagaaccag

SEQ ID NO: 308415 - DNA, 16 bp, C. familiaris
caagctggagacccag

SEQ ID NO: 308416 - DNA, 16 bp, C. familiaris
caagctggaggcccag

SEQ ID NO: 308417 - DNA, 16 bp, C. familiaris
caagctggtacagtca

SEQ ID NO: 308418 - DNA, 16 bp, C. familiaris
caagctggtgcagccc

SEQ ID NO: 308419 - DNA, 16 bp, C. familiaris
caagctgtattataaa

SEQ ID NO: 308420 - DNA, 16 bp, C. familiaris
caaggaaaatgaaaat

SEQ ID NO: 308421 - DNA, 16 bp, C. familiaris
caaggaaacaaatgaa

SEQ ID NO: 308422 - DNA, 16 bp, C. familiaris
caaggaaacagtgact

SEQ ID NO: 308423 - DNA, 16 bp, C. familiaris
caaggaaatagaaaat

SEQ ID NO: 308424 - DNA, 16 bp, C. familiaris
caaggaacagattctt

SEQ ID NO: 308425 - DNA, 16 bp, C. familiaris
caaggaaccagctcct

SEQ ID NO: 308426 - DNA, 16 bp, C. familiaris
caaggaagaagtcaaa

SEQ ID NO: 308427 - DNA, 16 bp, C. familiaris
caaggaagatggaaga

SEQ ID NO: 308428 - DNA, 16 bp, C. familiaris
caaggaagtaaaagat

SEQ ID NO: 308429 - DNA, 16 bp, C. familiaris
caaggaagtgaaaaat

SEQ ID NO: 308430 - DNA, 16 bp, C. familiaris
caaggaatacaggcag

SEQ ID NO: 308431 - DNA, 16 bp, C. familiaris
caaggaatgccaagga

SEQ ID NO: 308432 - DNA, 16 bp, C. familiaris
caaggaatgtgggcag

SEQ ID NO: 308433 - DNA, 16 bp, C. familiaris
caaggacacctacagc

SEQ ID NO: 308434 - DNA, 16 bp, C. familiaris
caaggacatggagaaa

SEQ ID NO: 308435 - DNA, 16 bp, C. familiaris
caaggacattgaggac

SEQ ID NO: 308436 - DNA, 16 bp, C. familiaris
caaggacttccagtac

SEQ ID NO: 308437 - DNA, 16 bp, C. familiaris
caaggagcccgaggtg

SEQ ID NO: 308438 - DNA, 16 bp, C. familiaris
caaggagccctggttc

SEQ ID NO: 308439 - DNA, 18 bp, C. familiaris
caaggagccgggctgagg

SEQ ID NO: 308440 - DNA, 16 bp, C. familiaris
caaggaggagcagagg

SEQ ID NO: 308441 - DNA, 16 bp, C. familiaris
caaggagggcttcctg

SEQ ID NO: 308442 - DNA, 16 bp, C. familiaris
caaggaggggatccct

SEQ ID NO: 308443 - DNA, 16 bp, C. familiaris
caaggaggtgaaaaat

SEQ ID NO: 308444 - DNA, 16 bp, C. familiaris
caaggagtttgcttct

SEQ ID NO: 308445 - DNA, 16 bp, C. familiaris
caaggatgcctactct

SEQ ID NO: 308446 - DNA, 16 bp, C. familiaris
caaggatgtgaaggaa

SEQ ID NO: 308447 - DNA, 16 bp, C. familiaris
caaggatgtggtgaaa

SEQ ID NO: 308448 - DNA, 16 bp, C. familiaris
caaggcaggaaaccat

SEQ ID NO: 308449 - DNA, 16 bp, C. familiaris
caaggcatgatcctga

SEQ ID NO: 308450 - DNA, 16 bp, C. familiaris
caaggccaacaagcac

SEQ ID NO: 308451 - DNA, 16 bp, C. familiaris
caaggccctggggcag

SEQ ID NO: 308452 - DNA, 17 bp, C. familiaris
caaggcgctgaccatgg

SEQ ID NO: 308453 - DNA, 17 bp, C. familiaris
caaggctggttcaacac

SEQ ID NO: 308454 - DNA, 16 bp, C. familiaris
caaggctgtggagaaa

SEQ ID NO: 308455 - DNA, 16 bp, C. familiaris
caagggaattttaaaa

SEQ ID NO: 308456 - DNA, 16 bp, C. familiaris
caagggcaacaaaagc

SEQ ID NO: 308457 - DNA, 16 bp, C. familiaris
caagggccagatcttg

SEQ ID NO: 308458 - DNA, 16 bp, C. familiaris
caagggttaacaaggt

SEQ ID NO: 308459 - DNA, 16 bp, C. familiaris
caagggttccagtttc

SEQ ID NO: 308460 - DNA, 16 bp, C. familiaris
caaggtcaaggtgctg

SEQ ID NO: 308461 - DNA, 16 bp, C. familiaris
caaggtcaaggtgttg

SEQ ID NO: 308462 - DNA, 16 bp, C. familiaris
caaggtcatgaaagac

SEQ ID NO: 308463 - DNA, 16 bp, C. familiaris
caaggtcctggagacc

SEQ ID NO: 308464 - DNA, 16 bp, C. familiaris
caaggtctgatcctgg

SEQ ID NO: 308465 - DNA, 16 bp, C. familiaris
caaggtggtggtggtg

SEQ ID NO: 308466 - DNA, 16 bp, C. familiaris
caaggttgtgagatcc

SEQ ID NO: 308467 - DNA, 16 bp, C. familiaris
caagtaaatttgaaga

SEQ ID NO: 308468 - DNA, 16 bp, C. familiaris
caagtactgcattggg

SEQ ID NO: 308469 - DNA, 16 bp, C. familiaris
caagtcacctgtccca

SEQ ID NO: 308470 - DNA, 16 bp, C. familiaris
caagtcactgaacctc

SEQ ID NO: 308471 - DNA, 16 bp, C. familiaris
caagtcattgcaaatg

SEQ ID NO: 308472 - DNA, 16 bp, C. familiaris
caagtcccatgtcagt

SEQ ID NO: 308473 - DNA, 16 bp, C. familiaris
caagtcctgcattggg

SEQ ID NO: 308474 - DNA, 16 bp, C. familiaris
caagtcctgcttcggg

SEQ ID NO: 308475 - DNA, 16 bp, C. familiaris
caagtccttcatcagg

SEQ ID NO: 308476 - DNA, 16 bp, C. familiaris
caagtgaaagaagcca

SEQ ID NO: 308477 - DNA, 16 bp, C. familiaris
caagtgcaaaagccct

SEQ ID NO: 308478 - DNA, 16 bp, C. familiaris
caagtggcagagctgg

SEQ ID NO: 308479 - DNA, 16 bp, C. familiaris
caagtgggggaggagc

SEQ ID NO: 308480 - DNA, 16 bp, C. familiaris
caagtggtgctgggaa

SEQ ID NO: 308481 - DNA, 16 bp, C. familiaris
caagtggtgggagggg

SEQ ID NO: 308482 - DNA, 16 bp, C. familiaris
caagttattgaccaag

SEQ ID NO: 308483 - DNA, 16 bp, C. familiaris
caagttatttttcttt

SEQ ID NO: 308484 - DNA, 16 bp, C. familiaris
caagttccacattggg

SEQ ID NO: 308485 - DNA, 16 bp, C. familiaris
caagttcccagatgat

SEQ ID NO: 308486 - DNA, 16 bp, C. familiaris
caagttggggaggggc

SEQ ID NO: 308487 - DNA, 16 bp, C. familiaris
caagtttgctagaact

SEQ ID NO: 308488 - DNA, 16 bp, C. familiaris
caataaagtgaatatc

SEQ ID NO: 308489 - DNA, 16 bp, C. familiaris
caataaagtgaatatt

SEQ ID NO: 308490 - DNA, 16 bp, C. familiaris
caataaatgtgatata

SEQ ID NO: 308491 - DNA, 16 bp, C. familiaris
caataaattggacaac

SEQ ID NO: 308492 - DNA, 16 bp, C. familiaris
caataagcacatggaa

SEQ ID NO: 308493 - DNA, 16 bp, C. familiaris
caataataatgaaaat

SEQ ID NO: 308494 - DNA, 16 bp, C. familiaris
caataatgaaaataat

SEQ ID NO: 308495 - DNA, 16 bp, C. familiaris
caataccaaatgctga

SEQ ID NO: 308496 - DNA, 16 bp, C. familiaris
caataccaaatgttgg

SEQ ID NO: 308497 - DNA, 16 bp, C. familiaris
caatagatgcagaaaa

SEQ ID NO: 308498 - DNA, 16 bp, C. familiaris
caatagcatcaaaaac

SEQ ID NO: 308499 - DNA, 16 bp, C. familiaris
caatatatgcaaatat

SEQ ID NO: 308500 - DNA, 16 bp, C. familiaris
caatattcacaaaata

SEQ ID NO: 308501 - DNA, 16 bp, C. familiaris
caatattgaaagagaa

SEQ ID NO: 308502 - DNA, 16 bp, C. familiaris
caatattgaaggagaa

SEQ ID NO: 308503 - DNA, 16 bp, C. familiaris
caatatttctgatgaa

SEQ ID NO: 308504 - DNA, 16 bp, C. familiaris
caatcaacatgataga

SEQ ID NO: 308505 - DNA, 16 bp, C. familiaris
caatcaagaaaatgaa

SEQ ID NO: 308506 - DNA, 16 bp, C. familiaris
caatcacaagaagaca

SEQ ID NO: 308507 - DNA, 16 bp, C. familiaris
caatcaccagtttgtt

SEQ ID NO: 308508 - DNA, 16 bp, C. familiaris
caatcagataagaaaa

SEQ ID NO: 308509 - DNA, 16 bp, C. familiaris
caatcaggaaacaaaa

SEQ ID NO: 308510 - DNA, 16 bp, C. familiaris
caatcaggcaacaaaa

SEQ ID NO: 308511 - DNA, 16 bp, C. familiaris
caatcagggaaataca

SEQ ID NO: 308512 - DNA, 16 bp, C. familiaris
caatcccggggctcca

SEQ ID NO: 308513 - DNA, 16 bp, C. familiaris
caatcctgagaaagaa

SEQ ID NO: 308514 - DNA, 16 bp, C. familiaris
caatcctggaactcca

SEQ ID NO: 308515 - DNA, 16 bp, C. familiaris
caatctccctgatgaa

SEQ ID NO: 308516 - DNA, 16 bp, C. familiaris
caatctctctctttct

SEQ ID NO: 308517 - DNA, 16 bp, C. familiaris
caatctctctgagcct

SEQ ID NO: 308518 - DNA, 16 bp, C. familiaris
caatctctttgtgtct

SEQ ID NO: 308519 - DNA, 16 bp, C. familiaris
caatctgaaatttcct

SEQ ID NO: 308520 - DNA, 16 bp, C. familiaris
caatctgaggaccctg

SEQ ID NO: 308521 - DNA, 16 bp, C. familiaris
caatctgcagaaacag

SEQ ID NO: 308522 - DNA, 16 bp, C. familiaris
caatcttatttacaat

SEQ ID NO: 308523 - DNA, 16 bp, C. familiaris
caatcttcagaaagaa

SEQ ID NO: 308524 - DNA, 16 bp, C. familiaris
caatgaaacgcctgga

SEQ ID NO: 308525 - DNA, 16 bp, C. familiaris
caatgaaatatcatct

SEQ ID NO: 308526 - DNA, 16 bp, C. familiaris
caatgaaatcaggaaa

SEQ ID NO: 308527 - DNA, 16 bp, C. familiaris
caatgaataaaacaga

SEQ ID NO: 308528 - DNA, 16 bp, C. familiaris
caatgagacatcacct

SEQ ID NO: 308529 - DNA, 16 bp, C. familiaris
caatgagcagggagcc

SEQ ID NO: 308530 - DNA, 16 bp, C. familiaris
caatgagcatggagcc

SEQ ID NO: 308531 - DNA, 16 bp, C. familiaris
caatgaggggctccat

SEQ ID NO: 308532 - DNA, 16 bp, C. familiaris
caatgataaaattcaa

SEQ ID NO: 308533 - DNA, 16 bp, C. familiaris
caatgatttcatcaat

SEQ ID NO: 308534 - DNA, 16 bp, C. familiaris
caatgcacaggacaac

SEQ ID NO: 308535 - DNA, 16 bp, C. familiaris
caatgcaggagggttc

SEQ ID NO: 308536 - DNA, 16 bp, C. familiaris
caatgccaggggcatc

SEQ ID NO: 308537 - DNA, 16 bp, C. familiaris
caatgctacccagagc

SEQ ID NO: 308538 - DNA, 16 bp, C. familiaris
caatgctactcagggc

SEQ ID NO: 308539 - DNA, 16 bp, C. familiaris
caatggaacagaaaac

SEQ ID NO: 308540 - DNA, 16 bp, C. familiaris
caatggaatactgttc

SEQ ID NO: 308541 - DNA, 16 bp, C. familiaris
caatggaggaaagata

SEQ ID NO: 308542 - DNA, 16 bp, C. familiaris
caatggggaaaaactg

SEQ ID NO: 308543 - DNA, 16 bp, C. familiaris
caatggggaaaggaaa

SEQ ID NO: 308544 - DNA, 16 bp, C. familiaris
caatggtgatgtcaat

SEQ ID NO: 308545 - DNA, 16 bp, C. familiaris
caatgtcaaggagctt

SEQ ID NO: 308546 - DNA, 16 bp, C. familiaris
caatgtccctgatgaa

SEQ ID NO: 308547 - DNA, 16 bp, C. familiaris
caatgtctctgatgaa

SEQ ID NO: 308548 - DNA, 16 bp, C. familiaris
caatgtgctgaatggg

SEQ ID NO: 308549 - DNA, 16 bp, C. familiaris
caatgtgggcctcaat

SEQ ID NO: 308550 - DNA, 16 bp, C. familiaris
caatgttttgcagttt

SEQ ID NO: 308551 - DNA, 16 bp, C. familiaris
caattaaaaatgggca

SEQ ID NO: 308552 - DNA, 16 bp, C. familiaris
caattaagagaccatg

SEQ ID NO: 308553 - DNA, 16 bp, C. familiaris
caattagaaattgaaa

SEQ ID NO: 308554 - DNA, 16 bp, C. familiaris
caattcacaaaggaag

SEQ ID NO: 308555 - DNA, 16 bp, C. familiaris
caattccacttccagg

SEQ ID NO: 308556 - DNA, 16 bp, C. familiaris
caattctccaagaaga

SEQ ID NO: 308557 - DNA, 16 bp, C. familiaris
caattgcacccaaaac

SEQ ID NO: 308558 - DNA, 16 bp, C. familiaris
caatttcctcatctac

SEQ ID NO: 308559 - DNA, 16 bp, C. familiaris
caatttgctttttaaa

SEQ ID NO: 308560 - DNA, 16 bp, C. familiaris
caattttagaatgttt

SEQ ID NO: 308561 - DNA, 16 bp, C. familiaris
caattttcttatttgt

SEQ ID NO: 308562 - DNA, 16 bp, C. familiaris
caattttgaaaaggaa

SEQ ID NO: 308563 - DNA, 16 bp, C. familiaris
caattttgctgatctt

SEQ ID NO: 308564 - DNA, 16 bp, C. familiaris
cacaaaaaatattttt

SEQ ID NO: 308565 - DNA, 16 bp, C. familiaris
cacaaaaacagataca

SEQ ID NO: 308566 - DNA, 16 bp, C. familiaris
cacaaaaatcagttgt

SEQ ID NO: 308567 - DNA, 16 bp, C. familiaris
cacaaaaggaaatgag

SEQ ID NO: 308568 - DNA, 16 bp, C. familiaris
cacaaaatgttacatt

SEQ ID NO: 308569 - DNA, 16 bp, C. familiaris
cacaaagaaaggcaga

SEQ ID NO: 308570 - DNA, 16 bp, C. familiaris
cacaaagaaatgggaa

SEQ ID NO: 308571 - DNA, 16 bp, C. familiaris
cacaaagacctggcag

SEQ ID NO: 308572 - DNA, 17 bp, C. familiaris
cacaaagagaaactcaa

SEQ ID NO: 308573 - DNA, 16 bp, C. familiaris
cacaaagagagaagca

SEQ ID NO: 308574 - DNA, 16 bp, C. familiaris
cacaaagcccaacatg

SEQ ID NO: 308575 - DNA, 16 bp, C. familiaris
cacaaataatgaagca

SEQ ID NO: 308576 - DNA, 16 bp, C. familiaris
cacaaatcagccctca

SEQ ID NO: 308577 - DNA, 16 bp, C. familiaris
cacaaatgaaaatgaa

SEQ ID NO: 308578 - DNA, 16 bp, C. familiaris
cacaaatggatgtcaa

SEQ ID NO: 308579 - DNA, 16 bp, C. familiaris
cacaaccactgagcca

SEQ ID NO: 308580 - DNA, 16 bp, C. familiaris
cacaaccctgaggcca

SEQ ID NO: 308581 - DNA, 16 bp, C. familiaris
cacaacctgaacagaa

SEQ ID NO: 308582 - DNA, 16 bp, C. familiaris
cacaacctgagccaga

SEQ ID NO: 308583 - DNA, 16 bp, C. familiaris
cacaacctgggccaaa

SEQ ID NO: 308584 - DNA, 16 bp, C. familiaris
cacaactccgagatca

SEQ ID NO: 308585 - DNA, 16 bp, C. familiaris
cacaagaaaaaatgct

SEQ ID NO: 308586 - DNA, 16 bp, C. familiaris
cacaagaagggggagc

SEQ ID NO: 308587 - DNA, 16 bp, C. familiaris
cacaagaagggtgagt

SEQ ID NO: 308588 - DNA, 16 bp, C. familiaris
cacaagatcaagagtt

SEQ ID NO: 308589 - DNA, 16 bp, C. familiaris
cacaagcaggaggaga

SEQ ID NO: 308590 - DNA, 16 bp, C. familiaris
cacaagcaggaggagg

SEQ ID NO: 308591 - DNA, 16 bp, C. familiaris
cacaagcagtgggaag

SEQ ID NO: 308592 - DNA, 16 bp, C. familiaris
cacaagccaaaggcag

SEQ ID NO: 308593 - DNA, 16 bp, C. familiaris
cacaatatgttaacta

SEQ ID NO: 308594 - DNA, 16 bp, C. familiaris
cacaatatgtttttaa

SEQ ID NO: 308595 - DNA, 16 bp, C. familiaris
cacaatctcagagtcc

SEQ ID NO: 308596 - DNA, 16 bp, C. familiaris
cacaatctcaggatcc

SEQ ID NO: 308597 - DNA, 16 bp, C. familiaris
cacaatttaaaaatga

SEQ ID NO: 308598 - DNA, 16 bp, C. familiaris
cacacacaaatacatg

SEQ ID NO: 308599 - DNA, 16 bp, C. familiaris
cacacacaaatggaat

SEQ ID NO: 308600 - DNA, 16 bp, C. familiaris
cacacacacaatttta

SEQ ID NO: 308601 - DNA, 16 bp, C. familiaris
cacacacacacagaga

SEQ ID NO: 308602 - DNA, 16 bp, C. familiaris
cacacacacagagcaa

SEQ ID NO: 308603 - DNA, 16 bp, C. familiaris
cacacacacagaggaa

SEQ ID NO: 308604 - DNA, 16 bp, C. familiaris
cacacacacagagtca

SEQ ID NO: 308605 - DNA, 16 bp, C. familiaris
cacacacacaggaagg

SEQ ID NO: 308606 - DNA, 16 bp, C. familiaris
cacacacacaggcatg

SEQ ID NO: 308607 - DNA, 16 bp, C. familiaris
cacacacacagggaaa

SEQ ID NO: 308608 - DNA, 16 bp, C. familiaris
cacacacacagggcag

SEQ ID NO: 308609 - DNA, 16 bp, C. familiaris
cacacacacaggggag

SEQ ID NO: 308610 - DNA, 16 bp, C. familiaris
cacacacacagtttct

SEQ ID NO: 308611 - DNA, 16 bp, C. familiaris
cacacacacatacact

SEQ ID NO: 308612 - DNA, 16 bp, C. familiaris
cacacacacatcccta

SEQ ID NO: 308613 - DNA, 16 bp, C. familiaris
cacacacacatcctgt

SEQ ID NO: 308614 - DNA, 16 bp, C. familiaris
cacacacacattttgt

SEQ ID NO: 308615 - DNA, 16 bp, C. familiaris
cacacacacccctgca

SEQ ID NO: 308616 - DNA, 16 bp, C. familiaris
cacacacacgcacgca

SEQ ID NO: 308617 - DNA, 16 bp, C. familiaris
cacacacacgcagaca

SEQ ID NO: 308618 - DNA, 16 bp, C. familiaris
cacacacacggaggca

SEQ ID NO: 308619 - DNA, 16 bp, C. familiaris
cacacacagaagaatg

SEQ ID NO: 308620 - DNA, 16 bp, C. familiaris
cacacacagacagaga

SEQ ID NO: 308621 - DNA, 16 bp, C. familiaris
cacacacagaggagga

SEQ ID NO: 308622 - DNA, 16 bp, C. familiaris
cacacacataaatatg

SEQ ID NO: 308623 - DNA, 16 bp, C. familiaris
cacacacatacataca

SEQ ID NO: 308624 - DNA, 16 bp, C. familiaris
cacacacatccataca

SEQ ID NO: 308625 - DNA, 16 bp, C. familiaris
cacacacatgcaaaca

SEQ ID NO: 308626 - DNA, 16 bp, C. familiaris
cacacacatgcaagca

SEQ ID NO: 308627 - DNA, 16 bp, C. familiaris
cacacacatgtgcaca

SEQ ID NO: 308628 - DNA, 16 bp, C. familiaris
cacacacctgtgcaca

SEQ ID NO: 308629 - DNA, 16 bp, C. familiaris
cacacacgcatgcaca

SEQ ID NO: 308630 - DNA, 16 bp, C. familiaris
cacacacgtgcacaca

SEQ ID NO: 308631 - DNA, 16 bp, C. familiaris
cacacactcacacaga

SEQ ID NO: 308632 - DNA, 16 bp, C. familiaris
cacacagacacactca

SEQ ID NO: 308633 - DNA, 16 bp, C. familiaris
cacacagacacagaca

SEQ ID NO: 308634 - DNA, 16 bp, C. familiaris
cacacagaggcacaga

SEQ ID NO: 308635 - DNA, 16 bp, C. familiaris
cacacagatgtgcaca

SEQ ID NO: 308636 - DNA, 16 bp, C. familiaris
cacacagcaaaggaaa

SEQ ID NO: 308637 - DNA, 16 bp, C. familiaris
cacacagcggagcagg

SEQ ID NO: 308638 - DNA, 16 bp, C. familiaris
cacacaggcagagaga

SEQ ID NO: 308639 - DNA, 16 bp, C. familiaris
cacacagggagagaga

SEQ ID NO: 308640 - DNA, 16 bp, C. familiaris
cacacaggtgcacaca

SEQ ID NO: 308641 - DNA, 16 bp, C. familiaris
cacacaggtgtccctc

SEQ ID NO: 308642 - DNA, 16 bp, C. familiaris
cacacagtgcctggca

SEQ ID NO: 308643 - DNA, 16 bp, C. familiaris
cacacatacatataca

SEQ ID NO: 308644 - DNA, 16 bp, C. familiaris
cacacatattcacaca

SEQ ID NO: 308645 - DNA, 16 bp, C. familiaris
cacacatcacccagtg

SEQ ID NO: 308646 - DNA, 16 bp, C. familiaris
cacacatgcatgcata

SEQ ID NO: 308647 - DNA, 16 bp, C. familiaris
cacacatgtgcacaga

SEQ ID NO: 308648 - DNA, 16 bp, C. familiaris
cacacatgtgtataca

SEQ ID NO: 308649 - DNA, 16 bp, C. familiaris
cacaccagtcaaaatg

SEQ ID NO: 308650 - DNA, 16 bp, C. familiaris
cacaccagtgagagtg

SEQ ID NO: 308651 - DNA, 16 bp, C. familiaris
cacacccacagagaga

SEQ ID NO: 308652 - DNA, 16 bp, C. familiaris
cacacccagcccagag

SEQ ID NO: 308653 - DNA, 16 bp, C. familiaris
cacacccatgttcact

SEQ ID NO: 308654 - DNA, 18 bp, C. familiaris
cacaccctgagctgcagg

SEQ ID NO: 308655 - DNA, 16 bp, C. familiaris
cacaccctgggctgac

SEQ ID NO: 308656 - DNA, 16 bp, C. familiaris
cacacctatcaggatg

SEQ ID NO: 308657 - DNA, 16 bp, C. familiaris
cacacgcacacgcaca

SEQ ID NO: 308658 - DNA, 16 bp, C. familiaris
cacacgcacactcaca

SEQ ID NO: 308659 - DNA, 16 bp, C. familiaris
cacacgtgtgtgcaca

SEQ ID NO: 308660 - DNA, 16 bp, C. familiaris
cacactcaacatggag

SEQ ID NO: 308661 - DNA, 16 bp, C. familiaris
cacactctctctcaaa

SEQ ID NO: 308662 - DNA, 16 bp, C. familiaris
cacactgagcgtggag

SEQ ID NO: 308663 - DNA, 16 bp, C. familiaris
cacactgcctggcaca

SEQ ID NO: 308664 - DNA, 16 bp, C. familiaris
cacactggatgtggag

SEQ ID NO: 308665 - DNA, 16 bp, C. familiaris
cacactgggtgtacag

SEQ ID NO: 308666 - DNA, 16 bp, C. familiaris
cacactgtggaaggag

SEQ ID NO: 308667 - DNA, 16 bp, C. familiaris
cacactttggctattg

SEQ ID NO: 308668 - DNA, 16 bp, C. familiaris
cacacttttaaaaatt

SEQ ID NO: 308669 - DNA, 16 bp, C. familiaris
cacagaaaagaaatga

SEQ ID NO: 308670 - DNA, 16 bp, C. familiaris
cacagaaactgaaaga

SEQ ID NO: 308671 - DNA, 16 bp, C. familiaris
cacagaaagaggcaga

SEQ ID NO: 308672 - DNA, 16 bp, C. familiaris
cacagaaatcagttgt

SEQ ID NO: 308673 - DNA, 16 bp, C. familiaris
cacagaaatttatttt

SEQ ID NO: 308674 - DNA, 16 bp, C. familiaris
cacagacacatagaca

SEQ ID NO: 308675 - DNA, 16 bp, C. familiaris
cacagagaaaagcaga

SEQ ID NO: 308676 - DNA, 16 bp, C. familiaris
cacagagaaagggaga

SEQ ID NO: 308677 - DNA, 16 bp, C. familiaris
cacagagaagcaaaga

SEQ ID NO: 308678 - DNA, 16 bp, C. familiaris
cacagagaaggcagag

SEQ ID NO: 308679 - DNA, 16 bp, C. familiaris
cacagagaatatcatt

SEQ ID NO: 308680 - DNA, 16 bp, C. familiaris
cacagagacagaaagt

SEQ ID NO: 308681 - DNA, 16 bp, C. familiaris
cacagagacccagaga

SEQ ID NO: 308682 - DNA, 16 bp, C. familiaris
cacagagacctggcag

SEQ ID NO: 308683 - DNA, 16 bp, C. familiaris
cacagagagaagacag

SEQ ID NO: 308684 - DNA, 16 bp, C. familiaris
cacagagagaagagag

SEQ ID NO: 308685 - DNA, 16 bp, C. familiaris
cacagagagaaggcag

SEQ ID NO: 308686 - DNA, 16 bp, C. familiaris
cacagagagagaaata

SEQ ID NO: 308687 - DNA, 16 bp, C. familiaris
cacagagagagcagag

SEQ ID NO: 308688 - DNA, 16 bp, C. familiaris
cacagagagatgcaga

SEQ ID NO: 308689 - DNA, 16 bp, C. familiaris
cacagagatgaaaaat

SEQ ID NO: 308690 - DNA, 16 bp, C. familiaris
cacagagcccaatgcc

SEQ ID NO: 308691 - DNA, 16 bp, C. familiaris
cacagagcccagagcc

SEQ ID NO: 308692 - DNA, 16 bp, C. familiaris
cacagagccccacatg

SEQ ID NO: 308693 - DNA, 16 bp, C. familiaris
cacagagctcaacatg

SEQ ID NO: 308694 - DNA, 16 bp, C. familiaris
cacagagctcctaaat

SEQ ID NO: 308695 - DNA, 16 bp, C. familiaris
cacagaggaggggctg

SEQ ID NO: 308696 - DNA, 16 bp, C. familiaris
cacagaggcagaaaca

SEQ ID NO: 308697 - DNA, 16 bp, C. familiaris
cacagagggaaggcag

SEQ ID NO: 308698 - DNA, 16 bp, C. familiaris
cacagagggagagagg

SEQ ID NO: 308699 - DNA, 16 bp, C. familiaris
cacagagtctgcttgt

SEQ ID NO: 308700 - DNA, 16 bp, C. familiaris
cacagagtgaggcaga

SEQ ID NO: 308701 - DNA, 16 bp, C. familiaris
cacagagtgggagaaa

SEQ ID NO: 308702 - DNA, 16 bp, C. familiaris
cacagatacctacaga

SEQ ID NO: 308703 - DNA, 16 bp, C. familiaris
cacagatagtactgaa

SEQ ID NO: 308704 - DNA, 16 bp, C. familiaris
cacagatatacacaca

SEQ ID NO: 308705 - DNA, 16 bp, C. familiaris
cacagatgagaaaact

SEQ ID NO: 308706 - DNA, 16 bp, C. familiaris
cacagattggctattg

SEQ ID NO: 308707 - DNA, 16 bp, C. familiaris
cacagcaaaagaaata

SEQ ID NO: 308708 - DNA, 16 bp, C. familiaris
cacagcaaaagaaatg

SEQ ID NO: 308709 - DNA, 16 bp, C. familiaris
cacagcaaaggatgca

SEQ ID NO: 308710 - DNA, 16 bp, C. familiaris
cacagcaacatcttgc

SEQ ID NO: 308711 - DNA, 16 bp, C. familiaris
cacagcaacttcctgc

SEQ ID NO: 308712 - DNA, 16 bp, C. familiaris
cacagcaagtgctcag

SEQ ID NO: 308713 - DNA, 16 bp, C. familiaris
cacagcagaggaagaa

SEQ ID NO: 308714 - DNA, 16 bp, C. familiaris
cacagcagcagcagca

SEQ ID NO: 308715 - DNA, 16 bp, C. familiaris
cacagcagcccctccc

SEQ ID NO: 308716 - DNA, 17 bp, C. familiaris
cacagcaggcccctccc

SEQ ID NO: 308717 - DNA, 16 bp, C. familiaris
cacagcaggcctctcc

SEQ ID NO: 308718 - DNA, 16 bp, C. familiaris
cacagcattttctcat

SEQ ID NO: 308719 - DNA, 16 bp, C. familiaris
cacagccaagaggagc

SEQ ID NO: 308720 - DNA, 16 bp, C. familiaris
cacagccagagagaga

SEQ ID NO: 308721 - DNA, 16 bp, C. familiaris
cacagccagcatggag

SEQ ID NO: 308722 - DNA, 16 bp, C. familiaris
cacagccccctccgcg

SEQ ID NO: 308723 - DNA, 16 bp, C. familiaris
cacagcctcagaagga

SEQ ID NO: 308724 - DNA, 16 bp, C. familiaris
cacagcctcccccatt

SEQ ID NO: 308725 - DNA, 16 bp, C. familiaris
cacagcctgcagccca

SEQ ID NO: 308726 - DNA, 16 bp, C. familiaris
cacagcctgggccgaa

SEQ ID NO: 308727 - DNA, 16 bp, C. familiaris
cacagctgctgctgct

SEQ ID NO: 308728 - DNA, 16 bp, C. familiaris
cacagctgctgtggaa

SEQ ID NO: 308729 - DNA, 16 bp, C. familiaris
cacaggaaaagatgct

SEQ ID NO: 308730 - DNA, 16 bp, C. familiaris
cacaggagaagctctg

SEQ ID NO: 308731 - DNA, 16 bp, C. familiaris
cacaggagagagaggc

SEQ ID NO: 308732 - DNA, 16 bp, C. familiaris
cacaggagagtgcagg

SEQ ID NO: 308733 - DNA, 16 bp, C. familiaris
cacaggaggaggcaga

SEQ ID NO: 308734 - DNA, 16 bp, C. familiaris
cacaggatttcagact

SEQ ID NO: 308735 - DNA, 16 bp, C. familiaris
cacaggcacacacagg

SEQ ID NO: 308736 - DNA, 16 bp, C. familiaris
cacaggcacacacatg

SEQ ID NO: 308737 - DNA, 16 bp, C. familiaris
cacaggcagagacaga

SEQ ID NO: 308738 - DNA, 16 bp, C. familiaris
cacaggcagggggaaa

SEQ ID NO: 308739 - DNA, 16 bp, C. familiaris
cacaggcagtggaaga

SEQ ID NO: 308740 - DNA, 16 bp, C. familiaris
cacaggccctggagcc

SEQ ID NO: 308741 - DNA, 16 bp, C. familiaris
cacaggctccatgcag

SEQ ID NO: 308742 - DNA, 16 bp, C. familiaris
cacagggacctggcag

SEQ ID NO: 308743 - DNA, 16 bp, C. familiaris
cacagggagaaagagg

SEQ ID NO: 308744 - DNA, 16 bp, C. familiaris
cacagggagaggaaga

SEQ ID NO: 308745 - DNA, 16 bp, C. familiaris
cacagggagcccgaca

SEQ ID NO: 308746 - DNA, 16 bp, C. familiaris
cacagggctcaacccc

SEQ ID NO: 308747 - DNA, 16 bp, C. familiaris
cacagggctgggcaca

SEQ ID NO: 308748 - DNA, 16 bp, C. familiaris
cacaggggaagggaga

SEQ ID NO: 308749 - DNA, 16 bp, C. familiaris
cacaggggagtgcagg

SEQ ID NO: 308750 - DNA, 16 bp, C. familiaris
cacaggggctgcccca

SEQ ID NO: 308751 - DNA, 16 bp, C. familiaris
cacagggggctccctg

SEQ ID NO: 308752 - DNA, 16 bp, C. familiaris
cacagggtggggtggg

SEQ ID NO: 308753 - DNA, 16 bp, C. familiaris
cacaggtcatgatctc

SEQ ID NO: 308754 - DNA, 16 bp, C. familiaris
cacaggtcctgtcccc

SEQ ID NO: 308755 - DNA, 16 bp, C. familiaris
cacaggttccaggaat

SEQ ID NO: 308756 - DNA, 16 bp, C. familiaris
cacagtgcccagcaca

SEQ ID NO: 308757 - DNA, 16 bp, C. familiaris
cacagtggaggaaaca

SEQ ID NO: 308758 - DNA, 16 bp, C. familiaris
cacagttctgaagact

SEQ ID NO: 308759 - DNA, 16 bp, C. familiaris
cacagttttgattact

SEQ ID NO: 308760 - DNA, 16 bp, C. familiaris
cacataaatatatttt

SEQ ID NO: 308761 - DNA, 16 bp, C. familiaris
cacatacaaacacatg

SEQ ID NO: 308762 - DNA, 16 bp, C. familiaris
cacatatttattgagt

SEQ ID NO: 308763 - DNA, 16 bp, C. familiaris
cacatcagactcccct

SEQ ID NO: 308764 - DNA, 16 bp, C. familiaris
cacatcaggcccctgc

SEQ ID NO: 308765 - DNA, 16 bp, C. familiaris
cacatcaggctctgct

SEQ ID NO: 308766 - DNA, 16 bp, C. familiaris
cacatcctcaccaaga

SEQ ID NO: 308767 - DNA, 16 bp, C. familiaris
cacatccttgtcaata

SEQ ID NO: 308768 - DNA, 16 bp, C. familiaris
cacatctggctcccag

SEQ ID NO: 308769 - DNA, 16 bp, C. familiaris
cacatcttctttacca

SEQ ID NO: 308770 - DNA, 16 bp, C. familiaris
cacatctttgccagca

SEQ ID NO: 308771 - DNA, 16 bp, C. familiaris
cacatgaaaacatttt

SEQ ID NO: 308772 - DNA, 16 bp, C. familiaris
cacatgaaaagattct

SEQ ID NO: 308773 - DNA, 16 bp, C. familiaris
cacatgaagaaatgct

SEQ ID NO: 308774 - DNA, 16 bp, C. familiaris
cacatgagaaaatcct

SEQ ID NO: 308775 - DNA, 16 bp, C. familiaris
cacatgcacacccaca

SEQ ID NO: 308776 - DNA, 16 bp, C. familiaris
cacatgcacgtacaca

SEQ ID NO: 308777 - DNA, 16 bp, C. familiaris
cacatgcacgtgcaca

SEQ ID NO: 308778 - DNA, 16 bp, C. familiaris
cacatgcagacacaca

SEQ ID NO: 308779 - DNA, 16 bp, C. familiaris
cacatgcatgcacact

SEQ ID NO: 308780 - DNA, 16 bp, C. familiaris
cacatgcctgtgtgtg

SEQ ID NO: 308781 - DNA, 16 bp, C. familiaris
cacatgctcacacaca

SEQ ID NO: 308782 - DNA, 16 bp, C. familiaris
cacatgctctttctct

SEQ ID NO: 308783 - DNA, 16 bp, C. familiaris
cacatgggacattctc

SEQ ID NO: 308784 - DNA, 16 bp, C. familiaris
cacatgggcagaggga

SEQ ID NO: 308785 - DNA, 16 bp, C. familiaris
cacatgggcctctcca

SEQ ID NO: 308786 - DNA, 16 bp, C. familiaris
cacatgtatacacaca

SEQ ID NO: 308787 - DNA, 16 bp, C. familiaris
cacatgtatacataca

SEQ ID NO: 308788 - DNA, 16 bp, C. familiaris
cacatgtgctctctct

SEQ ID NO: 308789 - DNA, 16 bp, C. familiaris
cacatgttttctctct

SEQ ID NO: 308790 - DNA, 16 bp, C. familiaris
cacattacatttagtc

SEQ ID NO: 308791 - DNA, 16 bp, C. familiaris
cacattcatttcaagt

SEQ ID NO: 308792 - DNA, 16 bp, C. familiaris
cacattctttttttaa

SEQ ID NO: 308793 - DNA, 16 bp, C. familiaris
cacattggctgtagag

SEQ ID NO: 308794 - DNA, 16 bp, C. familiaris
cacattggggatagag

SEQ ID NO: 308795 - DNA, 16 bp, C. familiaris
cacattgttttctttt

SEQ ID NO: 308796 - DNA, 16 bp, C. familiaris
cacattttaagtgctt

SEQ ID NO: 308797 - DNA, 16 bp, C. familiaris
caccaaaaaagagaat

SEQ ID NO: 308798 - DNA, 16 bp, C. familiaris
caccaaaacttgacaa

SEQ ID NO: 308799 - DNA, 16 bp, C. familiaris
caccaaaagggacaga

SEQ ID NO: 308800 - DNA, 16 bp, C. familiaris
caccaaaccaactctg

SEQ ID NO: 308801 - DNA, 17 bp, C. familiaris
caccaaaccgctgagcc

SEQ ID NO: 308802 - DNA, 16 bp, C. familiaris
caccaaactgctgtgc

SEQ ID NO: 308803 - DNA, 16 bp, C. familiaris
caccaaagaagacaga

SEQ ID NO: 308804 - DNA, 16 bp, C. familiaris
caccaaagaagataaa

SEQ ID NO: 308805 - DNA, 16 bp, C. familiaris
caccaaagaagatgta

SEQ ID NO: 308806 - DNA, 16 bp, C. familiaris
caccaacaaaagcttc

SEQ ID NO: 308807 - DNA, 16 bp, C. familiaris
caccaacagagcaaga

SEQ ID NO: 308808 - DNA, 16 bp, C. familiaris
caccaacagggcaaga

SEQ ID NO: 308809 - DNA, 16 bp, C. familiaris
caccaagaaatggaaa

SEQ ID NO: 308810 - DNA, 16 bp, C. familiaris
caccaagcagaagaaa

SEQ ID NO: 308811 - DNA, 16 bp, C. familiaris
caccaagcagagagcc

SEQ ID NO: 308812 - DNA, 16 bp, C. familiaris
caccaagcaggaagcc

SEQ ID NO: 308813 - DNA, 16 bp, C. familiaris
caccaagctacccagg

SEQ ID NO: 308814 - DNA, 16 bp, C. familiaris
caccaaggagtctgct

SEQ ID NO: 308815 - DNA, 16 bp, C. familiaris
caccaccaaatgctga

SEQ ID NO: 308816 - DNA, 16 bp, C. familiaris
caccaccaccaccgtg

SEQ ID NO: 308817 - DNA, 16 bp, C. familiaris
caccaccatcatcatc

SEQ ID NO: 308818 - DNA, 16 bp, C. familiaris
caccaccatcatctcc

SEQ ID NO: 308819 - DNA, 16 bp, C. familiaris
caccacccaggagccc

SEQ ID NO: 308820 - DNA, 16 bp, C. familiaris
caccacccaggtgctc

SEQ ID NO: 308821 - DNA, 16 bp, C. familiaris
caccaccgggactgcc

SEQ ID NO: 308822 - DNA, 16 bp, C. familiaris
caccacctgagccacc

SEQ ID NO: 308823 - DNA, 16 bp, C. familiaris
caccaccttcagccag

SEQ ID NO: 308824 - DNA, 16 bp, C. familiaris
caccactatttccaaa

SEQ ID NO: 308825 - DNA, 16 bp, C. familiaris
caccactcatcatcag

SEQ ID NO: 308826 - DNA, 16 bp, C. familiaris
caccagagctgccctg

SEQ ID NO: 308827 - DNA, 16 bp, C. familiaris
caccagcagattgaaa

SEQ ID NO: 308828 - DNA, 16 bp, C. familiaris
caccagcagcagcacc

SEQ ID NO: 308829 - DNA, 16 bp, C. familiaris
caccagctgagtgtcc

SEQ ID NO: 308830 - DNA, 16 bp, C. familiaris
caccagcttgtgttcc

SEQ ID NO: 308831 - DNA, 16 bp, C. familiaris
caccaggatggctcag

SEQ ID NO: 308832 - DNA, 16 bp, C. familiaris
caccaggcccagatgg

SEQ ID NO: 308833 - DNA, 16 bp, C. familiaris
caccaggccctgggga

SEQ ID NO: 308834 - DNA, 16 bp, C. familiaris
caccaggggacacagc

SEQ ID NO: 308835 - DNA, 16 bp, C. familiaris
caccagggtggctcaa

SEQ ID NO: 308836 - DNA, 16 bp, C. familiaris
caccaggtccgggtga

SEQ ID NO: 308837 - DNA, 16 bp, C. familiaris
caccaggttctggtga

SEQ ID NO: 308838 - DNA, 16 bp, C. familiaris
caccatcatcaccatc

SEQ ID NO: 308839 - DNA, 16 bp, C. familiaris
caccatcctcaccatc

SEQ ID NO: 308840 - DNA, 16 bp, C. familiaris
caccatctgttgaaga

SEQ ID NO: 308841 - DNA, 16 bp, C. familiaris
caccatgctgtacatc

SEQ ID NO: 308842 - DNA, 16 bp, C. familiaris
caccatgttgtacatt

SEQ ID NO: 308843 - DNA, 16 bp, C. familiaris
caccattttatgttcc

SEQ ID NO: 308844 - DNA, 16 bp, C. familiaris
cacccaagacaagcct

SEQ ID NO: 308845 - DNA, 16 bp, C. familiaris
cacccaatatggggct

SEQ ID NO: 308846 - DNA, 16 bp, C. familiaris
cacccacactggggag

SEQ ID NO: 308847 - DNA, 18 bp, C. familiaris
cacccacagtgcaggagg

SEQ ID NO: 308848 - DNA, 16 bp, C. familiaris
cacccacgtgcccctg

SEQ ID NO: 308849 - DNA, 16 bp, C. familiaris
cacccactgagccagc

SEQ ID NO: 308850 - DNA, 16 bp, C. familiaris
cacccagaagccccag

SEQ ID NO: 308851 - DNA, 16 bp, C. familiaris
cacccagaggcccctc

SEQ ID NO: 308852 - DNA, 16 bp, C. familiaris
cacccagatgcctctg

SEQ ID NO: 308853 - DNA, 16 bp, C. familiaris
cacccagatgctcctg

SEQ ID NO: 308854 - DNA, 16 bp, C. familiaris
cacccagcagaagaaa

SEQ ID NO: 308855 - DNA, 16 bp, C. familiaris
cacccagctgcccctg

SEQ ID NO: 308856 - DNA, 16 bp, C. familiaris
cacccaggaatccctg

SEQ ID NO: 308857 - DNA, 16 bp, C. familiaris
cacccaggagcccaaa

SEQ ID NO: 308858 - DNA, 16 bp, C. familiaris
cacccaggagccccag

SEQ ID NO: 308859 - DNA, 16 bp, C. familiaris
cacccaggagctcctg

SEQ ID NO: 308860 - DNA, 16 bp, C. familiaris
cacccaggagtccctg

SEQ ID NO: 308861 - DNA, 16 bp, C. familiaris
cacccaggatccccaa

SEQ ID NO: 308862 - DNA, 16 bp, C. familiaris
cacccaggcaccacct

SEQ ID NO: 308863 - DNA, 16 bp, C. familiaris
cacccaggcaccccat

SEQ ID NO: 308864 - DNA, 16 bp, C. familiaris
cacccaggcacccgag

SEQ ID NO: 308865 - DNA, 16 bp, C. familiaris
cacccaggcatccaaa

SEQ ID NO: 308866 - DNA, 16 bp, C. familiaris
cacccaggcatcccac

SEQ ID NO: 308867 - DNA, 16 bp, C. familiaris
cacccaggcatcctct

SEQ ID NO: 308868 - DNA, 16 bp, C. familiaris
cacccaggcggccctg

SEQ ID NO: 308869 - DNA, 16 bp, C. familiaris
cacccaggcgtcccct

SEQ ID NO: 308870 - DNA, 16 bp, C. familiaris
cacccaggctccccca

SEQ ID NO: 308871 - DNA, 16 bp, C. familiaris
cacccaggctccctgc

SEQ ID NO: 308872 - DNA, 16 bp, C. familiaris
cacccaggctgcccag

SEQ ID NO: 308873 - DNA, 16 bp, C. familiaris
cacccaggctgccctt

SEQ ID NO: 308874 - DNA, 16 bp, C. familiaris
cacccaggcttcccag

SEQ ID NO: 308875 - DNA, 16 bp, C. familiaris
cacccaggggccccgg

SEQ ID NO: 308876 - DNA, 16 bp, C. familiaris
cacccaggggccctgc

SEQ ID NO: 308877 - DNA, 16 bp, C. familiaris
cacccaggtgccccat

SEQ ID NO: 308878 - DNA, 16 bp, C. familiaris
cacccaggtgccccca

SEQ ID NO: 308879 - DNA, 16 bp, C. familiaris
cacccaggtgcccccc

SEQ ID NO: 308880 - DNA, 16 bp, C. familiaris
cacccaggtgccttgg

SEQ ID NO: 308881 - DNA, 16 bp, C. familiaris
cacccaggtggttcag

SEQ ID NO: 308882 - DNA, 16 bp, C. familiaris
cacccaggtgtcccgg

SEQ ID NO: 308883 - DNA, 16 bp, C. familiaris
cacccaggtgtcctta

SEQ ID NO: 308884 - DNA, 16 bp, C. familiaris
cacccaggtgttccag

SEQ ID NO: 308885 - DNA, 16 bp, C. familiaris
cacccaggttgccctg

SEQ ID NO: 308886 - DNA, 17 bp, C. familiaris
cacccagtcacccccac

SEQ ID NO: 308887 - DNA, 16 bp, C. familiaris
cacccagtgctcgtcc

SEQ ID NO: 308888 - DNA, 16 bp, C. familiaris
cacccatgagatcatg

SEQ ID NO: 308889 - DNA, 16 bp, C. familiaris
cacccatgcacccctg

SEQ ID NO: 308890 - DNA, 16 bp, C. familiaris
cacccatgtgcccctc

SEQ ID NO: 308891 - DNA, 16 bp, C. familiaris
caccccaatttttata

SEQ ID NO: 308892 - DNA, 16 bp, C. familiaris
caccccaggccgcagg

SEQ ID NO: 308893 - DNA, 16 bp, C. familiaris
caccccaggctgcagg

SEQ ID NO: 308894 - DNA, 16 bp, C. familiaris
caccccaggcttcagg

SEQ ID NO: 308895 - DNA, 16 bp, C. familiaris
caccccagggcagggc

SEQ ID NO: 308896 - DNA, 16 bp, C. familiaris
caccccagggcctgat

SEQ ID NO: 308897 - DNA, 16 bp, C. familiaris
cacccccaccctggct

SEQ ID NO: 308898 - DNA, 16 bp, C. familiaris
cacccccagcacagag

SEQ ID NO: 308899 - DNA, 16 bp, C. familiaris
cacccccagcccagct

SEQ ID NO: 308900 - DNA, 16 bp, C. familiaris
cacccccagcctcctg

SEQ ID NO: 308901 - DNA, 16 bp, C. familiaris
cacccccaggccttcc

SEQ ID NO: 308902 - DNA, 16 bp, C. familiaris
caccccctcactttca

SEQ ID NO: 308903 - DNA, 16 bp, C. familiaris
caccccctgccccagg

SEQ ID NO: 308904 - DNA, 16 bp, C. familiaris
caccccctgcctctgg

SEQ ID NO: 308905 - DNA, 16 bp, C. familiaris
caccccggctgcccag

SEQ ID NO: 308906 - DNA, 16 bp, C. familiaris
caccccgggctgcagg

SEQ ID NO: 308907 - DNA, 16 bp, C. familiaris
cacccctgcccccagg

SEQ ID NO: 308908 - DNA, 16 bp, C. familiaris
cacccctgcccctggg

SEQ ID NO: 308909 - DNA, 16 bp, C. familiaris
cacccgccacctcctg

SEQ ID NO: 308910 - DNA, 16 bp, C. familiaris
cacccgggctgccccg

SEQ ID NO: 308911 - DNA, 16 bp, C. familiaris
cacccgggctgccctc

SEQ ID NO: 308912 - DNA, 16 bp, C. familiaris
caccctcggctgaagg

SEQ ID NO: 308913 - DNA, 16 bp, C. familiaris
caccctctgccctcct

SEQ ID NO: 308914 - DNA, 16 bp, C. familiaris
caccctgacctgaagg

SEQ ID NO: 308915 - DNA, 16 bp, C. familiaris
caccctgagcccaagg

SEQ ID NO: 308916 - DNA, 16 bp, C. familiaris
caccctgagctgtagg

SEQ ID NO: 308917 - DNA, 16 bp, C. familiaris
caccctgctcatgctc

SEQ ID NO: 308918 - DNA, 16 bp, C. familiaris
caccctgctctctctc

SEQ ID NO: 308919 - DNA, 16 bp, C. familiaris
caccctggcaccccca

SEQ ID NO: 308920 - DNA, 16 bp, C. familiaris
caccctggcatccctg

SEQ ID NO: 308921 - DNA, 16 bp, C. familiaris
caccctggctgaaggc

SEQ ID NO: 308922 - DNA, 16 bp, C. familiaris
caccctggctgcccaa

SEQ ID NO: 308923 - DNA, 16 bp, C. familiaris
caccctggctgccctg

SEQ ID NO: 308924 - DNA, 16 bp, C. familiaris
caccctggggctgaag

SEQ ID NO: 308925 - DNA, 16 bp, C. familiaris
caccctgggtcaaagg

SEQ ID NO: 308926 - DNA, 16 bp, C. familiaris
caccgagggctccttc

SEQ ID NO: 308927 - DNA, 16 bp, C. familiaris
caccggcaccggcacc

SEQ ID NO: 308928 - DNA, 16 bp, C. familiaris
caccgttctggaggct

SEQ ID NO: 308929 - DNA, 16 bp, C. familiaris
cacctaaagcacaagc

SEQ ID NO: 308930 - DNA, 16 bp, C. familiaris
cacctaccagctgtgt

SEQ ID NO: 308931 - DNA, 16 bp, C. familiaris
cacctcacacctgtca

SEQ ID NO: 308932 - DNA, 16 bp, C. familiaris
cacctcatgctctctc

SEQ ID NO: 308933 - DNA, 16 bp, C. familiaris
cacctcattgtggttt

SEQ ID NO: 308934 - DNA, 16 bp, C. familiaris
cacctccccttctaca

SEQ ID NO: 308935 - DNA, 16 bp, C. familiaris
cacctccctgggcctc

SEQ ID NO: 308936 - DNA, 16 bp, C. familiaris
cacctcctccaagaag

SEQ ID NO: 308937 - DNA, 16 bp, C. familiaris
cacctctgcatccctg

SEQ ID NO: 308938 - DNA, 16 bp, C. familiaris
cacctcttccaagaag

SEQ ID NO: 308939 - DNA, 16 bp, C. familiaris
cacctgagccacctag

SEQ ID NO: 308940 - DNA, 16 bp, C. familiaris
cacctgagctgccctt

SEQ ID NO: 308941 - DNA, 16 bp, C. familiaris
cacctgagggagctgc

SEQ ID NO: 308942 - DNA, 16 bp, C. familiaris
cacctgcacccccatg

SEQ ID NO: 308943 - DNA, 16 bp, C. familiaris
cacctgcacccgcacc

SEQ ID NO: 308944 - DNA, 16 bp, C. familiaris
cacctgcacctgcacc

SEQ ID NO: 308945 - DNA, 16 bp, C. familiaris
cacctgcagcctgggg

SEQ ID NO: 308946 - DNA, 16 bp, C. familiaris
cacctgcatgcacaca

SEQ ID NO: 308947 - DNA, 16 bp, C. familiaris
cacctgcccctggctc

SEQ ID NO: 308948 - DNA, 16 bp, C. familiaris
cacctgccgcacctgc

SEQ ID NO: 308949 - DNA, 16 bp, C. familiaris
cacctgcctcctccca

SEQ ID NO: 308950 - DNA, 16 bp, C. familiaris
cacctgcctgcctgcc

SEQ ID NO: 308951 - DNA, 16 bp, C. familiaris
cacctgcctgggtggc

SEQ ID NO: 308952 - DNA, 16 bp, C. familiaris
cacctgcctgtgtctc

SEQ ID NO: 308953 - DNA, 16 bp, C. familiaris
cacctgccttcagcac

SEQ ID NO: 308954 - DNA, 16 bp, C. familiaris
cacctgccttctgctc

SEQ ID NO: 308955 - DNA, 16 bp, C. familiaris
cacctgcgtgtggacc

SEQ ID NO: 308956 - DNA, 16 bp, C. familiaris
cacctgctccagcccc

SEQ ID NO: 308957 - DNA, 16 bp, C. familiaris
cacctgctcctccctc

SEQ ID NO: 308958 - DNA, 16 bp, C. familiaris
cacctgctcctgctcc

SEQ ID NO: 308959 - DNA, 16 bp, C. familiaris
cacctgctcttccctc

SEQ ID NO: 308960 - DNA, 16 bp, C. familiaris
cacctgctgaaggaca

SEQ ID NO: 308961 - DNA, 16 bp, C. familiaris
cacctgctgccccagc

SEQ ID NO: 308962 - DNA, 16 bp, C. familiaris
cacctggcagggggca

SEQ ID NO: 308963 - DNA, 16 bp, C. familiaris
cacctggctgactcag

SEQ ID NO: 308964 - DNA, 16 bp, C. familiaris
cacctggctgctcagt

SEQ ID NO: 308965 - DNA, 16 bp, C. familiaris
cacctggctggcacag

SEQ ID NO: 308966 - DNA, 16 bp, C. familiaris
cacctggctggctgag

SEQ ID NO: 308967 - DNA, 16 bp, C. familiaris
cacctgggatccctgg

SEQ ID NO: 308968 - DNA, 16 bp, C. familiaris
cacctgggctgtcccc

SEQ ID NO: 308969 - DNA, 16 bp, C. familiaris
cacctgggctgtcctc

SEQ ID NO: 308970 - DNA, 16 bp, C. familiaris
cacctgggggggctca

SEQ ID NO: 308971 - DNA, 16 bp, C. familiaris
cacctgggtgactctg

SEQ ID NO: 308972 - DNA, 16 bp, C. familiaris
cacctgggtgccccca

SEQ ID NO: 308973 - DNA, 16 bp, C. familiaris
cacctgggtggcagag

SEQ ID NO: 308974 - DNA, 16 bp, C. familiaris
cacctgggtggccctg

SEQ ID NO: 308975 - DNA, 16 bp, C. familiaris
cacctgtacttctgac

SEQ ID NO: 308976 - DNA, 16 bp, C. familiaris
cacctgtcagaacggc

SEQ ID NO: 308977 - DNA, 16 bp, C. familiaris
cacctgtgagaatggg

SEQ ID NO: 308978 - DNA, 16 bp, C. familiaris
caccttcacagacaca

SEQ ID NO: 308979 - DNA, 16 bp, C. familiaris
caccttcaccttcacc

SEQ ID NO: 308980 - DNA, 16 bp, C. familiaris
caccttcagccctggg

SEQ ID NO: 308981 - DNA, 16 bp, C. familiaris
caccttgggatccctg

SEQ ID NO: 308982 - DNA, 16 bp, C. familiaris
caccttttctgaccac

SEQ ID NO: 308983 - DNA, 16 bp, C. familiaris
cacgactccaagatca

SEQ ID NO: 308984 - DNA, 16 bp, C. familiaris
cacgagcagtggggag

SEQ ID NO: 308985 - DNA, 16 bp, C. familiaris
cacgatgctgagatca

SEQ ID NO: 308986 - DNA, 16 bp, C. familiaris
cacgcacgcacgcaca

SEQ ID NO: 308987 - DNA, 16 bp, C. familiaris
cacgcagagaggcaga

SEQ ID NO: 308988 - DNA, 16 bp, C. familiaris
cacgccctgggccaca

SEQ ID NO: 308989 - DNA, 16 bp, C. familiaris
cacgccctgggccagg

SEQ ID NO: 308990 - DNA, 16 bp, C. familiaris
cacgccctgggctgcc

SEQ ID NO: 308991 - DNA, 16 bp, C. familiaris
cacggagccctgcacc

SEQ ID NO: 308992 - DNA, 16 bp, C. familiaris
cacggcctgggcccaa

SEQ ID NO: 308993 - DNA, 16 bp, C. familiaris
cacgggatgcctgggt

SEQ ID NO: 308994 - DNA, 16 bp, C. familiaris
cacggtgggctccctg

SEQ ID NO: 308995 - DNA, 16 bp, C. familiaris
cacgtcagcctccctg

SEQ ID NO: 308996 - DNA, 16 bp, C. familiaris
cacgtcaggctccttg

SEQ ID NO: 308997 - DNA, 16 bp, C. familiaris
cacgtcaggcttctgg

SEQ ID NO: 308998 - DNA, 16 bp, C. familiaris
cacgtcgggcttctgg

SEQ ID NO: 308999 - DNA, 16 bp, C. familiaris
cacgtgccaggcactg

SEQ ID NO: 309000 - DNA, 16 bp, C. familiaris
cacgtggctggctcag

SEQ ID NO: 309001 - DNA, 16 bp, C. familiaris
cacgtgtctgttggcc

SEQ ID NO: 309002 - DNA, 16 bp, C. familiaris
cacgtgtgcacgcaca

SEQ ID NO: 309003 - DNA, 16 bp, C. familiaris
cacgtgtgcatgtgca

SEQ ID NO: 309004 - DNA, 16 bp, C. familiaris
cactaaattctttttt

SEQ ID NO: 309005 - DNA, 16 bp, C. familiaris
cactaactggaaaaga

SEQ ID NO: 309006 - DNA, 16 bp, C. familiaris
cactacctgatttcaa

SEQ ID NO: 309007 - DNA, 16 bp, C. familiaris
cactactgaatattta

SEQ ID NO: 309008 - DNA, 16 bp, C. familiaris
cactatgccatcatca

SEQ ID NO: 309009 - DNA, 16 bp, C. familiaris
cactatgtttattgca

SEQ ID NO: 309010 - DNA, 16 bp, C. familiaris
cactattctgattttt

SEQ ID NO: 309011 - DNA, 16 bp, C. familiaris
cactattgggacttca

SEQ ID NO: 309012 - DNA, 16 bp, C. familiaris
cactatttgttgaaaa

SEQ ID NO: 309013 - DNA, 16 bp, C. familiaris
cactcaataaatattt

SEQ ID NO: 309014 - DNA, 16 bp, C. familiaris
cactcacatgcacaca

SEQ ID NO: 309015 - DNA, 16 bp, C. familiaris
cactcacatgtggaat

SEQ ID NO: 309016 - DNA, 16 bp, C. familiaris
cactcactctgtctct

SEQ ID NO: 309017 - DNA, 16 bp, C. familiaris
cactcactgagccctg

SEQ ID NO: 309018 - DNA, 16 bp, C. familiaris
cactcagcaggaaatc

SEQ ID NO: 309019 - DNA, 16 bp, C. familiaris
cactcagcagggagcc

SEQ ID NO: 309020 - DNA, 16 bp, C. familiaris
cactcagcgcagagtc

SEQ ID NO: 309021 - DNA, 16 bp, C. familiaris
cactcaggagccccaa

SEQ ID NO: 309022 - DNA, 16 bp, C. familiaris
cactcaggctgcccca

SEQ ID NO: 309023 - DNA, 16 bp, C. familiaris
cactcaggctgccctg

SEQ ID NO: 309024 - DNA, 16 bp, C. familiaris
cactcaggtgcccaaa

SEQ ID NO: 309025 - DNA, 16 bp, C. familiaris
cactcaggtgtcccac

SEQ ID NO: 309026 - DNA, 16 bp, C. familiaris
cactcagtgaatattt

SEQ ID NO: 309027 - DNA, 16 bp, C. familiaris
cactcatttattcatt

SEQ ID NO: 309028 - DNA, 16 bp, C. familiaris
cactcctggctgccct

SEQ ID NO: 309029 - DNA, 22 bp, C. familiaris
cactcgccccggcctcagcccg

SEQ ID NO: 309030 - DNA, 21 bp, C. familiaris
cactctcctgggcgcgcaggt

SEQ ID NO: 309031 - DNA, 22 bp, C. familiaris
cactctgcactaagcaaaatga

SEQ ID NO: 309032 - DNA, 16 bp, C. familiaris
cactctgcctgctgct

SEQ ID NO: 309033 - DNA, 16 bp, C. familiaris
cactctgggtgtggag

SEQ ID NO: 309034 - DNA, 16 bp, C. familiaris
cactctggtggggaat

SEQ ID NO: 309035 - DNA, 16 bp, C. familiaris
cactctgtgctgagca

SEQ ID NO: 309036 - DNA, 16 bp, C. familiaris
cactctttcaaataaa

SEQ ID NO: 309037 - DNA, 16 bp, C. familiaris
cactctttctgtcaaa

SEQ ID NO: 309038 - DNA, 16 bp, C. familiaris
cactgaaaaaaaaatc

SEQ ID NO: 309039 - DNA, 16 bp, C. familiaris
cactgaacatggaacc

SEQ ID NO: 309040 - DNA, 16 bp, C. familiaris
cactgaaccacctggg

SEQ ID NO: 309041 - DNA, 16 bp, C. familiaris
cactgaataaagccaa

SEQ ID NO: 309042 - DNA, 16 bp, C. familiaris
cactgagaatgatatt

SEQ ID NO: 309043 - DNA, 16 bp, C. familiaris
cactgagcaggagcct

SEQ ID NO: 309044 - DNA, 16 bp, C. familiaris
cactgagcagggaccc

SEQ ID NO: 309045 - DNA, 16 bp, C. familiaris
cactgagcagggatct

SEQ ID NO: 309046 - DNA, 16 bp, C. familiaris
cactgagccccccaag

SEQ ID NO: 309047 - DNA, 16 bp, C. familiaris
cactgagccggccagg

SEQ ID NO: 309048 - DNA, 23 bp, C. familiaris
cactgagcctcacagtggcctca

SEQ ID NO: 309049 - DNA, 16 bp, C. familiaris
cactgagccttccagg

SEQ ID NO: 309050 - DNA, 16 bp, C. familiaris
cactgagctccctgca

SEQ ID NO: 309051 - DNA, 16 bp, C. familiaris
cactgaggaaggcact

SEQ ID NO: 309052 - DNA, 16 bp, C. familiaris
cactgaggagggagcc

SEQ ID NO: 309053 - DNA, 16 bp, C. familiaris
cactgaggatgatgtt

SEQ ID NO: 309054 - DNA, 16 bp, C. familiaris
cactgagggggtcact

SEQ ID NO: 309055 - DNA, 16 bp, C. familiaris
cactgaggtgcccctg

SEQ ID NO: 309056 - DNA, 16 bp, C. familiaris
cactgagttgtacact

SEQ ID NO: 309057 - DNA, 16 bp, C. familiaris
cactgatcatcagaga

SEQ ID NO: 309058 - DNA, 16 bp, C. familiaris
cactgattcaaatgct

SEQ ID NO: 309059 - DNA, 16 bp, C. familiaris
cactgcaagaaatatt

SEQ ID NO: 309060 - DNA, 16 bp, C. familiaris
cactgccaaactgctg

SEQ ID NO: 309061 - DNA, 16 bp, C. familiaris
cactgccactgccacc

SEQ ID NO: 309062 - DNA, 16 bp, C. familiaris
cactgcccagcatcac

SEQ ID NO: 309063 - DNA, 16 bp, C. familiaris
cactgcccctgcccca

SEQ ID NO: 309064 - DNA, 16 bp, C. familiaris
cactgcccgtcaccca

SEQ ID NO: 309065 - DNA, 16 bp, C. familiaris
cactgccctaaaatcc

SEQ ID NO: 309066 - DNA, 16 bp, C. familiaris
cactgcctccagccca

SEQ ID NO: 309067 - DNA, 16 bp, C. familiaris
cactggaaacaaccca

SEQ ID NO: 309068 - DNA, 16 bp, C. familiaris
cactggacaagatgga

SEQ ID NO: 309069 - DNA, 16 bp, C. familiaris
cactggaccaaatgga

SEQ ID NO: 309070 - DNA, 16 bp, C. familiaris
cactgggaaaccaaaa

SEQ ID NO: 309071 - DNA, 16 bp, C. familiaris
cactgggagaaaatat

SEQ ID NO: 309072 - DNA, 16 bp, C. familiaris
cactgggagccagacg

SEQ ID NO: 309073 - DNA, 16 bp, C. familiaris
cactgggagtggagcc

SEQ ID NO: 309074 - DNA, 16 bp, C. familiaris
cactgggatcatgact

SEQ ID NO: 309075 - DNA, 16 bp, C. familiaris
cactgggccacctggg

SEQ ID NO: 309076 - DNA, 16 bp, C. familiaris
cactgggcctggagcc

SEQ ID NO: 309077 - DNA, 16 bp, C. familiaris
cactgggctccatgct

SEQ ID NO: 309078 - DNA, 16 bp, C. familiaris
cactgggctctgagct

SEQ ID NO: 309079 - DNA, 16 bp, C. familiaris
cactgggctctgtgct

SEQ ID NO: 309080 - DNA, 16 bp, C. familiaris
cactgggcttcctgct

SEQ ID NO: 309081 - DNA, 16 bp, C. familiaris
cactggggaatctgct

SEQ ID NO: 309082 - DNA, 16 bp, C. familiaris
cactggggagtctact

SEQ ID NO: 309083 - DNA, 16 bp, C. familiaris
cactggggctgcccag

SEQ ID NO: 309084 - DNA, 16 bp, C. familiaris
cactggggctgccctg

SEQ ID NO: 309085 - DNA, 16 bp, C. familiaris
cactgggggaaaaaaa

SEQ ID NO: 309086 - DNA, 16 bp, C. familiaris
cactgggtgtgaagcc

SEQ ID NO: 309087 - DNA, 16 bp, C. familiaris
cactgtgatgccccca

SEQ ID NO: 309088 - DNA, 16 bp, C. familiaris
cactgtggaaacagta

SEQ ID NO: 309089 - DNA, 16 bp, C. familiaris
cactgtggtgggaatg

SEQ ID NO: 309090 - DNA, 16 bp, C. familiaris
cactgtttgcagatga

SEQ ID NO: 309091 - DNA, 16 bp, C. familiaris
cacttaaaatttttaa

SEQ ID NO: 309092 - DNA, 16 bp, C. familiaris
cacttactgtgatgag

SEQ ID NO: 309093 - DNA, 16 bp, C. familiaris
cacttagcctctctga

SEQ ID NO: 309094 - DNA, 16 bp, C. familiaris
cacttatagcaatgga

SEQ ID NO: 309095 - DNA, 16 bp, C. familiaris
cacttcaggctccctg

SEQ ID NO: 309096 - DNA, 16 bp, C. familiaris
cacttcctaccttctt

SEQ ID NO: 309097 - DNA, 16 bp, C. familiaris
cacttgtcaaaactca

SEQ ID NO: 309098 - DNA, 16 bp, C. familiaris
cacttgtgctctctct

SEQ ID NO: 309099 - DNA, 16 bp, C. familiaris
cacttgtgctttctct

SEQ ID NO: 309100 - DNA, 16 bp, C. familiaris
cactttgaaaaaaaaa

SEQ ID NO: 309101 - DNA, 16 bp, C. familiaris
cactttgagaaacact

SEQ ID NO: 309102 - DNA, 16 bp, C. familiaris
cactttggaaaatagt

SEQ ID NO: 309103 - DNA, 16 bp, C. familiaris
cactttgggaaacagt

SEQ ID NO: 309104 - DNA, 16 bp, C. familiaris
cactttgggctcctca

SEQ ID NO: 309105 - DNA, 16 bp, C. familiaris
cactttttaaaaaaga

SEQ ID NO: 309106 - DNA, 16 bp, C. familiaris
cagaaaaagaccttaa

SEQ ID NO: 309107 - DNA, 16 bp, C. familiaris
cagaaaaagcagttga

SEQ ID NO: 309108 - DNA, 16 bp, C. familiaris
cagaaaaaggatatta

SEQ ID NO: 309109 - DNA, 16 bp, C. familiaris
cagaaaaataatttga

SEQ ID NO: 309110 - DNA, 16 bp, C. familiaris
cagaaaaatacaaatc

SEQ ID NO: 309111 - DNA, 16 bp, C. familiaris
cagaaaaatcatttga

SEQ ID NO: 309112 - DNA, 16 bp, C. familiaris
cagaaaaatggaaaga

SEQ ID NO: 309113 - DNA, 16 bp, C. familiaris
cagaaaaatggagaaa

SEQ ID NO: 309114 - DNA, 16 bp, C. familiaris
cagaaaacacattttt

SEQ ID NO: 309115 - DNA, 16 bp, C. familiaris
cagaaaacagtatgga

SEQ ID NO: 309116 - DNA, 16 bp, C. familiaris
cagaaaaccagctgga

SEQ ID NO: 309117 - DNA, 16 bp, C. familiaris
cagaaaacttttagac

SEQ ID NO: 309118 - DNA, 16 bp, C. familiaris
cagaaaagaaatattt

SEQ ID NO: 309119 - DNA, 16 bp, C. familiaris
cagaaaagaccccaga

SEQ ID NO: 309120 - DNA, 16 bp, C. familiaris
cagaaaagagaaccca

SEQ ID NO: 309121 - DNA, 16 bp, C. familiaris
cagaaaagtagaaaat

SEQ ID NO: 309122 - DNA, 16 bp, C. familiaris
cagaaaagttaaaaga

SEQ ID NO: 309123 - DNA, 16 bp, C. familiaris
cagaaaataaacaagg

SEQ ID NO: 309124 - DNA, 16 bp, C. familiaris
cagaaaatatttgaaa

SEQ ID NO: 309125 - DNA, 16 bp, C. familiaris
cagaaaatccaaaata

SEQ ID NO: 309126 - DNA, 16 bp, C. familiaris
cagaaaatgacagatg

SEQ ID NO: 309127 - DNA, 16 bp, C. familiaris
cagaaaatgacctgaa

SEQ ID NO: 309128 - DNA, 16 bp, C. familiaris
cagaaaatgcaaatta

SEQ ID NO: 309129 - DNA, 16 bp, C. familiaris
cagaaaatggagaaaa

SEQ ID NO: 309130 - DNA, 16 bp, C. familiaris
cagaaaattttctttt

SEQ ID NO: 309131 - DNA, 16 bp, C. familiaris
cagaaacacaaaggat

SEQ ID NO: 309132 - DNA, 16 bp, C. familiaris
cagaaacagaaatcaa

SEQ ID NO: 309133 - DNA, 16 bp, C. familiaris
cagaaacagaccctca

SEQ ID NO: 309134 - DNA, 16 bp, C. familiaris
cagaaacctttttttt

SEQ ID NO: 309135 - DNA, 16 bp, C. familiaris
cagaaactctgagggt

SEQ ID NO: 309136 - DNA, 16 bp, C. familiaris
cagaaactgaaaaaat

SEQ ID NO: 309137 - DNA, 16 bp, C. familiaris
cagaaactgaaagaaa

SEQ ID NO: 309138 - DNA, 16 bp, C. familiaris
cagaaagagaaactaa

SEQ ID NO: 309139 - DNA, 16 bp, C. familiaris
cagaaagataaaatga

SEQ ID NO: 309140 - DNA, 16 bp, C. familiaris
cagaaagtgaaaacaa

SEQ ID NO: 309141 - DNA, 16 bp, C. familiaris
cagaaagtgagacaga

SEQ ID NO: 309142 - DNA, 16 bp, C. familiaris
cagaaagtggtcactt

SEQ ID NO: 309143 - DNA, 16 bp, C. familiaris
cagaaagtttaagtaa

SEQ ID NO: 309144 - DNA, 16 bp, C. familiaris
cagaaataaaaatgat

SEQ ID NO: 309145 - DNA, 16 bp, C. familiaris
cagaaataaattttaa

SEQ ID NO: 309146 - DNA, 16 bp, C. familiaris
cagaaatagaaaatga

SEQ ID NO: 309147 - DNA, 16 bp, C. familiaris
cagaaatagaaggaaa

SEQ ID NO: 309148 - DNA, 16 bp, C. familiaris
cagaaatcaaaaatca

SEQ ID NO: 309149 - DNA, 16 bp, C. familiaris
cagaaatccctgccct

SEQ ID NO: 309150 - DNA, 16 bp, C. familiaris
cagaaatctcacagaa

SEQ ID NO: 309151 - DNA, 16 bp, C. familiaris
cagaaatctgaatttt

SEQ ID NO: 309152 - DNA, 16 bp, C. familiaris
cagaaatgaaaaatgc

SEQ ID NO: 309153 - DNA, 16 bp, C. familiaris
cagaaatgaaagaaga

SEQ ID NO: 309154 - DNA, 16 bp, C. familiaris
cagaaatgaaatattt

SEQ ID NO: 309155 - DNA, 16 bp, C. familiaris
cagaaatgaagaagaa

SEQ ID NO: 309156 - DNA, 16 bp, C. familiaris
cagaaatgaaggagga

SEQ ID NO: 309157 - DNA, 16 bp, C. familiaris
cagaaatgaatccaca

SEQ ID NO: 309158 - DNA, 16 bp, C. familiaris
cagaaatggaaaaaat

SEQ ID NO: 309159 - DNA, 16 bp, C. familiaris
cagaaatggaagaaaa

SEQ ID NO: 309160 - DNA, 16 bp, C. familiaris
cagaaatggaaggaaa

SEQ ID NO: 309161 - DNA, 16 bp, C. familiaris
cagaaatggatccaca

SEQ ID NO: 309162 - DNA, 16 bp, C. familiaris
cagaaattaaagaaat

SEQ ID NO: 309163 - DNA, 16 bp, C. familiaris
cagaaattaacaaaat

SEQ ID NO: 309164 - DNA, 16 bp, C. familiaris
cagaaatttaaaattt

SEQ ID NO: 309165 - DNA, 16 bp, C. familiaris
cagaacaaactgcaca

SEQ ID NO: 309166 - DNA, 16 bp, C. familiaris
cagaacagaaataaat

SEQ ID NO: 309167 - DNA, 16 bp, C. familiaris
cagaacattttcatta

SEQ ID NO: 309168 - DNA, 16 bp, C. familiaris
cagaaccagaatttga

SEQ ID NO: 309169 - DNA, 16 bp, C. familiaris
cagaaccagaggaggt

SEQ ID NO: 309170 - DNA, 16 bp, C. familiaris
cagaaccccaggatca

SEQ ID NO: 309171 - DNA, 16 bp, C. familiaris
cagaactagaaaaaac

SEQ ID NO: 309172 - DNA, 16 bp, C. familiaris
cagaactagaattcaa

SEQ ID NO: 309173 - DNA, 16 bp, C. familiaris
cagaactaggatttga

SEQ ID NO: 309174 - DNA, 16 bp, C. familiaris
cagaactctccacaga

SEQ ID NO: 309175 - DNA, 16 bp, C. familiaris
cagaactctggaaatt

SEQ ID NO: 309176 - DNA, 16 bp, C. familiaris
cagaactgaaggcaga

SEQ ID NO: 309177 - DNA, 16 bp, C. familiaris
cagaactggagggtat

SEQ ID NO: 309178 - DNA, 16 bp, C. familiaris
cagaactgggagagaa

SEQ ID NO: 309179 - DNA, 16 bp, C. familiaris
cagaacttcaaaatac

SEQ ID NO: 309180 - DNA, 16 bp, C. familiaris
cagaacttctttcaaa

SEQ ID NO: 309181 - DNA, 16 bp, C. familiaris
cagaagaaaaattatt

SEQ ID NO: 309182 - DNA, 16 bp, C. familiaris
cagaagaaaagattag

SEQ ID NO: 309183 - DNA, 16 bp, C. familiaris
cagaagaaaatctttg

SEQ ID NO: 309184 - DNA, 16 bp, C. familiaris
cagaagaaaatgaaat

SEQ ID NO: 309185 - DNA, 16 bp, C. familiaris
cagaagaaatgtggaa

SEQ ID NO: 309186 - DNA, 16 bp, C. familiaris
cagaagaactgcagaa

SEQ ID NO: 309187 - DNA, 16 bp, C. familiaris
cagaagaagaaataca

SEQ ID NO: 309188 - DNA, 16 bp, C. familiaris
cagaagaaggagaagc

SEQ ID NO: 309189 - DNA, 16 bp, C. familiaris
cagaagacaatgaaat

SEQ ID NO: 309190 - DNA, 16 bp, C. familiaris
cagaagacatgaatac

SEQ ID NO: 309191 - DNA, 16 bp, C. familiaris
cagaagagaaaattga

SEQ ID NO: 309192 - DNA, 16 bp, C. familiaris
cagaagagaagcagag

SEQ ID NO: 309193 - DNA, 16 bp, C. familiaris
cagaagagacagagag

SEQ ID NO: 309194 - DNA, 16 bp, C. familiaris
cagaagagagagaggc

SEQ ID NO: 309195 - DNA, 16 bp, C. familiaris
cagaagagagataata

SEQ ID NO: 309196 - DNA, 16 bp, C. familiaris
cagaagatcagctgga

SEQ ID NO: 309197 - DNA, 16 bp, C. familiaris
cagaagatcccaaata

SEQ ID NO: 309198 - DNA, 16 bp, C. familiaris
cagaagcacacacaca

SEQ ID NO: 309199 - DNA, 16 bp, C. familiaris
cagaagcagagaggag

SEQ ID NO: 309200 - DNA, 16 bp, C. familiaris
cagaagcagagcctga

SEQ ID NO: 309201 - DNA, 16 bp, C. familiaris
cagaagcagcagcagc

SEQ ID NO: 309202 - DNA, 16 bp, C. familiaris
cagaagccaggagaga

SEQ ID NO: 309203 - DNA, 16 bp, C. familiaris
cagaagctagaagaag

SEQ ID NO: 309204 - DNA, 16 bp, C. familiaris
cagaagctgaaagaat

SEQ ID NO: 309205 - DNA, 16 bp, C. familiaris
cagaagctggaagaag

SEQ ID NO: 309206 - DNA, 16 bp, C. familiaris
cagaagctttctattt

SEQ ID NO: 309207 - DNA, 16 bp, C. familiaris
cagaagcttttgatct

SEQ ID NO: 309208 - DNA, 16 bp, C. familiaris
cagaaggaaaaaaatc

SEQ ID NO: 309209 - DNA, 16 bp, C. familiaris
cagaaggaaaatgaaa

SEQ ID NO: 309210 - DNA, 16 bp, C. familiaris
cagaaggaaatgaaaa

SEQ ID NO: 309211 - DNA, 16 bp, C. familiaris
cagaaggaaatggaga

SEQ ID NO: 309212 - DNA, 16 bp, C. familiaris
cagaaggaagatcatc

SEQ ID NO: 309213 - DNA, 16 bp, C. familiaris
cagaaggacagggaga

SEQ ID NO: 309214 - DNA, 16 bp, C. familiaris
cagaaggagaagaagc

SEQ ID NO: 309215 - DNA, 16 bp, C. familiaris
cagaaggagaagcaga

SEQ ID NO: 309216 - DNA, 16 bp, C. familiaris
cagaaggagaagcagg

SEQ ID NO: 309217 - DNA, 16 bp, C. familiaris
cagaaggagacggaga

SEQ ID NO: 309218 - DNA, 16 bp, C. familiaris
cagaaggagagaagca

SEQ ID NO: 309219 - DNA, 16 bp, C. familiaris
cagaaggagatggaga

SEQ ID NO: 309220 - DNA, 16 bp, C. familiaris
cagaaggagcacagcc

SEQ ID NO: 309221 - DNA, 16 bp, C. familiaris
cagaaggaggcagaga

SEQ ID NO: 309222 - DNA, 16 bp, C. familiaris
cagaaggatagggaga

SEQ ID NO: 309223 - DNA, 16 bp, C. familiaris
cagaaggcacagagaa

SEQ ID NO: 309224 - DNA, 16 bp, C. familiaris
cagaaggcagaggctt

SEQ ID NO: 309225 - DNA, 16 bp, C. familiaris
cagaagggaaggtggg

SEQ ID NO: 309226 - DNA, 16 bp, C. familiaris
cagaagggctggagga

SEQ ID NO: 309227 - DNA, 16 bp, C. familiaris
cagaaggggagacaga

SEQ ID NO: 309228 - DNA, 16 bp, C. familiaris
cagaaggggaggtgag

SEQ ID NO: 309229 - DNA, 16 bp, C. familiaris
cagaaggtttaaataa

SEQ ID NO: 309230 - DNA, 16 bp, C. familiaris
cagaaggtttatttga

SEQ ID NO: 309231 - DNA, 16 bp, C. familiaris
cagaaggtttttagtt

SEQ ID NO: 309232 - DNA, 16 bp, C. familiaris
cagaagtagaattgtt

SEQ ID NO: 309233 - DNA, 16 bp, C. familiaris
cagaagttttcatttt

SEQ ID NO: 309234 - DNA, 16 bp, C. familiaris
cagaagtttttttttt

SEQ ID NO: 309235 - DNA, 16 bp, C. familiaris
cagaataaaagccaaa

SEQ ID NO: 309236 - DNA, 16 bp, C. familiaris
cagaataacctccagt

SEQ ID NO: 309237 - DNA, 16 bp, C. familiaris
cagaatacacattttt

SEQ ID NO: 309238 - DNA, 16 bp, C. familiaris
cagaatagagacccca

SEQ ID NO: 309239 - DNA, 16 bp, C. familiaris
cagaatagatttaaaa

SEQ ID NO: 309240 - DNA, 16 bp, C. familiaris
cagaatatatagagaa

SEQ ID NO: 309241 - DNA, 16 bp, C. familiaris
cagaatatatttttaa

SEQ ID NO: 309242 - DNA, 16 bp, C. familiaris
cagaatcacaacctga

SEQ ID NO: 309243 - DNA, 16 bp, C. familiaris
cagaatcagaagatat

SEQ ID NO: 309244 - DNA, 16 bp, C. familiaris
cagaatcataaataca

SEQ ID NO: 309245 - DNA, 16 bp, C. familiaris
cagaatctgaagcaga

SEQ ID NO: 309246 - DNA, 16 bp, C. familiaris
cagaatctgaatttta

SEQ ID NO: 309247 - DNA, 16 bp, C. familiaris
cagaatctgcttctcc

SEQ ID NO: 309248 - DNA, 16 bp, C. familiaris
cagaatctgcttggga

SEQ ID NO: 309249 - DNA, 16 bp, C. familiaris
cagaatgaaaaggcaa

SEQ ID NO: 309250 - DNA, 16 bp, C. familiaris
cagaatgaagaaaata

SEQ ID NO: 309251 - DNA, 16 bp, C. familiaris
cagaatgaagggaaaa

SEQ ID NO: 309252 - DNA, 16 bp, C. familiaris
cagaatggaaagaaat

SEQ ID NO: 309253 - DNA, 16 bp, C. familiaris
cagaatggaataaaaa

SEQ ID NO: 309254 - DNA, 16 bp, C. familiaris
cagaatggaggttcct

SEQ ID NO: 309255 - DNA, 16 bp, C. familiaris
cagaatgggaagaaat

SEQ ID NO: 309256 - DNA, 16 bp, C. familiaris
cagaatgggagaaata

SEQ ID NO: 309257 - DNA, 16 bp, C. familiaris
cagaatgggagaaggt

SEQ ID NO: 309258 - DNA, 16 bp, C. familiaris
cagaatgtattaaaaa

SEQ ID NO: 309259 - DNA, 16 bp, C. familiaris
cagaatttaaaaatat

SEQ ID NO: 309260 - DNA, 16 bp, C. familiaris
cagacaaatgaaaaga

SEQ ID NO: 309261 - DNA, 16 bp, C. familiaris
cagacaaatggataaa

SEQ ID NO: 309262 - DNA, 16 bp, C. familiaris
cagacacacagatcag

SEQ ID NO: 309263 - DNA, 16 bp, C. familiaris
cagacacagaaggcca

SEQ ID NO: 309264 - DNA, 16 bp, C. familiaris
cagacacagagataga

SEQ ID NO: 309265 - DNA, 16 bp, C. familiaris
cagacacatacacaca

SEQ ID NO: 309266 - DNA, 16 bp, C. familiaris
cagacacatgaaagaa

SEQ ID NO: 309267 - DNA, 16 bp, C. familiaris
cagacacatggaaaga

SEQ ID NO: 309268 - DNA, 16 bp, C. familiaris
cagacactcaaccgtt

SEQ ID NO: 309269 - DNA, 16 bp, C. familiaris
cagacactcaacctac

SEQ ID NO: 309270 - DNA, 16 bp, C. familiaris
cagacacttagccaac

SEQ ID NO: 309271 - DNA, 16 bp, C. familiaris
cagacactttaaccaa

SEQ ID NO: 309272 - DNA, 16 bp, C. familiaris
cagacagaagcagaga

SEQ ID NO: 309273 - DNA, 16 bp, C. familiaris
cagacagacacacagg

SEQ ID NO: 309274 - DNA, 16 bp, C. familiaris
cagacagacacagaga

SEQ ID NO: 309275 - DNA, 16 bp, C. familiaris
cagacagacagacaga

SEQ ID NO: 309276 - DNA, 16 bp, C. familiaris
cagacagacagacatg

SEQ ID NO: 309277 - DNA, 16 bp, C. familiaris
cagacagacagagaga

SEQ ID NO: 309278 - DNA, 16 bp, C. familiaris
cagacagagacagaga

SEQ ID NO: 309279 - DNA, 16 bp, C. familiaris
cagacagagggaagag

SEQ ID NO: 309280 - DNA, 16 bp, C. familiaris
cagacagggaggcaga

SEQ ID NO: 309281 - DNA, 16 bp, C. familiaris
cagacagggagggaga

SEQ ID NO: 309282 - DNA, 16 bp, C. familiaris
cagacagggggagaag

SEQ ID NO: 309283 - DNA, 16 bp, C. familiaris
cagacatctttgtctt

SEQ ID NO: 309284 - DNA, 16 bp, C. familiaris
cagaccaagaaagaca

SEQ ID NO: 309285 - DNA, 16 bp, C. familiaris
cagaccagaagaactg

SEQ ID NO: 309286 - DNA, 16 bp, C. familiaris
cagaccctgggccaaa

SEQ ID NO: 309287 - DNA, 16 bp, C. familiaris
cagaccctgggctgaa

SEQ ID NO: 309288 - DNA, 16 bp, C. familiaris
cagacgctgagccacc

SEQ ID NO: 309289 - DNA, 16 bp, C. familiaris
cagacggagagctcca

SEQ ID NO: 309290 - DNA, 16 bp, C. familiaris
cagacgtggggctcaa

SEQ ID NO: 309291 - DNA, 16 bp, C. familiaris
cagactcaaccgctga

SEQ ID NO: 309292 - DNA, 16 bp, C. familiaris
cagactcagatatgac

SEQ ID NO: 309293 - DNA, 17 bp, C. familiaris
cagactccagcatcatc

SEQ ID NO: 309294 - DNA, 16 bp, C. familiaris
cagactccatggaggg

SEQ ID NO: 309295 - DNA, 16 bp, C. familiaris
cagactccctgctgtg

SEQ ID NO: 309296 - DNA, 16 bp, C. familiaris
cagactctccactcag

SEQ ID NO: 309297 - DNA, 16 bp, C. familiaris
cagactctctgcagag

SEQ ID NO: 309298 - DNA, 16 bp, C. familiaris
cagactctctgctgat

SEQ ID NO: 309299 - DNA, 16 bp, C. familiaris
cagactctgtgcagag

SEQ ID NO: 309300 - DNA, 16 bp, C. familiaris
cagactctgtgctcag

SEQ ID NO: 309301 - DNA, 16 bp, C. familiaris
cagactgggagaaaac

SEQ ID NO: 309302 - DNA, 16 bp, C. familiaris
cagactgtttcccaaa

SEQ ID NO: 309303 - DNA, 16 bp, C. familiaris
cagacttaaatacaga

SEQ ID NO: 309304 - DNA, 16 bp, C. familiaris
cagacttaactacaga

SEQ ID NO: 309305 - DNA, 16 bp, C. familiaris
cagacttccagccccc

SEQ ID NO: 309306 - DNA, 16 bp, C. familiaris
cagacttccagcctcc

SEQ ID NO: 309307 - DNA, 16 bp, C. familiaris
cagagaaaaactacaa

SEQ ID NO: 309308 - DNA, 16 bp, C. familiaris
cagagaaaacagcaag

SEQ ID NO: 309309 - DNA, 16 bp, C. familiaris
cagagaaacagaccca

SEQ ID NO: 309310 - DNA, 16 bp, C. familiaris
cagagaaacagaggca

SEQ ID NO: 309311 - DNA, 16 bp, C. familiaris
cagagaaagacacaca

SEQ ID NO: 309312 - DNA, 16 bp, C. familiaris
cagagaaagacaggta

SEQ ID NO: 309313 - DNA, 16 bp, C. familiaris
cagagaaagagaaata

SEQ ID NO: 309314 - DNA, 16 bp, C. familiaris
cagagaaagagacaca

SEQ ID NO: 309315 - DNA, 16 bp, C. familiaris
cagagaaagagccaga

SEQ ID NO: 309316 - DNA, 16 bp, C. familiaris
cagagaaagataccat

SEQ ID NO: 309317 - DNA, 16 bp, C. familiaris
cagagaaagatagaga

SEQ ID NO: 309318 - DNA, 16 bp, C. familiaris
cagagaaagggacaga

SEQ ID NO: 309319 - DNA, 16 bp, C. familiaris
cagagaaagttctcag

SEQ ID NO: 309320 - DNA, 16 bp, C. familiaris
cagagaaataagcaga

SEQ ID NO: 309321 - DNA, 16 bp, C. familiaris
cagagaaatgaaaatc

SEQ ID NO: 309322 - DNA, 16 bp, C. familiaris
cagagaagaaaaatta

SEQ ID NO: 309323 - DNA, 16 bp, C. familiaris
cagagaagaaatacaa

SEQ ID NO: 309324 - DNA, 16 bp, C. familiaris
cagagaagaaggcaga

SEQ ID NO: 309325 - DNA, 16 bp, C. familiaris
cagagaaggaaaatca

SEQ ID NO: 309326 - DNA, 16 bp, C. familiaris
cagagaaggaaaccat

SEQ ID NO: 309327 - DNA, 16 bp, C. familiaris
cagagaaggcagagac

SEQ ID NO: 309328 - DNA, 16 bp, C. familiaris
cagagaagtgaagtaa

SEQ ID NO: 309329 - DNA, 16 bp, C. familiaris
cagagaatccagaaat

SEQ ID NO: 309330 - DNA, 16 bp, C. familiaris
cagagaatcttcaagc

SEQ ID NO: 309331 - DNA, 16 bp, C. familiaris
cagagaatttcaagca

SEQ ID NO: 309332 - DNA, 16 bp, C. familiaris
cagagacaatctacag

SEQ ID NO: 309333 - DNA, 16 bp, C. familiaris
cagagacacaagcaag

SEQ ID NO: 309334 - DNA, 16 bp, C. familiaris
cagagacacacaggga

SEQ ID NO: 309335 - DNA, 16 bp, C. familiaris
cagagacacaggcacg

SEQ ID NO: 309336 - DNA, 17 bp, C. familiaris
cagagacacaggcagag

SEQ ID NO: 309337 - DNA, 16 bp, C. familiaris
cagagacaccaggcag

SEQ ID NO: 309338 - DNA, 16 bp, C. familiaris
cagagacactgacaga

SEQ ID NO: 309339 - DNA, 16 bp, C. familiaris
cagagacagaaacaga

SEQ ID NO: 309340 - DNA, 16 bp, C. familiaris
cagagacagaagcaag

SEQ ID NO: 309341 - DNA, 16 bp, C. familiaris
cagagacagaagcaga

SEQ ID NO: 309342 - DNA, 16 bp, C. familiaris
cagagacagaggaaga

SEQ ID NO: 309343 - DNA, 16 bp, C. familiaris
cagagacagaggcata

SEQ ID NO: 309344 - DNA, 16 bp, C. familiaris
cagagacaggaggagg

SEQ ID NO: 309345 - DNA, 16 bp, C. familiaris
cagagacatacacaga

SEQ ID NO: 309346 - DNA, 16 bp, C. familiaris
cagagacatacatagg

SEQ ID NO: 309347 - DNA, 16 bp, C. familiaris
cagagaccagaaaatg

SEQ ID NO: 309348 - DNA, 16 bp, C. familiaris
cagagacccaggagag

SEQ ID NO: 309349 - DNA, 16 bp, C. familiaris
cagagacccaggctga

SEQ ID NO: 309350 - DNA, 16 bp, C. familiaris
cagagacctgggcaga

SEQ ID NO: 309351 - DNA, 16 bp, C. familiaris
cagagactcagagagg

SEQ ID NO: 309352 - DNA, 16 bp, C. familiaris
cagagagaaagccaga

SEQ ID NO: 309353 - DNA, 16 bp, C. familiaris
cagagagaacagcaag

SEQ ID NO: 309354 - DNA, 16 bp, C. familiaris
cagagagaagaaaatg

SEQ ID NO: 309355 - DNA, 16 bp, C. familiaris
cagagagaagagcagg

SEQ ID NO: 309356 - DNA, 16 bp, C. familiaris
cagagagaagcaagct

SEQ ID NO: 309357 - DNA, 16 bp, C. familiaris
cagagagaagcaggcc

SEQ ID NO: 309358 - DNA, 16 bp, C. familiaris
cagagagaagcaggct

SEQ ID NO: 309359 - DNA, 16 bp, C. familiaris
cagagagacagacaga

SEQ ID NO: 309360 - DNA, 16 bp, C. familiaris
cagagagagaaacagg

SEQ ID NO: 309361 - DNA, 16 bp, C. familiaris
cagagagagaacagag

SEQ ID NO: 309362 - DNA, 16 bp, C. familiaris
cagagagagacacaga

SEQ ID NO: 309363 - DNA, 16 bp, C. familiaris
cagagagagaccgaga

SEQ ID NO: 309364 - DNA, 16 bp, C. familiaris
cagagagagagtgagg

SEQ ID NO: 309365 - DNA, 16 bp, C. familiaris
cagagagagatgggga

SEQ ID NO: 309366 - DNA, 16 bp, C. familiaris
cagagagaggaagcaa

SEQ ID NO: 309367 - DNA, 16 bp, C. familiaris
cagagagaggagcagg

SEQ ID NO: 309368 - DNA, 16 bp, C. familiaris
cagagagaggcaaaga

SEQ ID NO: 309369 - DNA, 16 bp, C. familiaris
cagagagattaaatga

SEQ ID NO: 309370 - DNA, 16 bp, C. familiaris
cagagagcagagagca

SEQ ID NO: 309371 - DNA, 16 bp, C. familiaris
cagagagcctccttct

SEQ ID NO: 309372 - DNA, 16 bp, C. familiaris
cagagaggagaagcag

SEQ ID NO: 309373 - DNA, 16 bp, C. familiaris
cagagaggagaggcag

SEQ ID NO: 309374 - DNA, 16 bp, C. familiaris
cagagaggcacaggca

SEQ ID NO: 309375 - DNA, 16 bp, C. familiaris
cagagagggaaactga

SEQ ID NO: 309376 - DNA, 16 bp, C. familiaris
cagagaggtgaagcaa

SEQ ID NO: 309377 - DNA, 16 bp, C. familiaris
cagagagtactatttc

SEQ ID NO: 309378 - DNA, 16 bp, C. familiaris
cagagagttggaaaaa

SEQ ID NO: 309379 - DNA, 16 bp, C. familiaris
cagagattattttaaa

SEQ ID NO: 309380 - DNA, 16 bp, C. familiaris
cagagatttttgtctg

SEQ ID NO: 309381 - DNA, 16 bp, C. familiaris
cagagcaaagccagtg

SEQ ID NO: 309382 - DNA, 16 bp, C. familiaris
cagagcaagaagcaga

SEQ ID NO: 309383 - DNA, 16 bp, C. familiaris
cagagcaagagagaga

SEQ ID NO: 309384 - DNA, 16 bp, C. familiaris
cagagcaagagaggca

SEQ ID NO: 309385 - DNA, 16 bp, C. familiaris
cagagcaaggaaaatt

SEQ ID NO: 309386 - DNA, 16 bp, C. familiaris
cagagcaattgctggg

SEQ ID NO: 309387 - DNA, 16 bp, C. familiaris
cagagcacagagaatt

SEQ ID NO: 309388 - DNA, 16 bp, C. familiaris
cagagcacctggctgg

SEQ ID NO: 309389 - DNA, 16 bp, C. familiaris
cagagcagcaagcaga

SEQ ID NO: 309390 - DNA, 16 bp, C. familiaris
cagagcagcagagaca

SEQ ID NO: 309391 - DNA, 16 bp, C. familiaris
cagagcagcagaggga

SEQ ID NO: 309392 - DNA, 16 bp, C. familiaris
cagagcagcggccccg

SEQ ID NO: 309393 - DNA, 16 bp, C. familiaris
cagagcagctccccca

SEQ ID NO: 309394 - DNA, 16 bp, C. familiaris
cagagcaggaagcctg

SEQ ID NO: 309395 - DNA, 16 bp, C. familiaris
cagagcagtgcctggc

SEQ ID NO: 309396 - DNA, 16 bp, C. familiaris
cagagccacctgtggg

SEQ ID NO: 309397 - DNA, 16 bp, C. familiaris
cagagccagacttggg

SEQ ID NO: 309398 - DNA, 16 bp, C. familiaris
cagagccaggaccaga

SEQ ID NO: 309399 - DNA, 16 bp, C. familiaris
cagagccaggcccagg

SEQ ID NO: 309400 - DNA, 16 bp, C. familiaris
cagagcccaacaaggg

SEQ ID NO: 309401 - DNA, 16 bp, C. familiaris
cagagcccaacacgga

SEQ ID NO: 309402 - DNA, 16 bp, C. familiaris
cagagcccaacatgga

SEQ ID NO: 309403 - DNA, 16 bp, C. familiaris
cagagcccagagccca

SEQ ID NO: 309404 - DNA, 16 bp, C. familiaris
cagagcccagggcagg

SEQ ID NO: 309405 - DNA, 16 bp, C. familiaris
cagagcccagtgcagg

SEQ ID NO: 309406 - DNA, 16 bp, C. familiaris
cagagccccacacagg

SEQ ID NO: 309407 - DNA, 16 bp, C. familiaris
cagagcccgacgtggg

SEQ ID NO: 309408 - DNA, 16 bp, C. familiaris
cagagccctgggatgg

SEQ ID NO: 309409 - DNA, 16 bp, C. familiaris
cagagccgcccccgag

SEQ ID NO: 309410 - DNA, 16 bp, C. familiaris
cagagcctgactcaga

SEQ ID NO: 309411 - DNA, 16 bp, C. familiaris
cagagcctgccatggg

SEQ ID NO: 309412 - DNA, 16 bp, C. familiaris
cagagcctgcttggga

SEQ ID NO: 309413 - DNA, 16 bp, C. familiaris
cagagcctgcttttcc

SEQ ID NO: 309414 - DNA, 16 bp, C. familiaris
cagagcctgggctctg

SEQ ID NO: 309415 - DNA, 16 bp, C. familiaris
cagagcctggtgcagg

SEQ ID NO: 309416 - DNA, 16 bp, C. familiaris
cagagctcaatgcagg

SEQ ID NO: 309417 - DNA, 16 bp, C. familiaris
cagagctctttttttt

SEQ ID NO: 309418 - DNA, 16 bp, C. familiaris
cagagctgaaggcaga

SEQ ID NO: 309419 - DNA, 16 bp, C. familiaris
cagagctgccgcagcc

SEQ ID NO: 309420 - DNA, 16 bp, C. familiaris
cagagctggaacaaaa

SEQ ID NO: 309421 - DNA, 16 bp, C. familiaris
cagagctggatgcagg

SEQ ID NO: 309422 - DNA, 16 bp, C. familiaris
cagagctgggcctggg

SEQ ID NO: 309423 - DNA, 16 bp, C. familiaris
cagagcttctgcctcc

SEQ ID NO: 309424 - DNA, 16 bp, C. familiaris
cagaggaacaagcaga

SEQ ID NO: 309425 - DNA, 16 bp, C. familiaris
cagaggaacagggaga

SEQ ID NO: 309426 - DNA, 16 bp, C. familiaris
cagaggaagaaaatct

SEQ ID NO: 309427 - DNA, 16 bp, C. familiaris
cagaggaagaagcagg

SEQ ID NO: 309428 - DNA, 16 bp, C. familiaris
cagaggaagaatcagg

SEQ ID NO: 309429 - DNA, 16 bp, C. familiaris
cagaggaagaggctct

SEQ ID NO: 309430 - DNA, 16 bp, C. familiaris
cagaggaagcagcaga

SEQ ID NO: 309431 - DNA, 16 bp, C. familiaris
cagaggaagcaggctc

SEQ ID NO: 309432 - DNA, 16 bp, C. familiaris
cagaggagaaaactaa

SEQ ID NO: 309433 - DNA, 16 bp, C. familiaris
cagaggagagaagcag

SEQ ID NO: 309434 - DNA, 16 bp, C. familiaris
cagaggagcagaggga

SEQ ID NO: 309435 - DNA, 16 bp, C. familiaris
cagaggaggaaacaga

SEQ ID NO: 309436 - DNA, 16 bp, C. familiaris
cagaggaggaaatgag

SEQ ID NO: 309437 - DNA, 16 bp, C. familiaris
cagaggaggaacagag

SEQ ID NO: 309438 - DNA, 16 bp, C. familiaris
cagaggaggaagcaga

SEQ ID NO: 309439 - DNA, 16 bp, C. familiaris
cagaggaggaagcagg

SEQ ID NO: 309440 - DNA, 16 bp, C. familiaris
cagaggaggagacaga

SEQ ID NO: 309441 - DNA, 16 bp, C. familiaris
cagaggaggagactga

SEQ ID NO: 309442 - DNA, 16 bp, C. familiaris
cagaggaggagcagag

SEQ ID NO: 309443 - DNA, 16 bp, C. familiaris
cagaggaggagcaggc

SEQ ID NO: 309444 - DNA, 16 bp, C. familiaris
cagaggaggctgggaa

SEQ ID NO: 309445 - DNA, 16 bp, C. familiaris
cagaggagggaactga

SEQ ID NO: 309446 - DNA, 16 bp, C. familiaris
cagaggagggcagccc

SEQ ID NO: 309447 - DNA, 16 bp, C. familiaris
cagaggcacaagcaga

SEQ ID NO: 309448 - DNA, 16 bp, C. familiaris
cagaggcacaggtaga

SEQ ID NO: 309449 - DNA, 16 bp, C. familiaris
cagaggcacctggatg

SEQ ID NO: 309450 - DNA, 16 bp, C. familiaris
cagaggcagagatgca

SEQ ID NO: 309451 - DNA, 16 bp, C. familiaris
cagaggcagagcctgg

SEQ ID NO: 309452 - DNA, 16 bp, C. familiaris
cagaggcaggaaggag

SEQ ID NO: 309453 - DNA, 16 bp, C. familiaris
cagaggcaggcagagg

SEQ ID NO: 309454 - DNA, 16 bp, C. familiaris
cagaggcagggagtgg

SEQ ID NO: 309455 - DNA, 16 bp, C. familiaris
cagaggccagaggcca

SEQ ID NO: 309456 - DNA, 16 bp, C. familiaris
cagaggccaggaggcc

SEQ ID NO: 309457 - DNA, 16 bp, C. familiaris
cagaggcccagaggcc

SEQ ID NO: 309458 - DNA, 16 bp, C. familiaris
cagaggcctggatgct

SEQ ID NO: 309459 - DNA, 16 bp, C. familiaris
cagaggctcagaaaag

SEQ ID NO: 309460 - DNA, 16 bp, C. familiaris
cagaggctcagagagg

SEQ ID NO: 309461 - DNA, 16 bp, C. familiaris
cagaggctcagggagg

SEQ ID NO: 309462 - DNA, 16 bp, C. familiaris
cagaggctcctgggag

SEQ ID NO: 309463 - DNA, 16 bp, C. familiaris
cagaggctgagcatct

SEQ ID NO: 309464 - DNA, 16 bp, C. familiaris
cagaggctggaagagg

SEQ ID NO: 309465 - DNA, 16 bp, C. familiaris
cagaggctggaggagg

SEQ ID NO: 309466 - DNA, 16 bp, C. familiaris
cagaggctggggagag

SEQ ID NO: 309467 - DNA, 16 bp, C. familiaris
cagagggaaaagcaga

SEQ ID NO: 309468 - DNA, 16 bp, C. familiaris
cagagggaaagacaga

SEQ ID NO: 309469 - DNA, 16 bp, C. familiaris
cagagggaacagcagg

SEQ ID NO: 309470 - DNA, 16 bp, C. familiaris
cagagggaagaagcag

SEQ ID NO: 309471 - DNA, 16 bp, C. familiaris
cagagggaagaccatg

SEQ ID NO: 309472 - DNA, 16 bp, C. familiaris
cagagggacaaggagg

SEQ ID NO: 309473 - DNA, 16 bp, C. familiaris
cagagggagaagctag

SEQ ID NO: 309474 - DNA, 16 bp, C. familiaris
cagagggagaagctcc

SEQ ID NO: 309475 - DNA, 16 bp, C. familiaris
cagagggagaaggaca

SEQ ID NO: 309476 - DNA, 16 bp, C. familiaris
cagagggagagacaca

SEQ ID NO: 309477 - DNA, 16 bp, C. familiaris
cagagggagatgaaga

SEQ ID NO: 309478 - DNA, 16 bp, C. familiaris
cagagggagatggaga

SEQ ID NO: 309479 - DNA, 16 bp, C. familiaris
cagagggagcaacagg

SEQ ID NO: 309480 - DNA, 16 bp, C. familiaris
cagagggagcagcaag

SEQ ID NO: 309481 - DNA, 16 bp, C. familiaris
cagagggaggagctgg

SEQ ID NO: 309482 - DNA, 16 bp, C. familiaris
cagagggaggaggctc

SEQ ID NO: 309483 - DNA, 16 bp, C. familiaris
cagagggaggcagaga

SEQ ID NO: 309484 - DNA, 16 bp, C. familiaris
cagagggagtgtggcc

SEQ ID NO: 309485 - DNA, 16 bp, C. familiaris
cagagggatgcctggg

SEQ ID NO: 309486 - DNA, 16 bp, C. familiaris
cagagggcagagggca

SEQ ID NO: 309487 - DNA, 16 bp, C. familiaris
cagagggcctgcttct

SEQ ID NO: 309488 - DNA, 16 bp, C. familiaris
cagaggggagaagcag

SEQ ID NO: 309489 - DNA, 16 bp, C. familiaris
cagaggggaggctggg

SEQ ID NO: 309490 - DNA, 16 bp, C. familiaris
cagaggggcagaggaa

SEQ ID NO: 309491 - DNA, 16 bp, C. familiaris
cagagggggatggaga

SEQ ID NO: 309492 - DNA, 16 bp, C. familiaris
cagaggggtggaggga

SEQ ID NO: 309493 - DNA, 16 bp, C. familiaris
cagaggtagaagcaag

SEQ ID NO: 309494 - DNA, 16 bp, C. familiaris
cagaggtcagaggtca

SEQ ID NO: 309495 - DNA, 16 bp, C. familiaris
cagaggttagaagcag

SEQ ID NO: 309496 - DNA, 16 bp, C. familiaris
cagagtacctgggtgg

SEQ ID NO: 309497 - DNA, 16 bp, C. familiaris
cagagtcagagaaaga

SEQ ID NO: 309498 - DNA, 16 bp, C. familiaris
cagagtcagagagaga

SEQ ID NO: 309499 - DNA, 16 bp, C. familiaris
cagagtcctgagattg

SEQ ID NO: 309500 - DNA, 16 bp, C. familiaris
cagagtctcaggatcg

SEQ ID NO: 309501 - DNA, 16 bp, C. familiaris
cagagtctgctcaaga

SEQ ID NO: 309502 - DNA, 16 bp, C. familiaris
cagagtgagaaacagg

SEQ ID NO: 309503 - DNA, 16 bp, C. familiaris
cagagtggctggacca

SEQ ID NO: 309504 - DNA, 16 bp, C. familiaris
cagagttagaaaaaaa

SEQ ID NO: 309505 - DNA, 16 bp, C. familiaris
cagagttggtttcttc

SEQ ID NO: 309506 - DNA, 16 bp, C. familiaris
cagagtttctcaacct

SEQ ID NO: 309507 - DNA, 16 bp, C. familiaris
cagagtttggagtctt

SEQ ID NO: 309508 - DNA, 16 bp, C. familiaris
cagataaaaagcttct

SEQ ID NO: 309509 - DNA, 16 bp, C. familiaris
cagataaaatacaaga

SEQ ID NO: 309510 - DNA, 16 bp, C. familiaris
cagataaaatattttt

SEQ ID NO: 309511 - DNA, 16 bp, C. familiaris
cagataaaatttattt

SEQ ID NO: 309512 - DNA, 16 bp, C. familiaris
cagataaagaaactga

SEQ ID NO: 309513 - DNA, 16 bp, C. familiaris
cagataaatggaatca

SEQ ID NO: 309514 - DNA, 16 bp, C. familiaris
cagataagaaaaatga

SEQ ID NO: 309515 - DNA, 16 bp, C. familiaris
cagataaggaaactga

SEQ ID NO: 309516 - DNA, 16 bp, C. familiaris
cagataatgatctcag

SEQ ID NO: 309517 - DNA, 16 bp, C. familiaris
cagataatggttagca

SEQ ID NO: 309518 - DNA, 16 bp, C. familiaris
cagatacaaaaggaca

SEQ ID NO: 309519 - DNA, 16 bp, C. familiaris
cagatacctcttcaag

SEQ ID NO: 309520 - DNA, 16 bp, C. familiaris
cagatatatgaaaaga

SEQ ID NO: 309521 - DNA, 16 bp, C. familiaris
cagatatctctttaag

SEQ ID NO: 309522 - DNA, 16 bp, C. familiaris
cagatatgtttttttt

SEQ ID NO: 309523 - DNA, 16 bp, C. familiaris
cagatatttttttcct

SEQ ID NO: 309524 - DNA, 16 bp, C. familiaris
cagatcaataaaacca

SEQ ID NO: 309525 - DNA, 16 bp, C. familiaris
cagatcagcagcatca

SEQ ID NO: 309526 - DNA, 16 bp, C. familiaris
cagatcatggcctgag

SEQ ID NO: 309527 - DNA, 16 bp, C. familiaris
cagatccagcaggcag

SEQ ID NO: 309528 - DNA, 16 bp, C. familiaris
cagatcccacaggtta

SEQ ID NO: 309529 - DNA, 16 bp, C. familiaris
cagatcctgatctcag

SEQ ID NO: 309530 - DNA, 16 bp, C. familiaris
cagatctggaggctgg

SEQ ID NO: 309531 - DNA, 16 bp, C. familiaris
cagatcttggaaacta

SEQ ID NO: 309532 - DNA, 16 bp, C. familiaris
cagatgaacagcctga

SEQ ID NO: 309533 - DNA, 16 bp, C. familiaris
cagatgaagaaaaaga

SEQ ID NO: 309534 - DNA, 16 bp, C. familiaris
cagatgaagaaatgag

SEQ ID NO: 309535 - DNA, 16 bp, C. familiaris
cagatgaagaaattga

SEQ ID NO: 309536 - DNA, 16 bp, C. familiaris
cagatgaagaatctga

SEQ ID NO: 309537 - DNA, 16 bp, C. familiaris
cagatgaagagatata

SEQ ID NO: 309538 - DNA, 16 bp, C. familiaris
cagatgaagaggtaca

SEQ ID NO: 309539 - DNA, 16 bp, C. familiaris
cagatgaaggaactga

SEQ ID NO: 309540 - DNA, 16 bp, C. familiaris
cagatgaattctacca

SEQ ID NO: 309541 - DNA, 16 bp, C. familiaris
cagatgacatgactgt

SEQ ID NO: 309542 - DNA, 16 bp, C. familiaris
cagatgacttggggac

SEQ ID NO: 309543 - DNA, 16 bp, C. familiaris
cagatgagaaaatgct

SEQ ID NO: 309544 - DNA, 16 bp, C. familiaris
cagatgagcaaagaaa

SEQ ID NO: 309545 - DNA, 16 bp, C. familiaris
cagatgagccacccag

SEQ ID NO: 309546 - DNA, 16 bp, C. familiaris
cagatgaggaaaactg

SEQ ID NO: 309547 - DNA, 16 bp, C. familiaris
cagatgaggaagagga

SEQ ID NO: 309548 - DNA, 16 bp, C. familiaris
cagatgaggaagctga

SEQ ID NO: 309549 - DNA, 16 bp, C. familiaris
cagatgaggaatctga

SEQ ID NO: 309550 - DNA, 16 bp, C. familiaris
cagatgaggaggctga

SEQ ID NO: 309551 - DNA, 16 bp, C. familiaris
cagatgataaaactga

SEQ ID NO: 309552 - DNA, 16 bp, C. familiaris
cagatgatgatgatga

SEQ ID NO: 309553 - DNA, 16 bp, C. familiaris
cagatgcagaaacaga

SEQ ID NO: 309554 - DNA, 16 bp, C. familiaris
cagatgcagtgaaaca

SEQ ID NO: 309555 - DNA, 16 bp, C. familiaris
cagatgccagccaagg

SEQ ID NO: 309556 - DNA, 16 bp, C. familiaris
cagatgctcaaacaac

SEQ ID NO: 309557 - DNA, 16 bp, C. familiaris
cagatgctcaagcact

SEQ ID NO: 309558 - DNA, 16 bp, C. familiaris
cagatgctgaactgct

SEQ ID NO: 309559 - DNA, 16 bp, C. familiaris
cagatggacctaacag

SEQ ID NO: 309560 - DNA, 16 bp, C. familiaris
cagatggagaaactaa

SEQ ID NO: 309561 - DNA, 16 bp, C. familiaris
cagatggagaggaaga

SEQ ID NO: 309562 - DNA, 16 bp, C. familiaris
cagatggagagggaga

SEQ ID NO: 309563 - DNA, 16 bp, C. familiaris
cagatggcaaaactga

SEQ ID NO: 309564 - DNA, 16 bp, C. familiaris
cagatggcatgatatt

SEQ ID NO: 309565 - DNA, 16 bp, C. familiaris
cagatggctaccttct

SEQ ID NO: 309566 - DNA, 16 bp, C. familiaris
cagatggcttctcagg

SEQ ID NO: 309567 - DNA, 16 bp, C. familiaris
cagatggggcacctgg

SEQ ID NO: 309568 - DNA, 16 bp, C. familiaris
cagatggtttcacagg

SEQ ID NO: 309569 - DNA, 16 bp, C. familiaris
cagatgtggaaacaga

SEQ ID NO: 309570 - DNA, 16 bp, C. familiaris
cagatgtggggctgga

SEQ ID NO: 309571 - DNA, 16 bp, C. familiaris
cagatgttggtgagga

SEQ ID NO: 309572 - DNA, 16 bp, C. familiaris
cagattaagaaactga

SEQ ID NO: 309573 - DNA, 16 bp, C. familiaris
cagattacaaaaataa

SEQ ID NO: 309574 - DNA, 16 bp, C. familiaris
cagattcctgctgagc

SEQ ID NO: 309575 - DNA, 16 bp, C. familiaris
cagattctcaggcctc

SEQ ID NO: 309576 - DNA, 16 bp, C. familiaris
cagattgaaaaggaag

SEQ ID NO: 309577 - DNA, 16 bp, C. familiaris
cagattgagtcccacg

SEQ ID NO: 309578 - DNA, 16 bp, C. familiaris
cagattggcttccttc

SEQ ID NO: 309579 - DNA, 16 bp, C. familiaris
cagatttattgaggta

SEQ ID NO: 309580 - DNA, 16 bp, C. familiaris
cagatttatttaaaaa

SEQ ID NO: 309581 - DNA, 16 bp, C. familiaris
cagatttcaaattata

SEQ ID NO: 309582 - DNA, 16 bp, C. familiaris
cagatttcaatatata

SEQ ID NO: 309583 - DNA, 16 bp, C. familiaris
cagattttgaaaaaaa

SEQ ID NO: 309584 - DNA, 16 bp, C. familiaris
cagattttggacttgc

SEQ ID NO: 309585 - DNA, 17 bp, C. familiaris
cagcaaaagatacagtc

SEQ ID NO: 309586 - DNA, 16 bp, C. familiaris
cagcaaaagcagacct

SEQ ID NO: 309587 - DNA, 16 bp, C. familiaris
cagcaaaagctgtcct

SEQ ID NO: 309588 - DNA, 16 bp, C. familiaris
cagcaaaataaacagt

SEQ ID NO: 309589 - DNA, 16 bp, C. familiaris
cagcaaaatcaccaac

SEQ ID NO: 309590 - DNA, 16 bp, C. familiaris
cagcaaaccatgaaag

SEQ ID NO: 309591 - DNA, 16 bp, C. familiaris
cagcaaaccatgagag

SEQ ID NO: 309592 - DNA, 16 bp, C. familiaris
cagcaaagaaattaaa

SEQ ID NO: 309593 - DNA, 16 bp, C. familiaris
cagcaaaggatggttt

SEQ ID NO: 309594 - DNA, 22 bp, C. familiaris
cagcaaatagatcctacaccca

SEQ ID NO: 309595 - DNA, 16 bp, C. familiaris
cagcaacagcagcaac

SEQ ID NO: 309596 - DNA, 16 bp, C. familiaris
cagcaaccaccagaag

SEQ ID NO: 309597 - DNA, 16 bp, C. familiaris
cagcaacctcagtttg

SEQ ID NO: 309598 - DNA, 16 bp, C. familiaris
cagcaacttcttgctg

SEQ ID NO: 309599 - DNA, 16 bp, C. familiaris
cagcaagagaaaaccc

SEQ ID NO: 309600 - DNA, 16 bp, C. familiaris
cagcaagagagaagca

SEQ ID NO: 309601 - DNA, 16 bp, C. familiaris
cagcaagagtctgctt

SEQ ID NO: 309602 - DNA, 16 bp, C. familiaris
cagcaagcagtctgct

SEQ ID NO: 309603 - DNA, 16 bp, C. familiaris
cagcaaggagcctgct

SEQ ID NO: 309604 - DNA, 21 bp, C. familiaris
cagcaagtattatgtgaccat

SEQ ID NO: 309605 - DNA, 16 bp, C. familiaris
cagcaagtgcaaaggt

SEQ ID NO: 309606 - DNA, 16 bp, C. familiaris
cagcaataaggctgtt

SEQ ID NO: 309607 - DNA, 16 bp, C. familiaris
cagcaatgaaaataaa

SEQ ID NO: 309608 - DNA, 16 bp, C. familiaris
cagcaatggacagatc

SEQ ID NO: 309609 - DNA, 16 bp, C. familiaris
cagcaatggcactgct

SEQ ID NO: 309610 - DNA, 16 bp, C. familiaris
cagcaatggccacagt

SEQ ID NO: 309611 - DNA, 16 bp, C. familiaris
cagcaattacactact

SEQ ID NO: 309612 - DNA, 16 bp, C. familiaris
cagcaattccatttct

SEQ ID NO: 309613 - DNA, 16 bp, C. familiaris
cagcaattgcactctt

SEQ ID NO: 309614 - DNA, 21 bp, C. familiaris
cagcacacgggcttgcagcag

SEQ ID NO: 309615 - DNA, 16 bp, C. familiaris
cagcacagcagaccct

SEQ ID NO: 309616 - DNA, 16 bp, C. familiaris
cagcacagcagcccct

SEQ ID NO: 309617 - DNA, 16 bp, C. familiaris
cagcacatatactaaa

SEQ ID NO: 309618 - DNA, 16 bp, C. familiaris
cagcaccaccagcagc

SEQ ID NO: 309619 - DNA, 16 bp, C. familiaris
cagcaccacctgggaa

SEQ ID NO: 309620 - DNA, 16 bp, C. familiaris
cagcaccacggacagc

SEQ ID NO: 309621 - DNA, 16 bp, C. familiaris
cagcaccgccttcagc

SEQ ID NO: 309622 - DNA, 16 bp, C. familiaris
cagcactgaggggggc

SEQ ID NO: 309623 - DNA, 16 bp, C. familiaris
cagcactttacagttt

SEQ ID NO: 309624 - DNA, 16 bp, C. familiaris
cagcagaaggagaagc

SEQ ID NO: 309625 - DNA, 16 bp, C. familiaris
cagcagacagagggag

SEQ ID NO: 309626 - DNA, 16 bp, C. familiaris
cagcagagaggagaga

SEQ ID NO: 309627 - DNA, 16 bp, C. familiaris
cagcagagggagagag

SEQ ID NO: 309628 - DNA, 16 bp, C. familiaris
cagcagagtctgcttt

SEQ ID NO: 309629 - DNA, 16 bp, C. familiaris
cagcagatgcaggaaa

SEQ ID NO: 309630 - DNA, 16 bp, C. familiaris
cagcagatttctcagc

SEQ ID NO: 309631 - DNA, 16 bp, C. familiaris
cagcagcaagaggaaa

SEQ ID NO: 309632 - DNA, 16 bp, C. familiaris
cagcagcaataggaaa

SEQ ID NO: 309633 - DNA, 16 bp, C. familiaris
cagcagcacagggccc

SEQ ID NO: 309634 - DNA, 16 bp, C. familiaris
cagcagcaccagcacc

SEQ ID NO: 309635 - DNA, 16 bp, C. familiaris
cagcagcaccagcagc

SEQ ID NO: 309636 - DNA, 16 bp, C. familiaris
cagcagcagagctggg

SEQ ID NO: 309637 - DNA, 16 bp, C. familiaris
cagcagcagcaacaaa

SEQ ID NO: 309638 - DNA, 16 bp, C. familiaris
cagcagcagcaccagc

SEQ ID NO: 309639 - DNA, 16 bp, C. familiaris
cagcagcagcacctgg

SEQ ID NO: 309640 - DNA, 16 bp, C. familiaris
cagcagcagcagaagc

SEQ ID NO: 309641 - DNA, 16 bp, C. familiaris
cagcagcagcagcacc

SEQ ID NO: 309642 - DNA, 17 bp, C. familiaris
cagcagcagcagcagag

SEQ ID NO: 309643 - DNA, 17 bp, C. familiaris
cagcagcagcagcagct

SEQ ID NO: 309644 - DNA, 16 bp, C. familiaris
cagcagcagcagcagt

SEQ ID NO: 309645 - DNA, 16 bp, C. familiaris
cagcagcagcagcatt

SEQ ID NO: 309646 - DNA, 16 bp, C. familiaris
cagcagcagcagccac

SEQ ID NO: 309647 - DNA, 16 bp, C. familiaris
cagcagcagcagccca

SEQ ID NO: 309648 - DNA, 16 bp, C. familiaris
cagcagcagcagcccc

SEQ ID NO: 309649 - DNA, 16 bp, C. familiaris
cagcagcagcagcggg

SEQ ID NO: 309650 - DNA, 16 bp, C. familiaris
cagcagcagcagctgc

SEQ ID NO: 309651 - DNA, 16 bp, C. familiaris
cagcagcagcaggaag

SEQ ID NO: 309652 - DNA, 16 bp, C. familiaris
cagcagcagccccagc

SEQ ID NO: 309653 - DNA, 16 bp, C. familiaris
cagcagcagccccagg

SEQ ID NO: 309654 - DNA, 16 bp, C. familiaris
cagcagcagccgcagc

SEQ ID NO: 309655 - DNA, 16 bp, C. familiaris
cagcagcaggggcagc

SEQ ID NO: 309656 - DNA, 16 bp, C. familiaris
cagcagcatcagcacc

SEQ ID NO: 309657 - DNA, 16 bp, C. familiaris
cagcagccacagcagc

SEQ ID NO: 309658 - DNA, 16 bp, C. familiaris
cagcagccagaatgat

SEQ ID NO: 309659 - DNA, 16 bp, C. familiaris
cagcagccatcaacat

SEQ ID NO: 309660 - DNA, 16 bp, C. familiaris
cagcagccccagcagc

SEQ ID NO: 309661 - DNA, 16 bp, C. familiaris
cagcagccccaggaag

SEQ ID NO: 309662 - DNA, 16 bp, C. familiaris
cagcagccctagcaaa

SEQ ID NO: 309663 - DNA, 16 bp, C. familiaris
cagcagccgcagcagc

SEQ ID NO: 309664 - DNA, 16 bp, C. familiaris
cagcagcggcagcagc

SEQ ID NO: 309665 - DNA, 16 bp, C. familiaris
cagcagcggcggcggc

SEQ ID NO: 309666 - DNA, 16 bp, C. familiaris
cagcagctcttcctgc

SEQ ID NO: 309667 - DNA, 16 bp, C. familiaris
cagcagctgcagcagc

SEQ ID NO: 309668 - DNA, 16 bp, C. familiaris
cagcagcttaaaacaa

SEQ ID NO: 309669 - DNA, 16 bp, C. familiaris
cagcaggaagtagcca

SEQ ID NO: 309670 - DNA, 16 bp, C. familiaris
cagcaggaggagcaga

SEQ ID NO: 309671 - DNA, 16 bp, C. familiaris
cagcaggatggaagaa

SEQ ID NO: 309672 - DNA, 16 bp, C. familiaris
cagcaggcagcaggca

SEQ ID NO: 309673 - DNA, 16 bp, C. familiaris
cagcaggcagcctgct

SEQ ID NO: 309674 - DNA, 16 bp, C. familiaris
cagcaggcctctccac

SEQ ID NO: 309675 - DNA, 16 bp, C. familiaris
cagcaggctccctgcg

SEQ ID NO: 309676 - DNA, 16 bp, C. familiaris
cagcaggctggatttg

SEQ ID NO: 309677 - DNA, 16 bp, C. familiaris
cagcagggagaggcag

SEQ ID NO: 309678 - DNA, 16 bp, C. familiaris
cagcagggaggagcag

SEQ ID NO: 309679 - DNA, 16 bp, C. familiaris
cagcagggagtgtgct

SEQ ID NO: 309680 - DNA, 16 bp, C. familiaris
cagcagggccaggctc

SEQ ID NO: 309681 - DNA, 16 bp, C. familiaris
cagcagggctgggggc

SEQ ID NO: 309682 - DNA, 16 bp, C. familiaris
cagcaggggagcctgc

SEQ ID NO: 309683 - DNA, 16 bp, C. familiaris
cagcaggggcacctgg

SEQ ID NO: 309684 - DNA, 16 bp, C. familiaris
cagcagggggcagcag

SEQ ID NO: 309685 - DNA, 16 bp, C. familiaris
cagcagggggtctgct

SEQ ID NO: 309686 - DNA, 16 bp, C. familiaris
cagcaggtagagggag

SEQ ID NO: 309687 - DNA, 16 bp, C. familiaris
cagcaggtctgggatg

SEQ ID NO: 309688 - DNA, 16 bp, C. familiaris
cagcaggtgcagcagg

SEQ ID NO: 309689 - DNA, 16 bp, C. familiaris
cagcagtaaaaatgaa

SEQ ID NO: 309690 - DNA, 16 bp, C. familiaris
cagcagtacattaaga

SEQ ID NO: 309691 - DNA, 16 bp, C. familiaris
cagcagtgagtctgtt

SEQ ID NO: 309692 - DNA, 16 bp, C. familiaris
cagcagttcagcatct

SEQ ID NO: 309693 - DNA, 16 bp, C. familiaris
cagcagttcttctggg

SEQ ID NO: 309694 - DNA, 16 bp, C. familiaris
cagcagtttggtgctg

SEQ ID NO: 309695 - DNA, 16 bp, C. familiaris
cagcataaagagaaat

SEQ ID NO: 309696 - DNA, 16 bp, C. familiaris
cagcatcaacatcacc

SEQ ID NO: 309697 - DNA, 16 bp, C. familiaris
cagcatcagcaccacc

SEQ ID NO: 309698 - DNA, 16 bp, C. familiaris
cagcatcagcatcact

SEQ ID NO: 309699 - DNA, 16 bp, C. familiaris
cagcatcagcatcagc

SEQ ID NO: 309700 - DNA, 16 bp, C. familiaris
cagcatctttcacaga

SEQ ID NO: 309701 - DNA, 16 bp, C. familiaris
cagcatgagcagaggg

SEQ ID NO: 309702 - DNA, 16 bp, C. familiaris
cagcatgcagcctgct

SEQ ID NO: 309703 - DNA, 16 bp, C. familiaris
cagcatggaaacagtg

SEQ ID NO: 309704 - DNA, 16 bp, C. familiaris
cagcatggaggctgct

SEQ ID NO: 309705 - DNA, 16 bp, C. familiaris
cagcatggagtgtgct

SEQ ID NO: 309706 - DNA, 16 bp, C. familiaris
cagcatggggaataca

SEQ ID NO: 309707 - DNA, 16 bp, C. familiaris
cagcattatttattta

SEQ ID NO: 309708 - DNA, 16 bp, C. familiaris
cagcatttggtgctgt

SEQ ID NO: 309709 - DNA, 16 bp, C. familiaris
cagcattttttctttt

SEQ ID NO: 309710 - DNA, 16 bp, C. familiaris
cagccaaaatgtggaa

SEQ ID NO: 309711 - DNA, 16 bp, C. familiaris
cagccaaagaggccga

SEQ ID NO: 309712 - DNA, 16 bp, C. familiaris
cagccaaaggcaggtg

SEQ ID NO: 309713 - DNA, 16 bp, C. familiaris
cagccaactcttgatt

SEQ ID NO: 309714 - DNA, 16 bp, C. familiaris
cagccaagaatccttt

SEQ ID NO: 309715 - DNA, 16 bp, C. familiaris
cagccaagaattcttt

SEQ ID NO: 309716 - DNA, 16 bp, C. familiaris
cagccaagtgcccccc

SEQ ID NO: 309717 - DNA, 16 bp, C. familiaris
cagccaagtttgagaa

SEQ ID NO: 309718 - DNA, 16 bp, C. familiaris
cagccaatggctttgg

SEQ ID NO: 309719 - DNA, 16 bp, C. familiaris
cagccacagctcccag

SEQ ID NO: 309720 - DNA, 16 bp, C. familiaris
cagccaccatgctgtg

SEQ ID NO: 309721 - DNA, 16 bp, C. familiaris
cagccaccctggcctc

SEQ ID NO: 309722 - DNA, 16 bp, C. familiaris
cagccactcaactgac

SEQ ID NO: 309723 - DNA, 16 bp, C. familiaris
cagccactctgcaaaa

SEQ ID NO: 309724 - DNA, 16 bp, C. familiaris
cagccactgtgaaaaa

SEQ ID NO: 309725 - DNA, 16 bp, C. familiaris
cagccactgtggaaaa

SEQ ID NO: 309726 - DNA, 16 bp, C. familiaris
cagccactgttctaag

SEQ ID NO: 309727 - DNA, 16 bp, C. familiaris
cagccactttagaaaa

SEQ ID NO: 309728 - DNA, 16 bp, C. familiaris
cagccactttggaaga

SEQ ID NO: 309729 - DNA, 16 bp, C. familiaris
cagccactttggagaa

SEQ ID NO: 309730 - DNA, 16 bp, C. familiaris
cagccagaagagatac

SEQ ID NO: 309731 - DNA, 16 bp, C. familiaris
cagccagcagccagca

SEQ ID NO: 309732 - DNA, 16 bp, C. familiaris
cagccagccagccagc

SEQ ID NO: 309733 - DNA, 16 bp, C. familiaris
cagccaggagccccag

SEQ ID NO: 309734 - DNA, 16 bp, C. familiaris
cagccaggagtctgtt

SEQ ID NO: 309735 - DNA, 16 bp, C. familiaris
cagccaggcagccctg

SEQ ID NO: 309736 - DNA, 16 bp, C. familiaris
cagccaggctccccag

SEQ ID NO: 309737 - DNA, 16 bp, C. familiaris
cagccaggctcccctc

SEQ ID NO: 309738 - DNA, 16 bp, C. familiaris
cagccaggctcccctg

SEQ ID NO: 309739 - DNA, 16 bp, C. familiaris
cagccagggaccaccc

SEQ ID NO: 309740 - DNA, 16 bp, C. familiaris
cagccaggggcccctg

SEQ ID NO: 309741 - DNA, 16 bp, C. familiaris
cagccaggtaccccaa

SEQ ID NO: 309742 - DNA, 16 bp, C. familiaris
cagccaggtgcccaga

SEQ ID NO: 309743 - DNA, 16 bp, C. familiaris
cagccaggtgccccat

SEQ ID NO: 309744 - DNA, 16 bp, C. familiaris
cagccaggtgccctga

SEQ ID NO: 309745 - DNA, 16 bp, C. familiaris
cagccaggtgcctccc

SEQ ID NO: 309746 - DNA, 16 bp, C. familiaris
cagccaggtgctcctc

SEQ ID NO: 309747 - DNA, 16 bp, C. familiaris
cagccaggtgtcccag

SEQ ID NO: 309748 - DNA, 16 bp, C. familiaris
cagccatcaccactat

SEQ ID NO: 309749 - DNA, 16 bp, C. familiaris
cagccatcagaaaaaa

SEQ ID NO: 309750 - DNA, 16 bp, C. familiaris
cagccatctgcaaacc

SEQ ID NO: 309751 - DNA, 16 bp, C. familiaris
cagccattaaaaagaa

SEQ ID NO: 309752 - DNA, 16 bp, C. familiaris
cagccattccacttct

SEQ ID NO: 309753 - DNA, 16 bp, C. familiaris
cagccattctggaaaa

SEQ ID NO: 309754 - DNA, 16 bp, C. familiaris
cagccattctggagaa

SEQ ID NO: 309755 - DNA, 16 bp, C. familiaris
cagcccaagggtccat

SEQ ID NO: 309756 - DNA, 16 bp, C. familiaris
cagcccacggcatgat

SEQ ID NO: 309757 - DNA, 16 bp, C. familiaris
cagcccagcaggcccc

SEQ ID NO: 309758 - DNA, 16 bp, C. familiaris
cagcccagcccagcct

SEQ ID NO: 309759 - DNA, 16 bp, C. familiaris
cagcccagcccctggc

SEQ ID NO: 309760 - DNA, 16 bp, C. familiaris
cagcccagcctggagc

SEQ ID NO: 309761 - DNA, 16 bp, C. familiaris
cagcccaggaagccag

SEQ ID NO: 309762 - DNA, 16 bp, C. familiaris
cagcccaggaccctga

SEQ ID NO: 309763 - DNA, 16 bp, C. familiaris
cagcccaggccagccc

SEQ ID NO: 309764 - DNA, 16 bp, C. familiaris
cagcccaggccccagg

SEQ ID NO: 309765 - DNA, 16 bp, C. familiaris
cagcccaggcctgggg

SEQ ID NO: 309766 - DNA, 16 bp, C. familiaris
cagcccagggccaggg

SEQ ID NO: 309767 - DNA, 16 bp, C. familiaris
cagcccagggcccagg

SEQ ID NO: 309768 - DNA, 16 bp, C. familiaris
cagcccagggcctggg

SEQ ID NO: 309769 - DNA, 16 bp, C. familiaris
cagcccaggggcctga

SEQ ID NO: 309770 - DNA, 16 bp, C. familiaris
cagcccatggatcaag

SEQ ID NO: 309771 - DNA, 16 bp, C. familiaris
cagccccaccctccag

SEQ ID NO: 309772 - DNA, 16 bp, C. familiaris
cagccccagagccagc

SEQ ID NO: 309773 - DNA, 16 bp, C. familiaris
cagccccagcacccag

SEQ ID NO: 309774 - DNA, 16 bp, C. familiaris
cagccccagcagtggg

SEQ ID NO: 309775 - DNA, 16 bp, C. familiaris
cagccccagctctgcc

SEQ ID NO: 309776 - DNA, 16 bp, C. familiaris
cagccccaggcccagc

SEQ ID NO: 309777 - DNA, 16 bp, C. familiaris
cagccccaggccctgg

SEQ ID NO: 309778 - DNA, 16 bp, C. familiaris
cagccccaggggcagg

SEQ ID NO: 309779 - DNA, 16 bp, C. familiaris
cagccccagtggctca

SEQ ID NO: 309780 - DNA, 16 bp, C. familiaris
cagccccatgtgggac

SEQ ID NO: 309781 - DNA, 16 bp, C. familiaris
cagcccccagcccagg

SEQ ID NO: 309782 - DNA, 16 bp, C. familiaris
cagcccccaggccctg

SEQ ID NO: 309783 - DNA, 16 bp, C. familiaris
cagcccccagggaggg

SEQ ID NO: 309784 - DNA, 18 bp, C. familiaris
cagccccctccgtggagc

SEQ ID NO: 309785 - DNA, 16 bp, C. familiaris
cagcccctccctgggc

SEQ ID NO: 309786 - DNA, 16 bp, C. familiaris
cagcccctcctcctgg

SEQ ID NO: 309787 - DNA, 16 bp, C. familiaris
cagcccctcctctgtg

SEQ ID NO: 309788 - DNA, 16 bp, C. familiaris
cagcccctgacagcca

SEQ ID NO: 309789 - DNA, 16 bp, C. familiaris
cagcccctgcagcccc

SEQ ID NO: 309790 - DNA, 16 bp, C. familiaris
cagcccctggcagcca

SEQ ID NO: 309791 - DNA, 16 bp, C. familiaris
cagcccctggccacca

SEQ ID NO: 309792 - DNA, 16 bp, C. familiaris
cagcccctggccccca

SEQ ID NO: 309793 - DNA, 16 bp, C. familiaris
cagcccctgtggaaaa

SEQ ID NO: 309794 - DNA, 16 bp, C. familiaris
cagccccttccctgcc

SEQ ID NO: 309795 - DNA, 16 bp, C. familiaris
cagccccttcctctgg

SEQ ID NO: 309796 - DNA, 16 bp, C. familiaris
cagcccgatggctcag

SEQ ID NO: 309797 - DNA, 16 bp, C. familiaris
cagccctacatcaggc

SEQ ID NO: 309798 - DNA, 16 bp, C. familiaris
cagccctgcagccctg

SEQ ID NO: 309799 - DNA, 16 bp, C. familiaris
cagccctgccagcacc

SEQ ID NO: 309800 - DNA, 16 bp, C. familiaris
cagccctgcccacacc

SEQ ID NO: 309801 - DNA, 16 bp, C. familiaris
cagccctgcccagccc

SEQ ID NO: 309802 - DNA, 16 bp, C. familiaris
cagccctgcccccagg

SEQ ID NO: 309803 - DNA, 16 bp, C. familiaris
cagccctgcccctgcc

SEQ ID NO: 309804 - DNA, 16 bp, C. familiaris
cagccctgccctctgc

SEQ ID NO: 309805 - DNA, 16 bp, C. familiaris
cagccctgccctggcc

SEQ ID NO: 309806 - DNA, 16 bp, C. familiaris
cagccctgcctgcccc

SEQ ID NO: 309807 - DNA, 16 bp, C. familiaris
cagccctgctgccctg

SEQ ID NO: 309808 - DNA, 16 bp, C. familiaris
cagccctgctggcacc

SEQ ID NO: 309809 - DNA, 16 bp, C. familiaris
cagccctggcctggcc

SEQ ID NO: 309810 - DNA, 16 bp, C. familiaris
cagccctgggccctgg

SEQ ID NO: 309811 - DNA, 16 bp, C. familiaris
cagccctggtgaccag

SEQ ID NO: 309812 - DNA, 16 bp, C. familiaris
cagccctggtggccca

SEQ ID NO: 309813 - DNA, 16 bp, C. familiaris
cagccgcagccgcagc

SEQ ID NO: 309814 - DNA, 16 bp, C. familiaris
cagcctaggatgtgat

SEQ ID NO: 309815 - DNA, 16 bp, C. familiaris
cagcctcagtggccca

SEQ ID NO: 309816 - DNA, 16 bp, C. familiaris
cagcctcagtttccct

SEQ ID NO: 309817 - DNA, 16 bp, C. familiaris
cagcctccatgcagag

SEQ ID NO: 309818 - DNA, 16 bp, C. familiaris
cagcctcccagcctcc

SEQ ID NO: 309819 - DNA, 16 bp, C. familiaris
cagcctccccagcagc

SEQ ID NO: 309820 - DNA, 16 bp, C. familiaris
cagcctccctccccag

SEQ ID NO: 309821 - DNA, 16 bp, C. familiaris
cagcctccctgcaagg

SEQ ID NO: 309822 - DNA, 16 bp, C. familiaris
cagcctcctcacctct

SEQ ID NO: 309823 - DNA, 16 bp, C. familiaris
cagcctcctggcctcc

SEQ ID NO: 309824 - DNA, 16 bp, C. familiaris
cagcctctgcctctgc

SEQ ID NO: 309825 - DNA, 16 bp, C. familiaris
cagcctctgggagcag

SEQ ID NO: 309826 - DNA, 16 bp, C. familiaris
cagcctgcagcccggg

SEQ ID NO: 309827 - DNA, 16 bp, C. familiaris
cagcctgccagcctgc

SEQ ID NO: 309828 - DNA, 16 bp, C. familiaris
cagcctgcccttggcc

SEQ ID NO: 309829 - DNA, 16 bp, C. familiaris
cagcctgctggcctgc

SEQ ID NO: 309830 - DNA, 16 bp, C. familiaris
cagcctgcttctcctt

SEQ ID NO: 309831 - DNA, 16 bp, C. familiaris
cagcctggcccagccc

SEQ ID NO: 309832 - DNA, 16 bp, C. familiaris
cagcctggcctggcct

SEQ ID NO: 309833 - DNA, 16 bp, C. familiaris
cagcctgggctgaagg

SEQ ID NO: 309834 - DNA, 16 bp, C. familiaris
cagcctgggtctctgc

SEQ ID NO: 309835 - DNA, 16 bp, C. familiaris
cagcctgggtggctca

SEQ ID NO: 309836 - DNA, 16 bp, C. familiaris
cagcctgtctctgcct

SEQ ID NO: 309837 - DNA, 16 bp, C. familiaris
cagcctgtgtggctca

SEQ ID NO: 309838 - DNA, 16 bp, C. familiaris
cagccttcaaaaggaa

SEQ ID NO: 309839 - DNA, 16 bp, C. familiaris
cagccttgggctcagg

SEQ ID NO: 309840 - DNA, 16 bp, C. familiaris
cagcctttaaaaggaa

SEQ ID NO: 309841 - DNA, 16 bp, C. familiaris
cagcgaagagggagag

SEQ ID NO: 309842 - DNA, 16 bp, C. familiaris
cagcgagcccgacgtg

SEQ ID NO: 309843 - DNA, 16 bp, C. familiaris
cagcggcagcggcggc

SEQ ID NO: 309844 - DNA, 16 bp, C. familiaris
cagcgggagaagcaga

SEQ ID NO: 309845 - DNA, 16 bp, C. familiaris
cagctacctttggctc

SEQ ID NO: 309846 - DNA, 16 bp, C. familiaris
cagctataaaaaatga

SEQ ID NO: 309847 - DNA, 16 bp, C. familiaris
cagctataagccaata

SEQ ID NO: 309848 - DNA, 16 bp, C. familiaris
cagctcaaggagtgat

SEQ ID NO: 309849 - DNA, 16 bp, C. familiaris
cagctcaaggtgtgat

SEQ ID NO: 309850 - DNA, 16 bp, C. familiaris
cagctcagcccagctc

SEQ ID NO: 309851 - DNA, 16 bp, C. familiaris
cagctcagggtctgat

SEQ ID NO: 309852 - DNA, 16 bp, C. familiaris
cagctcaggtcatggg

SEQ ID NO: 309853 - DNA, 16 bp, C. familiaris
cagctcaggttctgat

SEQ ID NO: 309854 - DNA, 16 bp, C. familiaris
cagctcatcacaaaga

SEQ ID NO: 309855 - DNA, 16 bp, C. familiaris
cagctccagccagcca

SEQ ID NO: 309856 - DNA, 16 bp, C. familiaris
cagctccaggcccagc

SEQ ID NO: 309857 - DNA, 16 bp, C. familiaris
cagctcccaggcagcc

SEQ ID NO: 309858 - DNA, 16 bp, C. familiaris
cagctcccccaggtgc

SEQ ID NO: 309859 - DNA, 17 bp, C. familiaris
cagctccggcaggaact

SEQ ID NO: 309860 - DNA, 16 bp, C. familiaris
cagctcctccagctcc

SEQ ID NO: 309861 - DNA, 16 bp, C. familiaris
cagctcctccctctcc

SEQ ID NO: 309862 - DNA, 16 bp, C. familiaris
cagctcctgcctttgg

SEQ ID NO: 309863 - DNA, 16 bp, C. familiaris
cagctctgcagccctg

SEQ ID NO: 309864 - DNA, 16 bp, C. familiaris
cagctctgccaacacc

SEQ ID NO: 309865 - DNA, 16 bp, C. familiaris
cagctctgctgttgta

SEQ ID NO: 309866 - DNA, 16 bp, C. familiaris
cagctctgtgacttct

SEQ ID NO: 309867 - DNA, 16 bp, C. familiaris
cagctcttcctgccca

SEQ ID NO: 309868 - DNA, 16 bp, C. familiaris
cagctgacagccagca

SEQ ID NO: 309869 - DNA, 16 bp, C. familiaris
cagctgagagagagag

SEQ ID NO: 309870 - DNA, 16 bp, C. familiaris
cagctgagcaaggagc

SEQ ID NO: 309871 - DNA, 16 bp, C. familiaris
cagctgagccaaccag

SEQ ID NO: 309872 - DNA, 16 bp, C. familiaris
cagctgagtgaccttg

SEQ ID NO: 309873 - DNA, 16 bp, C. familiaris
cagctgcagcagcagc

SEQ ID NO: 309874 - DNA, 16 bp, C. familiaris
cagctgccataacaaa

SEQ ID NO: 309875 - DNA, 16 bp, C. familiaris
cagctgcccccagccc

SEQ ID NO: 309876 - DNA, 16 bp, C. familiaris
cagctgcccctgcccc

SEQ ID NO: 309877 - DNA, 16 bp, C. familiaris
cagctgccttcagctc

SEQ ID NO: 309878 - DNA, 16 bp, C. familiaris
cagctgctcctggaac

SEQ ID NO: 309879 - DNA, 16 bp, C. familiaris
cagctgctcttcctgc

SEQ ID NO: 309880 - DNA, 16 bp, C. familiaris
cagctgctttggaaga

SEQ ID NO: 309881 - DNA, 16 bp, C. familiaris
cagctggaagagcatg

SEQ ID NO: 309882 - DNA, 16 bp, C. familiaris
cagctggaaggctaca

SEQ ID NO: 309883 - DNA, 17 bp, C. familiaris
cagctggaatgctacag

SEQ ID NO: 309884 - DNA, 16 bp, C. familiaris
cagctggacacacagc

SEQ ID NO: 309885 - DNA, 16 bp, C. familiaris
cagctggagaaactga

SEQ ID NO: 309886 - DNA, 16 bp, C. familiaris
cagctggagctggagc

SEQ ID NO: 309887 - DNA, 16 bp, C. familiaris
cagctggcaaaggaga

SEQ ID NO: 309888 - DNA, 16 bp, C. familiaris
cagctgggtgactcag

SEQ ID NO: 309889 - DNA, 16 bp, C. familiaris
cagctggttgagcgtc

SEQ ID NO: 309890 - DNA, 16 bp, C. familiaris
cagctgtgtgacttca

SEQ ID NO: 309891 - DNA, 16 bp, C. familiaris
cagctgtttagcactg

SEQ ID NO: 309892 - DNA, 16 bp, C. familiaris
cagcttcacaggcaaa

SEQ ID NO: 309893 - DNA, 16 bp, C. familiaris
cagcttcctgcaggga

SEQ ID NO: 309894 - DNA, 16 bp, C. familiaris
cagcttccttccttga

SEQ ID NO: 309895 - DNA, 16 bp, C. familiaris
cagcttctccatcagc

SEQ ID NO: 309896 - DNA, 16 bp, C. familiaris
cagcttctccctcctc

SEQ ID NO: 309897 - DNA, 16 bp, C. familiaris
cagcttctgcctttgg

SEQ ID NO: 309898 - DNA, 16 bp, C. familiaris
cagcttctggaagctg

SEQ ID NO: 309899 - DNA, 16 bp, C. familiaris
cagcttctggaggcca

SEQ ID NO: 309900 - DNA, 16 bp, C. familiaris
cagcttctttatccat

SEQ ID NO: 309901 - DNA, 16 bp, C. familiaris
cagcttgtcttctatg

SEQ ID NO: 309902 - DNA, 16 bp, C. familiaris
cagctttactcataat

SEQ ID NO: 309903 - DNA, 16 bp, C. familiaris
cagctttattcaaggt

SEQ ID NO: 309904 - DNA, 16 bp, C. familiaris
cagctttggttttatt

SEQ ID NO: 309905 - DNA, 16 bp, C. familiaris
cagctttgtaatacag

SEQ ID NO: 309906 - DNA, 16 bp, C. familiaris
cagctttgtgaccttg

SEQ ID NO: 309907 - DNA, 16 bp, C. familiaris
cagctttgttcttcct

SEQ ID NO: 309908 - DNA, 16 bp, C. familiaris
cagcttttataccttt

SEQ ID NO: 309909 - DNA, 16 bp, C. familiaris
cagcttttctttttct

SEQ ID NO: 309910 - DNA, 16 bp, C. familiaris
cagcttttttcacaga

SEQ ID NO: 309911 - DNA, 16 bp, C. familiaris
caggaaaaaaatggaa

SEQ ID NO: 309912 - DNA, 16 bp, C. familiaris
caggaaaactggacag

SEQ ID NO: 309913 - DNA, 16 bp, C. familiaris
caggaaaagaaaacta

SEQ ID NO: 309914 - DNA, 16 bp, C. familiaris
caggaaacaaatgaaa

SEQ ID NO: 309915 - DNA, 16 bp, C. familiaris
caggaaacaacagatt

SEQ ID NO: 309916 - DNA, 16 bp, C. familiaris
caggaaacaacaggta

SEQ ID NO: 309917 - DNA, 16 bp, C. familiaris
caggaaaccaaaaatg

SEQ ID NO: 309918 - DNA, 16 bp, C. familiaris
caggaaagaaaatcca

SEQ ID NO: 309919 - DNA, 16 bp, C. familiaris
caggaaagaacatcca

SEQ ID NO: 309920 - DNA, 16 bp, C. familiaris
caggaaaggggcagag

SEQ ID NO: 309921 - DNA, 16 bp, C. familiaris
caggaaatgaagaaaa

SEQ ID NO: 309922 - DNA, 16 bp, C. familiaris
caggaacaaggcaaag

SEQ ID NO: 309923 - DNA, 16 bp, C. familiaris
caggaactgaatctgc

SEQ ID NO: 309924 - DNA, 16 bp, C. familiaris
caggaagaaaatgaaa

SEQ ID NO: 309925 - DNA, 16 bp, C. familiaris
caggaagaaattgaaa

SEQ ID NO: 309926 - DNA, 16 bp, C. familiaris
caggaagacttcctgg

SEQ ID NO: 309927 - DNA, 16 bp, C. familiaris
caggaagcaacagatg

SEQ ID NO: 309928 - DNA, 16 bp, C. familiaris
caggaagcaggaggag

SEQ ID NO: 309929 - DNA, 16 bp, C. familiaris
caggaagcctgctgtg

SEQ ID NO: 309930 - DNA, 16 bp, C. familiaris
caggaaggcttcctgg

SEQ ID NO: 309931 - DNA, 16 bp, C. familiaris
caggaagttgctgtgg

SEQ ID NO: 309932 - DNA, 16 bp, C. familiaris
caggaagtttgcttct

SEQ ID NO: 309933 - DNA, 16 bp, C. familiaris
caggaatgtgaccttt

SEQ ID NO: 309934 - DNA, 16 bp, C. familiaris
caggaattcagatcca

SEQ ID NO: 309935 - DNA, 16 bp, C. familiaris
caggaattcagcaaag

SEQ ID NO: 309936 - DNA, 16 bp, C. familiaris
caggaatttatttttt

SEQ ID NO: 309937 - DNA, 16 bp, C. familiaris
caggacagcgaggatg

SEQ ID NO: 309938 - DNA, 16 bp, C. familiaris
caggacaggacaggaa

SEQ ID NO: 309939 - DNA, 16 bp, C. familiaris
caggacaggcagaggc

SEQ ID NO: 309940 - DNA, 16 bp, C. familiaris
caggacagtgaggatg

SEQ ID NO: 309941 - DNA, 16 bp, C. familiaris
caggaccacagcctgg

SEQ ID NO: 309942 - DNA, 16 bp, C. familiaris
caggaccacgccccgg

SEQ ID NO: 309943 - DNA, 16 bp, C. familiaris
caggaccagacagctt

SEQ ID NO: 309944 - DNA, 16 bp, C. familiaris
caggaccaggaccagg

SEQ ID NO: 309945 - DNA, 16 bp, C. familiaris
caggaccaggtcctgg

SEQ ID NO: 309946 - DNA, 16 bp, C. familiaris
caggacccaggacccc

SEQ ID NO: 309947 - DNA, 16 bp, C. familiaris
caggacccaggagggc

SEQ ID NO: 309948 - DNA, 16 bp, C. familiaris
caggacccatgggcag

SEQ ID NO: 309949 - DNA, 16 bp, C. familiaris
caggaccccaggaaca

SEQ ID NO: 309950 - DNA, 16 bp, C. familiaris
caggaccccaggaagg

SEQ ID NO: 309951 - DNA, 16 bp, C. familiaris
caggacccccggatca

SEQ ID NO: 309952 - DNA, 16 bp, C. familiaris
caggaccccgagacca

SEQ ID NO: 309953 - DNA, 16 bp, C. familiaris
caggacccctgggcag

SEQ ID NO: 309954 - DNA, 16 bp, C. familiaris
caggacctcaagatca

SEQ ID NO: 309955 - DNA, 16 bp, C. familiaris
caggacctgtgggcag

SEQ ID NO: 309956 - DNA, 16 bp, C. familiaris
caggactcagagatca

SEQ ID NO: 309957 - DNA, 16 bp, C. familiaris
caggactggatcctgg

SEQ ID NO: 309958 - DNA, 16 bp, C. familiaris
caggagaaaataaaat

SEQ ID NO: 309959 - DNA, 16 bp, C. familiaris
caggagaaaccagccc

SEQ ID NO: 309960 - DNA, 16 bp, C. familiaris
caggagaacacaggca

SEQ ID NO: 309961 - DNA, 16 bp, C. familiaris
caggagagagaggcag

SEQ ID NO: 309962 - DNA, 16 bp, C. familiaris
caggagaggagcagag

SEQ ID NO: 309963 - DNA, 16 bp, C. familiaris
caggagagggatccct

SEQ ID NO: 309964 - DNA, 17 bp, C. familiaris
caggagagtcctcgctg

SEQ ID NO: 309965 - DNA, 16 bp, C. familiaris
caggagagtctgcttc

SEQ ID NO: 309966 - DNA, 16 bp, C. familiaris
caggagagttctcact

SEQ ID NO: 309967 - DNA, 16 bp, C. familiaris
caggagcaacagcccc

SEQ ID NO: 309968 - DNA, 16 bp, C. familiaris
caggagcagaaggagg

SEQ ID NO: 309969 - DNA, 19 bp, C. familiaris
caggagcagcagcagcagc

SEQ ID NO: 309970 - DNA, 16 bp, C. familiaris
caggagcagctgaagg

SEQ ID NO: 309971 - DNA, 16 bp, C. familiaris
caggagcaggagacat

SEQ ID NO: 309972 - DNA, 16 bp, C. familiaris
caggagcaggagcaga

SEQ ID NO: 309973 - DNA, 16 bp, C. familiaris
caggagcaggaggaga

SEQ ID NO: 309974 - DNA, 16 bp, C. familiaris
caggagcagggctggg

SEQ ID NO: 309975 - DNA, 16 bp, C. familiaris
caggagcaggtgcagg

SEQ ID NO: 309976 - DNA, 16 bp, C. familiaris
caggagcatccttgct

SEQ ID NO: 309977 - DNA, 16 bp, C. familiaris
caggagccaggccagg

SEQ ID NO: 309978 - DNA, 16 bp, C. familiaris
caggagcccagagagg

SEQ ID NO: 309979 - DNA, 16 bp, C. familiaris
caggagcccgaggtgg

SEQ ID NO: 309980 - DNA, 16 bp, C. familiaris
caggagcctgatgagg

SEQ ID NO: 309981 - DNA, 16 bp, C. familiaris
caggagctggaagagg

SEQ ID NO: 309982 - DNA, 16 bp, C. familiaris
caggagctggaggagg

SEQ ID NO: 309983 - DNA, 16 bp, C. familiaris
caggagctgggagagg

SEQ ID NO: 309984 - DNA, 16 bp, C. familiaris
caggagctgggggtgg

SEQ ID NO: 309985 - DNA, 16 bp, C. familiaris
caggagcttctgtccc

SEQ ID NO: 309986 - DNA, 16 bp, C. familiaris
caggaggaagagcaga

SEQ ID NO: 309987 - DNA, 16 bp, C. familiaris
caggaggagctgcagg

SEQ ID NO: 309988 - DNA, 16 bp, C. familiaris
caggaggaggagcaga

SEQ ID NO: 309989 - DNA, 16 bp, C. familiaris
caggaggaggaggtgg

SEQ ID NO: 309990 - DNA, 16 bp, C. familiaris
caggaggaggggcaaa

SEQ ID NO: 309991 - DNA, 16 bp, C. familiaris
caggaggcagaagcag

SEQ ID NO: 309992 - DNA, 16 bp, C. familiaris
caggaggcagaggaag

SEQ ID NO: 309993 - DNA, 16 bp, C. familiaris
caggaggctgggggtg

SEQ ID NO: 309994 - DNA, 16 bp, C. familiaris
caggagggaagcagag

SEQ ID NO: 309995 - DNA, 16 bp, C. familiaris
caggagggatgcctgg

SEQ ID NO: 309996 - DNA, 16 bp, C. familiaris
caggagggcagcaggg

SEQ ID NO: 309997 - DNA, 16 bp, C. familiaris
caggagggcagcccgg

SEQ ID NO: 309998 - DNA, 16 bp, C. familiaris
caggagggcccaggac

SEQ ID NO: 309999 - DNA, 16 bp, C. familiaris
caggagggcttcctgg

SEQ ID NO: 310000 - DNA, 16 bp, C. familiaris
caggaggtgatcctgg

SEQ ID NO: 310001 - DNA, 16 bp, C. familiaris
caggaggtgggcaggg

SEQ ID NO: 310002 - DNA, 16 bp, C. familiaris
caggagtgaggaggag

SEQ ID NO: 310003 - DNA, 17 bp, C. familiaris
caggatcacatcccagg

SEQ ID NO: 310004 - DNA, 16 bp, C. familiaris
caggatcactccttga

SEQ ID NO: 310005 - DNA, 16 bp, C. familiaris
caggatcagaccctgg

SEQ ID NO: 310006 - DNA, 16 bp, C. familiaris
caggatcagatcctgg

SEQ ID NO: 310007 - DNA, 16 bp, C. familiaris
caggatcaggccatgg

SEQ ID NO: 310008 - DNA, 16 bp, C. familiaris
caggatccaggatgga

SEQ ID NO: 310009 - DNA, 16 bp, C. familiaris
caggatccagggatca

SEQ ID NO: 310010 - DNA, 16 bp, C. familiaris
caggatccccgcaggg

SEQ ID NO: 310011 - DNA, 16 bp, C. familiaris
caggatcccgccctga

SEQ ID NO: 310012 - DNA, 16 bp, C. familiaris
caggatccctgagggg

SEQ ID NO: 310013 - DNA, 16 bp, C. familiaris
caggatccctgggatc

SEQ ID NO: 310014 - DNA, 16 bp, C. familiaris
caggatcctgagatcg

SEQ ID NO: 310015 - DNA, 16 bp, C. familiaris
caggatcctggagacc

SEQ ID NO: 310016 - DNA, 16 bp, C. familiaris
caggatctcaggatcc

SEQ ID NO: 310017 - DNA, 16 bp, C. familiaris
caggatgaaatagaaa

SEQ ID NO: 310018 - DNA, 16 bp, C. familiaris
caggatgaggccctgg

SEQ ID NO: 310019 - DNA, 16 bp, C. familiaris
caggatgatttcatct

SEQ ID NO: 310020 - DNA, 16 bp, C. familiaris
caggatggagtcccag

SEQ ID NO: 310021 - DNA, 16 bp, C. familiaris
caggattaccctgata

SEQ ID NO: 310022 - DNA, 16 bp, C. familiaris
caggattcaaatccag

SEQ ID NO: 310023 - DNA, 16 bp, C. familiaris
caggatttcagactgg

SEQ ID NO: 310024 - DNA, 16 bp, C. familiaris
caggatttcaggatca

SEQ ID NO: 310025 - DNA, 16 bp, C. familiaris
caggatttccctcttt

SEQ ID NO: 310026 - DNA, 16 bp, C. familiaris
caggatttctttttgg

SEQ ID NO: 310027 - DNA, 16 bp, C. familiaris
caggcaaagagagaag

SEQ ID NO: 310028 - DNA, 16 bp, C. familiaris
caggcaaaggcagaag

SEQ ID NO: 310029 - DNA, 17 bp, C. familiaris
caggcaacaccctttct

SEQ ID NO: 310030 - DNA, 16 bp, C. familiaris
caggcaaggagagcct

SEQ ID NO: 310031 - DNA, 16 bp, C. familiaris
caggcacaggcagagg

SEQ ID NO: 310032 - DNA, 16 bp, C. familiaris
caggcaccccagaaag

SEQ ID NO: 310033 - DNA, 16 bp, C. familiaris
caggcaccccagtaat

SEQ ID NO: 310034 - DNA, 16 bp, C. familiaris
caggcacccctagaga

SEQ ID NO: 310035 - DNA, 16 bp, C. familiaris
caggcacccctggact

SEQ ID NO: 310036 - DNA, 16 bp, C. familiaris
caggcacgaaaccact

SEQ ID NO: 310037 - DNA, 16 bp, C. familiaris
caggcactgaggaagg

SEQ ID NO: 310038 - DNA, 16 bp, C. familiaris
caggcactgagggagg

SEQ ID NO: 310039 - DNA, 16 bp, C. familiaris
caggcactgggagccc

SEQ ID NO: 310040 - DNA, 16 bp, C. familiaris
caggcactgtgctatg

SEQ ID NO: 310041 - DNA, 16 bp, C. familiaris
caggcagaaggaacag

SEQ ID NO: 310042 - DNA, 16 bp, C. familiaris
caggcagaaggagaaa

SEQ ID NO: 310043 - DNA, 16 bp, C. familiaris
caggcagaaggaggag

SEQ ID NO: 310044 - DNA, 16 bp, C. familiaris
caggcagaaggcaggc

SEQ ID NO: 310045 - DNA, 16 bp, C. familiaris
caggcagagacccagg

SEQ ID NO: 310046 - DNA, 16 bp, C. familiaris
caggcagaggaaacag

SEQ ID NO: 310047 - DNA, 16 bp, C. familiaris
caggcagaggaagaag

SEQ ID NO: 310048 - DNA, 16 bp, C. familiaris
caggcagaggaggagc

SEQ ID NO: 310049 - DNA, 16 bp, C. familiaris
caggcagagggcagag

SEQ ID NO: 310050 - DNA, 16 bp, C. familiaris
caggcagcaaaaagaa

SEQ ID NO: 310051 - DNA, 16 bp, C. familiaris
caggcagcctggggcc

SEQ ID NO: 310052 - DNA, 16 bp, C. familiaris
caggcagcgggagaag

SEQ ID NO: 310053 - DNA, 16 bp, C. familiaris
caggcaggaggagaag

SEQ ID NO: 310054 - DNA, 16 bp, C. familiaris
caggcaggggcagagc

SEQ ID NO: 310055 - DNA, 16 bp, C. familiaris
caggcagggggagtgg

SEQ ID NO: 310056 - DNA, 16 bp, C. familiaris
caggcagtgggagagg

SEQ ID NO: 310057 - DNA, 16 bp, C. familiaris
caggcatccccagaga

SEQ ID NO: 310058 - DNA, 16 bp, C. familiaris
caggcatccctcattg

SEQ ID NO: 310059 - DNA, 16 bp, C. familiaris
caggcatccctggatg

SEQ ID NO: 310060 - DNA, 16 bp, C. familiaris
caggccaaaggcagca

SEQ ID NO: 310061 - DNA, 16 bp, C. familiaris
caggccactgtgacca

SEQ ID NO: 310062 - DNA, 16 bp, C. familiaris
caggccaggccaggcc

SEQ ID NO: 310063 - DNA, 16 bp, C. familiaris
caggccagggtgtgat

SEQ ID NO: 310064 - DNA, 16 bp, C. familiaris
caggccatgatcctga

SEQ ID NO: 310065 - DNA, 16 bp, C. familiaris
caggcccagaaagggc

SEQ ID NO: 310066 - DNA, 16 bp, C. familiaris
caggcccagcatggag

SEQ ID NO: 310067 - DNA, 16 bp, C. familiaris
caggcccagcccagcc

SEQ ID NO: 310068 - DNA, 16 bp, C. familiaris
caggcccaggcccaga

SEQ ID NO: 310069 - DNA, 16 bp, C. familiaris
caggccccacctgccc

SEQ ID NO: 310070 - DNA, 16 bp, C. familiaris
caggccccagcccctc

SEQ ID NO: 310071 - DNA, 16 bp, C. familiaris
caggccccaggccctg

SEQ ID NO: 310072 - DNA, 16 bp, C. familiaris
caggccccaggccgaa

SEQ ID NO: 310073 - DNA, 16 bp, C. familiaris
caggccccagggaagg

SEQ ID NO: 310074 - DNA, 16 bp, C. familiaris
caggccccatgcaccg

SEQ ID NO: 310075 - DNA, 16 bp, C. familiaris
caggccccatgcaggc

SEQ ID NO: 310076 - DNA, 16 bp, C. familiaris
caggccccccacaggg

SEQ ID NO: 310077 - DNA, 16 bp, C. familiaris
caggccccctgctcag

SEQ ID NO: 310078 - DNA, 16 bp, C. familiaris
caggcccctcacccag

SEQ ID NO: 310079 - DNA, 16 bp, C. familiaris
caggcccctcccccag

SEQ ID NO: 310080 - DNA, 16 bp, C. familiaris
caggccctgcaggctg

SEQ ID NO: 310081 - DNA, 16 bp, C. familiaris
caggccctgccctggg

SEQ ID NO: 310082 - DNA, 16 bp, C. familiaris
caggccctgggagccc

SEQ ID NO: 310083 - DNA, 16 bp, C. familiaris
caggccctgggccaag

SEQ ID NO: 310084 - DNA, 16 bp, C. familiaris
caggccctgggccagg

SEQ ID NO: 310085 - DNA, 16 bp, C. familiaris
caggccctgggccctg

SEQ ID NO: 310086 - DNA, 16 bp, C. familiaris
caggccctgggctcag

SEQ ID NO: 310087 - DNA, 16 bp, C. familiaris
caggccctgggggagg

SEQ ID NO: 310088 - DNA, 16 bp, C. familiaris
caggccctgtgccagg

SEQ ID NO: 310089 - DNA, 16 bp, C. familiaris
caggccctgtgctcag

SEQ ID NO: 310090 - DNA, 16 bp, C. familiaris
caggcctccatcccag

SEQ ID NO: 310091 - DNA, 16 bp, C. familiaris
caggcctccccaggcc

SEQ ID NO: 310092 - DNA, 16 bp, C. familiaris
caggcctccctgcccc

SEQ ID NO: 310093 - DNA, 16 bp, C. familiaris
caggcctctcccccag

SEQ ID NO: 310094 - DNA, 16 bp, C. familiaris
caggcctgggcctggg

SEQ ID NO: 310095 - DNA, 16 bp, C. familiaris
caggcctggggcccag

SEQ ID NO: 310096 - DNA, 16 bp, C. familiaris
caggcctggggctggg

SEQ ID NO: 310097 - DNA, 16 bp, C. familiaris
caggcctgggggcagg

SEQ ID NO: 310098 - DNA, 16 bp, C. familiaris
caggcgcaggtgcagg

SEQ ID NO: 310099 - DNA, 16 bp, C. familiaris
caggcgcccctcagct

SEQ ID NO: 310100 - DNA, 16 bp, C. familiaris
caggcggaggccggga

SEQ ID NO: 310101 - DNA, 16 bp, C. familiaris
caggcgtcccaagcat

SEQ ID NO: 310102 - DNA, 16 bp, C. familiaris
caggctcaccactgag

SEQ ID NO: 310103 - DNA, 16 bp, C. familiaris
caggctcagcagggag

SEQ ID NO: 310104 - DNA, 16 bp, C. familiaris
caggctcaggcccagg

SEQ ID NO: 310105 - DNA, 16 bp, C. familiaris
caggctcagggagcct

SEQ ID NO: 310106 - DNA, 16 bp, C. familiaris
caggctcagtgggagc

SEQ ID NO: 310107 - DNA, 16 bp, C. familiaris
caggctcatgcaggaa

SEQ ID NO: 310108 - DNA, 16 bp, C. familiaris
caggctccacacaccg

SEQ ID NO: 310109 - DNA, 16 bp, C. familiaris
caggctccacacccac

SEQ ID NO: 310110 - DNA, 16 bp, C. familiaris
caggctccacactctg

SEQ ID NO: 310111 - DNA, 16 bp, C. familiaris
caggctccacccccag

SEQ ID NO: 310112 - DNA, 16 bp, C. familiaris
caggctccaggcactg

SEQ ID NO: 310113 - DNA, 16 bp, C. familiaris
caggctccaggctcag

SEQ ID NO: 310114 - DNA, 16 bp, C. familiaris
caggctccagggaagg

SEQ ID NO: 310115 - DNA, 16 bp, C. familiaris
caggctccatacccag

SEQ ID NO: 310116 - DNA, 16 bp, C. familiaris
caggctccatgcccag

SEQ ID NO: 310117 - DNA, 16 bp, C. familiaris
caggctccccaaaggg

SEQ ID NO: 310118 - DNA, 16 bp, C. familiaris
caggctccccaagggg

SEQ ID NO: 310119 - DNA, 16 bp, C. familiaris
caggctccccaccagg

SEQ ID NO: 310120 - DNA, 16 bp, C. familiaris
caggctccccacggag

SEQ ID NO: 310121 - DNA, 16 bp, C. familiaris
caggctcccctgggga

SEQ ID NO: 310122 - DNA, 16 bp, C. familiaris
caggctccccttgggg

SEQ ID NO: 310123 - DNA, 16 bp, C. familiaris
caggctcccggctcag

SEQ ID NO: 310124 - DNA, 16 bp, C. familiaris
caggctccctccgtgg

SEQ ID NO: 310125 - DNA, 16 bp, C. familiaris
caggctccctgcagac

SEQ ID NO: 310126 - DNA, 16 bp, C. familiaris
caggctccctgcccca

SEQ ID NO: 310127 - DNA, 16 bp, C. familiaris
caggctccctgggagg

SEQ ID NO: 310128 - DNA, 16 bp, C. familiaris
caggctccctgttggg

SEQ ID NO: 310129 - DNA, 16 bp, C. familiaris
caggctcctcccagga

SEQ ID NO: 310130 - DNA, 16 bp, C. familiaris
caggctcctgcttctc

SEQ ID NO: 310131 - DNA, 16 bp, C. familiaris
caggctccttgcatgc

SEQ ID NO: 310132 - DNA, 16 bp, C. familiaris
caggctctacacccag

SEQ ID NO: 310133 - DNA, 16 bp, C. familiaris
caggctctccctctgc

SEQ ID NO: 310134 - DNA, 16 bp, C. familiaris
caggctctctccatgg

SEQ ID NO: 310135 - DNA, 16 bp, C. familiaris
caggctctgcacacag

SEQ ID NO: 310136 - DNA, 16 bp, C. familiaris
caggctctgcacttag

SEQ ID NO: 310137 - DNA, 16 bp, C. familiaris
caggctctgcgctggg

SEQ ID NO: 310138 - DNA, 16 bp, C. familiaris
caggctctgggctggg

SEQ ID NO: 310139 - DNA, 16 bp, C. familiaris
caggctctgtgcttgg

SEQ ID NO: 310140 - DNA, 16 bp, C. familiaris
caggctgcaggcggtg

SEQ ID NO: 310141 - DNA, 16 bp, C. familiaris
caggctgcctgcaggg

SEQ ID NO: 310142 - DNA, 16 bp, C. familiaris
caggctggggcccagg

SEQ ID NO: 310143 - DNA, 16 bp, C. familiaris
caggctggggccctgg

SEQ ID NO: 310144 - DNA, 16 bp, C. familiaris
caggctgtgtgctcag

SEQ ID NO: 310145 - DNA, 16 bp, C. familiaris
caggcttcccgctcag

SEQ ID NO: 310146 - DNA, 16 bp, C. familiaris
caggcttcctgcagga

SEQ ID NO: 310147 - DNA, 16 bp, C. familiaris
caggcttggctgggat

SEQ ID NO: 310148 - DNA, 16 bp, C. familiaris
cagggaaaggcagagg

SEQ ID NO: 310149 - DNA, 16 bp, C. familiaris
cagggaacaaaggcct

SEQ ID NO: 310150 - DNA, 16 bp, C. familiaris
cagggaactcgggcag

SEQ ID NO: 310151 - DNA, 16 bp, C. familiaris
cagggaactttttttt

SEQ ID NO: 310152 - DNA, 16 bp, C. familiaris
cagggaagggacagag

SEQ ID NO: 310153 - DNA, 16 bp, C. familiaris
cagggaatctgcttga

SEQ ID NO: 310154 - DNA, 16 bp, C. familiaris
cagggacacctggctg

SEQ ID NO: 310155 - DNA, 16 bp, C. familiaris
cagggacaggggcaga

SEQ ID NO: 310156 - DNA, 16 bp, C. familiaris
cagggaccccaatgcg

SEQ ID NO: 310157 - DNA, 16 bp, C. familiaris
cagggaccctgcctct

SEQ ID NO: 310158 - DNA, 16 bp, C. familiaris
cagggacgcctggatg

SEQ ID NO: 310159 - DNA, 16 bp, C. familiaris
cagggactctgcttct

SEQ ID NO: 310160 - DNA, 16 bp, C. familiaris
cagggagagcagcagg

SEQ ID NO: 310161 - DNA, 16 bp, C. familiaris
cagggagagcctgatg

SEQ ID NO: 310162 - DNA, 16 bp, C. familiaris
cagggagaggcaggct

SEQ ID NO: 310163 - DNA, 16 bp, C. familiaris
cagggagcagcagagg

SEQ ID NO: 310164 - DNA, 16 bp, C. familiaris
cagggagcagggagcc

SEQ ID NO: 310165 - DNA, 16 bp, C. familiaris
cagggagccagatgcg

SEQ ID NO: 310166 - DNA, 16 bp, C. familiaris
cagggagccagatgct

SEQ ID NO: 310167 - DNA, 16 bp, C. familiaris
cagggagcccaacctg

SEQ ID NO: 310168 - DNA, 16 bp, C. familiaris
cagggagccccaggca

SEQ ID NO: 310169 - DNA, 16 bp, C. familiaris
cagggagccctttgtg

SEQ ID NO: 310170 - DNA, 16 bp, C. familiaris
cagggagcctgaccca

SEQ ID NO: 310171 - DNA, 16 bp, C. familiaris
cagggagcctgaggcg

SEQ ID NO: 310172 - DNA, 16 bp, C. familiaris
cagggagcctgccgtg

SEQ ID NO: 310173 - DNA, 16 bp, C. familiaris
cagggagcctgtgtct

SEQ ID NO: 310174 - DNA, 16 bp, C. familiaris
cagggagctcagtgtg

SEQ ID NO: 310175 - DNA, 16 bp, C. familiaris
cagggagctggacttg

SEQ ID NO: 310176 - DNA, 16 bp, C. familiaris
cagggagctggatgcc

SEQ ID NO: 310177 - DNA, 16 bp, C. familiaris
cagggagctggggcag

SEQ ID NO: 310178 - DNA, 16 bp, C. familiaris
cagggaggaagcagag

SEQ ID NO: 310179 - DNA, 16 bp, C. familiaris
cagggaggagacagag

SEQ ID NO: 310180 - DNA, 16 bp, C. familiaris
cagggaggagcagaag

SEQ ID NO: 310181 - DNA, 16 bp, C. familiaris
cagggaggagtggcag

SEQ ID NO: 310182 - DNA, 16 bp, C. familiaris
cagggaggccagggag

SEQ ID NO: 310183 - DNA, 16 bp, C. familiaris
cagggaggctgaggag

SEQ ID NO: 310184 - DNA, 16 bp, C. familiaris
cagggaggctggggag

SEQ ID NO: 310185 - DNA, 16 bp, C. familiaris
cagggagggagcccaa

SEQ ID NO: 310186 - DNA, 16 bp, C. familiaris
cagggagggatcctgg

SEQ ID NO: 310187 - DNA, 16 bp, C. familiaris
cagggagggcccagga

SEQ ID NO: 310188 - DNA, 16 bp, C. familiaris
cagggagggcctgggg

SEQ ID NO: 310189 - DNA, 16 bp, C. familiaris
cagggagtctgacttg

SEQ ID NO: 310190 - DNA, 16 bp, C. familiaris
cagggagtctgattct

SEQ ID NO: 310191 - DNA, 16 bp, C. familiaris
cagggagtctgctccc

SEQ ID NO: 310192 - DNA, 16 bp, C. familiaris
cagggagtctgtgtct

SEQ ID NO: 310193 - DNA, 16 bp, C. familiaris
cagggagtgattctgg

SEQ ID NO: 310194 - DNA, 16 bp, C. familiaris
cagggagtggcagagg

SEQ ID NO: 310195 - DNA, 16 bp, C. familiaris
cagggatcccaacaag

SEQ ID NO: 310196 - DNA, 16 bp, C. familiaris
cagggatcccaagcca

SEQ ID NO: 310197 - DNA, 16 bp, C. familiaris
cagggatcccaggact

SEQ ID NO: 310198 - DNA, 16 bp, C. familiaris
cagggatcccagtcct

SEQ ID NO: 310199 - DNA, 16 bp, C. familiaris
cagggatccccaacat

SEQ ID NO: 310200 - DNA, 16 bp, C. familiaris
cagggatccccaacca

SEQ ID NO: 310201 - DNA, 16 bp, C. familiaris
cagggatccccaccct

SEQ ID NO: 310202 - DNA, 16 bp, C. familiaris
cagggatccccaggag

SEQ ID NO: 310203 - DNA, 16 bp, C. familiaris
cagggatcccctatcc

SEQ ID NO: 310204 - DNA, 16 bp, C. familiaris
cagggatcccctgagc

SEQ ID NO: 310205 - DNA, 16 bp, C. familiaris
cagggatcccctgcat

SEQ ID NO: 310206 - DNA, 16 bp, C. familiaris
cagggatccctaagat

SEQ ID NO: 310207 - DNA, 16 bp, C. familiaris
cagggatccctcaatt

SEQ ID NO: 310208 - DNA, 16 bp, C. familiaris
cagggatccctccaag

SEQ ID NO: 310209 - DNA, 16 bp, C. familiaris
cagggatccctccaca

SEQ ID NO: 310210 - DNA, 16 bp, C. familiaris
cagggatccctccact

SEQ ID NO: 310211 - DNA, 16 bp, C. familiaris
cagggatccctttgct

SEQ ID NO: 310212 - DNA, 16 bp, C. familiaris
cagggatcctgatggg

SEQ ID NO: 310213 - DNA, 16 bp, C. familiaris
cagggatgctgctgaa

SEQ ID NO: 310214 - DNA, 16 bp, C. familiaris
cagggatgtgtgtgtg

SEQ ID NO: 310215 - DNA, 16 bp, C. familiaris
cagggattctgatgca

SEQ ID NO: 310216 - DNA, 16 bp, C. familiaris
cagggatttttaaaaa

SEQ ID NO: 310217 - DNA, 16 bp, C. familiaris
cagggcagagggaaag

SEQ ID NO: 310218 - DNA, 16 bp, C. familiaris
cagggcagcaaggacg

SEQ ID NO: 310219 - DNA, 16 bp, C. familiaris
cagggcagcagcaggg

SEQ ID NO: 310220 - DNA, 16 bp, C. familiaris
cagggcaggattctgg

SEQ ID NO: 310221 - DNA, 16 bp, C. familiaris
cagggcaggccagcag

SEQ ID NO: 310222 - DNA, 16 bp, C. familiaris
cagggcagggagcctg

SEQ ID NO: 310223 - DNA, 16 bp, C. familiaris
cagggcagggcagcag

SEQ ID NO: 310224 - DNA, 16 bp, C. familiaris
cagggcaggggcagag

SEQ ID NO: 310225 - DNA, 16 bp, C. familiaris
cagggcatgacctggg

SEQ ID NO: 310226 - DNA, 16 bp, C. familiaris
cagggcatgatctctg

SEQ ID NO: 310227 - DNA, 16 bp, C. familiaris
cagggcatgtgggtgg

SEQ ID NO: 310228 - DNA, 16 bp, C. familiaris
cagggccacgccctgg

SEQ ID NO: 310229 - DNA, 16 bp, C. familiaris
cagggccagggcaggg

SEQ ID NO: 310230 - DNA, 16 bp, C. familiaris
cagggccagggccagg

SEQ ID NO: 310231 - DNA, 16 bp, C. familiaris
cagggccagggcctgg

SEQ ID NO: 310232 - DNA, 16 bp, C. familiaris
cagggccatgctccct

SEQ ID NO: 310233 - DNA, 16 bp, C. familiaris
cagggcccaatgtggg

SEQ ID NO: 310234 - DNA, 16 bp, C. familiaris
cagggcccagagaggg

SEQ ID NO: 310235 - DNA, 16 bp, C. familiaris
cagggcccaggaggcc

SEQ ID NO: 310236 - DNA, 16 bp, C. familiaris
cagggcccagggcagg

SEQ ID NO: 310237 - DNA, 16 bp, C. familiaris
cagggccccagggccc

SEQ ID NO: 310238 - DNA, 16 bp, C. familiaris
cagggccctgtgatca

SEQ ID NO: 310239 - DNA, 16 bp, C. familiaris
cagggcctgatccagg

SEQ ID NO: 310240 - DNA, 16 bp, C. familiaris
cagggcctgatcctgg

SEQ ID NO: 310241 - DNA, 16 bp, C. familiaris
cagggcctgggaggag

SEQ ID NO: 310242 - DNA, 16 bp, C. familiaris
cagggcctggggctgg

SEQ ID NO: 310243 - DNA, 16 bp, C. familiaris
cagggcctgggggctg

SEQ ID NO: 310244 - DNA, 16 bp, C. familiaris
cagggcctgggtgggg

SEQ ID NO: 310245 - DNA, 16 bp, C. familiaris
cagggcgtgatgctgg

SEQ ID NO: 310246 - DNA, 16 bp, C. familiaris
cagggcgtgctcctgg

SEQ ID NO: 310247 - DNA, 16 bp, C. familiaris
cagggctcagtgcaga

SEQ ID NO: 310248 - DNA, 16 bp, C. familiaris
cagggctccatcccag

SEQ ID NO: 310249 - DNA, 16 bp, C. familiaris
cagggctccatcctgg

SEQ ID NO: 310250 - DNA, 16 bp, C. familiaris
cagggctccctcccct

SEQ ID NO: 310251 - DNA, 16 bp, C. familiaris
cagggctccctgcatg

SEQ ID NO: 310252 - DNA, 16 bp, C. familiaris
cagggctgcccaggag

SEQ ID NO: 310253 - DNA, 16 bp, C. familiaris
cagggctgccctcctg

SEQ ID NO: 310254 - DNA, 16 bp, C. familiaris
cagggctgccctgaaa

SEQ ID NO: 310255 - DNA, 16 bp, C. familiaris
cagggctgccctgaga

SEQ ID NO: 310256 - DNA, 16 bp, C. familiaris
cagggctgccctgcag

SEQ ID NO: 310257 - DNA, 16 bp, C. familiaris
cagggctgccctggag

SEQ ID NO: 310258 - DNA, 16 bp, C. familiaris
cagggctgctgtgggg

SEQ ID NO: 310259 - DNA, 16 bp, C. familiaris
cagggctggagagctg

SEQ ID NO: 310260 - DNA, 16 bp, C. familiaris
cagggctgggagaggg

SEQ ID NO: 310261 - DNA, 16 bp, C. familiaris
cagggctgggctgggc

SEQ ID NO: 310262 - DNA, 16 bp, C. familiaris
cagggctggggcaggg

SEQ ID NO: 310263 - DNA, 16 bp, C. familiaris
cagggctggggctggg

SEQ ID NO: 310264 - DNA, 16 bp, C. familiaris
cagggcttgaccctgg

SEQ ID NO: 310265 - DNA, 16 bp, C. familiaris
cagggcttgacctcag

SEQ ID NO: 310266 - DNA, 16 bp, C. familiaris
caggggaaagagcaga

SEQ ID NO: 310267 - DNA, 16 bp, C. familiaris
caggggaagaagcaga

SEQ ID NO: 310268 - DNA, 16 bp, C. familiaris
caggggaagctgcaga

SEQ ID NO: 310269 - DNA, 16 bp, C. familiaris
caggggacctgggtgg

SEQ ID NO: 310270 - DNA, 16 bp, C. familiaris
caggggagggaaatgg

SEQ ID NO: 310271 - DNA, 16 bp, C. familiaris
caggggatccccgggt

SEQ ID NO: 310272 - DNA, 16 bp, C. familiaris
caggggcacctggatg

SEQ ID NO: 310273 - DNA, 16 bp, C. familiaris
caggggcagagcaggg

SEQ ID NO: 310274 - DNA, 16 bp, C. familiaris
caggggccaggccagg

SEQ ID NO: 310275 - DNA, 16 bp, C. familiaris
caggggccccaggagg

SEQ ID NO: 310276 - DNA, 16 bp, C. familiaris
caggggcctggatgct

SEQ ID NO: 310277 - DNA, 16 bp, C. familiaris
caggggcctgggatgg

SEQ ID NO: 310278 - DNA, 16 bp, C. familiaris
caggggcctgggcagg

SEQ ID NO: 310279 - DNA, 16 bp, C. familiaris
caggggctgctgggag

SEQ ID NO: 310280 - DNA, 16 bp, C. familiaris
caggggctggaggagg

SEQ ID NO: 310281 - DNA, 16 bp, C. familiaris
caggggctgggccagg

SEQ ID NO: 310282 - DNA, 16 bp, C. familiaris
caggggctgggctggc

SEQ ID NO: 310283 - DNA, 16 bp, C. familiaris
caggggctggggaagg

SEQ ID NO: 310284 - DNA, 16 bp, C. familiaris
caggggctggggacag

SEQ ID NO: 310285 - DNA, 16 bp, C. familiaris
caggggctggggcagg

SEQ ID NO: 310286 - DNA, 16 bp, C. familiaris
cagggggaacagcagg

SEQ ID NO: 310287 - DNA, 16 bp, C. familiaris
cagggggaagtctgct

SEQ ID NO: 310288 - DNA, 16 bp, C. familiaris
cagggggacccctggg

SEQ ID NO: 310289 - DNA, 16 bp, C. familiaris
cagggggagctacaga

SEQ ID NO: 310290 - DNA, 16 bp, C. familiaris
cagggggcaggggctg

SEQ ID NO: 310291 - DNA, 16 bp, C. familiaris
cagggggctcagtcag

SEQ ID NO: 310292 - DNA, 16 bp, C. familiaris
caggggtgcctgactg

SEQ ID NO: 310293 - DNA, 16 bp, C. familiaris
caggggtgggagcagg

SEQ ID NO: 310294 - DNA, 16 bp, C. familiaris
caggggtggggaggca

SEQ ID NO: 310295 - DNA, 16 bp, C. familiaris
cagggtaatgctgacc

SEQ ID NO: 310296 - DNA, 16 bp, C. familiaris
cagggtcaggccctgg

SEQ ID NO: 310297 - DNA, 16 bp, C. familiaris
cagggtcccagggccc

SEQ ID NO: 310298 - DNA, 16 bp, C. familiaris
cagggtccctgccctc

SEQ ID NO: 310299 - DNA, 16 bp, C. familiaris
cagggtccctgtggga

SEQ ID NO: 310300 - DNA, 16 bp, C. familiaris
cagggtcctgggatac

SEQ ID NO: 310301 - DNA, 16 bp, C. familiaris
cagggtcctgggatgc

SEQ ID NO: 310302 - DNA, 16 bp, C. familiaris
cagggtcctgggccca

SEQ ID NO: 310303 - DNA, 16 bp, C. familiaris
cagggtcctgggctgt

SEQ ID NO: 310304 - DNA, 16 bp, C. familiaris
cagggtctccagggtc

SEQ ID NO: 310305 - DNA, 16 bp, C. familiaris
cagggtctggggatca

SEQ ID NO: 310306 - DNA, 16 bp, C. familiaris
cagggtgacagaatgg

SEQ ID NO: 310307 - DNA, 16 bp, C. familiaris
cagggtgccagggtgg

SEQ ID NO: 310308 - DNA, 16 bp, C. familiaris
cagggtggaggagcag

SEQ ID NO: 310309 - DNA, 16 bp, C. familiaris
cagggtttcttaacct

SEQ ID NO: 310310 - DNA, 16 bp, C. familiaris
cagggtttgaactcac

SEQ ID NO: 310311 - DNA, 16 bp, C. familiaris
caggtatttaaaaaaa

SEQ ID NO: 310312 - DNA, 16 bp, C. familiaris
caggtcacgatcccgg

SEQ ID NO: 310313 - DNA, 16 bp, C. familiaris
caggtcatgaactcag

SEQ ID NO: 310314 - DNA, 16 bp, C. familiaris
caggtcatgatccagc

SEQ ID NO: 310315 - DNA, 16 bp, C. familiaris
caggtcatggtctctg

SEQ ID NO: 310316 - DNA, 16 bp, C. familiaris
caggtcatggttctgg

SEQ ID NO: 310317 - DNA, 16 bp, C. familiaris
caggtccccagccctg

SEQ ID NO: 310318 - DNA, 18 bp, C. familiaris
caggtcctccatctccaa

SEQ ID NO: 310319 - DNA, 16 bp, C. familiaris
caggtcctgaccccag

SEQ ID NO: 310320 - DNA, 16 bp, C. familiaris
caggtcctggtcccag

SEQ ID NO: 310321 - DNA, 16 bp, C. familiaris
caggtctctgtggaca

SEQ ID NO: 310322 - DNA, 16 bp, C. familiaris
caggtctctgtggata

SEQ ID NO: 310323 - DNA, 16 bp, C. familiaris
caggtgacaccaggag

SEQ ID NO: 310324 - DNA, 16 bp, C. familiaris
caggtgcacaggtgca

SEQ ID NO: 310325 - DNA, 16 bp, C. familiaris
caggtgcagaatttag

SEQ ID NO: 310326 - DNA, 16 bp, C. familiaris
caggtgcagcaggtgc

SEQ ID NO: 310327 - DNA, 16 bp, C. familiaris
caggtgccccaaagcc

SEQ ID NO: 310328 - DNA, 16 bp, C. familiaris
caggtgccccaatgtg

SEQ ID NO: 310329 - DNA, 16 bp, C. familiaris
caggtgccccagcagg

SEQ ID NO: 310330 - DNA, 16 bp, C. familiaris
caggtgccccagctct

SEQ ID NO: 310331 - DNA, 16 bp, C. familiaris
caggtgccccaggatg

SEQ ID NO: 310332 - DNA, 16 bp, C. familiaris
caggtgccccccaaag

SEQ ID NO: 310333 - DNA, 16 bp, C. familiaris
caggtgcccccctcca

SEQ ID NO: 310334 - DNA, 16 bp, C. familiaris
caggtgcccctccact

SEQ ID NO: 310335 - DNA, 16 bp, C. familiaris
caggtgcccctcctcc

SEQ ID NO: 310336 - DNA, 16 bp, C. familiaris
caggtgcccctgaagg

SEQ ID NO: 310337 - DNA, 16 bp, C. familiaris
caggtgcccctgcagc

SEQ ID NO: 310338 - DNA, 16 bp, C. familiaris
caggtgcccctgctca

SEQ ID NO: 310339 - DNA, 16 bp, C. familiaris
caggtgcccctggaag

SEQ ID NO: 310340 - DNA, 16 bp, C. familiaris
caggtgcccctggagg

SEQ ID NO: 310341 - DNA, 16 bp, C. familiaris
caggtgcccctgggag

SEQ ID NO: 310342 - DNA, 16 bp, C. familiaris
caggtggagaaactga

SEQ ID NO: 310343 - DNA, 16 bp, C. familiaris
caggtggaggaggagg

SEQ ID NO: 310344 - DNA, 16 bp, C. familiaris
caggtggaggaggcag

SEQ ID NO: 310345 - DNA, 16 bp, C. familiaris
caggtggctcagcagg

SEQ ID NO: 310346 - DNA, 16 bp, C. familiaris
caggtggggcaggtgg

SEQ ID NO: 310347 - DNA, 16 bp, C. familiaris
caggtggtgatcccgg

SEQ ID NO: 310348 - DNA, 16 bp, C. familiaris
caggtggtggtggtgg

SEQ ID NO: 310349 - DNA, 16 bp, C. familiaris
caggtgtcccaaggga

SEQ ID NO: 310350 - DNA, 16 bp, C. familiaris
caggtgtcccaggaat

SEQ ID NO: 310351 - DNA, 16 bp, C. familiaris
caggtgtccctcaact

SEQ ID NO: 310352 - DNA, 16 bp, C. familiaris
caggtgtccctcttca

SEQ ID NO: 310353 - DNA, 16 bp, C. familiaris
caggtgtccctggagt

SEQ ID NO: 310354 - DNA, 16 bp, C. familiaris
caggtgtccctggatt

SEQ ID NO: 310355 - DNA, 16 bp, C. familiaris
caggtgtccctgggct

SEQ ID NO: 310356 - DNA, 16 bp, C. familiaris
caggtgtctcagcatt

SEQ ID NO: 310357 - DNA, 17 bp, C. familiaris
caggtgtctcggcgttt

SEQ ID NO: 310358 - DNA, 16 bp, C. familiaris
caggtgttccttggct

SEQ ID NO: 310359 - DNA, 16 bp, C. familiaris
caggttatattacaaa

SEQ ID NO: 310360 - DNA, 16 bp, C. familiaris
caggttccaagcaggg

SEQ ID NO: 310361 - DNA, 16 bp, C. familiaris
caggttctctatttct

SEQ ID NO: 310362 - DNA, 16 bp, C. familiaris
caggttgagggagaag

SEQ ID NO: 310363 - DNA, 16 bp, C. familiaris
caggttgtgatcctgg

SEQ ID NO: 310364 - DNA, 16 bp, C. familiaris
caggtttaattttttt

SEQ ID NO: 310365 - DNA, 16 bp, C. familiaris
caggtttctttttctt

SEQ ID NO: 310366 - DNA, 16 bp, C. familiaris
caggtttggttccaga

SEQ ID NO: 310367 - DNA, 16 bp, C. familiaris
caggttttgtttgttt

SEQ ID NO: 310368 - DNA, 16 bp, C. familiaris
caggtttttgtatgga

SEQ ID NO: 310369 - DNA, 16 bp, C. familiaris
cagtaaaattaaatat

SEQ ID NO: 310370 - DNA, 16 bp, C. familiaris
cagtaaatgtttattg

SEQ ID NO: 310371 - DNA, 16 bp, C. familiaris
cagtaacaggcacctg

SEQ ID NO: 310372 - DNA, 19 bp, C. familiaris
cagtaactacggagctctc

SEQ ID NO: 310373 - DNA, 16 bp, C. familiaris
cagtaatcagaacagt

SEQ ID NO: 310374 - DNA, 16 bp, C. familiaris
cagtacttctcaaact

SEQ ID NO: 310375 - DNA, 16 bp, C. familiaris
cagtagaaaagatcaa

SEQ ID NO: 310376 - DNA, 16 bp, C. familiaris
cagtaggttgcccttt

SEQ ID NO: 310377 - DNA, 16 bp, C. familiaris
cagtagtggaattact

SEQ ID NO: 310378 - DNA, 16 bp, C. familiaris
cagtagttttctttct

SEQ ID NO: 310379 - DNA, 16 bp, C. familiaris
cagtatggtactggtg

SEQ ID NO: 310380 - DNA, 16 bp, C. familiaris
cagtattgttagctat

SEQ ID NO: 310381 - DNA, 16 bp, C. familiaris
cagtatttgtctttct

SEQ ID NO: 310382 - DNA, 16 bp, C. familiaris
cagtcaacaaaagtaa

SEQ ID NO: 310383 - DNA, 16 bp, C. familiaris
cagtcaaggctgagaa

SEQ ID NO: 310384 - DNA, 16 bp, C. familiaris
cagtcaccccatcccc

SEQ ID NO: 310385 - DNA, 16 bp, C. familiaris
cagtcaccccatcctc

SEQ ID NO: 310386 - DNA, 16 bp, C. familiaris
cagtcacccccaccct

SEQ ID NO: 310387 - DNA, 16 bp, C. familiaris
cagtcactgtgaaaaa

SEQ ID NO: 310388 - DNA, 16 bp, C. familiaris
cagtcagaagagcctg

SEQ ID NO: 310389 - DNA, 16 bp, C. familiaris
cagtcagagatgaaga

SEQ ID NO: 310390 - DNA, 16 bp, C. familiaris
cagtcagagggagagg

SEQ ID NO: 310391 - DNA, 16 bp, C. familiaris
cagtcagtgaagcatc

SEQ ID NO: 310392 - DNA, 16 bp, C. familiaris
cagtcagtggagcctg

SEQ ID NO: 310393 - DNA, 16 bp, C. familiaris
cagtcatgatcctggg

SEQ ID NO: 310394 - DNA, 16 bp, C. familiaris
cagtcatgatctcatg

SEQ ID NO: 310395 - DNA, 16 bp, C. familiaris
cagtcattaaaaagaa

SEQ ID NO: 310396 - DNA, 16 bp, C. familiaris
cagtcattgtggaaaa

SEQ ID NO: 310397 - DNA, 16 bp, C. familiaris
cagtccatggacattt

SEQ ID NO: 310398 - DNA, 16 bp, C. familiaris
cagtcctctctctctc

SEQ ID NO: 310399 - DNA, 16 bp, C. familiaris
cagtctccagaactgt

SEQ ID NO: 310400 - DNA, 16 bp, C. familiaris
cagtctccctgctgag

SEQ ID NO: 310401 - DNA, 16 bp, C. familiaris
cagtctctgccctcag

SEQ ID NO: 310402 - DNA, 16 bp, C. familiaris
cagtctgcttgggatt

SEQ ID NO: 310403 - DNA, 16 bp, C. familiaris
cagtctggaagaaatg

SEQ ID NO: 310404 - DNA, 16 bp, C. familiaris
cagtcttgggcagccc

SEQ ID NO: 310405 - DNA, 16 bp, C. familiaris
cagtgaaaaaccaaga

SEQ ID NO: 310406 - DNA, 16 bp, C. familiaris
cagtgaaagaccgaga

SEQ ID NO: 310407 - DNA, 16 bp, C. familiaris
cagtgaagagggagag

SEQ ID NO: 310408 - DNA, 16 bp, C. familiaris
cagtgaagcctccaga

SEQ ID NO: 310409 - DNA, 16 bp, C. familiaris
cagtgaatttttcatt

SEQ ID NO: 310410 - DNA, 16 bp, C. familiaris
cagtgacacaggcaga

SEQ ID NO: 310411 - DNA, 16 bp, C. familiaris
cagtgacataggcaga

SEQ ID NO: 310412 - DNA, 16 bp, C. familiaris
cagtgacttttttttt

SEQ ID NO: 310413 - DNA, 16 bp, C. familiaris
cagtgagaaatctgct

SEQ ID NO: 310414 - DNA, 16 bp, C. familiaris
cagtgagaaggcagcc

SEQ ID NO: 310415 - DNA, 16 bp, C. familiaris
cagtgagaagggtgaa

SEQ ID NO: 310416 - DNA, 16 bp, C. familiaris
cagtgagaatggggac

SEQ ID NO: 310417 - DNA, 16 bp, C. familiaris
cagtgagagtgacaga

SEQ ID NO: 310418 - DNA, 16 bp, C. familiaris
cagtgagcaaaataaa

SEQ ID NO: 310419 - DNA, 16 bp, C. familiaris
cagtgaggagactgct

SEQ ID NO: 310420 - DNA, 16 bp, C. familiaris
cagtgaggaggaggag

SEQ ID NO: 310421 - DNA, 16 bp, C. familiaris
cagtgaggatggggaa

SEQ ID NO: 310422 - DNA, 16 bp, C. familiaris
cagtgattcaacattt

SEQ ID NO: 310423 - DNA, 16 bp, C. familiaris
cagtgcaacaatccac

SEQ ID NO: 310424 - DNA, 16 bp, C. familiaris
cagtgcaagagggatc

SEQ ID NO: 310425 - DNA, 16 bp, C. familiaris
cagtgcagaggatcat

SEQ ID NO: 310426 - DNA, 16 bp, C. familiaris
cagtgccagagggttc

SEQ ID NO: 310427 - DNA, 16 bp, C. familiaris
cagtgcccatcaccca

SEQ ID NO: 310428 - DNA, 16 bp, C. familiaris
cagtgccctctggaac

SEQ ID NO: 310429 - DNA, 16 bp, C. familiaris
cagtgcctgacataca

SEQ ID NO: 310430 - DNA, 16 bp, C. familiaris
cagtgcctgccaccca

SEQ ID NO: 310431 - DNA, 16 bp, C. familiaris
cagtgcctggcacctg

SEQ ID NO: 310432 - DNA, 16 bp, C. familiaris
cagtgctcagcacaga

SEQ ID NO: 310433 - DNA, 16 bp, C. familiaris
cagtgctgctggtcca

SEQ ID NO: 310434 - DNA, 16 bp, C. familiaris
cagtggaacagaagag

SEQ ID NO: 310435 - DNA, 16 bp, C. familiaris
cagtggaattattgga

SEQ ID NO: 310436 - DNA, 16 bp, C. familiaris
cagtggacacttagat

SEQ ID NO: 310437 - DNA, 16 bp, C. familiaris
cagtggagtatgtgac

SEQ ID NO: 310438 - DNA, 16 bp, C. familiaris
cagtggatgaatggat

SEQ ID NO: 310439 - DNA, 16 bp, C. familiaris
cagtggcagagggaga

SEQ ID NO: 310440 - DNA, 16 bp, C. familiaris
cagtggcggcggcagc

SEQ ID NO: 310441 - DNA, 16 bp, C. familiaris
cagtggctgcagcagt

SEQ ID NO: 310442 - DNA, 16 bp, C. familiaris
cagtgggaaacctgct

SEQ ID NO: 310443 - DNA, 16 bp, C. familiaris
cagtgggagaagcagg

SEQ ID NO: 310444 - DNA, 16 bp, C. familiaris
cagtggggaggaacag

SEQ ID NO: 310445 - DNA, 16 bp, C. familiaris
cagtggtatattagtt

SEQ ID NO: 310446 - DNA, 16 bp, C. familiaris
cagtggtggagcacct

SEQ ID NO: 310447 - DNA, 16 bp, C. familiaris
cagtggttctcagcca

SEQ ID NO: 310448 - DNA, 16 bp, C. familiaris
cagtggttctcagctg

SEQ ID NO: 310449 - DNA, 16 bp, C. familiaris
cagtggttctccaagt

SEQ ID NO: 310450 - DNA, 16 bp, C. familiaris
cagtggttgccagggg

SEQ ID NO: 310451 - DNA, 16 bp, C. familiaris
cagtggttttattttt

SEQ ID NO: 310452 - DNA, 16 bp, C. familiaris
cagtgtatacataaac

SEQ ID NO: 310453 - DNA, 16 bp, C. familiaris
cagtgtctggcatgtg

SEQ ID NO: 310454 - DNA, 16 bp, C. familiaris
cagtgtgaaagcagcc

SEQ ID NO: 310455 - DNA, 18 bp, C. familiaris
cagtgtgattcatcatat

SEQ ID NO: 310456 - DNA, 16 bp, C. familiaris
cagtgtggactgggag

SEQ ID NO: 310457 - DNA, 16 bp, C. familiaris
cagtgtggagattcct

SEQ ID NO: 310458 - DNA, 16 bp, C. familiaris
cagtgtggagtctgag

SEQ ID NO: 310459 - DNA, 16 bp, C. familiaris
cagtgtttcttttctt

SEQ ID NO: 310460 - DNA, 16 bp, C. familiaris
cagtgtttgaacatct

SEQ ID NO: 310461 - DNA, 16 bp, C. familiaris
cagttacagaatttgg

SEQ ID NO: 310462 - DNA, 16 bp, C. familiaris
cagttacaggaagaaa

SEQ ID NO: 310463 - DNA, 16 bp, C. familiaris
cagttaccccatcttc

SEQ ID NO: 310464 - DNA, 16 bp, C. familiaris
cagttagaagatgaat

SEQ ID NO: 310465 - DNA, 16 bp, C. familiaris
cagttcaggtcttgat

SEQ ID NO: 310466 - DNA, 16 bp, C. familiaris
cagttcagtcagttaa

SEQ ID NO: 310467 - DNA, 16 bp, C. familiaris
cagttccaggaccctg

SEQ ID NO: 310468 - DNA, 16 bp, C. familiaris
cagttcctggatgcct

SEQ ID NO: 310469 - DNA, 16 bp, C. familiaris
cagttctaagaaggaa

SEQ ID NO: 310470 - DNA, 16 bp, C. familiaris
cagttctctatattta

SEQ ID NO: 310471 - DNA, 16 bp, C. familiaris
cagttctgtgggtttt

SEQ ID NO: 310472 - DNA, 16 bp, C. familiaris
cagttcttgcctgtct

SEQ ID NO: 310473 - DNA, 16 bp, C. familiaris
cagttgagaagaatgt

SEQ ID NO: 310474 - DNA, 16 bp, C. familiaris
cagttggctcagtggt

SEQ ID NO: 310475 - DNA, 16 bp, C. familiaris
cagttgggggagctgc

SEQ ID NO: 310476 - DNA, 16 bp, C. familiaris
cagttggtgaagcatc

SEQ ID NO: 310477 - DNA, 16 bp, C. familiaris
cagtttaaagaaaaaa

SEQ ID NO: 310478 - DNA, 16 bp, C. familiaris
cagtttatttcctata

SEQ ID NO: 310479 - DNA, 16 bp, C. familiaris
cagtttcatgaccctg

SEQ ID NO: 310480 - DNA, 16 bp, C. familiaris
cagtttcattattttg

SEQ ID NO: 310481 - DNA, 16 bp, C. familiaris
cagtttcattcctttg

SEQ ID NO: 310482 - DNA, 16 bp, C. familiaris
cagtttccctgcctgt

SEQ ID NO: 310483 - DNA, 16 bp, C. familiaris
cagtttcctcatcttc

SEQ ID NO: 310484 - DNA, 16 bp, C. familiaris
cagtttcctctcctgt

SEQ ID NO: 310485 - DNA, 16 bp, C. familiaris
cagtttccttctctat

SEQ ID NO: 310486 - DNA, 16 bp, C. familiaris
cagtttctctcttttt

SEQ ID NO: 310487 - DNA, 16 bp, C. familiaris
cagtttcttcaacaaa

SEQ ID NO: 310488 - DNA, 16 bp, C. familiaris
cagtttgggaagtttc

SEQ ID NO: 310489 - DNA, 16 bp, C. familiaris
cagtttgtttcctctg

SEQ ID NO: 310490 - DNA, 16 bp, C. familiaris
cagttttaaaactgaa

SEQ ID NO: 310491 - DNA, 16 bp, C. familiaris
cagttttactgagata

SEQ ID NO: 310492 - DNA, 16 bp, C. familiaris
cagttttatcagtttt

SEQ ID NO: 310493 - DNA, 16 bp, C. familiaris
cagttttcctcctgtt

SEQ ID NO: 310494 - DNA, 16 bp, C. familiaris
cagttttcttatttta

SEQ ID NO: 310495 - DNA, 16 bp, C. familiaris
cagttttggcagtttg

SEQ ID NO: 310496 - DNA, 16 bp, C. familiaris
cagtttttaaatttca

SEQ ID NO: 310497 - DNA, 16 bp, C. familiaris
cagtttttccaacatc

SEQ ID NO: 310498 - DNA, 16 bp, C. familiaris
cataaaaagagacata

SEQ ID NO: 310499 - DNA, 16 bp, C. familiaris
cataaaaatgaggaaa

SEQ ID NO: 310500 - DNA, 16 bp, C. familiaris
cataaaaatgcaaaat

SEQ ID NO: 310501 - DNA, 16 bp, C. familiaris
cataaacacagacaca

SEQ ID NO: 310502 - DNA, 16 bp, C. familiaris
cataaagaaaggaaga

SEQ ID NO: 310503 - DNA, 16 bp, C. familiaris
cataaagaaatggaaa

SEQ ID NO: 310504 - DNA, 16 bp, C. familiaris
cataaagctttaaaaa

SEQ ID NO: 310505 - DNA, 16 bp, C. familiaris
cataaaggagctagaa

SEQ ID NO: 310506 - DNA, 16 bp, C. familiaris
cataaatgaatttaaa

SEQ ID NO: 310507 - DNA, 16 bp, C. familiaris
cataaattatttggga

SEQ ID NO: 310508 - DNA, 16 bp, C. familiaris
cataagtgaaatcata

SEQ ID NO: 310509 - DNA, 16 bp, C. familiaris
cataatatcctccagg

SEQ ID NO: 310510 - DNA, 16 bp, C. familiaris
cataatgctctcaagg

SEQ ID NO: 310511 - DNA, 16 bp, C. familiaris
cataattttaaaaaga

SEQ ID NO: 310512 - DNA, 16 bp, C. familiaris
catacagaaatattta

SEQ ID NO: 310513 - DNA, 16 bp, C. familiaris
catacattatattagt

SEQ ID NO: 310514 - DNA, 16 bp, C. familiaris
catacctaggaataaa

SEQ ID NO: 310515 - DNA, 16 bp, C. familiaris
catacctcaatgtaat

SEQ ID NO: 310516 - DNA, 16 bp, C. familiaris
catactcaaagataaa

SEQ ID NO: 310517 - DNA, 16 bp, C. familiaris
catactgtattcttac

SEQ ID NO: 310518 - DNA, 16 bp, C. familiaris
catactgtttttcaaa

SEQ ID NO: 310519 - DNA, 16 bp, C. familiaris
catagaaaatcccaag

SEQ ID NO: 310520 - DNA, 16 bp, C. familiaris
catagacacacagaga

SEQ ID NO: 310521 - DNA, 16 bp, C. familiaris
catagacacagagaaa

SEQ ID NO: 310522 - DNA, 16 bp, C. familiaris
catagacatttttcca

SEQ ID NO: 310523 - DNA, 16 bp, C. familiaris
catagacttaaaaaaa

SEQ ID NO: 310524 - DNA, 16 bp, C. familiaris
catagagacaggaagt

SEQ ID NO: 310525 - DNA, 16 bp, C. familiaris
catagatcaaaggaac

SEQ ID NO: 310526 - DNA, 16 bp, C. familiaris
catagcaatagaaact

SEQ ID NO: 310527 - DNA, 16 bp, C. familiaris
catagctgagggcatc

SEQ ID NO: 310528 - DNA, 16 bp, C. familiaris
cataggggtgcaggtg

SEQ ID NO: 310529 - DNA, 16 bp, C. familiaris
catataaatggaatga

SEQ ID NO: 310530 - DNA, 16 bp, C. familiaris
catataatccagaaat

SEQ ID NO: 310531 - DNA, 18 bp, C. familiaris
catataatgtttgtcctt

SEQ ID NO: 310532 - DNA, 16 bp, C. familiaris
catataattgtggttt

SEQ ID NO: 310533 - DNA, 16 bp, C. familiaris
catatacacacatgtg

SEQ ID NO: 310534 - DNA, 16 bp, C. familiaris
catatacatatatatg

SEQ ID NO: 310535 - DNA, 16 bp, C. familiaris
catatacctgttggcc

SEQ ID NO: 310536 - DNA, 16 bp, C. familiaris
catatatatcattata

SEQ ID NO: 310537 - DNA, 16 bp, C. familiaris
catatatatgataagg

SEQ ID NO: 310538 - DNA, 16 bp, C. familiaris
catatatatgtatata

SEQ ID NO: 310539 - DNA, 16 bp, C. familiaris
catatatatgtatatg

SEQ ID NO: 310540 - DNA, 16 bp, C. familiaris
catatatatgtgtatg

SEQ ID NO: 310541 - DNA, 16 bp, C. familiaris
catatatgtttttgaa

SEQ ID NO: 310542 - DNA, 16 bp, C. familiaris
catatatttgataaag

SEQ ID NO: 310543 - DNA, 16 bp, C. familiaris
catatattttgaattt

SEQ ID NO: 310544 - DNA, 16 bp, C. familiaris
catatccaagaaatca

SEQ ID NO: 310545 - DNA, 16 bp, C. familiaris
catatctcaataaaac

SEQ ID NO: 310546 - DNA, 16 bp, C. familiaris
catatgaaagaaattg

SEQ ID NO: 310547 - DNA, 16 bp, C. familiaris
catatgaatggaatca

SEQ ID NO: 310548 - DNA, 16 bp, C. familiaris
catatgaattatatct

SEQ ID NO: 310549 - DNA, 16 bp, C. familiaris
catatgagaagatgct

SEQ ID NO: 310550 - DNA, 16 bp, C. familiaris
catatgattttatttt

SEQ ID NO: 310551 - DNA, 16 bp, C. familiaris
catatgcacacgcaca

SEQ ID NO: 310552 - DNA, 16 bp, C. familiaris
catatgcagaatttaa

SEQ ID NO: 310553 - DNA, 16 bp, C. familiaris
catatgcatgcacaca

SEQ ID NO: 310554 - DNA, 16 bp, C. familiaris
catatgctccaccaac

SEQ ID NO: 310555 - DNA, 16 bp, C. familiaris
catatggaaatacaaa

SEQ ID NO: 310556 - DNA, 16 bp, C. familiaris
catatggtctttgtct

SEQ ID NO: 310557 - DNA, 16 bp, C. familiaris
catatggttggaatca

SEQ ID NO: 310558 - DNA, 16 bp, C. familiaris
catatgttgaagctct

SEQ ID NO: 310559 - DNA, 16 bp, C. familiaris
catattcatatataca

SEQ ID NO: 310560 - DNA, 16 bp, C. familiaris
catattctttcagttc

SEQ ID NO: 310561 - DNA, 16 bp, C. familiaris
catatttattatctca

SEQ ID NO: 310562 - DNA, 16 bp, C. familiaris
catatttattgccatt

SEQ ID NO: 310563 - DNA, 16 bp, C. familiaris
catatttcagaaaata

SEQ ID NO: 310564 - DNA, 16 bp, C. familiaris
catatttctgtatatt

SEQ ID NO: 310565 - DNA, 16 bp, C. familiaris
catattttacatcttt

SEQ ID NO: 310566 - DNA, 16 bp, C. familiaris
catatttttgtaaaat

SEQ ID NO: 310567 - DNA, 16 bp, C. familiaris
catcaaaaaaattttt

SEQ ID NO: 310568 - DNA, 16 bp, C. familiaris
catcaaaaagatgaaa

SEQ ID NO: 310569 - DNA, 16 bp, C. familiaris
catcaaaaatatgaaa

SEQ ID NO: 310570 - DNA, 16 bp, C. familiaris
catcaaaagaaagcag

SEQ ID NO: 310571 - DNA, 16 bp, C. familiaris
catcaaactgctgagc

SEQ ID NO: 310572 - DNA, 16 bp, C. familiaris
catcaaagaagaaata

SEQ ID NO: 310573 - DNA, 16 bp, C. familiaris
catcaagataagaaga

SEQ ID NO: 310574 - DNA, 16 bp, C. familiaris
catcaagcctgcttct

SEQ ID NO: 310575 - DNA, 16 bp, C. familiaris
catcaaggaaatgaaa

SEQ ID NO: 310576 - DNA, 16 bp, C. familiaris
catcaataattacttt

SEQ ID NO: 310577 - DNA, 16 bp, C. familiaris
catcaatagaagaatg

SEQ ID NO: 310578 - DNA, 16 bp, C. familiaris
catcaatctgttctct

SEQ ID NO: 310579 - DNA, 16 bp, C. familiaris
catcacaagaaaacaa

SEQ ID NO: 310580 - DNA, 16 bp, C. familiaris
catcacaagtgccccc

SEQ ID NO: 310581 - DNA, 77 bp, C. familiaris
catcacaatgccagatttcaggttgtactacaaagctgtggtcatcaagacagtgtggtactggcacaaaaacagac

SEQ ID NO: 310582 - DNA, 16 bp, C. familiaris
catcacatgccctcct

SEQ ID NO: 310583 - DNA, 16 bp, C. familiaris
catcaccaccaccagc

SEQ ID NO: 310584 - DNA, 16 bp, C. familiaris
catcaccaccatcact

SEQ ID NO: 310585 - DNA, 16 bp, C. familiaris
catcaccaccatctcc

SEQ ID NO: 310586 - DNA, 16 bp, C. familiaris
catcaccatcatcttc

SEQ ID NO: 310587 - DNA, 16 bp, C. familiaris
catcaccatcctcatc

SEQ ID NO: 310588 - DNA, 16 bp, C. familiaris
catcaccccaaaagga

SEQ ID NO: 310589 - DNA, 16 bp, C. familiaris
catcacccccaaaaga

SEQ ID NO: 310590 - DNA, 16 bp, C. familiaris
catcacctggaagctt

SEQ ID NO: 310591 - DNA, 16 bp, C. familiaris
catcactgaccatcag

SEQ ID NO: 310592 - DNA, 16 bp, C. familiaris
catcactgcagaaagt

SEQ ID NO: 310593 - DNA, 16 bp, C. familiaris
catcactggctatcag

SEQ ID NO: 310594 - DNA, 16 bp, C. familiaris
catcactgtcaccatc

SEQ ID NO: 310595 - DNA, 16 bp, C. familiaris
catcactgtcatcatc

SEQ ID NO: 310596 - DNA, 16 bp, C. familiaris
catcacttatcatcag

SEQ ID NO: 310597 - DNA, 16 bp, C. familiaris
catcagacacacacac

SEQ ID NO: 310598 - DNA, 16 bp, C. familiaris
catcagagagacagag

SEQ ID NO: 310599 - DNA, 16 bp, C. familiaris
catcagagtcacctgg

SEQ ID NO: 310600 - DNA, 16 bp, C. familiaris
catcagcaaaatgaaa

SEQ ID NO: 310601 - DNA, 16 bp, C. familiaris
catcagcatcagcatc

SEQ ID NO: 310602 - DNA, 17 bp, C. familiaris
catcagccttcggctca

SEQ ID NO: 310603 - DNA, 16 bp, C. familiaris
catcagctctgtgctc

SEQ ID NO: 310604 - DNA, 16 bp, C. familiaris
catcaggctcccggca

SEQ ID NO: 310605 - DNA, 16 bp, C. familiaris
catcaggcttcctgca

SEQ ID NO: 310606 - DNA, 16 bp, C. familiaris
catcaggcttcctgta

SEQ ID NO: 310607 - DNA, 16 bp, C. familiaris
catcagggaaatccaa

SEQ ID NO: 310608 - DNA, 16 bp, C. familiaris
catcagggaaatgcca

SEQ ID NO: 310609 - DNA, 16 bp, C. familiaris
catcagttgtaacaaa

SEQ ID NO: 310610 - DNA, 16 bp, C. familiaris
catcataaaaatgaaa

SEQ ID NO: 310611 - DNA, 16 bp, C. familiaris
catcatcactgtcatc

SEQ ID NO: 310612 - DNA, 16 bp, C. familiaris
catcatcatcaccacc

SEQ ID NO: 310613 - DNA, 16 bp, C. familiaris
catcatcatcaccatc

SEQ ID NO: 310614 - DNA, 16 bp, C. familiaris
catcatcatcactgtc

SEQ ID NO: 310615 - DNA, 16 bp, C. familiaris
catcatcatcatctca

SEQ ID NO: 310616 - DNA, 16 bp, C. familiaris
catcatcatcatctct

SEQ ID NO: 310617 - DNA, 16 bp, C. familiaris
catcatcatcattatt

SEQ ID NO: 310618 - DNA, 16 bp, C. familiaris
catcatcatcattgcc

SEQ ID NO: 310619 - DNA, 16 bp, C. familiaris
catcatcatcctcatc

SEQ ID NO: 310620 - DNA, 16 bp, C. familiaris
catcatcatcttcttc

SEQ ID NO: 310621 - DNA, 16 bp, C. familiaris
catcatcctcatcatc

SEQ ID NO: 310622 - DNA, 16 bp, C. familiaris
catcatcgtcatcatc

SEQ ID NO: 310623 - DNA, 16 bp, C. familiaris
catcatctccatcatc

SEQ ID NO: 310624 - DNA, 16 bp, C. familiaris
catcatctcttacctg

SEQ ID NO: 310625 - DNA, 16 bp, C. familiaris
catcatctgcaaatag

SEQ ID NO: 310626 - DNA, 16 bp, C. familiaris
catcatcttcatcacc

SEQ ID NO: 310627 - DNA, 16 bp, C. familiaris
catcatcttcatcatc

SEQ ID NO: 310628 - DNA, 16 bp, C. familiaris
catcatcttcttcatc

SEQ ID NO: 310629 - DNA, 16 bp, C. familiaris
catcatcttcttcttc

SEQ ID NO: 310630 - DNA, 16 bp, C. familiaris
catcattatcatcatc

SEQ ID NO: 310631 - DNA, 16 bp, C. familiaris
catcattgtcatcatc

SEQ ID NO: 310632 - DNA, 16 bp, C. familiaris
catcatttgttgaaga

SEQ ID NO: 310633 - DNA, 17 bp, C. familiaris
catccaaaaactggaaa

SEQ ID NO: 310634 - DNA, 16 bp, C. familiaris
catccaaaagaataaa

SEQ ID NO: 310635 - DNA, 16 bp, C. familiaris
catccaaaatacataa

SEQ ID NO: 310636 - DNA, 16 bp, C. familiaris
catccaaagtggtgcc

SEQ ID NO: 310637 - DNA, 16 bp, C. familiaris
catccacctgtccatc

SEQ ID NO: 310638 - DNA, 16 bp, C. familiaris
catccactctggaaaa

SEQ ID NO: 310639 - DNA, 16 bp, C. familiaris
catccactgtggaaaa

SEQ ID NO: 310640 - DNA, 16 bp, C. familiaris
catccagatccagaag

SEQ ID NO: 310641 - DNA, 16 bp, C. familiaris
catccagcaattccac

SEQ ID NO: 310642 - DNA, 16 bp, C. familiaris
catccaggctgcccag

SEQ ID NO: 310643 - DNA, 16 bp, C. familiaris
catccaggctgccctt

SEQ ID NO: 310644 - DNA, 16 bp, C. familiaris
catccagggaccccag

SEQ ID NO: 310645 - DNA, 16 bp, C. familiaris
catccagggcacctgg

SEQ ID NO: 310646 - DNA, 16 bp, C. familiaris
catccaggtgccccaa

SEQ ID NO: 310647 - DNA, 16 bp, C. familiaris
catccaggtgcctcag

SEQ ID NO: 310648 - DNA, 16 bp, C. familiaris
catccaggtggccaac

SEQ ID NO: 310649 - DNA, 16 bp, C. familiaris
catccaggtggctcag

SEQ ID NO: 310650 - DNA, 16 bp, C. familiaris
catccatctgtctgtc

SEQ ID NO: 310651 - DNA, 16 bp, C. familiaris
catcccaaatgaaaga

SEQ ID NO: 310652 - DNA, 16 bp, C. familiaris
catcccactgccttct

SEQ ID NO: 310653 - DNA, 16 bp, C. familiaris
catcccaggacaccag

SEQ ID NO: 310654 - DNA, 16 bp, C. familiaris
catcccaggaccccaa

SEQ ID NO: 310655 - DNA, 16 bp, C. familiaris
catcccaggcctccag

SEQ ID NO: 310656 - DNA, 16 bp, C. familiaris
catcccatcagtgccc

SEQ ID NO: 310657 - DNA, 16 bp, C. familiaris
catcccattggccaaa

SEQ ID NO: 310658 - DNA, 16 bp, C. familiaris
catcccctgccctcct

SEQ ID NO: 310659 - DNA, 16 bp, C. familiaris
catcccgggactctgg

SEQ ID NO: 310660 - DNA, 16 bp, C. familiaris
catcccggggtcctgg

SEQ ID NO: 310661 - DNA, 16 bp, C. familiaris
catcccgggtctccag

SEQ ID NO: 310662 - DNA, 16 bp, C. familiaris
catccctgtctcattc

SEQ ID NO: 310663 - DNA, 16 bp, C. familiaris
catccggctccctgca

SEQ ID NO: 310664 - DNA, 16 bp, C. familiaris
catccgggctgccccc

SEQ ID NO: 310665 - DNA, 16 bp, C. familiaris
catcctaaaggttttg

SEQ ID NO: 310666 - DNA, 16 bp, C. familiaris
catcctcaccaacatg

SEQ ID NO: 310667 - DNA, 16 bp, C. familiaris
catcctcaccaaccct

SEQ ID NO: 310668 - DNA, 16 bp, C. familiaris
catcctcaccaccatc

SEQ ID NO: 310669 - DNA, 16 bp, C. familiaris
catcctcactagcatt

SEQ ID NO: 310670 - DNA, 16 bp, C. familiaris
catcctcatcatcctc

SEQ ID NO: 310671 - DNA, 16 bp, C. familiaris
catcctcatcctcatc

SEQ ID NO: 310672 - DNA, 16 bp, C. familiaris
catcctcatgacctca

SEQ ID NO: 310673 - DNA, 16 bp, C. familiaris
catcctcctgcccacc

SEQ ID NO: 310674 - DNA, 16 bp, C. familiaris
catcctctccaacacc

SEQ ID NO: 310675 - DNA, 16 bp, C. familiaris
catcctctccagcatt

SEQ ID NO: 310676 - DNA, 16 bp, C. familiaris
catcctgccacccacc

SEQ ID NO: 310677 - DNA, 16 bp, C. familiaris
catcctgcccctcctc

SEQ ID NO: 310678 - DNA, 16 bp, C. familiaris
catcctggccaacatc

SEQ ID NO: 310679 - DNA, 16 bp, C. familiaris
catcctgggccgaagg

SEQ ID NO: 310680 - DNA, 16 bp, C. familiaris
catccttatatcagac

SEQ ID NO: 310681 - DNA, 16 bp, C. familiaris
catccttcaagactca

SEQ ID NO: 310682 - DNA, 16 bp, C. familiaris
catccttctcttcctg

SEQ ID NO: 310683 - DNA, 16 bp, C. familiaris
catccttgtcaacact

SEQ ID NO: 310684 - DNA, 16 bp, C. familiaris
catcctttcctgatca

SEQ ID NO: 310685 - DNA, 16 bp, C. familiaris
catcgggagcctgatg

SEQ ID NO: 310686 - DNA, 16 bp, C. familiaris
catcgggctccaggca

SEQ ID NO: 310687 - DNA, 16 bp, C. familiaris
catcgggctcctggtg

SEQ ID NO: 310688 - DNA, 16 bp, C. familiaris
catcggggctccctgc

SEQ ID NO: 310689 - DNA, 16 bp, C. familiaris
catcgggtccctgcat

SEQ ID NO: 310690 - DNA, 16 bp, C. familiaris
catcgtcgtcatcatc

SEQ ID NO: 310691 - DNA, 16 bp, C. familiaris
catctaaaggaactgg

SEQ ID NO: 310692 - DNA, 16 bp, C. familiaris
catctacaaagaccct

SEQ ID NO: 310693 - DNA, 16 bp, C. familiaris
catctacaagccagga

SEQ ID NO: 310694 - DNA, 16 bp, C. familiaris
catctacatgcagaag

SEQ ID NO: 310695 - DNA, 16 bp, C. familiaris
catctaccttgggctc

SEQ ID NO: 310696 - DNA, 16 bp, C. familiaris
catctatgaaatggga

SEQ ID NO: 310697 - DNA, 16 bp, C. familiaris
catctattgaaaagat

SEQ ID NO: 310698 - DNA, 16 bp, C. familiaris
catctcaagaaaccat

SEQ ID NO: 310699 - DNA, 16 bp, C. familiaris
catctcaagaaactac

SEQ ID NO: 310700 - DNA, 16 bp, C. familiaris
catctcaagaaatcac

SEQ ID NO: 310701 - DNA, 16 bp, C. familiaris
catctcaagatcctga

SEQ ID NO: 310702 - DNA, 16 bp, C. familiaris
catctcagcatcaagc

SEQ ID NO: 310703 - DNA, 16 bp, C. familiaris
catctccagacattgc

SEQ ID NO: 310704 - DNA, 16 bp, C. familiaris
catctccatcatcatc

SEQ ID NO: 310705 - DNA, 16 bp, C. familiaris
catctcccaaccctga

SEQ ID NO: 310706 - DNA, 16 bp, C. familiaris
catctccctctacctg

SEQ ID NO: 310707 - DNA, 16 bp, C. familiaris
catctctcacctggac

SEQ ID NO: 310708 - DNA, 16 bp, C. familiaris
catctctctgtgtctc

SEQ ID NO: 310709 - DNA, 16 bp, C. familiaris
catctctgcctccctc

SEQ ID NO: 310710 - DNA, 16 bp, C. familiaris
catctctgcctctgtg

SEQ ID NO: 310711 - DNA, 16 bp, C. familiaris
catctctttactttta

SEQ ID NO: 310712 - DNA, 16 bp, C. familiaris
catctgactccctgct

SEQ ID NO: 310713 - DNA, 16 bp, C. familiaris
catctgagctacccag

SEQ ID NO: 310714 - DNA, 16 bp, C. familiaris
catctgcaaaccagga

SEQ ID NO: 310715 - DNA, 16 bp, C. familiaris
catctgcaaagtggag

SEQ ID NO: 310716 - DNA, 16 bp, C. familiaris
catctgcaagccaaga

SEQ ID NO: 310717 - DNA, 16 bp, C. familiaris
catctgcccctggctc

SEQ ID NO: 310718 - DNA, 16 bp, C. familiaris
catctgcctggggctc

SEQ ID NO: 310719 - DNA, 16 bp, C. familiaris
catctgccttctgcct

SEQ ID NO: 310720 - DNA, 16 bp, C. familiaris
catctggaattaattt

SEQ ID NO: 310721 - DNA, 16 bp, C. familiaris
catctggacctggact

SEQ ID NO: 310722 - DNA, 16 bp, C. familiaris
catctgtaaaatcaga

SEQ ID NO: 310723 - DNA, 16 bp, C. familiaris
catctgtagatcttct

SEQ ID NO: 310724 - DNA, 16 bp, C. familiaris
catctgtatcttgggg

SEQ ID NO: 310725 - DNA, 16 bp, C. familiaris
catctgtccatccatc

SEQ ID NO: 310726 - DNA, 16 bp, C. familiaris
catctgtctgtctgtc

SEQ ID NO: 310727 - DNA, 16 bp, C. familiaris
catctgtgcaatgggg

SEQ ID NO: 310728 - DNA, 16 bp, C. familiaris
catctgttcattcatt

SEQ ID NO: 310729 - DNA, 18 bp, C. familiaris
catcttaaaagccatcta

SEQ ID NO: 310730 - DNA, 16 bp, C. familiaris
catcttcaaggagatt

SEQ ID NO: 310731 - DNA, 16 bp, C. familiaris
catcttcaccaacatc

SEQ ID NO: 310732 - DNA, 16 bp, C. familiaris
catcttcaccagcatt

SEQ ID NO: 310733 - DNA, 16 bp, C. familiaris
catcttcctctgcctg

SEQ ID NO: 310734 - DNA, 16 bp, C. familiaris
catcttcctttggctc

SEQ ID NO: 310735 - DNA, 16 bp, C. familiaris
catcttctcatgtgtc

SEQ ID NO: 310736 - DNA, 16 bp, C. familiaris
catcttctccctctgc

SEQ ID NO: 310737 - DNA, 16 bp, C. familiaris
catcttctttggaaaa

SEQ ID NO: 310738 - DNA, 16 bp, C. familiaris
catcttcttttttaaa

SEQ ID NO: 310739 - DNA, 16 bp, C. familiaris
catcttgaaaaaaaaa

SEQ ID NO: 310740 - DNA, 16 bp, C. familiaris
catcttgatcttggat

SEQ ID NO: 310741 - DNA, 16 bp, C. familiaris
catcttgccccacccc

SEQ ID NO: 310742 - DNA, 16 bp, C. familiaris
catctttccatccatc

SEQ ID NO: 310743 - DNA, 16 bp, C. familiaris
catctttgccaacact

SEQ ID NO: 310744 - DNA, 16 bp, C. familiaris
catctttgtcagcatt

SEQ ID NO: 310745 - DNA, 16 bp, C. familiaris
catctttgtctggttt

SEQ ID NO: 310746 - DNA, 16 bp, C. familiaris
catcttttcatttgtc

SEQ ID NO: 310747 - DNA, 16 bp, C. familiaris
catgaaaaagaatgaa

SEQ ID NO: 310748 - DNA, 16 bp, C. familiaris
catgaaaagatatgga

SEQ ID NO: 310749 - DNA, 16 bp, C. familiaris
catgaaaagatcttca

SEQ ID NO: 310750 - DNA, 16 bp, C. familiaris
catgaaaataataata

SEQ ID NO: 310751 - DNA, 16 bp, C. familiaris
catgaacaaggtggtg

SEQ ID NO: 310752 - DNA, 16 bp, C. familiaris
catgaagacacacaca

SEQ ID NO: 310753 - DNA, 16 bp, C. familiaris
catgaagcctgcttgg

SEQ ID NO: 310754 - DNA, 16 bp, C. familiaris
catgaataaatgaatt

SEQ ID NO: 310755 - DNA, 16 bp, C. familiaris
catgaatacattaaaa

SEQ ID NO: 310756 - DNA, 16 bp, C. familiaris
catgaatataaataaa

SEQ ID NO: 310757 - DNA, 16 bp, C. familiaris
catgaatatttttatt

SEQ ID NO: 310758 - DNA, 16 bp, C. familiaris
catgacccaagccaga

SEQ ID NO: 310759 - DNA, 16 bp, C. familiaris
catgaccctgagactg

SEQ ID NO: 310760 - DNA, 16 bp, C. familiaris
catgacctggagatca

SEQ ID NO: 310761 - DNA, 16 bp, C. familiaris
catgacctgtgccaaa

SEQ ID NO: 310762 - DNA, 16 bp, C. familiaris
catgaccttgacagtt

SEQ ID NO: 310763 - DNA, 16 bp, C. familiaris
catgactccagctgaa

SEQ ID NO: 310764 - DNA, 16 bp, C. familiaris
catgagaaaatgctgc

SEQ ID NO: 310765 - DNA, 16 bp, C. familiaris
catgagaaacagggag

SEQ ID NO: 310766 - DNA, 16 bp, C. familiaris
catgagaaaggcagag

SEQ ID NO: 310767 - DNA, 16 bp, C. familiaris
catgagaacacacaca

SEQ ID NO: 310768 - DNA, 16 bp, C. familiaris
catgagaagatgctct

SEQ ID NO: 310769 - DNA, 22 bp, C. familiaris
catgagacagacggttgctgtg

SEQ ID NO: 310770 - DNA, 16 bp, C. familiaris
catgagagaacacaca

SEQ ID NO: 310771 - DNA, 16 bp, C. familiaris
catgagagacacatat

SEQ ID NO: 310772 - DNA, 16 bp, C. familiaris
catgagagagagagac

SEQ ID NO: 310773 - DNA, 16 bp, C. familiaris
catgagagattcagag

SEQ ID NO: 310774 - DNA, 16 bp, C. familiaris
catgagcaaggaggag

SEQ ID NO: 310775 - DNA, 16 bp, C. familiaris
catgagcagcggggag

SEQ ID NO: 310776 - DNA, 16 bp, C. familiaris
catgagcaggagaagg

SEQ ID NO: 310777 - DNA, 16 bp, C. familiaris
catgagccaaagaatg

SEQ ID NO: 310778 - DNA, 16 bp, C. familiaris
catgagctggaggagg

SEQ ID NO: 310779 - DNA, 16 bp, C. familiaris
catgagctgggggagg

SEQ ID NO: 310780 - DNA, 16 bp, C. familiaris
catgaggaacacagag

SEQ ID NO: 310781 - DNA, 16 bp, C. familiaris
catgaggactccaccc

SEQ ID NO: 310782 - DNA, 16 bp, C. familiaris
catgagtgaggagagg

SEQ ID NO: 310783 - DNA, 16 bp, C. familiaris
catgagtggggagaag

SEQ ID NO: 310784 - DNA, 16 bp, C. familiaris
catgagtgtgtgtgca

SEQ ID NO: 310785 - DNA, 16 bp, C. familiaris
catgatccatgagatc

SEQ ID NO: 310786 - DNA, 16 bp, C. familiaris
catgatcccggagtcc

SEQ ID NO: 310787 - DNA, 16 bp, C. familiaris
catgatcctggaggcc

SEQ ID NO: 310788 - DNA, 16 bp, C. familiaris
catgatcctggagttc

SEQ ID NO: 310789 - DNA, 16 bp, C. familiaris
catgatcctggatttc

SEQ ID NO: 310790 - DNA, 16 bp, C. familiaris
catgatctcagtcctg

SEQ ID NO: 310791 - DNA, 16 bp, C. familiaris
catgatcttggaatcc

SEQ ID NO: 310792 - DNA, 16 bp, C. familiaris
catgatgctggagacc

SEQ ID NO: 310793 - DNA, 16 bp, C. familiaris
catgatgggtatagag

SEQ ID NO: 310794 - DNA, 16 bp, C. familiaris
catgatgtgggacttg

SEQ ID NO: 310795 - DNA, 16 bp, C. familiaris
catgatttttaaataa

SEQ ID NO: 310796 - DNA, 16 bp, C. familiaris
catgcaagaacagatg

SEQ ID NO: 310797 - DNA, 16 bp, C. familiaris
catgcaagcaagaaga

SEQ ID NO: 310798 - DNA, 16 bp, C. familiaris
catgcacacagggaga

SEQ ID NO: 310799 - DNA, 16 bp, C. familiaris
catgcacagagggaag

SEQ ID NO: 310800 - DNA, 16 bp, C. familiaris
catgcacatacacaaa

SEQ ID NO: 310801 - DNA, 16 bp, C. familiaris
catgcacgcacatgca

SEQ ID NO: 310802 - DNA, 16 bp, C. familiaris
catgcacggagcctga

SEQ ID NO: 310803 - DNA, 16 bp, C. familiaris
catgcactgggacccc

SEQ ID NO: 310804 - DNA, 16 bp, C. familiaris
catgcaggaagcccag

SEQ ID NO: 310805 - DNA, 16 bp, C. familiaris
catgcaggaggcccga

SEQ ID NO: 310806 - DNA, 16 bp, C. familiaris
catgcagggagcagga

SEQ ID NO: 310807 - DNA, 16 bp, C. familiaris
catgcagggagccaat

SEQ ID NO: 310808 - DNA, 16 bp, C. familiaris
catgcaggtgtgtgtg

SEQ ID NO: 310809 - DNA, 16 bp, C. familiaris
catgcccagcaaggag

SEQ ID NO: 310810 - DNA, 16 bp, C. familiaris
catgcccagcacaaag

SEQ ID NO: 310811 - DNA, 16 bp, C. familiaris
catgcccatcacccag

SEQ ID NO: 310812 - DNA, 17 bp, C. familiaris
catgccccgagctgaag

SEQ ID NO: 310813 - DNA, 16 bp, C. familiaris
catgccctcctcaatg

SEQ ID NO: 310814 - DNA, 16 bp, C. familiaris
catgccctccttcatg

SEQ ID NO: 310815 - DNA, 16 bp, C. familiaris
catgccctgagccacc

SEQ ID NO: 310816 - DNA, 16 bp, C. familiaris
catgctcaatggggag

SEQ ID NO: 310817 - DNA, 16 bp, C. familiaris
catgctcagcaaggag

SEQ ID NO: 310818 - DNA, 16 bp, C. familiaris
catgctcatggatcag

SEQ ID NO: 310819 - DNA, 16 bp, C. familiaris
catgctccacagactg

SEQ ID NO: 310820 - DNA, 16 bp, C. familiaris
catgctccattgactg

SEQ ID NO: 310821 - DNA, 16 bp, C. familiaris
catgctctaccacctg

SEQ ID NO: 310822 - DNA, 16 bp, C. familiaris
catgctctctccctca

SEQ ID NO: 310823 - DNA, 16 bp, C. familiaris
catgctgctgctgctg

SEQ ID NO: 310824 - DNA, 16 bp, C. familiaris
catgctggatgtggag

SEQ ID NO: 310825 - DNA, 16 bp, C. familiaris
catgctgggcatggag

SEQ ID NO: 310826 - DNA, 16 bp, C. familiaris
catgctgtatgcctta

SEQ ID NO: 310827 - DNA, 16 bp, C. familiaris
catgctgtgcatggag

SEQ ID NO: 310828 - DNA, 38 bp, C. familiaris
catgctgttgattgctaaatgtaatagtctgatcatga

SEQ ID NO: 310829 - DNA, 16 bp, C. familiaris
catgctgttttccaga

SEQ ID NO: 310830 - DNA, 16 bp, C. familiaris
catgcttggtgtggag

SEQ ID NO: 310831 - DNA, 16 bp, C. familiaris
catggaaacagtgatc

SEQ ID NO: 310832 - DNA, 16 bp, C. familiaris
catggaaaccaatgag

SEQ ID NO: 310833 - DNA, 16 bp, C. familiaris
catggaagaaaatgaa

SEQ ID NO: 310834 - DNA, 16 bp, C. familiaris
catggaattaaaaaaa

SEQ ID NO: 310835 - DNA, 16 bp, C. familiaris
catggactggaaaaat

SEQ ID NO: 310836 - DNA, 16 bp, C. familiaris
catggagattaaagaa

SEQ ID NO: 310837 - DNA, 16 bp, C. familiaris
catggagcccaaggtg

SEQ ID NO: 310838 - DNA, 16 bp, C. familiaris
catggagcccaatgag

SEQ ID NO: 310839 - DNA, 16 bp, C. familiaris
catggagcccattgtg

SEQ ID NO: 310840 - DNA, 16 bp, C. familiaris
catggagccccatgca

SEQ ID NO: 310841 - DNA, 16 bp, C. familiaris
catggagccccatgtg

SEQ ID NO: 310842 - DNA, 16 bp, C. familiaris
catggagcctgcgtct

SEQ ID NO: 310843 - DNA, 16 bp, C. familiaris
catggagctcaatgtg

SEQ ID NO: 310844 - DNA, 16 bp, C. familiaris
catggagggagcccca

SEQ ID NO: 310845 - DNA, 16 bp, C. familiaris
catggatggagctgga

SEQ ID NO: 310846 - DNA, 16 bp, C. familiaris
catggatggatttaga

SEQ ID NO: 310847 - DNA, 16 bp, C. familiaris
catggatgggaagaat

SEQ ID NO: 310848 - DNA, 16 bp, C. familiaris
catggcagagagagag

SEQ ID NO: 310849 - DNA, 16 bp, C. familiaris
catggcccctgccctc

SEQ ID NO: 310850 - DNA, 16 bp, C. familiaris
catggccttctccctg

SEQ ID NO: 310851 - DNA, 16 bp, C. familiaris
catggccttcttccct

SEQ ID NO: 310852 - DNA, 16 bp, C. familiaris
catgggagacccagag

SEQ ID NO: 310853 - DNA, 16 bp, C. familiaris
catggggaagacaaat

SEQ ID NO: 310854 - DNA, 16 bp, C. familiaris
catggggcagccccag

SEQ ID NO: 310855 - DNA, 16 bp, C. familiaris
catggggcagccctgg

SEQ ID NO: 310856 - DNA, 16 bp, C. familiaris
catggggcctgcttgt

SEQ ID NO: 310857 - DNA, 16 bp, C. familiaris
catggggctccttgct

SEQ ID NO: 310858 - DNA, 16 bp, C. familiaris
catggggctctaactc

SEQ ID NO: 310859 - DNA, 16 bp, C. familiaris
catgggttcaaatcct

SEQ ID NO: 310860 - DNA, 16 bp, C. familiaris
catggtctcggggtcc

SEQ ID NO: 310861 - DNA, 16 bp, C. familiaris
catgtacatatacaca

SEQ ID NO: 310862 - DNA, 16 bp, C. familiaris
catgtatgaatgaaat

SEQ ID NO: 310863 - DNA, 16 bp, C. familiaris
catgtatgtatgtaca

SEQ ID NO: 310864 - DNA, 16 bp, C. familiaris
catgtattttttcatt

SEQ ID NO: 310865 - DNA, 16 bp, C. familiaris
catgtcattgcaaagg

SEQ ID NO: 310866 - DNA, 16 bp, C. familiaris
catgtcattgcaagtg

SEQ ID NO: 310867 - DNA, 16 bp, C. familiaris
catgtcgggcttcctg

SEQ ID NO: 310868 - DNA, 16 bp, C. familiaris
catgtctggctccctg

SEQ ID NO: 310869 - DNA, 24 bp, C. familiaris
catgtcttctcacaagactttcag

SEQ ID NO: 310870 - DNA, 16 bp, C. familiaris
catgtctttccatggc

SEQ ID NO: 310871 - DNA, 16 bp, C. familiaris
catgtgaagatggaga

SEQ ID NO: 310872 - DNA, 16 bp, C. familiaris
catgtgacaaaattca

SEQ ID NO: 310873 - DNA, 16 bp, C. familiaris
catgtgatccaacaat

SEQ ID NO: 310874 - DNA, 16 bp, C. familiaris
catgtgatcctggagt

SEQ ID NO: 310875 - DNA, 16 bp, C. familiaris
catgtgcccctttgga

SEQ ID NO: 310876 - DNA, 16 bp, C. familiaris
catgtgcctgttggct

SEQ ID NO: 310877 - DNA, 16 bp, C. familiaris
catgtggctagtagct

SEQ ID NO: 310878 - DNA, 16 bp, C. familiaris
catgtggctccctgct

SEQ ID NO: 310879 - DNA, 16 bp, C. familiaris
catgtggggctccttg

SEQ ID NO: 310880 - DNA, 16 bp, C. familiaris
catgtgtatatgtata

SEQ ID NO: 310881 - DNA, 16 bp, C. familiaris
catgtgtgcacatgag

SEQ ID NO: 310882 - DNA, 16 bp, C. familiaris
catgtgtgcatgtgca

SEQ ID NO: 310883 - DNA, 16 bp, C. familiaris
catgtgtgcatgtgtg

SEQ ID NO: 310884 - DNA, 16 bp, C. familiaris
catgtgtgtgtgcgcg

SEQ ID NO: 310885 - DNA, 16 bp, C. familiaris
catgttaaaaaaaata

SEQ ID NO: 310886 - DNA, 16 bp, C. familiaris
catgttcagtgcagag

SEQ ID NO: 310887 - DNA, 16 bp, C. familiaris
catgttcatggcagca

SEQ ID NO: 310888 - DNA, 16 bp, C. familiaris
catgttgatgcaaatg

SEQ ID NO: 310889 - DNA, 16 bp, C. familiaris
catgttggcaaatcaa

SEQ ID NO: 310890 - DNA, 16 bp, C. familiaris
catgttgggctccctg

SEQ ID NO: 310891 - DNA, 16 bp, C. familiaris
catgtttaaaaagaaa

SEQ ID NO: 310892 - DNA, 16 bp, C. familiaris
catgttttattcatct

SEQ ID NO: 310893 - DNA, 16 bp, C. familiaris
catgttttcacaaatg

SEQ ID NO: 310894 - DNA, 16 bp, C. familiaris
cattaaaaagatcatt

SEQ ID NO: 310895 - DNA, 16 bp, C. familiaris
cattaaaaataatgat

SEQ ID NO: 310896 - DNA, 16 bp, C. familiaris
cattaaaatatttgtt

SEQ ID NO: 310897 - DNA, 16 bp, C. familiaris
cattaaaatgaaaatt

SEQ ID NO: 310898 - DNA, 16 bp, C. familiaris
cattaaatgtgcagat

SEQ ID NO: 310899 - DNA, 16 bp, C. familiaris
cattaaattttgagaa

SEQ ID NO: 310900 - DNA, 16 bp, C. familiaris
cattaagaaaatgaaa

SEQ ID NO: 310901 - DNA, 16 bp, C. familiaris
cattaagtataatgtt

SEQ ID NO: 310902 - DNA, 16 bp, C. familiaris
cattaatttctctttc

SEQ ID NO: 310903 - DNA, 16 bp, C. familiaris
cattaattttagaaaa

SEQ ID NO: 310904 - DNA, 16 bp, C. familiaris
cattaccaccatccat

SEQ ID NO: 310905 - DNA, 16 bp, C. familiaris
cattagaaacacagag

SEQ ID NO: 310906 - DNA, 17 bp, C. familiaris
cattagaaacgacagat

SEQ ID NO: 310907 - DNA, 16 bp, C. familiaris
cattagtttgttcttt

SEQ ID NO: 310908 - DNA, 16 bp, C. familiaris
cattatacagatgaga

SEQ ID NO: 310909 - DNA, 16 bp, C. familiaris
cattatagattttgga

SEQ ID NO: 310910 - DNA, 16 bp, C. familiaris
cattatcaacatcact

SEQ ID NO: 310911 - DNA, 16 bp, C. familiaris
cattatctcacttaat

SEQ ID NO: 310912 - DNA, 16 bp, C. familiaris
cattatctcatttgat

SEQ ID NO: 310913 - DNA, 16 bp, C. familiaris
cattatggaaaaaaaa

SEQ ID NO: 310914 - DNA, 16 bp, C. familiaris
cattattgacattttg

SEQ ID NO: 310915 - DNA, 16 bp, C. familiaris
cattatttcatcaaat

SEQ ID NO: 310916 - DNA, 16 bp, C. familiaris
cattatttccttaaat

SEQ ID NO: 310917 - DNA, 16 bp, C. familiaris
cattatttcttcatat

SEQ ID NO: 310918 - DNA, 16 bp, C. familiaris
cattattttaaatgaa

SEQ ID NO: 310919 - DNA, 16 bp, C. familiaris
cattattttacatgtg

SEQ ID NO: 310920 - DNA, 16 bp, C. familiaris
cattattttgtcttct

SEQ ID NO: 310921 - DNA, 16 bp, C. familiaris
cattatttttgtcatt

SEQ ID NO: 310922 - DNA, 16 bp, C. familiaris
cattcaaaatggatta

SEQ ID NO: 310923 - DNA, 16 bp, C. familiaris
cattcaaagccattgt

SEQ ID NO: 310924 - DNA, 16 bp, C. familiaris
cattcaaaggaaaaaa

SEQ ID NO: 310925 - DNA, 16 bp, C. familiaris
cattcaacaaatactt

SEQ ID NO: 310926 - DNA, 16 bp, C. familiaris
cattcaagtttgagaa

SEQ ID NO: 310927 - DNA, 16 bp, C. familiaris
cattcagaaaatgaaa

SEQ ID NO: 310928 - DNA, 16 bp, C. familiaris
cattcagatccagaaa

SEQ ID NO: 310929 - DNA, 16 bp, C. familiaris
cattcagatccaggaa

SEQ ID NO: 310930 - DNA, 16 bp, C. familiaris
cattcagtccatagca

SEQ ID NO: 310931 - DNA, 16 bp, C. familiaris
cattcatcttttggtg

SEQ ID NO: 310932 - DNA, 16 bp, C. familiaris
cattcatgtgttcact

SEQ ID NO: 310933 - DNA, 16 bp, C. familiaris
cattcattcactcaac

SEQ ID NO: 310934 - DNA, 16 bp, C. familiaris
cattcattcattcaac

SEQ ID NO: 310935 - DNA, 16 bp, C. familiaris
cattcattcattcttt

SEQ ID NO: 310936 - DNA, 16 bp, C. familiaris
cattcatttattccac

SEQ ID NO: 310937 - DNA, 16 bp, C. familiaris
cattcatttggggaaa

SEQ ID NO: 310938 - DNA, 16 bp, C. familiaris
cattcattttgatttt

SEQ ID NO: 310939 - DNA, 16 bp, C. familiaris
cattcattttttgatg

SEQ ID NO: 310940 - DNA, 16 bp, C. familiaris
cattccattgtatgaa

SEQ ID NO: 310941 - DNA, 16 bp, C. familiaris
cattcccaccaatgat

SEQ ID NO: 310942 - DNA, 16 bp, C. familiaris
cattcccaccagcagc

SEQ ID NO: 310943 - DNA, 16 bp, C. familiaris
cattcccaccaggagt

SEQ ID NO: 310944 - DNA, 16 bp, C. familiaris
cattcccatcagcaac

SEQ ID NO: 310945 - DNA, 16 bp, C. familiaris
cattccctttcactat

SEQ ID NO: 310946 - DNA, 16 bp, C. familiaris
cattctagcaaattat

SEQ ID NO: 310947 - DNA, 16 bp, C. familiaris
cattctcaccaacaat

SEQ ID NO: 310948 - DNA, 16 bp, C. familiaris
cattctctccaacatt

SEQ ID NO: 310949 - DNA, 16 bp, C. familiaris
cattctcttgcaccat

SEQ ID NO: 310950 - DNA, 16 bp, C. familiaris
cattctgatatcctat

SEQ ID NO: 310951 - DNA, 16 bp, C. familiaris
cattctgctctctgct

SEQ ID NO: 310952 - DNA, 16 bp, C. familiaris
cattctggaaaaagaa

SEQ ID NO: 310953 - DNA, 16 bp, C. familiaris
cattctggaaaacaat

SEQ ID NO: 310954 - DNA, 16 bp, C. familiaris
cattctttcattttca

SEQ ID NO: 310955 - DNA, 16 bp, C. familiaris
cattcttttgcatttg

SEQ ID NO: 310956 - DNA, 16 bp, C. familiaris
cattgaaattttaaaa

SEQ ID NO: 310957 - DNA, 16 bp, C. familiaris
cattgaaccatccttg

SEQ ID NO: 310958 - DNA, 16 bp, C. familiaris
cattgaacgtgtaaat

SEQ ID NO: 310959 - DNA, 16 bp, C. familiaris
cattgaaggacatttg

SEQ ID NO: 310960 - DNA, 16 bp, C. familiaris
cattgagaattatatt

SEQ ID NO: 310961 - DNA, 16 bp, C. familiaris
cattgagatcatgacc

SEQ ID NO: 310962 - DNA, 16 bp, C. familiaris
cattgatctctgtgtc

SEQ ID NO: 310963 - DNA, 16 bp, C. familiaris
cattgattgctttatg

SEQ ID NO: 310964 - DNA, 16 bp, C. familiaris
cattgatttatatatt

SEQ ID NO: 310965 - DNA, 16 bp, C. familiaris
cattgatttctgccct

SEQ ID NO: 310966 - DNA, 16 bp, C. familiaris
cattgcagaagaaaag

SEQ ID NO: 310967 - DNA, 16 bp, C. familiaris
cattgccattttcaca

SEQ ID NO: 310968 - DNA, 16 bp, C. familiaris
cattgcccatttttaa

SEQ ID NO: 310969 - DNA, 16 bp, C. familiaris
cattgcggtgcaggtg

SEQ ID NO: 310970 - DNA, 16 bp, C. familiaris
cattggactccctgtg

SEQ ID NO: 310971 - DNA, 16 bp, C. familiaris
cattggaggattttaa

SEQ ID NO: 310972 - DNA, 16 bp, C. familiaris
cattggcaaagaagaa

SEQ ID NO: 310973 - DNA, 16 bp, C. familiaris
cattgggggatccctg

SEQ ID NO: 310974 - DNA, 16 bp, C. familiaris
cattggtgggaatgca

SEQ ID NO: 310975 - DNA, 16 bp, C. familiaris
cattgtattcttcagc

SEQ ID NO: 310976 - DNA, 16 bp, C. familiaris
cattgtcaagttaaag

SEQ ID NO: 310977 - DNA, 16 bp, C. familiaris
cattgtcaccatcatc

SEQ ID NO: 310978 - DNA, 16 bp, C. familiaris
cattgtccatttgtat

SEQ ID NO: 310979 - DNA, 16 bp, C. familiaris
cattgtgtatgtatat

SEQ ID NO: 310980 - DNA, 16 bp, C. familiaris
cattgttgccatttta

SEQ ID NO: 310981 - DNA, 16 bp, C. familiaris
cattgttgtgcagcca

SEQ ID NO: 310982 - DNA, 16 bp, C. familiaris
catttaaaaatatctt

SEQ ID NO: 310983 - DNA, 16 bp, C. familiaris
catttaaaaattatgt

SEQ ID NO: 310984 - DNA, 16 bp, C. familiaris
catttaaaagaaacaa

SEQ ID NO: 310985 - DNA, 16 bp, C. familiaris
catttaaagctctttt

SEQ ID NO: 310986 - DNA, 16 bp, C. familiaris
catttaaatcagcaga

SEQ ID NO: 310987 - DNA, 16 bp, C. familiaris
catttaacaaatgttt

SEQ ID NO: 310988 - DNA, 16 bp, C. familiaris
catttaacatcctaaa

SEQ ID NO: 310989 - DNA, 16 bp, C. familiaris
catttaagaaaattct

SEQ ID NO: 310990 - DNA, 16 bp, C. familiaris
catttaaggtaattat

SEQ ID NO: 310991 - DNA, 16 bp, C. familiaris
catttaagtctttatt

SEQ ID NO: 310992 - DNA, 16 bp, C. familiaris
catttaagtgaaatca

SEQ ID NO: 310993 - DNA, 16 bp, C. familiaris
catttaagtttttatt

SEQ ID NO: 310994 - DNA, 16 bp, C. familiaris
catttaataaaacatt

SEQ ID NO: 310995 - DNA, 16 bp, C. familiaris
catttaatactgaaac

SEQ ID NO: 310996 - DNA, 16 bp, C. familiaris
catttaattatcacaa

SEQ ID NO: 310997 - DNA, 16 bp, C. familiaris
catttacagaacattc

SEQ ID NO: 310998 - DNA, 16 bp, C. familiaris
catttacagatgaaaa

SEQ ID NO: 310999 - DNA, 16 bp, C. familiaris
catttagaagattatt

SEQ ID NO: 311000 - DNA, 16 bp, C. familiaris
catttatagcagcatt

SEQ ID NO: 311001 - DNA, 16 bp, C. familiaris
catttatcagttctaa

SEQ ID NO: 311002 - DNA, 16 bp, C. familiaris
catttatcagttttag

SEQ ID NO: 311003 - DNA, 16 bp, C. familiaris
catttatcatcatcat

SEQ ID NO: 311004 - DNA, 16 bp, C. familiaris
catttatcctagagaa

SEQ ID NO: 311005 - DNA, 16 bp, C. familiaris
catttatctgtcagtg

SEQ ID NO: 311006 - DNA, 16 bp, C. familiaris
catttatgggttctct

SEQ ID NO: 311007 - DNA, 16 bp, C. familiaris
catttattcagcatca

SEQ ID NO: 311008 - DNA, 16 bp, C. familiaris
catttattcattcata

SEQ ID NO: 311009 - DNA, 16 bp, C. familiaris
catttatttactcatt

SEQ ID NO: 311010 - DNA, 16 bp, C. familiaris
catttatttattcatg

SEQ ID NO: 311011 - DNA, 16 bp, C. familiaris
catttcaaaataaatt

SEQ ID NO: 311012 - DNA, 16 bp, C. familiaris
catttcatggatgaag

SEQ ID NO: 311013 - DNA, 16 bp, C. familiaris
catttccaaataaggt

SEQ ID NO: 311014 - DNA, 16 bp, C. familiaris
catttccaaatatctt

SEQ ID NO: 311015 - DNA, 16 bp, C. familiaris
catttccagagttagg

SEQ ID NO: 311016 - DNA, 16 bp, C. familiaris
catttccatgatgatg

SEQ ID NO: 311017 - DNA, 16 bp, C. familiaris
catttccattttctcc

SEQ ID NO: 311018 - DNA, 16 bp, C. familiaris
catttcccccaaagaa

SEQ ID NO: 311019 - DNA, 16 bp, C. familiaris
catttcctagaatttt

SEQ ID NO: 311020 - DNA, 24 bp, C. familiaris
catttcctggtatgacaatgaatt

SEQ ID NO: 311021 - DNA, 16 bp, C. familiaris
catttccttatctgta

SEQ ID NO: 311022 - DNA, 16 bp, C. familiaris
catttctaattctagt

SEQ ID NO: 311023 - DNA, 16 bp, C. familiaris
catttctcacagaaat

SEQ ID NO: 311024 - DNA, 16 bp, C. familiaris
catttctcattttggt

SEQ ID NO: 311025 - DNA, 16 bp, C. familiaris
catttctccaaagaga

SEQ ID NO: 311026 - DNA, 16 bp, C. familiaris
catttctccaaggaag

SEQ ID NO: 311027 - DNA, 16 bp, C. familiaris
catttctccagagaag

SEQ ID NO: 311028 - DNA, 16 bp, C. familiaris
catttctggatattta

SEQ ID NO: 311029 - DNA, 16 bp, C. familiaris
catttctgtttccttt

SEQ ID NO: 311030 - DNA, 16 bp, C. familiaris
catttctgttttctct

SEQ ID NO: 311031 - DNA, 16 bp, C. familiaris
catttcttcaaggagc

SEQ ID NO: 311032 - DNA, 16 bp, C. familiaris
catttctttaacaaat

SEQ ID NO: 311033 - DNA, 16 bp, C. familiaris
catttgaaaaaaataa

SEQ ID NO: 311034 - DNA, 16 bp, C. familiaris
catttgaaaaattaaa

SEQ ID NO: 311035 - DNA, 16 bp, C. familiaris
catttgaagaaaaaaa

SEQ ID NO: 311036 - DNA, 16 bp, C. familiaris
catttgaatgataaat

SEQ ID NO: 311037 - DNA, 16 bp, C. familiaris
catttgattttcattt

SEQ ID NO: 311038 - DNA, 16 bp, C. familiaris
catttgcaaaaatctt

SEQ ID NO: 311039 - DNA, 16 bp, C. familiaris
catttgcaaaatatct

SEQ ID NO: 311040 - DNA, 16 bp, C. familiaris
catttgcaaaatggag

SEQ ID NO: 311041 - DNA, 16 bp, C. familiaris
catttgcaaaatggga

SEQ ID NO: 311042 - DNA, 16 bp, C. familiaris
catttgcaacaatatg

SEQ ID NO: 311043 - DNA, 16 bp, C. familiaris
catttgcatttttata

SEQ ID NO: 311044 - DNA, 16 bp, C. familiaris
catttgcctcaacgtg

SEQ ID NO: 311045 - DNA, 16 bp, C. familiaris
catttgctgaaaaaaa

SEQ ID NO: 311046 - DNA, 16 bp, C. familiaris
catttgcttattttta

SEQ ID NO: 311047 - DNA, 16 bp, C. familiaris
catttggaaaatactg

SEQ ID NO: 311048 - DNA, 16 bp, C. familiaris
catttggaattttatt

SEQ ID NO: 311049 - DNA, 16 bp, C. familiaris
catttggtaaatattt

SEQ ID NO: 311050 - DNA, 16 bp, C. familiaris
catttgtaagtcttct

SEQ ID NO: 311051 - DNA, 16 bp, C. familiaris
catttgtatatcttat

SEQ ID NO: 311052 - DNA, 16 bp, C. familiaris
catttgtatcctttat

SEQ ID NO: 311053 - DNA, 16 bp, C. familiaris
catttgtatttattta

SEQ ID NO: 311054 - DNA, 16 bp, C. familiaris
catttgtcaaaactaa

SEQ ID NO: 311055 - DNA, 16 bp, C. familiaris
catttgtgaaaggaag

SEQ ID NO: 311056 - DNA, 16 bp, C. familiaris
catttgtgaaatggag

SEQ ID NO: 311057 - DNA, 16 bp, C. familiaris
catttgtgaatttatt

SEQ ID NO: 311058 - DNA, 16 bp, C. familiaris
catttgtgattttatc

SEQ ID NO: 311059 - DNA, 16 bp, C. familiaris
catttgttcatttaat

SEQ ID NO: 311060 - DNA, 16 bp, C. familiaris
catttgtttatgtcat

SEQ ID NO: 311061 - DNA, 16 bp, C. familiaris
catttgtttccatttt

SEQ ID NO: 311062 - DNA, 16 bp, C. familiaris
catttgtttttcagat

SEQ ID NO: 311063 - DNA, 16 bp, C. familiaris
cattttaaaactttaa

SEQ ID NO: 311064 - DNA, 16 bp, C. familiaris
cattttaaaggaaaaa

SEQ ID NO: 311065 - DNA, 16 bp, C. familiaris
cattttaaagtgtttt

SEQ ID NO: 311066 - DNA, 16 bp, C. familiaris
cattttaagaataaat

SEQ ID NO: 311067 - DNA, 16 bp, C. familiaris
cattttaagatttaaa

SEQ ID NO: 311068 - DNA, 16 bp, C. familiaris
cattttacaagtgaag

SEQ ID NO: 311069 - DNA, 16 bp, C. familiaris
cattttaccagtttga

SEQ ID NO: 311070 - DNA, 16 bp, C. familiaris
cattttagaaatattt

SEQ ID NO: 311071 - DNA, 16 bp, C. familiaris
cattttagagatggag

SEQ ID NO: 311072 - DNA, 17 bp, C. familiaris
cattttatacatagacc

SEQ ID NO: 311073 - DNA, 16 bp, C. familiaris
cattttatatgcagta

SEQ ID NO: 311074 - DNA, 16 bp, C. familiaris
cattttatgttatgtg

SEQ ID NO: 311075 - DNA, 16 bp, C. familiaris
cattttattatgaaaa

SEQ ID NO: 311076 - DNA, 16 bp, C. familiaris
cattttattgtacttt

SEQ ID NO: 311077 - DNA, 16 bp, C. familiaris
cattttcaaattttaa

SEQ ID NO: 311078 - DNA, 16 bp, C. familiaris
cattttcaagaatttt

SEQ ID NO: 311079 - DNA, 16 bp, C. familiaris
cattttcagaaatatt

SEQ ID NO: 311080 - DNA, 16 bp, C. familiaris
cattttcagaactttt

SEQ ID NO: 311081 - DNA, 16 bp, C. familiaris
cattttcagatgagga

SEQ ID NO: 311082 - DNA, 16 bp, C. familiaris
cattttcataaatatt

SEQ ID NO: 311083 - DNA, 16 bp, C. familiaris
cattttcatcacctca

SEQ ID NO: 311084 - DNA, 16 bp, C. familiaris
cattttcatcatcccc

SEQ ID NO: 311085 - DNA, 16 bp, C. familiaris
cattttcattttcact

SEQ ID NO: 311086 - DNA, 16 bp, C. familiaris
cattttcattttcttg

SEQ ID NO: 311087 - DNA, 16 bp, C. familiaris
cattttccagatgaag

SEQ ID NO: 311088 - DNA, 16 bp, C. familiaris
cattttcctaatgatt

SEQ ID NO: 311089 - DNA, 16 bp, C. familiaris
cattttcctgattttt

SEQ ID NO: 311090 - DNA, 16 bp, C. familiaris
cattttctaagaaaga

SEQ ID NO: 311091 - DNA, 16 bp, C. familiaris
cattttctcagagaaa

SEQ ID NO: 311092 - DNA, 16 bp, C. familiaris
cattttcttctgcttt

SEQ ID NO: 311093 - DNA, 16 bp, C. familiaris
cattttctttcagttt

SEQ ID NO: 311094 - DNA, 16 bp, C. familiaris
cattttgaaaaacagt

SEQ ID NO: 311095 - DNA, 16 bp, C. familiaris
cattttgaaaaatttt

SEQ ID NO: 311096 - DNA, 16 bp, C. familiaris
cattttgagaaacatt

SEQ ID NO: 311097 - DNA, 16 bp, C. familiaris
cattttgagaatcact

SEQ ID NO: 311098 - DNA, 16 bp, C. familiaris
cattttgatttttaaa

SEQ ID NO: 311099 - DNA, 16 bp, C. familiaris
cattttgcccatcccc

SEQ ID NO: 311100 - DNA, 16 bp, C. familiaris
cattttgtttcattta

SEQ ID NO: 311101 - DNA, 16 bp, C. familiaris
catttttaaagaaaaa

SEQ ID NO: 311102 - DNA, 16 bp, C. familiaris
catttttaaatgtaaa

SEQ ID NO: 311103 - DNA, 16 bp, C. familiaris
catttttaattggatt

SEQ ID NO: 311104 - DNA, 16 bp, C. familiaris
catttttataaaacaa

SEQ ID NO: 311105 - DNA, 16 bp, C. familiaris
catttttatcagtttt

SEQ ID NO: 311106 - DNA, 16 bp, C. familiaris
catttttatgaaaaca

SEQ ID NO: 311107 - DNA, 16 bp, C. familiaris
catttttatgactgaa

SEQ ID NO: 311108 - DNA, 16 bp, C. familiaris
catttttatggaaaaa

SEQ ID NO: 311109 - DNA, 16 bp, C. familiaris
catttttattcaaaat

SEQ ID NO: 311110 - DNA, 16 bp, C. familiaris
catttttcaaatgttt

SEQ ID NO: 311111 - DNA, 16 bp, C. familiaris
catttttcacaaaatt

SEQ ID NO: 311112 - DNA, 16 bp, C. familiaris
catttttccaaagaaa

SEQ ID NO: 311113 - DNA, 16 bp, C. familiaris
catttttctttcaaat

SEQ ID NO: 311114 - DNA, 16 bp, C. familiaris
catttttctttgtcct

SEQ ID NO: 311115 - DNA, 16 bp, C. familiaris
catttttgaaaaagaa

SEQ ID NO: 311116 - DNA, 16 bp, C. familiaris
catttttgctattgtt

SEQ ID NO: 311117 - DNA, 16 bp, C. familiaris
cattttttaaaagaaa

SEQ ID NO: 311118 - DNA, 16 bp, C. familiaris
cattttttaaagatgt

SEQ ID NO: 311119 - DNA, 16 bp, C. familiaris
cattttttccccctca

SEQ ID NO: 311120 - DNA, 16 bp, C. familiaris
catttttttcaagtgt

SEQ ID NO: 311121 - DNA, 16 bp, C. familiaris
catttttttgaagatt

SEQ ID NO: 311122 - DNA, 16 bp, C. familiaris
ccaaaaaaggagaatt

SEQ ID NO: 311123 - DNA, 16 bp, C. familiaris
ccaaaaaatcattgcc

SEQ ID NO: 311124 - DNA, 16 bp, C. familiaris
ccaaaaaatggaaaca

SEQ ID NO: 311125 - DNA, 16 bp, C. familiaris
ccaaaaaatggaagag

SEQ ID NO: 311126 - DNA, 16 bp, C. familiaris
ccaaaaagaaatgagc

SEQ ID NO: 311127 - DNA, 16 bp, C. familiaris
ccaaaaaggagaatta

SEQ ID NO: 311128 - DNA, 16 bp, C. familiaris
ccaaaaccaaagatcc

SEQ ID NO: 311129 - DNA, 16 bp, C. familiaris
ccaaaaccaagagtcc

SEQ ID NO: 311130 - DNA, 16 bp, C. familiaris
ccaaaaccaagagttc

SEQ ID NO: 311131 - DNA, 16 bp, C. familiaris
ccaaaaccaaggaaat

SEQ ID NO: 311132 - DNA, 16 bp, C. familiaris
ccaaaacccagagtca

SEQ ID NO: 311133 - DNA, 16 bp, C. familiaris
ccaaaacctttgagat

SEQ ID NO: 311134 - DNA, 16 bp, C. familiaris
ccaaaacttttttttt

SEQ ID NO: 311135 - DNA, 16 bp, C. familiaris
ccaaaagcagagcctg

SEQ ID NO: 311136 - DNA, 16 bp, C. familiaris
ccaaaagcagagctca

SEQ ID NO: 311137 - DNA, 16 bp, C. familiaris
ccaaaagggacagagg

SEQ ID NO: 311138 - DNA, 16 bp, C. familiaris
ccaaaatcaaaagtct

SEQ ID NO: 311139 - DNA, 16 bp, C. familiaris
ccaaaatcaaagtgtt

SEQ ID NO: 311140 - DNA, 16 bp, C. familiaris
ccaaaatcaacaaaag

SEQ ID NO: 311141 - DNA, 16 bp, C. familiaris
ccaaaatcaagagctg

SEQ ID NO: 311142 - DNA, 16 bp, C. familiaris
ccaaaatcaagagtaa

SEQ ID NO: 311143 - DNA, 16 bp, C. familiaris
ccaaaatcctcaacaa

SEQ ID NO: 311144 - DNA, 16 bp, C. familiaris
ccaaaatctataaaga

SEQ ID NO: 311145 - DNA, 16 bp, C. familiaris
ccaaaatgctttgaaa

SEQ ID NO: 311146 - DNA, 16 bp, C. familiaris
ccaaaattcatatttt

SEQ ID NO: 311147 - DNA, 16 bp, C. familiaris
ccaaaattctaatttt

SEQ ID NO: 311148 - DNA, 16 bp, C. familiaris
ccaaacaagctctgca

SEQ ID NO: 311149 - DNA, 16 bp, C. familiaris
ccaaacactgcccact

SEQ ID NO: 311150 - DNA, 16 bp, C. familiaris
ccaaacattcaaagaa

SEQ ID NO: 311151 - DNA, 16 bp, C. familiaris
ccaaacatttgctctt

SEQ ID NO: 311152 - DNA, 16 bp, C. familiaris
ccaaaccaattaaatc

SEQ ID NO: 311153 - DNA, 16 bp, C. familiaris
ccaaaccagatctgca

SEQ ID NO: 311154 - DNA, 16 bp, C. familiaris
ccaaaccagctctgca

SEQ ID NO: 311155 - DNA, 16 bp, C. familiaris
ccaaaccagctctgta

SEQ ID NO: 311156 - DNA, 16 bp, C. familiaris
ccaaacccaaggtcat

SEQ ID NO: 311157 - DNA, 16 bp, C. familiaris
ccaaacccctgcacca

SEQ ID NO: 311158 - DNA, 16 bp, C. familiaris
ccaaacctctgcacca

SEQ ID NO: 311159 - DNA, 16 bp, C. familiaris
ccaaacctggaaacaa

SEQ ID NO: 311160 - DNA, 16 bp, C. familiaris
ccaaacggctgagcca

SEQ ID NO: 311161 - DNA, 16 bp, C. familiaris
ccaaactgaaggcaga

SEQ ID NO: 311162 - DNA, 16 bp, C. familiaris
ccaaactgcagagcca

SEQ ID NO: 311163 - DNA, 16 bp, C. familiaris
ccaaactggaaagaac

SEQ ID NO: 311164 - DNA, 16 bp, C. familiaris
ccaaactgtatccagc

SEQ ID NO: 311165 - DNA, 16 bp, C. familiaris
ccaaagaaaacataca

SEQ ID NO: 311166 - DNA, 16 bp, C. familiaris
ccaaagaaaatgaaat

SEQ ID NO: 311167 - DNA, 16 bp, C. familiaris
ccaaagaaaatggaaa

SEQ ID NO: 311168 - DNA, 16 bp, C. familiaris
ccaaagaaacaatctg

SEQ ID NO: 311169 - DNA, 16 bp, C. familiaris
ccaaagaaactgaaaa

SEQ ID NO: 311170 - DNA, 16 bp, C. familiaris
ccaaagaaatgttgaa

SEQ ID NO: 311171 - DNA, 16 bp, C. familiaris
ccaaagaacacataca

SEQ ID NO: 311172 - DNA, 16 bp, C. familiaris
ccaaagaagatataga

SEQ ID NO: 311173 - DNA, 16 bp, C. familiaris
ccaaagaagttgaaaa

SEQ ID NO: 311174 - DNA, 16 bp, C. familiaris
ccaaagacaaatgctc

SEQ ID NO: 311175 - DNA, 16 bp, C. familiaris
ccaaagacagacactt

SEQ ID NO: 311176 - DNA, 16 bp, C. familiaris
ccaaagaccccatctc

SEQ ID NO: 311177 - DNA, 16 bp, C. familiaris
ccaaagactggaagaa

SEQ ID NO: 311178 - DNA, 16 bp, C. familiaris
ccaaagagctaaagga

SEQ ID NO: 311179 - DNA, 16 bp, C. familiaris
ccaaagaggcaaaaga

SEQ ID NO: 311180 - DNA, 16 bp, C. familiaris
ccaaagaggtcaagga

SEQ ID NO: 311181 - DNA, 16 bp, C. familiaris
ccaaagaggtgaaaga

SEQ ID NO: 311182 - DNA, 16 bp, C. familiaris
ccaaagataaagagag

SEQ ID NO: 311183 - DNA, 16 bp, C. familiaris
ccaaagatcatgacct

SEQ ID NO: 311184 - DNA, 16 bp, C. familiaris
ccaaagcaaactacag

SEQ ID NO: 311185 - DNA, 16 bp, C. familiaris
ccaaagccaagagttg

SEQ ID NO: 311186 - DNA, 16 bp, C. familiaris
ccaaaggaagcctgct

SEQ ID NO: 311187 - DNA, 16 bp, C. familiaris
ccaaaggaagtgaaaa

SEQ ID NO: 311188 - DNA, 16 bp, C. familiaris
ccaaaggaccaggaaa

SEQ ID NO: 311189 - DNA, 16 bp, C. familiaris
ccaaaggcaaacactc

SEQ ID NO: 311190 - DNA, 16 bp, C. familiaris
ccaaaggcagaccccc

SEQ ID NO: 311191 - DNA, 16 bp, C. familiaris
ccaaaggcagattctc

SEQ ID NO: 311192 - DNA, 16 bp, C. familiaris
ccaaagtcacaaagat

SEQ ID NO: 311193 - DNA, 16 bp, C. familiaris
ccaaagtcatgaagat

SEQ ID NO: 311194 - DNA, 16 bp, C. familiaris
ccaaagtggctgcact

SEQ ID NO: 311195 - DNA, 16 bp, C. familiaris
ccaaataccatcacat

SEQ ID NO: 311196 - DNA, 16 bp, C. familiaris
ccaaatagccaaagaa

SEQ ID NO: 311197 - DNA, 16 bp, C. familiaris
ccaaatatataaagaa

SEQ ID NO: 311198 - DNA, 16 bp, C. familiaris
ccaaatatatatatat

SEQ ID NO: 311199 - DNA, 16 bp, C. familiaris
ccaaatcactgagcca

SEQ ID NO: 311200 - DNA, 16 bp, C. familiaris
ccaaatcccagctctg

SEQ ID NO: 311201 - DNA, 16 bp, C. familiaris
ccaaatctcagtgact

SEQ ID NO: 311202 - DNA, 16 bp, C. familiaris
ccaaatggatttcaca

SEQ ID NO: 311203 - DNA, 16 bp, C. familiaris
ccaaatgttcatcagc

SEQ ID NO: 311204 - DNA, 16 bp, C. familiaris
ccaaattaaatatttt

SEQ ID NO: 311205 - DNA, 16 bp, C. familiaris
ccaaattattattatt

SEQ ID NO: 311206 - DNA, 16 bp, C. familiaris
ccaaattctgcagtca

SEQ ID NO: 311207 - DNA, 16 bp, C. familiaris
ccaacaaattggaaaa

SEQ ID NO: 311208 - DNA, 16 bp, C. familiaris
ccaacaacatggatgg

SEQ ID NO: 311209 - DNA, 16 bp, C. familiaris
ccaacaagaagactta

SEQ ID NO: 311210 - DNA, 16 bp, C. familiaris
ccaacaccagacactt

SEQ ID NO: 311211 - DNA, 16 bp, C. familiaris
ccaacacggggctgga

SEQ ID NO: 311212 - DNA, 16 bp, C. familiaris
ccaacactgtttattg

SEQ ID NO: 311213 - DNA, 16 bp, C. familiaris
ccaacagcgcaggcct

SEQ ID NO: 311214 - DNA, 16 bp, C. familiaris
ccaacagtatttttca

SEQ ID NO: 311215 - DNA, 16 bp, C. familiaris
ccaacatagagcataa

SEQ ID NO: 311216 - DNA, 16 bp, C. familiaris
ccaacatggagctgga

SEQ ID NO: 311217 - DNA, 16 bp, C. familiaris
ccaacatggagtttga

SEQ ID NO: 311218 - DNA, 16 bp, C. familiaris
ccaacatggggctgga

SEQ ID NO: 311219 - DNA, 16 bp, C. familiaris
ccaacatgtgttattt

SEQ ID NO: 311220 - DNA, 16 bp, C. familiaris
ccaaccaggcacccct

SEQ ID NO: 311221 - DNA, 16 bp, C. familiaris
ccaaccaggcgcccct

SEQ ID NO: 311222 - DNA, 16 bp, C. familiaris
ccaacccagaagctct

SEQ ID NO: 311223 - DNA, 16 bp, C. familiaris
ccaacccccaggagcc

SEQ ID NO: 311224 - DNA, 16 bp, C. familiaris
ccaactcaggactcaa

SEQ ID NO: 311225 - DNA, 16 bp, C. familiaris
ccaactcatgctcact

SEQ ID NO: 311226 - DNA, 16 bp, C. familiaris
ccaactgagtcatcca

SEQ ID NO: 311227 - DNA, 16 bp, C. familiaris
ccaactgtgccaccca

SEQ ID NO: 311228 - DNA, 16 bp, C. familiaris
ccaacttgggagcagc

SEQ ID NO: 311229 - DNA, 16 bp, C. familiaris
ccaacttgtcttctat

SEQ ID NO: 311230 - DNA, 16 bp, C. familiaris
ccaactttctgaagaa

SEQ ID NO: 311231 - DNA, 16 bp, C. familiaris
ccaacttttggtttca

SEQ ID NO: 311232 - DNA, 16 bp, C. familiaris
ccaagaaaatgaaaga

SEQ ID NO: 311233 - DNA, 16 bp, C. familiaris
ccaagaaacaaaagtc

SEQ ID NO: 311234 - DNA, 16 bp, C. familiaris
ccaagaaacaagagtc

SEQ ID NO: 311235 - DNA, 16 bp, C. familiaris
ccaagaaagacaaata

SEQ ID NO: 311236 - DNA, 16 bp, C. familiaris
ccaagaaagtgaaaag

SEQ ID NO: 311237 - DNA, 16 bp, C. familiaris
ccaagaaagtgaaaga

SEQ ID NO: 311238 - DNA, 16 bp, C. familiaris
ccaagaagatgaaaga

SEQ ID NO: 311239 - DNA, 16 bp, C. familiaris
ccaagaatctgcattt

SEQ ID NO: 311240 - DNA, 16 bp, C. familiaris
ccaagacacctgcacc

SEQ ID NO: 311241 - DNA, 16 bp, C. familiaris
ccaagacaggcagcaa

SEQ ID NO: 311242 - DNA, 16 bp, C. familiaris
ccaagaccaagagtca

SEQ ID NO: 311243 - DNA, 16 bp, C. familiaris
ccaagaccaatgtcaa

SEQ ID NO: 311244 - DNA, 16 bp, C. familiaris
ccaagagagagaatct

SEQ ID NO: 311245 - DNA, 16 bp, C. familiaris
ccaagagtcagaggtt

SEQ ID NO: 311246 - DNA, 16 bp, C. familiaris
ccaagatacagatgca

SEQ ID NO: 311247 - DNA, 16 bp, C. familiaris
ccaagatagaccacat

SEQ ID NO: 311248 - DNA, 16 bp, C. familiaris
ccaagatcaaggtgct

SEQ ID NO: 311249 - DNA, 16 bp, C. familiaris
ccaagcaaactccctg

SEQ ID NO: 311250 - DNA, 16 bp, C. familiaris
ccaagcacagagcctg

SEQ ID NO: 311251 - DNA, 16 bp, C. familiaris
ccaagcaccaggagcc

SEQ ID NO: 311252 - DNA, 16 bp, C. familiaris
ccaagcactgggagcc

SEQ ID NO: 311253 - DNA, 16 bp, C. familiaris
ccaagcaggaagccca

SEQ ID NO: 311254 - DNA, 16 bp, C. familiaris
ccaagcagggagcctg

SEQ ID NO: 311255 - DNA, 16 bp, C. familiaris
ccaagccagaggcaga

SEQ ID NO: 311256 - DNA, 16 bp, C. familiaris
ccaagctgaaagcaga

SEQ ID NO: 311257 - DNA, 16 bp, C. familiaris
ccaagctgagcacaga

SEQ ID NO: 311258 - DNA, 16 bp, C. familiaris
ccaaggaaatgaaaga

SEQ ID NO: 311259 - DNA, 16 bp, C. familiaris
ccaaggacagaggcct

SEQ ID NO: 311260 - DNA, 16 bp, C. familiaris
ccaaggagccacccag

SEQ ID NO: 311261 - DNA, 16 bp, C. familiaris
ccaaggaggagcacaa

SEQ ID NO: 311262 - DNA, 16 bp, C. familiaris
ccaaggaggaggaaga

SEQ ID NO: 311263 - DNA, 16 bp, C. familiaris
ccaaggaggtgaaagg

SEQ ID NO: 311264 - DNA, 16 bp, C. familiaris
ccaaggatcccaggat

SEQ ID NO: 311265 - DNA, 16 bp, C. familiaris
ccaaggcagacaccca

SEQ ID NO: 311266 - DNA, 16 bp, C. familiaris
ccaaggccacacagct

SEQ ID NO: 311267 - DNA, 16 bp, C. familiaris
ccaaggccacagagct

SEQ ID NO: 311268 - DNA, 16 bp, C. familiaris
ccaaggcccagagagg

SEQ ID NO: 311269 - DNA, 16 bp, C. familiaris
ccaaggctgatgctca

SEQ ID NO: 311270 - DNA, 16 bp, C. familiaris
ccaagggcagccccag

SEQ ID NO: 311271 - DNA, 16 bp, C. familiaris
ccaagggcagcctggg

SEQ ID NO: 311272 - DNA, 16 bp, C. familiaris
ccaaggggaggggccc

SEQ ID NO: 311273 - DNA, 16 bp, C. familiaris
ccaagggtcctggaat

SEQ ID NO: 311274 - DNA, 16 bp, C. familiaris
ccaagggtcctgtccc

SEQ ID NO: 311275 - DNA, 16 bp, C. familiaris
ccaaggtcaaagaggt

SEQ ID NO: 311276 - DNA, 16 bp, C. familiaris
ccaaggtcaaggtgct

SEQ ID NO: 311277 - DNA, 16 bp, C. familiaris
ccaaggtcatccagct

SEQ ID NO: 311278 - DNA, 16 bp, C. familiaris
ccaagtcacacagctg

SEQ ID NO: 311279 - DNA, 16 bp, C. familiaris
ccaagtcccacatcag

SEQ ID NO: 311280 - DNA, 16 bp, C. familiaris
ccaagtctctgcctct

SEQ ID NO: 311281 - DNA, 16 bp, C. familiaris
ccaagtgagccagcca

SEQ ID NO: 311282 - DNA, 16 bp, C. familiaris
ccaagtgccccaagaa

SEQ ID NO: 311283 - DNA, 16 bp, C. familiaris
ccaagtgtccatagat

SEQ ID NO: 311284 - DNA, 16 bp, C. familiaris
ccaagtgtggagccca

SEQ ID NO: 311285 - DNA, 16 bp, C. familiaris
ccaagttcaaagaggg

SEQ ID NO: 311286 - DNA, 31 bp, C. familiaris
ccaataaattaggcaatctagaagaaatgga

SEQ ID NO: 311287 - DNA, 16 bp, C. familiaris
ccaataaatttgaaaa

SEQ ID NO: 311288 - DNA, 16 bp, C. familiaris
ccaataatactttatc

SEQ ID NO: 311289 - DNA, 16 bp, C. familiaris
ccaataccaaggaaat

SEQ ID NO: 311290 - DNA, 16 bp, C. familiaris
ccaatagcagcagaat

SEQ ID NO: 311291 - DNA, 16 bp, C. familiaris
ccaatagtatttttca

SEQ ID NO: 311292 - DNA, 16 bp, C. familiaris
ccaatatggtagccat

SEQ ID NO: 311293 - DNA, 16 bp, C. familiaris
ccaatctccctgatga

SEQ ID NO: 311294 - DNA, 16 bp, C. familiaris
ccaatgagggacttga

SEQ ID NO: 311295 - DNA, 16 bp, C. familiaris
ccaatgcggggctgga

SEQ ID NO: 311296 - DNA, 16 bp, C. familiaris
ccaatgtcaatttcct

SEQ ID NO: 311297 - DNA, 16 bp, C. familiaris
ccaattgagaatgata

SEQ ID NO: 311298 - DNA, 16 bp, C. familiaris
ccaatttttcccagca

SEQ ID NO: 311299 - DNA, 16 bp, C. familiaris
ccacaaaaggcagaaa

SEQ ID NO: 311300 - DNA, 16 bp, C. familiaris
ccacaaagctgtggtc

SEQ ID NO: 311301 - DNA, 16 bp, C. familiaris
ccacaaatacagagaa

SEQ ID NO: 311302 - DNA, 16 bp, C. familiaris
ccacaacagccaaaat

SEQ ID NO: 311303 - DNA, 16 bp, C. familiaris
ccacaactgtgagatc

SEQ ID NO: 311304 - DNA, 16 bp, C. familiaris
ccacaagagccaaact

SEQ ID NO: 311305 - DNA, 16 bp, C. familiaris
ccacaagatggaagga

SEQ ID NO: 311306 - DNA, 16 bp, C. familiaris
ccacaagccaaggaag

SEQ ID NO: 311307 - DNA, 16 bp, C. familiaris
ccacaaggagtctgct

SEQ ID NO: 311308 - DNA, 16 bp, C. familiaris
ccacacagccagtaag

SEQ ID NO: 311309 - DNA, 16 bp, C. familiaris
ccacacaggagtgaaa

SEQ ID NO: 311310 - DNA, 16 bp, C. familiaris
ccacacagtttccaga

SEQ ID NO: 311311 - DNA, 16 bp, C. familiaris
ccacacccagagtgga

SEQ ID NO: 311312 - DNA, 16 bp, C. familiaris
ccacacccagcatgga

SEQ ID NO: 311313 - DNA, 16 bp, C. familiaris
ccacacccagcatggg

SEQ ID NO: 311314 - DNA, 16 bp, C. familiaris
ccacacccagtgagga

SEQ ID NO: 311315 - DNA, 16 bp, C. familiaris
ccacaccccaggctga

SEQ ID NO: 311316 - DNA, 16 bp, C. familiaris
ccacaccccgggctga

SEQ ID NO: 311317 - DNA, 16 bp, C. familiaris
ccacactattttccat

SEQ ID NO: 311318 - DNA, 16 bp, C. familiaris
ccacactggactccct

SEQ ID NO: 311319 - DNA, 16 bp, C. familiaris
ccacagactgagagaa

SEQ ID NO: 311320 - DNA, 16 bp, C. familiaris
ccacagactgggaaaa

SEQ ID NO: 311321 - DNA, 16 bp, C. familiaris
ccacagagacagaaag

SEQ ID NO: 311322 - DNA, 16 bp, C. familiaris
ccacagagccagccag

SEQ ID NO: 311323 - DNA, 16 bp, C. familiaris
ccacagcaaatatcct

SEQ ID NO: 311324 - DNA, 16 bp, C. familiaris
ccacagcagcagcagc

SEQ ID NO: 311325 - DNA, 16 bp, C. familiaris
ccacagcctcaccagc

SEQ ID NO: 311326 - DNA, 16 bp, C. familiaris
ccacagcctgggagaa

SEQ ID NO: 311327 - DNA, 16 bp, C. familiaris
ccacagctccagccag

SEQ ID NO: 311328 - DNA, 16 bp, C. familiaris
ccacagcttctttatt

SEQ ID NO: 311329 - DNA, 16 bp, C. familiaris
ccacagggaacctgtt

SEQ ID NO: 311330 - DNA, 16 bp, C. familiaris
ccacagggaccctgct

SEQ ID NO: 311331 - DNA, 16 bp, C. familiaris
ccacagtgcaggaggg

SEQ ID NO: 311332 - DNA, 16 bp, C. familiaris
ccacagtgcccatcac

SEQ ID NO: 311333 - DNA, 16 bp, C. familiaris
ccacagtggctacacc

SEQ ID NO: 311334 - DNA, 16 bp, C. familiaris
ccacagtgggcatgga

SEQ ID NO: 311335 - DNA, 16 bp, C. familiaris
ccacatcagcctcccc

SEQ ID NO: 311336 - DNA, 16 bp, C. familiaris
ccacatcagccttcct

SEQ ID NO: 311337 - DNA, 16 bp, C. familiaris
ccacatccagctcccc

SEQ ID NO: 311338 - DNA, 16 bp, C. familiaris
ccacatcctctccaaa

SEQ ID NO: 311339 - DNA, 16 bp, C. familiaris
ccacatctccctctgc

SEQ ID NO: 311340 - DNA, 16 bp, C. familiaris
ccacatcttcaccaac

SEQ ID NO: 311341 - DNA, 16 bp, C. familiaris
ccacatcttcatccat

SEQ ID NO: 311342 - DNA, 16 bp, C. familiaris
ccacatcttctttttc

SEQ ID NO: 311343 - DNA, 16 bp, C. familiaris
ccacatgcagaatgaa

SEQ ID NO: 311344 - DNA, 16 bp, C. familiaris
ccacatggagaggcca

SEQ ID NO: 311345 - DNA, 16 bp, C. familiaris
ccacatgtggccactg

SEQ ID NO: 311346 - DNA, 16 bp, C. familiaris
ccacattcagaagaat

SEQ ID NO: 311347 - DNA, 16 bp, C. familiaris
ccacattcttaccaac

SEQ ID NO: 311348 - DNA, 16 bp, C. familiaris
ccacattgagctctgt

SEQ ID NO: 311349 - DNA, 16 bp, C. familiaris
ccacattggcttcctg

SEQ ID NO: 311350 - DNA, 16 bp, C. familiaris
ccacatttattcaaca

SEQ ID NO: 311351 - DNA, 16 bp, C. familiaris
ccaccaaaaatgagaa

SEQ ID NO: 311352 - DNA, 16 bp, C. familiaris
ccaccaaaccagccct

SEQ ID NO: 311353 - DNA, 16 bp, C. familiaris
ccaccaacagcacaag

SEQ ID NO: 311354 - DNA, 16 bp, C. familiaris
ccaccaagtctgtggt

SEQ ID NO: 311355 - DNA, 16 bp, C. familiaris
ccaccaccaccactgc

SEQ ID NO: 311356 - DNA, 16 bp, C. familiaris
ccaccaccactgccac

SEQ ID NO: 311357 - DNA, 16 bp, C. familiaris
ccaccaccagcagcag

SEQ ID NO: 311358 - DNA, 16 bp, C. familiaris
ccaccaccatcatcaa

SEQ ID NO: 311359 - DNA, 16 bp, C. familiaris
ccaccactgccaccac

SEQ ID NO: 311360 - DNA, 16 bp, C. familiaris
ccaccactgctgccac

SEQ ID NO: 311361 - DNA, 16 bp, C. familiaris
ccaccagagctgcccc

SEQ ID NO: 311362 - DNA, 16 bp, C. familiaris
ccaccagcagcagcac

SEQ ID NO: 311363 - DNA, 16 bp, C. familiaris
ccaccagctgcacctc

SEQ ID NO: 311364 - DNA, 16 bp, C. familiaris
ccaccaggcatcccag

SEQ ID NO: 311365 - DNA, 16 bp, C. familiaris
ccaccaggctgcccct

SEQ ID NO: 311366 - DNA, 16 bp, C. familiaris
ccaccagggatcccag

SEQ ID NO: 311367 - DNA, 16 bp, C. familiaris
ccaccagggctgcccc

SEQ ID NO: 311368 - DNA, 16 bp, C. familiaris
ccaccagggggcagca

SEQ ID NO: 311369 - DNA, 16 bp, C. familiaris
ccaccaggggtgccct

SEQ ID NO: 311370 - DNA, 16 bp, C. familiaris
ccaccaggtgccccca

SEQ ID NO: 311371 - DNA, 16 bp, C. familiaris
ccaccaggtgcccccc

SEQ ID NO: 311372 - DNA, 16 bp, C. familiaris
ccaccaggtgcccctc

SEQ ID NO: 311373 - DNA, 16 bp, C. familiaris
ccaccaggtgccctgg

SEQ ID NO: 311374 - DNA, 16 bp, C. familiaris
ccaccatctatctcca

SEQ ID NO: 311375 - DNA, 16 bp, C. familiaris
ccacccaactgcccct

SEQ ID NO: 311376 - DNA, 16 bp, C. familiaris
ccacccaactgctgag

SEQ ID NO: 311377 - DNA, 16 bp, C. familiaris
ccacccaagagcccct

SEQ ID NO: 311378 - DNA, 16 bp, C. familiaris
ccacccaagtgccccc

SEQ ID NO: 311379 - DNA, 16 bp, C. familiaris
ccacccacacgtccct

SEQ ID NO: 311380 - DNA, 16 bp, C. familiaris
ccacccacagtgcaag

SEQ ID NO: 311381 - DNA, 16 bp, C. familiaris
ccacccagaacctcag

SEQ ID NO: 311382 - DNA, 16 bp, C. familiaris
ccacccagaagcccct

SEQ ID NO: 311383 - DNA, 16 bp, C. familiaris
ccacccagacactccc

SEQ ID NO: 311384 - DNA, 16 bp, C. familiaris
ccacccagaggcccca

SEQ ID NO: 311385 - DNA, 16 bp, C. familiaris
ccacccagctgcccct

SEQ ID NO: 311386 - DNA, 16 bp, C. familiaris
ccacccagctgcccta

SEQ ID NO: 311387 - DNA, 16 bp, C. familiaris
ccacccaggagcacct

SEQ ID NO: 311388 - DNA, 16 bp, C. familiaris
ccacccaggagcccag

SEQ ID NO: 311389 - DNA, 16 bp, C. familiaris
ccacccaggagtcctg

SEQ ID NO: 311390 - DNA, 16 bp, C. familiaris
ccacccaggcagccca

SEQ ID NO: 311391 - DNA, 16 bp, C. familiaris
ccacccaggcagccct

SEQ ID NO: 311392 - DNA, 16 bp, C. familiaris
ccacccaggcatctcc

SEQ ID NO: 311393 - DNA, 16 bp, C. familiaris
ccacccaggccccctt

SEQ ID NO: 311394 - DNA, 16 bp, C. familiaris
ccacccaggccctcct

SEQ ID NO: 311395 - DNA, 16 bp, C. familiaris
ccacccaggcgcacct

SEQ ID NO: 311396 - DNA, 16 bp, C. familiaris
ccacccaggctcctca

SEQ ID NO: 311397 - DNA, 16 bp, C. familiaris
ccacccaggctgccac

SEQ ID NO: 311398 - DNA, 16 bp, C. familiaris
ccacccaggctgcctt

SEQ ID NO: 311399 - DNA, 16 bp, C. familiaris
ccacccagggaacccc

SEQ ID NO: 311400 - DNA, 16 bp, C. familiaris
ccacccagggagcccc

SEQ ID NO: 311401 - DNA, 16 bp, C. familiaris
ccacccagggcctgat

SEQ ID NO: 311402 - DNA, 16 bp, C. familiaris
ccacccaggggccctg

SEQ ID NO: 311403 - DNA, 16 bp, C. familiaris
ccacccaggtatcctg

SEQ ID NO: 311404 - DNA, 16 bp, C. familiaris
ccacccaggtccccca

SEQ ID NO: 311405 - DNA, 16 bp, C. familiaris
ccacccaggtgacccc

SEQ ID NO: 311406 - DNA, 16 bp, C. familiaris
ccacccaggtgcccac

SEQ ID NO: 311407 - DNA, 16 bp, C. familiaris
ccacccaggtgcccca

SEQ ID NO: 311408 - DNA, 16 bp, C. familiaris
ccacccaggtgccgcc

SEQ ID NO: 311409 - DNA, 16 bp, C. familiaris
ccacccaggtgcctca

SEQ ID NO: 311410 - DNA, 16 bp, C. familiaris
ccacccaggtgcctcc

SEQ ID NO: 311411 - DNA, 16 bp, C. familiaris
ccacccaggtgcctgg

SEQ ID NO: 311412 - DNA, 16 bp, C. familiaris
ccacccaggtggccca

SEQ ID NO: 311413 - DNA, 16 bp, C. familiaris
ccacccagtgccccca

SEQ ID NO: 311414 - DNA, 16 bp, C. familiaris
ccacccagtgcccctc

SEQ ID NO: 311415 - DNA, 16 bp, C. familiaris
ccacccatgtgctcct

SEQ ID NO: 311416 - DNA, 16 bp, C. familiaris
ccaccccaagattgcc

SEQ ID NO: 311417 - DNA, 16 bp, C. familiaris
ccaccccaccccaggt

SEQ ID NO: 311418 - DNA, 16 bp, C. familiaris
ccaccccagacctcct

SEQ ID NO: 311419 - DNA, 16 bp, C. familiaris
ccaccccagcatccca

SEQ ID NO: 311420 - DNA, 16 bp, C. familiaris
ccaccccagccctgct

SEQ ID NO: 311421 - DNA, 16 bp, C. familiaris
ccaccccaggatcccc

SEQ ID NO: 311422 - DNA, 16 bp, C. familiaris
ccaccccagtgcccct

SEQ ID NO: 311423 - DNA, 16 bp, C. familiaris
ccacccccagcctggg

SEQ ID NO: 311424 - DNA, 16 bp, C. familiaris
ccacccccagctctct

SEQ ID NO: 311425 - DNA, 16 bp, C. familiaris
ccaccccctgcctctg

SEQ ID NO: 311426 - DNA, 16 bp, C. familiaris
ccaccccggtgcccca

SEQ ID NO: 311427 - DNA, 16 bp, C. familiaris
ccacccctgccctgct

SEQ ID NO: 311428 - DNA, 16 bp, C. familiaris
ccacccggcctgccct

SEQ ID NO: 311429 - DNA, 16 bp, C. familiaris
ccacccgggccgccct

SEQ ID NO: 311430 - DNA, 16 bp, C. familiaris
ccacccgggctgcccg

SEQ ID NO: 311431 - DNA, 16 bp, C. familiaris
ccacccgggctgccct

SEQ ID NO: 311432 - DNA, 16 bp, C. familiaris
ccaccctcagcacaga

SEQ ID NO: 311433 - DNA, 16 bp, C. familiaris
ccaccctctgcctctg

SEQ ID NO: 311434 - DNA, 16 bp, C. familiaris
ccaccctggagcccct

SEQ ID NO: 311435 - DNA, 16 bp, C. familiaris
ccaccctggctgcccg

SEQ ID NO: 311436 - DNA, 16 bp, C. familiaris
ccaccctggctgcctg

SEQ ID NO: 311437 - DNA, 16 bp, C. familiaris
ccaccctgggatcatg

SEQ ID NO: 311438 - DNA, 16 bp, C. familiaris
ccaccctgggctccct

SEQ ID NO: 311439 - DNA, 16 bp, C. familiaris
ccaccctggtgcccct

SEQ ID NO: 311440 - DNA, 16 bp, C. familiaris
ccacccttgcagccca

SEQ ID NO: 311441 - DNA, 16 bp, C. familiaris
ccaccgggctgccccc

SEQ ID NO: 311442 - DNA, 16 bp, C. familiaris
ccaccgggctgcccct

SEQ ID NO: 311443 - DNA, 16 bp, C. familiaris
ccaccggggctacccc

SEQ ID NO: 311444 - DNA, 16 bp, C. familiaris
ccaccgtccatctcca

SEQ ID NO: 311445 - DNA, 16 bp, C. familiaris
ccacctacagcccagg

SEQ ID NO: 311446 - DNA, 16 bp, C. familiaris
ccacctcacacaagtg

SEQ ID NO: 311447 - DNA, 16 bp, C. familiaris
ccacctcaccccagtg

SEQ ID NO: 311448 - DNA, 16 bp, C. familiaris
ccacctcagtgcccct

SEQ ID NO: 311449 - DNA, 16 bp, C. familiaris
ccacctccacctccag

SEQ ID NO: 311450 - DNA, 16 bp, C. familiaris
ccacctccagctccct

SEQ ID NO: 311451 - DNA, 16 bp, C. familiaris
ccacctccaggaagcc

SEQ ID NO: 311452 - DNA, 16 bp, C. familiaris
ccacctcccccaggaa

SEQ ID NO: 311453 - DNA, 16 bp, C. familiaris
ccacctcccctctgat

SEQ ID NO: 311454 - DNA, 16 bp, C. familiaris
ccacctcccttccagc

SEQ ID NO: 311455 - DNA, 16 bp, C. familiaris
ccacctcctccaggaa

SEQ ID NO: 311456 - DNA, 16 bp, C. familiaris
ccacctctcccagatg

SEQ ID NO: 311457 - DNA, 16 bp, C. familiaris
ccacctctctgggcct

SEQ ID NO: 311458 - DNA, 16 bp, C. familiaris
ccacctctgcccccag

SEQ ID NO: 311459 - DNA, 16 bp, C. familiaris
ccacctgagctgcccc

SEQ ID NO: 311460 - DNA, 16 bp, C. familiaris
ccacctgagctgccct

SEQ ID NO: 311461 - DNA, 16 bp, C. familiaris
ccacctgattgtggtg

SEQ ID NO: 311462 - DNA, 16 bp, C. familiaris
ccacctgcagcccggg

SEQ ID NO: 311463 - DNA, 16 bp, C. familiaris
ccacctgcagcctggg

SEQ ID NO: 311464 - DNA, 16 bp, C. familiaris
ccacctgcagctccca

SEQ ID NO: 311465 - DNA, 16 bp, C. familiaris
ccacctgcctcctcct

SEQ ID NO: 311466 - DNA, 16 bp, C. familiaris
ccacctgcgtgtggac

SEQ ID NO: 311467 - DNA, 16 bp, C. familiaris
ccacctggatgcccca

SEQ ID NO: 311468 - DNA, 16 bp, C. familiaris
ccacctggcctgcccc

SEQ ID NO: 311469 - DNA, 16 bp, C. familiaris
ccacctgggcatcccc

SEQ ID NO: 311470 - DNA, 16 bp, C. familiaris
ccacctgggccgcccc

SEQ ID NO: 311471 - DNA, 16 bp, C. familiaris
ccacctgggctacccc

SEQ ID NO: 311472 - DNA, 16 bp, C. familiaris
ccacctgggctgcctg

SEQ ID NO: 311473 - DNA, 16 bp, C. familiaris
ccacctgggctgtcca

SEQ ID NO: 311474 - DNA, 16 bp, C. familiaris
ccacctgtgccaccca

SEQ ID NO: 311475 - DNA, 16 bp, C. familiaris
ccaccttcaacccagg

SEQ ID NO: 311476 - DNA, 16 bp, C. familiaris
ccaccttcagcccggg

SEQ ID NO: 311477 - DNA, 16 bp, C. familiaris
ccaccttcagcctggg

SEQ ID NO: 311478 - DNA, 16 bp, C. familiaris
ccaccttcctccatca

SEQ ID NO: 311479 - DNA, 16 bp, C. familiaris
ccaccttcggcctggg

SEQ ID NO: 311480 - DNA, 16 bp, C. familiaris
ccacctttgacccagg

SEQ ID NO: 311481 - DNA, 17 bp, C. familiaris
ccacgcagggagcccga

SEQ ID NO: 311482 - DNA, 16 bp, C. familiaris
ccacgcagggagccct

SEQ ID NO: 311483 - DNA, 16 bp, C. familiaris
ccacgccctggactga

SEQ ID NO: 311484 - DNA, 16 bp, C. familiaris
ccacgccgggagccca

SEQ ID NO: 311485 - DNA, 16 bp, C. familiaris
ccacggccacggccac

SEQ ID NO: 311486 - DNA, 16 bp, C. familiaris
ccacggcctgatcctg

SEQ ID NO: 311487 - DNA, 16 bp, C. familiaris
ccacggggagcctgcc

SEQ ID NO: 311488 - DNA, 16 bp, C. familiaris
ccacggtctccaggat

SEQ ID NO: 311489 - DNA, 17 bp, C. familiaris
ccacgtcgggctccctg

SEQ ID NO: 311490 - DNA, 16 bp, C. familiaris
ccactacccctgcttg

SEQ ID NO: 311491 - DNA, 16 bp, C. familiaris
ccactacctttactat

SEQ ID NO: 311492 - DNA, 16 bp, C. familiaris
ccactactccttgttc

SEQ ID NO: 311493 - DNA, 16 bp, C. familiaris
ccactcaagcacccca

SEQ ID NO: 311494 - DNA, 16 bp, C. familiaris
ccactcaagtgcccca

SEQ ID NO: 311495 - DNA, 16 bp, C. familiaris
ccactcagacatccct

SEQ ID NO: 311496 - DNA, 16 bp, C. familiaris
ccactcagccatccag

SEQ ID NO: 311497 - DNA, 16 bp, C. familiaris
ccactcaggctcccct

SEQ ID NO: 311498 - DNA, 16 bp, C. familiaris
ccactcatgatctctc

SEQ ID NO: 311499 - DNA, 16 bp, C. familiaris
ccactcatgtgtgctc

SEQ ID NO: 311500 - DNA, 16 bp, C. familiaris
ccactcccccagaaga

SEQ ID NO: 311501 - DNA, 16 bp, C. familiaris
ccactctcaccactgg

SEQ ID NO: 311502 - DNA, 16 bp, C. familiaris
ccactctccccactgc

SEQ ID NO: 311503 - DNA, 16 bp, C. familiaris
ccactctggaaaactt

SEQ ID NO: 311504 - DNA, 16 bp, C. familiaris
ccactctggaaaagag

SEQ ID NO: 311505 - DNA, 16 bp, C. familiaris
ccactctggagaacag

SEQ ID NO: 311506 - DNA, 16 bp, C. familiaris
ccactcttgatttcaa

SEQ ID NO: 311507 - DNA, 16 bp, C. familiaris
ccactgaacagggagc

SEQ ID NO: 311508 - DNA, 16 bp, C. familiaris
ccactgaacgtggagc

SEQ ID NO: 311509 - DNA, 16 bp, C. familiaris
ccactgaactgtgcac

SEQ ID NO: 311510 - DNA, 16 bp, C. familiaris
ccactgaatggatata

SEQ ID NO: 311511 - DNA, 16 bp, C. familiaris
ccactgacagagccag

SEQ ID NO: 311512 - DNA, 16 bp, C. familiaris
ccactgacctttgtcc

SEQ ID NO: 311513 - DNA, 16 bp, C. familiaris
ccactgagcaggaccc

SEQ ID NO: 311514 - DNA, 16 bp, C. familiaris
ccactgagccacccta

SEQ ID NO: 311515 - DNA, 16 bp, C. familiaris
ccactgagcccaccca

SEQ ID NO: 311516 - DNA, 16 bp, C. familiaris
ccactgagccctccag

SEQ ID NO: 311517 - DNA, 16 bp, C. familiaris
ccactgaggaaaacag

SEQ ID NO: 311518 - DNA, 16 bp, C. familiaris
ccactgccaccaccac

SEQ ID NO: 311519 - DNA, 16 bp, C. familiaris
ccactgccaccaccct

SEQ ID NO: 311520 - DNA, 16 bp, C. familiaris
ccactgccaccacctc

SEQ ID NO: 311521 - DNA, 16 bp, C. familiaris
ccactgccctgccctg

SEQ ID NO: 311522 - DNA, 16 bp, C. familiaris
ccactgctcctcctcc

SEQ ID NO: 311523 - DNA, 18 bp, C. familiaris
ccactggaagaaagacag

SEQ ID NO: 311524 - DNA, 16 bp, C. familiaris
ccactggcttgggctc

SEQ ID NO: 311525 - DNA, 16 bp, C. familiaris
ccactggggctgcccc

SEQ ID NO: 311526 - DNA, 16 bp, C. familiaris
ccactgtggagcccaa

SEQ ID NO: 311527 - DNA, 16 bp, C. familiaris
ccactgtgtgccaggc

SEQ ID NO: 311528 - DNA, 16 bp, C. familiaris
ccactgttaaaaaaaa

SEQ ID NO: 311529 - DNA, 16 bp, C. familiaris
ccacttacatgcagat

SEQ ID NO: 311530 - DNA, 16 bp, C. familiaris
ccacttccaagctcat

SEQ ID NO: 311531 - DNA, 16 bp, C. familiaris
ccacttgactgtggtg

SEQ ID NO: 311532 - DNA, 16 bp, C. familiaris
ccacttgtgccctctc

SEQ ID NO: 311533 - DNA, 16 bp, C. familiaris
ccacttgtttattttt

SEQ ID NO: 311534 - DNA, 16 bp, C. familiaris
ccactttacagatgag

SEQ ID NO: 311535 - DNA, 16 bp, C. familiaris
ccactttggcatgaag

SEQ ID NO: 311536 - DNA, 16 bp, C. familiaris
ccagaaaaatgttgct

SEQ ID NO: 311537 - DNA, 16 bp, C. familiaris
ccagaaaagatcctga

SEQ ID NO: 311538 - DNA, 16 bp, C. familiaris
ccagaaaatagaagca

SEQ ID NO: 311539 - DNA, 19 bp, C. familiaris
ccagaaagccaattcagaa

SEQ ID NO: 311540 - DNA, 16 bp, C. familiaris
ccagaaagtaaatatt

SEQ ID NO: 311541 - DNA, 16 bp, C. familiaris
ccagaaataccctcac

SEQ ID NO: 311542 - DNA, 16 bp, C. familiaris
ccagaaatcagtggta

SEQ ID NO: 311543 - DNA, 16 bp, C. familiaris
ccagaacacaggtgtc

SEQ ID NO: 311544 - DNA, 16 bp, C. familiaris
ccagaacaggcaaatc

SEQ ID NO: 311545 - DNA, 16 bp, C. familiaris
ccagaacatgatcctg

SEQ ID NO: 311546 - DNA, 16 bp, C. familiaris
ccagaaccaaaggcag

SEQ ID NO: 311547 - DNA, 16 bp, C. familiaris
ccagaaccacaccctg

SEQ ID NO: 311548 - DNA, 16 bp, C. familiaris
ccagaaccatttgttg

SEQ ID NO: 311549 - DNA, 16 bp, C. familiaris
ccagaaccccaagatc

SEQ ID NO: 311550 - DNA, 16 bp, C. familiaris
ccagaaccccaggacc

SEQ ID NO: 311551 - DNA, 16 bp, C. familiaris
ccagaaccctgggatg

SEQ ID NO: 311552 - DNA, 16 bp, C. familiaris
ccagaacctggggatc

SEQ ID NO: 311553 - DNA, 16 bp, C. familiaris
ccagaactctggaatc

SEQ ID NO: 311554 - DNA, 16 bp, C. familiaris
ccagaactgagaaaat

SEQ ID NO: 311555 - DNA, 16 bp, C. familiaris
ccagaactggaagaaa

SEQ ID NO: 311556 - DNA, 16 bp, C. familiaris
ccagaagaagagagag

SEQ ID NO: 311557 - DNA, 16 bp, C. familiaris
ccagaagaattgaaag

SEQ ID NO: 311558 - DNA, 16 bp, C. familiaris
ccagaagatagagagg

SEQ ID NO: 311559 - DNA, 16 bp, C. familiaris
ccagaagcagatgctc

SEQ ID NO: 311560 - DNA, 16 bp, C. familiaris
ccagaagctagaaaga

SEQ ID NO: 311561 - DNA, 16 bp, C. familiaris
ccagaagctgaaagag

SEQ ID NO: 311562 - DNA, 16 bp, C. familiaris
ccagaagctggaagag

SEQ ID NO: 311563 - DNA, 16 bp, C. familiaris
ccagaagctggaggag

SEQ ID NO: 311564 - DNA, 16 bp, C. familiaris
ccagaaggcttcacag

SEQ ID NO: 311565 - DNA, 16 bp, C. familiaris
ccagaagggagtggca

SEQ ID NO: 311566 - DNA, 16 bp, C. familiaris
ccagaagtgaaaaata

SEQ ID NO: 311567 - DNA, 26 bp, C. familiaris
ccagaagtggaccctgaactttatgg

SEQ ID NO: 311568 - DNA, 16 bp, C. familiaris
ccagaagtggaccctt

SEQ ID NO: 311569 - DNA, 16 bp, C. familiaris
ccagaatcagaccctg

SEQ ID NO: 311570 - DNA, 16 bp, C. familiaris
ccagaatcgagtccca

SEQ ID NO: 311571 - DNA, 16 bp, C. familiaris
ccagaattatgccctg

SEQ ID NO: 311572 - DNA, 16 bp, C. familiaris
ccagaattcaaaccca

SEQ ID NO: 311573 - DNA, 16 bp, C. familiaris
ccagaattctatatcc

SEQ ID NO: 311574 - DNA, 16 bp, C. familiaris
ccagacaaggacacca

SEQ ID NO: 311575 - DNA, 16 bp, C. familiaris
ccagacacaggaggcc

SEQ ID NO: 311576 - DNA, 16 bp, C. familiaris
ccagacagagacccca

SEQ ID NO: 311577 - DNA, 16 bp, C. familiaris
ccagacctccaggatc

SEQ ID NO: 311578 - DNA, 16 bp, C. familiaris
ccagactccaggatca

SEQ ID NO: 311579 - DNA, 16 bp, C. familiaris
ccagactgggaccccc

SEQ ID NO: 311580 - DNA, 16 bp, C. familiaris
ccagagaaagccaaat

SEQ ID NO: 311581 - DNA, 16 bp, C. familiaris
ccagagaagcaggagc

SEQ ID NO: 311582 - DNA, 16 bp, C. familiaris
ccagagaggaggtgga

SEQ ID NO: 311583 - DNA, 16 bp, C. familiaris
ccagagaggggaagga

SEQ ID NO: 311584 - DNA, 16 bp, C. familiaris
ccagagagttctgcag

SEQ ID NO: 311585 - DNA, 16 bp, C. familiaris
ccagagcacctgggtg

SEQ ID NO: 311586 - DNA, 16 bp, C. familiaris
ccagagcagcagcagc

SEQ ID NO: 311587 - DNA, 16 bp, C. familiaris
ccagagcagctgcacc

SEQ ID NO: 311588 - DNA, 16 bp, C. familiaris
ccagagccaccagcag

SEQ ID NO: 311589 - DNA, 16 bp, C. familiaris
ccagagccaggccctg

SEQ ID NO: 311590 - DNA, 16 bp, C. familiaris
ccagagccagggctgg

SEQ ID NO: 311591 - DNA, 16 bp, C. familiaris
ccagagcccaagctct

SEQ ID NO: 311592 - DNA, 16 bp, C. familiaris
ccagagctctctgtct

SEQ ID NO: 311593 - DNA, 16 bp, C. familiaris
ccagaggaagaggaaa

SEQ ID NO: 311594 - DNA, 16 bp, C. familiaris
ccagaggaggaagtca

SEQ ID NO: 311595 - DNA, 16 bp, C. familiaris
ccagaggcaaaggaaa

SEQ ID NO: 311596 - DNA, 16 bp, C. familiaris
ccagaggctttgggtt

SEQ ID NO: 311597 - DNA, 16 bp, C. familiaris
ccagagggagcccgat

SEQ ID NO: 311598 - DNA, 16 bp, C. familiaris
ccagaggggagctggg

SEQ ID NO: 311599 - DNA, 16 bp, C. familiaris
ccagaggggatccctg

SEQ ID NO: 311600 - DNA, 16 bp, C. familiaris
ccagagggtgctgaaa

SEQ ID NO: 311601 - DNA, 16 bp, C. familiaris
ccagagtaaggagtct

SEQ ID NO: 311602 - DNA, 16 bp, C. familiaris
ccagagtccagggatt

SEQ ID NO: 311603 - DNA, 16 bp, C. familiaris
ccagagtcctggggtt

SEQ ID NO: 311604 - DNA, 16 bp, C. familiaris
ccagagttagcacaga

SEQ ID NO: 311605 - DNA, 16 bp, C. familiaris
ccagagtttctgattt

SEQ ID NO: 311606 - DNA, 16 bp, C. familiaris
ccagatcaggccctgg

SEQ ID NO: 311607 - DNA, 16 bp, C. familiaris
ccagatccaggagaca

SEQ ID NO: 311608 - DNA, 16 bp, C. familiaris
ccagatccatccatgt

SEQ ID NO: 311609 - DNA, 16 bp, C. familiaris
ccagatctcaggatca

SEQ ID NO: 311610 - DNA, 16 bp, C. familiaris
ccagatctccagaatc

SEQ ID NO: 311611 - DNA, 16 bp, C. familiaris
ccagatgaagagatgc

SEQ ID NO: 311612 - DNA, 16 bp, C. familiaris
ccagatgatgctgatg

SEQ ID NO: 311613 - DNA, 16 bp, C. familiaris
ccagatgccccaagac

SEQ ID NO: 311614 - DNA, 16 bp, C. familiaris
ccagatgcccctcttc

SEQ ID NO: 311615 - DNA, 16 bp, C. familiaris
ccagatggagaaactg

SEQ ID NO: 311616 - DNA, 16 bp, C. familiaris
ccagatggccaaaaga

SEQ ID NO: 311617 - DNA, 16 bp, C. familiaris
ccagatggcctcccag

SEQ ID NO: 311618 - DNA, 16 bp, C. familiaris
ccagatggcttcacag

SEQ ID NO: 311619 - DNA, 16 bp, C. familiaris
ccagatggcttcactg

SEQ ID NO: 311620 - DNA, 16 bp, C. familiaris
ccagatggcttcccgg

SEQ ID NO: 311621 - DNA, 16 bp, C. familiaris
ccagatgtccatccac

SEQ ID NO: 311622 - DNA, 16 bp, C. familiaris
ccagatgtccatcgac

SEQ ID NO: 311623 - DNA, 16 bp, C. familiaris
ccagattaggaaaatt

SEQ ID NO: 311624 - DNA, 16 bp, C. familiaris
ccagattattttgaag

SEQ ID NO: 311625 - DNA, 16 bp, C. familiaris
ccagattcaagaggag

SEQ ID NO: 311626 - DNA, 16 bp, C. familiaris
ccagattcatcaagaa

SEQ ID NO: 311627 - DNA, 16 bp, C. familiaris
ccagattggaaaggaa

SEQ ID NO: 311628 - DNA, 16 bp, C. familiaris
ccagcaaaagaaacag

SEQ ID NO: 311629 - DNA, 16 bp, C. familiaris
ccagcaacatttgttg

SEQ ID NO: 311630 - DNA, 16 bp, C. familiaris
ccagcaaccctcactt

SEQ ID NO: 311631 - DNA, 16 bp, C. familiaris
ccagcaactccacttc

SEQ ID NO: 311632 - DNA, 16 bp, C. familiaris
ccagcaaggctatcat

SEQ ID NO: 311633 - DNA, 16 bp, C. familiaris
ccagcaaggtgcccct

SEQ ID NO: 311634 - DNA, 16 bp, C. familiaris
ccagcaagtggcagaa

SEQ ID NO: 311635 - DNA, 16 bp, C. familiaris
ccagcaattccactgc

SEQ ID NO: 311636 - DNA, 16 bp, C. familiaris
ccagcaattgcagtac

SEQ ID NO: 311637 - DNA, 16 bp, C. familiaris
ccagcacagagcctgg

SEQ ID NO: 311638 - DNA, 16 bp, C. familiaris
ccagcacagagcttga

SEQ ID NO: 311639 - DNA, 16 bp, C. familiaris
ccagcacagagtctgc

SEQ ID NO: 311640 - DNA, 16 bp, C. familiaris
ccagcacagtgcctgc

SEQ ID NO: 311641 - DNA, 16 bp, C. familiaris
ccagcaccagcaccat

SEQ ID NO: 311642 - DNA, 16 bp, C. familiaris
ccagcacggagcctga

SEQ ID NO: 311643 - DNA, 16 bp, C. familiaris
ccagcagaaaccaaga

SEQ ID NO: 311644 - DNA, 16 bp, C. familiaris
ccagcagaaatcaaga

SEQ ID NO: 311645 - DNA, 16 bp, C. familiaris
ccagcagaagaagaaa

SEQ ID NO: 311646 - DNA, 16 bp, C. familiaris
ccagcagactctgctg

SEQ ID NO: 311647 - DNA, 16 bp, C. familiaris
ccagcagattcagtgt

SEQ ID NO: 311648 - DNA, 16 bp, C. familiaris
ccagcagcaccagcag

SEQ ID NO: 311649 - DNA, 16 bp, C. familiaris
ccagcagcaccagcat

SEQ ID NO: 311650 - DNA, 16 bp, C. familiaris
ccagcagcacccagca

SEQ ID NO: 311651 - DNA, 16 bp, C. familiaris
ccagcagcagcagcag

SEQ ID NO: 311652 - DNA, 16 bp, C. familiaris
ccagcagcatcagcaa

SEQ ID NO: 311653 - DNA, 16 bp, C. familiaris
ccagcaggaagaagga

SEQ ID NO: 311654 - DNA, 16 bp, C. familiaris
ccagcagggagcctgg

SEQ ID NO: 311655 - DNA, 16 bp, C. familiaris
ccagcagtgggctggg

SEQ ID NO: 311656 - DNA, 16 bp, C. familiaris
ccagcatcaggctcct

SEQ ID NO: 311657 - DNA, 16 bp, C. familiaris
ccagcatcaggcttcc

SEQ ID NO: 311658 - DNA, 16 bp, C. familiaris
ccagcatcatgccctg

SEQ ID NO: 311659 - DNA, 16 bp, C. familiaris
ccagcatggagcccag

SEQ ID NO: 311660 - DNA, 16 bp, C. familiaris
ccagcatggggcccaa

SEQ ID NO: 311661 - DNA, 16 bp, C. familiaris
ccagcatggggctgga

SEQ ID NO: 311662 - DNA, 16 bp, C. familiaris
ccagcatttattgagc

SEQ ID NO: 311663 - DNA, 16 bp, C. familiaris
ccagcatttccactcc

SEQ ID NO: 311664 - DNA, 16 bp, C. familiaris
ccagcatttggtgtta

SEQ ID NO: 311665 - DNA, 16 bp, C. familiaris
ccagccaagcctgctg

SEQ ID NO: 311666 - DNA, 16 bp, C. familiaris
ccagccaagtgcccca

SEQ ID NO: 311667 - DNA, 16 bp, C. familiaris
ccagccaagtgccccc

SEQ ID NO: 311668 - DNA, 16 bp, C. familiaris
ccagccaagtgccctg

SEQ ID NO: 311669 - DNA, 16 bp, C. familiaris
ccagccactctggcct

SEQ ID NO: 311670 - DNA, 16 bp, C. familiaris
ccagccagccagccag

SEQ ID NO: 311671 - DNA, 16 bp, C. familiaris
ccagccagccagcctg

SEQ ID NO: 311672 - DNA, 16 bp, C. familiaris
ccagccagctgcccct

SEQ ID NO: 311673 - DNA, 16 bp, C. familiaris
ccagccaggagccctg

SEQ ID NO: 311674 - DNA, 16 bp, C. familiaris
ccagccaggagtccct

SEQ ID NO: 311675 - DNA, 16 bp, C. familiaris
ccagccaggcaacccc

SEQ ID NO: 311676 - DNA, 16 bp, C. familiaris
ccagccaggcaccacc

SEQ ID NO: 311677 - DNA, 16 bp, C. familiaris
ccagccaggcacccac

SEQ ID NO: 311678 - DNA, 16 bp, C. familiaris
ccagccaggtgcaccc

SEQ ID NO: 311679 - DNA, 16 bp, C. familiaris
ccagccaggtgcttct

SEQ ID NO: 311680 - DNA, 16 bp, C. familiaris
ccagcccactgcctgt

SEQ ID NO: 311681 - DNA, 16 bp, C. familiaris
ccagcccagcacccag

SEQ ID NO: 311682 - DNA, 16 bp, C. familiaris
ccagcccagccccagg

SEQ ID NO: 311683 - DNA, 16 bp, C. familiaris
ccagcccagccctgcc

SEQ ID NO: 311684 - DNA, 16 bp, C. familiaris
ccagcccaggaccctg

SEQ ID NO: 311685 - DNA, 16 bp, C. familiaris
ccagccccacatccag

SEQ ID NO: 311686 - DNA, 16 bp, C. familiaris
ccagccccagcccctg

SEQ ID NO: 311687 - DNA, 16 bp, C. familiaris
ccagccccagccctgc

SEQ ID NO: 311688 - DNA, 16 bp, C. familiaris
ccagccccagccctgg

SEQ ID NO: 311689 - DNA, 16 bp, C. familiaris
ccagccccaggcccag

SEQ ID NO: 311690 - DNA, 16 bp, C. familiaris
ccagcccccaccctgg

SEQ ID NO: 311691 - DNA, 16 bp, C. familiaris
ccagcccctccgagct

SEQ ID NO: 311692 - DNA, 16 bp, C. familiaris
ccagcccctgcagggg

SEQ ID NO: 311693 - DNA, 16 bp, C. familiaris
ccagccctccagccct

SEQ ID NO: 311694 - DNA, 16 bp, C. familiaris
ccagccctgcatctgg

SEQ ID NO: 311695 - DNA, 16 bp, C. familiaris
ccagccctgccctggg

SEQ ID NO: 311696 - DNA, 16 bp, C. familiaris
ccagccctgcctccca

SEQ ID NO: 311697 - DNA, 16 bp, C. familiaris
ccagccctgcctcctg

SEQ ID NO: 311698 - DNA, 16 bp, C. familiaris
ccagccctgcctctgc

SEQ ID NO: 311699 - DNA, 16 bp, C. familiaris
ccagccctgcctgccc

SEQ ID NO: 311700 - DNA, 16 bp, C. familiaris
ccagccctgctcctcc

SEQ ID NO: 311701 - DNA, 16 bp, C. familiaris
ccagccctggctctgg

SEQ ID NO: 311702 - DNA, 16 bp, C. familiaris
ccagcccttcctggcc

SEQ ID NO: 311703 - DNA, 16 bp, C. familiaris
ccagcctcacccctgc

SEQ ID NO: 311704 - DNA, 16 bp, C. familiaris
ccagcctcagccccag

SEQ ID NO: 311705 - DNA, 16 bp, C. familiaris
ccagcctcatctccca

SEQ ID NO: 311706 - DNA, 16 bp, C. familiaris
ccagcctccagaatgg

SEQ ID NO: 311707 - DNA, 16 bp, C. familiaris
ccagcctcccggggtc

SEQ ID NO: 311708 - DNA, 16 bp, C. familiaris
ccagcctcctcctcct

SEQ ID NO: 311709 - DNA, 16 bp, C. familiaris
ccagcctctccctctg

SEQ ID NO: 311710 - DNA, 16 bp, C. familiaris
ccagcctctgcctcca

SEQ ID NO: 311711 - DNA, 16 bp, C. familiaris
ccagcctctgcctgtc

SEQ ID NO: 311712 - DNA, 16 bp, C. familiaris
ccagcctgccagcctg

SEQ ID NO: 311713 - DNA, 16 bp, C. familiaris
ccagcctgcccttcct

SEQ ID NO: 311714 - DNA, 16 bp, C. familiaris
ccagcctggagcccaa

SEQ ID NO: 311715 - DNA, 16 bp, C. familiaris
ccagcctgggcctcca

SEQ ID NO: 311716 - DNA, 16 bp, C. familiaris
ccagccttcagaactg

SEQ ID NO: 311717 - DNA, 16 bp, C. familiaris
ccagccttcagcccag

SEQ ID NO: 311718 - DNA, 16 bp, C. familiaris
ccagccttgtgtccgg

SEQ ID NO: 311719 - DNA, 16 bp, C. familiaris
ccagcgcctgatcctg

SEQ ID NO: 311720 - DNA, 16 bp, C. familiaris
ccagctcagagcctga

SEQ ID NO: 311721 - DNA, 16 bp, C. familiaris
ccagctcagcgaggag

SEQ ID NO: 311722 - DNA, 16 bp, C. familiaris
ccagctccagcccagc

SEQ ID NO: 311723 - DNA, 16 bp, C. familiaris
ccagctcccttcctgc

SEQ ID NO: 311724 - DNA, 16 bp, C. familiaris
ccagctctaccactta

SEQ ID NO: 311725 - DNA, 16 bp, C. familiaris
ccagctctccagctct

SEQ ID NO: 311726 - DNA, 16 bp, C. familiaris
ccagctctctgctcag

SEQ ID NO: 311727 - DNA, 16 bp, C. familiaris
ccagctctgcactggg

SEQ ID NO: 311728 - DNA, 16 bp, C. familiaris
ccagctctgctgcttc

SEQ ID NO: 311729 - DNA, 16 bp, C. familiaris
ccagctcttcattttt

SEQ ID NO: 311730 - DNA, 16 bp, C. familiaris
ccagctgagcatggag

SEQ ID NO: 311731 - DNA, 16 bp, C. familiaris
ccagctgagcccagcc

SEQ ID NO: 311732 - DNA, 16 bp, C. familiaris
ccagctgagccctgcc

SEQ ID NO: 311733 - DNA, 16 bp, C. familiaris
ccagctgagctgccca

SEQ ID NO: 311734 - DNA, 16 bp, C. familiaris
ccagctgagtcaccca

SEQ ID NO: 311735 - DNA, 16 bp, C. familiaris
ccagctgagtggggag

SEQ ID NO: 311736 - DNA, 16 bp, C. familiaris
ccagctgctcctggaa

SEQ ID NO: 311737 - DNA, 16 bp, C. familiaris
ccagctgctgctgctg

SEQ ID NO: 311738 - DNA, 16 bp, C. familiaris
ccagctgggtgcccct

SEQ ID NO: 311739 - DNA, 16 bp, C. familiaris
ccagctggtcttctgc

SEQ ID NO: 311740 - DNA, 16 bp, C. familiaris
ccagctggtgtctgag

SEQ ID NO: 311741 - DNA, 16 bp, C. familiaris
ccagctgtgtgacctc

SEQ ID NO: 311742 - DNA, 16 bp, C. familiaris
ccagcttccaaaactg

SEQ ID NO: 311743 - DNA, 16 bp, C. familiaris
ccagcttctccctgag

SEQ ID NO: 311744 - DNA, 16 bp, C. familiaris
ccagctttcattccca

SEQ ID NO: 311745 - DNA, 16 bp, C. familiaris
ccagctttgtgacctt

SEQ ID NO: 311746 - DNA, 16 bp, C. familiaris
ccagcttttgattttg

SEQ ID NO: 311747 - DNA, 16 bp, C. familiaris
ccagcttttggttttg

SEQ ID NO: 311748 - DNA, 16 bp, C. familiaris
ccaggaaacagattct

SEQ ID NO: 311749 - DNA, 16 bp, C. familiaris
ccaggaaaccttccct

SEQ ID NO: 311750 - DNA, 16 bp, C. familiaris
ccaggaaataaaagaa

SEQ ID NO: 311751 - DNA, 16 bp, C. familiaris
ccaggaaatcaaagaa

SEQ ID NO: 311752 - DNA, 16 bp, C. familiaris
ccaggaacacaccctg

SEQ ID NO: 311753 - DNA, 16 bp, C. familiaris
ccaggaacaggccctg

SEQ ID NO: 311754 - DNA, 16 bp, C. familiaris
ccaggaagaaatagaa

SEQ ID NO: 311755 - DNA, 16 bp, C. familiaris
ccaggaagaggaggag

SEQ ID NO: 311756 - DNA, 16 bp, C. familiaris
ccaggaagagggctct

SEQ ID NO: 311757 - DNA, 16 bp, C. familiaris
ccaggaagcacagaga

SEQ ID NO: 311758 - DNA, 16 bp, C. familiaris
ccaggaagccctcctg

SEQ ID NO: 311759 - DNA, 16 bp, C. familiaris
ccaggaagcctgccct

SEQ ID NO: 311760 - DNA, 16 bp, C. familiaris
ccaggaagtggcagag

SEQ ID NO: 311761 - DNA, 16 bp, C. familiaris
ccaggaatctgggatc

SEQ ID NO: 311762 - DNA, 16 bp, C. familiaris
ccaggacagagtccca

SEQ ID NO: 311763 - DNA, 16 bp, C. familiaris
ccaggacaggaaagct

SEQ ID NO: 311764 - DNA, 16 bp, C. familiaris
ccaggacaggcagagg

SEQ ID NO: 311765 - DNA, 16 bp, C. familiaris
ccaggacatggtcctg

SEQ ID NO: 311766 - DNA, 16 bp, C. familiaris
ccaggaccacatcctg

SEQ ID NO: 311767 - DNA, 16 bp, C. familiaris
ccaggaccacgctctg

SEQ ID NO: 311768 - DNA, 16 bp, C. familiaris
ccaggaccccaagttc

SEQ ID NO: 311769 - DNA, 16 bp, C. familiaris
ccaggaccccaccctg

SEQ ID NO: 311770 - DNA, 16 bp, C. familiaris
ccaggaccccagccag

SEQ ID NO: 311771 - DNA, 16 bp, C. familiaris
ccaggaccccaggacc

SEQ ID NO: 311772 - DNA, 16 bp, C. familiaris
ccaggaccccagggtc

SEQ ID NO: 311773 - DNA, 16 bp, C. familiaris
ccaggacccccaagat

SEQ ID NO: 311774 - DNA, 16 bp, C. familiaris
ccaggacccccaggac

SEQ ID NO: 311775 - DNA, 16 bp, C. familiaris
ccaggacccctgggtg

SEQ ID NO: 311776 - DNA, 16 bp, C. familiaris
ccaggaccctgaggcc

SEQ ID NO: 311777 - DNA, 16 bp, C. familiaris
ccaggaccctggatca

SEQ ID NO: 311778 - DNA, 16 bp, C. familiaris
ccaggaccctggcatc

SEQ ID NO: 311779 - DNA, 16 bp, C. familiaris
ccaggaccctgggacc

SEQ ID NO: 311780 - DNA, 16 bp, C. familiaris
ccaggaccctgggtca

SEQ ID NO: 311781 - DNA, 16 bp, C. familiaris
ccaggacctgaggatc

SEQ ID NO: 311782 - DNA, 16 bp, C. familiaris
ccaggacctgggatca

SEQ ID NO: 311783 - DNA, 16 bp, C. familiaris
ccaggacctggggacc

SEQ ID NO: 311784 - DNA, 16 bp, C. familiaris
ccaggacctggtcctg

SEQ ID NO: 311785 - DNA, 16 bp, C. familiaris
ccaggacgcctgggtg

SEQ ID NO: 311786 - DNA, 16 bp, C. familiaris
ccaggacgtggtcctg

SEQ ID NO: 311787 - DNA, 16 bp, C. familiaris
ccaggactccagaacc

SEQ ID NO: 311788 - DNA, 16 bp, C. familiaris
ccaggagaagaagaga

SEQ ID NO: 311789 - DNA, 16 bp, C. familiaris
ccaggagaagaaggga

SEQ ID NO: 311790 - DNA, 18 bp, C. familiaris
ccaggagaagccaaggga

SEQ ID NO: 311791 - DNA, 16 bp, C. familiaris
ccaggagacccgggat

SEQ ID NO: 311792 - DNA, 16 bp, C. familiaris
ccaggagagaggcctc

SEQ ID NO: 311793 - DNA, 16 bp, C. familiaris
ccaggagagccagagg

SEQ ID NO: 311794 - DNA, 16 bp, C. familiaris
ccaggagagccagtgg

SEQ ID NO: 311795 - DNA, 16 bp, C. familiaris
ccaggagatcatgacc

SEQ ID NO: 311796 - DNA, 16 bp, C. familiaris
ccaggagcagctcggg

SEQ ID NO: 311797 - DNA, 16 bp, C. familiaris
ccaggagcaggccctg

SEQ ID NO: 311798 - DNA, 16 bp, C. familiaris
ccaggagcaggtgcag

SEQ ID NO: 311799 - DNA, 16 bp, C. familiaris
ccaggagcatgccctg

SEQ ID NO: 311800 - DNA, 16 bp, C. familiaris
ccaggagcccaggagg

SEQ ID NO: 311801 - DNA, 16 bp, C. familiaris
ccaggagcccctcttt

SEQ ID NO: 311802 - DNA, 16 bp, C. familiaris
ccaggagctgggagga

SEQ ID NO: 311803 - DNA, 16 bp, C. familiaris
ccaggagctgggaggg

SEQ ID NO: 311804 - DNA, 16 bp, C. familiaris
ccaggaggaaattgaa

SEQ ID NO: 311805 - DNA, 16 bp, C. familiaris
ccaggaggaggaagga

SEQ ID NO: 311806 - DNA, 16 bp, C. familiaris
ccaggaggcaggaggc

SEQ ID NO: 311807 - DNA, 16 bp, C. familiaris
ccaggaggccccagga

SEQ ID NO: 311808 - DNA, 16 bp, C. familiaris
ccaggaggggctggga

SEQ ID NO: 311809 - DNA, 16 bp, C. familiaris
ccaggaggtacagaga

SEQ ID NO: 311810 - DNA, 16 bp, C. familiaris
ccaggagttggttcct

SEQ ID NO: 311811 - DNA, 16 bp, C. familiaris
ccaggatcaagtggga

SEQ ID NO: 311812 - DNA, 16 bp, C. familiaris
ccaggatcacacagca

SEQ ID NO: 311813 - DNA, 16 bp, C. familiaris
ccaggatcacacctcg

SEQ ID NO: 311814 - DNA, 16 bp, C. familiaris
ccaggatcagccctgg

SEQ ID NO: 311815 - DNA, 16 bp, C. familiaris
ccaggatcagggctca

SEQ ID NO: 311816 - DNA, 16 bp, C. familiaris
ccaggatcccatcctg

SEQ ID NO: 311817 - DNA, 16 bp, C. familiaris
ccaggatcctgtcctg

SEQ ID NO: 311818 - DNA, 16 bp, C. familiaris
ccaggatgaggccctg

SEQ ID NO: 311819 - DNA, 16 bp, C. familiaris
ccaggatgagtcccac

SEQ ID NO: 311820 - DNA, 16 bp, C. familiaris
ccaggatggagcccaa

SEQ ID NO: 311821 - DNA, 16 bp, C. familiaris
ccaggattacatcctg

SEQ ID NO: 311822 - DNA, 16 bp, C. familiaris
ccaggattctgagatc

SEQ ID NO: 311823 - DNA, 16 bp, C. familiaris
ccaggatttctcaacc

SEQ ID NO: 311824 - DNA, 16 bp, C. familiaris
ccaggcaaccactgat

SEQ ID NO: 311825 - DNA, 16 bp, C. familiaris
ccaggcaccatgccag

SEQ ID NO: 311826 - DNA, 16 bp, C. familiaris
ccaggcaccccacctc

SEQ ID NO: 311827 - DNA, 16 bp, C. familiaris
ccaggcaccccacctt

SEQ ID NO: 311828 - DNA, 16 bp, C. familiaris
ccaggcaccccagaga

SEQ ID NO: 311829 - DNA, 16 bp, C. familiaris
ccaggcacccccaagt

SEQ ID NO: 311830 - DNA, 16 bp, C. familiaris
ccaggcaccccctctc

SEQ ID NO: 311831 - DNA, 16 bp, C. familiaris
ccaggcacccctccat

SEQ ID NO: 311832 - DNA, 16 bp, C. familiaris
ccaggcacccctggac

SEQ ID NO: 311833 - DNA, 16 bp, C. familiaris
ccaggcaccctgacaa

SEQ ID NO: 311834 - DNA, 16 bp, C. familiaris
ccaggcactcctcttt

SEQ ID NO: 311835 - DNA, 16 bp, C. familiaris
ccaggcactgggctgg

SEQ ID NO: 311836 - DNA, 16 bp, C. familiaris
ccaggcactgtgctga

SEQ ID NO: 311837 - DNA, 16 bp, C. familiaris
ccaggcactgtgctgg

SEQ ID NO: 311838 - DNA, 16 bp, C. familiaris
ccaggcagaaggaata

SEQ ID NO: 311839 - DNA, 16 bp, C. familiaris
ccaggcaggccagaaa

SEQ ID NO: 311840 - DNA, 16 bp, C. familiaris
ccaggcagggcagggc

SEQ ID NO: 311841 - DNA, 16 bp, C. familiaris
ccaggcagtctgactc

SEQ ID NO: 311842 - DNA, 16 bp, C. familiaris
ccaggcatcccacaac

SEQ ID NO: 311843 - DNA, 16 bp, C. familiaris
ccaggcatcccagaat

SEQ ID NO: 311844 - DNA, 16 bp, C. familiaris
ccaggcatccccactt

SEQ ID NO: 311845 - DNA, 16 bp, C. familiaris
ccaggcatccccagtt

SEQ ID NO: 311846 - DNA, 16 bp, C. familiaris
ccaggcatccccctca

SEQ ID NO: 311847 - DNA, 16 bp, C. familiaris
ccaggcatccctccac

SEQ ID NO: 311848 - DNA, 16 bp, C. familiaris
ccaggcatccctccag

SEQ ID NO: 311849 - DNA, 16 bp, C. familiaris
ccaggcatccctctgc

SEQ ID NO: 311850 - DNA, 16 bp, C. familiaris
ccaggccacaccccag

SEQ ID NO: 311851 - DNA, 16 bp, C. familiaris
ccaggccagcaacctc

SEQ ID NO: 311852 - DNA, 16 bp, C. familiaris
ccaggccagggcaggg

SEQ ID NO: 311853 - DNA, 16 bp, C. familiaris
ccaggccatctggctc

SEQ ID NO: 311854 - DNA, 16 bp, C. familiaris
ccaggcccagccctgc

SEQ ID NO: 311855 - DNA, 16 bp, C. familiaris
ccaggcccaggccagg

SEQ ID NO: 311856 - DNA, 16 bp, C. familiaris
ccaggcccaggccctg

SEQ ID NO: 311857 - DNA, 16 bp, C. familiaris
ccaggcccagggcagg

SEQ ID NO: 311858 - DNA, 16 bp, C. familiaris
ccaggcccagggctgg

SEQ ID NO: 311859 - DNA, 16 bp, C. familiaris
ccaggcccctggggtc

SEQ ID NO: 311860 - DNA, 16 bp, C. familiaris
ccaggccctgagcccc

SEQ ID NO: 311861 - DNA, 16 bp, C. familiaris
ccaggccctgcagagg

SEQ ID NO: 311862 - DNA, 16 bp, C. familiaris
ccaggccctgccctgg

SEQ ID NO: 311863 - DNA, 16 bp, C. familiaris
ccaggccctggcccag

SEQ ID NO: 311864 - DNA, 16 bp, C. familiaris
ccaggccctgggcact

SEQ ID NO: 311865 - DNA, 16 bp, C. familiaris
ccaggccctgggcagg

SEQ ID NO: 311866 - DNA, 16 bp, C. familiaris
ccaggccctgtgctag

SEQ ID NO: 311867 - DNA, 16 bp, C. familiaris
ccaggccctgtgctgg

SEQ ID NO: 311868 - DNA, 16 bp, C. familiaris
ccaggcctccaggacc

SEQ ID NO: 311869 - DNA, 16 bp, C. familiaris
ccaggcctctctcctc

SEQ ID NO: 311870 - DNA, 16 bp, C. familiaris
ccaggcctctgccctc

SEQ ID NO: 311871 - DNA, 16 bp, C. familiaris
ccaggcctgcctgcct

SEQ ID NO: 311872 - DNA, 16 bp, C. familiaris
ccaggcctggcctccc

SEQ ID NO: 311873 - DNA, 16 bp, C. familiaris
ccaggcctgggcaggg

SEQ ID NO: 311874 - DNA, 16 bp, C. familiaris
ccaggcctgggcctgg

SEQ ID NO: 311875 - DNA, 16 bp, C. familiaris
ccaggcctgggctctg

SEQ ID NO: 311876 - DNA, 16 bp, C. familiaris
ccaggcctggggcagg

SEQ ID NO: 311877 - DNA, 16 bp, C. familiaris
ccaggcctggggctgg

SEQ ID NO: 311878 - DNA, 16 bp, C. familiaris
ccaggcgccccagaag

SEQ ID NO: 311879 - DNA, 16 bp, C. familiaris
ccaggcgcccctcacc

SEQ ID NO: 311880 - DNA, 16 bp, C. familiaris
ccaggcgcccctgcct

SEQ ID NO: 311881 - DNA, 16 bp, C. familiaris
ccaggcgccccttcct

SEQ ID NO: 311882 - DNA, 16 bp, C. familiaris
ccaggcgtccctgcac

SEQ ID NO: 311883 - DNA, 16 bp, C. familiaris
ccaggcgtccctgggc

SEQ ID NO: 311884 - DNA, 16 bp, C. familiaris
ccaggctcccagcccc

SEQ ID NO: 311885 - DNA, 16 bp, C. familiaris
ccaggctccccggagg

SEQ ID NO: 311886 - DNA, 16 bp, C. familiaris
ccaggctctgccctca

SEQ ID NO: 311887 - DNA, 16 bp, C. familiaris
ccaggctctgcctctg

SEQ ID NO: 311888 - DNA, 16 bp, C. familiaris
ccaggctgcccaagag

SEQ ID NO: 311889 - DNA, 16 bp, C. familiaris
ccaggctgcccaaggg

SEQ ID NO: 311890 - DNA, 16 bp, C. familiaris
ccaggctgccccagca

SEQ ID NO: 311891 - DNA, 16 bp, C. familiaris
ccaggctgccccaggg

SEQ ID NO: 311892 - DNA, 16 bp, C. familiaris
ccaggctgccccataa

SEQ ID NO: 311893 - DNA, 16 bp, C. familiaris
ccaggctgcccccaga

SEQ ID NO: 311894 - DNA, 16 bp, C. familiaris
ccaggctgcccccagc

SEQ ID NO: 311895 - DNA, 16 bp, C. familiaris
ccaggctgccccctcc

SEQ ID NO: 311896 - DNA, 16 bp, C. familiaris
ccaggctgcccctttt

SEQ ID NO: 311897 - DNA, 16 bp, C. familiaris
ccaggctgccctctcc

SEQ ID NO: 311898 - DNA, 16 bp, C. familiaris
ccaggctgccctgcag

SEQ ID NO: 311899 - DNA, 16 bp, C. familiaris
ccaggctgccctgcct

SEQ ID NO: 311900 - DNA, 16 bp, C. familiaris
ccaggctgccctgctc

SEQ ID NO: 311901 - DNA, 16 bp, C. familiaris
ccaggctgccctggac

SEQ ID NO: 311902 - DNA, 16 bp, C. familiaris
ccaggctgccctgtgc

SEQ ID NO: 311903 - DNA, 16 bp, C. familiaris
ccaggctgccctgttg

SEQ ID NO: 311904 - DNA, 16 bp, C. familiaris
ccaggctgggctgggc

SEQ ID NO: 311905 - DNA, 16 bp, C. familiaris
ccaggctgggtgtgga

SEQ ID NO: 311906 - DNA, 16 bp, C. familiaris
ccagggaaaatgaaaa

SEQ ID NO: 311907 - DNA, 16 bp, C. familiaris
ccagggaaggagcttg

SEQ ID NO: 311908 - DNA, 16 bp, C. familiaris
ccagggacacagccca

SEQ ID NO: 311909 - DNA, 16 bp, C. familiaris
ccagggactccaagat

SEQ ID NO: 311910 - DNA, 16 bp, C. familiaris
ccagggagaggaagag

SEQ ID NO: 311911 - DNA, 16 bp, C. familiaris
ccagggaggagattga

SEQ ID NO: 311912 - DNA, 16 bp, C. familiaris
ccagggatcaagtccc

SEQ ID NO: 311913 - DNA, 16 bp, C. familiaris
ccagggatcccacccc

SEQ ID NO: 311914 - DNA, 16 bp, C. familiaris
ccagggatcccaccct

SEQ ID NO: 311915 - DNA, 16 bp, C. familiaris
ccagggatcccacctc

SEQ ID NO: 311916 - DNA, 16 bp, C. familiaris
ccagggatcccaggag

SEQ ID NO: 311917 - DNA, 16 bp, C. familiaris
ccagggatccctacca

SEQ ID NO: 311918 - DNA, 16 bp, C. familiaris
ccagggatccctccaa

SEQ ID NO: 311919 - DNA, 16 bp, C. familiaris
ccagggatccctccct

SEQ ID NO: 311920 - DNA, 16 bp, C. familiaris
ccagggatccctctga

SEQ ID NO: 311921 - DNA, 16 bp, C. familiaris
ccagggatccctggaa

SEQ ID NO: 311922 - DNA, 16 bp, C. familiaris
ccagggatccctgtaa

SEQ ID NO: 311923 - DNA, 16 bp, C. familiaris
ccagggatccctgttc

SEQ ID NO: 311924 - DNA, 16 bp, C. familiaris
ccagggatgcaagaat

SEQ ID NO: 311925 - DNA, 16 bp, C. familiaris
ccagggatgctgctca

SEQ ID NO: 311926 - DNA, 16 bp, C. familiaris
ccagggcacagagcag

SEQ ID NO: 311927 - DNA, 16 bp, C. familiaris
ccagggcacctgtgtg

SEQ ID NO: 311928 - DNA, 16 bp, C. familiaris
ccagggcagagccagg

SEQ ID NO: 311929 - DNA, 16 bp, C. familiaris
ccagggcagcccaggt

SEQ ID NO: 311930 - DNA, 16 bp, C. familiaris
ccagggcagctccagg

SEQ ID NO: 311931 - DNA, 16 bp, C. familiaris
ccagggcagggccagg

SEQ ID NO: 311932 - DNA, 16 bp, C. familiaris
ccagggcatgaccctg

SEQ ID NO: 311933 - DNA, 16 bp, C. familiaris
ccagggcatgagcctg

SEQ ID NO: 311934 - DNA, 16 bp, C. familiaris
ccagggcatggccctg

SEQ ID NO: 311935 - DNA, 16 bp, C. familiaris
ccagggccacacagcc

SEQ ID NO: 311936 - DNA, 16 bp, C. familiaris
ccagggccagagccag

SEQ ID NO: 311937 - DNA, 16 bp, C. familiaris
ccagggccagatcctg

SEQ ID NO: 311938 - DNA, 16 bp, C. familiaris
ccagggccagggcagg

SEQ ID NO: 311939 - DNA, 16 bp, C. familiaris
ccagggcccagagagg

SEQ ID NO: 311940 - DNA, 16 bp, C. familiaris
ccagggcccagggcag

SEQ ID NO: 311941 - DNA, 16 bp, C. familiaris
ccagggcccagggctg

SEQ ID NO: 311942 - DNA, 16 bp, C. familiaris
ccagggccccagcctg

SEQ ID NO: 311943 - DNA, 16 bp, C. familiaris
ccagggccccaggacc

SEQ ID NO: 311944 - DNA, 16 bp, C. familiaris
ccagggccccggggtc

SEQ ID NO: 311945 - DNA, 16 bp, C. familiaris
ccagggccctgggcag

SEQ ID NO: 311946 - DNA, 16 bp, C. familiaris
ccagggccctggggtc

SEQ ID NO: 311947 - DNA, 16 bp, C. familiaris
ccagggcctcatcctg

SEQ ID NO: 311948 - DNA, 16 bp, C. familiaris
ccagggcctgcgctgt

SEQ ID NO: 311949 - DNA, 16 bp, C. familiaris
ccagggcctgctcctg

SEQ ID NO: 311950 - DNA, 16 bp, C. familiaris
ccagggcctggagacc

SEQ ID NO: 311951 - DNA, 16 bp, C. familiaris
ccagggcctggagcag

SEQ ID NO: 311952 - DNA, 16 bp, C. familiaris
ccagggcctggccagg

SEQ ID NO: 311953 - DNA, 16 bp, C. familiaris
ccagggcctggcccag

SEQ ID NO: 311954 - DNA, 16 bp, C. familiaris
ccagggcctgggggag

SEQ ID NO: 311955 - DNA, 16 bp, C. familiaris
ccagggcgtggccctg

SEQ ID NO: 311956 - DNA, 16 bp, C. familiaris
ccagggctctgtggag

SEQ ID NO: 311957 - DNA, 16 bp, C. familiaris
ccagggctgcccaagc

SEQ ID NO: 311958 - DNA, 16 bp, C. familiaris
ccagggctgcccacat

SEQ ID NO: 311959 - DNA, 16 bp, C. familiaris
ccagggctgcccacca

SEQ ID NO: 311960 - DNA, 16 bp, C. familiaris
ccagggctgccccagc

SEQ ID NO: 311961 - DNA, 16 bp, C. familiaris
ccagggctgccctcag

SEQ ID NO: 311962 - DNA, 16 bp, C. familiaris
ccagggctgccctggc

SEQ ID NO: 311963 - DNA, 16 bp, C. familiaris
ccagggctgccctggt

SEQ ID NO: 311964 - DNA, 16 bp, C. familiaris
ccagggctgccctgtc

SEQ ID NO: 311965 - DNA, 16 bp, C. familiaris
ccagggctgggctggc

SEQ ID NO: 311966 - DNA, 16 bp, C. familiaris
ccagggcttgatccta

SEQ ID NO: 311967 - DNA, 16 bp, C. familiaris
ccagggcttgatcctg

SEQ ID NO: 311968 - DNA, 16 bp, C. familiaris
ccaggggaagtggagg

SEQ ID NO: 311969 - DNA, 16 bp, C. familiaris
ccaggggacgcctggg

SEQ ID NO: 311970 - DNA, 16 bp, C. familiaris
ccaggggagcctgctt

SEQ ID NO: 311971 - DNA, 16 bp, C. familiaris
ccaggggaggaaattg

SEQ ID NO: 311972 - DNA, 16 bp, C. familiaris
ccaggggaggcagggc

SEQ ID NO: 311973 - DNA, 16 bp, C. familiaris
ccaggggcagcctggg

SEQ ID NO: 311974 - DNA, 16 bp, C. familiaris
ccaggggcccctcctt

SEQ ID NO: 311975 - DNA, 16 bp, C. familiaris
ccaggggcccctgaaa

SEQ ID NO: 311976 - DNA, 16 bp, C. familiaris
ccaggggctgctgctg

SEQ ID NO: 311977 - DNA, 16 bp, C. familiaris
ccaggggctggaggaa

SEQ ID NO: 311978 - DNA, 16 bp, C. familiaris
ccaggggctgggggca

SEQ ID NO: 311979 - DNA, 16 bp, C. familiaris
ccaggggctgggggtg

SEQ ID NO: 311980 - DNA, 16 bp, C. familiaris
ccagggggtgcctggg

SEQ ID NO: 311981 - DNA, 16 bp, C. familiaris
ccagggtcacccagct

SEQ ID NO: 311982 - DNA, 16 bp, C. familiaris
ccagggtcaggacccc

SEQ ID NO: 311983 - DNA, 16 bp, C. familiaris
ccagggtcgtgggatt

SEQ ID NO: 311984 - DNA, 17 bp, C. familiaris
ccagggtctccagatca

SEQ ID NO: 311985 - DNA, 16 bp, C. familiaris
ccagggtctcctggat

SEQ ID NO: 311986 - DNA, 16 bp, C. familiaris
ccagggtgccaggatc

SEQ ID NO: 311987 - DNA, 16 bp, C. familiaris
ccaggtacagggtgac

SEQ ID NO: 311988 - DNA, 16 bp, C. familiaris
ccaggtacccctggag

SEQ ID NO: 311989 - DNA, 16 bp, C. familiaris
ccaggtccccaggatc

SEQ ID NO: 311990 - DNA, 16 bp, C. familiaris
ccaggtccccagggtc

SEQ ID NO: 311991 - DNA, 16 bp, C. familiaris
ccaggtcctggagacc

SEQ ID NO: 311992 - DNA, 16 bp, C. familiaris
ccaggtctccagccct

SEQ ID NO: 311993 - DNA, 16 bp, C. familiaris
ccaggtgaggctcagg

SEQ ID NO: 311994 - DNA, 16 bp, C. familiaris
ccaggtgatgctgctg

SEQ ID NO: 311995 - DNA, 16 bp, C. familiaris
ccaggtgccccacagc

SEQ ID NO: 311996 - DNA, 16 bp, C. familiaris
ccaggtgccccaccac

SEQ ID NO: 311997 - DNA, 16 bp, C. familiaris
ccaggtgccccactgt

SEQ ID NO: 311998 - DNA, 16 bp, C. familiaris
ccaggtgccccacttc

SEQ ID NO: 311999 - DNA, 16 bp, C. familiaris
ccaggtgccccagccc

SEQ ID NO: 312000 - DNA, 16 bp, C. familiaris
ccaggtgccccagggc

SEQ ID NO: 312001 - DNA, 16 bp, C. familiaris
ccaggtgccccaggtg

SEQ ID NO: 312002 - DNA, 16 bp, C. familiaris
ccaggtgccccaggtt

SEQ ID NO: 312003 - DNA, 16 bp, C. familiaris
ccaggtgccccagtga

SEQ ID NO: 312004 - DNA, 16 bp, C. familiaris
ccaggtgcccccaggg

SEQ ID NO: 312005 - DNA, 16 bp, C. familiaris
ccaggtgcccccatct

SEQ ID NO: 312006 - DNA, 16 bp, C. familiaris
ccaggtgccccccacc

SEQ ID NO: 312007 - DNA, 16 bp, C. familiaris
ccaggtgccccctcac

SEQ ID NO: 312008 - DNA, 16 bp, C. familiaris
ccaggtgccccctgtc

SEQ ID NO: 312009 - DNA, 16 bp, C. familiaris
ccaggtgcccctaatc

SEQ ID NO: 312010 - DNA, 16 bp, C. familiaris
ccaggtgcccctccct

SEQ ID NO: 312011 - DNA, 16 bp, C. familiaris
ccaggtgcccctgatg

SEQ ID NO: 312012 - DNA, 16 bp, C. familiaris
ccaggtgcccctggcc

SEQ ID NO: 312013 - DNA, 16 bp, C. familiaris
ccaggtgccctggatg

SEQ ID NO: 312014 - DNA, 16 bp, C. familiaris
ccaggtgccctggcct

SEQ ID NO: 312015 - DNA, 16 bp, C. familiaris
ccaggtgccctgtgag

SEQ ID NO: 312016 - DNA, 16 bp, C. familiaris
ccaggtgcctcagtgg

SEQ ID NO: 312017 - DNA, 16 bp, C. familiaris
ccaggtgctcctgtgt

SEQ ID NO: 312018 - DNA, 16 bp, C. familiaris
ccaggtgctgctgctg

SEQ ID NO: 312019 - DNA, 16 bp, C. familiaris
ccaggtggccaacaga

SEQ ID NO: 312020 - DNA, 16 bp, C. familiaris
ccaggtggctcagggt

SEQ ID NO: 312021 - DNA, 16 bp, C. familiaris
ccaggtggctctgtgg

SEQ ID NO: 312022 - DNA, 16 bp, C. familiaris
ccaggtggtctggctc

SEQ ID NO: 312023 - DNA, 16 bp, C. familiaris
ccaggtggttcagttg

SEQ ID NO: 312024 - DNA, 16 bp, C. familiaris
ccaggtgtcccaggag

SEQ ID NO: 312025 - DNA, 16 bp, C. familiaris
ccaggtgtcccaggat

SEQ ID NO: 312026 - DNA, 16 bp, C. familiaris
ccaggtgtccccagtt

SEQ ID NO: 312027 - DNA, 16 bp, C. familiaris
ccaggtgtccccatca

SEQ ID NO: 312028 - DNA, 16 bp, C. familiaris
ccaggtgtcccctgct

SEQ ID NO: 312029 - DNA, 16 bp, C. familiaris
ccaggtgtccctcccc

SEQ ID NO: 312030 - DNA, 16 bp, C. familiaris
ccaggtgtcccttctc

SEQ ID NO: 312031 - DNA, 16 bp, C. familiaris
ccaggtgtcccttttc

SEQ ID NO: 312032 - DNA, 16 bp, C. familiaris
ccaggttcgagtccca

SEQ ID NO: 312033 - DNA, 16 bp, C. familiaris
ccaggttgggctcccc

SEQ ID NO: 312034 - DNA, 16 bp, C. familiaris
ccaggttgtactacaa

SEQ ID NO: 312035 - DNA, 16 bp, C. familiaris
ccagtagaagaagaga

SEQ ID NO: 312036 - DNA, 16 bp, C. familiaris
ccagtatcacaacctg

SEQ ID NO: 312037 - DNA, 16 bp, C. familiaris
ccagtcaatctggaat

SEQ ID NO: 312038 - DNA, 16 bp, C. familiaris
ccagtcacagaagacc

SEQ ID NO: 312039 - DNA, 18 bp, C. familiaris
ccagtcacccccactccc

SEQ ID NO: 312040 - DNA, 16 bp, C. familiaris
ccagtcaggcacccca

SEQ ID NO: 312041 - DNA, 16 bp, C. familiaris
ccagtcaggtgcccca

SEQ ID NO: 312042 - DNA, 16 bp, C. familiaris
ccagtcataaaaagac

SEQ ID NO: 312043 - DNA, 16 bp, C. familiaris
ccagtcatgatcttgg

SEQ ID NO: 312044 - DNA, 16 bp, C. familiaris
ccagtcccagtcccag

SEQ ID NO: 312045 - DNA, 16 bp, C. familiaris
ccagtcgggctccctg

SEQ ID NO: 312046 - DNA, 16 bp, C. familiaris
ccagtctccagaactg

SEQ ID NO: 312047 - DNA, 16 bp, C. familiaris
ccagtctgcactggcc

SEQ ID NO: 312048 - DNA, 16 bp, C. familiaris
ccagtgagatttttac

SEQ ID NO: 312049 - DNA, 16 bp, C. familiaris
ccagtgatgcagagca

SEQ ID NO: 312050 - DNA, 16 bp, C. familiaris
ccagtgatgtggagca

SEQ ID NO: 312051 - DNA, 16 bp, C. familiaris
ccagtgcaaaggtcct

SEQ ID NO: 312052 - DNA, 17 bp, C. familiaris
ccagtggccaatgggat

SEQ ID NO: 312053 - DNA, 16 bp, C. familiaris
ccagtggcttagtggt

SEQ ID NO: 312054 - DNA, 16 bp, C. familiaris
ccagtgggaatgtaaa

SEQ ID NO: 312055 - DNA, 16 bp, C. familiaris
ccagtggttctcaaag

SEQ ID NO: 312056 - DNA, 16 bp, C. familiaris
ccagtgtgactggagc

SEQ ID NO: 312057 - DNA, 16 bp, C. familiaris
ccagtgtgagactcga

SEQ ID NO: 312058 - DNA, 16 bp, C. familiaris
ccagttaacattccca

SEQ ID NO: 312059 - DNA, 16 bp, C. familiaris
ccagttcacattcccc

SEQ ID NO: 312060 - DNA, 16 bp, C. familiaris
ccagttgctccagcac

SEQ ID NO: 312061 - DNA, 16 bp, C. familiaris
ccagtttaattcttct

SEQ ID NO: 312062 - DNA, 16 bp, C. familiaris
ccagtttacaggaaat

SEQ ID NO: 312063 - DNA, 16 bp, C. familiaris
ccagtttacatcccca

SEQ ID NO: 312064 - DNA, 16 bp, C. familiaris
ccagtttcattctgtt

SEQ ID NO: 312065 - DNA, 16 bp, C. familiaris
ccagtttgcagatggc

SEQ ID NO: 312066 - DNA, 16 bp, C. familiaris
ccagtttgttctttat

SEQ ID NO: 312067 - DNA, 16 bp, C. familiaris
ccataaaggcaaggga

SEQ ID NO: 312068 - DNA, 16 bp, C. familiaris
ccataacaaagtacca

SEQ ID NO: 312069 - DNA, 16 bp, C. familiaris
ccatacaaagttacta

SEQ ID NO: 312070 - DNA, 16 bp, C. familiaris
ccatactgttttcatt

SEQ ID NO: 312071 - DNA, 16 bp, C. familiaris
ccatagatgcagaaaa

SEQ ID NO: 312072 - DNA, 16 bp, C. familiaris
ccatatcttggctgtt

SEQ ID NO: 312073 - DNA, 16 bp, C. familiaris
ccatatgtggaattta

SEQ ID NO: 312074 - DNA, 16 bp, C. familiaris
ccatcaaaaaagaatg

SEQ ID NO: 312075 - DNA, 16 bp, C. familiaris
ccatcaaaaaagtgaa

SEQ ID NO: 312076 - DNA, 16 bp, C. familiaris
ccatcaaaagaatgaa

SEQ ID NO: 312077 - DNA, 17 bp, C. familiaris
ccatcaaaatcctagag

SEQ ID NO: 312078 - DNA, 16 bp, C. familiaris
ccatcaacaaaacaga

SEQ ID NO: 312079 - DNA, 16 bp, C. familiaris
ccatcaagtttgtggt

SEQ ID NO: 312080 - DNA, 16 bp, C. familiaris
ccatcacctcagaaag

SEQ ID NO: 312081 - DNA, 16 bp, C. familiaris
ccatcacctcccaaag

SEQ ID NO: 312082 - DNA, 16 bp, C. familiaris
ccatcactgccaccca

SEQ ID NO: 312083 - DNA, 16 bp, C. familiaris
ccatcagggatccctg

SEQ ID NO: 312084 - DNA, 16 bp, C. familiaris
ccatcatcatcaccac

SEQ ID NO: 312085 - DNA, 16 bp, C. familiaris
ccatcatcatcttcat

SEQ ID NO: 312086 - DNA, 16 bp, C. familiaris
ccatccaaccatccaa

SEQ ID NO: 312087 - DNA, 16 bp, C. familiaris
ccatccaagtcattgc

SEQ ID NO: 312088 - DNA, 16 bp, C. familiaris
ccatccacattgtcac

SEQ ID NO: 312089 - DNA, 16 bp, C. familiaris
ccatccagacatccct

SEQ ID NO: 312090 - DNA, 16 bp, C. familiaris
ccatccagctccctgc

SEQ ID NO: 312091 - DNA, 16 bp, C. familiaris
ccatccaggtgtccta

SEQ ID NO: 312092 - DNA, 16 bp, C. familiaris
ccatccataaaatggg

SEQ ID NO: 312093 - DNA, 16 bp, C. familiaris
ccatcccagcacccca

SEQ ID NO: 312094 - DNA, 16 bp, C. familiaris
ccatcccaggagccca

SEQ ID NO: 312095 - DNA, 16 bp, C. familiaris
ccatcccaggccccca

SEQ ID NO: 312096 - DNA, 16 bp, C. familiaris
ccatccccactgccac

SEQ ID NO: 312097 - DNA, 16 bp, C. familiaris
ccatccccagaccctg

SEQ ID NO: 312098 - DNA, 16 bp, C. familiaris
ccatccccctgctcat

SEQ ID NO: 312099 - DNA, 16 bp, C. familiaris
ccatccctggaccctg

SEQ ID NO: 312100 - DNA, 16 bp, C. familiaris
ccatccctggactctg

SEQ ID NO: 312101 - DNA, 16 bp, C. familiaris
ccatccgggtgcccca

SEQ ID NO: 312102 - DNA, 16 bp, C. familiaris
ccatcctcatcctcat

SEQ ID NO: 312103 - DNA, 16 bp, C. familiaris
ccatcctgggcatgga

SEQ ID NO: 312104 - DNA, 16 bp, C. familiaris
ccatcctgggtcccca

SEQ ID NO: 312105 - DNA, 16 bp, C. familiaris
ccatcctggtgcccca

SEQ ID NO: 312106 - DNA, 16 bp, C. familiaris
ccatcgtgtgtgtgtg

SEQ ID NO: 312107 - DNA, 148 bp, C. familiaris
ccatctatttgctgtctacaagagactcattttagacagaaggacacctacagcctgaaaataaaaggttggagaaccatttaccattcgaatggtcctcaaaagaaagcaggggtagccatccttatatcagataaactaaaattta

SEQ ID NO: 312108 - DNA, 16 bp, C. familiaris
ccatctccatcttcca

SEQ ID NO: 312109 - DNA, 16 bp, C. familiaris
ccatctctatggattt

SEQ ID NO: 312110 - DNA, 16 bp, C. familiaris
ccatctgcaaaccagg

SEQ ID NO: 312111 - DNA, 16 bp, C. familiaris
ccatctgctccagtgt

SEQ ID NO: 312112 - DNA, 16 bp, C. familiaris
ccatctggacctggac

SEQ ID NO: 312113 - DNA, 16 bp, C. familiaris
ccatctggcccctgga

SEQ ID NO: 312114 - DNA, 16 bp, C. familiaris
ccatctgttctttgtt

SEQ ID NO: 312115 - DNA, 16 bp, C. familiaris
ccatcttagccatttt

SEQ ID NO: 312116 - DNA, 16 bp, C. familiaris
ccatcttcatctctta

SEQ ID NO: 312117 - DNA, 16 bp, C. familiaris
ccatcttccagtaatt

SEQ ID NO: 312118 - DNA, 16 bp, C. familiaris
ccatcttctccctgtg

SEQ ID NO: 312119 - DNA, 16 bp, C. familiaris
ccatcttgccccaccc

SEQ ID NO: 312120 - DNA, 16 bp, C. familiaris
ccatcttgcccctcct

SEQ ID NO: 312121 - DNA, 16 bp, C. familiaris
ccatcttgctcctccc

SEQ ID NO: 312122 - DNA, 16 bp, C. familiaris
ccatgaaaaagaagga

SEQ ID NO: 312123 - DNA, 29 bp, C. familiaris
ccatgaaaggaggaaattttggaggcaga

SEQ ID NO: 312124 - DNA, 16 bp, C. familiaris
ccatgaagccagccct

SEQ ID NO: 312125 - DNA, 16 bp, C. familiaris
ccatgaaggaagcctg

SEQ ID NO: 312126 - DNA, 16 bp, C. familiaris
ccatgaatatactaaa

SEQ ID NO: 312127 - DNA, 16 bp, C. familiaris
ccatgacatcatgacc

SEQ ID NO: 312128 - DNA, 16 bp, C. familiaris
ccatgaccaagcagga

SEQ ID NO: 312129 - DNA, 16 bp, C. familiaris
ccatgaccccaagatc

SEQ ID NO: 312130 - DNA, 16 bp, C. familiaris
ccatgacttttttttt

SEQ ID NO: 312131 - DNA, 16 bp, C. familiaris
ccatgagaaagaaaga

SEQ ID NO: 312132 - DNA, 16 bp, C. familiaris
ccatgagaagacatgg

SEQ ID NO: 312133 - DNA, 16 bp, C. familiaris
ccatgcagaaagccca

SEQ ID NO: 312134 - DNA, 17 bp, C. familiaris
ccatgcagaaagcctga

SEQ ID NO: 312135 - DNA, 16 bp, C. familiaris
ccatgcagagagccag

SEQ ID NO: 312136 - DNA, 16 bp, C. familiaris
ccatgcagagagccct

SEQ ID NO: 312137 - DNA, 16 bp, C. familiaris
ccatgcagcgagcctg

SEQ ID NO: 312138 - DNA, 16 bp, C. familiaris
ccatgcaggaagccag

SEQ ID NO: 312139 - DNA, 16 bp, C. familiaris
ccatgcaggaaggctg

SEQ ID NO: 312140 - DNA, 16 bp, C. familiaris
ccatgcagggagaccg

SEQ ID NO: 312141 - DNA, 16 bp, C. familiaris
ccatgcagggagccag

SEQ ID NO: 312142 - DNA, 16 bp, C. familiaris
ccatgcagggagccat

SEQ ID NO: 312143 - DNA, 16 bp, C. familiaris
ccatgcagggctcaat

SEQ ID NO: 312144 - DNA, 16 bp, C. familiaris
ccatgcagggggccca

SEQ ID NO: 312145 - DNA, 16 bp, C. familiaris
ccatgcaggtgcccct

SEQ ID NO: 312146 - DNA, 16 bp, C. familiaris
ccatgcaggtgtccca

SEQ ID NO: 312147 - DNA, 16 bp, C. familiaris
ccatgcccagcacagg

SEQ ID NO: 312148 - DNA, 16 bp, C. familiaris
ccatgcccattcattt

SEQ ID NO: 312149 - DNA, 16 bp, C. familiaris
ccatgctctttccact

SEQ ID NO: 312150 - DNA, 16 bp, C. familiaris
ccatgctgagcaggaa

SEQ ID NO: 312151 - DNA, 16 bp, C. familiaris
ccatgctggccatgga

SEQ ID NO: 312152 - DNA, 16 bp, C. familiaris
ccatgctggcctcctt

SEQ ID NO: 312153 - DNA, 16 bp, C. familiaris
ccatgctgggcacaga

SEQ ID NO: 312154 - DNA, 16 bp, C. familiaris
ccatgctgggcatgaa

SEQ ID NO: 312155 - DNA, 16 bp, C. familiaris
ccatgctgggcatgga

SEQ ID NO: 312156 - DNA, 16 bp, C. familiaris
ccatggacaccaaggc

SEQ ID NO: 312157 - DNA, 16 bp, C. familiaris
ccatggagccactcag

SEQ ID NO: 312158 - DNA, 17 bp, C. familiaris
ccatggagggagcccga

SEQ ID NO: 312159 - DNA, 16 bp, C. familiaris
ccatggattttttttt

SEQ ID NO: 312160 - DNA, 16 bp, C. familiaris
ccatggggagccggat

SEQ ID NO: 312161 - DNA, 16 bp, C. familiaris
ccatggggatccctgg

SEQ ID NO: 312162 - DNA, 16 bp, C. familiaris
ccatggtcagtgggga

SEQ ID NO: 312163 - DNA, 16 bp, C. familiaris
ccatgtaccgggagcc

SEQ ID NO: 312164 - DNA, 16 bp, C. familiaris
ccatgtacttcttcct

SEQ ID NO: 312165 - DNA, 16 bp, C. familiaris
ccatgtacttttttat

SEQ ID NO: 312166 - DNA, 16 bp, C. familiaris
ccatgtccagctccct

SEQ ID NO: 312167 - DNA, 16 bp, C. familiaris
ccatgtctggttctga

SEQ ID NO: 312168 - DNA, 16 bp, C. familiaris
ccatgtcttctttatc

SEQ ID NO: 312169 - DNA, 16 bp, C. familiaris
ccatgtgaaaggtacc

SEQ ID NO: 312170 - DNA, 16 bp, C. familiaris
ccatgtggagagcctg

SEQ ID NO: 312171 - DNA, 16 bp, C. familiaris
ccatgtggggctccag

SEQ ID NO: 312172 - DNA, 16 bp, C. familiaris
ccatgtggggctccat

SEQ ID NO: 312173 - DNA, 16 bp, C. familiaris
ccatgttggactccat

SEQ ID NO: 312174 - DNA, 16 bp, C. familiaris
ccatgttggatgtaga

SEQ ID NO: 312175 - DNA, 16 bp, C. familiaris
ccatgttgggttccct

SEQ ID NO: 312176 - DNA, 16 bp, C. familiaris
ccattcaacaaatatt

SEQ ID NO: 312177 - DNA, 16 bp, C. familiaris
ccattcattctttaat

SEQ ID NO: 312178 - DNA, 16 bp, C. familiaris
ccattcatttgttgat

SEQ ID NO: 312179 - DNA, 16 bp, C. familiaris
ccattccaggacctgg

SEQ ID NO: 312180 - DNA, 16 bp, C. familiaris
ccattcctgggttctc

SEQ ID NO: 312181 - DNA, 16 bp, C. familiaris
ccattctgattggtgt

SEQ ID NO: 312182 - DNA, 16 bp, C. familiaris
ccattctgtaagttgt

SEQ ID NO: 312183 - DNA, 16 bp, C. familiaris
ccattgctcatcccat

SEQ ID NO: 312184 - DNA, 16 bp, C. familiaris
ccattggagaaggaca

SEQ ID NO: 312185 - DNA, 16 bp, C. familiaris
ccattggatatccttt

SEQ ID NO: 312186 - DNA, 16 bp, C. familiaris
ccattggatattcctt

SEQ ID NO: 312187 - DNA, 16 bp, C. familiaris
ccattggatgttcttt

SEQ ID NO: 312188 - DNA, 16 bp, C. familiaris
ccattgggatgcctgg

SEQ ID NO: 312189 - DNA, 16 bp, C. familiaris
ccattgtctggatgtg

SEQ ID NO: 312190 - DNA, 16 bp, C. familiaris
ccattgtgtatataga

SEQ ID NO: 312191 - DNA, 16 bp, C. familiaris
ccatttataacaacat

SEQ ID NO: 312192 - DNA, 16 bp, C. familiaris
ccatttcctcttctgt

SEQ ID NO: 312193 - DNA, 16 bp, C. familiaris
ccatttcttctatgtt

SEQ ID NO: 312194 - DNA, 16 bp, C. familiaris
ccatttcttctccatt

SEQ ID NO: 312195 - DNA, 16 bp, C. familiaris
ccatttgtgacaaaat

SEQ ID NO: 312196 - DNA, 16 bp, C. familiaris
ccatttgtgataaaaa

SEQ ID NO: 312197 - DNA, 16 bp, C. familiaris
ccattttacagacgaa

SEQ ID NO: 312198 - DNA, 16 bp, C. familiaris
ccattttgaaattctt

SEQ ID NO: 312199 - DNA, 16 bp, C. familiaris
ccattttgaccatttt

SEQ ID NO: 312200 - DNA, 16 bp, C. familiaris
ccattttgcaaatgag

SEQ ID NO: 312201 - DNA, 16 bp, C. familiaris
ccattttgtagatggg

SEQ ID NO: 312202 - DNA, 16 bp, C. familiaris
cccaaaaagaaacctc

SEQ ID NO: 312203 - DNA, 16 bp, C. familiaris
cccaaaagaaagaata

SEQ ID NO: 312204 - DNA, 16 bp, C. familiaris
cccaaaagcagaagat

SEQ ID NO: 312205 - DNA, 16 bp, C. familiaris
cccaaactggaacagg

SEQ ID NO: 312206 - DNA, 16 bp, C. familiaris
cccaaagaaacaatct

SEQ ID NO: 312207 - DNA, 16 bp, C. familiaris
cccaaagaatacaaag

SEQ ID NO: 312208 - DNA, 16 bp, C. familiaris
cccaaagactgtagtg

SEQ ID NO: 312209 - DNA, 16 bp, C. familiaris
cccaaagcagatgctc

SEQ ID NO: 312210 - DNA, 16 bp, C. familiaris
cccaaagcagcagaat

SEQ ID NO: 312211 - DNA, 16 bp, C. familiaris
cccaaaggagctggag

SEQ ID NO: 312212 - DNA, 16 bp, C. familiaris
cccaaaggctccacct

SEQ ID NO: 312213 - DNA, 16 bp, C. familiaris
cccaaatcaggctccc

SEQ ID NO: 312214 - DNA, 16 bp, C. familiaris
cccaaatttcaagata

SEQ ID NO: 312215 - DNA, 16 bp, C. familiaris
cccaaatttccttttt

SEQ ID NO: 312216 - DNA, 16 bp, C. familiaris
cccaacaacagcagaa

SEQ ID NO: 312217 - DNA, 16 bp, C. familiaris
cccaacaatagccagc

SEQ ID NO: 312218 - DNA, 16 bp, C. familiaris
cccaacaccatttatg

SEQ ID NO: 312219 - DNA, 16 bp, C. familiaris
cccaacagactgagcc

SEQ ID NO: 312220 - DNA, 16 bp, C. familiaris
cccaacatgagactca

SEQ ID NO: 312221 - DNA, 16 bp, C. familiaris
cccaacatggggtttg

SEQ ID NO: 312222 - DNA, 16 bp, C. familiaris
cccaagaaaacagaga

SEQ ID NO: 312223 - DNA, 16 bp, C. familiaris
cccaagagaactgaaa

SEQ ID NO: 312224 - DNA, 16 bp, C. familiaris
cccaagatcaagcccc

SEQ ID NO: 312225 - DNA, 16 bp, C. familiaris
cccaagatcatgccct

SEQ ID NO: 312226 - DNA, 16 bp, C. familiaris
cccaagatgatgacct

SEQ ID NO: 312227 - DNA, 16 bp, C. familiaris
cccaagcagactcctt

SEQ ID NO: 312228 - DNA, 16 bp, C. familiaris
cccaagcagagggaga

SEQ ID NO: 312229 - DNA, 16 bp, C. familiaris
cccaagcatcccagaa

SEQ ID NO: 312230 - DNA, 16 bp, C. familiaris
cccaagcccaaggcag

SEQ ID NO: 312231 - DNA, 16 bp, C. familiaris
cccaagctgtgcagat

SEQ ID NO: 312232 - DNA, 16 bp, C. familiaris
cccaagctgtgcaggt

SEQ ID NO: 312233 - DNA, 16 bp, C. familiaris
cccaaggagcagggag
